United States Patent 9,624,556 (VIRAL AND VIRAL ASSOCIATED MIRNAS AND USES THEREOF) - sequence listing, part 8

SEQ ID NO: 211689 - RNA, 64 nt, Human
caugcacacacacaugcacacauauaugcacaggcacacacauguacgcacacacacaugcacu

SEQ ID NO: 211690 - RNA, 64 nt, Human
ugcacacauauaugcacaggcacacacauguacgcacacacacaugcacugcacacauauccau

SEQ ID NO: 211691 - RNA, 64 nt, Human
cacacauauaugcacaggcacacacauguacgcacacacacaugcacugcacacauauccaugc

SEQ ID NO: 211692 - RNA, 64 nt, Human
aaggugacagaggacacaggggagggggaaaacccacacacacuccuuggaauggguccuguua

SEQ ID NO: 211693 - RNA, 64 nt, Human
ggcucuggauccccuuuuaaauuacacacacucucacacacauacauguauguuuauagaugcu

SEQ ID NO: 211694 - RNA, 64 nt, Human
uuugacuguauggggguucccacacucgugcauacacacacauccauacacucugacaaucucc

SEQ ID NO: 211695 - RNA, 64 nt, Human
uuugaguauuguaugaaagauccuucgugcacaccacacacagucaugauuuuguuaaaguagc

SEQ ID NO: 211696 - RNA, 64 nt, Human
cuaggcccuuuucuaugucuuuacaucucugucucacacacacacacguauacacacacacagu

SEQ ID NO: 211697 - RNA, 64 nt, Human
aggcccuuuucuaugucuuuacaucucugucucacacacacacacguauacacacacacaguuu

SEQ ID NO: 211698 - RNA, 64 nt, Human
gcccuuuucuaugucuuuacaucucugucucacacacacacacguauacacacacacaguuuau

SEQ ID NO: 211699 - RNA, 64 nt, Human
cuuuacaucucugucucacacacacacacguauacacacacacaguuuauuuuuaauaaaauag

SEQ ID NO: 211700 - RNA, 64 nt, Human
uuacaucucugucucacacacacacacguauacacacacacaguuuauuuuuaauaaaauagga

SEQ ID NO: 211701 - RNA, 64 nt, Human
cacacaguuuauuuuuaauaaaauaggauuauaccacacacauccugucacuugcuuuuuugcu

SEQ ID NO: 211702 - RNA, 64 nt, Human
cccaccuuagccuccugaguagcugggacuaaggcacacacacuguacuuggcagcuggcgaag

SEQ ID NO: 211703 - RNA, 64 nt, Human
ucccuccuagcucucccagugaacuccugccaggcacacacagccccuauagcacugagcucac

SEQ ID NO: 211704 - RNA, 64 nt, Human
cagccgccugacgaaauggaaacacacacagacacacacacaccuugcaaaaaaaaaauuguuu

SEQ ID NO: 211705 - RNA, 64 nt, Human
aacagccgccugacgaaauggaaacacacacagacacacacacaccuugcaaaaaaaaaauugu

SEQ ID NO: 211706 - RNA, 64 nt, Human
cgcagacaagaacagccgccugacgaaauggaaacacacacagacacacacacaccuugcaaaa

SEQ ID NO: 211707 - RNA, 64 nt, Human
gcgggggggacagugccccgggaacccggugggucacacacacgcacugcgccugucaguagug

SEQ ID NO: 211708 - RNA, 64 nt, Human
gcucuacaugacauucaggacacacacacacacacacacacaccacucgccuccacugaaucua

SEQ ID NO: 211709 - RNA, 64 nt, Human
ucgcucuacaugacauucaggacacacacacacacacacacacaccacucgccuccacugaauc

SEQ ID NO: 211710 - RNA, 64 nt, Human
gaucgcucuacaugacauucaggacacacacacacacacacacacaccacucgccuccacugaa

SEQ ID NO: 211711 - RNA, 64 nt, Human
cagaucgcucuacaugacauucaggacacacacacacacacacacacaccacucgccuccacug

SEQ ID NO: 211712 - RNA, 64 nt, Human
cccagaucgcucuacaugacauucaggacacacacacacacacacacacaccacucgccuccac

SEQ ID NO: 211713 - RNA, 64 nt, Human
cucccagaucgcucuacaugacauucaggacacacacacacacacacacacaccacucgccucc

SEQ ID NO: 211714 - RNA, 64 nt, Human
uccucccagaucgcucuacaugacauucaggacacacacacacacacacacacaccacucgccu

SEQ ID NO: 211715 - RNA, 64 nt, Human
gcuccucccagaucgcucuacaugacauucaggacacacacacacacacacacacaccacucgc

SEQ ID NO: 211716 - RNA, 64 nt, Human
uguuuuuuuaccaccuggugaaucagccauaacgcacacacacgccacccagccucuuguuucu

SEQ ID NO: 211717 - RNA, 64 nt, Human
gcuucuccuuuuaaaauccccuccacuccucacacacacacaccucuugaaacccuuccccaag

SEQ ID NO: 211718 - RNA, 64 nt, Human
augcuucuccuuuuaaaauccccuccacuccucacacacacacaccucuugaaacccuucccca

SEQ ID NO: 211719 - RNA, 64 nt, Human
aaaugcuucuccuuuuaaaauccccuccacuccucacacacacacaccucuugaaacccuuccc

SEQ ID NO: 211720 - RNA, 64 nt, Human
uauguauagacacacacacauaugcacacacacacacacacacccacagagagagagcugcaag

SEQ ID NO: 211721 - RNA, 64 nt, Human
aauauguauagacacacacacauaugcacacacacacacacacacccacagagagagagcugca

SEQ ID NO: 211722 - RNA, 64 nt, Human
auaauauguauagacacacacacauaugcacacacacacacacacacccacagagagagagcug

SEQ ID NO: 211723 - RNA, 64 nt, Human
aaauaauauguauagacacacacacauaugcacacacacacacacacacccacagagagagagc

SEQ ID NO: 211724 - RNA, 64 nt, Human
ccaaauaauauguauagacacacacacauaugcacacacacacacacacacccacagagagaga

SEQ ID NO: 211725 - RNA, 64 nt, Human
aaccaaauaauauguauagacacacacacauaugcacacacacacacacacacccacagagaga

SEQ ID NO: 211726 - RNA, 64 nt, Human
ccugugcugaccaaccaaauaauauguauagacacacacacauaugcacacacacacacacaca

SEQ ID NO: 211727 - RNA, 64 nt, Human
cuccugugcugaccaaccaaauaauauguauagacacacacacauaugcacacacacacacaca

SEQ ID NO: 211728 - RNA, 64 nt, Human
uauagacaaccagcuaaacugccuuuuuggugugcacacacauuucaugugcagacgugccucu

SEQ ID NO: 211729 - RNA, 64 nt, Human
caggcauacucacacacagacacacacacacacacacacacagacucauccacacuucaaauug

SEQ ID NO: 211730 - RNA, 64 nt, Human
cacaggcauacucacacacagacacacacacacacacacacacagacucauccacacuucaaau

SEQ ID NO: 211731 - RNA, 64 nt, Human
cacacaggcauacucacacacagacacacacacacacacacacacagacucauccacacuucaa

SEQ ID NO: 211732 - RNA, 64 nt, Human
cacacacaggcauacucacacacagacacacacacacacacacacacagacucauccacacuuc

SEQ ID NO: 211733 - RNA, 64 nt, Human
cacacacacaggcauacucacacacagacacacacacacacacacacacagacucauccacacu

SEQ ID NO: 211734 - RNA, 64 nt, Human
cucacacacacaggcauacucacacacagacacacacacacacacacacacagacucauccaca

SEQ ID NO: 211735 - RNA, 64 nt, Human
cacucacacacacaggcauacucacacacagacacacacacacacacacacacagacucaucca

SEQ ID NO: 211736 - RNA, 64 nt, Human
cacacucacacacacaggcauacucacacacagacacacacacacacacacacacagacucauc

SEQ ID NO: 211737 - RNA, 64 nt, Human
aauauacacacacacucacacacacaggcauacucacacacagacacacacacacacacacaca

SEQ ID NO: 211738 - RNA, 64 nt, Human
acuucaaaugcuacaaaauauacacacacacucacacacacaggcauacucacacacagacaca

SEQ ID NO: 211739 - RNA, 64 nt, Human
aaacuucaaaugcuacaaaauauacacacacacucacacacacaggcauacucacacacagaca

SEQ ID NO: 211740 - RNA, 64 nt, Human
ucuugccacaaaacuucaaaugcuacaaaauauacacacacacucacacacacaggcauacuca

SEQ ID NO: 211741 - RNA, 64 nt, Human
uauguguguguguguguguguauauauacacacacacacacauacuuaaaucuugcccugcaug

SEQ ID NO: 211742 - RNA, 64 nt, Human
uguauguguguguguguguguguauauauacacacacacacacauacuuaaaucuugcccugca

SEQ ID NO: 211743 - RNA, 64 nt, Human
uguguauguguguguguguguguguauauauacacacacacacacauacuuaaaucuugcccug

SEQ ID NO: 211744 - RNA, 64 nt, Human
uauguguauguguguguguguguguguauauauacacacacacacacauacuuaaaucuugccc

SEQ ID NO: 211745 - RNA, 64 nt, Human
gggggcuucaauauauauauauaauacacacacacacacacaugcacacauaccgcacuucaua

SEQ ID NO: 211746 - RNA, 64 nt, Human
augggggcuucaauauauauauauaauacacacacacacacacaugcacacauaccgcacuuca

SEQ ID NO: 211747 - RNA, 64 nt, Human
aaaugggggcuucaauauauauauauaauacacacacacacacacaugcacacauaccgcacuu

SEQ ID NO: 211748 - RNA, 64 nt, Human
guaaaugggggcuucaauauauauauauaauacacacacacacacacaugcacacauaccgcac

SEQ ID NO: 211749 - RNA, 64 nt, Human
auguaaaugggggcuucaauauauauauauaauacacacacacacacacaugcacacauaccgc

SEQ ID NO: 211750 - RNA, 64 nt, Human
cacacacacacacacacacacacacacacacacacacacacaaguaagagacucagccugcagu

SEQ ID NO: 211751 - RNA, 64 nt, Human
cacacacacacacacacacacacacacacacacacacacacacaaguaagagacucagccugca

SEQ ID NO: 211752 - RNA, 64 nt, Human
cacacacacacacacacacacacacacacacacacacacacacacaaguaagagacucagccug

SEQ ID NO: 211753 - RNA, 64 nt, Human
cacacacacacacacacacacacacacacacacacacacacacacacaaguaagagacucagcc

SEQ ID NO: 211754 - RNA, 64 nt, Human
cacacacacacacacacacacacacacacacacacacacacacacacacaaguaagagacucag

SEQ ID NO: 211755 - RNA, 64 nt, Human
cacacacacacacacacacacacacacacacacacacacacacacacacacaaguaagagacuc

SEQ ID NO: 211756 - RNA, 64 nt, Human
cacacacacacacacacacacacacacacacacacacacacacacacacacacaaguaagagac

SEQ ID NO: 211757 - RNA, 64 nt, Human
uacacacacacacacacacacacacacacacacacacacacacacacacacacacaaguaagag

SEQ ID NO: 211758 - RNA, 64 nt, Human
uauacacacacacacacacacacacacacacacacacacacacacacacacacacacaaguaag

SEQ ID NO: 211759 - RNA, 64 nt, Human
cauauacacacacacacacacacacacacacacacacacacacacacacacacacacacaagua

SEQ ID NO: 211760 - RNA, 64 nt, Human
cacauauacacacacacacacacacacacacacacacacacacacacacacacacacacacaag

SEQ ID NO: 211761 - RNA, 64 nt, Human
cgcacauauacacacacacacacacacacacacacacacacacacacacacacacacacacaca

SEQ ID NO: 211762 - RNA, 64 nt, Human
cacgcacauauacacacacacacacacacacacacacacacacacacacacacacacacacaca

SEQ ID NO: 211763 - RNA, 64 nt, Human
cacacgcacauauacacacacacacacacacacacacacacacacacacacacacacacacaca

SEQ ID NO: 211764 - RNA, 64 nt, Human
cacacacgcacauauacacacacacacacacacacacacacacacacacacacacacacacaca

SEQ ID NO: 211765 - RNA, 64 nt, Human
cacacacacgcacauauacacacacacacacacacacacacacacacacacacacacacacaca

SEQ ID NO: 211766 - RNA, 64 nt, Human
cacacacacacgcacauauacacacacacacacacacacacacacacacacacacacacacaca

SEQ ID NO: 211767 - RNA, 64 nt, Human
cacacacacacacgcacauauacacacacacacacacacacacacacacacacacacacacaca

SEQ ID NO: 211768 - RNA, 64 nt, Human
uacacacacacacacgcacauauacacacacacacacacacacacacacacacacacacacaca

SEQ ID NO: 211769 - RNA, 64 nt, Human
uauacacacacacacacgcacauauacacacacacacacacacacacacacacacacacacaca

SEQ ID NO: 211770 - RNA, 64 nt, Human
uauauacacacacacacacgcacauauacacacacacacacacacacacacacacacacacaca

SEQ ID NO: 211771 - RNA, 64 nt, Human
uauauauacacacacacacacgcacauauacacacacacacacacacacacacacacacacaca

SEQ ID NO: 211772 - RNA, 64 nt, Human
uauauauauacacacacacacacgcacauauacacacacacacacacacacacacacacacaca

SEQ ID NO: 211773 - RNA, 64 nt, Human
uauauauauauacacacacacacacgcacauauacacacacacacacacacacacacacacaca

SEQ ID NO: 211774 - RNA, 64 nt, Human
uccauauauauauauauauauauauauauacacacacacacacgcacauauacacacacacaca

SEQ ID NO: 211775 - RNA, 64 nt, Human
gcuccauauauauauauauauauauauauauacacacacacacacgcacauauacacacacaca

SEQ ID NO: 211776 - RNA, 64 nt, Human
aggcuccauauauauauauauauauauauauauacacacacacacacgcacauauacacacaca

SEQ ID NO: 211777 - RNA, 64 nt, Human
uuagauauguauuacuauacaugaauguauuauacacacacacuuuagagauuguaagaacccc

SEQ ID NO: 211778 - RNA, 64 nt, Human
aaacuauuucauccgcuguuuccuccccaaaacacacacacagagcaaacucccuuucauaaaa

SEQ ID NO: 211779 - RNA, 64 nt, Human
auaaacuauuucauccgcuguuuccuccccaaaacacacacacagagcaaacucccuuucauaa

SEQ ID NO: 211780 - RNA, 64 nt, Human
gauguaugaucuuccauguuuugacguuugcagucacacacaacaccuuaguuccucuaggggc

SEQ ID NO: 211781 - RNA, 64 nt, Human
auagaauuucgguuuguaucuuccauauaauaaccacacacagauaaccacacaaaaaauccuu

SEQ ID NO: 211782 - RNA, 64 nt, Human
gaagcuuucacagugcagagacugcuagccugggcacacacaccuccuuucuggccgucuucug

SEQ ID NO: 211783 - RNA, 64 nt, Human
gccagacaaacauaugauaucaugguguaaaaaacacacacauacacaaauauuuguaacauau

SEQ ID NO: 211784 - RNA, 64 nt, Human
cuggaguuuuuccagcauacaauacaugcacgugcacacacauacacacacauccauuaauaua

SEQ ID NO: 211785 - RNA, 64 nt, Human
uccagcauacaauacaugcacgugcacacacauacacacacauccauuaauauacuucaguaag

SEQ ID NO: 211786 - RNA, 64 nt, Human
cucagcaaaaaccuauucacagcggguggggaaacacacacagcuccugcugacuccccuuaug

SEQ ID NO: 211787 - RNA, 64 nt, Human
ugcuugugugugugaugcaugugagcgucucuggcacacacacuuggacauacaguucugugug

SEQ ID NO: 211788 - RNA, 64 nt, Human
auguaaucugcuuauauauuuuuaaaaauccauccacacacaugguaaauuaaguauaaauucu

SEQ ID NO: 211789 - RNA, 64 nt, Human
acauauauaauauauacacacagauacaaguguacacacacacaccacacaccacacacacccc

SEQ ID NO: 211790 - RNA, 64 nt, Human
auauauaauauauacacacagauacaaguguacacacacacaccacacaccacacacaccccac

SEQ ID NO: 211791 - RNA, 64 nt, Human
cacagauacaaguguacacacacacaccacacaccacacacaccccacuggcagucuuugugga

SEQ ID NO: 211792 - RNA, 64 nt, Human
cucagucuuuaauccuggcagggauucacgggcgcacacacacacacucaggauucagaucuug

SEQ ID NO: 211793 - RNA, 64 nt, Human
cagucuuuaauccuggcagggauucacgggcgcacacacacacacucaggauucagaucuuguu

SEQ ID NO: 211794 - RNA, 64 nt, Human
gucuuuaauccuggcagggauucacgggcgcacacacacacacucaggauucagaucuuguuga

SEQ ID NO: 211795 - RNA, 64 nt, Human
ggcccccuagaccagcucuuccagcuggauggagcacacacaggccuccagcugggccauguca

SEQ ID NO: 211796 - RNA, 64 nt, Human
ugcuucucuuucccagaggcuggucccagccaggcacacacaaaaggcagauucucguaaacgc

SEQ ID NO: 211797 - RNA, 64 nt, Human
acuaagauuuucccaugcauaauuacaaauaaugcacacacacaaauguauaugcuggguagua

SEQ ID NO: 211798 - RNA, 64 nt, Human
uaagauuuucccaugcauaauuacaaauaaugcacacacacaaauguauaugcuggguaguaug

SEQ ID NO: 211799 - RNA, 64 nt, Human
aggauguugaagauaaugacacuaaaucuauggacacacacacacacacacacacacacacaca

SEQ ID NO: 211800 - RNA, 64 nt, Human
gauguugaagauaaugacacuaaaucuauggacacacacacacacacacacacacacacacaca

SEQ ID NO: 211801 - RNA, 64 nt, Human
uguugaagauaaugacacuaaaucuauggacacacacacacacacacacacacacacacacaca

SEQ ID NO: 211802 - RNA, 64 nt, Human
uugaagauaaugacacuaaaucuauggacacacacacacacacacacacacacacacacacaca

SEQ ID NO: 211803 - RNA, 64 nt, Human
gaagauaaugacacuaaaucuauggacacacacacacacacacacacacacacacacacacaca

SEQ ID NO: 211804 - RNA, 64 nt, Human
agauaaugacacuaaaucuauggacacacacacacacacacacacacacacacacacacacaca

SEQ ID NO: 211805 - RNA, 64 nt, Human
auaaugacacuaaaucuauggacacacacacacacacacacacacacacacacacacacacaca

SEQ ID NO: 211806 - RNA, 64 nt, Human
aaugacacuaaaucuauggacacacacacacacacacacacacacacacacacacacacacaca

SEQ ID NO: 211807 - RNA, 64 nt, Human
ugacacuaaaucuauggacacacacacacacacacacacacacacacacacacacacacacaca

SEQ ID NO: 211808 - RNA, 64 nt, Human
acacuaaaucuauggacacacacacacacacacacacacacacacacacacacacacacacaca

SEQ ID NO: 211809 - RNA, 64 nt, Human
acuaaaucuauggacacacacacacacacacacacacacacacacacacacacacacacacaca

SEQ ID NO: 211810 - RNA, 64 nt, Human
uaaaucuauggacacacacacacacacacacacacacacacacacacacacacacacacacaca

SEQ ID NO: 211811 - RNA, 64 nt, Human
aaucuauggacacacacacacacacacacacacacacacacacacacacacacacacacacaca

SEQ ID NO: 211812 - RNA, 64 nt, Human
ucuauggacacacacacacacacacacacacacacacacacacacacacacacacacacacagu

SEQ ID NO: 211813 - RNA, 64 nt, Human
uauggacacacacacacacacacacacacacacacacacacacacacacacacacacacaguuu

SEQ ID NO: 211814 - RNA, 64 nt, Human
uggacacacacacacacacacacacacacacacacacacacacacacacacacacacaguuuaa

SEQ ID NO: 211815 - RNA, 64 nt, Human
gacacacacacacacacacacacacacacacacacacacacacacacacacacacaguuuaaug

SEQ ID NO: 211816 - RNA, 64 nt, Human
cacacacacacacacacacacacacacacacacacacacacacacacacacacaguuuaaugaa

SEQ ID NO: 211817 - RNA, 64 nt, Human
cacacacacacacacacacacacacacacacacacacacacacacacacacaguuuaaugaagg

SEQ ID NO: 211818 - RNA, 64 nt, Human
cacacacacacacacacacacacacacacacacacacacacacacacacaguuuaaugaaggcu

SEQ ID NO: 211819 - RNA, 64 nt, Human
cacacacacacacacacacacacacacacacacacacacacacacacaguuuaaugaaggcuua

SEQ ID NO: 211820 - RNA, 64 nt, Human
cacacacacacacacacacacacacacacacacacacacacacacaguuuaaugaaggcuuaaa

SEQ ID NO: 211821 - RNA, 64 nt, Human
cacacacacacacacacacacacacacacacacacacacacacaguuuaaugaaggcuuaaaga

SEQ ID NO: 211822 - RNA, 64 nt, Human
cacacacacacacacacacacacacacacacacacacacacaguuuaaugaaggcuuaaagaau

SEQ ID NO: 211823 - RNA, 64 nt, Human
auggaaacccauugacauuccaaaacaauauauacacacacacauaaaucagccaaaaucagag

SEQ ID NO: 211824 - RNA, 64 nt, Human
ggaaacccauugacauuccaaaacaauauauacacacacacauaaaucagccaaaaucagagaa

SEQ ID NO: 211825 - RNA, 64 nt, Human
aagccguauauagaucaauguccacauauauauacacacacacauauauauauauaaaguguaa

SEQ ID NO: 211826 - RNA, 64 nt, Human
gccguauauagaucaauguccacauauauauacacacacacauauauauauauaaaguguaaca

SEQ ID NO: 211827 - RNA, 64 nt, Human
caaucaucccuucuugcuccucuuugugcacguacacacacacacacacacacacacacacaca

SEQ ID NO: 211828 - RNA, 64 nt, Human
aucaucccuucuugcuccucuuugugcacguacacacacacacacacacacacacacacacacc

SEQ ID NO: 211829 - RNA, 64 nt, Human
caucccuucuugcuccucuuugugcacguacacacacacacacacacacacacacacacacccc

SEQ ID NO: 211830 - RNA, 64 nt, Human
ucccuucuugcuccucuuugugcacguacacacacacacacacacacacacacacacaccccug

SEQ ID NO: 211831 - RNA, 64 nt, Human
ccuucuugcuccucuuugugcacguacacacacacacacacacacacacacacacaccccugcu

SEQ ID NO: 211832 - RNA, 64 nt, Human
uucuugcuccucuuugugcacguacacacacacacacacacacacacacacacaccccugcuca

SEQ ID NO: 211833 - RNA, 64 nt, Human
cuugcuccucuuugugcacguacacacacacacacacacacacacacacacaccccugcucaac

SEQ ID NO: 211834 - RNA, 64 nt, Human
ugcuccucuuugugcacguacacacacacacacacacacacacacacacaccccugcucaacag

SEQ ID NO: 211835 - RNA, 64 nt, Human
cuccucuuugugcacguacacacacacacacacacacacacacacacaccccugcucaacagag

SEQ ID NO: 211836 - RNA, 64 nt, Human
ccucuuugugcacguacacacacacacacacacacacacacacacaccccugcucaacagaggu

SEQ ID NO: 211837 - RNA, 64 nt, Human
ucuuugugcacguacacacacacacacacacacacacacacacaccccugcucaacagagguuu

SEQ ID NO: 211838 - RNA, 64 nt, Human
uuugugcacguacacacacacacacacacacacacacacacaccccugcucaacagagguuuag

SEQ ID NO: 211839 - RNA, 64 nt, Human
caacaauggagugagagccaaagaaacaaagauccacacacauccucaccccacagaaacugcu

SEQ ID NO: 211840 - RNA, 64 nt, Human
aaccccgugcguccacccagccuucuuccgcauccacacacagccggcugcccuugacccggga

SEQ ID NO: 211841 - RNA, 64 nt, Human
ugggaaggcgaaauauacccccagccccuuccaacacacacacuccagcgagaggagggcaaga

SEQ ID NO: 211842 - RNA, 64 nt, Human
accugcccauggagacaguuguggugaggguugccacacacagugagggcggagcaggguggcu

SEQ ID NO: 211843 - RNA, 64 nt, Human
cgccucugguccuuuacaugugcauaaccacaugcacacacacucacgcaugagcaaacgugua

SEQ ID NO: 211844 - RNA, 64 nt, Human
cacacacaugcacauacacacacacacacacacacacacacagugugcaacuagccccaguuuu

SEQ ID NO: 211845 - RNA, 64 nt, Human
cacacacacaugcacauacacacacacacacacacacacacacagugugcaacuagccccaguu

SEQ ID NO: 211846 - RNA, 64 nt, Human
cacacacacacaugcacauacacacacacacacacacacacacacagugugcaacuagccccag

SEQ ID NO: 211847 - RNA, 64 nt, Human
cacacacacacacaugcacauacacacacacacacacacacacacacagugugcaacuagcccc

SEQ ID NO: 211848 - RNA, 64 nt, Human
cacacacacacacacaugcacauacacacacacacacacacacacacacagugugcaacuagcc

SEQ ID NO: 211849 - RNA, 64 nt, Human
aacacacacacacacacaugcacauacacacacacacacacacacacacacagugugcaacuag

SEQ ID NO: 211850 - RNA, 64 nt, Human
uaaacacacacacacacacaugcacauacacacacacacacacacacacacacagugugcaacu

SEQ ID NO: 211851 - RNA, 64 nt, Human
uuuaaacacacacacacacacaugcacauacacacacacacacacacacacacacagugugcaa

SEQ ID NO: 211852 - RNA, 64 nt, Human
ccuuuaaacacacacacacacacaugcacauacacacacacacacacacacacacacagugugc

SEQ ID NO: 211853 - RNA, 64 nt, Human
ccccuuuaaacacacacacacacacaugcacauacacacacacacacacacacacacacagugu

SEQ ID NO: 211854 - RNA, 64 nt, Human
gggugaaaacagaguaccccuuuaaacacacacacacacacaugcacauacacacacacacaca

SEQ ID NO: 211855 - RNA, 64 nt, Human
cagggugaaaacagaguaccccuuuaaacacacacacacacacaugcacauacacacacacaca

SEQ ID NO: 211856 - RNA, 64 nt, Human
uucagggugaaaacagaguaccccuuuaaacacacacacacacacaugcacauacacacacaca

SEQ ID NO: 211857 - RNA, 64 nt, Human
auuucagggugaaaacagaguaccccuuuaaacacacacacacacacaugcacauacacacaca

SEQ ID NO: 211858 - RNA, 64 nt, Human
ugauuucagggugaaaacagaguaccccuuuaaacacacacacacacacaugcacauacacaca

SEQ ID NO: 211859 - RNA, 64 nt, Human
aauuuauauauacauuguguguguguguaauacacacacacaacccccuauaccuggaagauug

SEQ ID NO: 211860 - RNA, 64 nt, Human
aaaauuuauauauacauuguguguguguguaauacacacacacaacccccuauaccuggaagau

SEQ ID NO: 211861 - RNA, 64 nt, Human
cauacaugcaugcacacauacauacauauguauacacacacauaauuugaaaacugauuggcac

SEQ ID NO: 211862 - RNA, 64 nt, Human
aacguuuucuuucacacacacacacacacacacacacacacaugcuaggaugcggaaauccccu

SEQ ID NO: 211863 - RNA, 64 nt, Human
guaacguuuucuuucacacacacacacacacacacacacacacaugcuaggaugcggaaauccc

SEQ ID NO: 211864 - RNA, 64 nt, Human
cuguaacguuuucuuucacacacacacacacacacacacacacacaugcuaggaugcggaaauc

SEQ ID NO: 211865 - RNA, 64 nt, Human
aacuguaacguuuucuuucacacacacacacacacacacacacacacaugcuaggaugcggaaa

SEQ ID NO: 211866 - RNA, 64 nt, Human
uuaacuguaacguuuucuuucacacacacacacacacacacacacacacaugcuaggaugcgga

SEQ ID NO: 211867 - RNA, 64 nt, Human
gguuaacuguaacguuuucuuucacacacacacacacacacacacacacacaugcuaggaugcg

SEQ ID NO: 211868 - RNA, 64 nt, Human
acgguuaacuguaacguuuucuuucacacacacacacacacacacacacacacaugcuaggaug

SEQ ID NO: 211869 - RNA, 64 nt, Human
uaacgguuaacuguaacguuuucuuucacacacacacacacacacacacacacacaugcuagga

SEQ ID NO: 211870 - RNA, 64 nt, Human
uguaacgguuaacuguaacguuuucuuucacacacacacacacacacacacacacacaugcuag

SEQ ID NO: 211871 - RNA, 64 nt, Human
auuguaacgguuaacuguaacguuuucuuucacacacacacacacacacacacacacacaugcu

SEQ ID NO: 211872 - RNA, 64 nt, Human
caauuguaacgguuaacuguaacguuuucuuucacacacacacacacacacacacacacacaug

SEQ ID NO: 211873 - RNA, 64 nt, Human
agcaauuguaacgguuaacuguaacguuuucuuucacacacacacacacacacacacacacaca

SEQ ID NO: 211874 - RNA, 64 nt, Human
gagcaguuacugucuguucaguucguuuggcaggcacacacaguggcauaaauucuauuguuuu

SEQ ID NO: 211875 - RNA, 64 nt, Human
cucugcacaugcagcccucuccucgagcacgucacacacacaugccaguguggagagcgccucu

SEQ ID NO: 211876 - RNA, 64 nt, Human
cucucugcacaugcagcccucuccucgagcacgucacacacacaugccaguguggagagcgccu

SEQ ID NO: 211877 - RNA, 64 nt, Human
uuacacacacacaacacauacacacacacacacacacacacauaucacaguuuucacacagccc

SEQ ID NO: 211878 - RNA, 64 nt, Human
uuuuacacacacacaacacauacacacacacacacacacacacauaucacaguuuucacacagc

SEQ ID NO: 211879 - RNA, 64 nt, Human
ccuuuuacacacacacaacacauacacacacacacacacacacacauaucacaguuuucacaca

SEQ ID NO: 211880 - RNA, 64 nt, Human
ggccuuuuacacacacacaacacauacacacacacacacacacacacauaucacaguuuucaca

SEQ ID NO: 211881 - RNA, 64 nt, Human
aaggccuuuuacacacacacaacacauacacacacacacacacacacacauaucacaguuuuca

SEQ ID NO: 211882 - RNA, 64 nt, Human
agaaggccuuuuacacacacacaacacauacacacacacacacacacacacauaucacaguuuu

SEQ ID NO: 211883 - RNA, 64 nt, Human
ggagaaggccuuuuacacacacacaacacauacacacacacacacacacacacauaucacaguu

SEQ ID NO: 211884 - RNA, 64 nt, Human
cuggagaaggccuuuuacacacacacaacacauacacacacacacacacacacacauaucacag

SEQ ID NO: 211885 - RNA, 64 nt, Human
ggggcccuuccuggccuggagaaggccuuuuacacacacacaacacauacacacacacacacac

SEQ ID NO: 211886 - RNA, 64 nt, Human
aaggggcccuuccuggccuggagaaggccuuuuacacacacacaacacauacacacacacacac

SEQ ID NO: 211887 - RNA, 64 nt, Human
ccccgguauaccaagggagccaguuguguucagacacacacaucacagcuugacucacuaacug

SEQ ID NO: 211888 - RNA, 64 nt, Human
cugucugcuucucucucucucacacacacacacacacacacagucccauuugcauaucacccuu

SEQ ID NO: 211889 - RNA, 64 nt, Human
uacugucugcuucucucucucucacacacacacacacacacacagucccauuugcauaucaccc

SEQ ID NO: 211890 - RNA, 64 nt, Human
gguacugucugcuucucucucucucacacacacacacacacacacagucccauuugcauaucac

SEQ ID NO: 211891 - RNA, 64 nt, Human
cagguacugucugcuucucucucucucacacacacacacacacacacagucccauuugcauauc

SEQ ID NO: 211892 - RNA, 64 nt, Human
ggcagguacugucugcuucucucucucucacacacacacacacacacacagucccauuugcaua

SEQ ID NO: 211893 - RNA, 64 nt, Human
caggcagguacugucugcuucucucucucucacacacacacacacacacacagucccauuugca

SEQ ID NO: 211894 - RNA, 64 nt, Human
cacaggcagguacugucugcuucucucucucucacacacacacacacacacacagucccauuug

SEQ ID NO: 211895 - RNA, 64 nt, Human
aacacaggcagguacugucugcuucucucucucucacacacacacacacacacacagucccauu

SEQ ID NO: 211896 - RNA, 64 nt, Human
uuacaccuauccccuacacauacaugcacauagacacacacaugaacacacugaagauauuucc

SEQ ID NO: 211897 - RNA, 64 nt, Human
aaagcaugcagcauggugccccucuucugaccaacacacacacgaccccucccccaacaccccc

SEQ ID NO: 211898 - RNA, 64 nt, Human
uaaaaaccacccaaacacuagaugugugugugcacacacacagaaaccacgagguaguuuaaau

SEQ ID NO: 211899 - RNA, 64 nt, Human
ccuaaaaaccacccaaacacuagaugugugugugcacacacacagaaaccacgagguaguuuaa

SEQ ID NO: 211900 - RNA, 64 nt, Human
ggaaagagacaauuaauuguacauaauguauacacacacacaaaaaaaaauaccuguagaaaua

SEQ ID NO: 211901 - RNA, 64 nt, Human
agggaaagagacaauuaauuguacauaauguauacacacacacaaaaaaaaauaccuguagaaa

SEQ ID NO: 211902 - RNA, 64 nt, Human
aagaggcaaggagcuucugaagaaacugccucugcacacacaucacuggcugugaccccucagg

SEQ ID NO: 211903 - RNA, 64 nt, Human
aauuuucauggcggaaugucucccccagcugccacacacacauuuuguauuaauuuuaaugauu

SEQ ID NO: 211904 - RNA, 64 nt, Human
ucaauuuucauggcggaaugucucccccagcugccacacacacauuuuguauuaauuuuaauga

SEQ ID NO: 211905 - RNA, 64 nt, Human
gggccuguccuaaugccuucuucccuaacaucaccacacacaccccugucggcauccuggagca

SEQ ID NO: 211906 - RNA, 64 nt, Human
ggacuccuugccauggacuuuuccuguuguuguacacacacaacagaacaaaaugaagcaaaac

SEQ ID NO: 211907 - RNA, 64 nt, Human
cccacacggccacaccaccacaugcccaaguguacacacacagagccacaccgucccucugggc

SEQ ID NO: 211908 - RNA, 64 nt, Human
agacuauuuauuuaaauacaaaaaaaggggaaaacacacacacggaaaaaaaauuguaagcacu

SEQ ID NO: 211909 - RNA, 64 nt, Human
gccauucucaaacccacucagccuucaucgcugacacacacacuccuaccccaaccagacuaaa

SEQ ID NO: 211910 - RNA, 64 nt, Human
accugggagcaucuggcaggcaggggggcagguacacacacacccacaggcacacccaccagua

SEQ ID NO: 211911 - RNA, 64 nt, Human
aguuuuuuccagucugaucugguucuuacacacucacacacauaacucaaaaguuuugugaaca

SEQ ID NO: 211912 - RNA, 64 nt, Human
ccccgccacagagacacaccauuacauacacagacacacacagaaagacacacacagacacaaa

SEQ ID NO: 211913 - RNA, 64 nt, Human
gaaacacaccauuacacacacauacacagaaagacacacacagacacacaaucacacgcagccc

SEQ ID NO: 211914 - RNA, 64 nt, Human
gauacgcccuuccggccacagaaacacaccauuacacacacauacacagaaagacacacacaga

SEQ ID NO: 211915 - RNA, 64 nt, Human
cagacacacacagaaagacacagacacaaaaucacacacacacccuccccgccacagagacaca

SEQ ID NO: 211916 - RNA, 64 nt, Human
cacagacacacacagaaagacacagacacaaaaucacacacacacccuccccgccacagagaca

SEQ ID NO: 211917 - RNA, 64 nt, Human
cuccccgccacagagacaccauuacauacacagacacacacagaaagacacagacacaaaauca

SEQ ID NO: 211918 - RNA, 64 nt, Human
cacacacagaaagacacacacagacacaaaaucacacacacacccuccccgccacagagacacc

SEQ ID NO: 211919 - RNA, 64 nt, Human
gacacacacagaaagacacacacagacacaaaaucacacacacacccuccccgccacagagaca

SEQ ID NO: 211920 - RNA, 64 nt, Human
gacaccauuacauacacagacacacacagaaagacacacacagacacaaaaucacacacacacc

SEQ ID NO: 211921 - RNA, 64 nt, Human
cuccccaccacagagacaccauuacauacacagacacacacagaaagacacacacagacacaaa

SEQ ID NO: 211922 - RNA, 64 nt, Human
uaacugaagccuaggccccguccccaccucaaaucacacacacccccuccccaccacagagaca

SEQ ID NO: 211923 - RNA, 64 nt, Human
ugcucuucacccagcaccacagaggcaccugcugcacacacaagcaucucacucggcccacgga

SEQ ID NO: 211924 - RNA, 64 nt, Human
uuaggaaggggacaaccaggccccgccacacgcucacacacaaaccugcucacgcagcugugau

SEQ ID NO: 211925 - RNA, 64 nt, Human
ugcaagggugcaaagggccugugccagaagaaaacacacacagggaaaccgcuuuuuuuaauca

SEQ ID NO: 211926 - RNA, 64 nt, Human
aauuuugccuauaccuuuaagacaaacaaacaaacacacacacaaacaagcucuaagcugcugu

SEQ ID NO: 211927 - RNA, 64 nt, Human
uuuugccuauaccuuuaagacaaacaaacaaacacacacacaaacaagcucuaagcugcuguag

SEQ ID NO: 211928 - RNA, 64 nt, Human
gggccuuaaggcauuuuguuauucuguuaaaaaccacacacacucguacaugcagacaccucca

SEQ ID NO: 211929 - RNA, 64 nt, Human
uaaaguaaaaacuaaaaaaauacaaaauacaaaacacacacacacacacacacacacacacaca

SEQ ID NO: 211930 - RNA, 64 nt, Human
aaguaaaaacuaaaaaaauacaaaauacaaaacacacacacacacacacacacacacacacaca

SEQ ID NO: 211931 - RNA, 64 nt, Human
guaaaaacuaaaaaaauacaaaauacaaaacacacacacacacacacacacacacacacacaca

SEQ ID NO: 211932 - RNA, 64 nt, Human
aaaaacuaaaaaaauacaaaauacaaaacacacacacacacacacacacacacacacacacaca

SEQ ID NO: 211933 - RNA, 64 nt, Human
aaacuaaaaaaauacaaaauacaaaacacacacacacacacacacacacacacacacacacaca

SEQ ID NO: 211934 - RNA, 64 nt, Human
acuaaaaaaauacaaaauacaaaacacacacacacacacacacacacacacacacacacacaca

SEQ ID NO: 211935 - RNA, 64 nt, Human
uaaaaaaauacaaaauacaaaacacacacacacacacacacacacacacacacacacacacaaa

SEQ ID NO: 211936 - RNA, 64 nt, Human
aaaaaauacaaaauacaaaacacacacacacacacacacacacacacacacacacacacaaaau

SEQ ID NO: 211937 - RNA, 64 nt, Human
aaaauacaaaauacaaaacacacacacacacacacacacacacacacacacacacacaaaauaa

SEQ ID NO: 211938 - RNA, 64 nt, Human
aauacaaaauacaaaacacacacacacacacacacacacacacacacacacacacaaaauaaau

SEQ ID NO: 211939 - RNA, 64 nt, Human
uacaaaauacaaaacacacacacacacacacacacacacacacacacacacacaaaauaaaucc

SEQ ID NO: 211940 - RNA, 64 nt, Human
caaaauacaaaacacacacacacacacacacacacacacacacacacacacaaaauaaauccgg

SEQ ID NO: 211941 - RNA, 64 nt, Human
aaauacaaaacacacacacacacacacacacacacacacacacacacacaaaauaaauccgggu

SEQ ID NO: 211942 - RNA, 64 nt, Human
auacaaaacacacacacacacacacacacacacacacacacacacacaaaauaaauccgggugu

SEQ ID NO: 211943 - RNA, 64 nt, Human
acaaaacacacacacacacacacacacacacacacacacacacacaaaauaaauccgggugugc

SEQ ID NO: 211944 - RNA, 64 nt, Human
aaaacacacacacacacacacacacacacacacacacacacacaaaauaaauccgggugugccu

SEQ ID NO: 211945 - RNA, 64 nt, Human
aacacacacacacacacacacacacacacacacacacacacaaaauaaauccgggugugccuga

SEQ ID NO: 211946 - RNA, 64 nt, Human
ccgccaaacaaggcaaaaaaauuuaaacaugaagcacacacacaaaaaaggcaguaggaaaaau

SEQ ID NO: 211947 - RNA, 64 nt, Human
gccaaacaaggcaaaaaaauuuaaacaugaagcacacacacaaaaaaggcaguaggaaaaaugc

SEQ ID NO: 211948 - RNA, 64 nt, Human
auuccugccucucaccaugcacgcauccauuguccacacacacacaaccagauaaucuucugaa

SEQ ID NO: 211949 - RNA, 64 nt, Human
uccugccucucaccaugcacgcauccauuguccacacacacacaaccagauaaucuucugaaag

SEQ ID NO: 211950 - RNA, 64 nt, Human
cugccucucaccaugcacgcauccauuguccacacacacacaaccagauaaucuucugaaagug

SEQ ID NO: 211951 - RNA, 64 nt, Human
aggcaggcccgggccuguuggcaagcuucgaucucacacacacagaaacauacauucgugccug

SEQ ID NO: 211952 - RNA, 64 nt, Human
gcaggcccgggccuguuggcaagcuucgaucucacacacacagaaacauacauucgugccugga

SEQ ID NO: 211953 - RNA, 64 nt, Human
cugaugaauaugggccccuuauagagcugcaaaacacacacaugcguauagacauacauacaug

SEQ ID NO: 211954 - RNA, 64 nt, Human
ccauacauagacaagcaucauaaaggcacaagugcacacacaucuaugcagacaagcuuccucg

SEQ ID NO: 211955 - RNA, 64 nt, Human
auauauuuaauuuaggaguauaugugugucuauacacacacauacauaaauauaccacauauac

SEQ ID NO: 211956 - RNA, 64 nt, Human
ggagaauaaaugcaguaauccucucccaaauaagcacacacauuuucaauucucauguuugagu

SEQ ID NO: 211957 - RNA, 64 nt, Human
ugugucuauaauuaaaaaaaaauauauauauauacacacacacauauacauacaaagucaaacu

SEQ ID NO: 211958 - RNA, 64 nt, Human
ugucuauaauuaaaaaaaaauauauauauauacacacacacauauacauacaaagucaaacuga

SEQ ID NO: 211959 - RNA, 64 nt, Human
aaguauguucagcaaaggcauaauuuucuaaaaacacacacagaaaucgcuugagugaggaaaa

SEQ ID NO: 211960 - RNA, 64 nt, Human
cugggaaaccccuucucugugacccacuucucaucacacacauggaaacccauaggcccacaca

SEQ ID NO: 211961 - RNA, 64 nt, Human
cacuucucaucacacacauggaaacccauaggcccacacacagguggugucacugucccuccug

SEQ ID NO: 211962 - RNA, 64 nt, Human
cacaaggucauggccacacugugacacacuacaccacacacaacagccaacagcuacaacagcc

SEQ ID NO: 211963 - RNA, 64 nt, Human
cagggcuccucauugcucccaucugccucugcugcacacacaggcaccagcagggaugccacag

SEQ ID NO: 211964 - RNA, 64 nt, Human
cagcagaaucaccaacacucuccgcuucccccagcacacacacauacaacacagaucauuuccc

SEQ ID NO: 211965 - RNA, 64 nt, Human
gcagaaucaccaacacucuccgcuucccccagcacacacacauacaacacagaucauuucccag

SEQ ID NO: 211966 - RNA, 64 nt, Human
aacaggauaauugggcaaauaaauuacauauaaacacacacaaucuauauauguauauacaaug

SEQ ID NO: 211967 - RNA, 64 nt, Human
cauggaaugaaccaaaucuggcaggaucugcucccacacacaccuuauggagauaaugccucug

SEQ ID NO: 211968 - RNA, 64 nt, Human
uguucuuaauuuuuaacugcuggaaguguuaaaacacacacacacacacacacacauuuuuuuu

SEQ ID NO: 211969 - RNA, 64 nt, Human
uucuuaauuuuuaacugcuggaaguguuaaaacacacacacacacacacacacauuuuuuuuuu

SEQ ID NO: 211970 - RNA, 64 nt, Human
cuuaauuuuuaacugcuggaaguguuaaaacacacacacacacacacacacauuuuuuuuuuga

SEQ ID NO: 211971 - RNA, 64 nt, Human
uaauuuuuaacugcuggaaguguuaaaacacacacacacacacacacacauuuuuuuuuugaga

SEQ ID NO: 211972 - RNA, 64 nt, Human
auuuuuaacugcuggaaguguuaaaacacacacacacacacacacacauuuuuuuuuugagaac

SEQ ID NO: 211973 - RNA, 64 nt, Human
uuuuaacugcuggaaguguuaaaacacacacacacacacacacacauuuuuuuuuugagaacuc

SEQ ID NO: 211974 - RNA, 64 nt, Human
uuaacugcuggaaguguuaaaacacacacacacacacacacacauuuuuuuuuugagaacucca

SEQ ID NO: 211975 - RNA, 64 nt, Human
aacugcuggaaguguuaaaacacacacacacacacacacacauuuuuuuuuugagaacuccaaa

SEQ ID NO: 211976 - RNA, 64 nt, Human
gcuucccaggaguuuugugccugucugcgccucucacacacagauaaguggcucuuacccagcu

SEQ ID NO: 211977 - RNA, 64 nt, Human
cugccaucagagagguuuauuucacacuuacaggcacacacagacacagaccagagacucccag

SEQ ID NO: 211978 - RNA, 64 nt, Human
caaggaaagccccagcacuaacguaaauacacaacacacacacucuacccuauacaacuggaca

SEQ ID NO: 211979 - RNA, 64 nt, Human
cagccuggagaccaccgagagucgagcuggggcacacacacaccuggccgggacccggcaggga

SEQ ID NO: 211980 - RNA, 64 nt, Human
ugcagccuggagaccaccgagagucgagcuggggcacacacacaccuggccgggacccggcagg

SEQ ID NO: 211981 - RNA, 64 nt, Human
acauaaucuugucuauggaaaauccuaaggaauccacacacaaaaaaacuacuagagcuaauaa

SEQ ID NO: 211982 - RNA, 64 nt, Human
uuagguuacagcuggagguguguauauauacacacacacacauguauauacacauauauaugug

SEQ ID NO: 211983 - RNA, 64 nt, Human
gguuagguuacagcuggagguguguauauauacacacacacacauguauauacacauauauaug

SEQ ID NO: 211984 - RNA, 64 nt, Human
cugguuagguuacagcuggagguguguauauauacacacacacacauguauauacacauauaua

SEQ ID NO: 211985 - RNA, 64 nt, Human
uaacaaaucucaagcaaacagcuucacaaauucucacacacauacauaccuauauacucacuuu

SEQ ID NO: 211986 - RNA, 64 nt, Human
ucucuguaaauuaaaauguuacagcacacacauacacacacagagagcauuucaaggccacagc

SEQ ID NO: 211987 - RNA, 64 nt, Human
agucauugcuucucuguaaauuaaaauguuacagcacacacauacacacacagagagcauuuca

SEQ ID NO: 211988 - RNA, 64 nt, Human
uucuuuccuuuuguuguugguuuuaaaauacauucacacacaaauacaaauugacaggucaaaa

SEQ ID NO: 211989 - RNA, 64 nt, Human
gaaaacaacaacacaaaccacacacacucgcacacacacacauacacagagacucuuucauuuu

SEQ ID NO: 211990 - RNA, 64 nt, Human
aagaaaacaacaacacaaaccacacacacucgcacacacacacauacacagagacucuuucauu

SEQ ID NO: 211991 - RNA, 64 nt, Human
acaagaaaacaacaacacaaaccacacacacucgcacacacacacauacacagagacucuuuca

SEQ ID NO: 211992 - RNA, 64 nt, Human
gagcuuuuuaauacaagaaaacaacaacacaaaccacacacacucgcacacacacacauacaca

SEQ ID NO: 211993 - RNA, 64 nt, Human
auucacccuugggcugcagauaguaauauauaaacacacacaaugauugcaagacuauguaaau

SEQ ID NO: 211994 - RNA, 64 nt, Human
auauucagcaggguauuuaagugcuagggcuggucacacacaaccaacugaaaaagacuagagg

SEQ ID NO: 211995 - RNA, 64 nt, Human
acucuguucuuuaguguccuuaccuuuaucuuaccacacacauggguguuucuauuauccuugg

SEQ ID NO: 211996 - RNA, 64 nt, Human
aaguugaugauuuacacacacacacacacacacacacacacaccccuucuugaauggcuccaag

SEQ ID NO: 211997 - RNA, 64 nt, Human
acaaguugaugauuuacacacacacacacacacacacacacacaccccuucuugaauggcucca

SEQ ID NO: 211998 - RNA, 64 nt, Human
auacaaguugaugauuuacacacacacacacacacacacacacacaccccuucuugaauggcuc

SEQ ID NO: 211999 - RNA, 64 nt, Human
cuauacaaguugaugauuuacacacacacacacacacacacacacacaccccuucuugaauggc

SEQ ID NO: 212000 - RNA, 64 nt, Human
aacuauacaaguugaugauuuacacacacacacacacacacacacacacaccccuucuugaaug

SEQ ID NO: 212001 - RNA, 64 nt, Human
uuaacuauacaaguugaugauuuacacacacacacacacacacacacacacaccccuucuugaa

SEQ ID NO: 212002 - RNA, 64 nt, Human
gcuuaacuauacaaguugaugauuuacacacacacacacacacacacacacacaccccuucuug

SEQ ID NO: 212003 - RNA, 64 nt, Human
aagcuuaacuauacaaguugaugauuuacacacacacacacacacacacacacacaccccuucu

SEQ ID NO: 212004 - RNA, 64 nt, Human
caaagcuuaacuauacaaguugaugauuuacacacacacacacacacacacacacacaccccuu

SEQ ID NO: 212005 - RNA, 64 nt, Human
cacaaagcuuaacuauacaaguugaugauuuacacacacacacacacacacacacacacacccc

SEQ ID NO: 212006 - RNA, 64 nt, Human
uacacaaagcuuaacuauacaaguugaugauuuacacacacacacacacacacacacacacacc

SEQ ID NO: 212007 - RNA, 64 nt, Human
caugacuauggauaaacuaaacacgugacacaaacacacacaaaagggaacccagcucuaauac

SEQ ID NO: 212008 - RNA, 64 nt, Human
uucauuuggagauguaugguguaaaacacacaaacacacacaaaaaagcacaagcccgcugcau

SEQ ID NO: 212009 - RNA, 64 nt, Human
uuguguuuuagucccuugcuccugcuucuuucuacacacacaucuaaagacggugcggcucgcu

SEQ ID NO: 212010 - RNA, 64 nt, Human
agggguaggaggagggcccucagcuggcccuccccacacacaggacggcaggggcacugugagg

SEQ ID NO: 212011 - RNA, 64 nt, Human
cagugggaacucugacaagggcugaccugccucucacacacauagauuaauggcacugauuguu

SEQ ID NO: 212012 - RNA, 64 nt, Human
caugguuauuuauauauauagauaucuguauauacacacacacauaugugcacacacacacucu

SEQ ID NO: 212013 - RNA, 64 nt, Human
ugguuauuuauauauauagauaucuguauauacacacacacauaugugcacacacacacucucu

SEQ ID NO: 212014 - RNA, 64 nt, Human
uauagauaucuguauauacacacacacauaugugcacacacacacucucucuccauuaucgaac

SEQ ID NO: 212015 - RNA, 64 nt, Human
uagauaucuguauauacacacacacauaugugcacacacacacucucucuccauuaucgaacga

SEQ ID NO: 212016 - RNA, 64 nt, Human
accaaaugagcuaaguugcaaauauauauauauacacacacacacauauauguacauguguaug

SEQ ID NO: 212017 - RNA, 64 nt, Human
caaaugagcuaaguugcaaauauauauauauacacacacacacauauauguacauguguaugua

SEQ ID NO: 212018 - RNA, 64 nt, Human
aaugagcuaaguugcaaauauauauauauacacacacacacauauauguacauguguauguaca

SEQ ID NO: 212019 - RNA, 64 nt, Human
aaauaugcuuucuuguugcauauaugcacagauacacacacacacacacacgaaaauaaauaaa

SEQ ID NO: 212020 - RNA, 64 nt, Human
auaugcuuucuuguugcauauaugcacagauacacacacacacacacacgaaaauaaauaaaug

SEQ ID NO: 212021 - RNA, 64 nt, Human
augcuuucuuguugcauauaugcacagauacacacacacacacacacgaaaauaaauaaauguu

SEQ ID NO: 212022 - RNA, 64 nt, Human
gcuuucuuguugcauauaugcacagauacacacacacacacacacgaaaauaaauaaauguuca

SEQ ID NO: 212023 - RNA, 64 nt, Human
uuucuuguugcauauaugcacagauacacacacacacacacacgaaaauaaauaaauguucaua

SEQ ID NO: 212024 - RNA, 64 nt, Human
aauuccaaugugaauuugcagggggagugggggacacacacaaauuucggggccauaccacccu

SEQ ID NO: 212025 - RNA, 64 nt, Human
cuccagagcugcccaccucccacugcccccucagcacacacacaguccccaggcggccuagggg

SEQ ID NO: 212026 - RNA, 64 nt, Human
ccagagcugcccaccucccacugcccccucagcacacacacaguccccaggcggccuaggggcc

SEQ ID NO: 212027 - RNA, 64 nt, Human
cugaagggccugcucuuuccauuguggaucacagcacacacauacauacacccuccaccucccc

SEQ ID NO: 212028 - RNA, 64 nt, Human
auagacuccuauuuuucuuguuuuauauuaugaccacacacaucucugcuggaaagucaacaug

SEQ ID NO: 212029 - RNA, 64 nt, Human
uuguaccauccacccauacccacacagucacagucacacacacauauguauuacuuacacuaua

SEQ ID NO: 212030 - RNA, 64 nt, Human
guaccauccacccauacccacacagucacagucacacacacauauguauuacuuacacuauaua

SEQ ID NO: 212031 - RNA, 64 nt, Human
cacauaugugggcauccagccucuggggccuuggcacacacacauucgugugcucugcugcaug

SEQ ID NO: 212032 - RNA, 64 nt, Human
cauaugugggcauccagccucuggggccuuggcacacacacauucgugugcucugcugcaugug

SEQ ID NO: 212033 - RNA, 64 nt, Human
ucagccaggaugggcugcgcgucuccagccucugcacacacauuggcggguggggugcagggag

SEQ ID NO: 212034 - RNA, 64 nt, Human
aaugcaaucuccccuugauuuaaacacacagauacacacacacacacacacacacacaaaccuu

SEQ ID NO: 212035 - RNA, 64 nt, Human
ugcaaucuccccuugauuuaaacacacagauacacacacacacacacacacacacaaaccuucu

SEQ ID NO: 212036 - RNA, 64 nt, Human
caaucuccccuugauuuaaacacacagauacacacacacacacacacacacacaaaccuucugc

SEQ ID NO: 212037 - RNA, 64 nt, Human
aucuccccuugauuuaaacacacagauacacacacacacacacacacacacaaaccuucugccu

SEQ ID NO: 212038 - RNA, 64 nt, Human
cuccccuugauuuaaacacacagauacacacacacacacacacacacacaaaccuucugccuuu

SEQ ID NO: 212039 - RNA, 64 nt, Human
ccccuugauuuaaacacacagauacacacacacacacacacacacacaaaccuucugccuuuga

SEQ ID NO: 212040 - RNA, 64 nt, Human
ccuugauuuaaacacacagauacacacacacacacacacacacacaaaccuucugccuuugaug

SEQ ID NO: 212041 - RNA, 64 nt, Human
uugauuuaaacacacagauacacacacacacacacacacacacaaaccuucugccuuugauguu

SEQ ID NO: 212042 - RNA, 64 nt, Human
gauuuaaacacacagauacacacacacacacacacacacacaaaccuucugccuuugauguuac

SEQ ID NO: 212043 - RNA, 64 nt, Human
agcagcuucaccagagcauuuccaacaccacagacacacacacgcacgcacacacacaaacaca

SEQ ID NO: 212044 - RNA, 64 nt, Human
agcauuuccaacaccacagacacacacacgcacgcacacacacaaacacacaugcacacacaca

SEQ ID NO: 212045 - RNA, 64 nt, Human
cauuuccaacaccacagacacacacacgcacgcacacacacaaacacacaugcacacacacaca

SEQ ID NO: 212046 - RNA, 64 nt, Human
cacacacacgcacgcacacacacaaacacacaugcacacacacacaucucauuucucuaguguc

SEQ ID NO: 212047 - RNA, 64 nt, Human
cacacacgcacgcacacacacaaacacacaugcacacacacacaucucauuucucuagugucuu

SEQ ID NO: 212048 - RNA, 64 nt, Human
cacacgcacgcacacacacaaacacacaugcacacacacacaucucauuucucuagugucuuuu

SEQ ID NO: 212049 - RNA, 64 nt, Human
guccagucuucaggcaaguucuguguuagucaugcacacacauaccuaugaaaccuuggaguuu

SEQ ID NO: 212050 - RNA, 64 nt, Human
cucagccucuucacaaugacuuucuaaaaaaaaucacacacacacacacacacacuacagaaga

SEQ ID NO: 212051 - RNA, 64 nt, Human
cagccucuucacaaugacuuucuaaaaaaaaucacacacacacacacacacacuacagaagagg

SEQ ID NO: 212052 - RNA, 64 nt, Human
gccucuucacaaugacuuucuaaaaaaaaucacacacacacacacacacacuacagaagaggau

SEQ ID NO: 212053 - RNA, 64 nt, Human
cucuucacaaugacuuucuaaaaaaaaucacacacacacacacacacacuacagaagaggauug

SEQ ID NO: 212054 - RNA, 64 nt, Human
cuucacaaugacuuucuaaaaaaaaucacacacacacacacacacacuacagaagaggauugca

SEQ ID NO: 212055 - RNA, 64 nt, Human
ucacaaugacuuucuaaaaaaaaucacacacacacacacacacacuacagaagaggauugcaaa

SEQ ID NO: 212056 - RNA, 64 nt, Human
acaaugacuuucuaaaaaaaaucacacacacacacacacacacuacagaagaggauugcaaaca

SEQ ID NO: 212057 - RNA, 64 nt, Human
gugauguaauuggaauagagcuguugauuuaaggcacacacaaucccucacacuguggguuuuu

SEQ ID NO: 212058 - RNA, 64 nt, Human
cagagcaggaggccccuggcccagcggccccucccacacacacccacacacucgcccgcccacu

SEQ ID NO: 212059 - RNA, 64 nt, Human
uuuggaggagccccgaguggcccaggaguccccccacacacagaugcauaggccugccuuccgg

SEQ ID NO: 212060 - RNA, 64 nt, Human
uuaacauuauuauggauauuuggcuuucauaggccacacacaggugugcugcgcgggaagcccc

SEQ ID NO: 212061 - RNA, 64 nt, Human
ucugaacacauugaguuggaaucacuguuuagaacacacacacuuacuuuuucuggucucuacc

SEQ ID NO: 212062 - RNA, 64 nt, Human
cauauauauauauacacacacacacacacacacacacacacauauauuuguauaaagcuaaguu

SEQ ID NO: 212063 - RNA, 64 nt, Human
uacauauauauauauacacacacacacacacacacacacacacauauauuuguauaaagcuaag

SEQ ID NO: 212064 - RNA, 64 nt, Human
cauacauauauauauauacacacacacacacacacacacacacacauauauuuguauaaagcua

SEQ ID NO: 212065 - RNA, 64 nt, Human
uucauacauauauauauauacacacacacacacacacacacacacacauauauuuguauaaagc

SEQ ID NO: 212066 - RNA, 64 nt, Human
uuuucauacauauauauauauacacacacacacacacacacacacacacauauauuuguauaaa

SEQ ID NO: 212067 - RNA, 64 nt, Human
uguuuucauacauauauauauauacacacacacacacacacacacacacacauauauuuguaua

SEQ ID NO: 212068 - RNA, 64 nt, Human
guuguuuucauacauauauauauauacacacacacacacacacacacacacacauauauuugua

SEQ ID NO: 212069 - RNA, 64 nt, Human
uaguuguuuucauacauauauauauauacacacacacacacacacacacacacacauauauuug

SEQ ID NO: 212070 - RNA, 64 nt, Human
gauaguuguuuucauacauauauauauauacacacacacacacacacacacacacacauauauu

SEQ ID NO: 212071 - RNA, 64 nt, Human
cagauaguuguuuucauacauauauauauauacacacacacacacacacacacacacacauaua

SEQ ID NO: 212072 - RNA, 64 nt, Human
aucagauaguuguuuucauacauauauauauauacacacacacacacacacacacacacacaua

SEQ ID NO: 212073 - RNA, 64 nt, Human
cuguauucuaguacguuauaauuuucuagaucagcacacacaugaucagcccacugaguuauga

SEQ ID NO: 212074 - RNA, 64 nt, Human
auguuaacaucauugcugcauuuuguacuuugaacacacacauaauauauauaaccagugguaa

SEQ ID NO: 212075 - RNA, 64 nt, Human
uguccucuuucagaaaacagaaaaaaaacacacacacacacaacaaaaauuugaaccaaaacau

SEQ ID NO: 212076 - RNA, 64 nt, Human
acuguccucuuucagaaaacagaaaaaaaacacacacacacacaacaaaaauuugaaccaaaac

SEQ ID NO: 212077 - RNA, 64 nt, Human
aaacuguccucuuucagaaaacagaaaaaaaacacacacacacacaacaaaaauuugaaccaaa

SEQ ID NO: 212078 - RNA, 64 nt, Human
auaaacuguccucuuucagaaaacagaaaaaaaacacacacacacacaacaaaaauuugaacca

SEQ ID NO: 212079 - RNA, 64 nt, Human
uuuuuauuggaaugguaggauaucuuggcuuugccacacacaguuacagagugaacacucuacu

SEQ ID NO: 212080 - RNA, 64 nt, Human
gcaccucccuuucagccauucuucaagaaugggccacacacagcuagaaguccucucccagcua

SEQ ID NO: 212081 - RNA, 64 nt, Human
acacagacacacauacacccaugaugugagcaaacacacacacgugcgccuucauagcccagcc

SEQ ID NO: 212082 - RNA, 64 nt, Human
acacacaacacacacacauacacaccccugaacacacacacagacacacauacacccaugaugu

SEQ ID NO: 212083 - RNA, 64 nt, Human
agacacacaacacacacacauacacaccccugaacacacacacagacacacauacacccaugau

SEQ ID NO: 212084 - RNA, 64 nt, Human
ugcacacccugaaaacacacacagacacacaacacacacacauacacaccccugaacacacaca

SEQ ID NO: 212085 - RNA, 64 nt, Human
caugcacacccugaaaacacacacagacacacaacacacacacauacacaccccugaacacaca

SEQ ID NO: 212086 - RNA, 64 nt, Human
caaucuggcccucuccacaugcacacccugaaaacacacacagacacacaacacacacacauac

SEQ ID NO: 212087 - RNA, 64 nt, Human
uuguucuagcguguauuaaaacuugacacacacccacacacaaaaacaaaaacaccacugucgg

SEQ ID NO: 212088 - RNA, 64 nt, Human
gccuaucccagcaaaacacacacacacacacacacacacacaaaauaaagacacacaaggacgu

SEQ ID NO: 212089 - RNA, 64 nt, Human
uugccuaucccagcaaaacacacacacacacacacacacacacaaaauaaagacacacaaggac

SEQ ID NO: 212090 - RNA, 64 nt, Human
cuuugccuaucccagcaaaacacacacacacacacacacacacacaaaauaaagacacacaagg

SEQ ID NO: 212091 - RNA, 64 nt, Human
gacuuugccuaucccagcaaaacacacacacacacacacacacacacaaaauaaagacacacaa

SEQ ID NO: 212092 - RNA, 64 nt, Human
aagacuuugccuaucccagcaaaacacacacacacacacacacacacacaaaauaaagacacac

SEQ ID NO: 212093 - RNA, 64 nt, Human
aaaagacuuugccuaucccagcaaaacacacacacacacacacacacacacaaaauaaagacac

SEQ ID NO: 212094 - RNA, 64 nt, Human
ccaaaagacuuugccuaucccagcaaaacacacacacacacacacacacacacaaaauaaagac

SEQ ID NO: 212095 - RNA, 64 nt, Human
ucccaaaagacuuugccuaucccagcaaaacacacacacacacacacacacacacaaaauaaag

SEQ ID NO: 212096 - RNA, 64 nt, Human
ugucccaaaagacuuugccuaucccagcaaaacacacacacacacacacacacacacaaaauaa

SEQ ID NO: 212097 - RNA, 64 nt, Human
cgugucccaaaagacuuugccuaucccagcaaaacacacacacacacacacacacacacaaaau

SEQ ID NO: 212098 - RNA, 64 nt, Human
gaaaagaccaggauucugugaguucugagguugccacacacaaagaagcugugguuucucugcc

SEQ ID NO: 212099 - RNA, 64 nt, Human
gggggagagaaacccuggcucuucacccagguuucacacacauguaaaugaaacacuauguuag

SEQ ID NO: 212100 - RNA, 64 nt, Human
aaaauggagucggggggccacauagaagcccucacacacacaugcccguaacaggauuuaucac

SEQ ID NO: 212101 - RNA, 64 nt, Human
auaaaauggagucggggggccacauagaagcccucacacacacaugcccguaacaggauuuauc

SEQ ID NO: 212102 - RNA, 64 nt, Human
gcaguuucuccaaaaacaaaaacaaaacacacaccacacacacgcgcuuuuccagucacacacc

SEQ ID NO: 212103 - RNA, 64 nt, Human
aaacaguuauuugaacaaacaaaaguacuguacucacacacauaagguauccaguggauuuuuc

SEQ ID NO: 212104 - RNA, 64 nt, Human
cugcgcgugcggagcggagccccccguguucacacacacacaauggcaagcauagucgccuggu

SEQ ID NO: 212105 - RNA, 64 nt, Human
gccugcgcgugcggagcggagccccccguguucacacacacacaauggcaagcauagucgccug

SEQ ID NO: 212106 - RNA, 64 nt, Human
cggccugcgcgugcggagcggagccccccguguucacacacacacaauggcaagcauagucgcc

SEQ ID NO: 212107 - RNA, 64 nt, Human
uagaaaaauucagaaaagcacacacucacauacacacacacaaaaucacucucuuaucccaucc

SEQ ID NO: 212108 - RNA, 64 nt, Human
cuuagaaaaauucagaaaagcacacacucacauacacacacacaaaaucacucucuuaucccau

SEQ ID NO: 212109 - RNA, 64 nt, Human
uuaauaauaguguuugagguuauauaugcacaaacacacacagaaauauauucaugucuaugug

SEQ ID NO: 212110 - RNA, 64 nt, Human
agagaugagagaggugccuucucuguauuagacucacacacaucaguccaguugaagaauuggu

SEQ ID NO: 212111 - RNA, 64 nt, Human
cacacacacacacacacacacacacacacacacacacacacaaacauauaaccuaugccaauaa

SEQ ID NO: 212112 - RNA, 64 nt, Human
gacacacacacacacacacacacacacacacacacacacacacaaacauauaaccuaugccaau

SEQ ID NO: 212113 - RNA, 64 nt, Human
cagacacacacacacacacacacacacacacacacacacacacacaaacauauaaccuaugcca

SEQ ID NO: 212114 - RNA, 64 nt, Human
agcagacacacacacacacacacacacacacacacacacacacacacaaacauauaaccuaugc

SEQ ID NO: 212115 - RNA, 64 nt, Human
gaagcagacacacacacacacacacacacacacacacacacacacacacaaacauauaaccuau

SEQ ID NO: 212116 - RNA, 64 nt, Human
augaagcagacacacacacacacacacacacacacacacacacacacacacaaacauauaaccu

SEQ ID NO: 212117 - RNA, 64 nt, Human
aaaugaagcagacacacacacacacacacacacacacacacacacacacacacaaacauauaac

SEQ ID NO: 212118 - RNA, 64 nt, Human
aaaaaugaagcagacacacacacacacacacacacacacacacacacacacacacaaacauaua

SEQ ID NO: 212119 - RNA, 64 nt, Human
agaaaaaugaagcagacacacacacacacacacacacacacacacacacacacacacaaacaua

SEQ ID NO: 212120 - RNA, 64 nt, Human
uuagaaaaaugaagcagacacacacacacacacacacacacacacacacacacacacacaaaca

SEQ ID NO: 212121 - RNA, 64 nt, Human
gauuagaaaaaugaagcagacacacacacacacacacacacacacacacacacacacacacaaa

SEQ ID NO: 212122 - RNA, 64 nt, Human
uugauuagaaaaaugaagcagacacacacacacacacacacacacacacacacacacacacaca

SEQ ID NO: 212123 - RNA, 64 nt, Human
guuugauuagaaaaaugaagcagacacacacacacacacacacacacacacacacacacacaca

SEQ ID NO: 212124 - RNA, 64 nt, Human
uuguuugauuagaaaaaugaagcagacacacacacacacacacacacacacacacacacacaca

SEQ ID NO: 212125 - RNA, 64 nt, Human
guuuguuugauuagaaaaaugaagcagacacacacacacacacacacacacacacacacacaca

SEQ ID NO: 212126 - RNA, 64 nt, Human
uuguuuguuugauuagaaaaaugaagcagacacacacacacacacacacacacacacacacaca

SEQ ID NO: 212127 - RNA, 64 nt, Human
aguuguuuguuugauuagaaaaaugaagcagacacacacacacacacacacacacacacacaca

SEQ ID NO: 212128 - RNA, 64 nt, Human
ucaguuguuuguuugauuagaaaaaugaagcagacacacacacacacacacacacacacacaca

SEQ ID NO: 212129 - RNA, 64 nt, Human
ucucugugucccaucucuacaacccacauacagacacacacacucucucucucuuucuuuccau

SEQ ID NO: 212130 - RNA, 64 nt, Human
aaggcacaugagugugaccucugccauggggaaacacacacagagauaucuauacauauauaca

SEQ ID NO: 212131 - RNA, 64 nt, Human
ucuccucaucaucauucccaacaacauccucugccacacacaacaaaacguaaguuucauuugg

SEQ ID NO: 212132 - RNA, 64 nt, Human
ugccccuuuuggaaugaucucugaauauauaaaacacacacacaaagagcaauaguuugccccu

SEQ ID NO: 212133 - RNA, 64 nt, Human
ccccuuuuggaaugaucucugaauauauaaaacacacacacaaagagcaauaguuugccccuuu

SEQ ID NO: 212134 - RNA, 64 nt, Human
ugccccuuuuggaacgaccccugaauauauaaaacacacacacaccccgcgcacucucacuccu

SEQ ID NO: 212135 - RNA, 64 nt, Human
ccccuuuuggaacgaccccugaauauauaaaacacacacacaccccgcgcacucucacuccuuu

SEQ ID NO: 212136 - RNA, 64 nt, Human
gcuauaugacuacggauccauuagugaggagcgacacacacaccuguaggcauccugugcaaac

SEQ ID NO: 212137 - RNA, 64 nt, Human
aauuuuaucuuuugguagaaauguguuuauuuaacacacacacacaccuaauacuacauucaaa

SEQ ID NO: 212138 - RNA, 64 nt, Human
uuuuaucuuuugguagaaauguguuuauuuaacacacacacacaccuaauacuacauucaaagu

SEQ ID NO: 212139 - RNA, 64 nt, Human
uuaucuuuugguagaaauguguuuauuuaacacacacacacaccuaauacuacauucaaaguau

SEQ ID NO: 212140 - RNA, 64 nt, Human
agacagaaggugaagacaucuagaaacauuacaccacacacaccgucaucacauuuucacaugc

SEQ ID NO: 212141 - RNA, 64 nt, Human
uauauauauauauauauauauauauauauauauacacacacacacacauacacaaauauuccag

SEQ ID NO: 212142 - RNA, 64 nt, Human
uauauauauauauauauauauauauauauauacacacacacacacauacacaaauauuccagga

SEQ ID NO: 212143 - RNA, 64 nt, Human
uauauauauauauauauauauauauauauacacacacacacacauacacaaauauuccaggaua

SEQ ID NO: 212144 - RNA, 64 nt, Human
uauauauauauauauauauauauauauacacacacacacacauacacaaauauuccaggauaca

SEQ ID NO: 212145 - RNA, 64 nt, Human
agauacauguaaaacauauucacacccaugcacgcacacacauacacacugaaggccacgauug

SEQ ID NO: 212146 - RNA, 64 nt, Human
agcuuagaggauaagucucuggagcagaauuuaucacacacaaaaguuacaccaacagaauacc

SEQ ID NO: 212147 - RNA, 64 nt, Human
uguggacgaacaucugggguggaaguuuuguagccacacacaggauacugcccaagauccagcg

SEQ ID NO: 212148 - RNA, 64 nt, Human
uuuaagagcacccggucagucagagaacagagaucacacacaccaaaccagacagaggcagggc

SEQ ID NO: 212149 - RNA, 64 nt, Human
aacuuggauaaagaaaaagacaaacagaaauagacacacacaccagcagagacagaaacagcaa

SEQ ID NO: 212150 - RNA, 64 nt, Human
gauuccaaucaauauaaauauauauauauauauacacacacauauauaaaaaguauaauuuuuc

SEQ ID NO: 212151 - RNA, 64 nt, Human
cuuacauuaguuaagcuaagcagcaaaaagaaaacacacacacacacucacauuuagcccaugu

SEQ ID NO: 212152 - RNA, 64 nt, Human
uacauuaguuaagcuaagcagcaaaaagaaaacacacacacacacucacauuuagcccauguca

SEQ ID NO: 212153 - RNA, 64 nt, Human
cauuaguuaagcuaagcagcaaaaagaaaacacacacacacacucacauuuagcccaugucauu

SEQ ID NO: 212154 - RNA, 64 nt, Human
gcccacuccccaguuggcccuucugcccuuaccccacacacaguccaacucuuccaccucuggg

SEQ ID NO: 212155 - RNA, 64 nt, Human
gaaauggcccguggugggcugaccccccacccuccacacacacaguuccaugacccagcgggcc

SEQ ID NO: 212156 - RNA, 64 nt, Human
aauggcccguggugggcugaccccccacccuccacacacacaguuccaugacccagcgggcccc

SEQ ID NO: 212157 - RNA, 64 nt, Human
gugugugugucaagcccucacucacccacgcacucacacacagcauucuguucuccaugcaaag

SEQ ID NO: 212158 - RNA, 64 nt, Human
ucugcgugcagauuuuguacaaaaaaaaaaaagacacacacacauacaugauaaugauucccag

SEQ ID NO: 212159 - RNA, 64 nt, Human
ugcgugcagauuuuguacaaaaaaaaaaaagacacacacacauacaugauaaugauucccagcc

SEQ ID NO: 212160 - RNA, 64 nt, Human
gaaaaguucggacucucugucucacuccuugccccacacacacuugucccugcccccacccuuc

SEQ ID NO: 212161 - RNA, 64 nt, Human
ccccugcccccaccccaugcccccacccuccccucacacacaaauugacucuuauuuauagaau

SEQ ID NO: 212162 - RNA, 64 nt, Human
uauuauccugcaccaccucacuguuccccaugcgcacacacauacacacaccccaaaacacaua

SEQ ID NO: 212163 - RNA, 64 nt, Human
uccaggggcagccuuaguucccauggcccugaaacacacacauuucccccuuccuuucccagaa

SEQ ID NO: 212164 - RNA, 64 nt, Human
cgcacgcacgcacacaaacaugcacacacgcaugcacacacacaaagccuuaagcagaagaaug

SEQ ID NO: 212165 - RNA, 64 nt, Human
cacgcacgcacacaaacaugcacacacgcaugcacacacacaaagccuuaagcagaagaauguc

SEQ ID NO: 212166 - RNA, 64 nt, Human
cacucaagauacuacagaugugggugcaggcaugcacacacacgauggaauauggccauuccua

SEQ ID NO: 212167 - RNA, 64 nt, Human
uguauguguguguauauauagauguauauauauacacacacagagauauauacauauggcugua

SEQ ID NO: 212168 - RNA, 64 nt, Human
uguguguguguguauacauauauacacauauauacacacacacauacauauacauguguauaua

SEQ ID NO: 212169 - RNA, 64 nt, Human
uguguguguguauacauauauacacauauauacacacacacauacauauacauguguauauaua

SEQ ID NO: 212170 - RNA, 64 nt, Human
aaaaaugaucauggcuuuaaaaaaaaaacaaaaacacacacacaugaacucagauuugcaaacc

SEQ ID NO: 212171 - RNA, 64 nt, Human
aaaugaucauggcuuuaaaaaaaaaacaaaaacacacacacaugaacucagauuugcaaaccag

SEQ ID NO: 212172 - RNA, 64 nt, Human
uucuucauaucaauuuuguauaaauauauagaaacacacacacagccucagacuuacaaacuga

SEQ ID NO: 212173 - RNA, 64 nt, Human
cuucauaucaauuuuguauaaauauauagaaacacacacacagccucagacuuacaaacugauu

SEQ ID NO: 212174 - RNA, 64 nt, Human
gugcauucugaggucuaacccggggugccaggaacacacacauccuccaucccagcauagagaa

SEQ ID NO: 212175 - RNA, 64 nt, Human
uuugucagguucacguccuauaacgguuaaaaaacacacacacacauacacaaaccguuucuau

SEQ ID NO: 212176 - RNA, 64 nt, Human
ugucagguucacguccuauaacgguuaaaaaacacacacacacauacacaaaccguuucuauga

SEQ ID NO: 212177 - RNA, 64 nt, Human
ucagguucacguccuauaacgguuaaaaaacacacacacacauacacaaaccguuucuaugaga

SEQ ID NO: 212178 - RNA, 64 nt, Human
auugagaaucuaucuaucuccuugcacacaugggcacacacaaucuccaccauccagggagguc

SEQ ID NO: 212179 - RNA, 64 nt, Human
uuuaggacuguuuuuagacccuccuagccuugaacacacacauguacacacacacacacacaca

SEQ ID NO: 212180 - RNA, 64 nt, Human
uuuagacccuccuagccuugaacacacacauguacacacacacacacacacacacacacacacc

SEQ ID NO: 212181 - RNA, 64 nt, Human
uagacccuccuagccuugaacacacacauguacacacacacacacacacacacacacacacccu

SEQ ID NO: 212182 - RNA, 64 nt, Human
gacccuccuagccuugaacacacacauguacacacacacacacacacacacacacacacccuuu

SEQ ID NO: 212183 - RNA, 64 nt, Human
cccuccuagccuugaacacacacauguacacacacacacacacacacacacacacacccuuuca

SEQ ID NO: 212184 - RNA, 64 nt, Human
cuccuagccuugaacacacacauguacacacacacacacacacacacacacacacccuuucauu

SEQ ID NO: 212185 - RNA, 64 nt, Human
ccuagccuugaacacacacauguacacacacacacacacacacacacacacacccuuucauucc

SEQ ID NO: 212186 - RNA, 64 nt, Human
uagccuugaacacacacauguacacacacacacacacacacacacacacacccuuucauucccu

SEQ ID NO: 212187 - RNA, 64 nt, Human
gccuugaacacacacauguacacacacacacacacacacacacacacacccuuucauucccugu

SEQ ID NO: 212188 - RNA, 64 nt, Human
cuugaacacacacauguacacacacacacacacacacacacacacacccuuucauucccugugu

SEQ ID NO: 212189 - RNA, 64 nt, Human
ugaacacacacauguacacacacacacacacacacacacacacacccuuucauucccuguguug

SEQ ID NO: 212190 - RNA, 64 nt, Human
aacacacacauguacacacacacacacacacacacacacacacccuuucauucccuguguugug

SEQ ID NO: 212191 - RNA, 64 nt, Human
aaacuccaccucuuggauuggcccuggcugcugccacacacauauccaagagcucagggccagu

SEQ ID NO: 212192 - RNA, 64 nt, Human
accucccuaccaaaaagacagagacccgcccccucacacacaaacacacauguccuguugaacu

SEQ ID NO: 212193 - RNA, 64 nt, Human
aggcuacaaccaagacagcugaaggagaaugaaacacacacauccacagaaacagagaggcgua

SEQ ID NO: 212194 - RNA, 64 nt, Human
agguguggcacuguggugagagugugugucuuugcacacacagugcagcgggaacgguggggcu

SEQ ID NO: 212195 - RNA, 64 nt, Human
gagggaagcucuaucugggaacucacccccagcgcacacacaucucccccagggucccaaggcc

SEQ ID NO: 212196 - RNA, 64 nt, Human
cacauuacauuagccaugggagcaauaaugucaccacacacacuucaugaagccucuggaaaac

SEQ ID NO: 212197 - RNA, 64 nt, Human
cagacugguuccuaacucucucccuccuccugcccacacacaucaaaagaaucuucccuacacc

SEQ ID NO: 212198 - RNA, 64 nt, Human
gacagacagacagacagacacacacacacacacacacacacauuuugggacaaguggggagccc

SEQ ID NO: 212199 - RNA, 64 nt, Human
cggacagacagacagacagacacacacacacacacacacacacauuuugggacaaguggggagc

SEQ ID NO: 212200 - RNA, 64 nt, Human
uacggacagacagacagacagacacacacacacacacacacacacauuuugggacaagugggga

SEQ ID NO: 212201 - RNA, 64 nt, Human
cuuacggacagacagacagacagacacacacacacacacacacacacauuuugggacaaguggg

SEQ ID NO: 212202 - RNA, 64 nt, Human
cacuuacggacagacagacagacagacacacacacacacacacacacacauuuugggacaagug

SEQ ID NO: 212203 - RNA, 64 nt, Human
accacuuacggacagacagacagacagacacacacacacacacacacacacauuuugggacaag

SEQ ID NO: 212204 - RNA, 64 nt, Human
cuaccacuuacggacagacagacagacagacacacacacacacacacacacacauuuugggaca

SEQ ID NO: 212205 - RNA, 64 nt, Human
cucuaccacuuacggacagacagacagacagacacacacacacacacacacacacauuuuggga

SEQ ID NO: 212206 - RNA, 64 nt, Human
gacucuaccacuuacggacagacagacagacagacacacacacacacacacacacacauuuugg

SEQ ID NO: 212207 - RNA, 64 nt, Human
uccuuacuugaguccauauggguuggacaguccccacacacauuaaauucuguaaaugaaagcc

SEQ ID NO: 212208 - RNA, 64 nt, Human
gucuaucaacauuaaaaauacuaaaaaauaaagacacacacagagcauuuuagugacauccacu

SEQ ID NO: 212209 - RNA, 64 nt, Human
gaauauugucugccuuaaagcaguaccccccuaccacacacaccccuguccuccagcaccauag

SEQ ID NO: 212210 - RNA, 64 nt, Human
cauacacacacacccacacacacaaacacacacacacacacaauuuucacgauguauggucagg

SEQ ID NO: 212211 - RNA, 64 nt, Human
gacauacacacacacccacacacacaaacacacacacacacacaauuuucacgauguaugguca

SEQ ID NO: 212212 - RNA, 64 nt, Human
uggacauacacacacacccacacacacaaacacacacacacacacaauuuucacgauguauggu

SEQ ID NO: 212213 - RNA, 64 nt, Human
cauggacauacacacacacccacacacacaaacacacacacacacacaauuuucacgauguaug

SEQ ID NO: 212214 - RNA, 64 nt, Human
uacauggacauacacacacacccacacacacaaacacacacacacacacaauuuucacgaugua

SEQ ID NO: 212215 - RNA, 64 nt, Human
caccagcauauacauggacauacacacacacccacacacacaaacacacacacacacacaauuu

SEQ ID NO: 212216 - RNA, 64 nt, Human
accaccagcauauacauggacauacacacacacccacacacacaaacacacacacacacacaau

SEQ ID NO: 212217 - RNA, 64 nt, Human
agggauaaaaaccaccagcauauacauggacauacacacacacccacacacacaaacacacaca

SEQ ID NO: 212218 - RNA, 64 nt, Human
uccgacuccagggugaucugcucaaaggcugagucacacacaaaacgcucacggaccuugaacg

SEQ ID NO: 212219 - RNA, 64 nt, Human
uacuuuacuucugguaugguuuauuaaccacacacacacacaaaagugaaaaacuguguugggg

SEQ ID NO: 212220 - RNA, 64 nt, Human
cauacuuuacuucugguaugguuuauuaaccacacacacacacaaaagugaaaaacuguguugg

SEQ ID NO: 212221 - RNA, 64 nt, Human
accauacuuuacuucugguaugguuuauuaaccacacacacacacaaaagugaaaaacuguguu

SEQ ID NO: 212222 - RNA, 64 nt, Human
acaccauacuuuacuucugguaugguuuauuaaccacacacacacacaaaagugaaaaacugug

SEQ ID NO: 212223 - RNA, 64 nt, Human
uagacacagacacuugccuauacagagacauaaccacacacacucagaggauagugaacaaauc

SEQ ID NO: 212224 - RNA, 64 nt, Human
uagcccugguugcuucugauacacagccacugcacacacacacucacacucacacucccuuguc

SEQ ID NO: 212225 - RNA, 64 nt, Human
ccuagcccugguugcuucugauacacagccacugcacacacacacucacacucacacucccuug

SEQ ID NO: 212226 - RNA, 64 nt, Human
caugcacaaauacacacucaugcacacacacacucacacacaugcauacacuuagguuucaugc

SEQ ID NO: 212227 - RNA, 64 nt, Human
cucccucguacaugcacaaauacacacucaugcacacacacacucacacacaugcauacacuua

SEQ ID NO: 212228 - RNA, 64 nt, Human
uacucccucguacaugcacaaauacacacucaugcacacacacacucacacacaugcauacacu

SEQ ID NO: 212229 - RNA, 64 nt, Human
acaugccugcaccugcagcgcgcacacgcacgcacacacacauacagagcucucugagggugau

SEQ ID NO: 212230 - RNA, 64 nt, Human
caacaugccugcaccugcagcgcgcacacgcacgcacacacacauacagagcucucugagggug

SEQ ID NO: 212231 - RNA, 64 nt, Human
uuagguaaggggguucaagggucaugguccucaucacacacaugucaucagggcccucugcacu

SEQ ID NO: 212232 - RNA, 64 nt, Human
uaaacccauucagauaaauggcaguacuuuaggacacacacaaacacacagacacaccuuuuga

SEQ ID NO: 212233 - RNA, 64 nt, Human
aaagaugaaaggcaggccuauuucaucacaagaacacacacauauacacgaauagacaucaaac

SEQ ID NO: 212234 - RNA, 64 nt, Human
cagacacacacacacacacacacacacacacacacacacacauucacccuaaggauccaaugga

SEQ ID NO: 212235 - RNA, 64 nt, Human
cacagacacacacacacacacacacacacacacacacacacacauucacccuaaggauccaaug

SEQ ID NO: 212236 - RNA, 64 nt, Human
uacacagacacacacacacacacacacacacacacacacacacacauucacccuaaggauccaa

SEQ ID NO: 212237 - RNA, 64 nt, Human
cauacacagacacacacacacacacacacacacacacacacacacacauucacccuaaggaucc

SEQ ID NO: 212238 - RNA, 64 nt, Human
uacauacacagacacacacacacacacacacacacacacacacacacacauucacccuaaggau

SEQ ID NO: 212239 - RNA, 64 nt, Human
ccuacauacacagacacacacacacacacacacacacacacacacacacacauucacccuaagg

SEQ ID NO: 212240 - RNA, 64 nt, Human
acccuacauacacagacacacacacacacacacacacacacacacacacacacauucacccuaa

SEQ ID NO: 212241 - RNA, 64 nt, Human
ccacccuacauacacagacacacacacacacacacacacacacacacacacacacauucacccu

SEQ ID NO: 212242 - RNA, 64 nt, Human
acccacccuacauacacagacacacacacacacacacacacacacacacacacacacauucacc

SEQ ID NO: 212243 - RNA, 64 nt, Human
acacccacccuacauacacagacacacacacacacacacacacacacacacacacacacauuca

SEQ ID NO: 212244 - RNA, 64 nt, Human
uaacacccacccuacauacacagacacacacacacacacacacacacacacacacacacacauu

SEQ ID NO: 212245 - RNA, 64 nt, Human
cuuaacacccacccuacauacacagacacacacacacacacacacacacacacacacacacaca

SEQ ID NO: 212246 - RNA, 64 nt, Human
cucuuaacacccacccuacauacacagacacacacacacacacacacacacacacacacacaca

SEQ ID NO: 212247 - RNA, 64 nt, Human
aucucuuaacacccacccuacauacacagacacacacacacacacacacacacacacacacaca

SEQ ID NO: 212248 - RNA, 64 nt, Human
aaaucucuuaacacccacccuacauacacagacacacacacacacacacacacacacacacaca

SEQ ID NO: 212249 - RNA, 64 nt, Human
gaaaaucucuuaacacccacccuacauacacagacacacacacacacacacacacacacacaca

SEQ ID NO: 212250 - RNA, 64 nt, Human
ucaauagaccacagccaaagccuuaaaucaaacccacacacaacugaaaauugccuccuccauc

SEQ ID NO: 212251 - RNA, 64 nt, Human
gguuuuuauacauacguacauauauauauauaaacacacacauagauauauaugaauaaacaaa

SEQ ID NO: 212252 - RNA, 64 nt, Human
gaaacuguaccauacacauuggaaggcucccuaacacacacagcggggaagcugggccgaguac

SEQ ID NO: 212253 - RNA, 64 nt, Human
acuauaaauaccagugcuaucacagccacacauacacacacacagacauaaaauaaccaaacau

SEQ ID NO: 212254 - RNA, 63 nt, Human
uauaaauaccagugcuaucacagccacacauacacacacacagacauaaaauaaccaaacauc

SEQ ID NO: 212255 - RNA, 64 nt, Human
uggucuaaaaaagggaagauauuguagaagauuucacacacacacgcgugugugggagacaacu

SEQ ID NO: 212256 - RNA, 64 nt, Human
gucuaaaaaagggaagauauuguagaagauuucacacacacacgcgugugugggagacaacuaa

SEQ ID NO: 212257 - RNA, 64 nt, Human
aaaaaaaaaaaaaaaaaauauauauauauauauacacacacacacacacauauguacacauaca

SEQ ID NO: 212258 - RNA, 64 nt, Human
aaaaaaaaaaaaaaaauauauauauauauauacacacacacacacacauauguacacauacaua

SEQ ID NO: 212259 - RNA, 64 nt, Human
aaaaaaaaaaaaaauauauauauauauauacacacacacacacacauauguacacauacauaua

SEQ ID NO: 212260 - RNA, 64 nt, Human
aaaaaaaaaaaauauauauauauauauacacacacacacacacauauguacacauacauauaua

SEQ ID NO: 212261 - RNA, 64 nt, Human
aaaaaaaaaauauauauauauauauacacacacacacacacauauguacacauacauauauaua

SEQ ID NO: 212262 - RNA, 64 nt, Human
auugcauaaguaaucuaauugucuucaauaaggucacacacauaaaaagagccaucuggucucu

SEQ ID NO: 212263 - RNA, 64 nt, Human
aauauauauguguauauguauacacauauauauacacacacacauauauauauuuagaaacgug

SEQ ID NO: 212264 - RNA, 64 nt, Human
uauauauguguauauguauacacauauauauacacacacacauauauauauuuagaaacgugag

SEQ ID NO: 212265 - RNA, 64 nt, Human
gagcuuuugcauuuaaaacaaacaagcaagcagacacacacagugaacacauuugauuaauugu

SEQ ID NO: 212266 - RNA, 64 nt, Human
ggacugcaaauuauccuucugccugccccugugacacacacacacacacacacacacacacaca

SEQ ID NO: 212267 - RNA, 64 nt, Human
acugcaaauuauccuucugccugccccugugacacacacacacacacacacacacacacacaaa

SEQ ID NO: 212268 - RNA, 64 nt, Human
ugcaaauuauccuucugccugccccugugacacacacacacacacacacacacacacacaaaca

SEQ ID NO: 212269 - RNA, 64 nt, Human
caaauuauccuucugccugccccugugacacacacacacacacacacacacacacacaaacaau

SEQ ID NO: 212270 - RNA, 64 nt, Human
aauuauccuucugccugccccugugacacacacacacacacacacacacacacacaaacaaucc

SEQ ID NO: 212271 - RNA, 64 nt, Human
uuauccuucugccugccccugugacacacacacacacacacacacacacacacaaacaauccag

SEQ ID NO: 212272 - RNA, 64 nt, Human
auccuucugccugccccugugacacacacacacacacacacacacacacacaaacaauccagug

SEQ ID NO: 212273 - RNA, 64 nt, Human
ccuucugccugccccugugacacacacacacacacacacacacacacacaaacaauccaguguu

SEQ ID NO: 212274 - RNA, 64 nt, Human
uucugccugccccugugacacacacacacacacacacacacacacacaaacaauccaguguuuu

SEQ ID NO: 212275 - RNA, 64 nt, Human
cugccugccccugugacacacacacacacacacacacacacacacaaacaauccaguguuuugu

SEQ ID NO: 212276 - RNA, 64 nt, Human
gccugccccugugacacacacacacacacacacacacacacacaaacaauccaguguuuuguca

SEQ ID NO: 212277 - RNA, 64 nt, Human
cugccccugugacacacacacacacacacacacacacacacaaacaauccaguguuuugucaug

SEQ ID NO: 212278 - RNA, 64 nt, Human
guguuuucauugcaaauuauaauugcuguagagccacacacaacuuuugaacuuuuaauuauaa

SEQ ID NO: 212279 - RNA, 64 nt, Human
caucuucccuccacccugccccugaaaaacaguacacacacauccguucaacacaagacagggc

SEQ ID NO: 212280 - RNA, 64 nt, Human
cucccuucuguuucuucagcacauugacccauagcacacacauacacaccaccaccaacaacgc

SEQ ID NO: 212281 - RNA, 64 nt, Human
cacccaauuuaauuagccauuugcaugaugcuuucacacacaauugauucaagcauuauacagg

SEQ ID NO: 212282 - RNA, 64 nt, Human
ugggaaaacgggcaaaauaauugugcuggauucucacacacacagaaauaucgaccaucacccu

SEQ ID NO: 212283 - RNA, 64 nt, Human
ggaaaacgggcaaaauaauugugcuggauucucacacacacagaaauaucgaccaucacccucc

SEQ ID NO: 212284 - RNA, 64 nt, Human
aacguguacacaagugugagcuccuacacgcauacacacacacacguguacaugcaccaaagca

SEQ ID NO: 212285 - RNA, 64 nt, Human
cguguacacaagugugagcuccuacacgcauacacacacacacguguacaugcaccaaagcaug

SEQ ID NO: 212286 - RNA, 64 nt, Human
gcagagagacguaugagcuucuacugcacacaugcacacacacacgcacacguacauucacuac

SEQ ID NO: 212287 - RNA, 64 nt, Human
agagagacguaugagcuucuacugcacacaugcacacacacacgcacacguacauucacuacaa

SEQ ID NO: 212288 - RNA, 64 nt, Human
ugcgcaggcuccugcaggcgugaauacacacaugcacacacauauacacacaugugccacaaac

SEQ ID NO: 212289 - RNA, 64 nt, Human
cuggagacaguagaggcaugaacacacauggaugcacacacacacacgccaaugcacacacaca

SEQ ID NO: 212290 - RNA, 64 nt, Human
ggagacaguagaggcaugaacacacauggaugcacacacacacacgccaaugcacacacacaga

SEQ ID NO: 212291 - RNA, 64 nt, Human
agacaguagaggcaugaacacacauggaugcacacacacacacgccaaugcacacacacagaga

SEQ ID NO: 212292 - RNA, 64 nt, Human
aacacacauggaugcacacacacacacgccaaugcacacacacagagauaugcacacacacgga

SEQ ID NO: 212293 - RNA, 64 nt, Human
cacacauggaugcacacacacacacgccaaugcacacacacagagauaugcacacacacggaug

SEQ ID NO: 212294 - RNA, 64 nt, Human
cacacacacgccaaugcacacacacagagauaugcacacacacggaugcacacacagaugguca

SEQ ID NO: 212295 - RNA, 64 nt, Human
ugcacacacacagagauaugcacacacacggaugcacacacagauggucacacagagauacgca

SEQ ID NO: 212296 - RNA, 64 nt, Human
caaacacaccgaugcacacgcacauagagauaugcacacacagaugcacacacagauauacaca

SEQ ID NO: 212297 - RNA, 64 nt, Human
ugcacacgcacauagagauaugcacacacagaugcacacacagauauacacauggaugcacgca

SEQ ID NO: 212298 - RNA, 64 nt, Human
cggaugcacagagauaugcacacaccgaugugcgcacacacagauaugcacacacauggaugag

SEQ ID NO: 212299 - RNA, 64 nt, Human
uaugcacacaccgaugugcgcacacacagauaugcacacacauggaugagcacacacacaccaa

SEQ ID NO: 212300 - RNA, 64 nt, Human
ugcgcacacacagauaugcacacacauggaugagcacacacacaccaaugcgcacacacaccga

SEQ ID NO: 212301 - RNA, 64 nt, Human
cgcacacacagauaugcacacacauggaugagcacacacacaccaaugcgcacacacaccgaug

SEQ ID NO: 212302 - RNA, 64 nt, Human
cacacacauggaugagcacacacacaccaaugcgcacacacaccgauguacacacacagaugca

SEQ ID NO: 212303 - RNA, 64 nt, Human
cacacacacaccaaugcgcacacacaccgauguacacacacagaugcacacacagaugcacaca

SEQ ID NO: 212304 - RNA, 64 nt, Human
aaugcgcacacacaccgauguacacacacagaugcacacacagaugcacacacaccgaugcuga

SEQ ID NO: 212305 - RNA, 64 nt, Human
caccgauguacacacacagaugcacacacagaugcacacacaccgaugcugacuccaugugugc

SEQ ID NO: 212306 - RNA, 64 nt, Human
uugccugggucggggccugcggccagcaccauuucacacacacuccuuguagaugggagccaga

SEQ ID NO: 212307 - RNA, 64 nt, Human
aucacacacacacucacacucacauacacacacacacacacacucugacugucuuuauugcaga

SEQ ID NO: 212308 - RNA, 64 nt, Human
acaucacacacacacucacacucacauacacacacacacacacacucugacugucuuuauugca

SEQ ID NO: 212309 - RNA, 64 nt, Human
guacaucacacacacacucacacucacauacacacacacacacacacucugacugucuuuauug

SEQ ID NO: 212310 - RNA, 64 nt, Human
auguacaucacacacacacucacacucacauacacacacacacacacacucugacugucuuuau

SEQ ID NO: 212311 - RNA, 64 nt, Human
uaauguacaucacacacacacucacacucacauacacacacacacacacacucugacugucuuu

SEQ ID NO: 212312 - RNA, 64 nt, Human
cacugugcccagcccuaacuuuuaauguacaucacacacacacucacacucacauacacacaca

SEQ ID NO: 212313 - RNA, 64 nt, Human
gccacugugcccagcccuaacuuuuaauguacaucacacacacacucacacucacauacacaca

SEQ ID NO: 212314 - RNA, 64 nt, Human
gagacacacacacacacacacacacacacacacacacacacagucuuuauugcagaagacagug

SEQ ID NO: 212315 - RNA, 64 nt, Human
gugagacacacacacacacacacacacacacacacacacacacagucuuuauugcagaagacag

SEQ ID NO: 212316 - RNA, 64 nt, Human
gcgugagacacacacacacacacacacacacacacacacacacacagucuuuauugcagaagac

SEQ ID NO: 212317 - RNA, 64 nt, Human
aggcgugagacacacacacacacacacacacacacacacacacacacagucuuuauugcagaag

SEQ ID NO: 212318 - RNA, 64 nt, Human
auaggcgugagacacacacacacacacacacacacacacacacacacacagucuuuauugcaga

SEQ ID NO: 212319 - RNA, 64 nt, Human
uuauaggcgugagacacacacacacacacacacacacacacacacacacacagucuuuauugca

SEQ ID NO: 212320 - RNA, 64 nt, Human
ccuuauaggcgugagacacacacacacacacacacacacacacacacacacacagucuuuauug

SEQ ID NO: 212321 - RNA, 64 nt, Human
ugccuuauaggcgugagacacacacacacacacacacacacacacacacacacacagucuuuau

SEQ ID NO: 212322 - RNA, 64 nt, Human
guugccuuauaggcgugagacacacacacacacacacacacacacacacacacacacagucuuu

SEQ ID NO: 212323 - RNA, 64 nt, Human
guguugccuuauaggcgugagacacacacacacacacacacacacacacacacacacacagucu

SEQ ID NO: 212324 - RNA, 64 nt, Human
guguguugccuuauaggcgugagacacacacacacacacacacacacacacacacacacacagu

SEQ ID NO: 212325 - RNA, 64 nt, Human
caguguguugccuuauaggcgugagacacacacacacacacacacacacacacacacacacaca

SEQ ID NO: 212326 - RNA, 64 nt, Human
gacaguguguugccuuauaggcgugagacacacacacacacacacacacacacacacacacaca

SEQ ID NO: 212327 - RNA, 64 nt, Human
aagacaguguguugccuuauaggcgugagacacacacacacacacacacacacacacacacaca

SEQ ID NO: 212328 - RNA, 64 nt, Human
agaagacaguguguugccuuauaggcgugagacacacacacacacacacacacacacacacaca

SEQ ID NO: 212329 - RNA, 64 nt, Human
gcagaagacaguguguugccuuauaggcgugagacacacacacacacacacacacacacacaca

SEQ ID NO: 212330 - RNA, 64 nt, Human
aggcgugagacagacacacauacacacacauacacacacacagagucuuuauugcagaagacag

SEQ ID NO: 212331 - RNA, 64 nt, Human
acaggcgugagacagacacacauacacacacauacacacacacagagucuuuauugcagaagac

SEQ ID NO: 212332 - RNA, 64 nt, Human
ugcuaggauuacaggcgugagacagacacacauacacacacauacacacacacagagucuuuau

SEQ ID NO: 212333 - RNA, 64 nt, Human
cacacacacacacacacacacacacacacacacacacacacacuauuucagaagacaguguguu

SEQ ID NO: 212334 - RNA, 64 nt, Human
cacacacacacacacacacacacacacacacacacacacacacacuauuucagaagacagugug

SEQ ID NO: 212335 - RNA, 64 nt, Human
cacacacacacacacacacacacacacacacacacacacacacacacuauuucagaagacagug

SEQ ID NO: 212336 - RNA, 64 nt, Human
cacacacacacacacacacacacacacacacacacacacacacacacacuauuucagaagacag

SEQ ID NO: 212337 - RNA, 64 nt, Human
cacacacacacacacacacacacacacacacacacacacacacacacacacuauuucagaagac

SEQ ID NO: 212338 - RNA, 64 nt, Human
cacacacacacacacacacacacacacacacacacacacacacacacacacacuauuucagaag

SEQ ID NO: 212339 - RNA, 64 nt, Human
cacacacacacacacacacacacacacacacacacacacacacacacacacacacuauuucaga

SEQ ID NO: 212340 - RNA, 64 nt, Human
cacacacacacacacacacacacacacacacacacacacacacacacacacacacacuauuuca

SEQ ID NO: 212341 - RNA, 64 nt, Human
aacacacacacacacacacacacacacacacacacacacacacacacacacacacacacuauuu

SEQ ID NO: 212342 - RNA, 64 nt, Human
acaacacacacacacacacacacacacacacacacacacacacacacacacacacacacacuau

SEQ ID NO: 212343 - RNA, 64 nt, Human
auacaacacacacacacacacacacacacacacacacacacacacacacacacacacacacacu

SEQ ID NO: 212344 - RNA, 64 nt, Human
auauacaacacacacacacacacacacacacacacacacacacacacacacacacacacacaca

SEQ ID NO: 212345 - RNA, 64 nt, Human
uaauauacaacacacacacacacacacacacacacacacacacacacacacacacacacacaca

SEQ ID NO: 212346 - RNA, 64 nt, Human
uuuaauauacaacacacacacacacacacacacacacacacacacacacacacacacacacaca

SEQ ID NO: 212347 - RNA, 64 nt, Human
cuuuuaauauacaacacacacacacacacacacacacacacacacacacacacacacacacaca

SEQ ID NO: 212348 - RNA, 64 nt, Human
aacuuuuaauauacaacacacacacacacacacacacacacacacacacacacacacacacaca

SEQ ID NO: 212349 - RNA, 64 nt, Human
cuaacuuuuaauauacaacacacacacacacacacacacacacacacacacacacacacacaca

SEQ ID NO: 212350 - RNA, 64 nt, Human
cccuaacuuuuaauauacaacacacacacacacacacacacacacacacacacacacacacaca

SEQ ID NO: 212351 - RNA, 64 nt, Human
ggcccuaacuuuuaauauacaacacacacacacacacacacacacacacacacacacacacaca

SEQ ID NO: 212352 - RNA, 64 nt, Human
cuggcccuaacuuuuaauauacaacacacacacacacacacacacacacacacacacacacaca

SEQ ID NO: 212353 - RNA, 64 nt, Human
accuggcccuaacuuuuaauauacaacacacacacacacacacacacacacacacacacacaca

SEQ ID NO: 212354 - RNA, 64 nt, Human
gcaccuggcccuaacuuuuaauauacaacacacacacacacacacacacacacacacacacaca

SEQ ID NO: 212355 - RNA, 64 nt, Human
ccgcaccuggcccuaacuuuuaauauacaacacacacacacacacacacacacacacacacaca

SEQ ID NO: 212356 - RNA, 64 nt, Human
caccgcaccuggcccuaacuuuuaauauacaacacacacacacacacacacacacacacacaca

SEQ ID NO: 212357 - RNA, 64 nt, Human
uccaccgcaccuggcccuaacuuuuaauauacaacacacacacacacacacacacacacacaca

SEQ ID NO: 212358 - RNA, 64 nt, Human
aacacacacacacacacacacacacacacacacacacacacaacaaaucuacauauacaaacaa

SEQ ID NO: 212359 - RNA, 64 nt, Human
acaacacacacacacacacacacacacacacacacacacacacaacaaaucuacauauacaaac

SEQ ID NO: 212360 - RNA, 64 nt, Human
guacaacacacacacacacacacacacacacacacacacacacacacacacaacaaaucuacau

SEQ ID NO: 212361 - RNA, 64 nt, Human
auguacaacacacacacacacacacacacacacacacacacacacacacacacaacaaaucuac

SEQ ID NO: 212362 - RNA, 64 nt, Human
uaauguacaacacacacacacacacacacacacacacacacacacacacacacacaacaaaucu

SEQ ID NO: 212363 - RNA, 64 nt, Human
guuaauguacaacacacacacacacacacacacacacacacacacacacacacacacaacaaau

SEQ ID NO: 212364 - RNA, 64 nt, Human
uuguuaauguacaacacacacacacacacacacacacacacacacacacacacacacacaacaa

SEQ ID NO: 212365 - RNA, 64 nt, Human
uauuguuaauguacaacacacacacacacacacacacacacacacacacacacacacacacaac

SEQ ID NO: 212366 - RNA, 64 nt, Human
aguauuguuaauguacaacacacacacacacacacacacacacacacacacacacacacacaca

SEQ ID NO: 212367 - RNA, 64 nt, Human
agaguauuguuaauguacaacacacacacacacacacacacacacacacacacacacacacaca

SEQ ID NO: 212368 - RNA, 64 nt, Human
acagaguauuguuaauguacaacacacacacacacacacacacacacacacacacacacacaca

SEQ ID NO: 212369 - RNA, 64 nt, Human
ccacagaguauuguuaauguacaacacacacacacacacacacacacacacacacacacacaca

SEQ ID NO: 212370 - RNA, 64 nt, Human
uuccacagaguauuguuaauguacaacacacacacacacacacacacacacacacacacacaca

SEQ ID NO: 212371 - RNA, 64 nt, Human
uauuccacagaguauuguuaauguacaacacacacacacacacacacacacacacacacacaca

SEQ ID NO: 212372 - RNA, 64 nt, Human
ucuauuccacagaguauuguuaauguacaacacacacacacacacacacacacacacacacaca

SEQ ID NO: 212373 - RNA, 64 nt, Human
uuucuauuccacagaguauuguuaauguacaacacacacacacacacacacacacacacacaca

SEQ ID NO: 212374 - RNA, 64 nt, Human
uguuucuauuccacagaguauuguuaauguacaacacacacacacacacacacacacacacaca

SEQ ID NO: 212375 - RNA, 64 nt, Human
auaugugccaaucaauagcaccccuacucacauacacacacaccuagccagcugucaagggcag

SEQ ID NO: 212376 - RNA, 64 nt, Human
aauacacguaugguuaauguucaguccaacaaaccacacacaguaaauguuuauuaauagucau

SEQ ID NO: 212377 - RNA, 64 nt, Human
uguuuuauugagugaagccuuaaaaagcacacaccacacacagcuaacugccaaaauacauuga

SEQ ID NO: 212378 - RNA, 64 nt, Human
uggauggaugaauggacaaacaaaaugcgauacacacacacaauggaaugcuauuaagccuuaa

SEQ ID NO: 212379 - RNA, 64 nt, Human
cauggauggaugaauggacaaacaaaaugcgauacacacacacaauggaaugcuauuaagccuu

SEQ ID NO: 212380 - RNA, 64 nt, Human
ggagccaccccagcgccaggcgcccguccagggacacacacagucuucacugugcugcagccag

SEQ ID NO: 212381 - RNA, 64 nt, Human
cugagaucgaagaggccaguaggagacacgacagcacacacaguggauuccagugcauggggag

SEQ ID NO: 212382 - RNA, 64 nt, Human
gggcuccugcaguaacucuguacuucucuaucugcacacacaaaaugcccaaggcacucacugg

SEQ ID NO: 212383 - RNA, 64 nt, Human
ucauauuuuacauauauauauauauauauacaugcacacacaccgauacauuuaccuuuuaaaa

SEQ ID NO: 212384 - RNA, 64 nt, Human
guuuuacuccuuuuuuuaaaaacacaugcgcgcgcacacacacaugcuuuacaaguuuuauuau

SEQ ID NO: 212385 - RNA, 64 nt, Human
uuuacuccuuuuuuuaaaaacacaugcgcgcgcacacacacaugcuuuacaaguuuuauuauaa

SEQ ID NO: 212386 - RNA, 64 nt, Human
cccaccccacuugcccuugguucuuuagaaggagcacacacaucccuugauuccucccugaugu

SEQ ID NO: 212387 - RNA, 64 nt, Human
aguuuauguucuacugaaagaggacguguguauacacacacacacacacacacacacacagauu

SEQ ID NO: 212388 - RNA, 64 nt, Human
uuuauguucuacugaaagaggacguguguauacacacacacacacacacacacacacagauugg

SEQ ID NO: 212389 - RNA, 64 nt, Human
uauguucuacugaaagaggacguguguauacacacacacacacacacacacacacagauuggua

SEQ ID NO: 212390 - RNA, 64 nt, Human
uguucuacugaaagaggacguguguauacacacacacacacacacacacacacagauugguaua

SEQ ID NO: 212391 - RNA, 64 nt, Human
uucuacugaaagaggacguguguauacacacacacacacacacacacacacagauugguauaau

SEQ ID NO: 212392 - RNA, 64 nt, Human
cuacugaaagaggacguguguauacacacacacacacacacacacacacagauugguauaaugg

SEQ ID NO: 212393 - RNA, 64 nt, Human
acugaaagaggacguguguauacacacacacacacacacacacacacagauugguauaauggag

SEQ ID NO: 212394 - RNA, 64 nt, Human
ugaaagaggacguguguauacacacacacacacacacacacacacagauugguauaauggagaa

SEQ ID NO: 212395 - RNA, 64 nt, Human
aaagaggacguguguauacacacacacacacacacacacacacagauugguauaauggagaaga

SEQ ID NO: 212396 - RNA, 64 nt, Human
agaggacguguguauacacacacacacacacacacacacacagauugguauaauggagaagaug

SEQ ID NO: 212397 - RNA, 64 nt, Human
acgacucugguggggaaaaccguuuuuuaaaggacacacacacacacagcgaugcaucucucuc

SEQ ID NO: 212398 - RNA, 64 nt, Human
gacucugguggggaaaaccguuuuuuaaaggacacacacacacacagcgaugcaucucucucua

SEQ ID NO: 212399 - RNA, 64 nt, Human
cucugguggggaaaaccguuuuuuaaaggacacacacacacacagcgaugcaucucucucuaaa

SEQ ID NO: 212400 - RNA, 64 nt, Human
cugguggggaaaaccguuuuuuaaaggacacacacacacacagcgaugcaucucucucuaaagc

SEQ ID NO: 212401 - RNA, 64 nt, Human
uuuaaaaacaaauaaaugaauaaagcugcugugacacacacacaaaaggaauuuaauaguauaa

SEQ ID NO: 212402 - RNA, 64 nt, Human
uaaaaacaaauaaaugaauaaagcugcugugacacacacacaaaaggaauuuaauaguauaaua

SEQ ID NO: 212403 - RNA, 64 nt, Human
gaucccuguuucccaacugaaaggugugaacggacacacacacagccuggaugacgccuuggcu

SEQ ID NO: 212404 - RNA, 64 nt, Human
ucccuguuucccaacugaaaggugugaacggacacacacacagccuggaugacgccuuggcugu

SEQ ID NO: 212405 - RNA, 64 nt, Human
ccugucauucccaccacccugaggccccaaccgccacacacacaggagcauuuggagagaaggc

SEQ ID NO: 212406 - RNA, 64 nt, Human
ugucauucccaccacccugaggccccaaccgccacacacacaggagcauuuggagagaaggcca

SEQ ID NO: 212407 - RNA, 64 nt, Human
uuugccaagcucaauaauggacaaaggauacaaacacacacacaucuacuauuuuagauaaaug

SEQ ID NO: 212408 - RNA, 64 nt, Human
ugccaagcucaauaauggacaaaggauacaaacacacacacaucuacuauuuuagauaaaugua

SEQ ID NO: 212409 - RNA, 64 nt, Human
gauuuuucuuccuuaaacuugaacaccaaaaaaacacacacacacacacacguggggauagcug

SEQ ID NO: 212410 - RNA, 64 nt, Human
uuuuucuuccuuaaacuugaacaccaaaaaaacacacacacacacacacguggggauagcugga

SEQ ID NO: 212411 - RNA, 64 nt, Human
uuucuuccuuaaacuugaacaccaaaaaaacacacacacacacacacguggggauagcuggaca

SEQ ID NO: 212412 - RNA, 64 nt, Human
ucuuccuuaaacuugaacaccaaaaaaacacacacacacacacacguggggauagcuggacaug

SEQ ID NO: 212413 - RNA, 64 nt, Human
uuccuuaaacuugaacaccaaaaaaacacacacacacacacacguggggauagcuggacauguc

SEQ ID NO: 212414 - RNA, 64 nt, Human
gaaagaaguaacuacaguuagggcuccuauucaacacacacaugcuucccuuuccugaguccca

SEQ ID NO: 212415 - RNA, 64 nt, Human
gcccaguguaugcauguguggguguguucaugcacacacacacucucucucuugucucucuguc

SEQ ID NO: 212416 - RNA, 64 nt, Human
uagcccaguguaugcauguguggguguguucaugcacacacacacucucucucuugucucucug

SEQ ID NO: 212417 - RNA, 64 nt, Human
ggccuuuuucccaugugugcagucugagcuuaggcacacacaggaggguuccaggacuuucuga

SEQ ID NO: 212418 - RNA, 64 nt, Human
cucccugccuugguccugccaacacaugcgaguacacacacaccccucucucugcuuuugucag

SEQ ID NO: 212419 - RNA, 64 nt, Human
uccccauccccauaaaugcauacacauacaugcacacacacacguuaucccaugauguuccacu

SEQ ID NO: 212420 - RNA, 64 nt, Human
gcuccccauccccauaaaugcauacacauacaugcacacacacacguuaucccaugauguucca

SEQ ID NO: 212421 - RNA, 64 nt, Human
uuggcacccugauuauucauacaugucugccuaccacacacaaaauauauccuugguucuaucu

SEQ ID NO: 212422 - RNA, 64 nt, Human
cagcagaguccugccuccucccaauccccacagacacacacauugauccuccuccucagcuccu

SEQ ID NO: 212423 - RNA, 64 nt, Human
aguaguaaaguacuuugaguguuuggggguucaacacacacaugcaauuuugcuuaacaaaagu

SEQ ID NO: 212424 - RNA, 64 nt, Human
uuuaucuuucaugcuuucucuguacacacacacacacacacaaauuuuuccucaaucauuugaa

SEQ ID NO: 212425 - RNA, 64 nt, Human
gcuuuaucuuucaugcuuucucuguacacacacacacacacacaaauuuuuccucaaucauuug

SEQ ID NO: 212426 - RNA, 64 nt, Human
gugcuuuaucuuucaugcuuucucuguacacacacacacacacacaaauuuuuccucaaucauu

SEQ ID NO: 212427 - RNA, 64 nt, Human
acgugcuuuaucuuucaugcuuucucuguacacacacacacacacacaaauuuuuccucaauca

SEQ ID NO: 212428 - RNA, 64 nt, Human
auacgugcuuuaucuuucaugcuuucucuguacacacacacacacacacaaauuuuuccucaau

SEQ ID NO: 212429 - RNA, 64 nt, Human
ucauacgugcuuuaucuuucaugcuuucucuguacacacacacacacacacaaauuuuuccuca

SEQ ID NO: 212430 - RNA, 64 nt, Human
auauacacaccacacacacacaccacauacaccacacacacacguucccauccacucacccaca

SEQ ID NO: 212431 - RNA, 64 nt, Human
agauauacacaccacacacacacaccacauacaccacacacacacguucccauccacucaccca

SEQ ID NO: 212432 - RNA, 64 nt, Human
caguccuugaggauagacagauauacacaccacacacacacaccacauacaccacacacacacg

SEQ ID NO: 212433 - RNA, 64 nt, Human
ggcaguccuugaggauagacagauauacacaccacacacacacaccacauacaccacacacaca

SEQ ID NO: 212434 - RNA, 64 nt, Human
caggcaguccuugaggauagacagauauacacaccacacacacacaccacauacaccacacaca

SEQ ID NO: 212435 - RNA, 64 nt, Human
agaauuguagacugauguuuuagcauuuuuccaacacacacaacguaaaaauaaaagcagucga

SEQ ID NO: 212436 - RNA, 64 nt, Human
auuuuuaaaguuaaguagcaugcauauauauaugcacacacaccucuuuuucagcauuuuuuga

SEQ ID NO: 212437 - RNA, 64 nt, Human
gaguuuuccaauguuaauguaaacagaacuggcacacacacauuaagaugaauguaauuauuau

SEQ ID NO: 212438 - RNA, 64 nt, Human
uggaguuuuccaauguuaauguaaacagaacuggcacacacacauuaagaugaauguaauuauu

SEQ ID NO: 212439 - RNA, 64 nt, Human
aggcucagcuuaccgggugauaggccccauaagacacacacaugagcagggugagaaaugcuug

SEQ ID NO: 212440 - RNA, 64 nt, Human
uuuguaaauguuaugcacucucugaaaggaaaaacacacacaaaagaaaaagacuuuuuuuuuu

SEQ ID NO: 212441 - RNA, 64 nt, Human
gugugucuuuuuaguggagucguaguaauaugugcacacacagaaggggaccugauuggguggg

SEQ ID NO: 212442 - RNA, 64 nt, Human
cgcacacacacacacacacacacacacacacacacacacacacgaaggagagagagagaaaacu

SEQ ID NO: 212443 - RNA, 64 nt, Human
cacgcacacacacacacacacacacacacacacacacacacacacgaaggagagagagagaaaa

SEQ ID NO: 212444 - RNA, 64 nt, Human
cgcacgcacacacacacacacacacacacacacacacacacacacacgaaggagagagagagaa

SEQ ID NO: 212445 - RNA, 64 nt, Human
cacgcacgcacacacacacacacacacacacacacacacacacacacacgaaggagagagagag

SEQ ID NO: 212446 - RNA, 64 nt, Human
ugcacgcacgcacacacacacacacacacacacacacacacacacacacacgaaggagagagag

SEQ ID NO: 212447 - RNA, 64 nt, Human
ugugcacgcacgcacacacacacacacacacacacacacacacacacacacacgaaggagagag

SEQ ID NO: 212448 - RNA, 64 nt, Human
ccugugcacgcacgcacacacacacacacacacacacacacacacacacacacacgaaggagag

SEQ ID NO: 212449 - RNA, 64 nt, Human
gcccugugcacgcacgcacacacacacacacacacacacacacacacacacacacacgaaggag

SEQ ID NO: 212450 - RNA, 64 nt, Human
uggcccugugcacgcacgcacacacacacacacacacacacacacacacacacacacacgaagg

SEQ ID NO: 212451 - RNA, 64 nt, Human
auuggcccugugcacgcacgcacacacacacacacacacacacacacacacacacacacacgaa

SEQ ID NO: 212452 - RNA, 64 nt, Human
agauuggcccugugcacgcacgcacacacacacacacacacacacacacacacacacacacacg

SEQ ID NO: 212453 - RNA, 64 nt, Human
gaagauuggcccugugcacgcacgcacacacacacacacacacacacacacacacacacacaca

SEQ ID NO: 212454 - RNA, 64 nt, Human
cugaagauuggcccugugcacgcacgcacacacacacacacacacacacacacacacacacaca

SEQ ID NO: 212455 - RNA, 64 nt, Human
gccugaagauuggcccugugcacgcacgcacacacacacacacacacacacacacacacacaca

SEQ ID NO: 212456 - RNA, 64 nt, Human
aagccugaagauuggcccugugcacgcacgcacacacacacacacacacacacacacacacaca

SEQ ID NO: 212457 - RNA, 64 nt, Human
auaagccugaagauuggcccugugcacgcacgcacacacacacacacacacacacacacacaca

SEQ ID NO: 212458 - RNA, 64 nt, Human
ccauaagccugaagauuggcccugugcacgcacgcacacacacacacacacacacacacacaca

SEQ ID NO: 212459 - RNA, 64 nt, Human
gugcuguaguagaugcugaaucugagguaucaaacacacacaggauaccagcaauggauggcag

SEQ ID NO: 212460 - RNA, 64 nt, Human
uuugaucaucggaaggagcagcauugcucagaaacacacacacacacacacacacuugacuuuc

SEQ ID NO: 212461 - RNA, 64 nt, Human
ugaucaucggaaggagcagcauugcucagaaacacacacacacacacacacacuugacuuucuu

SEQ ID NO: 212462 - RNA, 64 nt, Human
aucaucggaaggagcagcauugcucagaaacacacacacacacacacacacuugacuuucuugu

SEQ ID NO: 212463 - RNA, 64 nt, Human
caucggaaggagcagcauugcucagaaacacacacacacacacacacacuugacuuucuugucu

SEQ ID NO: 212464 - RNA, 64 nt, Human
ucggaaggagcagcauugcucagaaacacacacacacacacacacacuugacuuucuugucugc

SEQ ID NO: 212465 - RNA, 64 nt, Human
ggaaggagcagcauugcucagaaacacacacacacacacacacacuugacuuucuugucugcca

SEQ ID NO: 212466 - RNA, 64 nt, Human
aaggagcagcauugcucagaaacacacacacacacacacacacuugacuuucuugucugccaaa

SEQ ID NO: 212467 - RNA, 64 nt, Human
gaugagaucacacgcaugcacgugcacacauguacacacacacaccuaccugcacagcacgcug

SEQ ID NO: 212468 - RNA, 64 nt, Human
ugagaucacacgcaugcacgugcacacauguacacacacacaccuaccugcacagcacgcuguu

SEQ ID NO: 212469 - RNA, 64 nt, Human
uuguaacagaagauucaaaacaucccauucuagccacacacaaauaaauaucugcggcuuagug

SEQ ID NO: 212470 - RNA, 64 nt, Human
cagcucugcucaacugcgucuucucucagcccuccacacacacucacccccacucccacacaca

SEQ ID NO: 212471 - RNA, 64 nt, Human
cucucagcccuccacacacacucacccccacucccacacacauacacacacacacacacauacc

SEQ ID NO: 212472 - RNA, 64 nt, Human
uccacacacacucacccccacucccacacacauacacacacacacacacauaccccaucucccg

SEQ ID NO: 212473 - RNA, 64 nt, Human
cacacacacucacccccacucccacacacauacacacacacacacacauaccccaucucccgag

SEQ ID NO: 212474 - RNA, 64 nt, Human
cacacacucacccccacucccacacacauacacacacacacacacauaccccaucucccgaggg

SEQ ID NO: 212475 - RNA, 64 nt, Human
cacacucacccccacucccacacacauacacacacacacacacauaccccaucucccgagggcu

SEQ ID NO: 212476 - RNA, 64 nt, Human
cacucacccccacucccacacacauacacacacacacacacauaccccaucucccgagggcuga

SEQ ID NO: 212477 - RNA, 64 nt, Human
augaugguuacccuucauggacgucuuaaucuuccacacacauccccuuuuuuuggaauaaaau

SEQ ID NO: 212478 - RNA, 64 nt, Human
aaaaaaagguuccaaaaaaaaccaaaacucaguacacacacacaggcacagaugcacacacacg

SEQ ID NO: 212479 - RNA, 64 nt, Human
aaaaagguuccaaaaaaaaccaaaacucaguacacacacacaggcacagaugcacacacacgca

SEQ ID NO: 212480 - RNA, 64 nt, Human
accaaaacucaguacacacacacaggcacagaugcacacacacgcagacagacacaccgacuuu

SEQ ID NO: 212481 - RNA, 64 nt, Human
auuuuauaaacuaugcacaugcauuacacacaugcacacacauaugcacacacaugugcaaaca

SEQ ID NO: 212482 - RNA, 64 nt, Human
augcacaugcauuacacacaugcacacacauaugcacacacaugugcaaacauagccacuuuuu

SEQ ID NO: 212483 - RNA, 64 nt, Human
uuuauaccuguacacacacagacacacaagcagacacacacauauauacauacgcaauuguaua

SEQ ID NO: 212484 - RNA, 64 nt, Human
auauuacucugccugucaaguuuuuauaccuguacacacacagacacacaagcagacacacaca

SEQ ID NO: 212485 - RNA, 64 nt, Human
cacacacacacacacacacacacacacacacacacacacacacgccgagcagcugucucggguc

SEQ ID NO: 212486 - RNA, 64 nt, Human
cacacacacacacacacacacacacacacacacacacacacacacgccgagcagcugucucggg

SEQ ID NO: 212487 - RNA, 64 nt, Human
cacacacacacacacacacacacacacacacacacacacacacacacgccgagcagcugucucg

SEQ ID NO: 212488 - RNA, 64 nt, Human
cacacacacacacacacacacacacacacacacacacacacacacacacgccgagcagcugucu

SEQ ID NO: 212489 - RNA, 64 nt, Human
cacacacacacacacacacacacacacacacacacacacacacacacacacgccgagcagcugu

SEQ ID NO: 212490 - RNA, 64 nt, Human
cacacacacacacacacacacacacacacacacacacacacacacacacacacgccgagcagcu

SEQ ID NO: 212491 - RNA, 64 nt, Human
cacacacacacacacacacacacacacacacacacacacacacacacacacacacgccgagcag

SEQ ID NO: 212492 - RNA, 64 nt, Human
cacacacacacacacacacacacacacacacacacacacacacacacacacacacacgccgagc

SEQ ID NO: 212493 - RNA, 64 nt, Human
cacacacacacacacacacacacacacacacacacacacacacacacacacacacacacgccga

SEQ ID NO: 212494 - RNA, 64 nt, Human
cacacacacacacacacacacacacacacacacacacacacacacacacacacacacacacgcc

SEQ ID NO: 212495 - RNA, 64 nt, Human
uacacacacacacacacacacacacacacacacacacacacacacacacacacacacacacacg

SEQ ID NO: 212496 - RNA, 64 nt, Human
auuacacacacacacacacacacacacacacacacacacacacacacacacacacacacacaca

SEQ ID NO: 212497 - RNA, 64 nt, Human
aaauuacacacacacacacacacacacacacacacacacacacacacacacacacacacacaca

SEQ ID NO: 212498 - RNA, 64 nt, Human
guaaauuacacacacacacacacacacacacacacacacacacacacacacacacacacacaca

SEQ ID NO: 212499 - RNA, 64 nt, Human
caguaaauuacacacacacacacacacacacacacacacacacacacacacacacacacacaca

SEQ ID NO: 212500 - RNA, 64 nt, Human
aacaguaaauuacacacacacacacacacacacacacacacacacacacacacacacacacaca

SEQ ID NO: 212501 - RNA, 64 nt, Human
agaacaguaaauuacacacacacacacacacacacacacacacacacacacacacacacacaca

SEQ ID NO: 212502 - RNA, 64 nt, Human
gcagaacaguaaauuacacacacacacacacacacacacacacacacacacacacacacacaca

SEQ ID NO: 212503 - RNA, 64 nt, Human
cagcagaacaguaaauuacacacacacacacacacacacacacacacacacacacacacacaca

SEQ ID NO: 212504 - RNA, 64 nt, Human
agcagcagaacaguaaauuacacacacacacacacacacacacacacacacacacacacacaca

SEQ ID NO: 212505 - RNA, 64 nt, Human
gcagcagcagaacaguaaauuacacacacacacacacacacacacacacacacacacacacaca

SEQ ID NO: 212506 - RNA, 64 nt, Human
cagcagcagcagaacaguaaauuacacacacacacacacacacacacacacacacacacacaca

SEQ ID NO: 212507 - RNA, 62 nt, Human
cagcagcagcagaacaguaaauuacacacacacacacacacacacacacacacacacacaca

SEQ ID NO: 212508 - RNA, 60 nt, Human
cagcagcagcagaacaguaaauuacacacacacacacacacacacacacacacacacaca

SEQ ID NO: 212509 - RNA, 58 nt, Human
cagcagcagcagaacaguaaauuacacacacacacacacacacacacacacacacaca

SEQ ID NO: 212510 - RNA, 56 nt, Human
cagcagcagcagaacaguaaauuacacacacacacacacacacacacacacacaca

SEQ ID NO: 212511 - RNA, 54 nt, Human
cagcagcagcagaacaguaaauuacacacacacacacacacacacacacacaca

SEQ ID NO: 212512 - RNA, 64 nt, Human
cccucaugcaagggugcguguacacauacacacacacacacaccuggccccagguggggguugu

SEQ ID NO: 212513 - RNA, 64 nt, Human
cucccucaugcaagggugcguguacacauacacacacacacacaccuggccccagguggggguu

SEQ ID NO: 212514 - RNA, 64 nt, Human
accucccucaugcaagggugcguguacacauacacacacacacacaccuggccccagguggggg

SEQ ID NO: 212515 - RNA, 64 nt, Human
uuaccucccucaugcaagggugcguguacacauacacacacacacacaccuggccccagguggg

SEQ ID NO: 212516 - RNA, 64 nt, Human
cucuguagcuggucucacugcccagagggaacugcacacacagacuucucucuuacguucaugg

SEQ ID NO: 212517 - RNA, 64 nt, Human
gugacaaugcugcuccuguaauuuuguaagaauucacacacaccagcuguauuuggaaaagcca

SEQ ID NO: 212518 - RNA, 64 nt, Human
cccccuaagugauagguuuaaacacacagagacacacacacacguuuccaaagugcagcagugu

SEQ ID NO: 212519 - RNA, 64 nt, Human
ugcccccuaagugauagguuuaaacacacagagacacacacacacguuuccaaagugcagcagu

SEQ ID NO: 212520 - RNA, 64 nt, Human
cacacacacacacacacacacacacacacacacacacacacacugccucccauccuucccucau

SEQ ID NO: 212521 - RNA, 64 nt, Human
cacacacacacacacacacacacacacacacacacacacacacacugccucccauccuucccuc

SEQ ID NO: 212522 - RNA, 64 nt, Human
cacacacacacacacacacacacacacacacacacacacacacacacugccucccauccuuccc

SEQ ID NO: 212523 - RNA, 64 nt, Human
cacacacacacacacacacacacacacacacacacacacacacacacacugccucccauccuuc

SEQ ID NO: 212524 - RNA, 64 nt, Human
cacacacacacacacacacacacacacacacacacacacacacacacacacugccucccauccu

SEQ ID NO: 212525 - RNA, 64 nt, Human
cacacacacacacacacacacacacacacacacacacacacacacacacacacugccucccauc

SEQ ID NO: 212526 - RNA, 64 nt, Human
cacacacacacacacacacacacacacacacacacacacacacacacacacacacugccuccca

SEQ ID NO: 212527 - RNA, 64 nt, Human
cacacacacacacacacacacacacacacacacacacacacacacacacacacacacugccucc

SEQ ID NO: 212528 - RNA, 64 nt, Human
cacacacacacacacacacacacacacacacacacacacacacacacacacacacacacugccu

SEQ ID NO: 212529 - RNA, 64 nt, Human
uacacacacacacacacacacacacacacacacacacacacacacacacacacacacacacugc

SEQ ID NO: 212530 - RNA, 64 nt, Human
ccuacacacacacacacacacacacacacacacacacacacacacacacacacacacacacacu

SEQ ID NO: 212531 - RNA, 64 nt, Human
ucccuacacacacacacacacacacacacacacacacacacacacacacacacacacacacaca

SEQ ID NO: 212532 - RNA, 64 nt, Human
ccucccuacacacacacacacacacacacacacacacacacacacacacacacacacacacaca

SEQ ID NO: 212533 - RNA, 64 nt, Human
ccccucccuacacacacacacacacacacacacacacacacacacacacacacacacacacaca

SEQ ID NO: 212534 - RNA, 64 nt, Human
acccccucccuacacacacacacacacacacacacacacacacacacacacacacacacacaca

SEQ ID NO: 212535 - RNA, 64 nt, Human
ucacccccucccuacacacacacacacacacacacacacacacacacacacacacacacacaca

SEQ ID NO: 212536 - RNA, 64 nt, Human
uaucacccccucccuacacacacacacacacacacacacacacacacacacacacacacacaca

SEQ ID NO: 212537 - RNA, 64 nt, Human
uguaucacccccucccuacacacacacacacacacacacacacacacacacacacacacacaca

SEQ ID NO: 212538 - RNA, 64 nt, Human
ccuguaucacccccucccuacacacacacacacacacacacacacacacacacacacacacaca

SEQ ID NO: 212539 - RNA, 64 nt, Human
ucccuguaucacccccucccuacacacacacacacacacacacacacacacacacacacacaca

SEQ ID NO: 212540 - RNA, 64 nt, Human
ccucccuguaucacccccucccuacacacacacacacacacacacacacacacacacacacaca

SEQ ID NO: 212541 - RNA, 64 nt, Human
ccccucccuguaucacccccucccuacacacacacacacacacacacacacacacacacacaca

SEQ ID NO: 212542 - RNA, 64 nt, Human
cuccccucccuguaucacccccucccuacacacacacacacacacacacacacacacacacaca

SEQ ID NO: 212543 - RNA, 64 nt, Human
gccuccccucccuguaucacccccucccuacacacacacacacacacacacacacacacacaca

SEQ ID NO: 212544 - RNA, 64 nt, Human
gagccuccccucccuguaucacccccucccuacacacacacacacacacacacacacacacaca

SEQ ID NO: 212545 - RNA, 64 nt, Human
gggagccuccccucccuguaucacccccucccuacacacacacacacacacacacacacacaca

SEQ ID NO: 212546 - RNA, 64 nt, Human
auauaccaauaacaguaauaauuauuuaaaaaaccacacacaccagaaaaacaaaagacagcag

SEQ ID NO: 212547 - RNA, 64 nt, Human
accagcuuuacucucugacacacacacgcacacacacacacaauuuuaacuuguuuuuuuguac

SEQ ID NO: 212548 - RNA, 64 nt, Human
ccaccagcuuuacucucugacacacacacgcacacacacacacaauuuuaacuuguuuuuuugu

SEQ ID NO: 212549 - RNA, 64 nt, Human
auccaccagcuuuacucucugacacacacacgcacacacacacacaauuuuaacuuguuuuuuu

SEQ ID NO: 212550 - RNA, 64 nt, Human
ccauccaccagcuuuacucucugacacacacacgcacacacacacacaauuuuaacuuguuuuu

SEQ ID NO: 212551 - RNA, 64 nt, Human
uaccuuagugccauccaccagcuuuacucucugacacacacacgcacacacacacacaauuuua

SEQ ID NO: 212552 - RNA, 64 nt, Human
cucuugucaggcuacagagugguggaagaggacacacacacaucuccuccauguuccugccaca

SEQ ID NO: 212553 - RNA, 64 nt, Human
uccucuugucaggcuacagagugguggaagaggacacacacacaucuccuccauguuccugcca

SEQ ID NO: 212554 - RNA, 64 nt, Human
cuuagugugacacacaggcaucucccaggccaagcacacacaggcugcgcccaguuccgcagga

SEQ ID NO: 212555 - RNA, 64 nt, Human
aagcuugacucagggaaaagaaaugugggaccaucacacacaugaaaauggcuauaauccucac

SEQ ID NO: 212556 - RNA, 64 nt, Human
cucgugcacaggcacgcagaugcgcucacacguacacacacacaaaugcacgcccacuugcaca

SEQ ID NO: 212557 - RNA, 64 nt, Human
cgugcacaggcacgcagaugcgcucacacguacacacacacaaaugcacgcccacuugcacaug

SEQ ID NO: 212558 - RNA, 64 nt, Human
caccucucuccccccaugcaccucuccccaacaacacacacagcccccugcaccgcccgccccc

SEQ ID NO: 212559 - RNA, 64 nt, Human
ucaccacaugugcacaugcacgugugugcacguacacacacauacacacacacgcgugcacaca

SEQ ID NO: 212560 - RNA, 64 nt, Human
ugcacaugcacgugugugcacguacacacacauacacacacacgcgugcacacaccagagccca

SEQ ID NO: 212561 - RNA, 64 nt, Human
cugcauacacacucgcaacaugucuacacacguccacacacacagacacacagauaccccaaau

SEQ ID NO: 212562 - RNA, 64 nt, Human
gcauacacacucgcaacaugucuacacacguccacacacacagacacacagauaccccaaaucc

SEQ ID NO: 212563 - RNA, 64 nt, Human
cauuccucacugaaaaagaaaacacacacccacccacacacacacacacagaagaaaaugaaag

SEQ ID NO: 212564 - RNA, 64 nt, Human
uuccucacugaaaaagaaaacacacacccacccacacacacacacacagaagaaaaugaaagcu

SEQ ID NO: 212565 - RNA, 64 nt, Human
ccucacugaaaaagaaaacacacacccacccacacacacacacacagaagaaaaugaaagcuga

SEQ ID NO: 212566 - RNA, 64 nt, Human
ucacugaaaaagaaaacacacacccacccacacacacacacacagaagaaaaugaaagcugaca

SEQ ID NO: 212567 - RNA, 64 nt, Human
acugaaaaagaaaacacacacccacccacacacacacacacagaagaaaaugaaagcugacaca

SEQ ID NO: 212568 - RNA, 64 nt, Human
ucauacaacacgauuguauuuuggcaagcaaauacacacacacacacauacucucacacaggaa

SEQ ID NO: 212569 - RNA, 64 nt, Human
auacaacacgauuguauuuuggcaagcaaauacacacacacacacauacucucacacaggaaac

SEQ ID NO: 212570 - RNA, 64 nt, Human
acaacacgauuguauuuuggcaagcaaauacacacacacacacauacucucacacaggaaacga

SEQ ID NO: 212571 - RNA, 64 nt, Human
aacacgauuguauuuuggcaagcaaauacacacacacacacauacucucacacaggaaacgacc

SEQ ID NO: 212572 - RNA, 64 nt, Human
ggugcaaguguugggggggagaauggggaaaggacacacacaggauaugggagccaggggcugg

SEQ ID NO: 212573 - RNA, 64 nt, Human
gauuccaggcgaugugcaaguguaugcacgugugcacacacaccacacauacacacacacaagc

SEQ ID NO: 212574 - RNA, 64 nt, Human
aaguguaugcacgugugcacacacaccacacauacacacacacaagcuuuuuuacacaaauggu

SEQ ID NO: 212575 - RNA, 64 nt, Human
guguaugcacgugugcacacacaccacacauacacacacacaagcuuuuuuacacaaaugguag

SEQ ID NO: 212576 - RNA, 64 nt, Human
guucgcugacaggcgagggucagccugcugugcccacacacacccacuaaggagaaagaaguug

SEQ ID NO: 212577 - RNA, 64 nt, Human
ggggagcagaaagggaccuugaguagacaaaggccacacacaucauugucauuacuguuuuaau

SEQ ID NO: 212578 - RNA, 64 nt, Human
ccaccccugcccaggcagucuuugcucaguggaucacacacauggaaggugaugggggcauggg

SEQ ID NO: 212579 - RNA, 64 nt, Human
gcacuccagcuugggcgacagaucaagacucugucacacacaaaacaaacaaacaaauuuuccc

SEQ ID NO: 212580 - RNA, 64 nt, Human
ccaguccggcuaaguggagcucagagcggaugggcacacacacccgcccuguguguguccccuc

SEQ ID NO: 212581 - RNA, 64 nt, Human
ggaaucagugcagccuguaaguucuccacauugacacacacacacacacacacacacacacacg

SEQ ID NO: 212582 - RNA, 64 nt, Human
aaucagugcagccuguaaguucuccacauugacacacacacacacacacacacacacacacgac

SEQ ID NO: 212583 - RNA, 64 nt, Human
ucagugcagccuguaaguucuccacauugacacacacacacacacacacacacacacacgacau

SEQ ID NO: 212584 - RNA, 64 nt, Human
agugcagccuguaaguucuccacauugacacacacacacacacacacacacacacacgacaugc

SEQ ID NO: 212585 - RNA, 64 nt, Human
ugcagccuguaaguucuccacauugacacacacacacacacacacacacacacacgacaugcuc

SEQ ID NO: 212586 - RNA, 64 nt, Human
cagccuguaaguucuccacauugacacacacacacacacacacacacacacacgacaugcuccu

SEQ ID NO: 212587 - RNA, 64 nt, Human
gccuguaaguucuccacauugacacacacacacacacacacacacacacacgacaugcuccuuu

SEQ ID NO: 212588 - RNA, 64 nt, Human
cuguaaguucuccacauugacacacacacacacacacacacacacacacgacaugcuccuuucu

SEQ ID NO: 212589 - RNA, 64 nt, Human
guaaguucuccacauugacacacacacacacacacacacacacacacgacaugcuccuuucugu

SEQ ID NO: 212590 - RNA, 64 nt, Human
aaguucuccacauugacacacacacacacacacacacacacacacgacaugcuccuuucugugg

SEQ ID NO: 212591 - RNA, 64 nt, Human
guucuccacauugacacacacacacacacacacacacacacacgacaugcuccuuucuguggca

SEQ ID NO: 212592 - RNA, 64 nt, Human
ugcaguugcuuacuaaagguuuuaaccgcacaugcacacacacacgcuuucuuaugcaaucuau

SEQ ID NO: 212593 - RNA, 64 nt, Human
caguugcuuacuaaagguuuuaaccgcacaugcacacacacacgcuuucuuaugcaaucuaugu

SEQ ID NO: 212594 - RNA, 64 nt, Human
agguugugaugcaggcuggagcccccgaaugccccacacacacugcagcauugaccagaccauc

SEQ ID NO: 212595 - RNA, 64 nt, Human
gguggaagcaagacgacggccccugacgugcagccacacacagaaaaggcugcugugaacauuu

SEQ ID NO: 212596 - RNA, 64 nt, Human
ccuggggggcaggaugccuggggacaguucaggacacacacacaguaggcccgcaauaaaagca

SEQ ID NO: 212597 - RNA, 64 nt, Human
uggggggcaggaugccuggggacaguucaggacacacacacaguaggcccgcaauaaaagcaac

SEQ ID NO: 212598 - RNA, 64 nt, Human
aacacaaggcggggaugcucccacgccacgugcacacacacagacccacauguggguggggggc

SEQ ID NO: 212599 - RNA, 64 nt, Human
ccaacacaaggcggggaugcucccacgccacgugcacacacacagacccacauguggguggggg

SEQ ID NO: 212600 - RNA, 64 nt, Human
ggaauugacuccggcgugcacacacguacacacccacacacaucuaucuauacauaauggcuga

SEQ ID NO: 212601 - RNA, 64 nt, Human
auauauauauauauauauauauaugguaaacaagcacacacaauuuuauccaaugcaaacaaau

SEQ ID NO: 212602 - RNA, 64 nt, Human
uacgacccgaccucucuauguaagcacacaugcgcacacacacuugcauucaugaaucugauau

SEQ ID NO: 212603 - RNA, 64 nt, Human
uguucacacacacacacacacacacacacacacacacacacaggcucucgccccaggauagaag

SEQ ID NO: 212604 - RNA, 64 nt, Human
uguguucacacacacacacacacacacacacacacacacacacaggcucucgccccaggauaga

SEQ ID NO: 212605 - RNA, 64 nt, Human
uguguguucacacacacacacacacacacacacacacacacacacaggcucucgccccaggaua

SEQ ID NO: 212606 - RNA, 64 nt, Human
gcuguguguucacacacacacacacacacacacacacacacacacacaggcucucgccccagga

SEQ ID NO: 212607 - RNA, 64 nt, Human
uggcuguguguucacacacacacacacacacacacacacacacacacacaggcucucgccccag

SEQ ID NO: 212608 - RNA, 64 nt, Human
gguggcuguguguucacacacacacacacacacacacacacacacacacacaggcucucgcccc

SEQ ID NO: 212609 - RNA, 64 nt, Human
gagguggcuguguguucacacacacacacacacacacacacacacacacacacaggcucucgcc

SEQ ID NO: 212610 - RNA, 64 nt, Human
acgagguggcuguguguucacacacacacacacacacacacacacacacacacacaggcucucg

SEQ ID NO: 212611 - RNA, 64 nt, Human
ggacgagguggcuguguguucacacacacacacacacacacacacacacacacacacaggcucu

SEQ ID NO: 212612 - RNA, 64 nt, Human
ccggacgagguggcuguguguucacacacacacacacacacacacacacacacacacacaggcu

SEQ ID NO: 212613 - RNA, 64 nt, Human
ccccggacgagguggcuguguguucacacacacacacacacacacacacacacacacacacagg

SEQ ID NO: 212614 - RNA, 64 nt, Human
ccccccggacgagguggcuguguguucacacacacacacacacacacacacacacacacacaca

SEQ ID NO: 212615 - RNA, 64 nt, Human
ggccccccggacgagguggcuguguguucacacacacacacacacacacacacacacacacaca

SEQ ID NO: 212616 - RNA, 64 nt, Human
cuggccccccggacgagguggcuguguguucacacacacacacacacacacacacacacacaca

SEQ ID NO: 212617 - RNA, 64 nt, Human
cacuggccccccggacgagguggcuguguguucacacacacacacacacacacacacacacaca

SEQ ID NO: 212618 - RNA, 64 nt, Human
ggcacuggccccccggacgagguggcuguguguucacacacacacacacacacacacacacaca

SEQ ID NO: 212619 - RNA, 64 nt, Human
ggaaaauucaaggauuguuuaaaggucugaugaucacacacaaaauguaauuccgguuauuuaa

SEQ ID NO: 212620 - RNA, 64 nt, Human
aagcuaacaccgacugcccgccccuccccugccacacacacagacacguaauaccagaccaacc

SEQ ID NO: 212621 - RNA, 64 nt, Human
aaaagcuaacaccgacugcccgccccuccccugccacacacacagacacguaauaccagaccaa

SEQ ID NO: 212622 - RNA, 64 nt, Human
uuuuccagaguccaauccucaggacuuucccguccacacacaggccugguagucagguggcucu

SEQ ID NO: 212623 - RNA, 64 nt, Human
uuucugcacagggagugagauuauuaaaguaacacacacacaaaguaaauugcaaaaugaaaaa

SEQ ID NO: 212624 - RNA, 64 nt, Human
aauuucugcacagggagugagauuauuaaaguaacacacacacaaaguaaauugcaaaaugaaa

SEQ ID NO: 212625 - RNA, 57 nt, Human
gucaaagugacaugcucugagaggcagcacacacagaauaacccugcauccaaauuc

SEQ ID NO: 212626 - RNA, 64 nt, Human
uagccuuuucugugcauugcuguauacacacagacacacacauguauguuuguuaccaagaacu

SEQ ID NO: 212627 - RNA, 64 nt, Human
ccuagcugggugcaugugugugcacacacacacacacacacacccccacaccccuuugccgguu

SEQ ID NO: 212628 - RNA, 64 nt, Human
acccuagcugggugcaugugugugcacacacacacacacacacacccccacaccccuuugccgg

SEQ ID NO: 212629 - RNA, 64 nt, Human
cuacccuagcugggugcaugugugugcacacacacacacacacacacccccacaccccuuugcc

SEQ ID NO: 212630 - RNA, 64 nt, Human
uucuacccuagcugggugcaugugugugcacacacacacacacacacacccccacaccccuuug

SEQ ID NO: 212631 - RNA, 64 nt, Human
uuuucuacccuagcugggugcaugugugugcacacacacacacacacacacccccacaccccuu

SEQ ID NO: 212632 - RNA, 64 nt, Human
uauuuucuacccuagcugggugcaugugugugcacacacacacacacacacacccccacacccc

SEQ ID NO: 212633 - RNA, 64 nt, Human
cuuauuuucuacccuagcugggugcaugugugugcacacacacacacacacacacccccacacc

SEQ ID NO: 212634 - RNA, 64 nt, Human
agccggaagucagaccuccucagucaccagaggacacacacaggggagaagccuuaugucugca

SEQ ID NO: 212635 - RNA, 64 nt, Human
agugauaagucagauguuauuacacaccaaaggacacacacaggggggaagcccuacgucugca

SEQ ID NO: 212636 - RNA, 64 nt, Human
cacccacacaaauaggcucugccgugcacuccuacacacacacacacacacacacacgcuuguu

SEQ ID NO: 212637 - RNA, 64 nt, Human
cccacacaaauaggcucugccgugcacuccuacacacacacacacacacacacacgcuuguuca

SEQ ID NO: 212638 - RNA, 64 nt, Human
cacacaaauaggcucugccgugcacuccuacacacacacacacacacacacacgcuuguucaca

SEQ ID NO: 212639 - RNA, 64 nt, Human
cacaaauaggcucugccgugcacuccuacacacacacacacacacacacacgcuuguucacacu

SEQ ID NO: 212640 - RNA, 64 nt, Human
caaauaggcucugccgugcacuccuacacacacacacacacacacacacgcuuguucacacuca

SEQ ID NO: 212641 - RNA, 64 nt, Human
aauaggcucugccgugcacuccuacacacacacacacacacacacacgcuuguucacacucaga

SEQ ID NO: 212642 - RNA, 64 nt, Human
uaggcucugccgugcacuccuacacacacacacacacacacacacgcuuguucacacucagaac

SEQ ID NO: 212643 - RNA, 64 nt, Human
ggcucugccgugcacuccuacacacacacacacacacacacacgcuuguucacacucagaaccc

SEQ ID NO: 212644 - RNA, 64 nt, Human
accugucucccaguccugcucucaccccugcugccacacacaugcccugagcagccagguccca

SEQ ID NO: 212645 - RNA, 64 nt, Human
cccacugacccacccacccaccuacaccccccgccacacacacacacaaacgugcacacgcguc

SEQ ID NO: 212646 - RNA, 64 nt, Human
cacugacccacccacccaccuacaccccccgccacacacacacacaaacgugcacacgcgucuc

SEQ ID NO: 212647 - RNA, 64 nt, Human
cugacccacccacccaccuacaccccccgccacacacacacacaaacgugcacacgcgucucau

SEQ ID NO: 212648 - RNA, 64 nt, Human
gacccacccacccaccuacaccccccgccacacacacacacaaacgugcacacgcgucucauuu

SEQ ID NO: 212649 - RNA, 64 nt, Human
caaccagacucuguaacucacccccaccaccauacacacacacaaaaacagaaacaaaaucaaa

SEQ ID NO: 212650 - RNA, 64 nt, Human
accagacucuguaacucacccccaccaccauacacacacacaaaaacagaaacaaaaucaaaac

SEQ ID NO: 212651 - RNA, 64 nt, Human
ugagccccacguggcaggagccucugggacggggcacacacaggcccagccucugugcugucuc

SEQ ID NO: 212652 - RNA, 64 nt, Human
uuguuuuucuuuucuaaaaugaagugagauuguucacacacacacacacacacacacacacaca

SEQ ID NO: 212653 - RNA, 64 nt, Human
guuuuucuuuucuaaaaugaagugagauuguucacacacacacacacacacacacacacacaca

SEQ ID NO: 212654 - RNA, 64 nt, Human
uuuucuuuucuaaaaugaagugagauuguucacacacacacacacacacacacacacacacaaa

SEQ ID NO: 212655 - RNA, 64 nt, Human
uucuuuucuaaaaugaagugagauuguucacacacacacacacacacacacacacacacaaaca

SEQ ID NO: 212656 - RNA, 64 nt, Human
cuuuucuaaaaugaagugagauuguucacacacacacacacacacacacacacacacaaacaca

SEQ ID NO: 212657 - RNA, 64 nt, Human
uuucuaaaaugaagugagauuguucacacacacacacacacacacacacacacacaaacacaaa

SEQ ID NO: 212658 - RNA, 64 nt, Human
ucuaaaaugaagugagauuguucacacacacacacacacacacacacacacacaaacacaaagg

SEQ ID NO: 212659 - RNA, 64 nt, Human
uaaaaugaagugagauuguucacacacacacacacacacacacacacacacaaacacaaaggac

SEQ ID NO: 212660 - RNA, 64 nt, Human
aaaugaagugagauuguucacacacacacacacacacacacacacacacaaacacaaaggacag

SEQ ID NO: 212661 - RNA, 64 nt, Human
augaagugagauuguucacacacacacacacacacacacacacacacaaacacaaaggacaguc

SEQ ID NO: 212662 - RNA, 64 nt, Human
gaagugagauuguucacacacacacacacacacacacacacacacaaacacaaaggacagucau

SEQ ID NO: 212663 - RNA, 64 nt, Human
agugagauuguucacacacacacacacacacacacacacacacaaacacaaaggacagucauac

SEQ ID NO: 212664 - RNA, 64 nt, Human
ugagauuguucacacacacacacacacacacacacacacacaaacacaaaggacagucauacau

SEQ ID NO: 212665 - RNA, 64 nt, Human
cuagcucacacucauccacacuuaagcccucgugcacacacacaaauuauucagauguacaccc

SEQ ID NO: 212666 - RNA, 64 nt, Human
agcucacacucauccacacuuaagcccucgugcacacacacaaauuauucagauguacacccac

SEQ ID NO: 212667 - RNA, 64 nt, Human
gccugucugucaauuucugguugggcugggaggccacacacacacacugacaugacagggcuug

SEQ ID NO: 212668 - RNA, 64 nt, Human
cugucugucaauuucugguugggcugggaggccacacacacacacugacaugacagggcuuggg

SEQ ID NO: 212669 - RNA, 64 nt, Human
gucugucaauuucugguugggcugggaggccacacacacacacugacaugacagggcuugggca

SEQ ID NO: 212670 - RNA, 64 nt, Human
uaaaaauaaauguguauguguguacauauauauacacacacauacacauauauuaugcaugugg

SEQ ID NO: 212671 - RNA, 64 nt, Human
gccuggcuuuuaaauggggggcugaauuccagcucacacacaccucaaguccaaccuuacuuuc

SEQ ID NO: 212672 - RNA, 64 nt, Human
ggguccccugcccagggcacuguccccauuuucccacacacagcucauaugcugcauucgugca

SEQ ID NO: 212673 - RNA, 64 nt, Human
cuccuuccucucguccuuggauagauucagcucccacacacacacccgcacugcccaggucccu

SEQ ID NO: 212674 - RNA, 64 nt, Human
ccuuccucucguccuuggauagauucagcucccacacacacacccgcacugcccaggucccucc

SEQ ID NO: 212675 - RNA, 64 nt, Human
gggcugggggaagaugcccucaacucacccccuacacacacaugagagagagcccccacccagu

SEQ ID NO: 212676 - RNA, 64 nt, Human
cagccaccagcacccccauagggcccccagacaccacacacaugcgcgugcgcacacacacaaa

SEQ ID NO: 212677 - RNA, 64 nt, Human
uagggcccccagacaccacacacaugcgcgugcgcacacacacaaacacacacacacuggacag

SEQ ID NO: 212678 - RNA, 64 nt, Human
gggcccccagacaccacacacaugcgcgugcgcacacacacaaacacacacacacuggacagua

SEQ ID NO: 212679 - RNA, 64 nt, Human
acaccacacacaugcgcgugcgcacacacacaaacacacacacacuggacaguagaugggccga

SEQ ID NO: 212680 - RNA, 64 nt, Human
accacacacaugcgcgugcgcacacacacaaacacacacacacuggacaguagaugggccgaca

SEQ ID NO: 212681 - RNA, 64 nt, Human
gcacacagcuuuuaguacccaccugagcuuuggacacacacagcuucuagugauuucuggggcc

SEQ ID NO: 212682 - RNA, 64 nt, Human
uaggggccccacccucugggcuucccaucagcgacacacacacacuuauggcaccagccuggac

SEQ ID NO: 212683 - RNA, 64 nt, Human
ggggccccacccucugggcuucccaucagcgacacacacacacuuauggcaccagccuggacuc

SEQ ID NO: 212684 - RNA, 64 nt, Human
guguccagguauuguguguaugcauuuaguugugcacacacaaauaugcuccuauacuggcauu

SEQ ID NO: 212685 - RNA, 64 nt, Human
gcaggugcccggggcugggugaguggaauuaggacacacacaggcuugggcuucaaguucauuu

SEQ ID NO: 212686 - RNA, 64 nt, Human
uauguguaugcauguauacgcccauacagacaugcacacacagacuccuacuccauuagcuaac

SEQ ID NO: 212687 - RNA, 64 nt, Human
cucgcuuuccuccccugccggcccccuccgcccccacacacacucgggacgucuucauugaaga

SEQ ID NO: 212688 - RNA, 64 nt, Human
gauguaaaaaaaaaaaaaaaaaaaaaaaaaaaaacacacacacagaggaaagacgcucuuuagg

SEQ ID NO: 212689 - RNA, 64 nt, Human
uguaaaaaaaaaaaaaaaaaaaaaaaaaaaaacacacacacagaggaaagacgcucuuuagguu

SEQ ID NO: 212690 - RNA, 64 nt, Human
aaggaccccucaccuugcaacacacagacacacgcacacacacacacaggaggagaaaucucac

SEQ ID NO: 212691 - RNA, 64 nt, Human
ggaccccucaccuugcaacacacagacacacgcacacacacacacaggaggagaaaucucacuu

SEQ ID NO: 212692 - RNA, 64 nt, Human
accccucaccuugcaacacacagacacacgcacacacacacacaggaggagaaaucucacuuuu

SEQ ID NO: 212693 - RNA, 64 nt, Human
cccucaccuugcaacacacagacacacgcacacacacacacaggaggagaaaucucacuuuucu

SEQ ID NO: 212694 - RNA, 64 nt, Human
ccaggucaaugccgggcaccuguucgugcagcagcacacacacccuaccuuccacgcgcugcgc

SEQ ID NO: 212695 - RNA, 64 nt, Human
auugagacugacuccaaggccacaaacuguucaacacacacaaaguggacaaauggcguucagc

SEQ ID NO: 212696 - RNA, 64 nt, Human
ggggacccagggggacuccaccccccuaagcaagcacacacauacucacaguugaugaguugcu

SEQ ID NO: 212697 - RNA, 64 nt, Human
cuacucaccaguguuguucaccaacacccacccccacacacaccaacauuuugcugccuaccuu

SEQ ID NO: 212698 - RNA, 64 nt, Human
cuuucuaugaaaggagcugcuauguacacaugugcacacacacacaacugggaaucaacaauga

SEQ ID NO: 212699 - RNA, 64 nt, Human
uucuaugaaaggagcugcuauguacacaugugcacacacacacaacugggaaucaacaaugagu

SEQ ID NO: 212700 - RNA, 64 nt, Human
cuaugaaaggagcugcuauguacacaugugcacacacacacaacugggaaucaacaaugaguuu

SEQ ID NO: 212701 - RNA, 64 nt, Human
uuauuuguuuauguuauuuaaauacacacccagacacacacacacacaguuuuugcuuuuucug

SEQ ID NO: 212702 - RNA, 64 nt, Human
auuuguuuauguuauuuaaauacacacccagacacacacacacacaguuuuugcuuuuucugga

SEQ ID NO: 212703 - RNA, 64 nt, Human
uuguuuauguuauuuaaauacacacccagacacacacacacacaguuuuugcuuuuucuggaaa

SEQ ID NO: 212704 - RNA, 64 nt, Human
guuuauguuauuuaaauacacacccagacacacacacacacaguuuuugcuuuuucuggaaaau

SEQ ID NO: 212705 - RNA, 64 nt, Human
cuuuuuuauuuuaagaggaagaagaagaaaggggcacacacacacaauaccgacgucuauccuu

SEQ ID NO: 212706 - RNA, 64 nt, Human
uuuuuauuuuaagaggaagaagaagaaaggggcacacacacacaauaccgacgucuauccuuuc

SEQ ID NO: 212707 - RNA, 64 nt, Human
uuuauuuuaagaggaagaagaagaaaggggcacacacacacaauaccgacgucuauccuuuccu

SEQ ID NO: 212708 - RNA, 64 nt, Human
uucaaaaauaaaaauugaguccacucuccccguacacacacacucgggcacuucaggaggucag

SEQ ID NO: 212709 - RNA, 64 nt, Human
acucccuggcuuuggcauucagugagacgcccugcacacacagaaagccaaagcgaucggugcu

SEQ ID NO: 212710 - RNA, 64 nt, Human
ggggucuaaccuugaacccucaccacgugcaggucacacacagugaagccacuuguaacugcac

SEQ ID NO: 212711 - RNA, 64 nt, Human
augugcagauggcaccacggccggcaccugggggcacacacaugcaggcggcguggucucccug

SEQ ID NO: 212712 - RNA, 64 nt, Human
uccuuaaagacagaagucacacuugaacaaaacccacacacaacaaaaccugauuugggagacg

SEQ ID NO: 212713 - RNA, 64 nt, Human
cagccucaaggaccaagaaccaucugcgaaaggacacacacaggaaauucauaaaagaaaucug

SEQ ID NO: 212714 - RNA, 64 nt, Human
cuuccagccugggacacacacacacacacacacacacacacacgcacgcacacgcacacaucuu

SEQ ID NO: 212715 - RNA, 64 nt, Human
cccuuccagccugggacacacacacacacacacacacacacacacgcacgcacacgcacacauc

SEQ ID NO: 212716 - RNA, 64 nt, Human
agcccuuccagccugggacacacacacacacacacacacacacacacgcacgcacacgcacaca

SEQ ID NO: 212717 - RNA, 64 nt, Human
cuagcccuuccagccugggacacacacacacacacacacacacacacacgcacgcacacgcaca

SEQ ID NO: 212718 - RNA, 64 nt, Human
cccuagcccuuccagccugggacacacacacacacacacacacacacacacgcacgcacacgca

SEQ ID NO: 212719 - RNA, 64 nt, Human
cucccuagcccuuccagccugggacacacacacacacacacacacacacacacgcacgcacacg

SEQ ID NO: 212720 - RNA, 64 nt, Human
cccucccuagcccuuccagccugggacacacacacacacacacacacacacacacgcacgcaca

SEQ ID NO: 212721 - RNA, 64 nt, Human
cucccucccuagcccuuccagccugggacacacacacacacacacacacacacacacgcacgca

SEQ ID NO: 212722 - RNA, 64 nt, Human
cccucccucccuagcccuuccagccugggacacacacacacacacacacacacacacacgcacg

SEQ ID NO: 212723 - RNA, 64 nt, Human
ggcccucccucccuagcccuuccagccugggacacacacacacacacacacacacacacacgca

SEQ ID NO: 212724 - RNA, 64 nt, Human
cuggcccucccucccuagcccuuccagccugggacacacacacacacacacacacacacacacg

SEQ ID NO: 212725 - RNA, 64 nt, Human
cacaaccaucuacacacaucuacacccccaagcacacacacaugguccgugccaugucaccucc

SEQ ID NO: 212726 - RNA, 64 nt, Human
aacacaaccaucuacacacaucuacacccccaagcacacacacaugguccgugccaugucaccu

SEQ ID NO: 212727 - RNA, 64 nt, Human
cuccccacagcuuugcaccccuuuccuccccauacacacacaaaccauuuuauuuuuugggcca

SEQ ID NO: 212728 - RNA, 64 nt, Human
cacauauugagacuuaggaagagccacaagaccacacacacagcccuuacccuccucaggacua

SEQ ID NO: 212729 - RNA, 64 nt, Human
gacacauauugagacuuaggaagagccacaagaccacacacacagcccuuacccuccucaggac

SEQ ID NO: 212730 - RNA, 64 nt, Human
caccgggggccaccugcccucccccauccucucccacacacauuccagaagucagggcccccuc

SEQ ID NO: 212731 - RNA, 64 nt, Human
uccuuaggauccccgcccccaccugcccccaaugcacacacagacccaccgggggccaccugcc

SEQ ID NO: 212732 - RNA, 64 nt, Human
cuuagguacaauugcuccccuuuuuauauauagacacacacaggacacauauauuaaacagauu

SEQ ID NO: 212733 - RNA, 64 nt, Human
ucuacuucaagaccaccucucccugcaaacaccacacacacauggcaugcauguacgcacaugc

SEQ ID NO: 212734 - RNA, 64 nt, Human
ucucuacuucaagaccaccucucccugcaaacaccacacacacauggcaugcauguacgcacau

SEQ ID NO: 212735 - RNA, 64 nt, Human
cacacaugcacacacacgcgcgcgcacacacacacacacacauccaccccagggccaagagaaa

SEQ ID NO: 212736 - RNA, 64 nt, Human
cacacacaugcacacacacgcgcgcgcacacacacacacacacauccaccccagggccaagaga

SEQ ID NO: 212737 - RNA, 64 nt, Human
cacacacacaugcacacacacgcgcgcgcacacacacacacacacauccaccccagggccaaga

SEQ ID NO: 212738 - RNA, 64 nt, Human
cacacacacacaugcacacacacgcgcgcgcacacacacacacacacauccaccccagggccaa

SEQ ID NO: 212739 - RNA, 64 nt, Human
cacacacacacacaugcacacacacgcgcgcgcacacacacacacacacauccaccccagggcc

SEQ ID NO: 212740 - RNA, 64 nt, Human
ugcacacacacacacaugcacacacacgcgcgcgcacacacacacacacacauccaccccaggg

SEQ ID NO: 212741 - RNA, 64 nt, Human
cacccgugagcgccugugcacacacacacacaugcacacacacgcgcgcgcacacacacacaca

SEQ ID NO: 212742 - RNA, 64 nt, Human
acucacaugacacccgugagcgccugugcacacacacacacaugcacacacacgcgcgcgcaca

SEQ ID NO: 212743 - RNA, 64 nt, Human
ccacucacaugacacccgugagcgccugugcacacacacacacaugcacacacacgcgcgcgca

SEQ ID NO: 212744 - RNA, 64 nt, Human
uaccacucacaugacacccgugagcgccugugcacacacacacacaugcacacacacgcgcgcg

SEQ ID NO: 212745 - RNA, 64 nt, Human
ccuaccacucacaugacacccgugagcgccugugcacacacacacacaugcacacacacgcgcg

SEQ ID NO: 212746 - RNA, 55 nt, Human
ccucggagucucggaacugacccgucacacacaccugccuaaagacagggauggc

SEQ ID NO: 212747 - RNA, 64 nt, Human
aacaaguugucuggccugacacagcaucacaucacacacacagaaauuaguauauccauguaug

SEQ ID NO: 212748 - RNA, 64 nt, Human
auaacaaguugucuggccugacacagcaucacaucacacacacagaaauuaguauauccaugua

SEQ ID NO: 212749 - RNA, 64 nt, Human
gaacuggcaugaggaguuagguucaucacaaauacacacacacugcccccaacccucugccguu

SEQ ID NO: 212750 - RNA, 64 nt, Human
uauacauauaugucuauauauauauauagacacacacacacagacauauauuuccuucuuuaag

SEQ ID NO: 212751 - RNA, 64 nt, Human
aguauacauauaugucuauauauauauauagacacacacacacagacauauauuuccuucuuua

SEQ ID NO: 212752 - RNA, 64 nt, Human
aaaguauacauauaugucuauauauauauauagacacacacacacagacauauauuuccuucuu

SEQ ID NO: 212753 - RNA, 64 nt, Human
cagccuuguuuaauguuuugagcaauaagauaugcacacacagguauuuuguugcuaaagagau

SEQ ID NO: 212754 - RNA, 64 nt, Human
ccacagcaggaacugccccacuggccauuugagacacacacaggugguaaaugcucugcuggug

SEQ ID NO: 212755 - RNA, 64 nt, Human
cacacacacacacacacacacacacacacacacacacacacacgccccucuacugcuauguggc

SEQ ID NO: 212756 - RNA, 64 nt, Human
cacacacacacacacacacacacacacacacacacacacacacacacacacacgccccucuacu

SEQ ID NO: 212757 - RNA, 64 nt, Human
cacacacacacacacacacacacacacacacacacacacacacacacacacacacgccccucua

SEQ ID NO: 212758 - RNA, 64 nt, Human
cacacacacacacacacacacacacacacacacacacacacacacacacacacacacgccccuc

SEQ ID NO: 212759 - RNA, 64 nt, Human
cacacacacacacacacacacacacacacacacacacacacacacacacacacacacacgcccc

SEQ ID NO: 212760 - RNA, 64 nt, Human
aacacacacacacacacacacacacacacacacacacacacacacacacacacacacacacgcc

SEQ ID NO: 212761 - RNA, 64 nt, Human
ccaacacacacacacacacacacacacacacacacacacacacacacacacacacacacacacg

SEQ ID NO: 212762 - RNA, 64 nt, Human
cuccaacacacacacacacacacacacacacacacacacacacacacacacacacacacacaca

SEQ ID NO: 212763 - RNA, 64 nt, Human
cgcuccaacacacacacacacacacacacacacacacacacacacacacacacacacacacaca

SEQ ID NO: 212764 - RNA, 64 nt, Human
cacgcuccaacacacacacacacacacacacacacacacacacacacacacacacacacacaca

SEQ ID NO: 212765 - RNA, 64 nt, Human
cccacgcuccaacacacacacacacacacacacacacacacacacacacacacacacacacaca

SEQ ID NO: 212766 - RNA, 64 nt, Human
aacccacgcuccaacacacacacacacacacacacacacacacacacacacacacacacacaca

SEQ ID NO: 212767 - RNA, 64 nt, Human
ccaacccacgcuccaacacacacacacacacacacacacacacacacacacacacacacacaca

SEQ ID NO: 212768 - RNA, 64 nt, Human
ccccaacccacgcuccaacacacacacacacacacacacacacacacacacacacacacacaca

SEQ ID NO: 212769 - RNA, 64 nt, Human
ucccccaacccacgcuccaacacacacacacacacacacacacacacacacacacacacacaca

SEQ ID NO: 212770 - RNA, 64 nt, Human
ccucccccaacccacgcuccaacacacacacacacacacacacacacacacacacacacacaca

SEQ ID NO: 212771 - RNA, 64 nt, Human
gcccucccccaacccacgcuccaacacacacacacacacacacacacacacacacacacacaca

SEQ ID NO: 212772 - RNA, 64 nt, Human
gagcccucccccaacccacgcuccaacacacacacacacacacacacacacacacacacacaca

SEQ ID NO: 212773 - RNA, 64 nt, Human
cugagcccucccccaacccacgcuccaacacacacacacacacacacacacacacacacacaca

SEQ ID NO: 212774 - RNA, 64 nt, Human
ugcugagcccucccccaacccacgcuccaacacacacacacacacacacacacacacacacaca

SEQ ID NO: 212775 - RNA, 64 nt, Human
cuugcugagcccucccccaacccacgcuccaacacacacacacacacacacacacacacacaca

SEQ ID NO: 212776 - RNA, 64 nt, Human
gucuugcugagcccucccccaacccacgcuccaacacacacacacacacacacacacacacaca

SEQ ID NO: 212777 - RNA, 64 nt, Human
ugcuuucgauucguuaagagagcaacauuuuacccacacacagauaaaguuuucccuugaggaa

SEQ ID NO: 212778 - RNA, 64 nt, Human
augacagcaucuccccauucaucuagaagaaugccacacacaaauaugacucauuugauuaucc

SEQ ID NO: 212779 - RNA, 64 nt, Human
ucucgaccccaucagccucucacccacucccagacacacacaaguccucaaaaguuucagcucc

SEQ ID NO: 212780 - RNA, 64 nt, Human
cccagcugccucuuacgguuugguaugggacaugcacacacacucacaugcucucacucaccac

SEQ ID NO: 212781 - RNA, 64 nt, Human
ggcuugaaggacaguugcccuccaggagguuccucacacacaacuccagaggcgccauuuacac

SEQ ID NO: 212782 - RNA, 64 nt, Human
cuaagccaagggccucuugcggucccuucuuacucacacacaaaauguacccaguauucuaggu

SEQ ID NO: 212783 - RNA, 64 nt, Human
auugggcagugguucacuuuaaaacacacacauacacacacaaaacaauuuuuuaagaaauccu

SEQ ID NO: 212784 - RNA, 64 nt, Human
aaacuuucauauugggcagugguucacuuuaaaacacacacauacacacacaaaacaauuuuuu

SEQ ID NO: 212785 - RNA, 64 nt, Human
ugccagauagugcaguguuuuggucacgguaacacacacacacucucccucaucuuucgugccc

SEQ ID NO: 212786 - RNA, 64 nt, Human
acugccagauagugcaguguuuuggucacgguaacacacacacacucucccucaucuuucgugc

SEQ ID NO: 212787 - RNA, 64 nt, Human
ggacacuccaacucuacacagcucagcagacauccacacacaguaauggggugagcucacaacc

SEQ ID NO: 212788 - RNA, 64 nt, Human
cauacauacaaacacaugcaaacauaccuacacacacacacacucuuacaaccuccaucauggg

SEQ ID NO: 212789 - RNA, 64 nt, Human
cacauacauacaaacacaugcaaacauaccuacacacacacacacucuuacaaccuccaucaug

SEQ ID NO: 212790 - RNA, 64 nt, Human
ugcacauacauacaaacacaugcaaacauaccuacacacacacacacucuuacaaccuccauca

SEQ ID NO: 212791 - RNA, 64 nt, Human
agaggaauacaucucucacacauacucacaaacacacacacaagcacuugcacauacauacaaa

SEQ ID NO: 212792 - RNA, 64 nt, Human
gcagaggaauacaucucucacacauacucacaaacacacacacaagcacuugcacauacauaca

SEQ ID NO: 212793 - RNA, 64 nt, Human
aaauugugcauuugggaagcaaguagccauaguacacacacaacacgcuaucagcuuggguaag

SEQ ID NO: 212794 - RNA, 64 nt, Human
uauuaucagcaaugggcuacuucaaauguuuaaucacacacaacauauucgaauugagucaagc

SEQ ID NO: 212795 - RNA, 64 nt, Human
gcccaaucccaguaaugcugcugccugacagaaacacacacacagccacaguugccaaaucccg

SEQ ID NO: 212796 - RNA, 64 nt, Human
ccaaucccaguaaugcugcugccugacagaaacacacacacagccacaguugccaaaucccgua

SEQ ID NO: 212797 - RNA, 64 nt, Human
gacaggccaggcucguggcucggaagacaaaccccacacacacucaaggggucgaaaacaaacc

SEQ ID NO: 212798 - RNA, 64 nt, Human
guuggcuacuauuacaccuuaaaaauugaguuuacacacacacaauuaccuguuuauauggugc

SEQ ID NO: 212799 - RNA, 64 nt, Human
uggcuacuauuacaccuuaaaaauugaguuuacacacacacaauuaccuguuuauauggugcuc

SEQ ID NO: 212800 - RNA, 64 nt, Human
uauuggcauuuuucaacccagugucacuagaugucacacacauuuguggugcuuugauguuugc

SEQ ID NO: 212801 - RNA, 64 nt, Human
cucuugggucaacuggcuuacagauuuacaugugcacacacacacaaauuucuuaucacauuuu

SEQ ID NO: 212802 - RNA, 64 nt, Human
cuugggucaacuggcuuacagauuuacaugugcacacacacacaaauuucuuaucacauuuucg

SEQ ID NO: 212803 - RNA, 64 nt, Human
ugggucaacuggcuuacagauuuacaugugcacacacacacaaauuucuuaucacauuuucgac

SEQ ID NO: 212804 - RNA, 64 nt, Human
auuuguguauauguguguauacauauguuuaucucacacacauuaugagcuugaauucuuaauu

SEQ ID NO: 212805 - RNA, 64 nt, Human
cuaaauggacauauuucuuaugcaaaaaggaaaacacacacaaccaauaacucaaacaaaaaag

SEQ ID NO: 212806 - RNA, 64 nt, Human
ucacagacugauuggaauucuuucuguugaaaagcacacacaauaaagaaccccucguuagccu

SEQ ID NO: 212807 - RNA, 64 nt, Human
acauauaaacaucacacacacagacagacacacacacacacaacaauuaacagucuucaggcaa

SEQ ID NO: 212808 - RNA, 64 nt, Human
acacauauaaacaucacacacacagacagacacacacacacacaacaauuaacagucuucaggc

SEQ ID NO: 212809 - RNA, 64 nt, Human
acacacauauaaacaucacacacacagacagacacacacacacacaacaauuaacagucuucag

SEQ ID NO: 212810 - RNA, 64 nt, Human
uaacacacauauaaacaucacacacacagacagacacacacacacacaacaauuaacagucuuc

SEQ ID NO: 212811 - RNA, 64 nt, Human
uguuuaagaaaaaauaacacacauauaaacaucacacacacagacagacacacacacacacaac

SEQ ID NO: 212812 - RNA, 64 nt, Human
gcuguuuaagaaaaaauaacacacauauaaacaucacacacacagacagacacacacacacaca

SEQ ID NO: 212813 - RNA, 64 nt, Human
ucuacucuagaauacguacguaugcacccacagacacacacaguuuauugacacaucuauuaug

SEQ ID NO: 212814 - RNA, 64 nt, Human
uucaacuugcaaacugacuuuugggacaaaccaacacacacacagaagagaaagcaaagaacuu

SEQ ID NO: 212815 - RNA, 64 nt, Human
caacuugcaaacugacuuuugggacaaaccaacacacacacagaagagaaagcaaagaacuugg

SEQ ID NO: 212816 - RNA, 64 nt, Human
uagucugaaacagaccugaacagacagacagacgcacacacacaacagaugcgcagcaacuccc

SEQ ID NO: 212817 - RNA, 64 nt, Human
gucugaaacagaccugaacagacagacagacgcacacacacaacagaugcgcagcaacuccccg

SEQ ID NO: 212818 - RNA, 64 nt, Human
agccucccgcggggccacacacuuccccucccaacacacacacacaccugccaucuuggucaug

SEQ ID NO: 212819 - RNA, 64 nt, Human
ccucccgcggggccacacacuuccccucccaacacacacacacaccugccaucuuggucaugag

SEQ ID NO: 212820 - RNA, 64 nt, Human
ucccgcggggccacacacuuccccucccaacacacacacacaccugccaucuuggucaugagcu

SEQ ID NO: 212821 - RNA, 64 nt, Human
agagaugcucaguguuaaaacugaaacacacaaacacacacacacacacauuuuucucuuguag

SEQ ID NO: 212822 - RNA, 64 nt, Human
agaugcucaguguuaaaacugaaacacacaaacacacacacacacacauuuuucucuuguagau

SEQ ID NO: 212823 - RNA, 64 nt, Human
augcucaguguuaaaacugaaacacacaaacacacacacacacacauuuuucucuuguagauuu

SEQ ID NO: 212824 - RNA, 64 nt, Human
gcucaguguuaaaacugaaacacacaaacacacacacacacacauuuuucucuuguagauuuua

SEQ ID NO: 212825 - RNA, 64 nt, Human
ucaguguuaaaacugaaacacacaaacacacacacacacacauuuuucucuuguagauuuuaau

SEQ ID NO: 212826 - RNA, 64 nt, Human
aauauauauauauguauguauguauguauguaaacacacacacuaauuugagaggacccguagg

SEQ ID NO: 212827 - RNA, 64 nt, Human
accgccacauggcuuccuccugcgcgcaugugcgcacacacacacacacacgcacacacacaca

SEQ ID NO: 212828 - RNA, 64 nt, Human
cgccacauggcuuccuccugcgcgcaugugcgcacacacacacacacacgcacacacacacaca

SEQ ID NO: 212829 - RNA, 64 nt, Human
ccacauggcuuccuccugcgcgcaugugcgcacacacacacacacacgcacacacacacacaca

SEQ ID NO: 212830 - RNA, 64 nt, Human
acauggcuuccuccugcgcgcaugugcgcacacacacacacacacgcacacacacacacacaca

SEQ ID NO: 212831 - RNA, 64 nt, Human
auggcuuccuccugcgcgcaugugcgcacacacacacacacacgcacacacacacacacacacu

SEQ ID NO: 212832 - RNA, 64 nt, Human
ccugcgcgcaugugcgcacacacacacacacacgcacacacacacacacacacucacugcggag

SEQ ID NO: 212833 - RNA, 64 nt, Human
ugcgcgcaugugcgcacacacacacacacacgcacacacacacacacacacucacugcggagaa

SEQ ID NO: 212834 - RNA, 64 nt, Human
cgcgcaugugcgcacacacacacacacacgcacacacacacacacacacucacugcggagaacc

SEQ ID NO: 212835 - RNA, 64 nt, Human
cgcaugugcgcacacacacacacacacgcacacacacacacacacacucacugcggagaaccuu

SEQ ID NO: 212836 - RNA, 64 nt, Human
caugugcgcacacacacacacacacgcacacacacacacacacacucacugcggagaaccuugu

SEQ ID NO: 212837 - RNA, 64 nt, Human
ugugcgcacacacacacacacacgcacacacacacacacacacucacugcggagaaccuugugc

SEQ ID NO: 212838 - RNA, 64 nt, Human
cacaugguaaccuacuguuugccagccuguaaaacacacacacacacacacacacacacacaaa

SEQ ID NO: 212839 - RNA, 64 nt, Human
caugguaaccuacuguuugccagccuguaaaacacacacacacacacacacacacacacaaaua

SEQ ID NO: 212840 - RNA, 64 nt, Human
ugguaaccuacuguuugccagccuguaaaacacacacacacacacacacacacacacaaauauu

SEQ ID NO: 212841 - RNA, 64 nt, Human
guaaccuacuguuugccagccuguaaaacacacacacacacacacacacacacacaaauauuau

SEQ ID NO: 212842 - RNA, 64 nt, Human
aaccuacuguuugccagccuguaaaacacacacacacacacacacacacacacaaauauuauua

SEQ ID NO: 212843 - RNA, 64 nt, Human
ccuacuguuugccagccuguaaaacacacacacacacacacacacacacacaaauauuauuaga

SEQ ID NO: 212844 - RNA, 64 nt, Human
uacuguuugccagccuguaaaacacacacacacacacacacacacacacaaauauuauuagaca

SEQ ID NO: 212845 - RNA, 64 nt, Human
cuguuugccagccuguaaaacacacacacacacacacacacacacacaaauauuauuagacaaa

SEQ ID NO: 212846 - RNA, 64 nt, Human
guuugccagccuguaaaacacacacacacacacacacacacacacaaauauuauuagacaaauu

SEQ ID NO: 212847 - RNA, 64 nt, Human
uugccagccuguaaaacacacacacacacacacacacacacacaaauauuauuagacaaauuag

SEQ ID NO: 212848 - RNA, 64 nt, Human
gccagccuguaaaacacacacacacacacacacacacacacaaauauuauuagacaaauuagau

SEQ ID NO: 212849 - RNA, 64 nt, Human
agccaggagucauacuucaucagacaccagaggacacacacagugcuguggcuuuuucagccau

SEQ ID NO: 212850 - RNA, 64 nt, Human
caccagcagugguggagaugucgguccaugagcgcacacacaagacugagggacugucggcccu

SEQ ID NO: 212851 - RNA, 64 nt, Human
cugucggcccucccagguggugucaacacaacaucacacacaggugggggggccugauagccca

SEQ ID NO: 212852 - RNA, 64 nt, Human
guaaccacguggaaagcggccccugcugccccuccacacacacauacacacucacugaucuaca

SEQ ID NO: 212853 - RNA, 64 nt, Human
aaccacguggaaagcggccccugcugccccuccacacacacauacacacucacugaucuacagc

SEQ ID NO: 212854 - RNA, 64 nt, Human
cacacgcauacacacaugaacacaugcacaugugcacacacaaguaagauggcuucagagaggg

SEQ ID NO: 212855 - RNA, 64 nt, Human
auucuuucccauucuguccaugaaucaucuuccccacacacaaucauucauaucuacucaccua

SEQ ID NO: 212856 - RNA, 64 nt, Human
agacccccgcaggccaccaggcauucuggacacgcacacacacacacacacacacacacacaca

SEQ ID NO: 212857 - RNA, 64 nt, Human
acccccgcaggccaccaggcauucuggacacgcacacacacacacacacacacacacacacaca

SEQ ID NO: 212858 - RNA, 64 nt, Human
ccccgcaggccaccaggcauucuggacacgcacacacacacacacacacacacacacacacaaa

SEQ ID NO: 212859 - RNA, 64 nt, Human
ccgcaggccaccaggcauucuggacacgcacacacacacacacacacacacacacacacaaaac

SEQ ID NO: 212860 - RNA, 64 nt, Human
gcaggccaccaggcauucuggacacgcacacacacacacacacacacacacacacacaaaacuu

SEQ ID NO: 212861 - RNA, 64 nt, Human
aggccaccaggcauucuggacacgcacacacacacacacacacacacacacacacaaaacuuca

SEQ ID NO: 212862 - RNA, 64 nt, Human
gccaccaggcauucuggacacgcacacacacacacacacacacacacacacacaaaacuucaca

SEQ ID NO: 212863 - RNA, 64 nt, Human
caccaggcauucuggacacgcacacacacacacacacacacacacacacacaaaacuucacagc

SEQ ID NO: 212864 - RNA, 64 nt, Human
ccaggcauucuggacacgcacacacacacacacacacacacacacacacaaaacuucacagcag

SEQ ID NO: 212865 - RNA, 64 nt, Human
aggcauucuggacacgcacacacacacacacacacacacacacacacaaaacuucacagcaggc

SEQ ID NO: 212866 - RNA, 64 nt, Human
gcauucuggacacgcacacacacacacacacacacacacacacacaaaacuucacagcaggcca

SEQ ID NO: 212867 - RNA, 64 nt, Human
auucuggacacgcacacacacacacacacacacacacacacacaaaacuucacagcaggccagc

SEQ ID NO: 212868 - RNA, 64 nt, Human
ucuggacacgcacacacacacacacacacacacacacacacaaaacuucacagcaggccagcug

SEQ ID NO: 212869 - RNA, 64 nt, Human
uucuagggagcacccucccaccccccaccccccccacacacaccaucuuuccaucccaggcuuu

SEQ ID NO: 212870 - RNA, 64 nt, Human
ucacaccuccagccucacguucacuuaggcacaucacacacacacuggcacacgcaggcaucca

SEQ ID NO: 212871 - RNA, 64 nt, Human
acaccuccagccucacguucacuuaggcacaucacacacacacuggcacacgcaggcauccauc

SEQ ID NO: 212872 - RNA, 64 nt, Human
ucucugaagacuucucgcucaguuucagugaggacacacacaaagacgugggugaccauguugu

SEQ ID NO: 212873 - RNA, 64 nt, Human
cacugaggauaagcuggagccacaaugcaugaggcacacacacagcaaggaugacgcuguaaac

SEQ ID NO: 212874 - RNA, 64 nt, Human
cugaggauaagcuggagccacaaugcaugaggcacacacacagcaaggaugacgcuguaaacau

SEQ ID NO: 212875 - RNA, 64 nt, Human
uuucaaacucuuaugcacucaugaaacacacagacacacacacacacaaacuugcauaaauuuu

SEQ ID NO: 212876 - RNA, 64 nt, Human
ucaaacucuuaugcacucaugaaacacacagacacacacacacacaaacuugcauaaauuuucc

SEQ ID NO: 212877 - RNA, 64 nt, Human
aaacucuuaugcacucaugaaacacacagacacacacacacacaaacuugcauaaauuuucccu

SEQ ID NO: 212878 - RNA, 64 nt, Human
acucuuaugcacucaugaaacacacagacacacacacacacaaacuugcauaaauuuucccuga

SEQ ID NO: 212879 - RNA, 64 nt, Human
caccaagucugacccacacagcgucacucacucccacacacacccccuggcucugcugagguua

SEQ ID NO: 212880 - RNA, 64 nt, Human
cacauauuuaaaguguacgaguuaagucuugauacacacacacacacacacacacacacacaca

SEQ ID NO: 212881 - RNA, 64 nt, Human
cauauuuaaaguguacgaguuaagucuugauacacacacacacacacacacacacacacacaca

SEQ ID NO: 212882 - RNA, 64 nt, Human
uauuuaaaguguacgaguuaagucuugauacacacacacacacacacacacacacacacacaca

SEQ ID NO: 212883 - RNA, 64 nt, Human
uuuaaaguguacgaguuaagucuugauacacacacacacacacacacacacacacacacacaca

SEQ ID NO: 212884 - RNA, 64 nt, Human
uaaaguguacgaguuaagucuugauacacacacacacacacacacacacacacacacacacacu

SEQ ID NO: 212885 - RNA, 64 nt, Human
aaguguacgaguuaagucuugauacacacacacacacacacacacacacacacacacacacuug

SEQ ID NO: 212886 - RNA, 64 nt, Human
guguacgaguuaagucuugauacacacacacacacacacacacacacacacacacacacuugaa

SEQ ID NO: 212887 - RNA, 64 nt, Human
guacgaguuaagucuugauacacacacacacacacacacacacacacacacacacacuugaaac

SEQ ID NO: 212888 - RNA, 64 nt, Human
acgaguuaagucuugauacacacacacacacacacacacacacacacacacacacuugaaacua

SEQ ID NO: 212889 - RNA, 64 nt, Human
gaguuaagucuugauacacacacacacacacacacacacacacacacacacacuugaaacuauc

SEQ ID NO: 212890 - RNA, 64 nt, Human
guuaagucuugauacacacacacacacacacacacacacacacacacacacuugaaacuaucac

SEQ ID NO: 212891 - RNA, 64 nt, Human
uaagucuugauacacacacacacacacacacacacacacacacacacacuugaaacuaucaccc

SEQ ID NO: 212892 - RNA, 64 nt, Human
agucuugauacacacacacacacacacacacacacacacacacacacuugaaacuaucacccua

SEQ ID NO: 212893 - RNA, 64 nt, Human
ucuugauacacacacacacacacacacacacacacacacacacacuugaaacuaucacccuauc

SEQ ID NO: 212894 - RNA, 64 nt, Human
uugauacacacacacacacacacacacacacacacacacacacuugaaacuaucacccuaucag

SEQ ID NO: 212895 - RNA, 64 nt, Human
ugaggaaacugaggcacacggccuggccuggcuucacacacauagccgacucaggagagggaug

SEQ ID NO: 212896 - RNA, 64 nt, Human
cccagacacugugcugucucugcucucugcuacucacacacacccucaugugugaagggcagag

SEQ ID NO: 212897 - RNA, 64 nt, Human
gcuguccuggcugagccccugcaggagccccggccacacacagcaagaaagauacaucugacca

SEQ ID NO: 212898 - RNA, 64 nt, Human
aagagaguuaaggacacucacccccacccacgcacacacacaaggcagcgucgggugggagaga

SEQ ID NO: 212899 - RNA, 64 nt, Human
aaaagagaguuaaggacacucacccccacccacgcacacacacaaggcagcgucgggugggaga

SEQ ID NO: 212900 - RNA, 64 nt, Human
ugcccccgacccccccauacccccuucucugugacacacacaucuucucgucucuuuuucuuuc

SEQ ID NO: 212901 - RNA, 64 nt, Human
gucuagauccuggcagcccagucacagaguaucccacacacacuggugcccagagccggcuucu

SEQ ID NO: 212902 - RNA, 63 nt, Human
ccagccugggcagcaagagcaaaacaaccucugucacacacacaaaaaaaaaaaaaaaggaaa

SEQ ID NO: 212903 - RNA, 64 nt, Human
uaugggugccucgggacacaccaaccccuauacucacacacaggcauggaugcaugugugugua

SEQ ID NO: 212904 - RNA, 64 nt, Human
cauauacacacacacacacacacacacacacacacacacacauauauauauauauauauuuuuu

SEQ ID NO: 212905 - RNA, 64 nt, Human
uacauauacacacacacacacacacacacacacacacacacacauauauauauauauauauuuu

SEQ ID NO: 212906 - RNA, 64 nt, Human
uauacauauacacacacacacacacacacacacacacacacacacauauauauauauauauauu

SEQ ID NO: 212907 - RNA, 64 nt, Human
uauauacauauacacacacacacacacacacacacacacacacacacauauauauauauauaua

SEQ ID NO: 212908 - RNA, 64 nt, Human
cauauauacauauacacacacacacacacacacacacacacacacacacauauauauauauaua

SEQ ID NO: 212909 - RNA, 64 nt, Human
cacauauauacauauacacacacacacacacacacacacacacacacacacauauauauauaua

SEQ ID NO: 212910 - RNA, 64 nt, Human
cacacauauauacauauacacacacacacacacacacacacacacacacacacauauauauaua

SEQ ID NO: 212911 - RNA, 64 nt, Human
cacacacauauauacauauacacacacacacacacacacacacacacacacacacauauauaua

SEQ ID NO: 212912 - RNA, 64 nt, Human
cacacacacauauauacauauacacacacacacacacacacacacacacacacacacauauaua

SEQ ID NO: 212913 - RNA, 64 nt, Human
cacacacacacauauauacauauacacacacacacacacacacacacacacacacacacauaua

SEQ ID NO: 212914 - RNA, 64 nt, Human
cacacacacacacauauauacauauacacacacacacacacacacacacacacacacacacaua

SEQ ID NO: 212915 - RNA, 64 nt, Human
cacacacacacacacauauauacauauacacacacacacacacacacacacacacacacacaca

SEQ ID NO: 212916 - RNA, 64 nt, Human
cacacacacacacacacauauauacauauacacacacacacacacacacacacacacacacaca

SEQ ID NO: 212917 - RNA, 64 nt, Human
cacacacacacacacacacauauauacauauacacacacacacacacacacacacacacacaca

SEQ ID NO: 212918 - RNA, 64 nt, Human
cacacacacacacacacacacauauauacauauacacacacacacacacacacacacacacaca

SEQ ID NO: 212919 - RNA, 64 nt, Human
uauauauauauauauacacacacacacacacacacacacacauauauacauauacacacacaca

SEQ ID NO: 212920 - RNA, 64 nt, Human
uauauauauauauauauacacacacacacacacacacacacacauauauacauauacacacaca

SEQ ID NO: 212921 - RNA, 64 nt, Human
auuauauauauauauauauacacacacacacacacacacacacacauauauacauauacacaca

SEQ ID NO: 212922 - RNA, 64 nt, Human
auauuauauauauauauauauacacacacacacacacacacacacacauauauacauauacaca

SEQ ID NO: 212923 - RNA, 64 nt, Human
auauauuauauauauauauauauacacacacacacacacacacacacacauauauacauauaca

SEQ ID NO: 212924 - RNA, 64 nt, Human
auauauauuauauauauauauauauacacacacacacacacacacacacacauauauacauaua

SEQ ID NO: 212925 - RNA, 64 nt, Human
auauauauauuauauauauauauauauacacacacacacacacacacacacacauauauacaua

SEQ ID NO: 212926 - RNA, 64 nt, Human
auauauauauauuauauauauauauauauacacacacacacacacacacacacacauauauaca

SEQ ID NO: 212927 - RNA, 64 nt, Human
auauauauauauauuauauauauauauauauacacacacacacacacacacacacacauauaua

SEQ ID NO: 212928 - RNA, 64 nt, Human
auauauauauauauauuauauauauauauauauacacacacacacacacacacacacacauaua

SEQ ID NO: 212929 - RNA, 64 nt, Human
uauggcaccaacaucacaugcacgcaugcccuuucacacacacuuucuacccaauucucaccua

SEQ ID NO: 212930 - RNA, 64 nt, Human
cgcggcgauggcaucacacagacggugaugaugucacacacagacacagugacaacacacacca

SEQ ID NO: 212931 - RNA, 64 nt, Human
acacacuauauauauauauauauauacacacacacacacacaauauauguauauauaguauaua

SEQ ID NO: 212932 - RNA, 64 nt, Human
uaacacacuauauauauauauauauauacacacacacacacacaauauauguauauauaguaua

SEQ ID NO: 212933 - RNA, 64 nt, Human
cauaacacacuauauauauauauauauauacacacacacacacacaauauauguauauauagua

SEQ ID NO: 212934 - RNA, 64 nt, Human
uacauaacacacuauauauauauauauauauacacacacacacacacaauauauguauauauag

SEQ ID NO: 212935 - RNA, 64 nt, Human
acuacauaacacacuauauauauauauauauauacacacacacacacacaauauauguauauau

SEQ ID NO: 212936 - RNA, 64 nt, Human
cugguuauauuccaccauaacacacacacacacacacacacacuauauacauauaguguauaua

SEQ ID NO: 212937 - RNA, 64 nt, Human
aacugguuauauuccaccauaacacacacacacacacacacacacuauauacauauaguguaua

SEQ ID NO: 212938 - RNA, 64 nt, Human
ggaacugguuauauuccaccauaacacacacacacacacacacacacuauauacauauagugua

SEQ ID NO: 212939 - RNA, 64 nt, Human
uaggaacugguuauauuccaccauaacacacacacacacacacacacacuauauacauauagug

SEQ ID NO: 212940 - RNA, 64 nt, Human
cauaggaacugguuauauuccaccauaacacacacacacacacacacacacuauauacauauag

SEQ ID NO: 212941 - RNA, 64 nt, Human
uacauaggaacugguuauauuccaccauaacacacacacacacacacacacacuauauacauau

SEQ ID NO: 212942 - RNA, 64 nt, Human
cauacauaggaacugguuauauuccaccauaacacacacacacacacacacacacuauauacau

SEQ ID NO: 212943 - RNA, 64 nt, Human
cacauacauaggaacugguuauauuccaccauaacacacacacacacacacacacacuauauac

SEQ ID NO: 212944 - RNA, 64 nt, Human
aagcugagacccucgccacggggagggggacgcgcacacacaccggucaccgagacggcuggac

SEQ ID NO: 212945 - RNA, 64 nt, Human
gcuauacacacacacacacacacacacacacacacacacacacgaugcauuuaauaaagaugag

SEQ ID NO: 212946 - RNA, 64 nt, Human
gugcuauacacacacacacacacacacacacacacacacacacacgaugcauuuaauaaagaug

SEQ ID NO: 212947 - RNA, 64 nt, Human
augugcuauacacacacacacacacacacacacacacacacacacacgaugcauuuaauaaaga

SEQ ID NO: 212948 - RNA, 64 nt, Human
guaugugcuauacacacacacacacacacacacacacacacacacacacgaugcauuuaauaaa

SEQ ID NO: 212949 - RNA, 64 nt, Human
aaguaugugcuauacacacacacacacacacacacacacacacacacacacgaugcauuuaaua

SEQ ID NO: 212950 - RNA, 64 nt, Human
ugaaguaugugcuauacacacacacacacacacacacacacacacacacacacgaugcauuuaa

SEQ ID NO: 212951 - RNA, 64 nt, Human
ccugaaguaugugcuauacacacacacacacacacacacacacacacacacacacgaugcauuu

SEQ ID NO: 212952 - RNA, 64 nt, Human
agccugaaguaugugcuauacacacacacacacacacacacacacacacacacacacgaugcau

SEQ ID NO: 212953 - RNA, 64 nt, Human
caagccugaaguaugugcuauacacacacacacacacacacacacacacacacacacacgaugc

SEQ ID NO: 212954 - RNA, 64 nt, Human
cgcaagccugaaguaugugcuauacacacacacacacacacacacacacacacacacacacgau

SEQ ID NO: 212955 - RNA, 64 nt, Human
gccgcaagccugaaguaugugcuauacacacacacacacacacacacacacacacacacacacg

SEQ ID NO: 212956 - RNA, 64 nt, Human
gugccgcaagccugaaguaugugcuauacacacacacacacacacacacacacacacacacaca

SEQ ID NO: 212957 - RNA, 64 nt, Human
uggugccgcaagccugaaguaugugcuauacacacacacacacacacacacacacacacacaca

SEQ ID NO: 212958 - RNA, 64 nt, Human
gguggugccgcaagccugaaguaugugcuauacacacacacacacacacacacacacacacaca

SEQ ID NO: 212959 - RNA, 63 nt, Human
ggguggugccgcaagccugaaguaugugcuauacacacacacacacacacacacacacacaca

SEQ ID NO: 212960 - RNA, 64 nt, Human
uguuaaaaaacaaaaaacaaaaaacaaaaaaccacacacacauuuuguacgggguggggagggg

SEQ ID NO: 212961 - RNA, 64 nt, Human
cuuguuaaaaaacaaaaaacaaaaaacaaaaaaccacacacacauuuuguacgggguggggagg

SEQ ID NO: 212962 - RNA, 64 nt, Human
cucccaaaaugcugggauuacagaugugagccaccacacacaccaucugauuaaaaaaaaaaaa

SEQ ID NO: 212963 - RNA, 64 nt, Human
aauuucacagaagacaggucagcugaggggccugcacacacaggguguugaggaaccacagaug

SEQ ID NO: 212964 - RNA, 64 nt, Human
gaacccugcaggcagccccaggcuuugcagaaaccacacacacuguugcuggaucuugaguccc

SEQ ID NO: 212965 - RNA, 64 nt, Human
gucaaugggccaauccucucuguccuuucagacacacacacaccuguguccaccccuucuguuc

SEQ ID NO: 212966 - RNA, 64 nt, Human
augucaaugggccaauccucucuguccuuucagacacacacacaccuguguccaccccuucugu

SEQ ID NO: 212967 - RNA, 64 nt, Human
agaagucaagagcuagccuugagacugugcuauacacacacagcugagagccaagcccaguucu

SEQ ID NO: 212968 - RNA, 64 nt, Human
acaagauauauacuucaucucaaaagaaucuacucacacacacuuauuaauuacaaaaggaaaa

SEQ ID NO: 212969 - RNA, 64 nt, Human
uuggggaugauucagucuguaccagacaugacaacacacacacuggaaugaaaugugcaaacau

SEQ ID NO: 212970 - RNA, 64 nt, Human
guucacccucccggguggcucacacacucucauucacacacacaaaucucaggaacaaacgguc

SEQ ID NO: 212971 - RNA, 64 nt, Human
ucacccucccggguggcucacacacucucauucacacacacaaaucucaggaacaaacgguccc

SEQ ID NO: 212972 - RNA, 64 nt, Human
uguggagugugcuguguacacaucugcuuuguuccacacacaugcaguuccugcuugggugcuu

SEQ ID NO: 212973 - RNA, 64 nt, Human
acccagagacagcacauacgugugcacacgcaugcacacacacauucaguauuuuaaaagaaug

SEQ ID NO: 212974 - RNA, 64 nt, Human
ccagagacagcacauacgugugcacacgcaugcacacacacauucaguauuuuaaaagaauguu

SEQ ID NO: 212975 - RNA, 64 nt, Human
ccuucuccaucucacccucccucucucacacauacacacacaaacacauacacacaacacuaag

SEQ ID NO: 212976 - RNA, 64 nt, Human
agugaagauaugcgugcacgcacagacagacagacacacacacacacacacacacacacacaca

SEQ ID NO: 212977 - RNA, 64 nt, Human
ugaagauaugcgugcacgcacagacagacagacacacacacacacacacacacacacacacaca

SEQ ID NO: 212978 - RNA, 64 nt, Human
aagauaugcgugcacgcacagacagacagacacacacacacacacacacacacacacacacaca

SEQ ID NO: 212979 - RNA, 64 nt, Human
gauaugcgugcacgcacagacagacagacacacacacacacacacacacacacacacacacaca

SEQ ID NO: 212980 - RNA, 64 nt, Human
uaugcgugcacgcacagacagacagacacacacacacacacacacacacacacacacacacaca

SEQ ID NO: 212981 - RNA, 64 nt, Human
ugcgugcacgcacagacagacagacacacacacacacacacacacacacacacacacacacaca

SEQ ID NO: 212982 - RNA, 64 nt, Human
cgugcacgcacagacagacagacacacacacacacacacacacacacacacacacacacacaca

SEQ ID NO: 212983 - RNA, 64 nt, Human
ugcacgcacagacagacagacacacacacacacacacacacacacacacacacacacacacaca

SEQ ID NO: 212984 - RNA, 64 nt, Human
cacgcacagacagacagacacacacacacacacacacacacacacacacacacacacacacagu

SEQ ID NO: 212985 - RNA, 64 nt, Human
cgcacagacagacagacacacacacacacacacacacacacacacacacacacacacacaguca

SEQ ID NO: 212986 - RNA, 64 nt, Human
cacagacagacagacacacacacacacacacacacacacacacacacacacacacacagucaaa

SEQ ID NO: 212987 - RNA, 64 nt, Human
cagacagacagacacacacacacacacacacacacacacacacacacacacacacagucaaaua

SEQ ID NO: 212988 - RNA, 64 nt, Human
gacagacagacacacacacacacacacacacacacacacacacacacacacacagucaaauacu

SEQ ID NO: 212989 - RNA, 64 nt, Human
cagacagacacacacacacacacacacacacacacacacacacacacacacagucaaauacugu

SEQ ID NO: 212990 - RNA, 64 nt, Human
gacagacacacacacacacacacacacacacacacacacacacacacacagucaaauacuguuc

SEQ ID NO: 212991 - RNA, 64 nt, Human
cagacacacacacacacacacacacacacacacacacacacacacacagucaaauacuguucuc

SEQ ID NO: 212992 - RNA, 64 nt, Human
gacacacacacacacacacacacacacacacacacacacacacacagucaaauacuguucucug

SEQ ID NO: 212993 - RNA, 64 nt, Human
cacacacacacacacacacacacacacacacacacacacacacagucaaauacuguucucugaa

SEQ ID NO: 212994 - RNA, 64 nt, Human
cacacacacacacacacacacacacacacacacacacacacagucaaauacuguucucugaaaa

SEQ ID NO: 212995 - RNA, 64 nt, Human
uacccacuuagucauguaagugcauauacacauacacacacaugaguguagacauguguuuauu

SEQ ID NO: 212996 - RNA, 64 nt, Human
aacuuuccaugacaguagcauacugaugagacaacacacacacacacaaaacaacagcaacaac

SEQ ID NO: 212997 - RNA, 64 nt, Human
cuuuccaugacaguagcauacugaugagacaacacacacacacacaaaacaacagcaacaacaa

SEQ ID NO: 212998 - RNA, 64 nt, Human
uuccaugacaguagcauacugaugagacaacacacacacacacaaaacaacagcaacaacaaca

SEQ ID NO: 212999 - RNA, 64 nt, Human
ccaugacaguagcauacugaugagacaacacacacacacacaaaacaacagcaacaacaacaga

SEQ ID NO: 213000 - RNA, 64 nt, Human
gcgacaggaguauuuuuuuuuuuuuacagcuuuacacacacagaugugggcuuugauuuccaag

SEQ ID NO: 213001 - RNA, 64 nt, Human
gucaucuuguucuguguccuuuuaucucucagaccacacacaucuggaacgcugugggcaucuu

SEQ ID NO: 213002 - RNA, 64 nt, Human
gacaugcguccccucccuccccccgccaagugcucacacacaaccucacgcgcacacacacaca

SEQ ID NO: 213003 - RNA, 64 nt, Human
ccccccgccaagugcucacacacaaccucacgcgcacacacacacacgcagauggaggcgccuc

SEQ ID NO: 213004 - RNA, 64 nt, Human
ccccgccaagugcucacacacaaccucacgcgcacacacacacacgcagauggaggcgccucac

SEQ ID NO: 213005 - RNA, 64 nt, Human
ccgccaagugcucacacacaaccucacgcgcacacacacacacgcagauggaggcgccucacug

SEQ ID NO: 213006 - RNA, 64 nt, Human
gcuucuccggaucaguacaugcaugucacauuaacacacacacacacacacauauacacacaca

SEQ ID NO: 213007 - RNA, 64 nt, Human
uucuccggaucaguacaugcaugucacauuaacacacacacacacacacauauacacacacaca

SEQ ID NO: 213008 - RNA, 64 nt, Human
cuccggaucaguacaugcaugucacauuaacacacacacacacacacauauacacacacacaca

SEQ ID NO: 213009 - RNA, 64 nt, Human
ccggaucaguacaugcaugucacauuaacacacacacacacacacauauacacacacacacaag

SEQ ID NO: 213010 - RNA, 64 nt, Human
ggaucaguacaugcaugucacauuaacacacacacacacacacauauacacacacacacaagcu

SEQ ID NO: 213011 - RNA, 64 nt, Human
aucaguacaugcaugucacauuaacacacacacacacacacauauacacacacacacaagcucg

SEQ ID NO: 213012 - RNA, 64 nt, Human
augucacauuaacacacacacacacacacauauacacacacacacaagcucgaucagugugugu

SEQ ID NO: 213013 - RNA, 64 nt, Human
gucacauuaacacacacacacacacacauauacacacacacacaagcucgaucaguguguguag

SEQ ID NO: 213014 - RNA, 64 nt, Human
cacauuaacacacacacacacacacauauacacacacacacaagcucgaucaguguguguagga

SEQ ID NO: 213015 - RNA, 64 nt, Human
gaaucccagcugauucccugacaggagccgacuucacacacaggugacucucaggcauuggcuc

SEQ ID NO: 213016 - RNA, 64 nt, Human
ugaaggcaaaaacuguacuguguuucgcauuaagcacacacaucuggcccugacuucuggagau

SEQ ID NO: 213017 - RNA, 64 nt, Human
cgcaaaggugccucauagcauagccagcauucagcacacacaaaccuacugcccacauuugggc

SEQ ID NO: 213018 - RNA, 64 nt, Human
gguguccaggguccucuagcccacucccugccuacacacacagccuauaucaaacaugcacacg

SEQ ID NO: 213019 - RNA, 64 nt, Human
cuguccuuuucucucuucagcucucccugccucucacacacaauuuuacaugccccgaggagcc

SEQ ID NO: 213020 - RNA, 64 nt, Human
cucaugcaccugugcacacucacauccacccauacacacacacacacacacacacacacacaca

SEQ ID NO: 213021 - RNA, 64 nt, Human
caugcaccugugcacacucacauccacccauacacacacacacacacacacacacacacacaca

SEQ ID NO: 213022 - RNA, 64 nt, Human
ugcaccugugcacacucacauccacccauacacacacacacacacacacacacacacacacaca

SEQ ID NO: 213023 - RNA, 64 nt, Human
caccugugcacacucacauccacccauacacacacacacacacacacacacacacacacacaca

SEQ ID NO: 213024 - RNA, 64 nt, Human
ccugugcacacucacauccacccauacacacacacacacacacacacacacacacacacacacu

SEQ ID NO: 213025 - RNA, 64 nt, Human
ugugcacacucacauccacccauacacacacacacacacacacacacacacacacacacacucc

SEQ ID NO: 213026 - RNA, 64 nt, Human
ugcacacucacauccacccauacacacacacacacacacacacacacacacacacacacucccu

SEQ ID NO: 213027 - RNA, 64 nt, Human
cacacucacauccacccauacacacacacacacacacacacacacacacacacacacucccuua

SEQ ID NO: 213028 - RNA, 64 nt, Human
cacucacauccacccauacacacacacacacacacacacacacacacacacacacucccuuaca

SEQ ID NO: 213029 - RNA, 64 nt, Human
cucacauccacccauacacacacacacacacacacacacacacacacacacacucccuuacacu

SEQ ID NO: 213030 - RNA, 64 nt, Human
cacauccacccauacacacacacacacacacacacacacacacacacacacucccuuacacugu

SEQ ID NO: 213031 - RNA, 64 nt, Human
cauccacccauacacacacacacacacacacacacacacacacacacacucccuuacacuguug

SEQ ID NO: 213032 - RNA, 64 nt, Human
uccacccauacacacacacacacacacacacacacacacacacacacucccuuacacuguugua

SEQ ID NO: 213033 - RNA, 64 nt, Human
cacccauacacacacacacacacacacacacacacacacacacacucccuuacacuguuguacu

SEQ ID NO: 213034 - RNA, 64 nt, Human
cccauacacacacacacacacacacacacacacacacacacacucccuuacacuguuguacuuc

SEQ ID NO: 213035 - RNA, 64 nt, Human
uggggccccagcauccuggagcacacgcuccacgcacacacaccccagcccugucccaggggcc

SEQ ID NO: 213036 - RNA, 64 nt, Human
agcucccaccccacucaggggaccccacuccccucacacacacccccccacaaggaacccucag

SEQ ID NO: 213037 - RNA, 64 nt, Human
cucacaggucuugccuuuaaauuaccccucccugcacacacauacacagauacacacacacaaa

SEQ ID NO: 213038 - RNA, 64 nt, Human
aaauuaccccucccugcacacacauacacagauacacacacacaaauauaauguaacgaucuuu

SEQ ID NO: 213039 - RNA, 64 nt, Human
auuaccccucccugcacacacauacacagauacacacacacaaauauaauguaacgaucuuuua

SEQ ID NO: 213040 - RNA, 64 nt, Human
agcauccuggucucgggaggcuucugucauugcucacacacaguucagauuuccaccucuuuau

SEQ ID NO: 213041 - RNA, 64 nt, Human
acccuaccugcuguguuugugagaagaguaggaucacacacacaggugcaaucuugaccacacu

SEQ ID NO: 213042 - RNA, 64 nt, Human
ccuaccugcuguguuugugagaagaguaggaucacacacacaggugcaaucuugaccacacuua

SEQ ID NO: 213043 - RNA, 64 nt, Human
agggacagcacaggccacagagggcugcccccaccacacacacccccgcgucucgggagaaacc

SEQ ID NO: 213044 - RNA, 64 nt, Human
auucacacacacacacacccccacaccccacucccacacacaguuccuacugucuucaguccau

SEQ ID NO: 213045 - RNA, 64 nt, Human
ccaugcucaggccuuaggucuggccauucacacacacacacacccccacaccccacucccacac

SEQ ID NO: 213046 - RNA, 64 nt, Human
auccaugcucaggccuuaggucuggccauucacacacacacacacccccacaccccacucccac

SEQ ID NO: 213047 - RNA, 64 nt, Human
ccauccaugcucaggccuuaggucuggccauucacacacacacacacccccacaccccacuccc

SEQ ID NO: 213048 - RNA, 64 nt, Human
ucccauccaugcucaggccuuaggucuggccauucacacacacacacacccccacaccccacuc

SEQ ID NO: 213049 - RNA, 64 nt, Human
auaaacuugaacauguaacacacacacacacacacacacacaccauuuuaggaagugguucucc

SEQ ID NO: 213050 - RNA, 64 nt, Human
uaauaaacuugaacauguaacacacacacacacacacacacacaccauuuuaggaagugguucu

SEQ ID NO: 213051 - RNA, 64 nt, Human
acuaauaaacuugaacauguaacacacacacacacacacacacacaccauuuuaggaagugguu

SEQ ID NO: 213052 - RNA, 64 nt, Human
ugacuaauaaacuugaacauguaacacacacacacacacacacacacaccauuuuaggaagugg

SEQ ID NO: 213053 - RNA, 64 nt, Human
aaugacuaauaaacuugaacauguaacacacacacacacacacacacacaccauuuuaggaagu

SEQ ID NO: 213054 - RNA, 64 nt, Human
cuaaugacuaauaaacuugaacauguaacacacacacacacacacacacacaccauuuuaggaa

SEQ ID NO: 213055 - RNA, 64 nt, Human
cccuaaugacuaauaaacuugaacauguaacacacacacacacacacacacacaccauuuuagg

SEQ ID NO: 213056 - RNA, 64 nt, Human
uccccuaaugacuaauaaacuugaacauguaacacacacacacacacacacacacaccauuuua

SEQ ID NO: 213057 - RNA, 64 nt, Human
aguccccuaaugacuaauaaacuugaacauguaacacacacacacacacacacacacaccauuu

SEQ ID NO: 213058 - RNA, 64 nt, Human
ggaaugcaaauauauauauauauacacacacacacacacacauacacauacaauccauauacau

SEQ ID NO: 213059 - RNA, 64 nt, Human
ggggaaugcaaauauauauauauauacacacacacacacacacauacacauacaauccauauac

SEQ ID NO: 213060 - RNA, 64 nt, Human
uuggggaaugcaaauauauauauauauacacacacacacacacacauacacauacaauccauau

SEQ ID NO: 213061 - RNA, 64 nt, Human
auuuggggaaugcaaauauauauauauauacacacacacacacacacauacacauacaauccau

SEQ ID NO: 213062 - RNA, 64 nt, Human
aaauuuggggaaugcaaauauauauauauauacacacacacacacacacauacacauacaaucc

SEQ ID NO: 213063 - RNA, 64 nt, Human
uuaaauuuggggaaugcaaauauauauauauauacacacacacacacacacauacacauacaau

SEQ ID NO: 213064 - RNA, 64 nt, Human
cucucucucacacacacacacacacacacacacacacacacagagacacggcaccauucugccu

SEQ ID NO: 213065 - RNA, 64 nt, Human
cucucucucucacacacacacacacacacacacacacacacacagagacacggcaccauucugc

SEQ ID NO: 213066 - RNA, 64 nt, Human
cucucucucucucacacacacacacacacacacacacacacacacagagacacggcaccauucu

SEQ ID NO: 213067 - RNA, 64 nt, Human
cucucucucucucucacacacacacacacacacacacacacacacacagagacacggcaccauu

SEQ ID NO: 213068 - RNA, 64 nt, Human
cucucucucucucucucacacacacacacacacacacacacacacacacagagacacggcacca

SEQ ID NO: 213069 - RNA, 64 nt, Human
cucucucucucucucucucacacacacacacacacacacacacacacacacagagacacggcac

SEQ ID NO: 213070 - RNA, 64 nt, Human
uucucucucucucucucucucacacacacacacacacacacacacacacacacagagacacggc

SEQ ID NO: 213071 - RNA, 64 nt, Human
cuuucucucucucucucucucucacacacacacacacacacacacacacacacacagagacacg

SEQ ID NO: 213072 - RNA, 64 nt, Human
cucuuucucucucucucucucucucacacacacacacacacacacacacacacacacagagaca

SEQ ID NO: 213073 - RNA, 64 nt, Human
cacucuuucucucucucucucucucucacacacacacacacacacacacacacacacacagaga

SEQ ID NO: 213074 - RNA, 64 nt, Human
ugcacucuuucucucucucucucucucucacacacacacacacacacacacacacacacacaga

SEQ ID NO: 213075 - RNA, 64 nt, Human
ugugcacucuuucucucucucucucucucucacacacacacacacacacacacacacacacaca

SEQ ID NO: 213076 - RNA, 64 nt, Human
agugugcacucuuucucucucucucucucucucacacacacacacacacacacacacacacaca

SEQ ID NO: 213077 - RNA, 64 nt, Human
auagugugcacucuuucucucucucucucucucucacacacacacacacacacacacacacaca

SEQ ID NO: 213078 - RNA, 64 nt, Human
auuugauuuguacuuagacacacgcguuuacacacacacacauaucacaagaucuguuagaaau

SEQ ID NO: 213079 - RNA, 64 nt, Human
gaauuugauuuguacuuagacacacgcguuuacacacacacacauaucacaagaucuguuagaa

SEQ ID NO: 213080 - RNA, 64 nt, Human
gugaauuugauuuguacuuagacacacgcguuuacacacacacacauaucacaagaucuguuag

SEQ ID NO: 213081 - RNA, 64 nt, Human
cuuuguggcucaccacagccaucuguggggcaggcacacacaccucccgccagcuccaauuuug

SEQ ID NO: 213082 - RNA, 64 nt, Human
gagcagaguauguggauacccggaaacacacacacacacacaucaucauuaucaucaucaucau

SEQ ID NO: 213083 - RNA, 64 nt, Human
aagagcagaguauguggauacccggaaacacacacacacacacaucaucauuaucaucaucauc

SEQ ID NO: 213084 - RNA, 64 nt, Human
ggaagagcagaguauguggauacccggaaacacacacacacacacaucaucauuaucaucauca

SEQ ID NO: 213085 - RNA, 64 nt, Human
gaggaagagcagaguauguggauacccggaaacacacacacacacacaucaucauuaucaucau

SEQ ID NO: 213086 - RNA, 64 nt, Human
gugaggaagagcagaguauguggauacccggaaacacacacacacacacaucaucauuaucauc

SEQ ID NO: 213087 - RNA, 64 nt, Human
gauucuuguguacacacacacacacacacacacacacacacacccuaacuaguaucuucuugaa

SEQ ID NO: 213088 - RNA, 64 nt, Human
aagauucuuguguacacacacacacacacacacacacacacacacccuaacuaguaucuucuug

SEQ ID NO: 213089 - RNA, 64 nt, Human
ucaagauucuuguguacacacacacacacacacacacacacacacacccuaacuaguaucuucu

SEQ ID NO: 213090 - RNA, 64 nt, Human
gcucaagauucuuguguacacacacacacacacacacacacacacacacccuaacuaguaucuu

SEQ ID NO: 213091 - RNA, 64 nt, Human
gggcucaagauucuuguguacacacacacacacacacacacacacacacacccuaacuaguauc

SEQ ID NO: 213092 - RNA, 64 nt, Human
cugggcucaagauucuuguguacacacacacacacacacacacacacacacacccuaacuagua

SEQ ID NO: 213093 - RNA, 64 nt, Human
cucugggcucaagauucuuguguacacacacacacacacacacacacacacacacccuaacuag

SEQ ID NO: 213094 - RNA, 64 nt, Human
cucucugggcucaagauucuuguguacacacacacacacacacacacacacacacacccuaacu

SEQ ID NO: 213095 - RNA, 64 nt, Human
cacucucugggcucaagauucuuguguacacacacacacacacacacacacacacacacccuaa

SEQ ID NO: 213096 - RNA, 64 nt, Human
cacacucucugggcucaagauucuuguguacacacacacacacacacacacacacacacacccu

SEQ ID NO: 213097 - RNA, 64 nt, Human
gacacacucucugggcucaagauucuuguguacacacacacacacacacacacacacacacacc

SEQ ID NO: 213098 - RNA, 64 nt, Human
cagacacacucucugggcucaagauucuuguguacacacacacacacacacacacacacacaca

SEQ ID NO: 213099 - RNA, 64 nt, Human
uacgugcagauuaauuuauauauauauauauacacacacacauauacaguauaaauacucauuu

SEQ ID NO: 213100 - RNA, 64 nt, Human
uauacgugcagauuaauuuauauauauauauauacacacacacauauacaguauaaauacucau

SEQ ID NO: 213101 - RNA, 64 nt, Human
gagcuaagcagcaaagggccucccuugaauucaccacacacauaccagcccuucugcacacucu

SEQ ID NO: 213102 - RNA, 64 nt, Human
ggggcuucccuggugcugcagcacuuguaaaccacacacacagccucucucccuggacauacgu

SEQ ID NO: 213103 - RNA, 64 nt, Human
guggggcuucccuggugcugcagcacuuguaaaccacacacacagccucucucccuggacauac

SEQ ID NO: 213104 - RNA, 64 nt, Human
guccaugguuggguagaagaauguguaugacaaccacacacagugaagcucuuuuuucaaagua

SEQ ID NO: 213105 - RNA, 64 nt, Human
cuuaucuuugcuuugugguuccuuuaaacacacucacacacacuuggucagagaugcugugcuu

SEQ ID NO: 213106 - RNA, 64 nt, Human
uuccugccuaaagcaggcccuucggggcucgcugcacacacaucucuggcucuccaggcuucgu

SEQ ID NO: 213107 - RNA, 64 nt, Human
cacacaagugcacagagcacacugcacacaugcacacacacacgcgugcaugcacacuccucgc

SEQ ID NO: 213108 - RNA, 64 nt, Human
cacacacaagugcacagagcacacugcacacaugcacacacacacgcgugcaugcacacuccuc

SEQ ID NO: 213109 - RNA, 64 nt, Human
acagcacaugcacacaggugcacagaccacacagcacacacaagugcacagagcacacugcaca

SEQ ID NO: 213110 - RNA, 64 nt, Human
caagugcacagaccacacacagcacuaacacaugcacacacaaagugcauaggccacacagcac

SEQ ID NO: 213111 - RNA, 64 nt, Human
cacacacaguauacacauacacaagugcacagaccacacacagcacuaacacaugcacacacaa

SEQ ID NO: 213112 - RNA, 64 nt, Human
ugcacagaucacacacaugcacacacguguagcucacacacaguauacacauacacaagugcac

SEQ ID NO: 213113 - RNA, 64 nt, Human
acacaugcacgcuuacauguacacgugcacagaucacacacaugcacacacguguagcucacac

SEQ ID NO: 213114 - RNA, 64 nt, Human
uuuguuagagugcacaucccuacgugcccacuggcacacacacgugcucacauacauguccgca

SEQ ID NO: 213115 - RNA, 64 nt, Human
accaaugacagggugcccuggcuggagcugucaucacacacaccccucagcucggaggcugugg

SEQ ID NO: 213116 - RNA, 64 nt, Human
uuugagaguugagcuuuaacagccauggcaauuacacacacacacaaacauacacucacacaca

SEQ ID NO: 213117 - RNA, 64 nt, Human
ugagaguugagcuuuaacagccauggcaauuacacacacacacaaacauacacucacacacaca

SEQ ID NO: 213118 - RNA, 64 nt, Human
agaguugagcuuuaacagccauggcaauuacacacacacacaaacauacacucacacacacaau

SEQ ID NO: 213119 - RNA, 64 nt, Human
ccauggcaauuacacacacacacaaacauacacucacacacacaauuacuauguauaacauaua

SEQ ID NO: 213120 - RNA, 64 nt, Human
auggcaauuacacacacacacaaacauacacucacacacacaauuacuauguauaacauauaug

SEQ ID NO: 213121 - RNA, 64 nt, Human
auuaaagaaacuuauuacuguugucaacugaauucacacacacacaaauauaguaccauagaaa

SEQ ID NO: 213122 - RNA, 64 nt, Human
uaaagaaacuuauuacuguugucaacugaauucacacacacacaaauauaguaccauagaaaaa

SEQ ID NO: 213123 - RNA, 64 nt, Human
aagaaacuuauuacuguugucaacugaauucacacacacacaaauauaguaccauagaaaaagu

SEQ ID NO: 213124 - RNA, 64 nt, Human
gucgcccugaaggugucgcaugaagagcuugcuucacacacaacaggauucgauacuuugccaa

SEQ ID NO: 213125 - RNA, 64 nt, Human
uguucucucucucucucucucucucucucucuaucacacacacacacacacacacacacacaca

SEQ ID NO: 213126 - RNA, 64 nt, Human
uucucucucucucucucucucucucucucuaucacacacacacacacacacacacacacacaca

SEQ ID NO: 213127 - RNA, 64 nt, Human
cucucucucucucucucucucucucucuaucacacacacacacacacacacacacacacacaca

SEQ ID NO: 213128 - RNA, 64 nt, Human
cucucucucucucucucucucucucuaucacacacacacacacacacacacacacacacacaca

SEQ ID NO: 213129 - RNA, 64 nt, Human
cucucucucucucucucucucucuaucacacacacacacacacacacacacacacacacacaca

SEQ ID NO: 213130 - RNA, 64 nt, Human
cucucucucucucucucucucuaucacacacacacacacacacacacacacacacacacacaau

SEQ ID NO: 213131 - RNA, 64 nt, Human
cucucucucucucucucucuaucacacacacacacacacacacacacacacacacacacaauuu

SEQ ID NO: 213132 - RNA, 64 nt, Human
cucucucucucucucucuaucacacacacacacacacacacacacacacacacacacaauuuca

SEQ ID NO: 213133 - RNA, 64 nt, Human
cucucucucucucucuaucacacacacacacacacacacacacacacacacacacaauuucauu

SEQ ID NO: 213134 - RNA, 64 nt, Human
cucucucucucucuaucacacacacacacacacacacacacacacacacacacaauuucauuca

SEQ ID NO: 213135 - RNA, 64 nt, Human
cucucucucucuaucacacacacacacacacacacacacacacacacacacaauuucauucaua

SEQ ID NO: 213136 - RNA, 64 nt, Human
cucucucucuaucacacacacacacacacacacacacacacacacacacaauuucauucauaua

SEQ ID NO: 213137 - RNA, 64 nt, Human
cucucucuaucacacacacacacacacacacacacacacacacacacaauuucauucauauaug

SEQ ID NO: 213138 - RNA, 64 nt, Human
cucucuaucacacacacacacacacacacacacacacacacacacaauuucauucauauauggu

SEQ ID NO: 213139 - RNA, 64 nt, Human
cucuaucacacacacacacacacacacacacacacacacacacaauuucauucauauaugguau

SEQ ID NO: 213140 - RNA, 64 nt, Human
cuaucacacacacacacacacacacacacacacacacacacaauuucauucauauaugguauug

SEQ ID NO: 213141 - RNA, 64 nt, Human
uuugagauucucaaaggagcgagcaugucguggacacacacagacuauuuuuagauuuucuuuu

SEQ ID NO: 213142 - RNA, 64 nt, Human
aauuaaaagaacaacacccuagagagaagucauccacacacaauccacacacgcauagcaaacc

SEQ ID NO: 213143 - RNA, 64 nt, Human
acccauccucccugcucacagagggcacuguggucacacacagugccuccucugccaguuccuu

SEQ ID NO: 213144 - RNA, 64 nt, Human
augagacugggaaagaacggggcacucaaagagccacacacaucugggccugggcgacguggau

SEQ ID NO: 213145 - RNA, 64 nt, Human
cuaauaggaccucaaaauaagccaugcugcuuugcacacacacuagccuucuuuuguacuuuuc

SEQ ID NO: 213146 - RNA, 64 nt, Human
ggugcuauuccuaagguuaacuuugaauaugugacacacacacuccuaaguaccuuuaaggaaa

SEQ ID NO: 213147 - RNA, 64 nt, Human
cagucuauuacuugggugaguccuuguggacaaccacacacacgugcccacaugguacuagcug

SEQ ID NO: 213148 - RNA, 64 nt, Human
guccuucccacaccuuuguuuaggagucaucauucacacacacacacacacacacacacacaca

SEQ ID NO: 213149 - RNA, 64 nt, Human
ccuucccacaccuuuguuuaggagucaucauucacacacacacacacacacacacacacacaca

SEQ ID NO: 213150 - RNA, 64 nt, Human
uucccacaccuuuguuuaggagucaucauucacacacacacacacacacacacacacacacaca

SEQ ID NO: 213151 - RNA, 64 nt, Human
cccacaccuuuguuuaggagucaucauucacacacacacacacacacacacacacacacacaca

SEQ ID NO: 213152 - RNA, 64 nt, Human
cacaccuuuguuuaggagucaucauucacacacacacacacacacacacacacacacacacaca

SEQ ID NO: 213153 - RNA, 64 nt, Human
caccuuuguuuaggagucaucauucacacacacacacacacacacacacacacacacacacaca

SEQ ID NO: 213154 - RNA, 64 nt, Human
ccuuuguuuaggagucaucauucacacacacacacacacacacacacacacacacacacacaca

SEQ ID NO: 213155 - RNA, 64 nt, Human
uuuguuuaggagucaucauucacacacacacacacacacacacacacacacacacacacacaca

SEQ ID NO: 213156 - RNA, 64 nt, Human
uguuuaggagucaucauucacacacacacacacacacacacacacacacacacacacacacacu

SEQ ID NO: 213157 - RNA, 64 nt, Human
uuuaggagucaucauucacacacacacacacacacacacacacacacacacacacacacacucu

SEQ ID NO: 213158 - RNA, 64 nt, Human
uaggagucaucauucacacacacacacacacacacacacacacacacacacacacacacucucu

SEQ ID NO: 213159 - RNA, 64 nt, Human
ggagucaucauucacacacacacacacacacacacacacacacacacacacacacacucucuga

SEQ ID NO: 213160 - RNA, 64 nt, Human
agucaucauucacacacacacacacacacacacacacacacacacacacacacacucucugagc

SEQ ID NO: 213161 - RNA, 64 nt, Human
ucaucauucacacacacacacacacacacacacacacacacacacacacacacucucugagcac

SEQ ID NO: 213162 - RNA, 64 nt, Human
aucauucacacacacacacacacacacacacacacacacacacacacacacucucugagcacau

SEQ ID NO: 213163 - RNA, 64 nt, Human
cauucacacacacacacacacacacacacacacacacacacacacacacucucugagcacauua

SEQ ID NO: 213164 - RNA, 64 nt, Human
uucacacacacacacacacacacacacacacacacacacacacucugagcacauuaucugugau

SEQ ID NO: 213165 - RNA, 64 nt, Human
ugccgaaguccagcuuucugcagacuggcagucgcacacacauuuggaaugcacacagcggcug

SEQ ID NO: 213166 - RNA, 64 nt, Human
aagccuccauuaaagccacagcagugcuacccaccacacacaccuugcuggcccggccaccacu

SEQ ID NO: 213167 - RNA, 64 nt, Human
uaaauauuuacggauagauugcuagguagauagacacacacacaugcacacacacacaucugga

SEQ ID NO: 213168 - RNA, 64 nt, Human
aauauuuacggauagauugcuagguagauagacacacacacaugcacacacacacaucuggaga

SEQ ID NO: 213169 - RNA, 64 nt, Human
gauagauugcuagguagauagacacacacacaugcacacacacacaucuggagauggcaaaauc

SEQ ID NO: 213170 - RNA, 64 nt, Human
uagauugcuagguagauagacacacacacaugcacacacacacaucuggagauggcaaaauccu

SEQ ID NO: 213171 - RNA, 64 nt, Human
gauugcuagguagauagacacacacacaugcacacacacacaucuggagauggcaaaauccucu

SEQ ID NO: 213172 - RNA, 64 nt, Human
aacuggggccugcguggaaggccuccgcucccugcacacacacggacaggaauuuccgugacug

SEQ ID NO: 213173 - RNA, 64 nt, Human
ggaaggaacuacaagagagucggagaugaugcagcacacacacaauuccccagcccagugaugc

SEQ ID NO: 213174 - RNA, 64 nt, Human
aaggaacuacaagagagucggagaugaugcagcacacacacaauuccccagcccagugaugcuu

SEQ ID NO: 213175 - RNA, 64 nt, Human
aaaaaagcagcagacaacacacuguagagucuugcacacacacaagugcccaggcaaggugcuu

SEQ ID NO: 213176 - RNA, 64 nt, Human
aaaagcagcagacaacacacuguagagucuugcacacacacaagugcccaggcaaggugcuugg

SEQ ID NO: 213177 - RNA, 64 nt, Human
guucagcugccucugcacccccucccacccccagcacacacacaaguuggcccccagcugcgcc

SEQ ID NO: 213178 - RNA, 64 nt, Human
ucagcugccucugcacccccucccacccccagcacacacacaaguuggcccccagcugcgccug

SEQ ID NO: 213179 - RNA, 64 nt, Human
ccucugcccgccccugcugccccaccaccuucugcacacacagcgguggggaggcggggaggag

SEQ ID NO: 213180 - RNA, 64 nt, Human
cagcaaaucacuucucucccugcgcucacacagacacacacacacacacguacaugcacacauu

SEQ ID NO: 213181 - RNA, 64 nt, Human
gcaaaucacuucucucccugcgcucacacagacacacacacacacacguacaugcacacauuuu

SEQ ID NO: 213182 - RNA, 64 nt, Human
aaaucacuucucucccugcgcucacacagacacacacacacacacguacaugcacacauuuuuc

SEQ ID NO: 213183 - RNA, 64 nt, Human
aucacuucucucccugcgcucacacagacacacacacacacacguacaugcacacauuuuuccu

SEQ ID NO: 213184 - RNA, 64 nt, Human
uugggcuuggcccucucugccugagagagcucagcacacacacagcucagacccacggacagga

SEQ ID NO: 213185 - RNA, 64 nt, Human
gggcuuggcccucucugccugagagagcucagcacacacacagcucagacccacggacaggacc

SEQ ID NO: 213186 - RNA, 64 nt, Human
acccucugugggccacacgugcacuugcacccaccacacacacacacacacacacacacacaca

SEQ ID NO: 213187 - RNA, 64 nt, Human
ccucugugggccacacgugcacuugcacccaccacacacacacacacacacacacacacacaca

SEQ ID NO: 213188 - RNA, 64 nt, Human
ucugugggccacacgugcacuugcacccaccacacacacacacacacacacacacacacacaca

SEQ ID NO: 213189 - RNA, 64 nt, Human
ugugggccacacgugcacuugcacccaccacacacacacacacacacacacacacacacacaga

SEQ ID NO: 213190 - RNA, 64 nt, Human
ugggccacacgugcacuugcacccaccacacacacacacacacacacacacacacacacagaca

SEQ ID NO: 213191 - RNA, 64 nt, Human
ggccacacgugcacuugcacccaccacacacacacacacacacacacacacacacacagacaca

SEQ ID NO: 213192 - RNA, 64 nt, Human
ccacacgugcacuugcacccaccacacacacacacacacacacacacacacacacagacacaca

SEQ ID NO: 213193 - RNA, 64 nt, Human
acacgugcacuugcacccaccacacacacacacacacacacacacacacacacagacacacaga

SEQ ID NO: 213194 - RNA, 64 nt, Human
acgugcacuugcacccaccacacacacacacacacacacacacacacacacagacacacagaca

SEQ ID NO: 213195 - RNA, 64 nt, Human
gugcacuugcacccaccacacacacacacacacacacacacacacacacagacacacagacaca

SEQ ID NO: 213196 - RNA, 64 nt, Human
gcacuugcacccaccacacacacacacacacacacacacacacacacagacacacagacacaua

SEQ ID NO: 213197 - RNA, 64 nt, Human
acuugcacccaccacacacacacacacacacacacacacacacacagacacacagacacauacg

SEQ ID NO: 213198 - RNA, 64 nt, Human
uugcacccaccacacacacacacacacacacacacacacacacagacacacagacacauacgca

SEQ ID NO: 213199 - RNA, 64 nt, Human
gcacccaccacacacacacacacacacacacacacacacacagacacacagacacauacgcaca

SEQ ID NO: 213200 - RNA, 64 nt, Human
uacgcacacacgugcacacauguacacacggauacacacacacacacacacacugcauaucuga

SEQ ID NO: 213201 - RNA, 64 nt, Human
cgcacacacgugcacacauguacacacggauacacacacacacacacacacugcauaucugagc

SEQ ID NO: 213202 - RNA, 64 nt, Human
cacacacgugcacacauguacacacggauacacacacacacacacacacugcauaucugagcgc

SEQ ID NO: 213203 - RNA, 64 nt, Human
cacacgugcacacauguacacacggauacacacacacacacacacacugcauaucugagcgcgc

SEQ ID NO: 213204 - RNA, 64 nt, Human
cacgugcacacauguacacacggauacacacacacacacacacacugcauaucugagcgcgccc

SEQ ID NO: 213205 - RNA, 64 nt, Human
cgugcacacauguacacacggauacacacacacacacacacacugcauaucugagcgcgccccu

SEQ ID NO: 213206 - RNA, 57 nt, Human
agaugggacagagaccuugaugauauucacacacauucaggaaccuguuuugaugua

SEQ ID NO: 213207 - RNA, 64 nt, Human
ggucccauuucucugcagcacuggccccuuggugcacacacauucccuucgugggcccugucuu

SEQ ID NO: 213208 - RNA, 64 nt, Human
gccuggggcugcugaugagcuuuuuggugcucuccacacacaagcucgcaaacacacauguccc

SEQ ID NO: 213209 - RNA, 64 nt, Human
cauauauauauauauauauauauauauguguauacacacacacauagacagacauauauauaua

SEQ ID NO: 213210 - RNA, 64 nt, Human
uauauauauauauauauauauauauguguauacacacacacauagacagacauauauauauaua

SEQ ID NO: 213211 - RNA, 64 nt, Human
cguuauugugaagucuuucguagacaccccagagcacacacauccccuuaguccaccgguuaga

SEQ ID NO: 213212 - RNA, 64 nt, Human
uauauacauacaucuaucuacaucugccuguguacacacacaacuuuuuauacuaguaauuuau

SEQ ID NO: 213213 - RNA, 64 nt, Human
gcuugcuuucuuccuccuuacccuaccccccacucacacacacacacacacacacacacacaca

SEQ ID NO: 213214 - RNA, 64 nt, Human
uugcuuucuuccuccuuacccuaccccccacucacacacacacacacacacacacacacacaca

SEQ ID NO: 213215 - RNA, 64 nt, Human
gcuuucuuccuccuuacccuaccccccacucacacacacacacacacacacacacacacacaca

SEQ ID NO: 213216 - RNA, 64 nt, Human
uuucuuccuccuuacccuaccccccacucacacacacacacacacacacacacacacacacaca

SEQ ID NO: 213217 - RNA, 64 nt, Human
ucuuccuccuuacccuaccccccacucacacacacacacacacacacacacacacacacacaca

SEQ ID NO: 213218 - RNA, 64 nt, Human
uuccuccuuacccuaccccccacucacacacacacacacacacacacacacacacacacacaca

SEQ ID NO: 213219 - RNA, 64 nt, Human
ccuccuuacccuaccccccacucacacacacacacacacacacacacacacacacacacacaca

SEQ ID NO: 213220 - RNA, 64 nt, Human
uccuuacccuaccccccacucacacacacacacacacacacacacacacacacacacacacacu

SEQ ID NO: 213221 - RNA, 64 nt, Human
cuuacccuaccccccacucacacacacacacacacacacacacacacacacacacacacacuuu

SEQ ID NO: 213222 - RNA, 64 nt, Human
uacccuaccccccacucacacacacacacacacacacacacacacacacacacacacacuuucu

SEQ ID NO: 213223 - RNA, 64 nt, Human
cccuaccccccacucacacacacacacacacacacacacacacacacacacacacacuuucuau

SEQ ID NO: 213224 - RNA, 64 nt, Human
cuaccccccacucacacacacacacacacacacacacacacacacacacacacacuuucuauaa

SEQ ID NO: 213225 - RNA, 64 nt, Human
accccccacucacacacacacacacacacacacacacacacacacacacacacuuucuauaaaa

SEQ ID NO: 213226 - RNA, 64 nt, Human
cccccacucacacacacacacacacacacacacacacacacacacacacacuuucuauaaaacu

SEQ ID NO: 213227 - RNA, 64 nt, Human
cccacucacacacacacacacacacacacacacacacacacacacacacuuucuauaaaacuug

SEQ ID NO: 213228 - RNA, 64 nt, Human
cacucacacacacacacacacacacacacacacacacacacacacacuuucuauaaaacuugaa

SEQ ID NO: 213229 - RNA, 64 nt, Human
cucacacacacacacacacacacacacacacacacacacacacacuuucuauaaaacuugaaaa

SEQ ID NO: 213230 - RNA, 64 nt, Human
cacacacacacacacacacacacacacacacacacacacacacuuucuauaaaacuugaaaaua

SEQ ID NO: 213231 - RNA, 64 nt, Human
gaccacuucucugugucaucacacauacccacuucacacacacacaucccaaauaccaccacca

SEQ ID NO: 213232 - RNA, 64 nt, Human
ccacuucucugugucaucacacauacccacuucacacacacacaucccaaauaccaccaccaac

SEQ ID NO: 213233 - RNA, 64 nt, Human
acuucucugugucaucacacauacccacuucacacacacacaucccaaauaccaccaccaacca

SEQ ID NO: 213234 - RNA, 64 nt, Human
uuucuucuguccaaacaaacaaacaaaaacuaaacacacacacaaacccccagaaacccacaau

SEQ ID NO: 213235 - RNA, 64 nt, Human
ucuucuguccaaacaaacaaacaaaaacuaaacacacacacaaacccccagaaacccacaauau

SEQ ID NO: 213236 - RNA, 64 nt, Human
acguggccaguaucaucagcuccuucuuacagugcacacacacgcucccagcccagcuguagcu

SEQ ID NO: 213237 - RNA, 64 nt, Human
uuuaaaagcacgacaguggaugcuggguccauaucacacacauugcugugaacaggaaacuccu

SEQ ID NO: 213238 - RNA, 64 nt, Human
aggcacugggcugugcccacucgagcucacugcccacacacagcaugccuuugggugccaucuc

SEQ ID NO: 213239 - RNA, 64 nt, Human
guugacguuucccagaugugugcuugugaugauacacacacaugcacagguucucaaccacgug

SEQ ID NO: 213240 - RNA, 64 nt, Human
gauagacucuuucacccugcuggucccaggucggcacacacauccccauaauggcauuucuccu

SEQ ID NO: 213241 - RNA, 64 nt, Human
caugggaaagggcuuugaaggaacuacuucagugcacacacaagguacgaaccucucaggccuu

SEQ ID NO: 213242 - RNA, 64 nt, Human
aaaaaaacaaaaaaacaaaaaacaaaaaaacacacacacacaaaaaaagagaaaaaacauaaca

SEQ ID NO: 213243 - RNA, 64 nt, Human
caaaaaaaacaaaaaaacaaaaaacaaaaaaacacacacacacaaaaaaagagaaaaaacauaa

SEQ ID NO: 213244 - RNA, 64 nt, Human
aacaaaaaaaacaaaaaaacaaaaaacaaaaaaacacacacacacaaaaaaagagaaaaaacau

SEQ ID NO: 213245 - RNA, 64 nt, Human
caagaggauuuaagggaggaauguuuauaggacacacacacaaaagcucuuucuauuuauaaua

SEQ ID NO: 213246 - RNA, 64 nt, Human
cacaagaggauuuaagggaggaauguuuauaggacacacacacaaaagcucuuucuauuuauaa

SEQ ID NO: 213247 - RNA, 64 nt, Human
aggaggugacagcacuugcauggucacuugagcccacacacacgcucaaccccaaguccuuuau

SEQ ID NO: 213248 - RNA, 64 nt, Human
gccuuacauccccuucuagcccuccucccauccacacacacaggcacccacccacaccaggucg

SEQ ID NO: 213249 - RNA, 64 nt, Human
cugccuuacauccccuucuagcccuccucccauccacacacacaggcacccacccacaccaggu

SEQ ID NO: 213250 - RNA, 64 nt, Human
ccaucccuguccucaugaccccucguccaccccccacacacacuauaaggcugagggcugccag

SEQ ID NO: 213251 - RNA, 64 nt, Human
ggaugcuggaugggccugcagaaacaacacucaccacacacacuuccuucaaaagaccaaaagu

SEQ ID NO: 213252 - RNA, 64 nt, Human
uugugagaucuucagcuaccucauggugcaauaacacacacacgcuuaaccauguugauggcac

SEQ ID NO: 213253 - RNA, 64 nt, Human
uaaauucuugugaaaaaaccuguguuuuuaguuacacacacacacacacacacaccuacuuaaa

SEQ ID NO: 213254 - RNA, 64 nt, Human
aauucuugugaaaaaaccuguguuuuuaguuacacacacacacacacacacaccuacuuaaaug

SEQ ID NO: 213255 - RNA, 64 nt, Human
uucuugugaaaaaaccuguguuuuuaguuacacacacacacacacacacaccuacuuaaaugga

SEQ ID NO: 213256 - RNA, 64 nt, Human
cuugugaaaaaaccuguguuuuuaguuacacacacacacacacacacaccuacuuaaauggaau

SEQ ID NO: 213257 - RNA, 64 nt, Human
ugugaaaaaaccuguguuuuuaguuacacacacacacacacacacaccuacuuaaauggaaucu

SEQ ID NO: 213258 - RNA, 64 nt, Human
ugaaaaaaccuguguuuuuaguuacacacacacacacacacacaccuacuuaaauggaaucuaa

SEQ ID NO: 213259 - RNA, 64 nt, Human
aaaaaaccuguguuuuuaguuacacacacacacacacacacaccuacuuaaauggaaucuaaac

SEQ ID NO: 213260 - RNA, 64 nt, Human
ugcucuucaucauauauauaguuaugcauacauacacacacacacauacaguauauucuuuccu

SEQ ID NO: 213261 - RNA, 64 nt, Human
cucuucaucauauauauaguuaugcauacauacacacacacacauacaguauauucuuuccuca

SEQ ID NO: 213262 - RNA, 64 nt, Human
cuucaucauauauauaguuaugcauacauacacacacacacauacaguauauucuuuccucaaa

SEQ ID NO: 213263 - RNA, 64 nt, Human
ucugaagggcauacaaugaaaagugaaggggaaacacacacacacaaaaaaacaaguauuuggc

SEQ ID NO: 213264 - RNA, 64 nt, Human
ugaagggcauacaaugaaaagugaaggggaaacacacacacacaaaaaaacaaguauuuggcuu

SEQ ID NO: 213265 - RNA, 64 nt, Human
aagggcauacaaugaaaagugaaggggaaacacacacacacaaaaaaacaaguauuuggcuugu

SEQ ID NO: 213266 - RNA, 64 nt, Human
cuuaccaaagcagacgcgugcgcgugcacagaugcacacacacagaugucuuaaaagacuagaa

SEQ ID NO: 213267 - RNA, 64 nt, Human
uaccaaagcagacgcgugcgcgugcacagaugcacacacacagaugucuuaaaagacuagaauc

SEQ ID NO: 213268 - RNA, 64 nt, Human
aauacauuuaugaaccaaugcgacuggacuuagccacacacaauggaaauucagaccuugacua

SEQ ID NO: 213269 - RNA, 64 nt, Human
uuugacuaauucugguacugaaaaguuagcuauacacacacacacacacacacacacacacaca

SEQ ID NO: 213270 - RNA, 64 nt, Human
ugacuaauucugguacugaaaaguuagcuauacacacacacacacacacacacacacacacaca

SEQ ID NO: 213271 - RNA, 64 nt, Human
acuaauucugguacugaaaaguuagcuauacacacacacacacacacacacacacacacacaca

SEQ ID NO: 213272 - RNA, 64 nt, Human
uaauucugguacugaaaaguuagcuauacacacacacacacacacacacacacacacacacaca

SEQ ID NO: 213273 - RNA, 64 nt, Human
auucugguacugaaaaguuagcuauacacacacacacacacacacacacacacacacacacaca

SEQ ID NO: 213274 - RNA, 64 nt, Human
ucugguacugaaaaguuagcuauacacacacacacacacacacacacacacacacacacacaca

SEQ ID NO: 213275 - RNA, 64 nt, Human
ugguacugaaaaguuagcuauacacacacacacacacacacacacacacacacacacacacaca

SEQ ID NO: 213276 - RNA, 64 nt, Human
gcuauacacacacacacacacacacacacacacacacacacacacacacacacacacacacaca

SEQ ID NO: 213277 - RNA, 64 nt, Human
uauacacacacacacacacacacacacacacacacacacacacacacacacacacacacacaaa

SEQ ID NO: 213278 - RNA, 64 nt, Human
uacacacacacacacacacacacacacacacacacacacacacacacacacacacacacaaacu

SEQ ID NO: 213279 - RNA, 64 nt, Human
cacacacacacacacacacacacacacacacacacacacacacacacacacacacacaaacuuc

SEQ ID NO: 213280 - RNA, 64 nt, Human
cacacacacacacacacacacacacacacacacacacacacacacacacacacacaaacuucaa

SEQ ID NO: 213281 - RNA, 64 nt, Human
cacacacacacacacacacacacacacacacacacacacacacacacacacacaaacuucaaaa

SEQ ID NO: 213282 - RNA, 64 nt, Human
cacacacacacacacacacacacacacacacacacacacacacacacacacaaacuucaaaaau

SEQ ID NO: 213283 - RNA, 64 nt, Human
cacacacacacacacacacacacacacacacacacacacacacacacacaaacuucaaaaaugc

SEQ ID NO: 213284 - RNA, 64 nt, Human
cacacacacacacacacacacacacacacacacacacacacacacacaaacuucaaaaaugcuu

SEQ ID NO: 213285 - RNA, 64 nt, Human
cacacacacacacacacacacacacacacacacacacacacacacaaacuucaaaaaugcuuaa

SEQ ID NO: 213286 - RNA, 64 nt, Human
cacacacacacacacacacacacacacacacacacacacacacaaacuucaaaaaugcuuaacc

SEQ ID NO: 213287 - RNA, 64 nt, Human
cacacacacacacacacacacacacacacacacacacacacaaacuucaaaaaugcuuaaccau

SEQ ID NO: 213288 - RNA, 64 nt, Human
uaugggugugugugagugugaguguguguguacgcacacacacuggggauagauaagcuaccug

SEQ ID NO: 213289 - RNA, 64 nt, Human
aaugaaacuuugccacaaccagccuuugcuguagcacacacauauaucacugaaccuguuugaa

SEQ ID NO: 213290 - RNA, 64 nt, Human
uuaaauaacacccaccccuuauuuuccguaaauacacacacaaaauggaucgcaucugugugac

SEQ ID NO: 213291 - RNA, 64 nt, Human
aguguuuaauuuccgauuuuuuccucugcauuuacacacacaccacacacgcacacacacacac

SEQ ID NO: 213292 - RNA, 64 nt, Human
uuuuuccucugcauuuacacacacaccacacacgcacacacacacaccaaguaccaguauaagc

SEQ ID NO: 213293 - RNA, 64 nt, Human
uuuccucugcauuuacacacacaccacacacgcacacacacacaccaaguaccaguauaagcau

SEQ ID NO: 213294 - RNA, 64 nt, Human
uccucugcauuuacacacacaccacacacgcacacacacacaccaaguaccaguauaagcaucu

SEQ ID NO: 213295 - RNA, 64 nt, Human
aguguuuaauuucagacuuuuuccucugcauuuacacacacacacacacacacacgcacacaca

SEQ ID NO: 213296 - RNA, 64 nt, Human
uguuuaauuucagacuuuuuccucugcauuuacacacacacacacacacacacgcacacacaca

SEQ ID NO: 213297 - RNA, 64 nt, Human
uuuaauuucagacuuuuuccucugcauuuacacacacacacacacacacacgcacacacacaca

SEQ ID NO: 213298 - RNA, 64 nt, Human
uaauuucagacuuuuuccucugcauuuacacacacacacacacacacacgcacacacacacacc

SEQ ID NO: 213299 - RNA, 64 nt, Human
auuucagacuuuuuccucugcauuuacacacacacacacacacacacgcacacacacacaccaa

SEQ ID NO: 213300 - RNA, 64 nt, Human
uucagacuuuuuccucugcauuuacacacacacacacacacacacgcacacacacacaccaagu

SEQ ID NO: 213301 - RNA, 64 nt, Human
cagacuuuuuccucugcauuuacacacacacacacacacacacgcacacacacacaccaaguac

SEQ ID NO: 213302 - RNA, 64 nt, Human
ccucugcauuuacacacacacacacacacacacgcacacacacacaccaaguaccaguauaagc

SEQ ID NO: 213303 - RNA, 64 nt, Human
ucugcauuuacacacacacacacacacacacgcacacacacacaccaaguaccaguauaagcau

SEQ ID NO: 213304 - RNA, 64 nt, Human
ugcauuuacacacacacacacacacacacgcacacacacacaccaaguaccaguauaagcaucu

SEQ ID NO: 213305 - RNA, 64 nt, Human
ugacccccuccauccuugacccccaacaccucaacacacacacacacacacacacacaaaauca

SEQ ID NO: 213306 - RNA, 64 nt, Human
acccccuccauccuugacccccaacaccucaacacacacacacacacacacacacaaaaucaca

SEQ ID NO: 213307 - RNA, 64 nt, Human
ccccuccauccuugacccccaacaccucaacacacacacacacacacacacacaaaaucacacc

SEQ ID NO: 213308 - RNA, 64 nt, Human
ccuccauccuugacccccaacaccucaacacacacacacacacacacacacaaaaucacaccau

SEQ ID NO: 213309 - RNA, 64 nt, Human
uccauccuugacccccaacaccucaacacacacacacacacacacacacaaaaucacaccauuu

SEQ ID NO: 213310 - RNA, 64 nt, Human
cauccuugacccccaacaccucaacacacacacacacacacacacacaaaaucacaccauuuuc

SEQ ID NO: 213311 - RNA, 64 nt, Human
uccuugacccccaacaccucaacacacacacacacacacacacacaaaaucacaccauuuucau

SEQ ID NO: 213312 - RNA, 64 nt, Human
cuugacccccaacaccucaacacacacacacacacacacacacaaaaucacaccauuuucaugc

SEQ ID NO: 213313 - RNA, 64 nt, Human
ugacccccaacaccucaacacacacacacacacacacacacaaaaucacaccauuuucaugccu

SEQ ID NO: 213314 - RNA, 64 nt, Human
cagacuucuuccucugcauuuacacaccacacaacacacacacacacacacacacaccaaguac

SEQ ID NO: 213315 - RNA, 64 nt, Human
gacuucuuccucugcauuuacacaccacacaacacacacacacacacacacacaccaaguacca

SEQ ID NO: 213316 - RNA, 64 nt, Human
cuucuuccucugcauuuacacaccacacaacacacacacacacacacacacaccaaguaccauu

SEQ ID NO: 213317 - RNA, 64 nt, Human
ucuuccucugcauuuacacaccacacaacacacacacacacacacacacaccaaguaccauuau

SEQ ID NO: 213318 - RNA, 64 nt, Human
uuccucugcauuuacacaccacacaacacacacacacacacacacacaccaaguaccauuauaa

SEQ ID NO: 213319 - RNA, 64 nt, Human
ccucugcauuuacacaccacacaacacacacacacacacacacacaccaaguaccauuauaagc

SEQ ID NO: 213320 - RNA, 64 nt, Human
ucugcauuuacacaccacacaacacacacacacacacacacacaccaaguaccauuauaagcau

SEQ ID NO: 213321 - RNA, 64 nt, Human
ugcauuuacacaccacacaacacacacacacacacacacacaccaaguaccauuauaagcaucu

SEQ ID NO: 213322 - RNA, 64 nt, Human
aguguuuaauuucagauuuuuuccucugcauuuacacacacacgcacacaaaccacaccacaca

SEQ ID NO: 213323 - RNA, 64 nt, Human
ucugcauuuacacacacacgcacacaaaccacaccacacacacacacacacacacacacacaca

SEQ ID NO: 213324 - RNA, 64 nt, Human
ugcauuuacacacacacgcacacaaaccacaccacacacacacacacacacacacacacacaca

SEQ ID NO: 213325 - RNA, 64 nt, Human
cauuuacacacacacgcacacaaaccacaccacacacacacacacacacacacacacacacaca

SEQ ID NO: 213326 - RNA, 64 nt, Human
uuuacacacacacgcacacaaaccacaccacacacacacacacacacacacacacacacacaca

SEQ ID NO: 213327 - RNA, 64 nt, Human
uacacacacacgcacacaaaccacaccacacacacacacacacacacacacacacacacacaca

SEQ ID NO: 213328 - RNA, 64 nt, Human
cacacacacgcacacaaaccacaccacacacacacacacacacacacacacacacacacacaca

SEQ ID NO: 213329 - RNA, 64 nt, Human
cacacacgcacacaaaccacaccacacacacacacacacacacacacacacacacacacacaca

SEQ ID NO: 213330 - RNA, 64 nt, Human
cacacgcacacaaaccacaccacacacacacacacacacacacacacacacacacacacacaca

SEQ ID NO: 213331 - RNA, 64 nt, Human
cacgcacacaaaccacaccacacacacacacacacacacacacacacacacacacacacacaca

SEQ ID NO: 213332 - RNA, 64 nt, Human
cgcacacaaaccacaccacacacacacacacacacacacacacacacacacacacacacacacc

SEQ ID NO: 213333 - RNA, 64 nt, Human
cacacaaaccacaccacacacacacacacacacacacacacacacacacacacacacacaccaa

SEQ ID NO: 213334 - RNA, 64 nt, Human
cacaaaccacaccacacacacacacacacacacacacacacacacacacacacacacaccaagu

SEQ ID NO: 213335 - RNA, 64 nt, Human
caaaccacaccacacacacacacacacacacacacacacacacacacacacacacaccaaguac

SEQ ID NO: 213336 - RNA, 64 nt, Human
aaccacaccacacacacacacacacacacacacacacacacacacacacacacaccaaguacca

SEQ ID NO: 213337 - RNA, 64 nt, Human
ccacaccacacacacacacacacacacacacacacacacacacacacacacaccaaguaccagu

SEQ ID NO: 213338 - RNA, 64 nt, Human
acaccacacacacacacacacacacacacacacacacacacacacacacaccaaguaccaguau

SEQ ID NO: 213339 - RNA, 64 nt, Human
accacacacacacacacacacacacacacacacacacacacacacacaccaaguaccaguauaa

SEQ ID NO: 213340 - RNA, 64 nt, Human
cacacacacacacacacacacacacacacacacacacacacacacaccaaguaccaguauaagc

SEQ ID NO: 213341 - RNA, 64 nt, Human
cacacacacacacacacacacacacacacacacacacacacacaccaaguaccaguauaagcau

SEQ ID NO: 213342 - RNA, 64 nt, Human
cacacacacacacacacacacacacacacacacacacacacaccaaguaccaguauaagcaucu

SEQ ID NO: 213343 - RNA, 64 nt, Human
aacucggacacuaacccccuccuaaacauucguacacacacaaacacaaaacuugcugaacaaa

SEQ ID NO: 213344 - RNA, 64 nt, Human
ucuuauuuuugauaauggcucuuaaaucuuuaaacacacacacaaaaucguucuuuacuuucau

SEQ ID NO: 213345 - RNA, 64 nt, Human
uuauuuuugauaauggcucuuaaaucuuuaaacacacacacaaaaucguucuuuacuuucauuu

SEQ ID NO: 213346 - RNA, 64 nt, Human
ucaguuuucuagcuuuuaacugauuauaacaaugcacacacauaccugacacacuguuaaauuu

SEQ ID NO: 213347 - RNA, 64 nt, Human
uguguguguguguguauauguguuuauagagauacacacacauauauauguguguauauauaua

SEQ ID NO: 213348 - RNA, 64 nt, Human
cauacauauauauacacacacgcauuugcacagacacacacauauaucaauucucaugagugua

SEQ ID NO: 213349 - RNA, 64 nt, Human
uauccuggcaaugggguagucacugccacccuuccacacacacacacacacacacacacacaaa

SEQ ID NO: 213350 - RNA, 64 nt, Human
uccuggcaaugggguagucacugccacccuuccacacacacacacacacacacacacacaaaaa

SEQ ID NO: 213351 - RNA, 64 nt, Human
cuggcaaugggguagucacugccacccuuccacacacacacacacacacacacacacaaaaaaa

SEQ ID NO: 213352 - RNA, 64 nt, Human
ggcaaugggguagucacugccacccuuccacacacacacacacacacacacacacaaaaaaaaa

SEQ ID NO: 213353 - RNA, 64 nt, Human
caaugggguagucacugccacccuuccacacacacacacacacacacacacacaaaaaaaaauc

SEQ ID NO: 213354 - RNA, 64 nt, Human
augggguagucacugccacccuuccacacacacacacacacacacacacacaaaaaaaaauccc

SEQ ID NO: 213355 - RNA, 64 nt, Human
gggguagucacugccacccuuccacacacacacacacacacacacacacaaaaaaaaaucccuu

SEQ ID NO: 213356 - RNA, 64 nt, Human
gguagucacugccacccuuccacacacacacacacacacacacacacaaaaaaaaaucccuucc

SEQ ID NO: 213357 - RNA, 64 nt, Human
uagucacugccacccuuccacacacacacacacacacacacacacaaaaaaaaaucccuuccuu

SEQ ID NO: 213358 - RNA, 64 nt, Human
gucacugccacccuuccacacacacacacacacacacacacacaaaaaaaaaucccuuccuugu

SEQ ID NO: 213359 - RNA, 64 nt, Human
cacugccacccuuccacacacacacacacacacacacacacaaaaaaaaaucccuuccuugugg

SEQ ID NO: 213360 - RNA, 64 nt, Human
gggacccugcuuuagagcuaggguggggucuggucacacacagguguugaagaaauuauaaaga

SEQ ID NO: 213361 - RNA, 64 nt, Human
caggcucccucccucccagauccaggaacacaugcacacacacacacacacacacgcagacaca

SEQ ID NO: 213362 - RNA, 64 nt, Human
ggcucccucccucccagauccaggaacacaugcacacacacacacacacacacgcagacacaca

SEQ ID NO: 213363 - RNA, 64 nt, Human
cucccucccucccagauccaggaacacaugcacacacacacacacacacacgcagacacacaca

SEQ ID NO: 213364 - RNA, 64 nt, Human
cccucccucccagauccaggaacacaugcacacacacacacacacacacgcagacacacacaca

SEQ ID NO: 213365 - RNA, 64 nt, Human
cucccucccagauccaggaacacaugcacacacacacacacacacacgcagacacacacacaca

SEQ ID NO: 213366 - RNA, 64 nt, Human
cccucccagauccaggaacacaugcacacacacacacacacacacgcagacacacacacacaca

SEQ ID NO: 213367 - RNA, 64 nt, Human
cucccagauccaggaacacaugcacacacacacacacacacacgcagacacacacacacacaca

SEQ ID NO: 213368 - RNA, 64 nt, Human
aacacaugcacacacacacacacacacacgcagacacacacacacacacacauauauguauacg

SEQ ID NO: 213369 - RNA, 64 nt, Human
cacaugcacacacacacacacacacacgcagacacacacacacacacacauauauguauacgca

SEQ ID NO: 213370 - RNA, 64 nt, Human
caugcacacacacacacacacacacgcagacacacacacacacacacauauauguauacgcacg

SEQ ID NO: 213371 - RNA, 64 nt, Human
ugcacacacacacacacacacacgcagacacacacacacacacacauauauguauacgcacgca

SEQ ID NO: 213372 - RNA, 64 nt, Human
cacacacacacacacacacacgcagacacacacacacacacacauauauguauacgcacgcacc

SEQ ID NO: 213373 - RNA, 64 nt, Human
cacacacacacacacacacgcagacacacacacacacacacauauauguauacgcacgcaccca

SEQ ID NO: 213374 - RNA, 64 nt, Human
acugcuucuugcagucaacaagaaauaccaauaacacacacagaacaaaaaccaucaaaaucuc

SEQ ID NO: 213375 - RNA, 64 nt, Human
ucucucugcaaaacuuuaguuuucugaugaucuacacacacacacacacacacacgugcacaca

SEQ ID NO: 213376 - RNA, 64 nt, Human
ucucugcaaaacuuuaguuuucugaugaucuacacacacacacacacacacacgugcacacaca

SEQ ID NO: 213377 - RNA, 64 nt, Human
ucugcaaaacuuuaguuuucugaugaucuacacacacacacacacacacacgugcacacacaca

SEQ ID NO: 213378 - RNA, 64 nt, Human
ugcaaaacuuuaguuuucugaugaucuacacacacacacacacacacacgugcacacacacaca

SEQ ID NO: 213379 - RNA, 64 nt, Human
caaaacuuuaguuuucugaugaucuacacacacacacacacacacacgugcacacacacacaca

SEQ ID NO: 213380 - RNA, 64 nt, Human
aaacuuuaguuuucugaugaucuacacacacacacacacacacacgugcacacacacacacauu

SEQ ID NO: 213381 - RNA, 64 nt, Human
acuuuaguuuucugaugaucuacacacacacacacacacacacgugcacacacacacacauuua

SEQ ID NO: 213382 - RNA, 64 nt, Human
ugaugaucuacacacacacacacacacacacgugcacacacacacacauuuaaaugauauaaaa

SEQ ID NO: 213383 - RNA, 64 nt, Human
augaucuacacacacacacacacacacacgugcacacacacacacauuuaaaugauauaaaaag

SEQ ID NO: 213384 - RNA, 64 nt, Human
gaucuacacacacacacacacacacacgugcacacacacacacauuuaaaugauauaaaaagaa

SEQ ID NO: 213385 - RNA, 64 nt, Human
ucuacacacacacacacacacacacgugcacacacacacacauuuaaaugauauaaaaagaaga

SEQ ID NO: 213386 - RNA, 64 nt, Human
cacaaauuguucaguucuuaaaauguaauuaugucacacacacaaaaaauccuuuucaauccug

SEQ ID NO: 213387 - RNA, 64 nt, Human
caaauuguucaguucuuaaaauguaauuaugucacacacacaaaaaauccuuuucaauccugag

SEQ ID NO: 213388 - RNA, 64 nt, Human
uccuauccgaucugaaaacacacauacacaaaugcacacacaugcacacacacauuuaagggac

SEQ ID NO: 213389 - RNA, 64 nt, Human
ucugaaaacacacauacacaaaugcacacacaugcacacacacauuuaagggacauagcaguaa

SEQ ID NO: 213390 - RNA, 64 nt, Human
ugaaaacacacauacacaaaugcacacacaugcacacacacauuuaagggacauagcaguaaca

SEQ ID NO: 213391 - RNA, 64 nt, Human
ugugcgcgcgcgcgcgcacgcgcacacacucacgcacacacaagcagagaaggcgcugaucuug

SEQ ID NO: 213392 - RNA, 64 nt, Human
ugaguuuguaaucuaguuacagaaguaaggcauacacacacacaaagauaacaguaccuagaga

SEQ ID NO: 213393 - RNA, 64 nt, Human
aguuuguaaucuaguuacagaaguaaggcauacacacacacaaagauaacaguaccuagagaga

SEQ ID NO: 213394 - RNA, 64 nt, Human
cugaaaaccucacaugcauacauacacauauauacacacacaaagagaguuaaucaacugaaag

SEQ ID NO: 213395 - RNA, 64 nt, Human
agauaguaaaacaggcaaagcagaaucacaugugcacacacacauacacauguaaacauuggaa

SEQ ID NO: 213396 - RNA, 64 nt, Human
auaguaaaacaggcaaagcagaaucacaugugcacacacacauacacauguaaacauuggaaug

SEQ ID NO: 213397 - RNA, 64 nt, Human
auuauauuucuuuuuagauugucuaucuguauaacacacacacacacaccuaagagucucuauu

SEQ ID NO: 213398 - RNA, 64 nt, Human
uauauuucuuuuuagauugucuaucuguauaacacacacacacacaccuaagagucucuauuuc

SEQ ID NO: 213399 - RNA, 64 nt, Human
uauuucuuuuuagauugucuaucuguauaacacacacacacacaccuaagagucucuauuucac

SEQ ID NO: 213400 - RNA, 64 nt, Human
uuucuuuuuagauugucuaucuguauaacacacacacacacaccuaagagucucuauuucacaa

SEQ ID NO: 213401 - RNA, 64 nt, Human
augagaggcauuucccccaccccauuucucuccucacacacagacucauauuacugguaggaac

SEQ ID NO: 213402 - RNA, 64 nt, Human
gcauuaauaucuaacauaaaauuguuaauuuauacacacacauacacucauacauagagagaga

SEQ ID NO: 213403 - RNA, 64 nt, Human
aaugauuauuaugauuuuggugguaacgaucccccacacacaaccacuaugaagaaauaaugcc

SEQ ID NO: 213404 - RNA, 64 nt, Human
gaaaaauucuuaaaauauauaugaauuuguguaacacacacagagacacacacacauacuacuu

SEQ ID NO: 213405 - RNA, 64 nt, Human
aaauauauaugaauuuguguaacacacacagagacacacacacauacuacuuuaagggggugag

SEQ ID NO: 213406 - RNA, 64 nt, Human
auauauaugaauuuguguaacacacacagagacacacacacauacuacuuuaagggggugagga

SEQ ID NO: 213407 - RNA, 64 nt, Human
gauucucaaucucuuugaauuuuacuuacauuuacacacacacgcacacacauauguauauaca

SEQ ID NO: 213408 - RNA, 64 nt, Human
cucuuugaauuuuacuuacauuuacacacacacgcacacacauauguauauacacauaucauuu

SEQ ID NO: 213409 - RNA, 64 nt, Human
cucaaccucuuugaauuuuacuuauaauuacauacacacacacacugcuacuuauauaaauguu

SEQ ID NO: 213410 - RNA, 64 nt, Human
caaccucuuugaauuuuacuuauaauuacauacacacacacacugcuacuuauauaaauguucu

SEQ ID NO: 213411 - RNA, 64 nt, Human
ucccccagucucucuucucaaucccccuuucuaacacacacacacacacacacacacacacaca

SEQ ID NO: 213412 - RNA, 64 nt, Human
ccccagucucucuucucaaucccccuuucuaacacacacacacacacacacacacacacacaca

SEQ ID NO: 213413 - RNA, 64 nt, Human
ccagucucucuucucaaucccccuuucuaacacacacacacacacacacacacacacacacaca

SEQ ID NO: 213414 - RNA, 64 nt, Human
agucucucuucucaaucccccuuucuaacacacacacacacacacacacacacacacacacaca

SEQ ID NO: 213415 - RNA, 64 nt, Human
ucucucuucucaaucccccuuucuaacacacacacacacacacacacacacacacacacacaca

SEQ ID NO: 213416 - RNA, 64 nt, Human
ucucuucucaaucccccuuucuaacacacacacacacacacacacacacacacacacacacaca

SEQ ID NO: 213417 - RNA, 64 nt, Human
ucuucucaaucccccuuucuaacacacacacacacacacacacacacacacacacacacacaca

SEQ ID NO: 213418 - RNA, 64 nt, Human
uucucaaucccccuuucuaacacacacacacacacacacacacacacacacacacacacacaca

SEQ ID NO: 213419 - RNA, 64 nt, Human
cucaaucccccuuucuaacacacacacacacacacacacacacacacacacacacacacacaca

SEQ ID NO: 213420 - RNA, 64 nt, Human
caaucccccuuucuaacacacacacacacacacacacacacacacacacacacacacacacaca

SEQ ID NO: 213421 - RNA, 64 nt, Human
aucccccuuucuaacacacacacacacacacacacacacacacacacacacacacacacacaca

SEQ ID NO: 213422 - RNA, 64 nt, Human
cccccuuucuaacacacacacacacacacacacacacacacacacacacacacacacacacaca

SEQ ID NO: 213423 - RNA, 64 nt, Human
cccuuucuaacacacacacacacacacacacacacacacacacacacacacacacacacacaga

SEQ ID NO: 213424 - RNA, 64 nt, Human
cuuucuaacacacacacacacacacacacacacacacacacacacacacacacacacacagagu

SEQ ID NO: 213425 - RNA, 64 nt, Human
uucuaacacacacacacacacacacacacacacacacacacacacacacacacacacagaguca

SEQ ID NO: 213426 - RNA, 64 nt, Human
cuaacacacacacacacacacacacacacacacacacacacacacacacacacacagagucagg

SEQ ID NO: 213427 - RNA, 64 nt, Human
aacacacacacacacacacacacacacacacacacacacacacacacacacacagagucaggcc

SEQ ID NO: 213428 - RNA, 64 nt, Human
cacacacacacacacacacacacacacacacacacacacacacacacacacagagucaggccgu

SEQ ID NO: 213429 - RNA, 64 nt, Human
cacacacacacacacacacacacacacacacacacacacacacacacacagagucaggccguug

SEQ ID NO: 213430 - RNA, 64 nt, Human
cacacacacacacacacacacacacacacacacacacacacacacacagagucaggccguugcu

SEQ ID NO: 213431 - RNA, 64 nt, Human
cacacacacacacacacacacacacacacacacacacacacacacagagucaggccguugcuag

SEQ ID NO: 213432 - RNA, 64 nt, Human
cacacacacacacacacacacacacacacacacacacacacacagagucaggccguugcuaguc

SEQ ID NO: 213433 - RNA, 64 nt, Human
cacacacacacacacacacacacacacacacacacacacacagagucaggccguugcuagucag

SEQ ID NO: 213434 - RNA, 64 nt, Human
cggacucacacgaagucacacgcacacaugcacgcacacacacauauggggaccugcacaccug

SEQ ID NO: 213435 - RNA, 64 nt, Human
gacucacacgaagucacacgcacacaugcacgcacacacacauauggggaccugcacaccugca

SEQ ID NO: 213436 - RNA, 64 nt, Human
ugcaugcacauauguguauguguguggaucuguacacacacacguauauauggccagaugcgua

SEQ ID NO: 213437 - RNA, 64 nt, Human
acuuugggggguggggaaggggccaagcugcagacacacacagucauucauuucuguccacacc

SEQ ID NO: 213438 - RNA, 64 nt, Human
ugugugugcuugugugugcgcacgugucggcgcucacacacacaugcuagcccacugaugcacc

SEQ ID NO: 213439 - RNA, 64 nt, Human
ugugugcuugugugugcgcacgugucggcgcucacacacacaugcuagcccacugaugcaccca

SEQ ID NO: 213440 - RNA, 64 nt, Human
aacgugugauggugugaaacccacuuuggaccaucacacacauuucagcauuugaagugacaca

SEQ ID NO: 213441 - RNA, 64 nt, Human
gaguguauuuacagcuuguuaaauuagagacaugcacacacaaagaaucaguagggagaaacaa

SEQ ID NO: 213442 - RNA, 64 nt, Human
uacguauauaaauauauauauauauacacacacacacacacauuagucauaucaccucuguuuc

SEQ ID NO: 213443 - RNA, 64 nt, Human
uguacguauauaaauauauauauauauacacacacacacacacauuagucauaucaccucuguu

SEQ ID NO: 213444 - RNA, 64 nt, Human
ucuguacguauauaaauauauauauauauacacacacacacacacauuagucauaucaccucug

SEQ ID NO: 213445 - RNA, 64 nt, Human
gcucuguacguauauaaauauauauauauauacacacacacacacacauuagucauaucaccuc

SEQ ID NO: 213446 - RNA, 64 nt, Human
gugcucuguacguauauaaauauauauauauauacacacacacacacacauuagucauaucacc

SEQ ID NO: 213447 - RNA, 64 nt, Human
ggaguaugugauaaagugaauguacauguauauacacacacaccuccauauauacaugugugua

SEQ ID NO: 213448 - RNA, 64 nt, Human
uuccccuccauuugaauauggugguuguuauaagcacacacaagauacaugguggaagaucuaa

SEQ ID NO: 213449 - RNA, 64 nt, Human
acaaaacaaacacacacacacacacauacacacacacacacaaaacuuugaggcagcgcauugu

SEQ ID NO: 213450 - RNA, 64 nt, Human
aaacaaaacaaacacacacacacacacauacacacacacacacaaaacuuugaggcagcgcauu

SEQ ID NO: 213451 - RNA, 64 nt, Human
aaaaacaaaacaaacacacacacacacacauacacacacacacacaaaacuuugaggcagcgca

SEQ ID NO: 213452 - RNA, 64 nt, Human
cuaaaaacaaaacaaacacacacacacacacauacacacacacacacaaaacuuugaggcagcg

SEQ ID NO: 213453 - RNA, 64 nt, Human
auaaaaaccccuaaaaacaaaacaaacacacacacacacacauacacacacacacacaaaacuu

SEQ ID NO: 213454 - RNA, 64 nt, Human
uuauaaaaaccccuaaaaacaaaacaaacacacacacacacacauacacacacacacacaaaac

SEQ ID NO: 213455 - RNA, 64 nt, Human
guuuauaaaaaccccuaaaaacaaaacaaacacacacacacacacauacacacacacacacaaa

SEQ ID NO: 213456 - RNA, 64 nt, Human
uuguuuauaaaaaccccuaaaaacaaaacaaacacacacacacacacauacacacacacacaca

SEQ ID NO: 213457 - RNA, 64 nt, Human
aguuguuuauaaaaaccccuaaaaacaaaacaaacacacacacacacacauacacacacacaca

SEQ ID NO: 213458 - RNA, 64 nt, Human
ucuauagauauagauauacacacauauauauacucacacacauauagcauaaaauacucagcag

SEQ ID NO: 213459 - RNA, 64 nt, Human
uccaguaguguguaauauaaauucaaaccauauccacacacaacaacuaauuguaugaaacuuu

SEQ ID NO: 213460 - RNA, 64 nt, Human
cgcgcacacacacacacacacacacacacacacacacacacaccaaguaccaguauaggcaucu

SEQ ID NO: 213461 - RNA, 64 nt, Human
cgcgcgcacacacacacacacacacacacacacacacacacacaccaaguaccaguauaggcau

SEQ ID NO: 213462 - RNA, 64 nt, Human
cgcgcgcgcacacacacacacacacacacacacacacacacacacaccaaguaccaguauaggc

SEQ ID NO: 213463 - RNA, 64 nt, Human
cgcgcgcgcgcacacacacacacacacacacacacacacacacacacaccaaguaccaguauag

SEQ ID NO: 213464 - RNA, 64 nt, Human
cgcgcgcgcgcgcacacacacacacacacacacacacacacacacacacaccaaguaccaguau

SEQ ID NO: 213465 - RNA, 64 nt, Human
ugcgcgcgcgcgcgcacacacacacacacacacacacacacacacacacacaccaaguaccagu

SEQ ID NO: 213466 - RNA, 64 nt, Human
caugcgcgcgcgcgcgcacacacacacacacacacacacacacacacacacacaccaaguacca

SEQ ID NO: 213467 - RNA, 64 nt, Human
cacaugcgcgcgcgcgcgcacacacacacacacacacacacacacacacacacacaccaaguac

SEQ ID NO: 213468 - RNA, 64 nt, Human
cacacaugcgcgcgcgcgcgcacacacacacacacacacacacacacacacacacacaccaagu

SEQ ID NO: 213469 - RNA, 64 nt, Human
gacacacaugcgcgcgcgcgcgcacacacacacacacacacacacacacacacacacacaccaa

SEQ ID NO: 213470 - RNA, 64 nt, Human
cagacacacaugcgcgcgcgcgcgcacacacacacacacacacacacacacacacacacacacc

SEQ ID NO: 213471 - RNA, 64 nt, Human
cacagacacacaugcgcgcgcgcgcgcacacacacacacacacacacacacacacacacacaca

SEQ ID NO: 213472 - RNA, 64 nt, Human
cacacagacacacaugcgcgcgcgcgcgcacacacacacacacacacacacacacacacacaca

SEQ ID NO: 213473 - RNA, 64 nt, Human
gccacacagacacacaugcgcgcgcgcgcgcacacacacacacacacacacacacacacacaca

SEQ ID NO: 213474 - RNA, 64 nt, Human
augccacacagacacacaugcgcgcgcgcgcgcacacacacacacacacacacacacacacaca

SEQ ID NO: 213475 - RNA, 64 nt, Human
acaugccacacagacacacaugcgcgcgcgcgcgcacacacacacacacacacacacacacaca

SEQ ID NO: 213476 - RNA, 64 nt, Human
auuucagauuuuuuccucugcauuuacacaaacacacacacaugccacacagacacacaugcgc

SEQ ID NO: 213477 - RNA, 64 nt, Human
uaauuucagauuuuuuccucugcauuuacacaaacacacacacaugccacacagacacacaugc

SEQ ID NO: 213478 - RNA, 64 nt, Human
uacacacacacacacacacacacacagagacacacacacacaccaaguaccaguauaagcaucu

SEQ ID NO: 213479 - RNA, 64 nt, Human
uuuacacacacacacacacacacacacagagacacacacacacaccaaguaccaguauaagcau

SEQ ID NO: 213480 - RNA, 64 nt, Human
cauuuacacacacacacacacacacacacagagacacacacacacaccaaguaccaguauaagc

SEQ ID NO: 213481 - RNA, 64 nt, Human
uuuucuccucugcauuuacacacacacacacacacacacacagagacacacacacacaccaagu

SEQ ID NO: 213482 - RNA, 64 nt, Human
gauuuucuccucugcauuuacacacacacacacacacacacacagagacacacacacacaccaa

SEQ ID NO: 213483 - RNA, 64 nt, Human
ccgauuuucuccucugcauuuacacacacacacacacacacacacagagacacacacacacacc

SEQ ID NO: 213484 - RNA, 64 nt, Human
uuccgauuuucuccucugcauuuacacacacacacacacacacacacagagacacacacacaca

SEQ ID NO: 213485 - RNA, 64 nt, Human
auuuccgauuuucuccucugcauuuacacacacacacacacacacacacagagacacacacaca

SEQ ID NO: 213486 - RNA, 64 nt, Human
uaauuuccgauuuucuccucugcauuuacacacacacacacacacacacacagagacacacaca

SEQ ID NO: 213487 - RNA, 64 nt, Human
uuuaauuuccgauuuucuccucugcauuuacacacacacacacacacacacacagagacacaca

SEQ ID NO: 213488 - RNA, 64 nt, Human
uguuuaauuuccgauuuucuccucugcauuuacacacacacacacacacacacacagagacaca

SEQ ID NO: 213489 - RNA, 64 nt, Human
aguguuuaauuuccgauuuucuccucugcauuuacacacacacacacacacacacacagagaca

SEQ ID NO: 213490 - RNA, 64 nt, Human
cacacacacaaaccacaccacacacacacacacacacacacagacacacaccaaguaccaguau

SEQ ID NO: 213491 - RNA, 64 nt, Human
cacacacacacaaaccacaccacacacacacacacacacacacagacacacaccaaguaccagu

SEQ ID NO: 213492 - RNA, 64 nt, Human
uacacacacacacaaaccacaccacacacacacacacacacacacagacacacaccaaguacca

SEQ ID NO: 213493 - RNA, 64 nt, Human
uuuacacacacacacaaaccacaccacacacacacacacacacacacagacacacaccaaguac

SEQ ID NO: 213494 - RNA, 64 nt, Human
cauuuacacacacacacaaaccacaccacacacacacacacacacacacagacacacaccaagu

SEQ ID NO: 213495 - RNA, 64 nt, Human
ugcauuuacacacacacacaaaccacaccacacacacacacacacacacacagacacacaccaa

SEQ ID NO: 213496 - RNA, 64 nt, Human
ucugcauuuacacacacacacaaaccacaccacacacacacacacacacacacagacacacacc

SEQ ID NO: 213497 - RNA, 64 nt, Human
ccucugcauuuacacacacacacaaaccacaccacacacacacacacacacacacagacacaca

SEQ ID NO: 213498 - RNA, 64 nt, Human
uuccucugcauuuacacacacacacaaaccacaccacacacacacacacacacacacagacaca

SEQ ID NO: 213499 - RNA, 64 nt, Human
uuuaauuucagauuuuuuccucugcauuuacacacacacacaaaccacaccacacacacacaca

SEQ ID NO: 213500 - RNA, 64 nt, Human
uguuuaauuucagauuuuuuccucugcauuuacacacacacacaaaccacaccacacacacaca

SEQ ID NO: 213501 - RNA, 64 nt, Human
aguguuuaauuucagauuuuuuccucugcauuuacacacacacacaaaccacaccacacacaca

SEQ ID NO: 213502 - RNA, 64 nt, Human; identical to SEQ ID NO: 213294

SEQ ID NO: 213503 - RNA, 64 nt, Human; identical to SEQ ID NO: 213293

SEQ ID NO: 213504 - RNA, 64 nt, Human; identical to SEQ ID NO: 213292

SEQ ID NO: 213505 - RNA, 64 nt, Human; identical to SEQ ID NO: 213291

SEQ ID NO: 213506 - RNA, 64 nt, Human
ggugaggcgugggauccagagagaagcaccccaccacacacacccuuccccacucccgugauga

SEQ ID NO: 213507 - RNA, 64 nt, Human
accagacacacaaacacacacacacagacacacacacacacagacacaccaaguaccaguauaa

SEQ ID NO: 213508 - RNA, 64 nt, Human
acaccagacacacaaacacacacacacagacacacacacacacagacacaccaaguaccaguau

SEQ ID NO: 213509 - RNA, 64 nt, Human
acacaccagacacacaaacacacacacacagacacacacacacacagacacaccaaguaccagu

SEQ ID NO: 213510 - RNA, 64 nt, Human
uuacacaccagacacacaaacacacacacacagacacacacacacacagacacaccaaguacca

SEQ ID NO: 213511 - RNA, 64 nt, Human
cccucugcauuuacacaccagacacacaaacacacacacacagacacacacacacacagacaca

SEQ ID NO: 213512 - RNA, 64 nt, Human
uccccucugcauuuacacaccagacacacaaacacacacacacagacacacacacacacagaca

SEQ ID NO: 213513 - RNA, 64 nt, Human
uuuccccucugcauuuacacaccagacacacaaacacacacacacagacacacacacacacaga

SEQ ID NO: 213514 - RNA, 64 nt, Human
acaacugaagacaaugcacuuuacagauaucacccacacacaccucgcuggggcaggggcaccc

SEQ ID NO: 213515 - RNA, 64 nt, Human
ggaggugcugagcugaacagggccaucuguucaucacacacacccccuuccucccccucaucac

SEQ ID NO: 213516 - RNA, 64 nt, Human
cacacagacacacacacacacacacacacacacacacacacagagagauaaggaacaaaagugu

SEQ ID NO: 213517 - RNA, 64 nt, Human
cacacacagacacacacacacacacacacacacacacacacacagagagauaaggaacaaaagu

SEQ ID NO: 213518 - RNA, 64 nt, Human
cacacacacagacacacacacacacacacacacacacacacacacagagagauaaggaacaaaa

SEQ ID NO: 213519 - RNA, 64 nt, Human
cacacacacacagacacacacacacacacacacacacacacacacacagagagauaaggaacaa

SEQ ID NO: 213520 - RNA, 64 nt, Human
cacacacacacacagacacacacacacacacacacacacacacacacacagagagauaaggaac

SEQ ID NO: 213521 - RNA, 64 nt, Human
cacacacacacacacagacacacacacacacacacacacacacacacacacagagagauaagga

SEQ ID NO: 213522 - RNA, 64 nt, Human
uacacacacacacacacagacacacacacacacacacacacacacacacacacagagagauaag

SEQ ID NO: 213523 - RNA, 64 nt, Human
cauacacacacacacacacagacacacacacacacacacacacacacacacacacagagagaua

SEQ ID NO: 213524 - RNA, 64 nt, Human
cacauacacacacacacacacagacacacacacacacacacacacacacacacacacagagaga

SEQ ID NO: 213525 - RNA, 64 nt, Human
uacacauacacacacacacacacagacacacacacacacacacacacacacacacacacagaga

SEQ ID NO: 213526 - RNA, 64 nt, Human
aguacacauacacacacacacacacagacacacacacacacacacacacacacacacacacaga

SEQ ID NO: 213527 - RNA, 64 nt, Human
ugaguacacauacacacacacacacacagacacacacacacacacacacacacacacacacaca

SEQ ID NO: 213528 - RNA, 64 nt, Human
cuugaguacacauacacacacacacacacagacacacacacacacacacacacacacacacaca

SEQ ID NO: 213529 - RNA, 64 nt, Human
cccuugaguacacauacacacacacacacacagacacacacacacacacacacacacacacaca

SEQ ID NO: 213530 - RNA, 64 nt, Human
cacacagagacccuugaguacacauacacacacacacacacagacacacacacacacacacaca

SEQ ID NO: 213531 - RNA, 64 nt, Human
cacacacagagacccuugaguacacauacacacacacacacacagacacacacacacacacaca

SEQ ID NO: 213532 - RNA, 64 nt, Human
cacacacacagagacccuugaguacacauacacacacacacacacagacacacacacacacaca

SEQ ID NO: 213533 - RNA, 64 nt, Human
cacacacacacagagacccuugaguacacauacacacacacacacacagacacacacacacaca

SEQ ID NO: 213534 - RNA, 64 nt, Human
cacacacacacacagagacccuugaguacacauacacacacacacacacagacacacacacaca

SEQ ID NO: 213535 - RNA, 64 nt, Human
ucggagaagcacuguugaaauuuauacacacacacacacacagagacccuugaguacacauaca

SEQ ID NO: 213536 - RNA, 64 nt, Human
uuucggagaagcacuguugaaauuuauacacacacacacacacagagacccuugaguacacaua

SEQ ID NO: 213537 - RNA, 64 nt, Human
uuuuucggagaagcacuguugaaauuuauacacacacacacacacagagacccuugaguacaca

SEQ ID NO: 213538 - RNA, 64 nt, Human
cuuuuuucggagaagcacuguugaaauuuauacacacacacacacacagagacccuugaguaca

SEQ ID NO: 213539 - RNA, 64 nt, Human
accuuuuuucggagaagcacuguugaaauuuauacacacacacacacacagagacccuugagua

SEQ ID NO: 213540 - RNA, 64 nt, Human
uacacacacauauacauagacacacaaacacacacacacacauuaauaucuaucuugggggagg

SEQ ID NO: 213541 - RNA, 64 nt, Human
cauacacacacauauacauagacacacaaacacacacacacacauuaauaucuaucuuggggga

SEQ ID NO: 213542 - RNA, 64 nt, Human
cacauacacacacauauacauagacacacaaacacacacacacacauuaauaucuaucuugggg

SEQ ID NO: 213543 - RNA, 64 nt, Human
cacacauacacacacauauacauagacacacaaacacacacacacacauuaauaucuaucuugg

SEQ ID NO: 213544 - RNA, 64 nt, Human
cugucucccuccucaacacacacacacacacauacacacacauauacauagacacacaaacaca

SEQ ID NO: 213545 - RNA, 64 nt, Human
cuccuccacacugucucccuccucaacacacacacacacacauacacacacauauacauagaca

SEQ ID NO: 213546 - RNA, 64 nt, Human
agcuccuccacacugucucccuccucaacacacacacacacacauacacacacauauacauaga

SEQ ID NO: 213547 - RNA, 64 nt, Human
uuagcuccuccacacugucucccuccucaacacacacacacacacauacacacacauauacaua

SEQ ID NO: 213548 - RNA, 64 nt, Human
uuuuagcuccuccacacugucucccuccucaacacacacacacacacauacacacacauauaca

SEQ ID NO: 213549 - RNA, 64 nt, Human
ccuuuuagcuccuccacacugucucccuccucaacacacacacacacacauacacacacauaua

SEQ ID NO: 213550 - RNA, 64 nt, Human
ucccacauuuaaaguucuuauuuaaaaaaacacacacacacaaaugaaauuuuuaaucuuugaa

SEQ ID NO: 213551 - RNA, 64 nt, Human
uaucccacauuuaaaguucuuauuuaaaaaaacacacacacacaaaugaaauuuuuaaucuuug

SEQ ID NO: 213552 - RNA, 64 nt, Human
gauaucccacauuuaaaguucuuauuuaaaaaaacacacacacacaaaugaaauuuuuaaucuu

SEQ ID NO: 213553 - RNA, 64 nt, Human
aauggucugguacaggaguuaaauaacaaugacacacacacaacaaaacaaacacaaaaccacu

SEQ ID NO: 213554 - RNA, 64 nt, Human
aaaauggucugguacaggaguuaaauaacaaugacacacacacaacaaaacaaacacaaaacca

SEQ ID NO: 213555 - RNA, 64 nt, Human
caaacacauacacacacauacacacacacagacacacacacacgaaacacaacacagacacuac

SEQ ID NO: 213556 - RNA, 64 nt, Human
cacaaacacauacacacacauacacacacacagacacacacacacgaaacacaacacagacacu

SEQ ID NO: 213557 - RNA, 64 nt, Human
cccacacacacacaaacacauacacacacauacacacacacagacacacacacacgaaacacaa

SEQ ID NO: 213558 - RNA, 64 nt, Human
ugcccacacacacacaaacacauacacacacauacacacacacagacacacacacacgaaacac

SEQ ID NO: 213559 - RNA, 64 nt, Human
aaagaaauucugcccacacacacacaaacacauacacacacauacacacacacagacacacaca

SEQ ID NO: 213560 - RNA, 64 nt, Human
auuaggccuuaaauuaaaagaaauucugcccacacacacacaaacacauacacacacauacaca

SEQ ID NO: 213561 - RNA, 64 nt, Human
ucauuaggccuuaaauuaaaagaaauucugcccacacacacacaaacacauacacacacauaca

SEQ ID NO: 213562 - RNA, 64 nt, Human
acucauuaggccuuaaauuaaaagaaauucugcccacacacacacaaacacauacacacacaua

SEQ ID NO: 213563 - RNA, 64 nt, Human
uugcuuauauguacuuuuuaaugaacacgugucucacacacaaaaagaauuaaggauuuuuuuu

SEQ ID NO: 213564 - RNA, 64 nt, Human
guaguguaagaauaacugugccccucuaagagugcacacacacgcacacaagaggguaagagac

SEQ ID NO: 213565 - RNA, 64 nt, Human
cucucacagacacacacacacacacacacacacacacacacacgcacguccacacucacauuaa

SEQ ID NO: 213566 - RNA, 64 nt, Human
cucucucacagacacacacacacacacacacacacacacacacacgcacguccacacucacauu

SEQ ID NO: 213567 - RNA, 64 nt, Human
cccucucucacagacacacacacacacacacacacacacacacacacgcacguccacacucaca

SEQ ID NO: 213568 - RNA, 64 nt, Human
cucccucucucacagacacacacacacacacacacacacacacacacacgcacguccacacuca

SEQ ID NO: 213569 - RNA, 64 nt, Human
cccucccucucucacagacacacacacacacacacacacacacacacacacgcacguccacacu

SEQ ID NO: 213570 - RNA, 64 nt, Human
cucccucccucucucacagacacacacacacacacacacacacacacacacacgcacguccaca

SEQ ID NO: 213571 - RNA, 64 nt, Human
cucucccucccucucucacagacacacacacacacacacacacacacacacacacgcacgucca

SEQ ID NO: 213572 - RNA, 64 nt, Human
cucucucccucccucucucacagacacacacacacacacacacacacacacacacacgcacguc

SEQ ID NO: 213573 - RNA, 64 nt, Human
cucucucucccucccucucucacagacacacacacacacacacacacacacacacacacgcacg

SEQ ID NO: 213574 - RNA, 64 nt, Human
cucucucucucccucccucucucacagacacacacacacacacacacacacacacacacacgca

SEQ ID NO: 213575 - RNA, 64 nt, Human
cucucucucucucccucccucucucacagacacacacacacacacacacacacacacacacacg

SEQ ID NO: 213576 - RNA, 64 nt, Human
cucucucucucucucccucccucucucacagacacacacacacacacacacacacacacacaca

SEQ ID NO: 213577 - RNA, 64 nt, Human
cucucucucucucucucccucccucucucacagacacacacacacacacacacacacacacaca

SEQ ID NO: 213578 - RNA, 64 nt, Human
cagugggagacaaagccucggucccccacccauccacacacaccuacacucacacacgcgcaca

SEQ ID NO: 213579 - RNA, 64 nt, Human
uucucccuccuucuuacacacacacacacacacacacacacaauccaucucuugcuuguuccua

SEQ ID NO: 213580 - RNA, 64 nt, Human
acuucucccuccuucuuacacacacacacacacacacacacacaauccaucucuugcuuguucc

SEQ ID NO: 213581 - RNA, 64 nt, Human
auacuucucccuccuucuuacacacacacacacacacacacacacaauccaucucuugcuuguu

SEQ ID NO: 213582 - RNA, 64 nt, Human
cuauacuucucccuccuucuuacacacacacacacacacacacacacaauccaucucuugcuug

SEQ ID NO: 213583 - RNA, 64 nt, Human
cccuauacuucucccuccuucuuacacacacacacacacacacacacacaauccaucucuugcu

SEQ ID NO: 213584 - RNA, 64 nt, Human
cucccuauacuucucccuccuucuuacacacacacacacacacacacacacaauccaucucuug

SEQ ID NO: 213585 - RNA, 64 nt, Human
cacucccuauacuucucccuccuucuuacacacacacacacacacacacacacaauccaucucu

SEQ ID NO: 213586 - RNA, 64 nt, Human
accacucccuauacuucucccuccuucuuacacacacacacacacacacacacacaauccaucu

SEQ ID NO: 213587 - RNA, 64 nt, Human
ccaccacucccuauacuucucccuccuucuuacacacacacacacacacacacacacaauccau

SEQ ID NO: 213588 - RNA, 64 nt, Human
ugccaccacucccuauacuucucccuccuucuuacacacacacacacacacacacacacaaucc

SEQ ID NO: 213589 - RNA, 64 nt, Human
cacacacacacacacacacacacacacacacacacacacacacguacacacaucccucacuucu

SEQ ID NO: 213590 - RNA, 64 nt, Human
cacacacacacacacacacacacacacacacacacacacacacacguacacacaucccucacuu

SEQ ID NO: 213591 - RNA, 64 nt, Human
cacacacacacacacacacacacacacacacacacacacacacacacguacacacaucccucac

SEQ ID NO: 213592 - RNA, 64 nt, Human
cacacacacacacacacacacacacacacacacacacacacacacacacguacacacaucccuc

SEQ ID NO: 213593 - RNA, 64 nt, Human
aacacacacacacacacacacacacacacacacacacacacacacacacacguacacacauccc

SEQ ID NO: 213594 - RNA, 64 nt, Human
gaaacacacacacacacacacacacacacacacacacacacacacacacacacguacacacauc

SEQ ID NO: 213595 - RNA, 64 nt, Human
cugaaacacacacacacacacacacacacacacacacacacacacacacacacacguacacaca

SEQ ID NO: 213596 - RNA, 64 nt, Human
uucugaaacacacacacacacacacacacacacacacacacacacacacacacacacguacaca

SEQ ID NO: 213597 - RNA, 64 nt, Human
uuuucugaaacacacacacacacacacacacacacacacacacacacacacacacacacguaca

SEQ ID NO: 213598 - RNA, 64 nt, Human
gcuuuucugaaacacacacacacacacacacacacacacacacacacacacacacacacacgua

SEQ ID NO: 213599 - RNA, 64 nt, Human
uggcuuuucugaaacacacacacacacacacacacacacacacacacacacacacacacacacg

SEQ ID NO: 213600 - RNA, 64 nt, Human
aguggcuuuucugaaacacacacacacacacacacacacacacacacacacacacacacacaca

SEQ ID NO: 213601 - RNA, 64 nt, Human
ggaguggcuuuucugaaacacacacacacacacacacacacacacacacacacacacacacaca

SEQ ID NO: 213602 - RNA, 64 nt, Human
cuggaguggcuuuucugaaacacacacacacacacacacacacacacacacacacacacacaca

SEQ ID NO: 213603 - RNA, 64 nt, Human
gacuggaguggcuuuucugaaacacacacacacacacacacacacacacacacacacacacaca

SEQ ID NO: 213604 - RNA, 64 nt, Human
cagacuggaguggcuuuucugaaacacacacacacacacacacacacacacacacacacacaca

SEQ ID NO: 213605 - RNA, 64 nt, Human
cccagacuggaguggcuuuucugaaacacacacacacacacacacacacacacacacacacaca

SEQ ID NO: 213606 - RNA, 64 nt, Human
uucccagacuggaguggcuuuucugaaacacacacacacacacacacacacacacacacacaca

SEQ ID NO: 213607 - RNA, 64 nt, Human
uuuucccagacuggaguggcuuuucugaaacacacacacacacacacacacacacacacacaca

SEQ ID NO: 213608 - RNA, 64 nt, Human
uauuuucccagacuggaguggcuuuucugaaacacacacacacacacacacacacacacacaca

SEQ ID NO: 213609 - RNA, 64 nt, Human
uuuauuuucccagacuggaguggcuuuucugaaacacacacacacacacacacacacacacaca

SEQ ID NO: 213610 - RNA, 64 nt, Human
guuccaaaauauugacauugaauggaucaauacacacacacagacauauauauauauaugcaca

SEQ ID NO: 213611 - RNA, 64 nt, Human
ggguuccaaaauauugacauugaauggaucaauacacacacacagacauauauauauauaugca

SEQ ID NO: 213612 - RNA, 64 nt, Human
agauguuugggcacucagaugcuaucuuggugcacacacacaacauugcuguucagucacaaau

SEQ ID NO: 213613 - RNA, 64 nt, Human
uuagauguuugggcacucagaugcuaucuuggugcacacacacaacauugcuguucagucacaa

SEQ ID NO: 213614 - RNA, 64 nt, Human
aaaauaugcucaugugugggcacacacgcacaaacacacacacgcacgcacacaguggcagaag

SEQ ID NO: 213615 - RNA, 64 nt, Human
aauggacuauuuuugcaguccaacaucagccaaccacacacagccguguuuggaagcugaagag

SEQ ID NO: 213616 - RNA, 64 nt, Human
ugcaaggagcgaaccggucagcaccaaguaacaccacacacacgcagcacccaggaugaugguu

SEQ ID NO: 213617 - RNA, 64 nt, Human
cccaugcucuugcgugugcuugcacgugcacgcacacacacacccagugcucucuccacccgac

SEQ ID NO: 213618 - RNA, 64 nt, Human
cccccaugcucuugcgugugcuugcacgugcacgcacacacacacccagugcucucuccacccg

SEQ ID NO: 213619 - RNA, 64 nt, Human
cacucccuaagccccacagccagcucugcaucaccacacacagccagagccugugaggagcugc

SEQ ID NO: 213620 - RNA, 64 nt, Human
uguauaugcaucuuuguugcuuauuacauauuuacacacacaaccacaaauuuuaaacuuauga

SEQ ID NO: 213621 - RNA, 64 nt, Human
acugcuucuugcagucaagaagaaauaccaauaacacacacagaacaaaaaccaucaaaaucuc

SEQ ID NO: 213622 - RNA, 64 nt, Human
ucucucugcaaaccuuuaguuuucugaugaucuacacacacacauacacacacacacacacaca

SEQ ID NO: 213623 - RNA, 64 nt, Human
ucucugcaaaccuuuaguuuucugaugaucuacacacacacauacacacacacacacacacacg

SEQ ID NO: 213624 - RNA, 64 nt, Human
ccuuuaguuuucugaugaucuacacacacacauacacacacacacacacacacgugcacacaca

SEQ ID NO: 213625 - RNA, 64 nt, Human
uuuaguuuucugaugaucuacacacacacauacacacacacacacacacacgugcacacacaca

SEQ ID NO: 213626 - RNA, 64 nt, Human
uaguuuucugaugaucuacacacacacauacacacacacacacacacacgugcacacacacaca

SEQ ID NO: 213627 - RNA, 64 nt, Human
guuuucugaugaucuacacacacacauacacacacacacacacacacgugcacacacacacauu

SEQ ID NO: 213628 - RNA, 64 nt, Human
uuucugaugaucuacacacacacauacacacacacacacacacacgugcacacacacacauuua

SEQ ID NO: 213629 - RNA, 64 nt, Human
ucugaugaucuacacacacacauacacacacacacacacacacgugcacacacacacauuuaaa

SEQ ID NO: 213630 - RNA, 64 nt, Human
cacacacacauacacacacacacacacacacgugcacacacacacauuuaaaggauauaaaaag

SEQ ID NO: 213631 - RNA, 64 nt, Human
cacacacauacacacacacacacacacacgugcacacacacacauuuaaaggauauaaaaagaa

SEQ ID NO: 213632 - RNA, 64 nt, Human
cacacauacacacacacacacacacacgugcacacacacacauuuaaaggauauaaaaagaaga

SEQ ID NO: 213633 - RNA, 64 nt, Human
cacaaauuguucaguucuuaaaauguaauuaugucacacacacaaaaaaauccuuuucaauccu

SEQ ID NO: 213634 - RNA, 64 nt, Human
caaauuguucaguucuuaaaauguaauuaugucacacacacaaaaaaauccuuuucaauccuga

SEQ ID NO: 213635 - RNA, 64 nt, Human
aacgugugauggugugaaacccacuuuugaccgucacacacauuucagcauuugaagagacaca

SEQ ID NO: 213636 - RNA, 64 nt, Human
aaaguggaauguauuuaaaacuuguugaauuagacacacacacacagacacacacaaagaauca

SEQ ID NO: 213637 - RNA, 64 nt, Human
aguggaauguauuuaaaacuuguugaauuagacacacacacacagacacacacaaagaaucagc

SEQ ID NO: 213638 - RNA, 64 nt, Human
uggaauguauuuaaaacuuguugaauuagacacacacacacagacacacacaaagaaucagcag

SEQ ID NO: 213639 - RNA, 64 nt, Human
uuaaaacuuguugaauuagacacacacacacagacacacacaaagaaucagcagagaaaacaaa

SEQ ID NO: 213640 - RNA, 64 nt, Human
ggugaucuaagggccgcggccuccuccacacacacacacacaccaggggaaccaagagaaccac

SEQ ID NO: 213641 - RNA, 64 nt, Human
aaggugaucuaagggccgcggccuccuccacacacacacacacaccaggggaaccaagagaacc

SEQ ID NO: 213642 - RNA, 64 nt, Human
agaaggugaucuaagggccgcggccuccuccacacacacacacacaccaggggaaccaagagaa

SEQ ID NO: 213643 - RNA, 64 nt, Human
caagaaggugaucuaagggccgcggccuccuccacacacacacacacaccaggggaaccaagag

SEQ ID NO: 213644 - RNA, 64 nt, Human
cucaagaaggugaucuaagggccgcggccuccuccacacacacacacacaccaggggaaccaag

SEQ ID NO: 213645 - RNA, 64 nt, Human
cuuugagugaaaagauaacacaggucuauugacucacacacauguuuuaagauggaaaacuuua

SEQ ID NO: 213646 - RNA, 64 nt, Human
caagucagcuacucuccgugcccacuuccccccacacacacaccccacccuguugcugaccaag

SEQ ID NO: 213647 - RNA, 64 nt, Human
ugcaagucagcuacucuccgugcccacuuccccccacacacacaccccacccuguugcugacca

SEQ ID NO: 213648 - RNA, 64 nt, Human
gauaaccucuuuaaaaaaauuuuuaaagaacuauggcuaugaccaaagcuucuauuuugccaaa

SEQ ID NO: 213649 - RNA, 64 nt, Human
acacggcugugacgagguggcagucgcaggauuuggcuaugacaugagcacacccaacgcaccc

SEQ ID NO: 213650 - RNA, 64 nt, Human
uaguagauuuugaauccugccucugccauuuccuggcuaugaggugucuugagaaauuuacuug

SEQ ID NO: 213651 - RNA, 64 nt, Human
uuuuuggggguagauuagaaaacccuuacacuuuggcuaugaacaaauaauaaaaauuauucuu

SEQ ID NO: 213652 - RNA, 64 nt, Human
cuauaaaauaaugacuaggaaguaacuuauuaaaggcuaugacuuaaauuugaagaugaaguac

SEQ ID NO: 213653 - RNA, 64 nt, Human
augccaaacuaguaagcaggauagcugauaccacggcuaugagggaguaggcucugagagggca

SEQ ID NO: 213654 - RNA, 64 nt, Human
ucaugcuccugaucuuuuuuuucccccuuccuuuggcuaugaaaacccaaagcccggagugauu

SEQ ID NO: 213655 - RNA, 64 nt, Human
uaauuaauauccaaggucccuuccggcucuaaaaggcuaugauucuagaugagaaguuauauca

SEQ ID NO: 213656 - RNA, 64 nt, Human
gauuccuggauggcuucagguucagcgcccuuggggcuaugaaugggaggcucagcagugcccu

SEQ ID NO: 213657 - RNA, 64 nt, Human
cacccugggaugugggugcucugggcugaaccaaggcuaugacuucuggagagaggcucagggg

SEQ ID NO: 213658 - RNA, 64 nt, Human
uuucauuuuauucacccuggucagauacaauaaaggcuaugaguauaaauacauaacuuccuaa

SEQ ID NO: 213659 - RNA, 64 nt, Human
uagcaaugcacagauacuacaauuccagaauccuggcuaugacccagaacacuguccagauucc

SEQ ID NO: 213660 - RNA, 61 nt, Human
aucaggaguuaaucaaguaguaauuuagccaggcuaugaaaucauccugugaguuauuucc

SEQ ID NO: 213661 - RNA, 64 nt, Human
caaagauuauagucauuguauaauuuggcuuggaggcuaugaaaugucuuuuuuucuuuuuggu

SEQ ID NO: 213662 - RNA, 64 nt, Human
aaaaagcuuuguugguaaaagugacauguuaaggggcuaugaaguaaauaugcugcaguuaauu

SEQ ID NO: 213663 - RNA, 64 nt, Human
gggaguaugucacucacagcaaacuuggaaagaaggcuaugacucccaagaggcagugaaccau

SEQ ID NO: 213664 - RNA, 64 nt, Human
agugugacucagcuaaccacaaaugucuccuccaggcuaugaaauuggccgauuucaagaacac

SEQ ID NO: 213665 - RNA, 64 nt, Human
cucugagggugaguggagggguauauggaaacacggcuaugaccaaagggagaucccagccugg

SEQ ID NO: 213666 - RNA, 64 nt, Human; identical to SEQ ID NO: 213662

SEQ ID NO: 213667 - RNA, 64 nt, Human
gcaugaccagucccacccccccguggccaccaauggcuaugacaucauuggagcagaugccucc

SEQ ID NO: 213668 - RNA, 64 nt, Human
uaauguauuguuucuuaagaacauuuuguaauugggcuaugauuuuaugaucuacagacgucua

SEQ ID NO: 213669 - RNA, 64 nt, Human
uuauucuuuuagccugcacaacaguugaucuuuuggcuaugacaauuuguauggaggguacgau

SEQ ID NO: 213670 - RNA, 64 nt, Human
gugagaugacauaacacugcuuaccucuugguguggcuaugaggauugauugggcugaugugua

SEQ ID NO: 213671 - RNA, 64 nt, Human
ugacugauagcauuucagaaugugucuuuugaagggcuaugauaccaguuauuaaauaguguuu

SEQ ID NO: 213672 - RNA, 64 nt, Human
uguauaaagguguauuucuuuuuuaugaguuuauggcuaugaaaacagcuauuuuguuacagcu

SEQ ID NO: 213673 - RNA, 64 nt, Human
cugugguuacuaauccagcaaauucaaggaaccaggcuaugacuaagaauuuagguggaauuga

SEQ ID NO: 213674 - RNA, 64 nt, Human
ccugucaccugccuccucaucauggaagggggugggcuaugaaagccggucucaaagauaacug

SEQ ID NO: 213675 - RNA, 64 nt, Human
cguuuuauguggacuuauucauuccucacaaugaggcuaugaggaaacugagucacucacauug

SEQ ID NO: 213676 - RNA, 64 nt, Human
cuguuaagaagaccgaagcauguauuaaugcuguggcuaugagaggccuccugcugcagaaaca

SEQ ID NO: 213677 - RNA, 64 nt, Human
ccaccagggaccauggagcaguggcacccuauggggcuaugaucccuaggccugggccugggcc

SEQ ID NO: 213678 - RNA, 64 nt, Human
acucgaaaaaauaggcuccaggccuaggugcccaggcuaugaugagucugcuuuugaaggaggu

SEQ ID NO: 213679 - RNA, 64 nt, Human
aauuugaauaauaguuuuaccucuguuguuaauaggcuaugaagaggauguggguauugcuguu

SEQ ID NO: 213680 - RNA, 64 nt, Human
aagugaucagcagaguugcauuuccaaagaaaaaggcuaugagaugagcugaguuauagagaga

SEQ ID NO: 213681 - RNA, 52 nt, Human
aagagacaaauauugcuuaaaaggcuaugaaguuaccuccagguugguggca

SEQ ID NO: 213682 - RNA, 64 nt, Human
auuccugauccguucacaugaaugcaaaccugaaggcuaugaauucugucacaaccgcaaggug

SEQ ID NO: 213683 - RNA, 64 nt, Human
gauuuuaagaauccaaacguuaagaauuguuaaaggcuaugauugucuuuguucuucuaccacc

SEQ ID NO: 213684 - RNA, 64 nt, Human
uauaauaugauuuuacagauagaugcuuccccuuggcuaugacauggagaaagauuuucccaua

SEQ ID NO: 213685 - RNA, 64 nt, Human
ggggaaauugaaguuguagucacugucugagaauggcuaugaagcgucauuucacauuuuaccc

SEQ ID NO: 213686 - RNA, 64 nt, Human
ucccagucccaccugugcugugacagucccacguggcuaugacagacuguuuaguacuuacccu

SEQ ID NO: 213687 - RNA, 64 nt, Human
gacaagugggugggggugauggcacauucaguguggcuaugaagagcgaauccucucuauuguu

SEQ ID NO: 213688 - RNA, 64 nt, Human
ccaggggcucaagcccaagauacaaaugguuuauggcuaugaaugaaguauuuguuguagauag

SEQ ID NO: 213689 - RNA, 55 nt, Human
caguggcugagcuggucuagggcuuggcuaugagcaaguuuuccagaucaccacc

SEQ ID NO: 213690 - RNA, 64 nt, Human
cugauggggguuggggugcuuccuuucaggccaaggcuaugaagggacagcugcugggacccac

SEQ ID NO: 213691 - RNA, 64 nt, Human
acauugaguccagugagauuaagugauuuuugcaggcuaugagguuuuaugcuauuccuguguu

SEQ ID NO: 213692 - RNA, 64 nt, Human
aauuugaagccuuugcuuuaggcaggaggcauguggcuaugaauagggaacacguagauuugac

SEQ ID NO: 213693 - RNA, 64 nt, Human
uuuugggagaauaagaacucuuuuugucauuuuuggcuaugaauaaacuuucuggucuuuugag

SEQ ID NO: 213694 - RNA, 64 nt, Human
cagcuccuuuacuaaagcugugcagagaauccgaggcuaugagugggggugggggaaagaugua

SEQ ID NO: 213695 - RNA, 64 nt, Human
uggaaaaucagguguuuacaggaaagaucucagaggcuaugagcucugaauaaaucuucauugu

SEQ ID NO: 213696 - RNA, 64 nt, Human
cagcagcgccagaagcacucauuucugaccaccaggcuaugacguuccugcugcgcauuacaga

SEQ ID NO: 213697 - RNA, 64 nt, Human
gauaaaauuuuuuccuguuaaaaccaugaacauuggcuaugaugaagauuauuacauaugaaaa

SEQ ID NO: 213698 - RNA, 64 nt, Human
cuguuuaaugcacaggugugaguggauugcuuauggcuaugagauagguugaucucgcccuuac

SEQ ID NO: 213699 - RNA, 64 nt, Human
ccacaguacucuagucacccucuucaagcuuuugggcuaugacguccauguucuaugugaccag

SEQ ID NO: 213700 - RNA, 64 nt, Human
cgacuauuuauugagcgccuguugugugucacggggcuaugagggccgugggguguuugggugg

SEQ ID NO: 213701 - RNA, 64 nt, Human
caggcaggacagaucggggaagggguguguaccaggcuaugauuucucuugcauuaaaauguau

SEQ ID NO: 213702 - RNA, 64 nt, Human
gagcagugggccuggccagcagguccccagcuuuggcuaugagggccuugagucccccaaaaca

SEQ ID NO: 213703 - RNA, 64 nt, Human
augugcuuugucauuuucuuugcuaaacaaaagaggcuaugaaagaacuaaauaugaguacaua

SEQ ID NO: 213704 - RNA, 64 nt, Human
augggcagugccccacauggacagccauuccccaggcuaugaagugacauaggccucccccacg

SEQ ID NO: 213705 - RNA, 64 nt, Human
agggccccaugccagucaguguccccaucaugguggcuaugaagcucacggcugaagauuccag

SEQ ID NO: 213706 - RNA, 64 nt, Human
agggagaaguugcuaagugcugggucuguucauuggcuaugagguucaaauguguguggugcag

SEQ ID NO: 213707 - RNA, 64 nt, Human
ucuccuuagcugagcagaggaagggaaggaguguggcuaugagaauaugauuuaugccauuuuc

SEQ ID NO: 213708 - RNA, 64 nt, Human
aguugaaauuagguacagcuguugcuccuuagcaggcuaugaaguugcaaugcuucacaucucu

SEQ ID NO: 213709 - RNA, 64 nt, Human
cagugagagcagcacccucaucgggcgcuacuguggcuaugagaagccugaugacaucaagagc

SEQ ID NO: 213710 - RNA, 64 nt, Human
uuguuaaaauuuugaguuaaguugcauuucuuugggcuaugaaggaguccucuuaaguuugaua

SEQ ID NO: 213711 - RNA, 64 nt, Human
uagaauguuucugguauuucucauuuuuuucccuggcuaugauagaaucucaucuaaucuugac

SEQ ID NO: 213712 - RNA, 64 nt, Human
gaucaaaccaugacaggaugcaaccacaacacacggcuaugaucaugacaaccacgguccccac

SEQ ID NO: 213713 - RNA, 64 nt, Human
ugggucugugucaccuccaucucagucuuggccuggcuaugaggggaggaggaaugggagaggg

SEQ ID NO: 213714 - RNA, 64 nt, Human
ccaugugcauccugagcugugugaucugccucgaggcuaugaucugagcaagcaggagauaaca

SEQ ID NO: 213715 - RNA, 64 nt, Human
ucccggaggacugcuuccugccuacccgaucuauggcuaugacgagcuccagaugcugcaguca

SEQ ID NO: 213716 - RNA, 64 nt, Human
cugagaaauauggaaaccgucuuaauuuuccauuggcuaugauggaauuaauauuguauuuuaa

SEQ ID NO: 213717 - RNA, 64 nt, Human
cguuguguuuuacacaaaaccauuuuugaauuaaggcuaugauauuaagauagaaauuuggacu

SEQ ID NO: 213718 - RNA, 64 nt, Human
aagccaaacagcaagaagcuguuaccacacccagggcuaugaggauaaugggaagagguuuggu

SEQ ID NO: 213719 - RNA, 64 nt, Human
aaccauucuucagacaucagucaauggaagaaauggcuaugaacagaaacuacauuucuacuau

SEQ ID NO: 213720 - RNA, 64 nt, Human
ucccacccuccuugcuuaucgucccuguuuugagggcuaugacuugaguuuuuguuucccaugu

SEQ ID NO: 213721 - RNA, 64 nt, Human
ugugugugcgugugugguacguguguguguguguggcuaugaggcugauuccuguuuggauuuu

SEQ ID NO: 213722 - RNA, 64 nt, Human
ucagacagagccaaggcaauauccucuugcccauggcuaugaugucagacaguggaugggcucc

SEQ ID NO: 213723 - RNA, 64 nt, Human
cagagggaauaugcacuggcgaguuuaaaguaagggcuaugauauuugauggucccaaaguacg

SEQ ID NO: 213724 - RNA, 64 nt, Human
uguccucagacagugccaccauggccaugcagcaggcuaugauggcugcacacgaugacucauu

SEQ ID NO: 213725 - RNA, 64 nt, Human
uucccagaucuuuuccuuccacuucacagccaacggcuaugacaaaaccacucccuggccaaug

SEQ ID NO: 213726 - RNA, 64 nt, Human
ugagcuuccucuucacucugcucucaggagaccuggcuaugaggcccucggggcagggauacaa

SEQ ID NO: 213727 - RNA, 64 nt, Human
acaguggacagucuuugaucaucauguagaauauggcuaugaaucaggaaagagauuagaacau

SEQ ID NO: 213728 - RNA, 64 nt, Human
uuauuuuuuucucuguaaauauguacagugcacgggcuaugagauagcaacaaaaaaugcauag

SEQ ID NO: 213729 - RNA, 64 nt, Human
ucuuauugugaaucuuaacaugcuuuuuagcuguggcuaugauggauuuuauuuuuuccuaggu

SEQ ID NO: 213730 - RNA, 64 nt, Human
cuuggagggaggaagaaagggagccggcguucaaggcuaugacagucugcuacgcaaaacauuu

SEQ ID NO: 213731 - RNA, 64 nt, Human
ucucuugagcaugguuuuuagaggcuacgaauaaggcuaugaauaaggguuaucuuuaaguccu

SEQ ID NO: 213732 - RNA, 64 nt, Human
gaaguuuucagaucaguggcaaucucaguccccuggcuaugacccugcuuuguucuuucccuga

SEQ ID NO: 213733 - RNA, 64 nt, Human
agcccagggggcaaggacacagcugcuccccucuggcuaugaagagguuaacgcggccccucca

SEQ ID NO: 213734 - RNA, 64 nt, Human
cacuaugcagaggccaaaggucggcagccagcgaggcuaugaauuggaccuuuuugguaucugu

SEQ ID NO: 213735 - RNA, 64 nt, Human
gacauguaaaauauuuaggauuugaccacacaauggcuaugaaaaugcaaguaguuuccucgcg

SEQ ID NO: 213736 - RNA, 64 nt, Human
uguaucgucauagauguacauauugugucgguagggcuaugaggcauguuacaggaauguaauu

SEQ ID NO: 213737 - RNA, 64 nt, Human
uguuuucuaaaaccagagaauaaggaacugauuuggcuaugagguuuaacauuauaauuuucug

SEQ ID NO: 213738 - RNA, 64 nt, Human
cccgcagcagaauguuggaguggaaaugauggcuggcuaugaagaggaggucaacguguguggu

SEQ ID NO: 213739 - RNA, 64 nt, Human
guuuacaguguauauaaugguuguguuuucauggggcuaugaaagugcacguuaaaccugagcg

SEQ ID NO: 213740 - RNA, 64 nt, Human
uaccuuacugggauacagauuuuugcucagaaauggcuaugacacuuuuucuaggcucuaccaa

SEQ ID NO: 213741 - RNA, 64 nt, Human
aguagugaugguuuuagcgaugaauaacguaauuggcuaugaaguacuguggcagagcugcugu

SEQ ID NO: 213742 - RNA, 64 nt, Human
uaaguuauaaauaccaugucaaauugauuauacaggcuaugaaaaccauuuuaaaggaaagaaa

SEQ ID NO: 213743 - RNA, 64 nt, Human
uguguccacgaagagggagcugaaacaaauucggggcuaugaaguguuuuaaaaauccauucuu

SEQ ID NO: 213744 - RNA, 64 nt, Human
aggugucaucuuccaaccacacagaggacguuuuggcuaugaucaucugauggcaagugaagga

SEQ ID NO: 213745 - RNA, 64 nt, Human
aaccaaagugugucaacccuguuuccuuaaaagaggcuaugaaucccaaaggccacauccaaga

SEQ ID NO: 213746 - RNA, 64 nt, Human
cucagggcacuuccguaaggcaaguccuuuuagaggcuaugaagaaaacagcugcauggcacau

SEQ ID NO: 213747 - RNA, 64 nt, Human
uaacuacggggaugaucgucgugguggcagaggaggcuaugaucgaggcggcuaccggggccgc

SEQ ID NO: 213748 - RNA, 64 nt, Human
gggcagaagagacccaaccacuucuauuuuuugaggcuaugaauauaguaccugaaaaaaugcc

SEQ ID NO: 213749 - RNA, 64 nt, Human
cuucccccaugacagugaguaagagacacucacaggcuaugaggguacaccccuagcugaaugu

SEQ ID NO: 213750 - RNA, 64 nt, Human
gucaggaaguggccguagcaacuuggcggagacaggcuaugagucugacguuagagugguggcu

SEQ ID NO: 213751 - RNA, 64 nt, Human
uuggccgagcuccuggggagcuccugggacccuuggcuaugaaaaugagcccuggcucccaccu

SEQ ID NO: 213752 - RNA, 64 nt, Human
gggacagaaaaucugacuacuaggaagacuucuaggcuaugaaacugacuucuaggcuaugaaa

SEQ ID NO: 213753 - RNA, 64 nt, Human
uaggaagacuucuaggcuaugaaacugacuucuaggcuaugaaacuuacaggguaugggugggc

SEQ ID NO: 213754 - RNA, 64 nt, Human
caugugugagggaagcugcuuggguggguguuagggcuaugaaaucuuggauuuggggcugagg

SEQ ID NO: 213755 - RNA, 64 nt, Human
gggccucacugguugagauggaauagaauaacugggcuaugagucaccagcccacuuugugacc

SEQ ID NO: 213756 - RNA, 64 nt, Human
cugggugguaagggaagcccucccgguucccacaggcuaugaugcugcauggcagaggcaggua

SEQ ID NO: 213757 - RNA, 64 nt, Human
aaauaggaaagugaagcucaaggguaaccagugaggcuaugaaauugccagugaauuaagacca

SEQ ID NO: 213758 - RNA, 64 nt, Human
uuccuugcuccaacuccuugucucucaacguauuggcuaugacgcagcaagcagaaugaauuug

SEQ ID NO: 213759 - RNA, 64 nt, Human
cuucuaacuuucuguauguauaggccuguccaaaggcuaugagauaccagggacaguggaaucu

SEQ ID NO: 213760 - RNA, 64 nt, Human
cccucgcccacccgcucgcugcccggcccuccccggcuaugacgcccccggcccgugcucaaca

SEQ ID NO: 213761 - RNA, 64 nt, Human
gcuguggggggccuuggccacauaccugucccuuggcuaugagcaggcuuugggggcccuuccg

SEQ ID NO: 213762 - RNA, 64 nt, Human
uuaacuuccauuuuguaaaaauauaaacacauggggcuaugacuuucccucguaauacuccuuu

SEQ ID NO: 213763 - RNA, 64 nt, Human
gcugugggagaaggcaguccaacagcaccagcacggcuaugacagugaugaggagguggacagc

SEQ ID NO: 213764 - RNA, 64 nt, Human
ucuuugguuuccaguucaggaccucaaggggcucggcuaugagaaggggaagccugugggucua

SEQ ID NO: 213765 - RNA, 64 nt, Human
auaagauguuaacgcugaguuauuaggacuggaaggcuaugaaaagaacuugaaauugucggaa

SEQ ID NO: 213766 - RNA, 64 nt, Human
gcuugugggugauguuugaccuucagagccagccggcuaugaaagggagcgagccccucggcuc

SEQ ID NO: 213767 - RNA, 64 nt, Human
gcgagguauaggcuccagacuccucaccaagaugggcuaugaguuuggcaagggugaguacaag

SEQ ID NO: 213768 - RNA, 64 nt, Human
ucuuagucaguaaaaacaauucccuguuccuucaggcuaugaauggaccagccagggaaacucu

SEQ ID NO: 213769 - RNA, 64 nt, Human
gugcccugcauuccuuugaggcaaaaaauaaaugggcuaugacugguuaaauguccaaaaggug

SEQ ID NO: 213770 - RNA, 64 nt, Human
ucccuggucguacugcagucagcacccguaacccggcuaugaccagggaucuguaagcccugug

SEQ ID NO: 213771 - RNA, 64 nt, Human
cagugugcacgucugucuguccgucugugcuuguggcuaugagcgugugccuccacccacccca

SEQ ID NO: 213772 - RNA, 64 nt, Human
aaugggucacaaucccauuggauggaaaggacuuggcuaugaacuugacuggaaacacgcagcc

SEQ ID NO: 213773 - RNA, 64 nt, Human
agucaucagggaaugcaaauugaaaccacagcgaggcuaugacuuacuuaucucaauggcuaaa

SEQ ID NO: 213774 - RNA, 64 nt, Human
caguauguugccaagagcccgucugcuccugcgaggcuaugagugggaugagugaugcccccac

SEQ ID NO: 213775 - RNA, 64 nt, Human
cugaagucuuuuugucauguagcuauuaaucuguggcuaugaaaugaucagaaaugcuaaguga

SEQ ID NO: 213776 - RNA, 64 nt, Human
ucuauggaagagacuuuuguuuguguuuaauuagggcuaugagagauuucaggugagaaguuaa

SEQ ID NO: 213777 - RNA, 61 nt, Human
ucggggcuccggccuccugccaaggcucuuguccccauacaccaucccacaagggcgcugg

SEQ ID NO: 213778 - RNA, 61 nt, Human
ggcgagcccagcugcccagcccugcccccccuccccauagccagcacagcuaucccgcggg

SEQ ID NO: 213779 - RNA, 61 nt, Human
uguguguccguuugagugucugcgccccgccuccccauacuuccugggaugaugugugaaa

SEQ ID NO: 213780 - RNA, 61 nt, Human
aaggggcagccagacuugccagaggggucucuccccauagccacaguggaggagcugacag

SEQ ID NO: 213781 - RNA, 61 nt, Human
uucaguuaagucaaaacaacacguuccucuuuccccauauauucauauauuuuugcucguu

SEQ ID NO: 213782 - RNA, 61 nt, Human
uagggccugggguccuguucccugcuccgcuuccccauaccccagcccgaggugaagccca

SEQ ID NO: 213783 - RNA, 61 nt, Human
ucugcaugauagcuuuauucucaguuaucuuuccccauaauaaaaaauaucugccaccuuc

SEQ ID NO: 213784 - RNA, 61 nt, Human
uaaaguuagaguugauuacauaaguaaguauuccccauauaaucuuuuaaaaaguugugua

SEQ ID NO: 213785 - RNA, 61 nt, Human
uuuccugaucuugccgcaucacuuaaugugauccccauacugcaacugugaugcugaugau

SEQ ID NO: 213786 - RNA, 61 nt, Human
uaccaaagagccuguuguauugcuuaccauguccccauacuaugaggagaaguuuuguggu

SEQ ID NO: 213787 - RNA, 61 nt, Human
ucuuugcacaaguauggggcccaugugguaguccccauaccccuccaguuccuauauuuuu

SEQ ID NO: 213788 - RNA, 61 nt, Human
ucaacagacaugcaaagauccuaggagacaguccccauagaccuucagacauuaaaaaggg

SEQ ID NO: 213789 - RNA, 61 nt, Human
ucuucaucuucacacauucacugugcuuuccuccccauagugggagcugucaucaccaaca

SEQ ID NO: 213790 - RNA, 61 nt, Human
gccgccacccccgccggugucugcuguucuuuccccauaggucuugcuuuguugccugucu

SEQ ID NO: 213791 - RNA, 61 nt, Human
auaacugaauuggccuuugguucauguuuucuccccauauguauauaugccauaugugaau

SEQ ID NO: 213792 - RNA, 61 nt, Human
augcuaagcccuuuacagucauauccuauaauccccauaucaaccuuauaaggaagguguu

SEQ ID NO: 213793 - RNA, 61 nt, Human
uccgaaggcauucuuguuagcuuugcuuuucuccccauaucccaaggcgaagcgcugagau

SEQ ID NO: 213794 - RNA, 61 nt, Human
uccacucaaugugaacucuacuaccacgaccuccccauauuccucacuucuccaucaccuc

SEQ ID NO: 213795 - RNA, 61 nt, Human
cugagcaccucccauccugcucacacguccuuccccauaacuauggaaauggcccuaauuu

SEQ ID NO: 213796 - RNA, 61 nt, Human
aaaacauugcagcgaaggcacugcaaucccuuccccauaucccugcccaacccggacugcu

SEQ ID NO: 213797 - RNA, 61 nt, Human
uaaaauuaacacacacaugaacugcacaccuuccccauaaaauuuggagguggggugggag

SEQ ID NO: 213798 - RNA, 61 nt, Human
gcuaaagagcuuucauccucuugaguguauguccccauagugggccccuugacccacaugc

SEQ ID NO: 213799 - RNA, 61 nt, Human
uggggcaggccaccuggcucucaccucuagguccccauacuccuaugaucugagucagagc

SEQ ID NO: 213800 - RNA, 61 nt, Human
ccucucccccaugcuuacuaauacauucccuuccccauagccaucaaaacuggaccaacug

SEQ ID NO: 213801 - RNA, 61 nt, Human
agcuggucucuaugaauaugcugggggugcuuccccauaggucucucccuucauuugucuc

SEQ ID NO: 213802 - RNA, 61 nt, Human
aagggcuucaacagccuuaaccaaauauuauuccccauagccaguggaaaauggaugugac

SEQ ID NO: 213803 - RNA, 61 nt, Human
gggaaaggacauuugagggaaacaucaaauuuccccauaaauaaaugaauggaguuugcag

SEQ ID NO: 213804 - RNA, 61 nt, Human
gucauuguuaucugcuaagccccuggucauuuccccauauucguagucuuuuuuuccaucc

SEQ ID NO: 213805 - RNA, 61 nt, Human
augcaugcugcuaaacuagaacuuuaauuuuuccccauaacuuuuauaagucccauuuaua

SEQ ID NO: 213806 - RNA, 52 nt, Human
uuuuuuuuuaauguguccagguuccccauauuauuacaguuccacaucaagg

SEQ ID NO: 213807 - RNA, 61 nt, Human
uguauaccaucuucuauuuccagcuccugauuccccauagguaacaucccuuaggagcgaa

SEQ ID NO: 213808 - RNA, 61 nt, Human
gaaauauuuucuguugguaacuguuucuuguuccccauaccagauaaaaaccgcauauaac

SEQ ID NO: 213809 - RNA, 61 nt, Human
uuuguacuaagcugugccugccuuguugugauccccauagaaacauaauaaauauacaagu

SEQ ID NO: 213810 - RNA, 61 nt, Human
ugcaaauucugguaauaauucuugcauuuuuuccccauaaccugguuaaaauaaauacgcc

SEQ ID NO: 213811 - RNA, 61 nt, Human
gcuugagccagugagggguguuuccuuuuuauccccauagcuuuuagcuaaaacaucccuc

SEQ ID NO: 213812 - RNA, 61 nt, Human
cugguaagcuuucaucucccaugaacucauuuccccauaaaugaaauggguaaauaaugcc

SEQ ID NO: 213813 - RNA, 61 nt, Human
ugagggagagacagugagcugcaagacugccuccccauaacaacaggcaacucagagaaga

SEQ ID NO: 213814 - RNA, 61 nt, Human
uaggaccauuccaagaaaaccagguuucuucuccccauaccacguugugccugaagaacaa

SEQ ID NO: 213815 - RNA, 61 nt, Human
cuuaguuaaaucuuuuccaggaaaaagaacuuccccauacaaauaagcaugagacuaugua

SEQ ID NO: 213816 - RNA, 61 nt, Human
ccacacaggguccguugcuggcaacuggacuuccccauaagccuuggguauccugugaugg

SEQ ID NO: 213817 - RNA, 61 nt, Human
aguauuugcuaauguugauugaaccucccuuuccccauaaugugggcagauuuggcucagc

SEQ ID NO: 213818 - RNA, 61 nt, Human
acaaaucccucgguucuaagauacaauggauuccccauacuggaaggacucugaggcuuua

SEQ ID NO: 213819 - RNA, 61 nt, Human
ugucaucaaaaguucauaaaaguccuauuaauccccauauucuucuacugcccuuaacucu

SEQ ID NO: 213820 - RNA, 61 nt, Human
aaaguuaaaauaugcuucacuagucacacauuccccauaccauuucguguuauucacauuc

SEQ ID NO: 213821 - RNA, 61 nt, Human
augcaauauuuuuuuucugaauucauuaugauccccauauuggguaaugcugaacauuuau

SEQ ID NO: 213822 - RNA, 61 nt, Human
cguaaauaacccugagguuuuguacuuacuuuccccauaggaagacagaccauaggcaaac

SEQ ID NO: 213823 - RNA, 61 nt, Human
uguuaccaccuugauuuaauaacuucuuguuuccccauacauguguuuuguuuauagauug

SEQ ID NO: 213824 - RNA, 61 nt, Human
caugcuaagguggguugggcuuggaccgauguccccauauguacagaacugaauaaagugg

SEQ ID NO: 213825 - RNA, 61 nt, Human
cauucuauuuauuuucgcaguaauucucauguccccauaagcagagcugucacagugugca

SEQ ID NO: 213826 - RNA, 61 nt, Human
augcagaagaaugaaacugaaccccuacuucuccccauauauguaaaauaauucaauaugg

SEQ ID NO: 213827 - RNA, 61 nt, Human
cauucccaauaacagaaucgguuugcaugacuccccauacauguugcagcuuugaaaacau

SEQ ID NO: 213828 - RNA, 61 nt, Human
aaacucauccuuguguauagucucacacccuuccccauaaguauaaaugggcccauauuua

SEQ ID NO: 213829 - RNA, 61 nt, Human
ccaguucagucuccacauuucugguuuucuguccccauaguacaguucuucaguggacaug

SEQ ID NO: 213830 - RNA, 61 nt, Human
uggggugcuuguauauguaucuuccucaauuuccccauaaaugagguaucuuuuugucaca

SEQ ID NO: 213831 - RNA, 61 nt, Human
gaaggugaggcgagguggggaguuggcagaauccccauaccucgcagauuugcugagucug

SEQ ID NO: 213832 - RNA, 61 nt, Human
gucuuaugugguucaacucccacccccgccuuccccauauuuucaaccacucugauuaucu

SEQ ID NO: 213833 - RNA, 61 nt, Human
uaauauuuuguauaaaacauagcaguuuagguccccauaauccucaaaaauagucacaaau

SEQ ID NO: 213834 - RNA, 61 nt, Human
uucuaagucaguguuuuucaaagcguagugguccccauauuagcugcauugccaucuucug

SEQ ID NO: 213835 - RNA, 61 nt, Human
ugcgcaggauuuaggauaagcugucacccaguccccauaacaaaaccacuguccaacacug

SEQ ID NO: 213836 - RNA, 61 nt, Human
gagaacaaaccucaagacuaucagugugaccuccccauaacaagagaaccccauauauagu

SEQ ID NO: 213837 - RNA, 61 nt, Human
cagugugguuauggggagagggcauauaaauuccccauauuuguguucaguuccagcuuuu

SEQ ID NO: 213838 - RNA, 61 nt, Human
cggccaccacgcauggcaugcugugcuuggcuccccauaagacguccucuuugggugcacg

SEQ ID NO: 213839 - RNA, 61 nt, Human
uacaaaucacagcugauagacagcgaagccuuccccauagagaccgugcuccaacucgggc

SEQ ID NO: 213840 - RNA, 61 nt, Human
cacauagcuuuaaugaggagccugucauguuuccccauaaauuuauugccugagaacuuag

SEQ ID NO: 213841 - RNA, 61 nt, Human
aggcaaaguggaccuggcaaccacaagacccuccccauaagcaggggaccagcauacccgg

SEQ ID NO: 213842 - RNA, 61 nt, Human
gcuccugugggagaucuucacucugggcggcuccccauaccccggugugccuguggaggaa

SEQ ID NO: 213843 - RNA, 61 nt, Human
ucagccugacucuucccuuccccucucucauuccccauacucccuauuuucauuccuuuuu

SEQ ID NO: 213844 - RNA, 61 nt, Human
ucuccugcaauguuuuucuugcuuuuugccuuccccauauauauggaacuuggcuaccucu

SEQ ID NO: 213845 - RNA, 61 nt, Human
acucucauagauguuggaacuaccuuuuuacuccccauacuuuguaaguaaugcuuccaga

SEQ ID NO: 213846 - RNA, 61 nt, Human
acaugucauugacaccucucuucuuuacuuuuccccauaucuaaucauuccucaagucuua

SEQ ID NO: 213847 - RNA, 61 nt, Human
accuugcaggagugaagacugugaugugugguccccauauguggcucagcaaagacucgag

SEQ ID NO: 213848 - RNA, 61 nt, Human
caagccuguucuccauuucuucacucuccccuccccauauagcaacucucccagguuuaga

SEQ ID NO: 213849 - RNA, 61 nt, Human
aaauuuuuaauauagucuuaucuaccacacauccccauagauuuaaggauuuuaauagaaa

SEQ ID NO: 213850 - RNA, 61 nt, Human
guuggcuggugggucacccagcagaggcuucuccccauagcacgaggauguguugccuggg

SEQ ID NO: 213851 - RNA, 61 nt, Human
ggaguaguuaguggagggcaggauucucagguccccauagagagggaaagagaagaccaga

SEQ ID NO: 213852 - RNA, 61 nt, Human
agagugaucugcauguuuuuuaaccugcuuuuccccauagcacagaccauaagaaacaaca

SEQ ID NO: 213853 - RNA, 61 nt, Human
aacagguuugcagcuacccucucugaccuuuuccccauaucuugugcuguccagggccuag

SEQ ID NO: 213854 - RNA, 61 nt, Human
ggacauuuggauggugacuuuccugggugguuccccauagauucaccauugccucuaaugg

SEQ ID NO: 213855 - RNA, 61 nt, Human
ucugcugggcucugauucugcccaaugaguauccccauagguucucaaaaacaugaacaag

SEQ ID NO: 213856 - RNA, 61 nt, Human
ccacuucauuccccugaugggcccugacucuuccccauaaucacugaccagccuugacacu

SEQ ID NO: 213857 - RNA, 61 nt, Human
caauuaucuucuaggauugaaaggugcauuuuccccauaaaaaaggcgaggaaaacccaug

SEQ ID NO: 213858 - RNA, 61 nt, Human
ccugauaaaacagcuaaucaccagcauuuguuccccauagucacagggccacacaagggaa

SEQ ID NO: 213859 - RNA, 61 nt, Human
gggcggaucccuuauguaugacuuugugccauccccauaguaaugagugaguucucacucu

SEQ ID NO: 213860 - RNA, 61 nt, Human
uuugaagugaauauuugccaugacuccauuuuccccauaccacuucagacuuuagccuguu

SEQ ID NO: 213861 - RNA, 61 nt, Human
gagaugaccucuuuuaaaagcaaagccccccuccccauacaccccaagccugagcccuguc

SEQ ID NO: 213862 - RNA, 58 nt, Human
ucugggaugugcacgaaugacuguucuguccccauauuuucuguuuucuuggccggau

SEQ ID NO: 213863 - RNA, 61 nt, Human
ccccucccuuuuuccuucuccugcuuuucuuuccccauagaaaguaccuugaaguagcaca

SEQ ID NO: 213864 - RNA, 61 nt, Human
gggcugggagcagucccgguuuagccugagguccccauagggcuuccuccccugcuggguu

SEQ ID NO: 213865 - RNA, 61 nt, Human
agccccagaagggggcauuaugggcccugccuccccauaggccauuuggacucugccuuca

SEQ ID NO: 213866 - RNA, 61 nt, Human
ugugcuauuaaauggaaauuuccauacaucuuccccauacuauuuuuuauaaaagagccua

SEQ ID NO: 213867 - RNA, 61 nt, Human
augacccagcugcucaugagugauaaaugucuccccauaugcaggcugcccuugcagcugc

SEQ ID NO: 213868 - RNA, 61 nt, Human
gaggggaggagaacugcucacuccuuuucccuccccauacaaacucaaaguccccugggcc

SEQ ID NO: 213869 - RNA, 61 nt, Human
gugauaaugaaagcuaagccucgggcuaauuuccccauagccguggggugacuucccuggu

SEQ ID NO: 213870 - RNA, 61 nt, Human
uagaaaacauccaguggauuacagaauuucuuccccauauucacuccucacuuuuacaauu

SEQ ID NO: 213871 - RNA, 61 nt, Human
aucaggaacauagcucugugauucaugaguguccccauacugaugaauuggagcauccaua

SEQ ID NO: 213872 - RNA, 61 nt, Human
uauucucucccuacuacucacuaucaauucauccccauaugaaucucuaaccauauuguau

SEQ ID NO: 213873 - RNA, 61 nt, Human
gaaaaaucggaagaacaugaauuggcaucucuccccauauauaaauuauuacuuuaaauua

SEQ ID NO: 213874 - RNA, 61 nt, Human
uauuuguuuuucauucaucccauuaaucauuuccccauaacucaauggccuaaaacuggcc

SEQ ID NO: 213875 - RNA, 61 nt, Human
agggccccgggcagcaguggacgacccagccuccccauaccgggccucuggcccagaccua

SEQ ID NO: 213876 - RNA, 61 nt, Human
ggccuaaaaugggugauauacaggucuuauauccccauauggaauuuauccaucaaccaca

SEQ ID NO: 213877 - RNA, 61 nt, Human
uccuauuauuucugaauauauguccucaaaauccccauaaauauccaucccuuccuagaug

SEQ ID NO: 213878 - RNA, 61 nt, Human
agguuucagaccagaugguguuuaagguuucuccccauacuggaaugaaugauuucuuggu

SEQ ID NO: 213879 - RNA, 61 nt, Human
caucaaucugccucacugcuguucugggccauccccauagccauguuuacaugauuugaug

SEQ ID NO: 213880 - RNA, 61 nt, Human
ugccauaauucugagaagaaaaugaccuauauccccauaagaacugaaacucagucuaggu

SEQ ID NO: 213881 - RNA, 61 nt, Human
aagugauaagcauucaagcaacucuguauuuuccccauauuauuuuaaauguccauuuuca

SEQ ID NO: 213882 - RNA, 61 nt, Human
gcuguauaagguaauaaaacucugcaccuaauccccauaacuuccaguaucauuuuccaau

SEQ ID NO: 213883 - RNA, 61 nt, Human
uuuucacccuguauucucaaugaucccuuccuccccauaugccacccuucccccaaagcug

SEQ ID NO: 213884 - RNA, 61 nt, Human
ugggauaauggcuucaggcaacuccuagccuuccccauaucuccugccucagccccccugg

SEQ ID NO: 213885 - RNA, 61 nt, Human
cugccugguauccaggaggggaaugcugguauccccauaugucuguguuuguuugagauuu

SEQ ID NO: 213886 - RNA, 61 nt, Human
gguuguuuucuacuuugccccuuucaguauguccccauaagacaaacacugccauauugug

SEQ ID NO: 213887 - RNA, 61 nt, Human
uccuuuuccucacugaauucccagcuccccauccccauaaaugcauacacauacaugcaca

SEQ ID NO: 213888 - RNA, 61 nt, Human
guccucacccaaauuucaucucgaauuguaauccccauaauccccaugugucuagggagag

SEQ ID NO: 213889 - RNA, 61 nt, Human
gaucaagauauuaaaaugucggauuuaucuuuccccauauccaaguaccaaugcuguugua

SEQ ID NO: 213890 - RNA, 61 nt, Human
agccccauguguggcccaccccaccaggccauccccauaccuucugguuugaaggcgcuga

SEQ ID NO: 213891 - RNA, 61 nt, Human
aacuuucuccagucugggaaccuuuuuuacuuccccauauuuguuauuauuuagaaugguu

SEQ ID NO: 213892 - RNA, 61 nt, Human
gguuguuuuuuuggggugacucggacugaauuccccauacuguuuccacgccgggacacca

SEQ ID NO: 213893 - RNA, 61 nt, Human
uccauuggcucccaagucacacccacucccuuccccauagauaggccccuggggcucccga

SEQ ID NO: 213894 - RNA, 61 nt, Human
ucuccacauuuucucaggaguaguucgggcauccccauaucuucuccucuccccuugugaa

SEQ ID NO: 213895 - RNA, 61 nt, Human
cccugcaggucuuggcacaugcacagcaggcuccccauagcuuugucaccacaaagggcac

SEQ ID NO: 213896 - RNA, 61 nt, Human
uucucuuauuuucugcccauugauaaaccucuccccauauuuugcaaagaggaaauucaca

SEQ ID NO: 213897 - RNA, 61 nt, Human
cagcuggacagugauuuuagaaggccaccaguccccauagcuaugugacaaugagaagcaa

SEQ ID NO: 213898 - RNA, 61 nt, Human
gaaugcccuuagcucugcucucuaguggcuguccccauagcuggaacucuguuuuggagug

SEQ ID NO: 213899 - RNA, 61 nt, Human
cacggugcugugaguauuccuccguuagcuuuccccauaagguugggaguaucugcuuuug

SEQ ID NO: 213900 - RNA, 61 nt, Human
ucuuuuucacacaccccuucaugcccggcuuuccccauauccacaugcagagggcgagcuc

SEQ ID NO: 213901 - RNA, 61 nt, Human
ugucccucucucuuugacucucccuuuguccuccccauagagcuggggugggguggauccc

SEQ ID NO: 213902 - RNA, 61 nt, Human
auggaaugccauuugcacuuacacaagacuuuccccauacucugucucccuauaaugcugg

SEQ ID NO: 213903 - RNA, 61 nt, Human
caccgcuccccacagcuuugcaccccuuuccuccccauacacacacaaaccauuuuauuuu

SEQ ID NO: 213904 - RNA, 61 nt, Human
agcuuccaugccuuuggaucuuccauguuccuccccauauuccuggacuucggagauggcc

SEQ ID NO: 213905 - RNA, 61 nt, Human
ugcccccccacguagccuggacaucgucuuauccccauaauccuugccaucccuacaaggc

SEQ ID NO: 213906 - RNA, 61 nt, Human
cacagccaagguaggcaugcauaugaggucuuccccauacccucuggguguugagagguuu

SEQ ID NO: 213907 - RNA, 61 nt, Human
cuacacuuggaucuuacugauccagaaauaguccccauaguuagaguaguuacuuaugaag

SEQ ID NO: 213908 - RNA, 61 nt, Human
cuggauuuguggguguuuucaggccuuccauuccccauagaggcaaggcccaauggccagu

SEQ ID NO: 213909 - RNA, 61 nt, Human
acagaaaaauagcccgauguagguuucgguguccccauauaggcccguccacacaggcuug

SEQ ID NO: 213910 - RNA, 61 nt, Human
cugaucagccaugaugggugaugucagauguuccccauauugugacaucgagcuggaugug

SEQ ID NO: 213911 - RNA, 61 nt, Human
caggcggaugugucccccccagccccuccccuccccauaccaaagugcugacaggcccucc

SEQ ID NO: 213912 - RNA, 61 nt, Human
auucuagacugcuuucacuuauuucauuuccuccccauacaaauuugaugagcagguacac

SEQ ID NO: 213913 - RNA, 61 nt, Human
ucaaguauggauuucagaggugcucuuagauuccccauacacccaaggguaauaaacgugu

SEQ ID NO: 213914 - RNA, 61 nt, Human
ccaacaaaacccauaccuaucaagcugucacuccccauaccccauucucuuuuucaucucg

SEQ ID NO: 213915 - RNA, 61 nt, Human
uuuaacccaacuuuuuauacgaugccccaguuccccauaacuuugcacacaagcuucugug

SEQ ID NO: 213916 - RNA, 61 nt, Human
accacuccucauguaaucuuugccucucucuuccccauagcuuuucuaguuguuguuuuuc

SEQ ID NO: 213917 - RNA, 61 nt, Human
caugugggucccuaugaguguagagcccauauccccauagagucuaccuagagcagggguc

SEQ ID NO: 213918 - RNA, 61 nt, Human
acauauguauacauuccacguguguauauaguccccauauguauacauuccacguguguau

SEQ ID NO: 213919 - RNA, 61 nt, Human
ccccuacuccccgcaucuuuggggaaucgguuccccauaugucuuccuuacuagacuguga

SEQ ID NO: 213920 - RNA, 61 nt, Human
cuucagccaagucaaacuucaugcagcagaauccccauaccagaaaaauuaccuacaugua

SEQ ID NO: 213921 - RNA, 61 nt, Human
ugacaccucacuucccuagagaaggccugccuccccauagggaaucuggggguuucuucug

SEQ ID NO: 213922 - RNA, 61 nt, Human
ugcccaggccagaggguagagcacagggguuuccccauacuaccuccccuccccaggacac

SEQ ID NO: 213923 - RNA, 61 nt, Human
gaacccauucacccuucacccucacuccugguccccauacccagcaucuaaucauccaugc

SEQ ID NO: 213924 - RNA, 61 nt, Human
uguacaggagacaucgcguguauuuuuaacguccccauauuuaugugacuagaagcgcaac

SEQ ID NO: 213925 - RNA, 61 nt, Human
agcagcuagaaagagaaaaagcccucuucaauccccauaaugcuucuuuccucuuaauguc

SEQ ID NO: 213926 - RNA, 61 nt, Human
uuuauuucuuccaaccuugcaaggaccacacuccccauacccuucagugcaguguaccagg

SEQ ID NO: 213927 - RNA, 61 nt, Human
guccccaguguccccuccccuccaucucucuuccccauagaccccauaaccccagaccaaa

SEQ ID NO: 213928 - RNA, 61 nt, Human
gccaugaccaugcuggcagagucuuuccuguuccccauaugcugcuugaggggccccaccc

SEQ ID NO: 213929 - RNA, 61 nt, Human
ucugagggcccuaggucauggagagccucaguccccauaaugaggacaggguaccaugccc

SEQ ID NO: 213930 - RNA, 61 nt, Human
augccuuugcgugaggcaugcacucucagguuccccauagugucucccccgcugccaccca

SEQ ID NO: 213931 - RNA, 61 nt, Human
agauuggccuucggugaggaauucagggcuuuccccauaucuucucucccccaccuuuauc

SEQ ID NO: 213932 - RNA, 61 nt, Human
gccugugccgcacuagccucccucuccucuguccccauagcugguuuuucccaccaauccu

SEQ ID NO: 213933 - RNA, 61 nt, Human
cucugacuugcuaauggauguagccagggacuccccauagcaaagggucuguggccaguug

SEQ ID NO: 213934 - RNA, 61 nt, Human
cccucaccacggacacggacagaggaccaccuccccauacagagagaggcuucccucccag

SEQ ID NO: 213935 - RNA, 61 nt, Human
gucaugaggagaacugaccagcccucaucauuccccauaaaaccacggacagcgucugugu

SEQ ID NO: 213936 - RNA, 61 nt, Human
ucacccugcuggucccaggucggcacacacauccccauaauggcauuucuccuuucugugc

SEQ ID NO: 213937 - RNA, 61 nt, Human
cacuacaacuuaauugcucuaugccucaguuuccccauaauacccuuuuccaaccuaccuc

SEQ ID NO: 213938 - RNA, 61 nt, Human
agcaggcacugucacagaguaauggcauuaauccccauaauaauccugugaaggugauauu

SEQ ID NO: 213939 - RNA, 61 nt, Human
cagucuuaaaucucuccgcuaaaguggacauuccccauaaaaauuguccagcugccuggcu

SEQ ID NO: 213940 - RNA, 61 nt, Human
uaaauaauaaacaaaauuaccgagaaccccauccccauauaacaccaacaguguacauguu

SEQ ID NO: 213941 - RNA, 61 nt, Human
aauaauuaacucuuccucucuucugauaaauuccccauaccucccaauccaaguagcaucu

SEQ ID NO: 213942 - RNA, 61 nt, Human
caauguuaaaugccucuacuaaaguggggauuccccauaaaaauuguccagcuaccugacu

SEQ ID NO: 213943 - RNA, 62 nt, Human; identical to SEQ ID NO: 57488

SEQ ID NO: 213944 - RNA, 62 nt, Human; identical to SEQ ID NO: 57489

SEQ ID NO: 213945 - RNA, 62 nt, Human; identical to SEQ ID NO: 57490

SEQ ID NO: 213946 - RNA, 62 nt, Human; identical to SEQ ID NO: 57491

SEQ ID NO: 213947 - RNA, 62 nt, Human; identical to SEQ ID NO: 57492

SEQ ID NO: 213948 - RNA, 62 nt, Human; identical to SEQ ID NO: 57493

SEQ ID NO: 213949 - RNA, 62 nt, Human; identical to SEQ ID NO: 57494

SEQ ID NO: 213950 - RNA, 62 nt, Human; identical to SEQ ID NO: 57495

SEQ ID NO: 213951 - RNA, 62 nt, Human; identical to SEQ ID NO: 57496

SEQ ID NO: 213952 - RNA, 62 nt, Human; identical to SEQ ID NO: 57497

SEQ ID NO: 213953 - RNA, 62 nt, Human; identical to SEQ ID NO: 57498

SEQ ID NO: 213954 - RNA, 62 nt, Human; identical to SEQ ID NO: 57499

SEQ ID NO: 213955 - RNA, 62 nt, Human; identical to SEQ ID NO: 57500

SEQ ID NO: 213956 - RNA, 62 nt, Human; identical to SEQ ID NO: 57501

SEQ ID NO: 213957 - RNA, 62 nt, Human; identical to SEQ ID NO: 57502

SEQ ID NO: 213958 - RNA, 62 nt, Human; identical to SEQ ID NO: 57503

SEQ ID NO: 213959 - RNA, 62 nt, Human; identical to SEQ ID NO: 57504

SEQ ID NO: 213960 - RNA, 62 nt, Human; identical to SEQ ID NO: 57505

SEQ ID NO: 213961 - RNA, 62 nt, Human; identical to SEQ ID NO: 57506

SEQ ID NO: 213962 - RNA, 62 nt, Human; identical to SEQ ID NO: 57507

SEQ ID NO: 213963 - RNA, 62 nt, Human; identical to SEQ ID NO: 57508

SEQ ID NO: 213964 - RNA, 62 nt, Human; identical to SEQ ID NO: 57509

SEQ ID NO: 213965 - RNA, 62 nt, Human; identical to SEQ ID NO: 57510

SEQ ID NO: 213966 - RNA, 62 nt, Human; identical to SEQ ID NO: 57511

SEQ ID NO: 213967 - RNA, 62 nt, Human; identical to SEQ ID NO: 57512

SEQ ID NO: 213968 - RNA, 62 nt, Human; identical to SEQ ID NO: 57513

SEQ ID NO: 213969 - RNA, 62 nt, Human; identical to SEQ ID NO: 57514

SEQ ID NO: 213970 - RNA, 62 nt, Human; identical to SEQ ID NO: 57515

SEQ ID NO: 213971 - RNA, 62 nt, Human; identical to SEQ ID NO: 57516

SEQ ID NO: 213972 - RNA, 62 nt, Human; identical to SEQ ID NO: 57517

SEQ ID NO: 213973 - RNA, 62 nt, Human; identical to SEQ ID NO: 57518

SEQ ID NO: 213974 - RNA, 62 nt, Human; identical to SEQ ID NO: 57519

SEQ ID NO: 213975 - RNA, 62 nt, Human; identical to SEQ ID NO: 57520

SEQ ID NO: 213976 - RNA, 62 nt, Human; identical to SEQ ID NO: 57521

SEQ ID NO: 213977 - RNA, 62 nt, Human; identical to SEQ ID NO: 57522

SEQ ID NO: 213978 - RNA, 62 nt, Human; identical to SEQ ID NO: 57523

SEQ ID NO: 213979 - RNA, 62 nt, Human; identical to SEQ ID NO: 57524

SEQ ID NO: 213980 - RNA, 62 nt, Human; identical to SEQ ID NO: 57525

SEQ ID NO: 213981 - RNA, 62 nt, Human; identical to SEQ ID NO: 57526

SEQ ID NO: 213982 - RNA, 62 nt, Human; identical to SEQ ID NO: 57527

SEQ ID NO: 213983 - RNA, 62 nt, Human; identical to SEQ ID NO: 57528

SEQ ID NO: 213984 - RNA, 62 nt, Human; identical to SEQ ID NO: 57529

SEQ ID NO: 213985 - RNA, 62 nt, Human; identical to SEQ ID NO: 57530

SEQ ID NO: 213986 - RNA, 62 nt, Human; identical to SEQ ID NO: 57531

SEQ ID NO: 213987 - RNA, 62 nt, Human; identical to SEQ ID NO: 57532

SEQ ID NO: 213988 - RNA, 62 nt, Human; identical to SEQ ID NO: 57533

SEQ ID NO: 213989 - RNA, 62 nt, Human; identical to SEQ ID NO: 57534

SEQ ID NO: 213990 - RNA, 62 nt, Human; identical to SEQ ID NO: 57535

SEQ ID NO: 213991 - RNA, 62 nt, Human; identical to SEQ ID NO: 57536

SEQ ID NO: 213992 - RNA, 62 nt, Human; identical to SEQ ID NO: 57537

SEQ ID NO: 213993 - RNA, 62 nt, Human; identical to SEQ ID NO: 57538

SEQ ID NO: 213994 - RNA, 62 nt, Human; identical to SEQ ID NO: 57539

SEQ ID NO: 213995 - RNA, 62 nt, Human; identical to SEQ ID NO: 57540

SEQ ID NO: 213996 - RNA, 62 nt, Human; identical to SEQ ID NO: 57541

SEQ ID NO: 213997 - RNA, 62 nt, Human; identical to SEQ ID NO: 57542

SEQ ID NO: 213998 - RNA, 62 nt, Human; identical to SEQ ID NO: 57543

SEQ ID NO: 213999 - RNA, 62 nt, Human; identical to SEQ ID NO: 57544

SEQ ID NO: 214000 - RNA, 62 nt, Human; identical to SEQ ID NO: 57545

SEQ ID NO: 214001 - RNA, 62 nt, Human; identical to SEQ ID NO: 57546

SEQ ID NO: 214002 - RNA, 62 nt, Human; identical to SEQ ID NO: 57547

SEQ ID NO: 214003 - RNA, 62 nt, Human; identical to SEQ ID NO: 57548

SEQ ID NO: 214004 - RNA, 62 nt, Human; identical to SEQ ID NO: 57549

SEQ ID NO: 214005 - RNA, 62 nt, Human; identical to SEQ ID NO: 57550

SEQ ID NO: 214006 - RNA, 62 nt, Human; identical to SEQ ID NO: 57551

SEQ ID NO: 214007 - RNA, 62 nt, Human; identical to SEQ ID NO: 57552

SEQ ID NO: 214008 - RNA, 62 nt, Human; identical to SEQ ID NO: 57553

SEQ ID NO: 214009 - RNA, 62 nt, Human; identical to SEQ ID NO: 57554

SEQ ID NO: 214010 - RNA, 62 nt, Human; identical to SEQ ID NO: 57555

SEQ ID NO: 214011 - RNA, 62 nt, Human; identical to SEQ ID NO: 57556

SEQ ID NO: 214012 - RNA, 62 nt, Human; identical to SEQ ID NO: 57557

SEQ ID NO: 214013 - RNA, 62 nt, Human; identical to SEQ ID NO: 57558

SEQ ID NO: 214014 - RNA, 59 nt, Human
ucguagauguuuuugaaguugacaugacuuacgugcauuuaaauauauauugccauccu

SEQ ID NO: 214015 - RNA, 59 nt, Human
gaaagugacauuugcuuucgguacuguaauacgugcaccaaacugccucaauccuaggu

SEQ ID NO: 214016 - RNA, 59 nt, Human
acuauauguggguugagcuaugcagaagauacgugcaugaaaaaacaucuuuauuuucu

SEQ ID NO: 214017 - RNA, 59 nt, Human
accugcugaagcagguggaugcucaagauuacgugcaaggaaucccucccaucugguac

SEQ ID NO: 214018 - RNA, 59 nt, Human
acccacauacagacagaccuaccuauacauacgugcacacacacauacauauucauaca

SEQ ID NO: 214019 - RNA, 59 nt, Human
uuuggggagcaaugccaugauaaggagcauacgugcauguuuuccguacuuucagaaua

SEQ ID NO: 214020 - RNA, 59 nt, Human
ucucuguauuuuuguuacaaagccacugauacgugcacaauuguaauuaaguauguugc

SEQ ID NO: 214021 - RNA, 59 nt, Human
gaaaaugcauuuucuucagaauuauccauuacgugcauuuaaacucugccagaaaaaaa

SEQ ID NO: 214022 - RNA, 59 nt, Human
caccaccacagcccaccuccguccucacauacgugcaggcuggcucgggaguccaguga

SEQ ID NO: 214023 - RNA, 59 nt, Human
ucaggguaauuguauugagaacucaaauauacgugcacuuacaugugugguucguacuc

SEQ ID NO: 214024 - RNA, 59 nt, Human
uuuggguaaagagaaacauaaaucuagccuacgugcacaucugggcacaguaccuuucc

SEQ ID NO: 214025 - RNA, 59 nt, Human
cgcgggucguguccgcgggacuguguucguacgugcauaguuucgauaucacaucgcgg

SEQ ID NO: 214026 - RNA, 59 nt, Human
aaaaccuuugauauuuauaaaaucauuuuuacgugcaaaauauaaccuuaauauuugaa

SEQ ID NO: 214027 - RNA, 59 nt, Human
acacacgugcgugcgagcacacacacacauacgugcacaggguccccgagugccuaggu

SEQ ID NO: 214028 - RNA, 59 nt, Human
gugaaacccuacagcauugcuccguagaguacgugcaaguuccuugacccugggaaaug

SEQ ID NO: 214029 - RNA, 59 nt, Human
gcuggaugucuccaucucugucucaacuuuacgugcacugagcugcaacuucuuacuuc

SEQ ID NO: 214030 - RNA, 59 nt, Human
augugcugcauaaauaaucggggauucuguacgugcauugugcucucucauggucugua

SEQ ID NO: 214031 - RNA, 59 nt, Human
uaagcgcgacccaggcacugcagcaccccuacgugcagaggugggggugggagagaguc

SEQ ID NO: 214032 - RNA, 59 nt, Human
gaggagcgggaacuggggaauucuggcccuacgugcauucacaggcaaugauggguuug

SEQ ID NO: 214033 - RNA, 59 nt, Human
augaagaaaugucuuuugcccguuuugauuacgugcaugcaaacagcgauuugcaaaga

SEQ ID NO: 214034 - RNA, 59 nt, Human
aacauguaccgagaggacuaaaugucaucuacgugcaugugagagcguguuaaccuaga

SEQ ID NO: 214035 - RNA, 59 nt, Human
auucccauauucaccagcuccuccuuagcuacgugcacacuuguguccuccuuccccuu

SEQ ID NO: 214036 - RNA, 59 nt, Human
acacccucaacaaacaccagcgcuuuggguacgugcagcacuacggccugggcagugcc

SEQ ID NO: 214037 - RNA, 59 nt, Human
gaagaaguauauauauccauucuguauuuuacgugcagcagaauuaucuuccguaggau

SEQ ID NO: 214038 - RNA, 59 nt, Human
uuuuuaucguacuuuuuaaauagccuucuuacgugcaauucugaguuagagguaaagcc

SEQ ID NO: 214039 - RNA, 59 nt, Human
cauuuccuuauucucaauuuaucaauggauacgugcauguuauuucagaauuaugcaaa

SEQ ID NO: 214040 - RNA, 59 nt, Human
agagaugguuuugcugcucuccuugaggauacgugcaagggaaguugggcuguuguaaa

SEQ ID NO: 214041 - RNA, 59 nt, Human
gggcaugugcccauuucuaugugugugucuacgugcagcucacuaccaacagccucaug

SEQ ID NO: 214042 - RNA, 59 nt, Human
ccucaucuaagcaacaguuuaaagcacauuacgugcaauggcauagaaagugugaacaa

SEQ ID NO: 214043 - RNA, 59 nt, Human
gguuugugacuuuccuaaaucaauucuauuacgugcaauacuucaauacuucauuuaaa

SEQ ID NO: 214044 - RNA, 59 nt, Human
ccaucuccauaagcacccuaggcacugacuacgugcacaaguuugugggcaaagagcca

SEQ ID NO: 214045 - RNA, 59 nt, Human
gcaaggagcugcagcauucucaucauagauacgugcaguaucuuuaaugaguaucuuca

SEQ ID NO: 214046 - RNA, 59 nt, Human
acaaccaaaaaagcaagagcgagagagaguacgugcacacgcgcacaaaagagagaaac

SEQ ID NO: 214047 - RNA, 59 nt, Human
aacauucaccuugaccuuauuuaugacuuuacgugcaaauguuuugaccauauugauca

SEQ ID NO: 214048 - RNA, 59 nt, Human
auauuaaagugaacugcuaauaguguaaguacgugcacaaaaccacugccagauaacca

SEQ ID NO: 214049 - RNA, 59 nt, Human
guauagagagcuuucaguucauugauuuauacgugcauauuucagucucaguauuuaug

SEQ ID NO: 214050 - RNA, 59 nt, Human
ccagcccccuagucuaauacccacccugauacgugcaaucauguaguuuuggcggaaau

SEQ ID NO: 214051 - RNA, 59 nt, Human
cauugcauuugucaccuagucacuguauauacgugcacauuugaccuuuuggcacagcc

SEQ ID NO: 214052 - RNA, 59 nt, Human
uaacaagcccucaucacaugugugagucuuacgugcacaaaaagagaaggcuuugguac

SEQ ID NO: 214053 - RNA, 59 nt, Human
ugcugaggcugcaguggugucguggguguuacgugcaggaacguggagacccugacgug

SEQ ID NO: 214054 - RNA, 59 nt, Human
agacaaaagaaacuuaccaauugauguuuuacgugcaaacaaccugaaucuuuuuuuua

SEQ ID NO: 214055 - RNA, 59 nt, Human
ugggagcugguggcgacugaguccuucuguacgugcaacugggaaacuuuuguccuuug

SEQ ID NO: 214056 - RNA, 59 nt, Human
caugcacacaacccaguguacacaccaccuacgugcacacagcauccuuccacacugug

SEQ ID NO: 214057 - RNA, 59 nt, Human
auaggagccuauauaaauauaaacauauauacgugcacucuacagaauggccuucauac

SEQ ID NO: 214058 - RNA, 59 nt, Human
gcuggccuggcagccaggacuucuccguguacgugcauccccaguccccgccggggcgg

SEQ ID NO: 214059 - RNA, 59 nt, Human
ugaggccuccacgggacuucauuuaagaauacgugcauggcuggcacaguggcuuacgc

SEQ ID NO: 214060 - RNA, 59 nt, Human
acuuggaauuucuccuuuuaguguuuauauacgugcagauuaauuuauauauauauaua

SEQ ID NO: 214061 - RNA, 59 nt, Human
acaccuguauagaccaugcacaguacacauacgugcauacacaugccugcauacaggca

SEQ ID NO: 214062 - RNA, 59 nt, Human
ccugggcacccagcugcaggccccugcccuacgugcacuacaggaaggggugaggagag

SEQ ID NO: 214063 - RNA, 59 nt, Human
ggguucccacucccauuggccuggcccuguacgugcacucugucaucuccuuggucacc

SEQ ID NO: 214064 - RNA, 59 nt, Human
aagggcagacugcaaacuggggggcugcguacgugcaggaggcgcgguggggcugcgug

SEQ ID NO: 214065 - RNA, 59 nt, Human
uguauucaaauacuaaguaucuuauaugcuacgugcauacacauucuuuucuuaaacuu

SEQ ID NO: 214066 - RNA, 59 nt, Human
ggauguggcuucacgaguucagcccauuguacgugcaggucccgugggaaggaggcaaa

SEQ ID NO: 214067 - RNA, 59 nt, Human; identical to SEQ ID NO: 214065

SEQ ID NO: 214068 - RNA, 59 nt, Human
ucaggaggcuuagcauauugcuuggauucuacgugcagcggguucucugccuccgugaa

SEQ ID NO: 214069 - RNA, 64 nt, Human
uccgcccuucccugacacugucugcugccccaaucaccgucacaauaaaagaaacuguggucuc

SEQ ID NO: 214070 - RNA, 60 nt, Human
ccagagacuucuacccauagcacaucccaacaccgucacgccaaaggaagagaaagauca

SEQ ID NO: 214071 - RNA, 53 nt, Human
accugguuuucaccuacugagcccaccgucagcggggcgcgcacgcccccaaa

SEQ ID NO: 214072 - RNA, 64 nt, Human
ugagccuugaacucuguucuuugcauuucaauuucaccgucaagccuuucaccuuccucaaaau

SEQ ID NO: 214073 - RNA, 64 nt, Human
acacacacacuucacacauacacaccacucccaccaccgucaugauggaggaauuacguuauac

SEQ ID NO: 214074 - RNA, 64 nt, Human
ccucccaaagaggcccgcccugcccgggcucccacaccgucagguacuccugccagggaacugg

SEQ ID NO: 214075 - RNA, 64 nt, Human
uuccguggguucugucauguaacacgacaugcuccaccgucaggggggaguaugagcagagugc

SEQ ID NO: 214076 - RNA, 64 nt, Human
uacgccagggcgguuccaaacucuaaaccguucccaccgucagggagaccuacaguuucggggg

SEQ ID NO: 214077 - RNA, 64 nt, Human
agcagagucuggcuccccagugccuugcuagagucaccgucauucugaggucaaaucauggccc

SEQ ID NO: 214078 - RNA, 64 nt, Human
acccagagaggccuggcacacaaggcccaagcaccaccgucaacacagcccaguccauacagaa

SEQ ID NO: 214079 - RNA, 64 nt, Human
gaggcucauaguugaugagggacuuucccugcuccaccgucacucccccaacucugcccgccuc

SEQ ID NO: 214080 - RNA, 64 nt, Human
cgagguggaggguagcccuggggccccucgacaucaccgucauugauggagccugaaccgugug

SEQ ID NO: 214081 - RNA, 64 nt, Human
auuuugcuggaauucucccaugucaucaccccaccaccgucacuucuguaccugcaucaagaaa

SEQ ID NO: 214082 - RNA, 64 nt, Human
gaggauuuugacacauucaguaacuaauggaacacaccgucaacaugaauucgcaccuuacaug

SEQ ID NO: 214083 - RNA, 64 nt, Human
ugccuugcuucucaugagugugcuugacagucaucaccgucacucuaucuucauuucugguucu

SEQ ID NO: 214084 - RNA, 64 nt, Human
guacuuucuuaaugacugaaagauaaguggguagcaccgucagagagaaaauguuggaucugcc

SEQ ID NO: 214085 - RNA, 64 nt, Human
acuuaacggcauaaagcaaaacaggaccuuggcacaccgucagcucgaacucaacacuggcagc

SEQ ID NO: 214086 - RNA, 64 nt, Human
cccuucccaguuucccagcaggggcuucaugggccaccgucagugggucugggccugccagagu

SEQ ID NO: 214087 - RNA, 64 nt, Human
gaaauggacagaguuaucgaggcacauacuucaccaccgucacaggaagcacuugccaagcuug

SEQ ID NO: 214088 - RNA, 64 nt, Human
gaugucuugggugaggguagggagaggacaaggggucaccgagcccuucccagagagcagggag

SEQ ID NO: 214089 - RNA, 64 nt, Human
ccauauaccacccaaaaucaauuuucuuguacaacugguacacacuaauaaacaauuaaacaua

SEQ ID NO: 214090 - RNA, 64 nt, Human
aaaaauaguaugauaaagauuucagaguacaggucugguacaaucacaguucauugcagccuca

SEQ ID NO: 214091 - RNA, 64 nt, Human
ccgugcaaguaaccacgggguccaucuuuuacaucugguacacacaacagacgcucaguuguuc

SEQ ID NO: 214092 - RNA, 64 nt, Human
aagacaugcucucacauauagagguacacaaacacaccgucaugcacauuucagcuugcgucua

SEQ ID NO: 214093 - RNA, 64 nt, Human
cagaaacaacugggaauccugaaagagaagcagacaccgucacaggccccucugguuagacuag

SEQ ID NO: 214094 - RNA, 64 nt, Human
gccuggcccacccaaggugccuggggcaggcgggcaccgucauucgcugccauuggcuucucag

SEQ ID NO: 214095 - RNA, 64 nt, Human
cugcaagguugccaggacccacccucaucccuggcaccgucaugggaguuugcucuuggaugag

SEQ ID NO: 214096 - RNA, 64 nt, Human
cgcugacugccacccacacgcccuccccagacuccaccgucagcuguaacccucacccacagcc

SEQ ID NO: 214097 - RNA, 64 nt, Human
aucacgccugccccagagcaguguguggcggugacaccgucacccagcaugcgccacgccgugg

SEQ ID NO: 214098 - RNA, 64 nt, Human
ucucaggcugcugagcuagacuaaggaaugcauccaccgucaucacaugagacacugacucugu

SEQ ID NO: 214099 - RNA, 64 nt, Human
gcuguuuccacacguggacucggaucugcugugacaccgucagcccgacagucucuccauaugc

SEQ ID NO: 214100 - RNA, 64 nt, Human
ucugcccacggucaggugacagccaccuccagggcaccgucaggguggugcuggccacagaggc

SEQ ID NO: 214101 - RNA, 64 nt, Human
uguuggaucugaggugauauguucugaauguaagcaccgucaacaucagacaccuacucaugga

SEQ ID NO: 214102 - RNA, 64 nt, Human
aaggcagaugggagggggcuggucuggcuguggccaccgucacaguccaggaugaagaggagua

SEQ ID NO: 214103 - RNA, 64 nt, Human
caccucacugccucucauuugccuuacccagacgcaccgucacccugcaccagcuuuggcccuc

SEQ ID NO: 214104 - RNA, 64 nt, Human
guuacugcacaacuuuaguucuugacuuagucugcaccgucaucuagauuguauuguacaucuc

SEQ ID NO: 214105 - RNA, 64 nt, Human
cccagagccugccagggagggcuggccucaccaccaccgucaauaaaggauuugaauccccaug

SEQ ID NO: 214106 - RNA, 64 nt, Human
uuaauacagcagugucaucagaagauaacuugagcaccgucauggcuuaauguuuauuccugau

SEQ ID NO: 214107 - RNA, 64 nt, Human
uuuccuaaugccagaagggugaccagugaagauucaccgucaaaccaugaaaguccuuucuugg

SEQ ID NO: 214108 - RNA, 64 nt, Human
ccaggccagagcaggaccacagauacuggacaagcugguacagccaacccccuagguguggacc

SEQ ID NO: 214109 - RNA, 64 nt, Human
auuguggaaugauguaagcaaaugcuuuugguuacugguacauguguuuuuuccuagcugaccu

SEQ ID NO: 214110 - RNA, 64 nt, Human
aacagucaaaugcccaaccaacugcaaccaugaucugguacaggcaugcucaccagcccagccc

SEQ ID NO: 214111 - RNA, 64 nt, Human
agaaucaacaaaacuagguugguuaaacauaucucugguacaucaaggggcaugauacaaacca

SEQ ID NO: 214112 - RNA, 64 nt, Human
ccccucucccuccccaggacacgaaagugaacuccaccgucauccccgagacgcaacugcaggc

SEQ ID NO: 214113 - RNA, 64 nt, Human
aaagaacuuucuuccuaggauguggggcuuaaagcaccgucaugugggguggaucagauaauug

SEQ ID NO: 214114 - RNA, 64 nt, Human
ccaaaccuugagaaugcaggagcucugugagcuccaccgucagcaccauucagcugcaucccuu

SEQ ID NO: 214115 - RNA, 64 nt, Human
aaggugaagacaucuagaaacauuacaccacacacaccgucaucacauuuucacaugcucaauu

SEQ ID NO: 214116 - RNA, 64 nt, Human
uauuuguggucucuguauuuauauuuauguuuagcaccgucaguguuccuauccaauuucaaaa

SEQ ID NO: 214117 - RNA, 64 nt, Human
cauagagaggcgcuagagcccauuccucuuucuccaccgucacccaacaucaauccuuuaccac

SEQ ID NO: 214118 - RNA, 64 nt, Human
uuugauuauagagagacucugggccacccucaaacaccgucagaugcauuagcagcccacugca

SEQ ID NO: 214119 - RNA, 64 nt, Human
cccauuccuggagggaccaguucauggaggccaucaccgucagugcaggugagaagugucucag

SEQ ID NO: 214120 - RNA, 64 nt, Human
gcaucgugugugaguacagggugcucagcucuuccaccgucauuuugaauuguucacaugggua

SEQ ID NO: 214121 - RNA, 64 nt, Human
acaguaaaacuaugguauuacaauguuaugggaccaccgucauguaagugguaugucuuugaca

SEQ ID NO: 214122 - RNA, 64 nt, Human
gucuccugcagaccacgccagggagugcagacaccaccgucacacacgccccuuuuguguuuug

SEQ ID NO: 214123 - RNA, 64 nt, Human
cacacgggauacaauaacucucuguuaaccagaacaccgucauuugaccaagcccuacaagagu

SEQ ID NO: 214124 - RNA, 64 nt, Human
auaugccugcaguaggagggagaggaaggggugccaccgucaacggcuucccaucggagguggu

SEQ ID NO: 214125 - RNA, 64 nt, Human
agcagcccucugucggccuccucccgacuugacucaccgucaccuggaagcagggcaccagcug

SEQ ID NO: 214126 - RNA, 64 nt, Human
ggacacgcggcuucccucccagucccugccuuggcaccgucacagaugccaagcaggcagcacu

SEQ ID NO: 214127 - RNA, 64 nt, Human
cugagaccaucguacaggcagaagcuuuggccagcaccgucacucucacugccauugccgagag

SEQ ID NO: 214128 - RNA, 64 nt, Human
gggcaugucagagaccuuugagacauuacacaaccugguacacaaaggggucaagguggugaug

SEQ ID NO: 214129 - RNA, 64 nt, Human
ccaggaugaaaaggaccagcaaaauacaucucgccugguacaggaacauaaaaagcuuuuagau

SEQ ID NO: 214130 - RNA, 64 nt, Human
ucucccaucucagcugcgugaccacggaaacucacugguacaguggggagaccuguaaccaggg

SEQ ID NO: 214131 - RNA, 64 nt, Human
gugaaggauaagagugguguuucuuuugcccuuucugguacaaacagagggacacuaagcauua

SEQ ID NO: 214132 - RNA, 64 nt, Human
gaaacuaggguacaaaucucccaaagaugguuugcaccgucauuucaaauguuugcacaauaua

SEQ ID NO: 214133 - RNA, 64 nt, Human
gcuguggcugagcuggaaggaaaucaccaggugccaccgucaauauuuaucagcuuucagcacu

SEQ ID NO: 214134 - RNA, 64 nt, Human
uaaauguaaagccaucuguccggcguaaggacgacaccgucagcuguccgacucgcacacauuu

SEQ ID NO: 214135 - RNA, 64 nt, Human
ccgccagccaguggccgaaccccccacucccugccaccgucacacaguauuuauuguucccaca

SEQ ID NO: 214136 - RNA, 64 nt, Human
uuaauuacaggagguuuguucaggucccccaaaccaccgucagauuugaugauuuccuagcagg

SEQ ID NO: 214137 - RNA, 64 nt, Human
gugaaccauuugaccuggcguauuguguacuagucaccgucaccaucucuccauauguaucucc

SEQ ID NO: 214138 - RNA, 64 nt, Human
cucagccuccccagcagcugggacuacaggcacccaccgucacacccggcuaauuuuuuuguau

SEQ ID NO: 214139 - RNA, 64 nt, Human
agcagcaggaaggaugugggacucuguccaaguucaccgucaccaucaagccacuggcugugga

SEQ ID NO: 214140 - RNA, 64 nt, Human
agaccucgcugcccugaggacaagcacuugccaccaccgucacucagcccugggcguagccgga

SEQ ID NO: 214141 - RNA, 64 nt, Human
cuuuaggaacuuugaauacugaaugacucucaaucaccgucagcuuuaguaaaaucucuuucuu

SEQ ID NO: 214142 - RNA, 64 nt, Human
ugcuuuuucucccuccuccucaaguuccuuuuugcaccgucaccacccaacaccuuccaugaca

SEQ ID NO: 214143 - RNA, 64 nt, Human
caccaccaccaacuugaauuccgucaucaaugcucaccgucaauauguuuacaaguuguagcag

SEQ ID NO: 214144 - RNA, 64 nt, Human
acccaggcuugccagccacagagcgccccaaagucaccgucaucccagccccuggccuuccugc

SEQ ID NO: 214145 - RNA, 64 nt, Human
gugggacucuaggaugcuucagaagaagcgacggcaccgucaacccucuguuuuuuaaaggugg

SEQ ID NO: 214146 - RNA, 64 nt, Human
ucuucagcuacagugcccugcugugggcuuggugcaccgucaacaccagagccguguaccugag

SEQ ID NO: 214147 - RNA, 64 nt, Human
ccucuaacaccuuccauguaugucaacuuuuuaucaccgucaggcauagacucguggagauuag

SEQ ID NO: 214148 - RNA, 64 nt, Human
auauugccucugcuccuaucaggguugcuaaacccugguacaucguauauaaaauguauuaaaa

SEQ ID NO: 214149 - RNA, 64 nt, Human
ucccaucuaugcugucaagggcugcugguuggugcugguacaaggagcccacucagcaguuuuc

SEQ ID NO: 214150 - RNA, 64 nt, Human
uguuuaagucacugacuuaugagaaagcaaagcacugguacaguuauuuaacaggcauacacaa

SEQ ID NO: 214151 - RNA, 64 nt, Human
ccacgaccggcugaucagugaaacagacaagcagcugguacaacagcacauaggcagcuugguu

SEQ ID NO: 214152 - RNA, 64 nt, Human
uuuuuucauuuuaauuaaaauuugaaauucugaacaccgucagcacccucucuucccuaucaug

SEQ ID NO: 214153 - RNA, 64 nt, Human
ccuccugacuccuguagacauucccaaugauacccaccgucauacauuuaggcuuuucuugccu

SEQ ID NO: 214154 - RNA, 64 nt, Human
uagauaccaucaacauccugcuguaugaugacaacagcaucaugaccuucaaccucagucaggu

SEQ ID NO: 214155 - RNA, 64 nt, Human
auacaaggaagauuguuuacuucaucaaggaacacagcaucauuaugcaauaugaaaccagcca

SEQ ID NO: 214156 - RNA, 64 nt, Human
acacagucuguuuucuauuuguuaagaaaaacuacagcaucauugcauaauucuugaugguaau

SEQ ID NO: 214157 - RNA, 64 nt, Human
cuuuggcccacccccuaaucccuaacucuucccucagcaucacagggcuucacugcacacacug

SEQ ID NO: 214158 - RNA, 64 nt, Human
uggaagaaaaaauacuuggaaacaaagaaagucacagcaucaauggaggagguuuuaacaaaac

SEQ ID NO: 214159 - RNA, 64 nt, Human
gauggggauucacuuacaugccucaugucaaaugcagcaucagucuuuccggggcauuucaguu

SEQ ID NO: 214160 - RNA, 58 nt, Human
uuauuccuccaaggcugugaugcccacacagcaucagcaugggcuuagagcuggcaug

SEQ ID NO: 214161 - RNA, 64 nt, Human
aagcauaauuggaauccuuggauaaauuuuguagcugguacacucuggccugggucucugaauu

SEQ ID NO: 214162 - RNA, 64 nt, Human
uccuggugguauuuucaauagccacuaaccuugccugguacaguauggggguuguaaauuggca

SEQ ID NO: 214163 - RNA, 64 nt, Human
aggaguccaaguaagcagucuggcuggaauaaggcagcaucacggaaauucuguaaggacugac

SEQ ID NO: 214164 - RNA, 64 nt, Human
cugagagggcuucucagccuggaaacuauggaaacagcaucaaagagaaaggaauguggggggu

SEQ ID NO: 214165 - RNA, 64 nt, Human
agcaggggucuggggcacggagccuugcuggcaucagcaucagcccuuccucccagagcccuca

SEQ ID NO: 214166 - RNA, 64 nt, Human
uacucaagaaauauuugcaacauuaguuuuuuuccagcaucagcaauugcuacucaauugucaa

SEQ ID NO: 214167 - RNA, 64 nt, Human
uugaacuaauagaggaacucugagucacccaugccagcaucagcuucagccccagacccugcag

SEQ ID NO: 214168 - RNA, 64 nt, Human
uggggcuggcagccaugugaagaaaggaggcucccagcaucaucuuccuacacauuauuacauu

SEQ ID NO: 214169 - RNA, 64 nt, Human
ugcccgccucggccucccaaagugcugggaugaccagcaucagccccaauguccagccucuuua

SEQ ID NO: 214170 - RNA, 64 nt, Human
uuuauaaagcgucagucaugcuuccagcaagaggcagcaucagucauggcuuuauaacagcuuc

SEQ ID NO: 214171 - RNA, 64 nt, Human
cuggaauuuaugugaagaaccaaacaacuuaaaccagcaucacuuuugucuucaauuugccuuc

SEQ ID NO: 214172 - RNA, 64 nt, Human
ugggccuuguauugcuuuuaaaguuuccucugcucagcaucauuucaugccaaagugcugcuau

SEQ ID NO: 214173 - RNA, 64 nt, Human
ucagagcucauacccaaagcauuacagagaacagcagcaucauugcccuccccagcugaaaaac

SEQ ID NO: 214174 - RNA, 64 nt, Human
ugccaaauggucuggcagcugguuuuggcauccccagcaucaccacucucccaacccaucaccg

SEQ ID NO: 214175 - RNA, 64 nt, Human
cucuuagcaaccgucuguagcaaagaagugcuuccagcaucacuccagcaacacgcccaugcgu

SEQ ID NO: 214176 - RNA, 64 nt, Human
uuaaugagcacuuggacuggugccuugaaggugacagcaucaaagucaaaagcgaagaaagucu

SEQ ID NO: 214177 - RNA, 64 nt, Human
guggagguaacuucaaaaaaguaaaagcuaucaucagcaucaucuuagacuuguaugaaauaac

SEQ ID NO: 214178 - RNA, 64 nt, Human
gaaggauccugguugcuaccagugggugcugauucagcaucacaagugacugaaauuggcugug

SEQ ID NO: 214179 - RNA, 64 nt, Human
uauuuuggaaauugaaaaacuuaauuuacaagugcugguacaucuuuuuucuuuuguggaccac

SEQ ID NO: 214180 - RNA, 64 nt, Human
agcuagagucagaccagaaugaaaaugccaggagcugguacacuacagauguaguaagaaccug

SEQ ID NO: 214181 - RNA, 64 nt, Human
gagucucccuuuucuacaguugauauauuuguaacugguacaagaugaaggacagcagcuuucc

SEQ ID NO: 214182 - RNA, 64 nt, Human
agcuuguuuggggaaagcauccaaauuuaaagggcugguacauaggaggagagaaaauggggau

SEQ ID NO: 214183 - RNA, 64 nt, Human
gaacuggcuauuagguaugucuugugcggucagucagcaucacagacacauagaugcucaccag

SEQ ID NO: 214184 - RNA, 64 nt, Human
gaugcaguguggcugcacuuaagggucuguuucucagcaucauggaugcaggggcuugucugaa

SEQ ID NO: 214185 - RNA, 64 nt, Human
gcuaggccauugguucucaaacuuaaggaaggaucagcaucacggaaggucuugucaaaagagu

SEQ ID NO: 214186 - RNA, 64 nt, Human
ccgcgcugcucugcagcaggggcuggggaguggacagcaucaggugggaaaguggaguccaccc

SEQ ID NO: 214187 - RNA, 64 nt, Human
gcucguggugggugcucaagacuggcauggacaucagcaucacgacaggcucucuuguauucuu

SEQ ID NO: 214188 - RNA, 64 nt, Human
uuuuuuuaaucugaagccccugauuuuauuuuuccagcaucacucuaaggaagaguguggauua

SEQ ID NO: 214189 - RNA, 64 nt, Human
aucaucucuuuucccacucccuuugcgucaggagcagcaucauucagcaaaugccuuuucaaau

SEQ ID NO: 214190 - RNA, 64 nt, Human
cacccacauccagggcagagaggucugugguucucagcaucagaaggcagcgcagccccucucc

SEQ ID NO: 214191 - RNA, 64 nt, Human
gagaugcagaacugggcccguggagcagcagugucagcaucagggcggaagccuuaaagcagca

SEQ ID NO: 214192 - RNA, 64 nt, Human
uggaagaagcaggaaaagcaagaagaaaagacagcagcaucaagaggaggaggacaucuuggau

SEQ ID NO: 214193 - RNA, 64 nt, Human
acugucccaaguugcuaagugaacagaacuaucucagcaucagaaugagaaagccugagaagaa

SEQ ID NO: 214194 - RNA, 64 nt, Human
gccgguauacucuaaaacaugcuugaugccuugucagcaucauugcacacauugacucuguauu

SEQ ID NO: 214195 - RNA, 64 nt, Human
ucuaccugagagaaugagcaccccucauccaucucagcaucaacacaauuuccaggggaccuca

SEQ ID NO: 214196 - RNA, 64 nt, Human
gcaugccccaugugggaggugcugagcuccaaaccagcaucacaccaacucugacacauggaug

SEQ ID NO: 214197 - RNA, 64 nt, Human
auaaggcugguguuaagcagaacagccauuaaaucagcaucaaaagaacaaauaguaaaaucca

SEQ ID NO: 214198 - RNA, 64 nt, Human
ccucugcccuucagaguagccucaccauuaguggcagcaucauguaacugaguggacugugcuu

SEQ ID NO: 214199 - RNA, 64 nt, Human
aacaaauggaccuauggcaucauggcuuuagaagcugguacauuuacugagcugauggacagug

SEQ ID NO: 214200 - RNA, 64 nt, Human
auuuaaucaaccagcaguuuugaaacuagucauccugguacaaaaguuuugcagcauugccuaa

SEQ ID NO: 214201 - RNA, 64 nt, Human
aucuguugcacacagcucacucguauguccugcacugguacaugcaucuguaauacaguuucua

SEQ ID NO: 214202 - RNA, 64 nt, Human
gucuggcacgggggagggcuggggcuuucucugccugguacacacggaaaggcggcugugcgga

SEQ ID NO: 214203 - RNA, 64 nt, Human
gcgcuagagucggggaggaucugcgcagagaccgcagcaucacccaaaucggcgccggccccgg

SEQ ID NO: 214204 - RNA, 64 nt, Human
aaaccgugccuucuggcucugcgccccauauucccagcaucauagacauccaacagcaccagca

SEQ ID NO: 214205 - RNA, 64 nt, Human
cagaagagaaagcuguauuccacuguaccccuugcagcaucaauaaaacugacagccaaauucu

SEQ ID NO: 214206 - RNA, 64 nt, Human
ugacugguauuuuuuacugaggagcaacucauuccagcaucaacaauaagauaaccuuuaagua

SEQ ID NO: 214207 - RNA, 64 nt, Human
uuaucaugcccuuguucuguguguaguuacuugacagcaucaaaugccgccucuuccuaauguc

SEQ ID NO: 214208 - RNA, 64 nt, Human
cauggaggaccgccccacccuggaaugccaaugucagcaucaagccccacaguucuuaauacag

SEQ ID NO: 214209 - RNA, 64 nt, Human
agaucucaugagaagucacucacuauugcaaggacagcaucaaagagauggugcuaaaccauuc

SEQ ID NO: 214210 - RNA, 64 nt, Human
cuggacugcaauaucaacaacaaguuguuucaaacagcaucaaaauacaacuucauugcuacac

SEQ ID NO: 214211 - RNA, 64 nt, Human
uugcaggcuuucccauggucacaggaugcacugucagcaucaggucccagagggccaccguguc

SEQ ID NO: 214212 - RNA, 64 nt, Human
ccccaccagaucuccuugaagcagaauuagggaucagcaucauuaacaccuuccccacccccuc

SEQ ID NO: 214213 - RNA, 64 nt, Human
cuccacuaguggugaaugcaugugucugucugaucagcaucacugcacacggaggucuagugag

SEQ ID NO: 214214 - RNA, 64 nt, Human
ccaugucuuuucuggaacauacuugcauccaccacagcaucaauucccuugauccagcccaaga

SEQ ID NO: 214215 - RNA, 64 nt, Human
cggagcccaggcgcaagccaucuaccuucuggcacagcaucagccggcuggcacccuuccgcaa

SEQ ID NO: 214216 - RNA, 64 nt, Human
auggagguagaaggaauugccuuucuuuuuuaaacagcaucaucuugauucuuagcuuggacag

SEQ ID NO: 214217 - RNA, 64 nt, Human
aguucucaaaguguggucucuggaagagcaguaucagcaucaucugggaacuugucacagaugc

SEQ ID NO: 214218 - RNA, 64 nt, Human
uuaaauccaaauucagcauuugcuguuagcuauucagcaucaggcacucuuauugauucaugag

SEQ ID NO: 214219 - RNA, 64 nt, Human
gggccucaguaaugggcccccccaaccccuuucucugguacagugcugucugccuggcugccuc

SEQ ID NO: 214220 - RNA, 64 nt, Human
cugcccucccuccuuccuuuugcuucucauagcccugguacaugguacacacacccccaccucc

SEQ ID NO: 214221 - RNA, 62 nt, Human
cuauccaguaucaucccuagugccuuuccauccugguacauggaugcuuugaaagauaugga

SEQ ID NO: 214222 - RNA, 64 nt, Human
cugggaacuucuuugcaguucccaucuccuuucucugguacaauuucuuuugguucauuuucag

SEQ ID NO: 214223 - RNA, 64 nt, Human
guugcauaaacagaauuagguaguauauugaagacagcaucauuaaacaguuauguuguucucc

SEQ ID NO: 214224 - RNA, 64 nt, Human
ggugugggcugugucguagccaaggugggcugagcccuggcaggaugacccugcgaaggggccc

SEQ ID NO: 214225 - RNA, 64 nt, Human
cccccauccacaccuggcacuccccucuaccaaucccuggcacaggguuccuggagagcaggug

SEQ ID NO: 214226 - RNA, 64 nt, Human
gcccaccagggacaccucgcccuucagcccaccacccuggcaggcuuccauccccguccaugcu

SEQ ID NO: 214227 - RNA, 64 nt, Human
gcagucacucugcuaagagucccucccugccacgcccuggcaggacacaggcacuuuuccaaug

SEQ ID NO: 214228 - RNA, 64 nt, Human
gcaaugaauguagaauaagggucuagaaaguccucccuggcagcuucuucaagagacuugcaua

SEQ ID NO: 214229 - RNA, 64 nt, Human
aacaggguacuguucgcucuugucuacagaacagcccuggcacugcauucaaauccagucuuca

SEQ ID NO: 214230 - RNA, 64 nt, Human
guuggagacaucugguccaccccauugccccugccccuggcaagcccugaagucgggagaggug

SEQ ID NO: 214231 - RNA, 64 nt, Human
caggguggggggcaggcuggaccaccaccaucugcccuggcagccuggcugcuccagcuccuga

SEQ ID NO: 214232 - RNA, 64 nt, Human
acagucagcuguggggaacacagcuacaacccuacccuggcagggaccugagagcaucucagga

SEQ ID NO: 214233 - RNA, 64 nt, Human
gggggguacagagggagaaggcucugcaagagcucccuggcaauacccccuuguguaauugcuu

SEQ ID NO: 214234 - RNA, 64 nt, Human
gcucccccucaauagaucuccagcgucagcugcucccuggcauucaacaaauauucacuggccc

SEQ ID NO: 214235 - RNA, 64 nt, Human
cugacugugcucaccacacaucuggggcagccuucccuggcaggggcccucguggcuucucauu

SEQ ID NO: 214236 - RNA, 64 nt, Human
gaggcaggaaaaacgcgagugucugaagaccucacccuggcagggugggcuucuauccacccau

SEQ ID NO: 214237 - RNA, 54 nt, Human
ccagccucaucgagaucugagcagcccuggcaccggguacugggcggagagccc

SEQ ID NO: 214238 - RNA, 64 nt, Human
auggauugugaaauggaaucucccagaaccccugcccuggcagccuggaagaccgugccugccc

SEQ ID NO: 214239 - RNA, 64 nt, Human
agauucccaaguagaggcagccagaauucugacucccuggcagcagcagggcuuucaggcacca

SEQ ID NO: 214240 - RNA, 64 nt, Human
ucacaugaugaaacuccuuuugucuauaaccaggcccuggcaaagugcaaacaggaugcaacug

SEQ ID NO: 214241 - RNA, 64 nt, Human
ucagccuuguggccaguuccucuucacaugaagccccuggcauuugcuggggaagggacuggcc

SEQ ID NO: 214242 - RNA, 64 nt, Human
ccccaucuugcuucccuaaucuauggucgggagacagcaucaggguuaagaagacuuuuuuuuu

SEQ ID NO: 214243 - RNA, 64 nt, Human
ugaccgcacgcauucauaaagcaaaggaguacuacagcaucaaggcacaacacaaaaaccaaca

SEQ ID NO: 214244 - RNA, 64 nt, Human
ccuaggccagcuccuuagacaccuaucagagaagcagcaucaaccuaggagcagugggcccugg

SEQ ID NO: 214245 - RNA, 64 nt, Human
gugggaacgcuuugaucagaggaugcauauuauucagcaucagacagccgacacuggggaggag

SEQ ID NO: 214246 - RNA, 64 nt, Human
auguuggggcugaagacgagcaggggcaaccugccagcaucacagaauucaguguaguuuauac

SEQ ID NO: 214247 - RNA, 64 nt, Human
agcaagggggcugcugaaaucgcagagacuuuugcagcaucagaucugaggaguaaaacggcac

SEQ ID NO: 214248 - RNA, 64 nt, Human
agacucugcugaaaauauauagcucucacaaguucagcaucaccugcuuugaaauuagccuuag

SEQ ID NO: 214249 - RNA, 64 nt, Human
aauuuuuuuaaucucuagcaguuugguaauuuagcagcaucauuuauuugggauucuuuuaucu

SEQ ID NO: 214250 - RNA, 64 nt, Human
uauuucguauuucccccacugcuuuuuauuuguacagcaucauuaaacacuaagcucaguuaag

SEQ ID NO: 214251 - RNA, 64 nt, Human
agcccuuccccucugcagcuuccaggcuggcgugcagcaucagcaucccuagaaagccaugugc

SEQ ID NO: 214252 - RNA, 58 nt, Human
caucuagugcugaagucugagggcucugcagcaucagacccaccucuaagagaacuuu

SEQ ID NO: 214253 - RNA, 64 nt, Human
uaauuuaacacccuuuagaaccuuaaagaaccaucagcaucacccgggaacuuuuuuagaaaug

SEQ ID NO: 214254 - RNA, 64 nt, Human
acaagugccacuccaagggcgguccucggugcagcagcaucagcuucacuuguggggggguggg

SEQ ID NO: 214255 - RNA, 64 nt, Human
gguguggugcuucggacacguugaggggcuuugucagcaucaggaaggccuuugcuucuugcac

SEQ ID NO: 214256 - RNA, 64 nt, Human
ucaaaaucuacuuauuuaugaauccaagggguggcagcaucacucuguucuagcauucuuugug

SEQ ID NO: 214257 - RNA, 64 nt, Human
aguagacaaagauuaaugaaagggauguucaugacagcaucauauacgacugaaagaagaaaac

SEQ ID NO: 214258 - RNA, 64 nt, Human
guggcccccauacuugcccucccuugcucccccucccuggcaaacccuacccaaagccaguggg

SEQ ID NO: 214259 - RNA, 64 nt, Human
guuccucccucucuggccugugccgccucagcagcccuggcagaacugaagagcggcaccgggc

SEQ ID NO: 214260 - RNA, 64 nt, Human
uuccauaguuuugaugacuggcauuuuauagacacccuggcagccuuacuuuuaacaccuuuaa

SEQ ID NO: 214261 - RNA, 64 nt, Human
aggcugucucauuccacuagacugcccccugccacccuggcacuucccagggccuggcaguaug

SEQ ID NO: 214262 - RNA, 64 nt, Human
caugcagcccaggccuucuccauaccccucuccccagcaucaugagcaagggcauugccuccuc

SEQ ID NO: 214263 - RNA, 64 nt, Human
uccuugcgauguacaguaucagaaggugguuugacagcaucauaaacaggcugacuggcaggaa

SEQ ID NO: 214264 - RNA, 64 nt, Human
caauuuaguccucauuauuuauuuguagauccugcagcaucauguuguaauuaauuuuuuggaa

SEQ ID NO: 214265 - RNA, 64 nt, Human
agcagugguucucaaaguguggucccuggacuaucagcaucaaagcaucaccugggaacuugcu

SEQ ID NO: 214266 - RNA, 64 nt, Human
guggccaugccuauucuguugacuuuaaaagcagcagcaucaagaacuccuagccuucccaaau

SEQ ID NO: 214267 - RNA, 64 nt, Human
agaccgguacuagcuaacuccaagagaucguuagcagcaucaguccacaaacacuuaguggccc

SEQ ID NO: 214268 - RNA, 64 nt, Human
aaaugugucugcaacauggauuccaaagcauuuucagcaucaaacaugaaaacauugaugaaug

SEQ ID NO: 214269 - RNA, 64 nt, Human
cuucuguggcuacuucucggcuccugugugucaucagcaucaccuagguuuccagcugacuugg

SEQ ID NO: 214270 - RNA, 64 nt, Human
aacuucuccaauacaguaagagauaguguugaaccagcaucaagucuccagaaacauggcagag

SEQ ID NO: 214271 - RNA, 64 nt, Human
gaagaaagaugggaaacugaauaaagcaguugaucagcaucauuggaacauggggacgagugac

SEQ ID NO: 214272 - RNA, 64 nt, Human
gggaagggccacaaccucuguuucugugacccagcagcaucaagccccucgcugggcaccucgc

SEQ ID NO: 214273 - RNA, 64 nt, Human
ccacguuacuuuggccuguauuaaagcaguagagcagcaucaguuauuauaguccagaaaaagu

SEQ ID NO: 214274 - RNA, 64 nt, Human
uaucacggucgccaccuggcauuccuucugaccacagcaucauuuugcauucaaauuaaggguu

SEQ ID NO: 214275 - RNA, 64 nt, Human
ucuuggucauuuuaugacaauggaucuaaaaugucagcaucaugcaaagugcaacggaauagug

SEQ ID NO: 214276 - RNA, 64 nt, Human
gauauaguacuuuucaguuuuuguuuagugucuucagcaucacugugucuguauuucaaguaca

SEQ ID NO: 214277 - RNA, 64 nt, Human
gcccagcucugacugaaggggcuuggcuuccacucagcaucagcguggcagucaccaccccagu

SEQ ID NO: 214278 - RNA, 64 nt, Human
gagacucuucuggauacuuuugucuuccacccugcccuggcagugcagccaaucagaaauggcu

SEQ ID NO: 214279 - RNA, 64 nt, Human
cccauuauuaauuaaccucuuucuuugguuggaacccuggcaguucugcucccuuccuaggauc

SEQ ID NO: 214280 - RNA, 64 nt, Human
gaugcucugacucuucucuguaugucaaacucaucccuggcacaagaaauuccagucaugugaa

SEQ ID NO: 214281 - RNA, 64 nt, Human
cugggaggacuggaccguuuccaagcugcgggcucccuggcaggaugcugagcuugucuuuucu

SEQ ID NO: 214282 - RNA, 64 nt, Human
guguuaacugucaacaugaaguauuuucacuucgcagcaucaacuuucaagcauaaguaaaaac

SEQ ID NO: 214283 - RNA, 64 nt, Human
aaaaaauaagcaucaucaaugccauuaucccagacagcaucagcagaugcaccuguugacagcc

SEQ ID NO: 214284 - RNA, 64 nt, Human
uggauggaugugauuucaggagauugugcagugccagcaucagugcauaaaggguccuguaugu

SEQ ID NO: 214285 - RNA, 64 nt, Human
ccuacaauggccuuguaacagccauuguucccaacagcaucacuuaggggugugaaaagaagua

SEQ ID NO: 214286 - RNA, 64 nt, Human
ggaaucaugaugauaaucauagcagcacuuuucacagcaucagcagucaucucacuaguuaugu

SEQ ID NO: 214287 - RNA, 64 nt, Human
ccuagacauggaaaaacagauuacugucuauugucagcaucauuuucaucuguaagucacuacu

SEQ ID NO: 214288 - RNA, 58 nt, Human
aaggaaagaaaaagaaguaaccuaguaucagcaucaaguaugugguacuacuguaaga

SEQ ID NO: 214289 - RNA, 64 nt, Human
ccugcccgccuugguaguagugaccagucagugucagcaucagugucccaaccccagucucugu

SEQ ID NO: 214290 - RNA, 64 nt, Human
ggagugaggcucagagaaguugagggaccugucccagcaucacauggcugaugacaaguggaca

SEQ ID NO: 214291 - RNA, 64 nt, Human
uccaaauccagacaacuggacugucccagacuugcagcaucagagucuccugagucgaggaauc

SEQ ID NO: 214292 - RNA, 64 nt, Human
uaaguccggcugguugcagggcuauuugccccgacagcaucagccuguaacauuucuucucuuu

SEQ ID NO: 214293 - RNA, 64 nt, Human
ccuuaauugauagaccauaccagguucugcaggucagcaucauuguguaaugagagugaaguag

SEQ ID NO: 214294 - RNA, 64 nt, Human
gaagaauucucugcugaagacuuucuauggaacccagcaucauguggcucagucucugauugcc

SEQ ID NO: 214295 - RNA, 64 nt, Human
cucagagugggggcuccuuaagccuccaggccagcagcaucagcaucaccugggagauuguuag

SEQ ID NO: 214296 - RNA, 64 nt, Human
gugggggcuccuuaagccuccaggccagcagcaucagcaucaccugggagauuguuaggaaugc

SEQ ID NO: 214297 - RNA, 64 nt, Human
agguucugucgggaggacagugcugaucgugucucagcaucaggaaaggagaaaggcagaggga

SEQ ID NO: 214298 - RNA, 57 nt, Human
ugaucaccaucuacuccuaaugcccaacagcaucacggcacucugggacaggcacgg

SEQ ID NO: 214299 - RNA, 64 nt, Human
acccagacugccuuggguuuuaucuuucccuuaccccuggcaccuccagagaacugggaccuga

SEQ ID NO: 214300 - RNA, 64 nt, Human
gagaaaaauuaaaaugcaaugaguuagcaguauacccuggcacacuuaauaaauuaaacauuug

SEQ ID NO: 214301 - RNA, 64 nt, Human
uacuuucugccauggaguuccagcaggucacucucccuggcacaccuuccaggcuggauuuuua

SEQ ID NO: 214302 - RNA, 64 nt, Human
agcacugagaacaaaaugcaggcaucccccggggcagcaucagagugccuuucuagagggagcc

SEQ ID NO: 214303 - RNA, 64 nt, Human
caugugucagauaugcuucccucaaaccuuguuacagcaucaucacauuaccuguuugauguaa

SEQ ID NO: 214304 - RNA, 64 nt, Human
uaaauccacacacaacucugagaauacccacugccagcaucaaaaagcaaagauacuaauuuuu

SEQ ID NO: 214305 - RNA, 64 nt, Human
ucugugcuuucuuuaccaacuggcuagaacggaacagcaucacagcaacgcugcggaucuuggu

SEQ ID NO: 214306 - RNA, 64 nt, Human
uaccugcaggcugagccacucucuucccuuuccccagcaucacuccccaaggaagagccaaugu

SEQ ID NO: 214307 - RNA, 64 nt, Human
ucugucaguacgaugucaacucaugcuuuuaauucagcaucagcagaaaaugacuguagguaaa

SEQ ID NO: 214308 - RNA, 64 nt, Human
ccguguccagacuuugaacuugccugccagccuucagcaucaggaaaggccaaguccugggugu

SEQ ID NO: 214309 - RNA, 64 nt, Human
uuacauguuuucgaacacagaauagcucuuuucucagcaucauuauugcucuuucagcaucugu

SEQ ID NO: 214310 - RNA, 64 nt, Human
uuuuucgguaacuagacguggaugaauguaggaccagcaucacccucugcucgcaccauuguuu

SEQ ID NO: 214311 - RNA, 56 nt, Human
gaaacaccgcagaccacuagcccacccagcaucagagaccuucucuuccuuuccug

SEQ ID NO: 214312 - RNA, 64 nt, Human
ugccuagaaaauacacgguaacuuuucugccuugcagcaucaaacuauaguacagcugagcccc

SEQ ID NO: 214313 - RNA, 64 nt, Human
cuccucccccaccagcucuccccacagggccccucagcaucauggagacccgcaggcggggcuu

SEQ ID NO: 214314 - RNA, 64 nt, Human
aaaaugaaagucucacuaccauaaaauuaugguucagcaucagauuagcauugcacucaguagu

SEQ ID NO: 214315 - RNA, 64 nt, Human
cugccccaagcacaccccacacuaauuucugcugcagcaucacgaucagggcaaaucagcacag

SEQ ID NO: 214316 - RNA, 64 nt, Human
gaccuaauaauuacgggaaauggaaagucugggccagcaucaauaaaaugacaccaaaaauaag

SEQ ID NO: 214317 - RNA, 64 nt, Human
uguccccuggccguccugucaucccugugugcugcagcaucaccacggccuacuucccaauauc

SEQ ID NO: 214318 - RNA, 64 nt, Human
accaggaaccuuugagcugcuuuuaaaauucuuccccuggcaccacucaguuuugcuuuugcga

SEQ ID NO: 214319 - RNA, 64 nt, Human
uggccugggcaccuguccuccugcugugccgucacccuggcaagggccgugagggcgauugcuu

SEQ ID NO: 214320 - RNA, 64 nt, Human
gucaaugacaucuccuccauguccaccgaccagacccuggcaucugacacugacagcagccugg

SEQ ID NO: 214321 - RNA, 64 nt, Human
cuuccccuguuaggaaggauggcugcaccuggcccccuggcauuccugacgcucuaggagggaa

SEQ ID NO: 214322 - RNA, 64 nt, Human
uugaaaguccgcuuguaaaagcacaagugagaggcagcaucaggccccuggagggcuguggucc

SEQ ID NO: 214323 - RNA, 64 nt, Human
gggguuggucagcaacuuugagugccauugcaagcagcaucauuuaaguaguuuuauaaagaaa

SEQ ID NO: 214324 - RNA, 64 nt, Human
uaguaaaagcuuuaguuuauggugagucauuacucagcaucauggaguccacgaugaagagaau

SEQ ID NO: 214325 - RNA, 64 nt, Human
uugcccauuuuuacuuccucauucauuauuguaccagcaucauagcuuuauuacucuaauccca

SEQ ID NO: 214326 - RNA, 64 nt, Human
uuuuuauagaaucauucauauggaacugaguucccagcaucaucuuauucugaauagcauucag

SEQ ID NO: 214327 - RNA, 64 nt, Human
uuggacacuuggaucuaaaugauguaaagcaaaacagcaucaauauauaugugagguugcacua

SEQ ID NO: 214328 - RNA, 64 nt, Human
gacucagcacuguuuucaucacaacuuguuuucccagcaucauguagugcauuuaguuuugucu

SEQ ID NO: 214329 - RNA, 64 nt, Human
agaaacuucaugcuggccugugugauacaagagucagcaucauuaaaggaaacguggcaggacu

SEQ ID NO: 214330 - RNA, 64 nt, Human
gaccaagauuuuuuaaaauucccaauuacaaaagcagcaucacacuugcuucugagaacagcag

SEQ ID NO: 214331 - RNA, 64 nt, Human
cuuucugaacaccaccaccaccaauaauacuuaucagcaucauaaaguaucucuuaaacacuga

SEQ ID NO: 214332 - RNA, 64 nt, Human
uugccuuauauagaggcuucuauuucucuuaagucagcaucaauacaacggccggaguuucugu

SEQ ID NO: 214333 - RNA, 64 nt, Human
uggaaaagacuucagauugaauucacaucuuauucagcaucaaagaauucacacaggagagaaa

SEQ ID NO: 214334 - RNA, 64 nt, Human
uggaaaagcuuucagucaaaccucaugccuuauucagcaucacaaaaugcauaggaaagagaaa

SEQ ID NO: 214335 - RNA, 64 nt, Human
ugguaaagccuucagucauagcucagccauugcucagcaucagauaauucacaccagagagaaa

SEQ ID NO: 214336 - RNA, 64 nt, Human
aaaaaaccauacacacacacacacacacacaaaucagcaucauaagggaauguagccuuccaac

SEQ ID NO: 214337 - RNA, 64 nt, Human
ccuuuugaagugauuugcaguuacucaucugagacagcaucaguauuugacuaaaucauuguuu

SEQ ID NO: 214338 - RNA, 64 nt, Human
gcuccccaggucccgaagccugagacccggaaggcccuggcacccuuacacccucggacuccug

SEQ ID NO: 214339 - RNA, 64 nt, Human
auacgggcacaggagaccuuuuaugggacuuuggcccuggcaggacccagggccuccagacgug

SEQ ID NO: 214340 - RNA, 64 nt, Human
aggcggggcuuagccaccccucaaacccagggcccccuggcaccuggcucuggccguguuuucu

SEQ ID NO: 214341 - RNA, 64 nt, Human
aacuggaaugagcagcuuuagcaaagaacucuuacccuggcaaagcagcaacacacaugcuccg

SEQ ID NO: 214342 - RNA, 64 nt, Human
ccaagcaacauagauuucccuaucuuucaggaaacagcaucaaggaacucugaaaaauauagaa

SEQ ID NO: 214343 - RNA, 64 nt, Human
ucuccuuccacccugcuggcugggcggcugcacucagcaucaccccuuccuggguggcaugucu

SEQ ID NO: 214344 - RNA, 64 nt, Human
aggccagagugcaguggcacgaucauaguuaccgcagcaucaaauuccuggacugaagcggucc

SEQ ID NO: 214345 - RNA, 64 nt, Human
uugguaaagggaagcuguggguccacauucccuucagcaucaccucuagcccuggcaacuuuca

SEQ ID NO: 214346 - RNA, 64 nt, Human
guucaaauacuaaagauccucagguccagaauuccagcaucauuuauucuuuuaaaauuuuuaa

SEQ ID NO: 214347 - RNA, 64 nt, Human
auagccauguuaaaagucacugugcauuuauucucagcaucaaauaccuuguaacgucuucucu

SEQ ID NO: 214348 - RNA, 64 nt, Human
uaucagugagugccauacagaauuguguauucaccagcaucaugaaacaguuguggucuuuuga

SEQ ID NO: 214349 - RNA, 64 nt, Human
acuuaauggcuugcaguaccacuuugauaaaaaucagcaucaaaacauuccuaguguucaaaua

SEQ ID NO: 214350 - RNA, 64 nt, Human
cgugucccgggccccagcauuuugccccgggcuccagcaucacuccucugccaccuuggggugu

SEQ ID NO: 214351 - RNA, 64 nt, Human
acaucuguggccaacaauccuauggaaaaaagcccagcaucacugaucauuagagaaaugcaaa

SEQ ID NO: 214352 - RNA, 64 nt, Human
cuccagcuuuuaccaguuuaacauccaaaguucacagcaucagcauucaugguguaagaacagu

SEQ ID NO: 214353 - RNA, 64 nt, Human
cuuuugucuugucuuagagaugagggggcuacagcagcaucaugcaaagagggaaagaugaagg

SEQ ID NO: 214354 - RNA, 64 nt, Human
agguggagucccugggggagaccuaugacuucgacagcaucaugcauuacgcucggaacacauu

SEQ ID NO: 214355 - RNA, 64 nt, Human
gacuguguuuccaaagguuccccgcccccaaccccagcaucagccuguagcuccccugcugagg

SEQ ID NO: 214356 - RNA, 64 nt, Human
auuuauugcaacuauuuuccuugagaaacauucucagcaucaggauugauaaacaaauguagau

SEQ ID NO: 214357 - RNA, 64 nt, Human
uuucuucucaaaaauucuguucauugguuccacucagcaucaagaagacagggacaaacaacuc

SEQ ID NO: 214358 - RNA, 64 nt, Human
cugaacaaaucagcucuggaggugauuccacauccccuggcauuaugcucuaaugcugcucauc

SEQ ID NO: 214359 - RNA, 61 nt, Human
cgucugccgaggcucugugagccugaugccucccuggcagcacaggaaaagaauuuuuuuu

SEQ ID NO: 214360 - RNA, 64 nt, Human
cuugacccacgagcuguugagaagggugcagagccccuggcacagccaacccuguugcccccag

SEQ ID NO: 214361 - RNA, 64 nt, Human
cuaaaucacucaucuggccuggauaaucucacugcccuggcacauucccauuugugcuguggug

SEQ ID NO: 214362 - RNA, 64 nt, Human
uggaguguagcgggcaucgcugccgccauuccugcagcaucaccauaagcagugcagggugucu

SEQ ID NO: 214363 - RNA, 64 nt, Human
ugacgucacuaagaggccuuguguagaaguacaccagcaucauuguaguagaguguaaaccuuu

SEQ ID NO: 214364 - RNA, 64 nt, Human
cauucacuccuaucucauuagaagaaauagguagcagcaucacucaccagucuuaugccaugac

SEQ ID NO: 214365 - RNA, 64 nt, Human
ucaugcauucuuuucuguuugccuuuuuuaaauucagcaucauguuuuugugauacauccacau

SEQ ID NO: 214366 - RNA, 64 nt, Human
cucuccuaguccaacuuggggugggcaaggcagucagcaucaccagcaauaccacaggacccuc

SEQ ID NO: 214367 - RNA, 64 nt, Human
augaacacacuugugaccuuaguacuuggucauccagcaucauacaggcaucuccaaguuagac

SEQ ID NO: 214368 - RNA, 64 nt, Human
gcaucauacaggcaucuccaaguuagacucuaugcagcaucaucuuuugcagcauuccucugcu

SEQ ID NO: 214369 - RNA, 64 nt, Human
uauuucccugcaccaguuucccaccugucacuugcagcaucagaggguguugcauuaacuccau

SEQ ID NO: 214370 - RNA, 64 nt, Human
caccucuuccuauugaguuugcuuggaaugcugacagcaucaggcaacucugaacugaacauuu

SEQ ID NO: 214371 - RNA, 64 nt, Human
uugaaggcugaagauuguuuuguaugauacugcacagcaucaggcauuuuaaagcagaucuuua

SEQ ID NO: 214372 - RNA, 64 nt, Human
gguccaggauucgcccucucccaugccuucaagucagcaucaggcuuagggcaaagaccaggcc

SEQ ID NO: 214373 - RNA, 64 nt, Human
ccucugcaggggagaaggcucccuccccauggggcagcaucaggacgggggcucaagcugcaca

SEQ ID NO: 214374 - RNA, 64 nt, Human
ggcuggccugcagucagcaucauugugcaugugacagcaucaaugugauuaguaauuugucugu

SEQ ID NO: 214375 - RNA, 64 nt, Human
uuagcccugagauggugacaggcuggccugcagucagcaucauugugcaugugacagcaucaau

SEQ ID NO: 214376 - RNA, 64 nt, Human
acuguuuucuaguguuucuguguuuauuacuguucagcaucaucuugguuauauacugaaaauc

SEQ ID NO: 214377 - RNA, 64 nt, Human
aaacuugaaaaacaguuuguaagccuuucaacagcagcaucaaccuacgugguggaaauaguaa

SEQ ID NO: 214378 - RNA, 64 nt, Human
agagcauggauaagccacacagcagggcagugcacccuggcaccaugcacggccagcaagaauc

SEQ ID NO: 214379 - RNA, 64 nt, Human
agggcgcgccucugcacuaacucaggccagguagcccuggcagcaggaggcccagcuccgcagg

SEQ ID NO: 214380 - RNA, 64 nt, Human
aaggaguagcaagucagugggaggacuuuuucaccccuggcauuagcagcuucgaccucauuuu

SEQ ID NO: 214381 - RNA, 62 nt, Human
ccaaggaccggagcgaaugaggccuguauccucccuggcagacacaacccaauaggagucuu

SEQ ID NO: 214382 - RNA, 64 nt, Human
ggagucagaagggucagaugaacuggaguguagacagcaucagaugcagcagugcccaccgccc

SEQ ID NO: 214383 - RNA, 64 nt, Human
ccuuugucccuggggcugauggcccccaacucaccagcaucaugaccuugugccaguccugguc

SEQ ID NO: 214384 - RNA, 64 nt, Human
ggcagagaagcgaggcggaugcccuggaagcacccagcaucacacccaggcuugugcggggcca

SEQ ID NO: 214385 - RNA, 64 nt, Human
cccacccaaccccaagccagcccggccgcuccaccagcaucaccugccuguuaggagaagcugc

SEQ ID NO: 214386 - RNA, 64 nt, Human
aaguuggugugaaccaaaauagagucagcugacccagcaucagccacacucuggguuggaaaau

SEQ ID NO: 214387 - RNA, 64 nt, Human
acaggcauccugcaaaugcagacuccagaauccccagcaucagcgggaaccaccaucacaucuu

SEQ ID NO: 214388 - RNA, 64 nt, Human
gacaguggaaaccaagagcaggaucgcaaaguaacagcaucagacucuucugcccuccucuugc

SEQ ID NO: 214389 - RNA, 64 nt, Human
ugugaaaguacaauaaacuucuuguucaaauuaccagcaucagagagcuucccauuugcaucua

SEQ ID NO: 214390 - RNA, 64 nt, Human
ccaaaaacuuucuguagagcuguuccuuuggaggcagcaucacuuauuggcaguaaagacucag

SEQ ID NO: 214391 - RNA, 64 nt, Human
gcucucguucugagacaugagccuugggauguggcagcaucagugggacaagauggacacuggg

SEQ ID NO: 214392 - RNA, 64 nt, Human
cccucucagccacugucuucagucuccacagaaacagcaucaagugugcggagacaggcggcug

SEQ ID NO: 214393 - RNA, 64 nt, Human
auguugggaaguccauauuugucugcuuuucuugcagcaucauuuccuuacaauacuguccggu

SEQ ID NO: 214394 - RNA, 64 nt, Human
agcucccaugcaccggaauuccuuugggaugaaucagcaucauuuuaaacaaaguauauguaaa

SEQ ID NO: 214395 - RNA, 64 nt, Human
ggccuugcauucccugcauuggguugaugacugucagcaucacugccgcaggccaugcuugacu

SEQ ID NO: 214396 - RNA, 64 nt, Human
gauaagguggcauucacccccaggcucugacuuucagcaucaugcaggggcuuaucugucugga

SEQ ID NO: 214397 - RNA, 64 nt, Human
aagagggaaaacagaaaaccugaugcuggggacacagcaucagcucaagacgucacccuccauu

SEQ ID NO: 214398 - RNA, 64 nt, Human
ggugagcuggaguugggggugucucgggcccaggcccuggcagagaaacagggaggccugggga

SEQ ID NO: 214399 - RNA, 64 nt, Human
gcgcagcugcaagguugccaggacccacccucaucccuggcaccgucaugggaguuugcucuug

SEQ ID NO: 214400 - RNA, 64 nt, Human
cgacggaauuucucucccauuguugacacggacucccuggcagcucaagggcaugucuuaacga

SEQ ID NO: 214401 - RNA, 64 nt, Human
gugauugcauguuuccuuccuucaacuguguucucccuggcauucagagaggagggagaggagg

SEQ ID NO: 214402 - RNA, 64 nt, Human
uuugaacaacauguucguggugcugaaugccucucagcaucaucaaggauaacugaaacugggu

SEQ ID NO: 214403 - RNA, 64 nt, Human
gauaacuauuuaugaauauuugaccaaauuauuccagcaucagaauaauaagcaaaauaacuuu

SEQ ID NO: 214404 - RNA, 64 nt, Human
augugagggacuucuguuuaccuuccgcagcacccagcaucaaaggacggacuucaggggacac

SEQ ID NO: 214405 - RNA, 64 nt, Human
aauaaacaaacaaaaacaaauagccaucugcuaucagcaucauuauguaaaagaaaauauauuu

SEQ ID NO: 214406 - RNA, 64 nt, Human
agggcuucacauacguggcgccgucuguccuggacagcaucaaggagggcuucuccuuccagcc

SEQ ID NO: 214407 - RNA, 64 nt, Human
acugcccugauuacuccuuaggauguggucaaaacagcaucaaauguuucuucucuuccuuucc

SEQ ID NO: 214408 - RNA, 64 nt, Human
cccccaugcuucuggggaccuuuccuacccccaucagcaucaauaaaaccuccugucuccagug

SEQ ID NO: 214409 - RNA, 64 nt, Human
gacaccugucauauuuauggaccagacacuggggcagcaucaggcacagucugucugggugcaa

SEQ ID NO: 214410 - RNA, 64 nt, Human
uggcuggguucugauugcuagaugucacacccaccagcaucaccaaagugacucugagauagac

SEQ ID NO: 214411 - RNA, 64 nt, Human
gaagccugggguuuggagcccaccuacucucuggcagcaucagcauccuacuccuggcaacauc

SEQ ID NO: 214412 - RNA, 64 nt, Human
acccccgucaacccacugccucccaccccgaccccagcaucaaaaaaccaaugauuuugcugca

SEQ ID NO: 214413 - RNA, 64 nt, Human
auauuaauaucuuuugcguaaaaacugcuauuaucagcaucauaguuucucuaaaaagaaaacu

SEQ ID NO: 214414 - RNA, 64 nt, Human
ucagugggggaaggcuaucaacccauugucagaucagcaucaggcuguuaucaagucuguuggu

SEQ ID NO: 214415 - RNA, 64 nt, Human
gucaguuuugucagguucauggcccacuuugcuacagcaucagagugaagcacgccugucuagg

SEQ ID NO: 214416 - RNA, 64 nt, Human
cugcagggacugauccacagagaggaugagaaugcagcaucaaucgcagaccugcccugccuca

SEQ ID NO: 214417 - RNA, 64 nt, Human
uaagugacaaagccagaggagaagacaacccugacagcaucacgcugcaucccauugcuagcag

SEQ ID NO: 214418 - RNA, 64 nt, Human
cuuccuccuccccuuccucgggaggcuccccagacccuggcaugggaugggcugggaucuucuc

SEQ ID NO: 214419 - RNA, 64 nt, Human
ggacagggaggaaaaguaacaauaguccacaugucccuggcaucuguucagagcagugugcaga

SEQ ID NO: 214420 - RNA, 64 nt, Human
cccuuccuucccacgcucagcggccccggccagacccuggcagacuucacaccucauugcuuua

SEQ ID NO: 214421 - RNA, 64 nt, Human
cugcccagccuuggcacgagagguugguuccagccccuggcagggcuuccuuccaagggccccu

SEQ ID NO: 214422 - RNA, 64 nt, Human
gcaguggggagcaugggacugugccuuugggaggcagcaucagggacacaggggcaaagaacug

SEQ ID NO: 214423 - RNA, 64 nt, Human
gaggucucguucgucuccagcucauaaaauguagcagcaucauccuugacagugauguuuuuca

SEQ ID NO: 214424 - RNA, 64 nt, Human
gauuacuguuugcuggcuaauugacaguauuucucagcaucacuauguagcauucuguuuuagc

SEQ ID NO: 214425 - RNA, 64 nt, Human
ggggguugugaugagaggauaggggagauaauaucagcaucaaauucuuuggguaucucucuaa

SEQ ID NO: 214426 - RNA, 64 nt, Human
guacucugugucuggcaggcuacucugcccaccccagcaucagcacagcucuccuccuccaucu

SEQ ID NO: 214427 - RNA, 64 nt, Human
uuguuaaaaauguuuauaugauaaugucuguaaacagcaucacuuugauuacaauagauguagu

SEQ ID NO: 214428 - RNA, 64 nt, Human
uccaggaauuuauuugauauuaaugggcguaaaacagcaucauuguacuuaagcuauggauguu

SEQ ID NO: 214429 - RNA, 64 nt, Human
ucucuuggauaggaguuggugaauagaaggcaggcagcaucacacuggggucacugacagacuu

SEQ ID NO: 214430 - RNA, 64 nt, Human
ucacucucuagaucagccugcuaggagccucuaccagcaucauccuggggcccagcucaggccu

SEQ ID NO: 214431 - RNA, 64 nt, Human
agcccgauggggaugaggaggagagcacagcccucagcaucaacgaggagaugcagcgcaugcu

SEQ ID NO: 214432 - RNA, 64 nt, Human
agcgguucucaaacgguacacagacuauugacaucagcaucaccuagaaacuuguuagaaaugc

SEQ ID NO: 214433 - RNA, 64 nt, Human
gaagcauuugauauuaucuacaaacacugcagaacagcaucaugucauaaacgauucugagcca

SEQ ID NO: 214434 - RNA, 64 nt, Human
uuuuugaaagaguucuccucauaggaggaugauucagcaucagaagaagaaggaacccauagcu

SEQ ID NO: 214435 - RNA, 64 nt, Human
ucuccaccuccucgcuccucugaggcuccuccuccagcaucaggcucugccaaggccccucuga

SEQ ID NO: 214436 - RNA, 64 nt, Human
gaugcccucuguuucauuagcucuaguucucccccagcaucacuaacaaauaugcuuggcaaga

SEQ ID NO: 214437 - RNA, 64 nt, Human
acagaguccccagaacucauguggccauuuccgccagcaucacuccccggugccuauggggucc

SEQ ID NO: 214438 - RNA, 64 nt, Human
cuuacccugaaggggucucccuggaauggaaguccccuggcauggucaguccucaggcccaaga

SEQ ID NO: 214439 - RNA, 64 nt, Human
aaucugaagcauucugcggaguucuuaagcgcuccccuggcaaacaaauugaagugccaaacag

SEQ ID NO: 214440 - RNA, 64 nt, Human
uguauuaauaaccacacccuuucugcaucccugucccuggcauccacuugacuaugaagcuuuu

SEQ ID NO: 214441 - RNA, 64 nt, Human
agcaagcacuguagcaaaagccacuuccacauggcccuggcagggagcacugcugcuccaugcu

SEQ ID NO: 214442 - RNA, 64 nt, Human
agcacaaggggccucccaaaaaggagccccaccucagcaucacugccuuaaucguggccucccu

SEQ ID NO: 214443 - RNA, 64 nt, Human
auaaugaaaucaguugccucaaugguagagagcucagcaucacuggagguggucacacagaggu

SEQ ID NO: 214444 - RNA, 64 nt, Human
ggaaugugucuggcccuucagcaguuucucuuggcagcaucagcugggcugcuuucuuugugug

SEQ ID NO: 214445 - RNA, 64 nt, Human
uauuauuuuuuugguaaaacauuaauaguuuaagcagcaucauuuuuuuaaaaaauguaauuga

SEQ ID NO: 214446 - RNA, 64 nt, Human
cugcuguuuaaaguggaaucuuuuaguauuauaacagcaucacuuuagauuuuguaagucaaaa

SEQ ID NO: 214447 - RNA, 64 nt, Human
agcuaucaacauuaggaguaacuuucaaccuugccagcaucacugguaugauguauauuuaauu

SEQ ID NO: 214448 - RNA, 64 nt, Human
uaacugugaaaaggaaggcuguccuauaacaaagcagcaucaagucccaaguaaggacagugag

SEQ ID NO: 214449 - RNA, 64 nt, Human
cgugcccugagcccucuccuccaagagguccccucagcaucaagcagcccaaccaaggcgugca

SEQ ID NO: 214450 - RNA, 64 nt, Human
aauacauaugggaaaaaguacuugagaccaaggccagcaucaauuccagacaucuucauguucc

SEQ ID NO: 214451 - RNA, 64 nt, Human
cuuuauuguuuuccaaacagcuaguuuaacaaaacagcaucauacauagugaaugauguucauu

SEQ ID NO: 214452 - RNA, 64 nt, Human
aacaagcaugcagccagcaagcuucggaaaaccacagcaucaaagacaucccaaauaacaugcc

SEQ ID NO: 214453 - RNA, 64 nt, Human
aaugaaguacaauaaugugaacugcauguguaaacagcaucacauuauuaccaccucucuaugg

SEQ ID NO: 214454 - RNA, 64 nt, Human
uuaaauuauuucacauuagccauuuguuaaaacacagcaucauaacucagcaggcuggauuuaa

SEQ ID NO: 214455 - RNA, 64 nt, Human
auauuucuaaauguuuggcauguaaauguaaacucagcaucaaaauauuucagugaauuugcac

SEQ ID NO: 214456 - RNA, 64 nt, Human
agauucuccaggaauuuccucuaugggaccuucccagcaucagccuuagaacaagaaccuuacc

SEQ ID NO: 214457 - RNA, 64 nt, Human
gcaugaaaaacuguacaaugagguucagcacagccagcaucagccgagcuuuuuugugaaacuc

SEQ ID NO: 214458 - RNA, 64 nt, Human
uauggagccuuaaaacaugucaugaauuuggagucccuggcacauaaaucuaccuucaaaucag

SEQ ID NO: 214459 - RNA, 64 nt, Human
uuccauugcauuggcuacuucaagucucuuuuaccccuggcagagccaguugcagugcaauuuu

SEQ ID NO: 214460 - RNA, 64 nt, Human
gugguccccucuuugccaccuaggccaguuuugacccuggcauuaacuggccuuagaagaaacu

SEQ ID NO: 214461 - RNA, 64 nt, Human
cagugcuugcuugaaaagucucauuuuuaaaucucccuggcaugaggugcccacuuccccuuuc

SEQ ID NO: 214462 - RNA, 64 nt, Human
gggccucauggaauggaaugucuccacuucacuccagcaucaacaaguggggaauucugaugga

SEQ ID NO: 214463 - RNA, 64 nt, Human
uucaguuuauaccuugccuguaguccagucucuccagcaucaauuccaucagcacaaagacaua

SEQ ID NO: 214464 - RNA, 64 nt, Human
aaucauuccaaccgacccacugcaaagacuaugacagcaucaaauuucaggaccugcagacagu

SEQ ID NO: 214465 - RNA, 64 nt, Human
gcaucaugugcucuuggugggauacucugauuaucagcaucaacaguacuuuacugagcaagac

SEQ ID NO: 214466 - RNA, 64 nt, Human
acauuuguuauuccucaguuuuuaaugaccuuuucagcaucaauuguuaaucagauuauuuuag

SEQ ID NO: 214467 - RNA, 64 nt, Human
acagccauuaggcgucagcaucuugacuuuuccccagcaucacaaacagccauuuccucgggca

SEQ ID NO: 214468 - RNA, 64 nt, Human
agugaucucucccgacugcacugcccuggagaggcagcaucaggaccuaagccccaggaacuuc

SEQ ID NO: 214469 - RNA, 64 nt, Human
aucuggcacugcuggugugugcagggaugaaacccagcaucagagagguuuucagcaaaccuuc

SEQ ID NO: 214470 - RNA, 64 nt, Human
uaaauucucccagcagugucccaugucaugcugccagcaucacugaaugcacugaacucagagu

SEQ ID NO: 214471 - RNA, 64 nt, Human
aguucagagucacccguggcuccuaaggaaaaaacagcaucaugaaaggcaaaaaguauuugaa

SEQ ID NO: 214472 - RNA, 64 nt, Human
gugauguccuggcagggggccucgcgggucuccucagcaucagacgggcuuccaggaccgcagc

SEQ ID NO: 214473 - RNA, 64 nt, Human
caaugcauguuuuagccuugugcacucuuagagucagcaucaugggaaagaguaacagcaauug

SEQ ID NO: 214474 - RNA, 51 nt, Human
ucauagaucgagacauguaagcagcaucauggagguaaguuuuugaccuug

SEQ ID NO: 214475 - RNA, 64 nt, Human
ccuaauguuuuucucuauaaagggucaggcccgucagcaucacugaugggaauaaaaguauuaa

SEQ ID NO: 214476 - RNA, 64 nt, Human
gccaggacaucucagcacucccgccuggagcucucagcaucacugaagguaccacaguguaagu

SEQ ID NO: 214477 - RNA, 64 nt, Human
uacagaccagugguucucaaacuuuaaaaugccucagcaucacuugggagcuuauugaaaugca

SEQ ID NO: 214478 - RNA, 64 nt, Human
cugggagggagggggcagcaggccccuggccccucccuggcacugaggcccugaccccugcucc

SEQ ID NO: 214479 - RNA, 64 nt, Human
ugaccccaggaggacaccagauacagacuucagccccuggcagucugcccaccugggugcacug

SEQ ID NO: 214480 - RNA, 64 nt, Human
ccauuccugcagccagugagagaccuggccucagcccuggcagggcucucucuucaaggccaua

SEQ ID NO: 214481 - RNA, 64 nt, Human
agugucugggagcacagugaagaccaugggagcacccuggcaccugggagcacagugaagaccc

SEQ ID NO: 214482 - RNA, 64 nt, Human
agagcuaguacuucauuuucacuggauacauuuucagcaucaugaguugucacagccucugagc

SEQ ID NO: 214483 - RNA, 64 nt, Human
agaagagguaagggaggcuaaguggguaacagcccagcaucagggucacuguggcaacagcagg

SEQ ID NO: 214484 - RNA, 64 nt, Human
acgcagacagacacaccgacuuuguccuuuuucucagcaucagagccagacaggauucagaaua

SEQ ID NO: 214485 - RNA, 64 nt, Human
acauaaugcugucucagcuguauuuccaguaacacagcaucaucgcacugacuguggcgcacug

SEQ ID NO: 214486 - RNA, 64 nt, Human
cauuaugucaucugaauugaggccuuucugugaacagcaucauaacuucuaucauggaaagugu

SEQ ID NO: 214487 - RNA, 64 nt, Human
auguaccccucucaggcugccugccugacaaggucagcaucauuugcucuccugaauuuaugag

SEQ ID NO: 214488 - RNA, 64 nt, Human
cgcuuuauagcuucucuuuggcauauccaaaugccagcaucacuguuguauuuuggggucauua

SEQ ID NO: 214489 - RNA, 64 nt, Human
aguagcaaaaccacuuucuacuuuccaaacaccacagcaucagcaugguuuaggggaagcaauu

SEQ ID NO: 214490 - RNA, 64 nt, Human
cagugaguuacccagggcuccagggagcccacagcagcaucagacccauccaggggcuacaggg

SEQ ID NO: 214491 - RNA, 64 nt, Human
uuucccacuguuaaggacucuguccaaagaaccucagcaucagcucccucaagcuuaaugaucc

SEQ ID NO: 214492 - RNA, 64 nt, Human
uacaauaacugcugccuggcaaacugcaaacaagcagcaucacucaaguuugaaguuucgccgc

SEQ ID NO: 214493 - RNA, 64 nt, Human
aaacacuagagugaaaacacaugcuacaaugaggcagcaucagcugagagcaggaagagcgauc

SEQ ID NO: 214494 - RNA, 64 nt, Human
gccuaccauccuccucccuccccggcucuccucccagcaucacaccagccaugcagccagcagg

SEQ ID NO: 214495 - RNA, 64 nt, Human
caucacccucguuuccagugaauuagugucaugucagcaucagcucagggcuucaucguggggc

SEQ ID NO: 214496 - RNA, 64 nt, Human
ucaaagccaagguacagggugauaacuugugguccagcaucaguuuucuccacuucuuucuccc

SEQ ID NO: 214497 - RNA, 64 nt, Human
auggggccaggaaagucugguaauaaaugugacucagcaucacccaccuuagccccuuccagaa

SEQ ID NO: 214498 - RNA, 64 nt, Human
caaggauagcuacugacagccuccugcugcccuacccuggcaggcacaggcgcagcuggcuggg

SEQ ID NO: 214499 - RNA, 64 nt, Human
uuuggugagacuuuugcaacaucccugguuguuucccuggcaaugugacuauccagcccuaacc

SEQ ID NO: 214500 - RNA, 64 nt, Human
caaggcagaugcuccucuggugggagggugcuggcccuggcaagauugaaggaugugcagggcu

SEQ ID NO: 214501 - RNA, 64 nt, Human
ugaaacuguuagaguugggggcucugcuuuuucccccuggcaauuuuccccugguauaagaugu

SEQ ID NO: 214502 - RNA, 64 nt, Human
cugcucacuggcucuggggccucgaggugccaggcagcaucaggcccacuggguugccccggcc

SEQ ID NO: 214503 - RNA, 64 nt, Human
cucuugauacggaaacgagugucuucacuccagccagcaucauggucuucggugcuucccgggc

SEQ ID NO: 214504 - RNA, 64 nt, Human
ggauccgccaggcugagacccuggagcaagugcgcagcaucauggaugaggcgccacucacgga

SEQ ID NO: 214505 - RNA, 64 nt, Human
auuagaaaauauaaugaaaagauuucguucccagcagcaucaagaaaaguagauuuucuagaaa

SEQ ID NO: 214506 - RNA, 64 nt, Human
agcuacaacagccaucuuagguccccgaggugcccagcaucacguaaaacaucgauaugcuaag

SEQ ID NO: 214507 - RNA, 64 nt, Human
agugagaccggaggaugaucccccaaggacugcgcagcaucagcucuuggugggccucugccuu

SEQ ID NO: 214508 - RNA, 64 nt, Human
acacagcuaugaucagggaauuuuggagaaacuacagcaucauggaugcuguggacauggccau

SEQ ID NO: 214509 - RNA, 64 nt, Human
guuucuugaaaaagauucagugguucagcuuugucagcaucaucucaacacaagccugcuggcu

SEQ ID NO: 214510 - RNA, 64 nt, Human
cugaaauggaggcauugcaaugaaaaggcacccacagcaucaugcaaguggcaucuuguaaaaa

SEQ ID NO: 214511 - RNA, 64 nt, Human
aggcggcguugcugggacuguuuugcacuggagccagcaucaggauguccucuccaauggcugu

SEQ ID NO: 214512 - RNA, 64 nt, Human
ucuagaacacagcaccaucauuuacgaagacccacagcaucacccacugcuucgccucugcugg

SEQ ID NO: 214513 - RNA, 64 nt, Human
uucacauagaauaugauucccuaaguaugcuacacagcaucauauuagauguaagauguaagac

SEQ ID NO: 214514 - RNA, 64 nt, Human
gauugguggguuucggggugaagcaaguucacuacagcaucaauagaaagucaucuuugagaua

SEQ ID NO: 214515 - RNA, 64 nt, Human
gaugcaucuggggagagcaaagcacuaaggaauucagcaucagccugcagagggcugagucugg

SEQ ID NO: 214516 - RNA, 64 nt, Human
ccgcccagggguccgggcuguccuuggccgcuggcagcaucacugagcaggaagcgcacagccc

SEQ ID NO: 214517 - RNA, 64 nt, Human
cucacuuuuggaaucuguccguuagaaauaaaagcagcaucaaugcauaagaauguaaauaaac

SEQ ID NO: 214518 - RNA, 64 nt, Human
gcugccaugugccuguugcacaccugcacacacgcccuggcacacauacacacaugcgugcagg

SEQ ID NO: 214519 - RNA, 64 nt, Human
cuaauuuagaacauuguuuagaauugacaaaaggcccuggcaauuaaauugucaaggcccaagg

SEQ ID NO: 214520 - RNA, 64 nt, Human
ggcuuuccugucuauggcggcccugucuucuuggcccuggcacugcggacgcugcuccuggucc

SEQ ID NO: 214521 - RNA, 64 nt, Human
uggaccgagagcacauccagcauuugcaucaccucccuggcaccucccauaguuacagccacua

SEQ ID NO: 214522 - RNA, 64 nt, Human
uuaguaacauaauaacaaguugucuggccugacacagcaucacaucacacacacagaaauuagu

SEQ ID NO: 214523 - RNA, 64 nt, Human
uuugaugguggauaagaugaaauuuuagcuguuucagcaucaauccaacuuaaaagcaucuugg

SEQ ID NO: 214524 - RNA, 64 nt, Human
ggguaccuacugugugucagaagauguucaagaucagcaucauccgauggaaauagcauaugag

SEQ ID NO: 214525 - RNA, 64 nt, Human
ugccauguuuaggaaacacacuguacccugcucccagcaucacaaggcacuugucuacaagugu

SEQ ID NO: 214526 - RNA, 64 nt, Human
aguguccagcgugcugguuccccagagcacagcucagcaucacacugacacucacccugcccug

SEQ ID NO: 214527 - RNA, 64 nt, Human
aauuaucuaguaccaauuuucccuuuuuauuuuucagcaucaagagaaaaccaaucagcuucau

SEQ ID NO: 214528 - RNA, 64 nt, Human
uaauuauuucaagagucaagaccaaaaguuugcucagcaucacacuacaucucaaaauuaaugu

SEQ ID NO: 214529 - RNA, 64 nt, Human
uucuauguagcauuucuccuuauaucaccaugggcagcaucagugauuacaagguaagaaaaag

SEQ ID NO: 214530 - RNA, 64 nt, Human
uauaagggcucuagaaaaaacgaguuauucacaccagcaucaucuuaacuaacauucugaacua

SEQ ID NO: 214531 - RNA, 64 nt, Human
gaaaauauaaaaaauuccaaauucugccuuucagcagcaucaauugcuaggaacauuucauuca

SEQ ID NO: 214532 - RNA, 64 nt, Human
gggcaaacguuggaguccuuuccuuguaaauugccagcaucagcuuaaaaacuccuguauguua

SEQ ID NO: 214533 - RNA, 64 nt, Human
cagagagaucuucccauaauaaagcaaucugauucagcaucacuaaaccgauaaugcaugaagc

SEQ ID NO: 214534 - RNA, 64 nt, Human
ggugaauaugcaaggcgguacacuacgcacuggacagcaucagaaauccucuguuaauguggac

SEQ ID NO: 214535 - RNA, 64 nt, Human
caugcaaggauuuuucuuaauuaugcuguacucucagcaucagauacauucaaccauaacugua

SEQ ID NO: 214536 - RNA, 64 nt, Human
uugaaaaaugauuuguaaauugagggucauaguucagcaucaguuucaucuucugggauuauug

SEQ ID NO: 214537 - RNA, 64 nt, Human
guucccuggagggguggaggaaggagguguugggcagcaucaaaggugcugggacaucccaggg

SEQ ID NO: 214538 - RNA, 52 nt, Human
aucagacacagaucuacugagucagcaucaggguccccagccucugggcucc

SEQ ID NO: 214539 - RNA, 64 nt, Human
ggaccuaagccccaggaacuucacccaacuuaggcccuggcaauuaacugaaagggcaaagucu

SEQ ID NO: 214540 - RNA, 64 nt, Human
caugaugcccagagccaccccuauacuccagucucccuggcaucagcuacugcaguacuggggu

SEQ ID NO: 214541 - RNA, 64 nt, Human
cugcagccgcggcugcucggccacugaccaggggcccuggcagacauuaggggaucaguuguau

SEQ ID NO: 214542 - RNA, 64 nt, Human
gucugggagaaacagagccagacauagacaguuccagcaucacagaaccagaagaagagaccug

SEQ ID NO: 214543 - RNA, 64 nt, Human
gcacagaucccagcacuuuucccagcuuucucuccagcaucagucccugcagcagcuggggccu

SEQ ID NO: 214544 - RNA, 64 nt, Human
uaacgagcaaaauaaccagcuaacaucauaaugacagcaucaaauucucacauaacaauauuag

SEQ ID NO: 214545 - RNA, 64 nt, Human
uggaaaagccguuaauaucugcucacaucuuacucagcaucagaaaguacuuaauaaaagcauu

SEQ ID NO: 214546 - RNA, 64 nt, Human
ugugaauaugggcgcacauuugccucauaaagcacagcaucagauaauuuaugugagagaaaau

SEQ ID NO: 214547 - RNA, 64 nt, Human
cugggucaggcucaucuguggcgccucagagggucagcaucauuggugaacagaugcaggcgcu

SEQ ID NO: 214548 - RNA, 64 nt, Human
cugccucuggggaagcaaguuggcaguucuugaacagcaucagauaucaagaguuuguaggucu

SEQ ID NO: 214549 - RNA, 64 nt, Human
cagagggacuccucccuaucugauucuaugaggccagcaucauucuaauaccaaaaccugacag

SEQ ID NO: 214550 - RNA, 64 nt, Human
uuaguagccgucuuggugaucagaucaacuaucccagcaucacagugccugugcccaagcaguc

SEQ ID NO: 214551 - RNA, 64 nt, Human
ggacauccacacagaaaccccaucugaagguuaccagcaucaaagaccaaagguagauaaauuc

SEQ ID NO: 214552 - RNA, 64 nt, Human
uggaaaaucauuucgccgaagcucuucacucuugcagcaucagagaguucacacuagagaaagg

SEQ ID NO: 214553 - RNA, 64 nt, Human
cccaggccgucuguccacuccaugccaccuuucucagcaucaggacgggguugcccuguguuca

SEQ ID NO: 214554 - RNA, 64 nt, Human
ggccaucuuggagucuguccaccccaacuccugacagcaucauccucugcugaccuguuccuug

SEQ ID NO: 214555 - RNA, 64 nt, Human
uagaaaagcuuuuaucuauuacacgaaucuuuuucagcaucauuauacuuucaccaguuuccac

SEQ ID NO: 214556 - RNA, 64 nt, Human
augucaccuggagugucacaugggaguguuauggcagcaucauaccaaggccuacuguugcaca

SEQ ID NO: 214557 - RNA, 64 nt, Human
guggcaagguuuucagucacaauucacuccuacacagcaucagagaauuucauucuugagagaa

SEQ ID NO: 214558 - RNA, 64 nt, Human
ggcuaggaauuuggaauucacaaccuuuauuaaccccuggcaaaacuucccguuugcaugucaa

SEQ ID NO: 214559 - RNA, 64 nt, Human
ucucggcacucccaggcugggagcuggauaccugcccuggcagcauggcucagacugcaugaca

SEQ ID NO: 214560 - RNA, 64 nt, Human
augguaugcccggaugcccccgcgagccccagcgcccuggcagucagcagggauggccgccugc

SEQ ID NO: 214561 - RNA, 64 nt, Human
gcguuccugccgcagcucugaccuggugcugucgcccuggcaucuuaauaaaaccugcuuauac

SEQ ID NO: 214562 - RNA, 64 nt, Human
gugacaaguagcaacauggcuuggguccccugugcagcaucagcuuaugcugccacaagucagu

SEQ ID NO: 214563 - RNA, 64 nt, Human
gaaacugaggcccagagagcugaaguacugcacccagcaucaccagcuagaaaguggcagagcc

SEQ ID NO: 214564 - RNA, 64 nt, Human
ccacaucuuggcuugcuuuuggaacaggcuggcccagcaucauuugucaucaaguccacugugg

SEQ ID NO: 214565 - RNA, 64 nt, Human
cuuuucucccuuuuccauacaaauuaaaacuuaacagcaucaaauuauugggaccagaaaccaa

SEQ ID NO: 214566 - RNA, 64 nt, Human
agaacaugaacgucucuuccuaauuuuacaucuucagcaucauugcauuaaagugguguaaucu

SEQ ID NO: 214567 - RNA, 64 nt, Human
caugugaaagccuccagaggucccagcccuucuccagcaucacagaugaccuccagcccugcag

SEQ ID NO: 214568 - RNA, 64 nt, Human
cacccuugguggcugcuggaaggggagagguucucagcaucaggccaccuccaccccaaugcca

SEQ ID NO: 214569 - RNA, 64 nt, Human
aauggauaaugggaggaaaaguugcugcuuccuucagcaucaaagccuuuccuugggaaucugc

SEQ ID NO: 214570 - RNA, 64 nt, Human
acagagucagaagcccaaaggaauugcacuguggcagcaucagacguacucgucauaagugaga

SEQ ID NO: 214571 - RNA, 64 nt, Human
cuucacccgcugcagagcacacgcaacccagccucagcaucacagccgcagcucuguucagcgg

SEQ ID NO: 214572 - RNA, 64 nt, Human
accucucaccuccaccaccccucccugucccagccagcaucaucucuuuggggaccacuccucu

SEQ ID NO: 214573 - RNA, 64 nt, Human
uggaugcucuagauugguauagaccaguugacuucagcaucaguccaccucuaugacagaaaca

SEQ ID NO: 214574 - RNA, 64 nt, Human
gucacuaucaguguccaucucuacuguacucccucagcaucagagcaugcaucagggguccaca

SEQ ID NO: 214575 - RNA, 64 nt, Human
ggguugaugugagcuugcuuggagacacacggugcagcaucagggaccuucccaggccccagca

SEQ ID NO: 214576 - RNA, 64 nt, Human
ucauggcuuuucagaauucagaauauggagaugacagcaucaaaaaagcccaaaaugugaguua

SEQ ID NO: 214577 - RNA, 64 nt, Human
ugugcuuucuucuccuggcccugacagagcacuacagcaucaaaguaaaucuuuggggacagug

SEQ ID NO: 214578 - RNA, 64 nt, Human
ggggccggggugguggggacagagguggcuuuggcccuggcaagauggauuccagguaagacuu

SEQ ID NO: 214579 - RNA, 64 nt, Human
agggccccucuccccagggaagcagcagccucgccccuggcagagaugccucccugagcuagaa

SEQ ID NO: 214580 - RNA, 64 nt, Human
aagagggcugcggguaugagagaccccggcuccgcccuggcacguguccuugcuggcggcccgc

SEQ ID NO: 214581 - RNA, 64 nt, Human
gaguuuuuagaaaaacauauccacgguaaccggucccuggcaauucuguuuacaugaaaugggg

SEQ ID NO: 214582 - RNA, 64 nt, Human
ggcuugacuguguuugucccuucagauggcaagucagcaucauucuuuauauuccucuucucau

SEQ ID NO: 214583 - RNA, 64 nt, Human
uuccuagguuuucaugaaaaagcuggaaagcgaucagcaucaagggcuuugcuucugucuuaga

SEQ ID NO: 214584 - RNA, 64 nt, Human
agaucccguccggcagcuuggcguccacccugcacagcaucacugaaucacagagccuuugcgu

SEQ ID NO: 214585 - RNA, 64 nt, Human
ccccaccagaucuccuugaagcagaaguagggaucagcaucauuaacaccuuccccacccccuc

SEQ ID NO: 214586 - RNA, 64 nt, Human
auuuggaguuuuucugaaaaauggagcaguaaugcagcaucaaccuauuaaaauacauuuuaag

SEQ ID NO: 214587 - RNA, 64 nt, Human
aaauuauuaucuggccaacagugugacuaucagacagcaucaaauauuugcccaauccaagauu

SEQ ID NO: 214588 - RNA, 64 nt, Human
cucagguucagcuggacucugccaucugugggcccagcaucacucuguaaguuccuugaaagga

SEQ ID NO: 214589 - RNA, 64 nt, Human
ccugugacuccuuaauaaggaccugugacaugcccagcaucaagggauaagaccguaaauucac

SEQ ID NO: 214590 - RNA, 64 nt, Human
acuuaugugaugacuugaucgaggcaggcuuuuccagcaucacuguccugguuccaucucugcu

SEQ ID NO: 214591 - RNA, 64 nt, Human
ccgccuuagaauucggaaguguuuuggaauccagcagcaucauaagauaaccaaacucguccuc

SEQ ID NO: 214592 - RNA, 64 nt, Human
ucacccacacacaccucgcuggggcaggggcacccagcaucagcccuggggagagaggcuccca

SEQ ID NO: 214593 - RNA, 64 nt, Human
cagcugccugcuguggacaaagaacaucaaauuacagcaucacgagugcuauuguugccugugg

SEQ ID NO: 214594 - RNA, 64 nt, Human
guucuuuccugccagauagaaauugugcacagcacagcaucaaguaauucguuagaugcuuguu

SEQ ID NO: 214595 - RNA, 64 nt, Human
cagugcuacgcgcugcccaugcugggucaaugaacagcaucaaagggaggcugaagagauuuca

SEQ ID NO: 214596 - RNA, 64 nt, Human
cuccacugugccuucgcucucagagagagcucuccccuggcagugacaagauggcugcagcagc

SEQ ID NO: 214597 - RNA, 64 nt, Human
gccucacccagcgaaggccggagaagcgguugggcccuggcacacagggcuggcucagugugcg

SEQ ID NO: 214598 - RNA, 64 nt, Human
augagggagaugccaugagccgcccaaggccuuccccuggcacuggcaaacagggccucugcgg

SEQ ID NO: 214599 - RNA, 64 nt, Human
gaaucacccucgcuccgucaggcgggacucgugucccagagaggaaggggcugcugaggucuga

SEQ ID NO: 214600 - RNA, 64 nt, Human
ccucccaguuuugcucugcccagcaguguuggugcccagagaugacaagggccagggagccugg

SEQ ID NO: 214601 - RNA, 64 nt, Human
cuccagacacuucacggaaggaagaucacauguccccagagaggcacccccaggcaagcucgag

SEQ ID NO: 214602 - RNA, 64 nt, Human
ugagggccucgccuggcugcagccugcgccaccgcccagagacccaagcugccuccccucuccu

SEQ ID NO: 214603 - RNA, 64 nt, Human
uggcucuccagaaccuucuaucccacagucaggccccagagagggcaggacaagccuugucccg

SEQ ID NO: 214604 - RNA, 64 nt, Human
uaagucaccagauauuuuguucccaucaguuuagcccagagauagacaguagaaugcaaauacc

SEQ ID NO: 214605 - RNA, 64 nt, Human
caccugcagguguaagggacgauuggaguuucuucccagagagucugucccagaaggacugugg

SEQ ID NO: 214606 - RNA, 64 nt, Human
cagcccucagcagcugcagaccgccccucaccaacccagagaaccugcuuuacuuugcccaggg

SEQ ID NO: 214607 - RNA, 64 nt, Human
caggggucagaggcccaggcccugacuucggcuucccagagaucucuccgccuuaguuaagagc

SEQ ID NO: 214608 - RNA, 64 nt, Human
uuccugucuguauuugaugcaggauuaaacacuucccagagaggauucuagucugguaaauaac

SEQ ID NO: 214609 - RNA, 64 nt, Human
ugccaguggauccccugcggucaggcugggcagccccagagagaggauguggaaagcacuuuuu

SEQ ID NO: 214610 - RNA, 64 nt, Human
ugcgugucgguguauauaggaaccauguacagagcccagagaagcccccuacauccccccggga

SEQ ID NO: 214611 - RNA, 64 nt, Human
uugacugcagaagaccaagaaccuguuccccaagcccagagauguccaccugggcuggacugcc

SEQ ID NO: 214612 - RNA, 64 nt, Human
ccacuguugguccaauuuucacacacgugagaaucccuggcaaagggagcagaacugaaccggc

SEQ ID NO: 214613 - RNA, 64 nt, Human
acuagccacuuccgcaggugcugacucccgcacucccuggcauuuuuugcagacaagggcuugg

SEQ ID NO: 214614 - RNA, 64 nt, Human
cccagacugcaggcaguaacugacuucacacagucccuggcauuuagucaucugugauuguuuu

SEQ ID NO: 214615 - RNA, 64 nt, Human
uguguucucaggaagacugccuccaccaccgcuacccagagaaccucugcaucuggcauuucug

SEQ ID NO: 214616 - RNA, 64 nt, Human
agcagccagcaccaccuacacaggagucuucagacccagagaaggacggugccaagggccccag

SEQ ID NO: 214617 - RNA, 64 nt, Human
uuugguuugacacccagccucuucccuggcccuccccagagaacuuuggguaccuggugggucu

SEQ ID NO: 214618 - RNA, 64 nt, Human
caaccugcacacuugacaaguggagaaacagaagcccagagagagcacuggguuuguucaggac

SEQ ID NO: 214619 - RNA, 64 nt, Human
cuauucggauauucuguuuacacacccaugucaucccagagaggugaucacagggcagggacac

SEQ ID NO: 214620 - RNA, 64 nt, Human
uucccugacuccuggugcccucucccuuuguccccccagagagacauaugcccccagagagagc

SEQ ID NO: 214621 - RNA, 64 nt, Human
ccucucccuuuguccccccagagagacauaugcccccagagagagcaaaucgaagcgugggagg

SEQ ID NO: 214622 - RNA, 64 nt, Human
caugauuaggauuagugcccuuauuuaaaaaggccccagagagcuaacucacccuuccaccaua

SEQ ID NO: 214623 - RNA, 64 nt, Human
cccccaccucucacuuugcugugagcccgggaaccccagagaccacuccuguggagagcugagg

SEQ ID NO: 214624 - RNA, 64 nt, Human
agugagggccaggcccuucccggcugcgaggacgcccagagaccgcgggcgcugagcgcguugg

SEQ ID NO: 214625 - RNA, 64 nt, Human
ucccaauuccaucaccacugccaacaacuccucccccagagaucuggcuggagcccagaaaaag

SEQ ID NO: 214626 - RNA, 64 nt, Human
cuaagacuauguugguacuuggacuuguucgugccccagagaugggcaaagcugugcacuugca

SEQ ID NO: 214627 - RNA, 64 nt, Human
ugccaaaacugauuagcuaguggacagagauaugcccagagaugcauauguguauauuuuuaug

SEQ ID NO: 214628 - RNA, 64 nt, Human
gcucuuaucuaugaagacaucuucccagaguguccccagagacaugcaagucaugggucacacc

SEQ ID NO: 214629 - RNA, 55 nt, Human
cuauuaucauggaaaacuaauuuuucccagagaauuuccuuucaaaccucccagu

SEQ ID NO: 214630 - RNA, 64 nt, Human
ucagcccugggaagacacauucccuucccuguuccccagagagcccaccuccgcccugggcagg

SEQ ID NO: 214631 - RNA, 64 nt, Human
aaaaggcaaggcuuccaggccaguuggcccaggccccuggcagugcucccggaggggcccagga

SEQ ID NO: 214632 - RNA, 64 nt, Human
ugagaggucagcggaccaccuccuuagggacagacccuggcaggucgcugcccaccgagauuuc

SEQ ID NO: 214633 - RNA, 64 nt, Human
agaggugcucagcugaagaaggcaugggauggagcccuggcauagcugccaccaugccuaugug

SEQ ID NO: 214634 - RNA, 64 nt, Human
gagcugccggucuuggcuuccuggucgccucugucccagagauggucccagggagccauccuag

SEQ ID NO: 214635 - RNA, 64 nt, Human
accaucacuauaaucaacgaacuucucuucuccacccagagauggcuuuuccaacacauuuuaa

SEQ ID NO: 214636 - RNA, 64 nt, Human
uguuggcuuucccccagccgcacgggucccaggccccagagaagaugagucuauggcaucaggu

SEQ ID NO: 214637 - RNA, 64 nt, Human
ccuggggcugguggauugggcagaauccugggcccccagagaccuuugcccacacacacuccuu

SEQ ID NO: 214638 - RNA, 64 nt, Human
uugaccuucagcuccuaugcaggcuucucuugagcccagagacaaggcagcuuggucuagugga

SEQ ID NO: 214639 - RNA, 64 nt, Human
aucugaaagucaggccugcugcaggacaggaucccccagagaccccauuugccucucaacacuc

SEQ ID NO: 214640 - RNA, 64 nt, Human
gguuucaggaggagggagacugcccugcuuuggucccagagaggcccucugcagauaggcgugg

SEQ ID NO: 214641 - RNA, 64 nt, Human
agaaucagaguggggaggggacagccuggggcugcccagagacuguggguggagcugccugcug

SEQ ID NO: 214642 - RNA, 64 nt, Human
uccucuugcucaaaaaucuguuugaucccuguuacccagagaauauauacauucuuuaucuuga

SEQ ID NO: 214643 - RNA, 64 nt, Human
auaccuuaaacucccacugcaagcccaugaacuucccagagaguggaacggcuugcucuucuuu

SEQ ID NO: 214644 - RNA, 64 nt, Human
cgacccacugcagacacaggcucugauucucuuacccagagaugcccaugagcugacauuuuac

SEQ ID NO: 214645 - RNA, 64 nt, Human
ccaucagguuaaagacuucaucuagaugaugccccccagagaugccuuuaguguaaguagcugg

SEQ ID NO: 214646 - RNA, 64 nt, Human
uaauauaauuuuauauuuacacacauacgugcuacccagagauuaauuuaguccauaugaacua

SEQ ID NO: 214647 - RNA, 64 nt, Human
uaacuacacagaggcacauccugacaggguuugccccagagaucuaaauuccagaaggagggca

SEQ ID NO: 214648 - RNA, 64 nt, Human
uuugucuuuauccacccccacuguuguggucagccccagagaauuuuaucuucuuccuuggcau

SEQ ID NO: 214649 - RNA, 64 nt, Human
auaagacugucauguaagaggugcucuccuggcacccagagaaaaggagcauccuuaccuccaa

SEQ ID NO: 214650 - RNA, 64 nt, Human
gagaagggcuucgaagauaaacugagcuccauuccccuggcaugaaacuuucagauuccccugc

SEQ ID NO: 214651 - RNA, 64 nt, Human
cuggggccacccucccugccuccaaaacagggaucccuggcaggcugucuuuccacgccccuga

SEQ ID NO: 214652 - RNA, 64 nt, Human
gcaugaucgcgcccugcucccgugccaccguagucccuggcagacaggcagggcucugcccagg

SEQ ID NO: 214653 - RNA, 64 nt, Human
agccaagcugccuuaacucgccccucggggcucccccagagacugugccccgggcgggccgcgc

SEQ ID NO: 214654 - RNA, 64 nt, Human
uucugcgaucaguuaacccauuuuaccuaggaggcccagagaugugagggcuccuuccucagga

SEQ ID NO: 214655 - RNA, 64 nt, Human
accccaucuauucucuguuggcuccaagagcuaccccagagaccuuaaacagaaacaguagcug

SEQ ID NO: 214656 - RNA, 64 nt, Human
uauauauguagauauauauuuuagcagugacauucccagagagccccagagcucucaagcuccu

SEQ ID NO: 214657 - RNA, 64 nt, Human
gaaccccaguccugagcuugguuucuucccagcacccagagaauccuuccucagcucucuucuu

SEQ ID NO: 214658 - RNA, 64 nt, Human
guuaucuaaaccuuuaaaccuaucuuccaggcagcccagagaagaucuguuucccuguguccug

SEQ ID NO: 214659 - RNA, 64 nt, Human
cuuugugugcaugggucagucaccauauguuccccccagagaaugugucuauauccuccuucua

SEQ ID NO: 214660 - RNA, 64 nt, Human
ccaggauagucuaagggagguguucccaucugagcccagagauaagggugucuuccuagaacau

SEQ ID NO: 214661 - RNA, 64 nt, Human
cacagcugaguuguugagucuguuuuguaaaguccccagagaaagcgcagaugcuagcacaugc

SEQ ID NO: 214662 - RNA, 64 nt, Human
uuuagaaguacguuuuugcauuauucauaugcuucccagagaagcucauuuaguuagaaaauaa

SEQ ID NO: 214663 - RNA, 64 nt, Human
gucacagccugacauggccagguucucacacuggcccagagaaaagagccucagcaagagaguu

SEQ ID NO: 214664 - RNA, 64 nt, Human
aacuguccaagcucucagccccacagggaaccugcccagagagcuuuaccuuucccaagcaucu

SEQ ID NO: 214665 - RNA, 64 nt, Human
aagugcacaucagcacuauggggccuauguccugcccagagaccucugcuccuuccugcucaca

SEQ ID NO: 214666 - RNA, 64 nt, Human
gauaccaauauucuauuuugcagauagaauuuggcccagagagguuaacuaauauauccaugau

SEQ ID NO: 214667 - RNA, 64 nt, Human
ccaaucauguuaacucuuccuuaucagccuguggcccagagacacaaugggguccuucuguagg

SEQ ID NO: 214668 - RNA, 64 nt, Human
uucugcacaaaacuuuugggaauuccucuuugcacccagagacucagaggggaagagggugcua

SEQ ID NO: 214669 - RNA, 64 nt, Human
auguuugcguccccguccgucacaugugccaaaucccuggcaggcagauggcuccugccccaua

SEQ ID NO: 214670 - RNA, 64 nt, Human
ucaguucugggaggaugacuccagucccugcacgcccuggcacacccuucacgguugcuaccca

SEQ ID NO: 214671 - RNA, 64 nt, Human
ccaccgucccacuccacagccuucccgaaacauucccuggcaaacaaaggaacacuaggagaaa

SEQ ID NO: 214672 - RNA, 64 nt, Human
ggcaguaauugcauuuuaucugucucaugaugcccccagagaacuuccaacucaguaggacccc

SEQ ID NO: 214673 - RNA, 64 nt, Human
gagcuguguccauggugugucaugaaggauguaccccagagaguaacaugagccacugggcaga

SEQ ID NO: 214674 - RNA, 64 nt, Human
ucccacauuccaaaagggggccugggaugcuagccccagagaugccagcccuucaggaagcagg

SEQ ID NO: 214675 - RNA, 64 nt, Human
ugcugcacugcagcaaaaacaaaaccaccaccaccccagagaaaaccauguacuaauuggagug

SEQ ID NO: 214676 - RNA, 64 nt, Human
ggcuuaagggucccaggaguacugcagggacagccccagagaggcccaacucuggccccuuucu

SEQ ID NO: 214677 - RNA, 64 nt, Human
ugcccuagacccugccagaaaagggggcucuucccccagagaaguggcuuggagggaacuuccc

SEQ ID NO: 214678 - RNA, 64 nt, Human
uggaggagccugcugcauucuccugcugagggaucccagagagggcaggugcccaccccacagg

SEQ ID NO: 214679 - RNA, 64 nt, Human
gggcagagccccaggcguccccagcuguucaccucccagagaguccccagagccccaaagggcu

SEQ ID NO: 214680 - RNA, 64 nt, Human
cuuccaugaggcaggcugaaccugcagauaugcgcccagagauauggaucgcccaagaguugcg

SEQ ID NO: 214681 - RNA, 64 nt, Human
gauggaaggaagagaguagggccagugaaggcugcccagagagaaugucacagaugaggcugcc

SEQ ID NO: 214682 - RNA, 64 nt, Human
gaaaguuccugcuuuaguguuuuguucccucugccccagagagcuccccuuagugaucucaguu

SEQ ID NO: 214683 - RNA, 64 nt, Human
agagcccagcccugggcuggggggcuccucaggacccagagaugugccuggaaccacuccugau

SEQ ID NO: 214684 - RNA, 64 nt, Human
ccccucagguuguucucugauucuuccucccaaccccagagacugcagauuugugccaugcggc

SEQ ID NO: 214685 - RNA, 64 nt, Human
gccucuauccuaaggaagaccaagcaggccuggacccagagacgucccccaucgugggacacga

SEQ ID NO: 214686 - RNA, 64 nt, Human
cuggcaggugaugugcuggguauagcauggaccucccagagaagcucaagcuauguggcacugu

SEQ ID NO: 214687 - RNA, 64 nt, Human
cgauugugcuucucaacuccaccccauaauuucucccagagaccaucuaucaccuuuuccccaa

SEQ ID NO: 214688 - RNA, 64 nt, Human
cguuaguagauggccccuucucgugaggccucuccccuggcaccugcuucaguuguccuccaca

SEQ ID NO: 214689 - RNA, 64 nt, Human
ccuauuuccuggaaugugggugugauggcuggagcccuggcagccauacugccacguguacaga

SEQ ID NO: 214690 - RNA, 64 nt, Human
uacccaauucucaccuagugucacguucccccgacccuggcacacgggccaagguacccacagg

SEQ ID NO: 214691 - RNA, 64 nt, Human
agcuccagcagaaaccagauuggauguuccagcucccagagaagacucuaucacagugcacaua

SEQ ID NO: 214692 - RNA, 64 nt, Human
aacuggcacacgccccacgccuuccucuauaacccccagagacaggcuggggcagcgccaaggc

SEQ ID NO: 214693 - RNA, 59 nt, Human
cacgaccuggccuggauugacaacauccucccagagaaggaaaaaaaggagacagacaa

SEQ ID NO: 214694 - RNA, 64 nt, Human
gaaaagcaguuagcauuuccacacaaccgcuguccccagagauaacugcuguuuucauuuuaau

SEQ ID NO: 214695 - RNA, 64 nt, Human
uaugcuccuugacugaaacuuuaaggggaucucucccagagacuugacauuuuagcuuuauugu

SEQ ID NO: 214696 - RNA, 64 nt, Human
uuccccgcccguuuuacaaagggggaggcuaaagcccagagacagcuugaucaaaggcacacag

SEQ ID NO: 214697 - RNA, 64 nt, Human
aagcuuucuucuuacaccuugggcuuggauauugcccagagaagaaauuuggcuuuuuuuuucu

SEQ ID NO: 214698 - RNA, 61 nt, Human
ugcaauuugugucuuccuaaagagagcuguacccagagaguccugugcugaauguggacuc

SEQ ID NO: 214699 - RNA, 64 nt, Human
acugagcaacaggaggacucagccugggacaggccccagagagucacacaaaggaaucuuuauu

SEQ ID NO: 214700 - RNA, 64 nt, Human
auucugacaaaaaguccagaacccauaaacauagcccagagaagagaggcucugaaagaaagga

SEQ ID NO: 214701 - RNA, 64 nt, Human
acuccaggcuggccuuuggccgacugucugcucacccagagaccuuggacuccggacuauccau

SEQ ID NO: 214702 - RNA, 64 nt, Human
caugcaggaguuucuccugggcagcuggucacuccccagagaagcugggccuucauggacacau

SEQ ID NO: 214703 - RNA, 64 nt, Human
aguggaccuggagaccauccccuuggaaagacaacccagagauguucagcauccuguaucuaca

SEQ ID NO: 214704 - RNA, 64 nt, Human
gcuauguuucuauaagauauggugcccuguguaucccagagaugcuagaaaacuguucuuugcu

SEQ ID NO: 214705 - RNA, 64 nt, Human
gcucagcuuugggaugugggugggaacuggagcacccagagaaaacccauacagacaguggccu

SEQ ID NO: 214706 - RNA, 64 nt, Human
gaauagcugugauggaaggacuagagcgaaagggcccagagauaucaaggaagcuuuucauucu

SEQ ID NO: 214707 - RNA, 64 nt, Human
ggaccccucauuaaccaaccaagcacuuguaccucccuggcauacugagaauuccuggguccaa

SEQ ID NO: 214708 - RNA, 64 nt, Human
agaaguggggcucugggagggauguucuagcccucccuggcaugucagagccaggcucugccug

SEQ ID NO: 214709 - RNA, 64 nt, Human
ucgcugcuggcuugugcugguuuagugccugugucccuggcaguguccaguguguucacuucca

SEQ ID NO: 214710 - RNA, 64 nt, Human
aacaaucaacuaguauuuguugagcuccuauuugcccagagauggucauauuuaaacagaagua

SEQ ID NO: 214711 - RNA, 64 nt, Human
gggggauuguagcagacgucugggcuuuuccccacccagagaauagcccccuucgauacacauc

SEQ ID NO: 214712 - RNA, 64 nt, Human
uucauagagucaacuguuucaucaucauagugagcccagagagccacugcccagcagcaugcuc

SEQ ID NO: 214713 - RNA, 64 nt, Human
cacuguaaaaacagcuguagguauaauguauauucccagagaauuguauuuaacuaauuaaugu

SEQ ID NO: 214714 - RNA, 64 nt, Human
uaccaccggcacuuacaaaaugugcggacugaaucccagagaacacuggcagauguauacagua

SEQ ID NO: 214715 - RNA, 64 nt, Human
uaccacugaaguagaauugauuguucagcuggagcccagagaauuuaauuuaauguuuuuucuu

SEQ ID NO: 214716 - RNA, 64 nt, Human
aucaacugauuaaagcagugaccagcaggaacugcccagagaacuggcuggccuuguuuccuga

SEQ ID NO: 214717 - RNA, 64 nt, Human
ggcucaugccuccaagucagaguuucccuggugccccagagacaggagcacaagugggaucuga

SEQ ID NO: 214718 - RNA, 64 nt, Human
aaguguuuuacacaaaugcauaucuugaacgucacccagagacuguaauuuguguaguuuuucu

SEQ ID NO: 214719 - RNA, 64 nt, Human
aggacugguuuuccaguacaucuuuaaacaaggccccagagacucuaugucugcccguccauca

SEQ ID NO: 214720 - RNA, 64 nt, Human
cgcggccgaggccggagcaccacauccaccucgccccagagaggcucugcucccuccuauggag

SEQ ID NO: 214721 - RNA, 64 nt, Human
ggccccggggcugccguuuugcugggcagugguucccagagagucagagcuggcaccccucagu

SEQ ID NO: 214722 - RNA, 64 nt, Human
gcuguucccgcugcacggcccaccggcggccagccccagagaccagaacugauccagagcugga

SEQ ID NO: 214723 - RNA, 64 nt, Human
aggcaggggcaggcugaggaguugcccuuugccccccagagacugacucucagagccagagaug

SEQ ID NO: 214724 - RNA, 64 nt, Human
acucuuaaugcuguguuugagcuuucaugaguuucccagagagacauagcuggaaaauuccuau

SEQ ID NO: 214725 - RNA, 64 nt, Human
gaacccuucauaggaaauccccacccccguccaccccagagacccugcccuuccacccggaggc

SEQ ID NO: 214726 - RNA, 64 nt, Human
gauguggcuguggaaugauaagguccuagaggggcccuggcauuucaggaagcggaccugguau

SEQ ID NO: 214727 - RNA, 64 nt, Human
guggucuuuagcacaaagacuugcaugcagagaucccuggcagaacacccagagugcccguggc

SEQ ID NO: 214728 - RNA, 64 nt, Human
ugaguugcaccacuuguacucaauucuaauugcccccuggcaaucugggaaggguucagaaggu

SEQ ID NO: 214729 - RNA, 64 nt, Human
ggcugugucagcccagccccuucccuucuccaggcccagagaacucuuccacaaacaagaugag

SEQ ID NO: 214730 - RNA, 64 nt, Human
agggauguaggagggggaaggaggaaacaggaagcccagagagggcaaagggccuaccucgggg

SEQ ID NO: 214731 - RNA, 64 nt, Human
cucucugcucagaacacuaccauucaccccaucucccagagacacucucccuccuccucuuuca

SEQ ID NO: 214732 - RNA, 64 nt, Human
ggggaacagggaauagaaccuuucaaagagguugcccagagaaaagcugggccucuugcauucg

SEQ ID NO: 214733 - RNA, 64 nt, Human
gcaguagccuuggggcagagggcacccgcagagucccagagaugaugugggcagugggcagaga

SEQ ID NO: 214734 - RNA, 64 nt, Human
uccagugucugucaugccccugaguucuuuuggucccagagaggcagccugggcagucuguuua

SEQ ID NO: 214735 - RNA, 64 nt, Human
aagggcagacaaacaggugagggugaguguggcacccagagacugcucuuccugcccucacccu

SEQ ID NO: 214736 - RNA, 64 nt, Human
gugcauggaggcccuccugugcugggggaaugagcccagagaacagcgaaguagcuugcucccu

SEQ ID NO: 214737 - RNA, 64 nt, Human
ccugagcaccugcuucaugaaggaagauagguagcccagagaagaaguuuuggacuuaacaaca

SEQ ID NO: 214738 - RNA, 64 nt, Human
uuaauuguuuuagagcguguugcuguuguaacaucccagagaagaaugaaaaggcacaugcuuu

SEQ ID NO: 214739 - RNA, 64 nt, Human
ugcccggaggggucuggaggcauaagucuagaugcccagagagcauccaggcacugaacugcuc

SEQ ID NO: 214740 - RNA, 64 nt, Human
aacagaggacaggugacaaccaccucgaagagcucccagagauuguagaaagaguccaguguaa

SEQ ID NO: 214741 - RNA, 64 nt, Human
gggugauaacuacuuagcacugcccuggugauuacccagagauaucuaugaaaaccaguggcuu

SEQ ID NO: 214742 - RNA, 64 nt, Human
accacagccucauuuuacagacagcccccugaggcccagagacaugcagcucucuguccacaac

SEQ ID NO: 214743 - RNA, 64 nt, Human
gaaggugagaggaaggcaaaggccagggaggggacccagagaggccuggcacacaaggcccaag

SEQ ID NO: 214744 - RNA, 64 nt, Human
ggaacucaggaaaagcaggaacccuuuccaaaagcccagagaugcccugggcucagaucuguaa

SEQ ID NO: 214745 - RNA, 64 nt, Human
agagacccagagugcacgugacccgcagugugaucccuggcacgcacugacuuugauauuccag

SEQ ID NO: 214746 - RNA, 64 nt, Human
cgccaggcacuguccuccgcaaggccuggugcagcccuggcaguaacuggcuuguaagaggcuc

SEQ ID NO: 214747 - RNA, 64 nt, Human
gaauguggacaccuggcucccugguguccaaagacccuggcaccuggguggguuugagcuggac

SEQ ID NO: 214748 - RNA, 64 nt, Human
cuuuugugccaaacccauaggucugaaacugagacccagagaggcugaaugacaugcucacagu

SEQ ID NO: 214749 - RNA, 64 nt, Human
ugguucagguggggucuccagaaggcugcuugcccccagagagccaucucuuccauuuuugauu

SEQ ID NO: 214750 - RNA, 64 nt, Human
acucccauuugcucucagugaccccagggcagagcccagagaaguguuccguacccacugcuga

SEQ ID NO: 214751 - RNA, 64 nt, Human
ucaaaucuuuauuuugcagaugaggaaacagcaacccagagaggagaacuaacccacacaggau

SEQ ID NO: 214752 - RNA, 64 nt, Human
aggauacaucugaaagcauuccuuuggcauggaccccagagauaguuuuggagccaggcauuga

SEQ ID NO: 214753 - RNA, 64 nt, Human
ccaucagcagggggaaagccaagcugagaauaaacccagagacaaagaacccucggacucaggc

SEQ ID NO: 214754 - RNA, 64 nt, Human
ugggcagaaggggcggcccggacgggggagcuuucccagagacccggggauggauuggccucca

SEQ ID NO: 214755 - RNA, 64 nt, Human
gauaauggccagagauauccacagcuuggaggagcccagagaccguuugcuuuauacccacaca

SEQ ID NO: 214756 - RNA, 64 nt, Human
gugguuaugcagaagcagagaugaggaggcuggccccagagaugaucuugcccuuccuaacuaa

SEQ ID NO: 214757 - RNA, 64 nt, Human
acaccucagcaaaugcugcaaaauccuguuuucccccagagagcuggagguuaaauacuaccag

SEQ ID NO: 214758 - RNA, 64 nt, Human
uguaaauaaugugggaaaauaguauuguuuagcucccagagaaacauuuguuccacaguuaaca

SEQ ID NO: 214759 - RNA, 64 nt, Human
cgggcucagccauucggcuuggggcaccaggcuccccagagacaaugcucaguauucauucaua

SEQ ID NO: 214760 - RNA, 64 nt, Human
uucuuuguaauuuaugcuuucauauauccuuggucccagagauguuuagacaauuuuaggcuca

SEQ ID NO: 214761 - RNA, 64 nt, Human
ucaucccuacucaucagaaagacaaauauaaaaucccagagagguggaggagcuaaaaaagcaa

SEQ ID NO: 214762 - RNA, 64 nt, Human
ucaauagcaacagaaauauaaauuauauuccauucccagagagagaaugcgcuuuggauuguuu

SEQ ID NO: 214763 - RNA, 64 nt, Human
cagccuucagucccuaucagcgccuccuuuacuucccagagaacuucacagagacucuguccuu

SEQ ID NO: 214764 - RNA, 64 nt, Human
agaggggaagcagccagcccaggaugcuucagggcccuggcagcaaagaagcugggguggugug

SEQ ID NO: 214765 - RNA, 64 nt, Human
ggaaaccuacccugugggcacccauguccgagcccccuggcauuucugcaaugcaaauaaagag

SEQ ID NO: 214766 - RNA, 50 nt, Human
gugaggacaccuacuuguaacccuggcagcuaaggccuccagggcggggu

SEQ ID NO: 214767 - RNA, 64 nt, Human
ugagcugugucccuuuacuaugcaagcacaugaccccagagacagcugguucacuggcagaucc

SEQ ID NO: 214768 - RNA, 64 nt, Human
cugugugcaaggcaauaguuagccuugauuuuagcccagagacagauggcagagcuaucucucu

SEQ ID NO: 214769 - RNA, 64 nt, Human
aggagauguaaugacagagaguucuggugagauacccagagagaaaaagagagagcaggguggg

SEQ ID NO: 214770 - RNA, 64 nt, Human
gcugcuccccacaccuagccuuuguucuggaaaccccagagagggcugggcuugacucaucuca

SEQ ID NO: 214771 - RNA, 64 nt, Human
caccaggcaagagucuugcuuauugggcugcauccccagagaggauaugaauuauuuuuugaaa

SEQ ID NO: 214772 - RNA, 64 nt, Human
gggggacccaaagggucuggccucuuugggcagccccagagaugaggggucagcagaggagagc

SEQ ID NO: 214773 - RNA, 64 nt, Human
ccacuccccuugccccacacccuuuacuccccagcccagagagacgcugcuuuuaccaggaaag

SEQ ID NO: 214774 - RNA, 64 nt, Human
aggcagcaccauuugacagguuaggaugcuggggcccagagagguuaagugucuugcccgaggu

SEQ ID NO: 214775 - RNA, 64 nt, Human
gcagaccuggcuguggagagcagcuaauguguggcccagagagccugucuguguggagcacgua

SEQ ID NO: 214776 - RNA, 64 nt, Human
uugugcuuauuucugccauugucccucucacguucccagagaggucauucuuuuugguccaacu

SEQ ID NO: 214777 - RNA, 64 nt, Human
ccccagcgucuugacgggagcauuggccccugagcccagagaagcuggaagccugccgaaaaca

SEQ ID NO: 214778 - RNA, 64 nt, Human
cagggcccagcccugcuuccuggaguggauguggcccagagaaggaggcugggggaucaccagc

SEQ ID NO: 214779 - RNA, 64 nt, Human
ucagcucuuucugcaugugcuggucaaauccaaacccagagaacagaagcgcuuucuaagaaug

SEQ ID NO: 214780 - RNA, 64 nt, Human
ggaacaguccauauuagcuccagagagugucaaacccagagaaaugugugcaaaaaugauacuc

SEQ ID NO: 214781 - RNA, 64 nt, Human
ccuugccccuuauuucuucccugcuucccucgaacccagagauuuuugagggaugaacggguag

SEQ ID NO: 214782 - RNA, 64 nt, Human
acccugggaacugggucuuggguagcaaagcccucccagagaaaagauugggcacaacuaaggc

SEQ ID NO: 214783 - RNA, 64 nt, Human
uuugugguggggggugcggaggagguacccccaccccuggcacagccgccuggaaugcaggacu

SEQ ID NO: 214784 - RNA, 64 nt, Human
uucugaauuccuaucagguccagaggguggaaggcccuggcaggaagcaggaggaggaggagag

SEQ ID NO: 214785 - RNA, 53 nt, Human
aagacauuccuuauguguagugucccuggcaggcauuuaccaggccaugugcu

SEQ ID NO: 214786 - RNA, 64 nt, Human
uugccucuguauuuaagccaacagaguuacccaacccagagacuguuaaucauggauguuagag

SEQ ID NO: 214787 - RNA, 64 nt, Human
auccccucucccacugagucacagguuugagauucccagagaggccaaagacagcuacaggaag

SEQ ID NO: 214788 - RNA, 64 nt, Human
ugacugcuacuuccugucucuguuuccauuaucacccagagagggacaagauaggacauggccu

SEQ ID NO: 214789 - RNA, 64 nt, Human
ucucugggcugccggugggaggggaugucgccuccccagagaugccugguccgucuugggucug

SEQ ID NO: 214790 - RNA, 64 nt, Human
accaauaugugccacgugccuguggcugcagacucccagagaaccagcacuggguuuacagaau

SEQ ID NO: 214791 - RNA, 64 nt, Human
ccuucaggcaccuaggggagagcgugccugacaacccagagagauucgacagucagccuugugu

SEQ ID NO: 214792 - RNA, 64 nt, Human
gugccaagccuguggaucaggaauaucaacagcccccagagaguggugcuggcugagggucuga

SEQ ID NO: 214793 - RNA, 64 nt, Human
ugcaccucccuucccucccugaggcaggugagaacccagagagaggggccugcaggugagcagg

SEQ ID NO: 214794 - RNA, 64 nt, Human
uacaccucagggcgggugagguuccgacacugaucccagagaugccguggauacgccagggucc

SEQ ID NO: 214795 - RNA, 64 nt, Human
uauuugaguuguuuuggugccugccucugccaugcccagagaaucagggcaggcuugccaccgg

SEQ ID NO: 214796 - RNA, 64 nt, Human
aaggacuuggcugcgcguaacugccuggucagugcccagagacaagugaaggugucugcccugg

SEQ ID NO: 214797 - RNA, 64 nt, Human
ucuuuacgaguguuuuuuauuugggacccucgagcccagagauauuaauggauaucuguauuca

SEQ ID NO: 214798 - RNA, 64 nt, Human
ucagaggaagcagcccucccucgauggccucuagcccagagaagcccgcgcaucuuggacccac

SEQ ID NO: 214799 - RNA, 64 nt, Human
aagaaaaaaaaaaaaggaggggaaaugcauuuuccccagagauaaaggcugccauuuugggggu

SEQ ID NO: 214800 - RNA, 64 nt, Human
aagaguguaugauucuggaacagggugaaacucucccagagacgaagaaagaguccugggauuu

SEQ ID NO: 214801 - RNA, 64 nt, Human
gaugacaugacaucacucccaauucucuccaaaccccagagaaauacugacgaaguuuucugau

SEQ ID NO: 214802 - RNA, 64 nt, Human
aauggggccuggggcucucagggagaacugcuuccccuggcagagcuggguggcagcucuuccu

SEQ ID NO: 214803 - RNA, 64 nt, Human
ucccagcccuuaacucuaaugaggucucuugggccccuggcagccuugcccaguuguucucucu

SEQ ID NO: 214804 - RNA, 64 nt, Human
ucgccuuucagcaggcagccuuggcgguuuaucgcccuggcaggcaggggcccugcagcucuca

SEQ ID NO: 214805 - RNA, 64 nt, Human
cuguuuugaguuuugcccuggggcuugaaugagucccagagagucguucggauggugggaggcu

SEQ ID NO: 214806 - RNA, 64 nt, Human
aguacaacaaaggugacggguguguagguacacacccagagauggagcacugcagaucagcaac

SEQ ID NO: 214807 - RNA, 64 nt, Human
gagaaauaaacauuuagaggauuuaauuagaaagcccagagaaaaagccagaaaaccaagguaa

SEQ ID NO: 214808 - RNA, 64 nt, Human
gaaaggguauuucauaguuuuuaaaccuuucauucccagagauccgaaauaucauuuguggguu

SEQ ID NO: 214809 - RNA, 64 nt, Human
uauuaaucucauuguacaagugagaaaacugagacccagagagcuuaagugacuuccucgaggu

SEQ ID NO: 214810 - RNA, 64 nt, Human
ccccuuuaacacuggugaaagcuacgguacucuccccagagauaugucuugucagccucucuag

SEQ ID NO: 214811 - RNA, 64 nt, Human
agagccugcaauuggaaauaugagaaauucuuugcccagagagcugcccuaacagaacacuuca

SEQ ID NO: 214812 - RNA, 64 nt, Human
uaguuauuuucugaaaaauugguucuucucuuuucccagagaccuucugaucuccaaaaagagg

SEQ ID NO: 214813 - RNA, 64 nt, Human
aaaaggguucuuggaggccaggggaauacggggucccagagaaagauuuccuucucuuagaagu

SEQ ID NO: 214814 - RNA, 64 nt, Human
uauuaaaaggaagcagaagcauugaccauuuuuucccagagaagaggagaaaucuguagugagc

SEQ ID NO: 214815 - RNA, 64 nt, Human
ugggaccagaugcuucccugugcuggcuggaguccccagagauaucagccaccgagucuccugg

SEQ ID NO: 214816 - RNA, 64 nt, Human
gacuacaaugggcugaaacaguugguauagcaaccccagagaagugcuucauuuucuuuuuaua

SEQ ID NO: 214817 - RNA, 64 nt, Human
uaagaaagaauugcaguaaagucuugucuggugacccagagaucaccaugacuugaggcacaaa

SEQ ID NO: 214818 - RNA, 64 nt, Human
uucucuucuugcugcaaaacugguuggcuugcaacccagagagagcagcuucccuuggcucugg

SEQ ID NO: 214819 - RNA, 64 nt, Human
guccacaguaguucaggcaauuaagaauaugcaacccagagaauuucugugaaaacauuuugcu

SEQ ID NO: 214820 - RNA, 64 nt, Human
agccaaagccgaaaauaguauaugagcauucuagcccagagacugucgcuacuaaaagaaugaa

SEQ ID NO: 214821 - RNA, 64 nt, Human; identical to SEQ ID NO: 214228

SEQ ID NO: 214822 - RNA, 64 nt, Human; identical to SEQ ID NO: 214229

SEQ ID NO: 214823 - RNA, 64 nt, Human
caagcucugaaugucuagaccaggaccucccucccccuggcacugguuuguucccugugucauu

SEQ ID NO: 214824 - RNA, 64 nt, Human
gagggaaauggguagagccuguuugucuugcuuccccagagauagaaugugaagacacgcgcua

SEQ ID NO: 214825 - RNA, 64 nt, Human
ucuuggugccccgacccccaggguucgucuaggucccagagacccucugccuggaggcgggccu

SEQ ID NO: 214826 - RNA, 64 nt, Human
ggccgccuucuuggugccaaacccccuucccccacccagagacugggcagcugugucugguucg

SEQ ID NO: 214827 - RNA, 64 nt, Human
ggaggcaagcccccuugccuuucaaacuggaaaccccagagaaaacggugcccccaccugucgc

SEQ ID NO: 214828 - RNA, 64 nt, Human
uuacacuuuacagguaccuguuaucccuacgcuucccagagagaacaaugcugugagagaguuu

SEQ ID NO: 214829 - RNA, 64 nt, Human
ggaaggagccaggacacagcucagcuugcucacgcccagagagagaaaaaguuaagcugcugac

SEQ ID NO: 214830 - RNA, 64 nt, Human
gcucuugucccugggaggccucugcuugucacuucccagagauugcagagguguguccugccua

SEQ ID NO: 214831 - RNA, 64 nt, Human
ggcccagagcacuguuggaagucugguuagaguccccagagaguuacucuaaguuaaaaugagc

SEQ ID NO: 214832 - RNA, 61 nt, Human
gucugaaguggacugugugagccugggcauucccagagaggaagggccgcugugcacugcc

SEQ ID NO: 214833 - RNA, 64 nt, Human
gcuuuuaauccaaagaacauguauaguuuuuguacccagagacuaugauuuauauugauugcac

SEQ ID NO: 214834 - RNA, 64 nt, Human
uuccucugccgggaggguguuuucaacuccaaaccccagagagggguuguagauuggguccagc

SEQ ID NO: 214835 - RNA, 64 nt, Human
cuuuaugaugacugcuuaacuccccacugccugucccagagaggcuuuccaauguagcucagua

SEQ ID NO: 214836 - RNA, 64 nt, Human
cucagauggaacgaaaggcgaugugcaaggccaucccagagagacggaagcaggugcgauacua

SEQ ID NO: 214837 - RNA, 64 nt, Human
acuaugucuggucaccagcucccuccugcuggcacccagagacccggacccgcagggccugccu

SEQ ID NO: 214838 - RNA, 64 nt, Human
uggugucacguuggggaacaaguguccuucagaacccagagaaggccgccguucuguaaauagc

SEQ ID NO: 214839 - RNA, 64 nt, Human
gaaaacgggccgguauuuacacacgcgcaaaacacccagagacggcacaaggagguugaacuca

SEQ ID NO: 214840 - RNA, 64 nt, Human; identical to SEQ ID NO: 214231

SEQ ID NO: 214841 - RNA, 64 nt, Human; identical to SEQ ID NO: 214232

SEQ ID NO: 214842 - RNA, 64 nt, Human
ggccccuguggccugggugggcccucccgccccucccuggcaggacaaucugcuugugucuccc

SEQ ID NO: 214843 - RNA, 64 nt, Human
ucuucagaccagccagcaaggggccgugccagugcccagagagcaggucagacaacaggcaacc

SEQ ID NO: 214844 - RNA, 64 nt, Human
gccaguuucuugucuuuuuuauacauuuugucaucccagagacaaucaguaugugcuuaccugu

SEQ ID NO: 214845 - RNA, 64 nt, Human
aagaauuccaauuaauuaaauaucacaauagcaucccagagagacaguaggaaauuucuccuua

SEQ ID NO: 214846 - RNA, 64 nt, Human
cuccauggaggaggugucccaagcuuugaauacccccagagaccuuuucucucccauaccauca

SEQ ID NO: 214847 - RNA, 64 nt, Human
caacuguggccaugacugaggaaaggagcucacgcccagagacugggcugcucucccggaggcc

SEQ ID NO: 214848 - RNA, 64 nt, Human
gaauggucucugucaagcgggccgucucccuuggcccagagacggagugugggagugauuccca

SEQ ID NO: 214849 - RNA, 64 nt, Human
uaaauugauuuguuaugguuacauauuuagcgcacccagagaaaauuaauuauauuucuacaga

SEQ ID NO: 214850 - RNA, 64 nt, Human
acucuaaccaaucaaauaguuucuuugucuugcucccagagacaccuuguaaguguccccucug

SEQ ID NO: 214851 - RNA, 64 nt, Human
aaacagggaagagacauaccccugggcuuggauucccagagaggaaaccuuggggccccagaug

SEQ ID NO: 214852 - RNA, 64 nt, Human
aaugggacccacguggaguaggugacauaugcuucccagagacugguauuguggcugugccagg

SEQ ID NO: 214853 - RNA, 64 nt, Human
uggcuccuccaggcacgucccggaccuguggggccccagagaggggacauuucccuccugggag

SEQ ID NO: 214854 - RNA, 64 nt, Human
auacuaaaauacugauuaucuuaaucacauuuuccccagagauaaacauugagagaacgaaagc

SEQ ID NO: 214855 - RNA, 64 nt, Human
ccgagagcugucggaaccagaugcaacccggcagcccagagaacucuccugggaggcugugggu

SEQ ID NO: 214856 - RNA, 64 nt, Human
cauaaagugaaucaaauuugacauuauuuuagaucccagagaaaucaggugugauuaguucucc

SEQ ID NO: 214857 - RNA, 64 nt, Human
uuagggcauagaguugucuccuucccaacacggacccagagagcagcccuucccugcucaaagc

SEQ ID NO: 214858 - RNA, 64 nt, Human
cuacagagcagugugggcagccccaagugugguccccagagagcguuuggcuuuccugucuguc

SEQ ID NO: 214859 - RNA, 64 nt, Human; identical to SEQ ID NO: 214235

SEQ ID NO: 214860 - RNA, 64 nt, Human; identical to SEQ ID NO: 214236

SEQ ID NO: 214861 - RNA, 64 nt, Human
uagcuauaaaguaaaacuuggguggaaccuggggcccuggcaucacacaagugugauuaggaug

SEQ ID NO: 214862 - RNA, 64 nt, Human
gaguguuccucgacauguuucuccagugacaccucccagagaaguuguaaguauaaaaugaaaa

SEQ ID NO: 214863 - RNA, 64 nt, Human
uugaaauguugacuuaagugagggggaaauaaaacccagagagagagagagagcgagagagaga

SEQ ID NO: 214864 - RNA, 64 nt, Human
aagauccucaucugagagugcuuaaaaugggauccccagagaccauuaaccaauacuggaacug

SEQ ID NO: 214865 - RNA, 64 nt, Human
ucccagccugaggcuccagcugaugcccucagcucccagagagggggugccccaucuagcuggg

SEQ ID NO: 214866 - RNA, 64 nt, Human
gccacaccacgugcccucuuggcccagccuuccucccagagaggcggccugacuuaccuggaug

SEQ ID NO: 214867 - RNA, 64 nt, Human
cuuccuuccccucuguaaauguccaugacuauugcccagagaaggcuuaccccucucuaggguu

SEQ ID NO: 214868 - RNA, 53 nt, Human
caaguagcaaaaaaacaugaacucccagagaaggauugugggagacacuuuuu

SEQ ID NO: 214869 - RNA, 64 nt, Human
cucacaugggacugggauaugggggcaucucuuccccagagaggcacucagugagccuccugug

SEQ ID NO: 214870 - RNA, 64 nt, Human
uguuagcguuacuucuccuguggucaguaaguugcccagagagaaggaacaaaggucuggaguu

SEQ ID NO: 214871 - RNA, 64 nt, Human
gugacacguggacaaaugcgggcucaucagcccccccagagagggucaggccgaaccccauuuc

SEQ ID NO: 214872 - RNA, 64 nt, Human
ugaguccagcuccccccaagaugagcugcagccccccagagagagcucugcacgucaccaagua

SEQ ID NO: 214873 - RNA, 64 nt, Human
accccaacaaauauuaaauggcuucuucuuaaagcccagagaaagagguuuuuuaaaagacugu

SEQ ID NO: 214874 - RNA, 64 nt, Human
gccagacuuuaggagugugagggaugcugaaucucccagagagcucacacuggccaggaaugcu

SEQ ID NO: 214875 - RNA, 64 nt, Human
gacaucuauugucauuccauugcuauuuuuuuuccccagagacuuccauaauuuaaaauaaaau

SEQ ID NO: 214876 - RNA, 64 nt, Human
cuaauuuuuuaaaaauggaagguaaacugcauagcccagagaaagauaaguaaauauuuaagaa

SEQ ID NO: 214877 - RNA, 64 nt, Human
cacguacaguuguauggauuguguacugcacaaccccagagaauaccagucacaucaaucaggg

SEQ ID NO: 214878 - RNA, 64 nt, Human
auuuaauacuucagaaaauuucugcagagcccugcccuggcacuuaaaauagcuuccaauaagu

SEQ ID NO: 214879 - RNA, 64 nt, Human
agcagggaauugauccacuucuuaaugcuuuccucccuggcaugaccauccuguccuuuguuau

SEQ ID NO: 214880 - RNA, 64 nt, Human
gcaguacuugggugcugaagaacuguuggauuuacccuggcacgugugccacuugccagcuucu

SEQ ID NO: 214881 - RNA, 64 nt, Human
ccuuaaaugucgguccaggcccugugcaccuuaccccagagacagacucuuuuuguaagauuuu

SEQ ID NO: 214882 - RNA, 64 nt, Human
acggggggccccagucagccucucucccagucuacccagagaagccccuuccccaugggaagac

SEQ ID NO: 214883 - RNA, 64 nt, Human
ccacgagaagugaccuucagggucaucaggcugucccagagagguccgcguucuccccaccccg

SEQ ID NO: 214884 - RNA, 64 nt, Human
cuguacauacauuguauaggccaucuguaaauaucccagagaacaaucacuauucuuaagcacu

SEQ ID NO: 214885 - RNA, 64 nt, Human
ccuugcuguuuaaaaguaaugcaauaugugaacgcccagagaacaagcacuguggaacugcuau

SEQ ID NO: 214886 - RNA, 64 nt, Human
aggacacuuggcuuuggggggaaggaaacugaggcccagagaggggcaaccacuggccaagggu

SEQ ID NO: 214887 - RNA, 64 nt, Human
cauaacaugguacaugcuucaggacuacauaugacccagagagcaagguggcugaacuauaguc

SEQ ID NO: 214888 - RNA, 64 nt, Human
aaaaacccaagaguuuguacagacauccugucuucccagagaagguggacacucuugggcucau

SEQ ID NO: 214889 - RNA, 64 nt, Human
ggguagggagaggacaaggggucaccgagcccuucccagagagcagggagcuuauaaauggaac

SEQ ID NO: 214890 - RNA, 64 nt, Human
cugcaaagcaguguccaggagcaggccacuacugcccagagagcagaggaggagguuguuggca

SEQ ID NO: 214891 - RNA, 64 nt, Human
gcugcucgggaaggccugagggaagcccacccgccccagagacugcccacccugggccucccgu

SEQ ID NO: 214892 - RNA, 64 nt, Human
cccuguacaucuaauauauacugauuuguuugcccccagagaauuuuuaagguaucugccuaua

SEQ ID NO: 214893 - RNA, 64 nt, Human
gggcucugcauagccaggaugacggcuuucaugucccagagaccuguugugcuguguauuuuga

SEQ ID NO: 214894 - RNA, 64 nt, Human
gaccagucggaagggauucuggcuauugggggagcccagagacaggggaaggcagccuguccau

SEQ ID NO: 214895 - RNA, 64 nt, Human
ugggacacaagucacuucaagaagucuggugguccccagagaaacaacuauguuauccauccug

SEQ ID NO: 214896 - RNA, 64 nt, Human
cuaaagaagccucuucuauuuaaugcagacccggcccagagacugugcgugccacuaccaaagc

SEQ ID NO: 214897 - RNA, 64 nt, Human
gugauaucacacccaaauuucacaagcacugacccccuggcaccaacacccgccaguacuguga

SEQ ID NO: 214898 - RNA, 64 nt, Human
ugaucaaagcgaauauuccaucuguggauagaaccccuggcaguguugucagcucaaccuggug

SEQ ID NO: 214899 - RNA, 64 nt, Human
aauugagcgccaugucaggcuguuguggguaucccccuggcagggccagcuaggccugugguuc

SEQ ID NO: 214900 - RNA, 64 nt, Human
guaggaggauccacaggauuugagaugcuaaggccccagagaucguuugauccaacccucuuau

SEQ ID NO: 214901 - RNA, 64 nt, Human
auucaggaaagaagugcagaauuucuuccccaagcccagagaagagcagcccugagccccugua

SEQ ID NO: 214902 - RNA, 64 nt, Human
gagggucagaacuggacagcugcagagaccugugcccagagaagggucucgacccacucaagga

SEQ ID NO: 214903 - RNA, 64 nt, Human; identical to SEQ ID NO: 214811

SEQ ID NO: 214904 - RNA, 64 nt, Human
ugaccuucagcccucccuacagccggggguguggcccagagaagcuuccagcacagcccucuac

SEQ ID NO: 214905 - RNA, 64 nt, Human
uuaacuggacauuaguguacagcccauguccaagcccagagagaaaacaaugggaacaauuuca

SEQ ID NO: 214906 - RNA, 64 nt, Human
gccugaggucuccuauucuacucugaaccauaaacccagagaagaauuacucauuaaccagcau

SEQ ID NO: 214907 - RNA, 64 nt, Human
gaaccugggcuaagaguuuggcauugcaggagcucccagagagacugccuucccuacacuagaa

SEQ ID NO: 214908 - RNA, 64 nt, Human
uuacuuuaaaugccugccaaggagcagccucaagcccagagaagacugaggcuacggggaacuu

SEQ ID NO: 214909 - RNA, 64 nt, Human
ucccaaugccaacccccaccccguuucccuggugcccagagaacccaccucucccccaagggcc

SEQ ID NO: 214910 - RNA, 64 nt, Human
agaaaucucuuuguggcuuucaugggcagggaaucccagagauagcaaaugccaccugaccaga

SEQ ID NO: 214911 - RNA, 64 nt, Human
cuuaucuuccuuuugugguuuuuaauuugaagaccccagagaauuccauuacauaaugauuuug

SEQ ID NO: 214912 - RNA, 64 nt, Human
gcuaauacuuucucccuaauggaagcccugaucccccagagagcuacaggucugcucccgacgg

SEQ ID NO: 214913 - RNA, 64 nt, Human
gcccaaacuugugacugcaucccucuggagucuacccagagacagagaaugugucuuuaugugg

SEQ ID NO: 214914 - RNA, 64 nt, Human
gaggaaacagacagcggacugaggaagcgauggccccagagaaagggccccuguagccuggcuc

SEQ ID NO: 214915 - RNA, 64 nt, Human
cacaaaugaagagaaaagccaugcccaccccagccccagagaaaccaauaagaauccucuauua

SEQ ID NO: 214916 - RNA, 64 nt, Human; identical to SEQ ID NO: 214260

SEQ ID NO: 214917 - RNA, 64 nt, Human
ccagcagcuucucuugccccuuccauucaggguucccuggcaggggaagcugagagccauggcu

SEQ ID NO: 214918 - RNA, 64 nt, Human
cuccccaaagaguaaggagcuuccaugcuucauucccuggcauaaaaagugcucaaacacacca

SEQ ID NO: 214919 - RNA, 64 nt, Human
guaaaggcuccuggccucucaucaggaucugccccccagagaccccccccagacacugcagggc

SEQ ID NO: 214920 - RNA, 64 nt, Human
auugaucaccaugaaagaagaauaguuuuuuguccccagagacauucauuuaguugauauaauc

SEQ ID NO: 214921 - RNA, 64 nt, Human
guggugugggccagaaacaagggacagugaaacacccagagacuuguaucagcaggaagccauu

SEQ ID NO: 214922 - RNA, 64 nt, Human
cacagagcacagcucaugggcaacaucacuggggcccagagagagcuguccgccagugcaucau

SEQ ID NO: 214923 - RNA, 64 nt, Human
cucuagcaucacuccugagcugcgggagagguggcccagagaacagcagagucaguuacaccug

SEQ ID NO: 214924 - RNA, 64 nt, Human
cauguggcccaacacaauucuucuuccaacguggcccagagaagccaaaagauuggauacgcau

SEQ ID NO: 214925 - RNA, 64 nt, Human
aagguccaacccugcaaugaagcagccacuucagcccagagagauuauaagaacugauguggcc

SEQ ID NO: 214926 - RNA, 64 nt, Human
ccagcguuugccagagguggccacuucagccaagcccagagaagugugggcagaagcagugaag

SEQ ID NO: 214927 - RNA, 64 nt, Human
aauuuucugcaugggacucugaguuccuuuccuucccagagaguuuuaccguaugaagccugga

SEQ ID NO: 214928 - RNA, 64 nt, Human
agucuuuuuugcccagaucuuuuaagacuuacaccccagagauuuaagaagaaaaccucuaaau

SEQ ID NO: 214929 - RNA, 64 nt, Human
ggcauggcuuugaccuaguaugaacuggugucugcccagagagcagcauguagcaggggggaau

SEQ ID NO: 214930 - RNA, 64 nt, Human
uuugugucugaaaccgguuuuaaaaugugacucucccagagaagaagccgcuggcuguaugaaa

SEQ ID NO: 214931 - RNA, 64 nt, Human
ccuagggcugggguucucaagccccuggcccuggcccagagauuuggauucccuuggcggccgu

SEQ ID NO: 214932 - RNA, 64 nt, Human
cauccuuggucaucauugucuccuucccaccuggcccagagaugcuuaaauccaaguuguuucu

SEQ ID NO: 214933 - RNA, 64 nt, Human
cccucccaguuggccagaaucugaggggagagcccccagagagcccccuuccccaucagaagac

SEQ ID NO: 214934 - RNA, 64 nt, Human
uucccuagggucucuucuugcuugacucaaucuacccagagaugccccuuagcacaccuagagg

SEQ ID NO: 214935 - RNA, 64 nt, Human
guuauuuauuccccuccgcguccuacacaggcugcccuggcagcugucuucaaggguaggcuga

SEQ ID NO: 214936 - RNA, 64 nt, Human
gggagcagccucaguggggucgccguaccaggggcccuggcagggucagcugcaagaacaucaa

SEQ ID NO: 214937 - RNA, 64 nt, Human; identical to SEQ ID NO: 214281

SEQ ID NO: 214938 - RNA, 64 nt, Human
uuaaugcacuuuaaauaagguagaauggaaaaaacccagagagcaaagugcauuacuuaaagau

SEQ ID NO: 214939 - RNA, 64 nt, Human
gggccugaugaaagcuuccugaguggugucgggucccagagagggagcccaccugcugccuggg

SEQ ID NO: 214940 - RNA, 64 nt, Human
ccugcucagccaggccucuccugggagccacucgcccagagacucagcuuggccaacuuggggg

SEQ ID NO: 214941 - RNA, 64 nt, Human
uggcccucucugaaggaggccaccuccuaaaaggcccagagagaagagccccacucucagaggc

SEQ ID NO: 214942 - RNA, 64 nt, Human
ccagacuugggugcuuagcuucagauacucuaugcccagagauagugcacuuggcagcugucag

SEQ ID NO: 214943 - RNA, 64 nt, Human
uguaaagcuaggcagaugagcccagaagaauggucccagagaaagcagacuggcuccaauagau

SEQ ID NO: 214944 - RNA, 64 nt, Human
ugugccuacuguuccccaccucagaagcuuccugcccagagagccagcagccuugggauacuaa

SEQ ID NO: 214945 - RNA, 64 nt, Human
cuugcacugugcucucccacaaguccagcugcaacccagagauaguggaaacugaaauuaggaa

SEQ ID NO: 214946 - RNA, 64 nt, Human
gcucugaaaccaaacagcauccugccaugagcuucccagagacagaagagacuggagcaaaguc

SEQ ID NO: 214947 - RNA, 64 nt, Human
uuacugccacuaguguucaagugccucuuguuuucccagagauuuccugggucugccagaggcc

SEQ ID NO: 214948 - RNA, 64 nt, Human
uuuccccaucuguuggaccaaauaaucucaaaggcccagagaggacagugaccauccacagaca

SEQ ID NO: 214949 - RNA, 64 nt, Human
cauuccuuccaggagcaguaggugggagguuugacccagagaagccaauccuugcauuccagga

SEQ ID NO: 214950 - RNA, 64 nt, Human
caaccaaggagcuggggcccaaggccaguccugccccagagacacuccaaguccgccaggggca

SEQ ID NO: 214951 - RNA, 64 nt, Human
acaaagagggccccagcccagccccaccacagaucccagagauaggggcccagucuccaugggg

SEQ ID NO: 214952 - RNA, 64 nt, Human
uugcacccggggcugcaaacgucuccgugcagcccccagagagaggcccaugggcucagaccag

SEQ ID NO: 214953 - RNA, 64 nt, Human
auuuccuaccaccuuuguggccgaccccaagcaccccagagauaugaggcacccuuugcuccac

SEQ ID NO: 214954 - RNA, 64 nt, Human
cagggcaugagugggggcaaccccccggccucugcccuggcauggucuccgcaugggcugaggu

SEQ ID NO: 214955 - RNA, 64 nt, Human
caucucagaguaaugggaagaaccucccacaucucccuggcagcagaugagguggcuucacaug

SEQ ID NO: 214956 - RNA, 64 nt, Human
ggaccuccuaggacugggccuucuuccagggggccccuggcagcagcuggggugucgggcagaa

SEQ ID NO: 214957 - RNA, 64 nt, Human
gagauuguucuccagcaccccacauucaccccugcccagagauucccccuucuccucuccccua

SEQ ID NO: 214958 - RNA, 64 nt, Human
ugucagucccucuaucccuucuccuguccaggggcccagagagaaacacaccuaccccuggccu

SEQ ID NO: 214959 - RNA, 64 nt, Human
ccgaggccgcgugcgugagaaccgcgccgguguccccagagaccaggcugugucccucuucucu

SEQ ID NO: 214960 - RNA, 64 nt, Human
aguccagccuaaucaagucaaauggagaaacaggcccagagaggaagguggcuuaccaagauca

SEQ ID NO: 214961 - RNA, 64 nt, Human
uuuaucccagucguacucuuccagguuuggaagacccagagaggccaagaucccauccuuagcc

SEQ ID NO: 214962 - RNA, 64 nt, Human
ugaccucacucuaacucaaaguaauguccagguucccagagaauaucugcugguauuuuucugu

SEQ ID NO: 214963 - RNA, 64 nt, Human
aguguuuucaucucuuggucauaauuccgagauccccagagaccacuguuucuggaguaucugu

SEQ ID NO: 214964 - RNA, 64 nt, Human
agggacugcagagaggcuacuggaagguuaaggacccagagagaaaucgagaggugcccuacag

SEQ ID NO: 214965 - RNA, 64 nt, Human
agagacuuucagcccuaaaucuagacucaagguucccagagaugacaaauggagaagaaaggcc

SEQ ID NO: 214966 - RNA, 64 nt, Human
cuauggauuaucuuuauaucacugucuuucuaagcccagagaugucauaagugacaagaaaagu

SEQ ID NO: 214967 - RNA, 64 nt, Human
uguccuauacucacaucagacaugugaucauagucccagagacagaguugaggucucgaagaaa

SEQ ID NO: 214968 - RNA, 64 nt, Human
aaggagggagccgggagccuggugggaagccuuccccagagagauggcuuuaggggcuuuauuu

SEQ ID NO: 214969 - RNA, 64 nt, Human
uccauauccuuucuugaacgcacauucagcuuaccccagagagcaagugaggcaaucuggcaaa

SEQ ID NO: 214970 - RNA, 64 nt, Human
ccagcaaccugccagcuacaggagcccccugcgucccagagacucccucacccaggcaggcucc

SEQ ID NO: 214971 - RNA, 64 nt, Human
uauucuacccaaaugucaggaccaggauuuucuacccagagaccaagguguucuucccaaagac

SEQ ID NO: 214972 - RNA, 64 nt, Human
uauucuacccauaugucaggaccaggauuuucuacccagagaccaagguuaucuuccuaaagac

SEQ ID NO: 214973 - RNA, 64 nt, Human
gggcuccagugggacugcgcucugggagacugcucccuggcaucgguccugcggagguggaaag

SEQ ID NO: 214974 - RNA, 64 nt, Human
cugcuguagcuccuggccucagagccccugcugacccuggcacccagggaccugccugggggca

SEQ ID NO: 214975 - RNA, 64 nt, Human
auucaacuaguuacuaaugaccucaaguuguauucccuggcaaaauggacuuucucaaaauagg

SEQ ID NO: 214976 - RNA, 64 nt, Human
uauucuacccauaugucaggaccgggauuuucuacccagagaccugcauguucucuccaacgac

SEQ ID NO: 214977 - RNA, 64 nt, Human
cucuucccaucaauauccuaaaugugggggagggcccagagaauggcacccaagagccugcggg

SEQ ID NO: 214978 - RNA, 64 nt, Human
caguccuucacacucacacuacucuguuccucuucccagagacaucgauucacuucaaagagcu

SEQ ID NO: 214979 - RNA, 64 nt, Human
gcuguggcugcggccgggagcccgccccgcuucccccagagacuguaucguggcaccguggcgc

SEQ ID NO: 214980 - RNA, 64 nt, Human
gacaccaaugcugcuauccgcaagcucaagagaucccagagauucuaaccaccaugccuacuug

SEQ ID NO: 214981 - RNA, 64 nt, Human
gaaaauaccagaaaaugagggccgcuuugagucccccagagaugucaucagagcuccucugucc

SEQ ID NO: 214982 - RNA, 64 nt, Human
cuagacuguggcccagaauagggcuggggcagcucccagagaaugaauagugcuguuuccuauu

SEQ ID NO: 214983 - RNA, 64 nt, Human
gccugcuauccagccgcaaauccauacccccugccccagagaagccucagucccucccuccugg

SEQ ID NO: 214984 - RNA, 64 nt, Human
gcuucccaggacccugggucaccuuccugggcagcccagagagacccugccaacuuuccagacu

SEQ ID NO: 214985 - RNA, 64 nt, Human
uuccguggguuuccccuuugauucuguaaauagucccagagagaauucgugggcugagggcaau

SEQ ID NO: 214986 - RNA, 64 nt, Human
cccaggaggcaggggaaaaaucuccuuucugcuucccagagagggucuggccuugcccaaggcc

SEQ ID NO: 214987 - RNA, 64 nt, Human
ggagguaacgaggagggcggacuccaggccccggcccagagauuuggacuuggcuggcuugcag

SEQ ID NO: 214988 - RNA, 64 nt, Human
auauuucccauuugugccagaggaauccuggcagcccagagacuuuguagauccuuagaggucc

SEQ ID NO: 214989 - RNA, 64 nt, Human
cuagcugccggccucuggaggcuccgagccugcccccagagacgucccugccccuccaggaccu

SEQ ID NO: 214990 - RNA, 64 nt, Human
aaugagauuuacuaaguugacuuaccugacggaccccagagaccuauugcauugagcagugggg

SEQ ID NO: 214991 - RNA, 64 nt, Human
cauuguuaguccgggaccuucaguacugccaagucccagagaaaacccuuuuacucuggggaga

SEQ ID NO: 214992 - RNA, 64 nt, Human
auaaagauaaauugccccccucucccccacuuaccccuggcaaaggacucacaagucacuucuc

SEQ ID NO: 214993 - RNA, 64 nt, Human
uuuagagagggugugugcugucccuucccacagucccuggcaggcggcuggaaggccaggccug

SEQ ID NO: 214994 - RNA, 64 nt, Human
aaccuuucaaaaaagagguguggcuuuccucauccccuggcaaacauugucaccaaggugggau

SEQ ID NO: 214995 - RNA, 64 nt, Human
gaucuuuuccagaguaugcaacucugacguugaucccagagagcagcuucagugacaaacauau

SEQ ID NO: 214996 - RNA, 64 nt, Human
gagacccauguaaauaccagacugcagguuggaccccagagauucccaagccaaaaaccuuagc

SEQ ID NO: 214997 - RNA, 64 nt, Human
cccuggggggaggcaggaggcacaugugaggguccccagagagaagggagugggugggcagggg

SEQ ID NO: 214998 - RNA, 64 nt, Human
ugugcuauuagugcaauaaggugaaggcugucugcccagagaaauaaguaauuuauauaagaaa

SEQ ID NO: 214999 - RNA, 64 nt, Human
caaaucuggucuagcugggugaaacccuuauuuucccagagaugccuuaaccuuuguugguuuu

SEQ ID NO: 215000 - RNA, 64 nt, Human
ccccugcugacugcgccugucuucucccucugaccccagagaaaggggcuguggucagcuggga

SEQ ID NO: 215001 - RNA, 64 nt, Human
ugcccgggacccccgucuccaggggugccccagacccagagauuagccucccacuucggcgcag

SEQ ID NO: 215002 - RNA, 64 nt, Human
caucuccacccaucucuacaucugggcacagcaacccagagauggccaaaagcauucaagccug

SEQ ID NO: 215003 - RNA, 64 nt, Human
cagauggccuucuuugucaucuucacucuccacccccagagaggagucagagccauaacucaau

SEQ ID NO: 215004 - RNA, 64 nt, Human
ugguuugacuuauucuucguaucauuagaagaaccccagagauagcauuccucuauuuuauuuu

SEQ ID NO: 215005 - RNA, 64 nt, Human
gaggaggaggagggagaaauggccaccacaucaccccagagaaauuucuggaaucugauugagu

SEQ ID NO: 215006 - RNA, 64 nt, Human
cccuacucacauuuccuuggguuggagcaacagucccagagagggccacggugggagcugcgcc

SEQ ID NO: 215007 - RNA, 64 nt, Human
ucuguaauaucuuacuaaggccuuugguauacgacccagagauaacacgaugcguauuuuaguu

SEQ ID NO: 215008 - RNA, 64 nt, Human
uguaggaaggggaguaauaauguaaaacaacugacccagagaagcuaaaagccacuggcagcac

SEQ ID NO: 215009 - RNA, 64 nt, Human
ccagcuccuucucuuuucucagggacaaaugaggcccagagagaauacgaccuguguaagguca

SEQ ID NO: 215010 - RNA, 64 nt, Human
aggugccccaaaaugcaagauuuuccacaagauucccagagacaggaaaauccucuggcuggcu

SEQ ID NO: 215011 - RNA, 64 nt, Human
acuguugcccucuuccaauccucuuccccuacaucccuggcacugguuguuuucugugaaaaca

SEQ ID NO: 215012 - RNA, 64 nt, Human
cagagcaucuugacaugacugcugaccuaaagaucccuggcauuggccagggauccuguggaac

SEQ ID NO: 215013 - RNA, 64 nt, Human
cuccugagaaggaaaggaucugcccugaccacuccccuggcacuguuacuugccucugcgccuc

SEQ ID NO: 215014 - RNA, 64 nt, Human
uguccuugcaccugcauccguaguucccugaaaacccagagaggaaucagacuucacacugcaa

SEQ ID NO: 215015 - RNA, 64 nt, Human
ggggcagagggcagaggcuggaggcagggccuugcccagagaugccuccaccgcugccuaagug

SEQ ID NO: 215016 - RNA, 63 nt, Human
aguuguggcucuuugucuaggacccagaucauccccagagagagcccccacaagcuccucagg

SEQ ID NO: 215017 - RNA, 64 nt, Human
aggggcccuggcuauuugggaccuaagccuaggccccagagaucagcccgaacacccgcauccc

SEQ ID NO: 215018 - RNA, 64 nt, Human
agacccucuuggcuuucccgugcucuuugggcuccccagagaccugacaguauuagggagugaa

SEQ ID NO: 215019 - RNA, 64 nt, Human
caaguacugagagcccagccccagacagcugcugcccagagaagaaccagcuccacggcuccug

SEQ ID NO: 215020 - RNA, 64 nt, Human
ccucagccuggccagacacaggcccucccuguuccccagagaaaggggagcccacuguccuggg

SEQ ID NO: 215021 - RNA, 64 nt, Human
gugcugacggccagggagaagcuccucuccccagcccagagacauacuugaagggccagagcca

SEQ ID NO: 215022 - RNA, 64 nt, Human
cccagccuggccuguggcugcccuccaucccuuccccagagauggcuccuugggaugaagaggg

SEQ ID NO: 215023 - RNA, 64 nt, Human
gcaacucccccccaacaaugccauucccacuugccccagagaagcuacucggccaaaccuagcc

SEQ ID NO: 215024 - RNA, 64 nt, Human
ugcccuucugggguccugguuccugaagagcucacccagagaggcucaaagcagccuuuugucc

SEQ ID NO: 215025 - RNA, 64 nt, Human
ccuuggaccucuuugauucugugguuuggaggcucccagagacgugccuaguccugugugccuu

SEQ ID NO: 215026 - RNA, 64 nt, Human
gcucuccacccagcccgcuccugacccuuaucuucccagagaccaggccaggaaggcccgagau

SEQ ID NO: 215027 - RNA, 64 nt, Human
agugccagaauuaagugagucaagccaaguaaagcccagagaagauucucaucagcacuuuugu

SEQ ID NO: 215028 - RNA, 64 nt, Human
cauuuggcaguacaaaugagucugaguguaauagcccagagauuuauauauaguugaaugucua

SEQ ID NO: 215029 - RNA, 64 nt, Human
uggaaacagacuuaucauuauugauuugagguuucccagagauauaguucacaguuaauuguug

SEQ ID NO: 215030 - RNA, 64 nt, Human
gauugacuggcugcucacucaggcagguggccugcccuggcauccuguagauucugagcagguu

SEQ ID NO: 215031 - RNA, 64 nt, Human
uaagucacccaguccaugguacuuuguuaggcagcccuggcaaaugaaucaaagacccauuccu

SEQ ID NO: 215032 - RNA, 64 nt, Human
uacaucacagauuugcuaauaauguucacgugggcccuggcauaucucuguucaguuagaguga

SEQ ID NO: 215033 - RNA, 64 nt, Human
ugauaggcacacgaggaugaguggcuuuguaucgcccagagaggugcuuguccagauuucacau

SEQ ID NO: 215034 - RNA, 64 nt, Human
caguaaaggagaaaauaaaauuguuagcauucuacccagagauaauaucaauucauauuguagu

SEQ ID NO: 215035 - RNA, 64 nt, Human
auuuucauucuuguauuauaauuaauuuucuacccccagagauaaauguuuguuuauaucacug

SEQ ID NO: 215036 - RNA, 64 nt, Human
gaccuguccugcccuucuuagcuugaagggaaaccccagagacucuucugucagggaaaacuag

SEQ ID NO: 215037 - RNA, 64 nt, Human
aaucucagcucuccuaaucccaucacuuccccagcccagagaagacauuccaacccugucugau

SEQ ID NO: 215038 - RNA, 64 nt, Human
cugguaagaagccaaauauuuaagcucacuucuucccagagagaggaagcucugcucaggccuc

SEQ ID NO: 215039 - RNA, 64 nt, Human
guaucucuaaggccaauaaggauaacauuaucuacccagagaguuuagaagaaaaguaggaguc

SEQ ID NO: 215040 - RNA, 64 nt, Human
cucuucaccucccugcaaaccuaccagugaggcucccagagacgcagcugucucagugccaggg

SEQ ID NO: 215041 - RNA, 64 nt, Human
gugauggcuuugucccaucauagggggguguccccccagagacaaagcugcagagcacauucca

SEQ ID NO: 215042 - RNA, 64 nt, Human
gcuuuuaaggacgcuuaugaucacauugcgccuacccagagaacccaggucgucuuucuauuuu

SEQ ID NO: 215043 - RNA, 64 nt, Human
guugccuucccuuuugcccuuugggcauuccuuccccagagagggccuggaaauuauaaaucuc

SEQ ID NO: 215044 - RNA, 64 nt, Human
uuaaauaucaguucuguuuaucugaaggcuccuacccagagauucuacccagugaaacucccac

SEQ ID NO: 215045 - RNA, 64 nt, Human
aucuccagcccugcaugccgucucaagggugggccccagagaguuuggaguguaggauucccuc

SEQ ID NO: 215046 - RNA, 64 nt, Human
ugccauccuaaggggacaugaugguucugugauucccagagagcuggcagauugugacaaucuc

SEQ ID NO: 215047 - RNA, 64 nt, Human
cuggggaccggccaggaaggaggggugacuucaucccagagagacccgaguucccccagcccuu

SEQ ID NO: 215048 - RNA, 64 nt, Human
aaggggaggagcgacaccuccaggcuuccgggagcccagagagcauguggcaggcaguggggcc

SEQ ID NO: 215049 - RNA, 64 nt, Human
cuccaaagaaauagggcauggcuugccccuguggcccuggcauccaaauggcugcuuuugucuc

SEQ ID NO: 215050 - RNA, 64 nt, Human
ugaugaggggucagcaggaacacuggcccauugccccuggcacuccuugcagaggccacccacg

SEQ ID NO: 215051 - RNA, 64 nt, Human
auucagcucugcccgcagcuuguacaugucucuccccuggcaaaacaagagcuggguaguuuag

SEQ ID NO: 215052 - RNA, 64 nt, Human
guguggcccacuugugggagucuccuguccaccucccagagacggccacccagcgggucuggcu

SEQ ID NO: 215053 - RNA, 64 nt, Human
caccgccaccugccggccucgagaggggccgaugcccagagacacagcccccacggacaaaacc

SEQ ID NO: 215054 - RNA, 64 nt, Human
gugugagucuucucgaaggaggguugacucagaacccagagacaauacaaaaccccucacuucc

SEQ ID NO: 215055 - RNA, 64 nt, Human
cuacucaucccuuaacuucucccuuaccagugaccccagagacagagccaggacaggagugggg

SEQ ID NO: 215056 - RNA, 64 nt, Human
caauacugccuuuggaauaugacagaaucaauagcccagagagcuuagucaaagacgauaucac

SEQ ID NO: 215057 - RNA, 64 nt, Human
ccaucagcaagagagagcagcuggaacagcaggucccagagaacuacuucuaugugccagaccu

SEQ ID NO: 215058 - RNA, 64 nt, Human
uccuggggauccagcggauggacagcuuggcucucccagagaggugaaggagcaccuggccuua

SEQ ID NO: 215059 - RNA, 64 nt, Human
aggagcgccuggaagcagaaccaguagcuacaggcccagagauggacuggagagugaggaggag

SEQ ID NO: 215060 - RNA, 64 nt, Human
ccuaacaggaagguguccaguucaagagaacccacccagagacugggagugguggcucacgccu

SEQ ID NO: 215061 - RNA, 64 nt, Human
agccgagccagacugugaccaggaaacagcucaucccagagaaggagaugcuuaacaaaaaaaa

SEQ ID NO: 215062 - RNA, 64 nt, Human
cuguggccguagagggaaacagccacugugacaacccagagaccuggggucagccuuaaguagg

SEQ ID NO: 215063 - RNA, 64 nt, Human
ugggcuuuaauguguaggaaaagccuucuggccacccagagagccggagcccugcuugcuguau

SEQ ID NO: 215064 - RNA, 64 nt, Human
uuauggggagguuugaugagcauuugccuuucuccccagagagcuugaccaaguuacauauucu

SEQ ID NO: 215065 - RNA, 64 nt, Human
cuccacucccuccgcugccaugaagcucauuucucccagagauuuuguggacuuggugcuaguc

SEQ ID NO: 215066 - RNA, 64 nt, Human
gcagccacaagcuugcccgcccuggcucccucugcccagagacuauggaguaaggcauucagga

SEQ ID NO: 215067 - RNA, 64 nt, Human
gcugcacagucggugccugggaggcacguagaggcccagagagucccuggggguucugcucuga

SEQ ID NO: 215068 - RNA, 64 nt, Human
aggacgggagacaacugcuuggaggagcgaagagcccuggcauuuuaucucuggguuugagagc

SEQ ID NO: 215069 - RNA, 64 nt, Human
cagccuggagagccucagucccuguagcccccugcccuggcacagcugcaugcacuucaagggc

SEQ ID NO: 215070 - RNA, 64 nt, Human
cccgcucagguggcacggcuggccuggacccugccccuggcacggcagugccagcuguacuucc

SEQ ID NO: 215071 - RNA, 64 nt, Human
ucccugcagagccaauggugcacauugguuuaagcccagagauccugcuugagcccuggacuca

SEQ ID NO: 215072 - RNA, 64 nt, Human
ggucccacucaguccauagcagagaaugaaagggcccagagaggguggugaccucugccugaag

SEQ ID NO: 215073 - RNA, 64 nt, Human
ggccacuucccucccagugccagucuccauccaccccagagaggaacaggcgggugggccaugu

SEQ ID NO: 215074 - RNA, 64 nt, Human
agaccccagccuggggaacacgcugcccgcacugcccagagagcagugcaaacaccacaacacg

SEQ ID NO: 215075 - RNA, 64 nt, Human
agcgagaagccaaggccagguucuggguguagggcccagagaagcagaacagcccagagcccca

SEQ ID NO: 215076 - RNA, 64 nt, Human
augcacugugaccucuggcuuccccagcagcuuucccagagaggcagaggggccuuccacagcc

SEQ ID NO: 215077 - RNA, 64 nt, Human
ugacuccccagcccagcaccccuuccucgugggucccagagaccucaucagccuugggauagca

SEQ ID NO: 215078 - RNA, 64 nt, Human
cucaggacccaguccaggccuucuacgggcuaggcccagagacuuggguugcuggucccccuuc

SEQ ID NO: 215079 - RNA, 62 nt, Human
cagcccgcuuuggucugugagcugaggcuguccccagagaggauggcagcagguauuggguc

SEQ ID NO: 215080 - RNA, 64 nt, Human
cucacaguucacauucagcucagcagagcaagaccccagagaugcuuagagacaggacaccugg

SEQ ID NO: 215081 - RNA, 64 nt, Human
accccgacguagcugccccccuggggggccacagcccagagaaccagccuaggaacacucggga

SEQ ID NO: 215082 - RNA, 64 nt, Human
cggcuccaguguggggugaggcagugagguuaggcccagagagcuggaguuggcucagaugaaa

SEQ ID NO: 215083 - RNA, 64 nt, Human
ccgagggccaggcagaauggcugcacguagguuccccagagagcaggcaggggcaucugucugu

SEQ ID NO: 215084 - RNA, 64 nt, Human
auuaauuuauugggaaugagcugaggcggauuuccccagagaaacaaaaagguauaacuuuaac

SEQ ID NO: 215085 - RNA, 64 nt, Human
ccagaucucaugugcuacgaaggaaaccccaagacccagagaggaagggucaaccuggaggcag

SEQ ID NO: 215086 - RNA, 64 nt, Human
cacaccgcaucaguccccaucaucacuacuccuccccagagacauacagauugcccuccccggc

SEQ ID NO: 215087 - RNA, 64 nt, Human
cccugaacccugugcgggagagcugguccuccagcccuggcaggcccucagccagcuucccagc

SEQ ID NO: 215088 - RNA, 64 nt, Human
ucaggcugcuuuacagaauucuauuuccuuaagucccuggcacuucucauaccacaucacugaa

SEQ ID NO: 215089 - RNA, 64 nt, Human
gguccccacugccccgguacgagggggcccaagacccuggcaggucaggggcccuggccaagcc

SEQ ID NO: 215090 - RNA, 64 nt, Human
ugggcagagggacaggucagacacccaggcccaccccagagacccuccaugaacugugcuccca

SEQ ID NO: 215091 - RNA, 63 nt, Human
ucugccuccuccccugccagcccuagcgugacuacccagagacaaaaaaaaaaaaaaaaaaaa

SEQ ID NO: 215092 - RNA, 64 nt, Human
uccaaaugucaggguguuugcccaauaauaaagccccagagaacugggcugggcccuaugggau

SEQ ID NO: 215093 - RNA, 64 nt, Human
uaggucaucucaaggcugauacuugagcugugugcccagagaucaugcauuuagauuuauauuu

SEQ ID NO: 215094 - RNA, 64 nt, Human
cgagcccacuguaucugggcccaaggccagagggcccagagagaagccugagcaccguguuacc

SEQ ID NO: 215095 - RNA, 64 nt, Human
gcuucugaggacacaaggugggcugcccucaagccccagagagccccucauccuuccucuggga

SEQ ID NO: 215096 - RNA, 64 nt, Human
uacucgcaacaacuuaauuucuaaggguccaagucccagagaauccauagucgucaaagcuuug

SEQ ID NO: 215097 - RNA, 64 nt, Human
uccacuuguggaaaaaaagugcuaaaguuuucuucccagagagagcauaauuccgaaacaaaac

SEQ ID NO: 215098 - RNA, 64 nt, Human
ccucugagcuggugggcaggauggcuggguggcccccagagaagcacagaccugagaugggguc

SEQ ID NO: 215099 - RNA, 64 nt, Human
ugagccaagggcacuuugcugccaccgcugcauucccagagaucaagcagcccggugccguggc

SEQ ID NO: 215100 - RNA, 64 nt, Human
cacaggaaacagcaaacaguggggugaucugcagcccagagaccuucaaaugcgaacacuauaa

SEQ ID NO: 215101 - RNA, 64 nt, Human
guaguuggauugguacauucacugcugccagguacccagagaugucaucucucuccagguagag

SEQ ID NO: 215102 - RNA, 64 nt, Human
ggcaggggugggagagccagcucucucuacccggcccagagaccccuuccuuuccucugcagca

SEQ ID NO: 215103 - RNA, 64 nt, Human
cagucucagaugaccacggguuuaaccuucuuaucccagagacacccaauucuagagcuuuaug

SEQ ID NO: 215104 - RNA, 64 nt, Human
ucccuuugaccacaucgcucuaggauaacuggcacccagagaaaaggacuccucagaaaaaaca

SEQ ID NO: 215105 - RNA, 64 nt, Human
uggcccgaugacuuaaagggaaaaauaauucauucccagagaugagucagaacagucuccucaa

SEQ ID NO: 215106 - RNA, 64 nt, Human
gggaaaaucuccccccccacaggacauacuaguucccuggcaggcaagggcuuccaacugaggc

SEQ ID NO: 215107 - RNA, 64 nt, Human
uccuaggaaguuugugugcugguucacaagaggucccuggcacccuuucuggggauguuuggau

SEQ ID NO: 215108 - RNA, 64 nt, Human
agugcagaggcugagcaggacguuaggcccgggccccuggcacguccuccaccggugccuccuc

SEQ ID NO: 215109 - RNA, 64 nt, Human
augugcuugggcuaugguggccauaaacccugagcccagagagcuugggucacugucaccugag

SEQ ID NO: 215110 - RNA, 64 nt, Human
gacuaagguggcuuucccacuccuggcccacagccccagagagccugucugugcauccugaacc

SEQ ID NO: 215111 - RNA, 64 nt, Human
ccggcuuccagggagaccuccccgcccagcagcccccagagacacaacaaccuaccuuccagcc

SEQ ID NO: 215112 - RNA, 64 nt, Human
gagguccauccccagcaaauguuuuggagguccccccagagagcagagugggccauggcagaag

SEQ ID NO: 215113 - RNA, 64 nt, Human
uguccuaaaaauaggggccguuuucuuacacacccccagagagaggagggacugucacacuggu

SEQ ID NO: 215114 - RNA, 50 nt, Human
ggagaggaguuccuuacuaacccagagacuucaguguccugaaagauucc

SEQ ID NO: 215115 - RNA, 64 nt, Human
cuguguuugcuuguuugcccaccuuuggcugauacccagagaaccugggcacuugcugccugau

SEQ ID NO: 215116 - RNA, 64 nt, Human
cuuggucuggggcauuuuccucuccuuaucuugccccagagacaauucaagauuucuauauggg

SEQ ID NO: 215117 - RNA, 64 nt, Human
ucuuucuucuguccucagcuugagaucuucuuagcccagagagcaguggaguugagugaggagg

SEQ ID NO: 215118 - RNA, 64 nt, Human
gccucacuauuggcagaaaagaccccauuuaaaacccagagaacacuggagggggaugcucuag

SEQ ID NO: 215119 - RNA, 64 nt, Human
caccagggaugguacuagggggaagugacaaggccccagagacucagagggaggaaucgaggaa

SEQ ID NO: 215120 - RNA, 64 nt, Human
ucucacucaccacuaccagccagccucagaaggccccagagagacccugcaagaccacggaggg

SEQ ID NO: 215121 - RNA, 64 nt, Human
gaggguuagggaugucuccacccugauggggugucccagagacauuuucccauggcaguccucc

SEQ ID NO: 215122 - RNA, 64 nt, Human
cggucggggcaucuggccuggccagugcccugaucccagagagcccgaggaggugucucaggcu

SEQ ID NO: 215123 - RNA, 64 nt, Human
uggagcagcagcaggacagacccccacgaggccccccagagaggaggaagaucccacggaggaa

SEQ ID NO: 215124 - RNA, 64 nt, Human
acugccugagggacaacagacaucagaacaaacccccagagagaaacagucaaaaucagggccc

SEQ ID NO: 215125 - RNA, 64 nt, Human
ccgugggcugcguccuuugguccuguccccgcagcccuggcagggggcaugcggucgggcaggg

SEQ ID NO: 215126 - RNA, 64 nt, Human
augauucgguauuggggguuuggaggcacccagacccuggcaauauuaugugucccuuuggacc

SEQ ID NO: 215127 - RNA, 64 nt, Human
ucaguggggacacagccaaaccauaucauucuaccccuggcaccuccaaaucucauguccucac

SEQ ID NO: 215128 - RNA, 64 nt, Human
ccaagaaaaugcuucacucaacaguccucaugugcccagagauguuuauagaacuguuugaauu

SEQ ID NO: 215129 - RNA, 64 nt, Human
ccccguggccccugugccuguucggugggggugucccagagaagccuggcaccaguacccccgu

SEQ ID NO: 215130 - RNA, 64 nt, Human
agggggcagccaagaagccggagcuggcagcauacccagagauccggggcccccccacccccaa

SEQ ID NO: 215131 - RNA, 64 nt, Human
aaaccuaccuugcuuugggagcugccugcaccaccccagagaaggccccaccuucuucaucccu

SEQ ID NO: 215132 - RNA, 64 nt, Human
ggcaucgagcuagcucccugcacggccgcacccucccagagaacuccuugaggagaacaagugc

SEQ ID NO: 215133 - RNA, 64 nt, Human
gugggggugggggaggggagagggguaccuagaacccagagaacauuggcuuaugccagauacc

SEQ ID NO: 215134 - RNA, 64 nt, Human
acggggaugcuugccccucuccaggacuauugagcccagagagagcuguccucucauuggguga

SEQ ID NO: 215135 - RNA, 64 nt, Human
ccccucuaggucugggcagccaugaccugcagggcccagagacacuguccuuccccucauccac

SEQ ID NO: 215136 - RNA, 64 nt, Human
cguugguuuaggcauccugugugcugacaggagacccagagagcuagggcuggagggacaggga

SEQ ID NO: 215137 - RNA, 64 nt, Human
uuccuuccugggggucuguuccuuccuaugcucacccagagaacucucugaugugccagugggc

SEQ ID NO: 215138 - RNA, 64 nt, Human
gauccaggcucguagagucacucccugcccgucucccagagaugcuucaccagcaccugccucu

SEQ ID NO: 215139 - RNA, 64 nt, Human
ucccagccccuaccuugagacccucuucucugggcccagagagaggcguccuggugaggacaag

SEQ ID NO: 215140 - RNA, 64 nt, Human
aaagaagauccuaucaugaauaaaagcuguauggcccagagaggagcucaugugucuaaaguga

SEQ ID NO: 215141 - RNA, 64 nt, Human
gagcagacuggugagcagacuggugggaucugugcccagagaugggacugggagggcccacuuc

SEQ ID NO: 215142 - RNA, 64 nt, Human
gacugaccccugccagggcacagauaggcaggaccccagagagggcaggcagccacgcccugca

SEQ ID NO: 215143 - RNA, 64 nt, Human
ggaagacccucagauguggccagagcaccggccucccagagaaagcccaggaaguccccguggu

SEQ ID NO: 215144 - RNA, 64 nt, Human
caucuccucucgucuccuccaugguggucacugccccuggcaggucucugaaagggaaaugcuu

SEQ ID NO: 215145 - RNA, 64 nt, Human
aacgguaguaaccaggguugugaaucugaguacacccuggcaaggcuucucuucagacugaagc

SEQ ID NO: 215146 - RNA, 64 nt, Human
guucugucguuuagugcauaucugcuggcuucagcccuggcagcugagaaauuguuuucuauau

SEQ ID NO: 215147 - RNA, 64 nt, Human
cuacugccacuucgccuuacaucccugcugacugcccagagacucagaggaaauaaaguuuaau

SEQ ID NO: 215148 - RNA, 64 nt, Human
aaagauagcaagcuaccuuccaaggccgagccagcccagagaggagcaugucuuccuuuaccuc

SEQ ID NO: 215149 - RNA, 64 nt, Human
cagucuaggagggggauaaaugggaugcccuugccccagagagaacccaguucuagguacuguc

SEQ ID NO: 215150 - RNA, 64 nt, Human
aggucagagguggggacagagaacuccccuacagcccagagauguggcagggcucagagaagca

SEQ ID NO: 215151 - RNA, 64 nt, Human
ccgaaggggacggccggcgggggcucuccuagugcccagagacaggcccagagguuuacaaguu

SEQ ID NO: 215152 - RNA, 64 nt, Human
gucucccuacuuuuucucacuggccucguuuugacccagagaaagccuauggaaguuaugcagu

SEQ ID NO: 215153 - RNA, 64 nt, Human
aggggccgcuccaggccccacagagcaggagacccccagagaaagccggggcuggcaggaggcg

SEQ ID NO: 215154 - RNA, 64 nt, Human
agccucaacugacagcugaggaaaggcaauuaggcccagagaggcagagacacucgcuuaagau

SEQ ID NO: 215155 - RNA, 64 nt, Human
aggccacgcccagcuuccuccccccgacuccccccccagagacacggucccaccauguuaccca

SEQ ID NO: 215156 - RNA, 64 nt, Human
guucucaguggcaaaaccuaggaaggcucauguucccagagaagggaccacaugagccuucucc

SEQ ID NO: 215157 - RNA, 64 nt, Human
ggcagagcauuuuccuuauggaagggaugagauucccagagaccugcauugcuuucuccugguu

SEQ ID NO: 215158 - RNA, 64 nt, Human
ucuucggugcuaggaaagagugaugugugagauucccagagagucgucacaccaguguuaugcc

SEQ ID NO: 215159 - RNA, 64 nt, Human
gcaaaaggagaaagauaaaauacagaagacuggccccagagagaccucagaucaguauugugca

SEQ ID NO: 215160 - RNA, 64 nt, Human
aguuugguuugaauuauuaguacuauccuguagacccagagacauaguuuauauaagaauugcu

SEQ ID NO: 215161 - RNA, 64 nt, Human
augugcaaagcaguauguacaggcugagacacagcccagagacugaacggcaaucuuuccacac

SEQ ID NO: 215162 - RNA, 64 nt, Human
ggugugugacgaggcccccgauguucuugauuuucccagagaagcaaauaaacagcgugaacag

SEQ ID NO: 215163 - RNA, 64 nt, Human
ggggaggccagcaggcccgggcccagcaccccuucccuggcaccagggucugccucucacucgc

SEQ ID NO: 215164 - RNA, 64 nt, Human
accucugaggcaggagaggaauaaagacgguccgcccuggcagugaugucucgucucucuuccc

SEQ ID NO: 215165 - RNA, 64 nt, Human
ucgcugucugccaggaggcccugccauccuugggcccuggcaguggcugugucccagugagcuu

SEQ ID NO: 215166 - RNA, 64 nt, Human
caccucucccccaaggccacugcgcucuugggaccccagagaaaacccggagcaagcaggagug

SEQ ID NO: 215167 - RNA, 64 nt, Human
ccuggcccauguggagcuggcaugggggacacagcccagagacagagaagcuuaugaggaagug

SEQ ID NO: 215168 - RNA, 64 nt, Human
cacacaaagcucuucaggcagcugauagauuucccccagagagcuauucaaggacuuccuaagg

SEQ ID NO: 215169 - RNA, 64 nt, Human
aaacauggaagaugaaaggggaggggaugucaggcccagagaagcaaguggcuuucaacacaca

SEQ ID NO: 215170 - RNA, 64 nt, Human
ccaccccauucccgcagugggagcaaacugcaugcccagagacccagcggacacacgcgguuug

SEQ ID NO: 215171 - RNA, 64 nt, Human
gcccccucccaaacugugacugguauuuauuggacccagagaaccgggccgggcacagcguggc

SEQ ID NO: 215172 - RNA, 64 nt, Human
ucuguauggacccuuccugccauuuguauuuugucccagagagaaaggcucuuuggggggcccc

SEQ ID NO: 215173 - RNA, 64 nt, Human
gccuccucuggagccuucgccuggggagacagaacccagagagaaacaagagaguccagaaguc

SEQ ID NO: 215174 - RNA, 64 nt, Human
accuugaaggagccccccacauccuccccuacaucccagagaugccaccacuugugucuccaca

SEQ ID NO: 215175 - RNA, 53 nt, Human
auggcgagagcgaccugugaggccccagagaccugacccaacacccccgacgg

SEQ ID NO: 215176 - RNA, 64 nt, Human
cagggaacagcaugcccccuccggggucaugccacccagagacugucgcugucuauggccccaa

SEQ ID NO: 215177 - RNA, 64 nt, Human
ccgucugggguccaucucccuccugagcuagaaacccagagauggaggcugucuugcuauggca

SEQ ID NO: 215178 - RNA, 64 nt, Human
gcugaguaguggggauccagagaggacccccgcccccagagacuugguuuuggcuccagccuuc

SEQ ID NO: 215179 - RNA, 64 nt, Human
gggccaccagaaggugacacccccagaaucccuccccagagacugcaccagcgcagccagcagg

SEQ ID NO: 215180 - RNA, 64 nt, Human
cacucaagcaauagggccccgccauaggaagacccccagagagagggucagcaggggggccccg

SEQ ID NO: 215181 - RNA, 64 nt, Human
gaucagaacaacggaggauagcuuugugccuggacccagagagugugggacuccccgcuucauc

SEQ ID NO: 215182 - RNA, 64 nt, Human
cauuuugaggggaggguaguugugccuacuuauccccuggcagaggggaugccaggaccaugga

SEQ ID NO: 215183 - RNA, 64 nt, Human
agcaccaggaagcguugccgcuggcugugcccuccccuggcacucugacugcaugcugaugagc

SEQ ID NO: 215184 - RNA, 64 nt, Human
caucuugaaguuuuuccccuccgucuuuccccuccccuggcauggacaccuuguguuuaggauc

SEQ ID NO: 215185 - RNA, 64 nt, Human
gccuuggccccaagugaacucaagauuuggcagccccagagaugccaacugcagcaugcccacc

SEQ ID NO: 215186 - RNA, 64 nt, Human
ucgguuuaaccagggcucuguaagaccacucccacccagagacuuguguggccugguguggccu

SEQ ID NO: 215187 - RNA, 64 nt, Human
cucaucaaaccagguguccuuggcauuguguccacccagagagcucacuguuuucuuuucuuuu

SEQ ID NO: 215188 - RNA, 64 nt, Human
cuuuucccauucagcugugagugcccaacccuaucccagagaccuugaugcuuggccucccaau

SEQ ID NO: 215189 - RNA, 64 nt, Human
guuuuccuguaaguaauuaagaagacuaaguagccccagagauaagaccuccucggaucauugu

SEQ ID NO: 215190 - RNA, 64 nt, Human
ugcccaagcaguccucacuuugcuuaacaguggccccagagagcaggaguagugaugcugguga

SEQ ID NO: 215191 - RNA, 64 nt, Human
ugggaugggaagaggcucuuugcaaacgaggguccccagagaagacuggcggggaccugauggg

SEQ ID NO: 215192 - RNA, 64 nt, Human
ggaggagguggaacugauguaggggguggcacuccccagagacugcccucacgaggggacuggg

SEQ ID NO: 215193 - RNA, 64 nt, Human
gcacugcuacccucuauuucccacucagggcugucccagagagaaggcagccgaacugaggauu

SEQ ID NO: 215194 - RNA, 64 nt, Human
aggugagagggaugcaggcauggguuggggguggcccagagaaacuuaugacagcuguacacaa

SEQ ID NO: 215195 - RNA, 64 nt, Human
ucugccccacccacuuccuccccaccaccugugccccagagagcagggccugcccgggaaggug

SEQ ID NO: 215196 - RNA, 64 nt, Human
cagcagcacccugcagugcccaggacggccccgucccagagaacaauccagccccgaaugucag

SEQ ID NO: 215197 - RNA, 64 nt, Human
ugaacacccaggccagggacaccccuccccagcucccagagaggcccccugaggggugagcccu

SEQ ID NO: 215198 - RNA, 64 nt, Human
ccucuccccuuggugccuaacccaggacuuuguccccagagacccacugugugcccccuggagc

SEQ ID NO: 215199 - RNA, 64 nt, Human
cggcuguuggggacuuuaccugcugggaccugcucccagagaccuuccacacugaaucucaccu

SEQ ID NO: 215200 - RNA, 64 nt, Human
cggcggucggggacuuuaccugcugggaccugcucccagagaccuugccacacugaaucucacc

SEQ ID NO: 215201 - RNA, 64 nt, Human
ccugaccaggugggcuggaggggacaagcccuaucccuggcauuacguuucuagguagaaucug

SEQ ID NO: 215202 - RNA, 64 nt, Human
gggggaggugcuggcgcgggaugaggacgggccacccuggcaccggaaggccagcagagggcac

SEQ ID NO: 215203 - RNA, 64 nt, Human
ugcaacacagcccauuucccaguagucugccuugcccuggcagacugcuccggacucuucuagg

SEQ ID NO: 215204 - RNA, 64 nt, Human
cggcuguuggggacuuuaccugcugggaccugcucccagagaccuugccacacugaaugucacc

SEQ ID NO: 215205 - RNA, 64 nt, Human
ccagggaauuaauucccccagucaaccaauggcacccagagagggcauggaggcuccacgcaac

SEQ ID NO: 215206 - RNA, 64 nt, Human
cugggacuuccugcucaucauaguacccagugagcccagagauccuacuagacugggucagcaa

SEQ ID NO: 215207 - RNA, 64 nt, Human
ccuggacagcaggagagggugugggaugaggcuucccagagacccugggucuagaaagcggcuc

SEQ ID NO: 215208 - RNA, 64 nt, Human
gauaccacacauuucucaucucauuggcccccaccccagagaccuccaccucaacuucuggcug

SEQ ID NO: 215209 - RNA, 64 nt, Human
caggccaucagcccaccuccaccucuggaggguccccagagacccacgcccgacgcagacccgg

SEQ ID NO: 215210 - RNA, 64 nt, Human
aagucugugaaaugaaagucccugacaugaagcucccagagauaaaacuccccaaggugccuga

SEQ ID NO: 215211 - RNA, 64 nt, Human
augugcaccucccggaagugcagcucccgaaagucccagagaugaaacucccuaaaaugccuga

SEQ ID NO: 215212 - RNA, 64 nt, Human
augugcaccucccagaagugcagcuuccaaaagucccagagaugaagcucccugagaugaaacu

SEQ ID NO: 215213 - RNA, 64 nt, Human
gagaaagagacccagaaaaaggaagagguggaaacccagagagacagagacccaaagggagaga

SEQ ID NO: 215214 - RNA, 64 nt, Human
cagcccugacacuccuuucagacccucauuccuucccagagauguugagaauguucaucucucc

SEQ ID NO: 215215 - RNA, 56 nt, Human
aggagauugggcggauuugagccccucccagagauggcaauaaaacugacucucaa

SEQ ID NO: 215216 - RNA, 64 nt, Human
aaaaucuuuaguaggaauccuccagccauuauaucccagagagcucauuuagggcugaaacacu

SEQ ID NO: 215217 - RNA, 64 nt, Human
uuguccuaggugucugcugugaaccuccagugaccccagagacuuugcuguaauuaucugcccu

SEQ ID NO: 215218 - RNA, 64 nt, Human
gaaaccuuuagaacaucucugcuuuggagaaagacccagagaucaggcagaggugcagauucaa

SEQ ID NO: 215219 - RNA, 64 nt, Human
gguucuggggccaaggccuacccaggggccucugcccagagaacucacaacccccucucugacc

SEQ ID NO: 215220 - RNA, 64 nt, Human
uacuuacccauggagucaggauaacacugacgcucccuggcauccuaucuuauucagcccuacc

SEQ ID NO: 215221 - RNA, 64 nt, Human
gaccuacagcugccguggggcugaccacgguguucccuggcaucgucuguguccacacagaugc

SEQ ID NO: 215222 - RNA, 64 nt, Human; identical to SEQ ID NO: 214519

SEQ ID NO: 215223 - RNA, 64 nt, Human
auuggcuuguaaaccuucgucucccucucuuuuacccagagacagcacauacgugugcacacgc

SEQ ID NO: 215224 - RNA, 64 nt, Human
cucugucacuugcucuuucacucucucucucauucccagagagccacgggggagggaucacccu

SEQ ID NO: 215225 - RNA, 64 nt, Human
gagauaaggucaugggagaguggguggggacacacccagagacuggcuuugggauugggcacug

SEQ ID NO: 215226 - RNA, 64 nt, Human
guguauucccguuuuacagauaaggaaacugaggcccagagagcugaaguacugcacccagcau

SEQ ID NO: 215227 - RNA, 64 nt, Human
uccauucccaacuagacauuaccaaagugaccuacccagagauugcuucucauccccaguccca

SEQ ID NO: 215228 - RNA, 64 nt, Human
ucaugaaugggauuagugcccuuauauaaagagacccagagagcuccaucaccccuucugccau

SEQ ID NO: 215229 - RNA, 64 nt, Human
uuucacaccuguaugauagucauggaaacugaagcccagagagguuaagaaauuugcuaggauc

SEQ ID NO: 215230 - RNA, 64 nt, Human
ugggcccugcccaacuucaggcagaacagggaggcccagagauuacagauccccuccuguaagu

SEQ ID NO: 215231 - RNA, 64 nt, Human
guacaguuugacacugaucugguccaugaggcugcccagagaaagcacugcuucuguaugucuc

SEQ ID NO: 215232 - RNA, 64 nt, Human
gaugcugcugcaacuggaagaagcuggaaccagucccagagaggcucggccuggaaacaguccc

SEQ ID NO: 215233 - RNA, 64 nt, Human
ggccugggagucgggcggccccggucaggcccugcccagagagcuccugguuccugaacugagc

SEQ ID NO: 215234 - RNA, 64 nt, Human
uuagcccccuacuguggcccccauagccccauaacccagagagggagcuggacuucagggagcc

SEQ ID NO: 215235 - RNA, 64 nt, Human
cugcugccagcucucaacauagcaggccauaggacccagagaagaaucccagcguugcucaaag

SEQ ID NO: 215236 - RNA, 64 nt, Human
uuagaauucuuuggcgggaaggguaugauggguucccagagacaagaagcccaaccuucuggcc

SEQ ID NO: 215237 - RNA, 62 nt, Human
augagcagguccaacucugauuauucucgaugcccagagaugcucaugcaccugugcacacu

SEQ ID NO: 215238 - RNA, 64 nt, Human
cgucuguaccucaggggaugccccgcuguggucacccagagaaucacccuuccuggucuacaga

SEQ ID NO: 215239 - RNA, 64 nt, Human
ccuggucuaugccauugcacaugucuccccugcccccuggcauuagggcagcaugacaaggaga

SEQ ID NO: 215240 - RNA, 64 nt, Human
uuucagcuucagcuuuacgaggcuucuccucucucccuggcacccugcuggcugccucacugcu

SEQ ID NO: 215241 - RNA, 64 nt, Human
aagguacauaccaccccuucugccgcgccuccaccccuggcaccaaggucuucugcugcuuaug

SEQ ID NO: 215242 - RNA, 64 nt, Human
caagaccugagugaccagucaagccucauguuaccccagagagacacauggggaguagacccug

SEQ ID NO: 215243 - RNA, 64 nt, Human
ucugcucugaaaaauggggaaaacugcuaaacaucccagagauuugcaaucuucuagcucucca

SEQ ID NO: 215244 - RNA, 64 nt, Human
acagggcucagguggguggagcaguaaggcacuacccagagagcuugcugcugcggcccugucc

SEQ ID NO: 215245 - RNA, 64 nt, Human
uccugggcugggcagagugacagugcuagaagaccccagagagagggcaagggcuuugggcaag

SEQ ID NO: 215246 - RNA, 64 nt, Human
cuugaaaaugcauguuccucaggccuaugcaguucccagagacucuugacaccggucucugcug

SEQ ID NO: 215247 - RNA, 64 nt, Human
ccuucaggagcucucuacccaggggcaaggagagcccagagagaagcgcccuggucucuugagc

SEQ ID NO: 215248 - RNA, 64 nt, Human
uccugcggcaccggguucaggcagcuacuccugccccagagaugaaggggcagcuuugcaagga

SEQ ID NO: 215249 - RNA, 64 nt, Human
ccaacagggcaacuggaaccccugccugaccuuacccagagaagccaugggccaccugcucugu

SEQ ID NO: 215250 - RNA, 64 nt, Human
gugguguccugcacggaauagaaggggaaaggaccccagagaaguggcugugacccguccaagg

SEQ ID NO: 215251 - RNA, 64 nt, Human
cccugggccucagccuccaggcacccccaggauucccagagagacgcugugauuggcaggaggc

SEQ ID NO: 215252 - RNA, 64 nt, Human
ccuuuuccacagccacucacuggggccaccaaaacccagagauggcaggugugugggacagacu

SEQ ID NO: 215253 - RNA, 64 nt, Human
gcuccagcacagcagagaccagcaggccccccaacccagagacugggucugcuggagucuccac

SEQ ID NO: 215254 - RNA, 64 nt, Human
caaagccugcacaacccaaccucgcuuagggacccccagagaugcuggaaucgcuaggaggguu

SEQ ID NO: 215255 - RNA, 64 nt, Human
cgugggcagggcaugcgcuccccuggcugagcaccccagagauucuccugcaccuuccucaugc

SEQ ID NO: 215256 - RNA, 64 nt, Human
gagggagagaacacgcugugaaaacacagaagcucccagagaagccuucucagcuuuuaucucu

SEQ ID NO: 215257 - RNA, 64 nt, Human
gcagaaaggcuggaguuauuauucaacucaaucucccagagaacucagaggcuacaguuucuac

SEQ ID NO: 215258 - RNA, 64 nt, Human; identical to SEQ ID NO: 214540

SEQ ID NO: 215259 - RNA, 64 nt, Human; identical to SEQ ID NO: 214541

SEQ ID NO: 215260 - RNA, 64 nt, Human
uggggcucccugagacccgcccuccagcugcccucccuggcaccccugccccaccuggcuccuu

SEQ ID NO: 215261 - RNA, 64 nt, Human
uacuauagugagcccaugcagcaccucucacccacccagagauggagcugcucugccuuccagc

SEQ ID NO: 215262 - RNA, 64 nt, Human
aaacaaaaucugagucuccagccaggaggcuucucccagagaggacaaaaaagcccaacuugcc

SEQ ID NO: 215263 - RNA, 64 nt, Human
gggcuccacccacuagaugccaguggcacccccucccagagaugacaaacgaaaaugucucuag

SEQ ID NO: 215264 - RNA, 64 nt, Human
gcagaagaggcucccaggcccaagcucugugugacccagagaaauaaagaugccucaguguggc

SEQ ID NO: 215265 - RNA, 64 nt, Human
aggccagcccccaaugguccccuuacggacaggucccagagauggacagaggcacccagggccc

SEQ ID NO: 215266 - RNA, 64 nt, Human
ggacccguguccucagagcaccacacacugagcacccagagacagcgggccuggcagcgggccg

SEQ ID NO: 215267 - RNA, 64 nt, Human
acccaggucugcugcccaggaacccuccagaccucccagagagugaauaaagugugacuugcaa

SEQ ID NO: 215268 - RNA, 64 nt, Human
gucaccauggucuaaucccaagagggacucgucacccagagaccucaaaaggccccaggccuac

SEQ ID NO: 215269 - RNA, 64 nt, Human
gcugaggagcaggugucccugagaacccaaacuucccagagaguaugugagaaccaaccaauga

SEQ ID NO: 215270 - RNA, 54 nt, Human
ucagccggaagagaaaaugaagaccccagagacauuuauuggggaguaggaugu

SEQ ID NO: 215271 - RNA, 64 nt, Human
gcucuauauaaguaggggcagcuuagcccugaggcccagagaccugcuguccuuuuucuccuug

SEQ ID NO: 215272 - RNA, 64 nt, Human
ccagaugcuaagcgcuucagagaggaggugucugcccagagauguggagcagaagcugggcccu

SEQ ID NO: 215273 - RNA, 64 nt, Human; identical to SEQ ID NO: 215264

SEQ ID NO: 215274 - RNA, 64 nt, Human
gcugaagauucagacaggaaccucuuucccuguucccagagaaugcggcugagaaugagaacgc

SEQ ID NO: 215275 - RNA, 64 nt, Human
agaaagggcucauuaagccuuuuggacacaggaccccagagaggaaaaagugacuugcccaagg

SEQ ID NO: 215276 - RNA, 64 nt, Human
gcugaggagcaggugucccugagaacccaaacuucccagagaguaucugagaaccaaccaauga

SEQ ID NO: 215277 - RNA, 64 nt, Human; identical to SEQ ID NO: 214559

SEQ ID NO: 215278 - RNA, 64 nt, Human; identical to SEQ ID NO: 214560

SEQ ID NO: 215279 - RNA, 64 nt, Human; identical to SEQ ID NO: 214561

SEQ ID NO: 215280 - RNA, 64 nt, Human
ggccccugcucagucagccccacucccugggcuucccagagagugacagcugcucaggcccuaa

SEQ ID NO: 215281 - RNA, 64 nt, Human
gccaccuaugccacagugccuaagggcuaggccacccagagacugugcccggagcuggccgugu

SEQ ID NO: 215282 - RNA, 64 nt, Human
ccuuggccugaguaaacuuggaaaggggcucccucccagagaagggacuacucucuucaccccu

SEQ ID NO: 215283 - RNA, 64 nt, Human
ggugcuaaggggauggggaagaagggacaagauucccagagaggagaggaggcuguugguagga

SEQ ID NO: 215284 - RNA, 64 nt, Human
gcacccaccuaaagacauguauaugucuugggaucccagagauuggguccuugggccuggcuuc

SEQ ID NO: 215285 - RNA, 64 nt, Human
ucugggaaaaugaacguccaggacacaccuguaucccagagagcaaagugaugaggagacugag

SEQ ID NO: 215286 - RNA, 64 nt, Human
ucaccuccugcggcagaacagcacccgugacccacccagagagcaaggccaggggucuuggugc

SEQ ID NO: 215287 - RNA, 64 nt, Human
cuagguacaaugucuaucaggaaagcaaagcuuccccagagacgcucagcuuguauccauugac

SEQ ID NO: 215288 - RNA, 64 nt, Human
uuguuaucuuaugcuugagguaggcacugguuugcccagagaauuuuuauuuuucccagaccac

SEQ ID NO: 215289 - RNA, 64 nt, Human
agaguggucgugagcuggucuuggggcacaauuacccagagauauauuuauuaacagccaaccu

SEQ ID NO: 215290 - RNA, 64 nt, Human
gggaacugaaauccuugagaguuccggggagaaacccagagaugccugauuucauuccucgaug

SEQ ID NO: 215291 - RNA, 64 nt, Human
acauuccacccuguuacuuauguagaaacugaggcccagagagggaagaugaccugccccaagu

SEQ ID NO: 215292 - RNA, 64 nt, Human
ccucacuugcuucuuauccuuacacucccccagccccagagaaacugccacauacaccacaaaa

SEQ ID NO: 215293 - RNA, 64 nt, Human
uuauaacccagacuaagguugaacaaccugcaugcccagagaaaacuauggcgacaaaggggaa

SEQ ID NO: 215294 - RNA, 64 nt, Human
aagaaacuuauuauuggcuucuguuucauauggacccagagagccccaccaaaccuacgucaag

SEQ ID NO: 215295 - RNA, 64 nt, Human
ccagaaacuagacauuagaauguugaggcaguuucccagagaaacaagcauauugccucaugga

SEQ ID NO: 215296 - RNA, 64 nt, Human; identical to SEQ ID NO: 214578

SEQ ID NO: 215297 - RNA, 64 nt, Human
ugaaaaccucacaucaggcugcauccucuucugucccuggcaccaggcuuuguuuacacuugga

SEQ ID NO: 215298 - RNA, 64 nt, Human
gcagggguggucccgccacaacccugcguguggacccuggcaggggggggugccaggccccugg

SEQ ID NO: 215299 - RNA, 64 nt, Human
aaccugccuccccuccauagucuuguuggagaagcccagagagaaugggacuccaacuaaggga

SEQ ID NO: 215300 - RNA, 64 nt, Human
ugauauccucuucuuaaaaaugaguaaauggaggcccagagaaauguaauuugccugagaucaa

SEQ ID NO: 215301 - RNA, 64 nt, Human
uccccaaaauggaccuuuuuuuuuucuaaagagucccagagaauggggaauuguuccuguaaau

SEQ ID NO: 215302 - RNA, 64 nt, Human
gccagagcauccauggccaauuucaaauugugaacccagagacacucccauccacccuucucca

SEQ ID NO: 215303 - RNA, 64 nt, Human
uagguauaccuacagcagcuacaaugauucuugucccagagagggcuaugcugcuuuuccaauu

SEQ ID NO: 215304 - RNA, 56 nt, Human
ucagcuuucugaugaguuaaaaaggucccagagauauauagacacuggaguacugg

SEQ ID NO: 215305 - RNA, 64 nt, Human
agaccgugaacaccugcuuccucccucgggcaggcccagagagccagagguggguaggagguua

SEQ ID NO: 215306 - RNA, 59 nt, Human
augaucucacugagcucuaaaucugcaaucccagagaauccugacaaagcgugccaccc

SEQ ID NO: 215307 - RNA, 64 nt, Human
aaaauaucugccaucaucugccauaggaaagauacccagagacccaucauguucucuuuuuguu

SEQ ID NO: 215308 - RNA, 64 nt, Human
uauaaccuacuuacuccguaaggggaaaugaaggcccagagaagggaagggacuugaccgaggu

SEQ ID NO: 215309 - RNA, 64 nt, Human
gcugccaccugcccugcugccaggcuuacaucuucccagagaacuaugcugccacuucacaucc

SEQ ID NO: 215310 - RNA, 64 nt, Human
cugaagccaaaaaugaagccguggccaagcgugacccagagaugggguguccuggcccuuagug

SEQ ID NO: 215311 - RNA, 64 nt, Human
uaaccaagggccuaauguuuguuacagaaaugaucccagagaccuacaagaugugggaaucagc

SEQ ID NO: 215312 - RNA, 64 nt, Human
caucugcaugauuggcauuaguuaccacagccugcccagagagaaacuaucuucucccaacauu

SEQ ID NO: 215313 - RNA, 64 nt, Human
gcugaggcuccuucccagcaacacuccggucagccccuggcaaucccaccaaaucauccugaau

SEQ ID NO: 215314 - RNA, 64 nt, Human
cgcauuugguacuggcuuuugugauacuuaggaacccuggcaucuuuucuauauuauccagugu

SEQ ID NO: 215315 - RNA, 64 nt, Human
ccaucagggaucacuaaauuuaaggcuuccagaucccuggcaggaacagauuccaguccugcuu

SEQ ID NO: 215316 - RNA, 64 nt, Human
gcccaaagauuuccaagguucccaaagucaaggccaggccaaggccugguuggguccuuggggc

SEQ ID NO: 215317 - RNA, 64 nt, Human
aaagucuuugcuuuggaagcgucagacauuagaacaggccaaacuggacugucuguucauagcg

SEQ ID NO: 215318 - RNA, 64 nt, Human
gugcccuccacagccgcagccucccucugaccugcaggccaagagcagaggcagcgaguugugg

SEQ ID NO: 215319 - RNA, 64 nt, Human
aaucugccaauuuuuuaaaaaaguaaguaccacucaggccaacaagccaacgacaaagccaaac

SEQ ID NO: 215320 - RNA, 64 nt, Human
gaggagggguaggccugcauccacagagaggauccaggccaaggcacuggcugucaguggcaga

SEQ ID NO: 215321 - RNA, 64 nt, Human
uccccacaaugucugaagcugccccugggauucucaggccaaccugccaacagcaagcggauuu

SEQ ID NO: 215322 - RNA, 51 nt, Human
agaucccugccaugauguagccaggccaaaggacaagccagguugcaugau

SEQ ID NO: 215323 - RNA, 64 nt, Human
gacaaaggcucaggacggcuggcucugggggacucaggccaagccccuuggcaccauccuggcu

SEQ ID NO: 215324 - RNA, 64 nt, Human
ggcagggaugagugaggcccugcagagagcaucccaggccaagguucccacucagccugccccc

SEQ ID NO: 215325 - RNA, 64 nt, Human
caucgcuuccccugcccuuugguagugccaggaccaggccaaugaugcuucucaguagccuuau

SEQ ID NO: 215326 - RNA, 64 nt, Human
ggggcuuccggaaaagggaacccugcgguacccccaggccaaagcaaguaagcgguuagcaccc

SEQ ID NO: 215327 - RNA, 64 nt, Human
gcagaagcccugccugguccaguccgggggcggccaggccaacugcaagauucuggacuguuuu

SEQ ID NO: 215328 - RNA, 64 nt, Human
ccaggaagaugauauuugcgucuuuugcccaccccccuggcauucagcuggacccaacuaggcc

SEQ ID NO: 215329 - RNA, 64 nt, Human
ggugccgucucugcuccuugugguuauugcucagcccuggcauccccaggggaauggcagcagu

SEQ ID NO: 215330 - RNA, 64 nt, Human; identical to SEQ ID NO: 214613

SEQ ID NO: 215331 - RNA, 64 nt, Human
agggcgacaggcccggggcuacgcgaagaagucgcaggccaagauucuuuacaguuugagaaau

SEQ ID NO: 215332 - RNA, 64 nt, Human
ugcauccaacaugaauuuccagccgaugauaauccaggccaaagguuuaguuguuguuauuucc

SEQ ID NO: 215333 - RNA, 64 nt, Human
aaacucccgugggagauuuuggccccaacccacacaggccaaugcaagaggccaaggcuggaga

SEQ ID NO: 215334 - RNA, 64 nt, Human
cgcagugguggagaguucuaauguugacuguuugcaggccaaaagaugauugcuuuauaauuuu

SEQ ID NO: 215335 - RNA, 64 nt, Human
acagaauccagccgcuuaggcuuugaugaacucccaggccaaaaugaggaguuauugaagcaaa

SEQ ID NO: 215336 - RNA, 64 nt, Human
aauauauuuguucacuugagucuuaagaguaggucaggccaaggcagguggaucaccugagguc

SEQ ID NO: 215337 - RNA, 64 nt, Human
gggugaacagcuuggccuuuuuugggugucuugacaggccaagaagaacaaaugacucagaaug

SEQ ID NO: 215338 - RNA, 64 nt, Human
gugaagcuagaggcuacagccacuaaacuugcuucaggccaacgauaguuacucacaaguaagu

SEQ ID NO: 215339 - RNA, 64 nt, Human
ggucuccucaacacugggcugauccugaauggcacaggccaaggggaggccagccucgccuuuc

SEQ ID NO: 215340 - RNA, 64 nt, Human
ccaggccggcuccgcgggaacucucucccucagacaggccaaaaaccaguagcgaggucguggu

SEQ ID NO: 215341 - RNA, 64 nt, Human
ugugacugagucccuucaggcgugcaagcuggcccaggccaaugguuggugugucauggugccu

SEQ ID NO: 215342 - RNA, 64 nt, Human
gggggcccucagguggagagagcugcgauccauccaggccaagaccacagcucugugauccuuc

SEQ ID NO: 215343 - RNA, 64 nt, Human
gccgggggccgucccaaaccucgcagggcuccagcaggccaaccggcaccacggacuccugggu

SEQ ID NO: 215344 - RNA, 64 nt, Human
gauuuggcugaguggcuuugugugaccguggccccaggccaaggggaucauggcccuggcuggc

SEQ ID NO: 215345 - RNA, 64 nt, Human
gcaggagcucagccaccacugugccauggugacacaggccaaggcagacauuggcccucccuuc

SEQ ID NO: 215346 - RNA, 64 nt, Human
cagcuuaaccccugccaucccaugcugggcccuccaggccaagagucucagcuggccgagaguc

SEQ ID NO: 215347 - RNA, 64 nt, Human; identical to SEQ ID NO: 214614

SEQ ID NO: 215348 - RNA, 64 nt, Human; identical to SEQ ID NO: 214631

SEQ ID NO: 215349 - RNA, 64 nt, Human; identical to SEQ ID NO: 214632

SEQ ID NO: 215350 - RNA, 64 nt, Human
gcuggguccucuggcuauuuggcugagaaggggccaggccaagggccggguggggaugggcacc

SEQ ID NO: 215351 - RNA, 64 nt, Human
gauagccaaggccaaaggaagcacaugccucucucaggccaaacucaccugccccucaacucuc

SEQ ID NO: 215352 - RNA, 64 nt, Human
cuuuacuagagcugaaaggcccccuugacacauccaggccaaccucccauggaauagguaggca

SEQ ID NO: 215353 - RNA, 64 nt, Human
ggggcuggccuggcauuagucauuauuuaguuuccaggccaaccauccagauagagauucccuc

SEQ ID NO: 215354 - RNA, 64 nt, Human
cuccugaccccauugggaacacggaagucuauuccaggccaaccagcccaaaauuauuucaucu

SEQ ID NO: 215355 - RNA, 64 nt, Human
guggguuuuggagucugagccucaggcucaaauccaggccaagugaucuugggcaaguuaaucu

SEQ ID NO: 215356 - RNA, 64 nt, Human
gcaugugguucaaauaauauuuuccaauccacuucaggccaaaacaugcuaaagauaacacacc

SEQ ID NO: 215357 - RNA, 64 nt, Human
ggcaaauauuucaccauugccagagaagaugugacaggccaaucagacagggcccagagcaucu

SEQ ID NO: 215358 - RNA, 64 nt, Human
gcugucacaucagcaaauauguagucaaggcagccaggccaacuagaccacacuuauuggucua

SEQ ID NO: 215359 - RNA, 64 nt, Human
cccgcccugugguuggaaucgaugccacggauugcaggccaaauuucagaucguguuuccaaac

SEQ ID NO: 215360 - RNA, 64 nt, Human
caugaucugaagauuguguuacaaaaaauauuaucaggccaaaauuuguucggaauacacuaau

SEQ ID NO: 215361 - RNA, 64 nt, Human
ugccagcuugccuccauccuuuucacauauuaugcaggccaauugacauauaauuuguucuuaa

SEQ ID NO: 215362 - RNA, 64 nt, Human
caaacagcacuccaggccagcucaagaagcaaagcaggccaauagaaaugcaauauuuuuaauu

SEQ ID NO: 215363 - RNA, 64 nt, Human
uaaugguaacugaccaguguuacccugagccccgcaggccaacccauccccaguugagccuuau

SEQ ID NO: 215364 - RNA, 64 nt, Human
aggggccauuuggcauaccuuucacagcuuuuaucaggccaaguuaaaggcugacuacauuuuu

SEQ ID NO: 215365 - RNA, 64 nt, Human
ucuuuucuuuacaaaccauuuuguuauugacuaacaggccaaagagucuccaguuuacccuuca

SEQ ID NO: 215366 - RNA, 64 nt, Human
ggaauggccacggagugaugaguugugugcuugucccuggcaguggcaggcuguguccuaugga

SEQ ID NO: 215367 - RNA, 64 nt, Human
ccucaccucugcagacacggggagaaccccggaccccuggcaugcaugcuggcggcggcaugcc

SEQ ID NO: 215368 - RNA, 64 nt, Human
cgggcacggcugcugcagucucuucccagccuggcccuggcaaggggcgggugggcgcugccag

SEQ ID NO: 215369 - RNA, 64 nt, Human
uuaucucuucuuucucuaggagguauaaauauuucaggccaagguucaauuauuucagcgcagg

SEQ ID NO: 215370 - RNA, 64 nt, Human
gacucugaaaugaaguaaaagagauuuccugugacaggccaagucuuacagugccauggcccac

SEQ ID NO: 215371 - RNA, 64 nt, Human
uuccagagcaaaccuggagaagauucacaauagacaggccaagaaacccggugcuuccuccaga

SEQ ID NO: 215372 - RNA, 64 nt, Human
ccaacuggacaagggauggcggcagaccaggggccaggccaaagcacuggcaggacucaggugg

SEQ ID NO: 215373 - RNA, 64 nt, Human
gaaauagaacauuagccacgagccauaggcauuucaggccaaauccaugaaagggggaccaguc

SEQ ID NO: 215374 - RNA, 64 nt, Human
gaaggcuacauuugugggaguguugucauauucucaggccaacuguuuugaaauucgguaucuc

SEQ ID NO: 215375 - RNA, 61 nt, Human
ucagcaucuauuaccacugaugcacaggcgccaggccaagggggaaaugcucuuugaaagc

SEQ ID NO: 215376 - RNA, 64 nt, Human
gauuuaauuuucaauauuugguuucauuuuucaacaggccaagaggccucugguaaugaagugc

SEQ ID NO: 215377 - RNA, 64 nt, Human
uugcuccuaugguucccauaggcacaccuauucccaggccaaggagaguccuuccucuccccuu

SEQ ID NO: 215378 - RNA, 64 nt, Human
aguccuugaaacugagccccauucugaaucccugcaggccaagucauugcucagccaggacuca

SEQ ID NO: 215379 - RNA, 64 nt, Human
uuuagcagcugugauguugguaccuggugcagaccaggccaaaguucuggaaagcuccuuuugc

SEQ ID NO: 215380 - RNA, 64 nt, Human
gcauaggugguuugugaaacucacaggugguccccaggccaagaugggcaggugucacaaagaa

SEQ ID NO: 215381 - RNA, 54 nt, Human
aaaaagaguauuucauuuaagaugcaggccaagauucugaguuuuacuaccagg

SEQ ID NO: 215382 - RNA, 64 nt, Human
ccccuggcugagcauggcagccuugaagacaccacaggccaaaacaugaggggcagaaauggga

SEQ ID NO: 215383 - RNA, 64 nt, Human
gauucuacaccaggggcagcuacugcgagaacuucaggccaaugucucagcccaggugaguggg

SEQ ID NO: 215384 - RNA, 64 nt, Human
caccaacugaucaccacuaacucagagccuccuccaggccaaacagccccaaagucaauuaaag

SEQ ID NO: 215385 - RNA, 64 nt, Human
ccucauucucauuccugggcagcccuuccuuccacccuggcaccaaaauaauuucuccuccauc

SEQ ID NO: 215386 - RNA, 64 nt, Human
aucgccaucagcacucacuccccacucccccagccccuggcaaccacaaaucuuuccaacucua

SEQ ID NO: 215387 - RNA, 64 nt, Human
uugggggacagauggucccuguccugcgggguggcccuggcagaaccacugccugaagaaccag

SEQ ID NO: 215388 - RNA, 64 nt, Human
cccacucauccagccccagaucugagccuugacgcaggccaaguggaaaaauacuuucccgccc

SEQ ID NO: 215389 - RNA, 64 nt, Human
gaaagaaccagagcugggaagauggcugggaagccaggccaaagugggggcaacagcuugcuuc

SEQ ID NO: 215390 - RNA, 64 nt, Human
uaugcaggacaaggaaugucugcucuggggggcacaggccaacuauauggagggagggucccaa

SEQ ID NO: 215391 - RNA, 64 nt, Human
auuuuuaagaugaacuuaguucuaaagaagauaacaggccaauccugaagguacucccuguuug

SEQ ID NO: 215392 - RNA, 64 nt, Human
ugguuuugagggcuugagaaugggucagggacuccaggccaaguccaacagagaccccaaaccc

SEQ ID NO: 215393 - RNA, 64 nt, Human
caagggcugugguccgcucagggucucauuuccccaggccaaguucaaggcagcagcccuuugu

SEQ ID NO: 215394 - RNA, 64 nt, Human
gugcuguguugucauucaaggacuuccucuccugcaggccaacugaaauaccagaaaaugacau

SEQ ID NO: 215395 - RNA, 64 nt, Human
gucuccugcauggcaacaaaaugugugucaccaucaggccaacaggccagcccuugaaugggga

SEQ ID NO: 215396 - RNA, 64 nt, Human
uccucuaaaccagggaucagcaaacuauaacccccaggccaaaucuagcccacucccuguuuuu

SEQ ID NO: 215397 - RNA, 64 nt, Human
acugggccuaggugauggcaguccauguggcugccaggccaaggcagucacaggggcccugacc

SEQ ID NO: 215398 - RNA, 64 nt, Human
cagcuacgaugggaugggaacaguggacccuaagcaggccaagggugcguagggacggugguac

SEQ ID NO: 215399 - RNA, 64 nt, Human
ccccaaggagggacgucuugagggguccgagccucaggccaaggaccccugaugcagacucugg

SEQ ID NO: 215400 - RNA, 64 nt, Human
gcucccgcgggaagccagcccgugcaacggaagccaggccaacugccccgcgucuucagcuguu

SEQ ID NO: 215401 - RNA, 64 nt, Human
gauguuauuauaauuacagucaaauguagacuaucaggccaaauuaaaggggagcauggcagau

SEQ ID NO: 215402 - RNA, 64 nt, Human
uuuuuaacuuuuauuucgucucaguuuuuggucacaggccaaauaauacagcgcucucucugcu

SEQ ID NO: 215403 - RNA, 64 nt, Human
acgguggcucacaccuguaaucucagcacuuuggcaggccaaggcagguggaucaccugagguc

SEQ ID NO: 215404 - RNA, 64 nt, Human
cccuccacccccacaccccagccgugucccuaaccccuggcaaccaggaauccacucuccauuu

SEQ ID NO: 215405 - RNA, 64 nt, Human
cucccagggaguccucgagucgcccugcccagagcccuggcaccagagacgccaagagccugug

SEQ ID NO: 215406 - RNA, 64 nt, Human
agcucagaacaaagggaaaggggugcagcuuccacccuggcaggcucucagaaauuuuuaguuc

SEQ ID NO: 215407 - RNA, 64 nt, Human
cuauaauaacugaugcugcucuacugcuuuaauacaggccaaaguaacguggaagcgcacagca

SEQ ID NO: 215408 - RNA, 64 nt, Human
aggaccaauuucauauaguacaaguuucguaagucaggccaagugucaauuucaaaagacaaga

SEQ ID NO: 215409 - RNA, 64 nt, Human
gcccaacacgaucuuguaagauggauuucacccccaggccaaugcagcuaauuuugauagcugc

SEQ ID NO: 215410 - RNA, 64 nt, Human
aacccacccguugaguuuguggguaaccagcaggcaggccaaagacuggugcuuuucauuucau

SEQ ID NO: 215411 - RNA, 64 nt, Human
ccuuugguauauagucucgcauauuauauuauagcaggccaagauaaaauuuugacagcucuuu

SEQ ID NO: 215412 - RNA, 64 nt, Human
guggugguucauaucuguaauccuaacacuuugacaggccaaggcaggggaauugcuugaguuc

SEQ ID NO: 215413 - RNA, 64 nt, Human
agaaauaaaagauacuaucuuuaccguaguaguucaggccaagauuaugcuuaguuuuaguucu

SEQ ID NO: 215414 - RNA, 64 nt, Human
gcagaucacuugaggucagaaguuugagaccagccaggccaacauggugaaacuucaucucuac

SEQ ID NO: 215415 - RNA, 64 nt, Human
ggguggccuuucauuuggggugcccuuucacucccaggccaagcccuggagcaaucuucuucag

SEQ ID NO: 215416 - RNA, 64 nt, Human
gagcagcugggacuacaggugugcacuaccacaccaggccaauuuuuguuuuuuuuuuuuggua

SEQ ID NO: 215417 - RNA, 59 nt, Human
gcaagaaggagaagaaguaacauggaggccaggccaagagccacagggcggccucuccc

SEQ ID NO: 215418 - RNA, 64 nt, Human
auauuuauuagugguguauaugguccacugguuucaggccaaaucuagaauuuagugauacugg

SEQ ID NO: 215419 - RNA, 64 nt, Human
augaaacaggggugguagauuuauucccuugugucaggccaaagaaguucuuacaaaguacagu

SEQ ID NO: 215420 - RNA, 64 nt, Human
uuguuggcagaaauuaauucagaaaucaaaucugcaggccaaacaaggugcaggacccagcuuu

SEQ ID NO: 215421 - RNA, 64 nt, Human
aauaccuugacugcuugugagaccauuagcauugcaggccaaaccguacuguauuuccuucuca

SEQ ID NO: 215422 - RNA, 64 nt, Human
ccccaaccacugcuuaggccucccaacuucuccccaggccaaguauggggcccuggcuguguuc

SEQ ID NO: 215423 - RNA, 53 nt, Human
aagccgaggaccaucucugaccacccuggcaccuuaaauaaggaagaggccca

SEQ ID NO: 215424 - RNA, 64 nt, Human
ucccuugccgcuggucccccaccaggcuugggagcccuggcaucccaaaggggcaacgggagga

SEQ ID NO: 215425 - RNA, 64 nt, Human
guuggcgcauacccacccccgccacggccacaagcccuggcauccccugcaaauauuuauuggg

SEQ ID NO: 215426 - RNA, 64 nt, Human
aaguagaggggacgugagagaagggccaggccggcaggccaacccuccuccaauggaaauuccc

SEQ ID NO: 215427 - RNA, 64 nt, Human
aggaugugguugaugaagguuuccaauaugguuucaggccaaaaccagggaagauucuagcuuc

SEQ ID NO: 215428 - RNA, 64 nt, Human
cacccaguguccuuccaucuucacacugguuugccaggccaauguugcugauggcccccugcac

SEQ ID NO: 215429 - RNA, 64 nt, Human
cuacccagcugauggggguuggggugcuuccuuucaggccaaggcuaugaagggacagcugcug

SEQ ID NO: 215430 - RNA, 64 nt, Human
uccucaaaaugaucuuuagugccuuuauuccuuucaggccaauaauccacccaaaaauuagaau

SEQ ID NO: 215431 - RNA, 64 nt, Human
uccccagacccugccacacauggaagagacagcucaggccaaauacaggcaugauuucuuugcc

SEQ ID NO: 215432 - RNA, 64 nt, Human
auuccauggagaccuccccuugaggaggugaauucaggccaaaagggcuguuggcuguaauccu

SEQ ID NO: 215433 - RNA, 64 nt, Human
aucuuucccuucuguugugaaauauguuaagccacaggccaaacugcuauaagaucgaaguuug

SEQ ID NO: 215434 - RNA, 64 nt, Human
auaguccguauccccaacuauuaaggauuugucccaggccaauggugaacaugcugcauuuuau

SEQ ID NO: 215435 - RNA, 64 nt, Human
agccaagugggggccccuuuuccgaagccacuuccaggccaaggcagucgccagggcuucuugu

SEQ ID NO: 215436 - RNA, 64 nt, Human
ccagggugcuaugacugcucuggcacccuuggaucaggccaagcuagacuuuuucugagccuuc

SEQ ID NO: 215437 - RNA, 64 nt, Human
uuguacugccugccaccgcggaggaggcuggugacaggccaaaggccaguggaagaaacacccu

SEQ ID NO: 215438 - RNA, 64 nt, Human
gccauccguuauuauuuccaauggagaccuagcccaggccaagguaaaguuaguuaauagcauu

SEQ ID NO: 215439 - RNA, 64 nt, Human
auccuggaaaugguuuaccuaaaagcuacagaaccaggccaauauauuuugaaauauugaugca

SEQ ID NO: 215440 - RNA, 64 nt, Human
ucuacaaguagaugugcuagacaauggaaggaugcaggccaaccucuuugauuacaauugagau

SEQ ID NO: 215441 - RNA, 64 nt, Human
aucuaucuuuggcuucccaaacaguaacucacuccaggccaagugugccuuagcacgagugacc

SEQ ID NO: 215442 - RNA, 64 nt, Human; identical to SEQ ID NO: 214726

SEQ ID NO: 215443 - RNA, 64 nt, Human; identical to SEQ ID NO: 214727

SEQ ID NO: 215444 - RNA, 64 nt, Human
cacaaaucuagaauugcaaagccagccuuuauuucccuggcaggcagccuugccagaaggcaga

SEQ ID NO: 215445 - RNA, 64 nt, Human
accacuaacaaaaugguauaaagaaucucccagccaggccaacauggugaaacccugucucuac

SEQ ID NO: 215446 - RNA, 64 nt, Human
ugauaucacaggaggccagagagaggcaaaggcucaggccaagagccaacgcugugggaggccg

SEQ ID NO: 215447 - RNA, 64 nt, Human
ggaacaucaaguuuugguguuacuuucuugucuacaggccaaaugcgcacaguugauuuucggu

SEQ ID NO: 215448 - RNA, 64 nt, Human
aauugaacgggucgagaugccgaccucagccucacaggccaaagcaucagcaccagaacgcaca

SEQ ID NO: 215449 - RNA, 64 nt, Human
caucuaacaucuacacuucucuagcucagccucacaggccaaagcaucagcaccagaacgcaca

SEQ ID NO: 215450 - RNA, 64 nt, Human
caacagauguugacuucucauccccgaguucuuucaggccaaaaagcaaauggauuuccaccug

SEQ ID NO: 215451 - RNA, 64 nt, Human
guuaccuaucucguguguguuauuuccccagccacaggccaaauccuuggagucccaggggcag

SEQ ID NO: 215452 - RNA, 64 nt, Human
caggaggaaaguuuaaucccccauuccaaaaguccaggccaaauggugggcuuagccucuuuga

SEQ ID NO: 215453 - RNA, 64 nt, Human
ugauuuccaauagcugaacuugggcagaaaacagcaggccaauguuccuaugugguuucuuugu

SEQ ID NO: 215454 - RNA, 64 nt, Human
cccaucucagauacugucaacuccauccuucugucaggccaaaauccuuggagccauccucaac

SEQ ID NO: 215455 - RNA, 64 nt, Human
ggcuggagguggcagcuucacagaacuggagaaccaggccaaguccccuccccaaccuaauuag

SEQ ID NO: 215456 - RNA, 64 nt, Human
ugccuugcucuugccaccaggacaccuaugucaacaggccaaacagccaugcaucuauaaaggu

SEQ ID NO: 215457 - RNA, 64 nt, Human
uaggccaugcuggcugcugucacugagcgggacucaggccaagaggcgugaccucgggccagcc

SEQ ID NO: 215458 - RNA, 64 nt, Human
cccagagaacucuccugggaggcugugggugagccaggccaacauuggugucccuguccccaga

SEQ ID NO: 215459 - RNA, 64 nt, Human
uguuguuuaguuacauuaggcuuugcuauauccccaggccaaauagcaugugacacaggacagc

SEQ ID NO: 215460 - RNA, 64 nt, Human
gaaagugcugggauuacaggcgugagccaccagccaggccaagcuauucuuuuaaaguaagcuu

SEQ ID NO: 215461 - RNA, 64 nt, Human
cuuugagccuuuggccacauccaccucgaggggacccuggcaccccgggcacacaaaccucugu

SEQ ID NO: 215462 - RNA, 64 nt, Human
agagccacuucuuaccaggcaacgggcacagccacccuggcacacccucugccuggccgugcug

SEQ ID NO: 215463 - RNA, 64 nt, Human; identical to SEQ ID NO: 214764

SEQ ID NO: 215464 - RNA, 64 nt, Human
aaaaaguuuguuuuuucuuuauuguccuucauagcaggccaaguauugccucucugcaauagac

SEQ ID NO: 215465 - RNA, 64 nt, Human
agccauggaaaaacuuccuaguaagcaucuacuucaggccaacaagguuauaugaauauauagu

SEQ ID NO: 215466 - RNA, 64 nt, Human
cggauuacuuucuuggcagcuuaaguggcgcagccaggccaagcuguguaaguuaagggcagua

SEQ ID NO: 215467 - RNA, 64 nt, Human
gcuccuucagugccccuguacugcccugccaucucaggccaaagggaggggagcaaguggggac

SEQ ID NO: 215468 - RNA, 64 nt, Human
ugcccagccccguuuuaaggacauuaaaagcuaucaggccaagaccccagcuucauuaugcagc

SEQ ID NO: 215469 - RNA, 64 nt, Human
cuuuuggaaauuuggcugaacaauuagaacacaacaggccaacucauacucauuuggaucuauu

SEQ ID NO: 215470 - RNA, 64 nt, Human
uggauauacuaggauuaauuaucagaagacagcucaggccaaguuuugaucguuccauacagua

SEQ ID NO: 215471 - RNA, 64 nt, Human
ugaaggugggggugacacugggaggugggagggccaggccaacuggcugcggccaucacagcug

SEQ ID NO: 215472 - RNA, 64 nt, Human
aaaagaaaauacaauuagucacucaacauaaccacaggccaauuuguuggccaccagaaaaccg

SEQ ID NO: 215473 - RNA, 64 nt, Human
agcaagaagcagauuagguuuuugacaaaacaaacaggccaaaagggggcugaccuggagcaga

SEQ ID NO: 215474 - RNA, 64 nt, Human
uucuaagucuaccaaaaaaaguuuuaaacucaagcaggccaaaaccaauaugcuuauaagaaau

SEQ ID NO: 215475 - RNA, 64 nt, Human
agugccuggcagaaugcccugccugccugccugccaggccaaggccugcgucucucugcuguac

SEQ ID NO: 215476 - RNA, 64 nt, Human
ugggcaaggaaugaccuguuccaggcgcccuccucaggccaaccacagcgucuugggugggcag

SEQ ID NO: 215477 - RNA, 64 nt, Human
ggagguagagacggcccuuugagauggugcccagcaggccaaacccaccugccucugccaggaa

SEQ ID NO: 215478 - RNA, 64 nt, Human
gcauuugggcagacccugagcagaauacuggucucaggccaagcccaauacagccauuaaagau

SEQ ID NO: 215479 - RNA, 64 nt, Human
ccgggcuccagguuucugguugggaagggaaggccaggccaaaagcuccaccggccguauagau

SEQ ID NO: 215480 - RNA, 64 nt, Human; identical to SEQ ID NO: 214765

SEQ ID NO: 215481 - RNA, 50 nt, Human; identical to SEQ ID NO: 214766

SEQ ID NO: 215482 - RNA, 64 nt, Human
caucagggucccaaucaccagaaagcaccaaagccccuggcaccccacccacuccauccuaccc

SEQ ID NO: 215483 - RNA, 64 nt, Human
gggagaacuugaaacagauucaggccagcccagccaggccaacagcaccuccccgcugggaaga

SEQ ID NO: 215484 - RNA, 64 nt, Human
guacuaagcaaaauucucaucacagaauguagcccaggccaauuuauaacuaaaucucuauuug

SEQ ID NO: 215485 - RNA, 64 nt, Human
aaggugcuuuucaaaagaguaacugaaauuguugcaggccaaaacagcaauaugauaucucaga

SEQ ID NO: 215486 - RNA, 64 nt, Human
acaaauaaaaacuuuuguuacaucucauuauuuucaggccaaggugggaguauagugcauaaua

SEQ ID NO: 215487 - RNA, 64 nt, Human
ccacuucuggcuguccugcgggccacaagcucuucaggccaagucagagcugcuguugcugcca

SEQ ID NO: 215488 - RNA, 64 nt, Human
cauuuguggaauuaugaguucaugcaaaacucuccaggccaaguaggggucuagccuuuaauga

SEQ ID NO: 215489 - RNA, 64 nt, Human
ugcgugggucagaagaguugugcacgcagauuagcaggccaaggucugagccacagcagcauuu

SEQ ID NO: 215490 - RNA, 64 nt, Human
gagaugccuuccaggcagacacagcugucugguucaggccaagccccuuugcaaugcaagcccu

SEQ ID NO: 215491 - RNA, 64 nt, Human
ucugugguuuuuuuuuuuuuaaccaaaguguugucaggccaacugaaugaugaugugguugcua

SEQ ID NO: 215492 - RNA, 64 nt, Human
ucuugcaggaagcaaaccuccuuguuuacaucuucaggccaagaugacugauuugggggcuacu

SEQ ID NO: 215493 - RNA, 64 nt, Human
gugcagguaguaucugccugcggggcuggggaggcaggccaaaggggcuccacaugagaggucc

SEQ ID NO: 215494 - RNA, 64 nt, Human
acggacacaacuccgggaagccuuugagcagcuccaggccaagaaacaaauggccauggagaaa

SEQ ID NO: 215495 - RNA, 64 nt, Human
auguggaccacgggauuuguagccagccagcucccaggccaacgcccaaagcccugaugaccug

SEQ ID NO: 215496 - RNA, 64 nt, Human
cauugauucccagagggucuuaguccuggaaagucaggccaacaagcaacguuugcaucauguu

SEQ ID NO: 215497 - RNA, 64 nt, Human
uugucaagggaagcuuccugugaaccaaaguucucaggccaaggucucgcccaccaaagccaga

SEQ ID NO: 215498 - RNA, 64 nt, Human
ccuuccagaccaagcucaacgccuccaagaccagcaggccaaggccaagcccugccccagaucc

SEQ ID NO: 215499 - RNA, 64 nt, Human
ucugcccacagaauggcauccucaggggcguguacccuggcagccccaccagcuggcuggucgu

SEQ ID NO: 215500 - RNA, 64 nt, Human
gaaguggcaucuguguauucauaaucagcauuuacccuggcaggagacuaaucagauaggccgg

SEQ ID NO: 215501 - RNA, 57 nt, Human
augugcaaacucacuucugaggggggacccuggcaccgcauuagagcucgaaauaaa

SEQ ID NO: 215502 - RNA, 64 nt, Human
aggcccaggacuggagcuuucucuggccaaguuucaggccaaugauccccgcaugguguugggg

SEQ ID NO: 215503 - RNA, 64 nt, Human
gcugggcauuucaccugcugucacugacuuugugcaggccaaggaccuggcagggccagacgcu

SEQ ID NO: 215504 - RNA, 64 nt, Human
cacgucccucaugcacaucacucaucuccugcugcaggccaaggccaaaauugggcuaguccug

SEQ ID NO: 215505 - RNA, 64 nt, Human
uuccuugguccauaacuggugagcuauggagacccaggccaacaaauuauccccagugauaugg

SEQ ID NO: 215506 - RNA, 64 nt, Human
gcugacugagaugcaaggucugaccccacaaggccaggccaauguugcucagugaucacuaaga

SEQ ID NO: 215507 - RNA, 64 nt, Human
aacccagguuaaauacagcccaugcacaaagccacaggccaaagccuauggaauuguuuuuaau

SEQ ID NO: 215508 - RNA, 64 nt, Human
uuaguguuuugcuauaagacagcaugagggcuaucaggccaaaauucauuauuguauuuccaau

SEQ ID NO: 215509 - RNA, 64 nt, Human
uuaccuuuccucauagagcuauccugguuaauaacaggccaagauucucccauuauccccuguu

SEQ ID NO: 215510 - RNA, 64 nt, Human
ucuggcagcaucagcauccuacuccuggcaacaucaggccaacguccaccccagccucacauug

SEQ ID NO: 215511 - RNA, 64 nt, Human
cuuuaagaagaacaaguaguugggggcaaggucccaggccaacucccucccuccguucaggaaa

SEQ ID NO: 215512 - RNA, 64 nt, Human
ccuacugucccucucagugccuucucucagcucccaggccaacaguagccaaaccccuagagac

SEQ ID NO: 215513 - RNA, 64 nt, Human
gacuccugugggcuccugagcuuacaaagcauggcaggccaagggccucgaccacaggccagca

SEQ ID NO: 215514 - RNA, 64 nt, Human
uuggagcagauaaaauuaucaaaaguuucaugaacaggccaaacaaaauauuuuuuaaaguuuc

SEQ ID NO: 215515 - RNA, 64 nt, Human
acuguuuauaucuucacccuguaaugguugggaccaggccaaucccuucuccacuuacuauaau

SEQ ID NO: 215516 - RNA, 64 nt, Human
gcugcaaguucuuguauaaugaagucaaugccaucaggccaaggaaauaaaauaauugcuuacc

SEQ ID NO: 215517 - RNA, 64 nt, Human
augcaggaaacucuuuugaaauaacuuuggugcccaggccaaguagaaugagaugagacugagu

SEQ ID NO: 215518 - RNA, 64 nt, Human
ucauuuucucccagugcccaccccauccccgagccccuggcaaccacuaaucuauuucucucuc

SEQ ID NO: 215519 - RNA, 64 nt, Human
ugaaggccaggcugagugccugggucagccaaaccccuggcacccccagggugacggguggcga

SEQ ID NO: 215520 - RNA, 64 nt, Human; identical to SEQ ID NO: 214804

SEQ ID NO: 215521 - RNA, 64 nt, Human
uaauugagcaauugaggagugucucaggauagcacaggccaagguaggggaguaaaaaggaggu

SEQ ID NO: 215522 - RNA, 64 nt, Human
gccccuggcccuagaacagauccagggcaacguccaggccaaugugccagcuggaggccaggcc

SEQ ID NO: 215523 - RNA, 64 nt, Human
ccuucuuuucucuuuccagaaaauagucccuuuccaggccaaggaccugaauucuguuuacuuc

SEQ ID NO: 215524 - RNA, 64 nt, Human
agaacagcucagaugcacaaagauucacaccauacaggccaaauuauagaaucccccaacccca

SEQ ID NO: 215525 - RNA, 64 nt, Human
caugggaugcagcuaacugcaguugggucgcccccaggccaacgcuccucucaauccugggcug

SEQ ID NO: 215526 - RNA, 64 nt, Human
ccccuccccguguuaaucuguaacuugcagcccccaggccaaaguccuuucucacacuccacug

SEQ ID NO: 215527 - RNA, 64 nt, Human
aaacaacuagcaaaaagaauagccauaagaaaaccaggccaagauugaaaaauguggaucggag

SEQ ID NO: 215528 - RNA, 64 nt, Human
acagcaggaguuaauagcagaguugaggcggcgccaggccaaggaacaccggccuguuuaugag

SEQ ID NO: 215529 - RNA, 64 nt, Human
aucuuucuccugagcucacauuggcaggugaugucaggccaaugccuagaacaaagggcaaagg

SEQ ID NO: 215530 - RNA, 64 nt, Human
ccucagaaggcugucuggcacccaguguccuagccaggccaaguauaugagaaagguaagucca

SEQ ID NO: 215531 - RNA, 64 nt, Human
ucuacaguggaauagggggucucccuggggaaugcaggccaaguccuuuuauuuuaacaugaug

SEQ ID NO: 215532 - RNA, 64 nt, Human
ugagauccuaaaccguucuggguuuugaaagccucaggccaaccuucccaacugcugcgugagc

SEQ ID NO: 215533 - RNA, 64 nt, Human
gaagggugugcaggaguucgccagcaaagccaggcaggccaagacuugaguuggcaacucagcu

SEQ ID NO: 215534 - RNA, 64 nt, Human
agcugccccugcccugaauuagggggaaacauuccaggccaacucuagcuccuuucucaagcua

SEQ ID NO: 215535 - RNA, 64 nt, Human
gcagggugaguagcugcuugacaccccagugagucaggccaaaacugagauguguuuaaugaag

SEQ ID NO: 215536 - RNA, 64 nt, Human
cucccaggucagggucccggagccggugcccucacaggccaauagggaagccgagggcuguuuu

SEQ ID NO: 215537 - RNA, 64 nt, Human
cacuuucagcaccagggggucugaaggauggugacugcgccauggccuggaucugcugcagugu

SEQ ID NO: 215538 - RNA, 64 nt, Human
agcggcacccgggggcgcucaccugugaagccaucugcgccaagccuugccugaacggaggcgu

SEQ ID NO: 215539 - RNA, 64 nt, Human
gaacccaggaggcagagguugcagugcaccaagacugcgccauugcacuccagcccgggcaaca

SEQ ID NO: 215540 - RNA, 57 nt, Human
acagugccaaaaaguugugaggucuuccaggccaagguggaugggccccaugccaag

SEQ ID NO: 215541 - RNA, 64 nt, Human
ucuuauucaaagcccucauugacagaggaggaaacaggccaaggcaggacauggcuggaccaug

SEQ ID NO: 215542 - RNA, 64 nt, Human
ugcagcagcauuggaaggcuggggccgggcaggccaggccaagccaagcagggggccacagggu

SEQ ID NO: 215543 - RNA, 64 nt, Human
cuauuuauggaaacuaacuuuuuuguuuuuaauccaggccaacauguauguaaauuaaauuuuu

SEQ ID NO: 215544 - RNA, 64 nt, Human
ugagaugauuagucaagagucaagguugcgaguacaggccaagaccaugggaaaaaaagccaug

SEQ ID NO: 215545 - RNA, 64 nt, Human
uaagcuucuggaaccacguaguuucuacacguggcaggccaagaaugggaggcugacucaaaac

SEQ ID NO: 215546 - RNA, 64 nt, Human
cagcagagggacaugggccauuccaugacgugcccaggccaacgucgcaggacaguugugaaaa

SEQ ID NO: 215547 - RNA, 64 nt, Human
ucccucucuuagggugagaugaagugguuggcaacaggccaaugcuacuuucagaggcguuuga

SEQ ID NO: 215548 - RNA, 64 nt, Human
agucuacuguauauaacaucuaauauauauauuacaggccaaaugaacuaaacauugccuugcu

SEQ ID NO: 215549 - RNA, 64 nt, Human
auuauuuagaacggggcaggcaaacuacauccugcaggccaaaucugucccaccaccuguuuuc

SEQ ID NO: 215550 - RNA, 64 nt, Human
ggggcaaggagagcccuggggucagugacacugucaggccaaccaugcacuccacaaaggggag

SEQ ID NO: 215551 - RNA, 64 nt, Human
uuaggaaauaccucuuaggaagcauuagcggucucaggccaauuacuguggagcagcuuucauu

SEQ ID NO: 215552 - RNA, 64 nt, Human
gcucuucugucuguccugcuucuucaggugagugcaggccaaggcgggggugagauggcugagc

SEQ ID NO: 215553 - RNA, 64 nt, Human
ccuuuuauuccucacucggguuucucuguggcuccaggccaaagugccggugagacccauggcu

SEQ ID NO: 215554 - RNA, 64 nt, Human
uuacagaagcaaauucaccagaagggaaacaucucaggccaacauaggcaaaugaaaagggcua

SEQ ID NO: 215555 - RNA, 64 nt, Human
cagcagcagauguuacaaucugagugaggacaugcaggccaacuuuuacccuccugcauuugcc

SEQ ID NO: 215556 - RNA, 64 nt, Human
ggaaccaccaggaggaagaccugacugaauuccucugcgccaaccacgugcugaagggaaaaga

SEQ ID NO: 215557 - RNA, 64 nt, Human
ucuacccaggggccugaaaagaggggcugcccuccugcgccaaggcagacacaagcugcgggcu

SEQ ID NO: 215558 - RNA, 64 nt, Human
cuucuuccuccagaaagaggagcgugucucugaacugcgccaucaacuccagucucggcagcag

SEQ ID NO: 215559 - RNA, 64 nt, Human
uccuuacauagaccuuaaaaagagcucacccuuccaggccaaugcugaagacacagcuccgcuu

SEQ ID NO: 215560 - RNA, 64 nt, Human
ggugcaggccauuggagagaaggucuccuuggcccaggccaagauugagaagaucaagggcagc

SEQ ID NO: 215561 - RNA, 64 nt, Human
ugggaaggaaaaguagagaaagaaaugccaauuccaggccaaagcguuauuugccaaguuuucu

SEQ ID NO: 215562 - RNA, 64 nt, Human
uuuuugagacagaaucucaucacacucugucacccaggccaaguucaauggugcaaucuggcuc

SEQ ID NO: 215563 - RNA, 64 nt, Human
cugcuucccgagguugugguauugguagggguaacaggccaaucgguguggcuucagcuucuga

SEQ ID NO: 215564 - RNA, 64 nt, Human
cuggggcagaaacacucaaguugauuagaaagaccaggccaaugucaggguaccuggggccaaa

SEQ ID NO: 215565 - RNA, 64 nt, Human
uuagaguggcuuagugugacacacaggcaucucccaggccaagcacacacaggcugcgcccagu

SEQ ID NO: 215566 - RNA, 64 nt, Human
cccaaaacauaucaguuugaauacuugaaucaugcaggccaauauuauaaugugaaaagguauc

SEQ ID NO: 215567 - RNA, 64 nt, Human
ggcuuccuuuguuggagucaacuguugaugcuuccaggccaaacuggcuuccucuccuccucuc

SEQ ID NO: 215568 - RNA, 64 nt, Human
aaggaccuggguggccucgcuuacuguuccagcccaggccaagcacagggucuggcucguggca

SEQ ID NO: 215569 - RNA, 64 nt, Human
gccuuaggaagagccuuccacccaggggcagccccaggccaaaggggaccuggaagggaggugg

SEQ ID NO: 215570 - RNA, 64 nt, Human
agaggucagagguggcuuucugaggccuggaaggcaggccaaccagcaaaauccugauaacaag

SEQ ID NO: 215571 - RNA, 64 nt, Human
gcggcuccugcaaaaggaggugaaaucccugccucaggccaagggaccagguuugcaggagccc

SEQ ID NO: 215572 - RNA, 64 nt, Human
cacagcucccguccuggccacccuggaagcucaucaggccaagacccggacagagcuucagagg

SEQ ID NO: 215573 - RNA, 64 nt, Human
cagccagcugucaaaaguauuucaagauaaaauccaggccaagcaaagccuuuaaguucccguc

SEQ ID NO: 215574 - RNA, 63 nt, Human
guguccugccucggcgcucucgcaaaugaagcugcaggccaagaagccccuugugagucuguu

SEQ ID NO: 215575 - RNA, 64 nt, Human; identical to SEQ ID NO: 64099

SEQ ID NO: 215576 - RNA, 64 nt, Human; identical to SEQ ID NO: 64100

SEQ ID NO: 215577 - RNA, 64 nt, Human; identical to SEQ ID NO: 64101

SEQ ID NO: 215578 - RNA, 64 nt, Human
acugagcggguuuaggggcucgcccacaugcaugcaggccaagacagcaaaugccagccgggca

SEQ ID NO: 215579 - RNA, 64 nt, Human
ccuccuuggugucguccucucccuugcccuggugcaggccaagcauuuuauacauacccucgcu

SEQ ID NO: 215580 - RNA, 64 nt, Human
accucucuccuuugcugaggccuccagcuucaggcaggccaaggccuucuccuccccacccgcc

SEQ ID NO: 215581 - RNA, 64 nt, Human
ggugaugucaaagguauaugauacuugaggaaaucaggccaaguguagcugagcaauuaauaaa

SEQ ID NO: 215582 - RNA, 64 nt, Human
gcucuucagccagggcauuggaggggagcaggcccaggccaaguuugacagcugccuuucugac

SEQ ID NO: 215583 - RNA, 64 nt, Human
aaggacaaaagcaaagaagcuauuuaggaauuuacaggccaaagucuucauuuauugcccaguc

SEQ ID NO: 215584 - RNA, 64 nt, Human
ucagcaauaagucucacccuucuccccuacaggucaggccaagaagggugaaggccucuugcac

SEQ ID NO: 215585 - RNA, 64 nt, Human
gcgcuuugcuuaccaaaagcucagggcccugugccaggccaaagauccccccagacccccauuc

SEQ ID NO: 215586 - RNA, 64 nt, Human
ccugugggggccuugcccauuugaccauguggcccaggccaaagcccaguguuggccuuacgca

SEQ ID NO: 215587 - RNA, 64 nt, Human
ggaacuggcaucccauucagcaucucaggacucacaggccaacauguguuccauggcugggaau

SEQ ID NO: 215588 - RNA, 64 nt, Human
caagcgcauuacccacuuguggccaaucaguggccaggccaaccuuggcuaaauggagcagcga

SEQ ID NO: 215589 - RNA, 64 nt, Human
ggaccaugaugucucagucacuccacgcuccccacaggccaacccuggcacaggucaugucugc

SEQ ID NO: 215590 - RNA, 64 nt, Human
ggcuccuacgggucccuggggcagcuguccccaucaggccaagagcgagcgagaggcgcugccc

SEQ ID NO: 215591 - RNA, 64 nt, Human
ucuacagagcaucuuuuagagcaagagauucauacaggccaagugaugagagggggagucacca

SEQ ID NO: 215592 - RNA, 64 nt, Human
ggacgacaccuggcuugccacccacagugcaccacaggccaaccuacgcccuucaucacuuggu

SEQ ID NO: 215593 - RNA, 64 nt, Human
ccccaucgugggugaggguauccccugugugucccaggccaauaaaaucuaccugccacugccc

SEQ ID NO: 215594 - RNA, 64 nt, Human; identical to SEQ ID NO: 64103

SEQ ID NO: 215595 - RNA, 64 nt, Human; identical to SEQ ID NO: 64108

SEQ ID NO: 215596 - RNA, 64 nt, Human; identical to SEQ ID NO: 64113

SEQ ID NO: 215597 - RNA, 64 nt, Human
cuucuuccgagaugaccgcuacuggcgccucgaccaggccaaacugcaggcaaccaccucgggc

SEQ ID NO: 215598 - RNA, 64 nt, Human
gguggcuuuuuggguccacccagccaggaugcugcaggccaagcugggugugguauuuagggca

SEQ ID NO: 215599 - RNA, 64 nt, Human
aggagaaacgucccuugccacuccccacucucaucaggccaaguggaggacuggccagagggcc

SEQ ID NO: 215600 - RNA, 64 nt, Human
uggacaaggaguuuccagcugcuggcuggagucucaggccaaauugcagaggguccuccagggu

SEQ ID NO: 215601 - RNA, 64 nt, Human
gccauaccauucccauggaguugccaacuauucucaggccaagggccauggggaagauggagca

SEQ ID NO: 215602 - RNA, 64 nt, Human
augcagcccccgccagcugcccucgaaucccguccaggccaauuccagauucuaaacugauuuu

SEQ ID NO: 215603 - RNA, 64 nt, Human
uuguccacauuaaugguuggcaugauugugcuugcaggccaagaaaugaucauaccccuugcca

SEQ ID NO: 215604 - RNA, 64 nt, Human
agaaugcuaauccuccaaguggacaagauguccccaggccaaaaagcccuguuuuccuuucugu

SEQ ID NO: 215605 - RNA, 64 nt, Human
aaaauuuauuaaacauuauuaaacuugaucaggucaggccaaauaaaguuuuauuggaacacag

SEQ ID NO: 215606 - RNA, 64 nt, Human
gcacacagcccuuccacaguuggcacugcaggugcaggccaacccuuuaaagaauaaacaagga

SEQ ID NO: 215607 - RNA, 64 nt, Human
uuuuuccuaggcuuggcacugccuuuuccuuucucaggccaauggcaacugccauuugaguccg

SEQ ID NO: 215608 - RNA, 64 nt, Human
acaguggcucacgccuguaaucccagcacuuuggcaggccaagguggaaggaucacuuagagcu

SEQ ID NO: 215609 - RNA, 64 nt, Human
uaguguacuguccuuuuauaugaaauuuccagaacaggccaaucugaagagauguauaguggau

SEQ ID NO: 215610 - RNA, 64 nt, Human
cccucccugcugaauggaggagccgggggucccccaggccaacuggaaaaucucccaggcuagg

SEQ ID NO: 215611 - RNA, 64 nt, Human
uauuauccaggagaacuuccccaaucuagcaaggcaggccaacauucagauucaggaaauacag

SEQ ID NO: 215612 - RNA, 64 nt, Human
ugcuggcugccccagcaggcacccaccucccugccaggccaagccagguguccucuugcagcuu

SEQ ID NO: 215613 - RNA, 64 nt, Human; identical to SEQ ID NO: 64117

SEQ ID NO: 215614 - RNA, 64 nt, Human; identical to SEQ ID NO: 64122

SEQ ID NO: 215615 - RNA, 64 nt, Human; identical to SEQ ID NO: 64127

SEQ ID NO: 215616 - RNA, 64 nt, Human
uuugcucugaggucccuucaaggccuccccaauccaggccaaagccccaugugccuuguccagg

SEQ ID NO: 215617 - RNA, 64 nt, Human
gccugccgccugcucugaggcccgauccagugggcaggccaaggccugcugggcccccgcggac

SEQ ID NO: 215618 - RNA, 64 nt, Human
ucuguaaaucaucacuucagcuccugauuggucccaggccaagcugaauagcccuuaggaauaa

SEQ ID NO: 215619 - RNA, 64 nt, Human
aggacaggggcaacugguuuggcaaccccacauccaggccaauaaagaugugugagcugggugu

SEQ ID NO: 215620 - RNA, 64 nt, Human
ggggcagucuguaaaucagucaccuguguugcugcaggccaagguagaaacgcccuccgugugu

SEQ ID NO: 215621 - RNA, 64 nt, Human
cagcacggacuuugaccgcacgcuggagagugcccaggccaaccuugccgggcuguuucccgag

SEQ ID NO: 215622 - RNA, 64 nt, Human
cugugauuuucucgcugaaaccauguuucucagacaggccaaggccaccugacuccuaucacga

SEQ ID NO: 215623 - RNA, 64 nt, Human
cucaccccucucccacccuccccagggguaaccccaggccaagcacagauagcucagcugcgac

SEQ ID NO: 215624 - RNA, 64 nt, Human
gcggaacaccugaggucagguguucgagaccagccaggccaacauggugaaaccccgucucuac

SEQ ID NO: 215625 - RNA, 64 nt, Human
ugggggacuacuuguuucccaccccagguuccuccaggccaagucauggggugaugaggaguug

SEQ ID NO: 215626 - RNA, 64 nt, Human
uaguguacuguccuuuuauacgaaauuuccagaacaggccaaucugaagagaugcauagcggau

SEQ ID NO: 215627 - RNA, 64 nt, Human
gcugugagcuugaaucgggagugggguggaggcacaggccaaccugcgcucuccccuuagggga

SEQ ID NO: 215628 - RNA, 64 nt, Human
gaacccuuuuucgacugccccaacucuuggacaccaggccaacuagaacacccaacaccaaacu

SEQ ID NO: 215629 - RNA, 64 nt, Human
ccaccccuccaccacauggggccccaaagcacugcaggccaagcagggcaaccccacacccuug

SEQ ID NO: 215630 - RNA, 64 nt, Human
cugcagauacacgaacuggauccaaaaaaccauucaggccaagugacccugacaugugacaucu

SEQ ID NO: 215631 - RNA, 64 nt, Human
auuuauaauaauuauaugugauagagauuuuccgcaggccaaagucucacuaggcaucaaaaac

SEQ ID NO: 215632 - RNA, 64 nt, Human
cacagcuguauagcugcuuccaguguagacggagcccuggcaugucaacagcguuccuagagaa

SEQ ID NO: 215633 - RNA, 64 nt, Human
uuugccaggggcacgaugugacauaucugcagucccagcacagugggacaaaaagaauuuagac

SEQ ID NO: 215634 - RNA, 64 nt, Human
uuuguuaauaauaagauaaugaugaguaacuuaaccagcacauuucuccuguuuacacucgggg

SEQ ID NO: 215635 - RNA, 64 nt, Human
aagaaauggucuaucaacugaacaugaaauggagcaggccaagaccuuaggacauugggauuuu

SEQ ID NO: 215636 - RNA, 64 nt, Human
caggauggcgcguacugaagccacgauguucauccaggccaaagcaggguguccugggauaggu

SEQ ID NO: 215637 - RNA, 64 nt, Human
cggggaccccucaguguagugacuaagccauccacaggccaacucggccaagggcaacuuuagc

SEQ ID NO: 215638 - RNA, 64 nt, Human
acucucuuccuuguucugaaucauuucuucuucucaggccaaaguagccaugguaaggaggcuu

SEQ ID NO: 215639 - RNA, 64 nt, Human
accccagccuccccuccucccucccauccucacccaggccaaggcccaggggcucugccaggac

SEQ ID NO: 215640 - RNA, 64 nt, Human
uggaauacaugaaauauagaucaguuauaaguagcaggccaagucaggcccuuauuuucaagaa

SEQ ID NO: 215641 - RNA, 64 nt, Human
uuugguggcucucaacuggaauugguaguguuuccaggccaagggucgacugcagguuguuuga

SEQ ID NO: 215642 - RNA, 64 nt, Human
ucuugccucuaguucauggagaugugucucuguucaggccaagauacagccagccaggccuguc

SEQ ID NO: 215643 - RNA, 64 nt, Human
gugcuggggacaagccugugccugccaaagcucccaggccaaguuugggggcugguguuugggg

SEQ ID NO: 215644 - RNA, 64 nt, Human
gggcacagguuggggcucugcaggaugaggaagacaggccaaucccuucccucccagaagcugg

SEQ ID NO: 215645 - RNA, 64 nt, Human
uguggcuugugcccaugcaccugccagggcccagcaggccaacccaucaucuagaguaguggcc

SEQ ID NO: 215646 - RNA, 64 nt, Human
accaccauggacaacaagccuuggguaaccggaccaggccaagggucuacaauucuccaacgaa

SEQ ID NO: 215647 - RNA, 64 nt, Human
uuuucauucuggaugggcuuggccaaaacaggcucaggccaaagaccucccaagcuguauguac

SEQ ID NO: 215648 - RNA, 64 nt, Human
cgccacaugugcccccgagggucccacgagcugccaggccaaggcugccugccgugcaccacca

SEQ ID NO: 215649 - RNA, 64 nt, Human
cuaugcgcaugccuauggcagugggugcaccugccaggccaagggucagggugcccagagccuc

SEQ ID NO: 215650 - RNA, 64 nt, Human
ggcugacaauccuggaaaucuguucuccagaauccaggccaaaaaguucacagucaaaugggga

SEQ ID NO: 215651 - RNA, 64 nt, Human
uccugccucuguucccuuuucucuccuugaaaguccagcacaccauucuuguccuuccccaguu

SEQ ID NO: 215652 - RNA, 64 nt, Human
gaccuaccccagccaggcuccuaccugucugcugccagcacaguaggucccggccagcucugga

SEQ ID NO: 215653 - RNA, 64 nt, Human
cuaccuacuuucaugaguaaccucucacagcuacccagcacaugccacaauccuaugcucuugc

SEQ ID NO: 215654 - RNA, 64 nt, Human
acagcccugaugggagcagcuuggcugugagcaccaggccaagacuccugagaacaggcagccc

SEQ ID NO: 215655 - RNA, 64 nt, Human
gacaccacugcccacaccuccaucccguccugcgcaggccaacacucacugacaucgaaggcug

SEQ ID NO: 215656 - RNA, 64 nt, Human
ugaggcuucugugcuccuggcuucuuacgccguccaggccaaguauggugacuacgaccccagu

SEQ ID NO: 215657 - RNA, 64 nt, Human
gguuaucuguuggccugaagagugaaaccuguaccaggccaaaggugagggcgugagugagggc

SEQ ID NO: 215658 - RNA, 64 nt, Human
cacagugucuccacgugccuuaccccuucuccuucaggccaaguuucgcgggguguuuuauuaa

SEQ ID NO: 215659 - RNA, 64 nt, Human
gaagugccaagucacuggccguuaacucagcacccaggccaagcccccgccucccacuugaagc

SEQ ID NO: 215660 - RNA, 64 nt, Human
cggccccagcugaccucguccauucagccccugccaggccaagcccagccacugcccucccggg

SEQ ID NO: 215661 - RNA, 64 nt, Human
cccaaaacccacuaacaauuuuagcaaaacaguccaggccaaagaggaagcauuucauguucaa

SEQ ID NO: 215662 - RNA, 64 nt, Human
ccaggaaagggcccauguggcagaaggcaaaguacaggccaagaauugggggugggggagaugg

SEQ ID NO: 215663 - RNA, 64 nt, Human
ccuguguagccuuuggccacgcacugacacugcccaggccaagcaaaagcagagugugguuaag

SEQ ID NO: 215664 - RNA, 64 nt, Human
gaagggccaaggucugagcacuggaguggcucgccaggccaaaucacccuuagaaggcugcaga

SEQ ID NO: 215665 - RNA, 64 nt, Human
augaccagugaugaggggaaauggggggagggggcaggccaaugaggucugcauggccagggga

SEQ ID NO: 215666 - RNA, 64 nt, Human
uuuagaucagguacccagugucugucucccacgacaggccaagggaugugauaguguuguuggg

SEQ ID NO: 215667 - RNA, 64 nt, Human
cugaauuccuuaccugcuauucuuguacuugucucaggccaaaucuaugcugugguucuuauga

SEQ ID NO: 215668 - RNA, 64 nt, Human
gaaguggcaaaggccauggccauaucuguugucccaggccaaagacuaacaacugccuugggaa

SEQ ID NO: 215669 - RNA, 64 nt, Human
ugcuaaaaaucaggcuaaaaaucaggccaaaaaucaggccaaaugacuuggcaaauaauugaca

SEQ ID NO: 215670 - RNA, 64 nt, Human
uugggcagccggaacccgucacuauucuagacuucccuggcauucgaggagcccuuugaacuuu

SEQ ID NO: 215671 - RNA, 64 nt, Human
gcagccgagccccaggagcccgucaggccacagccccuggcacugcagguggccucccuccaga

SEQ ID NO: 215672 - RNA, 64 nt, Human; identical to SEQ ID NO: 214802

SEQ ID NO: 215673 - RNA, 64 nt, Human
cgggaagaguccugcuaaaaaucaggcuaaaaaucaggccaaaaaucaggccaaaugacuuggc

SEQ ID NO: 215674 - RNA, 64 nt, Human
ucuacaauaguucaggucagacaucuaagauccccaggccaaaccaugccacacacgugucugu

SEQ ID NO: 215675 - RNA, 56 nt, Human
uucugcaucucuacucuuaagagacucaggccaagaaacgucuucuaaacuucccc

SEQ ID NO: 215676 - RNA, 64 nt, Human; identical to SEQ ID NO: 214599

SEQ ID NO: 215677 - RNA, 64 nt, Human; identical to SEQ ID NO: 214600

SEQ ID NO: 215678 - RNA, 64 nt, Human; identical to SEQ ID NO: 214601

SEQ ID NO: 215679 - RNA, 64 nt, Human; identical to SEQ ID NO: 214602

SEQ ID NO: 215680 - RNA, 64 nt, Human; identical to SEQ ID NO: 214603

SEQ ID NO: 215681 - RNA, 64 nt, Human; identical to SEQ ID NO: 214604

SEQ ID NO: 215682 - RNA, 64 nt, Human; identical to SEQ ID NO: 214605

SEQ ID NO: 215683 - RNA, 64 nt, Human
ugaagcaaucauuuccccucccgucuuccuccuccccuggcaacugcugaucgacuuugugucu

SEQ ID NO: 215684 - RNA, 64 nt, Human
ugucauggcagacagccgccuugggugggcaccacccuggcaguuccagccuguaggggaguga

SEQ ID NO: 215685 - RNA, 53 nt, Human; identical to SEQ ID NO: 64126

SEQ ID NO: 215686 - RNA, 64 nt, Human; identical to SEQ ID NO: 214606

SEQ ID NO: 215687 - RNA, 64 nt, Human; identical to SEQ ID NO: 214607

SEQ ID NO: 215688 - RNA, 64 nt, Human; identical to SEQ ID NO: 214608

SEQ ID NO: 215689 - RNA, 64 nt, Human; identical to SEQ ID NO: 214609

SEQ ID NO: 215690 - RNA, 64 nt, Human; identical to SEQ ID NO: 214610

SEQ ID NO: 215691 - RNA, 64 nt, Human; identical to SEQ ID NO: 214611

SEQ ID NO: 215692 - RNA, 64 nt, Human; identical to SEQ ID NO: 214615

SEQ ID NO: 215693 - RNA, 64 nt, Human; identical to SEQ ID NO: 214616

SEQ ID NO: 215694 - RNA, 64 nt, Human; identical to SEQ ID NO: 214617

SEQ ID NO: 215695 - RNA, 64 nt, Human; identical to SEQ ID NO: 214618

SEQ ID NO: 215696 - RNA, 64 nt, Human; identical to SEQ ID NO: 214619

SEQ ID NO: 215697 - RNA, 64 nt, Human; identical to SEQ ID NO: 214620

SEQ ID NO: 215698 - RNA, 64 nt, Human; identical to SEQ ID NO: 214621

SEQ ID NO: 215699 - RNA, 64 nt, Human; identical to SEQ ID NO: 214622

SEQ ID NO: 215700 - RNA, 64 nt, Human; identical to SEQ ID NO: 214623

SEQ ID NO: 215701 - RNA, 64 nt, Human; identical to SEQ ID NO: 214624

SEQ ID NO: 215702 - RNA, 64 nt, Human; identical to SEQ ID NO: 64121

SEQ ID NO: 215703 - RNA, 64 nt, Human; identical to SEQ ID NO: 64128

SEQ ID NO: 215704 - RNA, 64 nt, Human; identical to SEQ ID NO: 64129

SEQ ID NO: 215705 - RNA, 64 nt, Human; identical to SEQ ID NO: 214625

SEQ ID NO: 215706 - RNA, 64 nt, Human; identical to SEQ ID NO: 214626

SEQ ID NO: 215707 - RNA, 64 nt, Human; identical to SEQ ID NO: 214627

SEQ ID NO: 215708 - RNA, 64 nt, Human; identical to SEQ ID NO: 214628

SEQ ID NO: 215709 - RNA, 55 nt, Human; identical to SEQ ID NO: 214629

SEQ ID NO: 215710 - RNA, 64 nt, Human; identical to SEQ ID NO: 214630

SEQ ID NO: 215711 - RNA, 64 nt, Human; identical to SEQ ID NO: 214634

SEQ ID NO: 215712 - RNA, 64 nt, Human; identical to SEQ ID NO: 214635

SEQ ID NO: 215713 - RNA, 64 nt, Human; identical to SEQ ID NO: 214636

SEQ ID NO: 215714 - RNA, 64 nt, Human; identical to SEQ ID NO: 214637

SEQ ID NO: 215715 - RNA, 64 nt, Human; identical to SEQ ID NO: 214638

SEQ ID NO: 215716 - RNA, 64 nt, Human; identical to SEQ ID NO: 214639

SEQ ID NO: 215717 - RNA, 64 nt, Human; identical to SEQ ID NO: 214640

SEQ ID NO: 215718 - RNA, 64 nt, Human; identical to SEQ ID NO: 214641

SEQ ID NO: 215719 - RNA, 64 nt, Human; identical to SEQ ID NO: 214642

SEQ ID NO: 215720 - RNA, 64 nt, Human; identical to SEQ ID NO: 214643

SEQ ID NO: 215721 - RNA, 64 nt, Human; identical to SEQ ID NO: 214709

SEQ ID NO: 215722 - RNA, 64 nt, Human
acuggcucugggacuugcagaaggccuggugcugcccuggcaucagccucuuccagucacaucu

SEQ ID NO: 215723 - RNA, 64 nt, Human
gucagaacagcagccucuacacauguuguccugccccuggcaauaaaggcccauuucugcaccc

SEQ ID NO: 215724 - RNA, 64 nt, Human; identical to SEQ ID NO: 214644

SEQ ID NO: 215725 - RNA, 64 nt, Human; identical to SEQ ID NO: 214645

SEQ ID NO: 215726 - RNA, 64 nt, Human; identical to SEQ ID NO: 214646

SEQ ID NO: 215727 - RNA, 64 nt, Human; identical to SEQ ID NO: 214647

SEQ ID NO: 215728 - RNA, 64 nt, Human; identical to SEQ ID NO: 214648

SEQ ID NO: 215729 - RNA, 64 nt, Human; identical to SEQ ID NO: 214649

SEQ ID NO: 215730 - RNA, 64 nt, Human; identical to SEQ ID NO: 214653

SEQ ID NO: 215731 - RNA, 64 nt, Human; identical to SEQ ID NO: 214654

SEQ ID NO: 215732 - RNA, 64 nt, Human; identical to SEQ ID NO: 214655

SEQ ID NO: 215733 - RNA, 64 nt, Human; identical to SEQ ID NO: 214656

SEQ ID NO: 215734 - RNA, 64 nt, Human; identical to SEQ ID NO: 214657

SEQ ID NO: 215735 - RNA, 64 nt, Human; identical to SEQ ID NO: 214658

SEQ ID NO: 215736 - RNA, 64 nt, Human; identical to SEQ ID NO: 214659

SEQ ID NO: 215737 - RNA, 64 nt, Human; identical to SEQ ID NO: 214660

SEQ ID NO: 215738 - RNA, 64 nt, Human; identical to SEQ ID NO: 214661

SEQ ID NO: 215739 - RNA, 64 nt, Human; identical to SEQ ID NO: 214662

SEQ ID NO: 215740 - RNA, 64 nt, Human
ccuccccccauggcccgcugcacgccucugggcccccuggcacagccaacccccccagugcaaa

SEQ ID NO: 215741 - RNA, 64 nt, Human
uaaaaaggauuacaugagaugccuuaggcuaaggcccuggcacacaggaacacaugugcuacaa

SEQ ID NO: 215742 - RNA, 64 nt, Human
uauccacguggcuguggcuguggcuguggcugggcccuggcagguggaaaaccaucucccagaa

SEQ ID NO: 215743 - RNA, 64 nt, Human; identical to SEQ ID NO: 214663

SEQ ID NO: 215744 - RNA, 64 nt, Human; identical to SEQ ID NO: 214664

SEQ ID NO: 215745 - RNA, 64 nt, Human; identical to SEQ ID NO: 214665

SEQ ID NO: 215746 - RNA, 64 nt, Human; identical to SEQ ID NO: 214666

SEQ ID NO: 215747 - RNA, 64 nt, Human; identical to SEQ ID NO: 214667

SEQ ID NO: 215748 - RNA, 64 nt, Human; identical to SEQ ID NO: 214668

SEQ ID NO: 215749 - RNA, 64 nt, Human; identical to SEQ ID NO: 214672

SEQ ID NO: 215750 - RNA, 64 nt, Human; identical to SEQ ID NO: 214673

SEQ ID NO: 215751 - RNA, 64 nt, Human; identical to SEQ ID NO: 214674

SEQ ID NO: 215752 - RNA, 64 nt, Human; identical to SEQ ID NO: 214675

SEQ ID NO: 215753 - RNA, 64 nt, Human; identical to SEQ ID NO: 214676

SEQ ID NO: 215754 - RNA, 64 nt, Human; identical to SEQ ID NO: 214677

SEQ ID NO: 215755 - RNA, 64 nt, Human; identical to SEQ ID NO: 214678

SEQ ID NO: 215756 - RNA, 64 nt, Human; identical to SEQ ID NO: 214679

SEQ ID NO: 215757 - RNA, 64 nt, Human; identical to SEQ ID NO: 214680

SEQ ID NO: 215758 - RNA, 64 nt, Human; identical to SEQ ID NO: 214681

SEQ ID NO: 215759 - RNA, 64 nt, Human
ucuuaacguagacugcagaaagauggcaugcggccccuggcauuucgccaaggguuuuauagca

SEQ ID NO: 215760 - RNA, 64 nt, Human
gaaaacauugaaaauguguuuagacaacgucauccccuggcaggcuaaagugcuguauccuuua

SEQ ID NO: 215761 - RNA, 64 nt, Human
augggugauaaagaauccaguuccucaaaaccuucccuggcaggcugggucccucuccugcugg

SEQ ID NO: 215762 - RNA, 64 nt, Human; identical to SEQ ID NO: 214682

SEQ ID NO: 215763 - RNA, 64 nt, Human; identical to SEQ ID NO: 214683

SEQ ID NO: 215764 - RNA, 64 nt, Human; identical to SEQ ID NO: 214684

SEQ ID NO: 215765 - RNA, 64 nt, Human; identical to SEQ ID NO: 214685

SEQ ID NO: 215766 - RNA, 64 nt, Human; identical to SEQ ID NO: 214686

SEQ ID NO: 215767 - RNA, 64 nt, Human; identical to SEQ ID NO: 214687

SEQ ID NO: 215768 - RNA, 64 nt, Human; identical to SEQ ID NO: 214691

SEQ ID NO: 215769 - RNA, 64 nt, Human; identical to SEQ ID NO: 214692

SEQ ID NO: 215770 - RNA, 59 nt, Human; identical to SEQ ID NO: 214693

SEQ ID NO: 215771 - RNA, 64 nt, Human; identical to SEQ ID NO: 214694

SEQ ID NO: 215772 - RNA, 64 nt, Human; identical to SEQ ID NO: 214695

SEQ ID NO: 215773 - RNA, 64 nt, Human; identical to SEQ ID NO: 214696

SEQ ID NO: 215774 - RNA, 64 nt, Human; identical to SEQ ID NO: 214697

SEQ ID NO: 215775 - RNA, 61 nt, Human; identical to SEQ ID NO: 214698

SEQ ID NO: 215776 - RNA, 64 nt, Human; identical to SEQ ID NO: 214699

SEQ ID NO: 215777 - RNA, 64 nt, Human; identical to SEQ ID NO: 214700

SEQ ID NO: 215778 - RNA, 64 nt, Human
ugccagguucuucuugagcuuugggccucaguugcccuggcagaaaaauggauucaacuuggcc

SEQ ID NO: 215779 - RNA, 64 nt, Human
acagcuggggaggaagcggggggacgccugucaccccuggcagguggugaguucaggugggggc

SEQ ID NO: 215780 - RNA, 64 nt, Human; identical to SEQ ID NO: 214728

SEQ ID NO: 215781 - RNA, 64 nt, Human; identical to SEQ ID NO: 214701

SEQ ID NO: 215782 - RNA, 64 nt, Human; identical to SEQ ID NO: 214702

SEQ ID NO: 215783 - RNA, 64 nt, Human; identical to SEQ ID NO: 214703

SEQ ID NO: 215784 - RNA, 64 nt, Human; identical to SEQ ID NO: 214704

SEQ ID NO: 215785 - RNA, 64 nt, Human; identical to SEQ ID NO: 214705

SEQ ID NO: 215786 - RNA, 64 nt, Human; identical to SEQ ID NO: 214706

SEQ ID NO: 215787 - RNA, 64 nt, Human; identical to SEQ ID NO: 214710

SEQ ID NO: 215788 - RNA, 64 nt, Human; identical to SEQ ID NO: 214711

SEQ ID NO: 215789 - RNA, 64 nt, Human; identical to SEQ ID NO: 214712

SEQ ID NO: 215790 - RNA, 64 nt, Human; identical to SEQ ID NO: 214713

SEQ ID NO: 215791 - RNA, 64 nt, Human; identical to SEQ ID NO: 214714

SEQ ID NO: 215792 - RNA, 64 nt, Human; identical to SEQ ID NO: 214715

SEQ ID NO: 215793 - RNA, 64 nt, Human; identical to SEQ ID NO: 214716

SEQ ID NO: 215794 - RNA, 64 nt, Human; identical to SEQ ID NO: 214717

SEQ ID NO: 215795 - RNA, 64 nt, Human; identical to SEQ ID NO: 214718

SEQ ID NO: 215796 - RNA, 64 nt, Human; identical to SEQ ID NO: 214719

SEQ ID NO: 215797 - RNA, 64 nt, Human
ucaacguuauccagugugaaaaucagugaguccucccuggcauccucgugaaagugcacacacu

SEQ ID NO: 215798 - RNA, 64 nt, Human
cucaugacagaaagucagcuuuuacuuuucuuuccccuggcaauucguuuuuggugcacucaug

SEQ ID NO: 215799 - RNA, 64 nt, Human; identical to SEQ ID NO: 214745

SEQ ID NO: 215800 - RNA, 64 nt, Human; identical to SEQ ID NO: 214720

SEQ ID NO: 215801 - RNA, 64 nt, Human; identical to SEQ ID NO: 214721

SEQ ID NO: 215802 - RNA, 64 nt, Human; identical to SEQ ID NO: 214722

SEQ ID NO: 215803 - RNA, 64 nt, Human; identical to SEQ ID NO: 214723

SEQ ID NO: 215804 - RNA, 64 nt, Human; identical to SEQ ID NO: 214724

SEQ ID NO: 215805 - RNA, 64 nt, Human; identical to SEQ ID NO: 214725

SEQ ID NO: 215806 - RNA, 64 nt, Human; identical to SEQ ID NO: 214729

SEQ ID NO: 215807 - RNA, 64 nt, Human; identical to SEQ ID NO: 214730

SEQ ID NO: 215808 - RNA, 64 nt, Human; identical to SEQ ID NO: 214731

SEQ ID NO: 215809 - RNA, 64 nt, Human; identical to SEQ ID NO: 214732

SEQ ID NO: 215810 - RNA, 64 nt, Human; identical to SEQ ID NO: 214733

SEQ ID NO: 215811 - RNA, 64 nt, Human; identical to SEQ ID NO: 214734

SEQ ID NO: 215812 - RNA, 64 nt, Human; identical to SEQ ID NO: 214735

SEQ ID NO: 215813 - RNA, 64 nt, Human; identical to SEQ ID NO: 214736

SEQ ID NO: 215814 - RNA, 64 nt, Human; identical to SEQ ID NO: 214737

SEQ ID NO: 215815 - RNA, 64 nt, Human; identical to SEQ ID NO: 214738

SEQ ID NO: 215816 - RNA, 64 nt, Human
ugcugugugaugggcaggcuuugccccagcccaccccuggcaaggugcacuuguuuucugguuu

SEQ ID NO: 215817 - RNA, 64 nt, Human; identical to SEQ ID NO: 214803

SEQ ID NO: 215818 - RNA, 64 nt, Human
caccucugauaacuggaaaaaugggucucuugggcccuggcacugguucuccauggccucagcc

SEQ ID NO: 215819 - RNA, 64 nt, Human; identical to SEQ ID NO: 214739

SEQ ID NO: 215820 - RNA, 64 nt, Human; identical to SEQ ID NO: 214740

SEQ ID NO: 215821 - RNA, 64 nt, Human; identical to SEQ ID NO: 214741

SEQ ID NO: 215822 - RNA, 64 nt, Human; identical to SEQ ID NO: 214742

SEQ ID NO: 215823 - RNA, 64 nt, Human; identical to SEQ ID NO: 214743

SEQ ID NO: 215824 - RNA, 64 nt, Human; identical to SEQ ID NO: 214744

SEQ ID NO: 215825 - RNA, 64 nt, Human; identical to SEQ ID NO: 214748

SEQ ID NO: 215826 - RNA, 64 nt, Human; identical to SEQ ID NO: 214749

SEQ ID NO: 215827 - RNA, 64 nt, Human; identical to SEQ ID NO: 214750

SEQ ID NO: 215828 - RNA, 64 nt, Human; identical to SEQ ID NO: 214751

SEQ ID NO: 215829 - RNA, 64 nt, Human; identical to SEQ ID NO: 214752

SEQ ID NO: 215830 - RNA, 64 nt, Human; identical to SEQ ID NO: 214753

SEQ ID NO: 215831 - RNA, 64 nt, Human; identical to SEQ ID NO: 214754

SEQ ID NO: 215832 - RNA, 64 nt, Human; identical to SEQ ID NO: 214755

SEQ ID NO: 215833 - RNA, 64 nt, Human; identical to SEQ ID NO: 214756

SEQ ID NO: 215834 - RNA, 64 nt, Human; identical to SEQ ID NO: 214757

SEQ ID NO: 215835 - RNA, 64 nt, Human
ggugccaggccuuagagcagacaagggcucucagcccuggcaugcccccuaaagggaccaaggu

SEQ ID NO: 215836 - RNA, 64 nt, Human
accugugugccggcagccccucagggacucucagcccuggcacuggcaccccaggguuggcccc

SEQ ID NO: 215837 - RNA, 64 nt, Human; identical to SEQ ID NO: 214746

SEQ ID NO: 215838 - RNA, 64 nt, Human; identical to SEQ ID NO: 214758

SEQ ID NO: 215839 - RNA, 64 nt, Human; identical to SEQ ID NO: 214759

SEQ ID NO: 215840 - RNA, 64 nt, Human; identical to SEQ ID NO: 214760

SEQ ID NO: 215841 - RNA, 64 nt, Human; identical to SEQ ID NO: 214761

SEQ ID NO: 215842 - RNA, 64 nt, Human; identical to SEQ ID NO: 214762

SEQ ID NO: 215843 - RNA, 64 nt, Human; identical to SEQ ID NO: 214763

SEQ ID NO: 215844 - RNA, 64 nt, Human; identical to SEQ ID NO: 214767

SEQ ID NO: 215845 - RNA, 64 nt, Human; identical to SEQ ID NO: 214768

SEQ ID NO: 215846 - RNA, 64 nt, Human; identical to SEQ ID NO: 214769

SEQ ID NO: 215847 - RNA, 64 nt, Human; identical to SEQ ID NO: 214770

SEQ ID NO: 215848 - RNA, 64 nt, Human; identical to SEQ ID NO: 214771

SEQ ID NO: 215849 - RNA, 64 nt, Human; identical to SEQ ID NO: 214772

SEQ ID NO: 215850 - RNA, 64 nt, Human; identical to SEQ ID NO: 214773

SEQ ID NO: 215851 - RNA, 64 nt, Human; identical to SEQ ID NO: 214774

SEQ ID NO: 215852 - RNA, 64 nt, Human; identical to SEQ ID NO: 214775

SEQ ID NO: 215853 - RNA, 64 nt, Human; identical to SEQ ID NO: 214776

SEQ ID NO: 215854 - RNA, 64 nt, Human; identical to SEQ ID NO: 214747

SEQ ID NO: 215855 - RNA, 64 nt, Human
ggaggaaucuguuacucgaauccacccaggaacucccuggcaguggauugugggaggcucuugc

SEQ ID NO: 215856 - RNA, 64 nt, Human
gguggccucaacagaggccaaggaguucugugagcccuggcagcaaaaaacaccuuggggggug

SEQ ID NO: 215857 - RNA, 64 nt, Human; identical to SEQ ID NO: 214777

SEQ ID NO: 215858 - RNA, 64 nt, Human; identical to SEQ ID NO: 214778

SEQ ID NO: 215859 - RNA, 64 nt, Human; identical to SEQ ID NO: 214779

SEQ ID NO: 215860 - RNA, 64 nt, Human; identical to SEQ ID NO: 214780

SEQ ID NO: 215861 - RNA, 64 nt, Human; identical to SEQ ID NO: 214781

SEQ ID NO: 215862 - RNA, 64 nt, Human; identical to SEQ ID NO: 214782

SEQ ID NO: 215863 - RNA, 64 nt, Human; identical to SEQ ID NO: 214786

SEQ ID NO: 215864 - RNA, 64 nt, Human; identical to SEQ ID NO: 214787

SEQ ID NO: 215865 - RNA, 64 nt, Human; identical to SEQ ID NO: 214788

SEQ ID NO: 215866 - RNA, 64 nt, Human; identical to SEQ ID NO: 214789

SEQ ID NO: 215867 - RNA, 64 nt, Human; identical to SEQ ID NO: 214790

SEQ ID NO: 215868 - RNA, 64 nt, Human; identical to SEQ ID NO: 214791

SEQ ID NO: 215869 - RNA, 64 nt, Human; identical to SEQ ID NO: 214792

SEQ ID NO: 215870 - RNA, 64 nt, Human; identical to SEQ ID NO: 214793

SEQ ID NO: 215871 - RNA, 64 nt, Human; identical to SEQ ID NO: 214794

SEQ ID NO: 215872 - RNA, 64 nt, Human; identical to SEQ ID NO: 214795

SEQ ID NO: 215873 - RNA, 64 nt, Human
cugccgaguuucugccuggagcagggccucaaggcccuggcacacagaagaugcguaucaguau

SEQ ID NO: 215874 - RNA, 64 nt, Human
acgagagaccuucuguccccucccagagggggaacccuggcacuggcccagcagccucuucucu

SEQ ID NO: 215875 - RNA, 64 nt, Human
cccuuuccagcuccuccgaugaaggcagccccugcccuggcaugggggggccacuagaugcacc

SEQ ID NO: 215876 - RNA, 64 nt, Human; identical to SEQ ID NO: 214796

SEQ ID NO: 215877 - RNA, 64 nt, Human; identical to SEQ ID NO: 214797

SEQ ID NO: 215878 - RNA, 64 nt, Human; identical to SEQ ID NO: 214798

SEQ ID NO: 215879 - RNA, 64 nt, Human; identical to SEQ ID NO: 214799

SEQ ID NO: 215880 - RNA, 64 nt, Human; identical to SEQ ID NO: 214800

SEQ ID NO: 215881 - RNA, 64 nt, Human; identical to SEQ ID NO: 214801

SEQ ID NO: 215882 - RNA, 64 nt, Human; identical to SEQ ID NO: 214805

SEQ ID NO: 215883 - RNA, 64 nt, Human; identical to SEQ ID NO: 214806

SEQ ID NO: 215884 - RNA, 64 nt, Human; identical to SEQ ID NO: 214807

SEQ ID NO: 215885 - RNA, 64 nt, Human; identical to SEQ ID NO: 214808

SEQ ID NO: 215886 - RNA, 64 nt, Human; identical to SEQ ID NO: 214809

SEQ ID NO: 215887 - RNA, 64 nt, Human; identical to SEQ ID NO: 214810

SEQ ID NO: 215888 - RNA, 64 nt, Human; identical to SEQ ID NO: 214811

SEQ ID NO: 215889 - RNA, 64 nt, Human; identical to SEQ ID NO: 214812

SEQ ID NO: 215890 - RNA, 64 nt, Human; identical to SEQ ID NO: 214813

SEQ ID NO: 215891 - RNA, 64 nt, Human; identical to SEQ ID NO: 214814

SEQ ID NO: 215892 - RNA, 64 nt, Human
cucccuccucggaauggucagcgaccucugcaggcccuggcauuuggaagagcuggguggcccu

SEQ ID NO: 215893 - RNA, 64 nt, Human
aggaggggccguggggucccuaagugauucuucucccuggcaaggcucuuccuuuucagggaua

SEQ ID NO: 215894 - RNA, 64 nt, Human
gaucuuuacccuaaaauaguucuguugaauuucacccuggcaauguaaauugauagcuuaucuu

SEQ ID NO: 215895 - RNA, 64 nt, Human; identical to SEQ ID NO: 214815

SEQ ID NO: 215896 - RNA, 64 nt, Human; identical to SEQ ID NO: 214816

SEQ ID NO: 215897 - RNA, 64 nt, Human; identical to SEQ ID NO: 214817

SEQ ID NO: 215898 - RNA, 64 nt, Human; identical to SEQ ID NO: 214818

SEQ ID NO: 215899 - RNA, 64 nt, Human; identical to SEQ ID NO: 214819

SEQ ID NO: 215900 - RNA, 64 nt, Human; identical to SEQ ID NO: 214820

SEQ ID NO: 215901 - RNA, 64 nt, Human; identical to SEQ ID NO: 214824

SEQ ID NO: 215902 - RNA, 64 nt, Human; identical to SEQ ID NO: 214825

SEQ ID NO: 215903 - RNA, 64 nt, Human; identical to SEQ ID NO: 214826

SEQ ID NO: 215904 - RNA, 64 nt, Human; identical to SEQ ID NO: 214827

SEQ ID NO: 215905 - RNA, 64 nt, Human; identical to SEQ ID NO: 214828

SEQ ID NO: 215906 - RNA, 64 nt, Human; identical to SEQ ID NO: 214829

SEQ ID NO: 215907 - RNA, 64 nt, Human; identical to SEQ ID NO: 214830

SEQ ID NO: 215908 - RNA, 64 nt, Human; identical to SEQ ID NO: 214831

SEQ ID NO: 215909 - RNA, 61 nt, Human; identical to SEQ ID NO: 214832

SEQ ID NO: 215910 - RNA, 64 nt, Human; identical to SEQ ID NO: 214833

SEQ ID NO: 215911 - RNA, 64 nt, Human
gcgcuccuagggugagaggcuuagccaucccugacccuggcagugcacugguaagcagacacug

SEQ ID NO: 215912 - RNA, 64 nt, Human; identical to SEQ ID NO: 64130

SEQ ID NO: 215913 - RNA, 64 nt, Human; identical to SEQ ID NO: 64131

SEQ ID NO: 215914 - RNA, 64 nt, Human; identical to SEQ ID NO: 214834

SEQ ID NO: 215915 - RNA, 64 nt, Human; identical to SEQ ID NO: 214835

SEQ ID NO: 215916 - RNA, 64 nt, Human; identical to SEQ ID NO: 214836

SEQ ID NO: 215917 - RNA, 64 nt, Human; identical to SEQ ID NO: 214837

SEQ ID NO: 215918 - RNA, 64 nt, Human; identical to SEQ ID NO: 214838

SEQ ID NO: 215919 - RNA, 64 nt, Human; identical to SEQ ID NO: 214839

SEQ ID NO: 215920 - RNA, 64 nt, Human; identical to SEQ ID NO: 214843

SEQ ID NO: 215921 - RNA, 64 nt, Human; identical to SEQ ID NO: 214844

SEQ ID NO: 215922 - RNA, 64 nt, Human; identical to SEQ ID NO: 214845

SEQ ID NO: 215923 - RNA, 64 nt, Human; identical to SEQ ID NO: 214846

SEQ ID NO: 215924 - RNA, 64 nt, Human; identical to SEQ ID NO: 214847

SEQ ID NO: 215925 - RNA, 64 nt, Human; identical to SEQ ID NO: 214848

SEQ ID NO: 215926 - RNA, 64 nt, Human; identical to SEQ ID NO: 214849

SEQ ID NO: 215927 - RNA, 64 nt, Human; identical to SEQ ID NO: 214850

SEQ ID NO: 215928 - RNA, 64 nt, Human; identical to SEQ ID NO: 214851

SEQ ID NO: 215929 - RNA, 64 nt, Human; identical to SEQ ID NO: 214852

SEQ ID NO: 215930 - RNA, 64 nt, Human; identical to SEQ ID NO: 214690

SEQ ID NO: 215931 - RNA, 64 nt, Human
gccuccccaagugcuggguugugugagucacugccccuggcaccuauuuauuguuuugguauuu

SEQ ID NO: 215932 - RNA, 64 nt, Human
ccagggagcacagcagccucugacccuagcccugcccuggcagcaugggaccugccaacagcug

SEQ ID NO: 215933 - RNA, 64 nt, Human; identical to SEQ ID NO: 214853

SEQ ID NO: 215934 - RNA, 64 nt, Human; identical to SEQ ID NO: 214854

SEQ ID NO: 215935 - RNA, 64 nt, Human; identical to SEQ ID NO: 214855

SEQ ID NO: 215936 - RNA, 64 nt, Human; identical to SEQ ID NO: 214856

SEQ ID NO: 215937 - RNA, 64 nt, Human; identical to SEQ ID NO: 214857

SEQ ID NO: 215938 - RNA, 64 nt, Human; identical to SEQ ID NO: 214858

SEQ ID NO: 215939 - RNA, 64 nt, Human; identical to SEQ ID NO: 214862

SEQ ID NO: 215940 - RNA, 64 nt, Human; identical to SEQ ID NO: 214863

SEQ ID NO: 215941 - RNA, 64 nt, Human; identical to SEQ ID NO: 214864

SEQ ID NO: 215942 - RNA, 64 nt, Human; identical to SEQ ID NO: 214865

SEQ ID NO: 215943 - RNA, 64 nt, Human; identical to SEQ ID NO: 214866

SEQ ID NO: 215944 - RNA, 64 nt, Human; identical to SEQ ID NO: 214867

SEQ ID NO: 215945 - RNA, 53 nt, Human; identical to SEQ ID NO: 214868

SEQ ID NO: 215946 - RNA, 64 nt, Human; identical to SEQ ID NO: 214869

SEQ ID NO: 215947 - RNA, 64 nt, Human; identical to SEQ ID NO: 214870

SEQ ID NO: 215948 - RNA, 64 nt, Human; identical to SEQ ID NO: 214871

SEQ ID NO: 215949 - RNA, 64 nt, Human
gugggucccuggcaagugucuugugauaggcagucccuggcagggccuucgggugguuggcaag

SEQ ID NO: 215950 - RNA, 64 nt, Human
ggugugccuuggcucccaagguggcacugugggucccuggcaagugucuugugauaggcagucc

SEQ ID NO: 215951 - RNA, 64 nt, Human; identical to SEQ ID NO: 214783

SEQ ID NO: 215952 - RNA, 64 nt, Human; identical to SEQ ID NO: 214872

SEQ ID NO: 215953 - RNA, 64 nt, Human; identical to SEQ ID NO: 214873

SEQ ID NO: 215954 - RNA, 64 nt, Human; identical to SEQ ID NO: 214874

SEQ ID NO: 215955 - RNA, 64 nt, Human; identical to SEQ ID NO: 214875

SEQ ID NO: 215956 - RNA, 64 nt, Human; identical to SEQ ID NO: 214876

SEQ ID NO: 215957 - RNA, 64 nt, Human; identical to SEQ ID NO: 214877

SEQ ID NO: 215958 - RNA, 64 nt, Human; identical to SEQ ID NO: 214881

SEQ ID NO: 215959 - RNA, 64 nt, Human; identical to SEQ ID NO: 214882

SEQ ID NO: 215960 - RNA, 64 nt, Human; identical to SEQ ID NO: 214883

SEQ ID NO: 215961 - RNA, 64 nt, Human; identical to SEQ ID NO: 214884

SEQ ID NO: 215962 - RNA, 64 nt, Human; identical to SEQ ID NO: 214885

SEQ ID NO: 215963 - RNA, 64 nt, Human; identical to SEQ ID NO: 214886

SEQ ID NO: 215964 - RNA, 64 nt, Human; identical to SEQ ID NO: 214887

SEQ ID NO: 215965 - RNA, 64 nt, Human; identical to SEQ ID NO: 214888

SEQ ID NO: 215966 - RNA, 64 nt, Human; identical to SEQ ID NO: 214889

SEQ ID NO: 215967 - RNA, 64 nt, Human; identical to SEQ ID NO: 214890

SEQ ID NO: 215968 - RNA, 64 nt, Human; identical to SEQ ID NO: 214633

SEQ ID NO: 215969 - RNA, 64 nt, Human
uucggggccguaggaccccuaacuccaccccccucccuggcagcaccucgagcagaaggccgag

SEQ ID NO: 215970 - RNA, 64 nt, Human
uuuucugcagcuuccacgccucugcacucccugccccuggcaagugcucccaucgccccggugc

SEQ ID NO: 215971 - RNA, 64 nt, Human; identical to SEQ ID NO: 214891

SEQ ID NO: 215972 - RNA, 64 nt, Human; identical to SEQ ID NO: 214892

SEQ ID NO: 215973 - RNA, 64 nt, Human; identical to SEQ ID NO: 214893

SEQ ID NO: 215974 - RNA, 64 nt, Human; identical to SEQ ID NO: 214894

SEQ ID NO: 215975 - RNA, 64 nt, Human; identical to SEQ ID NO: 214895

SEQ ID NO: 215976 - RNA, 64 nt, Human; identical to SEQ ID NO: 214896

SEQ ID NO: 215977 - RNA, 64 nt, Human; identical to SEQ ID NO: 214900

SEQ ID NO: 215978 - RNA, 64 nt, Human; identical to SEQ ID NO: 214901

SEQ ID NO: 215979 - RNA, 64 nt, Human; identical to SEQ ID NO: 214902

SEQ ID NO: 215980 - RNA, 64 nt, Human; identical to SEQ ID NO: 214811

SEQ ID NO: 215981 - RNA, 64 nt, Human; identical to SEQ ID NO: 214904

SEQ ID NO: 215982 - RNA, 64 nt, Human; identical to SEQ ID NO: 214905

SEQ ID NO: 215983 - RNA, 64 nt, Human; identical to SEQ ID NO: 214906

SEQ ID NO: 215984 - RNA, 64 nt, Human; identical to SEQ ID NO: 214907

SEQ ID NO: 215985 - RNA, 64 nt, Human; identical to SEQ ID NO: 214908

SEQ ID NO: 215986 - RNA, 64 nt, Human; identical to SEQ ID NO: 214909

SEQ ID NO: 215987 - RNA, 64 nt, Human; identical to SEQ ID NO: 214650

SEQ ID NO: 215988 - RNA, 64 nt, Human
aggcuacuauagguccagaaguccuuauguuaagcccuggcaggcagguguuuauuaaaauucu

SEQ ID NO: 215989 - RNA, 64 nt, Human
cuuuugcagucaauccccugcuccuauccuuggccccuggcaaacacugguuugcuuucuauca

SEQ ID NO: 215990 - RNA, 64 nt, Human; identical to SEQ ID NO: 214910

SEQ ID NO: 215991 - RNA, 64 nt, Human; identical to SEQ ID NO: 214911

SEQ ID NO: 215992 - RNA, 64 nt, Human; identical to SEQ ID NO: 214912

SEQ ID NO: 215993 - RNA, 64 nt, Human; identical to SEQ ID NO: 214913

SEQ ID NO: 215994 - RNA, 64 nt, Human; identical to SEQ ID NO: 214914

SEQ ID NO: 215995 - RNA, 64 nt, Human; identical to SEQ ID NO: 214915

SEQ ID NO: 215996 - RNA, 64 nt, Human; identical to SEQ ID NO: 214919

SEQ ID NO: 215997 - RNA, 64 nt, Human; identical to SEQ ID NO: 214920

SEQ ID NO: 215998 - RNA, 64 nt, Human; identical to SEQ ID NO: 214921

SEQ ID NO: 215999 - RNA, 64 nt, Human; identical to SEQ ID NO: 214922

SEQ ID NO: 216000 - RNA, 64 nt, Human; identical to SEQ ID NO: 214923

SEQ ID NO: 216001 - RNA, 64 nt, Human; identical to SEQ ID NO: 214924

SEQ ID NO: 216002 - RNA, 64 nt, Human; identical to SEQ ID NO: 214925

SEQ ID NO: 216003 - RNA, 64 nt, Human; identical to SEQ ID NO: 214926

SEQ ID NO: 216004 - RNA, 64 nt, Human; identical to SEQ ID NO: 214927

SEQ ID NO: 216005 - RNA, 64 nt, Human; identical to SEQ ID NO: 214928

SEQ ID NO: 216006 - RNA, 64 nt, Human
cccaggcugcaagggguggacugugggaugcaugcccuggcaacauugaaguucgaucauggua

SEQ ID NO: 216007 - RNA, 64 nt, Human
cgaaggccaguggggccaucgcuuccuggggcgacccuggcagugguugggagacgcccagaug

SEQ ID NO: 216008 - RNA, 64 nt, Human; identical to SEQ ID NO: 214652

SEQ ID NO: 216009 - RNA, 64 nt, Human; identical to SEQ ID NO: 214929

SEQ ID NO: 216010 - RNA, 64 nt, Human; identical to SEQ ID NO: 214930

SEQ ID NO: 216011 - RNA, 64 nt, Human; identical to SEQ ID NO: 214931

SEQ ID NO: 216012 - RNA, 64 nt, Human; identical to SEQ ID NO: 214932

SEQ ID NO: 216013 - RNA, 64 nt, Human; identical to SEQ ID NO: 214933

SEQ ID NO: 216014 - RNA, 64 nt, Human; identical to SEQ ID NO: 214934

SEQ ID NO: 216015 - RNA, 64 nt, Human; identical to SEQ ID NO: 214938

SEQ ID NO: 216016 - RNA, 64 nt, Human; identical to SEQ ID NO: 214939

SEQ ID NO: 216017 - RNA, 64 nt, Human; identical to SEQ ID NO: 214940

SEQ ID NO: 216018 - RNA, 64 nt, Human; identical to SEQ ID NO: 214941

SEQ ID NO: 216019 - RNA, 64 nt, Human; identical to SEQ ID NO: 214942

SEQ ID NO: 216020 - RNA, 64 nt, Human; identical to SEQ ID NO: 214943

SEQ ID NO: 216021 - RNA, 64 nt, Human; identical to SEQ ID NO: 214944

SEQ ID NO: 216022 - RNA, 64 nt, Human; identical to SEQ ID NO: 214945

SEQ ID NO: 216023 - RNA, 64 nt, Human; identical to SEQ ID NO: 214946

SEQ ID NO: 216024 - RNA, 64 nt, Human; identical to SEQ ID NO: 214947

SEQ ID NO: 216025 - RNA, 64 nt, Human
gagagagcagggucagcucccucggcugggaccucccuggcauugggagagccccacacggccu

SEQ ID NO: 216026 - RNA, 64 nt, Human
uugcugcauggguuaauugagaauagaaauuugccccuggcaaaugcacacaccucaugcuagc

SEQ ID NO: 216027 - RNA, 64 nt, Human; identical to SEQ ID NO: 214671

SEQ ID NO: 216028 - RNA, 64 nt, Human; identical to SEQ ID NO: 214948

SEQ ID NO: 216029 - RNA, 64 nt, Human; identical to SEQ ID NO: 214949

SEQ ID NO: 216030 - RNA, 64 nt, Human; identical to SEQ ID NO: 214950

SEQ ID NO: 216031 - RNA, 64 nt, Human; identical to SEQ ID NO: 214951

SEQ ID NO: 216032 - RNA, 64 nt, Human; identical to SEQ ID NO: 214952

SEQ ID NO: 216033 - RNA, 64 nt, Human; identical to SEQ ID NO: 214953

SEQ ID NO: 216034 - RNA, 64 nt, Human; identical to SEQ ID NO: 214957

SEQ ID NO: 216035 - RNA, 64 nt, Human; identical to SEQ ID NO: 214958

SEQ ID NO: 216036 - RNA, 64 nt, Human; identical to SEQ ID NO: 214959

SEQ ID NO: 216037 - RNA, 64 nt, Human; identical to SEQ ID NO: 214960

SEQ ID NO: 216038 - RNA, 64 nt, Human; identical to SEQ ID NO: 214961

SEQ ID NO: 216039 - RNA, 64 nt, Human; identical to SEQ ID NO: 214962

SEQ ID NO: 216040 - RNA, 64 nt, Human; identical to SEQ ID NO: 214963

SEQ ID NO: 216041 - RNA, 64 nt, Human; identical to SEQ ID NO: 214964

SEQ ID NO: 216042 - RNA, 64 nt, Human; identical to SEQ ID NO: 214965

SEQ ID NO: 216043 - RNA, 64 nt, Human; identical to SEQ ID NO: 214966

SEQ ID NO: 216044 - RNA, 64 nt, Human; identical to SEQ ID NO: 214651

SEQ ID NO: 216045 - RNA, 64 nt, Human
aggggcuggcccagggcugcaaugcagcauguugcccuggcaccuguggccaguacucgggaca

SEQ ID NO: 216046 - RNA, 64 nt, Human
ccaccacaccccacccccccccaacuggcugaaccccuggcaggcuuccaaacugaggaaagcu

SEQ ID NO: 216047 - RNA, 64 nt, Human; identical to SEQ ID NO: 214967

SEQ ID NO: 216048 - RNA, 64 nt, Human; identical to SEQ ID NO: 214968

SEQ ID NO: 216049 - RNA, 64 nt, Human; identical to SEQ ID NO: 214969

SEQ ID NO: 216050 - RNA, 64 nt, Human; identical to SEQ ID NO: 214970

SEQ ID NO: 216051 - RNA, 64 nt, Human; identical to SEQ ID NO: 214971

SEQ ID NO: 216052 - RNA, 64 nt, Human; identical to SEQ ID NO: 214972

SEQ ID NO: 216053 - RNA, 64 nt, Human; identical to SEQ ID NO: 214976

SEQ ID NO: 216054 - RNA, 64 nt, Human; identical to SEQ ID NO: 214977

SEQ ID NO: 216055 - RNA, 64 nt, Human; identical to SEQ ID NO: 214978

SEQ ID NO: 216056 - RNA, 64 nt, Human; identical to SEQ ID NO: 214979

SEQ ID NO: 216057 - RNA, 64 nt, Human; identical to SEQ ID NO: 214980

SEQ ID NO: 216058 - RNA, 64 nt, Human; identical to SEQ ID NO: 214981

SEQ ID NO: 216059 - RNA, 64 nt, Human; identical to SEQ ID NO: 214982

SEQ ID NO: 216060 - RNA, 64 nt, Human; identical to SEQ ID NO: 214983

SEQ ID NO: 216061 - RNA, 64 nt, Human; identical to SEQ ID NO: 214984

SEQ ID NO: 216062 - RNA, 64 nt, Human; identical to SEQ ID NO: 214985

SEQ ID NO: 216063 - RNA, 64 nt, Human
ccacuggcacaagugcccuuagugcugccacacucccuggcagccaggugcccuggugcccacc

SEQ ID NO: 216064 - RNA, 64 nt, Human
gcccuggagggugggcggcucauggugccacagccccuggcagggacggccggcccgcccccgu

SEQ ID NO: 216065 - RNA, 64 nt, Human
aaacaccuggagcgauggaauccggccaggacuccccuggcaccugacaucucccacgcuccac

SEQ ID NO: 216066 - RNA, 64 nt, Human; identical to SEQ ID NO: 214986

SEQ ID NO: 216067 - RNA, 64 nt, Human; identical to SEQ ID NO: 214987

SEQ ID NO: 216068 - RNA, 64 nt, Human; identical to SEQ ID NO: 214988

SEQ ID NO: 216069 - RNA, 64 nt, Human; identical to SEQ ID NO: 214989

SEQ ID NO: 216070 - RNA, 64 nt, Human; identical to SEQ ID NO: 214990

SEQ ID NO: 216071 - RNA, 64 nt, Human; identical to SEQ ID NO: 214991

SEQ ID NO: 216072 - RNA, 64 nt, Human; identical to SEQ ID NO: 214995

SEQ ID NO: 216073 - RNA, 64 nt, Human; identical to SEQ ID NO: 214996

SEQ ID NO: 216074 - RNA, 64 nt, Human; identical to SEQ ID NO: 214997

SEQ ID NO: 216075 - RNA, 64 nt, Human; identical to SEQ ID NO: 214998

SEQ ID NO: 216076 - RNA, 64 nt, Human; identical to SEQ ID NO: 214999

SEQ ID NO: 216077 - RNA, 64 nt, Human; identical to SEQ ID NO: 215000

SEQ ID NO: 216078 - RNA, 64 nt, Human; identical to SEQ ID NO: 215001

SEQ ID NO: 216079 - RNA, 64 nt, Human; identical to SEQ ID NO: 215002

SEQ ID NO: 216080 - RNA, 64 nt, Human; identical to SEQ ID NO: 215003

SEQ ID NO: 216081 - RNA, 64 nt, Human; identical to SEQ ID NO: 215004

SEQ ID NO: 216082 - RNA, 64 nt, Human
auuccuguucuguugugaagagaacauucccagacccuggcacccuccugagccggcgugugcc

SEQ ID NO: 216083 - RNA, 51 nt, Human
ccgcacggccccgggccugagcccuggcacccgcuggccgcccacccgcgc

SEQ ID NO: 216084 - RNA, 50 nt, Human
uuauucuuauuaggcuuugacccuggcaccucccuccagcugcccacuca

SEQ ID NO: 216085 - RNA, 64 nt, Human; identical to SEQ ID NO: 215005

SEQ ID NO: 216086 - RNA, 64 nt, Human; identical to SEQ ID NO: 215006

SEQ ID NO: 216087 - RNA, 64 nt, Human; identical to SEQ ID NO: 215007

SEQ ID NO: 216088 - RNA, 64 nt, Human; identical to SEQ ID NO: 215008

SEQ ID NO: 216089 - RNA, 64 nt, Human; identical to SEQ ID NO: 215009

SEQ ID NO: 216090 - RNA, 64 nt, Human; identical to SEQ ID NO: 215010

SEQ ID NO: 216091 - RNA, 64 nt, Human; identical to SEQ ID NO: 215014

SEQ ID NO: 216092 - RNA, 64 nt, Human; identical to SEQ ID NO: 215015

SEQ ID NO: 216093 - RNA, 63 nt, Human; identical to SEQ ID NO: 215016

SEQ ID NO: 216094 - RNA, 64 nt, Human; identical to SEQ ID NO: 215017

SEQ ID NO: 216095 - RNA, 64 nt, Human; identical to SEQ ID NO: 215018

SEQ ID NO: 216096 - RNA, 64 nt, Human; identical to SEQ ID NO: 215019

SEQ ID NO: 216097 - RNA, 64 nt, Human; identical to SEQ ID NO: 215020

SEQ ID NO: 216098 - RNA, 64 nt, Human; identical to SEQ ID NO: 215021

SEQ ID NO: 216099 - RNA, 64 nt, Human; identical to SEQ ID NO: 215022

SEQ ID NO: 216100 - RNA, 64 nt, Human; identical to SEQ ID NO: 215023

SEQ ID NO: 216101 - RNA, 64 nt, Human
caaguccucugaccuaauuuucugcugcaagguccccuggcaguggcccauccugucuucuacu

SEQ ID NO: 216102 - RNA, 64 nt, Human
agggcaggggguucccccaaacuuucgaaguaggcccuggcaggcagcugggagccauccugaa

SEQ ID NO: 216103 - RNA, 64 nt, Human; identical to SEQ ID NO: 214784

SEQ ID NO: 216104 - RNA, 64 nt, Human; identical to SEQ ID NO: 215024

SEQ ID NO: 216105 - RNA, 64 nt, Human; identical to SEQ ID NO: 215025

SEQ ID NO: 216106 - RNA, 64 nt, Human; identical to SEQ ID NO: 215026

SEQ ID NO: 216107 - RNA, 64 nt, Human; identical to SEQ ID NO: 215027

SEQ ID NO: 216108 - RNA, 64 nt, Human; identical to SEQ ID NO: 215028

SEQ ID NO: 216109 - RNA, 64 nt, Human; identical to SEQ ID NO: 215029

SEQ ID NO: 216110 - RNA, 64 nt, Human; identical to SEQ ID NO: 215033

SEQ ID NO: 216111 - RNA, 64 nt, Human; identical to SEQ ID NO: 215034

SEQ ID NO: 216112 - RNA, 64 nt, Human; identical to SEQ ID NO: 215035

SEQ ID NO: 216113 - RNA, 64 nt, Human; identical to SEQ ID NO: 215036

SEQ ID NO: 216114 - RNA, 64 nt, Human; identical to SEQ ID NO: 215037

SEQ ID NO: 216115 - RNA, 64 nt, Human; identical to SEQ ID NO: 215038

SEQ ID NO: 216116 - RNA, 64 nt, Human; identical to SEQ ID NO: 215039

SEQ ID NO: 216117 - RNA, 64 nt, Human; identical to SEQ ID NO: 215040

SEQ ID NO: 216118 - RNA, 64 nt, Human; identical to SEQ ID NO: 215041

SEQ ID NO: 216119 - RNA, 64 nt, Human; identical to SEQ ID NO: 215042

SEQ ID NO: 216120 - RNA, 64 nt, Human
agguguccaggcagguaggcugcagccaggagcucccuggcaccgcaggaccucgugguacucu

SEQ ID NO: 216121 - RNA, 64 nt, Human
gcugggggaccaacuacucuggcaggaucuggaccccuggcaggggaguccagcugagagugga

SEQ ID NO: 216122 - RNA, 64 nt, Human
gucacuguggccaaacagugcccagcuuaagcaucccuggcaucagacuauggccuucaagagc

SEQ ID NO: 216123 - RNA, 64 nt, Human; identical to SEQ ID NO: 215043

SEQ ID NO: 216124 - RNA, 64 nt, Human; identical to SEQ ID NO: 215044

SEQ ID NO: 216125 - RNA, 64 nt, Human; identical to SEQ ID NO: 215045

SEQ ID NO: 216126 - RNA, 64 nt, Human; identical to SEQ ID NO: 215046

SEQ ID NO: 216127 - RNA, 64 nt, Human; identical to SEQ ID NO: 215047

SEQ ID NO: 216128 - RNA, 64 nt, Human; identical to SEQ ID NO: 215048

SEQ ID NO: 216129 - RNA, 64 nt, Human; identical to SEQ ID NO: 215052

SEQ ID NO: 216130 - RNA, 64 nt, Human; identical to SEQ ID NO: 215053

SEQ ID NO: 216131 - RNA, 64 nt, Human; identical to SEQ ID NO: 215054

SEQ ID NO: 216132 - RNA, 64 nt, Human; identical to SEQ ID NO: 215055

SEQ ID NO: 216133 - RNA, 64 nt, Human; identical to SEQ ID NO: 215056

SEQ ID NO: 216134 - RNA, 64 nt, Human; identical to SEQ ID NO: 215057

SEQ ID NO: 216135 - RNA, 64 nt, Human; identical to SEQ ID NO: 215058

SEQ ID NO: 216136 - RNA, 64 nt, Human; identical to SEQ ID NO: 215059

SEQ ID NO: 216137 - RNA, 64 nt, Human; identical to SEQ ID NO: 215060

SEQ ID NO: 216138 - RNA, 64 nt, Human; identical to SEQ ID NO: 215061

SEQ ID NO: 216139 - RNA, 64 nt, Human
cuguuugcugccuucaccacauauuagugcuugacccuggcaggggaccccauggaaaagaugg

SEQ ID NO: 216140 - RNA, 64 nt, Human
uggugggaguaggggucauccggcccgaggccugcccuggcacacgcguuuccgccgcguaugg

SEQ ID NO: 216141 - RNA, 64 nt, Human; identical to SEQ ID NO: 214688

SEQ ID NO: 216142 - RNA, 64 nt, Human; identical to SEQ ID NO: 215062

SEQ ID NO: 216143 - RNA, 64 nt, Human; identical to SEQ ID NO: 215063

SEQ ID NO: 216144 - RNA, 64 nt, Human; identical to SEQ ID NO: 215064

SEQ ID NO: 216145 - RNA, 64 nt, Human; identical to SEQ ID NO: 215065

SEQ ID NO: 216146 - RNA, 64 nt, Human; identical to SEQ ID NO: 215066

SEQ ID NO: 216147 - RNA, 64 nt, Human; identical to SEQ ID NO: 215067

SEQ ID NO: 216148 - RNA, 64 nt, Human; identical to SEQ ID NO: 215071

SEQ ID NO: 216149 - RNA, 64 nt, Human; identical to SEQ ID NO: 215072

SEQ ID NO: 216150 - RNA, 64 nt, Human; identical to SEQ ID NO: 215073

SEQ ID NO: 216151 - RNA, 64 nt, Human; identical to SEQ ID NO: 215074

SEQ ID NO: 216152 - RNA, 64 nt, Human; identical to SEQ ID NO: 215075

SEQ ID NO: 216153 - RNA, 64 nt, Human; identical to SEQ ID NO: 215076

SEQ ID NO: 216154 - RNA, 64 nt, Human; identical to SEQ ID NO: 215077

SEQ ID NO: 216155 - RNA, 64 nt, Human; identical to SEQ ID NO: 215078

SEQ ID NO: 216156 - RNA, 62 nt, Human; identical to SEQ ID NO: 215079

SEQ ID NO: 216157 - RNA, 64 nt, Human; identical to SEQ ID NO: 215080

SEQ ID NO: 216158 - RNA, 64 nt, Human
cugccagccucccaggcccaugcccuccuggugccccuggcacugaggcacagaucgucaaggc

SEQ ID NO: 216159 - RNA, 64 nt, Human; identical to SEQ ID NO: 214669

SEQ ID NO: 216160 - RNA, 64 nt, Human
cucugaaauggggcauuuuguugggaccagugaccccuggcauggggaccacacccuggagccc

SEQ ID NO: 216161 - RNA, 64 nt, Human; identical to SEQ ID NO: 215081

SEQ ID NO: 216162 - RNA, 64 nt, Human; identical to SEQ ID NO: 215082

SEQ ID NO: 216163 - RNA, 64 nt, Human; identical to SEQ ID NO: 215083

SEQ ID NO: 216164 - RNA, 64 nt, Human; identical to SEQ ID NO: 215084

SEQ ID NO: 216165 - RNA, 64 nt, Human; identical to SEQ ID NO: 215085

SEQ ID NO: 216166 - RNA, 64 nt, Human; identical to SEQ ID NO: 215086

SEQ ID NO: 216167 - RNA, 64 nt, Human; identical to SEQ ID NO: 215090

SEQ ID NO: 216168 - RNA, 63 nt, Human; identical to SEQ ID NO: 215091

SEQ ID NO: 216169 - RNA, 64 nt, Human; identical to SEQ ID NO: 215092

SEQ ID NO: 216170 - RNA, 64 nt, Human; identical to SEQ ID NO: 215093

SEQ ID NO: 216171 - RNA, 64 nt, Human; identical to SEQ ID NO: 215094

SEQ ID NO: 216172 - RNA, 64 nt, Human; identical to SEQ ID NO: 215095

SEQ ID NO: 216173 - RNA, 64 nt, Human; identical to SEQ ID NO: 215096

SEQ ID NO: 216174 - RNA, 64 nt, Human; identical to SEQ ID NO: 215097

SEQ ID NO: 216175 - RNA, 64 nt, Human; identical to SEQ ID NO: 215098

SEQ ID NO: 216176 - RNA, 64 nt, Human; identical to SEQ ID NO: 215099

SEQ ID NO: 216177 - RNA, 64 nt, Human
gcccccccaccggccccggccgccccagcgaccucccuggcaccggccgccgccuucaaauacu

SEQ ID NO: 216178 - RNA, 64 nt, Human; identical to SEQ ID NO: 214689

SEQ ID NO: 216179 - RNA, 56 nt, Human
acaugaagcgccaccuuugagcccugcccuggcacuuggacucuccuagugacugg

SEQ ID NO: 216180 - RNA, 64 nt, Human; identical to SEQ ID NO: 215100

SEQ ID NO: 216181 - RNA, 64 nt, Human; identical to SEQ ID NO: 215101

SEQ ID NO: 216182 - RNA, 64 nt, Human; identical to SEQ ID NO: 215102

SEQ ID NO: 216183 - RNA, 64 nt, Human; identical to SEQ ID NO: 215103

SEQ ID NO: 216184 - RNA, 64 nt, Human; identical to SEQ ID NO: 215104

SEQ ID NO: 216185 - RNA, 64 nt, Human; identical to SEQ ID NO: 215105

SEQ ID NO: 216186 - RNA, 64 nt, Human; identical to SEQ ID NO: 215109

SEQ ID NO: 216187 - RNA, 64 nt, Human; identical to SEQ ID NO: 215110

SEQ ID NO: 216188 - RNA, 64 nt, Human; identical to SEQ ID NO: 215111

SEQ ID NO: 216189 - RNA, 64 nt, Human; identical to SEQ ID NO: 215112

SEQ ID NO: 216190 - RNA, 64 nt, Human; identical to SEQ ID NO: 215113

SEQ ID NO: 216191 - RNA, 50 nt, Human; identical to SEQ ID NO: 215114

SEQ ID NO: 216192 - RNA, 64 nt, Human; identical to SEQ ID NO: 215115

SEQ ID NO: 216193 - RNA, 64 nt, Human; identical to SEQ ID NO: 215116

SEQ ID NO: 216194 - RNA, 64 nt, Human; identical to SEQ ID NO: 215117

SEQ ID NO: 216195 - RNA, 64 nt, Human; identical to SEQ ID NO: 215118

SEQ ID NO: 216196 - RNA, 64 nt, Human
ccaacugagaagcuccaccagccacugaugccagcccuggcacugccccugcacaggagacaag

SEQ ID NO: 216197 - RNA, 64 nt, Human; identical to SEQ ID NO: 216196

SEQ ID NO: 216198 - RNA, 64 nt, Human; identical to SEQ ID NO: 214580

SEQ ID NO: 216199 - RNA, 64 nt, Human; identical to SEQ ID NO: 215119

SEQ ID NO: 216200 - RNA, 64 nt, Human; identical to SEQ ID NO: 215120

SEQ ID NO: 216201 - RNA, 64 nt, Human; identical to SEQ ID NO: 215121

SEQ ID NO: 216202 - RNA, 64 nt, Human; identical to SEQ ID NO: 215122

SEQ ID NO: 216203 - RNA, 64 nt, Human; identical to SEQ ID NO: 215123

SEQ ID NO: 216204 - RNA, 64 nt, Human; identical to SEQ ID NO: 215124

SEQ ID NO: 216205 - RNA, 64 nt, Human; identical to SEQ ID NO: 215128

SEQ ID NO: 216206 - RNA, 64 nt, Human; identical to SEQ ID NO: 215129

SEQ ID NO: 216207 - RNA, 64 nt, Human; identical to SEQ ID NO: 215130

SEQ ID NO: 216208 - RNA, 64 nt, Human; identical to SEQ ID NO: 215131

SEQ ID NO: 216209 - RNA, 64 nt, Human; identical to SEQ ID NO: 215132

SEQ ID NO: 216210 - RNA, 64 nt, Human; identical to SEQ ID NO: 215133

SEQ ID NO: 216211 - RNA, 64 nt, Human; identical to SEQ ID NO: 215134

SEQ ID NO: 216212 - RNA, 64 nt, Human; identical to SEQ ID NO: 215135

SEQ ID NO: 216213 - RNA, 64 nt, Human; identical to SEQ ID NO: 215136

SEQ ID NO: 216214 - RNA, 64 nt, Human; identical to SEQ ID NO: 215137

SEQ ID NO: 216215 - RNA, 64 nt, Human
uucacccaaguuccaagugagaagcagguguagucccuggcauucugucuguauccaaaccaga

SEQ ID NO: 216216 - RNA, 64 nt, Human; identical to SEQ ID NO: 214581

SEQ ID NO: 216217 - RNA, 64 nt, Human
ggggugagcuuuauagccaguagagguggagggacccuggcaugugccaaagaagaggcccucu

SEQ ID NO: 216218 - RNA, 64 nt, Human; identical to SEQ ID NO: 215138

SEQ ID NO: 216219 - RNA, 64 nt, Human; identical to SEQ ID NO: 215139

SEQ ID NO: 216220 - RNA, 64 nt, Human; identical to SEQ ID NO: 215140

SEQ ID NO: 216221 - RNA, 64 nt, Human; identical to SEQ ID NO: 215141

SEQ ID NO: 216222 - RNA, 64 nt, Human; identical to SEQ ID NO: 215142

SEQ ID NO: 216223 - RNA, 64 nt, Human; identical to SEQ ID NO: 215143

SEQ ID NO: 216224 - RNA, 64 nt, Human; identical to SEQ ID NO: 215147

SEQ ID NO: 216225 - RNA, 64 nt, Human; identical to SEQ ID NO: 215148

SEQ ID NO: 216226 - RNA, 64 nt, Human; identical to SEQ ID NO: 215149

SEQ ID NO: 216227 - RNA, 64 nt, Human; identical to SEQ ID NO: 215150

SEQ ID NO: 216228 - RNA, 64 nt, Human; identical to SEQ ID NO: 215151

SEQ ID NO: 216229 - RNA, 64 nt, Human; identical to SEQ ID NO: 215152

SEQ ID NO: 216230 - RNA, 64 nt, Human; identical to SEQ ID NO: 215153

SEQ ID NO: 216231 - RNA, 64 nt, Human; identical to SEQ ID NO: 215154

SEQ ID NO: 216232 - RNA, 64 nt, Human; identical to SEQ ID NO: 215155

SEQ ID NO: 216233 - RNA, 64 nt, Human; identical to SEQ ID NO: 215156

SEQ ID NO: 216234 - RNA, 64 nt, Human
ugugggaugacuggaaaaugaccucgcugcuguucccuggcaugacccucuuuggaagaguggu

SEQ ID NO: 216235 - RNA, 64 nt, Human
uugucagugccauguccacaguaucugccauacucccuggcauaguacgguaaggcaaaaauug

SEQ ID NO: 216236 - RNA, 64 nt, Human
cuagcaugaacuugugggauggugggguuggcuucccuggcaugauggacaaaggccuggcguc

SEQ ID NO: 216237 - RNA, 64 nt, Human; identical to SEQ ID NO: 215157

SEQ ID NO: 216238 - RNA, 64 nt, Human; identical to SEQ ID NO: 215158

SEQ ID NO: 216239 - RNA, 64 nt, Human; identical to SEQ ID NO: 215159

SEQ ID NO: 216240 - RNA, 64 nt, Human; identical to SEQ ID NO: 215160

SEQ ID NO: 216241 - RNA, 64 nt, Human; identical to SEQ ID NO: 215161

SEQ ID NO: 216242 - RNA, 64 nt, Human; identical to SEQ ID NO: 215162

SEQ ID NO: 216243 - RNA, 64 nt, Human; identical to SEQ ID NO: 215166

SEQ ID NO: 216244 - RNA, 64 nt, Human; identical to SEQ ID NO: 215167

SEQ ID NO: 216245 - RNA, 64 nt, Human; identical to SEQ ID NO: 215168

SEQ ID NO: 216246 - RNA, 64 nt, Human; identical to SEQ ID NO: 215169

SEQ ID NO: 216247 - RNA, 64 nt, Human; identical to SEQ ID NO: 215170

SEQ ID NO: 216248 - RNA, 64 nt, Human; identical to SEQ ID NO: 215171

SEQ ID NO: 216249 - RNA, 64 nt, Human; identical to SEQ ID NO: 215172

SEQ ID NO: 216250 - RNA, 64 nt, Human; identical to SEQ ID NO: 215173

SEQ ID NO: 216251 - RNA, 64 nt, Human; identical to SEQ ID NO: 215174

SEQ ID NO: 216252 - RNA, 53 nt, Human; identical to SEQ ID NO: 215175

SEQ ID NO: 216253 - RNA, 64 nt, Human; identical to SEQ ID NO: 214596

SEQ ID NO: 216254 - RNA, 64 nt, Human
uccaguccccaggccuccagcgcugucagcugcacccuggcauucucacagagcuggcugccca

SEQ ID NO: 216255 - RNA, 64 nt, Human
ucuggugacacauccugcagcagcugagggggugcccuggcacuggcugggaguggagaggcac

SEQ ID NO: 216256 - RNA, 64 nt, Human; identical to SEQ ID NO: 215176

SEQ ID NO: 216257 - RNA, 64 nt, Human; identical to SEQ ID NO: 215177

SEQ ID NO: 216258 - RNA, 64 nt, Human; identical to SEQ ID NO: 215178

SEQ ID NO: 216259 - RNA, 64 nt, Human; identical to SEQ ID NO: 215179

SEQ ID NO: 216260 - RNA, 64 nt, Human; identical to SEQ ID NO: 215180

SEQ ID NO: 216261 - RNA, 64 nt, Human; identical to SEQ ID NO: 215181

SEQ ID NO: 216262 - RNA, 64 nt, Human; identical to SEQ ID NO: 215185

SEQ ID NO: 216263 - RNA, 64 nt, Human; identical to SEQ ID NO: 215186

SEQ ID NO: 216264 - RNA, 64 nt, Human; identical to SEQ ID NO: 215187

SEQ ID NO: 216265 - RNA, 64 nt, Human; identical to SEQ ID NO: 215188

SEQ ID NO: 216266 - RNA, 64 nt, Human; identical to SEQ ID NO: 215189

SEQ ID NO: 216267 - RNA, 64 nt, Human; identical to SEQ ID NO: 215190

SEQ ID NO: 216268 - RNA, 64 nt, Human; identical to SEQ ID NO: 215191

SEQ ID NO: 216269 - RNA, 64 nt, Human; identical to SEQ ID NO: 215192

SEQ ID NO: 216270 - RNA, 64 nt, Human; identical to SEQ ID NO: 215193

SEQ ID NO: 216271 - RNA, 64 nt, Human; identical to SEQ ID NO: 215194

SEQ ID NO: 216272 - RNA, 64 nt, Human; identical to SEQ ID NO: 214597

SEQ ID NO: 216273 - RNA, 64 nt, Human
gggauccgggaggcccugggcuuccuguguguagcccuggcauagacuugcucgucaggguguu

SEQ ID NO: 216274 - RNA, 64 nt, Human
cauaucagcccguguggcugacugauguauaggucccuggcauccugguucauaucuguguugc

SEQ ID NO: 216275 - RNA, 64 nt, Human; identical to SEQ ID NO: 215195

SEQ ID NO: 216276 - RNA, 64 nt, Human; identical to SEQ ID NO: 215196

SEQ ID NO: 216277 - RNA, 64 nt, Human; identical to SEQ ID NO: 215197

SEQ ID NO: 216278 - RNA, 64 nt, Human; identical to SEQ ID NO: 215198

SEQ ID NO: 216279 - RNA, 64 nt, Human; identical to SEQ ID NO: 215199

SEQ ID NO: 216280 - RNA, 64 nt, Human; identical to SEQ ID NO: 215200

SEQ ID NO: 216281 - RNA, 64 nt, Human; identical to SEQ ID NO: 215204

SEQ ID NO: 216282 - RNA, 64 nt, Human; identical to SEQ ID NO: 215205

SEQ ID NO: 216283 - RNA, 64 nt, Human; identical to SEQ ID NO: 215206

SEQ ID NO: 216284 - RNA, 64 nt, Human; identical to SEQ ID NO: 215207

SEQ ID NO: 216285 - RNA, 64 nt, Human; identical to SEQ ID NO: 215208

SEQ ID NO: 216286 - RNA, 64 nt, Human; identical to SEQ ID NO: 215209

SEQ ID NO: 216287 - RNA, 64 nt, Human; identical to SEQ ID NO: 215210

SEQ ID NO: 216288 - RNA, 64 nt, Human; identical to SEQ ID NO: 215211

SEQ ID NO: 216289 - RNA, 64 nt, Human; identical to SEQ ID NO: 215212

SEQ ID NO: 216290 - RNA, 64 nt, Human; identical to SEQ ID NO: 215213

SEQ ID NO: 216291 - RNA, 64 nt, Human
uuagccagguucucauuagguuuugcuugggccucccuggcacugaaccuuaggcuuuguauga

SEQ ID NO: 216292 - RNA, 64 nt, Human; identical to SEQ ID NO: 214598

SEQ ID NO: 216293 - RNA, 64 nt, Human
ggggcagaugccccaggugucccagcuccacagccccuggcagaucccagaccccuugguggca

SEQ ID NO: 216294 - RNA, 64 nt, Human; identical to SEQ ID NO: 215214

SEQ ID NO: 216295 - RNA, 56 nt, Human; identical to SEQ ID NO: 215215

SEQ ID NO: 216296 - RNA, 64 nt, Human; identical to SEQ ID NO: 215216

SEQ ID NO: 216297 - RNA, 64 nt, Human; identical to SEQ ID NO: 215217

SEQ ID NO: 216298 - RNA, 64 nt, Human; identical to SEQ ID NO: 215218

SEQ ID NO: 216299 - RNA, 64 nt, Human; identical to SEQ ID NO: 215219

SEQ ID NO: 216300 - RNA, 64 nt, Human; identical to SEQ ID NO: 215223

SEQ ID NO: 216301 - RNA, 64 nt, Human; identical to SEQ ID NO: 215224

SEQ ID NO: 216302 - RNA, 64 nt, Human; identical to SEQ ID NO: 215225

SEQ ID NO: 216303 - RNA, 64 nt, Human; identical to SEQ ID NO: 215226

SEQ ID NO: 216304 - RNA, 64 nt, Human; identical to SEQ ID NO: 215227

SEQ ID NO: 216305 - RNA, 64 nt, Human; identical to SEQ ID NO: 215228

SEQ ID NO: 216306 - RNA, 64 nt, Human; identical to SEQ ID NO: 215229

SEQ ID NO: 216307 - RNA, 64 nt, Human; identical to SEQ ID NO: 215230

SEQ ID NO: 216308 - RNA, 64 nt, Human; identical to SEQ ID NO: 215231

SEQ ID NO: 216309 - RNA, 64 nt, Human; identical to SEQ ID NO: 215232

SEQ ID NO: 216310 - RNA, 64 nt, Human
uuagggcuuuuuuguacauagccaacuguagccacccuggcaugcugucucuaauugauucaag

SEQ ID NO: 216311 - RNA, 53 nt, Human
aagacauuccuuauguguagugucccuggcaggcauuugucaggccauauguu

SEQ ID NO: 216312 - RNA, 53 nt, Human; identical to SEQ ID NO: 214785

SEQ ID NO: 216313 - RNA, 64 nt, Human; identical to SEQ ID NO: 215233

SEQ ID NO: 216314 - RNA, 64 nt, Human; identical to SEQ ID NO: 215234

SEQ ID NO: 216315 - RNA, 64 nt, Human; identical to SEQ ID NO: 215235

SEQ ID NO: 216316 - RNA, 64 nt, Human; identical to SEQ ID NO: 215236

SEQ ID NO: 216317 - RNA, 62 nt, Human; identical to SEQ ID NO: 215237

SEQ ID NO: 216318 - RNA, 64 nt, Human; identical to SEQ ID NO: 215238

SEQ ID NO: 216319 - RNA, 64 nt, Human; identical to SEQ ID NO: 215242

SEQ ID NO: 216320 - RNA, 64 nt, Human; identical to SEQ ID NO: 215243

SEQ ID NO: 216321 - RNA, 64 nt, Human; identical to SEQ ID NO: 215244

SEQ ID NO: 216322 - RNA, 64 nt, Human; identical to SEQ ID NO: 215245

SEQ ID NO: 216323 - RNA, 64 nt, Human; identical to SEQ ID NO: 215246

SEQ ID NO: 216324 - RNA, 64 nt, Human; identical to SEQ ID NO: 215247

SEQ ID NO: 216325 - RNA, 64 nt, Human; identical to SEQ ID NO: 215248

SEQ ID NO: 216326 - RNA, 64 nt, Human; identical to SEQ ID NO: 215249

SEQ ID NO: 216327 - RNA, 64 nt, Human; identical to SEQ ID NO: 215250

SEQ ID NO: 216328 - RNA, 64 nt, Human; identical to SEQ ID NO: 215251

SEQ ID NO: 216329 - RNA, 64 nt, Human; identical to SEQ ID NO: 214579

SEQ ID NO: 216330 - RNA, 64 nt, Human
ccugcuuuccugcagcagucgcccaagcagacagcccuggcaaaugccugacucagugaccagu

SEQ ID NO: 216331 - RNA, 64 nt, Human; identical to SEQ ID NO: 214612

SEQ ID NO: 216332 - RNA, 64 nt, Human; identical to SEQ ID NO: 215252

SEQ ID NO: 216333 - RNA, 64 nt, Human; identical to SEQ ID NO: 215253

SEQ ID NO: 216334 - RNA, 64 nt, Human; identical to SEQ ID NO: 215254

SEQ ID NO: 216335 - RNA, 64 nt, Human; identical to SEQ ID NO: 215255

SEQ ID NO: 216336 - RNA, 64 nt, Human; identical to SEQ ID NO: 215256

SEQ ID NO: 216337 - RNA, 64 nt, Human; identical to SEQ ID NO: 215257

SEQ ID NO: 216338 - RNA, 64 nt, Human; identical to SEQ ID NO: 215261

SEQ ID NO: 216339 - RNA, 64 nt, Human; identical to SEQ ID NO: 215262

SEQ ID NO: 216340 - RNA, 64 nt, Human; identical to SEQ ID NO: 215263

SEQ ID NO: 216341 - RNA, 64 nt, Human; identical to SEQ ID NO: 215264

SEQ ID NO: 216342 - RNA, 64 nt, Human; identical to SEQ ID NO: 215265

SEQ ID NO: 216343 - RNA, 64 nt, Human; identical to SEQ ID NO: 215266

SEQ ID NO: 216344 - RNA, 64 nt, Human; identical to SEQ ID NO: 215267

SEQ ID NO: 216345 - RNA, 64 nt, Human; identical to SEQ ID NO: 215268

SEQ ID NO: 216346 - RNA, 64 nt, Human; identical to SEQ ID NO: 215269

SEQ ID NO: 216347 - RNA, 54 nt, Human; identical to SEQ ID NO: 215270

SEQ ID NO: 216348 - RNA, 64 nt, Human
caguuggcacaccugugggugaaucugccugauccccuggcauuuggucagaguaccucagagc

SEQ ID NO: 216349 - RNA, 64 nt, Human
gcugaugaagcagagauguucgcuggaucccaggcccuggcaccccucaggaaauacaagaaaa

SEQ ID NO: 216350 - RNA, 64 nt, Human
gccccgggcaagggacucuccaggcuccuccucccccuggcaggcccagcaacaugugccccag

SEQ ID NO: 216351 - RNA, 64 nt, Human; identical to SEQ ID NO: 215271

SEQ ID NO: 216352 - RNA, 64 nt, Human; identical to SEQ ID NO: 215272

SEQ ID NO: 216353 - RNA, 64 nt, Human; identical to SEQ ID NO: 215264

SEQ ID NO: 216354 - RNA, 64 nt, Human; identical to SEQ ID NO: 215274

SEQ ID NO: 216355 - RNA, 64 nt, Human; identical to SEQ ID NO: 215275

SEQ ID NO: 216356 - RNA, 64 nt, Human; identical to SEQ ID NO: 215276

SEQ ID NO: 216357 - RNA, 64 nt, Human; identical to SEQ ID NO: 215280

SEQ ID NO: 216358 - RNA, 64 nt, Human; identical to SEQ ID NO: 215281

SEQ ID NO: 216359 - RNA, 64 nt, Human; identical to SEQ ID NO: 215282

SEQ ID NO: 216360 - RNA, 64 nt, Human; identical to SEQ ID NO: 215283

SEQ ID NO: 216361 - RNA, 64 nt, Human; identical to SEQ ID NO: 215284

SEQ ID NO: 216362 - RNA, 64 nt, Human; identical to SEQ ID NO: 215285

SEQ ID NO: 216363 - RNA, 64 nt, Human; identical to SEQ ID NO: 215286

SEQ ID NO: 216364 - RNA, 64 nt, Human; identical to SEQ ID NO: 215287

SEQ ID NO: 216365 - RNA, 64 nt, Human; identical to SEQ ID NO: 215288

SEQ ID NO: 216366 - RNA, 64 nt, Human; identical to SEQ ID NO: 215289

SEQ ID NO: 216367 - RNA, 64 nt, Human
uccccugccaccgacugcccagccacuccaagcccccuggcagcugccccuccuggagcagaaa

SEQ ID NO: 216368 - RNA, 64 nt, Human
gcuggugcucauggcacuuccuccuugcucccaccccuggcagcagggaagggcuuugccugac

SEQ ID NO: 216369 - RNA, 64 nt, Human
ccagagcccugggggguggucuccaugccugccacccuggcaucggcuuucugugccgccuccc

SEQ ID NO: 216370 - RNA, 64 nt, Human; identical to SEQ ID NO: 215290

SEQ ID NO: 216371 - RNA, 64 nt, Human; identical to SEQ ID NO: 215291

SEQ ID NO: 216372 - RNA, 64 nt, Human; identical to SEQ ID NO: 215292

SEQ ID NO: 216373 - RNA, 64 nt, Human; identical to SEQ ID NO: 215293

SEQ ID NO: 216374 - RNA, 64 nt, Human; identical to SEQ ID NO: 215294

SEQ ID NO: 216375 - RNA, 64 nt, Human; identical to SEQ ID NO: 215295

SEQ ID NO: 216376 - RNA, 64 nt, Human; identical to SEQ ID NO: 215299

SEQ ID NO: 216377 - RNA, 64 nt, Human; identical to SEQ ID NO: 215300

SEQ ID NO: 216378 - RNA, 64 nt, Human; identical to SEQ ID NO: 215301

SEQ ID NO: 216379 - RNA, 64 nt, Human; identical to SEQ ID NO: 215302

SEQ ID NO: 216380 - RNA, 64 nt, Human; identical to SEQ ID NO: 215303

SEQ ID NO: 216381 - RNA, 56 nt, Human; identical to SEQ ID NO: 215304

SEQ ID NO: 216382 - RNA, 64 nt, Human; identical to SEQ ID NO: 215305

SEQ ID NO: 216383 - RNA, 59 nt, Human; identical to SEQ ID NO: 215306

SEQ ID NO: 216384 - RNA, 64 nt, Human; identical to SEQ ID NO: 215307

SEQ ID NO: 216385 - RNA, 64 nt, Human; identical to SEQ ID NO: 215308

SEQ ID NO: 216386 - RNA, 64 nt, Human
gagcagucugaauaaacgagaccgggaaagacaucccuggcaggcaucagaacuauuuugcaca

SEQ ID NO: 216387 - RNA, 64 nt, Human; identical to SEQ ID NO: 214707

SEQ ID NO: 216388 - RNA, 64 nt, Human
cuccauccucuggauucuggccaaugaaauaucucccuggcaggguccucuucuuuucccagag

SEQ ID NO: 216389 - RNA, 64 nt, Human; identical to SEQ ID NO: 215309

SEQ ID NO: 216390 - RNA, 64 nt, Human; identical to SEQ ID NO: 215310

SEQ ID NO: 216391 - RNA, 64 nt, Human; identical to SEQ ID NO: 215311

SEQ ID NO: 216392 - RNA, 64 nt, Human; identical to SEQ ID NO: 215312

SEQ ID NO: 216393 - RNA, 64 nt, Human; identical to SEQ ID NO: 215316

SEQ ID NO: 216394 - RNA, 64 nt, Human; identical to SEQ ID NO: 215317

SEQ ID NO: 216395 - RNA, 64 nt, Human; identical to SEQ ID NO: 215318

SEQ ID NO: 216396 - RNA, 64 nt, Human; identical to SEQ ID NO: 215319

SEQ ID NO: 216397 - RNA, 64 nt, Human; identical to SEQ ID NO: 215320

SEQ ID NO: 216398 - RNA, 64 nt, Human; identical to SEQ ID NO: 215321

SEQ ID NO: 216399 - RNA, 51 nt, Human; identical to SEQ ID NO: 215322

SEQ ID NO: 216400 - RNA, 64 nt, Human
gccucuccaguugcugaaguagggucugagagaacccuggcaucagcagacccagggugcuucu

SEQ ID NO: 216401 - RNA, 64 nt, Human
ucugggaaggggaggggaccaugaggcagccagccccuggcaggggcgacugugccaccgcagg

SEQ ID NO: 216402 - RNA, 64 nt, Human; identical to SEQ ID NO: 215323

SEQ ID NO: 216403 - RNA, 64 nt, Human; identical to SEQ ID NO: 215324

SEQ ID NO: 216404 - RNA, 64 nt, Human; identical to SEQ ID NO: 215325

SEQ ID NO: 216405 - RNA, 64 nt, Human; identical to SEQ ID NO: 215326

SEQ ID NO: 216406 - RNA, 64 nt, Human; identical to SEQ ID NO: 215327

SEQ ID NO: 216407 - RNA, 64 nt, Human; identical to SEQ ID NO: 215331

SEQ ID NO: 216408 - RNA, 64 nt, Human; identical to SEQ ID NO: 215332

SEQ ID NO: 216409 - RNA, 64 nt, Human; identical to SEQ ID NO: 215333

SEQ ID NO: 216410 - RNA, 64 nt, Human; identical to SEQ ID NO: 215334

SEQ ID NO: 216411 - RNA, 64 nt, Human; identical to SEQ ID NO: 215335

SEQ ID NO: 216412 - RNA, 64 nt, Human; identical to SEQ ID NO: 215336

SEQ ID NO: 216413 - RNA, 64 nt, Human; identical to SEQ ID NO: 215337

SEQ ID NO: 216414 - RNA, 64 nt, Human; identical to SEQ ID NO: 215338

SEQ ID NO: 216415 - RNA, 64 nt, Human; identical to SEQ ID NO: 215339

SEQ ID NO: 216416 - RNA, 64 nt, Human; identical to SEQ ID NO: 215340

SEQ ID NO: 216417 - RNA, 64 nt, Human; identical to SEQ ID NO: 215341

SEQ ID NO: 216418 - RNA, 64 nt, Human; identical to SEQ ID NO: 214558

SEQ ID NO: 216419 - RNA, 64 nt, Human
uccugugcuucacuuauuuaucccucccgccgugcccuggcaaccacugaucuuuuuacugucu

SEQ ID NO: 216420 - RNA, 64 nt, Human
uuuuuuguuguuuguuucuuuguguugacuuugucccuggcaaaauuuuccacucugaguaaaa

SEQ ID NO: 216421 - RNA, 64 nt, Human; identical to SEQ ID NO: 215342

SEQ ID NO: 216422 - RNA, 64 nt, Human; identical to SEQ ID NO: 215343

SEQ ID NO: 216423 - RNA, 64 nt, Human; identical to SEQ ID NO: 215344

SEQ ID NO: 216424 - RNA, 64 nt, Human; identical to SEQ ID NO: 215345

SEQ ID NO: 216425 - RNA, 64 nt, Human; identical to SEQ ID NO: 215346

SEQ ID NO: 216426 - RNA, 64 nt, Human; identical to SEQ ID NO: 215350

SEQ ID NO: 216427 - RNA, 64 nt, Human; identical to SEQ ID NO: 215351

SEQ ID NO: 216428 - RNA, 64 nt, Human; identical to SEQ ID NO: 215352

SEQ ID NO: 216429 - RNA, 64 nt, Human; identical to SEQ ID NO: 215353

SEQ ID NO: 216430 - RNA, 64 nt, Human; identical to SEQ ID NO: 215354

SEQ ID NO: 216431 - RNA, 64 nt, Human; identical to SEQ ID NO: 215355

SEQ ID NO: 216432 - RNA, 64 nt, Human; identical to SEQ ID NO: 215356

SEQ ID NO: 216433 - RNA, 64 nt, Human; identical to SEQ ID NO: 215357

SEQ ID NO: 216434 - RNA, 64 nt, Human; identical to SEQ ID NO: 215358

SEQ ID NO: 216435 - RNA, 64 nt, Human; identical to SEQ ID NO: 215359

SEQ ID NO: 216436 - RNA, 64 nt, Human; identical to SEQ ID NO: 215360

SEQ ID NO: 216437 - RNA, 64 nt, Human
acuguauccaggacaucacucccaugccagcccucccuggcagcccauguucuccucuuuucuc

SEQ ID NO: 216438 - RNA, 64 nt, Human
cugagcuccugggagcguggaaggagaugcuaggcccuggcacaguguuauguggacugggcca

SEQ ID NO: 216439 - RNA, 64 nt, Human
aauuucugccaggcaugguagcucaugccuguaacccuggcacuuaaggggccaaggcaggagg

SEQ ID NO: 216440 - RNA, 64 nt, Human; identical to SEQ ID NO: 215361

SEQ ID NO: 216441 - RNA, 64 nt, Human; identical to SEQ ID NO: 215362

SEQ ID NO: 216442 - RNA, 64 nt, Human; identical to SEQ ID NO: 215363

SEQ ID NO: 216443 - RNA, 64 nt, Human; identical to SEQ ID NO: 215364

SEQ ID NO: 216444 - RNA, 64 nt, Human; identical to SEQ ID NO: 215365

SEQ ID NO: 216445 - RNA, 64 nt, Human; identical to SEQ ID NO: 215369

SEQ ID NO: 216446 - RNA, 64 nt, Human; identical to SEQ ID NO: 215370

SEQ ID NO: 216447 - RNA, 64 nt, Human; identical to SEQ ID NO: 215371

SEQ ID NO: 216448 - RNA, 64 nt, Human; identical to SEQ ID NO: 215372

SEQ ID NO: 216449 - RNA, 64 nt, Human; identical to SEQ ID NO: 215373

SEQ ID NO: 216450 - RNA, 64 nt, Human; identical to SEQ ID NO: 215374

SEQ ID NO: 216451 - RNA, 61 nt, Human; identical to SEQ ID NO: 215375

SEQ ID NO: 216452 - RNA, 64 nt, Human; identical to SEQ ID NO: 215376

SEQ ID NO: 216453 - RNA, 64 nt, Human; identical to SEQ ID NO: 215377

SEQ ID NO: 216454 - RNA, 64 nt, Human; identical to SEQ ID NO: 215378

SEQ ID NO: 216455 - RNA, 64 nt, Human; identical to SEQ ID NO: 215379

SEQ ID NO: 216456 - RNA, 64 nt, Human
uguuuuagucacagacugagcugaucccaacaggcccuggcagcgucuggacuuguguaaacag

SEQ ID NO: 216457 - RNA, 64 nt, Human
cccuucgugggugauggccacgcccucaccaugucccuggcagagggcuucccuccgggauccc

SEQ ID NO: 216458 - RNA, 64 nt, Human
cugaggcuggcugguggauugugggcaccaggcucccuggcacggccuaacucugcggaccccc

SEQ ID NO: 216459 - RNA, 64 nt, Human; identical to SEQ ID NO: 215380

SEQ ID NO: 216460 - RNA, 54 nt, Human; identical to SEQ ID NO: 215381

SEQ ID NO: 216461 - RNA, 64 nt, Human; identical to SEQ ID NO: 215382

SEQ ID NO: 216462 - RNA, 64 nt, Human; identical to SEQ ID NO: 215383

SEQ ID NO: 216463 - RNA, 64 nt, Human; identical to SEQ ID NO: 215384

SEQ ID NO: 216464 - RNA, 64 nt, Human; identical to SEQ ID NO: 215388

SEQ ID NO: 216465 - RNA, 64 nt, Human; identical to SEQ ID NO: 215389

SEQ ID NO: 216466 - RNA, 64 nt, Human; identical to SEQ ID NO: 215390

SEQ ID NO: 216467 - RNA, 64 nt, Human; identical to SEQ ID NO: 215391

SEQ ID NO: 216468 - RNA, 64 nt, Human; identical to SEQ ID NO: 215392

SEQ ID NO: 216469 - RNA, 64 nt, Human; identical to SEQ ID NO: 215393

SEQ ID NO: 216470 - RNA, 64 nt, Human; identical to SEQ ID NO: 215394

SEQ ID NO: 216471 - RNA, 64 nt, Human; identical to SEQ ID NO: 215395

SEQ ID NO: 216472 - RNA, 64 nt, Human; identical to SEQ ID NO: 215396

SEQ ID NO: 216473 - RNA, 64 nt, Human; identical to SEQ ID NO: 215397

SEQ ID NO: 216474 - RNA, 64 nt, Human; identical to SEQ ID NO: 215398

SEQ ID NO: 216475 - RNA, 64 nt, Human; identical to SEQ ID NO: 214539

SEQ ID NO: 216476 - RNA, 64 nt, Human
gcccuucccgcaccgccgccagcgcccgcagacacccuggcaucucaagagggagugaggagag

SEQ ID NO: 216477 - RNA, 64 nt, Human
gaaggcaguggcaggggagcagguuccccaagggcccuggcacccccacaagcugucccugcag

SEQ ID NO: 216478 - RNA, 64 nt, Human; identical to SEQ ID NO: 215399

SEQ ID NO: 216479 - RNA, 64 nt, Human; identical to SEQ ID NO: 215400

SEQ ID NO: 216480 - RNA, 64 nt, Human; identical to SEQ ID NO: 215401

SEQ ID NO: 216481 - RNA, 64 nt, Human; identical to SEQ ID NO: 215402

SEQ ID NO: 216482 - RNA, 64 nt, Human; identical to SEQ ID NO: 215403

SEQ ID NO: 216483 - RNA, 64 nt, Human; identical to SEQ ID NO: 215407

SEQ ID NO: 216484 - RNA, 64 nt, Human; identical to SEQ ID NO: 215408

SEQ ID NO: 216485 - RNA, 64 nt, Human; identical to SEQ ID NO: 215409

SEQ ID NO: 216486 - RNA, 64 nt, Human; identical to SEQ ID NO: 215410

SEQ ID NO: 216487 - RNA, 64 nt, Human; identical to SEQ ID NO: 215411

SEQ ID NO: 216488 - RNA, 64 nt, Human; identical to SEQ ID NO: 215412

SEQ ID NO: 216489 - RNA, 64 nt, Human; identical to SEQ ID NO: 215413

SEQ ID NO: 216490 - RNA, 64 nt, Human; identical to SEQ ID NO: 215414

SEQ ID NO: 216491 - RNA, 64 nt, Human; identical to SEQ ID NO: 215415

SEQ ID NO: 216492 - RNA, 64 nt, Human; identical to SEQ ID NO: 215416

SEQ ID NO: 216493 - RNA, 59 nt, Human; identical to SEQ ID NO: 215417

SEQ ID NO: 216494 - RNA, 64 nt, Human
accugacaaagaguuuuuuuucaugccccaaccacccuggcagggagggccuggucugaucuca

SEQ ID NO: 216495 - RNA, 64 nt, Human
ggguagcgccucucauuccugaugucucaggcaacccuggcagacccagguccaacugcugggg

SEQ ID NO: 216496 - RNA, 64 nt, Human
caggaguaccuuucuccacaugaccaccaucccgcccuggcauggcaaccugcagcaggauuaa

SEQ ID NO: 216497 - RNA, 64 nt, Human; identical to SEQ ID NO: 215418

SEQ ID NO: 216498 - RNA, 64 nt, Human; identical to SEQ ID NO: 215419

SEQ ID NO: 216499 - RNA, 64 nt, Human; identical to SEQ ID NO: 215420

SEQ ID NO: 216500 - RNA, 64 nt, Human; identical to SEQ ID NO: 215421

SEQ ID NO: 216501 - RNA, 64 nt, Human; identical to SEQ ID NO: 215422

SEQ ID NO: 216502 - RNA, 64 nt, Human; identical to SEQ ID NO: 215426

SEQ ID NO: 216503 - RNA, 64 nt, Human; identical to SEQ ID NO: 215427

SEQ ID NO: 216504 - RNA, 64 nt, Human; identical to SEQ ID NO: 215428

SEQ ID NO: 216505 - RNA, 64 nt, Human; identical to SEQ ID NO: 215429

SEQ ID NO: 216506 - RNA, 64 nt, Human; identical to SEQ ID NO: 215430

SEQ ID NO: 216507 - RNA, 64 nt, Human; identical to SEQ ID NO: 215431

SEQ ID NO: 216508 - RNA, 64 nt, Human; identical to SEQ ID NO: 215432

SEQ ID NO: 216509 - RNA, 64 nt, Human; identical to SEQ ID NO: 215433

SEQ ID NO: 216510 - RNA, 64 nt, Human; identical to SEQ ID NO: 215434

SEQ ID NO: 216511 - RNA, 64 nt, Human; identical to SEQ ID NO: 215435

SEQ ID NO: 216512 - RNA, 64 nt, Human; identical to SEQ ID NO: 215436

SEQ ID NO: 216513 - RNA, 64 nt, Human
gcccuguaaccuggcucuagggcacaggccccuccccuggcacuuagugggucuaauaaaguau

SEQ ID NO: 216514 - RNA, 64 nt, Human
cacacagaacagucugaggugaugcuggcuacagcccuggcagcccauggcaacucaaagugcc

SEQ ID NO: 216515 - RNA, 64 nt, Human
gcugaugggaaggcagagccucggggcugcccagcccuggcaccugcuucacacggaccauucu

SEQ ID NO: 216516 - RNA, 64 nt, Human; identical to SEQ ID NO: 215437

SEQ ID NO: 216517 - RNA, 64 nt, Human; identical to SEQ ID NO: 215438

SEQ ID NO: 216518 - RNA, 64 nt, Human; identical to SEQ ID NO: 215439

SEQ ID NO: 216519 - RNA, 64 nt, Human; identical to SEQ ID NO: 215440

SEQ ID NO: 216520 - RNA, 64 nt, Human; identical to SEQ ID NO: 215441

SEQ ID NO: 216521 - RNA, 64 nt, Human; identical to SEQ ID NO: 215445

SEQ ID NO: 216522 - RNA, 64 nt, Human; identical to SEQ ID NO: 215446

SEQ ID NO: 216523 - RNA, 64 nt, Human; identical to SEQ ID NO: 215447

SEQ ID NO: 216524 - RNA, 64 nt, Human; identical to SEQ ID NO: 215448

SEQ ID NO: 216525 - RNA, 64 nt, Human; identical to SEQ ID NO: 215449

SEQ ID NO: 216526 - RNA, 64 nt, Human; identical to SEQ ID NO: 215450

SEQ ID NO: 216527 - RNA, 64 nt, Human; identical to SEQ ID NO: 215451

SEQ ID NO: 216528 - RNA, 64 nt, Human; identical to SEQ ID NO: 215452

SEQ ID NO: 216529 - RNA, 64 nt, Human; identical to SEQ ID NO: 215453

SEQ ID NO: 216530 - RNA, 64 nt, Human; identical to SEQ ID NO: 215454

SEQ ID NO: 216531 - RNA, 64 nt, Human; identical to SEQ ID NO: 215455

SEQ ID NO: 216532 - RNA, 64 nt, Human
gccagagaucauaggucacuucagguagcaagaccccuggcaaacugggcacuuggccuaugua

SEQ ID NO: 216533 - RNA, 64 nt, Human
uguugugauauuucacauucuauuugcacagguucccuggcacugguaggguagaugauuauug

SEQ ID NO: 216534 - RNA, 64 nt, Human
uugcugaccugggccccggcauugcccccucugccccuggcaccauuccagaacugcccaccuu

SEQ ID NO: 216535 - RNA, 64 nt, Human; identical to SEQ ID NO: 215456

SEQ ID NO: 216536 - RNA, 64 nt, Human; identical to SEQ ID NO: 215457

SEQ ID NO: 216537 - RNA, 64 nt, Human; identical to SEQ ID NO: 215458

SEQ ID NO: 216538 - RNA, 64 nt, Human; identical to SEQ ID NO: 215459

SEQ ID NO: 216539 - RNA, 64 nt, Human; identical to SEQ ID NO: 215460

SEQ ID NO: 216540 - RNA, 64 nt, Human; identical to SEQ ID NO: 215464

SEQ ID NO: 216541 - RNA, 64 nt, Human; identical to SEQ ID NO: 215465

SEQ ID NO: 216542 - RNA, 64 nt, Human; identical to SEQ ID NO: 215466

SEQ ID NO: 216543 - RNA, 64 nt, Human; identical to SEQ ID NO: 215467

SEQ ID NO: 216544 - RNA, 64 nt, Human; identical to SEQ ID NO: 215468

SEQ ID NO: 216545 - RNA, 64 nt, Human; identical to SEQ ID NO: 215469

SEQ ID NO: 216546 - RNA, 64 nt, Human; identical to SEQ ID NO: 215470

SEQ ID NO: 216547 - RNA, 64 nt, Human; identical to SEQ ID NO: 215471

SEQ ID NO: 216548 - RNA, 64 nt, Human; identical to SEQ ID NO: 215472

SEQ ID NO: 216549 - RNA, 64 nt, Human; identical to SEQ ID NO: 215473

SEQ ID NO: 216550 - RNA, 64 nt, Human; identical to SEQ ID NO: 215474

SEQ ID NO: 216551 - RNA, 64 nt, Human
auugaaaaaagagauucaagagccaaguacucagcccuggcaggggauggggacaugaugccca

SEQ ID NO: 216552 - RNA, 64 nt, Human
ccuggcccccaggagcuggaggcaccgcccacuccccuggcauuccagcuuugcaggugacccu

SEQ ID NO: 216553 - RNA, 52 nt, Human
acgucagcagucggcacugagucccuggcaccaggcucuggcgcucugcugg

SEQ ID NO: 216554 - RNA, 64 nt, Human; identical to SEQ ID NO: 215475

SEQ ID NO: 216555 - RNA, 64 nt, Human; identical to SEQ ID NO: 215476

SEQ ID NO: 216556 - RNA, 64 nt, Human; identical to SEQ ID NO: 215477

SEQ ID NO: 216557 - RNA, 64 nt, Human; identical to SEQ ID NO: 215478

SEQ ID NO: 216558 - RNA, 64 nt, Human; identical to SEQ ID NO: 215479

SEQ ID NO: 216559 - RNA, 64 nt, Human; identical to SEQ ID NO: 215483

SEQ ID NO: 216560 - RNA, 64 nt, Human; identical to SEQ ID NO: 215484

SEQ ID NO: 216561 - RNA, 64 nt, Human; identical to SEQ ID NO: 215485

SEQ ID NO: 216562 - RNA, 64 nt, Human; identical to SEQ ID NO: 215486

SEQ ID NO: 216563 - RNA, 64 nt, Human; identical to SEQ ID NO: 215487

SEQ ID NO: 216564 - RNA, 64 nt, Human; identical to SEQ ID NO: 215488

SEQ ID NO: 216565 - RNA, 64 nt, Human; identical to SEQ ID NO: 215489

SEQ ID NO: 216566 - RNA, 64 nt, Human; identical to SEQ ID NO: 215490

SEQ ID NO: 216567 - RNA, 64 nt, Human; identical to SEQ ID NO: 215491

SEQ ID NO: 216568 - RNA, 64 nt, Human; identical to SEQ ID NO: 215492

SEQ ID NO: 216569 - RNA, 64 nt, Human; identical to SEQ ID NO: 215493

SEQ ID NO: 216570 - RNA, 64 nt, Human
augucucagucacuccacgcuccccacaggccaacccuggcacaggucaugucugcagccccca

SEQ ID NO: 216571 - RNA, 64 nt, Human
ccugguaaaggugaccccugccauuuaccagcagcccuggcauguuccugccccacaggaauag

SEQ ID NO: 216572 - RNA, 64 nt, Human
cccccaggggugggggguauggggaccauucauucccuggcauuaaucccuuagagggaauaau

SEQ ID NO: 216573 - RNA, 64 nt, Human; identical to SEQ ID NO: 215494

SEQ ID NO: 216574 - RNA, 64 nt, Human; identical to SEQ ID NO: 215495

SEQ ID NO: 216575 - RNA, 64 nt, Human; identical to SEQ ID NO: 215496

SEQ ID NO: 216576 - RNA, 64 nt, Human; identical to SEQ ID NO: 215497

SEQ ID NO: 216577 - RNA, 64 nt, Human; identical to SEQ ID NO: 215498

SEQ ID NO: 216578 - RNA, 64 nt, Human; identical to SEQ ID NO: 215502

SEQ ID NO: 216579 - RNA, 64 nt, Human; identical to SEQ ID NO: 215503

SEQ ID NO: 216580 - RNA, 64 nt, Human; identical to SEQ ID NO: 215504

SEQ ID NO: 216581 - RNA, 64 nt, Human; identical to SEQ ID NO: 215505

SEQ ID NO: 216582 - RNA, 64 nt, Human; identical to SEQ ID NO: 215506

SEQ ID NO: 216583 - RNA, 64 nt, Human; identical to SEQ ID NO: 215507

SEQ ID NO: 216584 - RNA, 64 nt, Human; identical to SEQ ID NO: 215508

SEQ ID NO: 216585 - RNA, 64 nt, Human; identical to SEQ ID NO: 215509

SEQ ID NO: 216586 - RNA, 64 nt, Human; identical to SEQ ID NO: 215510

SEQ ID NO: 216587 - RNA, 64 nt, Human; identical to SEQ ID NO: 215511

SEQ ID NO: 216588 - RNA, 64 nt, Human; identical to SEQ ID NO: 215512

SEQ ID NO: 216589 - RNA, 64 nt, Human
ccaccaugcccuugggaccugguucucuucuaaccccuggcaauagcccccauuccugggucuu

SEQ ID NO: 216590 - RNA, 64 nt, Human
ggagcagggucuuaggacucucagcucugagcaucccuggcagggucuucaaccucuaaucucu

SEQ ID NO: 216591 - RNA, 64 nt, Human
cuucuggcccccuuaucugcccccgccccacgcgcccuggcagcaccaugagccgccagcuucu

SEQ ID NO: 216592 - RNA, 64 nt, Human; identical to SEQ ID NO: 215513

SEQ ID NO: 216593 - RNA, 64 nt, Human; identical to SEQ ID NO: 215514

SEQ ID NO: 216594 - RNA, 64 nt, Human; identical to SEQ ID NO: 215515

SEQ ID NO: 216595 - RNA, 64 nt, Human; identical to SEQ ID NO: 215516

SEQ ID NO: 216596 - RNA, 64 nt, Human; identical to SEQ ID NO: 215517

SEQ ID NO: 216597 - RNA, 64 nt, Human; identical to SEQ ID NO: 215521

SEQ ID NO: 216598 - RNA, 64 nt, Human; identical to SEQ ID NO: 215522

SEQ ID NO: 216599 - RNA, 64 nt, Human; identical to SEQ ID NO: 215523

SEQ ID NO: 216600 - RNA, 64 nt, Human; identical to SEQ ID NO: 215524

SEQ ID NO: 216601 - RNA, 64 nt, Human; identical to SEQ ID NO: 215525

SEQ ID NO: 216602 - RNA, 64 nt, Human; identical to SEQ ID NO: 215526

SEQ ID NO: 216603 - RNA, 64 nt, Human; identical to SEQ ID NO: 215527

SEQ ID NO: 216604 - RNA, 64 nt, Human; identical to SEQ ID NO: 215528

SEQ ID NO: 216605 - RNA, 64 nt, Human; identical to SEQ ID NO: 215529

SEQ ID NO: 216606 - RNA, 64 nt, Human; identical to SEQ ID NO: 215530

SEQ ID NO: 216607 - RNA, 64 nt, Human; identical to SEQ ID NO: 215531

SEQ ID NO: 216608 - RNA, 64 nt, Human
gcccaucucagcagcaccaggacugccugggacucccuggcaacccagcaccggggaagccguc

SEQ ID NO: 216609 - RNA, 64 nt, Human
ccgcuaggugagaggaaaagcucuuuacuuccgccccuggcagggacuucuggguuaugggaga

SEQ ID NO: 216610 - RNA, 64 nt, Human
gggcucucuucccauccauguugccuaccugugccccuggcagccgcguguccacacaguuagc

SEQ ID NO: 216611 - RNA, 64 nt, Human; identical to SEQ ID NO: 215532

SEQ ID NO: 216612 - RNA, 64 nt, Human; identical to SEQ ID NO: 215533

SEQ ID NO: 216613 - RNA, 64 nt, Human; identical to SEQ ID NO: 215534

SEQ ID NO: 216614 - RNA, 64 nt, Human; identical to SEQ ID NO: 215535

SEQ ID NO: 216615 - RNA, 64 nt, Human; identical to SEQ ID NO: 215536

SEQ ID NO: 216616 - RNA, 57 nt, Human; identical to SEQ ID NO: 215540

SEQ ID NO: 216617 - RNA, 64 nt, Human; identical to SEQ ID NO: 215541

SEQ ID NO: 216618 - RNA, 64 nt, Human; identical to SEQ ID NO: 215542

SEQ ID NO: 216619 - RNA, 64 nt, Human; identical to SEQ ID NO: 215543

SEQ ID NO: 216620 - RNA, 64 nt, Human; identical to SEQ ID NO: 215544

SEQ ID NO: 216621 - RNA, 64 nt, Human; identical to SEQ ID NO: 215545

SEQ ID NO: 216622 - RNA, 64 nt, Human; identical to SEQ ID NO: 215546

SEQ ID NO: 216623 - RNA, 64 nt, Human; identical to SEQ ID NO: 215547

SEQ ID NO: 216624 - RNA, 64 nt, Human; identical to SEQ ID NO: 215548

SEQ ID NO: 216625 - RNA, 64 nt, Human; identical to SEQ ID NO: 215549

SEQ ID NO: 216626 - RNA, 64 nt, Human; identical to SEQ ID NO: 215550

SEQ ID NO: 216627 - RNA, 64 nt, Human; identical to SEQ ID NO: 214480

SEQ ID NO: 216628 - RNA, 64 nt, Human
cgcccuggcaucuuaauaaaaccugcuuauacuucccuggcaggggagauaccaugaucgcgga

SEQ ID NO: 216629 - RNA, 64 nt, Human
agugacaaugacuucugacccuuuugccaagggacccuggcagauuaaaacccucagacuugua

SEQ ID NO: 216630 - RNA, 64 nt, Human; identical to SEQ ID NO: 215551

SEQ ID NO: 216631 - RNA, 64 nt, Human; identical to SEQ ID NO: 215552

SEQ ID NO: 216632 - RNA, 64 nt, Human; identical to SEQ ID NO: 215553

SEQ ID NO: 216633 - RNA, 64 nt, Human; identical to SEQ ID NO: 215554

SEQ ID NO: 216634 - RNA, 64 nt, Human; identical to SEQ ID NO: 215555

SEQ ID NO: 216635 - RNA, 64 nt, Human; identical to SEQ ID NO: 215559

SEQ ID NO: 216636 - RNA, 64 nt, Human; identical to SEQ ID NO: 215560

SEQ ID NO: 216637 - RNA, 64 nt, Human; identical to SEQ ID NO: 215561

SEQ ID NO: 216638 - RNA, 64 nt, Human; identical to SEQ ID NO: 215562

SEQ ID NO: 216639 - RNA, 64 nt, Human; identical to SEQ ID NO: 215563

SEQ ID NO: 216640 - RNA, 64 nt, Human; identical to SEQ ID NO: 215564

SEQ ID NO: 216641 - RNA, 64 nt, Human; identical to SEQ ID NO: 215565

SEQ ID NO: 216642 - RNA, 64 nt, Human; identical to SEQ ID NO: 215566

SEQ ID NO: 216643 - RNA, 64 nt, Human; identical to SEQ ID NO: 215567

SEQ ID NO: 216644 - RNA, 64 nt, Human; identical to SEQ ID NO: 215568

SEQ ID NO: 216645 - RNA, 64 nt, Human; identical to SEQ ID NO: 215569

SEQ ID NO: 216646 - RNA, 64 nt, Human; identical to SEQ ID NO: 214670

SEQ ID NO: 216647 - RNA, 64 nt, Human; identical to SEQ ID NO: 214708

SEQ ID NO: 216648 - RNA, 64 nt, Human
cagauggaauuagagaggugggcucaaaucuaggcccuggcacugucaucaagcaauucacugc

SEQ ID NO: 216649 - RNA, 64 nt, Human; identical to SEQ ID NO: 215570

SEQ ID NO: 216650 - RNA, 64 nt, Human; identical to SEQ ID NO: 215571

SEQ ID NO: 216651 - RNA, 64 nt, Human; identical to SEQ ID NO: 215572

SEQ ID NO: 216652 - RNA, 64 nt, Human; identical to SEQ ID NO: 215573

SEQ ID NO: 216653 - RNA, 63 nt, Human; identical to SEQ ID NO: 215574

SEQ ID NO: 216654 - RNA, 64 nt, Human; identical to SEQ ID NO: 215578

SEQ ID NO: 216655 - RNA, 64 nt, Human; identical to SEQ ID NO: 215579

SEQ ID NO: 216656 - RNA, 64 nt, Human; identical to SEQ ID NO: 215580

SEQ ID NO: 216657 - RNA, 64 nt, Human; identical to SEQ ID NO: 215581

SEQ ID NO: 216658 - RNA, 64 nt, Human; identical to SEQ ID NO: 215582

SEQ ID NO: 216659 - RNA, 64 nt, Human; identical to SEQ ID NO: 215583

SEQ ID NO: 216660 - RNA, 64 nt, Human; identical to SEQ ID NO: 215584

SEQ ID NO: 216661 - RNA, 64 nt, Human; identical to SEQ ID NO: 215585

SEQ ID NO: 216662 - RNA, 64 nt, Human; identical to SEQ ID NO: 215586

SEQ ID NO: 216663 - RNA, 64 nt, Human; identical to SEQ ID NO: 215587

SEQ ID NO: 216664 - RNA, 64 nt, Human; identical to SEQ ID NO: 215588

SEQ ID NO: 216665 - RNA, 64 nt, Human
ccauagcccagcuggagccgugaacacugggguccccuggcagaguccucaugacccauccugg

SEQ ID NO: 216666 - RNA, 64 nt, Human; identical to SEQ ID NO: 214460

SEQ ID NO: 216667 - RNA, 64 nt, Human
ugggucucuccagaccucugggagguagggaguucccuggcacuggcagcauucaguggggacc

SEQ ID NO: 216668 - RNA, 64 nt, Human; identical to SEQ ID NO: 215589

SEQ ID NO: 216669 - RNA, 64 nt, Human; identical to SEQ ID NO: 215590

SEQ ID NO: 216670 - RNA, 64 nt, Human; identical to SEQ ID NO: 215591

SEQ ID NO: 216671 - RNA, 64 nt, Human; identical to SEQ ID NO: 215592

SEQ ID NO: 216672 - RNA, 64 nt, Human; identical to SEQ ID NO: 215593

SEQ ID NO: 216673 - RNA, 64 nt, Human; identical to SEQ ID NO: 215597

SEQ ID NO: 216674 - RNA, 64 nt, Human; identical to SEQ ID NO: 215598

SEQ ID NO: 216675 - RNA, 64 nt, Human; identical to SEQ ID NO: 215599

SEQ ID NO: 216676 - RNA, 64 nt, Human; identical to SEQ ID NO: 215600

SEQ ID NO: 216677 - RNA, 64 nt, Human; identical to SEQ ID NO: 215601

SEQ ID NO: 216678 - RNA, 64 nt, Human; identical to SEQ ID NO: 215602

SEQ ID NO: 216679 - RNA, 64 nt, Human; identical to SEQ ID NO: 215603

SEQ ID NO: 216680 - RNA, 64 nt, Human; identical to SEQ ID NO: 215604

SEQ ID NO: 216681 - RNA, 64 nt, Human; identical to SEQ ID NO: 215605

SEQ ID NO: 216682 - RNA, 64 nt, Human; identical to SEQ ID NO: 215606

SEQ ID NO: 216683 - RNA, 64 nt, Human; identical to SEQ ID NO: 215607

SEQ ID NO: 216684 - RNA, 64 nt, Human
caccccgcugcgggcccacgugguuggggcccugcccuggcagggucauccugugcucggaggc

SEQ ID NO: 216685 - RNA, 64 nt, Human; identical to SEQ ID NO: 214461

SEQ ID NO: 216686 - RNA, 64 nt, Human
uuucacugccugccucuugcggaacuggguuacacccuggcacuguucugauccaagcauauuu

SEQ ID NO: 216687 - RNA, 64 nt, Human; identical to SEQ ID NO: 215608

SEQ ID NO: 216688 - RNA, 64 nt, Human; identical to SEQ ID NO: 215609

SEQ ID NO: 216689 - RNA, 64 nt, Human; identical to SEQ ID NO: 215610

SEQ ID NO: 216690 - RNA, 64 nt, Human; identical to SEQ ID NO: 215611

SEQ ID NO: 216691 - RNA, 64 nt, Human; identical to SEQ ID NO: 215612

SEQ ID NO: 216692 - RNA, 64 nt, Human; identical to SEQ ID NO: 215616

SEQ ID NO: 216693 - RNA, 64 nt, Human; identical to SEQ ID NO: 215617

SEQ ID NO: 216694 - RNA, 64 nt, Human; identical to SEQ ID NO: 215618

SEQ ID NO: 216695 - RNA, 64 nt, Human; identical to SEQ ID NO: 215619

SEQ ID NO: 216696 - RNA, 64 nt, Human; identical to SEQ ID NO: 215620

SEQ ID NO: 216697 - RNA, 64 nt, Human; identical to SEQ ID NO: 215621

SEQ ID NO: 216698 - RNA, 64 nt, Human; identical to SEQ ID NO: 215622

SEQ ID NO: 216699 - RNA, 64 nt, Human; identical to SEQ ID NO: 215623

SEQ ID NO: 216700 - RNA, 64 nt, Human; identical to SEQ ID NO: 215624

SEQ ID NO: 216701 - RNA, 64 nt, Human; identical to SEQ ID NO: 215625

SEQ ID NO: 216702 - RNA, 64 nt, Human; identical to SEQ ID NO: 215626

SEQ ID NO: 216703 - RNA, 50 nt, Human
gguccugcauccucuugugacccuggcacuuggcuuggaggcugccccug

SEQ ID NO: 216704 - RNA, 64 nt, Human; identical to SEQ ID NO: 214478

SEQ ID NO: 216705 - RNA, 64 nt, Human
ccaccuccccucaucuuccccgcccuguccagcgcccuggcaaaggcugacaacuggcugucuu

SEQ ID NO: 216706 - RNA, 64 nt, Human; identical to SEQ ID NO: 215627

SEQ ID NO: 216707 - RNA, 64 nt, Human; identical to SEQ ID NO: 215628

SEQ ID NO: 216708 - RNA, 64 nt, Human; identical to SEQ ID NO: 215629

SEQ ID NO: 216709 - RNA, 64 nt, Human; identical to SEQ ID NO: 215630

SEQ ID NO: 216710 - RNA, 64 nt, Human; identical to SEQ ID NO: 215631

SEQ ID NO: 216711 - RNA, 64 nt, Human; identical to SEQ ID NO: 215635

SEQ ID NO: 216712 - RNA, 64 nt, Human; identical to SEQ ID NO: 215636

SEQ ID NO: 216713 - RNA, 64 nt, Human; identical to SEQ ID NO: 215637

SEQ ID NO: 216714 - RNA, 64 nt, Human; identical to SEQ ID NO: 215638

SEQ ID NO: 216715 - RNA, 64 nt, Human; identical to SEQ ID NO: 215639

SEQ ID NO: 216716 - RNA, 64 nt, Human; identical to SEQ ID NO: 215640

SEQ ID NO: 216717 - RNA, 64 nt, Human; identical to SEQ ID NO: 215641

SEQ ID NO: 216718 - RNA, 64 nt, Human; identical to SEQ ID NO: 215642

SEQ ID NO: 216719 - RNA, 64 nt, Human; identical to SEQ ID NO: 215643

SEQ ID NO: 216720 - RNA, 64 nt, Human; identical to SEQ ID NO: 215644

SEQ ID NO: 216721 - RNA, 64 nt, Human; identical to SEQ ID NO: 215645

SEQ ID NO: 216722 - RNA, 64 nt, Human; identical to SEQ ID NO: 214520

SEQ ID NO: 216723 - RNA, 64 nt, Human
auuucccccuagccugccuccccugccucaccagcccuggcaacugcuaaucuacuuucugugu

SEQ ID NO: 216724 - RNA, 64 nt, Human
cugcaagcaagacuguuuuuuucuuuuuuaguuccccuggcaauaauaauggcacuucaauaga

SEQ ID NO: 216725 - RNA, 64 nt, Human; identical to SEQ ID NO: 215646

SEQ ID NO: 216726 - RNA, 64 nt, Human; identical to SEQ ID NO: 215647

SEQ ID NO: 216727 - RNA, 64 nt, Human; identical to SEQ ID NO: 215648

SEQ ID NO: 216728 - RNA, 64 nt, Human; identical to SEQ ID NO: 215649

SEQ ID NO: 216729 - RNA, 64 nt, Human; identical to SEQ ID NO: 215650

SEQ ID NO: 216730 - RNA, 64 nt, Human; identical to SEQ ID NO: 215654

SEQ ID NO: 216731 - RNA, 64 nt, Human; identical to SEQ ID NO: 215655

SEQ ID NO: 216732 - RNA, 64 nt, Human; identical to SEQ ID NO: 215656

SEQ ID NO: 216733 - RNA, 64 nt, Human; identical to SEQ ID NO: 215657

SEQ ID NO: 216734 - RNA, 64 nt, Human; identical to SEQ ID NO: 215658

SEQ ID NO: 216735 - RNA, 64 nt, Human; identical to SEQ ID NO: 215659

SEQ ID NO: 216736 - RNA, 64 nt, Human; identical to SEQ ID NO: 215660

SEQ ID NO: 216737 - RNA, 64 nt, Human; identical to SEQ ID NO: 215661

SEQ ID NO: 216738 - RNA, 64 nt, Human; identical to SEQ ID NO: 215662

SEQ ID NO: 216739 - RNA, 64 nt, Human; identical to SEQ ID NO: 215663

SEQ ID NO: 216740 - RNA, 64 nt, Human; identical to SEQ ID NO: 215664

SEQ ID NO: 216741 - RNA, 64 nt, Human; identical to SEQ ID NO: 214479

SEQ ID NO: 216742 - RNA, 64 nt, Human
ucgccacacaugcccuuuguugggcugaagccgucccuggcagagcccucgugcauugacuuga

SEQ ID NO: 216743 - RNA, 64 nt, Human
gcaggaagccggcagggaagggccugagugccagcccuggcagacugaggagccucccaggagc

SEQ ID NO: 216744 - RNA, 64 nt, Human; identical to SEQ ID NO: 215665

SEQ ID NO: 216745 - RNA, 64 nt, Human; identical to SEQ ID NO: 215666

SEQ ID NO: 216746 - RNA, 64 nt, Human; identical to SEQ ID NO: 215667

SEQ ID NO: 216747 - RNA, 64 nt, Human; identical to SEQ ID NO: 215668

SEQ ID NO: 216748 - RNA, 64 nt, Human; identical to SEQ ID NO: 215669

SEQ ID NO: 216749 - RNA, 64 nt, Human; identical to SEQ ID NO: 215673

SEQ ID NO: 216750 - RNA, 64 nt, Human; identical to SEQ ID NO: 215674

SEQ ID NO: 216751 - RNA, 56 nt, Human; identical to SEQ ID NO: 215675

SEQ ID NO: 216752 - RNA, 64 nt, Human; identical to SEQ ID NO: 214599

SEQ ID NO: 216753 - RNA, 64 nt, Human; identical to SEQ ID NO: 214600

SEQ ID NO: 216754 - RNA, 64 nt, Human
uacauagccccagcuugggguccaauccaucugucccuggcaugugccuucauguaguaggugc

SEQ ID NO: 216755 - RNA, 64 nt, Human
cacgcagguuaccuuggcgugugucccugugguacccuggcagagaagagaccaagcuuguuuc

SEQ ID NO: 216756 - RNA, 64 nt, Human
cccgccccauugcugccaaugcuggcagccccuccccuggcauggcaggaccaucgccacucug

SEQ ID NO: 216757 - RNA, 64 nt, Human; identical to SEQ ID NO: 214601

SEQ ID NO: 216758 - RNA, 64 nt, Human; identical to SEQ ID NO: 214602

SEQ ID NO: 216759 - RNA, 64 nt, Human; identical to SEQ ID NO: 214603

SEQ ID NO: 216760 - RNA, 64 nt, Human; identical to SEQ ID NO: 214604

SEQ ID NO: 216761 - RNA, 64 nt, Human; identical to SEQ ID NO: 214605

SEQ ID NO: 216762 - RNA, 64 nt, Human; identical to SEQ ID NO: 214606

SEQ ID NO: 216763 - RNA, 64 nt, Human; identical to SEQ ID NO: 214607

SEQ ID NO: 216764 - RNA, 64 nt, Human; identical to SEQ ID NO: 214608

SEQ ID NO: 216765 - RNA, 64 nt, Human; identical to SEQ ID NO: 214609

SEQ ID NO: 216766 - RNA, 64 nt, Human; identical to SEQ ID NO: 214610

SEQ ID NO: 216767 - RNA, 64 nt, Human; identical to SEQ ID NO: 214611

SEQ ID NO: 216768 - RNA, 64 nt, Human; identical to SEQ ID NO: 214615

SEQ ID NO: 216769 - RNA, 64 nt, Human; identical to SEQ ID NO: 214616

SEQ ID NO: 216770 - RNA, 64 nt, Human; identical to SEQ ID NO: 214617

SEQ ID NO: 216771 - RNA, 64 nt, Human; identical to SEQ ID NO: 214618

SEQ ID NO: 216772 - RNA, 64 nt, Human; identical to SEQ ID NO: 214619

SEQ ID NO: 216773 - RNA, 64 nt, Human
aaccacgagcagaugggccuucuccgggaugaggcccuggcagaggugaaggacauggagcagc

SEQ ID NO: 216774 - RNA, 64 nt, Human; identical to SEQ ID NO: 214498

SEQ ID NO: 216775 - RNA, 64 nt, Human
cucccauuccagguacuagcuguguguucugcaccccuggcaccuuccucuccucccacacagg

SEQ ID NO: 216776 - RNA, 64 nt, Human; identical to SEQ ID NO: 214620

SEQ ID NO: 216777 - RNA, 64 nt, Human; identical to SEQ ID NO: 214621

SEQ ID NO: 216778 - RNA, 64 nt, Human; identical to SEQ ID NO: 214622

SEQ ID NO: 216779 - RNA, 64 nt, Human; identical to SEQ ID NO: 214623

SEQ ID NO: 216780 - RNA, 64 nt, Human; identical to SEQ ID NO: 214624

SEQ ID NO: 216781 - RNA, 64 nt, Human; identical to SEQ ID NO: 214625

SEQ ID NO: 216782 - RNA, 64 nt, Human; identical to SEQ ID NO: 214626

SEQ ID NO: 216783 - RNA, 64 nt, Human; identical to SEQ ID NO: 214627

SEQ ID NO: 216784 - RNA, 64 nt, Human; identical to SEQ ID NO: 214628

SEQ ID NO: 216785 - RNA, 55 nt, Human; identical to SEQ ID NO: 214629

SEQ ID NO: 216786 - RNA, 64 nt, Human; identical to SEQ ID NO: 214630

SEQ ID NO: 216787 - RNA, 64 nt, Human; identical to SEQ ID NO: 214634

SEQ ID NO: 216788 - RNA, 64 nt, Human; identical to SEQ ID NO: 214635

SEQ ID NO: 216789 - RNA, 64 nt, Human; identical to SEQ ID NO: 214636

SEQ ID NO: 216790 - RNA, 64 nt, Human; identical to SEQ ID NO: 214637

SEQ ID NO: 216791 - RNA, 64 nt, Human; identical to SEQ ID NO: 214638

SEQ ID NO: 216792 - RNA, 64 nt, Human; identical to SEQ ID NO: 214481

SEQ ID NO: 216793 - RNA, 64 nt, Human
auuuucuagugacagaaugcuaacauuucuuacacccuggcagaagggagagaaauguguuuug

SEQ ID NO: 216794 - RNA, 64 nt, Human; identical to SEQ ID NO: 214521

SEQ ID NO: 216795 - RNA, 64 nt, Human; identical to SEQ ID NO: 214639

SEQ ID NO: 216796 - RNA, 64 nt, Human; identical to SEQ ID NO: 214640

SEQ ID NO: 216797 - RNA, 64 nt, Human; identical to SEQ ID NO: 214641

SEQ ID NO: 216798 - RNA, 64 nt, Human; identical to SEQ ID NO: 214642

SEQ ID NO: 216799 - RNA, 64 nt, Human; identical to SEQ ID NO: 214643

SEQ ID NO: 216800 - RNA, 64 nt, Human; identical to SEQ ID NO: 214644

SEQ ID NO: 216801 - RNA, 64 nt, Human; identical to SEQ ID NO: 214645

SEQ ID NO: 216802 - RNA, 64 nt, Human; identical to SEQ ID NO: 214646

SEQ ID NO: 216803 - RNA, 64 nt, Human; identical to SEQ ID NO: 214647

SEQ ID NO: 216804 - RNA, 64 nt, Human; identical to SEQ ID NO: 214648

SEQ ID NO: 216805 - RNA, 64 nt, Human; identical to SEQ ID NO: 214649

SEQ ID NO: 216806 - RNA, 64 nt, Human; identical to SEQ ID NO: 214653

SEQ ID NO: 216807 - RNA, 64 nt, Human; identical to SEQ ID NO: 214654

SEQ ID NO: 216808 - RNA, 64 nt, Human; identical to SEQ ID NO: 214655

SEQ ID NO: 216809 - RNA, 64 nt, Human; identical to SEQ ID NO: 214656

SEQ ID NO: 216810 - RNA, 64 nt, Human; identical to SEQ ID NO: 214657

SEQ ID NO: 216811 - RNA, 64 nt, Human
cucugguucucccccuucccccucccccaggcugcccuggcacccaaauugcugccaugcuggc

SEQ ID NO: 216812 - RNA, 64 nt, Human; identical to SEQ ID NO: 214499

SEQ ID NO: 216813 - RNA, 64 nt, Human
accuuuaguguuugagcuuugucauugcuugucucccuggcaugugccaguuauagacugucca

SEQ ID NO: 216814 - RNA, 64 nt, Human; identical to SEQ ID NO: 214658

SEQ ID NO: 216815 - RNA, 64 nt, Human; identical to SEQ ID NO: 214659

SEQ ID NO: 216816 - RNA, 64 nt, Human; identical to SEQ ID NO: 214660

SEQ ID NO: 216817 - RNA, 64 nt, Human; identical to SEQ ID NO: 214661

SEQ ID NO: 216818 - RNA, 64 nt, Human; identical to SEQ ID NO: 214662

SEQ ID NO: 216819 - RNA, 64 nt, Human; identical to SEQ ID NO: 214663

SEQ ID NO: 216820 - RNA, 64 nt, Human; identical to SEQ ID NO: 214664

SEQ ID NO: 216821 - RNA, 64 nt, Human; identical to SEQ ID NO: 214665

SEQ ID NO: 216822 - RNA, 64 nt, Human; identical to SEQ ID NO: 214666

SEQ ID NO: 216823 - RNA, 64 nt, Human; identical to SEQ ID NO: 214667

SEQ ID NO: 216824 - RNA, 64 nt, Human; identical to SEQ ID NO: 214668

SEQ ID NO: 216825 - RNA, 64 nt, Human; identical to SEQ ID NO: 214672

SEQ ID NO: 216826 - RNA, 64 nt, Human; identical to SEQ ID NO: 214673

SEQ ID NO: 216827 - RNA, 64 nt, Human; identical to SEQ ID NO: 214674

SEQ ID NO: 216828 - RNA, 64 nt, Human; identical to SEQ ID NO: 214675

SEQ ID NO: 216829 - RNA, 64 nt, Human; identical to SEQ ID NO: 214676

SEQ ID NO: 216830 - RNA, 64 nt, Human
ggacaccucaguuguccucccgcgggcccuggugcccuggcaugaaggcccagugcgacaggcc

SEQ ID NO: 216831 - RNA, 64 nt, Human
ugggggcacgcucuggccccaggcuugugccccacccuggcauacagccccugacaccuccucc

SEQ ID NO: 216832 - RNA, 64 nt, Human; identical to SEQ ID NO: 214500

SEQ ID NO: 216833 - RNA, 64 nt, Human; identical to SEQ ID NO: 214677

SEQ ID NO: 216834 - RNA, 64 nt, Human; identical to SEQ ID NO: 214678

SEQ ID NO: 216835 - RNA, 64 nt, Human; identical to SEQ ID NO: 214679

SEQ ID NO: 216836 - RNA, 64 nt, Human; identical to SEQ ID NO: 214680

SEQ ID NO: 216837 - RNA, 64 nt, Human; identical to SEQ ID NO: 214681

SEQ ID NO: 216838 - RNA, 64 nt, Human; identical to SEQ ID NO: 214682

SEQ ID NO: 216839 - RNA, 64 nt, Human; identical to SEQ ID NO: 214683

SEQ ID NO: 216840 - RNA, 64 nt, Human; identical to SEQ ID NO: 214684

SEQ ID NO: 216841 - RNA, 64 nt, Human; identical to SEQ ID NO: 214685

SEQ ID NO: 216842 - RNA, 64 nt, Human; identical to SEQ ID NO: 214686

SEQ ID NO: 216843 - RNA, 64 nt, Human; identical to SEQ ID NO: 214687

SEQ ID NO: 216844 - RNA, 64 nt, Human; identical to SEQ ID NO: 214691

SEQ ID NO: 216845 - RNA, 64 nt, Human; identical to SEQ ID NO: 214692

SEQ ID NO: 216846 - RNA, 59 nt, Human; identical to SEQ ID NO: 214693

SEQ ID NO: 216847 - RNA, 64 nt, Human; identical to SEQ ID NO: 214694

SEQ ID NO: 216848 - RNA, 64 nt, Human; identical to SEQ ID NO: 214695

SEQ ID NO: 216849 - RNA, 64 nt, Human
gggcugcccugggagcucauuccuggccaacacgcccuggcagcaccagcagcucuugccaccu

SEQ ID NO: 216850 - RNA, 64 nt, Human
ucaccccucuccuguggagcgggcguccgaggggcccuggcaucugacucaggccacaccaugg

SEQ ID NO: 216851 - RNA, 64 nt, Human; identical to SEQ ID NO: 214501

SEQ ID NO: 216852 - RNA, 64 nt, Human; identical to SEQ ID NO: 214696

SEQ ID NO: 216853 - RNA, 64 nt, Human; identical to SEQ ID NO: 214697

SEQ ID NO: 216854 - RNA, 61 nt, Human; identical to SEQ ID NO: 214698

SEQ ID NO: 216855 - RNA, 64 nt, Human; identical to SEQ ID NO: 214699

SEQ ID NO: 216856 - RNA, 64 nt, Human; identical to SEQ ID NO: 214700

SEQ ID NO: 216857 - RNA, 64 nt, Human; identical to SEQ ID NO: 214701

SEQ ID NO: 216858 - RNA, 64 nt, Human; identical to SEQ ID NO: 214702

SEQ ID NO: 216859 - RNA, 64 nt, Human; identical to SEQ ID NO: 214703

SEQ ID NO: 216860 - RNA, 64 nt, Human; identical to SEQ ID NO: 214704

SEQ ID NO: 216861 - RNA, 64 nt, Human; identical to SEQ ID NO: 214705

SEQ ID NO: 216862 - RNA, 64 nt, Human; identical to SEQ ID NO: 214706

SEQ ID NO: 216863 - RNA, 64 nt, Human; identical to SEQ ID NO: 214710

SEQ ID NO: 216864 - RNA, 64 nt, Human; identical to SEQ ID NO: 214711

SEQ ID NO: 216865 - RNA, 64 nt, Human; identical to SEQ ID NO: 214712

SEQ ID NO: 216866 - RNA, 64 nt, Human; identical to SEQ ID NO: 214713

SEQ ID NO: 216867 - RNA, 64 nt, Human; identical to SEQ ID NO: 214714

SEQ ID NO: 216868 - RNA, 64 nt, Human
aucacacagaaaaauggcauuccucucugucucucccuggcauggagagggcagacugugcaca

SEQ ID NO: 216869 - RNA, 64 nt, Human
cucagcuuugauauuucacuuacagcacccccaacccuggcacccagggugggaagggcuacac

SEQ ID NO: 216870 - RNA, 64 nt, Human
gaggggacguugggaggggccacccugcacaggacccuggcaaggauuuugucaucaucuggag

SEQ ID NO: 216871 - RNA, 64 nt, Human; identical to SEQ ID NO: 214715

SEQ ID NO: 216872 - RNA, 64 nt, Human; identical to SEQ ID NO: 214716

SEQ ID NO: 216873 - RNA, 64 nt, Human; identical to SEQ ID NO: 214717

SEQ ID NO: 216874 - RNA, 64 nt, Human; identical to SEQ ID NO: 214718

SEQ ID NO: 216875 - RNA, 64 nt, Human; identical to SEQ ID NO: 214719

SEQ ID NO: 216876 - RNA, 64 nt, Human; identical to SEQ ID NO: 214720

SEQ ID NO: 216877 - RNA, 64 nt, Human; identical to SEQ ID NO: 214721

SEQ ID NO: 216878 - RNA, 64 nt, Human; identical to SEQ ID NO: 214722

SEQ ID NO: 216879 - RNA, 64 nt, Human; identical to SEQ ID NO: 214723

SEQ ID NO: 216880 - RNA, 64 nt, Human; identical to SEQ ID NO: 214724

SEQ ID NO: 216881 - RNA, 64 nt, Human; identical to SEQ ID NO: 214725

SEQ ID NO: 216882 - RNA, 64 nt, Human; identical to SEQ ID NO: 214729

SEQ ID NO: 216883 - RNA, 64 nt, Human; identical to SEQ ID NO: 214730

SEQ ID NO: 216884 - RNA, 64 nt, Human; identical to SEQ ID NO: 214731

SEQ ID NO: 216885 - RNA, 64 nt, Human; identical to SEQ ID NO: 214732

SEQ ID NO: 216886 - RNA, 64 nt, Human; identical to SEQ ID NO: 214733

SEQ ID NO: 216887 - RNA, 64 nt, Human
gcuaaagcaucucacucccagggcagccccagcacccuggcauugcgggaggugcucugcugca

SEQ ID NO: 216888 - RNA, 64 nt, Human
agucaaacuuuuuuguagaaccuucuuucccuuacccuggcaaauugcuucuuuacuugcuggu

SEQ ID NO: 216889 - RNA, 64 nt, Human; identical to SEQ ID NO: 214401

SEQ ID NO: 216890 - RNA, 64 nt, Human; identical to SEQ ID NO: 214734

SEQ ID NO: 216891 - RNA, 64 nt, Human; identical to SEQ ID NO: 214735

SEQ ID NO: 216892 - RNA, 64 nt, Human; identical to SEQ ID NO: 214736

SEQ ID NO: 216893 - RNA, 64 nt, Human; identical to SEQ ID NO: 214737

SEQ ID NO: 216894 - RNA, 64 nt, Human; identical to SEQ ID NO: 214738

SEQ ID NO: 216895 - RNA, 64 nt, Human; identical to SEQ ID NO: 214739

SEQ ID NO: 216896 - RNA, 64 nt, Human; identical to SEQ ID NO: 214740

SEQ ID NO: 216897 - RNA, 64 nt, Human; identical to SEQ ID NO: 214741

SEQ ID NO: 216898 - RNA, 64 nt, Human; identical to SEQ ID NO: 214742

SEQ ID NO: 216899 - RNA, 64 nt, Human; identical to SEQ ID NO: 214743

SEQ ID NO: 216900 - RNA, 64 nt, Human; identical to SEQ ID NO: 214744

SEQ ID NO: 216901 - RNA, 64 nt, Human; identical to SEQ ID NO: 214748

SEQ ID NO: 216902 - RNA, 64 nt, Human; identical to SEQ ID NO: 214749

SEQ ID NO: 216903 - RNA, 64 nt, Human; identical to SEQ ID NO: 214750

SEQ ID NO: 216904 - RNA, 64 nt, Human; identical to SEQ ID NO: 214751

SEQ ID NO: 216905 - RNA, 64 nt, Human; identical to SEQ ID NO: 214752

SEQ ID NO: 216906 - RNA, 64 nt, Human
ugcugggccucgcagcauucccaagggucacaugcccuggcaugggcagaaacugggcuaauga

SEQ ID NO: 216907 - RNA, 64 nt, Human
gaugauggggugaggcaugucuuuccagaacuuucccuggcagggaggggauggcagaaacuca

SEQ ID NO: 216908 - RNA, 64 nt, Human
agauccugcucccucccugcugagccugggguuccccuggcauuggccccagccuucugaaagc

SEQ ID NO: 216909 - RNA, 64 nt, Human; identical to SEQ ID NO: 214753

SEQ ID NO: 216910 - RNA, 64 nt, Human; identical to SEQ ID NO: 214754

SEQ ID NO: 216911 - RNA, 64 nt, Human; identical to SEQ ID NO: 214755

SEQ ID NO: 216912 - RNA, 64 nt, Human; identical to SEQ ID NO: 214756

SEQ ID NO: 216913 - RNA, 64 nt, Human; identical to SEQ ID NO: 214757

SEQ ID NO: 216914 - RNA, 64 nt, Human; identical to SEQ ID NO: 214758

SEQ ID NO: 216915 - RNA, 64 nt, Human; identical to SEQ ID NO: 214759

SEQ ID NO: 216916 - RNA, 64 nt, Human; identical to SEQ ID NO: 214760

SEQ ID NO: 216917 - RNA, 64 nt, Human; identical to SEQ ID NO: 214761

SEQ ID NO: 216918 - RNA, 64 nt, Human; identical to SEQ ID NO: 214762

SEQ ID NO: 216919 - RNA, 64 nt, Human; identical to SEQ ID NO: 214763

SEQ ID NO: 216920 - RNA, 64 nt, Human; identical to SEQ ID NO: 214767

SEQ ID NO: 216921 - RNA, 64 nt, Human; identical to SEQ ID NO: 214768

SEQ ID NO: 216922 - RNA, 64 nt, Human; identical to SEQ ID NO: 214769

SEQ ID NO: 216923 - RNA, 64 nt, Human; identical to SEQ ID NO: 214770

SEQ ID NO: 216924 - RNA, 64 nt, Human; identical to SEQ ID NO: 214771

SEQ ID NO: 216925 - RNA, 64 nt, Human; identical to SEQ ID NO: 214418

SEQ ID NO: 216926 - RNA, 64 nt, Human
ccaaggccaggccuuggggacaaccuuggcuuggcccuggcagcccgcaucagcugcucagauc

SEQ ID NO: 216927 - RNA, 64 nt, Human; identical to SEQ ID NO: 214440

SEQ ID NO: 216928 - RNA, 64 nt, Human; identical to SEQ ID NO: 214772

SEQ ID NO: 216929 - RNA, 64 nt, Human; identical to SEQ ID NO: 214773

SEQ ID NO: 216930 - RNA, 64 nt, Human; identical to SEQ ID NO: 214774

SEQ ID NO: 216931 - RNA, 64 nt, Human; identical to SEQ ID NO: 214775

SEQ ID NO: 216932 - RNA, 64 nt, Human; identical to SEQ ID NO: 214776

SEQ ID NO: 216933 - RNA, 64 nt, Human; identical to SEQ ID NO: 214777

SEQ ID NO: 216934 - RNA, 64 nt, Human; identical to SEQ ID NO: 214778

SEQ ID NO: 216935 - RNA, 64 nt, Human; identical to SEQ ID NO: 214779

SEQ ID NO: 216936 - RNA, 64 nt, Human; identical to SEQ ID NO: 214780

SEQ ID NO: 216937 - RNA, 64 nt, Human; identical to SEQ ID NO: 214781

SEQ ID NO: 216938 - RNA, 64 nt, Human; identical to SEQ ID NO: 214782

SEQ ID NO: 216939 - RNA, 64 nt, Human; identical to SEQ ID NO: 214786

SEQ ID NO: 216940 - RNA, 64 nt, Human; identical to SEQ ID NO: 214787

SEQ ID NO: 216941 - RNA, 64 nt, Human; identical to SEQ ID NO: 214788

SEQ ID NO: 216942 - RNA, 64 nt, Human; identical to SEQ ID NO: 214789

SEQ ID NO: 216943 - RNA, 64 nt, Human; identical to SEQ ID NO: 214790

SEQ ID NO: 216944 - RNA, 64 nt, Human
accuauggcagagcauccucucugcccugggugacccuggcaggugcgcucagagcuguccuca

SEQ ID NO: 216945 - RNA, 64 nt, Human
uccccuggaaacccaccucucuggaaggccccuucccuggcagguggccaggcaggcgggggcu

SEQ ID NO: 216946 - RNA, 64 nt, Human
uguuugcuuccuuccagagcagaguucccuauuccccuggcauaaagaauguauauauauuuug

SEQ ID NO: 216947 - RNA, 64 nt, Human; identical to SEQ ID NO: 214791

SEQ ID NO: 216948 - RNA, 64 nt, Human; identical to SEQ ID NO: 214792

SEQ ID NO: 216949 - RNA, 64 nt, Human; identical to SEQ ID NO: 214793

SEQ ID NO: 216950 - RNA, 64 nt, Human; identical to SEQ ID NO: 214794

SEQ ID NO: 216951 - RNA, 64 nt, Human; identical to SEQ ID NO: 214795

SEQ ID NO: 216952 - RNA, 64 nt, Human; identical to SEQ ID NO: 214796

SEQ ID NO: 216953 - RNA, 64 nt, Human; identical to SEQ ID NO: 214797

SEQ ID NO: 216954 - RNA, 64 nt, Human; identical to SEQ ID NO: 214798

SEQ ID NO: 216955 - RNA, 64 nt, Human; identical to SEQ ID NO: 214799

SEQ ID NO: 216956 - RNA, 64 nt, Human; identical to SEQ ID NO: 214800

SEQ ID NO: 216957 - RNA, 64 nt, Human; identical to SEQ ID NO: 214801

SEQ ID NO: 216958 - RNA, 64 nt, Human; identical to SEQ ID NO: 214805

SEQ ID NO: 216959 - RNA, 64 nt, Human; identical to SEQ ID NO: 214806

SEQ ID NO: 216960 - RNA, 64 nt, Human; identical to SEQ ID NO: 214807

SEQ ID NO: 216961 - RNA, 64 nt, Human; identical to SEQ ID NO: 214808

SEQ ID NO: 216962 - RNA, 64 nt, Human; identical to SEQ ID NO: 214809

SEQ ID NO: 216963 - RNA, 64 nt, Human
acuggaauuaucuaguccccagauugaucaucuccccuggcaacgugacucuguuuuuugugug

SEQ ID NO: 216964 - RNA, 64 nt, Human
cuccugugcacagcccacccacuuuccucugcuucccuggcacagcccaggcauagacgagcug

SEQ ID NO: 216965 - RNA, 64 nt, Human
gcuggugagaguugggcuucuuggucuuggaacucccuggcauugggaacagagcauuuccagc

SEQ ID NO: 216966 - RNA, 64 nt, Human; identical to SEQ ID NO: 214810

SEQ ID NO: 216967 - RNA, 64 nt, Human; identical to SEQ ID NO: 214811

SEQ ID NO: 216968 - RNA, 64 nt, Human; identical to SEQ ID NO: 214812

SEQ ID NO: 216969 - RNA, 64 nt, Human; identical to SEQ ID NO: 214813

SEQ ID NO: 216970 - RNA, 64 nt, Human; identical to SEQ ID NO: 214814

SEQ ID NO: 216971 - RNA, 64 nt, Human; identical to SEQ ID NO: 214815

SEQ ID NO: 216972 - RNA, 64 nt, Human; identical to SEQ ID NO: 214816

SEQ ID NO: 216973 - RNA, 64 nt, Human; identical to SEQ ID NO: 214817

SEQ ID NO: 216974 - RNA, 64 nt, Human; identical to SEQ ID NO: 214818

SEQ ID NO: 216975 - RNA, 64 nt, Human; identical to SEQ ID NO: 214819

SEQ ID NO: 216976 - RNA, 64 nt, Human; identical to SEQ ID NO: 214820

SEQ ID NO: 216977 - RNA, 64 nt, Human; identical to SEQ ID NO: 214824

SEQ ID NO: 216978 - RNA, 64 nt, Human; identical to SEQ ID NO: 214825

SEQ ID NO: 216979 - RNA, 64 nt, Human; identical to SEQ ID NO: 214826

SEQ ID NO: 216980 - RNA, 64 nt, Human; identical to SEQ ID NO: 214827

SEQ ID NO: 216981 - RNA, 64 nt, Human; identical to SEQ ID NO: 214828

SEQ ID NO: 216982 - RNA, 64 nt, Human
caggcccagggccgcaugugugcacucuacgccucccuggcacugcuaucaggacugagccagg

SEQ ID NO: 216983 - RNA, 64 nt, Human; identical to SEQ ID NO: 214419

SEQ ID NO: 216984 - RNA, 64 nt, Human
agugaauguuccuguuugaugugacaggaauucucccuggcauuguuuccacccccuggugccu

SEQ ID NO: 216985 - RNA, 64 nt, Human; identical to SEQ ID NO: 214829

SEQ ID NO: 216986 - RNA, 64 nt, Human; identical to SEQ ID NO: 214830

SEQ ID NO: 216987 - RNA, 64 nt, Human; identical to SEQ ID NO: 214831

SEQ ID NO: 216988 - RNA, 61 nt, Human; identical to SEQ ID NO: 214832

SEQ ID NO: 216989 - RNA, 64 nt, Human; identical to SEQ ID NO: 214833

SEQ ID NO: 216990 - RNA, 64 nt, Human; identical to SEQ ID NO: 214834

SEQ ID NO: 216991 - RNA, 64 nt, Human; identical to SEQ ID NO: 214835

SEQ ID NO: 216992 - RNA, 64 nt, Human; identical to SEQ ID NO: 214836

SEQ ID NO: 216993 - RNA, 64 nt, Human; identical to SEQ ID NO: 214837

SEQ ID NO: 216994 - RNA, 64 nt, Human; identical to SEQ ID NO: 214838

SEQ ID NO: 216995 - RNA, 64 nt, Human; identical to SEQ ID NO: 214839

SEQ ID NO: 216996 - RNA, 64 nt, Human; identical to SEQ ID NO: 214843

SEQ ID NO: 216997 - RNA, 64 nt, Human; identical to SEQ ID NO: 214844

SEQ ID NO: 216998 - RNA, 64 nt, Human; identical to SEQ ID NO: 214845

SEQ ID NO: 216999 - RNA, 64 nt, Human; identical to SEQ ID NO: 214846

SEQ ID NO: 217000 - RNA, 64 nt, Human; identical to SEQ ID NO: 214847

SEQ ID NO: 217001 - RNA, 64 nt, Human
ccuuucuugaauggcuucguguuacucagccgugcccuggcaggaauggaacuccaucagggaa

SEQ ID NO: 217002 - RNA, 64 nt, Human
aaaaggcaaucuaugacucaccuugcucugccaucccuggcagcccccaccgguguccuguucc

SEQ ID NO: 217003 - RNA, 64 nt, Human
cagauuccaguguacuagucauggaucuuucucucccuggcaugugaaagucagucuuagagga

SEQ ID NO: 217004 - RNA, 64 nt, Human; identical to SEQ ID NO: 214848

SEQ ID NO: 217005 - RNA, 64 nt, Human; identical to SEQ ID NO: 214849

SEQ ID NO: 217006 - RNA, 64 nt, Human; identical to SEQ ID NO: 214850

SEQ ID NO: 217007 - RNA, 64 nt, Human; identical to SEQ ID NO: 214851

SEQ ID NO: 217008 - RNA, 64 nt, Human; identical to SEQ ID NO: 214852

SEQ ID NO: 217009 - RNA, 64 nt, Human; identical to SEQ ID NO: 214853

SEQ ID NO: 217010 - RNA, 64 nt, Human; identical to SEQ ID NO: 214854

SEQ ID NO: 217011 - RNA, 64 nt, Human; identical to SEQ ID NO: 214855

SEQ ID NO: 217012 - RNA, 64 nt, Human; identical to SEQ ID NO: 214856

SEQ ID NO: 217013 - RNA, 64 nt, Human; identical to SEQ ID NO: 214857

SEQ ID NO: 217014 - RNA, 64 nt, Human; identical to SEQ ID NO: 214858

SEQ ID NO: 217015 - RNA, 64 nt, Human; identical to SEQ ID NO: 214862

SEQ ID NO: 217016 - RNA, 64 nt, Human; identical to SEQ ID NO: 214863

SEQ ID NO: 217017 - RNA, 64 nt, Human; identical to SEQ ID NO: 214864

SEQ ID NO: 217018 - RNA, 64 nt, Human; identical to SEQ ID NO: 214865

SEQ ID NO: 217019 - RNA, 64 nt, Human; identical to SEQ ID NO: 214866

SEQ ID NO: 217020 - RNA, 64 nt, Human
aggguaguagggggcaccugaggagcagggucugcccuggcaugagcagagcccaggauggggu

SEQ ID NO: 217021 - RNA, 64 nt, Human
ccucuucuccccucucucagauuggccuggcagccccuggcacagagcagacccggccacuggu

SEQ ID NO: 217022 - RNA, 64 nt, Human; identical to SEQ ID NO: 214438

SEQ ID NO: 217023 - RNA, 64 nt, Human; identical to SEQ ID NO: 214867

SEQ ID NO: 217024 - RNA, 53 nt, Human; identical to SEQ ID NO: 214868

SEQ ID NO: 217025 - RNA, 64 nt, Human; identical to SEQ ID NO: 214869

SEQ ID NO: 217026 - RNA, 64 nt, Human; identical to SEQ ID NO: 214870

SEQ ID NO: 217027 - RNA, 64 nt, Human; identical to SEQ ID NO: 214871

SEQ ID NO: 217028 - RNA, 64 nt, Human; identical to SEQ ID NO: 214872

SEQ ID NO: 217029 - RNA, 64 nt, Human; identical to SEQ ID NO: 214873

SEQ ID NO: 217030 - RNA, 64 nt, Human; identical to SEQ ID NO: 214874

SEQ ID NO: 217031 - RNA, 64 nt, Human; identical to SEQ ID NO: 214875

SEQ ID NO: 217032 - RNA, 64 nt, Human; identical to SEQ ID NO: 214876

SEQ ID NO: 217033 - RNA, 64 nt, Human; identical to SEQ ID NO: 214877

SEQ ID NO: 217034 - RNA, 64 nt, Human; identical to SEQ ID NO: 214881

SEQ ID NO: 217035 - RNA, 64 nt, Human; identical to SEQ ID NO: 214882

SEQ ID NO: 217036 - RNA, 64 nt, Human; identical to SEQ ID NO: 214883

SEQ ID NO: 217037 - RNA, 64 nt, Human; identical to SEQ ID NO: 214884

SEQ ID NO: 217038 - RNA, 64 nt, Human; identical to SEQ ID NO: 214885

SEQ ID NO: 217039 - RNA, 64 nt, Human
aaaaaauaacucgccauuucucucucuccccagccccuggcaaccaccauucuuucugucucug

SEQ ID NO: 217040 - RNA, 64 nt, Human; identical to SEQ ID NO: 214439

SEQ ID NO: 217041 - RNA, 64 nt, Human
aucccuucccccgccgccgccccgcgcgggugcgcccuggcacccucucccugcccuccagcgu

SEQ ID NO: 217042 - RNA, 64 nt, Human; identical to SEQ ID NO: 214886

SEQ ID NO: 217043 - RNA, 64 nt, Human; identical to SEQ ID NO: 214887

SEQ ID NO: 217044 - RNA, 64 nt, Human; identical to SEQ ID NO: 214888

SEQ ID NO: 217045 - RNA, 64 nt, Human; identical to SEQ ID NO: 214889

SEQ ID NO: 217046 - RNA, 64 nt, Human; identical to SEQ ID NO: 214890

SEQ ID NO: 217047 - RNA, 64 nt, Human; identical to SEQ ID NO: 214891

SEQ ID NO: 217048 - RNA, 64 nt, Human; identical to SEQ ID NO: 214892

SEQ ID NO: 217049 - RNA, 64 nt, Human; identical to SEQ ID NO: 214893

SEQ ID NO: 217050 - RNA, 64 nt, Human; identical to SEQ ID NO: 214894

SEQ ID NO: 217051 - RNA, 64 nt, Human; identical to SEQ ID NO: 214895

SEQ ID NO: 217052 - RNA, 64 nt, Human; identical to SEQ ID NO: 214896

SEQ ID NO: 217053 - RNA, 64 nt, Human; identical to SEQ ID NO: 214900

SEQ ID NO: 217054 - RNA, 64 nt, Human; identical to SEQ ID NO: 214901

SEQ ID NO: 217055 - RNA, 64 nt, Human; identical to SEQ ID NO: 214902

SEQ ID NO: 217056 - RNA, 64 nt, Human; identical to SEQ ID NO: 214811

SEQ ID NO: 217057 - RNA, 64 nt, Human; identical to SEQ ID NO: 214904

SEQ ID NO: 217058 - RNA, 64 nt, Human
gguccuggggucccuagagugguccugcagcagccccuggcaaugagcugccugaugaugaguc

SEQ ID NO: 217059 - RNA, 64 nt, Human; identical to SEQ ID NO: 214420

SEQ ID NO: 217060 - RNA, 64 nt, Human
gggggccccuggguggacaccaccagccaccagucccuggcaugcccagugauccugguucccu

SEQ ID NO: 217061 - RNA, 64 nt, Human; identical to SEQ ID NO: 214905

SEQ ID NO: 217062 - RNA, 64 nt, Human; identical to SEQ ID NO: 214906

SEQ ID NO: 217063 - RNA, 64 nt, Human; identical to SEQ ID NO: 214907

SEQ ID NO: 217064 - RNA, 64 nt, Human; identical to SEQ ID NO: 214908

SEQ ID NO: 217065 - RNA, 64 nt, Human; identical to SEQ ID NO: 214909

SEQ ID NO: 217066 - RNA, 64 nt, Human; identical to SEQ ID NO: 214910

SEQ ID NO: 217067 - RNA, 64 nt, Human; identical to SEQ ID NO: 214911

SEQ ID NO: 217068 - RNA, 64 nt, Human; identical to SEQ ID NO: 214912

SEQ ID NO: 217069 - RNA, 64 nt, Human; identical to SEQ ID NO: 214913

SEQ ID NO: 217070 - RNA, 64 nt, Human; identical to SEQ ID NO: 214914

SEQ ID NO: 217071 - RNA, 64 nt, Human; identical to SEQ ID NO: 214915

SEQ ID NO: 217072 - RNA, 64 nt, Human; identical to SEQ ID NO: 214919

SEQ ID NO: 217073 - RNA, 64 nt, Human; identical to SEQ ID NO: 214920

SEQ ID NO: 217074 - RNA, 64 nt, Human; identical to SEQ ID NO: 214921

SEQ ID NO: 217075 - RNA, 64 nt, Human; identical to SEQ ID NO: 214922

SEQ ID NO: 217076 - RNA, 64 nt, Human; identical to SEQ ID NO: 214923

SEQ ID NO: 217077 - RNA, 64 nt, Human
ggcugccccuugcuggaccugaauucuacugagucccuggcaagacugucuuaccuggcagcaa

SEQ ID NO: 217078 - RNA, 64 nt, Human
uguuuucagcuguggguggccaugcagacacgcgcccuggcauguggggccugggugggcaggc

SEQ ID NO: 217079 - RNA, 64 nt, Human
uuuccacugagacaaauccuaggcuccugggaggcccuggcagaagccagaacacauggcuggg

SEQ ID NO: 217080 - RNA, 64 nt, Human; identical to SEQ ID NO: 214924

SEQ ID NO: 217081 - RNA, 64 nt, Human; identical to SEQ ID NO: 214925

SEQ ID NO: 217082 - RNA, 64 nt, Human; identical to SEQ ID NO: 214926

SEQ ID NO: 217083 - RNA, 64 nt, Human; identical to SEQ ID NO: 214927

SEQ ID NO: 217084 - RNA, 64 nt, Human; identical to SEQ ID NO: 214928

SEQ ID NO: 217085 - RNA, 64 nt, Human; identical to SEQ ID NO: 214929

SEQ ID NO: 217086 - RNA, 64 nt, Human; identical to SEQ ID NO: 214930

SEQ ID NO: 217087 - RNA, 64 nt, Human; identical to SEQ ID NO: 214931

SEQ ID NO: 217088 - RNA, 64 nt, Human; identical to SEQ ID NO: 214932

SEQ ID NO: 217089 - RNA, 64 nt, Human; identical to SEQ ID NO: 214933

SEQ ID NO: 217090 - RNA, 64 nt, Human; identical to SEQ ID NO: 214934

SEQ ID NO: 217091 - RNA, 64 nt, Human; identical to SEQ ID NO: 214938

SEQ ID NO: 217092 - RNA, 64 nt, Human; identical to SEQ ID NO: 214939

SEQ ID NO: 217093 - RNA, 64 nt, Human; identical to SEQ ID NO: 214940

SEQ ID NO: 217094 - RNA, 64 nt, Human; identical to SEQ ID NO: 214941

SEQ ID NO: 217095 - RNA, 64 nt, Human; identical to SEQ ID NO: 214942

SEQ ID NO: 217096 - RNA, 64 nt, Human; identical to SEQ ID NO: 214518

SEQ ID NO: 217097 - RNA, 64 nt, Human
agggccuaggaggaccccgggcguggaccacccgcccuggcaguugaauggggcggcaauugcg

SEQ ID NO: 217098 - RNA, 64 nt, Human
cauguggcacauccauguuaaggggcugaggcgucccuggcacggaaugcagagcccugagcua

SEQ ID NO: 217099 - RNA, 64 nt, Human; identical to SEQ ID NO: 214943

SEQ ID NO: 217100 - RNA, 64 nt, Human; identical to SEQ ID NO: 214944

SEQ ID NO: 217101 - RNA, 64 nt, Human; identical to SEQ ID NO: 214945

SEQ ID NO: 217102 - RNA, 64 nt, Human; identical to SEQ ID NO: 214946

SEQ ID NO: 217103 - RNA, 64 nt, Human; identical to SEQ ID NO: 214947

SEQ ID NO: 217104 - RNA, 64 nt, Human; identical to SEQ ID NO: 214948

SEQ ID NO: 217105 - RNA, 64 nt, Human; identical to SEQ ID NO: 214949

SEQ ID NO: 217106 - RNA, 64 nt, Human; identical to SEQ ID NO: 214950

SEQ ID NO: 217107 - RNA, 64 nt, Human; identical to SEQ ID NO: 214951

SEQ ID NO: 217108 - RNA, 64 nt, Human; identical to SEQ ID NO: 214952

SEQ ID NO: 217109 - RNA, 64 nt, Human; identical to SEQ ID NO: 214953

SEQ ID NO: 217110 - RNA, 64 nt, Human; identical to SEQ ID NO: 214957

SEQ ID NO: 217111 - RNA, 64 nt, Human; identical to SEQ ID NO: 214958

SEQ ID NO: 217112 - RNA, 64 nt, Human; identical to SEQ ID NO: 214959

SEQ ID NO: 217113 - RNA, 64 nt, Human; identical to SEQ ID NO: 214960

SEQ ID NO: 217114 - RNA, 64 nt, Human; identical to SEQ ID NO: 214961

SEQ ID NO: 217115 - RNA, 64 nt, Human
gagccagucagggugguguggcgguugcagcggccccuggcagaggccccgcggagcaagcucu

SEQ ID NO: 217116 - RNA, 64 nt, Human
uuguagcauugcugucugcaagggagccccuagccccuggcagacauagcugcuucagugcccc

SEQ ID NO: 217117 - RNA, 64 nt, Human; identical to SEQ ID NO: 214441

SEQ ID NO: 217118 - RNA, 64 nt, Human; identical to SEQ ID NO: 214962

SEQ ID NO: 217119 - RNA, 64 nt, Human; identical to SEQ ID NO: 214963

SEQ ID NO: 217120 - RNA, 64 nt, Human; identical to SEQ ID NO: 214964

SEQ ID NO: 217121 - RNA, 64 nt, Human; identical to SEQ ID NO: 214965

SEQ ID NO: 217122 - RNA, 64 nt, Human; identical to SEQ ID NO: 214966

SEQ ID NO: 217123 - RNA, 64 nt, Human; identical to SEQ ID NO: 214967

SEQ ID NO: 217124 - RNA, 64 nt, Human; identical to SEQ ID NO: 214968

SEQ ID NO: 217125 - RNA, 64 nt, Human; identical to SEQ ID NO: 214969

SEQ ID NO: 217126 - RNA, 64 nt, Human; identical to SEQ ID NO: 214970

SEQ ID NO: 217127 - RNA, 64 nt, Human; identical to SEQ ID NO: 214971

SEQ ID NO: 217128 - RNA, 64 nt, Human; identical to SEQ ID NO: 214972

SEQ ID NO: 217129 - RNA, 64 nt, Human; identical to SEQ ID NO: 214976

SEQ ID NO: 217130 - RNA, 64 nt, Human; identical to SEQ ID NO: 214977

SEQ ID NO: 217131 - RNA, 64 nt, Human; identical to SEQ ID NO: 214978

SEQ ID NO: 217132 - RNA, 64 nt, Human; identical to SEQ ID NO: 214979

SEQ ID NO: 217133 - RNA, 64 nt, Human; identical to SEQ ID NO: 214980

SEQ ID NO: 217134 - RNA, 64 nt, Human
caucauucuccugcuuuguacauagggugugguccccuggcacguggccaccaucaugucuagg

SEQ ID NO: 217135 - RNA, 64 nt, Human
ggguacuuugucaccccccucccccugccacccucccuggcacguuuauuucacagcagagcca

SEQ ID NO: 217136 - RNA, 61 nt, Human; identical to SEQ ID NO: 214359

SEQ ID NO: 217137 - RNA, 64 nt, Human; identical to SEQ ID NO: 214981

SEQ ID NO: 217138 - RNA, 64 nt, Human; identical to SEQ ID NO: 214982

SEQ ID NO: 217139 - RNA, 64 nt, Human; identical to SEQ ID NO: 214983

SEQ ID NO: 217140 - RNA, 64 nt, Human; identical to SEQ ID NO: 214984

SEQ ID NO: 217141 - RNA, 64 nt, Human; identical to SEQ ID NO: 214985

SEQ ID NO: 217142 - RNA, 64 nt, Human; identical to SEQ ID NO: 214986

SEQ ID NO: 217143 - RNA, 64 nt, Human; identical to SEQ ID NO: 214987

SEQ ID NO: 217144 - RNA, 64 nt, Human; identical to SEQ ID NO: 214988

SEQ ID NO: 217145 - RNA, 64 nt, Human; identical to SEQ ID NO: 214989

SEQ ID NO: 217146 - RNA, 64 nt, Human; identical to SEQ ID NO: 214990

SEQ ID NO: 217147 - RNA, 64 nt, Human; identical to SEQ ID NO: 214991

SEQ ID NO: 217148 - RNA, 64 nt, Human; identical to SEQ ID NO: 214995

SEQ ID NO: 217149 - RNA, 64 nt, Human; identical to SEQ ID NO: 214996

SEQ ID NO: 217150 - RNA, 64 nt, Human; identical to SEQ ID NO: 214997

SEQ ID NO: 217151 - RNA, 64 nt, Human; identical to SEQ ID NO: 214998

SEQ ID NO: 217152 - RNA, 64 nt, Human; identical to SEQ ID NO: 214999

SEQ ID NO: 217153 - RNA, 64 nt, Human
ggccccuugcuggccacccuauaggguccuccuucccuggcagccccccaugugggagaaauac

SEQ ID NO: 217154 - RNA, 64 nt, Human
ggggaguucuccaggccuagggccaggagagaggcccuggcacccuggcgugggugcccgccaa

SEQ ID NO: 217155 - RNA, 64 nt, Human; identical to SEQ ID NO: 214360

SEQ ID NO: 217156 - RNA, 64 nt, Human; identical to SEQ ID NO: 215000

SEQ ID NO: 217157 - RNA, 64 nt, Human; identical to SEQ ID NO: 215001

SEQ ID NO: 217158 - RNA, 64 nt, Human; identical to SEQ ID NO: 215002

SEQ ID NO: 217159 - RNA, 64 nt, Human; identical to SEQ ID NO: 215003

SEQ ID NO: 217160 - RNA, 64 nt, Human; identical to SEQ ID NO: 215004

SEQ ID NO: 217161 - RNA, 64 nt, Human; identical to SEQ ID NO: 215005

SEQ ID NO: 217162 - RNA, 64 nt, Human; identical to SEQ ID NO: 215006

SEQ ID NO: 217163 - RNA, 64 nt, Human; identical to SEQ ID NO: 215007

SEQ ID NO: 217164 - RNA, 64 nt, Human; identical to SEQ ID NO: 215008

SEQ ID NO: 217165 - RNA, 64 nt, Human; identical to SEQ ID NO: 215009

SEQ ID NO: 217166 - RNA, 64 nt, Human; identical to SEQ ID NO: 215010

SEQ ID NO: 217167 - RNA, 64 nt, Human; identical to SEQ ID NO: 215014

SEQ ID NO: 217168 - RNA, 64 nt, Human; identical to SEQ ID NO: 215015

SEQ ID NO: 217169 - RNA, 63 nt, Human; identical to SEQ ID NO: 215016

SEQ ID NO: 217170 - RNA, 64 nt, Human; identical to SEQ ID NO: 215017

SEQ ID NO: 217171 - RNA, 64 nt, Human; identical to SEQ ID NO: 215018

SEQ ID NO: 217172 - RNA, 64 nt, Human
agucuuggccaggcacgguggcuuacaccuguaacccuggcauuuugggaggccaaggugggca

SEQ ID NO: 217173 - RNA, 64 nt, Human; identical to SEQ ID NO: 214361

SEQ ID NO: 217174 - RNA, 64 nt, Human
ggaagaucucuccuuagauagaaccugucuuccucccuggcauuguggggucugggcgugacac

SEQ ID NO: 217175 - RNA, 64 nt, Human; identical to SEQ ID NO: 215019

SEQ ID NO: 217176 - RNA, 64 nt, Human; identical to SEQ ID NO: 215020

SEQ ID NO: 217177 - RNA, 64 nt, Human; identical to SEQ ID NO: 215021

SEQ ID NO: 217178 - RNA, 64 nt, Human; identical to SEQ ID NO: 215022

SEQ ID NO: 217179 - RNA, 64 nt, Human; identical to SEQ ID NO: 215023

SEQ ID NO: 217180 - RNA, 64 nt, Human; identical to SEQ ID NO: 215024

SEQ ID NO: 217181 - RNA, 64 nt, Human; identical to SEQ ID NO: 215025

SEQ ID NO: 217182 - RNA, 64 nt, Human; identical to SEQ ID NO: 215026

SEQ ID NO: 217183 - RNA, 64 nt, Human; identical to SEQ ID NO: 215027

SEQ ID NO: 217184 - RNA, 64 nt, Human; identical to SEQ ID NO: 215028

SEQ ID NO: 217185 - RNA, 64 nt, Human; identical to SEQ ID NO: 215029

SEQ ID NO: 217186 - RNA, 64 nt, Human; identical to SEQ ID NO: 215033

SEQ ID NO: 217187 - RNA, 64 nt, Human; identical to SEQ ID NO: 215034

SEQ ID NO: 217188 - RNA, 64 nt, Human; identical to SEQ ID NO: 215035

SEQ ID NO: 217189 - RNA, 64 nt, Human; identical to SEQ ID NO: 215036

SEQ ID NO: 217190 - RNA, 64 nt, Human; identical to SEQ ID NO: 215037

SEQ ID NO: 217191 - RNA, 64 nt, Human
ugcagaaacagcccuagacaggugcuggccucaacccuggcaggggagggggagcccagaguga

SEQ ID NO: 217192 - RNA, 64 nt, Human
uuacucccugccauggggcucugccacuuugccacccuggcacugauccugcuggugcugcugg

SEQ ID NO: 217193 - RNA, 64 nt, Human; identical to SEQ ID NO: 214458

SEQ ID NO: 217194 - RNA, 64 nt, Human; identical to SEQ ID NO: 215038

SEQ ID NO: 217195 - RNA, 64 nt, Human; identical to SEQ ID NO: 215039

SEQ ID NO: 217196 - RNA, 64 nt, Human; identical to SEQ ID NO: 215040

SEQ ID NO: 217197 - RNA, 64 nt, Human; identical to SEQ ID NO: 215041

SEQ ID NO: 217198 - RNA, 64 nt, Human; identical to SEQ ID NO: 215042

SEQ ID NO: 217199 - RNA, 64 nt, Human; identical to SEQ ID NO: 215043

SEQ ID NO: 217200 - RNA, 64 nt, Human; identical to SEQ ID NO: 215044

SEQ ID NO: 217201 - RNA, 64 nt, Human; identical to SEQ ID NO: 215045

SEQ ID NO: 217202 - RNA, 64 nt, Human; identical to SEQ ID NO: 215046

SEQ ID NO: 217203 - RNA, 64 nt, Human; identical to SEQ ID NO: 215047

SEQ ID NO: 217204 - RNA, 64 nt, Human; identical to SEQ ID NO: 215048

SEQ ID NO: 217205 - RNA, 64 nt, Human; identical to SEQ ID NO: 215052

SEQ ID NO: 217206 - RNA, 64 nt, Human; identical to SEQ ID NO: 215053

SEQ ID NO: 217207 - RNA, 64 nt, Human; identical to SEQ ID NO: 215054

SEQ ID NO: 217208 - RNA, 64 nt, Human; identical to SEQ ID NO: 215055

SEQ ID NO: 217209 - RNA, 64 nt, Human; identical to SEQ ID NO: 215056

SEQ ID NO: 217210 - RNA, 64 nt, Human
uguggguccacauucccuucagcaucaccucuagcccuggcaacuuucagccccuagcuggcau

SEQ ID NO: 217211 - RNA, 64 nt, Human; identical to SEQ ID NO: 214378

SEQ ID NO: 217212 - RNA, 64 nt, Human
ggaaacagcacagaacacgaggugguccccaugucccuggcacacuagcauuccgggggaugag

SEQ ID NO: 217213 - RNA, 64 nt, Human; identical to SEQ ID NO: 215057

SEQ ID NO: 217214 - RNA, 64 nt, Human; identical to SEQ ID NO: 215058

SEQ ID NO: 217215 - RNA, 64 nt, Human; identical to SEQ ID NO: 215059

SEQ ID NO: 217216 - RNA, 64 nt, Human; identical to SEQ ID NO: 215060

SEQ ID NO: 217217 - RNA, 64 nt, Human; identical to SEQ ID NO: 215061

SEQ ID NO: 217218 - RNA, 64 nt, Human; identical to SEQ ID NO: 215062

SEQ ID NO: 217219 - RNA, 64 nt, Human; identical to SEQ ID NO: 215063

SEQ ID NO: 217220 - RNA, 64 nt, Human; identical to SEQ ID NO: 215064

SEQ ID NO: 217221 - RNA, 64 nt, Human; identical to SEQ ID NO: 215065

SEQ ID NO: 217222 - RNA, 64 nt, Human; identical to SEQ ID NO: 215066

SEQ ID NO: 217223 - RNA, 64 nt, Human; identical to SEQ ID NO: 215067

SEQ ID NO: 217224 - RNA, 64 nt, Human; identical to SEQ ID NO: 215071

SEQ ID NO: 217225 - RNA, 64 nt, Human; identical to SEQ ID NO: 215072

SEQ ID NO: 217226 - RNA, 64 nt, Human; identical to SEQ ID NO: 215073

SEQ ID NO: 217227 - RNA, 64 nt, Human; identical to SEQ ID NO: 215074

SEQ ID NO: 217228 - RNA, 64 nt, Human; identical to SEQ ID NO: 215075

SEQ ID NO: 217229 - RNA, 64 nt, Human
gcuuaguagccuugaagcagcacaucuccacugucccuggcaggauugugggaggcuucacaac

SEQ ID NO: 217230 - RNA, 64 nt, Human
aagcugggaucggguggcagccggaaggagggagcccuggcaggagagacacuccaucaggucc

SEQ ID NO: 217231 - RNA, 64 nt, Human; identical to SEQ ID NO: 214379

SEQ ID NO: 217232 - RNA, 64 nt, Human; identical to SEQ ID NO: 215076

SEQ ID NO: 217233 - RNA, 64 nt, Human; identical to SEQ ID NO: 215077

SEQ ID NO: 217234 - RNA, 64 nt, Human; identical to SEQ ID NO: 215078

SEQ ID NO: 217235 - RNA, 62 nt, Human; identical to SEQ ID NO: 215079

SEQ ID NO: 217236 - RNA, 64 nt, Human; identical to SEQ ID NO: 215080

SEQ ID NO: 217237 - RNA, 64 nt, Human; identical to SEQ ID NO: 215081

SEQ ID NO: 217238 - RNA, 64 nt, Human; identical to SEQ ID NO: 215082

SEQ ID NO: 217239 - RNA, 64 nt, Human; identical to SEQ ID NO: 215083

SEQ ID NO: 217240 - RNA, 64 nt, Human; identical to SEQ ID NO: 215084

SEQ ID NO: 217241 - RNA, 64 nt, Human; identical to SEQ ID NO: 215085

SEQ ID NO: 217242 - RNA, 64 nt, Human; identical to SEQ ID NO: 215086

SEQ ID NO: 217243 - RNA, 64 nt, Human; identical to SEQ ID NO: 215090

SEQ ID NO: 217244 - RNA, 63 nt, Human; identical to SEQ ID NO: 215091

SEQ ID NO: 217245 - RNA, 64 nt, Human; identical to SEQ ID NO: 215092

SEQ ID NO: 217246 - RNA, 64 nt, Human; identical to SEQ ID NO: 215093

SEQ ID NO: 217247 - RNA, 64 nt, Human; identical to SEQ ID NO: 215094

SEQ ID NO: 217248 - RNA, 64 nt, Human
ccuucuugcacaaauccacucugcugcccaccuucccuggcauuuuaaacagaccuaccccacc

SEQ ID NO: 217249 - RNA, 64 nt, Human
uucauuggcuccaggucuaauuuuucacuguggucccuggcagccagucuuuugaaguuuaaag

SEQ ID NO: 217250 - RNA, 64 nt, Human; identical to SEQ ID NO: 214380

SEQ ID NO: 217251 - RNA, 64 nt, Human; identical to SEQ ID NO: 215095

SEQ ID NO: 217252 - RNA, 64 nt, Human; identical to SEQ ID NO: 215096

SEQ ID NO: 217253 - RNA, 64 nt, Human; identical to SEQ ID NO: 215097

SEQ ID NO: 217254 - RNA, 64 nt, Human; identical to SEQ ID NO: 215098

SEQ ID NO: 217255 - RNA, 64 nt, Human; identical to SEQ ID NO: 215099

SEQ ID NO: 217256 - RNA, 64 nt, Human; identical to SEQ ID NO: 215100

SEQ ID NO: 217257 - RNA, 64 nt, Human; identical to SEQ ID NO: 215101

SEQ ID NO: 217258 - RNA, 64 nt, Human; identical to SEQ ID NO: 215102

SEQ ID NO: 217259 - RNA, 64 nt, Human; identical to SEQ ID NO: 215103

SEQ ID NO: 217260 - RNA, 64 nt, Human; identical to SEQ ID NO: 215104

SEQ ID NO: 217261 - RNA, 64 nt, Human; identical to SEQ ID NO: 215105

SEQ ID NO: 217262 - RNA, 64 nt, Human; identical to SEQ ID NO: 215109

SEQ ID NO: 217263 - RNA, 64 nt, Human; identical to SEQ ID NO: 215110

SEQ ID NO: 217264 - RNA, 64 nt, Human; identical to SEQ ID NO: 215111

SEQ ID NO: 217265 - RNA, 64 nt, Human; identical to SEQ ID NO: 215112

SEQ ID NO: 217266 - RNA, 64 nt, Human; identical to SEQ ID NO: 215113

SEQ ID NO: 217267 - RNA, 50 nt, Human; identical to SEQ ID NO: 215114

SEQ ID NO: 217268 - RNA, 64 nt, Human; identical to SEQ ID NO: 214321

SEQ ID NO: 217269 - RNA, 64 nt, Human; identical to SEQ ID NO: 214400

SEQ ID NO: 217270 - RNA, 64 nt, Human; identical to SEQ ID NO: 215115

SEQ ID NO: 217271 - RNA, 64 nt, Human; identical to SEQ ID NO: 215116

SEQ ID NO: 217272 - RNA, 64 nt, Human; identical to SEQ ID NO: 215117

SEQ ID NO: 217273 - RNA, 64 nt, Human; identical to SEQ ID NO: 215118

SEQ ID NO: 217274 - RNA, 64 nt, Human; identical to SEQ ID NO: 215119

SEQ ID NO: 217275 - RNA, 64 nt, Human; identical to SEQ ID NO: 215120

SEQ ID NO: 217276 - RNA, 64 nt, Human; identical to SEQ ID NO: 215121

SEQ ID NO: 217277 - RNA, 64 nt, Human; identical to SEQ ID NO: 215122

SEQ ID NO: 217278 - RNA, 64 nt, Human; identical to SEQ ID NO: 215123

SEQ ID NO: 217279 - RNA, 64 nt, Human; identical to SEQ ID NO: 215124

SEQ ID NO: 217280 - RNA, 64 nt, Human; identical to SEQ ID NO: 215128

SEQ ID NO: 217281 - RNA, 64 nt, Human; identical to SEQ ID NO: 215129

SEQ ID NO: 217282 - RNA, 64 nt, Human; identical to SEQ ID NO: 215130

SEQ ID NO: 217283 - RNA, 64 nt, Human; identical to SEQ ID NO: 215131

SEQ ID NO: 217284 - RNA, 64 nt, Human; identical to SEQ ID NO: 215132

SEQ ID NO: 217285 - RNA, 64 nt, Human; identical to SEQ ID NO: 215133

SEQ ID NO: 217286 - RNA, 64 nt, Human; identical to SEQ ID NO: 214319

SEQ ID NO: 217287 - RNA, 64 nt, Human
uuguuuaugcuucuugucugagaacaguagugaccccuggcagcaauucauuaccaaaacacag

SEQ ID NO: 217288 - RNA, 64 nt, Human
uccucagcccccaggccaggugagguccaccggccccuggcagcacagcccagggccugcaugg

SEQ ID NO: 217289 - RNA, 64 nt, Human; identical to SEQ ID NO: 215134

SEQ ID NO: 217290 - RNA, 64 nt, Human; identical to SEQ ID NO: 215135

SEQ ID NO: 217291 - RNA, 64 nt, Human; identical to SEQ ID NO: 215136

SEQ ID NO: 217292 - RNA, 64 nt, Human; identical to SEQ ID NO: 215137

SEQ ID NO: 217293 - RNA, 64 nt, Human; identical to SEQ ID NO: 215138

SEQ ID NO: 217294 - RNA, 64 nt, Human; identical to SEQ ID NO: 215139

SEQ ID NO: 217295 - RNA, 64 nt, Human; identical to SEQ ID NO: 215140

SEQ ID NO: 217296 - RNA, 64 nt, Human; identical to SEQ ID NO: 215141

SEQ ID NO: 217297 - RNA, 64 nt, Human; identical to SEQ ID NO: 215142

SEQ ID NO: 217298 - RNA, 64 nt, Human; identical to SEQ ID NO: 215143

SEQ ID NO: 217299 - RNA, 64 nt, Human; identical to SEQ ID NO: 215147

SEQ ID NO: 217300 - RNA, 64 nt, Human; identical to SEQ ID NO: 215148

SEQ ID NO: 217301 - RNA, 64 nt, Human; identical to SEQ ID NO: 215149

SEQ ID NO: 217302 - RNA, 64 nt, Human; identical to SEQ ID NO: 215150

SEQ ID NO: 217303 - RNA, 64 nt, Human; identical to SEQ ID NO: 215151

SEQ ID NO: 217304 - RNA, 64 nt, Human; identical to SEQ ID NO: 215152

SEQ ID NO: 217305 - RNA, 64 nt, Human
auggccacaccaguccacucuucugcaguauccucccuggcagaacacggagaaucaggauuuc

SEQ ID NO: 217306 - RNA, 64 nt, Human
cagaaccuucccgucugauuguuccuccccagcccccuggcauguuucaccacaacccuguugc

SEQ ID NO: 217307 - RNA, 62 nt, Human; identical to SEQ ID NO: 214381

SEQ ID NO: 217308 - RNA, 64 nt, Human; identical to SEQ ID NO: 215153

SEQ ID NO: 217309 - RNA, 64 nt, Human; identical to SEQ ID NO: 215154

SEQ ID NO: 217310 - RNA, 64 nt, Human; identical to SEQ ID NO: 215155

SEQ ID NO: 217311 - RNA, 64 nt, Human; identical to SEQ ID NO: 215156

SEQ ID NO: 217312 - RNA, 64 nt, Human; identical to SEQ ID NO: 215157

SEQ ID NO: 217313 - RNA, 64 nt, Human; identical to SEQ ID NO: 215158

SEQ ID NO: 217314 - RNA, 64 nt, Human; identical to SEQ ID NO: 215159

SEQ ID NO: 217315 - RNA, 64 nt, Human; identical to SEQ ID NO: 215160

SEQ ID NO: 217316 - RNA, 64 nt, Human; identical to SEQ ID NO: 215161

SEQ ID NO: 217317 - RNA, 64 nt, Human; identical to SEQ ID NO: 215162

SEQ ID NO: 217318 - RNA, 64 nt, Human; identical to SEQ ID NO: 215166

SEQ ID NO: 217319 - RNA, 64 nt, Human; identical to SEQ ID NO: 215167

SEQ ID NO: 217320 - RNA, 64 nt, Human; identical to SEQ ID NO: 215168

SEQ ID NO: 217321 - RNA, 64 nt, Human; identical to SEQ ID NO: 215169

SEQ ID NO: 217322 - RNA, 64 nt, Human; identical to SEQ ID NO: 215170

SEQ ID NO: 217323 - RNA, 64 nt, Human; identical to SEQ ID NO: 215171

SEQ ID NO: 217324 - RNA, 64 nt, Human
cguaggacuuggggcuguagcaucaucuuccugacccuggcaccugugucuacuugcucccgag

SEQ ID NO: 217325 - RNA, 64 nt, Human
ccucuucccaggggcugccaaguccuggcccuggcccuggcauaucaccccgcacuguggggcc

SEQ ID NO: 217326 - RNA, 64 nt, Human; identical to SEQ ID NO: 214398

SEQ ID NO: 217327 - RNA, 64 nt, Human; identical to SEQ ID NO: 215172

SEQ ID NO: 217328 - RNA, 64 nt, Human; identical to SEQ ID NO: 215173

SEQ ID NO: 217329 - RNA, 64 nt, Human; identical to SEQ ID NO: 215174

SEQ ID NO: 217330 - RNA, 53 nt, Human; identical to SEQ ID NO: 215175

SEQ ID NO: 217331 - RNA, 64 nt, Human; identical to SEQ ID NO: 215176

SEQ ID NO: 217332 - RNA, 64 nt, Human; identical to SEQ ID NO: 215177

SEQ ID NO: 217333 - RNA, 64 nt, Human; identical to SEQ ID NO: 215178

SEQ ID NO: 217334 - RNA, 64 nt, Human; identical to SEQ ID NO: 215179

SEQ ID NO: 217335 - RNA, 64 nt, Human; identical to SEQ ID NO: 215180

SEQ ID NO: 217336 - RNA, 64 nt, Human; identical to SEQ ID NO: 215181

SEQ ID NO: 217337 - RNA, 64 nt, Human; identical to SEQ ID NO: 215185

SEQ ID NO: 217338 - RNA, 64 nt, Human; identical to SEQ ID NO: 215186

SEQ ID NO: 217339 - RNA, 64 nt, Human; identical to SEQ ID NO: 215187

SEQ ID NO: 217340 - RNA, 64 nt, Human; identical to SEQ ID NO: 215188

SEQ ID NO: 217341 - RNA, 64 nt, Human; identical to SEQ ID NO: 215189

SEQ ID NO: 217342 - RNA, 64 nt, Human; identical to SEQ ID NO: 215190

SEQ ID NO: 217343 - RNA, 64 nt, Human
acuucuguuuaaucugaucacggcucuuuuuaagcccuggcagcauuuuggucccugcuccuug

SEQ ID NO: 217344 - RNA, 64 nt, Human
ggggcccucuggaguugauacaagccugccugagcccuggcacacccguuugggguugguccuu

SEQ ID NO: 217345 - RNA, 64 nt, Human; identical to SEQ ID NO: 214399

SEQ ID NO: 217346 - RNA, 64 nt, Human; identical to SEQ ID NO: 215191

SEQ ID NO: 217347 - RNA, 64 nt, Human; identical to SEQ ID NO: 215192

SEQ ID NO: 217348 - RNA, 64 nt, Human; identical to SEQ ID NO: 215193

SEQ ID NO: 217349 - RNA, 64 nt, Human; identical to SEQ ID NO: 215194

SEQ ID NO: 217350 - RNA, 64 nt, Human; identical to SEQ ID NO: 215195

SEQ ID NO: 217351 - RNA, 64 nt, Human; identical to SEQ ID NO: 215196

SEQ ID NO: 217352 - RNA, 64 nt, Human; identical to SEQ ID NO: 215197

SEQ ID NO: 217353 - RNA, 64 nt, Human; identical to SEQ ID NO: 215198

SEQ ID NO: 217354 - RNA, 64 nt, Human; identical to SEQ ID NO: 215199

SEQ ID NO: 217355 - RNA, 64 nt, Human; identical to SEQ ID NO: 215200

SEQ ID NO: 217356 - RNA, 64 nt, Human; identical to SEQ ID NO: 215204

SEQ ID NO: 217357 - RNA, 64 nt, Human; identical to SEQ ID NO: 215205

SEQ ID NO: 217358 - RNA, 64 nt, Human; identical to SEQ ID NO: 215206

SEQ ID NO: 217359 - RNA, 64 nt, Human; identical to SEQ ID NO: 215207

SEQ ID NO: 217360 - RNA, 64 nt, Human; identical to SEQ ID NO: 215208

SEQ ID NO: 217361 - RNA, 64 nt, Human; identical to SEQ ID NO: 215209

SEQ ID NO: 217362 - RNA, 64 nt, Human
cccuguggacaaacccccauuguggcuccugccacccuggcagaugacucacugugggggggug

SEQ ID NO: 217363 - RNA, 64 nt, Human; identical to SEQ ID NO: 214299

SEQ ID NO: 217364 - RNA, 64 nt, Human
ugcccaucugcugucugugcaagcaacuucuggacccuggcacccugggcugcuggccuggagg

SEQ ID NO: 217365 - RNA, 64 nt, Human; identical to SEQ ID NO: 215210

SEQ ID NO: 217366 - RNA, 64 nt, Human; identical to SEQ ID NO: 215211

SEQ ID NO: 217367 - RNA, 64 nt, Human; identical to SEQ ID NO: 215212

SEQ ID NO: 217368 - RNA, 64 nt, Human; identical to SEQ ID NO: 215213

SEQ ID NO: 217369 - RNA, 64 nt, Human; identical to SEQ ID NO: 215214

SEQ ID NO: 217370 - RNA, 56 nt, Human; identical to SEQ ID NO: 215215

SEQ ID NO: 217371 - RNA, 64 nt, Human; identical to SEQ ID NO: 215216

SEQ ID NO: 217372 - RNA, 64 nt, Human; identical to SEQ ID NO: 215217

SEQ ID NO: 217373 - RNA, 64 nt, Human; identical to SEQ ID NO: 215218

SEQ ID NO: 217374 - RNA, 64 nt, Human; identical to SEQ ID NO: 215219

SEQ ID NO: 217375 - RNA, 64 nt, Human; identical to SEQ ID NO: 215223

SEQ ID NO: 217376 - RNA, 64 nt, Human; identical to SEQ ID NO: 215224

SEQ ID NO: 217377 - RNA, 64 nt, Human; identical to SEQ ID NO: 215225

SEQ ID NO: 217378 - RNA, 64 nt, Human; identical to SEQ ID NO: 215226

SEQ ID NO: 217379 - RNA, 64 nt, Human; identical to SEQ ID NO: 215227

SEQ ID NO: 217380 - RNA, 64 nt, Human; identical to SEQ ID NO: 215228

SEQ ID NO: 217381 - RNA, 64 nt, Human
uaccuacucuuugugacucccucauaucuuuucccccuggcauggauguccugcucagacacuc

SEQ ID NO: 217382 - RNA, 64 nt, Human; identical to SEQ ID NO: 214300

SEQ ID NO: 217383 - RNA, 64 nt, Human
cuccaaagugagcuccacuuugggucugaggagccccuggcagaguccacgcugccucagguau

SEQ ID NO: 217384 - RNA, 64 nt, Human; identical to SEQ ID NO: 215229

SEQ ID NO: 217385 - RNA, 64 nt, Human; identical to SEQ ID NO: 215230

SEQ ID NO: 217386 - RNA, 64 nt, Human; identical to SEQ ID NO: 215231

SEQ ID NO: 217387 - RNA, 64 nt, Human; identical to SEQ ID NO: 215232

SEQ ID NO: 217388 - RNA, 64 nt, Human; identical to SEQ ID NO: 215233

SEQ ID NO: 217389 - RNA, 64 nt, Human; identical to SEQ ID NO: 215234

SEQ ID NO: 217390 - RNA, 64 nt, Human; identical to SEQ ID NO: 215235

SEQ ID NO: 217391 - RNA, 64 nt, Human; identical to SEQ ID NO: 215236

SEQ ID NO: 217392 - RNA, 62 nt, Human; identical to SEQ ID NO: 215237

SEQ ID NO: 217393 - RNA, 64 nt, Human; identical to SEQ ID NO: 215238

SEQ ID NO: 217394 - RNA, 64 nt, Human; identical to SEQ ID NO: 215242

SEQ ID NO: 217395 - RNA, 64 nt, Human; identical to SEQ ID NO: 215243

SEQ ID NO: 217396 - RNA, 64 nt, Human; identical to SEQ ID NO: 215244

SEQ ID NO: 217397 - RNA, 64 nt, Human; identical to SEQ ID NO: 215245

SEQ ID NO: 217398 - RNA, 64 nt, Human; identical to SEQ ID NO: 215246

SEQ ID NO: 217399 - RNA, 64 nt, Human; identical to SEQ ID NO: 215247

SEQ ID NO: 217400 - RNA, 64 nt, Human
aucugcacugacaccgcggcaggaacugaagcugcccuggcaagugaggaaccaggagccguca

SEQ ID NO: 217401 - RNA, 64 nt, Human
cuggaccuguauauuuguaaagcuauuuaugggccccuggcacucuuguucccacaccccaaca

SEQ ID NO: 217402 - RNA, 64 nt, Human; identical to SEQ ID NO: 214301

SEQ ID NO: 217403 - RNA, 64 nt, Human; identical to SEQ ID NO: 215248

SEQ ID NO: 217404 - RNA, 64 nt, Human; identical to SEQ ID NO: 215249

SEQ ID NO: 217405 - RNA, 64 nt, Human; identical to SEQ ID NO: 215250

SEQ ID NO: 217406 - RNA, 64 nt, Human; identical to SEQ ID NO: 215251

SEQ ID NO: 217407 - RNA, 64 nt, Human; identical to SEQ ID NO: 215252

SEQ ID NO: 217408 - RNA, 64 nt, Human; identical to SEQ ID NO: 215253

SEQ ID NO: 217409 - RNA, 64 nt, Human; identical to SEQ ID NO: 215254

SEQ ID NO: 217410 - RNA, 64 nt, Human; identical to SEQ ID NO: 215255

SEQ ID NO: 217411 - RNA, 64 nt, Human; identical to SEQ ID NO: 215256

SEQ ID NO: 217412 - RNA, 64 nt, Human; identical to SEQ ID NO: 215257

SEQ ID NO: 217413 - RNA, 64 nt, Human; identical to SEQ ID NO: 215261

SEQ ID NO: 217414 - RNA, 64 nt, Human; identical to SEQ ID NO: 215262

SEQ ID NO: 217415 - RNA, 64 nt, Human; identical to SEQ ID NO: 215263

SEQ ID NO: 217416 - RNA, 64 nt, Human; identical to SEQ ID NO: 215264

SEQ ID NO: 217417 - RNA, 64 nt, Human; identical to SEQ ID NO: 215265

SEQ ID NO: 217418 - RNA, 64 nt, Human; identical to SEQ ID NO: 215266

SEQ ID NO: 217419 - RNA, 64 nt, Human; identical to SEQ ID NO: 214421

SEQ ID NO: 217420 - RNA, 64 nt, Human
gccggcugggcgccggggaggacgauggccccgacccuggcagcgagaggagaccaggaggcua

SEQ ID NO: 217421 - RNA, 64 nt, Human; identical to SEQ ID NO: 214459

SEQ ID NO: 217422 - RNA, 64 nt, Human; identical to SEQ ID NO: 215267

SEQ ID NO: 217423 - RNA, 64 nt, Human; identical to SEQ ID NO: 215268

SEQ ID NO: 217424 - RNA, 64 nt, Human; identical to SEQ ID NO: 215269

SEQ ID NO: 217425 - RNA, 54 nt, Human; identical to SEQ ID NO: 215270

SEQ ID NO: 217426 - RNA, 64 nt, Human; identical to SEQ ID NO: 215271

SEQ ID NO: 217427 - RNA, 64 nt, Human; identical to SEQ ID NO: 215272

SEQ ID NO: 217428 - RNA, 64 nt, Human; identical to SEQ ID NO: 215264

SEQ ID NO: 217429 - RNA, 64 nt, Human; identical to SEQ ID NO: 215274

SEQ ID NO: 217430 - RNA, 64 nt, Human; identical to SEQ ID NO: 215275

SEQ ID NO: 217431 - RNA, 64 nt, Human; identical to SEQ ID NO: 215276

SEQ ID NO: 217432 - RNA, 64 nt, Human; identical to SEQ ID NO: 215280

SEQ ID NO: 217433 - RNA, 64 nt, Human; identical to SEQ ID NO: 215281

SEQ ID NO: 217434 - RNA, 64 nt, Human; identical to SEQ ID NO: 215282

SEQ ID NO: 217435 - RNA, 64 nt, Human; identical to SEQ ID NO: 215283

SEQ ID NO: 217436 - RNA, 64 nt, Human; identical to SEQ ID NO: 215284

SEQ ID NO: 217437 - RNA, 64 nt, Human; identical to SEQ ID NO: 215285

SEQ ID NO: 217438 - RNA, 64 nt, Human
gagaggguuuguguggcgacuacacccucagcgucccuggcaaggugcaguuggcucucgccca

SEQ ID NO: 217439 - RNA, 64 nt, Human
ggaaaacaccauaagguuucguuucuguauacaacccuggcauuauguccacuguguauagaag

SEQ ID NO: 217440 - RNA, 64 nt, Human; identical to SEQ ID NO: 214318

SEQ ID NO: 217441 - RNA, 64 nt, Human; identical to SEQ ID NO: 215286

SEQ ID NO: 217442 - RNA, 64 nt, Human; identical to SEQ ID NO: 215287

SEQ ID NO: 217443 - RNA, 64 nt, Human; identical to SEQ ID NO: 215288

SEQ ID NO: 217444 - RNA, 64 nt, Human; identical to SEQ ID NO: 215289

SEQ ID NO: 217445 - RNA, 64 nt, Human; identical to SEQ ID NO: 215290

SEQ ID NO: 217446 - RNA, 64 nt, Human; identical to SEQ ID NO: 215291

SEQ ID NO: 217447 - RNA, 64 nt, Human; identical to SEQ ID NO: 215292

SEQ ID NO: 217448 - RNA, 64 nt, Human; identical to SEQ ID NO: 215293

SEQ ID NO: 217449 - RNA, 64 nt, Human; identical to SEQ ID NO: 215294

SEQ ID NO: 217450 - RNA, 64 nt, Human; identical to SEQ ID NO: 215295

SEQ ID NO: 217451 - RNA, 64 nt, Human; identical to SEQ ID NO: 215299

SEQ ID NO: 217452 - RNA, 64 nt, Human; identical to SEQ ID NO: 215300

SEQ ID NO: 217453 - RNA, 64 nt, Human; identical to SEQ ID NO: 215301

SEQ ID NO: 217454 - RNA, 64 nt, Human; identical to SEQ ID NO: 215302

SEQ ID NO: 217455 - RNA, 64 nt, Human; identical to SEQ ID NO: 215303

SEQ ID NO: 217456 - RNA, 56 nt, Human; identical to SEQ ID NO: 215304

SEQ ID NO: 217457 - RNA, 64 nt, Human
cccccucagcugucgaggagggggccgccgcggacccuggcagcgaugggucuccaggcaaguc

SEQ ID NO: 217458 - RNA, 64 nt, Human
uguccacguggaggcuaggaggucucaggugcugcccuggcagcaccagagugugggccgggcc

SEQ ID NO: 217459 - RNA, 64 nt, Human
accagaguguguggaggaggcaucugugugguggcccuggcacugcagagacugguccgggcug

SEQ ID NO: 217460 - RNA, 64 nt, Human; identical to SEQ ID NO: 215305

SEQ ID NO: 217461 - RNA, 59 nt, Human; identical to SEQ ID NO: 215306

SEQ ID NO: 217462 - RNA, 64 nt, Human; identical to SEQ ID NO: 215307

SEQ ID NO: 217463 - RNA, 64 nt, Human; identical to SEQ ID NO: 215308

SEQ ID NO: 217464 - RNA, 64 nt, Human; identical to SEQ ID NO: 215309

SEQ ID NO: 217465 - RNA, 64 nt, Human; identical to SEQ ID NO: 215310

SEQ ID NO: 217466 - RNA, 64 nt, Human; identical to SEQ ID NO: 215311

SEQ ID NO: 217467 - RNA, 64 nt, Human; identical to SEQ ID NO: 215312

SEQ ID NO: 217468 - RNA, 64 nt, Human; identical to SEQ ID NO: 215316

SEQ ID NO: 217469 - RNA, 64 nt, Human; identical to SEQ ID NO: 215317

SEQ ID NO: 217470 - RNA, 64 nt, Human
uuggaaauugcauuuguaaccaaggggugcgaaacccuggcagucccaggcagcaccaggccag

SEQ ID NO: 217471 - RNA, 64 nt, Human
acccagcuccagcucccguuagccaggacuuguccccuggcagcugggcugagucugcccugag

SEQ ID NO: 217472 - RNA, 64 nt, Human
guucaucauccuaagcuauucaguaauaacucuacccuggcacuauaauguaagcucuacugag

SEQ ID NO: 217473 - RNA, 64 nt, Human; identical to SEQ ID NO: 215318

SEQ ID NO: 217474 - RNA, 64 nt, Human; identical to SEQ ID NO: 215319

SEQ ID NO: 217475 - RNA, 64 nt, Human; identical to SEQ ID NO: 215320

SEQ ID NO: 217476 - RNA, 64 nt, Human; identical to SEQ ID NO: 215321

SEQ ID NO: 217477 - RNA, 51 nt, Human; identical to SEQ ID NO: 215322

SEQ ID NO: 217478 - RNA, 64 nt, Human; identical to SEQ ID NO: 215323

SEQ ID NO: 217479 - RNA, 64 nt, Human; identical to SEQ ID NO: 215324

SEQ ID NO: 217480 - RNA, 64 nt, Human; identical to SEQ ID NO: 215325

SEQ ID NO: 217481 - RNA, 64 nt, Human; identical to SEQ ID NO: 215326

SEQ ID NO: 217482 - RNA, 64 nt, Human; identical to SEQ ID NO: 215327

SEQ ID NO: 217483 - RNA, 64 nt, Human; identical to SEQ ID NO: 215331

SEQ ID NO: 217484 - RNA, 64 nt, Human; identical to SEQ ID NO: 215332

SEQ ID NO: 217485 - RNA, 64 nt, Human; identical to SEQ ID NO: 215333

SEQ ID NO: 217486 - RNA, 64 nt, Human; identical to SEQ ID NO: 215334

SEQ ID NO: 217487 - RNA, 64 nt, Human; identical to SEQ ID NO: 215335

SEQ ID NO: 217488 - RNA, 64 nt, Human; identical to SEQ ID NO: 215336

SEQ ID NO: 217489 - RNA, 64 nt, Human
gcaggcaggcagccugagagcuggcccagggguccccuggcaggggaaacucuggugccgggga

SEQ ID NO: 217490 - RNA, 64 nt, Human
gacggcaguguuguggauaagugaguuuuuaaugcccuggcaguggcuacauuugacacuuuag

SEQ ID NO: 217491 - RNA, 64 nt, Human
ggcugacucaguugacugcuugguccaagccuggcccuggcacuugucagggucagccuaagga

SEQ ID NO: 217492 - RNA, 64 nt, Human; identical to SEQ ID NO: 215337

SEQ ID NO: 217493 - RNA, 64 nt, Human; identical to SEQ ID NO: 215338

SEQ ID NO: 217494 - RNA, 64 nt, Human; identical to SEQ ID NO: 215339

SEQ ID NO: 217495 - RNA, 64 nt, Human; identical to SEQ ID NO: 215340

SEQ ID NO: 217496 - RNA, 64 nt, Human; identical to SEQ ID NO: 215341

SEQ ID NO: 217497 - RNA, 64 nt, Human; identical to SEQ ID NO: 215342

SEQ ID NO: 217498 - RNA, 64 nt, Human; identical to SEQ ID NO: 215343

SEQ ID NO: 217499 - RNA, 64 nt, Human; identical to SEQ ID NO: 215344

SEQ ID NO: 217500 - RNA, 64 nt, Human; identical to SEQ ID NO: 215345

SEQ ID NO: 217501 - RNA, 64 nt, Human; identical to SEQ ID NO: 215346

SEQ ID NO: 217502 - RNA, 64 nt, Human; identical to SEQ ID NO: 215350

SEQ ID NO: 217503 - RNA, 64 nt, Human; identical to SEQ ID NO: 215351

SEQ ID NO: 217504 - RNA, 64 nt, Human; identical to SEQ ID NO: 215352

SEQ ID NO: 217505 - RNA, 64 nt, Human; identical to SEQ ID NO: 215353

SEQ ID NO: 217506 - RNA, 64 nt, Human; identical to SEQ ID NO: 215354

SEQ ID NO: 217507 - RNA, 64 nt, Human; identical to SEQ ID NO: 215355

SEQ ID NO: 217508 - RNA, 64 nt, Human; identical to SEQ ID NO: 214320

SEQ ID NO: 217509 - RNA, 64 nt, Human
cuuuucaucuccaguggcauuaaacauaaaaagacccuggcauuuuuucacauacuugaauccc

SEQ ID NO: 217510 - RNA, 64 nt, Human
cccauccuguaccaagcagacugggcccuaagaccccuggcagaacccagccucugcucacacc

SEQ ID NO: 217511 - RNA, 64 nt, Human; identical to SEQ ID NO: 215356

SEQ ID NO: 217512 - RNA, 64 nt, Human; identical to SEQ ID NO: 215357

SEQ ID NO: 217513 - RNA, 64 nt, Human; identical to SEQ ID NO: 215358

SEQ ID NO: 217514 - RNA, 64 nt, Human; identical to SEQ ID NO: 215359

SEQ ID NO: 217515 - RNA, 64 nt, Human; identical to SEQ ID NO: 215360

SEQ ID NO: 217516 - RNA, 64 nt, Human; identical to SEQ ID NO: 215361

SEQ ID NO: 217517 - RNA, 64 nt, Human; identical to SEQ ID NO: 215362

SEQ ID NO: 217518 - RNA, 64 nt, Human; identical to SEQ ID NO: 215363

SEQ ID NO: 217519 - RNA, 64 nt, Human; identical to SEQ ID NO: 215364

SEQ ID NO: 217520 - RNA, 64 nt, Human; identical to SEQ ID NO: 215365

SEQ ID NO: 217521 - RNA, 64 nt, Human; identical to SEQ ID NO: 215369

SEQ ID NO: 217522 - RNA, 64 nt, Human; identical to SEQ ID NO: 215370

SEQ ID NO: 217523 - RNA, 64 nt, Human; identical to SEQ ID NO: 215371

SEQ ID NO: 217524 - RNA, 64 nt, Human; identical to SEQ ID NO: 215372

SEQ ID NO: 217525 - RNA, 64 nt, Human; identical to SEQ ID NO: 215373

SEQ ID NO: 217526 - RNA, 64 nt, Human; identical to SEQ ID NO: 215374

SEQ ID NO: 217527 - RNA, 64 nt, Human
cuuuguagggcugaggagcagacaucauucccugcccuggcagugacuuggagcccugaagaag

SEQ ID NO: 217528 - RNA, 64 nt, Human
gagccuuccuccccaucuggaauucacagcuguucccuggcagcacacaggaggguauuaagga

SEQ ID NO: 217529 - RNA, 64 nt, Human
uggcccucuaguccaccccccgccccaccccagccccuggcaaccacugaucugcuuucacaau

SEQ ID NO: 217530 - RNA, 61 nt, Human; identical to SEQ ID NO: 215375

SEQ ID NO: 217531 - RNA, 64 nt, Human; identical to SEQ ID NO: 215376

SEQ ID NO: 217532 - RNA, 64 nt, Human; identical to SEQ ID NO: 215377

SEQ ID NO: 217533 - RNA, 64 nt, Human; identical to SEQ ID NO: 215378

SEQ ID NO: 217534 - RNA, 64 nt, Human; identical to SEQ ID NO: 215379

SEQ ID NO: 217535 - RNA, 64 nt, Human; identical to SEQ ID NO: 215380

SEQ ID NO: 217536 - RNA, 54 nt, Human; identical to SEQ ID NO: 215381

SEQ ID NO: 217537 - RNA, 64 nt, Human; identical to SEQ ID NO: 215382

SEQ ID NO: 217538 - RNA, 64 nt, Human; identical to SEQ ID NO: 215383

SEQ ID NO: 217539 - RNA, 64 nt, Human; identical to SEQ ID NO: 215384

SEQ ID NO: 217540 - RNA, 64 nt, Human; identical to SEQ ID NO: 215388

SEQ ID NO: 217541 - RNA, 64 nt, Human; identical to SEQ ID NO: 215389

SEQ ID NO: 217542 - RNA, 64 nt, Human; identical to SEQ ID NO: 215390

SEQ ID NO: 217543 - RNA, 64 nt, Human; identical to SEQ ID NO: 215391

SEQ ID NO: 217544 - RNA, 64 nt, Human; identical to SEQ ID NO: 215392

SEQ ID NO: 217545 - RNA, 64 nt, Human; identical to SEQ ID NO: 215393

SEQ ID NO: 217546 - RNA, 64 nt, Human
agagauagggaucuaaggaugacuuggacacacucccuggcacugaagagucugaacacuggcc

SEQ ID NO: 217547 - RNA, 64 nt, Human
ggaggucacagcugggcucacagaagcucuugggcccuggcauccugggugaccgguguucuug

SEQ ID NO: 217548 - RNA, 64 nt, Human; identical to SEQ ID NO: 214339

SEQ ID NO: 217549 - RNA, 64 nt, Human; identical to SEQ ID NO: 215394

SEQ ID NO: 217550 - RNA, 64 nt, Human; identical to SEQ ID NO: 215395

SEQ ID NO: 217551 - RNA, 64 nt, Human; identical to SEQ ID NO: 215396

SEQ ID NO: 217552 - RNA, 64 nt, Human; identical to SEQ ID NO: 215397

SEQ ID NO: 217553 - RNA, 64 nt, Human; identical to SEQ ID NO: 215398

SEQ ID NO: 217554 - RNA, 64 nt, Human; identical to SEQ ID NO: 215399

SEQ ID NO: 217555 - RNA, 64 nt, Human; identical to SEQ ID NO: 215400

SEQ ID NO: 217556 - RNA, 64 nt, Human; identical to SEQ ID NO: 215401

SEQ ID NO: 217557 - RNA, 64 nt, Human; identical to SEQ ID NO: 215402

SEQ ID NO: 217558 - RNA, 64 nt, Human; identical to SEQ ID NO: 215403

SEQ ID NO: 217559 - RNA, 64 nt, Human; identical to SEQ ID NO: 215407

SEQ ID NO: 217560 - RNA, 64 nt, Human; identical to SEQ ID NO: 215408

SEQ ID NO: 217561 - RNA, 64 nt, Human; identical to SEQ ID NO: 215409

SEQ ID NO: 217562 - RNA, 64 nt, Human; identical to SEQ ID NO: 215410

SEQ ID NO: 217563 - RNA, 64 nt, Human; identical to SEQ ID NO: 215411

SEQ ID NO: 217564 - RNA, 64 nt, Human; identical to SEQ ID NO: 215412

SEQ ID NO: 217565 - RNA, 64 nt, Human
ugcccuauugucucccauccuagucuguccuggucccuggcaacaggaaccugggcagcuuauc

SEQ ID NO: 217566 - RNA, 64 nt, Human
agaacacagagagggacaaacacagccaugaacccccuggcacuaguaccagcaccuaguuggc

SEQ ID NO: 217567 - RNA, 64 nt, Human
cagaggggcaguugaagucucguccuggucucugcccuggcauggacuggcacagagguguucu

SEQ ID NO: 217568 - RNA, 64 nt, Human; identical to SEQ ID NO: 215413

SEQ ID NO: 217569 - RNA, 64 nt, Human; identical to SEQ ID NO: 215414

SEQ ID NO: 217570 - RNA, 64 nt, Human; identical to SEQ ID NO: 215415

SEQ ID NO: 217571 - RNA, 64 nt, Human; identical to SEQ ID NO: 215416

SEQ ID NO: 217572 - RNA, 59 nt, Human; identical to SEQ ID NO: 215417

SEQ ID NO: 217573 - RNA, 64 nt, Human; identical to SEQ ID NO: 215418

SEQ ID NO: 217574 - RNA, 64 nt, Human; identical to SEQ ID NO: 215419

SEQ ID NO: 217575 - RNA, 64 nt, Human; identical to SEQ ID NO: 215420

SEQ ID NO: 217576 - RNA, 64 nt, Human; identical to SEQ ID NO: 215421

SEQ ID NO: 217577 - RNA, 64 nt, Human; identical to SEQ ID NO: 215422

SEQ ID NO: 217578 - RNA, 64 nt, Human; identical to SEQ ID NO: 215426

SEQ ID NO: 217579 - RNA, 64 nt, Human; identical to SEQ ID NO: 215427

SEQ ID NO: 217580 - RNA, 64 nt, Human; identical to SEQ ID NO: 215428

SEQ ID NO: 217581 - RNA, 64 nt, Human; identical to SEQ ID NO: 215429

SEQ ID NO: 217582 - RNA, 64 nt, Human; identical to SEQ ID NO: 215430

SEQ ID NO: 217583 - RNA, 64 nt, Human; identical to SEQ ID NO: 215431

SEQ ID NO: 217584 - RNA, 64 nt, Human
cucugugcugaugaacagccuggcugagcccuggcccuggcagguuuagggcccauuuggggcc

SEQ ID NO: 217585 - RNA, 64 nt, Human
ucguuagauagugacuucugagcaagcugaucuccccuggcaugcuccaaccugauuggacaaa

SEQ ID NO: 217586 - RNA, 64 nt, Human
caccccgccccugggguuggcagccucaguuggccccuggcagaggaacaaggacacagacauu

SEQ ID NO: 217587 - RNA, 64 nt, Human; identical to SEQ ID NO: 215432

SEQ ID NO: 217588 - RNA, 64 nt, Human; identical to SEQ ID NO: 215433

SEQ ID NO: 217589 - RNA, 64 nt, Human; identical to SEQ ID NO: 215434

SEQ ID NO: 217590 - RNA, 64 nt, Human; identical to SEQ ID NO: 215435

SEQ ID NO: 217591 - RNA, 64 nt, Human; identical to SEQ ID NO: 215436

SEQ ID NO: 217592 - RNA, 64 nt, Human; identical to SEQ ID NO: 215437

SEQ ID NO: 217593 - RNA, 64 nt, Human; identical to SEQ ID NO: 215438

SEQ ID NO: 217594 - RNA, 64 nt, Human; identical to SEQ ID NO: 215439

SEQ ID NO: 217595 - RNA, 64 nt, Human; identical to SEQ ID NO: 215440

SEQ ID NO: 217596 - RNA, 64 nt, Human; identical to SEQ ID NO: 215441

SEQ ID NO: 217597 - RNA, 64 nt, Human; identical to SEQ ID NO: 215445

SEQ ID NO: 217598 - RNA, 64 nt, Human; identical to SEQ ID NO: 215446

SEQ ID NO: 217599 - RNA, 64 nt, Human; identical to SEQ ID NO: 215447

SEQ ID NO: 217600 - RNA, 64 nt, Human; identical to SEQ ID NO: 215448

SEQ ID NO: 217601 - RNA, 64 nt, Human; identical to SEQ ID NO: 215449

SEQ ID NO: 217602 - RNA, 64 nt, Human; identical to SEQ ID NO: 215450

SEQ ID NO: 217603 - RNA, 64 nt, Human; identical to SEQ ID NO: 214338

SEQ ID NO: 217604 - RNA, 64 nt, Human
gccccaucucauccuggcacgcccuacuccacugcccuggcagcagcagguguggccaauggag

SEQ ID NO: 217605 - RNA, 64 nt, Human; identical to SEQ ID NO: 214340

SEQ ID NO: 217606 - RNA, 64 nt, Human; identical to SEQ ID NO: 215451

SEQ ID NO: 217607 - RNA, 64 nt, Human; identical to SEQ ID NO: 215452

SEQ ID NO: 217608 - RNA, 64 nt, Human; identical to SEQ ID NO: 215453

SEQ ID NO: 217609 - RNA, 64 nt, Human; identical to SEQ ID NO: 215454

SEQ ID NO: 217610 - RNA, 64 nt, Human; identical to SEQ ID NO: 215455

SEQ ID NO: 217611 - RNA, 64 nt, Human; identical to SEQ ID NO: 215456

SEQ ID NO: 217612 - RNA, 64 nt, Human; identical to SEQ ID NO: 215457

SEQ ID NO: 217613 - RNA, 64 nt, Human; identical to SEQ ID NO: 215458

SEQ ID NO: 217614 - RNA, 64 nt, Human; identical to SEQ ID NO: 215459

SEQ ID NO: 217615 - RNA, 64 nt, Human; identical to SEQ ID NO: 215460

SEQ ID NO: 217616 - RNA, 64 nt, Human; identical to SEQ ID NO: 215464

SEQ ID NO: 217617 - RNA, 64 nt, Human; identical to SEQ ID NO: 215465

SEQ ID NO: 217618 - RNA, 64 nt, Human; identical to SEQ ID NO: 215466

SEQ ID NO: 217619 - RNA, 64 nt, Human; identical to SEQ ID NO: 215467

SEQ ID NO: 217620 - RNA, 64 nt, Human; identical to SEQ ID NO: 215468

SEQ ID NO: 217621 - RNA, 64 nt, Human; identical to SEQ ID NO: 215469

SEQ ID NO: 217622 - RNA, 64 nt, Human
auacuuuugaccacuugugacuggaguucaguggcccuggcaggcuuguccugcucuugaccau

SEQ ID NO: 217623 - RNA, 64 nt, Human
gagcuuuggcuauacucucuccucccgacccccacccuggcauacuacacagaucacucugggc

SEQ ID NO: 217624 - RNA, 64 nt, Human
uggcugaucaccccuugcuucuuggauggcacuucccuggcaccucuguggcuaguuguccuac

SEQ ID NO: 217625 - RNA, 64 nt, Human; identical to SEQ ID NO: 215470

SEQ ID NO: 217626 - RNA, 64 nt, Human; identical to SEQ ID NO: 215471

SEQ ID NO: 217627 - RNA, 64 nt, Human; identical to SEQ ID NO: 215472

SEQ ID NO: 217628 - RNA, 64 nt, Human; identical to SEQ ID NO: 215473

SEQ ID NO: 217629 - RNA, 64 nt, Human; identical to SEQ ID NO: 215474

SEQ ID NO: 217630 - RNA, 64 nt, Human; identical to SEQ ID NO: 215475

SEQ ID NO: 217631 - RNA, 64 nt, Human; identical to SEQ ID NO: 215476

SEQ ID NO: 217632 - RNA, 64 nt, Human; identical to SEQ ID NO: 215477

SEQ ID NO: 217633 - RNA, 64 nt, Human; identical to SEQ ID NO: 215478

SEQ ID NO: 217634 - RNA, 64 nt, Human; identical to SEQ ID NO: 215479

SEQ ID NO: 217635 - RNA, 64 nt, Human; identical to SEQ ID NO: 215483

SEQ ID NO: 217636 - RNA, 64 nt, Human; identical to SEQ ID NO: 215484

SEQ ID NO: 217637 - RNA, 64 nt, Human; identical to SEQ ID NO: 215485

SEQ ID NO: 217638 - RNA, 64 nt, Human; identical to SEQ ID NO: 215486

SEQ ID NO: 217639 - RNA, 64 nt, Human; identical to SEQ ID NO: 215487

SEQ ID NO: 217640 - RNA, 64 nt, Human; identical to SEQ ID NO: 215488

SEQ ID NO: 217641 - RNA, 64 nt, Human
augcuucaccuguucaucccuuucuucccuaauccccuggcaaccacuuuaaaaaaaaaauuag

SEQ ID NO: 217642 - RNA, 64 nt, Human
cgaagacugaucacccacgcuaggcacucgcggucccuggcaggcgcugggaugggggcuuaug

SEQ ID NO: 217643 - RNA, 64 nt, Human
cuuucucuggggaccccauuccugucaguagcaacccuggcaguguccggagcggcucuagaca

SEQ ID NO: 217644 - RNA, 64 nt, Human; identical to SEQ ID NO: 215489

SEQ ID NO: 217645 - RNA, 64 nt, Human; identical to SEQ ID NO: 215490

SEQ ID NO: 217646 - RNA, 64 nt, Human; identical to SEQ ID NO: 215491

SEQ ID NO: 217647 - RNA, 64 nt, Human; identical to SEQ ID NO: 215492

SEQ ID NO: 217648 - RNA, 64 nt, Human; identical to SEQ ID NO: 215493

SEQ ID NO: 217649 - RNA, 64 nt, Human; identical to SEQ ID NO: 215494

SEQ ID NO: 217650 - RNA, 64 nt, Human; identical to SEQ ID NO: 215495

SEQ ID NO: 217651 - RNA, 64 nt, Human; identical to SEQ ID NO: 215496

SEQ ID NO: 217652 - RNA, 64 nt, Human; identical to SEQ ID NO: 215497

SEQ ID NO: 217653 - RNA, 64 nt, Human; identical to SEQ ID NO: 215498

SEQ ID NO: 217654 - RNA, 64 nt, Human; identical to SEQ ID NO: 215502

SEQ ID NO: 217655 - RNA, 64 nt, Human; identical to SEQ ID NO: 215503

SEQ ID NO: 217656 - RNA, 64 nt, Human; identical to SEQ ID NO: 215504

SEQ ID NO: 217657 - RNA, 64 nt, Human; identical to SEQ ID NO: 215505

SEQ ID NO: 217658 - RNA, 64 nt, Human; identical to SEQ ID NO: 215506

SEQ ID NO: 217659 - RNA, 64 nt, Human; identical to SEQ ID NO: 215507

SEQ ID NO: 217660 - RNA, 64 nt, Human; identical to SEQ ID NO: 214240

SEQ ID NO: 217661 - RNA, 64 nt, Human; identical to SEQ ID NO: 214241

SEQ ID NO: 217662 - RNA, 64 nt, Human
cccugcagccuccccagaugaaguagguguauuccccuggcagucugggcaacggagaccaaga

SEQ ID NO: 217663 - RNA, 64 nt, Human; identical to SEQ ID NO: 215508

SEQ ID NO: 217664 - RNA, 64 nt, Human; identical to SEQ ID NO: 215509

SEQ ID NO: 217665 - RNA, 64 nt, Human; identical to SEQ ID NO: 215510

SEQ ID NO: 217666 - RNA, 64 nt, Human; identical to SEQ ID NO: 215511

SEQ ID NO: 217667 - RNA, 64 nt, Human; identical to SEQ ID NO: 215512

SEQ ID NO: 217668 - RNA, 64 nt, Human; identical to SEQ ID NO: 215513

SEQ ID NO: 217669 - RNA, 64 nt, Human; identical to SEQ ID NO: 215514

SEQ ID NO: 217670 - RNA, 64 nt, Human; identical to SEQ ID NO: 215515

SEQ ID NO: 217671 - RNA, 64 nt, Human; identical to SEQ ID NO: 215516

SEQ ID NO: 217672 - RNA, 64 nt, Human; identical to SEQ ID NO: 215517

SEQ ID NO: 217673 - RNA, 64 nt, Human; identical to SEQ ID NO: 215521

SEQ ID NO: 217674 - RNA, 64 nt, Human; identical to SEQ ID NO: 215522

SEQ ID NO: 217675 - RNA, 64 nt, Human; identical to SEQ ID NO: 215523

SEQ ID NO: 217676 - RNA, 64 nt, Human; identical to SEQ ID NO: 215524

SEQ ID NO: 217677 - RNA, 64 nt, Human; identical to SEQ ID NO: 215525

SEQ ID NO: 217678 - RNA, 64 nt, Human; identical to SEQ ID NO: 215526

SEQ ID NO: 217679 - RNA, 64 nt, Human; identical to SEQ ID NO: 214239

SEQ ID NO: 217680 - RNA, 64 nt, Human; identical to SEQ ID NO: 214341

SEQ ID NO: 217681 - RNA, 64 nt, Human
ccuuccaugugaaugcacaggaagcugagaugaacccuggcauuuggccucuuguagucuuggc

SEQ ID NO: 217682 - RNA, 64 nt, Human; identical to SEQ ID NO: 215527

SEQ ID NO: 217683 - RNA, 64 nt, Human; identical to SEQ ID NO: 215528

SEQ ID NO: 217684 - RNA, 64 nt, Human; identical to SEQ ID NO: 215529

SEQ ID NO: 217685 - RNA, 64 nt, Human; identical to SEQ ID NO: 215530

SEQ ID NO: 217686 - RNA, 64 nt, Human; identical to SEQ ID NO: 215531

SEQ ID NO: 217687 - RNA, 64 nt, Human; identical to SEQ ID NO: 215532

SEQ ID NO: 217688 - RNA, 64 nt, Human; identical to SEQ ID NO: 215533

SEQ ID NO: 217689 - RNA, 64 nt, Human; identical to SEQ ID NO: 215534

SEQ ID NO: 217690 - RNA, 64 nt, Human; identical to SEQ ID NO: 215535

SEQ ID NO: 217691 - RNA, 64 nt, Human; identical to SEQ ID NO: 215536

SEQ ID NO: 217692 - RNA, 57 nt, Human; identical to SEQ ID NO: 215540

SEQ ID NO: 217693 - RNA, 64 nt, Human; identical to SEQ ID NO: 215541

SEQ ID NO: 217694 - RNA, 64 nt, Human; identical to SEQ ID NO: 215542

SEQ ID NO: 217695 - RNA, 64 nt, Human; identical to SEQ ID NO: 215543

SEQ ID NO: 217696 - RNA, 64 nt, Human; identical to SEQ ID NO: 215544

SEQ ID NO: 217697 - RNA, 64 nt, Human; identical to SEQ ID NO: 215545

SEQ ID NO: 217698 - RNA, 64 nt, Human; identical to SEQ ID NO: 214258

SEQ ID NO: 217699 - RNA, 55 nt, Human
cagccaaaaaguuggagugaaaagacccuggcacccgcccgacaccugcgugagc

SEQ ID NO: 217700 - RNA, 64 nt, Human
gccaagcccucauuaaagaugccacccugggcugcccuggcaccuagcaaggcacaccaagaac

SEQ ID NO: 217701 - RNA, 64 nt, Human; identical to SEQ ID NO: 215546

SEQ ID NO: 217702 - RNA, 64 nt, Human; identical to SEQ ID NO: 215547

SEQ ID NO: 217703 - RNA, 64 nt, Human; identical to SEQ ID NO: 215548

SEQ ID NO: 217704 - RNA, 64 nt, Human; identical to SEQ ID NO: 215549

SEQ ID NO: 217705 - RNA, 64 nt, Human; identical to SEQ ID NO: 215550

SEQ ID NO: 217706 - RNA, 64 nt, Human; identical to SEQ ID NO: 215551

SEQ ID NO: 217707 - RNA, 64 nt, Human; identical to SEQ ID NO: 215552

SEQ ID NO: 217708 - RNA, 64 nt, Human; identical to SEQ ID NO: 215553

SEQ ID NO: 217709 - RNA, 64 nt, Human; identical to SEQ ID NO: 215554

SEQ ID NO: 217710 - RNA, 64 nt, Human; identical to SEQ ID NO: 215555

SEQ ID NO: 217711 - RNA, 64 nt, Human; identical to SEQ ID NO: 215559

SEQ ID NO: 217712 - RNA, 64 nt, Human; identical to SEQ ID NO: 215560

SEQ ID NO: 217713 - RNA, 64 nt, Human; identical to SEQ ID NO: 215561

SEQ ID NO: 217714 - RNA, 64 nt, Human; identical to SEQ ID NO: 215562

SEQ ID NO: 217715 - RNA, 64 nt, Human; identical to SEQ ID NO: 215563

SEQ ID NO: 217716 - RNA, 64 nt, Human; identical to SEQ ID NO: 215564

SEQ ID NO: 217717 - RNA, 64 nt, Human
ugcaguggggcugacuccagaucucuccugcccucccuggcagccaggaccagcaccuguaguc

SEQ ID NO: 217718 - RNA, 64 nt, Human
ugcucauugucuuuccucuguguguagugagugacccuggcaguguuugccugcucagaguggc

SEQ ID NO: 217719 - RNA, 64 nt, Human; identical to SEQ ID NO: 214261

SEQ ID NO: 217720 - RNA, 64 nt, Human; identical to SEQ ID NO: 215565

SEQ ID NO: 217721 - RNA, 64 nt, Human; identical to SEQ ID NO: 215566

SEQ ID NO: 217722 - RNA, 64 nt, Human; identical to SEQ ID NO: 215567

SEQ ID NO: 217723 - RNA, 64 nt, Human; identical to SEQ ID NO: 215568

SEQ ID NO: 217724 - RNA, 64 nt, Human; identical to SEQ ID NO: 215569

SEQ ID NO: 217725 - RNA, 64 nt, Human; identical to SEQ ID NO: 215570

SEQ ID NO: 217726 - RNA, 64 nt, Human; identical to SEQ ID NO: 215571

SEQ ID NO: 217727 - RNA, 64 nt, Human; identical to SEQ ID NO: 215572

SEQ ID NO: 217728 - RNA, 64 nt, Human; identical to SEQ ID NO: 215573

SEQ ID NO: 217729 - RNA, 63 nt, Human; identical to SEQ ID NO: 215574

SEQ ID NO: 217730 - RNA, 64 nt, Human; identical to SEQ ID NO: 215578

SEQ ID NO: 217731 - RNA, 64 nt, Human; identical to SEQ ID NO: 215579

SEQ ID NO: 217732 - RNA, 64 nt, Human; identical to SEQ ID NO: 215580

SEQ ID NO: 217733 - RNA, 64 nt, Human; identical to SEQ ID NO: 215581

SEQ ID NO: 217734 - RNA, 64 nt, Human; identical to SEQ ID NO: 215582

SEQ ID NO: 217735 - RNA, 64 nt, Human; identical to SEQ ID NO: 215583

SEQ ID NO: 217736 - RNA, 64 nt, Human
uugugguucuggaugaaaucuuugcaaaggguuucccuggcacucaaacagaauaaauaggcuu

SEQ ID NO: 217737 - RNA, 64 nt, Human; identical to SEQ ID NO: 214278

SEQ ID NO: 217738 - RNA, 64 nt, Human
guggcccgagccuguguccuccccaccucgcccacccuggcaaggacagcugcggccaaggacg

SEQ ID NO: 217739 - RNA, 64 nt, Human; identical to SEQ ID NO: 215584

SEQ ID NO: 217740 - RNA, 64 nt, Human; identical to SEQ ID NO: 215585

SEQ ID NO: 217741 - RNA, 64 nt, Human; identical to SEQ ID NO: 215586

SEQ ID NO: 217742 - RNA, 64 nt, Human; identical to SEQ ID NO: 215587

SEQ ID NO: 217743 - RNA, 64 nt, Human; identical to SEQ ID NO: 215588

SEQ ID NO: 217744 - RNA, 64 nt, Human; identical to SEQ ID NO: 215589

SEQ ID NO: 217745 - RNA, 64 nt, Human; identical to SEQ ID NO: 215590

SEQ ID NO: 217746 - RNA, 64 nt, Human; identical to SEQ ID NO: 215591

SEQ ID NO: 217747 - RNA, 64 nt, Human; identical to SEQ ID NO: 215592

SEQ ID NO: 217748 - RNA, 64 nt, Human; identical to SEQ ID NO: 215593

SEQ ID NO: 217749 - RNA, 64 nt, Human; identical to SEQ ID NO: 215597

SEQ ID NO: 217750 - RNA, 64 nt, Human; identical to SEQ ID NO: 215598

SEQ ID NO: 217751 - RNA, 64 nt, Human; identical to SEQ ID NO: 215599

SEQ ID NO: 217752 - RNA, 64 nt, Human; identical to SEQ ID NO: 215600

SEQ ID NO: 217753 - RNA, 64 nt, Human; identical to SEQ ID NO: 215601

SEQ ID NO: 217754 - RNA, 64 nt, Human; identical to SEQ ID NO: 215602

SEQ ID NO: 217755 - RNA, 64 nt, Human
cugggcccagcugggauugccgaggggccccuagcccuggcagcgguccugggcuagucggcug

SEQ ID NO: 217756 - RNA, 64 nt, Human; identical to SEQ ID NO: 214259

SEQ ID NO: 217757 - RNA, 64 nt, Human; identical to SEQ ID NO: 214358

SEQ ID NO: 217758 - RNA, 64 nt, Human; identical to SEQ ID NO: 215603

SEQ ID NO: 217759 - RNA, 64 nt, Human; identical to SEQ ID NO: 215604

SEQ ID NO: 217760 - RNA, 64 nt, Human; identical to SEQ ID NO: 215605

SEQ ID NO: 217761 - RNA, 64 nt, Human; identical to SEQ ID NO: 215606

SEQ ID NO: 217762 - RNA, 64 nt, Human; identical to SEQ ID NO: 215607

SEQ ID NO: 217763 - RNA, 64 nt, Human; identical to SEQ ID NO: 215608

SEQ ID NO: 217764 - RNA, 64 nt, Human; identical to SEQ ID NO: 215609

SEQ ID NO: 217765 - RNA, 64 nt, Human; identical to SEQ ID NO: 215610

SEQ ID NO: 217766 - RNA, 64 nt, Human; identical to SEQ ID NO: 215611

SEQ ID NO: 217767 - RNA, 64 nt, Human; identical to SEQ ID NO: 215612

SEQ ID NO: 217768 - RNA, 64 nt, Human; identical to SEQ ID NO: 215616

SEQ ID NO: 217769 - RNA, 64 nt, Human; identical to SEQ ID NO: 215617

SEQ ID NO: 217770 - RNA, 64 nt, Human; identical to SEQ ID NO: 215618

SEQ ID NO: 217771 - RNA, 64 nt, Human; identical to SEQ ID NO: 215619

SEQ ID NO: 217772 - RNA, 64 nt, Human; identical to SEQ ID NO: 215620

SEQ ID NO: 217773 - RNA, 64 nt, Human; identical to SEQ ID NO: 215621

SEQ ID NO: 217774 - RNA, 64 nt, Human; identical to SEQ ID NO: 214279

SEQ ID NO: 217775 - RNA, 64 nt, Human
aucaggggcaaaaagucacagcuuaucccaggcacccuggcagguucucagagccugccuccuc

SEQ ID NO: 217776 - RNA, 64 nt, Human
augaaggaaaugauacugaaugagucacaguguucccuggcaaguaagcuguuugcauugagaa

SEQ ID NO: 217777 - RNA, 64 nt, Human; identical to SEQ ID NO: 215622

SEQ ID NO: 217778 - RNA, 64 nt, Human; identical to SEQ ID NO: 215623

SEQ ID NO: 217779 - RNA, 64 nt, Human; identical to SEQ ID NO: 215624

SEQ ID NO: 217780 - RNA, 64 nt, Human; identical to SEQ ID NO: 215625

SEQ ID NO: 217781 - RNA, 64 nt, Human; identical to SEQ ID NO: 215626

SEQ ID NO: 217782 - RNA, 64 nt, Human; identical to SEQ ID NO: 215627

SEQ ID NO: 217783 - RNA, 64 nt, Human; identical to SEQ ID NO: 215628

SEQ ID NO: 217784 - RNA, 64 nt, Human; identical to SEQ ID NO: 215629

SEQ ID NO: 217785 - RNA, 64 nt, Human; identical to SEQ ID NO: 215630

SEQ ID NO: 217786 - RNA, 64 nt, Human; identical to SEQ ID NO: 215631

SEQ ID NO: 217787 - RNA, 64 nt, Human; identical to SEQ ID NO: 215635

SEQ ID NO: 217788 - RNA, 64 nt, Human; identical to SEQ ID NO: 215636

SEQ ID NO: 217789 - RNA, 64 nt, Human; identical to SEQ ID NO: 215637

SEQ ID NO: 217790 - RNA, 64 nt, Human; identical to SEQ ID NO: 215638

SEQ ID NO: 217791 - RNA, 64 nt, Human; identical to SEQ ID NO: 215639

SEQ ID NO: 217792 - RNA, 64 nt, Human; identical to SEQ ID NO: 215640

SEQ ID NO: 217793 - RNA, 54 nt, Human; identical to SEQ ID NO: 214237

SEQ ID NO: 217794 - RNA, 64 nt, Human
aaaaagaacugccaaguuuuggugaggaguaacacccuggcaugacauuccuucucuuuccugg

SEQ ID NO: 217795 - RNA, 64 nt, Human
aggcugggguaagccgggguuccacagggcccagcccuggcaggggucuggccccccagguagg

SEQ ID NO: 217796 - RNA, 64 nt, Human; identical to SEQ ID NO: 215641

SEQ ID NO: 217797 - RNA, 64 nt, Human; identical to SEQ ID NO: 215642

SEQ ID NO: 217798 - RNA, 64 nt, Human; identical to SEQ ID NO: 215643

SEQ ID NO: 217799 - RNA, 64 nt, Human; identical to SEQ ID NO: 215644

SEQ ID NO: 217800 - RNA, 64 nt, Human; identical to SEQ ID NO: 215645

SEQ ID NO: 217801 - RNA, 64 nt, Human; identical to SEQ ID NO: 215646

SEQ ID NO: 217802 - RNA, 64 nt, Human; identical to SEQ ID NO: 215647

SEQ ID NO: 217803 - RNA, 64 nt, Human; identical to SEQ ID NO: 215648

SEQ ID NO: 217804 - RNA, 64 nt, Human; identical to SEQ ID NO: 215649

SEQ ID NO: 217805 - RNA, 64 nt, Human; identical to SEQ ID NO: 215650

SEQ ID NO: 217806 - RNA, 64 nt, Human; identical to SEQ ID NO: 215654

SEQ ID NO: 217807 - RNA, 64 nt, Human; identical to SEQ ID NO: 215655

SEQ ID NO: 217808 - RNA, 64 nt, Human; identical to SEQ ID NO: 215656

SEQ ID NO: 217809 - RNA, 64 nt, Human; identical to SEQ ID NO: 215657

SEQ ID NO: 217810 - RNA, 64 nt, Human; identical to SEQ ID NO: 215658

SEQ ID NO: 217811 - RNA, 64 nt, Human; identical to SEQ ID NO: 215659

SEQ ID NO: 217812 - RNA, 64 nt, Human; identical to SEQ ID NO: 215818

SEQ ID NO: 217813 - RNA, 64 nt, Human; identical to SEQ ID NO: 216122

SEQ ID NO: 217814 - RNA, 64 nt, Human; identical to SEQ ID NO: 215518

SEQ ID NO: 217815 - RNA, 64 nt, Human; identical to SEQ ID NO: 215660

SEQ ID NO: 217816 - RNA, 64 nt, Human; identical to SEQ ID NO: 215661

SEQ ID NO: 217817 - RNA, 64 nt, Human; identical to SEQ ID NO: 215662

SEQ ID NO: 217818 - RNA, 64 nt, Human; identical to SEQ ID NO: 215663

SEQ ID NO: 217819 - RNA, 64 nt, Human; identical to SEQ ID NO: 215664

SEQ ID NO: 217820 - RNA, 64 nt, Human; identical to SEQ ID NO: 215665

SEQ ID NO: 217821 - RNA, 64 nt, Human; identical to SEQ ID NO: 215666

SEQ ID NO: 217822 - RNA, 64 nt, Human; identical to SEQ ID NO: 215667

SEQ ID NO: 217823 - RNA, 64 nt, Human; identical to SEQ ID NO: 215668

SEQ ID NO: 217824 - RNA, 64 nt, Human; identical to SEQ ID NO: 215669

SEQ ID NO: 217825 - RNA, 64 nt, Human; identical to SEQ ID NO: 215673

SEQ ID NO: 217826 - RNA, 64 nt, Human; identical to SEQ ID NO: 215674

SEQ ID NO: 217827 - RNA, 56 nt, Human; identical to SEQ ID NO: 215675

SEQ ID NO: 217828 - RNA, 64 nt, Human; identical to SEQ ID NO: 215742

SEQ ID NO: 217829 - RNA, 64 nt, Human; identical to SEQ ID NO: 215519

SEQ ID NO: 217830 - RNA, 64 nt, Human
ucacuguuggcugcauuggacaaucacauacaaacccuggcauguccuuccagaaaaaccagcu

SEQ ID NO: 217831 - RNA, 64 nt, Human; identical to SEQ ID NO: 214599

SEQ ID NO: 217832 - RNA, 64 nt, Human; identical to SEQ ID NO: 214600

SEQ ID NO: 217833 - RNA, 64 nt, Human; identical to SEQ ID NO: 214601

SEQ ID NO: 217834 - RNA, 64 nt, Human; identical to SEQ ID NO: 214602

SEQ ID NO: 217835 - RNA, 64 nt, Human; identical to SEQ ID NO: 214603

SEQ ID NO: 217836 - RNA, 64 nt, Human; identical to SEQ ID NO: 214604

SEQ ID NO: 217837 - RNA, 64 nt, Human; identical to SEQ ID NO: 214605

SEQ ID NO: 217838 - RNA, 64 nt, Human; identical to SEQ ID NO: 214606

SEQ ID NO: 217839 - RNA, 64 nt, Human; identical to SEQ ID NO: 214607

SEQ ID NO: 217840 - RNA, 64 nt, Human; identical to SEQ ID NO: 214608

SEQ ID NO: 217841 - RNA, 64 nt, Human; identical to SEQ ID NO: 214609

SEQ ID NO: 217842 - RNA, 64 nt, Human; identical to SEQ ID NO: 214610

SEQ ID NO: 217843 - RNA, 64 nt, Human; identical to SEQ ID NO: 214611

SEQ ID NO: 217844 - RNA, 64 nt, Human; identical to SEQ ID NO: 215671

SEQ ID NO: 217845 - RNA, 64 nt, Human
uucaaggagaucauauucaacuuucauggacugccccuggcaagguccucgauaaaggaagagg

SEQ ID NO: 217846 - RNA, 64 nt, Human
uggcccccaaaccucuuggcacccgguuguuacccccuggcagcuucucccccaaacucuccua

SEQ ID NO: 217847 - RNA, 64 nt, Human; identical to SEQ ID NO: 214615

SEQ ID NO: 217848 - RNA, 64 nt, Human; identical to SEQ ID NO: 214616

SEQ ID NO: 217849 - RNA, 64 nt, Human; identical to SEQ ID NO: 214617

SEQ ID NO: 217850 - RNA, 64 nt, Human; identical to SEQ ID NO: 214618

SEQ ID NO: 217851 - RNA, 64 nt, Human; identical to SEQ ID NO: 214619

SEQ ID NO: 217852 - RNA, 64 nt, Human; identical to SEQ ID NO: 214620

SEQ ID NO: 217853 - RNA, 64 nt, Human; identical to SEQ ID NO: 214621

SEQ ID NO: 217854 - RNA, 64 nt, Human; identical to SEQ ID NO: 214622

SEQ ID NO: 217855 - RNA, 64 nt, Human; identical to SEQ ID NO: 214623

SEQ ID NO: 217856 - RNA, 64 nt, Human; identical to SEQ ID NO: 214624

SEQ ID NO: 217857 - RNA, 64 nt, Human; identical to SEQ ID NO: 214625

SEQ ID NO: 217858 - RNA, 64 nt, Human; identical to SEQ ID NO: 214626

SEQ ID NO: 217859 - RNA, 64 nt, Human; identical to SEQ ID NO: 214627

SEQ ID NO: 217860 - RNA, 64 nt, Human; identical to SEQ ID NO: 214628

SEQ ID NO: 217861 - RNA, 55 nt, Human; identical to SEQ ID NO: 214629

SEQ ID NO: 217862 - RNA, 64 nt, Human; identical to SEQ ID NO: 214630

SEQ ID NO: 217863 - RNA, 64 nt, Human
ccugcccaaccagacaccucaaacucugucagugcccuggcauucuggcagagaauccucacca

SEQ ID NO: 217864 - RNA, 64 nt, Human
gaugaugguauuuggagaugugaaagccaaaagccccuggcagugguggggaauguugacugag

SEQ ID NO: 217865 - RNA, 64 nt, Human
cugggaggaggaagacugagguagagauuccaggcccuggcauaagcugaaucccaaauuugag

SEQ ID NO: 217866 - RNA, 64 nt, Human; identical to SEQ ID NO: 214634

SEQ ID NO: 217867 - RNA, 64 nt, Human; identical to SEQ ID NO: 214635

SEQ ID NO: 217868 - RNA, 64 nt, Human; identical to SEQ ID NO: 214636

SEQ ID NO: 217869 - RNA, 64 nt, Human; identical to SEQ ID NO: 214637

SEQ ID NO: 217870 - RNA, 64 nt, Human; identical to SEQ ID NO: 214638

SEQ ID NO: 217871 - RNA, 64 nt, Human; identical to SEQ ID NO: 214639

SEQ ID NO: 217872 - RNA, 64 nt, Human; identical to SEQ ID NO: 214640

SEQ ID NO: 217873 - RNA, 64 nt, Human; identical to SEQ ID NO: 214641

SEQ ID NO: 217874 - RNA, 64 nt, Human; identical to SEQ ID NO: 214642

SEQ ID NO: 217875 - RNA, 64 nt, Human; identical to SEQ ID NO: 214643

SEQ ID NO: 217876 - RNA, 64 nt, Human; identical to SEQ ID NO: 214644

SEQ ID NO: 217877 - RNA, 64 nt, Human; identical to SEQ ID NO: 214645

SEQ ID NO: 217878 - RNA, 64 nt, Human; identical to SEQ ID NO: 214646

SEQ ID NO: 217879 - RNA, 64 nt, Human; identical to SEQ ID NO: 214647

SEQ ID NO: 217880 - RNA, 64 nt, Human; identical to SEQ ID NO: 214648

SEQ ID NO: 217881 - RNA, 64 nt, Human; identical to SEQ ID NO: 214649

SEQ ID NO: 217882 - RNA, 64 nt, Human
uugcuucaguuggggcagacucugaucccuucugcccuggcagaauggcagggguaaucugagc

SEQ ID NO: 217883 - RNA, 64 nt, Human
uauuaaacuugagaccagugaugcucagaagcuccccuggcacaauuucagaguaagagcucgg

SEQ ID NO: 217884 - RNA, 64 nt, Human
gcugagaugcgcaaagagugugcucgggaguggccccuggcaccugggugcucuggcuggagag

SEQ ID NO: 217885 - RNA, 64 nt, Human; identical to SEQ ID NO: 214653

SEQ ID NO: 217886 - RNA, 64 nt, Human; identical to SEQ ID NO: 214654

SEQ ID NO: 217887 - RNA, 64 nt, Human; identical to SEQ ID NO: 214655

SEQ ID NO: 217888 - RNA, 64 nt, Human; identical to SEQ ID NO: 214656

SEQ ID NO: 217889 - RNA, 64 nt, Human; identical to SEQ ID NO: 214657

SEQ ID NO: 217890 - RNA, 64 nt, Human; identical to SEQ ID NO: 214658

SEQ ID NO: 217891 - RNA, 64 nt, Human; identical to SEQ ID NO: 214659

SEQ ID NO: 217892 - RNA, 64 nt, Human; identical to SEQ ID NO: 214660

SEQ ID NO: 217893 - RNA, 64 nt, Human; identical to SEQ ID NO: 214661

SEQ ID NO: 217894 - RNA, 64 nt, Human; identical to SEQ ID NO: 214662

SEQ ID NO: 217895 - RNA, 64 nt, Human; identical to SEQ ID NO: 214663

SEQ ID NO: 217896 - RNA, 64 nt, Human; identical to SEQ ID NO: 214664

SEQ ID NO: 217897 - RNA, 64 nt, Human; identical to SEQ ID NO: 214665

SEQ ID NO: 217898 - RNA, 64 nt, Human; identical to SEQ ID NO: 214666

SEQ ID NO: 217899 - RNA, 64 nt, Human; identical to SEQ ID NO: 214667

SEQ ID NO: 217900 - RNA, 64 nt, Human; identical to SEQ ID NO: 214668

SEQ ID NO: 217901 - RNA, 53 nt, Human; identical to SEQ ID NO: 216311

SEQ ID NO: 217902 - RNA, 64 nt, Human
uuugguaaucuugcacuaagacaucaacaaaaugcccuggcagagauaacuugggaaagauuuu

SEQ ID NO: 217903 - RNA, 64 nt, Human
ccuaagguagugacccugcauuguggugccugagcccuggcagaagcucuuguaaaauuuguua

SEQ ID NO: 217904 - RNA, 64 nt, Human; identical to SEQ ID NO: 214672

SEQ ID NO: 217905 - RNA, 64 nt, Human; identical to SEQ ID NO: 214673

SEQ ID NO: 217906 - RNA, 64 nt, Human; identical to SEQ ID NO: 214674

SEQ ID NO: 217907 - RNA, 64 nt, Human; identical to SEQ ID NO: 214675

SEQ ID NO: 217908 - RNA, 64 nt, Human; identical to SEQ ID NO: 214676

SEQ ID NO: 217909 - RNA, 64 nt, Human; identical to SEQ ID NO: 214677

SEQ ID NO: 217910 - RNA, 64 nt, Human; identical to SEQ ID NO: 214678

SEQ ID NO: 217911 - RNA, 64 nt, Human; identical to SEQ ID NO: 214679

SEQ ID NO: 217912 - RNA, 64 nt, Human; identical to SEQ ID NO: 214680

SEQ ID NO: 217913 - RNA, 64 nt, Human; identical to SEQ ID NO: 214681

SEQ ID NO: 217914 - RNA, 64 nt, Human; identical to SEQ ID NO: 214682

SEQ ID NO: 217915 - RNA, 64 nt, Human; identical to SEQ ID NO: 214683

SEQ ID NO: 217916 - RNA, 64 nt, Human; identical to SEQ ID NO: 214684

SEQ ID NO: 217917 - RNA, 64 nt, Human; identical to SEQ ID NO: 214685

SEQ ID NO: 217918 - RNA, 64 nt, Human; identical to SEQ ID NO: 214686

SEQ ID NO: 217919 - RNA, 64 nt, Human; identical to SEQ ID NO: 214687

SEQ ID NO: 217920 - RNA, 64 nt, Human; identical to SEQ ID NO: 216121

SEQ ID NO: 217921 - RNA, 64 nt, Human
ccugcggccuuugcucacggguggcccugcccaccccuggcacaaccaaaaucccacugaugcc

SEQ ID NO: 217922 - RNA, 64 nt, Human
gacuuucuucagggcccguagcugcugggcguaccccuggcaggcgggcugugccgcgggcaca

SEQ ID NO: 217923 - RNA, 64 nt, Human; identical to SEQ ID NO: 214691

SEQ ID NO: 217924 - RNA, 64 nt, Human; identical to SEQ ID NO: 214692

SEQ ID NO: 217925 - RNA, 59 nt, Human; identical to SEQ ID NO: 214693

SEQ ID NO: 217926 - RNA, 64 nt, Human; identical to SEQ ID NO: 214694

SEQ ID NO: 217927 - RNA, 64 nt, Human; identical to SEQ ID NO: 214695

SEQ ID NO: 217928 - RNA, 64 nt, Human; identical to SEQ ID NO: 214696

SEQ ID NO: 217929 - RNA, 64 nt, Human; identical to SEQ ID NO: 214697

SEQ ID NO: 217930 - RNA, 61 nt, Human; identical to SEQ ID NO: 214698

SEQ ID NO: 217931 - RNA, 64 nt, Human; identical to SEQ ID NO: 214699

SEQ ID NO: 217932 - RNA, 64 nt, Human; identical to SEQ ID NO: 214700

SEQ ID NO: 217933 - RNA, 64 nt, Human; identical to SEQ ID NO: 214701

SEQ ID NO: 217934 - RNA, 64 nt, Human; identical to SEQ ID NO: 214702

SEQ ID NO: 217935 - RNA, 64 nt, Human; identical to SEQ ID NO: 214703

SEQ ID NO: 217936 - RNA, 64 nt, Human; identical to SEQ ID NO: 214704

SEQ ID NO: 217937 - RNA, 64 nt, Human; identical to SEQ ID NO: 214705

SEQ ID NO: 217938 - RNA, 64 nt, Human; identical to SEQ ID NO: 214706

SEQ ID NO: 217939 - RNA, 64 nt, Human; identical to SEQ ID NO: 214230

SEQ ID NO: 217940 - RNA, 64 nt, Human
uaacaucucaacuugccaguugcugggugcugggcccuggcaggaaugggccaagccaagcagg

SEQ ID NO: 217941 - RNA, 64 nt, Human
ucagcuuggguucugcacuaacagccuccaagcccccuggcacuucuguugcccugagaguguc

SEQ ID NO: 217942 - RNA, 64 nt, Human; identical to SEQ ID NO: 214710

SEQ ID NO: 217943 - RNA, 64 nt, Human; identical to SEQ ID NO: 214711

SEQ ID NO: 217944 - RNA, 64 nt, Human; identical to SEQ ID NO: 214712

SEQ ID NO: 217945 - RNA, 64 nt, Human; identical to SEQ ID NO: 214713

SEQ ID NO: 217946 - RNA, 64 nt, Human; identical to SEQ ID NO: 214714

SEQ ID NO: 217947 - RNA, 64 nt, Human; identical to SEQ ID NO: 214715

SEQ ID NO: 217948 - RNA, 64 nt, Human; identical to SEQ ID NO: 214716

SEQ ID NO: 217949 - RNA, 64 nt, Human; identical to SEQ ID NO: 214717

SEQ ID NO: 217950 - RNA, 64 nt, Human; identical to SEQ ID NO: 214718

SEQ ID NO: 217951 - RNA, 64 nt, Human; identical to SEQ ID NO: 214719

SEQ ID NO: 217952 - RNA, 64 nt, Human; identical to SEQ ID NO: 214720

SEQ ID NO: 217953 - RNA, 64 nt, Human; identical to SEQ ID NO: 214721

SEQ ID NO: 217954 - RNA, 64 nt, Human; identical to SEQ ID NO: 214722

SEQ ID NO: 217955 - RNA, 64 nt, Human; identical to SEQ ID NO: 214723

SEQ ID NO: 217956 - RNA, 64 nt, Human; identical to SEQ ID NO: 214724

SEQ ID NO: 217957 - RNA, 64 nt, Human; identical to SEQ ID NO: 214725

SEQ ID NO: 217958 - RNA, 64 nt, Human
ucacgugguccuaaucuucugaacuuggcgcugccccuggcagccccuguucuggcagaguuga

SEQ ID NO: 217959 - RNA, 64 nt, Human; identical to SEQ ID NO: 214234

SEQ ID NO: 217960 - RNA, 64 nt, Human
cccaucccccaccaccauuccuuuccucccuucccccuggcagguagagacucuacucucuguc

SEQ ID NO: 217961 - RNA, 64 nt, Human; identical to SEQ ID NO: 214729

SEQ ID NO: 217962 - RNA, 64 nt, Human; identical to SEQ ID NO: 214730

SEQ ID NO: 217963 - RNA, 64 nt, Human; identical to SEQ ID NO: 214731

SEQ ID NO: 217964 - RNA, 64 nt, Human; identical to SEQ ID NO: 214732

SEQ ID NO: 217965 - RNA, 64 nt, Human; identical to SEQ ID NO: 214733

SEQ ID NO: 217966 - RNA, 64 nt, Human; identical to SEQ ID NO: 214734

SEQ ID NO: 217967 - RNA, 64 nt, Human; identical to SEQ ID NO: 214735

SEQ ID NO: 217968 - RNA, 64 nt, Human; identical to SEQ ID NO: 214736

SEQ ID NO: 217969 - RNA, 64 nt, Human; identical to SEQ ID NO: 214737

SEQ ID NO: 217970 - RNA, 64 nt, Human; identical to SEQ ID NO: 214738

SEQ ID NO: 217971 - RNA, 64 nt, Human; identical to SEQ ID NO: 214739

SEQ ID NO: 217972 - RNA, 64 nt, Human; identical to SEQ ID NO: 214740

SEQ ID NO: 217973 - RNA, 64 nt, Human; identical to SEQ ID NO: 214741

SEQ ID NO: 217974 - RNA, 64 nt, Human; identical to SEQ ID NO: 214742

SEQ ID NO: 217975 - RNA, 64 nt, Human; identical to SEQ ID NO: 214743

SEQ ID NO: 217976 - RNA, 64 nt, Human; identical to SEQ ID NO: 214744

SEQ ID NO: 217977 - RNA, 64 nt, Human; identical to SEQ ID NO: 216102

SEQ ID NO: 217978 - RNA, 64 nt, Human; identical to SEQ ID NO: 214233

SEQ ID NO: 217979 - RNA, 64 nt, Human; identical to SEQ ID NO: 214280

SEQ ID NO: 217980 - RNA, 64 nt, Human; identical to SEQ ID NO: 214748

SEQ ID NO: 217981 - RNA, 64 nt, Human; identical to SEQ ID NO: 214749

SEQ ID NO: 217982 - RNA, 64 nt, Human; identical to SEQ ID NO: 214750

SEQ ID NO: 217983 - RNA, 64 nt, Human; identical to SEQ ID NO: 214751

SEQ ID NO: 217984 - RNA, 64 nt, Human; identical to SEQ ID NO: 214752

SEQ ID NO: 217985 - RNA, 64 nt, Human; identical to SEQ ID NO: 214753

SEQ ID NO: 217986 - RNA, 64 nt, Human; identical to SEQ ID NO: 214754

SEQ ID NO: 217987 - RNA, 64 nt, Human; identical to SEQ ID NO: 214755

SEQ ID NO: 217988 - RNA, 64 nt, Human; identical to SEQ ID NO: 214756

SEQ ID NO: 217989 - RNA, 64 nt, Human; identical to SEQ ID NO: 214757

SEQ ID NO: 217990 - RNA, 64 nt, Human; identical to SEQ ID NO: 214758

SEQ ID NO: 217991 - RNA, 64 nt, Human; identical to SEQ ID NO: 214759

SEQ ID NO: 217992 - RNA, 64 nt, Human; identical to SEQ ID NO: 214760

SEQ ID NO: 217993 - RNA, 64 nt, Human; identical to SEQ ID NO: 214761

SEQ ID NO: 217994 - RNA, 64 nt, Human; identical to SEQ ID NO: 214762

SEQ ID NO: 217995 - RNA, 64 nt, Human; identical to SEQ ID NO: 214763

SEQ ID NO: 217996 - RNA, 64 nt, Human
gaacuagaguuuaagcugaggcagagugccgccacccuggcaugccccacaaacagaucaccag

SEQ ID NO: 217997 - RNA, 64 nt, Human
ugugagggaugaguugcauagcugauaugucagucccuggcaucguguauuccauaugucuaua

SEQ ID NO: 217998 - RNA, 64 nt, Human
gugcccauaugauuucuacacuucccaagccuuacccuggcaucuuucuuuuaaauuauaucug

SEQ ID NO: 217999 - RNA, 64 nt, Human; identical to SEQ ID NO: 214767

SEQ ID NO: 218000 - RNA, 64 nt, Human; identical to SEQ ID NO: 214768

SEQ ID NO: 218001 - RNA, 64 nt, Human; identical to SEQ ID NO: 214769

SEQ ID NO: 218002 - RNA, 64 nt, Human; identical to SEQ ID NO: 214770

SEQ ID NO: 218003 - RNA, 64 nt, Human; identical to SEQ ID NO: 214771

SEQ ID NO: 218004 - RNA, 64 nt, Human; identical to SEQ ID NO: 214772

SEQ ID NO: 218005 - RNA, 64 nt, Human; identical to SEQ ID NO: 214773

SEQ ID NO: 218006 - RNA, 64 nt, Human; identical to SEQ ID NO: 214774

SEQ ID NO: 218007 - RNA, 64 nt, Human; identical to SEQ ID NO: 214775

SEQ ID NO: 218008 - RNA, 64 nt, Human; identical to SEQ ID NO: 214776

SEQ ID NO: 218009 - RNA, 64 nt, Human; identical to SEQ ID NO: 214777

SEQ ID NO: 218010 - RNA, 64 nt, Human; identical to SEQ ID NO: 214778

SEQ ID NO: 218011 - RNA, 64 nt, Human; identical to SEQ ID NO: 214779

SEQ ID NO: 218012 - RNA, 64 nt, Human; identical to SEQ ID NO: 214780

SEQ ID NO: 218013 - RNA, 64 nt, Human; identical to SEQ ID NO: 214781

SEQ ID NO: 218014 - RNA, 64 nt, Human; identical to SEQ ID NO: 214782

SEQ ID NO: 218015 - RNA, 64 nt, Human
ggcucugcguucugcucugggccgggcccugcuccccuggcagcagaagugggugcaggaaggu

SEQ ID NO: 218016 - RNA, 64 nt, Human
cagagggaagcaacugcacagccccacaggcccucccuggcacuguccccccaaccccaucuca

SEQ ID NO: 218017 - RNA, 64 nt, Human
gacacugugcuuaccuccaaaaaucucaucucuucccuggcauucucccuaggcucuguuuugc

SEQ ID NO: 218018 - RNA, 64 nt, Human; identical to SEQ ID NO: 214786

SEQ ID NO: 218019 - RNA, 64 nt, Human; identical to SEQ ID NO: 214787

SEQ ID NO: 218020 - RNA, 64 nt, Human; identical to SEQ ID NO: 214788

SEQ ID NO: 218021 - RNA, 64 nt, Human; identical to SEQ ID NO: 214789

SEQ ID NO: 218022 - RNA, 64 nt, Human; identical to SEQ ID NO: 214790

SEQ ID NO: 218023 - RNA, 64 nt, Human; identical to SEQ ID NO: 214791

SEQ ID NO: 218024 - RNA, 64 nt, Human; identical to SEQ ID NO: 214792

SEQ ID NO: 218025 - RNA, 64 nt, Human; identical to SEQ ID NO: 214793

SEQ ID NO: 218026 - RNA, 64 nt, Human; identical to SEQ ID NO: 214794

SEQ ID NO: 218027 - RNA, 64 nt, Human; identical to SEQ ID NO: 214795

SEQ ID NO: 218028 - RNA, 64 nt, Human; identical to SEQ ID NO: 214796

SEQ ID NO: 218029 - RNA, 64 nt, Human; identical to SEQ ID NO: 214797

SEQ ID NO: 218030 - RNA, 64 nt, Human; identical to SEQ ID NO: 214798

SEQ ID NO: 218031 - RNA, 64 nt, Human; identical to SEQ ID NO: 214799

SEQ ID NO: 218032 - RNA, 64 nt, Human; identical to SEQ ID NO: 214800

SEQ ID NO: 218033 - RNA, 64 nt, Human; identical to SEQ ID NO: 214801

SEQ ID NO: 218034 - RNA, 64 nt, Human; identical to SEQ ID NO: 216101

SEQ ID NO: 218035 - RNA, 64 nt, Human; identical to SEQ ID NO: 215444

SEQ ID NO: 218036 - RNA, 64 nt, Human; identical to SEQ ID NO: 215797

SEQ ID NO: 218037 - RNA, 64 nt, Human; identical to SEQ ID NO: 214805

SEQ ID NO: 218038 - RNA, 64 nt, Human; identical to SEQ ID NO: 214806

SEQ ID NO: 218039 - RNA, 64 nt, Human; identical to SEQ ID NO: 214807

SEQ ID NO: 218040 - RNA, 64 nt, Human; identical to SEQ ID NO: 214808

SEQ ID NO: 218041 - RNA, 64 nt, Human; identical to SEQ ID NO: 214809

SEQ ID NO: 218042 - RNA, 64 nt, Human; identical to SEQ ID NO: 214810

SEQ ID NO: 218043 - RNA, 64 nt, Human; identical to SEQ ID NO: 214811

SEQ ID NO: 218044 - RNA, 64 nt, Human; identical to SEQ ID NO: 214812

SEQ ID NO: 218045 - RNA, 64 nt, Human; identical to SEQ ID NO: 214813

SEQ ID NO: 218046 - RNA, 64 nt, Human; identical to SEQ ID NO: 214814

SEQ ID NO: 218047 - RNA, 64 nt, Human; identical to SEQ ID NO: 214815

SEQ ID NO: 218048 - RNA, 64 nt, Human; identical to SEQ ID NO: 214816

SEQ ID NO: 218049 - RNA, 64 nt, Human; identical to SEQ ID NO: 214817

SEQ ID NO: 218050 - RNA, 64 nt, Human; identical to SEQ ID NO: 214818

SEQ ID NO: 218051 - RNA, 64 nt, Human; identical to SEQ ID NO: 214819

SEQ ID NO: 218052 - RNA, 64 nt, Human; identical to SEQ ID NO: 214820

SEQ ID NO: 218053 - RNA, 64 nt, Human
aaucccaguuuugcagucaacuauuaaccuggggcccuggcagauugggguauccacccaguca

SEQ ID NO: 218054 - RNA, 64 nt, Human
auggaggccacccucaggagugacuucucauccacccuggcagcuaguagguucugcuguuaug

SEQ ID NO: 218055 - RNA, 64 nt, Human; identical to SEQ ID NO: 214238

SEQ ID NO: 218056 - RNA, 64 nt, Human; identical to SEQ ID NO: 214824

SEQ ID NO: 218057 - RNA, 64 nt, Human; identical to SEQ ID NO: 214825

SEQ ID NO: 218058 - RNA, 64 nt, Human; identical to SEQ ID NO: 214826

SEQ ID NO: 218059 - RNA, 64 nt, Human; identical to SEQ ID NO: 214827

SEQ ID NO: 218060 - RNA, 64 nt, Human; identical to SEQ ID NO: 214828

SEQ ID NO: 218061 - RNA, 64 nt, Human; identical to SEQ ID NO: 214829

SEQ ID NO: 218062 - RNA, 64 nt, Human; identical to SEQ ID NO: 214830

SEQ ID NO: 218063 - RNA, 64 nt, Human; identical to SEQ ID NO: 214831

SEQ ID NO: 218064 - RNA, 61 nt, Human; identical to SEQ ID NO: 214832

SEQ ID NO: 218065 - RNA, 64 nt, Human; identical to SEQ ID NO: 214833

SEQ ID NO: 218066 - RNA, 64 nt, Human; identical to SEQ ID NO: 214834

SEQ ID NO: 218067 - RNA, 64 nt, Human; identical to SEQ ID NO: 214835

SEQ ID NO: 218068 - RNA, 64 nt, Human; identical to SEQ ID NO: 214836

SEQ ID NO: 218069 - RNA, 64 nt, Human; identical to SEQ ID NO: 214837

SEQ ID NO: 218070 - RNA, 64 nt, Human; identical to SEQ ID NO: 214838

SEQ ID NO: 218071 - RNA, 64 nt, Human; identical to SEQ ID NO: 214839

SEQ ID NO: 218072 - RNA, 64 nt, Human; identical to SEQ ID NO: 215683

SEQ ID NO: 218073 - RNA, 64 nt, Human; identical to SEQ ID NO: 215461

SEQ ID NO: 218074 - RNA, 64 nt, Human; identical to SEQ ID NO: 215835

SEQ ID NO: 218075 - RNA, 64 nt, Human; identical to SEQ ID NO: 214843

SEQ ID NO: 218076 - RNA, 64 nt, Human; identical to SEQ ID NO: 214844

SEQ ID NO: 218077 - RNA, 64 nt, Human; identical to SEQ ID NO: 214845

SEQ ID NO: 218078 - RNA, 64 nt, Human; identical to SEQ ID NO: 214846

SEQ ID NO: 218079 - RNA, 64 nt, Human; identical to SEQ ID NO: 214847

SEQ ID NO: 218080 - RNA, 64 nt, Human; identical to SEQ ID NO: 214848

SEQ ID NO: 218081 - RNA, 64 nt, Human; identical to SEQ ID NO: 214849

SEQ ID NO: 218082 - RNA, 64 nt, Human; identical to SEQ ID NO: 214850

SEQ ID NO: 218083 - RNA, 64 nt, Human; identical to SEQ ID NO: 214851

SEQ ID NO: 218084 - RNA, 64 nt, Human; identical to SEQ ID NO: 214852

SEQ ID NO: 218085 - RNA, 64 nt, Human; identical to SEQ ID NO: 214853

SEQ ID NO: 218086 - RNA, 64 nt, Human; identical to SEQ ID NO: 214854

SEQ ID NO: 218087 - RNA, 64 nt, Human; identical to SEQ ID NO: 214855

SEQ ID NO: 218088 - RNA, 64 nt, Human; identical to SEQ ID NO: 214856

SEQ ID NO: 218089 - RNA, 64 nt, Human; identical to SEQ ID NO: 214857

SEQ ID NO: 218090 - RNA, 64 nt, Human; identical to SEQ ID NO: 214858

SEQ ID NO: 218091 - RNA, 64 nt, Human; identical to SEQ ID NO: 215779

SEQ ID NO: 218092 - RNA, 64 nt, Human; identical to SEQ ID NO: 215798

SEQ ID NO: 218093 - RNA, 64 nt, Human; identical to SEQ ID NO: 215875

SEQ ID NO: 218094 - RNA, 64 nt, Human; identical to SEQ ID NO: 214862

SEQ ID NO: 218095 - RNA, 64 nt, Human; identical to SEQ ID NO: 214863

SEQ ID NO: 218096 - RNA, 64 nt, Human; identical to SEQ ID NO: 214864

SEQ ID NO: 218097 - RNA, 64 nt, Human; identical to SEQ ID NO: 214865

SEQ ID NO: 218098 - RNA, 64 nt, Human; identical to SEQ ID NO: 214866

SEQ ID NO: 218099 - RNA, 64 nt, Human; identical to SEQ ID NO: 214867

SEQ ID NO: 218100 - RNA, 53 nt, Human; identical to SEQ ID NO: 214868

SEQ ID NO: 218101 - RNA, 64 nt, Human; identical to SEQ ID NO: 214869

SEQ ID NO: 218102 - RNA, 64 nt, Human; identical to SEQ ID NO: 214870

SEQ ID NO: 218103 - RNA, 64 nt, Human; identical to SEQ ID NO: 214871

SEQ ID NO: 218104 - RNA, 64 nt, Human; identical to SEQ ID NO: 214872

SEQ ID NO: 218105 - RNA, 64 nt, Human; identical to SEQ ID NO: 214873

SEQ ID NO: 218106 - RNA, 64 nt, Human; identical to SEQ ID NO: 214874

SEQ ID NO: 218107 - RNA, 64 nt, Human; identical to SEQ ID NO: 214875

SEQ ID NO: 218108 - RNA, 64 nt, Human; identical to SEQ ID NO: 214876

SEQ ID NO: 218109 - RNA, 64 nt, Human; identical to SEQ ID NO: 214877

SEQ ID NO: 218110 - RNA, 64 nt, Human; identical to SEQ ID NO: 215911

SEQ ID NO: 218111 - RNA, 64 nt, Human; identical to SEQ ID NO: 215855

SEQ ID NO: 218112 - RNA, 64 nt, Human; identical to SEQ ID NO: 215856

SEQ ID NO: 218113 - RNA, 64 nt, Human; identical to SEQ ID NO: 214881

SEQ ID NO: 218114 - RNA, 64 nt, Human; identical to SEQ ID NO: 214882

SEQ ID NO: 218115 - RNA, 64 nt, Human; identical to SEQ ID NO: 214883

SEQ ID NO: 218116 - RNA, 64 nt, Human; identical to SEQ ID NO: 214884

SEQ ID NO: 218117 - RNA, 64 nt, Human; identical to SEQ ID NO: 214885

SEQ ID NO: 218118 - RNA, 64 nt, Human; identical to SEQ ID NO: 214886

SEQ ID NO: 218119 - RNA, 64 nt, Human; identical to SEQ ID NO: 214887

SEQ ID NO: 218120 - RNA, 64 nt, Human; identical to SEQ ID NO: 214888

SEQ ID NO: 218121 - RNA, 64 nt, Human; identical to SEQ ID NO: 214889

SEQ ID NO: 218122 - RNA, 64 nt, Human; identical to SEQ ID NO: 214890

SEQ ID NO: 218123 - RNA, 64 nt, Human; identical to SEQ ID NO: 214891

SEQ ID NO: 218124 - RNA, 64 nt, Human; identical to SEQ ID NO: 214892

SEQ ID NO: 218125 - RNA, 64 nt, Human; identical to SEQ ID NO: 214893

SEQ ID NO: 218126 - RNA, 64 nt, Human; identical to SEQ ID NO: 214894

SEQ ID NO: 218127 - RNA, 64 nt, Human; identical to SEQ ID NO: 214895

SEQ ID NO: 218128 - RNA, 64 nt, Human; identical to SEQ ID NO: 214896

SEQ ID NO: 218129 - RNA, 64 nt, Human; identical to SEQ ID NO: 215836

SEQ ID NO: 218130 - RNA, 64 nt, Human
agggaggcucuggaaagcccagccacaccugagucccuggcaguagccuuggggcagagggcac

SEQ ID NO: 218131 - RNA, 64 nt, Human
acuggcuccacccuggggccuugccccuaguacccccuggcaggagcaacccaccccauggucg

SEQ ID NO: 218132 - RNA, 64 nt, Human; identical to SEQ ID NO: 214900

SEQ ID NO: 218133 - RNA, 64 nt, Human; identical to SEQ ID NO: 214901

SEQ ID NO: 218134 - RNA, 64 nt, Human; identical to SEQ ID NO: 214902

SEQ ID NO: 218135 - RNA, 64 nt, Human; identical to SEQ ID NO: 214811

SEQ ID NO: 218136 - RNA, 64 nt, Human; identical to SEQ ID NO: 214904

SEQ ID NO: 218137 - RNA, 64 nt, Human; identical to SEQ ID NO: 214905

SEQ ID NO: 218138 - RNA, 64 nt, Human; identical to SEQ ID NO: 214906

SEQ ID NO: 218139 - RNA, 64 nt, Human; identical to SEQ ID NO: 214907

SEQ ID NO: 218140 - RNA, 64 nt, Human; identical to SEQ ID NO: 214908

SEQ ID NO: 218141 - RNA, 64 nt, Human; identical to SEQ ID NO: 214909

SEQ ID NO: 218142 - RNA, 64 nt, Human; identical to SEQ ID NO: 214910

SEQ ID NO: 218143 - RNA, 64 nt, Human; identical to SEQ ID NO: 214911

SEQ ID NO: 218144 - RNA, 64 nt, Human; identical to SEQ ID NO: 214912

SEQ ID NO: 218145 - RNA, 64 nt, Human; identical to SEQ ID NO: 214913

SEQ ID NO: 218146 - RNA, 64 nt, Human; identical to SEQ ID NO: 214914

SEQ ID NO: 218147 - RNA, 64 nt, Human; identical to SEQ ID NO: 214915

SEQ ID NO: 218148 - RNA, 64 nt, Human; identical to SEQ ID NO: 216386

SEQ ID NO: 218149 - RNA, 64 nt, Human; identical to SEQ ID NO: 215874

SEQ ID NO: 218150 - RNA, 64 nt, Human; identical to SEQ ID NO: 215894

SEQ ID NO: 218151 - RNA, 64 nt, Human; identical to SEQ ID NO: 214919

SEQ ID NO: 218152 - RNA, 64 nt, Human; identical to SEQ ID NO: 214920

SEQ ID NO: 218153 - RNA, 64 nt, Human; identical to SEQ ID NO: 214921

SEQ ID NO: 218154 - RNA, 64 nt, Human; identical to SEQ ID NO: 214922

SEQ ID NO: 218155 - RNA, 64 nt, Human; identical to SEQ ID NO: 214923

SEQ ID NO: 218156 - RNA, 64 nt, Human; identical to SEQ ID NO: 214924

SEQ ID NO: 218157 - RNA, 64 nt, Human; identical to SEQ ID NO: 214925

SEQ ID NO: 218158 - RNA, 64 nt, Human; identical to SEQ ID NO: 214926

SEQ ID NO: 218159 - RNA, 64 nt, Human; identical to SEQ ID NO: 214927

SEQ ID NO: 218160 - RNA, 64 nt, Human; identical to SEQ ID NO: 214928

SEQ ID NO: 218161 - RNA, 64 nt, Human; identical to SEQ ID NO: 214929

SEQ ID NO: 218162 - RNA, 64 nt, Human; identical to SEQ ID NO: 214930

SEQ ID NO: 218163 - RNA, 64 nt, Human; identical to SEQ ID NO: 214931

SEQ ID NO: 218164 - RNA, 64 nt, Human; identical to SEQ ID NO: 214932

SEQ ID NO: 218165 - RNA, 64 nt, Human; identical to SEQ ID NO: 214933

SEQ ID NO: 218166 - RNA, 64 nt, Human; identical to SEQ ID NO: 214934

SEQ ID NO: 218167 - RNA, 64 nt, Human; identical to SEQ ID NO: 215632

SEQ ID NO: 218168 - RNA, 64 nt, Human; identical to SEQ ID NO: 215931

SEQ ID NO: 218169 - RNA, 64 nt, Human; identical to SEQ ID NO: 215932

SEQ ID NO: 218170 - RNA, 64 nt, Human; identical to SEQ ID NO: 214938

SEQ ID NO: 218171 - RNA, 64 nt, Human; identical to SEQ ID NO: 214939

SEQ ID NO: 218172 - RNA, 64 nt, Human; identical to SEQ ID NO: 214940

SEQ ID NO: 218173 - RNA, 64 nt, Human; identical to SEQ ID NO: 214941

SEQ ID NO: 218174 - RNA, 64 nt, Human; identical to SEQ ID NO: 214942

SEQ ID NO: 218175 - RNA, 64 nt, Human; identical to SEQ ID NO: 214943

SEQ ID NO: 218176 - RNA, 64 nt, Human; identical to SEQ ID NO: 214944

SEQ ID NO: 218177 - RNA, 64 nt, Human; identical to SEQ ID NO: 214945

SEQ ID NO: 218178 - RNA, 64 nt, Human; identical to SEQ ID NO: 214946

SEQ ID NO: 218179 - RNA, 64 nt, Human; identical to SEQ ID NO: 214947

SEQ ID NO: 218180 - RNA, 64 nt, Human; identical to SEQ ID NO: 214948

SEQ ID NO: 218181 - RNA, 64 nt, Human; identical to SEQ ID NO: 214949

SEQ ID NO: 218182 - RNA, 64 nt, Human; identical to SEQ ID NO: 214950

SEQ ID NO: 218183 - RNA, 64 nt, Human; identical to SEQ ID NO: 214951

SEQ ID NO: 218184 - RNA, 64 nt, Human; identical to SEQ ID NO: 214952

SEQ ID NO: 218185 - RNA, 64 nt, Human; identical to SEQ ID NO: 214953

SEQ ID NO: 218186 - RNA, 64 nt, Human; identical to SEQ ID NO: 216177

SEQ ID NO: 218187 - RNA, 64 nt, Human; identical to SEQ ID NO: 215462

SEQ ID NO: 218188 - RNA, 64 nt, Human; identical to SEQ ID NO: 215949

SEQ ID NO: 218189 - RNA, 64 nt, Human; identical to SEQ ID NO: 214957

SEQ ID NO: 218190 - RNA, 64 nt, Human; identical to SEQ ID NO: 214958

SEQ ID NO: 218191 - RNA, 64 nt, Human; identical to SEQ ID NO: 214959

SEQ ID NO: 218192 - RNA, 64 nt, Human; identical to SEQ ID NO: 214960

SEQ ID NO: 218193 - RNA, 64 nt, Human; identical to SEQ ID NO: 214961

SEQ ID NO: 218194 - RNA, 64 nt, Human; identical to SEQ ID NO: 214962

SEQ ID NO: 218195 - RNA, 64 nt, Human; identical to SEQ ID NO: 214963

SEQ ID NO: 218196 - RNA, 64 nt, Human; identical to SEQ ID NO: 214964

SEQ ID NO: 218197 - RNA, 64 nt, Human; identical to SEQ ID NO: 214965

SEQ ID NO: 218198 - RNA, 64 nt, Human; identical to SEQ ID NO: 214966

SEQ ID NO: 218199 - RNA, 64 nt, Human; identical to SEQ ID NO: 214967

SEQ ID NO: 218200 - RNA, 64 nt, Human; identical to SEQ ID NO: 214968

SEQ ID NO: 218201 - RNA, 64 nt, Human; identical to SEQ ID NO: 214969

SEQ ID NO: 218202 - RNA, 64 nt, Human; identical to SEQ ID NO: 214970

SEQ ID NO: 218203 - RNA, 64 nt, Human; identical to SEQ ID NO: 214971

SEQ ID NO: 218204 - RNA, 64 nt, Human; identical to SEQ ID NO: 214972

SEQ ID NO: 218205 - RNA, 64 nt, Human; identical to SEQ ID NO: 215950

SEQ ID NO: 218206 - RNA, 64 nt, Human
cacacucucagaucugugucaaguucaaugugagcccuggcaaggcuggcauauuaacaccugc

SEQ ID NO: 218207 - RNA, 64 nt, Human
guaaaugcugguauuugauuuccuguguguguugcccuggcauuaagggcauuuuacccuugca

SEQ ID NO: 218208 - RNA, 64 nt, Human; identical to SEQ ID NO: 214976

SEQ ID NO: 218209 - RNA, 64 nt, Human; identical to SEQ ID NO: 214977

SEQ ID NO: 218210 - RNA, 64 nt, Human; identical to SEQ ID NO: 214978

SEQ ID NO: 218211 - RNA, 64 nt, Human; identical to SEQ ID NO: 214979

SEQ ID NO: 218212 - RNA, 64 nt, Human; identical to SEQ ID NO: 214980

SEQ ID NO: 218213 - RNA, 64 nt, Human; identical to SEQ ID NO: 214981

SEQ ID NO: 218214 - RNA, 64 nt, Human; identical to SEQ ID NO: 214982

SEQ ID NO: 218215 - RNA, 64 nt, Human; identical to SEQ ID NO: 214983

SEQ ID NO: 218216 - RNA, 64 nt, Human; identical to SEQ ID NO: 214984

SEQ ID NO: 218217 - RNA, 64 nt, Human; identical to SEQ ID NO: 214985

SEQ ID NO: 218218 - RNA, 64 nt, Human; identical to SEQ ID NO: 214986

SEQ ID NO: 218219 - RNA, 64 nt, Human; identical to SEQ ID NO: 214987

SEQ ID NO: 218220 - RNA, 64 nt, Human; identical to SEQ ID NO: 214988

SEQ ID NO: 218221 - RNA, 64 nt, Human; identical to SEQ ID NO: 214989

SEQ ID NO: 218222 - RNA, 64 nt, Human; identical to SEQ ID NO: 214990

SEQ ID NO: 218223 - RNA, 64 nt, Human; identical to SEQ ID NO: 214991

SEQ ID NO: 218224 - RNA, 64 nt, Human; identical to SEQ ID NO: 215425

SEQ ID NO: 218225 - RNA, 64 nt, Human; identical to SEQ ID NO: 215816

SEQ ID NO: 218226 - RNA, 64 nt, Human; identical to SEQ ID NO: 215482

SEQ ID NO: 218227 - RNA, 64 nt, Human; identical to SEQ ID NO: 214995

SEQ ID NO: 218228 - RNA, 64 nt, Human; identical to SEQ ID NO: 214996

SEQ ID NO: 218229 - RNA, 64 nt, Human; identical to SEQ ID NO: 214997

SEQ ID NO: 218230 - RNA, 64 nt, Human; identical to SEQ ID NO: 214998

SEQ ID NO: 218231 - RNA, 64 nt, Human; identical to SEQ ID NO: 214999

SEQ ID NO: 218232 - RNA, 64 nt, Human; identical to SEQ ID NO: 215000

SEQ ID NO: 218233 - RNA, 64 nt, Human; identical to SEQ ID NO: 215001

SEQ ID NO: 218234 - RNA, 64 nt, Human; identical to SEQ ID NO: 215002

SEQ ID NO: 218235 - RNA, 64 nt, Human; identical to SEQ ID NO: 215003

SEQ ID NO: 218236 - RNA, 64 nt, Human; identical to SEQ ID NO: 215004

SEQ ID NO: 218237 - RNA, 64 nt, Human; identical to SEQ ID NO: 215005

SEQ ID NO: 218238 - RNA, 64 nt, Human; identical to SEQ ID NO: 215006

SEQ ID NO: 218239 - RNA, 64 nt, Human; identical to SEQ ID NO: 215007

SEQ ID NO: 218240 - RNA, 64 nt, Human; identical to SEQ ID NO: 215008

SEQ ID NO: 218241 - RNA, 64 nt, Human; identical to SEQ ID NO: 215009

SEQ ID NO: 218242 - RNA, 64 nt, Human; identical to SEQ ID NO: 215010

SEQ ID NO: 218243 - RNA, 64 nt, Human; identical to SEQ ID NO: 215684

SEQ ID NO: 218244 - RNA, 64 nt, Human; identical to SEQ ID NO: 215499

SEQ ID NO: 218245 - RNA, 64 nt, Human; identical to SEQ ID NO: 216310

SEQ ID NO: 218246 - RNA, 64 nt, Human; identical to SEQ ID NO: 215014

SEQ ID NO: 218247 - RNA, 64 nt, Human; identical to SEQ ID NO: 215015

SEQ ID NO: 218248 - RNA, 63 nt, Human; identical to SEQ ID NO: 215016

SEQ ID NO: 218249 - RNA, 64 nt, Human; identical to SEQ ID NO: 215017

SEQ ID NO: 218250 - RNA, 64 nt, Human; identical to SEQ ID NO: 215018

SEQ ID NO: 218251 - RNA, 64 nt, Human; identical to SEQ ID NO: 215019

SEQ ID NO: 218252 - RNA, 64 nt, Human; identical to SEQ ID NO: 215020

SEQ ID NO: 218253 - RNA, 64 nt, Human; identical to SEQ ID NO: 215021

SEQ ID NO: 218254 - RNA, 64 nt, Human; identical to SEQ ID NO: 215022

SEQ ID NO: 218255 - RNA, 64 nt, Human; identical to SEQ ID NO: 215023

SEQ ID NO: 218256 - RNA, 64 nt, Human; identical to SEQ ID NO: 215024

SEQ ID NO: 218257 - RNA, 64 nt, Human; identical to SEQ ID NO: 215025

SEQ ID NO: 218258 - RNA, 64 nt, Human; identical to SEQ ID NO: 215026

SEQ ID NO: 218259 - RNA, 64 nt, Human; identical to SEQ ID NO: 215027

SEQ ID NO: 218260 - RNA, 64 nt, Human; identical to SEQ ID NO: 215028

SEQ ID NO: 218261 - RNA, 64 nt, Human; identical to SEQ ID NO: 215029

SEQ ID NO: 218262 - RNA, 64 nt, Human; identical to SEQ ID NO: 216082

SEQ ID NO: 218263 - RNA, 64 nt, Human; identical to SEQ ID NO: 215385

SEQ ID NO: 218264 - RNA, 64 nt, Human; identical to SEQ ID NO: 216045

SEQ ID NO: 218265 - RNA, 64 nt, Human; identical to SEQ ID NO: 215033

SEQ ID NO: 218266 - RNA, 64 nt, Human; identical to SEQ ID NO: 215034

SEQ ID NO: 218267 - RNA, 64 nt, Human; identical to SEQ ID NO: 215035

SEQ ID NO: 218268 - RNA, 64 nt, Human; identical to SEQ ID NO: 215036

SEQ ID NO: 218269 - RNA, 64 nt, Human; identical to SEQ ID NO: 215037

SEQ ID NO: 218270 - RNA, 64 nt, Human; identical to SEQ ID NO: 215038

SEQ ID NO: 218271 - RNA, 64 nt, Human; identical to SEQ ID NO: 215039

SEQ ID NO: 218272 - RNA, 64 nt, Human; identical to SEQ ID NO: 215040

SEQ ID NO: 218273 - RNA, 64 nt, Human; identical to SEQ ID NO: 215041

SEQ ID NO: 218274 - RNA, 64 nt, Human; identical to SEQ ID NO: 215042

SEQ ID NO: 218275 - RNA, 64 nt, Human; identical to SEQ ID NO: 215043

SEQ ID NO: 218276 - RNA, 64 nt, Human; identical to SEQ ID NO: 215044

SEQ ID NO: 218277 - RNA, 64 nt, Human; identical to SEQ ID NO: 215045

SEQ ID NO: 218278 - RNA, 64 nt, Human; identical to SEQ ID NO: 215046

SEQ ID NO: 218279 - RNA, 64 nt, Human; identical to SEQ ID NO: 215047

SEQ ID NO: 218280 - RNA, 64 nt, Human; identical to SEQ ID NO: 215048

SEQ ID NO: 218281 - RNA, 64 nt, Human; identical to SEQ ID NO: 216007

SEQ ID NO: 218282 - RNA, 64 nt, Human; identical to SEQ ID NO: 216046

SEQ ID NO: 218283 - RNA, 64 nt, Human; identical to SEQ ID NO: 215893

SEQ ID NO: 218284 - RNA, 64 nt, Human; identical to SEQ ID NO: 215052

SEQ ID NO: 218285 - RNA, 64 nt, Human; identical to SEQ ID NO: 215053

SEQ ID NO: 218286 - RNA, 64 nt, Human; identical to SEQ ID NO: 215054

SEQ ID NO: 218287 - RNA, 64 nt, Human; identical to SEQ ID NO: 215055

SEQ ID NO: 218288 - RNA, 64 nt, Human; identical to SEQ ID NO: 215056

SEQ ID NO: 218289 - RNA, 64 nt, Human; identical to SEQ ID NO: 215057

SEQ ID NO: 218290 - RNA, 64 nt, Human; identical to SEQ ID NO: 215058

SEQ ID NO: 218291 - RNA, 64 nt, Human; identical to SEQ ID NO: 215059

SEQ ID NO: 218292 - RNA, 64 nt, Human; identical to SEQ ID NO: 215060

SEQ ID NO: 218293 - RNA, 64 nt, Human; identical to SEQ ID NO: 215061

SEQ ID NO: 218294 - RNA, 64 nt, Human; identical to SEQ ID NO: 215062

SEQ ID NO: 218295 - RNA, 64 nt, Human; identical to SEQ ID NO: 215063

SEQ ID NO: 218296 - RNA, 64 nt, Human; identical to SEQ ID NO: 215064

SEQ ID NO: 218297 - RNA, 64 nt, Human; identical to SEQ ID NO: 215065

SEQ ID NO: 218298 - RNA, 64 nt, Human; identical to SEQ ID NO: 215066

SEQ ID NO: 218299 - RNA, 64 nt, Human; identical to SEQ ID NO: 215067

SEQ ID NO: 218300 - RNA, 64 nt, Human; identical to SEQ ID NO: 215989

SEQ ID NO: 218301 - RNA, 64 nt, Human; identical to SEQ ID NO: 215386

SEQ ID NO: 218302 - RNA, 64 nt, Human; identical to SEQ ID NO: 216064

SEQ ID NO: 218303 - RNA, 64 nt, Human; identical to SEQ ID NO: 215071

SEQ ID NO: 218304 - RNA, 64 nt, Human; identical to SEQ ID NO: 215072

SEQ ID NO: 218305 - RNA, 64 nt, Human; identical to SEQ ID NO: 215073

SEQ ID NO: 218306 - RNA, 64 nt, Human; identical to SEQ ID NO: 215074

SEQ ID NO: 218307 - RNA, 64 nt, Human; identical to SEQ ID NO: 215075

SEQ ID NO: 218308 - RNA, 64 nt, Human; identical to SEQ ID NO: 215076

SEQ ID NO: 218309 - RNA, 64 nt, Human; identical to SEQ ID NO: 215077

SEQ ID NO: 218310 - RNA, 64 nt, Human; identical to SEQ ID NO: 215078

SEQ ID NO: 218311 - RNA, 62 nt, Human; identical to SEQ ID NO: 215079

SEQ ID NO: 218312 - RNA, 64 nt, Human; identical to SEQ ID NO: 215080

SEQ ID NO: 218313 - RNA, 64 nt, Human; identical to SEQ ID NO: 215081

SEQ ID NO: 218314 - RNA, 64 nt, Human; identical to SEQ ID NO: 215082

SEQ ID NO: 218315 - RNA, 64 nt, Human; identical to SEQ ID NO: 215083

SEQ ID NO: 218316 - RNA, 64 nt, Human; identical to SEQ ID NO: 215084

SEQ ID NO: 218317 - RNA, 64 nt, Human; identical to SEQ ID NO: 215085

SEQ ID NO: 218318 - RNA, 64 nt, Human; identical to SEQ ID NO: 215086

SEQ ID NO: 218319 - RNA, 64 nt, Human; identical to SEQ ID NO: 216065

SEQ ID NO: 218320 - RNA, 64 nt, Human; identical to SEQ ID NO: 215387

SEQ ID NO: 218321 - RNA, 51 nt, Human; identical to SEQ ID NO: 216083

SEQ ID NO: 218322 - RNA, 64 nt, Human; identical to SEQ ID NO: 215090

SEQ ID NO: 218323 - RNA, 63 nt, Human; identical to SEQ ID NO: 215091

SEQ ID NO: 218324 - RNA, 64 nt, Human; identical to SEQ ID NO: 215092

SEQ ID NO: 218325 - RNA, 64 nt, Human; identical to SEQ ID NO: 215093

SEQ ID NO: 218326 - RNA, 64 nt, Human; identical to SEQ ID NO: 215094

SEQ ID NO: 218327 - RNA, 64 nt, Human; identical to SEQ ID NO: 215095

SEQ ID NO: 218328 - RNA, 64 nt, Human; identical to SEQ ID NO: 215096

SEQ ID NO: 218329 - RNA, 64 nt, Human; identical to SEQ ID NO: 215097

SEQ ID NO: 218330 - RNA, 64 nt, Human; identical to SEQ ID NO: 215098

SEQ ID NO: 218331 - RNA, 64 nt, Human; identical to SEQ ID NO: 215099

SEQ ID NO: 218332 - RNA, 64 nt, Human; identical to SEQ ID NO: 215100

SEQ ID NO: 218333 - RNA, 64 nt, Human; identical to SEQ ID NO: 215101

SEQ ID NO: 218334 - RNA, 64 nt, Human; identical to SEQ ID NO: 215102

SEQ ID NO: 218335 - RNA, 64 nt, Human; identical to SEQ ID NO: 215103

SEQ ID NO: 218336 - RNA, 64 nt, Human; identical to SEQ ID NO: 215104

SEQ ID NO: 218337 - RNA, 64 nt, Human; identical to SEQ ID NO: 215105

SEQ ID NO: 218338 - RNA, 64 nt, Human; identical to SEQ ID NO: 215367

SEQ ID NO: 218339 - RNA, 64 nt, Human; identical to SEQ ID NO: 215404

SEQ ID NO: 218340 - RNA, 64 nt, Human; identical to SEQ ID NO: 216139

SEQ ID NO: 218341 - RNA, 64 nt, Human; identical to SEQ ID NO: 215109

SEQ ID NO: 218342 - RNA, 64 nt, Human; identical to SEQ ID NO: 215110

SEQ ID NO: 218343 - RNA, 64 nt, Human; identical to SEQ ID NO: 215111

SEQ ID NO: 218344 - RNA, 64 nt, Human; identical to SEQ ID NO: 215112

SEQ ID NO: 218345 - RNA, 64 nt, Human; identical to SEQ ID NO: 215113

SEQ ID NO: 218346 - RNA, 50 nt, Human; identical to SEQ ID NO: 215114

SEQ ID NO: 218347 - RNA, 64 nt, Human; identical to SEQ ID NO: 215115

SEQ ID NO: 218348 - RNA, 64 nt, Human; identical to SEQ ID NO: 215116

SEQ ID NO: 218349 - RNA, 64 nt, Human; identical to SEQ ID NO: 215117

SEQ ID NO: 218350 - RNA, 64 nt, Human; identical to SEQ ID NO: 215118

SEQ ID NO: 218351 - RNA, 64 nt, Human; identical to SEQ ID NO: 215119

SEQ ID NO: 218352 - RNA, 64 nt, Human; identical to SEQ ID NO: 215120

SEQ ID NO: 218353 - RNA, 64 nt, Human; identical to SEQ ID NO: 215121

SEQ ID NO: 218354 - RNA, 64 nt, Human; identical to SEQ ID NO: 215122

SEQ ID NO: 218355 - RNA, 64 nt, Human; identical to SEQ ID NO: 215123

SEQ ID NO: 218356 - RNA, 64 nt, Human; identical to SEQ ID NO: 215124

SEQ ID NO: 218357 - RNA, 64 nt, Human; identical to SEQ ID NO: 215670

SEQ ID NO: 218358 - RNA, 64 nt, Human; identical to SEQ ID NO: 215500

SEQ ID NO: 218359 - RNA, 57 nt, Human; identical to SEQ ID NO: 215501

SEQ ID NO: 218360 - RNA, 64 nt, Human; identical to SEQ ID NO: 215128

SEQ ID NO: 218361 - RNA, 64 nt, Human; identical to SEQ ID NO: 215129

SEQ ID NO: 218362 - RNA, 64 nt, Human; identical to SEQ ID NO: 215130

SEQ ID NO: 218363 - RNA, 64 nt, Human; identical to SEQ ID NO: 215131

SEQ ID NO: 218364 - RNA, 64 nt, Human; identical to SEQ ID NO: 215132

SEQ ID NO: 218365 - RNA, 64 nt, Human; identical to SEQ ID NO: 215133

SEQ ID NO: 218366 - RNA, 64 nt, Human; identical to SEQ ID NO: 215134

SEQ ID NO: 218367 - RNA, 64 nt, Human; identical to SEQ ID NO: 215135

SEQ ID NO: 218368 - RNA, 64 nt, Human; identical to SEQ ID NO: 215136

SEQ ID NO: 218369 - RNA, 64 nt, Human; identical to SEQ ID NO: 215137

SEQ ID NO: 218370 - RNA, 64 nt, Human; identical to SEQ ID NO: 215138

SEQ ID NO: 218371 - RNA, 64 nt, Human; identical to SEQ ID NO: 215139

SEQ ID NO: 218372 - RNA, 64 nt, Human; identical to SEQ ID NO: 215140

SEQ ID NO: 218373 - RNA, 64 nt, Human; identical to SEQ ID NO: 215141

SEQ ID NO: 218374 - RNA, 64 nt, Human; identical to SEQ ID NO: 215142

SEQ ID NO: 218375 - RNA, 64 nt, Human; identical to SEQ ID NO: 215143

SEQ ID NO: 218376 - RNA, 50 nt, Human; identical to SEQ ID NO: 216084

SEQ ID NO: 218377 - RNA, 64 nt, Human; identical to SEQ ID NO: 216160

SEQ ID NO: 218378 - RNA, 64 nt, Human; identical to SEQ ID NO: 215405

SEQ ID NO: 218379 - RNA, 64 nt, Human; identical to SEQ ID NO: 215147

SEQ ID NO: 218380 - RNA, 64 nt, Human; identical to SEQ ID NO: 215148

SEQ ID NO: 218381 - RNA, 64 nt, Human; identical to SEQ ID NO: 215149

SEQ ID NO: 218382 - RNA, 64 nt, Human; identical to SEQ ID NO: 215150

SEQ ID NO: 218383 - RNA, 64 nt, Human; identical to SEQ ID NO: 215151

SEQ ID NO: 218384 - RNA, 64 nt, Human; identical to SEQ ID NO: 215152

SEQ ID NO: 218385 - RNA, 64 nt, Human; identical to SEQ ID NO: 215153

SEQ ID NO: 218386 - RNA, 64 nt, Human; identical to SEQ ID NO: 215154

SEQ ID NO: 218387 - RNA, 64 nt, Human; identical to SEQ ID NO: 215155

SEQ ID NO: 218388 - RNA, 64 nt, Human; identical to SEQ ID NO: 215156

SEQ ID NO: 218389 - RNA, 64 nt, Human; identical to SEQ ID NO: 215157

SEQ ID NO: 218390 - RNA, 64 nt, Human; identical to SEQ ID NO: 215158

SEQ ID NO: 218391 - RNA, 64 nt, Human; identical to SEQ ID NO: 215159

SEQ ID NO: 218392 - RNA, 64 nt, Human; identical to SEQ ID NO: 215160

SEQ ID NO: 218393 - RNA, 64 nt, Human; identical to SEQ ID NO: 215161

SEQ ID NO: 218394 - RNA, 64 nt, Human; identical to SEQ ID NO: 215162

SEQ ID NO: 218395 - RNA, 56 nt, Human; identical to SEQ ID NO: 216179

SEQ ID NO: 218396 - RNA, 64 nt, Human; identical to SEQ ID NO: 216235

SEQ ID NO: 218397 - RNA, 64 nt, Human; identical to SEQ ID NO: 215406

SEQ ID NO: 218398 - RNA, 64 nt, Human; identical to SEQ ID NO: 215166

SEQ ID NO: 218399 - RNA, 64 nt, Human; identical to SEQ ID NO: 215167

SEQ ID NO: 218400 - RNA, 64 nt, Human; identical to SEQ ID NO: 215168

SEQ ID NO: 218401 - RNA, 64 nt, Human; identical to SEQ ID NO: 215169

SEQ ID NO: 218402 - RNA, 64 nt, Human; identical to SEQ ID NO: 215170

SEQ ID NO: 218403 - RNA, 64 nt, Human; identical to SEQ ID NO: 215171

SEQ ID NO: 218404 - RNA, 64 nt, Human; identical to SEQ ID NO: 215172

SEQ ID NO: 218405 - RNA, 64 nt, Human; identical to SEQ ID NO: 215173

SEQ ID NO: 218406 - RNA, 64 nt, Human; identical to SEQ ID NO: 215174

SEQ ID NO: 218407 - RNA, 53 nt, Human; identical to SEQ ID NO: 215175

SEQ ID NO: 218408 - RNA, 64 nt, Human; identical to SEQ ID NO: 215176

SEQ ID NO: 218409 - RNA, 64 nt, Human; identical to SEQ ID NO: 215177

SEQ ID NO: 218410 - RNA, 64 nt, Human; identical to SEQ ID NO: 215178

SEQ ID NO: 218411 - RNA, 64 nt, Human; identical to SEQ ID NO: 215179

SEQ ID NO: 218412 - RNA, 64 nt, Human; identical to SEQ ID NO: 215180

SEQ ID NO: 218413 - RNA, 64 nt, Human; identical to SEQ ID NO: 215181

SEQ ID NO: 218414 - RNA, 64 nt, Human; identical to SEQ ID NO: 215366

SEQ ID NO: 218415 - RNA, 64 nt, Human; identical to SEQ ID NO: 216236

SEQ ID NO: 218416 - RNA, 53 nt, Human; identical to SEQ ID NO: 215423

SEQ ID NO: 218417 - RNA, 64 nt, Human; identical to SEQ ID NO: 215185

SEQ ID NO: 218418 - RNA, 64 nt, Human; identical to SEQ ID NO: 215186

SEQ ID NO: 218419 - RNA, 64 nt, Human; identical to SEQ ID NO: 215187

SEQ ID NO: 218420 - RNA, 64 nt, Human; identical to SEQ ID NO: 215188

SEQ ID NO: 218421 - RNA, 64 nt, Human; identical to SEQ ID NO: 215189

SEQ ID NO: 218422 - RNA, 64 nt, Human; identical to SEQ ID NO: 215190

SEQ ID NO: 218423 - RNA, 64 nt, Human; identical to SEQ ID NO: 215191

SEQ ID NO: 218424 - RNA, 64 nt, Human; identical to SEQ ID NO: 215192

SEQ ID NO: 218425 - RNA, 64 nt, Human; identical to SEQ ID NO: 215193

SEQ ID NO: 218426 - RNA, 64 nt, Human; identical to SEQ ID NO: 215194

SEQ ID NO: 218427 - RNA, 64 nt, Human; identical to SEQ ID NO: 215195

SEQ ID NO: 218428 - RNA, 64 nt, Human; identical to SEQ ID NO: 215196

SEQ ID NO: 218429 - RNA, 64 nt, Human; identical to SEQ ID NO: 215197

SEQ ID NO: 218430 - RNA, 64 nt, Human; identical to SEQ ID NO: 215198

SEQ ID NO: 218431 - RNA, 64 nt, Human; identical to SEQ ID NO: 215199

SEQ ID NO: 218432 - RNA, 64 nt, Human; identical to SEQ ID NO: 215200

SEQ ID NO: 218433 - RNA, 64 nt, Human
ccccagucccaggguggaucuguccugcucuguucccuggcauguuggucauagucugcacuuu

SEQ ID NO: 218434 - RNA, 64 nt, Human
uguauacccaguuagaacguguaggguucugggucccuggcaagucuaggugggcgggugacag

SEQ ID NO: 218435 - RNA, 64 nt, Human
gagcccccguccugcccucuggggcuccacaggccccuggcaaggccgauggcucaggaugaug

SEQ ID NO: 218436 - RNA, 64 nt, Human; identical to SEQ ID NO: 215204

SEQ ID NO: 218437 - RNA, 64 nt, Human; identical to SEQ ID NO: 215205

SEQ ID NO: 218438 - RNA, 64 nt, Human; identical to SEQ ID NO: 215206

SEQ ID NO: 218439 - RNA, 64 nt, Human; identical to SEQ ID NO: 215207

SEQ ID NO: 218440 - RNA, 64 nt, Human; identical to SEQ ID NO: 215208

SEQ ID NO: 218441 - RNA, 64 nt, Human; identical to SEQ ID NO: 215209

SEQ ID NO: 218442 - RNA, 64 nt, Human; identical to SEQ ID NO: 215210

SEQ ID NO: 218443 - RNA, 64 nt, Human; identical to SEQ ID NO: 215211

SEQ ID NO: 218444 - RNA, 64 nt, Human; identical to SEQ ID NO: 215212

SEQ ID NO: 218445 - RNA, 64 nt, Human; identical to SEQ ID NO: 215213

SEQ ID NO: 218446 - RNA, 64 nt, Human; identical to SEQ ID NO: 215214

SEQ ID NO: 218447 - RNA, 56 nt, Human; identical to SEQ ID NO: 215215

SEQ ID NO: 218448 - RNA, 64 nt, Human; identical to SEQ ID NO: 215216

SEQ ID NO: 218449 - RNA, 64 nt, Human; identical to SEQ ID NO: 215217

SEQ ID NO: 218450 - RNA, 64 nt, Human; identical to SEQ ID NO: 215218

SEQ ID NO: 218451 - RNA, 64 nt, Human; identical to SEQ ID NO: 215219

SEQ ID NO: 218452 - RNA, 64 nt, Human; identical to SEQ ID NO: 216140

SEQ ID NO: 218453 - RNA, 64 nt, Human; identical to SEQ ID NO: 216388

SEQ ID NO: 218454 - RNA, 64 nt, Human; identical to SEQ ID NO: 215892

SEQ ID NO: 218455 - RNA, 64 nt, Human; identical to SEQ ID NO: 215223

SEQ ID NO: 218456 - RNA, 64 nt, Human; identical to SEQ ID NO: 215224

SEQ ID NO: 218457 - RNA, 64 nt, Human; identical to SEQ ID NO: 215225

SEQ ID NO: 218458 - RNA, 64 nt, Human; identical to SEQ ID NO: 215226

SEQ ID NO: 218459 - RNA, 64 nt, Human; identical to SEQ ID NO: 215227

SEQ ID NO: 218460 - RNA, 64 nt, Human; identical to SEQ ID NO: 215228

SEQ ID NO: 218461 - RNA, 64 nt, Human; identical to SEQ ID NO: 215229

SEQ ID NO: 218462 - RNA, 64 nt, Human; identical to SEQ ID NO: 215230

SEQ ID NO: 218463 - RNA, 64 nt, Human; identical to SEQ ID NO: 215231

SEQ ID NO: 218464 - RNA, 64 nt, Human; identical to SEQ ID NO: 215232

SEQ ID NO: 218465 - RNA, 64 nt, Human; identical to SEQ ID NO: 215233

SEQ ID NO: 218466 - RNA, 64 nt, Human; identical to SEQ ID NO: 215234

SEQ ID NO: 218467 - RNA, 64 nt, Human; identical to SEQ ID NO: 215235

SEQ ID NO: 218468 - RNA, 64 nt, Human; identical to SEQ ID NO: 215236

SEQ ID NO: 218469 - RNA, 62 nt, Human; identical to SEQ ID NO: 215237

SEQ ID NO: 218470 - RNA, 64 nt, Human; identical to SEQ ID NO: 215238

SEQ ID NO: 218471 - RNA, 64 nt, Human; identical to SEQ ID NO: 215424

SEQ ID NO: 218472 - RNA, 64 nt, Human; identical to SEQ ID NO: 216648

SEQ ID NO: 218473 - RNA, 64 nt, Human; identical to SEQ ID NO: 215873

SEQ ID NO: 218474 - RNA, 64 nt, Human; identical to SEQ ID NO: 215242

SEQ ID NO: 218475 - RNA, 64 nt, Human; identical to SEQ ID NO: 215243

SEQ ID NO: 218476 - RNA, 64 nt, Human; identical to SEQ ID NO: 215244

SEQ ID NO: 218477 - RNA, 64 nt, Human; identical to SEQ ID NO: 215245

SEQ ID NO: 218478 - RNA, 64 nt, Human; identical to SEQ ID NO: 215246

SEQ ID NO: 218479 - RNA, 64 nt, Human; identical to SEQ ID NO: 215247

SEQ ID NO: 218480 - RNA, 64 nt, Human; identical to SEQ ID NO: 215248

SEQ ID NO: 218481 - RNA, 64 nt, Human; identical to SEQ ID NO: 215249

SEQ ID NO: 218482 - RNA, 64 nt, Human; identical to SEQ ID NO: 215250

SEQ ID NO: 218483 - RNA, 64 nt, Human; identical to SEQ ID NO: 215251

SEQ ID NO: 218484 - RNA, 64 nt, Human; identical to SEQ ID NO: 215252

SEQ ID NO: 218485 - RNA, 64 nt, Human; identical to SEQ ID NO: 215253

SEQ ID NO: 218486 - RNA, 64 nt, Human; identical to SEQ ID NO: 215254

SEQ ID NO: 218487 - RNA, 64 nt, Human; identical to SEQ ID NO: 215255

SEQ ID NO: 218488 - RNA, 64 nt, Human; identical to SEQ ID NO: 215256

SEQ ID NO: 218489 - RNA, 64 nt, Human; identical to SEQ ID NO: 215257

SEQ ID NO: 218490 - RNA, 64 nt, Human; identical to SEQ ID NO: 216234

SEQ ID NO: 218491 - RNA, 64 nt, Human; identical to SEQ ID NO: 215722

SEQ ID NO: 218492 - RNA, 64 nt, Human; identical to SEQ ID NO: 215723

SEQ ID NO: 218493 - RNA, 64 nt, Human; identical to SEQ ID NO: 215261

SEQ ID NO: 218494 - RNA, 64 nt, Human; identical to SEQ ID NO: 215262

SEQ ID NO: 218495 - RNA, 64 nt, Human; identical to SEQ ID NO: 215263

SEQ ID NO: 218496 - RNA, 64 nt, Human; identical to SEQ ID NO: 215264

SEQ ID NO: 218497 - RNA, 64 nt, Human; identical to SEQ ID NO: 215265

SEQ ID NO: 218498 - RNA, 64 nt, Human; identical to SEQ ID NO: 215266

SEQ ID NO: 218499 - RNA, 64 nt, Human; identical to SEQ ID NO: 215267

SEQ ID NO: 218500 - RNA, 64 nt, Human; identical to SEQ ID NO: 215268

SEQ ID NO: 218501 - RNA, 64 nt, Human; identical to SEQ ID NO: 215269

SEQ ID NO: 218502 - RNA, 54 nt, Human; identical to SEQ ID NO: 215270

SEQ ID NO: 218503 - RNA, 64 nt, Human; identical to SEQ ID NO: 215271

SEQ ID NO: 218504 - RNA, 64 nt, Human; identical to SEQ ID NO: 215272

SEQ ID NO: 218505 - RNA, 64 nt, Human; identical to SEQ ID NO: 215264

SEQ ID NO: 218506 - RNA, 64 nt, Human; identical to SEQ ID NO: 215274

SEQ ID NO: 218507 - RNA, 64 nt, Human; identical to SEQ ID NO: 215275

SEQ ID NO: 218508 - RNA, 64 nt, Human; identical to SEQ ID NO: 215276

SEQ ID NO: 218509 - RNA, 64 nt, Human; identical to SEQ ID NO: 216254

SEQ ID NO: 218510 - RNA, 64 nt, Human; identical to SEQ ID NO: 216255

SEQ ID NO: 218511 - RNA, 64 nt, Human; identical to SEQ ID NO: 216401

SEQ ID NO: 218512 - RNA, 64 nt, Human; identical to SEQ ID NO: 215280

SEQ ID NO: 218513 - RNA, 64 nt, Human; identical to SEQ ID NO: 215281

SEQ ID NO: 218514 - RNA, 64 nt, Human; identical to SEQ ID NO: 215282

SEQ ID NO: 218515 - RNA, 64 nt, Human; identical to SEQ ID NO: 215283

SEQ ID NO: 218516 - RNA, 64 nt, Human; identical to SEQ ID NO: 215284

SEQ ID NO: 218517 - RNA, 64 nt, Human; identical to SEQ ID NO: 215285

SEQ ID NO: 218518 - RNA, 64 nt, Human; identical to SEQ ID NO: 215286

SEQ ID NO: 218519 - RNA, 64 nt, Human; identical to SEQ ID NO: 215287

SEQ ID NO: 218520 - RNA, 64 nt, Human; identical to SEQ ID NO: 215288

SEQ ID NO: 218521 - RNA, 64 nt, Human; identical to SEQ ID NO: 215289

SEQ ID NO: 218522 - RNA, 64 nt, Human; identical to SEQ ID NO: 215290

SEQ ID NO: 218523 - RNA, 64 nt, Human; identical to SEQ ID NO: 215291

SEQ ID NO: 218524 - RNA, 64 nt, Human; identical to SEQ ID NO: 215292

SEQ ID NO: 218525 - RNA, 64 nt, Human; identical to SEQ ID NO: 215293

SEQ ID NO: 218526 - RNA, 64 nt, Human; identical to SEQ ID NO: 215294

SEQ ID NO: 218527 - RNA, 64 nt, Human; identical to SEQ ID NO: 215295

SEQ ID NO: 218528 - RNA, 64 nt, Human; identical to SEQ ID NO: 216273

SEQ ID NO: 218529 - RNA, 64 nt, Human; identical to SEQ ID NO: 216274

SEQ ID NO: 218530 - RNA, 64 nt, Human; identical to SEQ ID NO: 216291

SEQ ID NO: 218531 - RNA, 64 nt, Human; identical to SEQ ID NO: 215299

SEQ ID NO: 218532 - RNA, 64 nt, Human; identical to SEQ ID NO: 215300

SEQ ID NO: 218533 - RNA, 64 nt, Human; identical to SEQ ID NO: 215301

SEQ ID NO: 218534 - RNA, 64 nt, Human; identical to SEQ ID NO: 215302

SEQ ID NO: 218535 - RNA, 64 nt, Human; identical to SEQ ID NO: 215303

SEQ ID NO: 218536 - RNA, 56 nt, Human; identical to SEQ ID NO: 215304

SEQ ID NO: 218537 - RNA, 64 nt, Human; identical to SEQ ID NO: 215305

SEQ ID NO: 218538 - RNA, 59 nt, Human; identical to SEQ ID NO: 215306

SEQ ID NO: 218539 - RNA, 64 nt, Human; identical to SEQ ID NO: 215307

SEQ ID NO: 218540 - RNA, 64 nt, Human; identical to SEQ ID NO: 215308

SEQ ID NO: 218541 - RNA, 64 nt, Human; identical to SEQ ID NO: 215309

SEQ ID NO: 218542 - RNA, 64 nt, Human; identical to SEQ ID NO: 215310

SEQ ID NO: 218543 - RNA, 64 nt, Human; identical to SEQ ID NO: 215311

SEQ ID NO: 218544 - RNA, 64 nt, Human; identical to SEQ ID NO: 215312

SEQ ID NO: 218545 - RNA, 64 nt, Human; identical to SEQ ID NO: 215315

SEQ ID NO: 218546 - RNA, 64 nt, Human; identical to SEQ ID NO: 216293

SEQ ID NO: 218547 - RNA, 64 nt, Human; identical to SEQ ID NO: 216419

SEQ ID NO: 218548 - RNA, 64 nt, Human; identical to SEQ ID NO: 215316

SEQ ID NO: 218549 - RNA, 64 nt, Human; identical to SEQ ID NO: 215317

SEQ ID NO: 218550 - RNA, 64 nt, Human; identical to SEQ ID NO: 215318

SEQ ID NO: 218551 - RNA, 64 nt, Human; identical to SEQ ID NO: 215319

SEQ ID NO: 218552 - RNA, 64 nt, Human; identical to SEQ ID NO: 215320

SEQ ID NO: 218553 - RNA, 64 nt, Human; identical to SEQ ID NO: 215321

SEQ ID NO: 218554 - RNA, 51 nt, Human; identical to SEQ ID NO: 215322

SEQ ID NO: 218555 - RNA, 64 nt, Human; identical to SEQ ID NO: 215323

SEQ ID NO: 218556 - RNA, 64 nt, Human; identical to SEQ ID NO: 215324

SEQ ID NO: 218557 - RNA, 64 nt, Human; identical to SEQ ID NO: 215325

SEQ ID NO: 218558 - RNA, 64 nt, Human; identical to SEQ ID NO: 215326

SEQ ID NO: 218559 - RNA, 64 nt, Human; identical to SEQ ID NO: 215327

SEQ ID NO: 218560 - RNA, 64 nt, Human; identical to SEQ ID NO: 216063

SEQ ID NO: 218561 - RNA, 64 nt, Human; identical to SEQ ID NO: 215740

SEQ ID NO: 218562 - RNA, 64 nt, Human; identical to SEQ ID NO: 215741

SEQ ID NO: 218563 - RNA, 64 nt, Human; identical to SEQ ID NO: 215331

SEQ ID NO: 218564 - RNA, 64 nt, Human; identical to SEQ ID NO: 215332

SEQ ID NO: 218565 - RNA, 64 nt, Human; identical to SEQ ID NO: 215333

SEQ ID NO: 218566 - RNA, 64 nt, Human; identical to SEQ ID NO: 215334

SEQ ID NO: 218567 - RNA, 64 nt, Human; identical to SEQ ID NO: 215335

SEQ ID NO: 218568 - RNA, 64 nt, Human; identical to SEQ ID NO: 215336

SEQ ID NO: 218569 - RNA, 64 nt, Human; identical to SEQ ID NO: 215337

SEQ ID NO: 218570 - RNA, 64 nt, Human; identical to SEQ ID NO: 215338

SEQ ID NO: 218571 - RNA, 64 nt, Human; identical to SEQ ID NO: 215339

SEQ ID NO: 218572 - RNA, 64 nt, Human; identical to SEQ ID NO: 215340

SEQ ID NO: 218573 - RNA, 64 nt, Human; identical to SEQ ID NO: 215341

SEQ ID NO: 218574 - RNA, 64 nt, Human; identical to SEQ ID NO: 215342

SEQ ID NO: 218575 - RNA, 64 nt, Human; identical to SEQ ID NO: 215343

SEQ ID NO: 218576 - RNA, 64 nt, Human; identical to SEQ ID NO: 215344

SEQ ID NO: 218577 - RNA, 64 nt, Human; identical to SEQ ID NO: 215345

SEQ ID NO: 218578 - RNA, 64 nt, Human; identical to SEQ ID NO: 215346

SEQ ID NO: 218579 - RNA, 64 nt, Human; identical to SEQ ID NO: 216158

SEQ ID NO: 218580 - RNA, 64 nt, Human; identical to SEQ ID NO: 215329

SEQ ID NO: 218581 - RNA, 64 nt, Human; identical to SEQ ID NO: 216350

SEQ ID NO: 218582 - RNA, 64 nt, Human; identical to SEQ ID NO: 215350

SEQ ID NO: 218583 - RNA, 64 nt, Human; identical to SEQ ID NO: 215351

SEQ ID NO: 218584 - RNA, 64 nt, Human; identical to SEQ ID NO: 215352

SEQ ID NO: 218585 - RNA, 64 nt, Human; identical to SEQ ID NO: 215353

SEQ ID NO: 218586 - RNA, 64 nt, Human; identical to SEQ ID NO: 215354

SEQ ID NO: 218587 - RNA, 64 nt, Human; identical to SEQ ID NO: 215355

SEQ ID NO: 218588 - RNA, 64 nt, Human; identical to SEQ ID NO: 215356

SEQ ID NO: 218589 - RNA, 64 nt, Human; identical to SEQ ID NO: 215357

SEQ ID NO: 218590 - RNA, 64 nt, Human; identical to SEQ ID NO: 215358

SEQ ID NO: 218591 - RNA, 64 nt, Human; identical to SEQ ID NO: 215359

SEQ ID NO: 218592 - RNA, 64 nt, Human; identical to SEQ ID NO: 215360

SEQ ID NO: 218593 - RNA, 64 nt, Human; identical to SEQ ID NO: 215361

SEQ ID NO: 218594 - RNA, 64 nt, Human; identical to SEQ ID NO: 215362

SEQ ID NO: 218595 - RNA, 64 nt, Human; identical to SEQ ID NO: 215363

SEQ ID NO: 218596 - RNA, 64 nt, Human; identical to SEQ ID NO: 215364

SEQ ID NO: 218597 - RNA, 64 nt, Human; identical to SEQ ID NO: 215365

SEQ ID NO: 218598 - RNA, 64 nt, Human; identical to SEQ ID NO: 216367

SEQ ID NO: 218599 - RNA, 64 nt, Human; identical to SEQ ID NO: 216368

SEQ ID NO: 218600 - RNA, 64 nt, Human; identical to SEQ ID NO: 216369

SEQ ID NO: 218601 - RNA, 64 nt, Human; identical to SEQ ID NO: 215369

SEQ ID NO: 218602 - RNA, 64 nt, Human; identical to SEQ ID NO: 215370

SEQ ID NO: 218603 - RNA, 64 nt, Human; identical to SEQ ID NO: 215371

SEQ ID NO: 218604 - RNA, 64 nt, Human; identical to SEQ ID NO: 215372

SEQ ID NO: 218605 - RNA, 64 nt, Human; identical to SEQ ID NO: 215373

SEQ ID NO: 218606 - RNA, 64 nt, Human; identical to SEQ ID NO: 215374

SEQ ID NO: 218607 - RNA, 61 nt, Human; identical to SEQ ID NO: 215375

SEQ ID NO: 218608 - RNA, 64 nt, Human; identical to SEQ ID NO: 215376

SEQ ID NO: 218609 - RNA, 64 nt, Human; identical to SEQ ID NO: 215377

SEQ ID NO: 218610 - RNA, 64 nt, Human; identical to SEQ ID NO: 215378

SEQ ID NO: 218611 - RNA, 64 nt, Human; identical to SEQ ID NO: 215379

SEQ ID NO: 218612 - RNA, 64 nt, Human; identical to SEQ ID NO: 215380

SEQ ID NO: 218613 - RNA, 54 nt, Human; identical to SEQ ID NO: 215381

SEQ ID NO: 218614 - RNA, 64 nt, Human; identical to SEQ ID NO: 215382

SEQ ID NO: 218615 - RNA, 64 nt, Human; identical to SEQ ID NO: 215383

SEQ ID NO: 218616 - RNA, 64 nt, Human; identical to SEQ ID NO: 215384

SEQ ID NO: 218617 - RNA, 64 nt, Human; identical to SEQ ID NO: 215313

SEQ ID NO: 218618 - RNA, 64 nt, Human; identical to SEQ ID NO: 215328

SEQ ID NO: 218619 - RNA, 64 nt, Human; identical to SEQ ID NO: 216420

SEQ ID NO: 218620 - RNA, 64 nt, Human; identical to SEQ ID NO: 215388

SEQ ID NO: 218621 - RNA, 64 nt, Human; identical to SEQ ID NO: 215389

SEQ ID NO: 218622 - RNA, 64 nt, Human; identical to SEQ ID NO: 215390

SEQ ID NO: 218623 - RNA, 64 nt, Human; identical to SEQ ID NO: 215391

SEQ ID NO: 218624 - RNA, 64 nt, Human; identical to SEQ ID NO: 215392

SEQ ID NO: 218625 - RNA, 64 nt, Human; identical to SEQ ID NO: 215393

SEQ ID NO: 218626 - RNA, 64 nt, Human; identical to SEQ ID NO: 215394

SEQ ID NO: 218627 - RNA, 64 nt, Human; identical to SEQ ID NO: 215395

SEQ ID NO: 218628 - RNA, 64 nt, Human; identical to SEQ ID NO: 215396

SEQ ID NO: 218629 - RNA, 64 nt, Human; identical to SEQ ID NO: 215397

SEQ ID NO: 218630 - RNA, 64 nt, Human; identical to SEQ ID NO: 215398

SEQ ID NO: 218631 - RNA, 64 nt, Human; identical to SEQ ID NO: 215399

SEQ ID NO: 218632 - RNA, 64 nt, Human; identical to SEQ ID NO: 215400

SEQ ID NO: 218633 - RNA, 64 nt, Human; identical to SEQ ID NO: 215401

SEQ ID NO: 218634 - RNA, 64 nt, Human; identical to SEQ ID NO: 215402

SEQ ID NO: 218635 - RNA, 64 nt, Human; identical to SEQ ID NO: 215403

SEQ ID NO: 218636 - RNA, 64 nt, Human; identical to SEQ ID NO: 216400

SEQ ID NO: 218637 - RNA, 64 nt, Human; identical to SEQ ID NO: 216215

SEQ ID NO: 218638 - RNA, 64 nt, Human; identical to SEQ ID NO: 215314

SEQ ID NO: 218639 - RNA, 64 nt, Human; identical to SEQ ID NO: 215407

SEQ ID NO: 218640 - RNA, 64 nt, Human; identical to SEQ ID NO: 215408

SEQ ID NO: 218641 - RNA, 64 nt, Human; identical to SEQ ID NO: 215409

SEQ ID NO: 218642 - RNA, 64 nt, Human; identical to SEQ ID NO: 215410

SEQ ID NO: 218643 - RNA, 64 nt, Human; identical to SEQ ID NO: 215411

SEQ ID NO: 218644 - RNA, 64 nt, Human; identical to SEQ ID NO: 215412

SEQ ID NO: 218645 - RNA, 64 nt, Human; identical to SEQ ID NO: 215413

SEQ ID NO: 218646 - RNA, 64 nt, Human; identical to SEQ ID NO: 215414

SEQ ID NO: 218647 - RNA, 64 nt, Human; identical to SEQ ID NO: 215415

SEQ ID NO: 218648 - RNA, 64 nt, Human; identical to SEQ ID NO: 215416

SEQ ID NO: 218649 - RNA, 59 nt, Human; identical to SEQ ID NO: 215417

SEQ ID NO: 218650 - RNA, 64 nt, Human; identical to SEQ ID NO: 215418

SEQ ID NO: 218651 - RNA, 64 nt, Human; identical to SEQ ID NO: 215419

SEQ ID NO: 218652 - RNA, 64 nt, Human; identical to SEQ ID NO: 215420

SEQ ID NO: 218653 - RNA, 64 nt, Human; identical to SEQ ID NO: 215421

SEQ ID NO: 218654 - RNA, 64 nt, Human; identical to SEQ ID NO: 215422

SEQ ID NO: 218655 - RNA, 64 nt, Human; identical to SEQ ID NO: 215759

SEQ ID NO: 218656 - RNA, 64 nt, Human; identical to SEQ ID NO: 215760

SEQ ID NO: 218657 - RNA, 64 nt, Human; identical to SEQ ID NO: 215761

SEQ ID NO: 218658 - RNA, 64 nt, Human; identical to SEQ ID NO: 215426

SEQ ID NO: 218659 - RNA, 64 nt, Human; identical to SEQ ID NO: 215427

SEQ ID NO: 218660 - RNA, 64 nt, Human; identical to SEQ ID NO: 215428

SEQ ID NO: 218661 - RNA, 64 nt, Human; identical to SEQ ID NO: 215429

SEQ ID NO: 218662 - RNA, 64 nt, Human; identical to SEQ ID NO: 215430

SEQ ID NO: 218663 - RNA, 64 nt, Human; identical to SEQ ID NO: 215431

SEQ ID NO: 218664 - RNA, 64 nt, Human; identical to SEQ ID NO: 215432

SEQ ID NO: 218665 - RNA, 64 nt, Human; identical to SEQ ID NO: 215433

SEQ ID NO: 218666 - RNA, 64 nt, Human; identical to SEQ ID NO: 215434

SEQ ID NO: 218667 - RNA, 64 nt, Human; identical to SEQ ID NO: 215435

SEQ ID NO: 218668 - RNA, 64 nt, Human; identical to SEQ ID NO: 215436

SEQ ID NO: 218669 - RNA, 64 nt, Human; identical to SEQ ID NO: 215437

SEQ ID NO: 218670 - RNA, 64 nt, Human; identical to SEQ ID NO: 215438

SEQ ID NO: 218671 - RNA, 64 nt, Human; identical to SEQ ID NO: 215439

SEQ ID NO: 218672 - RNA, 64 nt, Human; identical to SEQ ID NO: 215440

SEQ ID NO: 218673 - RNA, 64 nt, Human; identical to SEQ ID NO: 215441

SEQ ID NO: 218674 - RNA, 64 nt, Human; identical to SEQ ID NO: 216196

SEQ ID NO: 218675 - RNA, 64 nt, Human; identical to SEQ ID NO: 216495

SEQ ID NO: 218676 - RNA, 64 nt, Human; identical to SEQ ID NO: 216496

SEQ ID NO: 218677 - RNA, 64 nt, Human; identical to SEQ ID NO: 215445

SEQ ID NO: 218678 - RNA, 64 nt, Human; identical to SEQ ID NO: 215446

SEQ ID NO: 218679 - RNA, 64 nt, Human; identical to SEQ ID NO: 215447

SEQ ID NO: 218680 - RNA, 64 nt, Human; identical to SEQ ID NO: 215448

SEQ ID NO: 218681 - RNA, 64 nt, Human; identical to SEQ ID NO: 215449

SEQ ID NO: 218682 - RNA, 64 nt, Human; identical to SEQ ID NO: 215450

SEQ ID NO: 218683 - RNA, 64 nt, Human; identical to SEQ ID NO: 215451

SEQ ID NO: 218684 - RNA, 64 nt, Human; identical to SEQ ID NO: 215452

SEQ ID NO: 218685 - RNA, 64 nt, Human; identical to SEQ ID NO: 215453

SEQ ID NO: 218686 - RNA, 64 nt, Human; identical to SEQ ID NO: 215454

SEQ ID NO: 218687 - RNA, 64 nt, Human; identical to SEQ ID NO: 215455

SEQ ID NO: 218688 - RNA, 64 nt, Human; identical to SEQ ID NO: 215456

SEQ ID NO: 218689 - RNA, 64 nt, Human; identical to SEQ ID NO: 215457

SEQ ID NO: 218690 - RNA, 64 nt, Human; identical to SEQ ID NO: 215458

SEQ ID NO: 218691 - RNA, 64 nt, Human; identical to SEQ ID NO: 215459

SEQ ID NO: 218692 - RNA, 64 nt, Human; identical to SEQ ID NO: 215460

SEQ ID NO: 218693 - RNA, 64 nt, Human; identical to SEQ ID NO: 216571

SEQ ID NO: 218694 - RNA, 64 nt, Human; identical to SEQ ID NO: 216572

SEQ ID NO: 218695 - RNA, 64 nt, Human; identical to SEQ ID NO: 216025

SEQ ID NO: 218696 - RNA, 64 nt, Human; identical to SEQ ID NO: 215464

SEQ ID NO: 218697 - RNA, 64 nt, Human; identical to SEQ ID NO: 215465

SEQ ID NO: 218698 - RNA, 64 nt, Human; identical to SEQ ID NO: 215466

SEQ ID NO: 218699 - RNA, 64 nt, Human; identical to SEQ ID NO: 215467

SEQ ID NO: 218700 - RNA, 64 nt, Human; identical to SEQ ID NO: 215468

SEQ ID NO: 218701 - RNA, 64 nt, Human; identical to SEQ ID NO: 215469

SEQ ID NO: 218702 - RNA, 64 nt, Human; identical to SEQ ID NO: 215470

SEQ ID NO: 218703 - RNA, 64 nt, Human; identical to SEQ ID NO: 215471

SEQ ID NO: 218704 - RNA, 64 nt, Human; identical to SEQ ID NO: 215472

SEQ ID NO: 218705 - RNA, 64 nt, Human; identical to SEQ ID NO: 215473

SEQ ID NO: 218706 - RNA, 64 nt, Human; identical to SEQ ID NO: 215474

SEQ ID NO: 218707 - RNA, 64 nt, Human; identical to SEQ ID NO: 215475

SEQ ID NO: 218708 - RNA, 64 nt, Human; identical to SEQ ID NO: 215476

SEQ ID NO: 218709 - RNA, 64 nt, Human; identical to SEQ ID NO: 215477

SEQ ID NO: 218710 - RNA, 64 nt, Human; identical to SEQ ID NO: 215478

SEQ ID NO: 218711 - RNA, 64 nt, Human; identical to SEQ ID NO: 215479

SEQ ID NO: 218712 - RNA, 64 nt, Human; identical to SEQ ID NO: 215969

SEQ ID NO: 218713 - RNA, 64 nt, Human; identical to SEQ ID NO: 215970

SEQ ID NO: 218714 - RNA, 64 nt, Human; identical to SEQ ID NO: 216026

SEQ ID NO: 218715 - RNA, 64 nt, Human; identical to SEQ ID NO: 215483

SEQ ID NO: 218716 - RNA, 64 nt, Human; identical to SEQ ID NO: 215484

SEQ ID NO: 218717 - RNA, 64 nt, Human; identical to SEQ ID NO: 215485

SEQ ID NO: 218718 - RNA, 64 nt, Human; identical to SEQ ID NO: 215486

SEQ ID NO: 218719 - RNA, 64 nt, Human; identical to SEQ ID NO: 215487

SEQ ID NO: 218720 - RNA, 64 nt, Human; identical to SEQ ID NO: 215488

SEQ ID NO: 218721 - RNA, 64 nt, Human; identical to SEQ ID NO: 215489

SEQ ID NO: 218722 - RNA, 64 nt, Human; identical to SEQ ID NO: 215490

SEQ ID NO: 218723 - RNA, 64 nt, Human; identical to SEQ ID NO: 215491

SEQ ID NO: 218724 - RNA, 64 nt, Human; identical to SEQ ID NO: 215492

SEQ ID NO: 218725 - RNA, 64 nt, Human; identical to SEQ ID NO: 215493

SEQ ID NO: 218726 - RNA, 64 nt, Human; identical to SEQ ID NO: 215494

SEQ ID NO: 218727 - RNA, 64 nt, Human; identical to SEQ ID NO: 215495

SEQ ID NO: 218728 - RNA, 64 nt, Human; identical to SEQ ID NO: 215496

SEQ ID NO: 218729 - RNA, 64 nt, Human; identical to SEQ ID NO: 215497

SEQ ID NO: 218730 - RNA, 64 nt, Human; identical to SEQ ID NO: 215498

SEQ ID NO: 218731 - RNA, 64 nt, Human; identical to SEQ ID NO: 215240

SEQ ID NO: 218732 - RNA, 64 nt, Human; identical to SEQ ID NO: 216456

SEQ ID NO: 218733 - RNA, 64 nt, Human; identical to SEQ ID NO: 216457

SEQ ID NO: 218734 - RNA, 64 nt, Human; identical to SEQ ID NO: 215502

SEQ ID NO: 218735 - RNA, 64 nt, Human; identical to SEQ ID NO: 215503

SEQ ID NO: 218736 - RNA, 64 nt, Human; identical to SEQ ID NO: 215504

SEQ ID NO: 218737 - RNA, 64 nt, Human; identical to SEQ ID NO: 215505

SEQ ID NO: 218738 - RNA, 64 nt, Human; identical to SEQ ID NO: 215506

SEQ ID NO: 218739 - RNA, 64 nt, Human; identical to SEQ ID NO: 215507

SEQ ID NO: 218740 - RNA, 64 nt, Human; identical to SEQ ID NO: 215508

SEQ ID NO: 218741 - RNA, 64 nt, Human; identical to SEQ ID NO: 215509

SEQ ID NO: 218742 - RNA, 64 nt, Human; identical to SEQ ID NO: 215510

SEQ ID NO: 218743 - RNA, 64 nt, Human; identical to SEQ ID NO: 215511

SEQ ID NO: 218744 - RNA, 64 nt, Human; identical to SEQ ID NO: 215512

SEQ ID NO: 218745 - RNA, 64 nt, Human; identical to SEQ ID NO: 215513

SEQ ID NO: 218746 - RNA, 64 nt, Human; identical to SEQ ID NO: 215514

SEQ ID NO: 218747 - RNA, 64 nt, Human; identical to SEQ ID NO: 215515

SEQ ID NO: 218748 - RNA, 64 nt, Human; identical to SEQ ID NO: 215516

SEQ ID NO: 218749 - RNA, 64 nt, Human; identical to SEQ ID NO: 215517

SEQ ID NO: 218750 - RNA, 64 nt, Human; identical to SEQ ID NO: 216723

SEQ ID NO: 218751 - RNA, 64 nt, Human; identical to SEQ ID NO: 216870

SEQ ID NO: 218752 - RNA, 64 nt, Human; identical to SEQ ID NO: 215778

SEQ ID NO: 218753 - RNA, 64 nt, Human; identical to SEQ ID NO: 215521

SEQ ID NO: 218754 - RNA, 64 nt, Human; identical to SEQ ID NO: 215522

SEQ ID NO: 218755 - RNA, 64 nt, Human; identical to SEQ ID NO: 215523

SEQ ID NO: 218756 - RNA, 64 nt, Human; identical to SEQ ID NO: 215524

SEQ ID NO: 218757 - RNA, 64 nt, Human; identical to SEQ ID NO: 215525

SEQ ID NO: 218758 - RNA, 64 nt, Human; identical to SEQ ID NO: 215526

SEQ ID NO: 218759 - RNA, 64 nt, Human; identical to SEQ ID NO: 215527

SEQ ID NO: 218760 - RNA, 64 nt, Human; identical to SEQ ID NO: 215528

SEQ ID NO: 218761 - RNA, 64 nt, Human; identical to SEQ ID NO: 215529

SEQ ID NO: 218762 - RNA, 64 nt, Human; identical to SEQ ID NO: 215530

SEQ ID NO: 218763 - RNA, 64 nt, Human; identical to SEQ ID NO: 215531

SEQ ID NO: 218764 - RNA, 64 nt, Human; identical to SEQ ID NO: 215532

SEQ ID NO: 218765 - RNA, 64 nt, Human; identical to SEQ ID NO: 215533

SEQ ID NO: 218766 - RNA, 64 nt, Human; identical to SEQ ID NO: 215534

SEQ ID NO: 218767 - RNA, 64 nt, Human; identical to SEQ ID NO: 215535

SEQ ID NO: 218768 - RNA, 64 nt, Human; identical to SEQ ID NO: 215536

SEQ ID NO: 218769 - RNA, 64 nt, Human; identical to SEQ ID NO: 215241

SEQ ID NO: 218770 - RNA, 64 nt, Human; identical to SEQ ID NO: 216476

SEQ ID NO: 218771 - RNA, 64 nt, Human; identical to SEQ ID NO: 216477

SEQ ID NO: 218772 - RNA, 57 nt, Human; identical to SEQ ID NO: 215540

SEQ ID NO: 218773 - RNA, 64 nt, Human; identical to SEQ ID NO: 215541

SEQ ID NO: 218774 - RNA, 64 nt, Human; identical to SEQ ID NO: 215542

SEQ ID NO: 218775 - RNA, 64 nt, Human; identical to SEQ ID NO: 215543

SEQ ID NO: 218776 - RNA, 64 nt, Human; identical to SEQ ID NO: 215544

SEQ ID NO: 218777 - RNA, 64 nt, Human; identical to SEQ ID NO: 215545

SEQ ID NO: 218778 - RNA, 64 nt, Human; identical to SEQ ID NO: 215546

SEQ ID NO: 218779 - RNA, 64 nt, Human; identical to SEQ ID NO: 215547

SEQ ID NO: 218780 - RNA, 64 nt, Human; identical to SEQ ID NO: 215548

SEQ ID NO: 218781 - RNA, 64 nt, Human; identical to SEQ ID NO: 215549

SEQ ID NO: 218782 - RNA, 64 nt, Human; identical to SEQ ID NO: 215550

SEQ ID NO: 218783 - RNA, 64 nt, Human; identical to SEQ ID NO: 215551

SEQ ID NO: 218784 - RNA, 64 nt, Human; identical to SEQ ID NO: 215552

SEQ ID NO: 218785 - RNA, 64 nt, Human; identical to SEQ ID NO: 215553

SEQ ID NO: 218786 - RNA, 64 nt, Human; identical to SEQ ID NO: 215554

SEQ ID NO: 218787 - RNA, 64 nt, Human; identical to SEQ ID NO: 215555

SEQ ID NO: 218788 - RNA, 64 nt, Human; identical to SEQ ID NO: 216513

SEQ ID NO: 218789 - RNA, 64 nt, Human; identical to SEQ ID NO: 216514

SEQ ID NO: 218790 - RNA, 64 nt, Human; identical to SEQ ID NO: 216515

SEQ ID NO: 218791 - RNA, 64 nt, Human; identical to SEQ ID NO: 215559

SEQ ID NO: 218792 - RNA, 64 nt, Human; identical to SEQ ID NO: 215560

SEQ ID NO: 218793 - RNA, 64 nt, Human; identical to SEQ ID NO: 215561

SEQ ID NO: 218794 - RNA, 64 nt, Human; identical to SEQ ID NO: 215562

SEQ ID NO: 218795 - RNA, 64 nt, Human; identical to SEQ ID NO: 215563

SEQ ID NO: 218796 - RNA, 64 nt, Human; identical to SEQ ID NO: 215564

SEQ ID NO: 218797 - RNA, 64 nt, Human; identical to SEQ ID NO: 215565

SEQ ID NO: 218798 - RNA, 64 nt, Human; identical to SEQ ID NO: 215566

SEQ ID NO: 218799 - RNA, 64 nt, Human; identical to SEQ ID NO: 215567

SEQ ID NO: 218800 - RNA, 64 nt, Human; identical to SEQ ID NO: 215568

SEQ ID NO: 218801 - RNA, 64 nt, Human; identical to SEQ ID NO: 215569

SEQ ID NO: 218802 - RNA, 64 nt, Human; identical to SEQ ID NO: 215570

SEQ ID NO: 218803 - RNA, 64 nt, Human; identical to SEQ ID NO: 215571

SEQ ID NO: 218804 - RNA, 64 nt, Human; identical to SEQ ID NO: 215572

SEQ ID NO: 218805 - RNA, 64 nt, Human; identical to SEQ ID NO: 215573

SEQ ID NO: 218806 - RNA, 63 nt, Human; identical to SEQ ID NO: 215574

SEQ ID NO: 218807 - RNA, 64 nt, Human; identical to SEQ ID NO: 217003

SEQ ID NO: 218808 - RNA, 64 nt, Human; identical to SEQ ID NO: 216532

SEQ ID NO: 218809 - RNA, 64 nt, Human; identical to SEQ ID NO: 216533

SEQ ID NO: 218810 - RNA, 64 nt, Human; identical to SEQ ID NO: 215578

SEQ ID NO: 218811 - RNA, 64 nt, Human; identical to SEQ ID NO: 215579

SEQ ID NO: 218812 - RNA, 64 nt, Human; identical to SEQ ID NO: 215580

SEQ ID NO: 218813 - RNA, 64 nt, Human; identical to SEQ ID NO: 215581

SEQ ID NO: 218814 - RNA, 64 nt, Human; identical to SEQ ID NO: 215582

SEQ ID NO: 218815 - RNA, 64 nt, Human; identical to SEQ ID NO: 215583

SEQ ID NO: 218816 - RNA, 64 nt, Human; identical to SEQ ID NO: 215584

SEQ ID NO: 218817 - RNA, 64 nt, Human; identical to SEQ ID NO: 215585

SEQ ID NO: 218818 - RNA, 64 nt, Human; identical to SEQ ID NO: 215586

SEQ ID NO: 218819 - RNA, 64 nt, Human; identical to SEQ ID NO: 215587

SEQ ID NO: 218820 - RNA, 64 nt, Human; identical to SEQ ID NO: 215588

SEQ ID NO: 218821 - RNA, 64 nt, Human; identical to SEQ ID NO: 215589

SEQ ID NO: 218822 - RNA, 64 nt, Human; identical to SEQ ID NO: 215590

SEQ ID NO: 218823 - RNA, 64 nt, Human; identical to SEQ ID NO: 215591

SEQ ID NO: 218824 - RNA, 64 nt, Human; identical to SEQ ID NO: 215592

SEQ ID NO: 218825 - RNA, 64 nt, Human; identical to SEQ ID NO: 215593

SEQ ID NO: 218826 - RNA, 64 nt, Human; identical to SEQ ID NO: 216570

SEQ ID NO: 218827 - RNA, 64 nt, Human; identical to SEQ ID NO: 216120

SEQ ID NO: 218828 - RNA, 64 nt, Human; identical to SEQ ID NO: 215988

SEQ ID NO: 218829 - RNA, 64 nt, Human; identical to SEQ ID NO: 215597

SEQ ID NO: 218830 - RNA, 64 nt, Human; identical to SEQ ID NO: 215598

SEQ ID NO: 218831 - RNA, 64 nt, Human; identical to SEQ ID NO: 215599

SEQ ID NO: 218832 - RNA, 64 nt, Human; identical to SEQ ID NO: 215600

SEQ ID NO: 218833 - RNA, 64 nt, Human; identical to SEQ ID NO: 215601

SEQ ID NO: 218834 - RNA, 64 nt, Human; identical to SEQ ID NO: 215602

SEQ ID NO: 218835 - RNA, 64 nt, Human; identical to SEQ ID NO: 215603

SEQ ID NO: 218836 - RNA, 64 nt, Human; identical to SEQ ID NO: 215604

SEQ ID NO: 218837 - RNA, 64 nt, Human; identical to SEQ ID NO: 215605

SEQ ID NO: 218838 - RNA, 64 nt, Human; identical to SEQ ID NO: 215606

SEQ ID NO: 218839 - RNA, 64 nt, Human; identical to SEQ ID NO: 215607

SEQ ID NO: 218840 - RNA, 64 nt, Human; identical to SEQ ID NO: 215608

SEQ ID NO: 218841 - RNA, 64 nt, Human; identical to SEQ ID NO: 215609

SEQ ID NO: 218842 - RNA, 64 nt, Human; identical to SEQ ID NO: 215610

SEQ ID NO: 218843 - RNA, 64 nt, Human; identical to SEQ ID NO: 215611

SEQ ID NO: 218844 - RNA, 64 nt, Human; identical to SEQ ID NO: 215612

SEQ ID NO: 218845 - RNA, 64 nt, Human; identical to SEQ ID NO: 215260

SEQ ID NO: 218846 - RNA, 64 nt, Human; identical to SEQ ID NO: 216552

SEQ ID NO: 218847 - RNA, 52 nt, Human; identical to SEQ ID NO: 216553

SEQ ID NO: 218848 - RNA, 64 nt, Human; identical to SEQ ID NO: 215616

SEQ ID NO: 218849 - RNA, 64 nt, Human; identical to SEQ ID NO: 215617

SEQ ID NO: 218850 - RNA, 64 nt, Human; identical to SEQ ID NO: 215618

SEQ ID NO: 218851 - RNA, 64 nt, Human; identical to SEQ ID NO: 215619

SEQ ID NO: 218852 - RNA, 64 nt, Human; identical to SEQ ID NO: 215620

SEQ ID NO: 218853 - RNA, 64 nt, Human; identical to SEQ ID NO: 215621

SEQ ID NO: 218854 - RNA, 64 nt, Human; identical to SEQ ID NO: 215622

SEQ ID NO: 218855 - RNA, 64 nt, Human; identical to SEQ ID NO: 215623

SEQ ID NO: 218856 - RNA, 64 nt, Human; identical to SEQ ID NO: 215624

SEQ ID NO: 218857 - RNA, 64 nt, Human; identical to SEQ ID NO: 215625

SEQ ID NO: 218858 - RNA, 64 nt, Human; identical to SEQ ID NO: 215626

SEQ ID NO: 218859 - RNA, 64 nt, Human; identical to SEQ ID NO: 215627

SEQ ID NO: 218860 - RNA, 64 nt, Human; identical to SEQ ID NO: 215628

SEQ ID NO: 218861 - RNA, 64 nt, Human; identical to SEQ ID NO: 215629

SEQ ID NO: 218862 - RNA, 64 nt, Human; identical to SEQ ID NO: 215630

SEQ ID NO: 218863 - RNA, 64 nt, Human; identical to SEQ ID NO: 215631

SEQ ID NO: 218864 - RNA, 64 nt, Human; identical to SEQ ID NO: 216534

SEQ ID NO: 218865 - RNA, 64 nt, Human; identical to SEQ ID NO: 216590

SEQ ID NO: 218866 - RNA, 64 nt, Human; identical to SEQ ID NO: 216591

SEQ ID NO: 218867 - RNA, 64 nt, Human; identical to SEQ ID NO: 215635

SEQ ID NO: 218868 - RNA, 64 nt, Human; identical to SEQ ID NO: 215636

SEQ ID NO: 218869 - RNA, 64 nt, Human; identical to SEQ ID NO: 215637

SEQ ID NO: 218870 - RNA, 64 nt, Human; identical to SEQ ID NO: 215638

SEQ ID NO: 218871 - RNA, 64 nt, Human; identical to SEQ ID NO: 215639

SEQ ID NO: 218872 - RNA, 64 nt, Human; identical to SEQ ID NO: 215640

SEQ ID NO: 218873 - RNA, 64 nt, Human; identical to SEQ ID NO: 215641

SEQ ID NO: 218874 - RNA, 64 nt, Human; identical to SEQ ID NO: 215642

SEQ ID NO: 218875 - RNA, 64 nt, Human; identical to SEQ ID NO: 215643

SEQ ID NO: 218876 - RNA, 64 nt, Human; identical to SEQ ID NO: 215644

SEQ ID NO: 218877 - RNA, 64 nt, Human; identical to SEQ ID NO: 215645

SEQ ID NO: 218878 - RNA, 64 nt, Human; identical to SEQ ID NO: 215646

SEQ ID NO: 218879 - RNA, 64 nt, Human; identical to SEQ ID NO: 215647

SEQ ID NO: 218880 - RNA, 64 nt, Human; identical to SEQ ID NO: 215648

SEQ ID NO: 218881 - RNA, 64 nt, Human; identical to SEQ ID NO: 215649

SEQ ID NO: 218882 - RNA, 64 nt, Human; identical to SEQ ID NO: 215650

SEQ ID NO: 218883 - RNA, 64 nt, Human; identical to SEQ ID NO: 216608

SEQ ID NO: 218884 - RNA, 64 nt, Human; identical to SEQ ID NO: 216609

SEQ ID NO: 218885 - RNA, 64 nt, Human; identical to SEQ ID NO: 216610

SEQ ID NO: 218886 - RNA, 64 nt, Human; identical to SEQ ID NO: 215654

SEQ ID NO: 218887 - RNA, 64 nt, Human; identical to SEQ ID NO: 215655

SEQ ID NO: 218888 - RNA, 64 nt, Human; identical to SEQ ID NO: 215656

SEQ ID NO: 218889 - RNA, 64 nt, Human; identical to SEQ ID NO: 215657

SEQ ID NO: 218890 - RNA, 64 nt, Human; identical to SEQ ID NO: 215658

SEQ ID NO: 218891 - RNA, 64 nt, Human; identical to SEQ ID NO: 215659

SEQ ID NO: 218892 - RNA, 64 nt, Human; identical to SEQ ID NO: 215660

SEQ ID NO: 218893 - RNA, 64 nt, Human; identical to SEQ ID NO: 215661

SEQ ID NO: 218894 - RNA, 64 nt, Human; identical to SEQ ID NO: 215662

SEQ ID NO: 218895 - RNA, 64 nt, Human; identical to SEQ ID NO: 215663

SEQ ID NO: 218896 - RNA, 64 nt, Human; identical to SEQ ID NO: 215664

SEQ ID NO: 218897 - RNA, 64 nt, Human; identical to SEQ ID NO: 215665

SEQ ID NO: 218898 - RNA, 64 nt, Human; identical to SEQ ID NO: 215666

SEQ ID NO: 218899 - RNA, 64 nt, Human; identical to SEQ ID NO: 215667

SEQ ID NO: 218900 - RNA, 64 nt, Human; identical to SEQ ID NO: 215668

SEQ ID NO: 218901 - RNA, 64 nt, Human; identical to SEQ ID NO: 215669

SEQ ID NO: 218902 - RNA, 64 nt, Human; identical to SEQ ID NO: 215203

SEQ ID NO: 218903 - RNA, 64 nt, Human; identical to SEQ ID NO: 216628

SEQ ID NO: 218904 - RNA, 64 nt, Human; identical to SEQ ID NO: 216629

SEQ ID NO: 218905 - RNA, 64 nt, Human; identical to SEQ ID NO: 215673

SEQ ID NO: 218906 - RNA, 64 nt, Human; identical to SEQ ID NO: 215674

SEQ ID NO: 218907 - RNA, 56 nt, Human; identical to SEQ ID NO: 215675

SEQ ID NO: 218908 - RNA, 64 nt, Human
ccccgcuguggucuuuguugucccacuuugggaccggguccagucuggggucuagucucgagca

SEQ ID NO: 218909 - RNA, 64 nt, Human
ucuaccccaacucaucauuuuccuauugaggaaacggguccagggcagucgugugucuuaccca

SEQ ID NO: 218910 - RNA, 64 nt, Human
ccaggagucccagccaggguggccccggcgggggcggguccagcuuuggaagccaggcuccccu

SEQ ID NO: 218911 - RNA, 64 nt, Human
gccacugcucaacuucccccuccugcaggggauccggguccaugggauggaggcgcuggggagc

SEQ ID NO: 218912 - RNA, 64 nt, Human
ccauccccucuccccgcguggacuccugagccugcggguccaggguggggggcugucacuuuau

SEQ ID NO: 218913 - RNA, 64 nt, Human
uguccacugcccaugacugagcccagccccagcccggguccauugcccacauucucugucuccu

SEQ ID NO: 218914 - RNA, 64 nt, Human
ccuggacucccugcuccgugaggcgaauuuacaccggguccagcugcgucagcccgaguucuga

SEQ ID NO: 218915 - RNA, 64 nt, Human
gaucugaggucucugauagaaaucuggacgccaccggguccaggccuggccucagacuuggccu

SEQ ID NO: 218916 - RNA, 64 nt, Human
aguggaggccuggacucccuuugcucacuccauucggguccacagcugagguugccgcugacaa

SEQ ID NO: 218917 - RNA, 64 nt, Human
ggcaaauguggauccaagaaaccagggccaugaccggguccacuguggagcagccaucuaucua

SEQ ID NO: 218918 - RNA, 64 nt, Human
gcuggagcagaggaccacaaggcagcagaaagcgcggguccagaugagggccaggaaggggagg

SEQ ID NO: 218919 - RNA, 64 nt, Human
auaaagaucaccacuuccccaaagaagcagcccucggguccauguguuguucagacaugugaag

SEQ ID NO: 218920 - RNA, 64 nt, Human
ugucccaaguccuccgguucuuccucgggauuggcggguccacuugccagggcucugggggcag

SEQ ID NO: 218921 - RNA, 64 nt, Human
auuuccugcucucuccccucuuuugugaagaaagcggguccaaaugugauucaaacaacuguac

SEQ ID NO: 218922 - RNA, 64 nt, Human
uccucuugccucgagguggaagcuguauagagcccggguccacggugaacagucaguggcaggg

SEQ ID NO: 218923 - RNA, 64 nt, Human
aaauuagaacuuacuaugugcaaauauagaagcacggguccacagaguuccagagaaugaaugc

SEQ ID NO: 218924 - RNA, 64 nt, Human
ccccaauuucuggccuucaacuucuccccuugaccggguccaacucugccacucaucugccaac

SEQ ID NO: 218925 - RNA, 64 nt, Human
cgcacgcucccuuucugaaagaaacacccguuaccggguccagacugaaugugggcguaagaaa

SEQ ID NO: 218926 - RNA, 64 nt, Human
ugcagggcugcgugcauugaggccgccucuuugacggguccauccagggggacccucuccuuuc

SEQ ID NO: 218927 - RNA, 64 nt, Human
uacccggcggggcgagaaggaggagugcuuugagcggguccauggcgaguguaucgccaacuug

SEQ ID NO: 218928 - RNA, 64 nt, Human
uacucacuugcugcgagacuucaggccgcuucugcggguccaaacucccugagccuaucgucuc

SEQ ID NO: 218929 - RNA, 64 nt, Human
cguccagccgccucuggcucaaguucgucucugacggguccauuaacaaagcgggcuuugccgu

SEQ ID NO: 218930 - RNA, 64 nt, Human
cuaugcuccaucccaagggccaagggucaggggccggguccacucuuucccuaggcugagcacc

SEQ ID NO: 218931 - RNA, 64 nt, Human
caaaaauauaugcuaagcauaauuaaacuccaugcggguccauaacagccaagaagccugcagg

SEQ ID NO: 218932 - RNA, 64 nt, Human
cacagcguugcuaggguggcauggcuccccaucucggguccauccuauacuuccaugggacucc

SEQ ID NO: 218933 - RNA, 64 nt, Human
uggaugcuugccucuuuccuaacaguuauuuccccggguccagcuuaaagacucgauggaagga

SEQ ID NO: 218934 - RNA, 64 nt, Human
gcugcagaaaauaaaccuccagauuccaccaacacggguccauucuuccuggugauggcagagg

SEQ ID NO: 218935 - RNA, 64 nt, Human
cgcuccaaggacaagugaaggucagccggccgggcggguccacaguuaccagcacgcugucuca

SEQ ID NO: 218936 - RNA, 64 nt, Human
agagugaccgcgcuggccgugaaaucgacugcugcggguccaguguccgccaucuucaggguug

SEQ ID NO: 218937 - RNA, 64 nt, Human
ucccugugacgggugaacuucguguacugugucucggguccauauaugaauugugagcaggguu

SEQ ID NO: 218938 - RNA, 64 nt, Human
cacacacacacacacacacgccgagcagcugucucggguccagagcgagcagcguggagcucag

SEQ ID NO: 218939 - RNA, 64 nt, Human
auaggggauguagggccuugccuggccuggucugcggguccaucgucagugccugagcggccag

SEQ ID NO: 218940 - RNA, 64 nt, Human
uggacagcagugucccggcacaggcccaucgagccggguccaguacccaaccuucgcacgagug

SEQ ID NO: 218941 - RNA, 64 nt, Human
aggaggcaguggacaucguaggcagccacggccccggguccaggagaagugcucccuggaggca

SEQ ID NO: 218942 - RNA, 64 nt, Human
ucucugugcagcuggagacgcuggugaggagagccggguccagguucuuaagaaugaggugcgg

SEQ ID NO: 218943 - RNA, 64 nt, Human
gggcguccuagcagcugcagcagcugugccgccgcggguccaccgaggacgccaaucaaucaac

SEQ ID NO: 218944 - RNA, 64 nt, Human
aguuuugauguccaucuuccaggagagacggucucggguccagggaguggagggggcugccccu

SEQ ID NO: 218945 - RNA, 64 nt, Human
cccggcgccugcccacccuccacccacagccucacggguccaggacuuggcguguuguuacaug

SEQ ID NO: 218946 - RNA, 64 nt, Human
gcgcaucccccaacagcagccccugccagucccucggguccaggcaaggcccugggggucuccu

SEQ ID NO: 218947 - RNA, 64 nt, Human
gcucccagcucgcccggcugccacaagcucucugcggguccauccuccccaccgggguccgucc

SEQ ID NO: 218948 - RNA, 64 nt, Human
gggacagaagcaaggugggagugugcucugcagccggguccagcuacuuccuuuuggaaccuua

SEQ ID NO: 218949 - RNA, 64 nt, Human
cagcuccugggggcugggcagggcagggcagggccggguccacuuccauuguuagcaguuguuu

SEQ ID NO: 218950 - RNA, 64 nt, Human
gauccugcugaaugcuauccuugcaaacuucucccggguccagcgccuggggcugccccucaag

SEQ ID NO: 218951 - RNA, 64 nt, Human
ucccugaccuuagcguucuggacucugccccaaucggguccagagaccacaccacuaaccaucc

SEQ ID NO: 218952 - RNA, 64 nt, Human
ccugccgcagaauggggccccagccggccccgaccggguccaggagcacugcucgccuguacau

SEQ ID NO: 218953 - RNA, 64 nt, Human
aaagccuguaacuguccagcuucuaauuucaaaacggguccauuagggcuucguuguguuaaca

SEQ ID NO: 218954 - RNA, 64 nt, Human
uugcuuaauuacgugaauaaugaaauguaaaauccggguccauaagccuuuauuucauacaguc

SEQ ID NO: 218955 - RNA, 64 nt, Human
ccagccuggcuuggacacgugaugggccuguggccggguccagugggcacugggcgggguggug

SEQ ID NO: 218956 - RNA, 64 nt, Human; identical to SEQ ID NO: 215368

SEQ ID NO: 218957 - RNA, 64 nt, Human; identical to SEQ ID NO: 216006

SEQ ID NO: 218958 - RNA, 64 nt, Human
ugggaagcggucuccccaccggcacugggauuggcggguccaagcccagcaaccggcuucgcuc

SEQ ID NO: 218959 - RNA, 64 nt, Human
ugaacuugacaagauuagcucaagcagauagagucggguccagcaguggguggcccucguguga

SEQ ID NO: 218960 - RNA, 64 nt, Human
ggcuagacuaccggacacucgucaccccagcccucggguccauagagaugagcccacccugcug

SEQ ID NO: 218961 - RNA, 64 nt, Human
cugaaagggaaagcagcugucaccugacuucuggcggguccaacauagcccucagcuuaccucu

SEQ ID NO: 218962 - RNA, 64 nt, Human
ccaagaguggccgcggcuuugggacaccuggggucggguccaccaugaggauaaaaccuccuuc

SEQ ID NO: 218963 - RNA, 64 nt, Human
acgcgggguccggccugggauccaggcuaagggccggcggaagaggccccaauggggcggugac

SEQ ID NO: 218964 - RNA, 64 nt, Human
cuggggugggccaugugccaggacaggagggucccggcggaaagccagccccggacucaucgug

SEQ ID NO: 218965 - RNA, 64 nt, Human
ggucguuuuccaaagagccgcgucccggcaaguccggcggaauucaccaguguuccugaagcug

SEQ ID NO: 218966 - RNA, 53 nt, Human
ccuuccggugguuucagugacggcggcggaacccaaagcugcccucuccgugc

SEQ ID NO: 218967 - RNA, 64 nt, Human
cuguguggugaccauggucaucauagugggcucacggcggaaacgggaucauucaaccuauaca

SEQ ID NO: 218968 - RNA, 64 nt, Human
cggugacaaaggcugggugagccccugcugggcacggcggaagucacgaccucuccagccaggg

SEQ ID NO: 218969 - RNA, 64 nt, Human
agagugagugccuuucccuccuaaagcugaaucccggcggaaagccucuguccgccuuuacaag

SEQ ID NO: 218970 - RNA, 64 nt, Human
ugugaucaccguaggguaacuggagcgucaccaccggcggaaucgcagcuucugagacuggaac

SEQ ID NO: 218971 - RNA, 64 nt, Human
cccaccuaauucgaugaaggcugccaacggggagcggcggaaagccuguaagccugcaagccug

SEQ ID NO: 218972 - RNA, 64 nt, Human
ucugggcucuaaccugggagacucgcauccagcccggcggaagcuacagucucuacccugagcu

SEQ ID NO: 218973 - RNA, 64 nt, Human
cugggaugcccgcgccacccgcagcccccucacucggcggaaacccgcgagccggcccuuccgc

SEQ ID NO: 218974 - RNA, 64 nt, Human; identical to SEQ ID NO: 216869

SEQ ID NO: 218975 - RNA, 64 nt, Human
cccggccgugugagugcccgggugcugccagccacggcggaagcucccuuggaggcagcccugc

SEQ ID NO: 218976 - RNA, 64 nt, Human
ccucucuccuucucuguacaaugauucagcaucucggcggaagaggaaaauggagcuuuuugag

SEQ ID NO: 218977 - RNA, 64 nt, Human
gagagagaaaaaaccucaacuguguauuuugucacggcggaaaaucugcucgcaucgaagcauu

SEQ ID NO: 218978 - RNA, 64 nt, Human
cuucaguuccaugcaccacgcuccguagaagccccggcggaagccguagcuuucccugccaccu

SEQ ID NO: 218979 - RNA, 64 nt, Human
cugccugcgggaugagaccuuggcaggcgggcagcggcggaaacucagcucaagguucccggug

SEQ ID NO: 218980 - RNA, 64 nt, Human
cuccaggcagugggaagccaauggagggauuaagcggcggaagcuucuuagaagaggcaggggg

SEQ ID NO: 218981 - RNA, 64 nt, Human
ugucuuuuucauugacagaaggaacccagccagccggcggaaugcaagcagcaguaggaagcgg

SEQ ID NO: 218982 - RNA, 64 nt, Human
ugucuacaggagccaaggugaaagucucugaugacggcggaacuggcuccauuagaccaugguu

SEQ ID NO: 218983 - RNA, 64 nt, Human
uugcagcuuccugguggcccugaugcagaagaaccggcggaaggaccggaagcuaggggccagu

SEQ ID NO: 218984 - RNA, 64 nt, Human
aaggaaaggcggggcuccuuccucaaacaucggacggcggaauguggcagaugaaaugugcugg

SEQ ID NO: 218985 - RNA, 64 nt, Human
gcaaaauuucuuaaggaaggcacugaaagaaacacggcggaaucucuccaggagaagcucggcg

SEQ ID NO: 218986 - RNA, 57 nt, Human
cggggcugucccaguauuaaaagguggcggcggaagagcuaagcaacguggcuuagu

SEQ ID NO: 218987 - RNA, 64 nt, Human
acucuuugaccgguugcucauuuucuggucugaccggcggaacccccacgaggugaagccagcc

SEQ ID NO: 218988 - RNA, 64 nt, Human
acauugagacccugaaaugaacaauuauauucugacucgacaucuuguccccaauccuuccaaa

SEQ ID NO: 218989 - RNA, 64 nt, Human; identical to SEQ ID NO: 216348

SEQ ID NO: 218990 - RNA, 64 nt, Human; identical to SEQ ID NO: 215297

SEQ ID NO: 218991 - RNA, 64 nt, Human; identical to SEQ ID NO: 216196

SEQ ID NO: 218992 - RNA, 64 nt, Human
aucuggauaauuuguacugcuaaaguuuuaauaaacucgacaugagaaaaacacuuugguguag

SEQ ID NO: 218993 - RNA, 64 nt, Human
uuggcuaaauuauacaagacuuacaagauugauuacucgacaggcuuguauuuaagagguaacu

SEQ ID NO: 218994 - RNA, 64 nt, Human
uaauaaucaugauaaccugaaacauguuacugggacucgacauuuuucuggggauugaaaucuu

SEQ ID NO: 218995 - RNA, 64 nt, Human
guggcugugccaccaagcauuccugcucaagcugacucgacaccgugucaccuacgugccacuc

SEQ ID NO: 218996 - RNA, 64 nt, Human
ccaucuucaaguuucacauccuggucaucaaaagacucgacagcaagacuuagaaugaaaaagg

SEQ ID NO: 218997 - RNA, 64 nt, Human
acagcaccacugagaugaaucucauggcagaacaacucgacaugccuaugcagccacacagugg

SEQ ID NO: 218998 - RNA, 64 nt, Human
gcauuuccagagcagagccuacagaagggcagugacucgacaaaggccacaggcaguccaggcc

SEQ ID NO: 218999 - RNA, 64 nt, Human
cuugaccuaggucuugacccucauccagcaagggacucgacagacccaagggucccuggaacgu

SEQ ID NO: 219000 - RNA, 64 nt, Human
guagacaagaauuugauguaacgcaaauggaaaaacucgacaccacauuucaggcuuuacccaa

SEQ ID NO: 219001 - RNA, 64 nt, Human
uguaggcaacucggaauauagcucuuuugaaaguacucgacaccuuuagauaagaauuaaaacc

SEQ ID NO: 219002 - RNA, 64 nt, Human
uuuccucuguagcagccuccuggacuuccugaggacucgacauuguccacagauguacuggcca

SEQ ID NO: 219003 - RNA, 64 nt, Human
gaguuuccagaaaagcacaucgcccuuucucuccacucgacacagccugcgguuugcagugcca

SEQ ID NO: 219004 - RNA, 64 nt, Human
uugcagguggccaaguuccucuaacuuggcucacacucgacaugaaaauucagaauuuuauacu

SEQ ID NO: 219005 - RNA, 64 nt, Human
gacagcuaguugggcgccccccacccucccccggacucgacaggagccuggaccuccggcuuca

SEQ ID NO: 219006 - RNA, 64 nt, Human
uaucuaugagggagucaaguauguacuuaaggugacucgacagucccccaacuccuauguggug

SEQ ID NO: 219007 - RNA, 56 nt, Human
uuuagcagcaugcuuuuugaagauuaacucgacaauauggccagcuaaugaaauua

SEQ ID NO: 219008 - RNA, 64 nt, Human; identical to SEQ ID NO: 216439

SEQ ID NO: 219009 - RNA, 64 nt, Human; identical to SEQ ID NO: 216458

SEQ ID NO: 219010 - RNA, 64 nt, Human; identical to SEQ ID NO: 216724

SEQ ID NO: 219011 - RNA, 64 nt, Human
gaguuauucagugaauccauuuuaucaguuuggcacucgacagcaaauuucuugauaucaagga

SEQ ID NO: 219012 - RNA, 64 nt, Human
ccccggggauuccccccccccgagggugcccaggacucgacaagcuggacccccugcucccggg

SEQ ID NO: 219013 - RNA, 64 nt, Human
cauugggucagcaccugugaaaggaagauuaaaaacucgacaccccaauucacucaaccaagaa

SEQ ID NO: 219014 - RNA, 64 nt, Human
gagagaaccggcgcugggcaacacgggccugcaaacucgacaggacccugcccgaggggcccuc

SEQ ID NO: 219015 - RNA, 64 nt, Human
gaauggagacacccgugaccucaggcugaaagucacucgacauuggucucuuguguugauaggg

SEQ ID NO: 219016 - RNA, 64 nt, Human
agacuuacaaaaaaagauuuaaaguggcagcuucacucgacauuuggugagagaaguacaaagg

SEQ ID NO: 219017 - RNA, 64 nt, Human; identical to SEQ ID NO: 19157

SEQ ID NO: 219018 - RNA, 64 nt, Human; identical to SEQ ID NO: 19158

SEQ ID NO: 219019 - RNA, 64 nt, Human; identical to SEQ ID NO: 19159

SEQ ID NO: 219020 - RNA, 54 nt, Human; identical to SEQ ID NO: 19160

SEQ ID NO: 219021 - RNA, 64 nt, Human; identical to SEQ ID NO: 19161

SEQ ID NO: 219022 - RNA, 64 nt, Human; identical to SEQ ID NO: 19162

SEQ ID NO: 219023 - RNA, 64 nt, Human; identical to SEQ ID NO: 19163

SEQ ID NO: 219024 - RNA, 64 nt, Human; identical to SEQ ID NO: 19164

SEQ ID NO: 219025 - RNA, 64 nt, Human; identical to SEQ ID NO: 19165

SEQ ID NO: 219026 - RNA, 50 nt, Human; identical to SEQ ID NO: 216703

SEQ ID NO: 219027 - RNA, 64 nt, Human; identical to SEQ ID NO: 216705

SEQ ID NO: 219028 - RNA, 64 nt, Human; identical to SEQ ID NO: 217078

SEQ ID NO: 219029 - RNA, 64 nt, Human; identical to SEQ ID NO: 19166

SEQ ID NO: 219030 - RNA, 64 nt, Human; identical to SEQ ID NO: 19167

SEQ ID NO: 219031 - RNA, 64 nt, Human; identical to SEQ ID NO: 19168

SEQ ID NO: 219032 - RNA, 64 nt, Human; identical to SEQ ID NO: 19169

SEQ ID NO: 219033 - RNA, 64 nt, Human; identical to SEQ ID NO: 19170

SEQ ID NO: 219034 - RNA, 64 nt, Human; identical to SEQ ID NO: 19171

SEQ ID NO: 219035 - RNA, 64 nt, Human; identical to SEQ ID NO: 19172

SEQ ID NO: 219036 - RNA, 64 nt, Human; identical to SEQ ID NO: 19173

SEQ ID NO: 219037 - RNA, 64 nt, Human; identical to SEQ ID NO: 19174

SEQ ID NO: 219038 - RNA, 64 nt, Human; identical to SEQ ID NO: 19175

SEQ ID NO: 219039 - RNA, 64 nt, Human; identical to SEQ ID NO: 19176

SEQ ID NO: 219040 - RNA, 64 nt, Human; identical to SEQ ID NO: 19177

SEQ ID NO: 219041 - RNA, 64 nt, Human; identical to SEQ ID NO: 19178

SEQ ID NO: 219042 - RNA, 64 nt, Human; identical to SEQ ID NO: 19179

SEQ ID NO: 219043 - RNA, 64 nt, Human; identical to SEQ ID NO: 19180

SEQ ID NO: 219044 - RNA, 64 nt, Human; identical to SEQ ID NO: 19181

SEQ ID NO: 219045 - RNA, 64 nt, Human; identical to SEQ ID NO: 216684

SEQ ID NO: 219046 - RNA, 64 nt, Human; identical to SEQ ID NO: 215182

SEQ ID NO: 219047 - RNA, 64 nt, Human; identical to SEQ ID NO: 216742

SEQ ID NO: 219048 - RNA, 64 nt, Human; identical to SEQ ID NO: 19182

SEQ ID NO: 219049 - RNA, 64 nt, Human; identical to SEQ ID NO: 19183

SEQ ID NO: 219050 - RNA, 56 nt, Human; identical to SEQ ID NO: 19184

SEQ ID NO: 219051 - RNA, 64 nt, Human; identical to SEQ ID NO: 19185

SEQ ID NO: 219052 - RNA, 64 nt, Human; identical to SEQ ID NO: 19186

SEQ ID NO: 219053 - RNA, 64 nt, Human; identical to SEQ ID NO: 19187

SEQ ID NO: 219054 - RNA, 52 nt, Human; identical to SEQ ID NO: 19188

SEQ ID NO: 219055 - RNA, 64 nt, Human; identical to SEQ ID NO: 19189

SEQ ID NO: 219056 - RNA, 64 nt, Human; identical to SEQ ID NO: 19190

SEQ ID NO: 219057 - RNA, 64 nt, Human; identical to SEQ ID NO: 19191

SEQ ID NO: 219058 - RNA, 64 nt, Human; identical to SEQ ID NO: 19192

SEQ ID NO: 219059 - RNA, 64 nt, Human; identical to SEQ ID NO: 19193

SEQ ID NO: 219060 - RNA, 64 nt, Human; identical to SEQ ID NO: 19194

SEQ ID NO: 219061 - RNA, 64 nt, Human; identical to SEQ ID NO: 19195

SEQ ID NO: 219062 - RNA, 64 nt, Human; identical to SEQ ID NO: 19196

SEQ ID NO: 219063 - RNA, 64 nt, Human; identical to SEQ ID NO: 19197

SEQ ID NO: 219064 - RNA, 64 nt, Human; identical to SEQ ID NO: 215183

SEQ ID NO: 219065 - RNA, 64 nt, Human; identical to SEQ ID NO: 216754

SEQ ID NO: 219066 - RNA, 64 nt, Human; identical to SEQ ID NO: 216755

SEQ ID NO: 219067 - RNA, 64 nt, Human; identical to SEQ ID NO: 19198

SEQ ID NO: 219068 - RNA, 64 nt, Human; identical to SEQ ID NO: 19199

SEQ ID NO: 219069 - RNA, 64 nt, Human; identical to SEQ ID NO: 19200

SEQ ID NO: 219070 - RNA, 64 nt, Human; identical to SEQ ID NO: 19201

SEQ ID NO: 219071 - RNA, 64 nt, Human; identical to SEQ ID NO: 19202

SEQ ID NO: 219072 - RNA, 64 nt, Human; identical to SEQ ID NO: 19203

SEQ ID NO: 219073 - RNA, 64 nt, Human; identical to SEQ ID NO: 19204

SEQ ID NO: 219074 - RNA, 64 nt, Human; identical to SEQ ID NO: 19205

SEQ ID NO: 219075 - RNA, 64 nt, Human; identical to SEQ ID NO: 19206

SEQ ID NO: 219076 - RNA, 64 nt, Human; identical to SEQ ID NO: 19207

SEQ ID NO: 219077 - RNA, 64 nt, Human; identical to SEQ ID NO: 19208

SEQ ID NO: 219078 - RNA, 64 nt, Human; identical to SEQ ID NO: 19209

SEQ ID NO: 219079 - RNA, 64 nt, Human; identical to SEQ ID NO: 19210

SEQ ID NO: 219080 - RNA, 64 nt, Human; identical to SEQ ID NO: 19211

SEQ ID NO: 219081 - RNA, 64 nt, Human; identical to SEQ ID NO: 19212

SEQ ID NO: 219082 - RNA, 64 nt, Human; identical to SEQ ID NO: 19213

SEQ ID NO: 219083 - RNA, 64 nt, Human; identical to SEQ ID NO: 216665

SEQ ID NO: 219084 - RNA, 64 nt, Human; identical to SEQ ID NO: 216743

SEQ ID NO: 219085 - RNA, 64 nt, Human; identical to SEQ ID NO: 215184

SEQ ID NO: 219086 - RNA, 64 nt, Human; identical to SEQ ID NO: 19214

SEQ ID NO: 219087 - RNA, 64 nt, Human; identical to SEQ ID NO: 19215

SEQ ID NO: 219088 - RNA, 64 nt, Human; identical to SEQ ID NO: 19216

SEQ ID NO: 219089 - RNA, 64 nt, Human; identical to SEQ ID NO: 19217

SEQ ID NO: 219090 - RNA, 64 nt, Human; identical to SEQ ID NO: 19218

SEQ ID NO: 219091 - RNA, 57 nt, Human; identical to SEQ ID NO: 19219

SEQ ID NO: 219092 - RNA, 64 nt, Human; identical to SEQ ID NO: 19220

SEQ ID NO: 219093 - RNA, 64 nt, Human; identical to SEQ ID NO: 19221

SEQ ID NO: 219094 - RNA, 64 nt, Human; identical to SEQ ID NO: 19222

SEQ ID NO: 219095 - RNA, 64 nt, Human; identical to SEQ ID NO: 19223

SEQ ID NO: 219096 - RNA, 64 nt, Human; identical to SEQ ID NO: 19224

SEQ ID NO: 219097 - RNA, 64 nt, Human; identical to SEQ ID NO: 19225

SEQ ID NO: 219098 - RNA, 64 nt, Human; identical to SEQ ID NO: 19226

SEQ ID NO: 219099 - RNA, 64 nt, Human; identical to SEQ ID NO: 19227

SEQ ID NO: 219100 - RNA, 64 nt, Human; identical to SEQ ID NO: 19228

SEQ ID NO: 219101 - RNA, 64 nt, Human; identical to SEQ ID NO: 19229

SEQ ID NO: 219102 - RNA, 64 nt, Human; identical to SEQ ID NO: 217567

SEQ ID NO: 219103 - RNA, 64 nt, Human; identical to SEQ ID NO: 216330

SEQ ID NO: 219104 - RNA, 64 nt, Human; identical to SEQ ID NO: 215298

SEQ ID NO: 219105 - RNA, 64 nt, Human; identical to SEQ ID NO: 19230

SEQ ID NO: 219106 - RNA, 64 nt, Human; identical to SEQ ID NO: 19231

SEQ ID NO: 219107 - RNA, 64 nt, Human; identical to SEQ ID NO: 19232

SEQ ID NO: 219108 - RNA, 64 nt, Human; identical to SEQ ID NO: 19233

SEQ ID NO: 219109 - RNA, 64 nt, Human; identical to SEQ ID NO: 19234

SEQ ID NO: 219110 - RNA, 64 nt, Human; identical to SEQ ID NO: 19235

SEQ ID NO: 219111 - RNA, 64 nt, Human; identical to SEQ ID NO: 19236

SEQ ID NO: 219112 - RNA, 64 nt, Human; identical to SEQ ID NO: 19237

SEQ ID NO: 219113 - RNA, 64 nt, Human; identical to SEQ ID NO: 19238

SEQ ID NO: 219114 - RNA, 64 nt, Human; identical to SEQ ID NO: 19239

SEQ ID NO: 219115 - RNA, 64 nt, Human; identical to SEQ ID NO: 19240

SEQ ID NO: 219116 - RNA, 64 nt, Human; identical to SEQ ID NO: 19241

SEQ ID NO: 219117 - RNA, 64 nt, Human; identical to SEQ ID NO: 19242

SEQ ID NO: 219118 - RNA, 64 nt, Human; identical to SEQ ID NO: 19243

SEQ ID NO: 219119 - RNA, 64 nt, Human; identical to SEQ ID NO: 19244

SEQ ID NO: 219120 - RNA, 64 nt, Human; identical to SEQ ID NO: 19245

SEQ ID NO: 219121 - RNA, 64 nt, Human; identical to SEQ ID NO: 216775

SEQ ID NO: 219122 - RNA, 64 nt, Human; identical to SEQ ID NO: 217079

SEQ ID NO: 219123 - RNA, 64 nt, Human; identical to SEQ ID NO: 215201

SEQ ID NO: 219124 - RNA, 64 nt, Human; identical to SEQ ID NO: 19246

SEQ ID NO: 219125 - RNA, 64 nt, Human; identical to SEQ ID NO: 19247

SEQ ID NO: 219126 - RNA, 64 nt, Human; identical to SEQ ID NO: 19248

SEQ ID NO: 219127 - RNA, 64 nt, Human; identical to SEQ ID NO: 19249

SEQ ID NO: 219128 - RNA, 50 nt, Human; identical to SEQ ID NO: 19250

SEQ ID NO: 219129 - RNA, 64 nt, Human; identical to SEQ ID NO: 19251

SEQ ID NO: 219130 - RNA, 64 nt, Human; identical to SEQ ID NO: 19252

SEQ ID NO: 219131 - RNA, 64 nt, Human; identical to SEQ ID NO: 19253

SEQ ID NO: 219132 - RNA, 64 nt, Human; identical to SEQ ID NO: 19254

SEQ ID NO: 219133 - RNA, 64 nt, Human; identical to SEQ ID NO: 19255

SEQ ID NO: 219134 - RNA, 64 nt, Human; identical to SEQ ID NO: 19256

SEQ ID NO: 219135 - RNA, 64 nt, Human; identical to SEQ ID NO: 19257

SEQ ID NO: 219136 - RNA, 64 nt, Human; identical to SEQ ID NO: 19258

SEQ ID NO: 219137 - RNA, 64 nt, Human; identical to SEQ ID NO: 19259

SEQ ID NO: 219138 - RNA, 64 nt, Human; identical to SEQ ID NO: 19260

SEQ ID NO: 219139 - RNA, 64 nt, Human; identical to SEQ ID NO: 19261

SEQ ID NO: 219140 - RNA, 64 nt, Human; identical to SEQ ID NO: 215146

SEQ ID NO: 219141 - RNA, 64 nt, Human; identical to SEQ ID NO: 216756

SEQ ID NO: 219142 - RNA, 64 nt, Human; identical to SEQ ID NO: 216811

SEQ ID NO: 219143 - RNA, 64 nt, Human; identical to SEQ ID NO: 19262

SEQ ID NO: 219144 - RNA, 64 nt, Human; identical to SEQ ID NO: 19263

SEQ ID NO: 219145 - RNA, 64 nt, Human; identical to SEQ ID NO: 19264

SEQ ID NO: 219146 - RNA, 64 nt, Human; identical to SEQ ID NO: 19265

SEQ ID NO: 219147 - RNA, 64 nt, Human; identical to SEQ ID NO: 19266

SEQ ID NO: 219148 - RNA, 64 nt, Human; identical to SEQ ID NO: 19267

SEQ ID NO: 219149 - RNA, 64 nt, Human; identical to SEQ ID NO: 19268

SEQ ID NO: 219150 - RNA, 64 nt, Human; identical to SEQ ID NO: 19269

SEQ ID NO: 219151 - RNA, 64 nt, Human; identical to SEQ ID NO: 19270

SEQ ID NO: 219152 - RNA, 64 nt, Human; identical to SEQ ID NO: 19271

SEQ ID NO: 219153 - RNA, 64 nt, Human; identical to SEQ ID NO: 19272

SEQ ID NO: 219154 - RNA, 64 nt, Human; identical to SEQ ID NO: 19273

SEQ ID NO: 219155 - RNA, 64 nt, Human; identical to SEQ ID NO: 19274

SEQ ID NO: 219156 - RNA, 64 nt, Human; identical to SEQ ID NO: 19275

SEQ ID NO: 219157 - RNA, 64 nt, Human; identical to SEQ ID NO: 19276

SEQ ID NO: 219158 - RNA, 64 nt, Human; identical to SEQ ID NO: 19277

SEQ ID NO: 219159 - RNA, 64 nt, Human; identical to SEQ ID NO: 216813

SEQ ID NO: 219160 - RNA, 64 nt, Human; identical to SEQ ID NO: 216830

SEQ ID NO: 219161 - RNA, 64 nt, Human; identical to SEQ ID NO: 215202

SEQ ID NO: 219162 - RNA, 64 nt, Human; identical to SEQ ID NO: 19278

SEQ ID NO: 219163 - RNA, 64 nt, Human; identical to SEQ ID NO: 19279

SEQ ID NO: 219164 - RNA, 64 nt, Human; identical to SEQ ID NO: 19280

SEQ ID NO: 219165 - RNA, 64 nt, Human; identical to SEQ ID NO: 19281

SEQ ID NO: 219166 - RNA, 64 nt, Human; identical to SEQ ID NO: 19282

SEQ ID NO: 219167 - RNA, 64 nt, Human; identical to SEQ ID NO: 19283

SEQ ID NO: 219168 - RNA, 64 nt, Human; identical to SEQ ID NO: 19284

SEQ ID NO: 219169 - RNA, 64 nt, Human; identical to SEQ ID NO: 19285

SEQ ID NO: 219170 - RNA, 64 nt, Human; identical to SEQ ID NO: 19286

SEQ ID NO: 219171 - RNA, 64 nt, Human; identical to SEQ ID NO: 19287

SEQ ID NO: 219172 - RNA, 64 nt, Human; identical to SEQ ID NO: 19288

SEQ ID NO: 219173 - RNA, 64 nt, Human; identical to SEQ ID NO: 19289

SEQ ID NO: 219174 - RNA, 64 nt, Human; identical to SEQ ID NO: 19290

SEQ ID NO: 219175 - RNA, 64 nt, Human; identical to SEQ ID NO: 19291

SEQ ID NO: 219176 - RNA, 64 nt, Human; identical to SEQ ID NO: 19292

SEQ ID NO: 219177 - RNA, 64 nt, Human; identical to SEQ ID NO: 19293

SEQ ID NO: 219178 - RNA, 64 nt, Human; identical to SEQ ID NO: 217060

SEQ ID NO: 219179 - RNA, 64 nt, Human; identical to SEQ ID NO: 216831

SEQ ID NO: 219180 - RNA, 64 nt, Human; identical to SEQ ID NO: 216589

SEQ ID NO: 219181 - RNA, 64 nt, Human; identical to SEQ ID NO: 19294

SEQ ID NO: 219182 - RNA, 64 nt, Human; identical to SEQ ID NO: 19295

SEQ ID NO: 219183 - RNA, 64 nt, Human; identical to SEQ ID NO: 19296

SEQ ID NO: 219184 - RNA, 64 nt, Human; identical to SEQ ID NO: 19297

SEQ ID NO: 219185 - RNA, 64 nt, Human; identical to SEQ ID NO: 19298

SEQ ID NO: 219186 - RNA, 64 nt, Human; identical to SEQ ID NO: 19299

SEQ ID NO: 219187 - RNA, 64 nt, Human; identical to SEQ ID NO: 19300

SEQ ID NO: 219188 - RNA, 64 nt, Human; identical to SEQ ID NO: 19301

SEQ ID NO: 219189 - RNA, 64 nt, Human; identical to SEQ ID NO: 19302

SEQ ID NO: 219190 - RNA, 64 nt, Human; identical to SEQ ID NO: 19303

SEQ ID NO: 219191 - RNA, 64 nt, Human; identical to SEQ ID NO: 19304

SEQ ID NO: 219192 - RNA, 64 nt, Human; identical to SEQ ID NO: 19305

SEQ ID NO: 219193 - RNA, 64 nt, Human; identical to SEQ ID NO: 19306

SEQ ID NO: 219194 - RNA, 64 nt, Human; identical to SEQ ID NO: 19307

SEQ ID NO: 219195 - RNA, 64 nt, Human; identical to SEQ ID NO: 19308

SEQ ID NO: 219196 - RNA, 53 nt, Human; identical to SEQ ID NO: 19309

SEQ ID NO: 219197 - RNA, 64 nt, Human; identical to SEQ ID NO: 216494

SEQ ID NO: 219198 - RNA, 64 nt, Human; identical to SEQ ID NO: 215220

SEQ ID NO: 219199 - RNA, 64 nt, Human; identical to SEQ ID NO: 217002

SEQ ID NO: 219200 - RNA, 64 nt, Human; identical to SEQ ID NO: 19310

SEQ ID NO: 219201 - RNA, 64 nt, Human; identical to SEQ ID NO: 19311

SEQ ID NO: 219202 - RNA, 64 nt, Human; identical to SEQ ID NO: 19312

SEQ ID NO: 219203 - RNA, 64 nt, Human; identical to SEQ ID NO: 19313

SEQ ID NO: 219204 - RNA, 64 nt, Human; identical to SEQ ID NO: 19314

SEQ ID NO: 219205 - RNA, 64 nt, Human; identical to SEQ ID NO: 19315

SEQ ID NO: 219206 - RNA, 64 nt, Human; identical to SEQ ID NO: 19316

SEQ ID NO: 219207 - RNA, 64 nt, Human; identical to SEQ ID NO: 19317

SEQ ID NO: 219208 - RNA, 64 nt, Human; identical to SEQ ID NO: 19318

SEQ ID NO: 219209 - RNA, 64 nt, Human; identical to SEQ ID NO: 19319

SEQ ID NO: 219210 - RNA, 64 nt, Human; identical to SEQ ID NO: 19320

SEQ ID NO: 219211 - RNA, 64 nt, Human; identical to SEQ ID NO: 19321

SEQ ID NO: 219212 - RNA, 56 nt, Human; identical to SEQ ID NO: 19322

SEQ ID NO: 219213 - RNA, 64 nt, Human; identical to SEQ ID NO: 19323

SEQ ID NO: 219214 - RNA, 64 nt, Human; identical to SEQ ID NO: 19324

SEQ ID NO: 219215 - RNA, 64 nt, Human; identical to SEQ ID NO: 19325

SEQ ID NO: 219216 - RNA, 64 nt, Human; identical to SEQ ID NO: 217021

SEQ ID NO: 219217 - RNA, 64 nt, Human; identical to SEQ ID NO: 215145

SEQ ID NO: 219218 - RNA, 64 nt, Human; identical to SEQ ID NO: 216773

SEQ ID NO: 219219 - RNA, 64 nt, Human; identical to SEQ ID NO: 19326

SEQ ID NO: 219220 - RNA, 64 nt, Human; identical to SEQ ID NO: 19327

SEQ ID NO: 219221 - RNA, 64 nt, Human; identical to SEQ ID NO: 19328

SEQ ID NO: 219222 - RNA, 64 nt, Human; identical to SEQ ID NO: 19329

SEQ ID NO: 219223 - RNA, 64 nt, Human; identical to SEQ ID NO: 19330

SEQ ID NO: 219224 - RNA, 64 nt, Human; identical to SEQ ID NO: 19331

SEQ ID NO: 219225 - RNA, 64 nt, Human; identical to SEQ ID NO: 19332

SEQ ID NO: 219226 - RNA, 64 nt, Human; identical to SEQ ID NO: 19333

SEQ ID NO: 219227 - RNA, 64 nt, Human; identical to SEQ ID NO: 19334

SEQ ID NO: 219228 - RNA, 64 nt, Human; identical to SEQ ID NO: 19335

SEQ ID NO: 219229 - RNA, 64 nt, Human; identical to SEQ ID NO: 19336

SEQ ID NO: 219230 - RNA, 64 nt, Human; identical to SEQ ID NO: 19337

SEQ ID NO: 219231 - RNA, 64 nt, Human; identical to SEQ ID NO: 19338

SEQ ID NO: 219232 - RNA, 64 nt, Human; identical to SEQ ID NO: 19339

SEQ ID NO: 219233 - RNA, 64 nt, Human; identical to SEQ ID NO: 19340

SEQ ID NO: 219234 - RNA, 64 nt, Human; identical to SEQ ID NO: 19341

SEQ ID NO: 219235 - RNA, 64 nt, Human; identical to SEQ ID NO: 216551

SEQ ID NO: 219236 - RNA, 64 nt, Human; identical to SEQ ID NO: 216217

SEQ ID NO: 219237 - RNA, 64 nt, Human; identical to SEQ ID NO: 216349

SEQ ID NO: 219238 - RNA, 64 nt, Human; identical to SEQ ID NO: 19342

SEQ ID NO: 219239 - RNA, 64 nt, Human; identical to SEQ ID NO: 19343

SEQ ID NO: 219240 - RNA, 64 nt, Human; identical to SEQ ID NO: 19344

SEQ ID NO: 219241 - RNA, 64 nt, Human; identical to SEQ ID NO: 19345

SEQ ID NO: 219242 - RNA, 64 nt, Human; identical to SEQ ID NO: 19346

SEQ ID NO: 219243 - RNA, 64 nt, Human; identical to SEQ ID NO: 19347

SEQ ID NO: 219244 - RNA, 64 nt, Human; identical to SEQ ID NO: 19348

SEQ ID NO: 219245 - RNA, 64 nt, Human; identical to SEQ ID NO: 19349

SEQ ID NO: 219246 - RNA, 64 nt, Human; identical to SEQ ID NO: 19350

SEQ ID NO: 219247 - RNA, 64 nt, Human; identical to SEQ ID NO: 19351

SEQ ID NO: 219248 - RNA, 64 nt, Human; identical to SEQ ID NO: 19352

SEQ ID NO: 219249 - RNA, 64 nt, Human; identical to SEQ ID NO: 19353

SEQ ID NO: 219250 - RNA, 64 nt, Human; identical to SEQ ID NO: 19354

SEQ ID NO: 219251 - RNA, 64 nt, Human; identical to SEQ ID NO: 19355

SEQ ID NO: 219252 - RNA, 64 nt, Human; identical to SEQ ID NO: 19356

SEQ ID NO: 219253 - RNA, 64 nt, Human; identical to SEQ ID NO: 19357

SEQ ID NO: 219254 - RNA, 64 nt, Human; identical to SEQ ID NO: 216906

SEQ ID NO: 219255 - RNA, 64 nt, Human; identical to SEQ ID NO: 215089

SEQ ID NO: 219256 - RNA, 64 nt, Human; identical to SEQ ID NO: 216907

SEQ ID NO: 219257 - RNA, 64 nt, Human; identical to SEQ ID NO: 19358

SEQ ID NO: 219258 - RNA, 64 nt, Human; identical to SEQ ID NO: 19359

SEQ ID NO: 219259 - RNA, 64 nt, Human; identical to SEQ ID NO: 19360

SEQ ID NO: 219260 - RNA, 64 nt, Human; identical to SEQ ID NO: 19361

SEQ ID NO: 219261 - RNA, 64 nt, Human; identical to SEQ ID NO: 19362

SEQ ID NO: 219262 - RNA, 64 nt, Human; identical to SEQ ID NO: 19363

SEQ ID NO: 219263 - RNA, 64 nt, Human; identical to SEQ ID NO: 19364

SEQ ID NO: 219264 - RNA, 64 nt, Human; identical to SEQ ID NO: 19365

SEQ ID NO: 219265 - RNA, 64 nt, Human; identical to SEQ ID NO: 19366

SEQ ID NO: 219266 - RNA, 64 nt, Human; identical to SEQ ID NO: 19367

SEQ ID NO: 219267 - RNA, 58 nt, Human; identical to SEQ ID NO: 19368

SEQ ID NO: 219268 - RNA, 64 nt, Human; identical to SEQ ID NO: 19369

SEQ ID NO: 219269 - RNA, 64 nt, Human; identical to SEQ ID NO: 19370

SEQ ID NO: 219270 - RNA, 64 nt, Human; identical to SEQ ID NO: 19371

SEQ ID NO: 219271 - RNA, 64 nt, Human; identical to SEQ ID NO: 19372

SEQ ID NO: 219272 - RNA, 64 nt, Human; identical to SEQ ID NO: 19373

SEQ ID NO: 219273 - RNA, 64 nt, Human; identical to SEQ ID NO: 215221

SEQ ID NO: 219274 - RNA, 64 nt, Human; identical to SEQ ID NO: 217097

SEQ ID NO: 219275 - RNA, 64 nt, Human; identical to SEQ ID NO: 217098

SEQ ID NO: 219276 - RNA, 64 nt, Human; identical to SEQ ID NO: 19374

SEQ ID NO: 219277 - RNA, 64 nt, Human; identical to SEQ ID NO: 19375

SEQ ID NO: 219278 - RNA, 64 nt, Human; identical to SEQ ID NO: 19376

SEQ ID NO: 219279 - RNA, 64 nt, Human; identical to SEQ ID NO: 19377

SEQ ID NO: 219280 - RNA, 64 nt, Human; identical to SEQ ID NO: 19378

SEQ ID NO: 219281 - RNA, 64 nt, Human; identical to SEQ ID NO: 19379

SEQ ID NO: 219282 - RNA, 64 nt, Human; identical to SEQ ID NO: 19380

SEQ ID NO: 219283 - RNA, 64 nt, Human; identical to SEQ ID NO: 19381

SEQ ID NO: 219284 - RNA, 62 nt, Human; identical to SEQ ID NO: 19382

SEQ ID NO: 219285 - RNA, 64 nt, Human; identical to SEQ ID NO: 19383

SEQ ID NO: 219286 - RNA, 64 nt, Human; identical to SEQ ID NO: 19384

SEQ ID NO: 219287 - RNA, 64 nt, Human; identical to SEQ ID NO: 19385

SEQ ID NO: 219288 - RNA, 64 nt, Human; identical to SEQ ID NO: 19386

SEQ ID NO: 219289 - RNA, 64 nt, Human; identical to SEQ ID NO: 19387

SEQ ID NO: 219290 - RNA, 64 nt, Human; identical to SEQ ID NO: 19388

SEQ ID NO: 219291 - RNA, 64 nt, Human; identical to SEQ ID NO: 19389

SEQ ID NO: 219292 - RNA, 64 nt, Human; identical to SEQ ID NO: 215106

SEQ ID NO: 219293 - RNA, 64 nt, Human; identical to SEQ ID NO: 216944

SEQ ID NO: 219294 - RNA, 64 nt, Human; identical to SEQ ID NO: 216945

SEQ ID NO: 219295 - RNA, 64 nt, Human; identical to SEQ ID NO: 19390

SEQ ID NO: 219296 - RNA, 64 nt, Human; identical to SEQ ID NO: 19391

SEQ ID NO: 219297 - RNA, 64 nt, Human; identical to SEQ ID NO: 19392

SEQ ID NO: 219298 - RNA, 64 nt, Human; identical to SEQ ID NO: 19393

SEQ ID NO: 219299 - RNA, 64 nt, Human; identical to SEQ ID NO: 19394

SEQ ID NO: 219300 - RNA, 64 nt, Human; identical to SEQ ID NO: 19395

SEQ ID NO: 219301 - RNA, 64 nt, Human; identical to SEQ ID NO: 19396

SEQ ID NO: 219302 - RNA, 64 nt, Human; identical to SEQ ID NO: 19397

SEQ ID NO: 219303 - RNA, 64 nt, Human; identical to SEQ ID NO: 19398

SEQ ID NO: 219304 - RNA, 64 nt, Human; identical to SEQ ID NO: 19399

SEQ ID NO: 219305 - RNA, 64 nt, Human; identical to SEQ ID NO: 19400

SEQ ID NO: 219306 - RNA, 64 nt, Human; identical to SEQ ID NO: 19401

SEQ ID NO: 219307 - RNA, 64 nt, Human; identical to SEQ ID NO: 19402

SEQ ID NO: 219308 - RNA, 64 nt, Human; identical to SEQ ID NO: 19403

SEQ ID NO: 219309 - RNA, 64 nt, Human; identical to SEQ ID NO: 19404

SEQ ID NO: 219310 - RNA, 64 nt, Human; identical to SEQ ID NO: 19405

SEQ ID NO: 219311 - RNA, 64 nt, Human; identical to SEQ ID NO: 215107

SEQ ID NO: 219312 - RNA, 64 nt, Human; identical to SEQ ID NO: 216963

SEQ ID NO: 219313 - RNA, 64 nt, Human; identical to SEQ ID NO: 216964

SEQ ID NO: 219314 - RNA, 64 nt, Human; identical to SEQ ID NO: 19406

SEQ ID NO: 219315 - RNA, 64 nt, Human; identical to SEQ ID NO: 19407

SEQ ID NO: 219316 - RNA, 64 nt, Human; identical to SEQ ID NO: 19408

SEQ ID NO: 219317 - RNA, 64 nt, Human; identical to SEQ ID NO: 19409

SEQ ID NO: 219318 - RNA, 64 nt, Human; identical to SEQ ID NO: 19410

SEQ ID NO: 219319 - RNA, 64 nt, Human; identical to SEQ ID NO: 19411

SEQ ID NO: 219320 - RNA, 64 nt, Human; identical to SEQ ID NO: 19412

SEQ ID NO: 219321 - RNA, 64 nt, Human; identical to SEQ ID NO: 19413

SEQ ID NO: 219322 - RNA, 64 nt, Human; identical to SEQ ID NO: 19414

SEQ ID NO: 219323 - RNA, 64 nt, Human; identical to SEQ ID NO: 19415

SEQ ID NO: 219324 - RNA, 64 nt, Human; identical to SEQ ID NO: 19416

SEQ ID NO: 219325 - RNA, 64 nt, Human; identical to SEQ ID NO: 19417

SEQ ID NO: 219326 - RNA, 64 nt, Human; identical to SEQ ID NO: 19418

SEQ ID NO: 219327 - RNA, 64 nt, Human; identical to SEQ ID NO: 19419

SEQ ID NO: 219328 - RNA, 64 nt, Human; identical to SEQ ID NO: 19420

SEQ ID NO: 219329 - RNA, 64 nt, Human; identical to SEQ ID NO: 19421

SEQ ID NO: 219330 - RNA, 64 nt, Human; identical to SEQ ID NO: 216888

SEQ ID NO: 219331 - RNA, 64 nt, Human; identical to SEQ ID NO: 216908

SEQ ID NO: 219332 - RNA, 64 nt, Human; identical to SEQ ID NO: 215108

SEQ ID NO: 219333 - RNA, 64 nt, Human; identical to SEQ ID NO: 19422

SEQ ID NO: 219334 - RNA, 64 nt, Human; identical to SEQ ID NO: 19423

SEQ ID NO: 219335 - RNA, 64 nt, Human; identical to SEQ ID NO: 19424

SEQ ID NO: 219336 - RNA, 64 nt, Human; identical to SEQ ID NO: 19425

SEQ ID NO: 219337 - RNA, 64 nt, Human; identical to SEQ ID NO: 19426

SEQ ID NO: 219338 - RNA, 64 nt, Human; identical to SEQ ID NO: 19427

SEQ ID NO: 219339 - RNA, 64 nt, Human; identical to SEQ ID NO: 19428

SEQ ID NO: 219340 - RNA, 64 nt, Human; identical to SEQ ID NO: 19429

SEQ ID NO: 219341 - RNA, 64 nt, Human; identical to SEQ ID NO: 19430

SEQ ID NO: 219342 - RNA, 64 nt, Human; identical to SEQ ID NO: 19431

SEQ ID NO: 219343 - RNA, 64 nt, Human; identical to SEQ ID NO: 19432

SEQ ID NO: 219344 - RNA, 64 nt, Human; identical to SEQ ID NO: 19433

SEQ ID NO: 219345 - RNA, 64 nt, Human; identical to SEQ ID NO: 19434

SEQ ID NO: 219346 - RNA, 64 nt, Human; identical to SEQ ID NO: 19435

SEQ ID NO: 219347 - RNA, 64 nt, Human; identical to SEQ ID NO: 19436

SEQ ID NO: 219348 - RNA, 64 nt, Human; identical to SEQ ID NO: 19437

SEQ ID NO: 219349 - RNA, 64 nt, Human; identical to SEQ ID NO: 217491

SEQ ID NO: 219350 - RNA, 64 nt, Human; identical to SEQ ID NO: 215125

SEQ ID NO: 219351 - RNA, 64 nt, Human; identical to SEQ ID NO: 217020

SEQ ID NO: 219352 - RNA, 59 nt, Human; identical to SEQ ID NO: 19438

SEQ ID NO: 219353 - RNA, 64 nt, Human; identical to SEQ ID NO: 19439

SEQ ID NO: 219354 - RNA, 64 nt, Human; identical to SEQ ID NO: 19440

SEQ ID NO: 219355 - RNA, 64 nt, Human; identical to SEQ ID NO: 19441

SEQ ID NO: 219356 - RNA, 64 nt, Human; identical to SEQ ID NO: 19442

SEQ ID NO: 219357 - RNA, 64 nt, Human; identical to SEQ ID NO: 19443

SEQ ID NO: 219358 - RNA, 64 nt, Human; identical to SEQ ID NO: 19444

SEQ ID NO: 219359 - RNA, 64 nt, Human; identical to SEQ ID NO: 19445

SEQ ID NO: 219360 - RNA, 64 nt, Human; identical to SEQ ID NO: 19446

SEQ ID NO: 219361 - RNA, 64 nt, Human; identical to SEQ ID NO: 19447

SEQ ID NO: 219362 - RNA, 64 nt, Human; identical to SEQ ID NO: 19448

SEQ ID NO: 219363 - RNA, 64 nt, Human; identical to SEQ ID NO: 19449

SEQ ID NO: 219364 - RNA, 64 nt, Human; identical to SEQ ID NO: 19450

SEQ ID NO: 219365 - RNA, 64 nt, Human; identical to SEQ ID NO: 19451

SEQ ID NO: 219366 - RNA, 64 nt, Human; identical to SEQ ID NO: 19452

SEQ ID NO: 219367 - RNA, 64 nt, Human; identical to SEQ ID NO: 19453

SEQ ID NO: 219368 - RNA, 64 nt, Human; identical to SEQ ID NO: 216946

SEQ ID NO: 219369 - RNA, 64 nt, Human; identical to SEQ ID NO: 216793

SEQ ID NO: 219370 - RNA, 64 nt, Human; identical to SEQ ID NO: 217566

SEQ ID NO: 219371 - RNA, 64 nt, Human; identical to SEQ ID NO: 19454

SEQ ID NO: 219372 - RNA, 64 nt, Human; identical to SEQ ID NO: 19455

SEQ ID NO: 219373 - RNA, 64 nt, Human; identical to SEQ ID NO: 19456

SEQ ID NO: 219374 - RNA, 64 nt, Human; identical to SEQ ID NO: 19457

SEQ ID NO: 219375 - RNA, 64 nt, Human; identical to SEQ ID NO: 19458

SEQ ID NO: 219376 - RNA, 64 nt, Human; identical to SEQ ID NO: 19459

SEQ ID NO: 219377 - RNA, 64 nt, Human; identical to SEQ ID NO: 19460

SEQ ID NO: 219378 - RNA, 64 nt, Human; identical to SEQ ID NO: 19461

SEQ ID NO: 219379 - RNA, 64 nt, Human; identical to SEQ ID NO: 19462

SEQ ID NO: 219380 - RNA, 64 nt, Human; identical to SEQ ID NO: 19463

SEQ ID NO: 219381 - RNA, 64 nt, Human; identical to SEQ ID NO: 19464

SEQ ID NO: 219382 - RNA, 64 nt, Human; identical to SEQ ID NO: 19465

SEQ ID NO: 219383 - RNA, 64 nt, Human; identical to SEQ ID NO: 19466

SEQ ID NO: 219384 - RNA, 64 nt, Human; identical to SEQ ID NO: 19467

SEQ ID NO: 219385 - RNA, 64 nt, Human; identical to SEQ ID NO: 19468

SEQ ID NO: 219386 - RNA, 64 nt, Human; identical to SEQ ID NO: 19469

SEQ ID NO: 219387 - RNA, 64 nt, Human; identical to SEQ ID NO: 217344

SEQ ID NO: 219388 - RNA, 64 nt, Human; identical to SEQ ID NO: 216926

SEQ ID NO: 219389 - RNA, 64 nt, Human; identical to SEQ ID NO: 215126

SEQ ID NO: 219390 - RNA, 64 nt, Human; identical to SEQ ID NO: 19470

SEQ ID NO: 219391 - RNA, 64 nt, Human; identical to SEQ ID NO: 19471

SEQ ID NO: 219392 - RNA, 64 nt, Human; identical to SEQ ID NO: 19472

SEQ ID NO: 219393 - RNA, 64 nt, Human; identical to SEQ ID NO: 19473

SEQ ID NO: 219394 - RNA, 64 nt, Human; identical to SEQ ID NO: 19474

SEQ ID NO: 219395 - RNA, 64 nt, Human; identical to SEQ ID NO: 19475

SEQ ID NO: 219396 - RNA, 64 nt, Human; identical to SEQ ID NO: 19476

SEQ ID NO: 219397 - RNA, 64 nt, Human; identical to SEQ ID NO: 19477

SEQ ID NO: 219398 - RNA, 64 nt, Human; identical to SEQ ID NO: 19478

SEQ ID NO: 219399 - RNA, 64 nt, Human; identical to SEQ ID NO: 19479

SEQ ID NO: 219400 - RNA, 64 nt, Human; identical to SEQ ID NO: 19480

SEQ ID NO: 219401 - RNA, 64 nt, Human; identical to SEQ ID NO: 19481

SEQ ID NO: 219402 - RNA, 64 nt, Human; identical to SEQ ID NO: 19482

SEQ ID NO: 219403 - RNA, 64 nt, Human; identical to SEQ ID NO: 19483

SEQ ID NO: 219404 - RNA, 64 nt, Human; identical to SEQ ID NO: 19484

SEQ ID NO: 219405 - RNA, 64 nt, Human; identical to SEQ ID NO: 19485

SEQ ID NO: 219406 - RNA, 64 nt, Human; identical to SEQ ID NO: 217041

SEQ ID NO: 219407 - RNA, 64 nt, Human; identical to SEQ ID NO: 217420

SEQ ID NO: 219408 - RNA, 64 nt, Human; identical to SEQ ID NO: 215127

SEQ ID NO: 219409 - RNA, 64 nt, Human; identical to SEQ ID NO: 19486

SEQ ID NO: 219410 - RNA, 64 nt, Human; identical to SEQ ID NO: 19487

SEQ ID NO: 219411 - RNA, 64 nt, Human; identical to SEQ ID NO: 19488

SEQ ID NO: 219412 - RNA, 64 nt, Human; identical to SEQ ID NO: 19489

SEQ ID NO: 219413 - RNA, 64 nt, Human; identical to SEQ ID NO: 19490

SEQ ID NO: 219414 - RNA, 64 nt, Human; identical to SEQ ID NO: 19491

SEQ ID NO: 219415 - RNA, 64 nt, Human; identical to SEQ ID NO: 19492

SEQ ID NO: 219416 - RNA, 64 nt, Human; identical to SEQ ID NO: 19493

SEQ ID NO: 219417 - RNA, 64 nt, Human; identical to SEQ ID NO: 19494

SEQ ID NO: 219418 - RNA, 64 nt, Human; identical to SEQ ID NO: 19495

SEQ ID NO: 219419 - RNA, 64 nt, Human; identical to SEQ ID NO: 19496

SEQ ID NO: 219420 - RNA, 64 nt, Human; identical to SEQ ID NO: 19497

SEQ ID NO: 219421 - RNA, 64 nt, Human; identical to SEQ ID NO: 19498

SEQ ID NO: 219422 - RNA, 64 nt, Human; identical to SEQ ID NO: 19499

SEQ ID NO: 219423 - RNA, 64 nt, Human; identical to SEQ ID NO: 19500

SEQ ID NO: 219424 - RNA, 64 nt, Human; identical to SEQ ID NO: 19501

SEQ ID NO: 219425 - RNA, 64 nt, Human; identical to SEQ ID NO: 216965

SEQ ID NO: 219426 - RNA, 64 nt, Human; identical to SEQ ID NO: 215144

SEQ ID NO: 219427 - RNA, 64 nt, Human; identical to SEQ ID NO: 217115

SEQ ID NO: 219428 - RNA, 64 nt, Human; identical to SEQ ID NO: 19502

SEQ ID NO: 219429 - RNA, 64 nt, Human; identical to SEQ ID NO: 19503

SEQ ID NO: 219430 - RNA, 64 nt, Human; identical to SEQ ID NO: 19504

SEQ ID NO: 219431 - RNA, 64 nt, Human; identical to SEQ ID NO: 19505

SEQ ID NO: 219432 - RNA, 64 nt, Human; identical to SEQ ID NO: 19506

SEQ ID NO: 219433 - RNA, 64 nt, Human; identical to SEQ ID NO: 19507

SEQ ID NO: 219434 - RNA, 64 nt, Human; identical to SEQ ID NO: 19508

SEQ ID NO: 219435 - RNA, 64 nt, Human; identical to SEQ ID NO: 19509

SEQ ID NO: 219436 - RNA, 64 nt, Human; identical to SEQ ID NO: 19510

SEQ ID NO: 219437 - RNA, 64 nt, Human; identical to SEQ ID NO: 19511

SEQ ID NO: 219438 - RNA, 64 nt, Human; identical to SEQ ID NO: 19512

SEQ ID NO: 219439 - RNA, 64 nt, Human; identical to SEQ ID NO: 19513

SEQ ID NO: 219440 - RNA, 64 nt, Human; identical to SEQ ID NO: 19514

SEQ ID NO: 219441 - RNA, 64 nt, Human; identical to SEQ ID NO: 19515

SEQ ID NO: 219442 - RNA, 64 nt, Human; identical to SEQ ID NO: 19516

SEQ ID NO: 219443 - RNA, 64 nt, Human; identical to SEQ ID NO: 19517

SEQ ID NO: 219444 - RNA, 64 nt, Human; identical to SEQ ID NO: 215069

SEQ ID NO: 219445 - RNA, 64 nt, Human; identical to SEQ ID NO: 217039

SEQ ID NO: 219446 - RNA, 64 nt, Human; identical to SEQ ID NO: 217192

SEQ ID NO: 219447 - RNA, 64 nt, Human; identical to SEQ ID NO: 19518

SEQ ID NO: 219448 - RNA, 64 nt, Human; identical to SEQ ID NO: 19519

SEQ ID NO: 219449 - RNA, 64 nt, Human; identical to SEQ ID NO: 19520

SEQ ID NO: 219450 - RNA, 64 nt, Human; identical to SEQ ID NO: 19521

SEQ ID NO: 219451 - RNA, 64 nt, Human; identical to SEQ ID NO: 19522

SEQ ID NO: 219452 - RNA, 64 nt, Human; identical to SEQ ID NO: 19523

SEQ ID NO: 219453 - RNA, 64 nt, Human; identical to SEQ ID NO: 19524

SEQ ID NO: 219454 - RNA, 64 nt, Human; identical to SEQ ID NO: 19525

SEQ ID NO: 219455 - RNA, 64 nt, Human; identical to SEQ ID NO: 19526

SEQ ID NO: 219456 - RNA, 64 nt, Human; identical to SEQ ID NO: 19527

SEQ ID NO: 219457 - RNA, 64 nt, Human; identical to SEQ ID NO: 19528

SEQ ID NO: 219458 - RNA, 64 nt, Human; identical to SEQ ID NO: 19529

SEQ ID NO: 219459 - RNA, 64 nt, Human; identical to SEQ ID NO: 19530

SEQ ID NO: 219460 - RNA, 64 nt, Human; identical to SEQ ID NO: 19531

SEQ ID NO: 219461 - RNA, 64 nt, Human; identical to SEQ ID NO: 19532

SEQ ID NO: 219462 - RNA, 64 nt, Human; identical to SEQ ID NO: 19533

SEQ ID NO: 219463 - RNA, 64 nt, Human; identical to SEQ ID NO: 215239

SEQ ID NO: 219464 - RNA, 64 nt, Human; identical to SEQ ID NO: 216437

SEQ ID NO: 219465 - RNA, 64 nt, Human; identical to SEQ ID NO: 216438

SEQ ID NO: 219466 - RNA, 64 nt, Human; identical to SEQ ID NO: 19534

SEQ ID NO: 219467 - RNA, 64 nt, Human; identical to SEQ ID NO: 19535

SEQ ID NO: 219468 - RNA, 64 nt, Human; identical to SEQ ID NO: 19536

SEQ ID NO: 219469 - RNA, 64 nt, Human; identical to SEQ ID NO: 19537

SEQ ID NO: 219470 - RNA, 64 nt, Human; identical to SEQ ID NO: 19538

SEQ ID NO: 219471 - RNA, 64 nt, Human; identical to SEQ ID NO: 19539

SEQ ID NO: 219472 - RNA, 64 nt, Human; identical to SEQ ID NO: 19540

SEQ ID NO: 219473 - RNA, 64 nt, Human; identical to SEQ ID NO: 19541

SEQ ID NO: 219474 - RNA, 64 nt, Human; identical to SEQ ID NO: 19542

SEQ ID NO: 219475 - RNA, 64 nt, Human; identical to SEQ ID NO: 19543

SEQ ID NO: 219476 - RNA, 64 nt, Human; identical to SEQ ID NO: 217230

SEQ ID NO: 219477 - RNA, 64 nt, Human; identical to SEQ ID NO: 217116

SEQ ID NO: 219478 - RNA, 64 nt, Human; identical to SEQ ID NO: 217001

SEQ ID NO: 219479 - RNA, 64 nt, Human
cuccccagcggcccagggugggccagaccagcagcccaggaagcagcacacgcggccgugggga

SEQ ID NO: 219480 - RNA, 64 nt, Human
caagguccggcccauccccaggcaccucacaggccccaggaaaggcccagccaccgaagccgcc

SEQ ID NO: 219481 - RNA, 64 nt, Human
gccuuccugaccaacagccagcucuguccuuccccccaggaaacacauguucauuugugugauc

SEQ ID NO: 219482 - RNA, 64 nt, Human
ccugcacuccuccagcuggagucucaccgcggaucccaggaauaccugcuguucccacagggcu

SEQ ID NO: 219483 - RNA, 64 nt, Human
gaaugcaccugacuuaugaaauggggauaauacucccaggaaauagcgcaggacaucacaagga

SEQ ID NO: 219484 - RNA, 64 nt, Human
uggccucuggauccuccguggaccgaaccguccccccaggaacacaccuucagguagaccccga

SEQ ID NO: 219485 - RNA, 64 nt, Human
cuugcucacucacucacuccaagaccaccagggucccaggaagccggugccuggguggccaucc

SEQ ID NO: 219486 - RNA, 64 nt, Human
cucacaccuccuuuucuucuagcuuuguuguccucccaggaaccaaaaaaccccagcuauuuuc

SEQ ID NO: 219487 - RNA, 64 nt, Human
cagcuugggaaugauggcugccaacucccaaucucccaggaaggcagggggcagaaucuuuuuu

SEQ ID NO: 219488 - RNA, 64 nt, Human
gauaagaucaacaggucccccccacaugaggccacccaggaaaaaaggcaggggcaguggcauc

SEQ ID NO: 219489 - RNA, 64 nt, Human
acugcuagcagggcuucaaccaggaagggaucaacccaggaagggaugaucaggagaggcuucc

SEQ ID NO: 219490 - RNA, 64 nt, Human
guggauucauugccacacucuuuucucccagggacccaggaaacuaggacuuuguguguuugcu

SEQ ID NO: 219491 - RNA, 64 nt, Human; identical to SEQ ID NO: 216984

SEQ ID NO: 219492 - RNA, 64 nt, Human; identical to SEQ ID NO: 216849

SEQ ID NO: 219493 - RNA, 64 nt, Human; identical to SEQ ID NO: 215163

SEQ ID NO: 219494 - RNA, 64 nt, Human
acuuugggaggccaaggugggaagaucacuugaucccaggaauucuagaucagcuuggacaaug

SEQ ID NO: 219495 - RNA, 64 nt, Human
agaggcagauaacgcugaagcaggccucucaugacccaggaaggccgggguggaucccucuuug

SEQ ID NO: 219496 - RNA, 64 nt, Human
aaagggugugccucguccugcccgcacugccucucccaggaacuggaaaagcccuguccgguga

SEQ ID NO: 219497 - RNA, 64 nt, Human
uggaacaggggucccuggaguucacaggcuuauccccaggaagccucacuccuggggaaagaca

SEQ ID NO: 219498 - RNA, 64 nt, Human
gcaagaugaccuugcugccuggggccugcucucucccaggaauucucaugugggauuccccuug

SEQ ID NO: 219499 - RNA, 64 nt, Human
gauauuauuuucagugcucagcugaaauaccaaccccaggaauaagaacuccauuucaaacagu

SEQ ID NO: 219500 - RNA, 64 nt, Human
caacacuggggcuuuuguuugggguccuuuuauccccaggaaucaauaauuuuuuugccuaggu

SEQ ID NO: 219501 - RNA, 64 nt, Human
ugggcauggguggauuuagccaaggaccuggcaacccaggaaacaugauguuuuaagcugcuaa

SEQ ID NO: 219502 - RNA, 64 nt, Human
agugauccagccccaccaaggggccuccagagaccccaggaacaauaagugucuccucccacca

SEQ ID NO: 219503 - RNA, 64 nt, Human
auaaaucugcgagguaguuucuuugguauucuugcccaggaaauggguugauucaucacagauu

SEQ ID NO: 219504 - RNA, 64 nt, Human
ugaagcacuucgucuuacccauuuauguaggggccccaggaaaccuacacacagccagaaugag

SEQ ID NO: 219505 - RNA, 64 nt, Human
uccugcuucccuuaccagucgugcaccgcugacucccaggaagucuuuccugaagucugaccac

SEQ ID NO: 219506 - RNA, 64 nt, Human
agguacaggauaucaccugaauuauuaaugaaugcccaggaaguaauuuucuucucauucuucu

SEQ ID NO: 219507 - RNA, 64 nt, Human
cuucugccuccauauauccugaacaucaaacuaucccaggaaaaccaucuagaguaguuuguuu

SEQ ID NO: 219508 - RNA, 64 nt, Human
guucaacuuccucuguaaauauccaaguauaaagcccaggaacuucuagaauaacccagaugcg

SEQ ID NO: 219509 - RNA, 64 nt, Human; identical to SEQ ID NO: 217229

SEQ ID NO: 219510 - RNA, 64 nt, Human; identical to SEQ ID NO: 215030

SEQ ID NO: 219511 - RNA, 64 nt, Human; identical to SEQ ID NO: 217134

SEQ ID NO: 219512 - RNA, 64 nt, Human
acaaaguguguuuccacuuggagcaccauuuugacccaggaauuuuucauaguuucuguauucu

SEQ ID NO: 219513 - RNA, 64 nt, Human
agccaaucccaaggauggaggcugugcccagagccccaggaaaaugggagugagaagaugccug

SEQ ID NO: 219514 - RNA, 64 nt, Human
gaaaaggcagacuaaggccuccuuucucugaccucccaggaagaaaauagcuucuccuacagug

SEQ ID NO: 219515 - RNA, 64 nt, Human
agccaaggagaagugggagacguuuggcuagcaccccaggaagaugugagagggagcaagcaag

SEQ ID NO: 219516 - RNA, 64 nt, Human
agcugaggucaguuucaggagggugaagcugauccccaggaauggaucagcugccaugggcaca

SEQ ID NO: 219517 - RNA, 64 nt, Human
cccacgaaggguuuuuagccagggaaaacugagccccaggaaaaccuaaccacugggcaggcag

SEQ ID NO: 219518 - RNA, 64 nt, Human
ccagagaugagacucuuagaaucaaaguguucagcccaggaagucuuggagaucccaccuucug

SEQ ID NO: 219519 - RNA, 64 nt, Human
ccaugacauaagugcuauugcagagccguggccacccaggaacuccugacugcuuuccuucccc

SEQ ID NO: 219520 - RNA, 64 nt, Human
cagcgacccacacauuccucacguagcuucugcucccaggaagguaguuuaaauccuguauaua

SEQ ID NO: 219521 - RNA, 64 nt, Human
gcucccuucuccucugccugguuagacucgggcacccaggaaagccuggccagggcuccuuugg

SEQ ID NO: 219522 - RNA, 64 nt, Human
agagaagaugagucuauggcaucagguucuuaaacccaggaaagcaccuacagaccggcuccuc

SEQ ID NO: 219523 - RNA, 64 nt, Human
uaaccaaagagucucuggcucagcuguggucccacccaggaagggagggagcugaggccucccu

SEQ ID NO: 219524 - RNA, 64 nt, Human
agagcucccuguugcccuccuuuucccguuuagucccaggaacaaaaaagggcauuuuggguac

SEQ ID NO: 219525 - RNA, 64 nt, Human
aaaccagagcagugagggcgggcggggcauuucacccaggaauauugagaaugagggccuggag

SEQ ID NO: 219526 - RNA, 64 nt, Human
gguggagacuggaggugguggggcuugaaaugagcccaggaaaccagagcagugagggcgggcg

SEQ ID NO: 219527 - RNA, 64 nt, Human; identical to SEQ ID NO: 217249

SEQ ID NO: 219528 - RNA, 64 nt, Human; identical to SEQ ID NO: 215031

SEQ ID NO: 219529 - RNA, 64 nt, Human; identical to SEQ ID NO: 217153

SEQ ID NO: 219530 - RNA, 64 nt, Human
uuauccagcaaugccucaaggauguugcauugcucccaggaacuggcuauuagguaugucuugu

SEQ ID NO: 219531 - RNA, 64 nt, Human
agcacugaguggugauacccagaccagcagucaccccaggaagugggggcuacccauacccuca

SEQ ID NO: 219532 - RNA, 64 nt, Human
acuuuggaaggcugaggcagaaggaucacuugagcccaggaauuugagguuguaguaagcuacg

SEQ ID NO: 219533 - RNA, 64 nt, Human
uacuagggaggcugagacacacgaaucccuugagcccaggaagcagagguugcagugagccucg

SEQ ID NO: 219534 - RNA, 64 nt, Human
ggcaaaucuuuucaccucuggcuauuccugagaccccaggaagucaggaaaagccuuucagcuc

SEQ ID NO: 219535 - RNA, 64 nt, Human
cuugcugcgugcccaccaggauuuccugugagggcccaggaaugagcaaggcauggucugccac

SEQ ID NO: 219536 - RNA, 64 nt, Human
aagguuaaaaacuuccccucaaaaaggaaucaaccccaggaaguaauuauuuacaacgauuuuc

SEQ ID NO: 219537 - RNA, 64 nt, Human
uacccaggaggcugaggugggaggaucacuugagcccaggaauuugaagcugcagugagcugug

SEQ ID NO: 219538 - RNA, 64 nt, Human
cuaagacagcuuacuuggcucaucguucagggaacccaggaaaaugggaggagaacgccgcgug

SEQ ID NO: 219539 - RNA, 64 nt, Human
acaaggcccaggcgcccagggucccaccgaccugcccaggaaugcaucacauuguucucuggug

SEQ ID NO: 219540 - RNA, 64 nt, Human
gcucucucaaaaggaacuugggaaacuugugaaacccaggaaaaccuuuagucuuauaccucaa

SEQ ID NO: 219541 - RNA, 64 nt, Human
uuuccacaggccauccucuuauuccguucuggggcccaggaaguggggaagaguagguucucgg

SEQ ID NO: 219542 - RNA, 64 nt, Human
caagcgauuuuggaggaaacaagaaucccaagggcccaggaaaaccccaucuugaugcaugagu

SEQ ID NO: 219543 - RNA, 64 nt, Human
agugacccagccccaccaaugggccuccagagaccccaggaacaauaaaaugucuucucccacc

SEQ ID NO: 219544 - RNA, 64 nt, Human
agaaguuuucaagggguauuacucaggcacuaaccccaggaaagaugacagcacauugccauaa

SEQ ID NO: 219545 - RNA, 64 nt, Human; identical to SEQ ID NO: 217154

SEQ ID NO: 219546 - RNA, 64 nt, Human; identical to SEQ ID NO: 217288

SEQ ID NO: 219547 - RNA, 64 nt, Human; identical to SEQ ID NO: 215032

SEQ ID NO: 219548 - RNA, 64 nt, Human
gagcagaaugaaguggggaggacccagcuuccagcccaggaagcccacuguaccuggagccauc

SEQ ID NO: 219549 - RNA, 64 nt, Human
gcuuucuaauucuucucaugcauaugcauucacucccaggaauacucauucgucuacucugaug

SEQ ID NO: 219550 - RNA, 64 nt, Human
cugcaaaucuccccugugccugaucuguguguuccccaggaagagagcaggcagccucugagca

SEQ ID NO: 219551 - RNA, 64 nt, Human
uacucuggaggcugagacaggagaaucgcuugaacccaggaaguggagguugcagugagcugag

SEQ ID NO: 219552 - RNA, 64 nt, Human
ggcuguggggagcagggcugugacucuggcugagcccaggaaagcgacaagggugaacugggag

SEQ ID NO: 219553 - RNA, 64 nt, Human
gggcucagggccagguccucacagcagucacaggcccaggaaggcggcaggcagagaaguggag

SEQ ID NO: 219554 - RNA, 64 nt, Human
cagccagaucugaaggacauuugggagagggaugcccaggaacgccucaucucagcagccuggg

SEQ ID NO: 219555 - RNA, 64 nt, Human
ggaucucuuccugaucuucccugcccauuggguacccaggaaacugcaagcauugccuguguuc

SEQ ID NO: 219556 - RNA, 64 nt, Human
gaacuuaacagccuugcuccugaagaacuggcugcccaggaagccaagcuagcuuuuuagggga

SEQ ID NO: 219557 - RNA, 64 nt, Human
caaugauccuguuucuaccaacacugcaccuuaucccaggaaccugcccuagaccuccagagac

SEQ ID NO: 219558 - RNA, 64 nt, Human
gggaaagaugagcuuuucuaggcuacaauuuucucccaggaagcuuugauuuuuaccguuucuu

SEQ ID NO: 219559 - RNA, 64 nt, Human
gugugacgggggaaagccaaggucuggagaagcucccaggaacaaucgauggccuugcagcacu

SEQ ID NO: 219560 - RNA, 64 nt, Human
cuugucuuccuucauccuuaaaggucuuugugaccccaggaaaauauugacucugucuaacaca

SEQ ID NO: 219561 - RNA, 64 nt, Human
uauauacuucuucugggcuccuuugcucaguugccccaggaaggcuucccugugaguaaugcuu

SEQ ID NO: 219562 - RNA, 64 nt, Human
gccuugggagaaccaguccuuccuuuugacccaccccaggaagauggagugcucuuuucuaggc

SEQ ID NO: 219563 - RNA, 64 nt, Human; identical to SEQ ID NO: 217174

SEQ ID NO: 219564 - RNA, 64 nt, Human; identical to SEQ ID NO: 217191

SEQ ID NO: 219565 - RNA, 64 nt, Human; identical to SEQ ID NO: 215049

SEQ ID NO: 219566 - RNA, 64 nt, Human
gaagcuccgccuccgccgcuuagucccaacccugcccaggaagaagggcccguggggcuuugcc

SEQ ID NO: 219567 - RNA, 64 nt, Human
acuuuuggaggcugagguuggaggauugcuugagcccaggaauuugagaccagccuaggugaca

SEQ ID NO: 219568 - RNA, 64 nt, Human
cuuucugccuuggccucggcgggcuuuucuggggcccaggaagcccacacuaugcacagagccc

SEQ ID NO: 219569 - RNA, 64 nt, Human
uuugcgaccacaagcuucaugaugucuuaauugccccaggaacagcagaucuaacagcugaugu

SEQ ID NO: 219570 - RNA, 64 nt, Human
uacuugggaggcugaggcacaauaauuguuugaacccaggaagcagagguugcagugagcugag

SEQ ID NO: 219571 - RNA, 51 nt, Human
ggcgguuccaggucuugugagcccaggaaugaaagaggagaagaaacgcaa

SEQ ID NO: 219572 - RNA, 64 nt, Human
ugguugguugaacugaacauaucuugucuuagcacccaggaaacagaacuuuaagauauauaca

SEQ ID NO: 219573 - RNA, 64 nt, Human
uaggagagagguuauggguauuggugucucuauccccaggaauagaacuuaaggggugggaaga

SEQ ID NO: 219574 - RNA, 64 nt, Human
accagagggaugggagagucaagggaaggacaaucccaggaaguccuaagaaguggggcagaug

SEQ ID NO: 219575 - RNA, 64 nt, Human
caaaaucuaggcagugaacaagucuucauccuggcccaggaaauagccuauuaaaaaaugcugu

SEQ ID NO: 219576 - RNA, 64 nt, Human
gggggaggaugacaagccgcugcccaccuccaagcccaggaaacaguacaagauggcuaaggag

SEQ ID NO: 219577 - RNA, 64 nt, Human
ugcugacccagcaccacuucccagccaggagccccccaggaacagcacagaacagcagggccug

SEQ ID NO: 219578 - RNA, 64 nt, Human
gaugaauucccugugagugagagaaguugaucaccccaggaauuagucacuaagaauuccuaag

SEQ ID NO: 219579 - RNA, 59 nt, Human
uuacguggaagaaacgcuaaggguuugcucccaggaaaggagaggaagagcuauauaua

SEQ ID NO: 219580 - RNA, 64 nt, Human
aaucccaacacuuuggcucagcagauugcuugaacccaggaauucaaguccaaucugggcaaca

SEQ ID NO: 219581 - RNA, 64 nt, Human; identical to SEQ ID NO: 216667

SEQ ID NO: 219582 - RNA, 64 nt, Human; identical to SEQ ID NO: 216850

SEQ ID NO: 219583 - RNA, 64 nt, Human; identical to SEQ ID NO: 215164

SEQ ID NO: 219584 - RNA, 64 nt, Human
cuucucacccuuuccaucuucaguuugaaugacucccaggaaggccuagagcagacccuuuaga

SEQ ID NO: 219585 - RNA, 64 nt, Human
gaccugccccugaccaaugauacccacaccuccucccaggaagacugcccaggccuuuguuagg

SEQ ID NO: 219586 - RNA, 64 nt, Human
gggagcgguaccuuucccuugggcagccuggggucccaggaacaagccagggcgaguggcaugu

SEQ ID NO: 219587 - RNA, 64 nt, Human
gggacugcagguugugcccuguggcugccugcaccccaggaaaggagggggcucaggccaucca

SEQ ID NO: 219588 - RNA, 64 nt, Human
cagugauugauuuuaggaggcccacaccaaacuccccaggaaaugacugccuuccuugggacca

SEQ ID NO: 219589 - RNA, 64 nt, Human
gggaacaccucucaccugaacccgggggucccaucccaggaagaagggccaucucaggacauga

SEQ ID NO: 219590 - RNA, 64 nt, Human
aguaaguguuuuccggcugauaaggcuaacccuacccaggaaaggauugauaacuaaauaaauu

SEQ ID NO: 219591 - RNA, 64 nt, Human
cugcuaggccccaguucuuccuccuucccccuuucccaggaaaggccagcccaguccauggccu

SEQ ID NO: 219592 - RNA, 64 nt, Human
aaaggcuuggcuauggcccugugugacuccaggucccaggaaccuugccuucgucaucugugga

SEQ ID NO: 219593 - RNA, 64 nt, Human
ggucaaggcuuccccugaguaagguccauuucuucccaggaauccaaucuccuguggauggagc

SEQ ID NO: 219594 - RNA, 64 nt, Human
agcgucuccuccuccugcgcccccacugcgucugcccaggaacagcauccuggguagcagaaca

SEQ ID NO: 219595 - RNA, 64 nt, Human
cagccauaagugacucugagcugggaaggggaaacccaggaauuuugcuacuuggaauuuggag

SEQ ID NO: 219596 - RNA, 64 nt, Human
gggagugucuuugagggccuuaaaaggaccauggcccaggaaugggggcgcugguugggcuugg

SEQ ID NO: 219597 - RNA, 64 nt, Human
cgcaacaucucagcgaggagugaaggacccaugucccaggaaccgcgcugcgccaccugcacuc

SEQ ID NO: 219598 - RNA, 64 nt, Human
ccccaucugaggcagagaagacucgaguccagcccccaggaagccugcuccccucucuggccca

SEQ ID NO: 219599 - RNA, 64 nt, Human; identical to SEQ ID NO: 217212

SEQ ID NO: 219600 - RNA, 64 nt, Human; identical to SEQ ID NO: 217324

SEQ ID NO: 219601 - RNA, 64 nt, Human; identical to SEQ ID NO: 215050

SEQ ID NO: 219602 - RNA, 64 nt, Human
aagugccucauauuuugaaaauauccauuaaggacccaggaauuagcauuucacuuguuuauac

SEQ ID NO: 219603 - RNA, 64 nt, Human
caguucuccaagcaucgugauagcaaugcuuaaccccaggaagauuucaaggcagggagaagaa

SEQ ID NO: 219604 - RNA, 64 nt, Human
uacuugggaggcugaggcaggaggaucgcuugaacccaggaagcagagguugcagugagcugag

SEQ ID NO: 219605 - RNA, 64 nt, Human
cacccagagaaaacccauacagacaguggccuugcccaggaaucagucuuguuucuuuuuuguu

SEQ ID NO: 219606 - RNA, 64 nt, Human
gaacugccagaggaagaucuggcgucacauggcucccaggaaagugcugugcccuauccccacu

SEQ ID NO: 219607 - RNA, 64 nt, Human
aggagugacuccaagaagaguuccggcagcuuuccccaggaaagggugaggggugacacucggc

SEQ ID NO: 219608 - RNA, 64 nt, Human
gcaccaggaaaggccugcacccucuuccugcucucccaggaagccagcucccugagcuccugag

SEQ ID NO: 219609 - RNA, 64 nt, Human
ucaacccaaaggagcugccgcacugacccagccccccaggaaacagugagacaagaaucaagua

SEQ ID NO: 219610 - RNA, 64 nt, Human
gagugccagcucaaguuggaguugacugcucauacccaggaagagcugacccaucuggcccucc

SEQ ID NO: 219611 - RNA, 64 nt, Human
gcaccagcauacacacguuuuucuagguacagcucccaggaacagcuaggugggaaagucccau

SEQ ID NO: 219612 - RNA, 64 nt, Human
ccuuuauucugcuacugcucucauucugucucaucccaggaauccagucccaagugcugccugc

SEQ ID NO: 219613 - RNA, 64 nt, Human
acgcuugggcuuuucuguuaccaaacagcacuaucccaggaacuauugucugccugggaacacu

SEQ ID NO: 219614 - RNA, 64 nt, Human
agugagcagucaaguguucaggccacacagucagcccaggaaaaagagaagcagggccaaaugg

SEQ ID NO: 219615 - RNA, 64 nt, Human
agacucaauaucuaucucagaggaaauaugguuacccaggaaagaaauggucugcuagagugau

SEQ ID NO: 219616 - RNA, 64 nt, Human
acuaaaaugccagggccaggcuguguauuucuuucccaggaaauuagcuuuccagccccuuuau

SEQ ID NO: 219617 - RNA, 64 nt, Human; identical to SEQ ID NO: 215013

SEQ ID NO: 219618 - RNA, 64 nt, Human; identical to SEQ ID NO: 217172

SEQ ID NO: 219619 - RNA, 64 nt, Human; identical to SEQ ID NO: 217058

SEQ ID NO: 219620 - RNA, 64 nt, Human
ucuuaacucccuuauuaccuaaacuugucuggcucccaggaacagccuuauagagagagggagu

SEQ ID NO: 219621 - RNA, 64 nt, Human
auauuucaaaaugguauuuugaugccaucaaaugcccaggaaauugacuuugcagugucaccac

SEQ ID NO: 219622 - RNA, 64 nt, Human
acaccugcuuccuuaaaaugcucucugcaaaaugcccaggaagcccucauugugacauggcaga

SEQ ID NO: 219623 - RNA, 64 nt, Human
ggaaaauaaagaagcugccaccuaacaggagucacccaggaaagcaccgcacaggcuggcgcgg

SEQ ID NO: 219624 - RNA, 64 nt, Human
ugcauaucuggguuggauguuagacuaaaggaaacccaggaauauuuaccugguguuacauuua

SEQ ID NO: 219625 - RNA, 64 nt, Human
uacagucaacaaaaauugggcuaagucacuuuuccccaggaaagaauauuucccucuccugcau

SEQ ID NO: 219626 - RNA, 64 nt, Human
ucagaaggugagcuguuguuuuucuaaaccucuucccaggaaggggacauugacacuugaauuu

SEQ ID NO: 219627 - RNA, 64 nt, Human
acaugcucaguuuuuuaaguaaaccuguaaaauacccaggaaggcaaauguucauuguuuaauu

SEQ ID NO: 219628 - RNA, 64 nt, Human
auaaauucaggcugcugaaacaagaaauucugagcccaggaagcgggcucuucuuucuucaaaa

SEQ ID NO: 219629 - RNA, 64 nt, Human
cagcuacugcgagaacuucaggccaaugucucagcccaggaaccaggcuuugcugaggugcugc

SEQ ID NO: 219630 - RNA, 64 nt, Human
ccaagcugggacuucuccaggccuguguucccuccccaggaagugcgccccaaaccucuucaua

SEQ ID NO: 219631 - RNA, 64 nt, Human
ugaggaacaccucccaccaggcuagaggcaacugcccaggaaggacugugcuuccgucaccucu

SEQ ID NO: 219632 - RNA, 64 nt, Human
guggucccgacaaccucccugucccuugcccgcccccaggaagggggaaauggggcauuugggg

SEQ ID NO: 219633 - RNA, 64 nt, Human
accucaaaaaguuaaacguagagugaccauaugacccaggaaugccacuccuagguauuuaccc

SEQ ID NO: 219634 - RNA, 64 nt, Human
cuguuuucuaaagccaggacuauucccuuuccuccccaggaauauguguuuuccuuugucuuaa

SEQ ID NO: 219635 - RNA, 64 nt, Human; identical to SEQ ID NO: 217510

SEQ ID NO: 219636 - RNA, 64 nt, Human; identical to SEQ ID NO: 215012

SEQ ID NO: 219637 - RNA, 64 nt, Human; identical to SEQ ID NO: 217135

SEQ ID NO: 219638 - RNA, 64 nt, Human
cacagcccagcccagccugacguggauguggcugcccaggaaaagacuuaacugugaaaaagua

SEQ ID NO: 219639 - RNA, 64 nt, Human
uacucaggaggcugaggcaggagaauugcuugaacccaggaagcagagguugcaguaagcugag

SEQ ID NO: 219640 - RNA, 64 nt, Human
acuaugggaggcugaggcaagcagguuguuugagcccaggaauuugagaacaggauuuugagaa

SEQ ID NO: 219641 - RNA, 64 nt, Human
augggcucugguucugccaggagccugugacacccccaggaaggggguggaacugaggaagagc

SEQ ID NO: 219642 - RNA, 64 nt, Human
agagagccuuggcgccucuguuugccaccacuuccccaggaaggagggacagcauuucucuggc

SEQ ID NO: 219643 - RNA, 64 nt, Human
gguggacaaacuggagucuggagugggcagagcccccaggaagcccaggagggcauccauacca

SEQ ID NO: 219644 - RNA, 64 nt, Human
gccgccacugcaguucugcuaggucugcuuccugcccaggaaggugccugcacaugagaggaga

SEQ ID NO: 219645 - RNA, 64 nt, Human
ggcauccuggugccugcauaccucuggcagcuggcccaggaagagccagcaagagcaaggcaug

SEQ ID NO: 219646 - RNA, 64 nt, Human
cuugcugcccgaaugcucggaaacaggagccuuucccaggaacucuuuuuuaugccagaacgcu

SEQ ID NO: 219647 - RNA, 64 nt, Human
uccuaagccauagacaggcuaauugcccaccacucccaggaauauugaaauagcuacaugacca

SEQ ID NO: 219648 - RNA, 64 nt, Human
aauucaguagcaacauagcuggcuuguucccagacccaggaaguauaagucauugacaguuucc

SEQ ID NO: 219649 - RNA, 64 nt, Human
uguaaccagcuuaguaaccagaguaucuggauuacccaggaagguugagcugcugagauuucag

SEQ ID NO: 219650 - RNA, 64 nt, Human
ucuacagugauucuacuucugaggagucuucugucccaggaagagauaccuucuuuacaggaga

SEQ ID NO: 219651 - RNA, 64 nt, Human
uaaaaaaaucugugcaauaauuuuaaaaugugcucccaggaauagacacaaauguuuugaguau

SEQ ID NO: 219652 - RNA, 64 nt, Human
cagugaaauggagaauuucaggucuccacgucugcccaggaaagaacuucagcugacuccacgg

SEQ ID NO: 219653 - RNA, 64 nt, Human; identical to SEQ ID NO: 217325

SEQ ID NO: 219654 - RNA, 64 nt, Human; identical to SEQ ID NO: 215068

SEQ ID NO: 219655 - RNA, 64 nt, Human; identical to SEQ ID NO: 217305

SEQ ID NO: 219656 - RNA, 64 nt, Human
guucuuauaccacguuccacggaggagugaggagcccaggaacgacguggucuuccagcccauc

SEQ ID NO: 219657 - RNA, 64 nt, Human
gaaggcuggcacgugcagcguccuuggcaguuggcccaggaacuggagccacagagcuggugcu

SEQ ID NO: 219658 - RNA, 64 nt, Human
cagcugggugggggccggggcuggcccugggacccccaggaacgcuaagacacaggcuccagua

SEQ ID NO: 219659 - RNA, 64 nt, Human
guccccaucaacaaccguccugcuccccaccucccccaggaaauaaggggccugcuccucuccc

SEQ ID NO: 219660 - RNA, 64 nt, Human
agcccugggcagaugccccggccccagggcuucccccaggaacuccauguaacagaacagaccc

SEQ ID NO: 219661 - RNA, 64 nt, Human
gaagcaggaggagcacucaaggggguuuggucuucccaggaagagggccugagguucuccuagu

SEQ ID NO: 219662 - RNA, 64 nt, Human
ugccguaaauccuggggcaagggaucagccucuucccaggaaccaucgccuucuauaaaccgug

SEQ ID NO: 219663 - RNA, 64 nt, Human
cgcccccccaacgcgcacacacacguccucuccucccaggaaccucauucaaauauuuacccgg

SEQ ID NO: 219664 - RNA, 64 nt, Human
auuuuuuauguuacuagaagagauuauuugacuucccaggaauuuucugucuguaaucacuaaa

SEQ ID NO: 219665 - RNA, 64 nt, Human
gccuccugcagacgggcgaagccgccugcugcagcccaggaagccagcccucugcucggccucg

SEQ ID NO: 219666 - RNA, 64 nt, Human
cuaguuuugguuccuuuugcagagugaaaugccucccaggaaaaaaauacauauguauuuuuuu

SEQ ID NO: 219667 - RNA, 64 nt, Human
uggguguggugguguguaccuguagucccagcuacccaggaagcuaaggcaggagaaucgcuug

SEQ ID NO: 219668 - RNA, 64 nt, Human
caggggcagccccaacccacccgggccaggaacccccaggaagguggggccacgcugcaggcag

SEQ ID NO: 219669 - RNA, 64 nt, Human
cucuaccuucuggaaaacagggcugguauuccuacccaggaaccuccuuugagcauagaguuag

SEQ ID NO: 219670 - RNA, 64 nt, Human
uguuuuguuuuguuuuuuacaagauauaacauaacccaggaaacagacccagcugagguuauuc

SEQ ID NO: 219671 - RNA, 64 nt, Human; identical to SEQ ID NO: 217604

SEQ ID NO: 219672 - RNA, 64 nt, Human; identical to SEQ ID NO: 217306

SEQ ID NO: 219673 - RNA, 64 nt, Human; identical to SEQ ID NO: 217077

SEQ ID NO: 219674 - RNA, 64 nt, Human
uucaaaaaguguggccucagcucuggaggccacccccaggaaggaguuugagguucauugucau

SEQ ID NO: 219675 - RNA, 64 nt, Human
agugaugucauuuuauuccccucccaaaacaugccccaggaacaagcaccccuugccucugugg

SEQ ID NO: 219676 - RNA, 64 nt, Human
ccccauuucucauuagugcaaugucauaucugaucccaggaagccuggaaaauaaaagacgaug

SEQ ID NO: 219677 - RNA, 64 nt, Human
cagucuucauuguggugcucuucaugaucauagccccaggaacccuugagguucuucuucacaa

SEQ ID NO: 219678 - RNA, 64 nt, Human
uccuuccagaccguuacgugucuccuggccaagccccaggaaggaaaugaugcagcucuggcuc

SEQ ID NO: 219679 - RNA, 64 nt, Human
uaauuuguucuguuucugccaaacuucuuuaacucccaggaaggguagaauuuugaaaccuuga

SEQ ID NO: 219680 - RNA, 64 nt, Human
uuuuuugugagccacaucugauauuucugauauccccaggaaggaguggccuggaggucacugg

SEQ ID NO: 219681 - RNA, 64 nt, Human
acuuugggaggcagaggagggaggaucacuugaacccaggaauucaaggcugcaguaagcuacg

SEQ ID NO: 219682 - RNA, 64 nt, Human
aagguauuuuauuacugcauaauagauggugaaacccaggaaaauuaaguacuugugcauggcc

SEQ ID NO: 219683 - RNA, 64 nt, Human
uacaugggaggcugaggugggaggaucacuugagcccaggaaguccagaacguagugagccuug

SEQ ID NO: 219684 - RNA, 64 nt, Human
cuuggagcucugugucaacuuugauccuuugucucccaggaaggugugaccucuccuuugccug

SEQ ID NO: 219685 - RNA, 64 nt, Human
gauucaauaaugagagcucagacugggaacagggcccaggaaucugugugguacaaaccugcau

SEQ ID NO: 219686 - RNA, 64 nt, Human
gaauuagcuggaguaggagucugggaguggagaccccaggaaacagcaugaggugaggguguga

SEQ ID NO: 219687 - RNA, 64 nt, Human
cccuccaacugccaaauucugcuucccucugaaccccaggaaauacuuucuggagaggcuuguc

SEQ ID NO: 219688 - RNA, 64 nt, Human
acugacagacugauugcguggcucuuucagaagacccaggaagggcagcuccagccagaggacc

SEQ ID NO: 219689 - RNA, 64 nt, Human; identical to SEQ ID NO: 216686

SEQ ID NO: 219690 - RNA, 64 nt, Human; identical to SEQ ID NO: 216868

SEQ ID NO: 219691 - RNA, 64 nt, Human; identical to SEQ ID NO: 215165

SEQ ID NO: 219692 - RNA, 64 nt, Human
ucacauuccacaaucuauggcuuccaccagcuagcccaggaaauacuugaaaucagcauuccaa

SEQ ID NO: 219693 - RNA, 64 nt, Human
guaggguggguaagaguccaugggggugcccagucccaggaaaggggacaaugaagggacaggc

SEQ ID NO: 219694 - RNA, 64 nt, Human
aggaaugaugcuuauuagaaaacaaacugcuugacccaggaacaaguggcuuagcuuaaguaaa

SEQ ID NO: 219695 - RNA, 64 nt, Human
acuuauuuauuuaacuuacuuaucuggucaaagccccaggaaaccuaccaaagcuagaauuaau

SEQ ID NO: 219696 - RNA, 64 nt, Human
cucagaaucccacugcaauggacccaggcagcgccccaggaagccaugcugggcccccgccagg

SEQ ID NO: 219697 - RNA, 64 nt, Human
uuccuagcagcuccuccuccucccucccaaggcccccaggaaucccuuccucccauguccuggc

SEQ ID NO: 219698 - RNA, 64 nt, Human
uggcucaagguguagagggagcagagacgaagaccccaggaagucauccugcaaugggagagac

SEQ ID NO: 219699 - RNA, 64 nt, Human
aagcagcuugaguguuuucaucuugccugggaagcccaggaauuccaccugguccacaccggca

SEQ ID NO: 219700 - RNA, 64 nt, Human
uucugcccucugacuccagugguugcagaauuagcccaggaacuagaauuggauggagucacac

SEQ ID NO: 219701 - RNA, 64 nt, Human
cuggacucuccguuaaucucuaaggggucugcuccccaggaacguuucugaacaauggggacuu

SEQ ID NO: 219702 - RNA, 64 nt, Human
ugauaacaugcuguggcaagcuauguccgcaguucccaggaauuuguccaguugauauuacccu

SEQ ID NO: 219703 - RNA, 64 nt, Human
acaucuuauugagauuugaaacuggugguaguuucccaggaaggcacagguggaguuauuugug

SEQ ID NO: 219704 - RNA, 64 nt, Human
cccacagcaacaccaagcauauuagaagaggaaccccaggaacgcaacucagaccuugggaaau

SEQ ID NO: 219705 - RNA, 64 nt, Human
caccuugaagcauccuguucuccuucugugcugucccaggaagugucuggcgggcgugggcagc

SEQ ID NO: 219706 - RNA, 64 nt, Human
uaauaauaaaacaacuuguuuccuuuuggccacccccaggaagggcugauuucaaaaucugggg

SEQ ID NO: 219707 - RNA, 64 nt, Human; identical to SEQ ID NO: 217439

SEQ ID NO: 219708 - RNA, 64 nt, Human; identical to SEQ ID NO: 216982

SEQ ID NO: 219709 - RNA, 64 nt, Human; identical to SEQ ID NO: 215070

SEQ ID NO: 219710 - RNA, 53 nt, Human
guaaccgaaaacauggauaagaucccaggaagacaagugcuucuaaaccuuca

SEQ ID NO: 219711 - RNA, 64 nt, Human
gcccaaucuccaucugucaacaggggcgugaggucccaggaaguggccaaaagcuagacagauc

SEQ ID NO: 219712 - RNA, 64 nt, Human
gaaaaagcaucagggggaaauggaaugccccugccccaggaacauggcagaagcacagguucug

SEQ ID NO: 219713 - RNA, 64 nt, Human
gagggcugagucugguucccuaggggacccucaucccaggaacaacauuccagccccacccuca

SEQ ID NO: 219714 - RNA, 64 nt, Human
guguaccugaggggcacccuugggccugggcuuucccaggaaggagaugaagguagaagcaccu

SEQ ID NO: 219715 - RNA, 64 nt, Human
gggccugcaucuccuggcgccggcugcuucugggcccaggaagaggcuguggcucccaccuucc

SEQ ID NO: 219716 - RNA, 64 nt, Human
gacuuugaaacuaucucaugccagugccuuauuacccaggaagauuuuaaaggaccucauuaau

SEQ ID NO: 219717 - RNA, 64 nt, Human
aaugccccccgccuuccacaaauccuuuugcugacccaggaaguucugggaguugccguuuuuc

SEQ ID NO: 219718 - RNA, 64 nt, Human
caaaagaaagcagcuuguuuugaaagaagaaacucccaggaauuggaauucagcaccuguuccg

SEQ ID NO: 219719 - RNA, 64 nt, Human
uggaagggcccucgaaugccauucacaggaacagcccaggaacccagggacuucagaagggcug

SEQ ID NO: 219720 - RNA, 64 nt, Human
ugaggaauuaucaugggaaaagaccagggcuuuucccaggaauaucccaaacuucggaaacaag

SEQ ID NO: 219721 - RNA, 64 nt, Human
ccuggagcaucugcccuuugcuccuagcagccuccccaggaagggacugcagaggcgggcaagc

SEQ ID NO: 219722 - RNA, 64 nt, Human
ggaggccugcaucccuccugagcucuuggaggugcccaggaacccugcuucuccucacagggcc

SEQ ID NO: 219723 - RNA, 64 nt, Human
gcugugcccucuucugccaaggaaagacacaagccccaggaagaacucagagccgucaugggua

SEQ ID NO: 219724 - RNA, 64 nt, Human
augucagugguuucuacuuccccugggaugcugacccaggaauaguggacauggucacaguccu

SEQ ID NO: 219725 - RNA, 64 nt, Human; identical to SEQ ID NO: 217903

SEQ ID NO: 219726 - RNA, 64 nt, Human; identical to SEQ ID NO: 218130

SEQ ID NO: 219727 - RNA, 64 nt, Human; identical to SEQ ID NO: 214954

SEQ ID NO: 219728 - RNA, 64 nt, Human
gggggucaccuaggggacugccucugugccucuccccaggaagcauccagggcagaggaagcca

SEQ ID NO: 219729 - RNA, 64 nt, Human
uauuugggaggcugaugcaggagaauagcuuaagcccaggaauuugagucugggaguuugaguc

SEQ ID NO: 219730 - RNA, 64 nt, Human
caucuucccguggaguguggggaagcugcugucucccaggaagugccuuacucaucccgcaacc

SEQ ID NO: 219731 - RNA, 64 nt, Human
cuuguauauuuuuaguaccauacagaaguaaaaucccaggaacuaugaacacuagaccuuaugu

SEQ ID NO: 219732 - RNA, 64 nt, Human
aauucuacaaugugccagauacauguuuccuaugcccaggaaguuaugaagacuucaacaauua

SEQ ID NO: 219733 - RNA, 64 nt, Human
uucucuaauagcuuuuuuuuuacauaaaaaaagacccaggaacuuaauaguguaugcauaagac

SEQ ID NO: 219734 - RNA, 53 nt, Human
ugccacuuuuagauagcuaaauccccaggaaguggacuuuacauguauauauu

SEQ ID NO: 219735 - RNA, 64 nt, Human
guaacaaaaagaauugccaaggaagaaaaauccacccaggaaugaaaauuaagauuuugacaau

SEQ ID NO: 219736 - RNA, 64 nt, Human
ucaugcccagccaacuaauaaaaauaaguguaaccccaggaagagucugucaaaacaaguauau

SEQ ID NO: 219737 - RNA, 64 nt, Human
aaggugggaaugacugggugguggcugccacuagcccaggaacaugacaacgugaccacaccac

SEQ ID NO: 219738 - RNA, 64 nt, Human
aaauuggccucuuugauacacuuuugcuugccuccccaggaaagaaggaauugcauccaaggua

SEQ ID NO: 219739 - RNA, 64 nt, Human
auacauuucaaccaaaaugaccucauuugaaaugcccaggaaguauuuguuuugccauucuuac

SEQ ID NO: 219740 - RNA, 64 nt, Human
gcuggaccacgccgacaccugggaucuugagauacccaggaagggaggcugucuggccagccuc

SEQ ID NO: 219741 - RNA, 64 nt, Human
agauuauucacugauuugacauagucuggcuguacccaggaauggagccugcacggugaauggc

SEQ ID NO: 219742 - RNA, 64 nt, Human
uagcaccucauuagcccacaagccagccaggggccccaggaagauggggcaccccccagcaccc

SEQ ID NO: 219743 - RNA, 64 nt, Human; identical to SEQ ID NO: 217547

SEQ ID NO: 219744 - RNA, 64 nt, Human; identical to SEQ ID NO: 217210

SEQ ID NO: 219745 - RNA, 64 nt, Human; identical to SEQ ID NO: 215051

SEQ ID NO: 219746 - RNA, 64 nt, Human
cacaucacgguaaagcccaaggaguaauuaggaccccaggaagccuugcugcccagaaaacacc

SEQ ID NO: 219747 - RNA, 64 nt, Human
aauggcuucuguuacauggagcucaauggacgugcccaggaaugcuuuuggcuguuauuuugca

SEQ ID NO: 219748 - RNA, 64 nt, Human
uuuuuucuguuccuccccgagaggcccucuggcccccaggaaaccuguugugcagagcucuucc

SEQ ID NO: 219749 - RNA, 64 nt, Human
acuuugggaggcugagguggguagauuacuugagcccaggaauucaagaccagccugggcaaca

SEQ ID NO: 219750 - RNA, 64 nt, Human
ccaaaagcuggagugugaggcaggaggcuggaaacccaggaaagcugauggugcaagguccagu

SEQ ID NO: 219751 - RNA, 64 nt, Human
aaagagagcuaugauguccuaggacugagaguaccccaggaaagaauacccuugaaagggucuc

SEQ ID NO: 219752 - RNA, 64 nt, Human
auccccuggagcacugcccuccagagcugcccuucccaggaaggaauuugguuggauucuguca

SEQ ID NO: 219753 - RNA, 64 nt, Human
uuuuuuuuaaguaaaguuuguagcuccucccaugcccaggaaagcacagaacucaaguguggug

SEQ ID NO: 219754 - RNA, 64 nt, Human
ggcccuuuugcuuuucacgcccagggcucaguggcccaggaagugugcugggcagccuguucuu

SEQ ID NO: 219755 - RNA, 64 nt, Human
uggguucguaccagcaaguagacuaggaacugagcccaggaaagggggauguuuuccugguguu

SEQ ID NO: 219756 - RNA, 64 nt, Human
cuacacaguacuuagauuuuuuuuacuuuccagucccaggaagugucaauguuuguugagugga

SEQ ID NO: 219757 - RNA, 64 nt, Human
cccucccgcgcccccaccccagaccccgagccaccccaggaaaagcacaaggacugccgccuuc

SEQ ID NO: 219758 - RNA, 64 nt, Human
ucagggcagaggccaaguuccaggugucuguguucccaggaaccaaauggggagucuggggccc

SEQ ID NO: 219759 - RNA, 64 nt, Human
gucagucugggcucaggguucccagagcucauuccccaggaaucucuaagaccagggcuggggc

SEQ ID NO: 219760 - RNA, 64 nt, Human
cccuucaucgguucaugucacagggauuuucuuucccaggaagcggacacggagagucagcccu

SEQ ID NO: 219761 - RNA, 64 nt, Human; identical to SEQ ID NO: 217364

SEQ ID NO: 219762 - RNA, 64 nt, Human; identical to SEQ ID NO: 218131

SEQ ID NO: 219763 - RNA, 64 nt, Human; identical to SEQ ID NO: 214955

SEQ ID NO: 219764 - RNA, 64 nt, Human
auacccuaacaaagcagaguauauuuauuuguuucccaggaaggccauugcaguuugacuggcu

SEQ ID NO: 219765 - RNA, 64 nt, Human
gcucccgggccucagccucccaucuccucuccuucccaggaauccuugaucucaugacuauuaa

SEQ ID NO: 219766 - RNA, 64 nt, Human
gcgggaggggaucugugucacuguagguacugugcccaggaaggcugggugaagugaccaucua

SEQ ID NO: 219767 - RNA, 64 nt, Human
ccccaaaccuaauaacccaaauuuggggauggggcccaggaauaugcauuuuuaaaaagucauc

SEQ ID NO: 219768 - RNA, 64 nt, Human
gugugaccagcccccaguuccucccccaguuccucccaggaagcccaggagccucacuggggca

SEQ ID NO: 219769 - RNA, 52 nt, Human
guaguccuagccuccuauaaggcccaggaagagggcagaggggccagaagga

SEQ ID NO: 219770 - RNA, 64 nt, Human
cuaaccucauuaccuuuccuuugucugccucagccccaggaagggcaaggcaagaugguggaca

SEQ ID NO: 219771 - RNA, 64 nt, Human
aacucuagaauugggcuuguacagaaggauaaaacccaggaaaauggauauuucuauucagauu

SEQ ID NO: 219772 - RNA, 64 nt, Human
aagagcgguggggcgacccuccuuuuggcuuggccccaggaauuuccugugacuccaccagcca

SEQ ID NO: 219773 - RNA, 64 nt, Human
auaucauauuacuaggacuuaauauaguggcauacccaggaaaugcuuaguaaguguucccuuc

SEQ ID NO: 219774 - RNA, 64 nt, Human
agcgcugguccccucccucugucuucaggcucugcccaggaacucgcaccugugcuggagcccu

SEQ ID NO: 219775 - RNA, 64 nt, Human
cgggcguggugaugcgugccuguaaucccagcuacccaggaaggcugaggcggcagaaucacuu

SEQ ID NO: 219776 - RNA, 64 nt, Human
aagagcagauaacuagcgcugcucuggcauuaaucccaggaaccacuagcaguaguggggcgcc

SEQ ID NO: 219777 - RNA, 64 nt, Human
aagagaagggcccaggaaggaugcucucauaaggcccaggaaggaugcucucauaagcaccuug

SEQ ID NO: 219778 - RNA, 64 nt, Human
cugccauccacggccuuuucuggcaagagaagggcccaggaaggaugcucucauaaggcccagg

SEQ ID NO: 219779 - RNA, 64 nt, Human; identical to SEQ ID NO: 217383

SEQ ID NO: 219780 - RNA, 64 nt, Human; identical to SEQ ID NO: 217400

SEQ ID NO: 219781 - RNA, 64 nt, Human; identical to SEQ ID NO: 214956

SEQ ID NO: 219782 - RNA, 64 nt, Human
uacucaggaggcugaggugggagaauugcuugggcccaggaauucaaggcuagagugagccgug

SEQ ID NO: 219783 - RNA, 64 nt, Human
agaaagaccaugcauuuaaaguauucuccauccucccaggaaccgaacauaucauuugugaaga

SEQ ID NO: 219784 - RNA, 64 nt, Human
uacuugggaggcugaggcaggagaaucgcuugaucccaggaaggcagagguggcagugagcuga

SEQ ID NO: 219785 - RNA, 64 nt, Human
gcuccaacucgggccuggggcacugcucgcugcucccaggaaggggguggcgugacaggcagga

SEQ ID NO: 219786 - RNA, 64 nt, Human
cuucuccuguagggcaccucccugccccuagccucccaggaaauggugcucuccuggcccugcc

SEQ ID NO: 219787 - RNA, 64 nt, Human
uucgauagcucacacuccugcacugugccugucacccaggaaugucuuuuuuaauuagaagaca

SEQ ID NO: 219788 - RNA, 64 nt, Human
ucauccuaaaaguggggguugccucaagacagcccccaggaacugauaagaagggaugaacucc

SEQ ID NO: 219789 - RNA, 64 nt, Human
gucuuuuugucugcagugaauguucaacaguuugcccaggaacugggggaucauauaugucuua

SEQ ID NO: 219790 - RNA, 64 nt, Human
cggauacuggggaguaaacggcccaggccaggugcccaggaaaggacggcugagcauguggagc

SEQ ID NO: 219791 - RNA, 64 nt, Human
ggagagagaggggaaggagguaugaaucccaguccccaggaaccuagcucuuuaaacucugggg

SEQ ID NO: 219792 - RNA, 64 nt, Human
ccuugccaggacaagaaccaagaacucuaacugucccaggaaucuugugaauuuucacccauaa

SEQ ID NO: 219793 - RNA, 64 nt, Human
gaagggguguggaaaaggugauccuuuacccccacccaggaaaaccugcauugugcuagcaugg

SEQ ID NO: 219794 - RNA, 64 nt, Human
guccagcccggggcagucugacugucggugcccucccaggaacggggaaggccuccgucugugu

SEQ ID NO: 219795 - RNA, 64 nt, Human
auagaugguaguuugguacuucugguucccagugcccaggaaugguccacucccaagaaauuca

SEQ ID NO: 219796 - RNA, 64 nt, Human
caaaaauuaggcugagacaggagaauugcuugaacccaggaagcagagguugcaaugagcugag

SEQ ID NO: 219797 - RNA, 64 nt, Human; identical to SEQ ID NO: 217457

SEQ ID NO: 219798 - RNA, 64 nt, Human; identical to SEQ ID NO: 214973

SEQ ID NO: 219799 - RNA, 64 nt, Human; identical to SEQ ID NO: 217438

SEQ ID NO: 219800 - RNA, 64 nt, Human
acagaccagaaaaaguuccaucuaaaauaucaugcccaggaaagcacaugggaucaaaaguaaa

SEQ ID NO: 219801 - RNA, 64 nt, Human
uccacccuuaacccugugcucaggcaccucuucccccaggaagccuucccugcccaccccaucu

SEQ ID NO: 219802 - RNA, 64 nt, Human
agggaaggggauuuggagggaggcugucgucgcccccaggaaagacgggccugggggaggcggg

SEQ ID NO: 219803 - RNA, 64 nt, Human
cucugaagaguuuuuaaucuucagcucaucaugucccaggaaguggcaucauaaaaggaaauau

SEQ ID NO: 219804 - RNA, 64 nt, Human
cauuuugagcagcgcgagaguagaagugaauacccccaggaacuccaauugugcugaagcugau

SEQ ID NO: 219805 - RNA, 64 nt, Human
ggggagugagguugggcagugugguggaugggcacccaggaaggguugaccagggaaggaggca

SEQ ID NO: 219806 - RNA, 64 nt, Human
gacccaguggaucauguuggaaaugcaacugcaucccaggaacuugguuaugguugucucaagg

SEQ ID NO: 219807 - RNA, 64 nt, Human
auuuugcauguaagaauguacuuuaggaaacauacccaggaaguacaguugauaaauauaacau

SEQ ID NO: 219808 - RNA, 64 nt, Human
uauuuucucggagguuguuuuucuccuucuccuucccaggaaggucuuuguaugucgaauccag

SEQ ID NO: 219809 - RNA, 64 nt, Human
gaagaugccuauauucugagagacaggacaguuucccaggaagaugggcagagacuugaguggc

SEQ ID NO: 219810 - RNA, 64 nt, Human
cccugaucagccagcacucuggaagcuuugggaucccaggaaccauggaauuauucccaaaugg

SEQ ID NO: 219811 - RNA, 64 nt, Human
aagaagaaguugcaguauggauaucuuucacccucccaggaaacucuuucaaaccuaaucugua

SEQ ID NO: 219812 - RNA, 64 nt, Human
guuaguuauaucuaucuagugguugucuguuuuacccaggaauucuuggauauuuaguuuucug

SEQ ID NO: 219813 - RNA, 64 nt, Human
ugaggacucugcaagugucuggagcggcugcucgcccaggaaggccuaggcuaggacguuggcc

SEQ ID NO: 219814 - RNA, 64 nt, Human
guguguuagcgggcaggggagccauugugggguccccaggaaagggcaagggcucagccacauc

SEQ ID NO: 219815 - RNA, 64 nt, Human; identical to SEQ ID NO: 217489

SEQ ID NO: 219816 - RNA, 64 nt, Human; identical to SEQ ID NO: 215087

SEQ ID NO: 219817 - RNA, 64 nt, Human; identical to SEQ ID NO: 217490

SEQ ID NO: 219818 - RNA, 64 nt, Human
aagucaauuaaaaacuucccaggauuucuuuggacccaggaaacagccauguggguccuuucug

SEQ ID NO: 219819 - RNA, 61 nt, Human
aggaagaagacaacgaauaaacuuccuucaacccaggaagcgucuuuggugcuugggagac

SEQ ID NO: 219820 - RNA, 64 nt, Human
acgaaaaggaaguccccccaucagacucuggacacccaggaaucaaaagagaaaggacuuuuuu

SEQ ID NO: 219821 - RNA, 64 nt, Human
uccuuagcacccaaccggucugccuuuaauuuuacccaggaaggacucacauuggggcgaauga

SEQ ID NO: 219822 - RNA, 64 nt, Human
cuucucacuaauugagucugcuuccacguccucucccaggaacauucuuagcucggacucuuga

SEQ ID NO: 219823 - RNA, 64 nt, Human
ccuggguggacagcaauagaaaagggggcagacgcccaggaagugaccuucuccuggaugagcu

SEQ ID NO: 219824 - RNA, 64 nt, Human
agacgcguguggagagagccgcacaccagcgccacccaggaaaggcggagcgguuaccaguguu

SEQ ID NO: 219825 - RNA, 64 nt, Human
cccgugcccccucugacagccauccuccugggagcccaggaaggcauccacgagggagcuccug

SEQ ID NO: 219826 - RNA, 64 nt, Human
gguggaccacccuggcugaaaugacacaccuacucccaggaacagcagagguggaggcaagcag

SEQ ID NO: 219827 - RNA, 64 nt, Human
gcuuaggaagggugguaccucucccugcaucauacccaggaacugccagcuccaaaauauuggg

SEQ ID NO: 219828 - RNA, 64 nt, Human
uccaggggcgcuuggcaucucccauggacugauucccaggaagaaaagcccaaagggaaaccca

SEQ ID NO: 219829 - RNA, 64 nt, Human
agggagggauggaccccgaaaggagaaaaguacucccaggaaacagacgcgugaaaacugagcc

SEQ ID NO: 219830 - RNA, 64 nt, Human
gcaaagaauaaaugaaauaucuugguuuuuauuucccaggaagcuugagagaaaugaguuuaua

SEQ ID NO: 219831 - RNA, 64 nt, Human
cuuauuuuuuuuaaaaagaaaacacaucuaaaagcccaggaacugauuuuuuuaagaggaaaac

SEQ ID NO: 219832 - RNA, 64 nt, Human
ucuuucauaaaggaccucauuccuugcgucccagcccaggaacagugcugucuuugcugucuua

SEQ ID NO: 219833 - RNA, 64 nt, Human; identical to SEQ ID NO: 217546

SEQ ID NO: 219834 - RNA, 64 nt, Human; identical to SEQ ID NO: 214974

SEQ ID NO: 219835 - RNA, 64 nt, Human; identical to SEQ ID NO: 217458

SEQ ID NO: 219836 - RNA, 64 nt, Human
ccuggacaaggaauguaggaagugagugcugugucccaggaagcugcucacacucuuaaaaugg

SEQ ID NO: 219837 - RNA, 64 nt, Human
cagacacacauggcacagacacagcugaccauaacccaggaauccagagcucgguuucucauuu

SEQ ID NO: 219838 - RNA, 64 nt, Human
acauguccuuucccaugaggccuugguucagagccccaggaauggaccccccaaucacucccca

SEQ ID NO: 219839 - RNA, 64 nt, Human
cuucaggagccuagguuugaacagcagaugcugucccaggaagggcuagggacaucggagggga

SEQ ID NO: 219840 - RNA, 64 nt, Human
agggacuguggcgaccgugccucugugccagcgucccaggaaggaagccaacccugagcgagcc

SEQ ID NO: 219841 - RNA, 64 nt, Human
caccccacccucagcgucucugccccuaaggcagcccaggaaauaggaacugagacucugguac

SEQ ID NO: 219842 - RNA, 64 nt, Human
uacucgcgagguugaggcaggagaauugcuugaacccaggaaguggcaguugcagugagccgag

SEQ ID NO: 219843 - RNA, 64 nt, Human
gccugaagaagacaagauuucuggacaagcucagcccaggaaacaaaggguaaacaaaaaacua

SEQ ID NO: 219844 - RNA, 64 nt, Human
agccaccuaagguggaggugggggaauaguguuucccaggaagcucauugaguugugugcgggu

SEQ ID NO: 219845 - RNA, 64 nt, Human
uggauccgggaccgaggguggucucuuggacaaccccaggaacuuggaccaaggcagagccaau

SEQ ID NO: 219846 - RNA, 64 nt, Human
aauggaauaaaauuaauuaggcuaauaggcuuaacccaggaaauccuaaguuccuugaauaucc

SEQ ID NO: 219847 - RNA, 64 nt, Human
auuauuagcucgagaaauaccacaugccagucuucccaggaaggugaccugccugaccaugaag

SEQ ID NO: 219848 - RNA, 64 nt, Human
uacuggggaggcugaggcacgagaaucacuugaacccaggaagcgggguugcagugagccaaag

SEQ ID NO: 219849 - RNA, 64 nt, Human
cagcuccuccccugcuaccugcugagccagauuccccaggaaucuugaaugcuuucucuccucu

SEQ ID NO: 219850 - RNA, 64 nt, Human
uuugggagauguauauaguaauaugauucucauacccaggaacuguaaauuuaaaccuaaauau

SEQ ID NO: 219851 - RNA, 64 nt, Human; identical to SEQ ID NO: 214975

SEQ ID NO: 219852 - RNA, 64 nt, Human; identical to SEQ ID NO: 217470

SEQ ID NO: 219853 - RNA, 64 nt, Human; identical to SEQ ID NO: 217471

SEQ ID NO: 219854 - RNA, 64 nt, Human
uguuuugauacagucauuauauuugauuaguauucccaggaauacccccaccuaguuacucaaa

SEQ ID NO: 219855 - RNA, 64 nt, Human
aggggacgguaccaagaguagcgcuuagcccuuacccaggaaauauccuucauggccacagaaa

SEQ ID NO: 219856 - RNA, 64 nt, Human
cauagagagcccuauucaucgcugcccaggccuucccaggaaaaucauuuuuucugggcugaug

SEQ ID NO: 219857 - RNA, 64 nt, Human
cuugccaggccgucucuugcucccuaauucauuucccaggaagcugugauacagggugaaauaa

SEQ ID NO: 219858 - RNA, 64 nt, Human
cuaggcacccuacgcuagugugagaagccugcgccccaggaaggaucuguguuagucccuggga

SEQ ID NO: 219859 - RNA, 64 nt, Human
agugagugggcucgagggaggguugccugggaaccccaggaauugacccugaguuuuaaauucg

SEQ ID NO: 219860 - RNA, 64 nt, Human
cucucucuaggguacauggugcugggagaggcagcccaggaagucucaucuggggagcaggcag

SEQ ID NO: 219861 - RNA, 64 nt, Human
auccaugugauuaagauccaggccgcugaaguuccccaggaaaugaucuuccacuugagcaacc

SEQ ID NO: 219862 - RNA, 64 nt, Human
ugggacuuuggagcuuaccagagaugcagucccucccaggaaccuguuggagaggcaggaccug

SEQ ID NO: 219863 - RNA, 64 nt, Human
guuccugcacaaccucagaggggcaaaaacccuccccaggaaggaggaggguguucaggagcca

SEQ ID NO: 219864 - RNA, 64 nt, Human
gcuaaccaccugcccagaagaguggaucucacagcccaggaacauucccaagcaggaaaaccgu

SEQ ID NO: 219865 - RNA, 61 nt, Human
ucucuccaucaggcagcuagccauacccaaccccaggaaggaaggccuuggauggacccuc

SEQ ID NO: 219866 - RNA, 64 nt, Human
ccaggagcucucugcugagcagcccagcacaacccccaggaaacacaaaugggguccaggucac

SEQ ID NO: 219867 - RNA, 64 nt, Human
caucuucuggcagcagaaauccaugaagcccgggcccaggaaaauuagaaguuuuccauuccug

SEQ ID NO: 219868 - RNA, 64 nt, Human
acuucagugggagagcugucugguucauauucuacccaggaaugguacuuuucagugcagccag

SEQ ID NO: 219869 - RNA, 64 nt, Human; identical to SEQ ID NO: 217472

SEQ ID NO: 219870 - RNA, 64 nt, Human; identical to SEQ ID NO: 214992

SEQ ID NO: 219871 - RNA, 64 nt, Human; identical to SEQ ID NO: 217509

SEQ ID NO: 219872 - RNA, 64 nt, Human
gacuauuccuuagccuuauagauuucuaguacugcccaggaaaucuaauuucaauacauuuauc

SEQ ID NO: 219873 - RNA, 64 nt, Human
ugugcagaaauuaaauuuuauuuucagcauuuagcccaggaauucuuccaguaggugcucagcu

SEQ ID NO: 219874 - RNA, 64 nt, Human
cucgcuccuaccuccccacaccucucucugaguccccaggaacacacagaggugcacaucacau

SEQ ID NO: 219875 - RNA, 64 nt, Human
uuaugaaguuagugcgggcuuugcugcucccuggcccaggaaagagggacuaccugacccucac

SEQ ID NO: 219876 - RNA, 64 nt, Human
ccuguggcuuaagccuaagucucuucagccaccucccaggaagaucuggccuccguccuaugcc

SEQ ID NO: 219877 - RNA, 64 nt, Human
aggaagugcauucuccauccucauccucugcccucccaggaagucagugauugucuuuuugggc

SEQ ID NO: 219878 - RNA, 64 nt, Human
ccccccugccagcuauugacacagcugcgaagugcccaggaagaggagaaccggcagcugcugg

SEQ ID NO: 219879 - RNA, 64 nt, Human
ccaagucugagcuuggaguggcagucguccaaaccccaggaagagagcucuaaagauggggcuu

SEQ ID NO: 219880 - RNA, 64 nt, Human
uggcgccauggauuccucugggggcuggcgcaugcccaggaaagccugggccacacgggacacu

SEQ ID NO: 219881 - RNA, 64 nt, Human
cagcugagcaaacccagggaauagcccuccucuccccaggaaacuucucugaaaucuuagacuu

SEQ ID NO: 219882 - RNA, 64 nt, Human
agagcuugucauccccagccuggugucccgcagucccaggaagccgcuucuugccuucauggcu

SEQ ID NO: 219883 - RNA, 64 nt, Human
uguuacuccacagcggaggagaccagcucagaggcccaggaaucggagcgaagcagagaggugg

SEQ ID NO: 219884 - RNA, 64 nt, Human
ccugacaucuguucauuuaggcuucaguuccacucccaggaacuuugccugucccacgagggag

SEQ ID NO: 219885 - RNA, 64 nt, Human
uucuccucuggggccugauccaccucuacaccagcccaggaagccccaucugugccugcccuca

SEQ ID NO: 219886 - RNA, 64 nt, Human
cuuggcagggccuucaagaggccugugugggggccccaggaauccuuagcugaagcggggagac

SEQ ID NO: 219887 - RNA, 64 nt, Human; identical to SEQ ID NO: 217830

SEQ ID NO: 219888 - RNA, 64 nt, Human; identical to SEQ ID NO: 217362

SEQ ID NO: 219889 - RNA, 64 nt, Human; identical to SEQ ID NO: 217459

SEQ ID NO: 219890 - RNA, 64 nt, Human
cacuggcccugagcacgacagcccuucuuacccucccaggaaugccgugaaaggagacaagguc

SEQ ID NO: 219891 - RNA, 64 nt, Human
aacagaagaaaaaaguauauucucacaguuuuuccccaggaagucuggagaaaaaguccucaug

SEQ ID NO: 219892 - RNA, 64 nt, Human
uaagaaacacacugaggcagggaaguccccaggccccaggaagccgugcccugcccccgugagg

SEQ ID NO: 219893 - RNA, 64 nt, Human
gugccaggccuggggccccucccaguucccccgccccaggaaacacugcugaccuuugcaaagg

SEQ ID NO: 219894 - RNA, 64 nt, Human
uggcucagugagacuccugcugggaggguggaggcccaggaaugggcgggcaggacacccucau

SEQ ID NO: 219895 - RNA, 64 nt, Human
cagccuucuccagccugugugauacaaguuugaucccaggaacuugaguucuaagcagugcucg

SEQ ID NO: 219896 - RNA, 64 nt, Human
caccagauggcauccuugggaccugaaucuaucacccaggaaucucaaacucccuuuggcccug

SEQ ID NO: 219897 - RNA, 64 nt, Human
cagacagggacacagggucacugagcuuuguguccccaggaacugguauagggcaccuagaggu

SEQ ID NO: 219898 - RNA, 64 nt, Human
auucaacggggccauggcaggaaagcugacccuacccaggaaaguaauagcuucuuuaaaaguc

SEQ ID NO: 219899 - RNA, 64 nt, Human
gugagggauaagcaaaagaggauguucaccauaacccaggaaugaagauaccaucagcaaagaa

SEQ ID NO: 219900 - RNA, 64 nt, Human
cuccuagcccauggcagacccagaccucuucucccccaggaauuagaaguggcaggagagaaca

SEQ ID NO: 219901 - RNA, 64 nt, Human
cccaguugguuuucucauggacaucucuuccucucccaggaagcuuacaauuuucuucucucuc

SEQ ID NO: 219902 - RNA, 64 nt, Human
gggaagaaaucaccaccggucauucuaacccucacccaggaaugggggugacucgcacaagacc

SEQ ID NO: 219903 - RNA, 64 nt, Human
cccaucccccauagucgccagacuuucucauguucccaggaagcucagaaguauggcagcuaag

SEQ ID NO: 219904 - RNA, 64 nt, Human
gauggugggauugggaccugggggauacaggggccccaggaagaagcugccagaggggcagcuc

SEQ ID NO: 219905 - RNA, 64 nt, Human; identical to SEQ ID NO: 217776

SEQ ID NO: 219906 - RNA, 64 nt, Human; identical to SEQ ID NO: 214993

SEQ ID NO: 219907 - RNA, 64 nt, Human; identical to SEQ ID NO: 217528

SEQ ID NO: 219908 - RNA, 64 nt, Human
gcccauuugggccugcauagugccaugauuggaacccaggaacucuggucuccuugccuagugc

SEQ ID NO: 219909 - RNA, 64 nt, Human
ugguagaccgaagccuugugcauaaggauuuuuucccaggaaaagauagacuuuauaaacagug

SEQ ID NO: 219910 - RNA, 64 nt, Human
gaaauguguucacaugcugugggaaccccuuuaucccaggaaguccucuuccuugugccuuaac

SEQ ID NO: 219911 - RNA, 64 nt, Human
gaagccaagacaguggcagcaaaggaagacuuggcccaggaaaaaccuguggguugugcuaauu

SEQ ID NO: 219912 - RNA, 64 nt, Human
ccacuccaaucacccuacaagaugccaaggaggucccaggaaguccagcuccuuaaacugacgc

SEQ ID NO: 219913 - RNA, 64 nt, Human
gagucuuuuuuuccucugcccugaucaacuggggcccaggaaaagcaaugucucuucacgggcc

SEQ ID NO: 219914 - RNA, 64 nt, Human
guuuuuucuccuuuguccaaaggccagagaccaucccaggaagaguggugggugguuuauacac

SEQ ID NO: 219915 - RNA, 64 nt, Human
gccaagagagcugagaggagcaguugugacucuacccaggaacaaacugugccugaaccugagg

SEQ ID NO: 219916 - RNA, 64 nt, Human
aauacuucugauaauuuauugucuuuauuuuuaucccaggaaauaaaagguuaccuuguugagg

SEQ ID NO: 219917 - RNA, 64 nt, Human
ccagccugggcucacccuguguggcucauucccacccaggaaacugaagauaaaagauuuggga

SEQ ID NO: 219918 - RNA, 64 nt, Human
auuucagccaugauaagaacagagugccugcauucccaggaaaauacgaaaaucccaugagaua

SEQ ID NO: 219919 - RNA, 64 nt, Human
uguuuucugccuacaccguucaucagccccauaacccaggaaggaacaggcauuguuagcauca

SEQ ID NO: 219920 - RNA, 64 nt, Human
ccuuaaaaaaauaaaaccucugaaccaaaaucuucccaggaauaguacuuaauagauuuuaaug

SEQ ID NO: 219921 - RNA, 64 nt, Human
cacgagugucugugaggcgcugcgcggacucgcccccaggaacgcucuccucgagcccuccccc

SEQ ID NO: 219922 - RNA, 64 nt, Human
acucuccccaguccucaggcagcagcuuuuccaccccaggaaucucuguuccuucucugucugc

SEQ ID NO: 219923 - RNA, 64 nt, Human; identical to SEQ ID NO: 217381

SEQ ID NO: 219924 - RNA, 64 nt, Human; identical to SEQ ID NO: 215088

SEQ ID NO: 219925 - RNA, 64 nt, Human; identical to SEQ ID NO: 216887

SEQ ID NO: 219926 - RNA, 64 nt, Human
auagggaccucagggagccccagcuucuuacccacccaggaaacccuugguccagagaggacag

SEQ ID NO: 219927 - RNA, 64 nt, Human
auaagcccuaagggugguaggaacccaggagggacccaggaaacuaagauuugagauucagugc

SEQ ID NO: 219928 - RNA, 64 nt, Human
ucccuguccagucaccuuuccaucagggcacuagcccaggaaugacuccucacacuuucaccuu

SEQ ID NO: 219929 - RNA, 64 nt, Human
cuuuucuucauaaaaccuuugggguuuggauuuccccaggaagauggagaauggaauacucacu

SEQ ID NO: 219930 - RNA, 64 nt, Human
ccucuccucaggcuccuccuugcccccaccuugccccaggaaaggccaaaguccaggugacugc

SEQ ID NO: 219931 - RNA, 64 nt, Human
uuucuccucuccccaggaugcagaaaguggugaacccaggaacugaggaaggagguuuccaguu

SEQ ID NO: 219932 - RNA, 64 nt, Human
guagccagcugugcacuuucuucucuuucccaaccccaggaaagguuuuccuuauuuugugugc

SEQ ID NO: 219933 - RNA, 64 nt, Human
cccuccccuggggacgccaaggaggugggccacacccaggaagggaaagcgggcagccccguuu

SEQ ID NO: 219934 - RNA, 64 nt, Human
cugggcgguggcuucacuccugagucugcaaaaucccaggaaacuugggucuugcugcccaucc

SEQ ID NO: 219935 - RNA, 64 nt, Human
cacugcucugcucccuaagguccuugacuuucuccccaggaauucacuuaaaaagggacugagc

SEQ ID NO: 219936 - RNA, 64 nt, Human
gcgaccccauuucccgugugaaccauaggcacaacccaggaaguuuccccacuuguaggagugu

SEQ ID NO: 219937 - RNA, 64 nt, Human
caaguacagccacuguaaauaacccucgucccugcccaggaacccagacuggacuucagucucc

SEQ ID NO: 219938 - RNA, 64 nt, Human
aggagggucaggccuguaccccagccuccugucccccaggaaccucacagggguaucaaaaaga

SEQ ID NO: 219939 - RNA, 64 nt, Human
gauaguuuucuucaggugucaauggcguuagacucccaggaagacuagcccugcccacagggcc

SEQ ID NO: 219940 - RNA, 64 nt, Human
gaaaagagauugagauguaagucucaacucuguccccaggaaguugugugacccuaggccucuc

SEQ ID NO: 219941 - RNA, 64 nt, Human; identical to SEQ ID NO: 217902

SEQ ID NO: 219942 - RNA, 64 nt, Human; identical to SEQ ID NO: 214935

SEQ ID NO: 219943 - RNA, 64 nt, Human; identical to SEQ ID NO: 214994

SEQ ID NO: 219944 - RNA, 64 nt, Human
aggugugcaggggagcacacagggcccggcagcccccaggaaucaaggauagggcuaagguuuu

SEQ ID NO: 219945 - RNA, 64 nt, Human
uggguuaacaaaugagccauccccagggcccacccccaggaaggccacagugcugggcggcauc

SEQ ID NO: 219946 - RNA, 64 nt, Human
agcuccugcuuagggaaggucagcaggcacugugcccaggaagagccugcggccucggcguccc

SEQ ID NO: 219947 - RNA, 64 nt, Human
ccacacuuuauucaccacccuggagaaaaaaaaacccaggaauauguggaaaagccauuaauaa

SEQ ID NO: 219948 - RNA, 64 nt, Human
cccucccucaaggcugggaggagauaaacaccaacccaggaauucucaauaaauuuuuauuacu

SEQ ID NO: 219949 - RNA, 64 nt, Human
cucugauaauugucuccccuccauaggaauuucucccaggaaagaaauauauccccaucuccgu

SEQ ID NO: 219950 - RNA, 64 nt, Human
gaagaucugggggaauaaaaagccaacaguaagccccaggaaaggguuuuuugagaccauaugu

SEQ ID NO: 219951 - RNA, 64 nt, Human
gaggaagaagggugaggacagcaccagacuuagccccaggaaggauccuacuuccuaaaaucug

SEQ ID NO: 219952 - RNA, 64 nt, Human
ggcccuucacauuuuuggccuggguggggcugggcccaggaaggggugggcuggauuuuguaaa

SEQ ID NO: 219953 - RNA, 64 nt, Human
gaagccuagcaggauuucagaugcaggagagagacccaggaagcccggcagagcccugagcccc

SEQ ID NO: 219954 - RNA, 64 nt, Human
ccuggcccuccccuccuuggcauucaugggggagcccaggaaccccccacaccuaugggguuag

SEQ ID NO: 219955 - RNA, 61 nt, Human
agucggaggucucagaguaaggcggcuggaccccaggaaccccagggcacuccacugcagc

SEQ ID NO: 219956 - RNA, 64 nt, Human
caauagaaaugaacaagucugcuaccucuucauccccaggaagcccacuacauaguuuggaaac

SEQ ID NO: 219957 - RNA, 64 nt, Human
ccaaccaggguugaggaaccaucucagccauccucccaggaagcccaccccugacccuuacuaa

SEQ ID NO: 219958 - RNA, 64 nt, Human
agugcggugguguguguagccccaaccacugguccccaggaagugguggugguugauggcuuuu

SEQ ID NO: 219959 - RNA, 64 nt, Human; identical to SEQ ID NO: 217529

SEQ ID NO: 219960 - RNA, 64 nt, Human; identical to SEQ ID NO: 217343

SEQ ID NO: 219961 - RNA, 64 nt, Human; identical to SEQ ID NO: 215011

SEQ ID NO: 219962 - RNA, 64 nt, Human
caccacuguauccuccagcuccuuccuuccuucccccaggaacacggaggccaccgagggggcu

SEQ ID NO: 219963 - RNA, 64 nt, Human
gccaucuccaauauuucuauaguauaccaaccaccccaggaaugcacuuuaacaauaucaggau

SEQ ID NO: 219964 - RNA, 64 nt, Human
acagccucacaggagcaguuugugggcugguuuccccaggaauccagacccuaacccgugagaa

SEQ ID NO: 219965 - RNA, 64 nt, Human
uauugggaaaugaaaaugcauuucuaucuagcuucccaggaauauuucuacccaaaauagaaaa

SEQ ID NO: 219966 - RNA, 64 nt, Human
uacucaggagguugaggcagaagaaucgcuugaacccaggaaguggagguugcagugagccgag

SEQ ID NO: 219967 - RNA, 57 nt, Human
ugaccccagucgugucuugaugacucucccaggaaucagaaagauaguauuuacuaa

SEQ ID NO: 219968 - RNA, 64 nt, Human
gccuuauuucuagaagcacauguguauuuauacccccaggaaacuagcuuuugccaguauuaug

SEQ ID NO: 219969 - RNA, 64 nt, Human
guggagggaauuggguuuguggcaaagagcuugacccaggaaauagauggugccccccaaauug

SEQ ID NO: 219970 - RNA, 64 nt, Human
acucagggagguugaggcagcaggauugcuggagcccaggaaauugaggcugcagugagccaug

SEQ ID NO: 219971 - RNA, 64 nt, Human
ggcagagcuggcacugucacugcugcaggagacacccaggaacuaugaguugggggauguggua

SEQ ID NO: 219972 - RNA, 64 nt, Human
aaucaaucuucaacagauaaucuuuaaguacagacccaggaauaucagaucugaaguggcacca

SEQ ID NO: 219973 - RNA, 64 nt, Human
ccagaaaggcacccuucauuccaccagaacuuuacccaggaagaacacgaucauuuccuuuuuc

SEQ ID NO: 219974 - RNA, 64 nt, Human
uaaggauugagggacaguugcuuuucagcaugggcccaggaaugccaaggagacaucuaugcac

SEQ ID NO: 219975 - RNA, 64 nt, Human
uucauccccugcccugccgggcaccucgcucuaccccaggaaaaugugagcucguuuuccugcu

SEQ ID NO: 219976 - RNA, 64 nt, Human
ucaggccucaagugggcaugggggcagggacgggcccaggaacuguuguuuucucaggauucuu

SEQ ID NO: 219977 - RNA, 64 nt, Human; identical to SEQ ID NO: 214880

SEQ ID NO: 219978 - RNA, 64 nt, Human; identical to SEQ ID NO: 217584

SEQ ID NO: 219979 - RNA, 64 nt, Human; identical to SEQ ID NO: 217585

SEQ ID NO: 219980 - RNA, 64 nt, Human
gccugccaacccccucccucaaggaauggccuugcccaggaaugcccaccacacauacccucuu

SEQ ID NO: 219981 - RNA, 64 nt, Human
auacauguauaaaguuuauuaaaagucauaaugacccaggaauagcuaaugacacagaaguaga

SEQ ID NO: 219982 - RNA, 64 nt, Human
uuuauuccaauuuccagagagaagagaaaacucacccaggaaguuuaaaaauucuuuaaacagg

SEQ ID NO: 219983 - RNA, 64 nt, Human
auuuaucauggaugaaagagaucuguaaaaccugcccaggaacuuacagaauuuacuuugcaga

SEQ ID NO: 219984 - RNA, 64 nt, Human
uuuuccuuccuugagucauagaacguauccaucucccaggaaauguccuucucuggcgucugcu

SEQ ID NO: 219985 - RNA, 64 nt, Human
cacuaucaguggucguguaccuucuccaccugcccccaggaaaaagagucucccccuuaaauuu

SEQ ID NO: 219986 - RNA, 64 nt, Human
cacugcccuggagaggcagcaucaggaccuaagccccaggaacuucacccaacuuaggcccugg

SEQ ID NO: 219987 - RNA, 64 nt, Human
gucagaccagguucggauacaaucaucugcucaucccaggaauaguuucuugggggacucacuc

SEQ ID NO: 219988 - RNA, 64 nt, Human
auugauuuugguccuccuccgcugucccccaacacccaggaaugggaaucuggcuugguucgag

SEQ ID NO: 219989 - RNA, 64 nt, Human
gcugggauuaacgggugugagccacggcgcccagcccaggaagaguuuuuaaauuagagcucug

SEQ ID NO: 219990 - RNA, 64 nt, Human
gacccccuccaccaggcauuagagguccaccucccccaggaaugcguccaccaagaccuuagca

SEQ ID NO: 219991 - RNA, 64 nt, Human
uccaggugcacccagcauguccuaggaaugcagccccaggaagucccagaccuaaaacaaccag

SEQ ID NO: 219992 - RNA, 64 nt, Human
aaauuauuuuauguuaaaaugugugcuaaacuaucccaggaaaguauuuaauccaacauuguaa

SEQ ID NO: 219993 - RNA, 64 nt, Human
uuuccuucugguuuugagagacuuccucuugggucccaggaagagggauucccugacuuugaua

SEQ ID NO: 219994 - RNA, 64 nt, Human
guacauguguucauguucccagccagcucugagacccaggaaccaaauauuccauuuuggcuuc

SEQ ID NO: 219995 - RNA, 64 nt, Human; identical to SEQ ID NO: 214879

SEQ ID NO: 219996 - RNA, 64 nt, Human; identical to SEQ ID NO: 218433

SEQ ID NO: 219997 - RNA, 64 nt, Human; identical to SEQ ID NO: 218434

SEQ ID NO: 219998 - RNA, 64 nt, Human
ccugcugaugagcccacuccaggggccccagccccccaggaacuuggggcugccggugagcagg

SEQ ID NO: 219999 - RNA, 64 nt, Human
auuuuaggaggccaagguuggaggaucauuugagcccaggaauuggaaagcagccuggccaaca

SEQ ID NO: 220000 - RNA, 64 nt, Human
gugaaagaauuaucagugagugaaaggccaucaccccaggaagccaaaugagggagcagcaaca

SEQ ID NO: 220001 - RNA, 64 nt, Human
cauaacugguaacugcaaagccuuuugugcuggacccaggaauccuuaccauggagcagcagau

SEQ ID NO: 220002 - RNA, 64 nt, Human
ugcccugagcugccagugcuggguaucccccagccccaggaaauguggggucggccaggacccu

SEQ ID NO: 220003 - RNA, 64 nt, Human
cucuucauucagaagaggaacacaaaggaagccacccaggaaggaagcacagagcugggggcuc

SEQ ID NO: 220004 - RNA, 64 nt, Human
cuggggguuauucgggaugguucagccagggccucccaggaagagugcuguggagccacgguga

SEQ ID NO: 220005 - RNA, 64 nt, Human
guucagccccuucucugggaugugguucuauucccccaggaaaaaggagccccagccuucugag

SEQ ID NO: 220006 - RNA, 64 nt, Human
uggagaaaugcgcaugggggugggccugguaagucccaggaaccacaggaagugagcuaaggcu

SEQ ID NO: 220007 - RNA, 64 nt, Human
gacucucccuguuuuagcacugaaagucucuugccccaggaaaccccaucagucccaggcagau

SEQ ID NO: 220008 - RNA, 64 nt, Human
uggguuucugaaauauuuuauggacuuauuucuccccaggaaaugauucuuacggaaaaaaauu

SEQ ID NO: 220009 - RNA, 64 nt, Human
uagguauaaaccucuguaugaagagaagauuucucccaggaaaucuuuguacagcuuuaaguug

SEQ ID NO: 220010 - RNA, 64 nt, Human
guagcagagauggccugccaagaguugcaggagacccaggaaagggaguugcugagggcagguc

SEQ ID NO: 220011 - RNA, 64 nt, Human
aaaaucuaguuaaaauaauccaauggacagaagccccaggaagggguauuuccaacacuuggcg

SEQ ID NO: 220012 - RNA, 59 nt, Human
agggcuucaagaucuucugaggcccccuccccaggaagccuaggcucgguggcuggaca

SEQ ID NO: 220013 - RNA, 64 nt, Human; identical to SEQ ID NO: 214897

SEQ ID NO: 220014 - RNA, 64 nt, Human; identical to SEQ ID NO: 217622

SEQ ID NO: 220015 - RNA, 64 nt, Human; identical to SEQ ID NO: 217623

SEQ ID NO: 220016 - RNA, 64 nt, Human
caagaguccucagcacuccacauucccaaaaaaucccaggaacuccuaaaccuuccccugugac

SEQ ID NO: 220017 - RNA, 64 nt, Human
gcccugcagucacauggguguggccuccaagcuccccaggaaagcaguggcagccucugggguu

SEQ ID NO: 220018 - RNA, 64 nt, Human
ccugggcuguccucucugaaugccuuggagggaucccaggaagccccaguaggagggagcuuca

SEQ ID NO: 220019 - RNA, 64 nt, Human
ugcuuaagaauggaauuuccucucugugacagaacccaggaauuaauuccuaaauacauaacgu

SEQ ID NO: 220020 - RNA, 64 nt, Human
ugaccagaugcccugcuccaucacaaccuccuuccccaggaaaacccacuuuccaaaagcccaa

SEQ ID NO: 220021 - RNA, 64 nt, Human
gcuggccuuccuucucuucugagcccuccccugccccaggaacccuggccucaccaaaacagca

SEQ ID NO: 220022 - RNA, 64 nt, Human
caagggcaauaauaagguggaauuugcaggucagcccaggaauuggcagaggaaguaggugucu

SEQ ID NO: 220023 - RNA, 64 nt, Human
gcucauccaccuucacaccacuugugagcugacccccaggaacagcuuggcuguuccaccagag

SEQ ID NO: 220024 - RNA, 64 nt, Human
ugugguggcuacuuuuggucugaaacccacuuggcccaggaaagagaaaagguuguauguuuug

SEQ ID NO: 220025 - RNA, 64 nt, Human
cuggugcccugagacagacacacagccucacgcccccaggaaugcaagugguuuccuggugcuu

SEQ ID NO: 220026 - RNA, 57 nt, Human
gucaggagugggggaaaugaggugcaccccaggaaggccccguagaccuccgaagac

SEQ ID NO: 220027 - RNA, 64 nt, Human
uacuuaggaggcugaggcaggagaaucgcuugaacccaggaaguggagguugcagugagcugau

SEQ ID NO: 220028 - RNA, 64 nt, Human
cuugugcugggcuaggaccucaaccccagggauucccaggaagcagaacucuccagaagaaggg

SEQ ID NO: 220029 - RNA, 64 nt, Human
guccuuguuccuuguuugagacugggcugcaggccccaggaagacuuuccuucacccaccaucc

SEQ ID NO: 220030 - RNA, 64 nt, Human
uuuuauuuauauguuguggggacugcauaacuagcccaggaaaugacucugguuuugaguggcc

SEQ ID NO: 220031 - RNA, 64 nt, Human; identical to SEQ ID NO: 217624

SEQ ID NO: 220032 - RNA, 64 nt, Human; identical to SEQ ID NO: 217401

SEQ ID NO: 220033 - RNA, 64 nt, Human; identical to SEQ ID NO: 217287

SEQ ID NO: 220034 - RNA, 64 nt, Human
agcagcagcaugucagcugagccuccugcccucccccaggaacaugcacgcucacucugcuucc

SEQ ID NO: 220035 - RNA, 64 nt, Human
agggagggagggcuccagacacauguccaagaagcccaggaaaggcuccaggagcagccacauu

SEQ ID NO: 220036 - RNA, 64 nt, Human
uugaagcagggagaaauugaccuuugccuugucgcccaggaaguggggcucggcacccauaacu

SEQ ID NO: 220037 - RNA, 64 nt, Human
gcacauuccucuagcuuccuggaggacucacucccccaggaagccuucccugccuucucugggc

SEQ ID NO: 220038 - RNA, 64 nt, Human
ggaccugggcucucuccacgauucuggcuguuugcccaggaacuuaggguggguaccucugagu

SEQ ID NO: 220039 - RNA, 64 nt, Human
agcuuuagcuuucuccaccagauaaccagcuaaucccaggaauuugcugccccccaccaguggc

SEQ ID NO: 220040 - RNA, 64 nt, Human
ccaggccucugcuaucugcaucugcagugggcuucccaggaacuugacugucuuucauuugauc

SEQ ID NO: 220041 - RNA, 64 nt, Human
cucagugcugacucacgggcaugcuucauugaggcccaggaagaggcccugguuuggggcugug

SEQ ID NO: 220042 - RNA, 64 nt, Human
gacugcaucccauguucccaugcucuucuccguccccaggaaugcgaacggcaguuucccuucc

SEQ ID NO: 220043 - RNA, 64 nt, Human
agcccaaagauuuuccugucccuggagugccagccccaggaagcuccagggcugaguggucagg

SEQ ID NO: 220044 - RNA, 64 nt, Human
uauaauaaaguccucguuuucguuucgauuugggcccaggaacaggcagcuacgacguuaagac

SEQ ID NO: 220045 - RNA, 64 nt, Human
gggcaagcuccggggucucuggguggagagcugacccaggaagggcugcagcugagcugggggu

SEQ ID NO: 220046 - RNA, 64 nt, Human
ggguggggggucauagccacaggggagggcaguucccaggaagguaaccagaugucucuuuugu

SEQ ID NO: 220047 - RNA, 64 nt, Human
guaucaguucucugauccacuuccauuuaagcuccccaggaaaucccaugacaaacuggccucu

SEQ ID NO: 220048 - RNA, 64 nt, Human
ucuaaggucccuuccagcccagccguucugggagcccaggaauccaugaugccggacagaguuc

SEQ ID NO: 220049 - RNA, 64 nt, Human; identical to SEQ ID NO: 214898

SEQ ID NO: 220050 - RNA, 64 nt, Human; identical to SEQ ID NO: 217641

SEQ ID NO: 220051 - RNA, 64 nt, Human; identical to SEQ ID NO: 217642

SEQ ID NO: 220052 - RNA, 64 nt, Human
gcuaauugggccucagugcccgggcuauuuugaacccaggaauccuuggggguggugggaggag

SEQ ID NO: 220053 - RNA, 64 nt, Human
cugacccacuauuucuccucugcuucagaggaaacccaggaaaugcccuuacugccaggcugag

SEQ ID NO: 220054 - RNA, 64 nt, Human
agccauguggaggaaggcuggagcuuguuccugccccaggaauaggccaggagggaaggccgca

SEQ ID NO: 220055 - RNA, 64 nt, Human
ccccagcucugcgucgguccuggugcccuggaugcccaggaaucuguauauauuuauggccggg

SEQ ID NO: 220056 - RNA, 64 nt, Human
ccccagcuucuggggagggacacagcuuccccuucccaggaauugagugggccuagccccuccc

SEQ ID NO: 220057 - RNA, 64 nt, Human
caccccacagcccuucaccuucgcuaucaaacaucccaggaaaggguaagaauuuagggccacc

SEQ ID NO: 220058 - RNA, 64 nt, Human
auucauguucaucaauaccugcugagaguacugucccaggaauauccaguggauggauucauca

SEQ ID NO: 220059 - RNA, 64 nt, Human
caguucugcucuaacauggcaugcccuuucucagcccaggaaacagcaugugguucagagaaaa

SEQ ID NO: 220060 - RNA, 64 nt, Human
aaacacccaaacagaaaaauacaaauacacguaccccaggaaggggucccucaagucucugcua

SEQ ID NO: 220061 - RNA, 64 nt, Human
ccaagccccuaggcuggggcacagccuggccaugcccaggaagacccaccccauucccacuccu

SEQ ID NO: 220062 - RNA, 64 nt, Human
cuacaguucacagaggucuuucagcucauuuaaucccaggaaagaggcaucaaagcuagaaugu

SEQ ID NO: 220063 - RNA, 64 nt, Human
ccuguccagcuucuuccuggucagggcugggacccccaggaauauuauguugccgugugugugu

SEQ ID NO: 220064 - RNA, 64 nt, Human
agaacagaagaugugcaauagggcucagagcagccccaggaagugggccaugucuguggggagc

SEQ ID NO: 220065 - RNA, 64 nt, Human
aaucccccaaccagagauguuaaagugagccugucccaggaaacaucuccacccaagacgucuu

SEQ ID NO: 220066 - RNA, 64 nt, Human
gaugaugucaucguccaucccaucuuccuuugcccccaggaaaggacgcauccaccgguagcgg

SEQ ID NO: 220067 - RNA, 64 nt, Human; identical to SEQ ID NO: 218053

SEQ ID NO: 220068 - RNA, 64 nt, Human; identical to SEQ ID NO: 214899

SEQ ID NO: 220069 - RNA, 64 nt, Human; identical to SEQ ID NO: 217662

SEQ ID NO: 220070 - RNA, 64 nt, Human
ccuccugcggcccuagcgacccucaggcuucuuccccaggaagcggggucuuggccuggaaccu

SEQ ID NO: 220071 - RNA, 64 nt, Human
uuuguccugccucgccaucggagcucucaugggccccaggaaguccagggacagcucccuuaua

SEQ ID NO: 220072 - RNA, 64 nt, Human
ucguguacccccucaaggcugaccccuuagauggcccaggaauggcaggugcuacaaaaauggu

SEQ ID NO: 220073 - RNA, 64 nt, Human
agcacuccccagaccagaucacuuuuuggacacacccaggaaggcuuuugaagucaagccaguu

SEQ ID NO: 220074 - RNA, 64 nt, Human
uuggcccaggccccuggcagugcucccggaggggcccaggaaggccugggcagagacccuguag

SEQ ID NO: 220075 - RNA, 64 nt, Human
gauuuuauauuauuaggagcaaaaguaaaugaagcccaggaaaacaccuuugggaacaaacucu

SEQ ID NO: 220076 - RNA, 64 nt, Human
ccugguguucuaccagaaaaacgucucccaaucacccaggaaagcuguccacaguagucccccc

SEQ ID NO: 220077 - RNA, 64 nt, Human
gcaaacucuauaagaguguuuuaaaaauuaacuucccaggaagugaguuaaaaacaauaaaagc

SEQ ID NO: 220078 - RNA, 64 nt, Human
cccuggugggucccagccagggcagaggggccuccccaggaagucuccuacccucucagccagg

SEQ ID NO: 220079 - RNA, 64 nt, Human
acuggagcuuagccugagaggguucuuggccucccccaggaaagauuucaaaggcaagcgccag

SEQ ID NO: 220080 - RNA, 64 nt, Human
uucuuggaacuguaaagauuacaacccaaagucucccaggaagcuguggggagaccagaggauc

SEQ ID NO: 220081 - RNA, 64 nt, Human
ccucccaccaugggccccucugcccauguuuccucccaggaagagcgggcagaguggcccagcc

SEQ ID NO: 220082 - RNA, 64 nt, Human
uuugggauuacagcuugaguucugucaccccauccccaggaaacuguagcuucuuaacugguga

SEQ ID NO: 220083 - RNA, 64 nt, Human
cuccuggacuggucuucccagcccuaaacccugccccaggaagcccacagccucaccugcugcu

SEQ ID NO: 220084 - RNA, 64 nt, Human
gggcauauucuggagaggagcagagguccaaggacccaggaauuuggcauggaacaggugguag

SEQ ID NO: 220085 - RNA, 55 nt, Human; identical to SEQ ID NO: 217699

SEQ ID NO: 220086 - RNA, 64 nt, Human; identical to SEQ ID NO: 217700

SEQ ID NO: 220087 - RNA, 64 nt, Human; identical to SEQ ID NO: 217565

SEQ ID NO: 220088 - RNA, 64 nt, Human
ucaccccagggccuguggcugccugggcaccucucccaggaagugguggggcaccggucucccc

SEQ ID NO: 220089 - RNA, 64 nt, Human
aaaaacggugucauauuuagucagaggccccacccccaggaagcauggauggggaugaaggcac

SEQ ID NO: 220090 - RNA, 64 nt, Human
ucccuucccauuuacaacuaaaacugaccagagccccaggaauaaaugguuuucuuggcuuccu

SEQ ID NO: 220091 - RNA, 64 nt, Human
aagaggcagaugggggucaaaccacugccuuggccccaggaaggggccauagguaggucugaac

SEQ ID NO: 220092 - RNA, 64 nt, Human
caccccccaccuccaugccucagccuuugccuaccccaggaaugagcuuggccuccaacauccc

SEQ ID NO: 220093 - RNA, 64 nt, Human
cugucaguuccugucccaggcuuugcccggccgccccaggaacccaacccucugggcugaccuu

SEQ ID NO: 220094 - RNA, 64 nt, Human
cugacucccaggcgcugagauuguugccugguuacccaggaagcugcuguuccggcugcccagc

SEQ ID NO: 220095 - RNA, 64 nt, Human
uuggucaccagauaucucugagggccaagcuaugcccaggaaugugucagagucaccuccauaa

SEQ ID NO: 220096 - RNA, 64 nt, Human
agauguggccagagcaccggccucccagagaaagcccaggaaguccccgugguguccccuggcc

SEQ ID NO: 220097 - RNA, 52 nt, Human
uugaaguggaagaaagaugaaacccaggaaauauauucuucccucucuccug

SEQ ID NO: 220098 - RNA, 64 nt, Human
ucugaauguuugugucugugguugcagucuuucccccaggaaaaaaaaaaaaagaaauucgcau

SEQ ID NO: 220099 - RNA, 64 nt, Human
uucagcuuccuccaccucgcuuccacugcacaggcccaggaaggagaaaggccaagccaaagug

SEQ ID NO: 220100 - RNA, 64 nt, Human
ccaucaccagagucuuaagggucacuggccucuccccaggaaguggcucagaccccucagcccc

SEQ ID NO: 220101 - RNA, 64 nt, Human
aacgaauuguauuuucucucuccuggacaacuuccccaggaaccccguaccagccuguugauca

SEQ ID NO: 220102 - RNA, 64 nt, Human
caaccagcuccugcugccauccccagggagguggcccaggaaggugccuggcccagaauaagga

SEQ ID NO: 220103 - RNA, 64 nt, Human; identical to SEQ ID NO: 218207

SEQ ID NO: 220104 - RNA, 64 nt, Human; identical to SEQ ID NO: 217794

SEQ ID NO: 220105 - RNA, 64 nt, Human; identical to SEQ ID NO: 214918

SEQ ID NO: 220106 - RNA, 64 nt, Human
guguugacugcugcuccccaccccuaccgauggucccaggaagcagggagaguuggggaaggca

SEQ ID NO: 220107 - RNA, 64 nt, Human
ugaucuguuuugugcgucucuucucucccuuuuccccaggaaugaaccgaggccgucgccccug

SEQ ID NO: 220108 - RNA, 64 nt, Human
agcucuuuuuucaucucacaguaaagccuauuuccccaggaaaaaaauaaaugccuuugaauga

SEQ ID NO: 220109 - RNA, 64 nt, Human
cacagaagugauaaaggaauccaaaguugaagagcccaggaaacgggaaacuguauccauaaug

SEQ ID NO: 220110 - RNA, 64 nt, Human
gugagucuauaguacaaaaugcauaaaccauguccccaggaaauuugaaaggaagcaggugcug

SEQ ID NO: 220111 - RNA, 64 nt, Human
gugggguggggacacugacagccccuaucugguccccaggaacauucuaccauuucugccacug

SEQ ID NO: 220112 - RNA, 64 nt, Human
aaaggauucuauaucaugaccaaguggaauuuaucccaggaauucaagguugguucaacaucua

SEQ ID NO: 220113 - RNA, 64 nt, Human
aagagaccuucaguaucagcccuaacucuucucucccaggaaggacuugcugggcucuguggcc

SEQ ID NO: 220114 - RNA, 64 nt, Human
ugucgucacucacaugcacgacaguccuuguucccccaggaagggccugguggccccagcacac

SEQ ID NO: 220115 - RNA, 64 nt, Human
gugcccuuccucacagaguuaaauaugcaucuggcccaggaauuagagaagcugaaaggaugau

SEQ ID NO: 220116 - RNA, 64 nt, Human
cagcuccucuuccuccggauccucuuuugaucugcccaggaaagggaugcauugacacucuccu

SEQ ID NO: 220117 - RNA, 64 nt, Human
ccaggcgcccagcccugcggaggaggccggggcucccaggaagcggacgcccgguccccacaca

SEQ ID NO: 220118 - RNA, 64 nt, Human
uagugacauuggugagacaacagcccuaacacuucccaggaacugaagugccucaugugauuga

SEQ ID NO: 220119 - RNA, 64 nt, Human
caaaggucuucuucccucgccccuucuccaucgucccaggaaucccagggggcagcacagccgg

SEQ ID NO: 220120 - RNA, 64 nt, Human
ggacugcugcucccugccccucccuugcgggucccccaggaagccaggugaccccaggugggag

SEQ ID NO: 220121 - RNA, 64 nt, Human; identical to SEQ ID NO: 217736

SEQ ID NO: 220122 - RNA, 64 nt, Human; identical to SEQ ID NO: 217681

SEQ ID NO: 220123 - RNA, 64 nt, Human; identical to SEQ ID NO: 217248

SEQ ID NO: 220124 - RNA, 64 nt, Human
gagcagaggaggucccagauaccaaguggcgccucccaggaaaggcugggagaagagguggccu

SEQ ID NO: 220125 - RNA, 64 nt, Human
cugggcacacgccaucccagagggcucaggaugccccaggaaggaaagaagggcaacagacuac

SEQ ID NO: 220126 - RNA, 64 nt, Human
uacucgggaggcugaggcaggaggaucgcuugaacccaggaaguggagacugcagugagccgau

SEQ ID NO: 220127 - RNA, 64 nt, Human
aagcugccuggcauguggcacuuugucagggcagcccaggaaucugaaacaggaucaaacucug

SEQ ID NO: 220128 - RNA, 64 nt, Human
cuccuguuuccauaggaaggggcgacaccuuccucccaggaagcugagaccuuuguggucugag

SEQ ID NO: 220129 - RNA, 64 nt, Human
gaggccacacagugaggucuggugggugaaaggacccaggaacgaggcguucaggaaagcaggu

SEQ ID NO: 220130 - RNA, 64 nt, Human
gcagcuggggccucuggucaggaacccucagggacccaggaacucagcuuccaaacaucugcac

SEQ ID NO: 220131 - RNA, 64 nt, Human
cucgcuuucccaccucccuccagacuccuuugaccccaggaaguuuugccccuccuucuucucc

SEQ ID NO: 220132 - RNA, 64 nt, Human
uacggcggccuagcaaauuccgccccagaagcgccccaggaagggcgccgagugcccucuccug

SEQ ID NO: 220133 - RNA, 64 nt, Human
acacuggaaaacugggaaauggccagcugugugucccaggaaauuccuccccuuauucuuccuu

SEQ ID NO: 220134 - RNA, 64 nt, Human
acuuugggaggugcaggcaggcagauggcuugagcccaggaauucaagaccaguccgagcaaca

SEQ ID NO: 220135 - RNA, 58 nt, Human
cccagccuggcugcacuugagguucccgcccaggaaggccuuuugcaagaaggagagg

SEQ ID NO: 220136 - RNA, 64 nt, Human
gggcugugauggggaugugcagggacagugggaucccaggaaacagaccuccauggugggagau

SEQ ID NO: 220137 - RNA, 64 nt, Human
cccagugcuccccuccugcuaaagaaccaguuaccccaggaaaauucgacuccuguuuuucuuu

SEQ ID NO: 220138 - RNA, 64 nt, Human
ggaggacaucgucuguguccaggucagaaaguggcccaggaagggggcaguuucugucgcgggu

SEQ ID NO: 220139 - RNA, 64 nt, Human; identical to SEQ ID NO: 218435

SEQ ID NO: 220140 - RNA, 64 nt, Human; identical to SEQ ID NO: 217738

SEQ ID NO: 220141 - RNA, 64 nt, Human; identical to SEQ ID NO: 217527

SEQ ID NO: 220142 - RNA, 64 nt, Human
gcccccuuccucccuggaccccacgggccccugucccaggaaccccgcccucugacuucuugcc

SEQ ID NO: 220143 - RNA, 64 nt, Human
uaaaaccuaaaaguauuaaauuccuagaagaaaacccaggaaaugccauucuggacauaagugc

SEQ ID NO: 220144 - RNA, 64 nt, Human
acuuugagaggccaaggagggaggaucgcuuaagcccaggaauucgaaaucagccuaggcaaca

SEQ ID NO: 220145 - RNA, 64 nt, Human
gagggaggccccaagccacggggcaucccccucucccaggaagcagggagggggccgggagguu

SEQ ID NO: 220146 - RNA, 64 nt, Human
acccucaaacagaaaauaaugaagccuucuuccucccaggaaaggggacguucagcugagccga

SEQ ID NO: 220147 - RNA, 64 nt, Human
cagcugcauuuccagcccaggcuguuuggcgcugcccaggaaugguaucaauuccccuguuucu

SEQ ID NO: 220148 - RNA, 64 nt, Human
aagaagaagcaccagccacaggggcagguguccucccaggaaguacagcuccccccuacaccua

SEQ ID NO: 220149 - RNA, 64 nt, Human
gaaaacggcugcggccucggccucccuucgggcacccaggaaugcgggggucugcucagucccc

SEQ ID NO: 220150 - RNA, 64 nt, Human
caaguagcugggauuacaggugugcgccaccacgcccaggaaauuauuguaguuuuaguagaga

SEQ ID NO: 220151 - RNA, 64 nt, Human
uacuugggaggcugaggcaagugaaucacuugaacccaggaagcagagguugcagugagcagag

SEQ ID NO: 220152 - RNA, 64 nt, Human
uguggaucugugacccugggcgcugaaaaugggacccaggaaucccccccgucaauaucuuggc

SEQ ID NO: 220153 - RNA, 64 nt, Human
acuuugggaggccgaggugaaaggaucacuugagcccaggaauuggagaccagcgugggcaacu

SEQ ID NO: 220154 - RNA, 64 nt, Human
cauuuauuuuaagcucuuagaagcaacuccuuggcccaggaaugcgugaccccugagauggguc

SEQ ID NO: 220155 - RNA, 64 nt, Human
uuggacaccaggucacggagaaacacaaacaccacccaggaacacgcagacauaugcccauagc

SEQ ID NO: 220156 - RNA, 61 nt, Human
augagaagaacgaggacugagcggcugcggucccaggaaggucuuacccccucuucuauuu

SEQ ID NO: 220157 - RNA, 64 nt, Human; identical to SEQ ID NO: 218054

SEQ ID NO: 220158 - RNA, 64 nt, Human; identical to SEQ ID NO: 217643

SEQ ID NO: 220159 - RNA, 64 nt, Human; identical to SEQ ID NO: 217775

SEQ ID NO: 220160 - RNA, 64 nt, Human
ccaccugugcccccaccugggugcccuaugcugacccaggaaaggccagaccugccccuccaaa

SEQ ID NO: 220161 - RNA, 64 nt, Human
aguagguagacuuagaucccauuucuguccugcucccaggaagauucuuagguccucuucaauc

SEQ ID NO: 220162 - RNA, 53 nt, Human
ucagcgcucugcugcagugagaucccaggaagcuggucagugaggagggggcg

SEQ ID NO: 220163 - RNA, 64 nt, Human
gugcggcccuggggacccccccuccccgagugugcccaggaacucagagagggcgcggcccccg

SEQ ID NO: 220164 - RNA, 64 nt, Human
aagaauggguacaggaaaggauuguccuugaggccccaggaagcucugccgcccccucccuguc

SEQ ID NO: 220165 - RNA, 64 nt, Human
cgcuuccugagcagucccugcuuaugaugggcuccccaggaagcccacugccuccucccuggcu

SEQ ID NO: 220166 - RNA, 64 nt, Human
uuacagagcaaagcugggagaaccgaggacucaccccaggaaccucaacuuccccuaaguuugu

SEQ ID NO: 220167 - RNA, 64 nt, Human
uaaaaugugucuugcugucauuuauauuccuuuucccaggaaagaagcauuucugauacuuucu

SEQ ID NO: 220168 - RNA, 64 nt, Human
gggaaucccaaauuugaaaauccaaucccaaguccccaggaaacccaaucaugagguccuugug

SEQ ID NO: 220169 - RNA, 64 nt, Human
gaccuucuugaaggaguuaacagacagguggccccccaggaagcagagagcgccagauuugugg

SEQ ID NO: 220170 - RNA, 64 nt, Human
ucaggcagcccggcuggccgccgccgcuccuccccccaggaaagccaagguggaggcugaggug

SEQ ID NO: 220171 - RNA, 64 nt, Human
aauuuauauuugaauugaggcuuuggccuuaacacccaggaacuuuucuauuacaaucgcuuag

SEQ ID NO: 220172 - RNA, 51 nt, Human
aggcggccggcgaggccugagcccaggaaagccccccucacugucccuggu

SEQ ID NO: 220173 - RNA, 64 nt, Human
ugccauggagccugguggugcuaacggcccuuuccccaggaaucccuccccaacggcugccuuc

SEQ ID NO: 220174 - RNA, 64 nt, Human
aaauuucuagauuggggauagggagaaagggaggcccaggaaggucuccccugauuuuuuuuca

SEQ ID NO: 220175 - RNA, 64 nt, Human; identical to SEQ ID NO: 217717

SEQ ID NO: 220176 - RNA, 64 nt, Human; identical to SEQ ID NO: 214936

SEQ ID NO: 220177 - RNA, 64 nt, Human; identical to SEQ ID NO: 217795

SEQ ID NO: 220178 - RNA, 64 nt, Human
cagcccauaucuacaguacuuccagauggcugcccccaggaauggggaacucucccucuggucu

SEQ ID NO: 220179 - RNA, 58 nt, Human
gccggacuggccgggccugagacccaugcccaggaaaauaacagagcuggaugcugag

SEQ ID NO: 220180 - RNA, 64 nt, Human
gucuuggagggacguguuuaaugaaaucuugaaccccaggaauaguauuauguaaugaaaaccu

SEQ ID NO: 220181 - RNA, 64 nt, Human
ucucuggggggcuggagaagccucccucauuccucccaggaauuaauaaaugugaagagaggcu

SEQ ID NO: 220182 - RNA, 64 nt, Human
aaaagccuucagaagcuacucuguuucugaccagcccaggaaccuuugcagggccaucucaccc

SEQ ID NO: 220183 - RNA, 64 nt, Human
ggcaagagcugaugagguccugaggaacaguguccccaggaaccaccuucuggagccuagcggc

SEQ ID NO: 220184 - RNA, 64 nt, Human
aaccuggagaauccacauaccuuguguauugaaccccaggaaaaggaagaggucgaaccaaccc

SEQ ID NO: 220185 - RNA, 64 nt, Human
agacucccuccagugaggagcugggaggagacaucccaggaaaagaauuugauacuccucugug

SEQ ID NO: 220186 - RNA, 64 nt, Human
auggaagguaaguucugucguucuuuccccaauccccaggaauggacaagaagccaacuuagaa

SEQ ID NO: 220187 - RNA, 64 nt, Human
cuucuggauucaugggugaguucccugggcagcccccaggaaggccuuccagaucuggcuccag

SEQ ID NO: 220188 - RNA, 64 nt, Human
cuccccagcccuaugguuuuuuuauuucauguaccccaggaaauacugugugguuucuaaaagc

SEQ ID NO: 220189 - RNA, 64 nt, Human
uuaggcacccaggagccccaggucggcggguguucccaggaagaggaaguaaaucugcaacccu

SEQ ID NO: 220190 - RNA, 64 nt, Human
auucgucggaggcaucauggaaagacugggacagcccaggaaacaaggggucugaggaugcauu

SEQ ID NO: 220191 - RNA, 64 nt, Human
gcaagugccaccgugcggggccuggcucugcacacccaggaaaagucugcagacccccagcccu

SEQ ID NO: 220192 - RNA, 64 nt, Human
cugcccuguccaccaggauaagugacaccuaggacccaggaaauaaaugccgaugauuugugug

SEQ ID NO: 220193 - RNA, 64 nt, Human
gauggaacaggucucuaagcuagugguuuucaaacugguacacauuagacucacccgaggaauu

SEQ ID NO: 220194 - RNA, 64 nt, Human
ggccugcaucuggaaggacacagguugccagagccccuggcacaacucuagcauaucugugagc

SEQ ID NO: 220195 - RNA, 64 nt, Human
accuuccucuuacauacuguuccccaauggaggccccuggcauaggggacagcccugggcaucu

SEQ ID NO: 220196 - RNA, 64 nt, Human
uuuauauuggcgcuuuuaacucagaguuuuaaaccccaggaacagagacuccuaguugagugau

SEQ ID NO: 220197 - RNA, 64 nt, Human
uuaaagaaugcccuuuaugaugcacugauuccaucccaggaacccaacagagcucaggacagcc

SEQ ID NO: 220198 - RNA, 64 nt, Human
gauuuauuggcucuuccauugccacugagcaaugcccaggaagcaggcacauugccaaggacug

SEQ ID NO: 220199 - RNA, 64 nt, Human
uuuauauaguuuaaauuucuuacuacuguuagaucccaggaauucauuaauaaucauccuuggc

SEQ ID NO: 220200 - RNA, 64 nt, Human
cgauggugccuggucucugaguaagaugccaggucccaggaacucaggcuucaggugagaagga

SEQ ID NO: 220201 - RNA, 64 nt, Human
gagaagccaccgggaaagcagccagcacaaagggcccaggaagccagcccccgagagcugagcg

SEQ ID NO: 220202 - RNA, 64 nt, Human
agccaugccuauccaaugacgucuccauaaaaggcccaggaacacgggagcuucugaagagcug

SEQ ID NO: 220203 - RNA, 64 nt, Human
ugcaagauugcaaaaaugacugugcaaccugaaacccaggaaagcagucuccauagucaaucag

SEQ ID NO: 220204 - RNA, 64 nt, Human
gggcaccccaggaaccgccauugcccauaagacccccaggaagcuaggcacuuucuuuccaugg

SEQ ID NO: 220205 - RNA, 64 nt, Human
aaucugagccaugagaacgaggggaucugggcaccccaggaaccgccauugcccauaagacccc

SEQ ID NO: 220206 - RNA, 64 nt, Human
cccacuuauuccccauucuuccuaguuuucuccucccaggaacugggccaacucaccugaguca

SEQ ID NO: 220207 - RNA, 64 nt, Human
cugaaggccagagccacguggcacaauugcuggccccaggaaugggcaagguggagauggaacc

SEQ ID NO: 220208 - RNA, 64 nt, Human
ucccugcugcagagagcacagcccuugccuggagcccaggaaccccauccuugcuucaucucag

SEQ ID NO: 220209 - RNA, 64 nt, Human
gguccagggagacagacucugaaugggacugagucccaggaaacagugcuuuccgaugagacuc

SEQ ID NO: 220210 - RNA, 64 nt, Human
agcuacuugggaggcugaggcagaauugcuugaacccaggaagcggagguuguggugagccaag

SEQ ID NO: 220211 - RNA, 64 nt, Human
cccucugaaucaugcagggaagggucugccccugcccuggcacacacaggcacccauucccucc

SEQ ID NO: 220212 - RNA, 64 nt, Human; identical to SEQ ID NO: 217845

SEQ ID NO: 220213 - RNA, 64 nt, Human; identical to SEQ ID NO: 217846

SEQ ID NO: 220214 - RNA, 64 nt, Human
uccugcgcauauagacuguacauuaugaagaauacccaggaagacuuugugacugucacuugcu

SEQ ID NO: 220215 - RNA, 64 nt, Human
ucccccaaggugagggcuuaggcagcuguagaaccccaggaaagaacggaauccaggcaaucug

SEQ ID NO: 220216 - RNA, 64 nt, Human
cuguuuggggaagaugcaaggaaguaaugagaagcccaggaaauuucuccaccuguguuuaugg

SEQ ID NO: 220217 - RNA, 64 nt, Human
caccagugcccaggaauuugaacauuuuccuuuacccaggaaaucuccggagccaacaccacca

SEQ ID NO: 220218 - RNA, 64 nt, Human
uguggcaaggcuuggaugagauggggcaccagugcccaggaauuugaacauuuuccuuuaccca

SEQ ID NO: 220219 - RNA, 64 nt, Human
uuucagauauauuuuaguaacacauucccagcuccccaggaaagccagucucaucuaauuucuu

SEQ ID NO: 220220 - RNA, 64 nt, Human
acgggccaaaccuuggcuguuccagaaacugaaccccaggaauugcuuacacacuuucuuccag

SEQ ID NO: 220221 - RNA, 64 nt, Human
ccccuccaguuugcuuuccuuuggccuuccagaccccaggaaguuggccuucccuuccuagugc

SEQ ID NO: 220222 - RNA, 64 nt, Human
ugaucagcuggauccccacgugagcaacagcuggcccaggaaaggcugccugcagaggacaggu

SEQ ID NO: 220223 - RNA, 64 nt, Human
gcuucaagcagagcauggugggucauugaggagacccaggaaucucaucugagaacccacucuc

SEQ ID NO: 220224 - RNA, 64 nt, Human
aaaaucaaauuccagaaugauuuuacggagauaucccaggaaaauuaaggcuucucuuaaacac

SEQ ID NO: 220225 - RNA, 64 nt, Human
gugggaagcccauccugaccagcugcuccgaggacccaggaaaggcaggauugaaaauguccag

SEQ ID NO: 220226 - RNA, 64 nt, Human
cuggagagaugggcccaucauuaggggccagcaucccaggaacuggaccuuuccccagagccuc

SEQ ID NO: 220227 - RNA, 64 nt, Human
ccaacaaugccuccaauuccagcucggagucaaucccaggaaaauaugcgaaguucuccaaacc

SEQ ID NO: 220228 - RNA, 64 nt, Human
uuugacugcgaccuuggcggugcugucuccgcagcccaggaagccugcuguggggaggcuucgc

SEQ ID NO: 220229 - RNA, 64 nt, Human; identical to SEQ ID NO: 217882

SEQ ID NO: 220230 - RNA, 64 nt, Human; identical to SEQ ID NO: 217863

SEQ ID NO: 220231 - RNA, 64 nt, Human; identical to SEQ ID NO: 217864

SEQ ID NO: 220232 - RNA, 64 nt, Human
caccaugccuccuucccaggacccaggucugcugcccaggaacccuccagaccucccagagagu

SEQ ID NO: 220233 - RNA, 64 nt, Human
cucuggcccguccugggaaggggggugucuagagcccaggaaacuucuucuuccguggcuuuug

SEQ ID NO: 220234 - RNA, 64 nt, Human
cuuugggccaggaggaaucuguuacucgaauccacccaggaacucccuggcaguggauuguggg

SEQ ID NO: 220235 - RNA, 64 nt, Human
gaaaucgauuucacaauccaaaaauggcccacagcccaggaagcuacccugaacaugccaguug

SEQ ID NO: 220236 - RNA, 64 nt, Human
acaaggcaguuuguucuggcuagaugagagggaacccaggaauugugagguuagcaggaauauc

SEQ ID NO: 220237 - RNA, 64 nt, Human
aauuugggaggcagaggugagagaaucgcuugagcccaggaauucgagaccagccugggccaca

SEQ ID NO: 220238 - RNA, 64 nt, Human
cagcaggugccucgauucccugcccuugugaccucccaggaaacagaacugaucugggacacua

SEQ ID NO: 220239 - RNA, 64 nt, Human
uggcucccuccuccccaucaagcacaagagagggcccaggaaaaaagguuucacauaaguguag

SEQ ID NO: 220240 - RNA, 64 nt, Human
cucugcaauugucaccgguuaacuguggccugugcccaggaagagccauucacuccugccccug

SEQ ID NO: 220241 - RNA, 64 nt, Human
gaggguccgaaaagccugcaggggcccggcgagccccaggaagagccucagcuccaggcugggg

SEQ ID NO: 220242 - RNA, 64 nt, Human
uccucuuuucugccuggauuugugaccaugaauucccaggaagagcugggccccugggagcugc

SEQ ID NO: 220243 - RNA, 64 nt, Human
aacacuggucugcuguuccagugguaagcuaugucccaggaaucaguuuaaaagcacgacagug

SEQ ID NO: 220244 - RNA, 64 nt, Human
aggcauucagaguccaccugcagacagcgagagccccaggaagguuugcacagcugugccccaa

SEQ ID NO: 220245 - RNA, 64 nt, Human
gaauaaaugccaagagggagaaaguugaauuaaacccaggaaaauaucagaagaacucuuuaaa

SEQ ID NO: 220246 - RNA, 64 nt, Human
uguggaacugcagccucagcccaucuggcagagucccaggaacucggagacuggcacagcugcu

SEQ ID NO: 220247 - RNA, 64 nt, Human
augucuucuuguugcgcugagaacaccauauguucaugacgagauuccuggcaccaugucagcc

SEQ ID NO: 220248 - RNA, 64 nt, Human
caugacguuuguaaaauguuuguaaaagcucaaacaugacgauuccauaaaauaaacuugaggu

SEQ ID NO: 220249 - RNA, 64 nt, Human
aacauacauguuuaaauacaaaauaauuaugggccaugacgacgauuaauauuaaaacugugau

SEQ ID NO: 220250 - RNA, 64 nt, Human
cauagacggugcggggggccuggcugggccagaccccaggaaggugggguagacuggggggauc

SEQ ID NO: 220251 - RNA, 64 nt, Human
uggaauccugcagcccuccccaaaaacagauugacccaggaaugaaucugcuacaauuccaccu

SEQ ID NO: 220252 - RNA, 64 nt, Human
agggccugagaacauacuuucuaaaugccuuugacccaggaaccgauuaucuauauuuguuccc

SEQ ID NO: 220253 - RNA, 64 nt, Human
gcugccucuaccaaccacccucuaucagcaguggcccaggaaggaggucaagcaucuucggccg

SEQ ID NO: 220254 - RNA, 64 nt, Human
agaaagggaagucaggguucuagggguuauucgucccaggaaauagaagugaaauugucuuuau

SEQ ID NO: 220255 - RNA, 64 nt, Human
cacccacacugaaagaugaggggcugcaccuucccccaggaaugacccucuaucccaggaccug

SEQ ID NO: 220256 - RNA, 64 nt, Human
uuuaugcaacacccaaacaucuuggcauccccaccccaggaagugcggggaggagguuaugauc

SEQ ID NO: 220257 - RNA, 64 nt, Human
cuccccuuuccccauccucuaucuaucccucuuucccaggaacaaaucaaaagguggauuaucu

SEQ ID NO: 220258 - RNA, 64 nt, Human
gucucuuuguugcuauguuuuuuuguuugaaguucccaggaauauuugagggguuccggugaug

SEQ ID NO: 220259 - RNA, 64 nt, Human
aagggugucugaugugggguggggcuggcauccucccaggaagguucuaggugggaccccgucu

SEQ ID NO: 220260 - RNA, 64 nt, Human
cauuacucaaaaugcaggacagaucaggucagagcccaggaauucucacagguucacccagcgc

SEQ ID NO: 220261 - RNA, 64 nt, Human
accuuccuguccgaaguacacggacacuagcugccccaggaaguugugugauuuuaaaucacuu

SEQ ID NO: 220262 - RNA, 64 nt, Human
cguguucauaucuacucuuuacccuugagcccuccccaggaauuugggacccugcuuuagagcu

SEQ ID NO: 220263 - RNA, 64 nt, Human
cagugcucacacaaucagaccaaggaacaagacccccaggaaggaaacagauuuaagcaagacc

SEQ ID NO: 220264 - RNA, 64 nt, Human
uaacuugccuccaucuuuuucuugggugaggacacccaggaaugacccuuuugugucuaugaug

SEQ ID NO: 220265 - RNA, 64 nt, Human
guaaucuucaggauuucaagaccagccuagccaacaugacgaaaccccaucucuacugaaaaua

SEQ ID NO: 220266 - RNA, 64 nt, Human
ccugaggucaggaguucgagaccaaccuggccaacaugacgaaacuccgucucuauuuaaaaua

SEQ ID NO: 220267 - RNA, 64 nt, Human
cagacuugugacuauggcuuuucauucuucaauucaugacgagugccaaacuugauuuucucua

SEQ ID NO: 220268 - RNA, 64 nt, Human
gggauugcagcugaggugggaguggagaaugguucccaggaagacaguuccaccucuaaggucc

SEQ ID NO: 220269 - RNA, 64 nt, Human
uccuucuccaagaccuauggagaaggucccaggccccaggaacacagggcuucuuggccccaga

SEQ ID NO: 220270 - RNA, 64 nt, Human
gaacgaauacuagcaucaguggggaagaaaccuccccaggaaauuggaauuaaagugaaaaauc

SEQ ID NO: 220271 - RNA, 64 nt, Human
gucuucaggaucaucuacacugcacuaggggagccccaggaaggcagcacccuggaggcccugu

SEQ ID NO: 220272 - RNA, 64 nt, Human
cugcucaggcuucccacccugugcggggcacacccccaggaagggacccuggacacggcuccca

SEQ ID NO: 220273 - RNA, 64 nt, Human
ugauuucagaauguaugcuuggugagucucagugcccaggaacacuuuuggaauaauuuaucag

SEQ ID NO: 220274 - RNA, 64 nt, Human
cuuggcauucaacauuaaaaagcggauccaaagacccaggaaugacaggugaaguauuaauuuu

SEQ ID NO: 220275 - RNA, 64 nt, Human
gggcuguccaguuagcugugcccugcaccuucagcccaggaaagauuugaacagagcaaaggcu

SEQ ID NO: 220276 - RNA, 64 nt, Human
gaugaaggaaggggcuauccugggaccuccccagcccaggaaaaacuggaagccuucccccagc

SEQ ID NO: 220277 - RNA, 64 nt, Human
gaucaggccucaccccuccccugggacuuucccacccaggaaaggaggaccagucaggaugagg

SEQ ID NO: 220278 - RNA, 62 nt, Human
accuaaaacaccaacuguaaucuugcagucuccccaggaacuuaugaugccuccgaaaacca

SEQ ID NO: 220279 - RNA, 64 nt, Human
ucuguccuguggccaugucccucagggugacaggcccaggaaccaaugcuacucauucugaagg

SEQ ID NO: 220280 - RNA, 64 nt, Human
agaggauaugacagcuuaccagcuaagaguaccucccaggaaacagucugacuaauguggaacc

SEQ ID NO: 220281 - RNA, 64 nt, Human
ucuuugccuauuccaaagagcuaaaaaagucuaacccaggaaagcuuuugauauuuuguguuug

SEQ ID NO: 220282 - RNA, 64 nt, Human
guauguugggagggagcacagugucuguggggagcccaggaagcugcucacccaagauuuggug

SEQ ID NO: 220283 - RNA, 64 nt, Human
cuugagcccaggaguucgagagcagccugggcaacaugacgaaaccccgucucuacagagaaua

SEQ ID NO: 220284 - RNA, 64 nt, Human
uguccuccagccacccuugcuugccacuguuccccaugacgagagccuccugucugcaguggcc

SEQ ID NO: 220285 - RNA, 64 nt, Human
caaacaaugguagcucacuaaaaugaccucagcacaugacgauuucuauuaacauuuuauuguu

SEQ ID NO: 220286 - RNA, 64 nt, Human
cugaugacccccccagcuucacuucugacucuuccccaggaagggaaggggggucagaagagag

SEQ ID NO: 220287 - RNA, 64 nt, Human
acauguuaaaggccugggguuuaggaagcuaagucccaggaaaacauaccuacagacaggacaa

SEQ ID NO: 220288 - RNA, 64 nt, Human
cugcacagacuggcugcuggaccugcgcacgcagcccaggaauggacauuccuaacggguggug

SEQ ID NO: 220289 - RNA, 64 nt, Human
ugggcugcuaugggggauggcaccucucagcccucccaggaaacacacagagcucugggcccau

SEQ ID NO: 220290 - RNA, 64 nt, Human
guuuggagaccaagcagcagaugcagguguggaccccaggaaccuacaggggugucagccgcug

SEQ ID NO: 220291 - RNA, 64 nt, Human; identical to SEQ ID NO: 178508

SEQ ID NO: 220292 - RNA, 64 nt, Human; identical to SEQ ID NO: 178509

SEQ ID NO: 220293 - RNA, 64 nt, Human; identical to SEQ ID NO: 178510

SEQ ID NO: 220294 - RNA, 64 nt, Human; identical to SEQ ID NO: 214823

SEQ ID NO: 220295 - RNA, 64 nt, Human; identical to SEQ ID NO: 217883

SEQ ID NO: 220296 - RNA, 64 nt, Human; identical to SEQ ID NO: 217884

SEQ ID NO: 220297 - RNA, 64 nt, Human; identical to SEQ ID NO: 178511

SEQ ID NO: 220298 - RNA, 64 nt, Human; identical to SEQ ID NO: 178512

SEQ ID NO: 220299 - RNA, 64 nt, Human; identical to SEQ ID NO: 178513

SEQ ID NO: 220300 - RNA, 64 nt, Human; identical to SEQ ID NO: 178514

SEQ ID NO: 220301 - RNA, 64 nt, Human; identical to SEQ ID NO: 178515

SEQ ID NO: 220302 - RNA, 64 nt, Human; identical to SEQ ID NO: 178516

SEQ ID NO: 220303 - RNA, 64 nt, Human; identical to SEQ ID NO: 178517

SEQ ID NO: 220304 - RNA, 64 nt, Human; identical to SEQ ID NO: 178518

SEQ ID NO: 220305 - RNA, 64 nt, Human; identical to SEQ ID NO: 178519

SEQ ID NO: 220306 - RNA, 64 nt, Human; identical to SEQ ID NO: 178520

SEQ ID NO: 220307 - RNA, 64 nt, Human; identical to SEQ ID NO: 178521

SEQ ID NO: 220308 - RNA, 64 nt, Human; identical to SEQ ID NO: 178522

SEQ ID NO: 220309 - RNA, 64 nt, Human; identical to SEQ ID NO: 178523

SEQ ID NO: 220310 - RNA, 64 nt, Human; identical to SEQ ID NO: 178524

SEQ ID NO: 220311 - RNA, 64 nt, Human; identical to SEQ ID NO: 178525

SEQ ID NO: 220312 - RNA, 64 nt, Human
uuagccuguggcaguaaagagaaacuuugugcuacaugacgacaaagcugcuaaaucuccuauu

SEQ ID NO: 220313 - RNA, 64 nt, Human
guaccauucaggacauaggcacaggcaaagauuucaugacgaagacgccaaaaacaauugcaac

SEQ ID NO: 220314 - RNA, 64 nt, Human
cgagcggccccucggccaauaagacaguggacaucaugacgaggacuccggguggggaccugaa

SEQ ID NO: 220315 - RNA, 64 nt, Human; identical to SEQ ID NO: 178526

SEQ ID NO: 220316 - RNA, 64 nt, Human; identical to SEQ ID NO: 178527

SEQ ID NO: 220317 - RNA, 64 nt, Human; identical to SEQ ID NO: 178528

SEQ ID NO: 220318 - RNA, 64 nt, Human; identical to SEQ ID NO: 178529

SEQ ID NO: 220319 - RNA, 64 nt, Human; identical to SEQ ID NO: 178530

SEQ ID NO: 220320 - RNA, 64 nt, Human; identical to SEQ ID NO: 178531

SEQ ID NO: 220321 - RNA, 64 nt, Human; identical to SEQ ID NO: 178532

SEQ ID NO: 220322 - RNA, 64 nt, Human; identical to SEQ ID NO: 178533

SEQ ID NO: 220323 - RNA, 64 nt, Human; identical to SEQ ID NO: 178534

SEQ ID NO: 220324 - RNA, 64 nt, Human; identical to SEQ ID NO: 178535

SEQ ID NO: 220325 - RNA, 64 nt, Human; identical to SEQ ID NO: 178536

SEQ ID NO: 220326 - RNA, 64 nt, Human; identical to SEQ ID NO: 178537

SEQ ID NO: 220327 - RNA, 64 nt, Human; identical to SEQ ID NO: 178538

SEQ ID NO: 220328 - RNA, 64 nt, Human; identical to SEQ ID NO: 178539

SEQ ID NO: 220329 - RNA, 64 nt, Human; identical to SEQ ID NO: 178540

SEQ ID NO: 220330 - RNA, 64 nt, Human
ugcuuugguaauugaauucugaagaauuuaucugcaugacgauaacuaggcauucuauccauuu

SEQ ID NO: 220331 - RNA, 64 nt, Human
auggcaggcccucagccugagccuucacauacaucaugacgaggauggcagcucuucccagcua

SEQ ID NO: 220332 - RNA, 64 nt, Human; identical to SEQ ID NO: 178541

SEQ ID NO: 220333 - RNA, 64 nt, Human; identical to SEQ ID NO: 178542

SEQ ID NO: 220334 - RNA, 64 nt, Human; identical to SEQ ID NO: 178543

SEQ ID NO: 220335 - RNA, 64 nt, Human; identical to SEQ ID NO: 178544

SEQ ID NO: 220336 - RNA, 64 nt, Human; identical to SEQ ID NO: 178545

SEQ ID NO: 220337 - RNA, 64 nt, Human; identical to SEQ ID NO: 178546

SEQ ID NO: 220338 - RNA, 64 nt, Human; identical to SEQ ID NO: 178547

SEQ ID NO: 220339 - RNA, 64 nt, Human; identical to SEQ ID NO: 178548

SEQ ID NO: 220340 - RNA, 64 nt, Human; identical to SEQ ID NO: 178549

SEQ ID NO: 220341 - RNA, 64 nt, Human; identical to SEQ ID NO: 178550

SEQ ID NO: 220342 - RNA, 64 nt, Human; identical to SEQ ID NO: 178551

SEQ ID NO: 220343 - RNA, 64 nt, Human; identical to SEQ ID NO: 178552

SEQ ID NO: 220344 - RNA, 64 nt, Human; identical to SEQ ID NO: 178553

SEQ ID NO: 220345 - RNA, 64 nt, Human; identical to SEQ ID NO: 178554

SEQ ID NO: 220346 - RNA, 58 nt, Human; identical to SEQ ID NO: 178555

SEQ ID NO: 220347 - RNA, 64 nt, Human; identical to SEQ ID NO: 217865

SEQ ID NO: 220348 - RNA, 64 nt, Human; identical to SEQ ID NO: 217921

SEQ ID NO: 220349 - RNA, 64 nt, Human; identical to SEQ ID NO: 217922

SEQ ID NO: 220350 - RNA, 64 nt, Human; identical to SEQ ID NO: 178556

SEQ ID NO: 220351 - RNA, 64 nt, Human; identical to SEQ ID NO: 178557

SEQ ID NO: 220352 - RNA, 64 nt, Human; identical to SEQ ID NO: 178558

SEQ ID NO: 220353 - RNA, 64 nt, Human; identical to SEQ ID NO: 178559

SEQ ID NO: 220354 - RNA, 64 nt, Human; identical to SEQ ID NO: 178560

SEQ ID NO: 220355 - RNA, 64 nt, Human; identical to SEQ ID NO: 178561

SEQ ID NO: 220356 - RNA, 64 nt, Human; identical to SEQ ID NO: 178562

SEQ ID NO: 220357 - RNA, 64 nt, Human; identical to SEQ ID NO: 178563

SEQ ID NO: 220358 - RNA, 64 nt, Human; identical to SEQ ID NO: 178564

SEQ ID NO: 220359 - RNA, 64 nt, Human; identical to SEQ ID NO: 178565

SEQ ID NO: 220360 - RNA, 64 nt, Human; identical to SEQ ID NO: 178566

SEQ ID NO: 220361 - RNA, 64 nt, Human; identical to SEQ ID NO: 178567

SEQ ID NO: 220362 - RNA, 64 nt, Human; identical to SEQ ID NO: 178568

SEQ ID NO: 220363 - RNA, 64 nt, Human; identical to SEQ ID NO: 178569

SEQ ID NO: 220364 - RNA, 64 nt, Human; identical to SEQ ID NO: 178570

SEQ ID NO: 220365 - RNA, 64 nt, Human
gccucaugcaucaucagaugacaaggacaacccucaugacgaagcaacaugaauuagggggccu

SEQ ID NO: 220366 - RNA, 64 nt, Human
cugcuuucuuauccauuucccuggaggcgggccccccuggcagcaguauuggaggggcuacagg

SEQ ID NO: 220367 - RNA, 64 nt, Human; identical to SEQ ID NO: 217940

SEQ ID NO: 220368 - RNA, 64 nt, Human; identical to SEQ ID NO: 178571

SEQ ID NO: 220369 - RNA, 64 nt, Human; identical to SEQ ID NO: 178572

SEQ ID NO: 220370 - RNA, 64 nt, Human; identical to SEQ ID NO: 178573

SEQ ID NO: 220371 - RNA, 64 nt, Human; identical to SEQ ID NO: 178574

SEQ ID NO: 220372 - RNA, 64 nt, Human; identical to SEQ ID NO: 178575

SEQ ID NO: 220373 - RNA, 64 nt, Human; identical to SEQ ID NO: 178576

SEQ ID NO: 220374 - RNA, 64 nt, Human; identical to SEQ ID NO: 178577

SEQ ID NO: 220375 - RNA, 64 nt, Human; identical to SEQ ID NO: 178578

SEQ ID NO: 220376 - RNA, 64 nt, Human; identical to SEQ ID NO: 178579

SEQ ID NO: 220377 - RNA, 64 nt, Human; identical to SEQ ID NO: 178580

SEQ ID NO: 220378 - RNA, 64 nt, Human; identical to SEQ ID NO: 178581

SEQ ID NO: 220379 - RNA, 64 nt, Human; identical to SEQ ID NO: 178582

SEQ ID NO: 220380 - RNA, 64 nt, Human; identical to SEQ ID NO: 178583

SEQ ID NO: 220381 - RNA, 64 nt, Human; identical to SEQ ID NO: 178584

SEQ ID NO: 220382 - RNA, 54 nt, Human; identical to SEQ ID NO: 178585

SEQ ID NO: 220383 - RNA, 64 nt, Human
ccuuucgguucccauggacccggcaccccaccugcaugacgauuuauuuguaucugggaaaaua

SEQ ID NO: 220384 - RNA, 64 nt, Human; identical to SEQ ID NO: 217941

SEQ ID NO: 220385 - RNA, 64 nt, Human; identical to SEQ ID NO: 214842

SEQ ID NO: 220386 - RNA, 56 nt, Human; identical to SEQ ID NO: 178586

SEQ ID NO: 220387 - RNA, 64 nt, Human; identical to SEQ ID NO: 178587

SEQ ID NO: 220388 - RNA, 64 nt, Human; identical to SEQ ID NO: 178588

SEQ ID NO: 220389 - RNA, 64 nt, Human; identical to SEQ ID NO: 178589

SEQ ID NO: 220390 - RNA, 64 nt, Human; identical to SEQ ID NO: 178590

SEQ ID NO: 220391 - RNA, 64 nt, Human; identical to SEQ ID NO: 178591

SEQ ID NO: 220392 - RNA, 64 nt, Human; identical to SEQ ID NO: 178592

SEQ ID NO: 220393 - RNA, 64 nt, Human; identical to SEQ ID NO: 178593

SEQ ID NO: 220394 - RNA, 64 nt, Human; identical to SEQ ID NO: 178594

SEQ ID NO: 220395 - RNA, 64 nt, Human; identical to SEQ ID NO: 178595

SEQ ID NO: 220396 - RNA, 64 nt, Human; identical to SEQ ID NO: 178596

SEQ ID NO: 220397 - RNA, 64 nt, Human; identical to SEQ ID NO: 178597

SEQ ID NO: 220398 - RNA, 64 nt, Human; identical to SEQ ID NO: 178598

SEQ ID NO: 220399 - RNA, 64 nt, Human; identical to SEQ ID NO: 178599

SEQ ID NO: 220400 - RNA, 64 nt, Human; identical to SEQ ID NO: 178600

SEQ ID NO: 220401 - RNA, 62 nt, Human
gggaggaauggagucuuugguacauuccucaccgagguuagcagcucaguuugugguuauga

SEQ ID NO: 220402 - RNA, 64 nt, Human; identical to SEQ ID NO: 218015

SEQ ID NO: 220403 - RNA, 64 nt, Human; identical to SEQ ID NO: 217960

SEQ ID NO: 220404 - RNA, 64 nt, Human; identical to SEQ ID NO: 178601

SEQ ID NO: 220405 - RNA, 64 nt, Human; identical to SEQ ID NO: 178602

SEQ ID NO: 220406 - RNA, 64 nt, Human; identical to SEQ ID NO: 178603

SEQ ID NO: 220407 - RNA, 64 nt, Human; identical to SEQ ID NO: 178604

SEQ ID NO: 220408 - RNA, 64 nt, Human; identical to SEQ ID NO: 178605

SEQ ID NO: 220409 - RNA, 64 nt, Human; identical to SEQ ID NO: 178606

SEQ ID NO: 220410 - RNA, 64 nt, Human; identical to SEQ ID NO: 178607

SEQ ID NO: 220411 - RNA, 64 nt, Human; identical to SEQ ID NO: 178608

SEQ ID NO: 220412 - RNA, 64 nt, Human; identical to SEQ ID NO: 178609

SEQ ID NO: 220413 - RNA, 64 nt, Human; identical to SEQ ID NO: 178610

SEQ ID NO: 220414 - RNA, 64 nt, Human; identical to SEQ ID NO: 178611

SEQ ID NO: 220415 - RNA, 64 nt, Human; identical to SEQ ID NO: 178612

SEQ ID NO: 220416 - RNA, 64 nt, Human; identical to SEQ ID NO: 178613

SEQ ID NO: 220417 - RNA, 64 nt, Human; identical to SEQ ID NO: 178614

SEQ ID NO: 220418 - RNA, 64 nt, Human; identical to SEQ ID NO: 178615

SEQ ID NO: 220419 - RNA, 64 nt, Human; identical to SEQ ID NO: 217996

SEQ ID NO: 220420 - RNA, 64 nt, Human; identical to SEQ ID NO: 217997

SEQ ID NO: 220421 - RNA, 64 nt, Human; identical to SEQ ID NO: 217998

SEQ ID NO: 220422 - RNA, 64 nt, Human; identical to SEQ ID NO: 178616

SEQ ID NO: 220423 - RNA, 64 nt, Human; identical to SEQ ID NO: 178617

SEQ ID NO: 220424 - RNA, 64 nt, Human; identical to SEQ ID NO: 178618

SEQ ID NO: 220425 - RNA, 64 nt, Human; identical to SEQ ID NO: 178619

SEQ ID NO: 220426 - RNA, 64 nt, Human; identical to SEQ ID NO: 178620

SEQ ID NO: 220427 - RNA, 64 nt, Human; identical to SEQ ID NO: 178621

SEQ ID NO: 220428 - RNA, 64 nt, Human; identical to SEQ ID NO: 178622

SEQ ID NO: 220429 - RNA, 64 nt, Human; identical to SEQ ID NO: 178623

SEQ ID NO: 220430 - RNA, 64 nt, Human; identical to SEQ ID NO: 178624

SEQ ID NO: 220431 - RNA, 64 nt, Human; identical to SEQ ID NO: 178625

SEQ ID NO: 220432 - RNA, 64 nt, Human; identical to SEQ ID NO: 178626

SEQ ID NO: 220433 - RNA, 64 nt, Human; identical to SEQ ID NO: 178627

SEQ ID NO: 220434 - RNA, 64 nt, Human; identical to SEQ ID NO: 178628

SEQ ID NO: 220435 - RNA, 64 nt, Human; identical to SEQ ID NO: 178629

SEQ ID NO: 220436 - RNA, 64 nt, Human; identical to SEQ ID NO: 178630

SEQ ID NO: 220437 - RNA, 64 nt, Human
uaagagugggcacugacgggccccuaauaugugacaugacgauuuggcauagauagggauguga

SEQ ID NO: 220438 - RNA, 64 nt, Human
accguggagguugcccacgggccucggcaccuggcccuggcagcacagcucucaggcccagccc

SEQ ID NO: 220439 - RNA, 64 nt, Human; identical to SEQ ID NO: 218016

SEQ ID NO: 220440 - RNA, 64 nt, Human; identical to SEQ ID NO: 178631

SEQ ID NO: 220441 - RNA, 64 nt, Human; identical to SEQ ID NO: 178632

SEQ ID NO: 220442 - RNA, 64 nt, Human; identical to SEQ ID NO: 178633

SEQ ID NO: 220443 - RNA, 64 nt, Human; identical to SEQ ID NO: 178634

SEQ ID NO: 220444 - RNA, 64 nt, Human; identical to SEQ ID NO: 178635

SEQ ID NO: 220445 - RNA, 64 nt, Human; identical to SEQ ID NO: 178636

SEQ ID NO: 220446 - RNA, 64 nt, Human; identical to SEQ ID NO: 178637

SEQ ID NO: 220447 - RNA, 64 nt, Human; identical to SEQ ID NO: 178638

SEQ ID NO: 220448 - RNA, 64 nt, Human; identical to SEQ ID NO: 178639

SEQ ID NO: 220449 - RNA, 64 nt, Human; identical to SEQ ID NO: 178640

SEQ ID NO: 220450 - RNA, 64 nt, Human; identical to SEQ ID NO: 178641

SEQ ID NO: 220451 - RNA, 64 nt, Human; identical to SEQ ID NO: 178642

SEQ ID NO: 220452 - RNA, 64 nt, Human; identical to SEQ ID NO: 178643

SEQ ID NO: 220453 - RNA, 64 nt, Human; identical to SEQ ID NO: 178644

SEQ ID NO: 220454 - RNA, 64 nt, Human; identical to SEQ ID NO: 178645

SEQ ID NO: 220455 - RNA, 64 nt, Human
cagauccgcucaggcacgguugggugaccguggggucaccgauugcguagauuauuucuagggc

SEQ ID NO: 220456 - RNA, 64 nt, Human
auucugccuggggcacuggaacacauuccugggggucaccgauggucagagucacuagaaguua

SEQ ID NO: 220457 - RNA, 64 nt, Human
auaagaauaguccuacaaagagaaaaauauacaugucaccgaagcaaguguacccuuuauagga

SEQ ID NO: 220458 - RNA, 64 nt, Human; identical to SEQ ID NO: 178646

SEQ ID NO: 220459 - RNA, 64 nt, Human; identical to SEQ ID NO: 178647

SEQ ID NO: 220460 - RNA, 64 nt, Human; identical to SEQ ID NO: 178648

SEQ ID NO: 220461 - RNA, 64 nt, Human; identical to SEQ ID NO: 178649

SEQ ID NO: 220462 - RNA, 64 nt, Human; identical to SEQ ID NO: 178650

SEQ ID NO: 220463 - RNA, 64 nt, Human; identical to SEQ ID NO: 178651

SEQ ID NO: 220464 - RNA, 64 nt, Human; identical to SEQ ID NO: 178652

SEQ ID NO: 220465 - RNA, 64 nt, Human; identical to SEQ ID NO: 178653

SEQ ID NO: 220466 - RNA, 64 nt, Human; identical to SEQ ID NO: 178654

SEQ ID NO: 220467 - RNA, 64 nt, Human; identical to SEQ ID NO: 178655

SEQ ID NO: 220468 - RNA, 64 nt, Human; identical to SEQ ID NO: 178656

SEQ ID NO: 220469 - RNA, 64 nt, Human; identical to SEQ ID NO: 178657

SEQ ID NO: 220470 - RNA, 64 nt, Human; identical to SEQ ID NO: 178658

SEQ ID NO: 220471 - RNA, 64 nt, Human; identical to SEQ ID NO: 178659

SEQ ID NO: 220472 - RNA, 64 nt, Human; identical to SEQ ID NO: 178660

SEQ ID NO: 220473 - RNA, 64 nt, Human; identical to SEQ ID NO: 178661

SEQ ID NO: 220474 - RNA, 64 nt, Human; identical to SEQ ID NO: 178662

SEQ ID NO: 220475 - RNA, 62 nt, Human
gucgcuuugagcuucugacaugucacuugccccgagguuaaaacuuuucaccccuugaagac

SEQ ID NO: 220476 - RNA, 62 nt, Human
uaugugucauuugagugguuuccagauuggagcgagguuauucugaucuaaaugaacagcau

SEQ ID NO: 220477 - RNA, 62 nt, Human
uugcccuggagcugucucuggaaaguagcuggcgagguuaccuuaacuaucacugaagaaag

SEQ ID NO: 220478 - RNA, 64 nt, Human; identical to SEQ ID NO: 7297

SEQ ID NO: 220479 - RNA, 64 nt, Human; identical to SEQ ID NO: 7298

SEQ ID NO: 220480 - RNA, 64 nt, Human; identical to SEQ ID NO: 7299

SEQ ID NO: 220481 - RNA, 64 nt, Human; identical to SEQ ID NO: 7300

SEQ ID NO: 220482 - RNA, 64 nt, Human; identical to SEQ ID NO: 7301

SEQ ID NO: 220483 - RNA, 64 nt, Human; identical to SEQ ID NO: 7302

SEQ ID NO: 220484 - RNA, 64 nt, Human; identical to SEQ ID NO: 7303

SEQ ID NO: 220485 - RNA, 64 nt, Human; identical to SEQ ID NO: 7304

SEQ ID NO: 220486 - RNA, 64 nt, Human; identical to SEQ ID NO: 7305

SEQ ID NO: 220487 - RNA, 64 nt, Human; identical to SEQ ID NO: 7306

SEQ ID NO: 220488 - RNA, 64 nt, Human; identical to SEQ ID NO: 7307

SEQ ID NO: 220489 - RNA, 64 nt, Human; identical to SEQ ID NO: 7308

SEQ ID NO: 220490 - RNA, 64 nt, Human; identical to SEQ ID NO: 7309

SEQ ID NO: 220491 - RNA, 62 nt, Human
ugagauuacaggugugagcuaccgcaccccgccgagguuagcacuuucaucaccaaagaccc

SEQ ID NO: 220492 - RNA, 64 nt, Human
ccugaggucaggaguuuuagaccagccuggccaacaugacgaaacccggucucuacuaaaaaua

SEQ ID NO: 220493 - RNA, 64 nt, Human
aggcaacugcaugguacauuguugauuguuaugacugguacacucuggcccagccagagcuaua

SEQ ID NO: 220494 - RNA, 64 nt, Human; identical to SEQ ID NO: 7310

SEQ ID NO: 220495 - RNA, 64 nt, Human; identical to SEQ ID NO: 7311

SEQ ID NO: 220496 - RNA, 64 nt, Human; identical to SEQ ID NO: 7312

SEQ ID NO: 220497 - RNA, 64 nt, Human; identical to SEQ ID NO: 7313

SEQ ID NO: 220498 - RNA, 64 nt, Human; identical to SEQ ID NO: 7314

SEQ ID NO: 220499 - RNA, 64 nt, Human; identical to SEQ ID NO: 7315

SEQ ID NO: 220500 - RNA, 64 nt, Human; identical to SEQ ID NO: 7316

SEQ ID NO: 220501 - RNA, 64 nt, Human; identical to SEQ ID NO: 7317

SEQ ID NO: 220502 - RNA, 64 nt, Human; identical to SEQ ID NO: 7318

SEQ ID NO: 220503 - RNA, 64 nt, Human; identical to SEQ ID NO: 7319

SEQ ID NO: 220504 - RNA, 64 nt, Human; identical to SEQ ID NO: 7320

SEQ ID NO: 220505 - RNA, 64 nt, Human; identical to SEQ ID NO: 7321

SEQ ID NO: 220506 - RNA, 64 nt, Human; identical to SEQ ID NO: 7322

SEQ ID NO: 220507 - RNA, 64 nt, Human; identical to SEQ ID NO: 7323

SEQ ID NO: 220508 - RNA, 64 nt, Human; identical to SEQ ID NO: 7324

SEQ ID NO: 220509 - RNA, 62 nt, Human
uggcaaaaggcccucuggagggcugguggccacgagguuaaagaagcugcauguuaagugcc

SEQ ID NO: 220510 - RNA, 62 nt, Human
uccauccuuaccaaaggauugugaccgcagaccgagguuaguuuaguucugcaguucuuguc

SEQ ID NO: 220511 - RNA, 62 nt, Human
cccccugacauagucucagagaucuguagggccgagguuacauuuggagaacccguacucua

SEQ ID NO: 220512 - RNA, 64 nt, Human; identical to SEQ ID NO: 7325

SEQ ID NO: 220513 - RNA, 64 nt, Human; identical to SEQ ID NO: 7326

SEQ ID NO: 220514 - RNA, 64 nt, Human; identical to SEQ ID NO: 7327

SEQ ID NO: 220515 - RNA, 64 nt, Human; identical to SEQ ID NO: 7328

SEQ ID NO: 220516 - RNA, 64 nt, Human; identical to SEQ ID NO: 7329

SEQ ID NO: 220517 - RNA, 64 nt, Human; identical to SEQ ID NO: 7331

SEQ ID NO: 220518 - RNA, 64 nt, Human; identical to SEQ ID NO: 7332

SEQ ID NO: 220519 - RNA, 64 nt, Human; identical to SEQ ID NO: 7333

SEQ ID NO: 220520 - RNA, 64 nt, Human; identical to SEQ ID NO: 7334

SEQ ID NO: 220521 - RNA, 64 nt, Human; identical to SEQ ID NO: 7335

SEQ ID NO: 220522 - RNA, 64 nt, Human; identical to SEQ ID NO: 7336

SEQ ID NO: 220523 - RNA, 64 nt, Human; identical to SEQ ID NO: 7337

SEQ ID NO: 220524 - RNA, 64 nt, Human; identical to SEQ ID NO: 7338

SEQ ID NO: 220525 - RNA, 64 nt, Human; identical to SEQ ID NO: 7339

SEQ ID NO: 220526 - RNA, 64 nt, Human; identical to SEQ ID NO: 7340

SEQ ID NO: 220527 - RNA, 62 nt, Human
gaagcugacagaagcagcguuccugaaguggccgagguuaaacggaaucacagaauggucca

SEQ ID NO: 220528 - RNA, 62 nt, Human
acucaucaccaggacaguuggaggggguaggccgagguuaaaugguccacguuucaaaaaug

SEQ ID NO: 220529 - RNA, 62 nt, Human
acuggguugcugguuuucaucguaacacagaacgagguuaucuaggguuguagcuuuugaua

SEQ ID NO: 220530 - RNA, 64 nt, Human; identical to SEQ ID NO: 7341

SEQ ID NO: 220531 - RNA, 64 nt, Human; identical to SEQ ID NO: 7342

SEQ ID NO: 220532 - RNA, 64 nt, Human; identical to SEQ ID NO: 7343

SEQ ID NO: 220533 - RNA, 64 nt, Human; identical to SEQ ID NO: 7344

SEQ ID NO: 220534 - RNA, 64 nt, Human; identical to SEQ ID NO: 7345

SEQ ID NO: 220535 - RNA, 64 nt, Human; identical to SEQ ID NO: 7346

SEQ ID NO: 220536 - RNA, 64 nt, Human; identical to SEQ ID NO: 7347

SEQ ID NO: 220537 - RNA, 64 nt, Human; identical to SEQ ID NO: 7348

SEQ ID NO: 220538 - RNA, 64 nt, Human; identical to SEQ ID NO: 7350

SEQ ID NO: 220539 - RNA, 64 nt, Human; identical to SEQ ID NO: 7351

SEQ ID NO: 220540 - RNA, 64 nt, Human; identical to SEQ ID NO: 7352

SEQ ID NO: 220541 - RNA, 64 nt, Human; identical to SEQ ID NO: 7353

SEQ ID NO: 220542 - RNA, 64 nt, Human; identical to SEQ ID NO: 7354

SEQ ID NO: 220543 - RNA, 64 nt, Human; identical to SEQ ID NO: 7355

SEQ ID NO: 220544 - RNA, 64 nt, Human; identical to SEQ ID NO: 7356

SEQ ID NO: 220545 - RNA, 64 nt, Human
ucugagaccacaccccaguagcagguuacgccaugucaccgagccccauugauucccagagggu

SEQ ID NO: 220546 - RNA, 62 nt, Human
agugcuguuucccggccuccagacacaaggcucgagguuauggcagugacuuucagcugaga

SEQ ID NO: 220547 - RNA, 62 nt, Human
ccugguggaucccaagggacccucaaggaccucgagguuacugcagucagaugccaucucau

SEQ ID NO: 220548 - RNA, 64 nt, Human; identical to SEQ ID NO: 7357

SEQ ID NO: 220549 - RNA, 64 nt, Human; identical to SEQ ID NO: 7358

SEQ ID NO: 220550 - RNA, 64 nt, Human; identical to SEQ ID NO: 7359

SEQ ID NO: 220551 - RNA, 64 nt, Human; identical to SEQ ID NO: 7360

SEQ ID NO: 220552 - RNA, 64 nt, Human; identical to SEQ ID NO: 7361

SEQ ID NO: 220553 - RNA, 64 nt, Human; identical to SEQ ID NO: 7362

SEQ ID NO: 220554 - RNA, 64 nt, Human; identical to SEQ ID NO: 7363

SEQ ID NO: 220555 - RNA, 64 nt, Human; identical to SEQ ID NO: 7364

SEQ ID NO: 220556 - RNA, 64 nt, Human; identical to SEQ ID NO: 7365

SEQ ID NO: 220557 - RNA, 64 nt, Human; identical to SEQ ID NO: 7366

SEQ ID NO: 220558 - RNA, 64 nt, Human; identical to SEQ ID NO: 7367

SEQ ID NO: 220559 - RNA, 64 nt, Human; identical to SEQ ID NO: 7369

SEQ ID NO: 220560 - RNA, 64 nt, Human; identical to SEQ ID NO: 7370

SEQ ID NO: 220561 - RNA, 64 nt, Human; identical to SEQ ID NO: 7371

SEQ ID NO: 220562 - RNA, 64 nt, Human; identical to SEQ ID NO: 7372

SEQ ID NO: 220563 - RNA, 64 nt, Human
cagggacacgcccuucagagcccgucucuaugacgucaccgacagccaucaccuccuucuugga

SEQ ID NO: 220564 - RNA, 64 nt, Human
gccagaauguccguuugaaacuccuagcucaucugucaccgagcuucauccgaaugugccacgg

SEQ ID NO: 220565 - RNA, 62 nt, Human
aacaugagccaucugagugaguccauaugaagcgagguuaggcugaaauaauugcuuaaaga

SEQ ID NO: 220566 - RNA, 64 nt, Human; identical to SEQ ID NO: 7373

SEQ ID NO: 220567 - RNA, 64 nt, Human; identical to SEQ ID NO: 7374

SEQ ID NO: 220568 - RNA, 64 nt, Human; identical to SEQ ID NO: 7375

SEQ ID NO: 220569 - RNA, 64 nt, Human; identical to SEQ ID NO: 7376

SEQ ID NO: 220570 - RNA, 64 nt, Human; identical to SEQ ID NO: 7377

SEQ ID NO: 220571 - RNA, 64 nt, Human; identical to SEQ ID NO: 7378

SEQ ID NO: 220572 - RNA, 64 nt, Human; identical to SEQ ID NO: 7379

SEQ ID NO: 220573 - RNA, 64 nt, Human; identical to SEQ ID NO: 7380

SEQ ID NO: 220574 - RNA, 64 nt, Human; identical to SEQ ID NO: 7381

SEQ ID NO: 220575 - RNA, 64 nt, Human; identical to SEQ ID NO: 7382

SEQ ID NO: 220576 - RNA, 64 nt, Human; identical to SEQ ID NO: 7383

SEQ ID NO: 220577 - RNA, 64 nt, Human; identical to SEQ ID NO: 7384

SEQ ID NO: 220578 - RNA, 64 nt, Human; identical to SEQ ID NO: 7385

SEQ ID NO: 220579 - RNA, 64 nt, Human; identical to SEQ ID NO: 7386

SEQ ID NO: 220580 - RNA, 64 nt, Human; identical to SEQ ID NO: 7388

SEQ ID NO: 220581 - RNA, 64 nt, Human
uuaaggggaaauaauuucucagaggauuauaauugucaccgaagccuuaaauccuucugucuuc

SEQ ID NO: 220582 - RNA, 62 nt, Human
agcagagcagccuuaagcaucuuggaagaucccgagguuagauucuuaagcaagagaagagu

SEQ ID NO: 220583 - RNA, 64 nt, Human; identical to SEQ ID NO: 214861

SEQ ID NO: 220584 - RNA, 64 nt, Human; identical to SEQ ID NO: 7389

SEQ ID NO: 220585 - RNA, 64 nt, Human; identical to SEQ ID NO: 7390

SEQ ID NO: 220586 - RNA, 64 nt, Human; identical to SEQ ID NO: 7391

SEQ ID NO: 220587 - RNA, 64 nt, Human; identical to SEQ ID NO: 7392

SEQ ID NO: 220588 - RNA, 64 nt, Human; identical to SEQ ID NO: 7393

SEQ ID NO: 220589 - RNA, 59 nt, Human; identical to SEQ ID NO: 7394

SEQ ID NO: 220590 - RNA, 64 nt, Human; identical to SEQ ID NO: 7395

SEQ ID NO: 220591 - RNA, 64 nt, Human; identical to SEQ ID NO: 7396

SEQ ID NO: 220592 - RNA, 64 nt, Human; identical to SEQ ID NO: 7397

SEQ ID NO: 220593 - RNA, 64 nt, Human; identical to SEQ ID NO: 7398

SEQ ID NO: 220594 - RNA, 64 nt, Human; identical to SEQ ID NO: 7399

SEQ ID NO: 220595 - RNA, 64 nt, Human; identical to SEQ ID NO: 7400

SEQ ID NO: 220596 - RNA, 64 nt, Human; identical to SEQ ID NO: 7401

SEQ ID NO: 220597 - RNA, 64 nt, Human; identical to SEQ ID NO: 7402

SEQ ID NO: 220598 - RNA, 64 nt, Human; identical to SEQ ID NO: 7403

SEQ ID NO: 220599 - RNA, 62 nt, Human
aacggccccauuuacugaccccgcccccuuuucgagguuaugcucaccuggucagcuccuca

SEQ ID NO: 220600 - RNA, 62 nt, Human
aaauugaguuucuuguaaaugugacugaugagcgagguuagaaguggaagaaauuccugugc

SEQ ID NO: 220601 - RNA, 62 nt, Human
uaggaaggcugauggcaaaagcggcugugugucgagguuauuuuaacuuuuuacuacuuuuu

SEQ ID NO: 220602 - RNA, 64 nt, Human; identical to SEQ ID NO: 7404

SEQ ID NO: 220603 - RNA, 64 nt, Human; identical to SEQ ID NO: 7405

SEQ ID NO: 220604 - RNA, 64 nt, Human; identical to SEQ ID NO: 7407

SEQ ID NO: 220605 - RNA, 64 nt, Human; identical to SEQ ID NO: 7408

SEQ ID NO: 220606 - RNA, 64 nt, Human; identical to SEQ ID NO: 7409

SEQ ID NO: 220607 - RNA, 64 nt, Human; identical to SEQ ID NO: 7410

SEQ ID NO: 220608 - RNA, 64 nt, Human; identical to SEQ ID NO: 7411

SEQ ID NO: 220609 - RNA, 64 nt, Human; identical to SEQ ID NO: 7412

SEQ ID NO: 220610 - RNA, 64 nt, Human; identical to SEQ ID NO: 7413

SEQ ID NO: 220611 - RNA, 64 nt, Human; identical to SEQ ID NO: 7414

SEQ ID NO: 220612 - RNA, 64 nt, Human; identical to SEQ ID NO: 7415

SEQ ID NO: 220613 - RNA, 64 nt, Human; identical to SEQ ID NO: 7416

SEQ ID NO: 220614 - RNA, 64 nt, Human; identical to SEQ ID NO: 7417

SEQ ID NO: 220615 - RNA, 64 nt, Human; identical to SEQ ID NO: 7418

SEQ ID NO: 220616 - RNA, 64 nt, Human; identical to SEQ ID NO: 7419

SEQ ID NO: 220617 - RNA, 62 nt, Human
uguguuacagcagcuccaugaugguuguugcccgagguuaauguaguuguuuguuagaccug

SEQ ID NO: 220618 - RNA, 64 nt, Human
caaguguuaggugcauuuaacugcuuucuucauccaugacgacauucccaccaugggggucuug

SEQ ID NO: 220619 - RNA, 64 nt, Human
cuugagcccaggaguucaagaccagccugggcuacaugacgaaacuccaucucuaucaaaaaua

SEQ ID NO: 220620 - RNA, 64 nt, Human; identical to SEQ ID NO: 7420

SEQ ID NO: 220621 - RNA, 64 nt, Human; identical to SEQ ID NO: 7421

SEQ ID NO: 220622 - RNA, 64 nt, Human; identical to SEQ ID NO: 7422

SEQ ID NO: 220623 - RNA, 64 nt, Human; identical to SEQ ID NO: 7423

SEQ ID NO: 220624 - RNA, 64 nt, Human; identical to SEQ ID NO: 7424

SEQ ID NO: 220625 - RNA, 64 nt, Human; identical to SEQ ID NO: 7425

SEQ ID NO: 220626 - RNA, 64 nt, Human; identical to SEQ ID NO: 7426

SEQ ID NO: 220627 - RNA, 64 nt, Human; identical to SEQ ID NO: 7427

SEQ ID NO: 220628 - RNA, 64 nt, Human; identical to SEQ ID NO: 7428

SEQ ID NO: 220629 - RNA, 64 nt, Human; identical to SEQ ID NO: 7429

SEQ ID NO: 220630 - RNA, 64 nt, Human; identical to SEQ ID NO: 7430

SEQ ID NO: 220631 - RNA, 64 nt, Human; identical to SEQ ID NO: 7431

SEQ ID NO: 220632 - RNA, 64 nt, Human; identical to SEQ ID NO: 7432

SEQ ID NO: 220633 - RNA, 64 nt, Human; identical to SEQ ID NO: 7433

SEQ ID NO: 220634 - RNA, 64 nt, Human; identical to SEQ ID NO: 7434

SEQ ID NO: 220635 - RNA, 64 nt, Human
guggaacaggagggguggggaggaagccggggcagucaccgagugaccaccaagaggaagaccc

SEQ ID NO: 220636 - RNA, 62 nt, Human
caagaaaaaugccaaaagcuauuuaaauaauucgagguuacaucguagguuuugauuuuucu

SEQ ID NO: 220637 - RNA, 64 nt, Human
accuucugccaccccagcagaagccuucauacaacaugacgaaacaagggaucauguugaagug

SEQ ID NO: 220638 - RNA, 64 nt, Human; identical to SEQ ID NO: 7435

SEQ ID NO: 220639 - RNA, 64 nt, Human; identical to SEQ ID NO: 7436

SEQ ID NO: 220640 - RNA, 64 nt, Human; identical to SEQ ID NO: 7437

SEQ ID NO: 220641 - RNA, 64 nt, Human; identical to SEQ ID NO: 7438

SEQ ID NO: 220642 - RNA, 64 nt, Human; identical to SEQ ID NO: 7439

SEQ ID NO: 220643 - RNA, 64 nt, Human; identical to SEQ ID NO: 7440

SEQ ID NO: 220644 - RNA, 64 nt, Human; identical to SEQ ID NO: 7441

SEQ ID NO: 220645 - RNA, 64 nt, Human; identical to SEQ ID NO: 7442

SEQ ID NO: 220646 - RNA, 64 nt, Human; identical to SEQ ID NO: 7443

SEQ ID NO: 220647 - RNA, 64 nt, Human; identical to SEQ ID NO: 7444

SEQ ID NO: 220648 - RNA, 64 nt, Human; identical to SEQ ID NO: 7445

SEQ ID NO: 220649 - RNA, 64 nt, Human; identical to SEQ ID NO: 7446

SEQ ID NO: 220650 - RNA, 64 nt, Human; identical to SEQ ID NO: 7447

SEQ ID NO: 220651 - RNA, 64 nt, Human; identical to SEQ ID NO: 7448

SEQ ID NO: 220652 - RNA, 64 nt, Human; identical to SEQ ID NO: 7449

SEQ ID NO: 220653 - RNA, 64 nt, Human
cuaauaggauauugacuuggauagcuugaugucucaugacgagcggcgcucugcaucccucacc

SEQ ID NO: 220654 - RNA, 64 nt, Human
aucuuauacaacagcaaacccugaugugacauuccaugacgacauacaugcuacuuuuuuuuag

SEQ ID NO: 220655 - RNA, 64 nt, Human
uaaaccuccgagaugagcugcucagacucuacagcaugacgacuacaauuucuuuucauaaaac

SEQ ID NO: 220656 - RNA, 64 nt, Human; identical to SEQ ID NO: 7450

SEQ ID NO: 220657 - RNA, 64 nt, Human; identical to SEQ ID NO: 7451

SEQ ID NO: 220658 - RNA, 64 nt, Human; identical to SEQ ID NO: 7452

SEQ ID NO: 220659 - RNA, 64 nt, Human; identical to SEQ ID NO: 7453

SEQ ID NO: 220660 - RNA, 64 nt, Human; identical to SEQ ID NO: 7454

SEQ ID NO: 220661 - RNA, 64 nt, Human; identical to SEQ ID NO: 7455

SEQ ID NO: 220662 - RNA, 64 nt, Human; identical to SEQ ID NO: 7456

SEQ ID NO: 220663 - RNA, 64 nt, Human; identical to SEQ ID NO: 7457

SEQ ID NO: 220664 - RNA, 64 nt, Human; identical to SEQ ID NO: 7458

SEQ ID NO: 220665 - RNA, 64 nt, Human; identical to SEQ ID NO: 7459

SEQ ID NO: 220666 - RNA, 64 nt, Human; identical to SEQ ID NO: 7460

SEQ ID NO: 220667 - RNA, 64 nt, Human; identical to SEQ ID NO: 7461

SEQ ID NO: 220668 - RNA, 64 nt, Human; identical to SEQ ID NO: 7462

SEQ ID NO: 220669 - RNA, 50 nt, Human; identical to SEQ ID NO: 7463

SEQ ID NO: 220670 - RNA, 64 nt, Human; identical to SEQ ID NO: 7464

SEQ ID NO: 220671 - RNA, 64 nt, Human
ggcucugagaaaccucgggaaacuuagaucaucagucaccgaagguccuacagggccacaacug

SEQ ID NO: 220672 - RNA, 64 nt, Human
uagaagccagucucugucacauacaccgcagguggucaccgaguuauuuuccaaaagcugagga

SEQ ID NO: 220673 - RNA, 64 nt, Human
acccaguuugaaacguaacugguucccugaccaggucaccgacgaugagggcgcaccugcuguc

SEQ ID NO: 220674 - RNA, 64 nt, Human; identical to SEQ ID NO: 7465

SEQ ID NO: 220675 - RNA, 64 nt, Human; identical to SEQ ID NO: 7466

SEQ ID NO: 220676 - RNA, 64 nt, Human; identical to SEQ ID NO: 7467

SEQ ID NO: 220677 - RNA, 64 nt, Human; identical to SEQ ID NO: 7468

SEQ ID NO: 220678 - RNA, 64 nt, Human; identical to SEQ ID NO: 7469

SEQ ID NO: 220679 - RNA, 64 nt, Human; identical to SEQ ID NO: 7470

SEQ ID NO: 220680 - RNA, 64 nt, Human; identical to SEQ ID NO: 7471

SEQ ID NO: 220681 - RNA, 64 nt, Human; identical to SEQ ID NO: 7472

SEQ ID NO: 220682 - RNA, 64 nt, Human; identical to SEQ ID NO: 7473

SEQ ID NO: 220683 - RNA, 64 nt, Human; identical to SEQ ID NO: 7474

SEQ ID NO: 220684 - RNA, 64 nt, Human; identical to SEQ ID NO: 7475

SEQ ID NO: 220685 - RNA, 64 nt, Human; identical to SEQ ID NO: 7476

SEQ ID NO: 220686 - RNA, 64 nt, Human; identical to SEQ ID NO: 7477

SEQ ID NO: 220687 - RNA, 64 nt, Human; identical to SEQ ID NO: 7478

SEQ ID NO: 220688 - RNA, 64 nt, Human; identical to SEQ ID NO: 7479

SEQ ID NO: 220689 - RNA, 64 nt, Human
ucagacaccgccuucucaagccugucuauaaaaucugguacacuaugacgagggucagauuucc

SEQ ID NO: 220690 - RNA, 64 nt, Human; identical to SEQ ID NO: 217755

SEQ ID NO: 220691 - RNA, 64 nt, Human; identical to SEQ ID NO: 7480

SEQ ID NO: 220692 - RNA, 64 nt, Human; identical to SEQ ID NO: 7481

SEQ ID NO: 220693 - RNA, 64 nt, Human; identical to SEQ ID NO: 7483

SEQ ID NO: 220694 - RNA, 64 nt, Human; identical to SEQ ID NO: 7484

SEQ ID NO: 220695 - RNA, 64 nt, Human; identical to SEQ ID NO: 7485

SEQ ID NO: 220696 - RNA, 64 nt, Human; identical to SEQ ID NO: 7486

SEQ ID NO: 220697 - RNA, 64 nt, Human; identical to SEQ ID NO: 7487

SEQ ID NO: 220698 - RNA, 64 nt, Human; identical to SEQ ID NO: 7488

SEQ ID NO: 220699 - RNA, 64 nt, Human; identical to SEQ ID NO: 7489

SEQ ID NO: 220700 - RNA, 64 nt, Human; identical to SEQ ID NO: 7490

SEQ ID NO: 220701 - RNA, 64 nt, Human; identical to SEQ ID NO: 7491

SEQ ID NO: 220702 - RNA, 64 nt, Human; identical to SEQ ID NO: 7492

SEQ ID NO: 220703 - RNA, 64 nt, Human; identical to SEQ ID NO: 7493

SEQ ID NO: 220704 - RNA, 64 nt, Human; identical to SEQ ID NO: 7494

SEQ ID NO: 220705 - RNA, 64 nt, Human; identical to SEQ ID NO: 7495

SEQ ID NO: 220706 - RNA, 64 nt, Human
cguguucacacacccuccuguguacccccccagggucaccgaaguccccacacgcuggcucucc

SEQ ID NO: 220707 - RNA, 64 nt, Human
cagcuggacaagguguuuggggcaugcugcccccgucaccgaggaucuguguggguagccucaa

SEQ ID NO: 220708 - RNA, 64 nt, Human
ggugagcccuccagcugugagcccaggcaguguggucaccgagugaggacccuccucaccagga

SEQ ID NO: 220709 - RNA, 64 nt, Human; identical to SEQ ID NO: 7496

SEQ ID NO: 220710 - RNA, 64 nt, Human; identical to SEQ ID NO: 7497

SEQ ID NO: 220711 - RNA, 64 nt, Human; identical to SEQ ID NO: 7498

SEQ ID NO: 220712 - RNA, 64 nt, Human; identical to SEQ ID NO: 7499

SEQ ID NO: 220713 - RNA, 64 nt, Human; identical to SEQ ID NO: 7500

SEQ ID NO: 220714 - RNA, 64 nt, Human; identical to SEQ ID NO: 7502

SEQ ID NO: 220715 - RNA, 64 nt, Human; identical to SEQ ID NO: 7503

SEQ ID NO: 220716 - RNA, 64 nt, Human; identical to SEQ ID NO: 7504

SEQ ID NO: 220717 - RNA, 64 nt, Human; identical to SEQ ID NO: 7505

SEQ ID NO: 220718 - RNA, 64 nt, Human; identical to SEQ ID NO: 7506

SEQ ID NO: 220719 - RNA, 64 nt, Human; identical to SEQ ID NO: 7507

SEQ ID NO: 220720 - RNA, 64 nt, Human; identical to SEQ ID NO: 7508

SEQ ID NO: 220721 - RNA, 64 nt, Human; identical to SEQ ID NO: 7509

SEQ ID NO: 220722 - RNA, 64 nt, Human; identical to SEQ ID NO: 7510

SEQ ID NO: 220723 - RNA, 64 nt, Human; identical to SEQ ID NO: 7511

SEQ ID NO: 220724 - RNA, 64 nt, Human
cauccagcagcagcacuuagaccugccagccacugucaccgagcgggugcaagcacucgggguc

SEQ ID NO: 220725 - RNA, 64 nt, Human
ugaggccugcuccccugcgaccgcccugccccccgucaccgaaucggacacucauccuuucuca

SEQ ID NO: 220726 - RNA, 64 nt, Human
cgggcgggggcaugguaacagugguccuguugaugucaccgaugaugcugagcgccuccuucag

SEQ ID NO: 220727 - RNA, 64 nt, Human; identical to SEQ ID NO: 7512

SEQ ID NO: 220728 - RNA, 64 nt, Human; identical to SEQ ID NO: 7513

SEQ ID NO: 220729 - RNA, 64 nt, Human; identical to SEQ ID NO: 7514

SEQ ID NO: 220730 - RNA, 64 nt, Human; identical to SEQ ID NO: 7515

SEQ ID NO: 220731 - RNA, 64 nt, Human; identical to SEQ ID NO: 7516

SEQ ID NO: 220732 - RNA, 64 nt, Human; identical to SEQ ID NO: 7517

SEQ ID NO: 220733 - RNA, 64 nt, Human; identical to SEQ ID NO: 7518

SEQ ID NO: 220734 - RNA, 64 nt, Human; identical to SEQ ID NO: 7519

SEQ ID NO: 220735 - RNA, 64 nt, Human; identical to SEQ ID NO: 7521

SEQ ID NO: 220736 - RNA, 64 nt, Human; identical to SEQ ID NO: 7522

SEQ ID NO: 220737 - RNA, 64 nt, Human; identical to SEQ ID NO: 7523

SEQ ID NO: 220738 - RNA, 55 nt, Human; identical to SEQ ID NO: 7524

SEQ ID NO: 220739 - RNA, 64 nt, Human; identical to SEQ ID NO: 7525

SEQ ID NO: 220740 - RNA, 64 nt, Human; identical to SEQ ID NO: 7526

SEQ ID NO: 220741 - RNA, 64 nt, Human; identical to SEQ ID NO: 7527

SEQ ID NO: 220742 - RNA, 64 nt, Human
cugcuugaggaaacgcagggccugguuugggagagucaccgagggcccauguggcuggagguug

SEQ ID NO: 220743 - RNA, 64 nt, Human
gugugcgcgugcgcugucuggcgcugcaggcggagucaccgacucugugcagagaggcuuugag

SEQ ID NO: 220744 - RNA, 64 nt, Human
cauccugguaccccacauccucuccuccgggacagucaccgaaaacacagguuccaaagucuac

SEQ ID NO: 220745 - RNA, 64 nt, Human; identical to SEQ ID NO: 7528

SEQ ID NO: 220746 - RNA, 64 nt, Human; identical to SEQ ID NO: 7529

SEQ ID NO: 220747 - RNA, 64 nt, Human; identical to SEQ ID NO: 7530

SEQ ID NO: 220748 - RNA, 64 nt, Human; identical to SEQ ID NO: 7531

SEQ ID NO: 220749 - RNA, 64 nt, Human; identical to SEQ ID NO: 7532

SEQ ID NO: 220750 - RNA, 64 nt, Human; identical to SEQ ID NO: 7533

SEQ ID NO: 220751 - RNA, 64 nt, Human; identical to SEQ ID NO: 7534

SEQ ID NO: 220752 - RNA, 64 nt, Human; identical to SEQ ID NO: 7535

SEQ ID NO: 220753 - RNA, 64 nt, Human; identical to SEQ ID NO: 7536

SEQ ID NO: 220754 - RNA, 64 nt, Human; identical to SEQ ID NO: 7537

SEQ ID NO: 220755 - RNA, 64 nt, Human; identical to SEQ ID NO: 7538

SEQ ID NO: 220756 - RNA, 64 nt, Human; identical to SEQ ID NO: 7539

SEQ ID NO: 220757 - RNA, 64 nt, Human; identical to SEQ ID NO: 7540

SEQ ID NO: 220758 - RNA, 64 nt, Human; identical to SEQ ID NO: 7541

SEQ ID NO: 220759 - RNA, 64 nt, Human; identical to SEQ ID NO: 7542

SEQ ID NO: 220760 - RNA, 62 nt, Human
aggaggcagugaggaccaggcacuauuuccuccgagguuacuucuacccagaugacaccugc

SEQ ID NO: 220761 - RNA, 64 nt, Human
gcguuucugacagcucccagcugggagaaaccaacaugacgaaaagacaaagaauacuggagaa

SEQ ID NO: 220762 - RNA, 64 nt, Human
auucucucauccuacuuagccuaccuagauuucucaugacgaguuaaugcauguccgugguugg

SEQ ID NO: 220763 - RNA, 57 nt, Human; identical to SEQ ID NO: 7543

SEQ ID NO: 220764 - RNA, 64 nt, Human; identical to SEQ ID NO: 7544

SEQ ID NO: 220765 - RNA, 64 nt, Human; identical to SEQ ID NO: 7545

SEQ ID NO: 220766 - RNA, 64 nt, Human; identical to SEQ ID NO: 7546

SEQ ID NO: 220767 - RNA, 64 nt, Human; identical to SEQ ID NO: 7547

SEQ ID NO: 220768 - RNA, 64 nt, Human; identical to SEQ ID NO: 7548

SEQ ID NO: 220769 - RNA, 64 nt, Human; identical to SEQ ID NO: 7549

SEQ ID NO: 220770 - RNA, 64 nt, Human; identical to SEQ ID NO: 7550

SEQ ID NO: 220771 - RNA, 64 nt, Human; identical to SEQ ID NO: 7551

SEQ ID NO: 220772 - RNA, 64 nt, Human; identical to SEQ ID NO: 7552

SEQ ID NO: 220773 - RNA, 64 nt, Human; identical to SEQ ID NO: 7553

SEQ ID NO: 220774 - RNA, 64 nt, Human; identical to SEQ ID NO: 7554

SEQ ID NO: 220775 - RNA, 64 nt, Human; identical to SEQ ID NO: 7555

SEQ ID NO: 220776 - RNA, 64 nt, Human; identical to SEQ ID NO: 7556

SEQ ID NO: 220777 - RNA, 64 nt, Human; identical to SEQ ID NO: 7557

SEQ ID NO: 220778 - RNA, 64 nt, Human
aauuccuuuuuuuuugagauggaguuucacucuugucaccgaggcuggagugcaaugacaugau

SEQ ID NO: 220779 - RNA, 64 nt, Human
acagaagucuggucaccucugggcgccugggauggucaccgaagagaagcacgcuguccccguc

SEQ ID NO: 220780 - RNA, 64 nt, Human
cucgccacggggagggggacgcgcacacacaccggucaccgagacggcuggaccugcacgccac

SEQ ID NO: 220781 - RNA, 64 nt, Human; identical to SEQ ID NO: 7558

SEQ ID NO: 220782 - RNA, 64 nt, Human; identical to SEQ ID NO: 7559

SEQ ID NO: 220783 - RNA, 64 nt, Human; identical to SEQ ID NO: 7560

SEQ ID NO: 220784 - RNA, 64 nt, Human; identical to SEQ ID NO: 7561

SEQ ID NO: 220785 - RNA, 64 nt, Human; identical to SEQ ID NO: 7562

SEQ ID NO: 220786 - RNA, 64 nt, Human; identical to SEQ ID NO: 7563

SEQ ID NO: 220787 - RNA, 64 nt, Human; identical to SEQ ID NO: 7564

SEQ ID NO: 220788 - RNA, 64 nt, Human; identical to SEQ ID NO: 7565

SEQ ID NO: 220789 - RNA, 64 nt, Human
cuuccuuugaaggccccagcaccucugcccuguggucaccgaaucuguacuaaggaccuguguu

SEQ ID NO: 220790 - RNA, 64 nt, Human
ccuggcacccuugaggucucuccuuugagccguggucaccgagaggguugaggacgcagcaccc

SEQ ID NO: 220791 - RNA, 64 nt, Human
acccucccuagucauucucaacuggggcggugcugucaccgaaugguguuugagaguguugggg

SEQ ID NO: 220792 - RNA, 64 nt, Human
guccccaggcguggacucugcccucagcuucacagucaccgaagaaaugaaguuacaggagggg

SEQ ID NO: 220793 - RNA, 64 nt, Human
cgggcaccacccgaccucgcagggagcaggcccugucaccgacgggucaccucgcccacacggc

SEQ ID NO: 220794 - RNA, 64 nt, Human
cgcacagcaguggggagaacagcgucuuuuaccugucaccgaagccaggaagccccguuuguaa

SEQ ID NO: 220795 - RNA, 64 nt, Human
gacaucaacuccuucuagcauccagcaagucaaugucaccgacagugaugaggaggaagaagaa

SEQ ID NO: 220796 - RNA, 64 nt, Human
auuaaacguccucuauucaccgggcccugugugugucaccgaggugcgggaggggaggagcauu

SEQ ID NO: 220797 - RNA, 64 nt, Human
cuugauucagugcucaguggucuccuaguaagaagucaccgacgguagcgucauaugagaagaa

SEQ ID NO: 220798 - RNA, 64 nt, Human
auuauagaagcucagccuggccugcuccccucuggucaccgacaccccuguccucgcugggaca

SEQ ID NO: 220799 - RNA, 64 nt, Human
ccgcugcacaucacaacauuuacuuaacagaacagucaccgacaacaugcugugugcuggagac

SEQ ID NO: 220800 - RNA, 64 nt, Human
cccugcuggggaagaacagccccggggcccccuggucaccgagacucagccucugcuggagaaa

SEQ ID NO: 220801 - RNA, 64 nt, Human
gacccuggacacucaagccaaaguuaggccacaccaggcccaacccugugcuggucaagccagg

SEQ ID NO: 220802 - RNA, 64 nt, Human
ugccaguaagucugcaggugcggggugccaccuacaggcccaggccugugucccaagcaguacc

SEQ ID NO: 220803 - RNA, 64 nt, Human
agaugacucaccacaccucuacggcuggggagaucaggcccagccccauaaaggagaaucuacg

SEQ ID NO: 220804 - RNA, 64 nt, Human
cauguguuggaggccaaauguggcaaaccaaccccaggcccacccagagcgagcaaacgcugag

SEQ ID NO: 220805 - RNA, 64 nt, Human
gccuggccgccagccccagccccagccccagccccaggcccagcugccuuuggcuuugaucuca

SEQ ID NO: 220806 - RNA, 64 nt, Human
caaguuggggaacagauggcugaggcugcagacucaggcccaggacacucaaccccaggagggg

SEQ ID NO: 220807 - RNA, 64 nt, Human
cugcucccuguguucccacccuccaguguuggcacaggcccaccccuggcuccaccagagccag

SEQ ID NO: 220808 - RNA, 64 nt, Human
gggccucggcaccuggcccuggcagcacagcucucaggcccagcccugggcgaccuccuuggcc

SEQ ID NO: 220809 - RNA, 64 nt, Human
cacccaggagauggaauccccugcccgcccagcucaggcccagcuguccuagguugggcaggug

SEQ ID NO: 220810 - RNA, 64 nt, Human
ggucccagagcccugggcaucagaccuuaaccaccaggcccacagcccagcgagggagaggucg

SEQ ID NO: 220811 - RNA, 64 nt, Human
cccuaacugcccccugccugcuccggcacugccccaggcccagcuccuggcccuaggucccucc

SEQ ID NO: 220812 - RNA, 64 nt, Human
cagggugugggggcagcugugccaaucuaccucacaggcccacccccugccgggcaugccgugg

SEQ ID NO: 220813 - RNA, 64 nt, Human
acacccuggugcccugcaccagacaggccguggucaggcccaggccaccggccggguucugcca

SEQ ID NO: 220814 - RNA, 64 nt, Human
uggagcaugggaucgugggaaagaggagggggaccaggcccagggcaggggucagaggcccagg

SEQ ID NO: 220815 - RNA, 64 nt, Human
uggaaaggucagcuggggccaguggugccucaggcaggcccacacaacuggccaccucuucccg

SEQ ID NO: 220816 - RNA, 64 nt, Human
cacagcaggcagcauauguugaaauaaguuauuacugguacacaccugcauugccucaccagug

SEQ ID NO: 220817 - RNA, 64 nt, Human
gagccggggcuguccaacuccccuaacucaaucccugguacauuccuaauaaagcaguuuugag

SEQ ID NO: 220818 - RNA, 64 nt, Human
uuuguuuaauuccugauuuuaaagccugcucuaucugguacaggcccuuauuuuuucagcuuuu

SEQ ID NO: 220819 - RNA, 64 nt, Human
cccccaggcccuacaaugcucaugucccuguccccaggcccagcccuccuucaggggaguugag

SEQ ID NO: 220820 - RNA, 64 nt, Human
ggagccaggggccacuucugaacugcaccagcaccaggcccacccucgucucugccugggugag

SEQ ID NO: 220821 - RNA, 64 nt, Human
ccaggcuguguauccuuuggaaagucauugaauccaggcccauuuccuuuucucuaaaaugagg

SEQ ID NO: 220822 - RNA, 64 nt, Human
agucuaaguagcugggacuacaggcacgugccaccaggcccagcuaauuuuuguguuuuguuag

SEQ ID NO: 220823 - RNA, 64 nt, Human
cggagcucucuguguuuggccucucacacacacacaggcccauagacagaugggcagaugcacc

SEQ ID NO: 220824 - RNA, 64 nt, Human
gaacugggcugucuagccggguauagguaacccacaggcccagugccagcccucaaaggacaua

SEQ ID NO: 220825 - RNA, 64 nt, Human
uggacagaggaggcuggccauggggcccaggggucaggcccagcuuuugagcagaauacaacgc

SEQ ID NO: 220826 - RNA, 64 nt, Human
gccagagggccagcaggcuccuggcugugcccagcaggcccagcaugcagguggugggacacug

SEQ ID NO: 220827 - RNA, 56 nt, Human
uuaguggcugccacuucugaccgcagcaggcccagggccgguuagguccgcacucc

SEQ ID NO: 220828 - RNA, 64 nt, Human
uguccaggccuggccucuuucuugagguggccaccaggcccaggccaggcccuuugcccaagaa

SEQ ID NO: 220829 - RNA, 64 nt, Human
gccccagacccagggcucuaaccuuguaugcgggcaggcccagggagcaggcagcaguguucuu

SEQ ID NO: 220830 - RNA, 64 nt, Human
uauggagaggccccuggcuucaugagaacaaaggcaggcccagguuauaauuacagcuuucucc

SEQ ID NO: 220831 - RNA, 64 nt, Human
uuguuggauggguuuaaaaauaacuagaaaaacucaggcccauccauuuucucagaucuccuug

SEQ ID NO: 220832 - RNA, 64 nt, Human
gugacugacacaaagugacuuucagggcuguggucaggcccaugugguggugugaugggugugu

SEQ ID NO: 220833 - RNA, 64 nt, Human
uaggcccuuccaccagcuggggagcuagagggagcaggcccaagggcagagcagaggcugaggc

SEQ ID NO: 220834 - RNA, 64 nt, Human
ugaacuuggcccgugucugcuacucuguaccuugcugguacagacagggguggugggcagccag

SEQ ID NO: 220835 - RNA, 64 nt, Human
agucuucuuuaugaauacucagagcauuguucagcugguacagagguaguaacuuguaacucca

SEQ ID NO: 220836 - RNA, 64 nt, Human
guucaucuucggaauuuauuuaaagaaagaucuacugguacaggguguaaaaauacuuacaaga

SEQ ID NO: 220837 - RNA, 64 nt, Human
cucccuucuucaguaagcaaggagccccgccccucaggcccagccucuggcaagagguggugga

SEQ ID NO: 220838 - RNA, 64 nt, Human
ugugccggguaguagaggaggauaagggcaaaaccaggcccaggccagugccuggcuuggucug

SEQ ID NO: 220839 - RNA, 64 nt, Human
aaggauauucccuuggcuaugguccugccaggugcaggcccaggcccaugaccccaccuuuacu

SEQ ID NO: 220840 - RNA, 64 nt, Human
auucccuuggcuaugguccugccaggugcaggcccaggcccaugaccccaccuuuacuaagcac

SEQ ID NO: 220841 - RNA, 64 nt, Human
ucugcucuccaucauaacugcuauuagccaaauucaggcccagucaucuccuaucugaauuauu

SEQ ID NO: 220842 - RNA, 64 nt, Human
gaagugagcaguguuggagugaggaccuguaaggcaggcccauucagagcuauggugcuugcug

SEQ ID NO: 220843 - RNA, 64 nt, Human
uugcuucauguuuguagaggaaccuugugccggccaggcccaguuuccuugugugauacacuaa

SEQ ID NO: 220844 - RNA, 64 nt, Human
auaccugagcucuaggcugccuggagggaaggaacaggcccaugggaagaaggggguuuuaaaa

SEQ ID NO: 220845 - RNA, 64 nt, Human
uucagggguguggagggagcagacuccaccggcccaggcccagcuaagagggggccgaccccuu

SEQ ID NO: 220846 - RNA, 64 nt, Human
cucuccccaaccuccuuacaagacuuuguggccccaggcccaauggcagagcuagugccucggg

SEQ ID NO: 220847 - RNA, 64 nt, Human
gcaagucccuucagacuggcccuuaagccaaacucaggcccagaauugcaguucagaauggcag

SEQ ID NO: 220848 - RNA, 64 nt, Human
ucgcagucgcaggauccgcugccaccacgucugccaggcccaucucaggugccacucccugagc

SEQ ID NO: 220849 - RNA, 52 nt, Human
ccgccggcccccugagguagugcaggcccacgggcaccccagacacuggaac

SEQ ID NO: 220850 - RNA, 64 nt, Human
gcagaugguguggguaccucacccagauaucauccaggcccaaggccccucucccugagugagg

SEQ ID NO: 220851 - RNA, 64 nt, Human
gagggaaucagagacuacaagcuggacagucacccaggcccaaccuuccccaaugcacgagucc

SEQ ID NO: 220852 - RNA, 64 nt, Human
ggaugucccauacaugaaaaauaugcacuucuuacugguacaguuuucuuuuguuuguuuuugu

SEQ ID NO: 220853 - RNA, 64 nt, Human
uugccacucauauuguaagucaguuuuuucauugcugguacaaugacucaguauuucuuuauaa

SEQ ID NO: 220854 - RNA, 64 nt, Human
uacauccauuccuuccucaacaggaggaaaauuccugguacaguuuaacguaaggcuucacuga

SEQ ID NO: 220855 - RNA, 64 nt, Human
cuccagaguagcugggacuacaaacgugugucaccaggcccagcuaauuuuuguauuuuuaaua

SEQ ID NO: 220856 - RNA, 64 nt, Human
cucccaaaguguugagaugacaggcacgagccaccaggcccagccugagugguauuuucuuuag

SEQ ID NO: 220857 - RNA, 64 nt, Human
agguuguucuaguuuuuagugagaccucugcagacaggcccaucacuguccauguuccagggca

SEQ ID NO: 220858 - RNA, 64 nt, Human
uccuccagagaccacaggagccaaagcgagccuccaggcccagcaaugagggacuugggagaaa

SEQ ID NO: 220859 - RNA, 64 nt, Human
acaggaccugcagguggcuggacugagugucccccaggcccagccaggacuuugccuaccccag

SEQ ID NO: 220860 - RNA, 64 nt, Human
gagaggguggggaggggcccagcggccuuggugacaggcccagggugggaggggucggggcccc

SEQ ID NO: 220861 - RNA, 64 nt, Human
cccugagagcugaaugagggcaucauaggccagacaggcccaaggauggaugaauggagaggac

SEQ ID NO: 220862 - RNA, 64 nt, Human
uuuuuuucuuuuucuuuuuuccuguuuucuaaugcaggcccaaugugacaaauuuguugguugg

SEQ ID NO: 220863 - RNA, 64 nt, Human
gagaaggauuccauuuuucuucucagcugguccccaggcccacgggcacagggagagggacaac

SEQ ID NO: 220864 - RNA, 64 nt, Human
cugcagggccugccuagggacacuguccagccuccaggcccaugcagaaagaguucagugcuac

SEQ ID NO: 220865 - RNA, 64 nt, Human
uggacacacauacccaugggugauuuuugcuccucaggcccaauauucucagacagcccagcag

SEQ ID NO: 220866 - RNA, 64 nt, Human
ggagucuguuccagaucagugccagaacugugcccaggcccaaaggagacaacuaacuaaagua

SEQ ID NO: 220867 - RNA, 54 nt, Human
gauccaucaaggggccuugagcaucaggcccagacagagccuggcaggcauccu

SEQ ID NO: 220868 - RNA, 64 nt, Human
gcugaauuuucucuuuaggcggaaaugcucuccccaggcccauugcguucgucaaguucuugga

SEQ ID NO: 220869 - RNA, 64 nt, Human
cgcacccccuggaucuggcugagggcucaggacacaggcccagccacccccaggggccuccaca

SEQ ID NO: 220870 - RNA, 64 nt, Human; identical to SEQ ID NO: 217718

SEQ ID NO: 220871 - RNA, 64 nt, Human; identical to SEQ ID NO: 214878

SEQ ID NO: 220872 - RNA, 64 nt, Human; identical to SEQ ID NO: 218206

SEQ ID NO: 220873 - RNA, 64 nt, Human
cuuacucaggaaacugcugugcccaacccauggacaggcccagcuggggcccacaugcugacac

SEQ ID NO: 220874 - RNA, 64 nt, Human
ccucuuggaggacagggcagccugcagcuguguccaggcccaggccccaccccauaacaggugg

SEQ ID NO: 220875 - RNA, 64 nt, Human
cguccugccccuuccuccuucaugccugggccugcaggcccaccccagccaccacugaguccac

SEQ ID NO: 220876 - RNA, 64 nt, Human
aaggaaguaaaaccaaagacaggcagcccagcgccaggcccaaaaccaggccugggccugccug

SEQ ID NO: 220877 - RNA, 64 nt, Human
cccacaccccagcucacacagcaaaaacaauggacaggcccagaggcugaagcaaacagugucc

SEQ ID NO: 220878 - RNA, 64 nt, Human
gcuuuaguuuaucucucugccugaagacaggaaacaggcccaagugcauacucggguucuuucc

SEQ ID NO: 220879 - RNA, 64 nt, Human
aauccaagagaaguuugugaggauccuacaaacccaggcccacucacuuugcucuaauucuuuc

SEQ ID NO: 220880 - RNA, 64 nt, Human
agggcuaucagaaggucuccuuuuuagcccagcacaggcccaggccacuuugucguguuuguuu

SEQ ID NO: 220881 - RNA, 64 nt, Human
agacccaaagcuuaugaaagaagaacaaaugucacaggcccagcucuucaccagaagcuuugau

SEQ ID NO: 220882 - RNA, 64 nt, Human
gugagugcuugucauggaaaauguccuguggugacaggcccaguggaacagucacccuucuggg

SEQ ID NO: 220883 - RNA, 64 nt, Human
ccuacucaugugauuucucccuuguccaaagucccaggcccagugcaguccuugcggccccugg

SEQ ID NO: 220884 - RNA, 64 nt, Human
cuggguugacugcauuucuagacucucgccggcccaggcccaucuuccaaagcaagaggaagga

SEQ ID NO: 220885 - RNA, 64 nt, Human
ccaucucugccugucaauaucguaccugucccuccaggcccaucucaaaucacaaggauuucuc

SEQ ID NO: 220886 - RNA, 64 nt, Human
accuagcaucuuacaaaaacaagacacccaaguccaggcccaaggaguaaguacaaauauuccu

SEQ ID NO: 220887 - RNA, 64 nt, Human
cugguaccaaaaggaguacccagggccugguacccaggcccacuccagaauggccucuggacuc

SEQ ID NO: 220888 - RNA, 64 nt, Human
ugaaaacaccugagcugguggcuguguacuuugacugguacauggaggcuauuuuaauccuucu

SEQ ID NO: 220889 - RNA, 64 nt, Human
acucuagugacuuccuggugaggcccagccuguccugguacagcagggucuugcuguaacucag

SEQ ID NO: 220890 - RNA, 64 nt, Human
ugcccucccuccuuccuucuugcuucuaauagaccugguacaugguacacacacccccaccucc

SEQ ID NO: 220891 - RNA, 64 nt, Human
ccaugggcucagggccagguccucacagcagucacaggcccaggaaggcggcaggcagagaagu

SEQ ID NO: 220892 - RNA, 64 nt, Human
gguuacuuuuccgcaguuggcauggguugcccuacaggcccacagggccaccagcacacccccg

SEQ ID NO: 220893 - RNA, 64 nt, Human
cucuccccuacuccaccuccuuccaaguccagcucaggcccaggaggugggagaaggucacaga

SEQ ID NO: 220894 - RNA, 64 nt, Human
uagaggagagagcagagcccagaaaugucuuuugcaggcccacguucugacuugaagcuuucgu

SEQ ID NO: 220895 - RNA, 64 nt, Human
uggcuugcagcaccauucggaguaaggaugacagcaggcccagaaggugucuuacucagaaaaa

SEQ ID NO: 220896 - RNA, 64 nt, Human
aacucaaaagcccacgucaggaccacagaccccccaggcccagcagaagagccuccuucagcag

SEQ ID NO: 220897 - RNA, 64 nt, Human
ucuccugcgccccgcccacacccucggggggucacaggcccagaaggguagcugggcggggcuc

SEQ ID NO: 220898 - RNA, 64 nt, Human
cuuuguguccauuccccaaauuaaccucuccgcccaggcccagaggaggggcugccugggcuag

SEQ ID NO: 220899 - RNA, 64 nt, Human
agcuccagccccacucauccucucggauguucugcaggcccagcaaacucaucauguccaaagu

SEQ ID NO: 220900 - RNA, 64 nt, Human
gaggcgacuuccucuccagccuucucucucuggucaggcccacugcagagaugguggugagcac

SEQ ID NO: 220901 - RNA, 64 nt, Human
aggccaccccccucuucaggcugcugcaggaggccaggcccaggccagagaccccaggcagccu

SEQ ID NO: 220902 - RNA, 64 nt, Human
cucacugcuggagcggggaaaccgcagcucagcccaggcccagcuggggagaaggcgcuaccug

SEQ ID NO: 220903 - RNA, 64 nt, Human
gaaauaauauauguaaagcacuuuaacacagcaccaggcccacggaaaguggcuaauguuagcu

SEQ ID NO: 220904 - RNA, 64 nt, Human
ucacccacccuccuucccaccagccugcucuccgcaggcccacuguccuuggguuuaaugacgu

SEQ ID NO: 220905 - RNA, 64 nt, Human
ugcacaucuagugaggugaaaauuuggucuaugccaggcccauuuccugcuuuuguguaaggaa

SEQ ID NO: 220906 - RNA, 64 nt, Human
cccacaaggaauuuuccuaucacugugaacuuugcugguacagaggaauaauaucugccuucac

SEQ ID NO: 220907 - RNA, 60 nt, Human
gcaccccuuccugcugcugaccagcugcuccugguacacggggguacacaccuguauccc

SEQ ID NO: 220908 - RNA, 62 nt, Human
cauccugaaaauucgugcgugggcuucuuucucccugguacaaacguauggaaugcuucuua

SEQ ID NO: 220909 - RNA, 64 nt, Human
gagugcugggcugguccuacuuccugccccucuccaggcccagcuccccucuuggcagggggag

SEQ ID NO: 220910 - RNA, 64 nt, Human
uucacugcuguuauauuucaucaugauaauucagcaggcccaaguaaagguuaaaaauaagguc

SEQ ID NO: 220911 - RNA, 64 nt, Human
ggguaggggcagcuucuggagccuugggacagagcaggcccacaaugccccccuucuuccagcc

SEQ ID NO: 220912 - RNA, 64 nt, Human
aaacguuaugccagaugauaaaaggggacgauugcaggcccauggacuguguuacaguuugucu

SEQ ID NO: 220913 - RNA, 64 nt, Human
ugacugcgucucggcucuggccaugagcucugcccaggcccacaagccccuccccugggcucuc

SEQ ID NO: 220914 - RNA, 64 nt, Human
cagggaaagugggagguggugcuggugcucucuccaggcccaccaugcugggagaggcggccag

SEQ ID NO: 220915 - RNA, 64 nt, Human
ucccucggcaagauggcagaggguacggagucuucaggcccaguuucucacuuuagccaauucg

SEQ ID NO: 220916 - RNA, 64 nt, Human
uucccagagcucccucugccccagccagcgccuccaggcccagcugaggagcugugagaagcag

SEQ ID NO: 220917 - RNA, 64 nt, Human
ucuugccccaccuggcugaggcgccacccuucuucaggcccaggcuccagaggaagacuccuga

SEQ ID NO: 220918 - RNA, 64 nt, Human
cucccaacagccuggguucgguccuuggcuggcccaggcccaguuaagccuguggccaccaagc

SEQ ID NO: 220919 - RNA, 64 nt, Human
aguaucuguagccaagcaugggaaucuuugcucccaggcccagcaccgagcagaacagaccaga

SEQ ID NO: 220920 - RNA, 64 nt, Human
uaccauauagaacuuacugucagucaacuauaaacaggcccaauuaaaaacuguuccauuacua

SEQ ID NO: 220921 - RNA, 64 nt, Human
ggcgugggguuagguugcuguuucaaauaacucacaggcccaggugacauggaaucuuggagca

SEQ ID NO: 220922 - RNA, 64 nt, Human
cauuucugaagaggggcuuuauaagcaggcugggcaggcccagcuuauaaguuaaagggcauca

SEQ ID NO: 220923 - RNA, 64 nt, Human
cucccaaagugcugggauuacaggugugagccaccaggcccagccuauaucuaggagucucuug

SEQ ID NO: 220924 - RNA, 64 nt, Human
ugcccucccuccuuccuucuugcuucuaauagcccugguacaugguacacacccccccaccucc

SEQ ID NO: 220925 - RNA, 64 nt, Human
aaugcgaagccguuaugguucagguuuuuaaaaacugguacaguauuguauuugucucaucugu

SEQ ID NO: 220926 - RNA, 64 nt, Human
cauggcaaaucugaguggcuucucuaagcaucugcugguacaagucaauguggcaccaugagcu

SEQ ID NO: 220927 - RNA, 64 nt, Human
gcgugcaacagccacgggaagccuuucugccgcccaggcccacaggucucgagacgcacaugca

SEQ ID NO: 220928 - RNA, 64 nt, Human
aggugcucauggggugcggugcuugggagacagccaggcccaggguggcugcugcuuccugcua

SEQ ID NO: 220929 - RNA, 64 nt, Human
cgggucugaaccugagcccucccgugacagccggcaggcccagcccauccccucccucauccuc

SEQ ID NO: 220930 - RNA, 64 nt, Human
cucagggguggaggagccuaggaaugccucucuccaggcccaagucgugcucuccuuccaggcc

SEQ ID NO: 220931 - RNA, 64 nt, Human
uacagcugcacacaagcaguugagaguugaugaccaggcccauagggcucccacagcugguucc

SEQ ID NO: 220932 - RNA, 64 nt, Human
ugucagcaucaggaaggccuuugcuucuugcacccaggcccagcugagacaggccccugagucc

SEQ ID NO: 220933 - RNA, 64 nt, Human
cagcucccugaggaccaccuccuacacuauugaccaggcccagaaggaaccagccaugaggugc

SEQ ID NO: 220934 - RNA, 64 nt, Human
uaucccuuuggccuguuuuagauuuuggcaaagccaggcccauagugcuugcugggcucucucu

SEQ ID NO: 220935 - RNA, 64 nt, Human
agggacuugccuuccccacccacucugcugccagcaggcccagggaucccugaccugcaccagg

SEQ ID NO: 220936 - RNA, 64 nt, Human
auaaacgaagcacuuuauucuguacagauuugggcaggcccaaggugcccgagugaucugagga

SEQ ID NO: 220937 - RNA, 64 nt, Human
cuucuucaguguguuggaaaucacuggcuucacacaggcccaacuccagcuggucagggcagag

SEQ ID NO: 220938 - RNA, 64 nt, Human
cuguuuucugguccacaugaacacaggcuccauccaggcccagcuccuacccaccgccucucug

SEQ ID NO: 220939 - RNA, 64 nt, Human
ggucagagacggcagaaaacagagccugccuaaccaggcccagccaguugguggggccaggcca

SEQ ID NO: 220940 - RNA, 64 nt, Human
uuugacucagaggcugggagcauagcagaggggccaggcccaggcagagcugacgggaggcccc

SEQ ID NO: 220941 - RNA, 64 nt, Human
ccuggcuucccugauggucucucccuccuggccucaggcccauuccugaggaagggccuuggcg

SEQ ID NO: 220942 - RNA, 64 nt, Human
agccagaacccagggauuggagucuuaggcaucucugguacaguggggugcacgucucaggugg

SEQ ID NO: 220943 - RNA, 64 nt, Human; identical to SEQ ID NO: 218017

SEQ ID NO: 220944 - RNA, 64 nt, Human; identical to SEQ ID NO: 217586

SEQ ID NO: 220945 - RNA, 64 nt, Human
ccagggcagccaguggcucuagcucagggaaagccaggcccaccugcccuauccccucccuugc

SEQ ID NO: 220946 - RNA, 64 nt, Human
cuguggagucugcuucucccauguaccagggcaccaggcccacccaacugaaggcauggcggcg

SEQ ID NO: 220947 - RNA, 64 nt, Human
cacccuacagaaacucagagggcagaguggcagccaggcccacaugucucucaaguaccugucc

SEQ ID NO: 220948 - RNA, 64 nt, Human
uaacuguggccagacucagccccauguccuuggccaggcccaaggagaggacucggccccaugg

SEQ ID NO: 220949 - RNA, 64 nt, Human
auuugcugcaagucucuuggauuauauaggcucgcaggcccaauacuugcacacauucauggcc

SEQ ID NO: 220950 - RNA, 64 nt, Human
accaccguugccacugagcccacaucccaagagacaggcccagagccuaaaggcaaggacagug

SEQ ID NO: 220951 - RNA, 64 nt, Human
ccaucucuucucauuccagauuuccagcgugaagcaggcccaagcuagggaaggugagaagcuu

SEQ ID NO: 220952 - RNA, 64 nt, Human
cgauggcugugucagcccagccccuucccuucuccaggcccagagaacucuuccacaaacaaga

SEQ ID NO: 220953 - RNA, 64 nt, Human
cccuucugaugagaaauagggaauacucccaguccaggcccagcaaaaccaaaaugcuaagcaa

SEQ ID NO: 220954 - RNA, 64 nt, Human
accauggcaccuuugagagagggggcacuguggucaggcccagccucucuggcucagcccggga

SEQ ID NO: 220955 - RNA, 64 nt, Human
uuggcccugcgcccugugcagggaaagggauggucaggcccaguucucgugcccuuagagggga

SEQ ID NO: 220956 - RNA, 64 nt, Human
ucuucccccuucccaaaggccacagccuuuauuccaggcccagggauguaggagggggaaggag

SEQ ID NO: 220957 - RNA, 64 nt, Human
uuuaaaauuaucaucgaagguggugaaacuauuucaggcccaaaugaaaggaaaucgccaguug

SEQ ID NO: 220958 - RNA, 64 nt, Human
cucccugccccaugccagagagcccugucccugccaggcccagccuucuuagccccaacuuggg

SEQ ID NO: 220959 - RNA, 64 nt, Human
aaguagauccaggccuguggcagccaaggccaagcaggcccaucucacaacccugaagcacaua

SEQ ID NO: 220960 - RNA, 64 nt, Human
auuguauguugucagaugaggaaauugugcaguucugguacauaaagaugaguaauauaaacug

SEQ ID NO: 220961 - RNA, 64 nt, Human
auauuuacaucuuugaaauaaucaguaaaauggucugguacaggaguuaaauaacaaugacaca

SEQ ID NO: 220962 - RNA, 64 nt, Human
ucucuuugugcuuuguaaagcaaacucaagaaaacugguacaccuguaccagcuggguccuuua

SEQ ID NO: 220963 - RNA, 64 nt, Human
gcaggaucugcagugacggcagccucggccugggcaggcccaaggccacggucuaggacacacc

SEQ ID NO: 220964 - RNA, 64 nt, Human
gggccuguggaggacaggccagagaggaggccagcaggcccagaguccccaggggaggaggacc

SEQ ID NO: 220965 - RNA, 64 nt, Human
gugggugcucugaaaacccacaggaucccaccuccaggcccaccugggucccaucucacucucu

SEQ ID NO: 220966 - RNA, 64 nt, Human
cauggucagaaggggcugagcuggucuuucacugcaggcccacucugaaagagaaaucccauga

SEQ ID NO: 220967 - RNA, 64 nt, Human
aauccccuucuuagagcagaggcacaaguuagagcaggcccagcauuugggccaacuuacugug

SEQ ID NO: 220968 - RNA, 64 nt, Human
ccagaugcccaagucuuccaggcaauaccuggcucaggcccagccccaauccauccccuuacuu

SEQ ID NO: 220969 - RNA, 64 nt, Human
cccaggccaggucccuggaccagccuccuguuugcaggcccagaggagccaagucauuaaaaug

SEQ ID NO: 220970 - RNA, 64 nt, Human
aggcaccacccccucugauaaauccaagcccgcccaggcccacggggggcccacgggacccccc

SEQ ID NO: 220971 - RNA, 64 nt, Human
agaaucuucuggagaauauggucagagucuuaaacaggcccagugcugaguucuuuguccacuu

SEQ ID NO: 220972 - RNA, 64 nt, Human
aauguaaugugccaggcgcaaugggauaugccugcaggcccagcuacacgggaggccaaggcag

SEQ ID NO: 220973 - RNA, 64 nt, Human
auacugaacauuccuguccuagcgucccugccaccaggcccaaugcaucugauccuugaauaua

SEQ ID NO: 220974 - RNA, 64 nt, Human
uccaguucuccuucaguugacgccagccucuccacaggcccacugcugugccauucuggaagcu

SEQ ID NO: 220975 - RNA, 64 nt, Human
ccacgacugagcucugaggccagugccugucccccaggcccacuuguauucuuucuacuguaaa

SEQ ID NO: 220976 - RNA, 64 nt, Human
uagcauuucuuuuuuauuuuucaaucuauauucacaggcccauacuucagucaguccaaucaua

SEQ ID NO: 220977 - RNA, 64 nt, Human
acauaucuuuugggggacacaauucuacccacuacaggcccauaucuuaucuaggauguuggug

SEQ ID NO: 220978 - RNA, 64 nt, Human
ugcagaugaucugggcuuguuucuggcagagauucugguacagagaaaggagaggcgcugagug

SEQ ID NO: 220979 - RNA, 64 nt, Human; identical to SEQ ID NO: 217958

SEQ ID NO: 220980 - RNA, 64 nt, Human; identical to SEQ ID NO: 214917

SEQ ID NO: 220981 - RNA, 59 nt, Human
ccagcagcucugccuacugacgcaggccucaggcccagggcgcgccgucggggcaaggu

SEQ ID NO: 220982 - RNA, 64 nt, Human
aaggugacugcaggaaaccaauucuuacaagauccaggcccagccuuuuugaccugcuugagag

SEQ ID NO: 220983 - RNA, 64 nt, Human
auaagccaggcuugcaacuaaguaucuaacuuuacaggcccacucacauuugaggcaaggggcu

SEQ ID NO: 220984 - RNA, 64 nt, Human
guuacagcugaacuccuccaucuuccaaaucaaucaggcccauccaucccaugccucccuccuc

SEQ ID NO: 220985 - RNA, 64 nt, Human
aguccugcucaggcuacaccuccaagggugggaccaggcccaccuuaucuuccuguacuccaga

SEQ ID NO: 220986 - RNA, 64 nt, Human
auguacagacacgguccccacacccucccagccucaggcccaggcagacaugggcgagcuggug

SEQ ID NO: 220987 - RNA, 64 nt, Human
agugagaggcguauaaaauggggcugugugcaugcaggcccauguuucagccucagcccacgcc

SEQ ID NO: 220988 - RNA, 64 nt, Human
agggcccaggagggacagugccuggagccugggccaggcccagcccaucuguguguguguaugu

SEQ ID NO: 220989 - RNA, 64 nt, Human
cagacagauccccuaggccuaucugagacccauacaggcccacaccugagcuccugucugccug

SEQ ID NO: 220990 - RNA, 64 nt, Human
accaaaacuuggcagcugugccagaaaccaaagccaggcccagauguagggggagggcacgaga

SEQ ID NO: 220991 - RNA, 64 nt, Human
cagacgggugccccagagggggcuggggggcggccaggcccaggccucccuccugccccuccuc

SEQ ID NO: 220992 - RNA, 51 nt, Human
ggguccauccaccccggugagcaggcccaaggcagcgggggcccacacccc

SEQ ID NO: 220993 - RNA, 64 nt, Human
gaaaguaauaagguaaaagcuagucucuaacuuccaggcccacggcucaagugaauuugaauac

SEQ ID NO: 220994 - RNA, 64 nt, Human
cauccucugccuuccuugagcuucugggugaugccaggcccaagucuuuguggcacccagcucc

SEQ ID NO: 220995 - RNA, 64 nt, Human
ucgcuaguguuaugucaaaguuaagcccgcacgccaggcccaguuaaugcuagucuuucaugug

SEQ ID NO: 220996 - RNA, 64 nt, Human
gcagggggccgccugugcuuucuuaugcugggcucccuggcagcagguaguggcagccucuaug

SEQ ID NO: 220997 - RNA, 64 nt, Human
aagaauccaugugacuuuagaauggaacugccggcccuggcaacugucacgugugcuagaaggu

SEQ ID NO: 220998 - RNA, 64 nt, Human
guagcucggcugccggaagagaggggugcccuaucccuggcaaccccuccacguagcguacccc

SEQ ID NO: 220999 - RNA, 64 nt, Human
gcccaccacccccucaagccccagcagcccucaacaggcccagggagggaagugugagcgccuu

SEQ ID NO: 221000 - RNA, 64 nt, Human
ccaucucagaacaccccagccuugagcuuagcugcaggcccaggcccucugcucugcucccggg

SEQ ID NO: 221001 - RNA, 64 nt, Human
cuguagcuuuccuggucccucacccccauggccccaggcccacagcgugggaacucacuuuccc

SEQ ID NO: 221002 - RNA, 64 nt, Human
uucugacccccaaagguggggaggggcaugggcccaggcccaucagccucccugcugggacagg

SEQ ID NO: 221003 - RNA, 64 nt, Human
guggcagguuacagaguucugggauuucuucucacaggcccaauccugaaugugccccuggacc

SEQ ID NO: 221004 - RNA, 64 nt, Human
gugcucuuaaaagccagcagcugagaacauagcacaggcccacguggugagggcacccacagcu

SEQ ID NO: 221005 - RNA, 64 nt, Human
cgcagccauagcaagugccugugucccuguccuucaggcccaucaguccuggggcuuuuucuuu

SEQ ID NO: 221006 - RNA, 64 nt, Human
ugcccaggcccaggggcaggcucuuggccugccccaggcccagagggcuucccaguaaggccca

SEQ ID NO: 221007 - RNA, 64 nt, Human
acuggccucuguccuuggcagagaccuugcugcccaggcccaggggcaggcucuuggccugccc

SEQ ID NO: 221008 - RNA, 64 nt, Human
ugucugcuggguucuuuucucaaguccugcugcccaggcccaggugagacaggcaacgccaggu

SEQ ID NO: 221009 - RNA, 64 nt, Human
cugccuuaacuccuccucccacugccccugaucccaggcccaggcuuuuacaaccuggugcuca

SEQ ID NO: 221010 - RNA, 64 nt, Human
cuggagccgggucggggucugccuguuucccagccaggcccagccacccaggacuccugggaca

SEQ ID NO: 221011 - RNA, 64 nt, Human
ucacccagggcgggccucugcccucuacucgugccaggcccacuugccaggcaggagcccuccc

SEQ ID NO: 221012 - RNA, 64 nt, Human
uuugaccccuuccugucuggcccaaaggaaguagcaggcccagcuggggccccucggcuacccc

SEQ ID NO: 221013 - RNA, 54 nt, Human
ucuuccuccuuuuccagugacccacaggcccagcucacaccuguacagauccgu

SEQ ID NO: 221014 - RNA, 64 nt, Human
guggccaucuggagcuggugcuauaggugaccaucugguacauugaggggaccuguuugccucc

SEQ ID NO: 221015 - RNA, 64 nt, Human
acaccggcgcuggcucccugcccggcccggcccucccuggcaaucccugggcucucuugcaccc

SEQ ID NO: 221016 - RNA, 64 nt, Human
uucuagcaauacuagaucccacugagaaaauccacccuggcaucugggcuccugaucagcugau

SEQ ID NO: 221017 - RNA, 64 nt, Human
ucugcagacuucccagcuaggaagagcaggacuccaggcccaaggcucccggaauuccgucacc

SEQ ID NO: 221018 - RNA, 64 nt, Human
auacaggaacacacagggcuguguagcaugauaccaggcccaggagaucaguaauuacaaauua

SEQ ID NO: 221019 - RNA, 64 nt, Human
ggaucauauuuaaugaauuauaguauaaugcuugcaggcccaguacaagcauauauauugugcc

SEQ ID NO: 221020 - RNA, 64 nt, Human
gccccagcugccucagagcaggcacagcacaaggcaggcccagccccaugggccgucacaaagg

SEQ ID NO: 221021 - RNA, 64 nt, Human
cucagaagccugccucugauuuacccuacagcuucaggcccagcugccccccagucuuugggug

SEQ ID NO: 221022 - RNA, 64 nt, Human
gaauaauagaagaacauccaaggagaaacagagacaggcccaagagaugaagagugagagggca

SEQ ID NO: 221023 - RNA, 64 nt, Human
cacaggaaaggcaggaacaggaccuucucucucccaggcccaacgcaggggcccucacuggcug

SEQ ID NO: 221024 - RNA, 64 nt, Human
cuuugcuccgcucccaccgcccccaccccuuccccaggcccaccaucaccaccgccucuggccg

SEQ ID NO: 221025 - RNA, 64 nt, Human
cccucagcccgggcugugccagcccucccagccccaggcccaucugagggaccaagacgcuguu

SEQ ID NO: 221026 - RNA, 64 nt, Human
cugcuaugccagguggugucucugccaggcuccucaggcccagacagaggccagcccacaaccu

SEQ ID NO: 221027 - RNA, 64 nt, Human
gacugucugugugcccuguggggguccgugugagcaggcccaccuggcuccagacccgccccca

SEQ ID NO: 221028 - RNA, 64 nt, Human
uggagacauccacacccauucccagguguccuuccaggcccauuguccacgucuucaagggggc

SEQ ID NO: 221029 - RNA, 64 nt, Human
cugcagauuccagcagggucccucugaguggggccaggcccaggacugucacacaaggcuugag

SEQ ID NO: 221030 - RNA, 64 nt, Human
gcuguccacuguguggugcuaggacugccaaugccaggcccaagggacaaaaagaacagagcuu

SEQ ID NO: 221031 - RNA, 57 nt, Human
acuuuccaagacaauccugagcauaaacaggcccacaaaacaugugcugacugcacu

SEQ ID NO: 221032 - RNA, 64 nt, Human
ccgagcugcccucaguguuccccaaggccgcgugcugguacacugugccauggggguaagccgc

SEQ ID NO: 221033 - RNA, 64 nt, Human
gcacauucguccacuaagggaacagccucagaaacugguacagcaaugggugagaugagaucau

SEQ ID NO: 221034 - RNA, 64 nt, Human
cauguguucauacuaucauuguagcugugaaguucugguacaguuguaaaaagagaaauugagu

SEQ ID NO: 221035 - RNA, 64 nt, Human
cccagagaagcccgcgcaucuuggacccaccaagcaggcccagccuuccugcugccaccaucuc

SEQ ID NO: 221036 - RNA, 64 nt, Human
accagaagccaacagcaaaacuggaaaagcccggcaggcccaggagagggcgcugaccuguggu

SEQ ID NO: 221037 - RNA, 64 nt, Human
auaugacuccuccuuggcaacugcccuuuccugccaggcccacacauacccucuucuggcuguu

SEQ ID NO: 221038 - RNA, 64 nt, Human
cucuggaaagaggguuuaagaugcuaggaugaggcaggcccaguccuccuccagaaaauaagac

SEQ ID NO: 221039 - RNA, 64 nt, Human
ggaccgucucugucugauccuguccauucggaaccaggcccaccuggaaucccacaacaucagc

SEQ ID NO: 221040 - RNA, 64 nt, Human
acaagugacuguaggggggaccgucuagaaacaccaggcccagacacacggucccucaggucag

SEQ ID NO: 221041 - RNA, 64 nt, Human
guuuucaugaauagaaaacaagagcagcagcugucaggcccagcugacaagcguggggcuggug

SEQ ID NO: 221042 - RNA, 64 nt, Human
ccuucgggacccuggggcaggggugcuuccuccucaggcccagcugcuccccuggaggacagag

SEQ ID NO: 221043 - RNA, 64 nt, Human
uccaggauugaggauucaucuaccugccaggccucaggcccaggacccaggaggccuccccacc

SEQ ID NO: 221044 - RNA, 64 nt, Human
ggccugggguccucauccuccuuguuggucuacucaggcccagcccagagcuguguucccuguc

SEQ ID NO: 221045 - RNA, 64 nt, Human
gaccuggagcagagagcaugggccuuggguaaagcaggcccaggucaaggucuuacuccagccc

SEQ ID NO: 221046 - RNA, 64 nt, Human
accugaauuagacagagacucacucaggaagugacaggcccaucauaucaaauaacuuauucac

SEQ ID NO: 221047 - RNA, 64 nt, Human
uuuagaggaauggcccgugcaucccugcuagucucaggcccaucccagagcacugagaggccac

SEQ ID NO: 221048 - RNA, 64 nt, Human
ccaggauggcagcaauggcgcugugcggccucaccaggcccacgaggagcagcagcgcucggcc

SEQ ID NO: 221049 - RNA, 64 nt, Human
cacucucacccugcacagggggucuugcagcccccaggcccacagccucguugggaggacaggg

SEQ ID NO: 221050 - RNA, 64 nt, Human
acugacugacauucauugugaugagggcagcuuucugguacaggauucuaagcucuauguuuua

SEQ ID NO: 221051 - RNA, 64 nt, Human
ccuuccuuuggauuaggaaagaugaguuuuaccucugguacacugucuugguaagccuggaugu

SEQ ID NO: 221052 - RNA, 64 nt, Human
gagcagaaacauggaaugccagacgcuggggaugcugguacaaguugugggacugcaugcuacu

SEQ ID NO: 221053 - RNA, 64 nt, Human
gugggucugcuugucaaggccaguucugcagugacaggcccaggggcugcccaccaggugugcu

SEQ ID NO: 221054 - RNA, 64 nt, Human
aauacacacucaugaacuccugauggaacaauaacaggcccaagccugugguaugaugugcaca

SEQ ID NO: 221055 - RNA, 64 nt, Human
gcccaccacagaggccacaggcaggcccccacuucaggcccaaggccuggggcggggggaacag

SEQ ID NO: 221056 - RNA, 64 nt, Human
gcuugcugguagcacuugcuacccugaguucauccaggcccaacugugagcaaggagcacaagc

SEQ ID NO: 221057 - RNA, 64 nt, Human
uccuuuccuuccguccuucugaaaccacauaccccaggcccaagcgccuugcugccacgcccaa

SEQ ID NO: 221058 - RNA, 64 nt, Human
ccuggguguguuuggcuuggccuuggcaugggcgcaggcccagugacaaagacuccucugggcc

SEQ ID NO: 221059 - RNA, 64 nt, Human
ugggccuccaauaagugucccauaggugucuggccaggcccaccugcugcggauguggucucug

SEQ ID NO: 221060 - RNA, 64 nt, Human
augcugccuggacauuuacuggggaggugaguagcaggcccagcuccaggaucugaauuggaau

SEQ ID NO: 221061 - RNA, 64 nt, Human
uaccaaaugagggucuugguuccagccugccacucaggcccaaagccucgacacagaguggacu

SEQ ID NO: 221062 - RNA, 64 nt, Human
cucauuccacaacccuaugggggcugccacgucacaggcccaaaggacucuucuucagcagcau

SEQ ID NO: 221063 - RNA, 60 nt, Human
gagacgagaaagaggaaugaggggcagggccaggcccacgggggggcaccucaauaaacu

SEQ ID NO: 221064 - RNA, 64 nt, Human
cccacuuuuuaccaaacuaguaaaccugacauuccaggcccaugaggggaaagaggaucuucca

SEQ ID NO: 221065 - RNA, 64 nt, Human
aaaguggcccaaagcgucccaaaguaggccucgccaggcccaccuccugcccggcguaggcccu

SEQ ID NO: 221066 - RNA, 64 nt, Human
ccccucaccuugccucaccucgcagcagccuuuccaggcccagcucccgccucccggcggccuu

SEQ ID NO: 221067 - RNA, 64 nt, Human
uugaggcccagcuuuucccuugugguggccucuccaggcccagaacuuccucaagucggccucc

SEQ ID NO: 221068 - RNA, 64 nt, Human
ugaaauacuguaugugaagugccuggcacagugucugguacauuuguguuuaauaaaagcuaac

SEQ ID NO: 221069 - RNA, 64 nt, Human
cuacacugaccaggguuuguaaaacccuuucauucugguacaagagucggggguauaacuuuua

SEQ ID NO: 221070 - RNA, 64 nt, Human
gaaguucauuuaaaaaaauaacuacaguauagcgcugguacaguacacuaaaagacuuugauaa

SEQ ID NO: 221071 - RNA, 64 nt, Human
aagcuguagggccgcccggaguccugccggcccacaggcccaucccggcggggcaccggggacu

SEQ ID NO: 221072 - RNA, 64 nt, Human
cccugacuaguggccaaggugcuuuucuuccucccaggcccaguggguggaaucuguccccacc

SEQ ID NO: 221073 - RNA, 64 nt, Human
gagcacccgccagaggcugcagcagcagcugacccaggcccaagagacccugaagagccugggu

SEQ ID NO: 221074 - RNA, 64 nt, Human
gaggcaggacacaggcagcguguggcccauucagcaggcccaggucuucagggugaggcugcug

SEQ ID NO: 221075 - RNA, 64 nt, Human
gcuuuaggauucuaguagauggauacugaauacucaggcccacuuaaauuauuaauguauacau

SEQ ID NO: 221076 - RNA, 64 nt, Human
cuuaaucacaguuuaguuuuuuucuuaaccucgucaggcccagaguucacuucuuuguuucucu

SEQ ID NO: 221077 - RNA, 64 nt, Human
aagcggcucuaacccugggggcggccauguuguccaggcccaggccccuccaggacuguggcug

SEQ ID NO: 221078 - RNA, 64 nt, Human
aguccaagagggcagggccaguuccucccaucuucaggcccagccaggcagggggcagucggcu

SEQ ID NO: 221079 - RNA, 64 nt, Human
cacuucugaaggucccauccccugcugcccuccgcaggcccagggcugggcacucccugagacc

SEQ ID NO: 221080 - RNA, 64 nt, Human
ucuaaccauucaaaugacgccugauggugcugcucaggcccaugcuaugaguuuucuccuugau

SEQ ID NO: 221081 - RNA, 64 nt, Human
agggaaagcgacccagacagcagccccuccucgacaggcccacccugcagcucaggcaccaaga

SEQ ID NO: 221082 - RNA, 64 nt, Human
gcgggcagaugggcggacggcuguggaccguggacaggcccagcgcggccagcgucccagggua

SEQ ID NO: 221083 - RNA, 64 nt, Human
cucacgugccugaucugugcccuuggucccaggucaggcccacccccugcaccuccaccugccc

SEQ ID NO: 221084 - RNA, 64 nt, Human
gggggaggacacuccccacgugugcugggagccgcaggcccagggccgcaugugugcacucuac

SEQ ID NO: 221085 - RNA, 64 nt, Human
accugcggagccgcacucuuuagccccggagcuccaggcccagcggaugcuggcacccaagcgc

SEQ ID NO: 221086 - RNA, 64 nt, Human
ggacccuccuauuagaguacgaaauuccuggcaacugguacagaaccaaccuagaggcuuugca

SEQ ID NO: 221087 - RNA, 64 nt, Human
uggccaccucuggaggcucugccuuucccaagggcccuggcagaggguggggcacugcaccuua

SEQ ID NO: 221088 - RNA, 64 nt, Human
cucagggacagcguccaggcuucagccaagggcucccuggcaaggggcuguuggguagaagugg

SEQ ID NO: 221089 - RNA, 64 nt, Human
guuagucuccagacccucacagcagccacgcccccaggcccaccgugcauggugugggcgggac

SEQ ID NO: 221090 - RNA, 64 nt, Human
guaugacaggggaccaguagggugguuucccucucaggcccagcagcccauugacagcauuaga

SEQ ID NO: 221091 - RNA, 64 nt, Human
gaaaggaaggcaaaagaguaaaaauuaaaaaggccaggcccaguaaguguaccuuguacuuuau

SEQ ID NO: 221092 - RNA, 64 nt, Human
uucagcaguccuuaucaccagccucacaaucccacaggcccacccccagugggccuguggcauu

SEQ ID NO: 221093 - RNA, 64 nt, Human
cucauugucgcugccaaacaggaggcaccggccacaggcccauucaucugcucguagaaucucc

SEQ ID NO: 221094 - RNA, 64 nt, Human
agagugagaagccugacugaccccgccuagacgccaggcccacuucacgccgucuaaguggaga

SEQ ID NO: 221095 - RNA, 64 nt, Human
uguuuucuuuuacaaaauuaaaaacaucuaaaaccaggcccaaguggcagcuugagucccucca

SEQ ID NO: 221096 - RNA, 64 nt, Human
cugucucccccaacaccccgccugccuccuggcucaggcccagcuuauugugugcgcugccugg

SEQ ID NO: 221097 - RNA, 64 nt, Human
uagacgcacccgcagggaggguggggagagcuggcaggcccagggcuuguccugcugaccccag

SEQ ID NO: 221098 - RNA, 64 nt, Human
uuuggcacucagaaugggcccagugggggcugggcaggcccauugagggccaccgccgagguuu

SEQ ID NO: 221099 - RNA, 64 nt, Human
guccccaggcugggcccugcaggugcugggccuucaggcccagugugagccugcucugcaagaa

SEQ ID NO: 221100 - RNA, 64 nt, Human
guggaggcgcccagaccugggcaggcagcaggcucaggcccacaccuugugauuuuugaaacca

SEQ ID NO: 221101 - RNA, 64 nt, Human
acugcacaggccugugcccacauaccuuauagcacaggcccagguggaucaucucaugcuaaca

SEQ ID NO: 221102 - RNA, 64 nt, Human
acucaagaggacagaggcuggugaggagguaaagcaggcccagugaaauggaccugacagccca

SEQ ID NO: 221103 - RNA, 64 nt, Human
cuaugauauugaaugacaguuuuaaguggcaacucaggcccagcucaugcccuuuuuugccugg

SEQ ID NO: 221104 - RNA, 64 nt, Human
aguaccagcagcaauaaaauugcacuaguuuuaucugguacauacaaaaacagccauuuaaaau

SEQ ID NO: 221105 - RNA, 64 nt, Human
agguuuugauauguguuuacuagcuugccugugucugguacaucucaugaccucaauucccuca

SEQ ID NO: 221106 - RNA, 64 nt, Human
gaagacaucgcucuggcauccccaguucagugaacugguacaauguggucccucucaauauuua

SEQ ID NO: 221107 - RNA, 64 nt, Human
ucuacagcggaggccgccauguggagagagcaggcaggcccacugcugcugagaacagggcagg

SEQ ID NO: 221108 - RNA, 64 nt, Human
uguugaaacaccccauccccucacguucucaccccaggcccagaaguagguugcaacugccuuu

SEQ ID NO: 221109 - RNA, 62 nt, Human
aguggcugaaggaggaaugauggagacagugccaggcccaagaacuagaacuuuaaaacguu

SEQ ID NO: 221110 - RNA, 64 nt, Human
uuuuagagaaaagauaauuuauccucauucaacacaggcccagaaaauugugucccagaaggau

SEQ ID NO: 221111 - RNA, 64 nt, Human
ggaagaaggggaagaaaaggaccuguggguggcucaggcccaagcagaccccgggcuccacccc

SEQ ID NO: 221112 - RNA, 64 nt, Human
aaguugggggugguuuccuuccucuucaggcagccaggcccauggcuggaaggccgggcuggag

SEQ ID NO: 221113 - RNA, 64 nt, Human
cugcucagcagcccuggacccgcgugcguuacgucaggcccagaugcagggcggcuuuuccaag

SEQ ID NO: 221114 - RNA, 64 nt, Human
gggaccagcaccagcugggaggcauaggcuaggacaggcccacguggaggcugggcaggaaggg

SEQ ID NO: 221115 - RNA, 50 nt, Human
ugggcuuccugucacaguagcaggcccagcugcagaaggaccgugagugu

SEQ ID NO: 221116 - RNA, 64 nt, Human
aguagguauccuaguuuaguagugguuacauuaucaggcccaucccagauguuugugauguccu

SEQ ID NO: 221117 - RNA, 64 nt, Human
ccaauguccucucagcccauacaaguggcaggaccaggcccaauauuaaggaguggaaaagugu

SEQ ID NO: 221118 - RNA, 64 nt, Human
ccuggaauggaaguccccuggcauggucaguccucaggcccaagacucaagugugcacagaccc

SEQ ID NO: 221119 - RNA, 64 nt, Human
ugaaaacaugaccguggggccaggauguuucuggcaggcccagaagugcuggccguucuucccc

SEQ ID NO: 221120 - RNA, 64 nt, Human
uccuguggggcuggccgggcagagaccccggacccaggcccaggccuaaccugcuaaauguccc

SEQ ID NO: 221121 - RNA, 64 nt, Human
ccaacuuuuugaugucccuguagggcuggccagucaggcccagccaaagcccccuccucagucu

SEQ ID NO: 221122 - RNA, 64 nt, Human
gaaacaguacacucaaaacauccuugacuguccccugguacacauaugcaagagacuuuaugcg

SEQ ID NO: 221123 - RNA, 64 nt, Human
ccugcaaauaugcccaugcuggccuucuaaauagcugguacauccaucaccacugacgggccug

SEQ ID NO: 221124 - RNA, 64 nt, Human
uuaacaauaauaauguaaauuucagaaugugucucugguacagaauaguugauauuaacagaaa

SEQ ID NO: 221125 - RNA, 64 nt, Human
uccucagucuccacagacccacaugugagcagcccaggcccaucggugcuccucagagguaggu

SEQ ID NO: 221126 - RNA, 64 nt, Human
cgagugagccugcccauucugcccugugggaccccaggcccacucaggggucacugaggccuga

SEQ ID NO: 221127 - RNA, 64 nt, Human
gucugcugcuccuacaagggaagcuucuugcugccaggcccacacauccccaguuguugguuug

SEQ ID NO: 221128 - RNA, 64 nt, Human
cuggacaggcagucauccugccucugaugugaaucaggcccauuaaagacgucuggguuugaag

SEQ ID NO: 221129 - RNA, 64 nt, Human
uccucagucugugggccccgcaggugcagcagcccaggcccaggcucuagcugggcccagccua

SEQ ID NO: 221130 - RNA, 64 nt, Human
aaauggggaacacaucuucccuacaucaggaagacaggcccaaauucaggcauggggugaaaua

SEQ ID NO: 221131 - RNA, 64 nt, Human
gaggaugauagugaaacugaccagccacagcagacaggcccagauugagguggugccuucugcc

SEQ ID NO: 221132 - RNA, 64 nt, Human
augaaacaggaaugucaucagagauuuuuuaguacaggcccaagagccuguucucuaagaaaga

SEQ ID NO: 221133 - RNA, 64 nt, Human
aguagguauccuaauuuaguagugguuacuucaucaggcccaucccagguguuugucguguccu

SEQ ID NO: 221134 - RNA, 64 nt, Human
acucaggcccuccuugucuuuuuacugcaacccacaggcccacaguaugcuugaaaagauaaau

SEQ ID NO: 221135 - RNA, 64 nt, Human
gaagggacagaaacaggagugccuccugcugugccaggcccaugggcagugcaggcagaucccu

SEQ ID NO: 221136 - RNA, 64 nt, Human
gaacaugacgcugguagaggccauccagacggugcaggcccaccgcaauaucugcccuaacuca

SEQ ID NO: 221137 - RNA, 64 nt, Human
agacagagggccacggcugcgugcgauccaggcccaggcccacacacucugcccgugucacacg

SEQ ID NO: 221138 - RNA, 64 nt, Human
cuuuguagacagagggccacggcugcgugcgauccaggcccaggcccacacacucugcccgugu

SEQ ID NO: 221139 - RNA, 64 nt, Human
aaccauccuugccuucaguucucuccaauauuaccaggcccaacucagucuucagugauuuuaa

SEQ ID NO: 221140 - RNA, 64 nt, Human
caaaacugcaugauacugguacaaaagcauggugcugguacaaaagcagacacauagaucaaug

SEQ ID NO: 221141 - RNA, 64 nt, Human
aggccugcagauguuucuaugaggggcagagcuccugguacauccauguguggcucugcuccac

SEQ ID NO: 221142 - RNA, 64 nt, Human
acuacugcugccacaugggaacugugaagaggcacccuggcaagcagcagugauugggggaggg

SEQ ID NO: 221143 - RNA, 64 nt, Human
guucuguuagagaaauuaaaacagacuguuuccucaggcccauuuuaaacugaacuuaugcuag

SEQ ID NO: 221144 - RNA, 64 nt, Human
gaccggggaucgggaccugaccuggggcuggccucaggcccacgugcacgugacugcccucugu

SEQ ID NO: 221145 - RNA, 64 nt, Human
ugccggcuucagacacucccagcgcccacucuuacaggcccaggacuggagcuuucucuggcca

SEQ ID NO: 221146 - RNA, 64 nt, Human
ccauguauggccaggaaguagcacaggcugagugcaggcccacccugcuuggcccagggggcuu

SEQ ID NO: 221147 - RNA, 64 nt, Human
aggaugcaggcugcucuagagaccaaaggaacaccaggcccagcgcccucuuugguccagccag

SEQ ID NO: 221148 - RNA, 64 nt, Human
gcccugcccucguggcuucggagagcagaggggucaggcccaggggaacgagcuggccuugcca

SEQ ID NO: 221149 - RNA, 64 nt, Human
gaggagccagccagggaggggcagcugcagugaccaggcccagcagggaggacuugugcagccg

SEQ ID NO: 221150 - RNA, 64 nt, Human
ccgggcucagaccaacuccaaggucagcuggccacaggcccaggccuccucugaagcagggacc

SEQ ID NO: 221151 - RNA, 64 nt, Human
gccuuggucuccccccugggcacacgugcucacucaggcccagcaaugaccucugcucauuuuu

SEQ ID NO: 221152 - RNA, 64 nt, Human
auggguagugucuacacguccccgggcucaggcucaggcccagcccugggcugaccugagagga

SEQ ID NO: 221153 - RNA, 64 nt, Human
cuccuucccgcuuuuccccuucucccuccugcuccaggcccaaggcguguugguuuugccuucu

SEQ ID NO: 221154 - RNA, 64 nt, Human
ucagccagggagaacugggcggguuuaguggccccaggcccacuccucaugcagcagugugcug

SEQ ID NO: 221155 - RNA, 64 nt, Human
gagcuccgaagcggucaaagugagcugagcaggacaggcccagccuuucuccacugccacgucc

SEQ ID NO: 221156 - RNA, 64 nt, Human
agacccagguccuugugcucaguccugcgcaaaccaggcccagacccugcaagcauuuguugau

SEQ ID NO: 221157 - RNA, 64 nt, Human
gcccagacccugcaagcauuuguugaugcccuugcaggcccacugggagaaagaugccucaggc

SEQ ID NO: 221158 - RNA, 64 nt, Human
cugcuguauacuucuucuucugugucccuaaggccugguacagugccaagcacauacuugguau

SEQ ID NO: 221159 - RNA, 64 nt, Human
uucauaauuccaguuuuuacauuccguuaucuuucugguacaaccauucccauucagccuuaaa

SEQ ID NO: 221160 - RNA, 64 nt, Human
cuuuuuaaauaaccucauguuacuucaggcaaaucugguacaggagaagcccaagcuaacugag

SEQ ID NO: 221161 - RNA, 64 nt, Human
ucacuacagccucaccuccuacagccuuaagucccaggcccaugucugccuguccaagggcuca

SEQ ID NO: 221162 - RNA, 59 nt, Human
gcagcugcacacugcucugagcccuuccccaggcccaggcuguagaccaccaugacagc

SEQ ID NO: 221163 - RNA, 64 nt, Human
agggucauccugugcucggaggccaucucgggcacaggcccaccccgccccaccccuccagaac

SEQ ID NO: 221164 - RNA, 64 nt, Human
ccuucuagauccagaggcuaagaggaagacuggccaggcccaaggacccagccaucaaaaccag

SEQ ID NO: 221165 - RNA, 64 nt, Human
uuggaguccagccuaaucaagucaaauggagaaacaggcccagagaggaagguggcuuaccaag

SEQ ID NO: 221166 - RNA, 64 nt, Human
ggugccagugcuucugggcagugcaggcggcugccaggcccagcccugacuuccacucuggcuc

SEQ ID NO: 221167 - RNA, 64 nt, Human
ggcaagucugggcccugggguagggagggagacucaggcccacacuuggguauuuucuaauuuc

SEQ ID NO: 221168 - RNA, 64 nt, Human
guggcaccugguucuccgaugccugggcuggugucaggcccaggacuguagugcugggagcagu

SEQ ID NO: 221169 - RNA, 64 nt, Human
gguuccaugccugcucucgaggcagcaguggguucaggcccaucagcuaccccugcagcugggg

SEQ ID NO: 221170 - RNA, 64 nt, Human
accacuauuuguugcacugugccuugaagggcagcaggcccaagugcugcucugacugaaaacu

SEQ ID NO: 221171 - RNA, 64 nt, Human
aucaguccauuuuaccgaggaaggagccaagguccaggcccacugaaggacuugcauaacauua

SEQ ID NO: 221172 - RNA, 64 nt, Human
aaccacaagagauagcaauguguuuuaaguugcgcaggcccaucgugauaaggaauuaggucac

SEQ ID NO: 221173 - RNA, 64 nt, Human
ccagaacuugcaguaacccuuuaggguccugccccaggcccagccagggcugaggagcugucac

SEQ ID NO: 221174 - RNA, 64 nt, Human
ucacaggcuggcccaggugcucccucccuuccugcaggcccaccugccagcagagggugugguu

SEQ ID NO: 221175 - RNA, 64 nt, Human
cuagacaaagaacuagaaaaaaaaaagcaguuuccaggcccauccauauuguaauuuuucuuua

SEQ ID NO: 221176 - RNA, 64 nt, Human
gcccaggcuaccagagcaccugucccucggccgccugguacagcucccacucucagcaggugac

SEQ ID NO: 221177 - RNA, 64 nt, Human
uuuccuucuucccacuugucucaugucugugaaacugguacaaccugccauaagaugaaaugaa

SEQ ID NO: 221178 - RNA, 64 nt, Human
gaagcuaacggcuacuccuguaccacucuauucacugguacaguccagccaguaaaaaacacuu

SEQ ID NO: 221179 - RNA, 64 nt, Human
ggaucuagcacuaggaauaaaccuuucauaaaagcaggcccagcgaggucaauuugucggggac

SEQ ID NO: 221180 - RNA, 64 nt, Human
acucagacuaccacccuuuccccaaguauaacgucaggcccaaguguggacacacugccgccca

SEQ ID NO: 221181 - RNA, 64 nt, Human
ggugaccugaaccagagcuggagugaggaucaaacaggcccaggagccugaggaaauacccagu

SEQ ID NO: 221182 - RNA, 64 nt, Human
auuacccuuugacuuuuauaaucaacauaaguuccaggcccaguauggauuuacaaaaucugug

SEQ ID NO: 221183 - RNA, 64 nt, Human
cgucagcugccucugcauagcuguuugagaaauucaggcccaaaucaugcagccuauccaauaa

SEQ ID NO: 221184 - RNA, 64 nt, Human
uggucccugcauucacagguuucucagugggaagcaggcccagguccucuuacauuugacauaa

SEQ ID NO: 221185 - RNA, 64 nt, Human
cccacagagccuccagagcuagcugaggccaacgcaggcccauccgucucuucacucugucgca

SEQ ID NO: 221186 - RNA, 64 nt, Human
uuuuuuacaaccuggccagaggcauuuuuuaaaucaggcccaauaucaguauucuuuuugugug

SEQ ID NO: 221187 - RNA, 64 nt, Human
acccuuggagccagaaguggccccucugccccuccaggcccagggcaugguccugcugcuucac

SEQ ID NO: 221188 - RNA, 64 nt, Human
aacccaugcauggccucccagccacccggaucuccaggcccagccuggccccaaauguucuuuc

SEQ ID NO: 221189 - RNA, 64 nt, Human
ggcugcccagcuggacagauggcuuccugcuccccaggcccagccaggguccucucucaaccac

SEQ ID NO: 221190 - RNA, 64 nt, Human
ccccaagccuucaacagaagcugugcugccacggcaggcccaggccagccagugcccgaggcca

SEQ ID NO: 221191 - RNA, 64 nt, Human
gcugccaugcugggggggggucaccccgaccccucaggcccaccugucacggggaacauggagc

SEQ ID NO: 221192 - RNA, 64 nt, Human
cagcgcaggggucaguucccacccccacccgucccaggcccaggccgaagccagcgcccagcuu

SEQ ID NO: 221193 - RNA, 64 nt, Human
auugaugggcaggagggauccccgcacugggagacaggcccagguaugaaugagccagccaugc

SEQ ID NO: 221194 - RNA, 64 nt, Human
uggacccggccaggagacaaggguacgggccucucugguacacgagcgugggguucggcggccu

SEQ ID NO: 221195 - RNA, 64 nt, Human
acuguuugaaaguucgaaagaggggcauucuuuucugguacauggugagaguucaggcuccaga

SEQ ID NO: 221196 - RNA, 64 nt, Human
cguuacuggccaagggcucuguagaaucacggugcugguacaggaugcaggaauaaauuguauc

SEQ ID NO: 221197 - RNA, 64 nt, Human
acagaacaggaauaucagaaacgaaguuguugaucaggcccacugcgaccuuccuuucuaucuc

SEQ ID NO: 221198 - RNA, 64 nt, Human
cugcaaauccuccuuacagaucugaguggaugaucaggcccagagcaacccugagaccccaggu

SEQ ID NO: 221199 - RNA, 64 nt, Human
ugugacuagugcugaagcuuauuaaugcuaagggcaggcccaaauuaucaagcuaauaaaauau

SEQ ID NO: 221200 - RNA, 63 nt, Human
gccaucugggggaccccugaggaucuaccugcccaggcccauucccagcuccuugucugggga

SEQ ID NO: 221201 - RNA, 64 nt, Human
cugccccgccccuucacagagcgcccggggauuccaggcccagggcuucuacucugccccuggg

SEQ ID NO: 221202 - RNA, 64 nt, Human
ucuggagaagaccuggggugggggcugaugggggcaggcccacagugagagacugccucugcuu

SEQ ID NO: 221203 - RNA, 64 nt, Human
gagcaaggacaaccugccccuccccagcccuuugcaggcccagcagacuugagucugaggcccc

SEQ ID NO: 221204 - RNA, 64 nt, Human
agcgcugcaaaguggaaaauaugaaaagaccacacaggcccagcaguccagaaacugggcaaaa

SEQ ID NO: 221205 - RNA, 64 nt, Human
guuaguccaguuugauggugugaauggugaauuucaggcccaguugcuaaauuuuguggcaucu

SEQ ID NO: 221206 - RNA, 64 nt, Human
gcuuuugaauaaugguuuugguuaccugggaaggcaggcccagaacccauuuccuugacuugca

SEQ ID NO: 221207 - RNA, 64 nt, Human
gcacagcguggaggucagcggcucccagcucugccaggcccauucccagcugcugcaguacgug

SEQ ID NO: 221208 - RNA, 64 nt, Human
cguccugcccaccuucuuaagaggcgagauggagcaggcccaucugccucugcccuuucuagcc

SEQ ID NO: 221209 - RNA, 64 nt, Human
cagugaggugucaccccccuccagcugaggagaccaggcccaguggcagggguuucucugucug

SEQ ID NO: 221210 - RNA, 64 nt, Human
acccuggauagugguucuaugacucugcgagggacaggcccacgcguguggggagaacaucucc

SEQ ID NO: 221211 - RNA, 64 nt, Human
ccuuccccgcccccagccugcuaaguuaaguggacaggcccacaagaugaccuugcaugugagc

SEQ ID NO: 221212 - RNA, 64 nt, Human
aauuggcacugagauuugcuacacuucuccccaccugguacaugauacaugaccccagguucca

SEQ ID NO: 221213 - RNA, 64 nt, Human
ggacgugcuugccgggacagcaggcaguggccaccugguacaccacacuggagccggaaggcaa

SEQ ID NO: 221214 - RNA, 64 nt, Human
cuucauaaaaccacuuacccaaggugucuugagucugguacaacuggcauucaaaucuagguca

SEQ ID NO: 221215 - RNA, 64 nt, Human
ucguuggaaaauaaauucagaucaaaaugccuuucaggcccauuaccuagaaaucuaucuuaaa

SEQ ID NO: 221216 - RNA, 64 nt, Human
ggcagagccugugcccuucagcccuuucaccuaacaggcccauauucgggccuuugccugacca

SEQ ID NO: 221217 - RNA, 64 nt, Human
gggcaacguccaggccaaugugccagcuggaggccaggcccaggugcgugccuuguccuggggg

SEQ ID NO: 221218 - RNA, 64 nt, Human
acucccagaguuuccauuucaggaggucugggaucaggcccaagaauuugcauuuuuaacaaau

SEQ ID NO: 221219 - RNA, 64 nt, Human
cccaauucccucaucuguaggauuugggcugccccaggcccacccagggggcucugaauguauu

SEQ ID NO: 221220 - RNA, 64 nt, Human
aacguuuccacuuagaucuuuuauuuuuaauaagcaggcccauaaaaauuguugacaagaauua

SEQ ID NO: 221221 - RNA, 64 nt, Human
uccaugccguccacagcgccucuucccagacagccaggcccaucugcugcccagggaagcgcag

SEQ ID NO: 221222 - RNA, 64 nt, Human
cugucuucugugcacagcagcacuugccgcugugcaggcccaccucuuuggcucuuuggguggg

SEQ ID NO: 221223 - RNA, 64 nt, Human
aagauaacggggucaggccuuuaacuuccucaaacaggcccaagcaaaggcuggaagacauuug

SEQ ID NO: 221224 - RNA, 64 nt, Human
cucagaagccuccugucuccagcucucuccaggacaggcccaguccucugaggcacggcggcuc

SEQ ID NO: 221225 - RNA, 64 nt, Human
gucugccuccugcugcuucuguaacugcagaccccaggcccaauggcaagcccucggcucagcu

SEQ ID NO: 221226 - RNA, 64 nt, Human
aacuguucuuucuuuuuuuuucccuuccuuuuugcaggcccauggucagcucuggucuagaugu

SEQ ID NO: 221227 - RNA, 64 nt, Human
ggagaccccuggucccaccccugccgugaagccccaggcccacuucccaagaaucucacuucuc

SEQ ID NO: 221228 - RNA, 64 nt, Human
gcccauuuuccagauguguauucuguugaggacccaggcccauccagggauuucaucucuaagc

SEQ ID NO: 221229 - RNA, 64 nt, Human
cgaugacccaaaggauaagaaagaaaagagagcucaggcccaaguggaguuugcagacauaggc

SEQ ID NO: 221230 - RNA, 64 nt, Human
caucaauguggcugcuggccuggaccccaggggucugguacagccaagauguucuggacaacau

SEQ ID NO: 221231 - RNA, 64 nt, Human
uuguaauguuuauccguuuaaacauuucguccuccugguacacgaagggaacugucugcccagg

SEQ ID NO: 221232 - RNA, 64 nt, Human
ucucuagaccuggaaaaggugucccuaggcagagcccuggcagggcgcucagagcuggggauuu

SEQ ID NO: 221233 - RNA, 64 nt, Human
aguggaucaaaccucagccgcagccuccgggggacaggcccagggcgggaaauggagccggaga

SEQ ID NO: 221234 - RNA, 64 nt, Human
cauuuauggagugcuugcuaugugccccucauggcaggcccacagcacucugaacaggcacagc

SEQ ID NO: 221235 - RNA, 64 nt, Human
gcuccccacacagcuggcuacacugcucaggcuucaggcccacuuguugaacagaacaaucugg

SEQ ID NO: 221236 - RNA, 64 nt, Human
ugaugaagaucacugccuugggcuucauggaaaacaggcccagccuggggcugcguuuggauuu

SEQ ID NO: 221237 - RNA, 64 nt, Human
aaaaccaagacuggaagguccccucuaccccucccaggcccagagcuagcugacuguguaugag

SEQ ID NO: 221238 - RNA, 64 nt, Human
gagaggagugggggcggcugcguagcuguggucccaggcccaggagccugagggggugucuagg

SEQ ID NO: 221239 - RNA, 64 nt, Human
ccagaacuggaaacgcaugaacgacccagaauaccaggcccagggccuagcaauguaucuucag

SEQ ID NO: 221240 - RNA, 64 nt, Human
ggaagaauugguggccugagccgauggggccccccaggcccaggcgaaagggcagcagcaugug

SEQ ID NO: 221241 - RNA, 64 nt, Human
agaagcuacuuugaaagucuggccagugucuauucaggcccacugggaguuaggaaguauaagu

SEQ ID NO: 221242 - RNA, 64 nt, Human
gugggaguagcugguggaagagcugcagcuuuaucaggcccaauccaugccauaaugaacaggg

SEQ ID NO: 221243 - RNA, 64 nt, Human
ugggccugggcuuccacagugugaagacacugugcaggcccaggcaggcccagccucugcccca

SEQ ID NO: 221244 - RNA, 64 nt, Human
cuuccacagugugaagacacugugcaggcccaggcaggcccagccucugccccacccaucagug

SEQ ID NO: 221245 - RNA, 64 nt, Human
aggggcgugugcuggaccccaccacuguggguugcaggcccaaugcagaagaguauuaagaaag

SEQ ID NO: 221246 - RNA, 64 nt, Human
ggcuuucagagugauagagcuccuaacagguguacaggcccaagaguugaaggugauugguuuu

SEQ ID NO: 221247 - RNA, 64 nt, Human
caggcuggcugcuuuuuuuagccugccccuggcccaggcccaguccuuggugucagggagcccc

SEQ ID NO: 221248 - RNA, 64 nt, Human
caugggccugcccuccugugaugggcagaggcuccugguacaucgagaagauuccuguggaucc

SEQ ID NO: 221249 - RNA, 64 nt, Human
gaagaaaucucacuuuucagccaggguacugguucugguacauauggaucauaaguccauuugg

SEQ ID NO: 221250 - RNA, 64 nt, Human
acuacagggcuacaguaaccaaaacugcaugauacugguacaaaagcauggugcugguacaaaa

SEQ ID NO: 221251 - RNA, 64 nt, Human
ccccgccuguccucagccagcacugcagggaucccaggcccagacucuggaggccuucacugau

SEQ ID NO: 221252 - RNA, 64 nt, Human
gccauuuguguggaccaaucuacucggggaauuccaggcccaccaggacacgugccaauggccc

SEQ ID NO: 221253 - RNA, 64 nt, Human
ccagucauucacgcgucugacagagcuggugcugcaggcccauaggaaggagcuggaaggccuc

SEQ ID NO: 221254 - RNA, 64 nt, Human
uuucacuaaucccaaaggucccaaggaacaaguccaggcccagaguacugugaggggugauuuu

SEQ ID NO: 221255 - RNA, 64 nt, Human
accuagaaggcacgugggcaaaguaaucaucguucaggcccaacccuuagguuuaaaaagucag

SEQ ID NO: 221256 - RNA, 64 nt, Human
ccugccugggcuggcugugaggccaccuuugucccaggcccagccucaaggcaaggagggcgcu

SEQ ID NO: 221257 - RNA, 64 nt, Human
cuuccuguuccaguucaccuaaaggcugauugugcaggcccagcacuguggcuggacugccgcg

SEQ ID NO: 221258 - RNA, 64 nt, Human
gaaaaacuuuggaaccagacucuugccuguuucccaggcccacugugccucagagaccagggcu

SEQ ID NO: 221259 - RNA, 64 nt, Human
cacaaugugacaguccccaggcaugcccacaggccaggcccagucacagcugggcuuccacagg

SEQ ID NO: 221260 - RNA, 64 nt, Human
cugggcacuugaacucagggcccaagcagaagcacaggcccaguccuggcugcaagcacaauag

SEQ ID NO: 221261 - RNA, 64 nt, Human
agcaagguucugaaggagaguuucuugcauuggacaggcccagucuucucccaucauugcccug

SEQ ID NO: 221262 - RNA, 64 nt, Human
gaaagcacaggugggcuucccaguggcugcugcccaggcccagaccuucuaggacgccacccag

SEQ ID NO: 221263 - RNA, 64 nt, Human
cccaggcaggcucucugagggcauucuguagucccaggcccacuggaaaaaugaaucuauauuu

SEQ ID NO: 221264 - RNA, 64 nt, Human
uuggugcacagugauuuuuuucuuguaauuuaaacaggcccagcauugcugguucuauuuaaug

SEQ ID NO: 221265 - RNA, 64 nt, Human
gcuggggcaaggccaucagcuucagagaccuugccaggcccaggcugggugcccuguggccuga

SEQ ID NO: 221266 - RNA, 64 nt, Human
cgucuugaaccuuuuguaugaaaccaagaaacaucugguacagcugccaaacaucaaccggguc

SEQ ID NO: 221267 - RNA, 64 nt, Human
gaugagagauucuauucaguggaucagaaucaaacugguacauugauccacuugagccguuaag

SEQ ID NO: 221268 - RNA, 64 nt, Human
aagugaagaggauuagcccuuaagguuuuaauaccugguacaguagugaaccgcacagauuuca

SEQ ID NO: 221269 - RNA, 64 nt, Human
acggcagagcaggugggcaaggccagggcuaccccaggcccauguggccuccuccuugcuugga

SEQ ID NO: 221270 - RNA, 64 nt, Human
ggcuccuucccguggcugcuucaacccaguuccccaggcccagcuucuggaauagacaguuccu

SEQ ID NO: 221271 - RNA, 64 nt, Human
gaccagaugcuccuguaaacauccaggggugugccaggcccacccucacaacugcuuguucagg

SEQ ID NO: 221272 - RNA, 64 nt, Human
cccagcccuucuucuagugguagcucuggcuuugcaggcccagcuccaggcccugcuccucaga

SEQ ID NO: 221273 - RNA, 64 nt, Human
ccuuaggagcgccuggaagcagaaccaguagcuacaggcccagagauggacuggagagugagga

SEQ ID NO: 221274 - RNA, 64 nt, Human
ucugguggagcggacccacuccccucacauuccacaggcccauggacucacuuuuguaacaaac

SEQ ID NO: 221275 - RNA, 64 nt, Human
ucaaaucacugccaggaguucuugcuccuggcugcaggcccaggccccaaggucuccuucuugg

SEQ ID NO: 221276 - RNA, 64 nt, Human
ggggcuaugugcacuccagaccccugcccaggcucaggcccaugagguauggagacacccuggc

SEQ ID NO: 221277 - RNA, 64 nt, Human
ggugugucaccugcccaccaccuggcucaucccucaggcccacccugacccuacauuacauagg

SEQ ID NO: 221278 - RNA, 64 nt, Human
ccuagggauuuaaagggacaccccuacacacacccaggcccaugccaaggccucccucaggcuc

SEQ ID NO: 221279 - RNA, 64 nt, Human
cugcaccacagagaguugaggcccuaacaaauuucaggcccagccaagagcccaugaauggagg

SEQ ID NO: 221280 - RNA, 64 nt, Human
auggaugcucccaaggguuagggacugcauugagcaggcccaccugcuucccagaaccuccuca

SEQ ID NO: 221281 - RNA, 64 nt, Human
auauauaaagacuggcacccugccucucugugcccaggcccagcccuggugacauggcaccacu

SEQ ID NO: 221282 - RNA, 64 nt, Human
caggcagagccgagaguucgccccaacccuuccccaggcccagugugaaaaacagacucacaag

SEQ ID NO: 221283 - RNA, 64 nt, Human
aguccugccagcagccgcaaagagccgaggcugccaggcccauuuaugucccucaugucucuag

SEQ ID NO: 221284 - RNA, 64 nt, Human
ggaaauguguuuggagauaggggaaaucacauaacugguacaaguaugggguaauugcuuaaac

SEQ ID NO: 221285 - RNA, 64 nt, Human
cucccgugcuccucagggcccaccccugcucugucugguacaggccccugcugagugggccccu

SEQ ID NO: 221286 - RNA, 64 nt, Human
ccugacauuuaguugauuauuuucugcuacagaccugguacacucugauuuuagauaaaguaag

SEQ ID NO: 221287 - RNA, 64 nt, Human
ggcagaagccucugcccaucccccucaagggcugcaggcccaguucucaugcugcccuugggug

SEQ ID NO: 221288 - RNA, 64 nt, Human
agcccccagggugggauuucucaggcugccagggcaggcccaggccucaggaagaaggggaggc

SEQ ID NO: 221289 - RNA, 64 nt, Human
cccagcugggccucucuggccuauuccuaccuuccaggcccacugcacuccugucugggaggcc

SEQ ID NO: 221290 - RNA, 64 nt, Human
gaggccugggcucgguucccgggcccugcaggggcaggcccaggcagcgucagccggagagcuu

SEQ ID NO: 221291 - RNA, 64 nt, Human
cuauccuccaggagucucagccuuucccugggcgcaggcccaccuuggcauggccgccucaggc

SEQ ID NO: 221292 - RNA, 64 nt, Human
gcgucccugcacacugcgaggacugccuuggccacaggcccacucccuacgacacgugacucgu

SEQ ID NO: 221293 - RNA, 64 nt, Human
cccuggugccagggacguaccugggaguuugaaucaggcccauuugagcguggcagccguguug

SEQ ID NO: 221294 - RNA, 64 nt, Human
acugcacuugguacuuccuagagacggccggagccaggcccaagacacagcagaggucaaaggc

SEQ ID NO: 221295 - RNA, 64 nt, Human
cuccugaguagcugggauuacaggcacgugacaccaggcccagcugauuuuuguauuuuuguuc

SEQ ID NO: 221296 - RNA, 64 nt, Human
aaagugcugggauuacaggugugagccacuucaccaggcccauuuucuccuaaaacuucaagga

SEQ ID NO: 221297 - RNA, 64 nt, Human
acagguggaucccauggcauccccauggaggaaccaggcccaucugggcagcagcaucugguug

SEQ ID NO: 221298 - RNA, 64 nt, Human
ugcagaagcuuagcauaugcccuuguguucggaucaggcccacagggcugcucaaagaguagag

SEQ ID NO: 221299 - RNA, 64 nt, Human
uuuugaucauuccagcuccucugggcucuggccucaggcccacuaaugauccugcuacccucuu

SEQ ID NO: 221300 - RNA, 64 nt, Human
uaggguggguaccucugagucccagggaccugggcaggcccaagcccaccacgagcaucaucca

SEQ ID NO: 221301 - RNA, 64 nt, Human
cuacugggcccucaugcuugccuuuccuggcccccaggcccagccccuuuuuacuggggcaguu

SEQ ID NO: 221302 - RNA, 64 nt, Human
acaggaguaucuucuguacacuguuccgcaguuacugguacaugaacaguuggaacugcugacu

SEQ ID NO: 221303 - RNA, 64 nt, Human
auguugccuuuucucuuaguaggauaacuaguagcugguacauaaucacugaggagcuauuucu

SEQ ID NO: 221304 - RNA, 64 nt, Human
uugugcuggaagauauuucacucuggugacuacucugguacacucugguguucucuaaucuugu

SEQ ID NO: 221305 - RNA, 64 nt, Human
gaaagcugcaggaaccucgugggcuccagggacccaggcccacauccauccagcguucccgcug

SEQ ID NO: 221306 - RNA, 64 nt, Human
ccagugaccacacagcuccuccaugccugaccaacaggcccagcuuucccugccaggcccuuug

SEQ ID NO: 221307 - RNA, 64 nt, Human
acuggcucuggggccucgaggugccaggcagcaucaggcccacuggguugccccggccaggccu

SEQ ID NO: 221308 - RNA, 64 nt, Human
gugcacuccccggccugcauccggcuuggguacacaggcccagaggacuggggugacucacggg

SEQ ID NO: 221309 - RNA, 64 nt, Human
gggcaguggucuccccccuuggcgccuccuugcgcaggcccagccuccacucuccucgucuagg

SEQ ID NO: 221310 - RNA, 64 nt, Human
aggccuggugaggccacuuggccucuugguuggccaggcccaccaggaagucaccaggacaguc

SEQ ID NO: 221311 - RNA, 64 nt, Human
uucucaccuuucaaccccaucuguggccuuuguccaggcccacagcuuagccauggcuucccuc

SEQ ID NO: 221312 - RNA, 64 nt, Human
auucaccugugggcagagggacaggucagacacccaggcccaccccagagacccuccaugaacu

SEQ ID NO: 221313 - RNA, 64 nt, Human
guccucagccugaguggacagcagugucccggcacaggcccaucgagccggguccaguacccaa

SEQ ID NO: 221314 - RNA, 64 nt, Human
ccgucagacauaagcucucacagcgcuaaggaagcaggcccaggcuggcaggcaucucggcuug

SEQ ID NO: 221315 - RNA, 64 nt, Human
ggcaggacaccugggauggacucguaggcugacccaggcccaaagggggcugccuguucccaac

SEQ ID NO: 221316 - RNA, 64 nt, Human
cucccccauuccucucuugcuacaaauaaggaaacaggcccaggagauuaagugacuuggcuaa

SEQ ID NO: 221317 - RNA, 64 nt, Human
uccauucugaauaccaaaaacagggcuucacagccaggcccagaagaggucuggugauaauggc

SEQ ID NO: 221318 - RNA, 64 nt, Human
cugccccccggguggggcugcggcucuggccucccaggcccauccucaacagcuaccccagcca

SEQ ID NO: 221319 - RNA, 64 nt, Human
caccaagcucuucagccagggcauuggaggggagcaggcccaggccaaguuugacagcugccuu

SEQ ID NO: 221320 - RNA, 64 nt, Human
uaguaaagcacauagugaguguauguccgucuaacugguacauugauaauuuaguuugggcaca

SEQ ID NO: 221321 - RNA, 64 nt, Human
gucaaccugacuggauuaaggaauaccuagacagcugguacaacauuauuucugggugugucug

SEQ ID NO: 221322 - RNA, 64 nt, Human
gcuguucuuuucugguggauuuaaugcugacucacugguacaaacagcuguugaagcucagagc

SEQ ID NO: 221323 - RNA, 64 nt, Human
cauggagugagcuuuagaaccauacuaccaucuccaggcccaaacucugaaauaaagacaugag

SEQ ID NO: 221324 - RNA, 64 nt, Human
cugggccuuagagcaggccccgaacuguggucgccaggcccaggaggcgacugcaugguggaga

SEQ ID NO: 221325 - RNA, 64 nt, Human
ccggacacagcaccgugccaaccccacccagcuccaggcccaccggaugcugugccuggccucc

SEQ ID NO: 221326 - RNA, 64 nt, Human
cagcauguggaagaagauuuggccugaguguguucaggcccagcguuuuucccaggcagauaac

SEQ ID NO: 221327 - RNA, 64 nt, Human
agccaaguggggcccucggccucuuccuucguuccaggcccaugauuuucccuacacuucuccc

SEQ ID NO: 221328 - RNA, 57 nt, Human
acauucucggggggcccuagcugagcgcaggcccaggccccacuugcuuccugcggg

SEQ ID NO: 221329 - RNA, 64 nt, Human
aggccccacuugcuuccugcgggugggaaagcugcaggcccaggccuugcuucccuaucaggcu

SEQ ID NO: 221330 - RNA, 64 nt, Human
cucuucccagcacuucccugccucccccaggccucaggcccagcacccaguuccuccucacaug

SEQ ID NO: 221331 - RNA, 64 nt, Human
agaacagcgucuccaucuaaaucccaggggaacacaggcccagaugacaucccuuugaccacau

SEQ ID NO: 221332 - RNA, 64 nt, Human
ccacguggcaggagccucugggacggggcacacacaggcccagccucugugcugucuccuccuc

SEQ ID NO: 221333 - RNA, 64 nt, Human
gucaagugaugcuuuugagcuuacacacaauucacaggcccaccagugacaauuuacugugagu

SEQ ID NO: 221334 - RNA, 64 nt, Human
gggcagucuggguccucucaucauccccacuucccaggcccagccuuuccaacccugccuggga

SEQ ID NO: 221335 - RNA, 64 nt, Human
ucaaaaguccagccacacucauucauccuuuccccaggcccaugaagagaggcaucucauugua

SEQ ID NO: 221336 - RNA, 64 nt, Human
cucccccauacacaccuaggcuugaaaugcccuacaggcccagaacuuucucacaucugaaaug

SEQ ID NO: 221337 - RNA, 64 nt, Human
ccaaugugaagacacuacagaggauucugucuuccaggcccaguccacuggggagugcuggaau

SEQ ID NO: 221338 - RNA, 64 nt, Human
acccggaauuuucaccaacaguucacucacccuccugguacauugccauuccaaggaauucuga

SEQ ID NO: 221339 - RNA, 64 nt, Human
cgcaauuggaaaggauauauguggcaauauuaaccugguacaugaauauauggggauaacauuu

SEQ ID NO: 221340 - RNA, 64 nt, Human
cauauugagaacacuacacagugcugaaguccagcugguacacaccggggugacaccuuggcug

SEQ ID NO: 221341 - RNA, 64 nt, Human
ccagugugcggggagccucugccugagugugcaccaggcccauguuuauugaccacagucugag

SEQ ID NO: 221342 - RNA, 64 nt, Human
cggggcccugauguggaguagacagugcgcaccucaggcccacacacggccccgcccuggggcc

SEQ ID NO: 221343 - RNA, 64 nt, Human
uguuggcuugugaucugggaacucccaagaacagcaggcccaccuaccuucaaagcugaagccg

SEQ ID NO: 221344 - RNA, 64 nt, Human
aggagaaaugggggccuugaugcucacccugguucaggcccagagguccaagcuauacugugca

SEQ ID NO: 221345 - RNA, 64 nt, Human
gccccuacggccaggggacugucugccagccucccaggcccaugcccuccuggugccccuggca

SEQ ID NO: 221346 - RNA, 64 nt, Human
gccucagaugaugugaaucuggggaagggcgggucaggcccacagccuuccugcaaagcccagg

SEQ ID NO: 221347 - RNA, 64 nt, Human
uuccagaaaaccucuccugaccccugccuguuggcaggcccacuccccagccccagccccuucc

SEQ ID NO: 221348 - RNA, 64 nt, Human
cuaaucauguguuuauaggauaguacacguuccccaggcccauaacagaggacuaaaaucucug

SEQ ID NO: 221349 - RNA, 64 nt, Human
uuucugcucccagaagaauaguuucucuggcucacaggcccaaguucucaaugaaaucguuuuu

SEQ ID NO: 221350 - RNA, 64 nt, Human
ggcaagggacucuccaggcuccuccucccccuggcaggcccagcaacaugugccccagaucugg

SEQ ID NO: 221351 - RNA, 64 nt, Human
ucugccccaggucugggacgcaggugaugccagccaggcccaggagugcccagcaucccccaac

SEQ ID NO: 221352 - RNA, 64 nt, Human
cagauacuccuuuugccacugcugugugauuagacaggcccagugagccgcggggcacaugcug

SEQ ID NO: 221353 - RNA, 64 nt, Human
aguccccuuccaaacccagacccaccuccugccccaggcccacugaagcauguuccauuucuaa

SEQ ID NO: 221354 - RNA, 64 nt, Human
caggccaagagcgagcgagaggcgcugccccagccaggcccaccaccucucacagucagugcac

SEQ ID NO: 221355 - RNA, 64 nt, Human
guuucuguccccagggagcagacugugcggcacccaggcccaguggcaccauuucccagacccc

SEQ ID NO: 221356 - RNA, 64 nt, Human
ccauauaccaccuaaaaucaauuuucuuguacaacugguacacacuaauaaacaaacaugugag

SEQ ID NO: 221357 - RNA, 64 nt, Human
ugcugguggaagaguuugaggaggugaucgaggacugguacaggaaccaccaggaggaagaccu

SEQ ID NO: 221358 - RNA, 64 nt, Human
cuuuaauggguuuuuuaaaaaucuguggagguugcugguacacaccaaaugaguccaaacugga

SEQ ID NO: 221359 - RNA, 64 nt, Human
gccacgguccuccaggaccugggaagcaaaggcacaggcccacgguggccagccauuguggugc

SEQ ID NO: 221360 - RNA, 64 nt, Human
uccuggcguggggccaggagcuuguccaaggccacaggcccacagcacccccugccggcgggcu

SEQ ID NO: 221361 - RNA, 64 nt, Human
ucggguccugagggccgggaagccgaagaguccacaggcccagaggaagcagaagcccccgagu

SEQ ID NO: 221362 - RNA, 64 nt, Human
cugcagaccaggugcggauucuguguagguucugcaggcccaguguagaggcucacaccuguaa

SEQ ID NO: 221363 - RNA, 64 nt, Human
cacucucucacccaccagcuccacacauuccagccaggcccaggccagcccccccacccacccc

SEQ ID NO: 221364 - RNA, 64 nt, Human
gugggaaccaaacaccuucagugcugguggcccucaggcccacagguuuaaggcugaggcugcc

SEQ ID NO: 221365 - RNA, 64 nt, Human
guuggcaugugaggccagggugggcaccaaagaccaggcccagagccaggggacagguuggggc

SEQ ID NO: 221366 - RNA, 64 nt, Human
ccaucucgcuugcugcccaacaccauggcccucacaggcccaacugaccugcgcuggagcugcu

SEQ ID NO: 221367 - RNA, 64 nt, Human
ccggacagccuagcugggggcucccccauauucccaggcccagaagacagacccacagcccugc

SEQ ID NO: 221368 - RNA, 58 nt, Human
ccacuggugugcaggugugaggcuccugcaggcccacucucuucagcagccacccggc

SEQ ID NO: 221369 - RNA, 64 nt, Human
gucuccugccugcuugccaaaagcuaggaugcuucaggcccauguacaauugaaagcagaggca

SEQ ID NO: 221370 - RNA, 64 nt, Human
aagacccucugcaagggggacaggcaggccccuccaggcccaccagccugguucccgcggccca

SEQ ID NO: 221371 - RNA, 64 nt, Human
cuucgcugagguuuccuccucccccuccucccugcaggcccaaggcguugguaagggggcagcu

SEQ ID NO: 221372 - RNA, 64 nt, Human
agcccacugcccuggcucaucucucccuucacugcaggcccacaguuguagaccauucuucugu

SEQ ID NO: 221373 - RNA, 64 nt, Human
cuuguagcccaauccccucucuucgcgcagagcccaggcccagggucuggcugaaaaggcuuuc

SEQ ID NO: 221374 - RNA, 63 nt, Human
ugugugcacacaagucuuacuuggaauaaauuuacugguacaaauucuuaacugugcauuucu

SEQ ID NO: 221375 - RNA, 64 nt, Human
auuccaccccauguaaauauguacaagugcaucacugguacaauuuuauguaacucaguuggac

SEQ ID NO: 221376 - RNA, 64 nt, Human
uaggaacggcccagaucgcccucaugagugccaccugguacagguagguggcgcucacguuccu

SEQ ID NO: 221377 - RNA, 64 nt, Human
acucuuccccagagcagcaggccccgagccccuucaggcccagcacugccccagacucgcuggc

SEQ ID NO: 221378 - RNA, 64 nt, Human
cccucuacagacaggggcgcugcugcagaugcuccaggcccaccuuggugggugcccgggguca

SEQ ID NO: 221379 - RNA, 64 nt, Human
uggauccacguuucaucuuuaaucacgccagguccaggcccaucugucuuguuuccucugccga

SEQ ID NO: 221380 - RNA, 64 nt, Human
ucaguucagcuuccuccaccucgcuuccacugcacaggcccaggaaggagaaaggccaagccaa

SEQ ID NO: 221381 - RNA, 64 nt, Human
cagugaugcugcggucucuccuccccuuucccuccaggcccagugccagcacccuccugaacca

SEQ ID NO: 221382 - RNA, 64 nt, Human
gguucagcagaugccuccucugccccccugcaggcaggcccaaguaggacugcuggaggcugug

SEQ ID NO: 221383 - RNA, 64 nt, Human
ccugugacugaggcucccccucauguagccuccccaggcccagggcccugaggccugcuagaau

SEQ ID NO: 221384 - RNA, 64 nt, Human
ggcagauaccguuaagcgcugugcuaccgggccccaggcccagccacccgguaccucccgagag

SEQ ID NO: 221385 - RNA, 64 nt, Human
augccgcgggcagcagcuggagcuaaaggaagggcaggcccacaggggccaccgcagagccgag

SEQ ID NO: 221386 - RNA, 64 nt, Human
acaucuuggcaggacauggaauuuggccucaugacaggcccaacuagggauaggaaggaaaaug

SEQ ID NO: 221387 - RNA, 64 nt, Human
ccuuaggcagccccccucuuuggcccccucccgucaggcccagggcuuggagugaaagugacuc

SEQ ID NO: 221388 - RNA, 64 nt, Human
gacggccggcgggggcucuccuagugcccagagacaggcccagagguuuacaaguuuucuaagc

SEQ ID NO: 221389 - RNA, 64 nt, Human
cgucgagggcugcagaacacagcgggguccuguccaggcccagggacaucuuugcaagccagac

SEQ ID NO: 221390 - RNA, 64 nt, Human
gggcuggccaggcccugcucaacaucuggagauacaggcccaccccucaguccugcccacagag

SEQ ID NO: 221391 - RNA, 64 nt, Human
ccuccgaccccccuccucagcccucccccacccacaggcccagccuccucggucuccugucucg

SEQ ID NO: 221392 - RNA, 64 nt, Human
ggacugccgccaugcggaacaccaaacgagguuccugguacaucgaggcucuugcucaaguguu

SEQ ID NO: 221393 - RNA, 64 nt, Human
agguuacuaaaacagggugggcaaacucucuaaacugguacaauuuuauaggugaaagaaaaaa

SEQ ID NO: 221394 - RNA, 64 nt, Human
acagauuagaguuagaaguggcccaaaggagcaucugguacaacccccuuugguuagagaaggg

SEQ ID NO: 221395 - RNA, 64 nt, Human
ucuguauguugucuuuucaccuguggauuguaaucaggcccaaggaauauccuggagugguccc

SEQ ID NO: 221396 - RNA, 64 nt, Human
aggugaagggagaguucaucuaggcggggcuccccaggcccagggcucaacuucauggccccag

SEQ ID NO: 221397 - RNA, 64 nt, Human
aauaaagaaucaucucaccccgaaaugcaaauugcaggcccauugagauacacagcaaguuagu

SEQ ID NO: 221398 - RNA, 64 nt, Human
ucaacuagccagugacucgcucaucugcccugcccaggcccacguuuugaaguuggagcaucag

SEQ ID NO: 221399 - RNA, 64 nt, Human
acgccgcucccaucaccgcaggcgcuggagccuccaggcccaaacaggcugaagcuccuaaacu

SEQ ID NO: 221400 - RNA, 64 nt, Human
cccaggaacugaagugccucaugugauugauucccaggcccaggcagcggagguuacacccuca

SEQ ID NO: 221401 - RNA, 64 nt, Human
ucgccugcacugaugcagacaaaaucucaccuggcaggcccaacccccccccaccccucccccg

SEQ ID NO: 221402 - RNA, 55 nt, Human
aggaguacaaccuggucugagcgcccaggcccagggagacgggauggagacacgg

SEQ ID NO: 221403 - RNA, 62 nt, Human
cccuggacgaggagagcugagccgcgggcagccaggcccagcccccgcccgagcucaggcug

SEQ ID NO: 221404 - RNA, 64 nt, Human
ggcagccuccuagcguccuggcugggccuggucccaggcccacgaaagacggugacucuuggcu

SEQ ID NO: 221405 - RNA, 64 nt, Human
uuccagcaagcuucuugcgcuucucugcacccggcaggcccacuuuccuggcacccucgacuuu

SEQ ID NO: 221406 - RNA, 64 nt, Human
ccccaaaaagcaacaccugugcuugcagccaggucaggcccagcugcagcccaggcaggagcag

SEQ ID NO: 221407 - RNA, 64 nt, Human
agccaggccgagccccuggccgacuugggagccucaggcccacgcccacccuucgaggaaggug

SEQ ID NO: 221408 - RNA, 64 nt, Human
ccucaaacauggaagaugaaaggggaggggaugucaggcccagagaagcaaguggcuuucaaca

SEQ ID NO: 221409 - RNA, 64 nt, Human
agggaggcugcugcugcucuuggcuggacccagccaggcccagccgacccccucucccugcaug

SEQ ID NO: 221410 - RNA, 64 nt, Human
uuagugcccugauacuauaagcucagcaaguaaccugguacauuugaaauaaaaaccaaauuuu

SEQ ID NO: 221411 - RNA, 64 nt, Human
agaguaaccuugagauugggaggaauagaggaggcugguacaaauagauggagaccugcuggga

SEQ ID NO: 221412 - RNA, 64 nt, Human
uuaucuggacagcuucuuugagacuauuuaaaaacugguacaacaggucucuacaacgccaaga

SEQ ID NO: 221413 - RNA, 64 nt, Human
caaccuaaccccuagccgucaucuccacacucaccaggcccaccaggggagggggcuggccugg

SEQ ID NO: 221414 - RNA, 64 nt, Human
cuaagaagggaacuugccaucaagauuccuguaccaggcccacggccgucucgggcagagccac

SEQ ID NO: 221415 - RNA, 64 nt, Human
accccauccucagugcccaaugcuguggccccaccaggcccagagccugguuggccauucucau

SEQ ID NO: 221416 - RNA, 64 nt, Human
ucgacccgggccaggaggcccggggcgcugagcucaggcccagaacuggcugauuucagggaua

SEQ ID NO: 221417 - RNA, 53 nt, Human
ggggcaaccuggcgccaugaccccaggcccagucugggccgugacucugggug

SEQ ID NO: 221418 - RNA, 64 nt, Human
ccuggcccuguccuuugcuacccagggcugcccccaggcccaugaagccaauaggagagcgugu

SEQ ID NO: 221419 - RNA, 64 nt, Human
gcccagccagagacugccgugcugugggugccaccaggcccagggacugcagccugagcucccc

SEQ ID NO: 221420 - RNA, 64 nt, Human
gcauggcugcaggguggaccagcugccuggcauucaggcccagaugccugcagggcuggggcuc

SEQ ID NO: 221421 - RNA, 64 nt, Human
aggaguccuugcagaccugcugccucccccacgacaggcccaaagauggacccccccuggccuu

SEQ ID NO: 221422 - RNA, 64 nt, Human
cagugccuuugucuauauucugcucccagccugccaggcccaggaggaaauaaacaugccccag

SEQ ID NO: 221423 - RNA, 64 nt, Human
ucaccuguucuccaggaccagcccugcuggggcccaggcccaggcucugagaggccguguccua

SEQ ID NO: 221424 - RNA, 64 nt, Human
aaggagaugagggggucgacagguugaacgucuucaggcccaggaccccaagcuccucagccug

SEQ ID NO: 221425 - RNA, 64 nt, Human
gcagguguccuggcagggggacaggagacuguaacaggcccagguccuugugcagcccgugaau

SEQ ID NO: 221426 - RNA, 64 nt, Human
ugaccacggcugcuggaccccuucccuguucaggcaggcccagccccucucagaaccugcugcc

SEQ ID NO: 221427 - RNA, 64 nt, Human
aauaaacaaucauugacccaugccuacuccaugccaggcccagugcuggacacagagacaugaa

SEQ ID NO: 221428 - RNA, 64 nt, Human
guaugcucuugguaccaggagcucugauauauaucugguacauguuugauaaugacuugauugu

SEQ ID NO: 221429 - RNA, 64 nt, Human
uucuuuaaaccacagguuguugaaauggccaacacugguacagacacggacuauaaaaaucucc

SEQ ID NO: 221430 - RNA, 64 nt, Human
acugcugggaagaccuuugaaauuuuauauuguucugguacaugucugaaauucuauugcuugg

SEQ ID NO: 221431 - RNA, 64 nt, Human
guuagcauggauuuauugagugccaacugcgugccaggcccaguacggaggacgcuggggaaau

SEQ ID NO: 221432 - RNA, 64 nt, Human
cugggaaagugcccuggaccggcagcuggcgcaccaggcccagcagcagcuggaggaggaggag

SEQ ID NO: 221433 - RNA, 64 nt, Human
cguggagcacgugcacagcuucacgcccuggauccaggcccacgggggcugggugagccgcuga

SEQ ID NO: 221434 - RNA, 64 nt, Human
ugcucaggaccccccgcacugucccaaucccacucaggcccaccuccagcuggccucacuccgc

SEQ ID NO: 221435 - RNA, 64 nt, Human
ccugcucaggagcccccacugucccagucccacucaggcccaucucuggcuggccucacugcgc

SEQ ID NO: 221436 - RNA, 64 nt, Human
ccugauaaaguuaguagcugcccucaucagaaaccaggcccaggcaguggggacacauccagag

SEQ ID NO: 221437 - RNA, 64 nt, Human
uccgccacagccuguuuaucaaaagcaagccccccaggcccagcccacgugcagagggaggaga

SEQ ID NO: 221438 - RNA, 64 nt, Human
caucugcugcuggggcccccccaccacgcggugccaggcccagugucccccaggccgucugucc

SEQ ID NO: 221439 - RNA, 64 nt, Human
aucugcccacguggcuugcagugacucaggagagcaggcccacagcguuugccaucuugcagag

SEQ ID NO: 221440 - RNA, 64 nt, Human
cgcugcccaguccuguccugaaaacagcacgccccaggcccacagaaccccccacccuacauuu

SEQ ID NO: 221441 - RNA, 64 nt, Human
gagagaguggagagugcggcgugggggcacugaccaggcccaaggaggguccaggcgggcaagu

SEQ ID NO: 221442 - RNA, 63 nt, Human
cugccccucuccacucuugagcauggauacagccaggcccagagcaagacccugaagaccccc

SEQ ID NO: 221443 - RNA, 64 nt, Human
gccuccccggcagcaagaccccggcacuccccgccaggcccagggugggguggaugggcccaaa

SEQ ID NO: 221444 - RNA, 64 nt, Human
caggaacacgcagacauaugcccauagcaucccacaggcccaggcaggaggucccaccccagac

SEQ ID NO: 221445 - RNA, 64 nt, Human
gcccuaugcccgggggaagggugaaauugggguucaggcccacccagggggccgcuucccacuc

SEQ ID NO: 221446 - RNA, 64 nt, Human
aucaugaaaccugagaaaugcuaauggagauuugcugguacauaggaaucuagcaaauucagga

SEQ ID NO: 221447 - RNA, 64 nt, Human
accagccugcuguucccaacugugcccagcugcacugguacacacgcucaucaggagaaucccu

SEQ ID NO: 221448 - RNA, 53 nt, Human
gauugaagaguaaggaaugagaccugguacaacacggaaaugauucuuauaga

SEQ ID NO: 221449 - RNA, 64 nt, Human
ccgcaaccuccuccccaccucccaucucuccuuccaggcccaucccuggcccagagcaggaggg

SEQ ID NO: 221450 - RNA, 64 nt, Human
cccucgcugccccugacccgcgcccccgugcccccaggcccagccgccgcccugcuccaggcuc

SEQ ID NO: 221451 - RNA, 64 nt, Human
ggcucucaccauggaaacaaacugucccuguccccaggcccacuccaguuccagaccacccucc

SEQ ID NO: 221452 - RNA, 64 nt, Human
cauuaggcagguaucucuuaacuguaagacauaccaggcccagcugggaccauaauuuguacag

SEQ ID NO: 221453 - RNA, 64 nt, Human
gccccaccacaucgcccaucucuuccccgucccccaggcccaggaccgccccugucaguccccc

SEQ ID NO: 221454 - RNA, 64 nt, Human
auucaggaauaucuguucccagccccuccucccucaggcccaggaguccaggcccccagccccu

SEQ ID NO: 221455 - RNA, 64 nt, Human
ugacccccgcagcccacgucccgcuuucagaccccaggcccauuguaagccuaggucacaacau

SEQ ID NO: 221456 - RNA, 64 nt, Human
ccucuggacccccaggaggcuggugccagggagacaggcccaacccacccccauuugcacugag

SEQ ID NO: 221457 - RNA, 64 nt, Human
cuugcucuggucuccacguguaugaugggguucucaggcccaggcuucgaccagaggacccucu

SEQ ID NO: 221458 - RNA, 64 nt, Human
uuggaccaauucccugguuuuccagcagaugaaacaggcccaaagagguuaaaugacuggguga

SEQ ID NO: 221459 - RNA, 64 nt, Human
acaugggacggacacugacagacaguacucccagcaggcccaggccagccagggcuucgucagg

SEQ ID NO: 221460 - RNA, 64 nt, Human
uuggcuccagccauugcggugguuucuagauagccaggcccaccaagagauauugccccuugau

SEQ ID NO: 221461 - RNA, 64 nt, Human
gggggucacccauggccucagaugauggggucagcaggcccaggagaauuaggaaggccauggg

SEQ ID NO: 221462 - RNA, 64 nt, Human
ugauccuggaaagguggcagagccuccacugagccaggcccagagcuccuugcagugccuucuu

SEQ ID NO: 221463 - RNA, 64 nt, Human
augcagcguuagugaucccacuagcugugacagccaggcccagaaaaugccuggcgugagagcc

SEQ ID NO: 221464 - RNA, 64 nt, Human
aaauggcauagguugcaggaaagaauuucugcaucugguacaugggcaaguaaguuauuuaguu

SEQ ID NO: 221465 - RNA, 64 nt, Human
uccacuuuuuguuagcauacuuucauuggauuuacugguacauguuuugugaucaugauaaugu

SEQ ID NO: 221466 - RNA, 64 nt, Human
gagccaggaggucuagaacuggagcuuaguccagcugguacaauaccaacuccccuucuaguuc

SEQ ID NO: 221467 - RNA, 64 nt, Human
ccgcucaagucugggagggcaugggagcagugagcaggcccauggggagaaauuggccaauuua

SEQ ID NO: 221468 - RNA, 64 nt, Human
ccgccuuaacugucccccccagucacuucucccacaggcccagcaggacgcaguccugaggauc

SEQ ID NO: 221469 - RNA, 64 nt, Human
ugcucugacgccaggugccaaggcuucaggcaggcaggcccaggaugggcguuugcugcgcaca

SEQ ID NO: 221470 - RNA, 64 nt, Human
aagucuuugcagucaaguacugaugcauccaagccaggcccaugccuggugucucccugacugc

SEQ ID NO: 221471 - RNA, 64 nt, Human
uuugcuuguggcugugcaggcugaggucuggagccaggcccagagcuggcuucaggguggggcc

SEQ ID NO: 221472 - RNA, 64 nt, Human
gcuccagaggggugaaugggccuuugcucagcuccaggcccagcgggaagggaggcugcaggga

SEQ ID NO: 221473 - RNA, 64 nt, Human
uuggugagcgccgccccaacgagacucgcggccccaggcccaggccccaccccggcggcggugg

SEQ ID NO: 221474 - RNA, 64 nt, Human
cuauuuucacaguguucugauugcucucacagcccaggcccaucgucuguucucugaaugcagc

SEQ ID NO: 221475 - RNA, 64 nt, Human
ucagcaccagccucagcaacugugcagagaccuacaggcccacagccaguggccuguccgcauu

SEQ ID NO: 221476 - RNA, 64 nt, Human
uuuaccacggagcagggucaccaacccagaucuccaggcccaugaggauggaacaugaaaggag

SEQ ID NO: 221477 - RNA, 64 nt, Human
accugcauuuauuuauugagcagcagugcugugucaggcccagggaccgagccccucucccugu

SEQ ID NO: 221478 - RNA, 64 nt, Human
ggccuggagaccacccagcccugaccugggaccccaggcccaggggcacauugaacaggaggac

SEQ ID NO: 221479 - RNA, 64 nt, Human
ccuacauuguccagcccuaccuagaguacccauccaggcccaugugugagaguccucucccuuc

SEQ ID NO: 221480 - RNA, 64 nt, Human
ggagguggguagaugggaguggggcucggucccccaggcccaggggacucucuccacucuuucc

SEQ ID NO: 221481 - RNA, 64 nt, Human
ccccgcgggcagugacgugaguggggaggagacucaggcccacauugcccacaccugccucuga

SEQ ID NO: 221482 - RNA, 64 nt, Human
aauauguauaccuggcauagagaaaaauauauaccugguacauuggagaaaaauaauuacacuu

SEQ ID NO: 221483 - RNA, 64 nt, Human
ucggcuuccuggaagggcugcucccguggcagcacugguacaugagccgccucuugcaucagua

SEQ ID NO: 221484 - RNA, 64 nt, Human
aguuaaauggacauacucccucuuuuuugauuuacugguacauuuuuaaaauaauaaaucugcc

SEQ ID NO: 221485 - RNA, 64 nt, Human
cucaugggagucagggagcccugggguuuccacacaggcccaugcccuccguccuggcagggca

SEQ ID NO: 221486 - RNA, 64 nt, Human
cagggauuaccugaaggccagcaggagccgggggcaggcccaggauccucagaggaagauggag

SEQ ID NO: 221487 - RNA, 64 nt, Human
cuuuuaguugaagcacucaggaaauauacuaaugcaggcccagacaccccagaagggcaagcuc

SEQ ID NO: 221488 - RNA, 64 nt, Human
agcugggcggacaggaccgucccucgcagggucccaggcccagaagaggccccacgccucuaga

SEQ ID NO: 221489 - RNA, 64 nt, Human
uuggcagcugcagcccccaugcagaagaggcucccaggcccaagcucugugugacccagagaaa

SEQ ID NO: 221490 - RNA, 64 nt, Human
uccgcugcccaaucucucagacccaccccaccugcaggcccagaccacgugggacagaacuccu

SEQ ID NO: 221491 - RNA, 64 nt, Human
caacuccacucacugaagcccagaccuccgugcccaggcccaaucucgucaggcugccagagaa

SEQ ID NO: 221492 - RNA, 64 nt, Human
gcugagccgggaggcccuugaggugaggacacagcaggcccaggaccauggcuggggaggauau

SEQ ID NO: 221493 - RNA, 64 nt, Human
uguguggcuccccucuucacugggcaccuggauccaggcccaccugugucccugacucagggug

SEQ ID NO: 221494 - RNA, 64 nt, Human
uacaaggcuucgucucaucugcugucugagcauccaggcccaaaggcacugagggagucaggag

SEQ ID NO: 221495 - RNA, 64 nt, Human
ugggugggcaguggccaagcugcuguuccuaugacaggcccacucaaccugggcagaccgagag

SEQ ID NO: 221496 - RNA, 64 nt, Human
uuuuuuuuuuuuuugauggaagaccaaggguugccaggcccacuguaacugccgagcugccugc

SEQ ID NO: 221497 - RNA, 64 nt, Human
uccacuaacaggaaacacuucucacccccucacacaggcccaggggagccccuggagggaaauu

SEQ ID NO: 221498 - RNA, 64 nt, Human
gguuggaggacugagcccacugcaccugcagccacaggcccaccccuccccacucccugauccc

SEQ ID NO: 221499 - RNA, 64 nt, Human
cuucuguuggcagaggacagccccuggggaaccccaggcccaacucuguccgguaucccuuuuc

SEQ ID NO: 221500 - RNA, 64 nt, Human
ggaaguggauuaucugccucgggagugggaauugcugguacaaagaccaaaacaaccaaaugcc

SEQ ID NO: 221501 - RNA, 64 nt, Human
uuaacaucuauuauaaaaccauguugauucccuucugguacaauccuuugaguuauaguuugcu

SEQ ID NO: 221502 - RNA, 64 nt, Human
aaaaauuacaucuuacuguugauauauguaugcucugguacacagaugucauuuuguugucaca

SEQ ID NO: 221503 - RNA, 64 nt, Human
gcaggaagaggcgcccugugaacccugaguguugcaggcccagcagacccugcugucccaagcc

SEQ ID NO: 221504 - RNA, 64 nt, Human
gauucgggcagccagggacaggagccacccuccccaggcccaacucugcuagcuucccagacca

SEQ ID NO: 221505 - RNA, 64 nt, Human
uucaaaaauuagucaauaaaaauugaugucagugcaggcccaggcccgcccccagauacacuag

SEQ ID NO: 221506 - RNA, 53 nt, Human
ccaaucacuacaagaaaugagcccaggcccacccgcagcuggccucacugucc

SEQ ID NO: 221507 - RNA, 64 nt, Human
gagggugacuuaccaagagccagggagggcagcccaggcccaagugacagcaagaacaagaacc

SEQ ID NO: 221508 - RNA, 64 nt, Human
guugauuccugggucuagcuugcaugccugggcccaggcccagccucuuguucuuagggcuugg

SEQ ID NO: 221509 - RNA, 64 nt, Human; identical to SEQ ID NO: 221489

SEQ ID NO: 221510 - RNA, 64 nt, Human
cccaggagccaaacucuugaagcacccccugggucaggcccagcagcggaguggccagccccag

SEQ ID NO: 221511 - RNA, 64 nt, Human
caaagcauuuucauuucuaauggcccaugggagccaggcccagaaagcaggaauggcuugccua

SEQ ID NO: 221512 - RNA, 64 nt, Human
accucaucucccuguggacuugggagcucugugccaggcccaccuugcggcccuggcucugagu

SEQ ID NO: 221513 - RNA, 64 nt, Human
ggcuguugcgcucccaccucagccccaaguuccccaggcccagugggguggccgggcgggccac

SEQ ID NO: 221514 - RNA, 64 nt, Human
auugaccaugaggccuugugaacaucaguggccacaggcccagugugcugcuuggcacugcacu

SEQ ID NO: 221515 - RNA, 64 nt, Human
uguucucugcauguaggaggucagcaggggugggcaggcccagcuggaggcagcugggugaggg

SEQ ID NO: 221516 - RNA, 64 nt, Human
cagcagcugggggucaagacguccccugaggacccaggcccacacccagcccuucugccuccca

SEQ ID NO: 221517 - RNA, 64 nt, Human
ugggugugccuagggccuacuucccaaggugccacaggcccaugaugggauguugaggggccug

SEQ ID NO: 221518 - RNA, 64 nt, Human
acuguguuuccuaccgaaacccugcagagggaaccugguacauccagucacuuugccagagccu

SEQ ID NO: 221519 - RNA, 64 nt, Human
uuugcaugguaagaauaaaauaagaauauugaaacugguacauuagcuaauucuauuacuacuu

SEQ ID NO: 221520 - RNA, 64 nt, Human
ccuguccuggugguauuuagccacuaaccuuugccugguacaguauggggguuguaaauuggca

SEQ ID NO: 221521 - RNA, 64 nt, Human
gggguggccgcccgcccccuugucccccaugcaacaggcccaguggcuuccccuucagggccac

SEQ ID NO: 221522 - RNA, 64 nt, Human
cacagucuggugcccagucuggcaugcagcuacccaggcccacccaucacgugugauugacaug

SEQ ID NO: 221523 - RNA, 64 nt, Human
cauucucuguugaggauguccagucagggcuugacaggcccaggcucagcccgccguggcuggg

SEQ ID NO: 221524 - RNA, 64 nt, Human
gccucgccugucacccccacucccgccucagggccaggcccaggccucaccaccugacgcugca

SEQ ID NO: 221525 - RNA, 64 nt, Human
cgggcuuaggcaggcuguugaggagcugugggagcaggcccagugggaggcuguggacaccccg

SEQ ID NO: 221526 - RNA, 64 nt, Human
cccaggggagcuggaguccagcuuggagcagccacaggcccagggagcuguagcaagaggguag

SEQ ID NO: 221527 - RNA, 64 nt, Human
ggccaaacuuuagccaagcuccucaaccuucucccaggcccaaucugggcacuuccuuguaaaa

SEQ ID NO: 221528 - RNA, 64 nt, Human
guacuccccuaucuccgagagcagcgacuaaguucaggcccagccgccagaccucagagaucuc

SEQ ID NO: 221529 - RNA, 64 nt, Human
uuugcuggcccacaguuuuugagggucaggaguccaggcccagcauaacuggguccucugcuca

SEQ ID NO: 221530 - RNA, 64 nt, Human
gcagcccccugggugccgcugucaggagcagagccaggcccagguggcuccagcugccuguccu

SEQ ID NO: 221531 - RNA, 64 nt, Human
ggggggugggcuuuguugugagaauggccuggagcaggcccaaugcugcuuuugggggucagca

SEQ ID NO: 221532 - RNA, 64 nt, Human
auugcuggcccugcuuucccugguagguauuugccaggcccaaugcuuuaaccuuaagcugaua

SEQ ID NO: 221533 - RNA, 64 nt, Human
ccccacaguaaaagaggaagucuuguaccucaggcaggcccaucuagagcuauugcuccuuccc

SEQ ID NO: 221534 - RNA, 64 nt, Human
auggggguggggguucccucuccaggugguuguccaggcccaugucccggcccugggugcucag

SEQ ID NO: 221535 - RNA, 64 nt, Human
cuacuccccuaucuccgagagcagcgacuaaguucaggcccagccgccagaccucagagaucuc

SEQ ID NO: 221536 - RNA, 64 nt, Human
cgaauuugagguagcaaaaaaaaaaaagaauguucugguacaugaacagacugagaaggccuuu

SEQ ID NO: 221537 - RNA, 64 nt, Human
gauuuccauuaaaugaugccucuguuuaauacaccugguacauuucugaagaggggcuuuauaa

SEQ ID NO: 221538 - RNA, 64 nt, Human
gggcccacacaguuaaccagcccauuucuccacacugguacaguagucaccugugaaaaaaaaa

SEQ ID NO: 221539 - RNA, 53 nt, Human
ucuccgagagcaccgacuaaguucaggcccagccgccagaccucagagaucuc

SEQ ID NO: 221540 - RNA, 64 nt, Human
aaugucuguccuguggccaugucccucagggugacaggcccaggaaccaaugcuacucauucug

SEQ ID NO: 221541 - RNA, 64 nt, Human
uaccagaccgugaacaccugcuuccucccucgggcaggcccagagagccagagguggguaggag

SEQ ID NO: 221542 - RNA, 64 nt, Human
auugucaacccugcuuucccugguagauauuugccaggcccaaugcuuuaaccuuaagcugaua

SEQ ID NO: 221543 - RNA, 64 nt, Human
ccacacccagcaguuucccuguccugugugaaaucaggcccauucuucccucuguguuugauga

SEQ ID NO: 221544 - RNA, 64 nt, Human
ccaccgugugagcugcccgggcggguacacggcccaggcccagggaacccccuggggccccggc

SEQ ID NO: 221545 - RNA, 64 nt, Human
ccuggccuugggauccaggccccucccucuccagcaggcccaugggaggcuggaguuggggcag

SEQ ID NO: 221546 - RNA, 64 nt, Human
ccaggucaggcuucggaggccacaagcucagccucaggcccaggcacugauuguggcagagggg

SEQ ID NO: 221547 - RNA, 64 nt, Human
ugucuucuuuaugaggauagaucaaauuggcagucaggcccaugauagucagugcaguuggggc

SEQ ID NO: 221548 - RNA, 64 nt, Human
aaaaauuuuacauuuguaaaauuaauauauuguacugguacaaaauaguuuuaaauuauauuuu

SEQ ID NO: 221549 - RNA, 64 nt, Human
ugcgugucaagccccaacagggcacagcagucuucugguacaacuaccugccugaugggcaagg

SEQ ID NO: 221550 - RNA, 64 nt, Human
cauagccugcagccucaucauuucccaucuggaccugguacaaaugcacgucacaggcucagcu

SEQ ID NO: 221551 - RNA, 64 nt, Human
ccuuuuuguaggagguaggauauuuuauauucugccgcaggauagaacccacgcaaggauuuuc

SEQ ID NO: 221552 - RNA, 64 nt, Human
uucuccggaaggcucuggccccaagcuggccggcccgcaggagccccauucucagagaaugugu

SEQ ID NO: 221553 - RNA, 64 nt, Human
cuuauuuauuaauagauuaaguucugaggcagcuccgcaggacugugugugaauguguauguau

SEQ ID NO: 221554 - RNA, 64 nt, Human
cucagucagaggcccccgucccuccuuuugccuuccgcaggacugaagaccugaaggggcuggc

SEQ ID NO: 221555 - RNA, 64 nt, Human
ggggcaguauugggggacugugcuagcuuuacccccgcaggacauacacaggagccuuugaucu

SEQ ID NO: 221556 - RNA, 64 nt, Human
cgggugggaaugaccccuaggcaaggggaugagaccgcaggaggaaauggcggggaggaggcau

SEQ ID NO: 221557 - RNA, 64 nt, Human
gaaccaagccagggaugggcuggccauuguguccccgcaggagagaugggcagaauggcccuag

SEQ ID NO: 221558 - RNA, 64 nt, Human
gacugagcucaaaggaacaggauggcacccagagccgcaggacggagacugggggcagcccuca

SEQ ID NO: 221559 - RNA, 64 nt, Human
cugaauguuuccaauagacuaaauacuguuuaggccgcaggagaguuuggaauccggaauaaau

SEQ ID NO: 221560 - RNA, 64 nt, Human
uugacuccuguggcuucuggaccccuccucugccccgcaggaggaaguuccacggcagguggug

SEQ ID NO: 221561 - RNA, 64 nt, Human
ucaguagccagcaucugccuccccuucacucccaccgcaggauuugggcucuuggaauccuggg

SEQ ID NO: 221562 - RNA, 64 nt, Human
cugugagcaggccccaugcccagcacgccagccaccgcaggauaccucagucauaccaguugua

SEQ ID NO: 221563 - RNA, 64 nt, Human
uguaauuugcuaacuugauuugaguuagugaaaacugguacaguguucugcuugauuuacaaca

SEQ ID NO: 221564 - RNA, 64 nt, Human
ccaagccuaauugugcaaccugauuacagaauaacugguacacuucauuuauccaucaauauua

SEQ ID NO: 221565 - RNA, 64 nt, Human
uucagugacuggcuugagucauaggaggaggagucugguacagcugcaggagagcagggccauc

SEQ ID NO: 221566 - RNA, 64 nt, Human
gacuaggacuugccacacacugccaauucauaauccgcaggaucuguagaagacauuuugggaa

SEQ ID NO: 221567 - RNA, 64 nt, Human
acuauuccauuagccuguggucugcaggguaggcccgcaggaaaugaggaauggccgagcugga

SEQ ID NO: 221568 - RNA, 64 nt, Human
gagugucccuggccccuuccugccaugggcaggcccgcaggaagagccgguagggguggaaagg

SEQ ID NO: 221569 - RNA, 64 nt, Human
uccauguagaauaaaugaagaaagggaggcccagccgcaggaaggcagaauaaauccuugggag

SEQ ID NO: 221570 - RNA, 64 nt, Human
gcuaaggggucaggccagauggggcaggaaggcuccgcaggaccggaccccuagaccacccugc

SEQ ID NO: 221571 - RNA, 64 nt, Human
acccuuaucugcggccggugaagaagcccaagauccgcaggaagaagugaguuggaggcugggg

SEQ ID NO: 221572 - RNA, 64 nt, Human
cuuuucacguuuucuuuacacacacguugacgggccgcaggagggaggcggggaggaggaacgg

SEQ ID NO: 221573 - RNA, 64 nt, Human
uggccgucaccucagacaucacuccagggagcacccgcaggagcugggcccccucacgccugcc

SEQ ID NO: 221574 - RNA, 64 nt, Human
gacgcaguucucggacgccgaggggcuggcgcucccgcaggacggccucuauuaccucuacugu

SEQ ID NO: 221575 - RNA, 64 nt, Human
guccacagacacacucacgcccgccaccugcuccccgcaggaugugucugugugugggaauugg

SEQ ID NO: 221576 - RNA, 64 nt, Human
cuaagccugcaguaggaucucagccacaagggccccgcaggauggagcugggucaaggaccagg

SEQ ID NO: 221577 - RNA, 64 nt, Human
ucaccgagaggcaggucaagaucugguuccagaaccgcaggaugaaaaugaagaaaaucaacaa

SEQ ID NO: 221578 - RNA, 64 nt, Human
agggaugccauguagccccagcuggaagugacuuccgcaggaauugagagggaauagcucaccc

SEQ ID NO: 221579 - RNA, 64 nt, Human
gccuguccucuccguggaggacccugggcccucaccgcaggaagcaguuuggguuuugaaaggu

SEQ ID NO: 221580 - RNA, 64 nt, Human
auugcugcugaccuuacgccuguauauuaagccuccgcaggaugccggacaauggugaagaaac

SEQ ID NO: 221581 - RNA, 64 nt, Human
uggaaagaagaacugauauggcuaguucagcuagcugguacagauaauucaaaacugcuguugg

SEQ ID NO: 221582 - RNA, 64 nt, Human
gacaggcccuuggaccagcuaagcgacagggaaccugguacauuauguuuaguuacuguuuucu

SEQ ID NO: 221583 - RNA, 64 nt, Human
auuuuguacuacaugaagaacuguuuuuugccugcugguacauuacauuuccggaggcuugggu

SEQ ID NO: 221584 - RNA, 64 nt, Human
gcagccccacucacagcugcugcaccaccaccuuccgcaggaugcacaggugaguacagugaug

SEQ ID NO: 221585 - RNA, 64 nt, Human
ugaugccguuggggcggaggcugcccuugcagcgccgcaggaacucggccaggugcugaucggu

SEQ ID NO: 221586 - RNA, 64 nt, Human
ccaggcagcccacagugcugcacguagccaugggccgcaggagugcauacaacccugcauccag

SEQ ID NO: 221587 - RNA, 64 nt, Human
acucgcagccccaucggacgcucucccgggaccgccgcaggaccaguuuccauagacugcggac

SEQ ID NO: 221588 - RNA, 64 nt, Human
cacacauacaacacagaucauuucccaguuagauccgcaggaaguagguugguggggguggaug

SEQ ID NO: 221589 - RNA, 64 nt, Human
ccuuugaaacugugaagccucgccccgcggccugccgcaggauauguuuugguaaauguagacu

SEQ ID NO: 221590 - RNA, 64 nt, Human
uguuccgugcaugcaguggaauaguaccagccuuccgcaggaaggaaauucugacauaugcggu

SEQ ID NO: 221591 - RNA, 64 nt, Human
acuccgcauccuugucccucugcauucccaguuuccgcaggagccuugaucaauggggaagccu

SEQ ID NO: 221592 - RNA, 64 nt, Human
ugccuggaggccauuugugccugccucugugcugccgcaggagggcaggccgcaagugggguug

SEQ ID NO: 221593 - RNA, 64 nt, Human
uuggucagaaucaauccuuuggugaaaguaagaaccgcaggaguugaguuuugguuugguccug

SEQ ID NO: 221594 - RNA, 64 nt, Human
gaugggaaaucugccuaugucauaccgugacagcccgcaggaucaggugacuucuagcagagac

SEQ ID NO: 221595 - RNA, 64 nt, Human
gcccugcccccgugaggaugucacucagauggaaccgcaggaagcugcuccgugcuuguuugcu

SEQ ID NO: 221596 - RNA, 64 nt, Human
aggggugcugugagaaggcugugcccauguggggccgcaggaauccccuguauguucagggcug

SEQ ID NO: 221597 - RNA, 64 nt, Human
uucucauauagcccucagucacugagggagucccccgcaggauuggagaggcacauucccuugg

SEQ ID NO: 221598 - RNA, 53 nt, Human
aauccuacacccugguguagggcccgcaggaagagcagccacgccuggaccgc

SEQ ID NO: 221599 - RNA, 64 nt, Human
uauugcuuccuaaagguauuuucacccucuucgccugguacagcccucacagcucuucagagca

SEQ ID NO: 221600 - RNA, 64 nt, Human
ccaaagguggcaguggcuacaucugccuguuggacugguacagguuacaauauguccucuucca

SEQ ID NO: 221601 - RNA, 64 nt, Human
aguaccaacaaugaacacauuauuuccuggucuacugguacaagucagcucugcuaccugggag

SEQ ID NO: 221602 - RNA, 64 nt, Human
ggccuggcuuccugguaaggaguuucagccgccuccgcaggaacccccaaagugcagauuccgg

SEQ ID NO: 221603 - RNA, 64 nt, Human
guaccuagucagaugguagacgagcugucugcugccgcaggagcaccucuauacaggacuuaga

SEQ ID NO: 221604 - RNA, 64 nt, Human
ugcauggcugagagccaggcuuccuuccuggucuccgcaggaggcuguggcagcuguggcaucc

SEQ ID NO: 221605 - RNA, 64 nt, Human
ggcucagcucgguacccggggcccagggcaagcuccgcaggacuuccccggagggcugcggcgu

SEQ ID NO: 221606 - RNA, 64 nt, Human
augcaaccacagugcauguugcagauaccggcggccgcaggaggggcagcauccaguagaggac

SEQ ID NO: 221607 - RNA, 64 nt, Human
aagacccuccugaggagugaagagugacaugccaccgcaggauccuuugcucugcacgaguuac

SEQ ID NO: 221608 - RNA, 64 nt, Human
ggcagaugagugggagacugguugcaaggugugaccgcaggaauccuggaggaauagagaguaa

SEQ ID NO: 221609 - RNA, 64 nt, Human
ggcagaugagugggagacugguugcaaggugugaccgcaggaauccuggaggaacagagaguaa

SEQ ID NO: 221610 - RNA, 64 nt, Human
ccuuuaguuuccugacaccuguguccugagugagccgcaggaguucuuagcuccucagcgagca

SEQ ID NO: 221611 - RNA, 64 nt, Human
caguggccaggauccaauacgaguccaggggugaccgcaggauggugggggcagcgggcuucuc

SEQ ID NO: 221612 - RNA, 64 nt, Human
uguguucacagaccucagcagggcaucgcauggaccgcaggagggcagauucggaccacuaggc

SEQ ID NO: 221613 - RNA, 64 nt, Human
ugccggaggacagccagcggcugcuuuguggacaccgcaggaaguuccucgggacacggcugcu

SEQ ID NO: 221614 - RNA, 64 nt, Human
aaugacgaagcugcucagcaacuccaccugcccgccgcaggaaggagcaguccccugcuauccc

SEQ ID NO: 221615 - RNA, 64 nt, Human
gcuccugccgccucuucccuaccuccuccacuagccgcaggaagggccuccagcacccacaacu

SEQ ID NO: 221616 - RNA, 64 nt, Human
ucccaggccaagcacacacaggcugcgcccaguuccgcaggagccgucccacagcguggcucuc

SEQ ID NO: 221617 - RNA, 64 nt, Human
ggcugaccugugcuuagaaguccuuuaaucugggcugguacaggccucagccuugcccucaaug

SEQ ID NO: 221618 - RNA, 64 nt, Human
ccugaaauugggacugucauguuauccagaagggcugguacauccgcccaccaugucccccugc

SEQ ID NO: 221619 - RNA, 64 nt, Human
acucuguuuuggcaccacacauguauauuucccccugguacacuuggaagacucuuauccaucu

SEQ ID NO: 221620 - RNA, 64 nt, Human
ucggggucugcaccccaggcacagcggugucaccccgcaggaccgcgggccugccccaaccccc

SEQ ID NO: 221621 - RNA, 64 nt, Human
ccggagggacggcagccccggucgcgcgcuggccccgcaggaccuuccuuuuccaggaagagcc

SEQ ID NO: 221622 - RNA, 64 nt, Human
guggggguggggguggggguggggguggaagcagccgcaggagcaagggccccucccacauaca

SEQ ID NO: 221623 - RNA, 64 nt, Human
aaauggccacugaguaggccccagaggucgcacuccgcaggaggacugaggccaugugccauuc

SEQ ID NO: 221624 - RNA, 64 nt, Human
accuaggaaaucucggugcacuaggaagugaaucccgcaggacagcugcacucagggauacgcc

SEQ ID NO: 221625 - RNA, 64 nt, Human
ggcagcagccagggacccccagaacaagaagaccccgcaggaucccuccugagcucggggggcu

SEQ ID NO: 221626 - RNA, 63 nt, Human
uuguauuguugccggcaugacaccgcgggacggccgcaggacgcaggcgagggccgcacggcu

SEQ ID NO: 221627 - RNA, 64 nt, Human
ccaaccugucccacccccgugcccccuccuuaccccgcaggacgggccuacaggggggucuccc

SEQ ID NO: 221628 - RNA, 64 nt, Human
gaggacgcagagugcaggcuguggccucggcaucccgcaggaggucccuagaacaugccguuuc

SEQ ID NO: 221629 - RNA, 64 nt, Human
ccuccaugaccugcgcucucagcugaccaucaucccgcaggaccccauccuguucucggggacc

SEQ ID NO: 221630 - RNA, 64 nt, Human
ggccgccuggcagaaucuagcaccguccgaauccccgcaggacccauggagcuaugaccacacc

SEQ ID NO: 221631 - RNA, 64 nt, Human
ccgccugauuucgcucgggcuucgggugacuucgccgcaggaccuacccagcucgcucacuucg

SEQ ID NO: 221632 - RNA, 64 nt, Human
aggcagguaggcugcagccaggagcucccuggcaccgcaggaccucgugguacucuugccuuag

SEQ ID NO: 221633 - RNA, 64 nt, Human
uugcacaggguggggcgcgcaguaggaaccucccccgcaggagcuggcgcccucucgcuccugc

SEQ ID NO: 221634 - RNA, 64 nt, Human
ccucccaggccccuuguggacuuagacucaaaacccgcaggagaaacagguccgacucaguaug

SEQ ID NO: 221635 - RNA, 64 nt, Human
uauauauauauaacauauauggaagaggaaaaggcugguacaacggaggccugcgacccugggg

SEQ ID NO: 221636 - RNA, 64 nt, Human
gugaauaguugccucuuuuuagccauuuucauggcugguacauauucguacgcauuacuuuuca

SEQ ID NO: 221637 - RNA, 64 nt, Human
cucccucuccucuggcugcuacaacuuccccuuucugguacaagaagaaccauucuuuaaaggu

SEQ ID NO: 221638 - RNA, 64 nt, Human
gugcaggccaugugagcccugccucuuuaaggagccgcaggacaugaaagaugaccuugugaca

SEQ ID NO: 221639 - RNA, 64 nt, Human
gccgcggggcucucugggccgguucccugcagacccgcaggagagcacaugugccuugcaugaa

SEQ ID NO: 221640 - RNA, 64 nt, Human
cuccuggucugugaagagccgguggugcccgugcccgcaggaacugggcugggccucgugcgcc

SEQ ID NO: 221641 - RNA, 64 nt, Human
cauuauucaagagaccaccugacaugcaucuccuccgcaggaauacauucguccucucuuagag

SEQ ID NO: 221642 - RNA, 64 nt, Human
aaaggaaugcagugcucaaaaccuacccaaauucccgcaggauucuaccaaacccuuccccagg

SEQ ID NO: 221643 - RNA, 64 nt, Human
gggccagcagccgcgaaccuugaagcuggggugaccgcaggagacccuguaaggccugugagcg

SEQ ID NO: 221644 - RNA, 64 nt, Human
ggacgggagcuccacugugaaucggcggcacgcgccgcaggaggcugggacugguccaguuugu

SEQ ID NO: 221645 - RNA, 64 nt, Human
agacgcaacguuuccaacucucgggacgccaaggccgcaggacuggagggccaggccccgccac

SEQ ID NO: 221646 - RNA, 64 nt, Human
gccgcuguggucuggcccccucccuguccaggccccgcaggaggcagaugcagucccaggcauc

SEQ ID NO: 221647 - RNA, 64 nt, Human
aagcacaaccagcucgcccucccccuacccggggccgcaggacgcugagacgguuugggggugg

SEQ ID NO: 221648 - RNA, 64 nt, Human
agcucacguggccuuuaaaaaccuacuuccccgcccgcaggagcucagagcaucgcugggccug

SEQ ID NO: 221649 - RNA, 64 nt, Human
aucagaagcccugggguuccuggccccccgugagccgcaggaggaugcguugccugcagugcag

SEQ ID NO: 221650 - RNA, 64 nt, Human
caaagccaaagccgaaugagaacggugucucugcccgcaggacgccugcccccagcccccgcag

SEQ ID NO: 221651 - RNA, 64 nt, Human
aacccagaugccugaggccuggcuggggcugcccccgcaggacacuguggccaugccacggagg

SEQ ID NO: 221652 - RNA, 64 nt, Human
ccgaguaggggugggggugggauggcaggaggagccgcaggaggaaggagguugugcagggucu

SEQ ID NO: 221653 - RNA, 64 nt, Human
cugaguaaagaugucagaaaaggaaagcaauggucugguacaagucuuguauagaacaagaagu

SEQ ID NO: 221654 - RNA, 64 nt, Human
uuggggcuggcccauagcagugccugccgugccucugguacaucuguagccaauucccauauca

SEQ ID NO: 221655 - RNA, 64 nt, Human
uuucaguguguggaguugugguuguaguguuugccugguacaucacccaugaugucaauuaaaa

SEQ ID NO: 221656 - RNA, 64 nt, Human
gguaagugaguucacaccuagaacacuguccugaccgcaggacgcgugccuuggacuugguauu

SEQ ID NO: 221657 - RNA, 64 nt, Human
ugagccagauccauggcaauggucuccccacagaccgcaggacugagccuggagagagaaguug

SEQ ID NO: 221658 - RNA, 64 nt, Human
ugcuugucuggccaugaucuggagagcaucaggcccgcaggacugcacaacucugccaggggug

SEQ ID NO: 221659 - RNA, 64 nt, Human
gugucccccaccccaucagcugggaaagcccaggccgcaggagugggaugcccguuggacuuug

SEQ ID NO: 221660 - RNA, 64 nt, Human
ggccauccguggaggaggggccgguccuggacucccgcaggacuccucugaggcagggccugaa

SEQ ID NO: 221661 - RNA, 64 nt, Human
guuagaguguacucugaaaccaacucgucucuggccgcaggagucuauauguuuucguaaucuu

SEQ ID NO: 221662 - RNA, 64 nt, Human
aguggcugaguuacuugcugcccugugcuccuccccgcaggacauggcucccccuccaccugcu

SEQ ID NO: 221663 - RNA, 64 nt, Human
uuuuuguuuugcccucuggguguuuucuuuggucccgcaggaggguggguggagcagguggacu

SEQ ID NO: 221664 - RNA, 64 nt, Human
aucuccauugguggccccagcucaguaacuauaccugguacauuuccugugugcaaucaguacc

SEQ ID NO: 221665 - RNA, 64 nt, Human
cuuuucccuaccccagccccugugccaggcuaagcugguacaagagcugccaaccucacagagu

SEQ ID NO: 221666 - RNA, 64 nt, Human
uuugccuaggcaaaaaucuaagacucgugcccuccugguacaugggguuuuaagacugaaugug

SEQ ID NO: 221667 - RNA, 64 nt, Human
caucaccacccuuccagggccugagcagcuggaucugguacaaagcaaucggacauagaguugg

SEQ ID NO: 221668 - RNA, 64 nt, Human
cauuugccccuaucaguugcuccucaggaaucuucugguacagguuaacaucagcauuuucauu

SEQ ID NO: 221669 - RNA, 64 nt, Human
gagaaggcagggaaguauacaagcagagccaguucugguacaaacaaagaauuugacagggaca

SEQ ID NO: 221670 - RNA, 64 nt, Human
cugugcuguaaaauacugucauacuugcuauuuccugguacaguguaguuuuuccccuuucauu

SEQ ID NO: 221671 - RNA, 64 nt, Human
auacugucauggaggugcugaacacagggaaggucugguacauauuggaaauuaugagcagaac

SEQ ID NO: 221672 - RNA, 64 nt, Human
aaugaagucaugucuuuaaagugcuuaauagugccugguacaugggcagugcccaauaaacggu

SEQ ID NO: 221673 - RNA, 64 nt, Human; identical to SEQ ID NO: 220996

SEQ ID NO: 221674 - RNA, 64 nt, Human; identical to SEQ ID NO: 220997

SEQ ID NO: 221675 - RNA, 64 nt, Human; identical to SEQ ID NO: 220998

SEQ ID NO: 221676 - RNA, 64 nt, Human; identical to SEQ ID NO: 220438

SEQ ID NO: 221677 - RNA, 64 nt, Human; identical to SEQ ID NO: 214224

SEQ ID NO: 221678 - RNA, 64 nt, Human; identical to SEQ ID NO: 221015

SEQ ID NO: 221679 - RNA, 64 nt, Human; identical to SEQ ID NO: 221016

SEQ ID NO: 221680 - RNA, 64 nt, Human; identical to SEQ ID NO: 220366

SEQ ID NO: 221681 - RNA, 64 nt, Human; identical to SEQ ID NO: 214225

SEQ ID NO: 221682 - RNA, 64 nt, Human; identical to SEQ ID NO: 221087

SEQ ID NO: 221683 - RNA, 64 nt, Human; identical to SEQ ID NO: 221088

SEQ ID NO: 221684 - RNA, 64 nt, Human; identical to SEQ ID NO: 221232

SEQ ID NO: 221685 - RNA, 64 nt, Human; identical to SEQ ID NO: 214226

SEQ ID NO: 221686 - RNA, 64 nt, Human; identical to SEQ ID NO: 221142

SEQ ID NO: 221687 - RNA, 64 nt, Human; identical to SEQ ID NO: 220211

SEQ ID NO: 221688 - RNA, 64 nt, Human; identical to SEQ ID NO: 214227

SEQ ID NO: 221689 - RNA, 64 nt, Human; identical to SEQ ID NO: 220194

SEQ ID NO: 221690 - RNA, 64 nt, Human; identical to SEQ ID NO: 220195

SEQ ID NO: 221691 - RNA, 64 nt, Human
ccuuaaggggaccguggcccccaccagggacguccugcgccauccguucacgucucugcaucca

SEQ ID NO: 221692 - RNA, 64 nt, Human
uuccugugugugcucugggcccugccucggccuccugcgccaauacugugacuuccaaacaaug

SEQ ID NO: 221693 - RNA, 64 nt, Human
ugcugggcacagcucugcguugcucccgugcugccugcgccagccccaggcugcugaggagcag

SEQ ID NO: 221694 - RNA, 64 nt, Human
ccgagauccacugagggccucgccuggcugcagccugcgccaccgcccagagacccaagcugcc

SEQ ID NO: 221695 - RNA, 64 nt, Human
gugaccugugugcuggcaggacgacucacugcggcugcgccacugggaccccuccccuacaugc

SEQ ID NO: 221696 - RNA, 64 nt, Human
uugauguuuccagguuuucaaaacugcauuuaaccugcgccagagaguucaccguaggcaucuu

SEQ ID NO: 221697 - RNA, 64 nt, Human
gcuuggguagugagugacaugugcacacguccagcugcgccaucaccagcccugcgcaacagga

SEQ ID NO: 221698 - RNA, 64 nt, Human
acuacccuguacccuuccuucuuccccaauaugccugcgccaucuucacauucugaaguugaaa

SEQ ID NO: 221699 - RNA, 64 nt, Human
gacaugcuggcuuuugugcccaagcucaccagcccugcgccaccucacugcaguagugcaccau

SEQ ID NO: 221700 - RNA, 64 nt, Human
cuugcagauauagaaauaggggaggagcucaggucugcgccaggcaggaagaaggcaggcuucu

SEQ ID NO: 221701 - RNA, 64 nt, Human
ggugcccaggcucccucccuuggcguccuucuuccugcgccaaacccaucucauccuuaagauc

SEQ ID NO: 221702 - RNA, 64 nt, Human
uacccacucuggcugccguuguccuguccugcuucugcgccagaguguuuaauaagcacucccu

SEQ ID NO: 221703 - RNA, 64 nt, Human
cgaggagugaaggacccaugucccaggaaccgcgcugcgccaccugcacucaccccccucacau

SEQ ID NO: 221704 - RNA, 64 nt, Human
gaaguggcuuguuacccaagggugccucacucaucugcgccaccaggaagaugaacugugaggg

SEQ ID NO: 221705 - RNA, 64 nt, Human
gcccgcugcugcugcucgcuuacuucagucgccucugcgccaagggcgacauccccccgccgcu

SEQ ID NO: 221706 - RNA, 64 nt, Human
ucugaggagcaaugggacaugagugucccuguaucugcgccacugccgcaagggaagccucagg

SEQ ID NO: 221707 - RNA, 64 nt, Human
ugauccaaaauuauuuacugagugccuaccuacucugcgccaggcucucuagccucucacuacu

SEQ ID NO: 221708 - RNA, 64 nt, Human
cauccaauuucucuguuuccucaggaagucauuacugcgccaccacaucacaugaccuuaacau

SEQ ID NO: 221709 - RNA, 64 nt, Human
gccacagcaggcaucacggugcgacgugagaugccugcgccagccccgagcccacuggcagcca

SEQ ID NO: 221710 - RNA, 64 nt, Human
ugucuuuugaaaucagaccuuauccaugaggcugcugcgccauguugcacuaaaggaagaggaa

SEQ ID NO: 221711 - RNA, 64 nt, Human
gaggguccugaccugggggcuucuccaagccucacugcgccagccuccccgcccgcucucuuuu

SEQ ID NO: 221712 - RNA, 64 nt, Human
aaccgguccccgucgcagacggagugcacgugcccugcgccacauccucacgcucgguggaggg

SEQ ID NO: 221713 - RNA, 64 nt, Human
cgcugugugucggcuccagcaguaaccguccucacugcgccacgcacuccucuguagaugugug

SEQ ID NO: 221714 - RNA, 64 nt, Human
cccugcaacggaggaggacagugagacgaugccacugcgccacgcucgccccugcacacucaca

SEQ ID NO: 221715 - RNA, 64 nt, Human
cucaagaagcacaccuacagagcaccuguagcugcugcgccacccaccaucaaaggaauauaag

SEQ ID NO: 221716 - RNA, 64 nt, Human
cuccacuucugggcugaagccuccccaagccccgcugcgccaaccuguguggggucuucuucgg

SEQ ID NO: 221717 - RNA, 64 nt, Human
cugggcccuucuacuggugaacuuucaucaagaucugcgccaugccgugucacuaucaagccau

SEQ ID NO: 221718 - RNA, 64 nt, Human
cacaacuguacaguccagcuguagcuaucuucaccugcgccaauugugagggcgcuuuagcauu

SEQ ID NO: 221719 - RNA, 64 nt, Human
gggacuagugagucagcaccuuggcccaggagcucugcgccaggcagagcugagggcccugugg

SEQ ID NO: 221720 - RNA, 64 nt, Human
ucuuuucaccugucucagucuuccgcaggcuuaccugcgccaggaagucuaaccaaggaacaag

SEQ ID NO: 221721 - RNA, 64 nt, Human
cauuccaugaggaacuuuccccuucagaucaccucugcgccacaucucauccaugccuccucca

SEQ ID NO: 221722 - RNA, 64 nt, Human
ugcuccaggcaugugggaagcugaagcggcagcucugcgccaucuaccggcugaacuuucugac

SEQ ID NO: 221723 - RNA, 64 nt, Human
ggccucccugcgcucccagccccucgugggagaccugcgccagaggauggacaaguuugucaag

SEQ ID NO: 221724 - RNA, 64 nt, Human
ccucgaauuccacagacgaaguacuuucuuuugucugcgccaagaggaauguguucagaagcug

SEQ ID NO: 221725 - RNA, 63 nt, Human
uguaaaaugguguauauauguauaaauaaaaucucugcgccagaaucucgggccccuggcucc

SEQ ID NO: 221726 - RNA, 64 nt, Human
gaucacugugggcuggagaggagaaggaaagggucugcgccagcccuguccgucuucacccauc

SEQ ID NO: 221727 - RNA, 64 nt, Human
agggguggucuguuucuuccccuccuacgaguaccugcgccagguccaugcccacugggagaag

SEQ ID NO: 221728 - RNA, 64 nt, Human
guggacacagccuuccuccccaagcacguggucucugcgccaggcagcccgggcgucagagcuc

SEQ ID NO: 221729 - RNA, 64 nt, Human
cugcaagcggggcgccuuccaccuggcugggggucugcgccacaguuugguccagaggagggag

SEQ ID NO: 221730 - RNA, 64 nt, Human
ucugacauuuguuuggaaucgugccacugcuggucugcgccagauguaccguccuuuccaauac

SEQ ID NO: 221731 - RNA, 64 nt, Human
agccgcuuccucccgcaagcagcccggguccgcacugcgccaggagccgccugcgaccgcccgg

SEQ ID NO: 221732 - RNA, 64 nt, Human
gcuucaggccacgagagccccuucacccgcccugcugcgccauaggcagaggcuuauaaagaaa

SEQ ID NO: 221733 - RNA, 64 nt, Human
aacaacccacccgucgcccuucuccguaugcugccugcgccagaagagcuuugcugggcccugg

SEQ ID NO: 221734 - RNA, 64 nt, Human
gccugugcuccauggggggacggcuccacccagccugcgccacuguguucuucucuuaagaggc

SEQ ID NO: 221735 - RNA, 50 nt, Human
agcggguugcccgccgcugacugcgccaggaugcacagaccgaccgacag

SEQ ID NO: 221736 - RNA, 63 nt, Human
ucaaccgcuuccaggacuagcccccgcaggggccugcgccaccccguccuggugaauaaacgc

SEQ ID NO: 221737 - RNA, 64 nt, Human
uuugagccucagaccccaggucagcaucucgguucugcgccacuuccuuuguguuuauauggcg

SEQ ID NO: 221738 - RNA, 64 nt, Human
ucgugcagaggcacgggaugagucugggugaccucugcgccaugcgugcgagacacgugugcgu

SEQ ID NO: 221739 - RNA, 64 nt, Human
gcacccaggucagagcagacccuccccugccggccugcgccagcuggaccugauggcccccugu

SEQ ID NO: 221740 - RNA, 64 nt, Human
accugagaccgggccggugggcgcccauuugggacugcgccacccccaggcuuguucuuguuuu

SEQ ID NO: 221741 - RNA, 64 nt, Human
guacuagcuuggcccgccuuccgccagccgcgcccugcgccaccuacccgggguccuccacagc

SEQ ID NO: 221742 - RNA, 64 nt, Human
acugccuggggacacggacuucugcugcugccaccugcgccagcccuaccuuccaccacagaug

SEQ ID NO: 221743 - RNA, 64 nt, Human
gcuggccugcaccggaagacucacuuugucugcccugcgccagccucaccucacccugcaguuc

SEQ ID NO: 221744 - RNA, 64 nt, Human
ccaggcgcccaguggagccguuugggagaauugccugcgccacgcagcggggccggacaggccg

SEQ ID NO: 221745 - RNA, 64 nt, Human
ugugauaaaggaaaaauucuuuccugcccaggaccugcgccauccuuuaggccgaccuugguca

SEQ ID NO: 221746 - RNA, 64 nt, Human
cgauguauggaaauaaaggcccuuuuccuccuggcugcgccaguuuuccugccuguuccuucag

SEQ ID NO: 221747 - RNA, 64 nt, Human
gccccuuucucagggggcguggccacaccacacacugcgccagugacacauaguuacuuccugg

SEQ ID NO: 221748 - RNA, 64 nt, Human
cuccuccuccuccuccgucugucuccuuucaccucugcgccaggucgguccucccugccaaccu

SEQ ID NO: 221749 - RNA, 64 nt, Human
cagcucgcgcccuccugaggcccugauggcagcucugcgccaggccacagcagccgcccgcugc

SEQ ID NO: 221750 - RNA, 64 nt, Human
cucccuggcuccuccgucugacccucugcggccacugcgccacugccaucggacaggaggauuc

SEQ ID NO: 221751 - RNA, 64 nt, Human
cgggaaggacuuccucuuuacacccacagaggugcugcgccaccggaagcagcacgugugagcu

SEQ ID NO: 221752 - RNA, 64 nt, Human
guccucgggacuccucgcucccacccggaggaggcugcgccagcuuuaggccccgcccuccucc

SEQ ID NO: 221753 - RNA, 64 nt, Human
gccucauaaaagguggcugugggucgucaggaaucugcgccaucuuccuggggcuucugcgcug

SEQ ID NO: 221754 - RNA, 64 nt, Human
uccccgcccgcaggagcucagagcaucgcugggccugcgccagagugaggggugcaggaagaca

SEQ ID NO: 221755 - RNA, 64 nt, Human
uaaguacuuuagcuucuuucugcagccauuucaucugcgccaacacuuuggaaccuaauacugu

SEQ ID NO: 221756 - RNA, 55 nt, Human
gccggcugcaggaccagugaggggccugcgccaguccugcuaccucccuugccuu

SEQ ID NO: 221757 - RNA, 64 nt, Human
uaguaaaugcuugaugagaagaacacaucaggcacugcgccaccugcuucacaguacuucccaa

SEQ ID NO: 221758 - RNA, 64 nt, Human
uggcccccacccugcgggaggccuccccaugugccugcgccaagagacagacagagaaggcugc

SEQ ID NO: 221759 - RNA, 64 nt, Human
gaagggccccuggccugagaucuagacaaccuagcugcgccaagaccugcuguguaaagugguc

SEQ ID NO: 221760 - RNA, 64 nt, Human
cagcuacagggaaugauuggucauggggaagucucugcgccauaagccacgaucccagcgcaaa

SEQ ID NO: 221761 - RNA, 64 nt, Human
gaacccaggagguggagguugcagugaacugagacugcgccacggcacuccagccugggcgaca

SEQ ID NO: 221762 - RNA, 64 nt, Human
gcuguccguccagugagcggcccagaccccaccucugcgccauugucaccagggcccuguccug

SEQ ID NO: 221763 - RNA, 64 nt, Human
aaucuguggcccuucaucaugcuaagaacaagaacugcgccauggcuggcuccuucucuucucc

SEQ ID NO: 221764 - RNA, 64 nt, Human
cugcuccaaagaaauuuuggagugaguggcaguccugcgccagccucgcgggacacguguugua

SEQ ID NO: 221765 - RNA, 64 nt, Human
aggacguucgccaagggccguguguaaauacgaacugcgccauggagaggagaggcacugccgg

SEQ ID NO: 221766 - RNA, 64 nt, Human
acuggcacagccccacacugucagugccaagaggcugcgccaggccacucucucagcccagggc

SEQ ID NO: 221767 - RNA, 64 nt, Human
cgggcggcacccugcacagagcuccugggccagccugcgccagggaugcugcugagcugggagc

SEQ ID NO: 221768 - RNA, 64 nt, Human
uagagagccagccagcaauggaaccuucugguuccugcgccaaucgccaccaguaucaauugug

SEQ ID NO: 221769 - RNA, 62 nt, Human
agaugccacgguacaccugaauucagaaaagucugcgccagguugaaagugaaacuuugagc

SEQ ID NO: 221770 - RNA, 64 nt, Human
cuucuggcagcgagccuucaaugccaccucguuccugcgccacauccggaagcuggggcagauc

SEQ ID NO: 221771 - RNA, 64 nt, Human
cguggggaggcaggcaccgggcaugucggcgccucuggucaaaccaccuacacugccuggggug

SEQ ID NO: 221772 - RNA, 64 nt, Human
gccaaaguuaggccacaccaggcccaacccugugcuggucaagccagggcagucacagcugcuu

SEQ ID NO: 221773 - RNA, 64 nt, Human
auacgccuuuaaagguuuuuaaauuguuucauaucuggucaaguugagauuuuuaagaacuuca

SEQ ID NO: 221774 - RNA, 64 nt, Human
uguauaauuucugucacuagugucauacaguuuucuggucaacaugugugaucuuugugucucc

SEQ ID NO: 221775 - RNA, 64 nt, Human
gagcacuugaaaaugaaaugacugucuaagagaucuggucaaagcaacuggauacuagaucuua

SEQ ID NO: 221776 - RNA, 64 nt, Human
cuuauagcguuuccuccucgaaauucuaccaagacuggucaaauguugcugaggggccuggacc

SEQ ID NO: 221777 - RNA, 64 nt, Human
ucuuagaggccuccuaacacugacagaaacuuuucuggucaaaaaugaaagguccugguaccau

SEQ ID NO: 221778 - RNA, 64 nt, Human
agggagaaaaauaaaaggaagccauagaauugcucuggucaaaaccaagcacaccauagccuua

SEQ ID NO: 221779 - RNA, 64 nt, Human
caagagaagcucucuaaacaaaggaguacccucucuggucaaguaccuuugguaaauacaccau

SEQ ID NO: 221780 - RNA, 50 nt, Human
caaguacaagugcaaauuaacuggucaagugugucagugacugcacauug

SEQ ID NO: 221781 - RNA, 64 nt, Human; identical to SEQ ID NO: 64116

SEQ ID NO: 221782 - RNA, 64 nt, Human; identical to SEQ ID NO: 64132

SEQ ID NO: 221783 - RNA, 64 nt, Human
cauuacaauugucuacagaucacauccauucuggcuggucaacaugcaugcuguacuggcuguu

SEQ ID NO: 221784 - RNA, 64 nt, Human
acagagcugcaauaagaaauaaccaaagaugaagcuggucaaauauuuucauaacuugcuucug

SEQ ID NO: 221785 - RNA, 64 nt, Human
uggcaaggcuuaggaaagugauaugcauuuccugcuggucaaguuguaaauuaguauagcuacu

SEQ ID NO: 221786 - RNA, 64 nt, Human
ggaggggagcaggggagggaaagaaaccaggcaucuggucaaaccagcagaucaaaaagcacaa

SEQ ID NO: 221787 - RNA, 64 nt, Human
cacuuguccacauagguuuagagauaagaguuggcuggucaacuugagcauguuacugacagag

SEQ ID NO: 221788 - RNA, 64 nt, Human
ucuuuuguuucuugguccacucugucacucugcucuggucaagccccauuuggucuacagccca

SEQ ID NO: 221789 - RNA, 64 nt, Human
gcaggcaugggcuguacccaagcugauuucucaucuggucaauaaagcuguuuagaccagaacu

SEQ ID NO: 221790 - RNA, 64 nt, Human
aauuaaacacauugagaaugcaacacuauaaaagcuggucaaauuuuugcagagcccuuauucu

SEQ ID NO: 221791 - RNA, 64 nt, Human
uuucaauuugugcacaugccucuuguucaauggccuggucaacaucaacaaccccucccucuga

SEQ ID NO: 221792 - RNA, 64 nt, Human
guggaucacuugaggucaggaguuccuaaccagccuggucaacauggugaaaccccgucucuac

SEQ ID NO: 221793 - RNA, 64 nt, Human
uaaagagcagaugcuucagaaccaucagaagguucuggucaacagucaguauuaucucuuaaau

SEQ ID NO: 221794 - RNA, 64 nt, Human
guccaggucacuuuauucuguaacucuccauucacuggucaaauaacuccaugaggcuaucagu

SEQ ID NO: 221795 - RNA, 64 nt, Human
cuuguaaaggugcuccucuuuuuucuugucauugcuggucaagauuacuaauauuugggaaggc

SEQ ID NO: 221796 - RNA, 64 nt, Human
cgaggugggcagaucacuugagaucaggaccagccuggucaagauggugaaacuccgucuguac

SEQ ID NO: 221797 - RNA, 64 nt, Human
acuuaagacacacaaagcagauuuucagaagugucuggucaagauaacaugcuggccaaccaca

SEQ ID NO: 221798 - RNA, 64 nt, Human
ugauggauuuuguagcuugcugcuuguuucaccacuggucaaauuuuaaccauuaaauugccau

SEQ ID NO: 221799 - RNA, 64 nt, Human; identical to SEQ ID NO: 64098

SEQ ID NO: 221800 - RNA, 51 nt, Human; identical to SEQ ID NO: 64102

SEQ ID NO: 221801 - RNA, 64 nt, Human; identical to SEQ ID NO: 64133

SEQ ID NO: 221802 - RNA, 64 nt, Human
uaguagggcaguaacaguuacuuuugagaguuuucuggucaagcuuuuaccaggcauucucuag

SEQ ID NO: 221803 - RNA, 64 nt, Human
ggcgagacuucugugagugaagaggaaggggucucuggucaaacccagcccccagggccuaggg

SEQ ID NO: 221804 - RNA, 64 nt, Human
gggccccaccuucgcuguguucuugcugcaaagucuggucaauaaaucacugcacuguugccuu

SEQ ID NO: 221805 - RNA, 64 nt, Human
gaggaucaccugaugucagggguuugagaccagccuggucaacauugcaaaaccuugucucuac

SEQ ID NO: 221806 - RNA, 64 nt, Human
agggguccagacagcugaccagacagcuugacagcuggucaagacggucacgggagcucuaggu

SEQ ID NO: 221807 - RNA, 64 nt, Human
ggaucacuuuaggccugguguguucaagaccagccuggucaacauagugagacacugucucuac

SEQ ID NO: 221808 - RNA, 64 nt, Human
aaguugauauuuucucuucuccgaguucauggagcuggucaagugcagcaguuggcuuuagagg

SEQ ID NO: 221809 - RNA, 64 nt, Human
ccauccauaaauccaguucuacuauggcugaguucuggucaaagaaagaaaguuuagaagcuga

SEQ ID NO: 221810 - RNA, 64 nt, Human
gcagaucacuugaggucaggaguuugagauuggccuggucaacauggugaaauccugucucuac

SEQ ID NO: 221811 - RNA, 64 nt, Human
aaagugcugggauuacaggcaugagccaucacaccuggucaacuuucuuuugauuaguguuuuu

SEQ ID NO: 221812 - RNA, 64 nt, Human
caugcaaaugagcucugaaaucuucccaugcauucuggucaagggcugucauugcacauaagcu

SEQ ID NO: 221813 - RNA, 64 nt, Human
agaaaugcuuacaggauguuuuucuguaaccauccuggucaacuuagcagaaaugcugcgcugg

SEQ ID NO: 221814 - RNA, 64 nt, Human
gaagcugagcugcuaaaugaauaucccugcucugcuggucaauaaaacgcuuccuaauagcagc

SEQ ID NO: 221815 - RNA, 64 nt, Human
ggaguuaugggcccaccaggcaagccugggccuucuggucaaccuggccguccggggcccccag

SEQ ID NO: 221816 - RNA, 64 nt, Human
ucuagaggcuggcugcauucccaggcuccaguggcuggucaagcuuuucucacauggcaucacu

SEQ ID NO: 221817 - RNA, 64 nt, Human
uuccagccugcggugcugucugcugggaggucagcuggucaaggcagaggaggagaggaggaaa

SEQ ID NO: 221818 - RNA, 64 nt, Human; identical to SEQ ID NO: 64134

SEQ ID NO: 221819 - RNA, 64 nt, Human; identical to SEQ ID NO: 64135

SEQ ID NO: 221820 - RNA, 64 nt, Human; identical to SEQ ID NO: 64136

SEQ ID NO: 221821 - RNA, 64 nt, Human
gucccaagccugcccgggggcccugcggugaacacuggucaagcucucuccggcugggaugauc

SEQ ID NO: 221822 - RNA, 64 nt, Human
cccaucagaaauaacuuuuuaucuugcucaaguucuggucaacuaguagccugacggcuuagaa

SEQ ID NO: 221823 - RNA, 64 nt, Human
uacuuuuugccuuguguaguuaaaaauuaaggggcuggucaauacaaaaacuuguacacaaaua

SEQ ID NO: 221824 - RNA, 64 nt, Human
ucccauugugcuuuagguuuccagccaauggauucuggucaacugguggagauuggcugacacc

SEQ ID NO: 221825 - RNA, 64 nt, Human
auuuucuuuauucaaaugaaaacauguuugaugacuggucaaaaaauaagcucauaaucuauuu

SEQ ID NO: 221826 - RNA, 64 nt, Human
gcaugaucaagcuuaguaucuugguuuuugaacucuggucaacuggauauguuugucauuuugu

SEQ ID NO: 221827 - RNA, 64 nt, Human
cugccuguuccuugaaucugaaagagcauuauuccuggucaaagcuccuuaaaguucugggcag

SEQ ID NO: 221828 - RNA, 64 nt, Human
cucacagacguuccuguuuuuugugauugagaaacuggucaaugaacaggaagacuuagagaug

SEQ ID NO: 221829 - RNA, 64 nt, Human
gcagaucacuugaggucaggaguucaagacuagccuggucaacauggugaaacccugucucuac

SEQ ID NO: 221830 - RNA, 64 nt, Human
guuuggcagguaacaaaaaauugagacccagacacuggucaacaggaaaacaauacagacuccc

SEQ ID NO: 221831 - RNA, 64 nt, Human
uacccacauccugcauuuuaaggucuaaguuuaacuggucaacauuuaaauggauuggagcuau

SEQ ID NO: 221832 - RNA, 64 nt, Human
gcucuuugucugcauuaagagaggaugaggagagcuggucaaacauuccuuguguuaaaaaaau

SEQ ID NO: 221833 - RNA, 64 nt, Human
aguggguggaucacuugaggaguucaagaccagccuggucaacaugucaaaacccuguaccuac

SEQ ID NO: 221834 - RNA, 64 nt, Human
gaggggagugcacuuauuuauuuaacuuacuuaucuggucaaagccccaggaaaccuaccaaag

SEQ ID NO: 221835 - RNA, 64 nt, Human
ccaagcccagccccuaggaggggguggggcaucccuggucaacccucaaacauuccggacuccc

SEQ ID NO: 221836 - RNA, 64 nt, Human
gcuuugaaauuugauaacaaaucaucaacuuccacuggucaauauauagauuuugggugucuga

SEQ ID NO: 221837 - RNA, 64 nt, Human; identical to SEQ ID NO: 64137

SEQ ID NO: 221838 - RNA, 64 nt, Human; identical to SEQ ID NO: 64138

SEQ ID NO: 221839 - RNA, 64 nt, Human; identical to SEQ ID NO: 64139

SEQ ID NO: 221840 - RNA, 64 nt, Human
auguuuuguguagauaaagcauucuuguuacauacuggucaauuugugauauguuuuaacuuaa

SEQ ID NO: 221841 - RNA, 64 nt, Human
uacagagaaacacaaucagcucuuucugcaugugcuggucaaauccaaacccagagaacagaag

SEQ ID NO: 221842 - RNA, 64 nt, Human
cucaguuuaccccugcauuaaaaugguggggggacuggucaaaggacucuuaugucacugcagu

SEQ ID NO: 221843 - RNA, 64 nt, Human
ccauggccaccuuuucagcgauguaugcagcuaucuggucaaccuccuggacauuuuuucaguc

SEQ ID NO: 221844 - RNA, 64 nt, Human
gagcggaucaugaggucagaagaucuagaacagccuggucaacauggugaaaccccgucucuac

SEQ ID NO: 221845 - RNA, 64 nt, Human
gagaagaguauucugcugaaaccaacagguuuuacuggucaaaaugacugcugaaaauaauuuu

SEQ ID NO: 221846 - RNA, 64 nt, Human
aucguaaaauuugugcaauguaaugucaaauugacuggucaaugucaaccuaguagucaaucua

SEQ ID NO: 221847 - RNA, 64 nt, Human
uugagaaaguuguacagaaauguguucaucaaaucuggucaagggacuaagcuccuagcugacc

SEQ ID NO: 221848 - RNA, 64 nt, Human
guaaagugaccaugauuccuacauagaggcucugcuggucaaauacuugacucccacucuugcc

SEQ ID NO: 221849 - RNA, 64 nt, Human
ccaguaugucuccuggccucuuaugaugagauuucuggucaaggagcgagcucucaggauacga

SEQ ID NO: 221850 - RNA, 64 nt, Human
gcaacccugugauacuauuaccaccaccugcucacuggucaaaaccuacacagcuguuuccuca

SEQ ID NO: 221851 - RNA, 64 nt, Human
aaaggaauggaguuuuucagccuguggcccagcacuggucaagaaaacaagauggcaacauaua

SEQ ID NO: 221852 - RNA, 64 nt, Human
ggauagauguuuuugauucucuuggguggaauugcuggucaaaugguaagucuauguuuaaauu

SEQ ID NO: 221853 - RNA, 64 nt, Human
aauggggaucacaauggccuaugagauagucugccuggucaaugcugagcuguaccccacauuc

SEQ ID NO: 221854 - RNA, 64 nt, Human
cggaaggguaggcaucgccaggcgcuggugagcccuggucaaugagcgcuuccauggaaaccgc

SEQ ID NO: 221855 - RNA, 64 nt, Human
cuuguuuacacaccuuugaaaaucuggaaaugggcuggucaaguggauuacagaguaggaaauu

SEQ ID NO: 221856 - RNA, 64 nt, Human; identical to SEQ ID NO: 64112

SEQ ID NO: 221857 - RNA, 64 nt, Human
uuuuaaaauucucuuuguguauuuggaaucaaagccagcacauuguaaccugugcuuguacgca

SEQ ID NO: 221858 - RNA, 64 nt, Human
uuaauccaguggcaaggugcucccacuccagggcccagcacaucuccuggauuccuuagugggc

SEQ ID NO: 221859 - RNA, 64 nt, Human
acguagagaacccagauagacgccggugguggaacuggucaaacuccacgcccgccugggaggu

SEQ ID NO: 221860 - RNA, 64 nt, Human
gcagaucacuugaggucaggcguuugagaccagccuggucaacauggcgaaacccugucucuac

SEQ ID NO: 221861 - RNA, 64 nt, Human
guggaucacuugaggccaggaguucgagaccagccuggucaagauggugaaaccccaucucuac

SEQ ID NO: 221862 - RNA, 64 nt, Human
ugguuaggaauucagaauuccgccggcucuauuacuggucaaguacaucuuuucucuuaaaauu

SEQ ID NO: 221863 - RNA, 64 nt, Human
guguguguguguguguguguguauuugugugccucuggucaacucuaaggaugacagacacugu

SEQ ID NO: 221864 - RNA, 64 nt, Human
cagcaggggauggcgcuaggggacuuggggauuucuggucaaccccacaagcaccacucugggc

SEQ ID NO: 221865 - RNA, 64 nt, Human
aaaaaauuuacuucugucauuaauuacacuucaacuggucaauauaguggcagcauaaaguguu

SEQ ID NO: 221866 - RNA, 64 nt, Human
uuugucuggguugcugucagccccaguuggcuuccuggucaacaaggaccucaagaacugccug

SEQ ID NO: 221867 - RNA, 64 nt, Human
cuucuuuagaucugaaguugcagguuaagcuugucuggucaacauuccaguguggaaaaauaau

SEQ ID NO: 221868 - RNA, 64 nt, Human
uacuacaaggacagacugaugggaaauuaugcaccuggucaacuuagcuuuuaagcagacgaug

SEQ ID NO: 221869 - RNA, 64 nt, Human
uguggaauuuuuacaacuaugagaguaaauggaacuggucaacucuugacaguugccucaagau

SEQ ID NO: 221870 - RNA, 64 nt, Human
gaaggauuuacugcaagaaguacaugaagagcagcuggucaaccugcucacuguucuaucucca

SEQ ID NO: 221871 - RNA, 64 nt, Human
cugugggugggccgagggugucuagggguucugccuggucaacguuauuugucgucccaucuuu

SEQ ID NO: 221872 - RNA, 64 nt, Human
ggcgccccgguuuuccuccccgcccugucccucucuggucaaacaacauacuaaagaggcgagg

SEQ ID NO: 221873 - RNA, 64 nt, Human
auuaauuugccauauaacacuugcacaugugacucuggucaauucaaaagacucuuauuucggc

SEQ ID NO: 221874 - RNA, 64 nt, Human
uccaauugcugcuaccucaccauguugcugugcccuggucaacaauaaacauacuuuugucccc

SEQ ID NO: 221875 - RNA, 64 nt, Human
uaagcaccacaccauguuucugucuccccagcacccagcacagugcugugaaccuuggcagaug

SEQ ID NO: 221876 - RNA, 64 nt, Human
ccucccacaggaugcggaaggauugcaaugcccgccagcacaguggcggcaacauugaagacgu

SEQ ID NO: 221877 - RNA, 64 nt, Human
caaauauucuugucauuuggagucaguggaaaauccagcacaccaagcaccagucuucuucuga

SEQ ID NO: 221878 - RNA, 64 nt, Human
ccugccuuggugcugcuuccccgagugcugccuccuggucaaggagaagugcagagaguaaggu

SEQ ID NO: 221879 - RNA, 64 nt, Human
uuugggaggcugagguugggaguucaagaccagccuggucaacauggugaaacugugucucuac

SEQ ID NO: 221880 - RNA, 64 nt, Human
cuggaucaccugaggucaggaguucaagaccagccuggucaacguggugaaacgccguuucuac

SEQ ID NO: 221881 - RNA, 64 nt, Human
ggguggaucacaaggucaggaguucgagaccagccuggucaacauggugaaacccccuaucuac

SEQ ID NO: 221882 - RNA, 64 nt, Human
uaauacauaguguauuuugcacaaaaaaauuaaccuggucaauagugauuaccaaaauauauau

SEQ ID NO: 221883 - RNA, 64 nt, Human
ucguauguacaaugcaaucauuucauacuuuaaacuggucaaaaaacuaauugugauuucuagu

SEQ ID NO: 221884 - RNA, 64 nt, Human
caaugcuaccgccccaaaguaaaagaaaccacuucuggucaaucaacacuaccagcguauauau

SEQ ID NO: 221885 - RNA, 64 nt, Human
uuaauagaguuguuucugggagggacuuucauaucuggucaaugucauaauauuauuuuguauu

SEQ ID NO: 221886 - RNA, 64 nt, Human
auugucaaauaucccaucgggugcaaaaugaucccuggucaagaucuguugcccaagauguuac

SEQ ID NO: 221887 - RNA, 64 nt, Human
ucauccauucuugcauuugugacuuaaagguugacuggucaaaauuguagaaacaaguaguuac

SEQ ID NO: 221888 - RNA, 64 nt, Human
ucuucccuucuucaggcuggcccaggucccaggccuggucaacucggucacagccaguccagag

SEQ ID NO: 221889 - RNA, 64 nt, Human
gaaggagcucccaggaggggcuucugggcagacucuggucaagaagcaucgugucuggcguugu

SEQ ID NO: 221890 - RNA, 64 nt, Human
auuuacacaauccuguggauaguccuaccucacccuggucaaccuacaugauccuuaagcuaau

SEQ ID NO: 221891 - RNA, 64 nt, Human
agcacucuugguuucuuuugaugaaaagagugagcuggucaaugcaacauugggaaacggcaga

SEQ ID NO: 221892 - RNA, 64 nt, Human
ugggaugcggcuccugcaggagagagguugagaccuggucaaauuuauuuccuaucaaucacug

SEQ ID NO: 221893 - RNA, 64 nt, Human
aucuacuuaaccugaauagguguuucacacaggucuggucaacagccccaugcacucccuguau

SEQ ID NO: 221894 - RNA, 64 nt, Human
ccccauggucuggcuccugucaccuggguccgugccagcacaaucugccaaaguucuagagacc

SEQ ID NO: 221895 - RNA, 64 nt, Human
gucaggccgggcgugguggcucacaccuguaaucccagcacacugggaggccgaggcaggggga

SEQ ID NO: 221896 - RNA, 64 nt, Human
acugagaucacagggaaggagauuggaggugauaccagcacagacagacucucaccucuucucc

SEQ ID NO: 221897 - RNA, 64 nt, Human
gguugccuuugugggggcgaugaagcagaguccccuggucaagucucucggcuccuuuaaugua

SEQ ID NO: 221898 - RNA, 64 nt, Human
gauauaaaauaggcuuagagaggaaaagcugccucuggucaaguagaucauggcagcaugaauu

SEQ ID NO: 221899 - RNA, 64 nt, Human
uuuuccuaguauacccacugcauccuacuccuaccuggucaacccgcugcuuccagguauggga

SEQ ID NO: 221900 - RNA, 64 nt, Human
uuguuuacgacaguacucagcuuaaauauuuaugcuggucaaaugugauuuaaauuggacauuu

SEQ ID NO: 221901 - RNA, 64 nt, Human
ugggugguuuguccaaggaugcugaauguaaugccuggucaauguggaagcccaugagguugcc

SEQ ID NO: 221902 - RNA, 64 nt, Human
acacuaaaaauauuugcugaauaaauauguacuucuggucaaacuaucacuuguugcaucauuc

SEQ ID NO: 221903 - RNA, 64 nt, Human
aguagcccuuugcaauuuauacuugaguucacuccuggucaauggcacauggcuggaaaaugca

SEQ ID NO: 221904 - RNA, 64 nt, Human
gcagaucaccugaggucaggaguuugagaccagccuggucaacaugguaaaaccccauuucugc

SEQ ID NO: 221905 - RNA, 61 nt, Human
caauuuuccgucguccguaaccagcgggccccuggucaagugcuggcucugcuguccuugc

SEQ ID NO: 221906 - RNA, 64 nt, Human
aucaggaguucgagaccagccuggccaacccagccuggucaacauggugaaacccugucccuac

SEQ ID NO: 221907 - RNA, 64 nt, Human
gacccaggcugggggcagguguguuggagacaggcuggucaaagaggugacaaugauuaagaga

SEQ ID NO: 221908 - RNA, 64 nt, Human
guauggccugaacugguggcugggggaacugugucuggucaaguuauggcagaugucacagcuu

SEQ ID NO: 221909 - RNA, 64 nt, Human
uaacucuaaagcaggauuacuaaauuugauuaaucuggucaaugagaaucaaauggaaacauau

SEQ ID NO: 221910 - RNA, 64 nt, Human
ggucuaaaauacuuuccuacagcuguguaaaauacuggucaaggagaacuuuuuccuuuuaccu

SEQ ID NO: 221911 - RNA, 64 nt, Human
ccaacauucguugaucccaauacaggcaaacaaccuggucaaccuuuugaaguagaagaaauga

SEQ ID NO: 221912 - RNA, 64 nt, Human
cagggagaccuacaggauguuggcugcuugcagacuggucaaugggggaugacgguggggaggu

SEQ ID NO: 221913 - RNA, 64 nt, Human
ugugcgguggggaccggggccggcgggcuccaggccagcacaccuaacccauggauguggaacc

SEQ ID NO: 221914 - RNA, 64 nt, Human
agaacgauaugucuguccaucuuucuccuuucuuccagcacacacagcuaagagauaagaaggc

SEQ ID NO: 221915 - RNA, 64 nt, Human
gaagagccuugcugugccccuguagccucagcacccagcacaggccugucagacagcagguccu

SEQ ID NO: 221916 - RNA, 64 nt, Human
uacaagugugguuuauauguuuucuuugugauuccuggucaagaaagauccccaaaacuguauc

SEQ ID NO: 221917 - RNA, 64 nt, Human
auugauugugagcaagauauuuaucucuuuagcccuuggggauccagcugagagcaaucucuug

SEQ ID NO: 221918 - RNA, 64 nt, Human
aaaauuuauccaaguagagugcaggcuaggcugucuuggggaaauaaacauuaaaacuuaaagc

SEQ ID NO: 221919 - RNA, 64 nt, Human
auaaaaugaaagauuggcaaaggcccuugaggggcuuggggaugacaguauggaacugucugca

SEQ ID NO: 221920 - RNA, 64 nt, Human
auuuaaaaguaaauuuuacugucgaaaaugcaaacuuggggagggcggaaacaucacacacaag

SEQ ID NO: 221921 - RNA, 64 nt, Human
agugaacuccuugcccaggccaguuagaaaaucccuuggggaacugugaugaauauuccaucuu

SEQ ID NO: 221922 - RNA, 64 nt, Human
uuagguguuuuaagauguuuaccuuaaaguuuuucuuggggaaagaaugaauuaauuucuauuu

SEQ ID NO: 221923 - RNA, 64 nt, Human
uacuucaggccuagggguuauccaaccaagcauucuuggggaaagagaaaucacugacauucua

SEQ ID NO: 221924 - RNA, 64 nt, Human
uucucauaaaauaggaaauauuuuaguucuguuucuuggggaauauguuacucuuuacccuagg

SEQ ID NO: 221925 - RNA, 64 nt, Human
gugcugauccauuauuacuuuagggcuugauucucuuggggagugacuuggcuaagcuucaggu

SEQ ID NO: 221926 - RNA, 64 nt, Human
gcagucacuguugacucuauucugaauuuccucccuuggggaagaagggaaccaacauuuauac

SEQ ID NO: 221927 - RNA, 64 nt, Human
auugaacauaauccagaagaaucucucuguuucccuuggggaaugccauauuuaauucaccagc

SEQ ID NO: 221928 - RNA, 64 nt, Human
agcuggaccugguggcccuuuccuagugccucugcuuggggaggagaaccucuguccacgugga

SEQ ID NO: 221929 - RNA, 64 nt, Human
gcugacaccaaaguauuuuaaacaaauaaaaggucuuggggaauucuguuuggcuaccugggca

SEQ ID NO: 221930 - RNA, 64 nt, Human
caccacuguuuuccuugcuguuauuuuuccaagucuuggggagaaaacauccuccucugauggc

SEQ ID NO: 221931 - RNA, 64 nt, Human
acaaucaacuuuucugagcugguguaagccaguuccagcacaccauugcaugaauucacaaaca

SEQ ID NO: 221932 - RNA, 64 nt, Human
aucgauuucucuuuagucguugguguuagaaguaccagcacaauuugagcauucccauuaacaa

SEQ ID NO: 221933 - RNA, 64 nt, Human
gccaucccugaguucaugcgaugcugacgggaccccagcacacuucccugccuccuuugagauc

SEQ ID NO: 221934 - RNA, 64 nt, Human
aagaaacucaaauguaauccuacgaucaaagcaacuggucaacacuuccaucagaagugaagau

SEQ ID NO: 221935 - RNA, 64 nt, Human
uauccuagccuuuauuucucugucauuuggauggcuggucaauggggaagaauugaguggguga

SEQ ID NO: 221936 - RNA, 64 nt, Human
aaugccagaagaaggcccagucugcaccaggcgucuggucaacuuagcacaagggcagugccug

SEQ ID NO: 221937 - RNA, 64 nt, Human
cugccccgaggccccgauccugcugcacuucccgcuggucaaugccuccuucaaggaccacuca

SEQ ID NO: 221938 - RNA, 64 nt, Human
gcuagacacugaaucaagagauuucaguguuacucuggucaaguuagucgcccucucugggcuc

SEQ ID NO: 221939 - RNA, 64 nt, Human
cauugagaacuggcauucgauccugcgcaaugggcuggucaaugcauccuacaccaaacugcag

SEQ ID NO: 221940 - RNA, 64 nt, Human
ucucauggcaccaauggaaguguccuccuguucucuggucaauauguguguuuacuuugcuugc

SEQ ID NO: 221941 - RNA, 64 nt, Human
agccgcccuggcccuggucacugcaugauccgcucuggucaaacccuuccaggccagccagagu

SEQ ID NO: 221942 - RNA, 64 nt, Human
cccacgcugccccaucuugccugcuguuccaguucuggucaagggccuugggggcuggcccccc

SEQ ID NO: 221943 - RNA, 64 nt, Human
gaggaucgcuugagcccaagaguucauaucuagccuggucaacauagcaagaccccugucucua

SEQ ID NO: 221944 - RNA, 64 nt, Human
guggcagauccuggcuagaucugccucuguuuugcuggucaaaaccucuuccccacaagccaga

SEQ ID NO: 221945 - RNA, 64 nt, Human
auauauaaaaauauauaaaugccacgguccugcucuggucaauaaaggauccuuuguugauacg

SEQ ID NO: 221946 - RNA, 64 nt, Human
guccugcaaggucguuggccagagguagaggaaacuggucaaaguggcuguugggcuugucaag

SEQ ID NO: 221947 - RNA, 64 nt, Human
gcagugagccgagaucgugccacugcacuccagccuggucaacagagcaagacuccaucucgaa

SEQ ID NO: 221948 - RNA, 64 nt, Human
cuaaguucucuguacucaguugguucucaguuagcuggucaaguggaguguaaugguggcguag

SEQ ID NO: 221949 - RNA, 64 nt, Human
ucagaggcccaaaacaguuauacagaugacgguacuggucaagaugggucaagcaagcggccac

SEQ ID NO: 221950 - RNA, 59 nt, Human; identical to SEQ ID NO: 64109

SEQ ID NO: 221951 - RNA, 64 nt, Human; identical to SEQ ID NO: 64110

SEQ ID NO: 221952 - RNA, 64 nt, Human; identical to SEQ ID NO: 64111

SEQ ID NO: 221953 - RNA, 64 nt, Human
cacagcugauccuggcccccugugaagaaguguucuggucaaaacuaaaggaacucccucccca

SEQ ID NO: 221954 - RNA, 64 nt, Human
cguaaaggauguggcuccauguccauggugcccccuggucaacauaaggagcgugggauccgau

SEQ ID NO: 221955 - RNA, 64 nt, Human
gcagugagccaagaucacgucauugcacuccagccuggucaacaagaguaaaacuucaucucaa

SEQ ID NO: 221956 - RNA, 64 nt, Human
ucagaggggucugaacagacuugacaauucuguucuggucaagcuggaguuuucuucugugacu

SEQ ID NO: 221957 - RNA, 64 nt, Human
acagaagcacaggaacucagcccauggccgcaagcuggucaaggccugcucacuguaaacaugg

SEQ ID NO: 221958 - RNA, 64 nt, Human
acuccaucgaguguuccauuauguccuggauaaucuggucaauguaaugaauggauacugccuu

SEQ ID NO: 221959 - RNA, 64 nt, Human
acuucuuggcuuggugaggaaaagcggacaucagcuggucaaacaaacucucugaaccccuccc

SEQ ID NO: 221960 - RNA, 64 nt, Human
gaaagaaagaaaggcugccuuugcaaaaauccuacuggucaaauaaccuaaggaaauuauucau

SEQ ID NO: 221961 - RNA, 64 nt, Human
uuucacuccucuaacaucucuggauacagugucccuggucaacaugaagaaguuacagaagaac

SEQ ID NO: 221962 - RNA, 64 nt, Human
cuuuaaaaagaagcucagaaagucuuuauaaccacuggucaacgauuagaaaaauauaacugga

SEQ ID NO: 221963 - RNA, 64 nt, Human
uuauuuuaaacagucuucuguuuuggccaguugucuggucaaaaucggcuucagugauuguggg

SEQ ID NO: 221964 - RNA, 64 nt, Human
gaggauugauugaggccaagaguuaaagaccagccuggucaauauagcaagaccacgucucuaa

SEQ ID NO: 221965 - RNA, 64 nt, Human
gaagggaauguacguaaaacaaaauagggcuuggcuggucaaaggagacaagcaggauggaugg

SEQ ID NO: 221966 - RNA, 64 nt, Human
aggcggaccacgaggucaguaguucgagaccagccuggucaauauggugaaaccccaucucuac

SEQ ID NO: 221967 - RNA, 64 nt, Human
ucagaucaccuaaggucaggaguucaagaccagccuggucaacauggugaaaucuugucucuag

SEQ ID NO: 221968 - RNA, 64 nt, Human
gagguauuuuuaggcuauuuuuguaauauggcuucuggucaaaaucccuguguagcugaauucc

SEQ ID NO: 221969 - RNA, 64 nt, Human; identical to SEQ ID NO: 64104

SEQ ID NO: 221970 - RNA, 57 nt, Human; identical to SEQ ID NO: 64105

SEQ ID NO: 221971 - RNA, 64 nt, Human; identical to SEQ ID NO: 64106

SEQ ID NO: 221972 - RNA, 64 nt, Human
gggcagaucaugaggucaacagauugagaccauccuggucaacaugguaaaacccugucucuac

SEQ ID NO: 221973 - RNA, 64 nt, Human
gcagugagcuaugacugugccacugcacuccagccuggucaacaaagcaagacccuuucucaaa

SEQ ID NO: 221974 - RNA, 64 nt, Human
acaagaacuuaggaagagugagguuggugugucacuggucaaccuuugugcucccagaucccau

SEQ ID NO: 221975 - RNA, 64 nt, Human
ugaggagguccuggaagcuccagacccucuccaccuggucaacauggagcaagcgcuuguggag

SEQ ID NO: 221976 - RNA, 64 nt, Human
augggaggaagugaauagagccuuuaggaacuuccuggucaagcuuauggugcuuauuuugauc

SEQ ID NO: 221977 - RNA, 64 nt, Human
ugggcacuggaaaacauagaguagaccugagaugcuggucaagcccccuuugauugaguucauc

SEQ ID NO: 221978 - RNA, 64 nt, Human
uagccuguggaaacccuggguauucuuuaaaguucuggucaauguauaucaccuccacagagcu

SEQ ID NO: 221979 - RNA, 64 nt, Human
cucacuucugaaugugccacuuccaguagacaugcuggucaaagagcagucaucauugggguga

SEQ ID NO: 221980 - RNA, 64 nt, Human
uguagcacuucccacccucaggcaugaguacagacuggucaaaauguuuaugcagucaaggcca

SEQ ID NO: 221981 - RNA, 64 nt, Human
cuuggggagcaguggccgggcuggggaggccugccuggucaauaaaccacuguuccugcagcug

SEQ ID NO: 221982 - RNA, 64 nt, Human
ggcuccucagccuccaccaucccccaggugaugucuggucaacuggccugccuucagcuagaau

SEQ ID NO: 221983 - RNA, 64 nt, Human
aucucccaucugcuuuucuccacugccauguguccuggucaagccccccucacucuguuuccug

SEQ ID NO: 221984 - RNA, 64 nt, Human
caucucccaucugcuuuucccauugccaugcguccuggucaagccccccucacucuguuuccug

SEQ ID NO: 221985 - RNA, 64 nt, Human
caucucccaucugcuuuucccauugccgugcauccuggucaagccccccucacucuguuuccug

SEQ ID NO: 221986 - RNA, 64 nt, Human
caucugccaucugcuuuucccauugccaugcguccuggucaagcuccccucacucuguuuccug

SEQ ID NO: 221987 - RNA, 64 nt, Human
uuuccuauugacucaucaggaaccaguccucagucuggucaaguuguuucuuauuugugagcag

SEQ ID NO: 221988 - RNA, 64 nt, Human; identical to SEQ ID NO: 64107

SEQ ID NO: 221989 - RNA, 64 nt, Human; identical to SEQ ID NO: 64114

SEQ ID NO: 221990 - RNA, 61 nt, Human; identical to SEQ ID NO: 64115

SEQ ID NO: 221991 - RNA, 64 nt, Human
uuaacacaugggaacaccaaaauauucaauaagccuggucaauucuauaguuaucuuuuuugua

SEQ ID NO: 221992 - RNA, 64 nt, Human
aauuugggagcauaugccuugcuauauuaucaagcuggucaagguagaaauacugauauguauc

SEQ ID NO: 221993 - RNA, 64 nt, Human
auuaaaugcuaacuuaacagcacuggcuuucuggcuggucaacuauaugaaaccuuguucauuc

SEQ ID NO: 221994 - RNA, 64 nt, Human
uuuuuucagggaacuagacugcaagaauaucuuucuggucaacccauuuuugucccucaucacc

SEQ ID NO: 221995 - RNA, 64 nt, Human
auaggcaucucccaacugcuuuuccccauguguccuggucaagccccccucacucuguuuccug

SEQ ID NO: 221996 - RNA, 64 nt, Human
aucucccaucugcuuuuccccauugccaugcguccuggucaagccccccucacucuguuuccug

SEQ ID NO: 221997 - RNA, 64 nt, Human
aucucccaucugcuuuucuccauugccaugcgaccuggucaagccccccucacucuguuuccug

SEQ ID NO: 221998 - RNA, 64 nt, Human
aucucccauaugcuuuuccccauugccaugaguccuggucaagccccccuucaauuuguuuccu

SEQ ID NO: 221999 - RNA, 64 nt, Human
cauuuccgaagaguuuauaaagcacagugaauuccuggucaaucucuccacugaggcaauuugg

SEQ ID NO: 222000 - RNA, 64 nt, Human
agaaaccugagaaucugagggugaugucuggccgcuggucaagaagccaacagucauguggcuc

SEQ ID NO: 222001 - RNA, 64 nt, Human
agaaaaaagcaaguacaaguuccaacaugcaauacuggucaacuuaagguauauuuaguugcag

SEQ ID NO: 222002 - RNA, 64 nt, Human
cuuucuuuuuuuuuuuuuuuagauuugugguauucuggucaaguuauugugcuguacuuugugc

SEQ ID NO: 222003 - RNA, 64 nt, Human
aggcuucugcaugccugguaaaguccagccaaggcuggucaaggcaacaucuccacacagaaaa

SEQ ID NO: 222004 - RNA, 64 nt, Human
gaaacuaucuucucccaacauuuacuaacauccacuggucaacucucuuauuuccauaacacau

SEQ ID NO: 222005 - RNA, 60 nt, Human
ucuucuuagugcugugacggcggggccucugggugcgaguuccuccugcauaugaaccga

SEQ ID NO: 222006 - RNA, 64 nt, Human
gaaccuggccucccggggagcugagacuagggucccagcacagcccagaaaccuuuggccacaa

SEQ ID NO: 222007 - RNA, 64 nt, Human
augaccagggaagcccccugauaagccaagagggccagcacagcccuugcucccaggcuccugc

SEQ ID NO: 222008 - RNA, 64 nt, Human
ggugacugaagucgugcuuuuccugugugugcugccagcacagggcuguaaaugcagauauugc

SEQ ID NO: 222009 - RNA, 60 nt, Human
acguuugcugauagcaauacuggaaccaccgggugcgauggcagugaggagacugcccag

SEQ ID NO: 222010 - RNA, 60 nt, Human
uggcacucggacuugaaaagcuuggcccaagggugcgaggggaacuccgaguucuuucug

SEQ ID NO: 222011 - RNA, 60 nt, Human
cugcucccugcacauugagggcuucauggggggugcgaggggcucaguggggcuucucuu

SEQ ID NO: 222012 - RNA, 60 nt, Human
uuugaaauuggagacaaacugucuggcaaagggugcgagagggagcuugugcucaggagu

SEQ ID NO: 222013 - RNA, 60 nt, Human
aaaugcccaaaugaggucaagauggcgagugggugcgagugagaaugaguggcaaaaugu

SEQ ID NO: 222014 - RNA, 60 nt, Human
ccuuccuguaaaauuuuuaaauggagaauugggugcgagaugugguuuccagccuggugc

SEQ ID NO: 222015 - RNA, 60 nt, Human
uuauuuuuggaaauugcauuuguaaccaaggggugcgaaacccuggcagucccaggcagc

SEQ ID NO: 222016 - RNA, 60 nt, Human
gaaugggacuggaauuuccccaguagagaagggugcgagaaacaucagggugcagaauug

SEQ ID NO: 222017 - RNA, 60 nt, Human
gcgaccccucagugcucggcagucauacuggggugcgagagaggugggcagcagcucagc

SEQ ID NO: 222018 - RNA, 60 nt, Human
cgccagcuccggggcgaguucagcacugcggggugcgacuagggcugcgcugccaggguc

SEQ ID NO: 222019 - RNA, 60 nt, Human
caagauggaaagaaccacgcaggauccccugggugcgaggagagugaugccgguaaagaa

SEQ ID NO: 222020 - RNA, 60 nt, Human
ggucacuguaaguuuuacucuuuugaaugagggugcgacagaaugcaguuagaaucaguu

SEQ ID NO: 222021 - RNA, 60 nt, Human
uagcaaggacggcugguggagggggaaggagggugcgaggugucugucugaugcuuuagg

SEQ ID NO: 222022 - RNA, 60 nt, Human
uggcugugggcuggggugcaugggagagcugggugcgagaacauggcgccuccagggggc

SEQ ID NO: 222023 - RNA, 60 nt, Human
gugacuuuugcgccccgcgccugggguggggggugcgaagagacgcuacguuccuuuccg

SEQ ID NO: 222024 - RNA, 60 nt, Human
ccuggccugaggucucgcugaugcugggcugggugcgaccccaucugcccaggacggggc

SEQ ID NO: 222025 - RNA, 64 nt, Human; identical to SEQ ID NO: 64118

SEQ ID NO: 222026 - RNA, 64 nt, Human; identical to SEQ ID NO: 64119

SEQ ID NO: 222027 - RNA, 64 nt, Human; identical to SEQ ID NO: 64120

SEQ ID NO: 222028 - RNA, 60 nt, Human
uucuuugaagccuuucuaagaaagaaaugggggugcgaguggcuugaaucucccaugaug

SEQ ID NO: 222029 - RNA, 60 nt, Human
cuggaggcuggcgggaggcucccugaaagugggugcgaaggaguccggcuggcaugaaaa

SEQ ID NO: 222030 - RNA, 60 nt, Human
uagagcaacuuugccccagcgauuccucuugggugcgaacagaacuacuaacguuucaag

SEQ ID NO: 222031 - RNA, 60 nt, Human
cuaaccacauuaagcuaagacaaggccagagggugcgauugaaugaguauugagacugag

SEQ ID NO: 222032 - RNA, 60 nt, Human
uccacuguuacgggagaauguugauuucgcgggugcgagggccgggagacagauacuugg

SEQ ID NO: 222033 - RNA, 60 nt, Human
aaaagagggggagaaugagaagggaaggccgggugcgaaagggacgguauccagggcgcc

SEQ ID NO: 222034 - RNA, 60 nt, Human
ggugggcaucccuccugguaccaagcugcugggugcgaaggcagaucauauggggucacc

SEQ ID NO: 222035 - RNA, 60 nt, Human
cagaaaauuccuagcucacauagcccaaaagggugcgagggagagguggauuaccaguau

SEQ ID NO: 222036 - RNA, 60 nt, Human
acaacuagcuaucaaagcuagaucucagcugggugcgauggcucacgccuguaaucccgg

SEQ ID NO: 222037 - RNA, 60 nt, Human
gaagcgccgggcuuuccucacaccugagccgggugcgaggaggagcaugcacggaccaag

SEQ ID NO: 222038 - RNA, 60 nt, Human
gauauaaagugccaguaauccgccaagagggggugcgaagggggcaugucacgacagcuc

SEQ ID NO: 222039 - RNA, 60 nt, Human
agcagcgagugaccugggcaguggccaggugggugcgaugacucugaugccucacucagu

SEQ ID NO: 222040 - RNA, 60 nt, Human
cagcaggggugggggccgggcugagggugggggugcgagguggucacucccaucgugccc

SEQ ID NO: 222041 - RNA, 60 nt, Human
auuuuuacaaucuguaucuuugacaauucugggugcgagugugagagugugagcagggcu

SEQ ID NO: 222042 - RNA, 60 nt, Human
uucacagccaugcacgcgcucaagccaccagggugcgagaugccagcucuggaguucucg

SEQ ID NO: 222043 - RNA, 60 nt, Human
gcagggugggcccucggcccugaugcaggagggugcgauagcggacguggccaggcagga

SEQ ID NO: 222044 - RNA, 64 nt, Human; identical to SEQ ID NO: 64123

SEQ ID NO: 222045 - RNA, 64 nt, Human; identical to SEQ ID NO: 64124

SEQ ID NO: 222046 - RNA, 64 nt, Human; identical to SEQ ID NO: 64125

SEQ ID NO: 222047 - RNA, 60 nt, Human
ugcagagaauggagcccaaacagauguucugggugcgagcccggggcuauauugguaaga

SEQ ID NO: 222048 - RNA, 60 nt, Human
gccgccugcuguaacccuccgugucgccucgggugcgaaaucagacccaccugacaccau

SEQ ID NO: 222049 - RNA, 60 nt, Human
uggagguucgugccguccccagccugccacgggugcgaggacagccaaguccugagugac

SEQ ID NO: 222050 - RNA, 60 nt, Human
ugggcucuuguggggacguucaggguaucggggugcgaggucugucugcaccggccccca

SEQ ID NO: 222051 - RNA, 60 nt, Human
aaucgccaccaguaucaauugugugagcuugggugcgagugcacgcgugcgugaguacgg

SEQ ID NO: 222052 - RNA, 60 nt, Human
cuauaaggaucaugcagaggcagcaaagccgggugcgaugagcucagccuuuacucauuc

SEQ ID NO: 222053 - RNA, 64 nt, Human; identical to SEQ ID NO: 64085

SEQ ID NO: 222054 - RNA, 64 nt, Human; identical to SEQ ID NO: 64086

SEQ ID NO: 222055 - RNA, 64 nt, Human; identical to SEQ ID NO: 64087

SEQ ID NO: 222056 - RNA, 64 nt, Human; identical to SEQ ID NO: 64088

SEQ ID NO: 222057 - RNA, 64 nt, Human; identical to SEQ ID NO: 64089

SEQ ID NO: 222058 - RNA, 64 nt, Human; identical to SEQ ID NO: 64090

SEQ ID NO: 222059 - RNA, 64 nt, Human; identical to SEQ ID NO: 64091

SEQ ID NO: 222060 - RNA, 64 nt, Human; identical to SEQ ID NO: 64092

SEQ ID NO: 222061 - RNA, 64 nt, Human; identical to SEQ ID NO: 64093

SEQ ID NO: 222062 - RNA, 64 nt, Human; identical to SEQ ID NO: 64094

SEQ ID NO: 222063 - RNA, 64 nt, Human; identical to SEQ ID NO: 64095

SEQ ID NO: 222064 - RNA, 64 nt, Human; identical to SEQ ID NO: 64096

SEQ ID NO: 222065 - RNA, 64 nt, Human; identical to SEQ ID NO: 64097

SEQ ID NO: 222066 - RNA, 64 nt, Human; identical to SEQ ID NO: 64140

SEQ ID NO: 222067 - RNA, 64 nt, Human; identical to SEQ ID NO: 64141

SEQ ID NO: 222068 - RNA, 64 nt, Human; identical to SEQ ID NO: 64142

SEQ ID NO: 222069 - RNA, 64 nt, Human; identical to SEQ ID NO: 64143

SEQ ID NO: 222070 - RNA, 64 nt, Human; identical to SEQ ID NO: 64144

SEQ ID NO: 222071 - RNA, 64 nt, Human; identical to SEQ ID NO: 64145

SEQ ID NO: 222072 - RNA, 64 nt, Human; identical to SEQ ID NO: 64146

SEQ ID NO: 222073 - RNA, 64 nt, Human; identical to SEQ ID NO: 64147

SEQ ID NO: 222074 - RNA, 64 nt, Human; identical to SEQ ID NO: 64148

SEQ ID NO: 222075 - RNA, 64 nt, Human; identical to SEQ ID NO: 64149

SEQ ID NO: 222076 - RNA, 64 nt, Human; identical to SEQ ID NO: 64150

SEQ ID NO: 222077 - RNA, 64 nt, Human; identical to SEQ ID NO: 64151

SEQ ID NO: 222078 - RNA, 64 nt, Human; identical to SEQ ID NO: 64152

SEQ ID NO: 222079 - RNA, 64 nt, Human; identical to SEQ ID NO: 64153

SEQ ID NO: 222080 - RNA, 64 nt, Human; identical to SEQ ID NO: 64154

SEQ ID NO: 222081 - RNA, 64 nt, Human; identical to SEQ ID NO: 64155

SEQ ID NO: 222082 - RNA, 64 nt, Human; identical to SEQ ID NO: 64156

SEQ ID NO: 222083 - RNA, 64 nt, Human; identical to SEQ ID NO: 64157

SEQ ID NO: 222084 - RNA, 64 nt, Human; identical to SEQ ID NO: 64158

SEQ ID NO: 222085 - RNA, 64 nt, Human; identical to SEQ ID NO: 64159

SEQ ID NO: 222086 - RNA, 64 nt, Human; identical to SEQ ID NO: 64160

SEQ ID NO: 222087 - RNA, 64 nt, Human; identical to SEQ ID NO: 64161

SEQ ID NO: 222088 - RNA, 64 nt, Human; identical to SEQ ID NO: 64162

SEQ ID NO: 222089 - RNA, 64 nt, Human; identical to SEQ ID NO: 64163

SEQ ID NO: 222090 - RNA, 64 nt, Human; identical to SEQ ID NO: 64164

SEQ ID NO: 222091 - RNA, 64 nt, Human; identical to SEQ ID NO: 64165

SEQ ID NO: 222092 - RNA, 64 nt, Human; identical to SEQ ID NO: 64166

SEQ ID NO: 222093 - RNA, 62 nt, Human; identical to SEQ ID NO: 64167

SEQ ID NO: 222094 - RNA, 64 nt, Human; identical to SEQ ID NO: 64168

SEQ ID NO: 222095 - RNA, 64 nt, Human; identical to SEQ ID NO: 64169

SEQ ID NO: 222096 - RNA, 64 nt, Human; identical to SEQ ID NO: 64170

SEQ ID NO: 222097 - RNA, 58 nt, Human; identical to SEQ ID NO: 64171

SEQ ID NO: 222098 - RNA, 64 nt, Human; identical to SEQ ID NO: 64172

SEQ ID NO: 222099 - RNA, 64 nt, Human; identical to SEQ ID NO: 64173

SEQ ID NO: 222100 - RNA, 64 nt, Human; identical to SEQ ID NO: 64174

SEQ ID NO: 222101 - RNA, 64 nt, Human; identical to SEQ ID NO: 64175

SEQ ID NO: 222102 - RNA, 64 nt, Human; identical to SEQ ID NO: 64176

SEQ ID NO: 222103 - RNA, 64 nt, Human; identical to SEQ ID NO: 64177

SEQ ID NO: 222104 - RNA, 64 nt, Human; identical to SEQ ID NO: 64178

SEQ ID NO: 222105 - RNA, 52 nt, Human; identical to SEQ ID NO: 64179

SEQ ID NO: 222106 - RNA, 64 nt, Human; identical to SEQ ID NO: 64180

SEQ ID NO: 222107 - RNA, 64 nt, Human; identical to SEQ ID NO: 64181

SEQ ID NO: 222108 - RNA, 64 nt, Human; identical to SEQ ID NO: 64182

SEQ ID NO: 222109 - RNA, 64 nt, Human; identical to SEQ ID NO: 64183

SEQ ID NO: 222110 - RNA, 64 nt, Human; identical to SEQ ID NO: 64184

SEQ ID NO: 222111 - RNA, 59 nt, Human; identical to SEQ ID NO: 64185

SEQ ID NO: 222112 - RNA, 64 nt, Human; identical to SEQ ID NO: 64186

SEQ ID NO: 222113 - RNA, 64 nt, Human; identical to SEQ ID NO: 64187

SEQ ID NO: 222114 - RNA, 64 nt, Human; identical to SEQ ID NO: 64188

SEQ ID NO: 222115 - RNA, 64 nt, Human; identical to SEQ ID NO: 64189

SEQ ID NO: 222116 - RNA, 59 nt, Human; identical to SEQ ID NO: 64190

SEQ ID NO: 222117 - RNA, 64 nt, Human; identical to SEQ ID NO: 64191

SEQ ID NO: 222118 - RNA, 64 nt, Human; identical to SEQ ID NO: 64192

SEQ ID NO: 222119 - RNA, 64 nt, Human; identical to SEQ ID NO: 64193

SEQ ID NO: 222120 - RNA, 64 nt, Human; identical to SEQ ID NO: 64194

SEQ ID NO: 222121 - RNA, 64 nt, Human; identical to SEQ ID NO: 64195

SEQ ID NO: 222122 - RNA, 64 nt, Human; identical to SEQ ID NO: 64196

SEQ ID NO: 222123 - RNA, 64 nt, Human; identical to SEQ ID NO: 64197

SEQ ID NO: 222124 - RNA, 64 nt, Human; identical to SEQ ID NO: 64198

SEQ ID NO: 222125 - RNA, 64 nt, Human; identical to SEQ ID NO: 64199

SEQ ID NO: 222126 - RNA, 64 nt, Human; identical to SEQ ID NO: 64200

SEQ ID NO: 222127 - RNA, 64 nt, Human; identical to SEQ ID NO: 64201

SEQ ID NO: 222128 - RNA, 64 nt, Human; identical to SEQ ID NO: 64202

SEQ ID NO: 222129 - RNA, 64 nt, Human; identical to SEQ ID NO: 64203

SEQ ID NO: 222130 - RNA, 64 nt, Human; identical to SEQ ID NO: 64204

SEQ ID NO: 222131 - RNA, 64 nt, Human; identical to SEQ ID NO: 64205

SEQ ID NO: 222132 - RNA, 64 nt, Human; identical to SEQ ID NO: 64206

SEQ ID NO: 222133 - RNA, 64 nt, Human; identical to SEQ ID NO: 64207

SEQ ID NO: 222134 - RNA, 64 nt, Human; identical to SEQ ID NO: 64208

SEQ ID NO: 222135 - RNA, 64 nt, Human; identical to SEQ ID NO: 64209

SEQ ID NO: 222136 - RNA, 64 nt, Human; identical to SEQ ID NO: 64210

SEQ ID NO: 222137 - RNA, 64 nt, Human; identical to SEQ ID NO: 64211

SEQ ID NO: 222138 - RNA, 64 nt, Human; identical to SEQ ID NO: 64212

SEQ ID NO: 222139 - RNA, 64 nt, Human; identical to SEQ ID NO: 64213

SEQ ID NO: 222140 - RNA, 64 nt, Human; identical to SEQ ID NO: 64214

SEQ ID NO: 222141 - RNA, 64 nt, Human; identical to SEQ ID NO: 64215

SEQ ID NO: 222142 - RNA, 64 nt, Human; identical to SEQ ID NO: 115711

SEQ ID NO: 222143 - RNA, 64 nt, Human; identical to SEQ ID NO: 115712

SEQ ID NO: 222144 - RNA, 64 nt, Human; identical to SEQ ID NO: 115713

SEQ ID NO: 222145 - RNA, 64 nt, Human; identical to SEQ ID NO: 115714

SEQ ID NO: 222146 - RNA, 64 nt, Human; identical to SEQ ID NO: 115715

SEQ ID NO: 222147 - RNA, 64 nt, Human; identical to SEQ ID NO: 115716

SEQ ID NO: 222148 - RNA, 64 nt, Human; identical to SEQ ID NO: 115717

SEQ ID NO: 222149 - RNA, 63 nt, Human; identical to SEQ ID NO: 115718

SEQ ID NO: 222150 - RNA, 64 nt, Human; identical to SEQ ID NO: 115719

SEQ ID NO: 222151 - RNA, 64 nt, Human; identical to SEQ ID NO: 115720

SEQ ID NO: 222152 - RNA, 64 nt, Human; identical to SEQ ID NO: 115721

SEQ ID NO: 222153 - RNA, 64 nt, Human; identical to SEQ ID NO: 115722

SEQ ID NO: 222154 - RNA, 64 nt, Human; identical to SEQ ID NO: 115723

SEQ ID NO: 222155 - RNA, 64 nt, Human; identical to SEQ ID NO: 115724

SEQ ID NO: 222156 - RNA, 64 nt, Human; identical to SEQ ID NO: 115725

SEQ ID NO: 222157 - RNA, 64 nt, Human; identical to SEQ ID NO: 115726

SEQ ID NO: 222158 - RNA, 64 nt, Human; identical to SEQ ID NO: 115727

SEQ ID NO: 222159 - RNA, 64 nt, Human; identical to SEQ ID NO: 115728

SEQ ID NO: 222160 - RNA, 64 nt, Human; identical to SEQ ID NO: 115729

SEQ ID NO: 222161 - RNA, 64 nt, Human; identical to SEQ ID NO: 115730

SEQ ID NO: 222162 - RNA, 64 nt, Human; identical to SEQ ID NO: 115731

SEQ ID NO: 222163 - RNA, 64 nt, Human; identical to SEQ ID NO: 115732

SEQ ID NO: 222164 - RNA, 64 nt, Human; identical to SEQ ID NO: 115733

SEQ ID NO: 222165 - RNA, 64 nt, Human; identical to SEQ ID NO: 115734

SEQ ID NO: 222166 - RNA, 64 nt, Human; identical to SEQ ID NO: 115735

SEQ ID NO: 222167 - RNA, 64 nt, Human; identical to SEQ ID NO: 115736

SEQ ID NO: 222168 - RNA, 64 nt, Human; identical to SEQ ID NO: 115737

SEQ ID NO: 222169 - RNA, 64 nt, Human; identical to SEQ ID NO: 115738

SEQ ID NO: 222170 - RNA, 64 nt, Human; identical to SEQ ID NO: 115739

SEQ ID NO: 222171 - RNA, 64 nt, Human; identical to SEQ ID NO: 115740

SEQ ID NO: 222172 - RNA, 64 nt, Human; identical to SEQ ID NO: 115741

SEQ ID NO: 222173 - RNA, 64 nt, Human; identical to SEQ ID NO: 115742

SEQ ID NO: 222174 - RNA, 64 nt, Human; identical to SEQ ID NO: 115743

SEQ ID NO: 222175 - RNA, 64 nt, Human; identical to SEQ ID NO: 115744

SEQ ID NO: 222176 - RNA, 64 nt, Human; identical to SEQ ID NO: 115745

SEQ ID NO: 222177 - RNA, 64 nt, Human; identical to SEQ ID NO: 115746

SEQ ID NO: 222178 - RNA, 64 nt, Human; identical to SEQ ID NO: 115747

SEQ ID NO: 222179 - RNA, 64 nt, Human; identical to SEQ ID NO: 115748

SEQ ID NO: 222180 - RNA, 64 nt, Human; identical to SEQ ID NO: 115749

SEQ ID NO: 222181 - RNA, 64 nt, Human; identical to SEQ ID NO: 115750

SEQ ID NO: 222182 - RNA, 64 nt, Human; identical to SEQ ID NO: 115751

SEQ ID NO: 222183 - RNA, 64 nt, Human; identical to SEQ ID NO: 115752

SEQ ID NO: 222184 - RNA, 64 nt, Human; identical to SEQ ID NO: 115753

SEQ ID NO: 222185 - RNA, 64 nt, Human; identical to SEQ ID NO: 115754

SEQ ID NO: 222186 - RNA, 64 nt, Human; identical to SEQ ID NO: 115755

SEQ ID NO: 222187 - RNA, 64 nt, Human; identical to SEQ ID NO: 115756

SEQ ID NO: 222188 - RNA, 64 nt, Human; identical to SEQ ID NO: 115757

SEQ ID NO: 222189 - RNA, 64 nt, Human; identical to SEQ ID NO: 115758

SEQ ID NO: 222190 - RNA, 64 nt, Human; identical to SEQ ID NO: 115759

SEQ ID NO: 222191 - RNA, 64 nt, Human; identical to SEQ ID NO: 115760

SEQ ID NO: 222192 - RNA, 64 nt, Human; identical to SEQ ID NO: 115761

SEQ ID NO: 222193 - RNA, 64 nt, Human; identical to SEQ ID NO: 115762

SEQ ID NO: 222194 - RNA, 64 nt, Human; identical to SEQ ID NO: 115763

SEQ ID NO: 222195 - RNA, 64 nt, Human; identical to SEQ ID NO: 115764

SEQ ID NO: 222196 - RNA, 64 nt, Human; identical to SEQ ID NO: 115765

SEQ ID NO: 222197 - RNA, 64 nt, Human; identical to SEQ ID NO: 115766

SEQ ID NO: 222198 - RNA, 64 nt, Human; identical to SEQ ID NO: 115767

SEQ ID NO: 222199 - RNA, 64 nt, Human; identical to SEQ ID NO: 115768

SEQ ID NO: 222200 - RNA, 64 nt, Human; identical to SEQ ID NO: 115769

SEQ ID NO: 222201 - RNA, 64 nt, Human; identical to SEQ ID NO: 115770

SEQ ID NO: 222202 - RNA, 64 nt, Human; identical to SEQ ID NO: 115771

SEQ ID NO: 222203 - RNA, 64 nt, Human; identical to SEQ ID NO: 115772

SEQ ID NO: 222204 - RNA, 64 nt, Human; identical to SEQ ID NO: 115773

SEQ ID NO: 222205 - RNA, 64 nt, Human; identical to SEQ ID NO: 115774

SEQ ID NO: 222206 - RNA, 64 nt, Human; identical to SEQ ID NO: 115775

SEQ ID NO: 222207 - RNA, 64 nt, Human; identical to SEQ ID NO: 115776

SEQ ID NO: 222208 - RNA, 64 nt, Human; identical to SEQ ID NO: 115777

SEQ ID NO: 222209 - RNA, 64 nt, Human; identical to SEQ ID NO: 115778

SEQ ID NO: 222210 - RNA, 64 nt, Human; identical to SEQ ID NO: 115779

SEQ ID NO: 222211 - RNA, 64 nt, Human; identical to SEQ ID NO: 115780

SEQ ID NO: 222212 - RNA, 64 nt, Human; identical to SEQ ID NO: 115781

SEQ ID NO: 222213 - RNA, 64 nt, Human; identical to SEQ ID NO: 115782

SEQ ID NO: 222214 - RNA, 64 nt, Human; identical to SEQ ID NO: 115783

SEQ ID NO: 222215 - RNA, 64 nt, Human; identical to SEQ ID NO: 115784

SEQ ID NO: 222216 - RNA, 64 nt, Human; identical to SEQ ID NO: 115785

SEQ ID NO: 222217 - RNA, 64 nt, Human; identical to SEQ ID NO: 115786

SEQ ID NO: 222218 - RNA, 64 nt, Human; identical to SEQ ID NO: 115787

SEQ ID NO: 222219 - RNA, 64 nt, Human; identical to SEQ ID NO: 115788

SEQ ID NO: 222220 - RNA, 64 nt, Human; identical to SEQ ID NO: 115789

SEQ ID NO: 222221 - RNA, 64 nt, Human; identical to SEQ ID NO: 115790

SEQ ID NO: 222222 - RNA, 64 nt, Human; identical to SEQ ID NO: 115791

SEQ ID NO: 222223 - RNA, 64 nt, Human; identical to SEQ ID NO: 115792

SEQ ID NO: 222224 - RNA, 64 nt, Human; identical to SEQ ID NO: 115793

SEQ ID NO: 222225 - RNA, 64 nt, Human; identical to SEQ ID NO: 115794

SEQ ID NO: 222226 - RNA, 64 nt, Human; identical to SEQ ID NO: 115795

SEQ ID NO: 222227 - RNA, 64 nt, Human; identical to SEQ ID NO: 115796

SEQ ID NO: 222228 - RNA, 64 nt, Human; identical to SEQ ID NO: 115797

SEQ ID NO: 222229 - RNA, 64 nt, Human; identical to SEQ ID NO: 115798

SEQ ID NO: 222230 - RNA, 64 nt, Human; identical to SEQ ID NO: 115799

SEQ ID NO: 222231 - RNA, 64 nt, Human; identical to SEQ ID NO: 115800

SEQ ID NO: 222232 - RNA, 64 nt, Human; identical to SEQ ID NO: 115801

SEQ ID NO: 222233 - RNA, 64 nt, Human; identical to SEQ ID NO: 115802

SEQ ID NO: 222234 - RNA, 64 nt, Human; identical to SEQ ID NO: 115803

SEQ ID NO: 222235 - RNA, 64 nt, Human; identical to SEQ ID NO: 115804

SEQ ID NO: 222236 - RNA, 64 nt, Human; identical to SEQ ID NO: 115805

SEQ ID NO: 222237 - RNA, 64 nt, Human; identical to SEQ ID NO: 115806

SEQ ID NO: 222238 - RNA, 64 nt, Human; identical to SEQ ID NO: 115807

SEQ ID NO: 222239 - RNA, 64 nt, Human; identical to SEQ ID NO: 115808

SEQ ID NO: 222240 - RNA, 64 nt, Human; identical to SEQ ID NO: 115809

SEQ ID NO: 222241 - RNA, 64 nt, Human; identical to SEQ ID NO: 115810

SEQ ID NO: 222242 - RNA, 64 nt, Human; identical to SEQ ID NO: 115811

SEQ ID NO: 222243 - RNA, 64 nt, Human; identical to SEQ ID NO: 115812

SEQ ID NO: 222244 - RNA, 64 nt, Human; identical to SEQ ID NO: 115813

SEQ ID NO: 222245 - RNA, 64 nt, Human; identical to SEQ ID NO: 115814

SEQ ID NO: 222246 - RNA, 64 nt, Human; identical to SEQ ID NO: 115815

SEQ ID NO: 222247 - RNA, 64 nt, Human; identical to SEQ ID NO: 115816

SEQ ID NO: 222248 - RNA, 64 nt, Human; identical to SEQ ID NO: 115817

SEQ ID NO: 222249 - RNA, 50 nt, Human; identical to SEQ ID NO: 115818

SEQ ID NO: 222250 - RNA, 64 nt, Human; identical to SEQ ID NO: 115819

SEQ ID NO: 222251 - RNA, 64 nt, Human; identical to SEQ ID NO: 115820

SEQ ID NO: 222252 - RNA, 64 nt, Human; identical to SEQ ID NO: 115821

SEQ ID NO: 222253 - RNA, 64 nt, Human; identical to SEQ ID NO: 115822

SEQ ID NO: 222254 - RNA, 64 nt, Human; identical to SEQ ID NO: 115823

SEQ ID NO: 222255 - RNA, 64 nt, Human; identical to SEQ ID NO: 115824

SEQ ID NO: 222256 - RNA, 64 nt, Human; identical to SEQ ID NO: 115825

SEQ ID NO: 222257 - RNA, 64 nt, Human; identical to SEQ ID NO: 115826

SEQ ID NO: 222258 - RNA, 64 nt, Human; identical to SEQ ID NO: 115827

SEQ ID NO: 222259 - RNA, 64 nt, Human; identical to SEQ ID NO: 115828

SEQ ID NO: 222260 - RNA, 64 nt, Human; identical to SEQ ID NO: 115829

SEQ ID NO: 222261 - RNA, 64 nt, Human; identical to SEQ ID NO: 115830

SEQ ID NO: 222262 - RNA, 64 nt, Human; identical to SEQ ID NO: 115831

SEQ ID NO: 222263 - RNA, 64 nt, Human; identical to SEQ ID NO: 115832

SEQ ID NO: 222264 - RNA, 64 nt, Human; identical to SEQ ID NO: 115833

SEQ ID NO: 222265 - RNA, 64 nt, Human; identical to SEQ ID NO: 115834

SEQ ID NO: 222266 - RNA, 64 nt, Human; identical to SEQ ID NO: 115835

SEQ ID NO: 222267 - RNA, 64 nt, Human; identical to SEQ ID NO: 115836

SEQ ID NO: 222268 - RNA, 64 nt, Human; identical to SEQ ID NO: 115837

SEQ ID NO: 222269 - RNA, 64 nt, Human; identical to SEQ ID NO: 115838

SEQ ID NO: 222270 - RNA, 64 nt, Human; identical to SEQ ID NO: 115839

SEQ ID NO: 222271 - RNA, 64 nt, Human; identical to SEQ ID NO: 115840

SEQ ID NO: 222272 - RNA, 64 nt, Human; identical to SEQ ID NO: 115841

SEQ ID NO: 222273 - RNA, 64 nt, Human; identical to SEQ ID NO: 115842

SEQ ID NO: 222274 - RNA, 64 nt, Human; identical to SEQ ID NO: 115843

SEQ ID NO: 222275 - RNA, 64 nt, Human; identical to SEQ ID NO: 115844

SEQ ID NO: 222276 - RNA, 64 nt, Human; identical to SEQ ID NO: 115845

SEQ ID NO: 222277 - RNA, 64 nt, Human; identical to SEQ ID NO: 115846

SEQ ID NO: 222278 - RNA, 64 nt, Human; identical to SEQ ID NO: 115847

SEQ ID NO: 222279 - RNA, 64 nt, Human; identical to SEQ ID NO: 115848

SEQ ID NO: 222280 - RNA, 64 nt, Human; identical to SEQ ID NO: 115849

SEQ ID NO: 222281 - RNA, 64 nt, Human; identical to SEQ ID NO: 115850

SEQ ID NO: 222282 - RNA, 64 nt, Human; identical to SEQ ID NO: 115851

SEQ ID NO: 222283 - RNA, 64 nt, Human; identical to SEQ ID NO: 115852

SEQ ID NO: 222284 - RNA, 64 nt, Human; identical to SEQ ID NO: 115853

SEQ ID NO: 222285 - RNA, 64 nt, Human; identical to SEQ ID NO: 115854

SEQ ID NO: 222286 - RNA, 64 nt, Human; identical to SEQ ID NO: 115855

SEQ ID NO: 222287 - RNA, 64 nt, Human; identical to SEQ ID NO: 115856

SEQ ID NO: 222288 - RNA, 64 nt, Human; identical to SEQ ID NO: 115857

SEQ ID NO: 222289 - RNA, 64 nt, Human; identical to SEQ ID NO: 115858

SEQ ID NO: 222290 - RNA, 64 nt, Human; identical to SEQ ID NO: 115859

SEQ ID NO: 222291 - RNA, 64 nt, Human; identical to SEQ ID NO: 115860

SEQ ID NO: 222292 - RNA, 64 nt, Human; identical to SEQ ID NO: 115861

SEQ ID NO: 222293 - RNA, 64 nt, Human; identical to SEQ ID NO: 115862

SEQ ID NO: 222294 - RNA, 64 nt, Human; identical to SEQ ID NO: 115863

SEQ ID NO: 222295 - RNA, 64 nt, Human; identical to SEQ ID NO: 115864

SEQ ID NO: 222296 - RNA, 64 nt, Human; identical to SEQ ID NO: 115865

SEQ ID NO: 222297 - RNA, 64 nt, Human; identical to SEQ ID NO: 115866

SEQ ID NO: 222298 - RNA, 64 nt, Human; identical to SEQ ID NO: 115867

SEQ ID NO: 222299 - RNA, 64 nt, Human; identical to SEQ ID NO: 115868

SEQ ID NO: 222300 - RNA, 64 nt, Human; identical to SEQ ID NO: 115869

SEQ ID NO: 222301 - RNA, 64 nt, Human; identical to SEQ ID NO: 115870

SEQ ID NO: 222302 - RNA, 64 nt, Human; identical to SEQ ID NO: 115871

SEQ ID NO: 222303 - RNA, 64 nt, Human; identical to SEQ ID NO: 115872

SEQ ID NO: 222304 - RNA, 64 nt, Human; identical to SEQ ID NO: 115873

SEQ ID NO: 222305 - RNA, 64 nt, Human; identical to SEQ ID NO: 115874

SEQ ID NO: 222306 - RNA, 64 nt, Human; identical to SEQ ID NO: 115875

SEQ ID NO: 222307 - RNA, 64 nt, Human; identical to SEQ ID NO: 115876

SEQ ID NO: 222308 - RNA, 64 nt, Human; identical to SEQ ID NO: 115877

SEQ ID NO: 222309 - RNA, 64 nt, Human; identical to SEQ ID NO: 115878

SEQ ID NO: 222310 - RNA, 64 nt, Human; identical to SEQ ID NO: 115879

SEQ ID NO: 222311 - RNA, 64 nt, Human; identical to SEQ ID NO: 115880

SEQ ID NO: 222312 - RNA, 64 nt, Human; identical to SEQ ID NO: 115881

SEQ ID NO: 222313 - RNA, 64 nt, Human; identical to SEQ ID NO: 115882

SEQ ID NO: 222314 - RNA, 64 nt, Human; identical to SEQ ID NO: 115883

SEQ ID NO: 222315 - RNA, 64 nt, Human; identical to SEQ ID NO: 115884

SEQ ID NO: 222316 - RNA, 64 nt, Human; identical to SEQ ID NO: 115885

SEQ ID NO: 222317 - RNA, 64 nt, Human; identical to SEQ ID NO: 115886

SEQ ID NO: 222318 - RNA, 64 nt, Human; identical to SEQ ID NO: 115887

SEQ ID NO: 222319 - RNA, 64 nt, Human; identical to SEQ ID NO: 115888

SEQ ID NO: 222320 - RNA, 64 nt, Human; identical to SEQ ID NO: 115889

SEQ ID NO: 222321 - RNA, 64 nt, Human; identical to SEQ ID NO: 115890

SEQ ID NO: 222322 - RNA, 64 nt, Human; identical to SEQ ID NO: 115891

SEQ ID NO: 222323 - RNA, 64 nt, Human; identical to SEQ ID NO: 115892

SEQ ID NO: 222324 - RNA, 64 nt, Human; identical to SEQ ID NO: 115893

SEQ ID NO: 222325 - RNA, 64 nt, Human; identical to SEQ ID NO: 115894

SEQ ID NO: 222326 - RNA, 64 nt, Human; identical to SEQ ID NO: 115895

SEQ ID NO: 222327 - RNA, 64 nt, Human; identical to SEQ ID NO: 115896

SEQ ID NO: 222328 - RNA, 64 nt, Human; identical to SEQ ID NO: 115897

SEQ ID NO: 222329 - RNA, 64 nt, Human; identical to SEQ ID NO: 115898

SEQ ID NO: 222330 - RNA, 64 nt, Human; identical to SEQ ID NO: 115899

SEQ ID NO: 222331 - RNA, 64 nt, Human; identical to SEQ ID NO: 115900

SEQ ID NO: 222332 - RNA, 64 nt, Human; identical to SEQ ID NO: 115901

SEQ ID NO: 222333 - RNA, 64 nt, Human; identical to SEQ ID NO: 115902

SEQ ID NO: 222334 - RNA, 64 nt, Human; identical to SEQ ID NO: 115903

SEQ ID NO: 222335 - RNA, 64 nt, Human; identical to SEQ ID NO: 115904

SEQ ID NO: 222336 - RNA, 64 nt, Human; identical to SEQ ID NO: 115905

SEQ ID NO: 222337 - RNA, 64 nt, Human; identical to SEQ ID NO: 115906

SEQ ID NO: 222338 - RNA, 64 nt, Human; identical to SEQ ID NO: 115907

SEQ ID NO: 222339 - RNA, 64 nt, Human; identical to SEQ ID NO: 115908

SEQ ID NO: 222340 - RNA, 64 nt, Human; identical to SEQ ID NO: 115909

SEQ ID NO: 222341 - RNA, 64 nt, Human; identical to SEQ ID NO: 115910

SEQ ID NO: 222342 - RNA, 64 nt, Human; identical to SEQ ID NO: 115911

SEQ ID NO: 222343 - RNA, 64 nt, Human; identical to SEQ ID NO: 115912

SEQ ID NO: 222344 - RNA, 64 nt, Human; identical to SEQ ID NO: 115913

SEQ ID NO: 222345 - RNA, 64 nt, Human; identical to SEQ ID NO: 115914

SEQ ID NO: 222346 - RNA, 64 nt, Human; identical to SEQ ID NO: 115915

SEQ ID NO: 222347 - RNA, 56 nt, Human
ggaagcuguuccuggacugacugcuggcuggcgaggaggcugcgagcguggaaucg

SEQ ID NO: 222348 - RNA, 64 nt, Human
cugcugcacucaucugauguaaaaccaucccagagcuggcgagaggauggagcuggguggaaac

SEQ ID NO: 222349 - RNA, 64 nt, Human
augugggcuucaacuccucgacaucacuguucaugcuggcgagugaaugccagugugcugaugg

SEQ ID NO: 222350 - RNA, 64 nt, Human
ucucacaguguacuugguaccaucccugggcucugcuggcgagacgaaacagcuguagagauga

SEQ ID NO: 222351 - RNA, 64 nt, Human
guguguuucugaaguguucgaggguaccaggagagcuggcgaugacugaacugcugauggacaa

SEQ ID NO: 222352 - RNA, 64 nt, Human
acagcucaggagaguugugagggaugggacggaggcuggcgaccaggcgaggccuaggccaggc

SEQ ID NO: 222353 - RNA, 64 nt, Human
cccaguauugcccuggagcugucucuggaaaguagcuggcgagguuaccuuaacuaucacugaa

SEQ ID NO: 222354 - RNA, 64 nt, Human
ugcagcauuaugcuuugggcaguauuacaaaauagcuggcgagugcuuucuguauuuaaauauu

SEQ ID NO: 222355 - RNA, 64 nt, Human
acauuucugaauugcaguugaaugguuggagauugcuggcgaugugaugcugcacugaaaaaac

SEQ ID NO: 222356 - RNA, 64 nt, Human
agacugguccccgggggacuucuucacaggggcugcuggcgagcucuuucucuuuagggacugc

SEQ ID NO: 222357 - RNA, 64 nt, Human
ccccggcuccuuggggcucucuggucucaggccagcuggcgauggguggcuagagugaugaacu

SEQ ID NO: 222358 - RNA, 64 nt, Human
ucugugcuuaugagaggcagugguuaaaacaggggcuggcgaguugacaacuguggguucaaau

SEQ ID NO: 222359 - RNA, 64 nt, Human
cucccaaucauccaccagucagacugaauguguagcuggcgaggaauuacuuccacuucuggcc

SEQ ID NO: 222360 - RNA, 64 nt, Human
caaaccagucuaaagacuguuuauaaaggagagagcuggcgacuuauuuuuauuuuuauuuuuu

SEQ ID NO: 222361 - RNA, 64 nt, Human
gcaauccuaaaugaaaguguguaaauuauaagaagcuggcgaucuuuugauaugcuguuucaca

SEQ ID NO: 222362 - RNA, 64 nt, Human
gccaggcucaggggcagaggcugggacacaaggggcuggcgagggcugcgaggccagggaagcc

SEQ ID NO: 222363 - RNA, 64 nt, Human
ggccagggccucccucucuguuaccaaaguccaggcuggcgaauugucucugguucagggaaag

SEQ ID NO: 222364 - RNA, 64 nt, Human
ccauucagcaggcccaggucuucagggugaggcugcuggcgagggcaggggagagggggcauuc

SEQ ID NO: 222365 - RNA, 64 nt, Human
augucgacuccugcggugcggggcuggcugucuggcuggcgaggagcugcugcgcuuccuucac

SEQ ID NO: 222366 - RNA, 64 nt, Human
agcugggacuaaggcacacacacuguacuuggcagcuggcgaagcauuguuucugaguguguga

SEQ ID NO: 222367 - RNA, 64 nt, Human
auugggcugcggggucaggggcuccagcauccgagcuggcgaggaaacaguacagggucugagu

SEQ ID NO: 222368 - RNA, 64 nt, Human
acccuaaagggcggcccaggccccacgcuagaaggcuggcgagaccgaaggcagcaugugaggc

SEQ ID NO: 222369 - RNA, 64 nt, Human
cuuugcugggaagacuguggggcugccuguguuggcuggcgaccagcaggauugcuccaggauu

SEQ ID NO: 222370 - RNA, 64 nt, Human
cuaaggcauccauuaugaauacagcagaacauuugcuggcgagaguccugucugcugagaagac

SEQ ID NO: 222371 - RNA, 64 nt, Human
cccucugaggacagagcugguggggcgcgggggggcuggcgagcuacuguaaacuuuaaagaau

SEQ ID NO: 222372 - RNA, 64 nt, Human
caguuucuagagggcacuagaacuuugugccagcgcuggcgagauaccauggugccauccuccu

SEQ ID NO: 222373 - RNA, 64 nt, Human
agcucccacgcagcucucccgccacuggccacucgcuggcgacccgauggaagguuuucaggcu

SEQ ID NO: 222374 - RNA, 64 nt, Human
cggagccuggagggaugccacccagcaacacagagcuggcgacugcagcugcaccaucacacau

SEQ ID NO: 222375 - RNA, 64 nt, Human
uuuguucccggcuggacggguuagacagccaaaggcuggcgagagucuggcccuagacucgggg

SEQ ID NO: 222376 - RNA, 52 nt, Human
aggacaagggcagcuccuaggagcuggcgagucccagccugacugcucuguc

SEQ ID NO: 222377 - RNA, 64 nt, Human
caugggugaacauuagaaagagccaggguucaaagcuggcgaauggaugacgcacccuagccac

SEQ ID NO: 222378 - RNA, 64 nt, Human
agcauggcagcugguugcuccauuugagagacacgcuggcgacacacuccguccauccgacugc

SEQ ID NO: 222379 - RNA, 64 nt, Human
uuucugcggcuguguaguaaaucuccccggcccagcuggcgaacccugggccauccucacaugu

SEQ ID NO: 222380 - RNA, 64 nt, Human
caagaaaaggcuuuagcaugaaauaucuuucugagcuggcgaguuagaagaauggaagguaagg

SEQ ID NO: 222381 - RNA, 64 nt, Human
uccccugaccgagccugugagcacaucgcccccugcuggcgacagcggggaaaugagggcugaa

SEQ ID NO: 222382 - RNA, 64 nt, Human
gucucccugugcuauauuuaauuccaccagcaaagcuggcgaggcagggcccagcccugaagga

SEQ ID NO: 222383 - RNA, 64 nt, Human
ggggaaggacuccaugggccaucgugggccaagggcuggcgagggugggggcgggcaagggaug

SEQ ID NO: 222384 - RNA, 64 nt, Human
ggcugagagaauugggcagggagagggcggaagggcuggcgaucgcuuggagucauuaacguga

SEQ ID NO: 222385 - RNA, 57 nt, Human
ccaagaccccaucccagugaccacagugcuggcgagcaccgaugacugcugggggcu

SEQ ID NO: 222386 - RNA, 64 nt, Human
acccccgccauuacuuucuuuucuggagugccaugcuggcgaggauccggaugcggcagcaccc

SEQ ID NO: 222387 - RNA, 62 nt, Human
agcgcugcgucaucagcuaggagccccgccgcgcuggcgacacaaccuaaggaggaccuuuu

SEQ ID NO: 222388 - RNA, 64 nt, Human
uucacccuggcugggagcaucucugaugaggcaugcuggcgacuggauggauaauccugugcau

SEQ ID NO: 222389 - RNA, 64 nt, Human
caccuggccuggugggagaggagcuuuggaaccagcuggcgacucggaaaguaaaugcuucaaa

SEQ ID NO: 222390 - RNA, 64 nt, Human
gagggcugccauuccugacagccucccagccagggcuggcgauaaaggaccgagauagauggag

SEQ ID NO: 222391 - RNA, 64 nt, Human
uauaugggaaugagaaacagaagaagugguauuugcuggcgaguuaaauaggcaagguacccag

SEQ ID NO: 222392 - RNA, 64 nt, Human
uguagugcuacaauuagagaaacagaaguccaaggcuggcgacagcuugaaaagucugacagcu

SEQ ID NO: 222393 - RNA, 64 nt, Human
agagagagagguccugagggccccagggcugcgggcuggcgaaggaaauggucacaccccccgc

SEQ ID NO: 222394 - RNA, 64 nt, Human
acauucuuucugugaggagauugaguacucugcagcuggcgaggaguugguugaggcacuucuu

SEQ ID NO: 222395 - RNA, 64 nt, Human
gacacaugcucauuaucagggugcccucggugcagcuggcgauguuagccaaggagcggcuaca

SEQ ID NO: 222396 - RNA, 64 nt, Human
ugacccaccaauaaggauucagcuguccacacgggcuggcgacacacuuaccgcaucaaucugu

SEQ ID NO: 222397 - RNA, 64 nt, Human
agccagaccugccucacccaccaaugcagccggggcuggcgacaccagccaggugcuggucuug

SEQ ID NO: 222398 - RNA, 64 nt, Human
gggaagguuugagguuugaugagugaauauucuggcuggcgaacuccuacacauccuucaaaac

SEQ ID NO: 222399 - RNA, 64 nt, Human
agaugaugacugcaaagugaaggccccccgggcagcuggcgaugcccguucucuugaucucucu

SEQ ID NO: 222400 - RNA, 64 nt, Human
cuuucuggagauggagucucgcucuguugcccaggcuggcgagugcaauggcgcgaucuuggcu

SEQ ID NO: 222401 - RNA, 64 nt, Human
gggauacccucugccagccgcuggaagugggaaugcuggcgacagacuguguccucuuucccac

SEQ ID NO: 222402 - RNA, 64 nt, Human
gcaggacaugggcggggacaauaagggaauaaaagcuggcgagcgcggcaccccaccagagucu

SEQ ID NO: 222403 - RNA, 64 nt, Human
ggucagaacaccuaccuccccugguuauugugaggcuggcgauuacauaaguauaagcaggucc

SEQ ID NO: 222404 - RNA, 64 nt, Human
acugcuucuucucagcuucucugguugaaagcaagcuggcgaaguaagaggagguagaguugag

SEQ ID NO: 222405 - RNA, 64 nt, Human
cuucacagcagacagagcugccaggccaugaugggcuggcgacagcccggcugagcuucaguga

SEQ ID NO: 222406 - RNA, 64 nt, Human
cuccuuucuugagaagcucagccugagagaaggagcuggcgagaaccuuccccacacucagcuc

SEQ ID NO: 222407 - RNA, 64 nt, Human
uugaggguccgcauggauggccugugccgcccucgcuggcgaggcuccugugugccccuggcuu

SEQ ID NO: 222408 - RNA, 64 nt, Human
ccacacuggguuggaugauaccuuaaugagugacgcuggcgagaggcacccuacccgacgcagc

SEQ ID NO: 222409 - RNA, 64 nt, Human
gcccugugccgcacucuggcgguggccacagcgugcuggcgacacucagggcagcugccuggcc

SEQ ID NO: 222410 - RNA, 64 nt, Human
ugccagccaugccuucaggguaggcucugagcaagcuggcgaacagcccuggcugcuccaaaac

SEQ ID NO: 222411 - RNA, 64 nt, Human
gccacuggagcuagaacagcccuccugcacccaggcuggcgacagcccagcagugcccacacag

SEQ ID NO: 222412 - RNA, 64 nt, Human
agggagagcugggcagaagcagcgagggggcccagcuggcgagacuguagcccccucccacucc

SEQ ID NO: 222413 - RNA, 64 nt, Human
uguucacggauaguugucaauuggucugaaacaaauucgcuagggaaucuauuuguguagaacu

SEQ ID NO: 222414 - RNA, 64 nt, Human
aagggaaggucuucaaagcacaucgaaauguauuauucgcuaguagcggcuacuuuaaaaugcu

SEQ ID NO: 222415 - RNA, 64 nt, Human
ucagaaauuuucagagcaaucuaaaagcgccaaaauucgcuauguuuacagugauacuauuaag

SEQ ID NO: 222416 - RNA, 64 nt, Human
agccugcggguccaggguggggggcugucacuuuauucgcuacacgccucuucucuccuauaag

SEQ ID NO: 222417 - RNA, 64 nt, Human
gaggcuuaaagugcuuugugagugaauaggagccauucgcuaauucuagacccacagugucugg

SEQ ID NO: 222418 - RNA, 64 nt, Human
cccaauaggcgccuuuauuucugaggugguucuaauucgcuaggcaggccugagcgaauacaag

SEQ ID NO: 222419 - RNA, 64 nt, Human
aaagucuggacggaagauuaaaggaaggggcacaauucgcuaucacacaccuccaagaucaaga

SEQ ID NO: 222420 - RNA, 64 nt, Human
ccguauaccugagaaauaacuugcucuggugucaauucgcuauucgccagcagacaucagaaca

SEQ ID NO: 222421 - RNA, 64 nt, Human
ccuguuauuuucagugauuuuccauuuaucuuuaauucgcuauccaaaauuaaauuauugcaag

SEQ ID NO: 222422 - RNA, 64 nt, Human
acgauguuuggaaauaugguuggaagcacaauucauucgcuacuaguuauucagagcguacuuu

SEQ ID NO: 222423 - RNA, 64 nt, Human
uuggagaaggugaggccaguaaccaucucaugggauucgcuauaaucagccuauuugagcugcu

SEQ ID NO: 222424 - RNA, 64 nt, Human
gaggacuaugccagcuauagaacuuggacucauaauucgcuauccaauuuuucaugcaguuguc

SEQ ID NO: 222425 - RNA, 64 nt, Human
agaggcucagauuguaauauguaaaugguaugucauucgcuacuaugauuuaauuugaaauaug

SEQ ID NO: 222426 - RNA, 64 nt, Human
aaaccuuuagacuuuuuuuagcaauuaguuugacauucgcuacuauaguaaccaagcacucauu

SEQ ID NO: 222427 - RNA, 64 nt, Human
ccaggcacagaagggcagggccauagggagggagauucgcuacggauccaggccauuccugggu

SEQ ID NO: 222428 - RNA, 64 nt, Human
ccuuaccaaggauuuuuagccccaaaucucucauauucgcuaguguuuaaaaggcuaagaauag

SEQ ID NO: 222429 - RNA, 64 nt, Human
caagguguucugacaaggguggcuuuucucugccauucgcuaaggccuuugucacuuuuccacc

SEQ ID NO: 222430 - RNA, 64 nt, Human
ggggcgaagccuguaaucacugcagccgccgguaauucgcuaaugagggcuuugcagggauugu

SEQ ID NO: 222431 - RNA, 64 nt, Human
gaaagaacaaaagaaaugaagccuuuugauaugcauucgcuauucccagauguacgccaugccu

SEQ ID NO: 222432 - RNA, 64 nt, Human
gcuggcaggugcacauggggccuccaggucugccauucgcuauugagaacuagaaaugaggaag

SEQ ID NO: 222433 - RNA, 64 nt, Human
cuuuuggggugaacgaggaugaggcaucugaucuauucgcuaccgggacuccuccaggcucccg

SEQ ID NO: 222434 - RNA, 64 nt, Human
ucuccugcagucuguggagcguccuuguccccgccgccggaaugaaugagcauucugcagcccg

SEQ ID NO: 222435 - RNA, 64 nt, Human
gagagacugguguaagagugugggguguggcaggcgccggaaauccucaaagcuuucagaagca

SEQ ID NO: 222436 - RNA, 64 nt, Human
aauuaaagaccgcaauaaacuuucuacagaggaacgccggaaguuguuugagcaagagguggcu

SEQ ID NO: 222437 - RNA, 64 nt, Human
accccuaggcugcugugcggugggacuccacaugcgccggaaggagcuucaggugagcacugcu

SEQ ID NO: 222438 - RNA, 64 nt, Human
gaugcuaugccuggauaccagucuccacuuugcacgccggaacugccuugggaccacaguuaca

SEQ ID NO: 222439 - RNA, 64 nt, Human
cagguucuagaagaaacuggcgcuuaaaccaaaucgcauggauuucuuuuucagugacguucaa

SEQ ID NO: 222440 - RNA, 60 nt, Human
acaccgucugcuucuacugagcccagcgcccgcauggagccgccucuggagcuuccuguu

SEQ ID NO: 222441 - RNA, 64 nt, Human
caccgagaggccgaagaaggccaaggaggagcggcgcauggaccagguaggccugcggcuggcu

SEQ ID NO: 222442 - RNA, 64 nt, Human
aaaagccuuauagaagcaguaagaggcuugaccacgccggaagaguccuggagcuaaagcugga

SEQ ID NO: 222443 - RNA, 64 nt, Human
acugucccccuguguccaccagcuauucuccuggcgccggaacugccucuggucuugauagcau

SEQ ID NO: 222444 - RNA, 64 nt, Human
guggccacaauccacgcuucuccggaucgcggugcgccggaaccacggaggaugaugccaguua

SEQ ID NO: 222445 - RNA, 64 nt, Human
ucccaucggaaguuuuggguuuuccgcccacagccgccggaaguggcuccguggccccgcccuc

SEQ ID NO: 222446 - RNA, 64 nt, Human
gcacauuuugaaaagagcagcugcugcuuagggccgccggaagcugguguccugucauuuucuc

SEQ ID NO: 222447 - RNA, 64 nt, Human
uccgaagccugcggccucgcuugaaggagggcgucgccggaaacccagggaaccucucugaagu

SEQ ID NO: 222448 - RNA, 64 nt, Human
cccugcaaccgugccacguggaggagcugggggucgccggaaacaucgugcgccacaucccgga

SEQ ID NO: 222449 - RNA, 64 nt, Human
ugaaaaucaguacaaucacacaaggaggaugaaacgccggaacaaaaaugagguguguagaaca

SEQ ID NO: 222450 - RNA, 64 nt, Human
ucaauuauauauaaagagugaaacauuaaaaugacgcauggauuuauauuuauuauaauuaugu

SEQ ID NO: 222451 - RNA, 64 nt, Human
cucugguauucagguuucucuggguuuuacagaacgcauggaccccauucacguuugguuuguu

SEQ ID NO: 222452 - RNA, 64 nt, Human
ucagaaauuugauuuauucuuggacuguacucuucgcauggacugggaaguucuuuuaaaucau

SEQ ID NO: 222453 - RNA, 64 nt, Human
ggaggaaaguggcaagcuguagaaaauguuuacacgcauggaggggcauugcucuagcccucag

SEQ ID NO: 222454 - RNA, 64 nt, Human
uagcugcugaaauuccucuccgcccuugggauugcgcauggagggcaaaaucccggugacucau

SEQ ID NO: 222455 - RNA, 64 nt, Human
cacccuggggucccaaacgccgcuaacgcccagacgcauggaugcacccccuacccugccucca

SEQ ID NO: 222456 - RNA, 64 nt, Human
guuauuuugauacugcgaugaguaaggguaagggcgcauggaauggggcuaaggugggagugaa

SEQ ID NO: 222457 - RNA, 64 nt, Human
cgccaccgagcuuguagccugaaugccuggcugucgcauggagcauuuugcuucuggggugucu

SEQ ID NO: 222458 - RNA, 64 nt, Human
ccuucccacgcagcucugggaugcagcagccgcucgcauggaagugccgcccagaggcaugcag

SEQ ID NO: 222459 - RNA, 64 nt, Human
cuauuccugaggcugggggccagagaagcuuuuacgcauggaaaaacacuaaucaugccaaggu

SEQ ID NO: 222460 - RNA, 64 nt, Human
ggaaacaaggaaaacugauuaagagaaaugagcacgcauggaaaaguuucccagucuucagcag

SEQ ID NO: 222461 - RNA, 64 nt, Human
uuaugugaauuucaaacacguauggaauucauuccgcauggacucugggaucaaaggcucuuuc

SEQ ID NO: 222462 - RNA, 64 nt, Human
accauuccggguucgagcaucacaagcuuuugagcgcauggaacuccauaaacuaacaaauuac

SEQ ID NO: 222463 - RNA, 64 nt, Human
cggggagcagaucaugcaugccaaucccuguugccgcauggagcuccucagcccacugaccucu

SEQ ID NO: 222464 - RNA, 64 nt, Human
auauacauauauauauauauauauguaugaaacccgcauggaauuaucuguaugaaaucaaggu

SEQ ID NO: 222465 - RNA, 64 nt, Human
ucgggccaucucagauacuuggcugacggugaaccgcauggaacagugcaggacggaauauaga

SEQ ID NO: 222466 - RNA, 64 nt, Human
ggaggaacuuuucaagcugcugaaggagggucaccgcauggacaagcccaguaacugcaccaac

SEQ ID NO: 222467 - RNA, 64 nt, Human
uugcggucccgcccggcugagacgcucgccccgacgcauggacccgagaggcgacgacacgagu

SEQ ID NO: 222468 - RNA, 64 nt, Human
gcuaguuuuauugguuuaguauucuuguuguuuacgcauggaaucacuauuccugguuaucuca

SEQ ID NO: 222469 - RNA, 64 nt, Human
auccucgcaguugcaugugacagccacagccacacgcauggacguuucauccaacagcuccccg

SEQ ID NO: 222470 - RNA, 64 nt, Human
aggaaaacgaauuugugcaggagaaggacuugcccgcauggagcuauuuuuauuucuaaccaca

SEQ ID NO: 222471 - RNA, 64 nt, Human
aaauuacccucucucugcagacaugcugggaacucgcauggaacaggagggcagcagggcacua

SEQ ID NO: 222472 - RNA, 64 nt, Human
uaauggaggagaggcaguagccuccgacacagaacgcauggaccuccuacuacugugugugagg

SEQ ID NO: 222473 - RNA, 64 nt, Human
ucuggagcauuuaacccgggugcaccguaucauccgcauggaccgcggccacgcccugcugguc

SEQ ID NO: 222474 - RNA, 64 nt, Human
gaaacgacccggcacgggcauccugugugcggcccgcauggaggguuuggaaaaguucacggag

SEQ ID NO: 222475 - RNA, 64 nt, Human
acuucugacaaaaaacaaaaagugcugcauggcucgcauggaauccacgcgcuccagggacucu

SEQ ID NO: 222476 - RNA, 64 nt, Human
ucaugagcuguguucacagaccucagcagggcaucgcauggaccgcaggagggcagauucggac

SEQ ID NO: 222477 - RNA, 64 nt, Human
ucaaguccuuaccucuuccggagauguagcaaaacgcauggaguguguauuguucccagugaca

SEQ ID NO: 222478 - RNA, 64 nt, Human
acuucaugcccuuuugggauaagaaaccacaaaacgcauggaacaacuauccauggcucuuagc

SEQ ID NO: 222479 - RNA, 64 nt, Human
cccugcccgcccccccccccaccaguccugcccccgcauggagcccccgugauuaguagcccgu

SEQ ID NO: 222480 - RNA, 64 nt, Human
aguuccaugagagaacagcacucaagcuucuggccgcauggacccgauggcucgcauucugugu

SEQ ID NO: 222481 - RNA, 52 nt, Human
ugggccuugacaaaguguaaaccgcauggaugggcuuccccaaggauuuauu

SEQ ID NO: 222482 - RNA, 64 nt, Human
ucaguuuggaaucucauucuggaaaagauggaaucgcauggagauucucuagcuguuagguaga

SEQ ID NO: 222483 - RNA, 64 nt, Human
uaucuccuuggaauucauccaaagcccccauggacgcauggacgcagggcgacaauaaacugua

SEQ ID NO: 222484 - RNA, 64 nt, Human
gaggaugauuaucuaccucacugauaagaggcaucgcauggacguucucuggucuguaguggag

SEQ ID NO: 222485 - RNA, 64 nt, Human
agccagcguugguguggugggcggagcucccagucgcauggagcgguguucauggaugcaacag

SEQ ID NO: 222486 - RNA, 64 nt, Human
uggcucgcguggacagguggacggacgcuguggccgcauggaaccuugagaacccagggacgag

SEQ ID NO: 222487 - RNA, 64 nt, Human
gaagcgccgcuccaccgucugcccuccaaggacccgcauggaggcagugggcuggcagcuuccu

SEQ ID NO: 222488 - RNA, 64 nt, Human
cagcgagcugggcaccugggagcaccagcugcggcgcauggagauggauaagaccagggguaug

SEQ ID NO: 222489 - RNA, 64 nt, Human
gggaauugagccaugccaccaaagccaagaggagcgcauggaaacccgguagucuagaacuaau

SEQ ID NO: 222490 - RNA, 64 nt, Human
ccuugaugcagccuucacaugagauuugaggguccgcauggauggccugugccgcccucgcugg

SEQ ID NO: 222491 - RNA, 64 nt, Human
cacagggccuaguacauagugggcccccuacauacgcauggauucugggucuccagauuggaac

SEQ ID NO: 222492 - RNA, 52 nt, Human
uggaacucacuggaaagugacgcgcauggacggggcccagcuaggcgccagg

SEQ ID NO: 222493 - RNA, 64 nt, Human
cgccugcgaggcguuggauaagccuggggagccccgcauggaccgcggcuuccgccggguagcg

SEQ ID NO: 222494 - RNA, 64 nt, Human
gggagcuuaggcgcacauggaaaugagagcccggcgcauggauuuuaauguuuuucuaacaacu

SEQ ID NO: 222495 - RNA, 64 nt, Human
ugugcgccccuuguuggaugaugaggaauauuaccgcauggaguugcuggccaaagaauuccag

SEQ ID NO: 222496 - RNA, 64 nt, Human
ggacgaucacgaaacaaucacggugcgaaauguccgcauggaugaucacgaaacaaucacggug

SEQ ID NO: 222497 - RNA, 64 nt, Human
aaauagcugacccgggugggcauuccaaaauguccgcauggacgaucacgaaacaaucacggug

SEQ ID NO: 222498 - RNA, 64 nt, Human
ugcuuuacguauagauggguccuguugggauaugcgcauggacgugugagugagugugcguaug

SEQ ID NO: 222499 - RNA, 64 nt, Human
ggagagccgggggcgcagcuuggagauccaggggcgcauggagaggccacggugccagagguuc

SEQ ID NO: 222500 - RNA, 63 nt, Human
caugugcagauuccaggcaccgaggcagggcuggaggaguaaguggcuuugcaauaaaauggg

SEQ ID NO: 222501 - RNA, 63 nt, Human
cucaauuuaagaugggguauucuuucacuaguugaggaguagaagaggaugaccagcuagacu

SEQ ID NO: 222502 - RNA, 63 nt, Human
ugacucuacuaaaaguuuagggaaaaaaaacaggaggaguaugacacacacagcaacuugauu

SEQ ID NO: 222503 - RNA, 63 nt, Human
caucccuccccuccuuuucagguaaggagacaggaggaguaggaggaggcagggccucuccau

SEQ ID NO: 222504 - RNA, 63 nt, Human
ggaagucguuucaggacauggggcauagaaacugaggaguagcugagaggaagaugaagagaa

SEQ ID NO: 222505 - RNA, 63 nt, Human
auaaugacauuucaaccaucaacauaauauagugaggaguagcauaauauuuuuuaauaaugc

SEQ ID NO: 222506 - RNA, 63 nt, Human
cucucgcauacuuugccaaaugaggccugcucagaggaguaggagcugaaagauggugccuuc

SEQ ID NO: 222507 - RNA, 63 nt, Human
gcauaccaaccuggaucacucuuccacccaaccgaggaguagaugcaucugaaucuucauauc

SEQ ID NO: 222508 - RNA, 63 nt, Human
acuacucagagggauaaccccuuacaguggucugaggaguaacuauuuccuaaaguauucuaa

SEQ ID NO: 222509 - RNA, 63 nt, Human
gauacaguuugcuuguaauauuuuuaauaaugugaggaguacaguguuuucuaauucauucaa

SEQ ID NO: 222510 - RNA, 63 nt, Human
gagugaaagggcuauggcaagggggugucaucugaggaguauuaagaaugcagauuccugggc

SEQ ID NO: 222511 - RNA, 63 nt, Human
acugcugcucucaacuccccaccucugggcacugaggaguauuuccccucauucuaccucucu

SEQ ID NO: 222512 - RNA, 63 nt, Human
ccugcacacagucuguuggauagguagggccacgaggaguagccagguaggcgagacacaaaa

SEQ ID NO: 222513 - RNA, 63 nt, Human
gaauugcguuggucucugcauuuuucugcagaagaggaguaaccgcuccagguaccuugaccu

SEQ ID NO: 222514 - RNA, 63 nt, Human
ugguucucugauuauguccaugcuguguccaaggaggaguagguacauacaaucagcacagau

SEQ ID NO: 222515 - RNA, 63 nt, Human
cuaggccucccuugcagccaacucuggaaggcagaggaguaagagaggaagaugcuuaccagu

SEQ ID NO: 222516 - RNA, 63 nt, Human
acuacagguuauggaaagaaucauggcauuacugaggaguaaaccucucuggcacacugagca

SEQ ID NO: 222517 - RNA, 63 nt, Human
caugcagcauaagaaacugcugcagaguggugcgaggaguacauuuucagagcaggugcagua

SEQ ID NO: 222518 - RNA, 63 nt, Human
cugugauuuaagaugcucgaaaagaguguccaagaggaguaaaggucaugacagaauuuacuc

SEQ ID NO: 222519 - RNA, 63 nt, Human
agcaacuuuauuauagauuuaaacuuucuucaugaggaguaaaaauccaaggcuuuacugcug

SEQ ID NO: 222520 - RNA, 63 nt, Human
ccuguugcugguuaacauucaccuuccucuuuugaggaguauuuuuccauuauguauucauaa

SEQ ID NO: 222521 - RNA, 63 nt, Human
ucuuuuaauuuuuuuuuaaugugagaaggaagggaggaguaggaaucuugagauuccagaucg

SEQ ID NO: 222522 - RNA, 63 nt, Human
ugaaauuuuagaaauauucacaucuucggagaugaggaguaaaauucaguuuuuuuccaguuc

SEQ ID NO: 222523 - RNA, 63 nt, Human
uacaaggaaugucauuuuugugcauccuacagugaggaguaacugaucaggugucuauaacau

SEQ ID NO: 222524 - RNA, 63 nt, Human
ugaaaacuggccagucgggaugacugggugaaagaggaguagcuccugccacuggcguuuuga

SEQ ID NO: 222525 - RNA, 63 nt, Human
ugaaaucgcagagacuuuugcagcaucagaucugaggaguaaaacggcaccucuggccuucau

SEQ ID NO: 222526 - RNA, 63 nt, Human
uaccaagguugggggugagccuacccuuucgaggaggaguauuuuaaucaccaacauuguuua

SEQ ID NO: 222527 - RNA, 63 nt, Human
gaacccuggaaacccccuucuuaaauuugggaggaggaguaugccuuuggugucccccuccca

SEQ ID NO: 222528 - RNA, 63 nt, Human
gaaguaaacuuuuuguucugguccuuuuuggucgaggaguaacaauacaaauggauuuuggga

SEQ ID NO: 222529 - RNA, 63 nt, Human
aagcaauagaauaaucuuccauuuggcugucgugaggaguaauugaauguaauccaucucuua

SEQ ID NO: 222530 - RNA, 63 nt, Human
ccauggccccaaaaagaacugccaaguuuuggugaggaguaacacccuggcaugacauuccuu

SEQ ID NO: 222531 - RNA, 63 nt, Human
gaacucauguucuugaugagaauacuucuagaugaggaguauagugguaaguaagcucugacu

SEQ ID NO: 222532 - RNA, 63 nt, Human
augauucagagaaguucuucaggccuguagaaagaggaguauggaacaaccuuacauuuguug

SEQ ID NO: 222533 - RNA, 63 nt, Human
cauuuaaaaaagaaagaacaugggugguacauugaggaguauuuacauuuuauaaaaugacuu

SEQ ID NO: 222534 - RNA, 63 nt, Human
gcacuucccugucuggacuucagcccguauuccgaggaguagagaggcagaagagaugucagc

SEQ ID NO: 222535 - RNA, 63 nt, Human
uguuagugucggggaaauaguuugcagauaauggaggaguaacccuacaacuauauguccuua

SEQ ID NO: 222536 - RNA, 63 nt, Human
uuucugguuuuuagaaaguagaugaugauuucagaggaguaaggcaugccaagcagcaugcuc

SEQ ID NO: 222537 - RNA, 63 nt, Human
accugcugcauugcucuaacuuacacagaaugagaggaguaaauguucuugccuucaaauagu

SEQ ID NO: 222538 - RNA, 63 nt, Human
aguacccucucuauucacuagcuucugaaaagggaggaguauuuuuaguuugacaauuuaaua

SEQ ID NO: 222539 - RNA, 63 nt, Human
ggaugaugacugaaucuuggauuauggggugaagaggaguacagacuagguuccaguuuucuc

SEQ ID NO: 222540 - RNA, 63 nt, Human
caccaguuuuuguauuugugaacucaucugugggaggaguaaagaaaauccaaaagcauuuaa

SEQ ID NO: 222541 - RNA, 63 nt, Human
ugacaaggcauauagggauauaugccauccugagaggaguaaaguguuuagauucugaaccug

SEQ ID NO: 222542 - RNA, 63 nt, Human
caacacauaaaguugcguaagaaacuuuaccaagaggaguauuauagccaaguuuucuuugaa

SEQ ID NO: 222543 - RNA, 63 nt, Human
gggaugauggggugggcaggggauuugcaugaugaggaguaucauuccagaucugugcagagc

SEQ ID NO: 222544 - RNA, 63 nt, Human
gucaucaucuuuagucaguaaaaaccuuguaaugaggaguaguaaauaaacaagagaacauua

SEQ ID NO: 222545 - RNA, 63 nt, Human
caccagacccucaaaacccauccaagacugugggaggaguaaacaacccagcccaguuaagag

SEQ ID NO: 222546 - RNA, 63 nt, Human
cacacaagauuccaucagcccugaaggacagcagaggaguauuuuccaucauuucaaaccaca

SEQ ID NO: 222547 - RNA, 63 nt, Human
ugauuuggugagccuaauugcuguuacuaauuagaggaguaaaaauguuucacgauaacucag

SEQ ID NO: 222548 - RNA, 63 nt, Human
gaaaguguuccagacggagacucugaguuaauagaggaguagaagcugguguuaaaguuccca

SEQ ID NO: 222549 - RNA, 63 nt, Human
uagcaugaccaggagaggguuaaugagagccaagaggaguaccuggugcaccuggugccggug

SEQ ID NO: 222550 - RNA, 63 nt, Human
guugcuauucuaugcugaagagccugcuuagaggaggaguaccaggagggagccagcauuuca

SEQ ID NO: 222551 - RNA, 63 nt, Human
ugccccgguguuuacaagagccagauggugucagaggaguacgcaguuguaugcaguuauggu

SEQ ID NO: 222552 - RNA, 63 nt, Human
cugucuuuacuucuaaagaaguuagcuugaacugaggaguaaaaguguguacauauauaauau

SEQ ID NO: 222553 - RNA, 63 nt, Human
uccagucugucucuguguacugguagaggcugggaggaguagggggcagccuguuccauuucu

SEQ ID NO: 222554 - RNA, 63 nt, Human
aauguuaaguguucaccaggguauuaaaauacagaggaguauggucaaaucuuugacaaaauu

SEQ ID NO: 222555 - RNA, 63 nt, Human
cuuuaagugccuauauaugauuauuugaaugaagaggaguaggaaggaaaauggaaucaauau

SEQ ID NO: 222556 - RNA, 63 nt, Human
ccuccacuggggacucuuccaggauggguuggagaggaguaacuuugucuuauucgaccauuc

SEQ ID NO: 222557 - RNA, 63 nt, Human
uuuguggguuuuuuuuaagggaugaguggaugagaggaguaauagggaacagcuauccucucu

SEQ ID NO: 222558 - RNA, 63 nt, Human
aauucccuggugacuagagcuuugccuggugaugaggaguauuuuguggcauaauacauauau

SEQ ID NO: 222559 - RNA, 63 nt, Human
uuaccccauuaggggagacagagagagugaauggaggaguaccgagcuggcuauggacuuggg

SEQ ID NO: 222560 - RNA, 63 nt, Human
guaagcaguuuucaucugacagcguagauaaaagaggaguauaggaauuugaaugcuagagca

SEQ ID NO: 222561 - RNA, 63 nt, Human
gcugaucucagaaaggaauaaggaugaggcagagaggaguacuugaguuugugugugugugug

SEQ ID NO: 222562 - RNA, 63 nt, Human
uagcccauccuuuccucugucccagauucaaaugaggaguaagagcccagacgagaggaaggc

SEQ ID NO: 222563 - RNA, 63 nt, Human
ccccaggaccccggggggauggcccaggccugcgaggaguaccucagccagauccacaguugc

SEQ ID NO: 222564 - RNA, 63 nt, Human
augugaaggcugcccagaaaaaguuuauggcuggaggaguaucauacagugucuacauaugau

SEQ ID NO: 222565 - RNA, 63 nt, Human
gucagagaaagcagcaggauagagacgccgagagaggaguauaugugggucacagcagugagc

SEQ ID NO: 222566 - RNA, 63 nt, Human
ccaaggaagugcauccaccuggcaggugaccuggaggaguagcuuccccgaggacccccaggc

SEQ ID NO: 222567 - RNA, 63 nt, Human
agaggucucaucucccaggccccaggggagaaagaggaguagcaugaacgccaaggaauguac

SEQ ID NO: 222568 - RNA, 63 nt, Human
aggauccucguuuucuggguuuuggugauguuggaggaguaccccccagcccaccgccccgau

SEQ ID NO: 222569 - RNA, 63 nt, Human
gcgaauaaauguaauugagagucuauucauggugaggaguacaucccagugccuuuaaccugg

SEQ ID NO: 222570 - RNA, 63 nt, Human
cccagggauguaccaaaugucgaauucuagacugaggaguagaguucauuggagucuuaaacu

SEQ ID NO: 222571 - RNA, 63 nt, Human
uagagcaguggagggguggaguugaugaaaggagaggaguagaugagauggaauuuuuccagc

SEQ ID NO: 222572 - RNA, 63 nt, Human
ugacucaguccauaugagagggacaucuggguggaggaguaaauuccugugcucugaaaugcc

SEQ ID NO: 222573 - RNA, 63 nt, Human
cccacucuguuccuuggaaccuagagcuggagugaggaguagaggucuccggcuauuccagaa

SEQ ID NO: 222574 - RNA, 63 nt, Human
gauggaacauagauuagugguugccaggggauagaggaguaauuguuagugggcaugggauuu

SEQ ID NO: 222575 - RNA, 63 nt, Human
uagcauuaaauguucaucuagaguuaauagugggaggaguaaagguagccuugaggccagagc

SEQ ID NO: 222576 - RNA, 63 nt, Human
gcauggggaaaugcauauauuaaucaggggcuggaggaguauacaugauucuuguguucaugu

SEQ ID NO: 222577 - RNA, 63 nt, Human
cgaggccuggaccaagagaggcccaggcuacuggaggaguagaaggaugggccccgugggguc

SEQ ID NO: 222578 - RNA, 63 nt, Human
gggagguuacugaggggaccaggaugggagaaugaggaguaaaaugcucacggcaaagucagc

SEQ ID NO: 222579 - RNA, 63 nt, Human
cuggucaccgcgggggccgaugguggagaauccgaggaguaaagaguuugcucacugcugccu

SEQ ID NO: 222580 - RNA, 63 nt, Human
uacuuuauaguuuuaauuauuuucuuugauuuugaggaguaucuuauuugcuuucuaucauca

SEQ ID NO: 222581 - RNA, 63 nt, Human
uuuuagaaaugugauuuucuucuuuugaccugugaggaguauaacuucuuucagcccucagau

SEQ ID NO: 222582 - RNA, 63 nt, Human
uagaauggccucuuuguagaacccugugguauagaggaguauggccacugccccacuauuuuu

SEQ ID NO: 222583 - RNA, 63 nt, Human
cagaauaaacuucauggugguugccauugggcagaggaguauaggacuggggucuaggauagg

SEQ ID NO: 222584 - RNA, 63 nt, Human
uaaaaugggaucaucaucuuugaaaggggggaggaggaguaaaagcccgauuauaauggugau

SEQ ID NO: 222585 - RNA, 63 nt, Human
ucaccuuaaaaauugacacagaguuuacuaauagaggaguagagauuguugaccauuuuuaaa

SEQ ID NO: 222586 - RNA, 63 nt, Human
cuggcuguggccaccgucacaguccaggaugaagaggaguacaggguccugugagcuguuuga

SEQ ID NO: 222587 - RNA, 63 nt, Human
ugcaaauauuuuuuaaggcaguauuaagugcaagaggaguaacaugaaauaaacauucuuuca

SEQ ID NO: 222588 - RNA, 63 nt, Human
auagaagcugugaucgacuuagaauccaaauuugaggaguaagcagcauaaccuucuaccuug

SEQ ID NO: 222589 - RNA, 63 nt, Human
cccccaucuaaguggugcuuugcaaaugucuuggaggaguauaggacagaggaccaaaauaca

SEQ ID NO: 222590 - RNA, 63 nt, Human
ccauuccaggagacagacagcuucucccucccugaggaguacuucacaccagcuccuuccccu

SEQ ID NO: 222591 - RNA, 63 nt, Human
gagcuuguugucuccacuuguauauauggaucagaggaguaaauaauuggaaaaguaaucagc

SEQ ID NO: 222592 - RNA, 63 nt, Human
ggcgcccucaccuccagccagccucuuccugcagaggaguagugucagccaccuuguacuaag

SEQ ID NO: 222593 - RNA, 63 nt, Human
agaguguauuuuucccuugcuuuuggggguucagaggaguauguacaauucuucugggaagcc

SEQ ID NO: 222594 - RNA, 63 nt, Human
uguagccaacauucauucaauacuguuauaucagaggaguaggagagaggaaacauuugacuu

SEQ ID NO: 222595 - RNA, 63 nt, Human
guuuucacacucauuuuuccuuacaacaauucugaggaguagguguuguuauuaucuccauuu

SEQ ID NO: 222596 - RNA, 63 nt, Human
caauuuuuucaaagaauucuuuuuucccaaaaagaggaguaacaaaaugucauuucugaaaga

SEQ ID NO: 222597 - RNA, 63 nt, Human
acucucuaugcauaugagguuuccuaaauaaaugaggaguagcauaguuuaaaauauauauau

SEQ ID NO: 222598 - RNA, 63 nt, Human
gaacuugcuauguaauuugugucuaguuauucagaggaguaagauggugauguucaccuggca

SEQ ID NO: 222599 - RNA, 63 nt, Human
gaauggacugggugccacgguggacuuagcucugaggaguacccccagcccaagagaugaaca

SEQ ID NO: 222600 - RNA, 63 nt, Human
ccucuuagccucuggaucuagaagggaccauaagaggaguaggcccugguuccugcuguccug

SEQ ID NO: 222601 - RNA, 63 nt, Human
gcccugucuucugggccccuaggagggaugagagaggaguagcccccuuuuucagagaguuug

SEQ ID NO: 222602 - RNA, 63 nt, Human
ugauugugagaauuauaaauacagacauaaaaagaggaguacaacauacugagaaaagagcuc

SEQ ID NO: 222603 - RNA, 63 nt, Human
ccccuucaucuucugcuccaaaggugguagcaagaggaguacccaguuagggguuggagcccc

SEQ ID NO: 222604 - RNA, 63 nt, Human
gggagcccggaucugugcgacugaaggugggaagaggaguacacggugcggauccagcugcaa

SEQ ID NO: 222605 - RNA, 63 nt, Human
uacucuucugugauugggagacugcaaggcacugaggaguaucaaagaagcaaauauuuucac

SEQ ID NO: 222606 - RNA, 63 nt, Human
uaguuuaucucaguccuggaugggagagagagggaggaguaaaacugggcaagacaaagagcc

SEQ ID NO: 222607 - RNA, 63 nt, Human
auggucaccaaacaggaaguggacauucuaagggaggaguacugaagagugacggacuucuga

SEQ ID NO: 222608 - RNA, 63 nt, Human
aagcuguacaccccaggacaguuuauccugucugaggaguaaguguacaauugaucuuuuuua

SEQ ID NO: 222609 - RNA, 63 nt, Human
uaaauuuggcgcauagaggagagaaggaaaccugaggaguaguguuccuccugaaugaagguu

SEQ ID NO: 222610 - RNA, 63 nt, Human
acauauuaaaagauucagacagggaucuguguagaggaguaauuugcaguuauuuaacauaaa

SEQ ID NO: 222611 - RNA, 63 nt, Human
ucggaaccuguugcguuuugacccacggagguggaggaguaacuuuuugacauguuggccuuu

SEQ ID NO: 222612 - RNA, 63 nt, Human
uuuguuggcugacucauucucauuuacuuaauugaggaguaggagacuaaaagaauguaagug

SEQ ID NO: 222613 - RNA, 63 nt, Human
uguuggcaccaccucuccaggaggauuggaaaggaggaguaaaggauucugauuugauugaug

SEQ ID NO: 222614 - RNA, 63 nt, Human
aacggccgagccugcaccgacaacccccuggaggaggaguaccuagcacaguugcaggaggcc

SEQ ID NO: 222615 - RNA, 63 nt, Human
cgagaacacccaguaacuggggccacggggagagaggaguagccccucagacucuucuuacua

SEQ ID NO: 222616 - RNA, 63 nt, Human
cuggaggcccugggguugguagggcagcugguagaggaguaccagcuggugugccaauucccc

SEQ ID NO: 222617 - RNA, 63 nt, Human
ggagcagccugguuauuuccuaucuguaccaaagaggaguauggugggagagggaguggagug

SEQ ID NO: 222618 - RNA, 63 nt, Human
aauccuagggaagggugguggagccaguaaacagaggaguacaggugaagcaccaagcucaaa

SEQ ID NO: 222619 - RNA, 63 nt, Human
gaacuuugggugaagcaagcagaugacaaugaagaggaguaauguuccgaaucauguuuuuga

SEQ ID NO: 222620 - RNA, 63 nt, Human
aaaacagcugaagacaguggccaugcaguccgagaggaguaguggucugccucuaauuuucua

SEQ ID NO: 222621 - RNA, 63 nt, Human
acuagugguuuuuaaucaaaguuggcuuuauaggaggaguauaauguaugcacuacuguuuua

SEQ ID NO: 222622 - RNA, 63 nt, Human
ucacaaaagaccccuuaccacugcucugaugaagaggaguacacagaacacauaauucaggaa

SEQ ID NO: 222623 - RNA, 63 nt, Human
ccgcaggagcaagggccccucccacauacacaggaggaguauuucauuucuccuuaaugaagg

SEQ ID NO: 222624 - RNA, 63 nt, Human
gcuaaauaggaaaguuuugagcuucaagucagugaggaguaaaaaagauuuuuaaaaagcaaa

SEQ ID NO: 222625 - RNA, 63 nt, Human
cccaccagggcagcacgggacagaaacgucacggaggaguagccuccaggcucagguuggugu

SEQ ID NO: 222626 - RNA, 63 nt, Human
gugucagcccacguugcuggccuuuggggucaagaggaguagggaucccaggcugcccuggac

SEQ ID NO: 222627 - RNA, 63 nt, Human
uacuuugcacuuaauuuaauaagggcauucucggaggaguagacguuuaauacgaaguggcgg

SEQ ID NO: 222628 - RNA, 63 nt, Human
augcaggagcuaauuggcuuauauguuaccauggaggaguacuucaugagggagacugucaau

SEQ ID NO: 222629 - RNA, 63 nt, Human
uccuuaggcuguucuacuucuggcuuguugcaagaggaguagaugcccccucacccacacaaa

SEQ ID NO: 222630 - RNA, 63 nt, Human
agcuuuaaaaacucaagguuuuuucaaccuacugaggaguacuuuucucuaguuguuaaauag

SEQ ID NO: 222631 - RNA, 63 nt, Human
ggaacuacagcagaucgcuguuuccagaacggggaggaguaucucauugugaaacagacucua

SEQ ID NO: 222632 - RNA, 63 nt, Human
agccgcauaacagaccaauuuuuauuccacgaggaggaguaccuggaaauuaggcaaguuugc

SEQ ID NO: 222633 - RNA, 63 nt, Human
uggggcccugcccaaguggaugaggcauuccuugaggaguaucauuuucccugacaaucccca

SEQ ID NO: 222634 - RNA, 63 nt, Human
gcacugaugaugucucccuuacaagaugguugugaggaguaaaugugaucagcauguaaagug

SEQ ID NO: 222635 - RNA, 63 nt, Human
agaggacugguuuccuggguucucaggggccaggaggaguaacagaaccaggucugcucccca

SEQ ID NO: 222636 - RNA, 63 nt, Human
cauucuuaugcaguuaaacagaguuucgaccuggaggaguacagccucucacagucuacccug

SEQ ID NO: 222637 - RNA, 63 nt, Human
guugguagaaaaauuauuuguauauaauguuaagaggaguaaaagauuuuuuguagaauaaua

SEQ ID NO: 222638 - RNA, 63 nt, Human
gugagucauggccucuugcuggcaauggggugggaggaguacccccaaguccucucacuccuc

SEQ ID NO: 222639 - RNA, 63 nt, Human
gggagccuucuuacuguugagguucaacaagcugaggaguagaugggaauuugagggagaaua

SEQ ID NO: 222640 - RNA, 63 nt, Human
augggaaacauaauaccugccaucaggauuguugaggaguaaauaaauggaaauugguggacg

SEQ ID NO: 222641 - RNA, 63 nt, Human
uuuggcugggucauuuuaauaguuagagaugaggaggaguaaaagugaaauuuuugugaagga

SEQ ID NO: 222642 - RNA, 63 nt, Human
ggaaugauguucuguagagauggccuuucacuugaggaguacucaguuuucagguucuuccua

SEQ ID NO: 222643 - RNA, 63 nt, Human
cacaggugcaaucuugaccacacuuaccugcaagaggaguaaccagaggacacacuuccuucc

SEQ ID NO: 222644 - RNA, 63 nt, Human
uaagaacaugucuauguacccguuucuaggaaggaggaguauaugccuuuugucuauuucuga

SEQ ID NO: 222645 - RNA, 63 nt, Human
uaugcacauacaugugguauaagcacauguacagaggaguacacauagcauauaaacaugucu

SEQ ID NO: 222646 - RNA, 63 nt, Human
aacuuacacaaugcuaaacugugaguauguauagaggaguaaaaucuuauaaauguaaugaau

SEQ ID NO: 222647 - RNA, 63 nt, Human
uguuuuccauaaaacauauuuauauauugugaugaggaguacuuucugaagaguacuucguau

SEQ ID NO: 222648 - RNA, 63 nt, Human
cggggagggcuggggcuggccggggguccuguggaggaguacauggaggacuccagguacagc

SEQ ID NO: 222649 - RNA, 63 nt, Human
uuuauuagugccucucacaaaagauccuggauggaggaguaagaugaaauauuaugcuauuau

SEQ ID NO: 222650 - RNA, 63 nt, Human
gaaacauuggcagaacccaguuuuaaugguacagaggaguaguuuauaguguugauuucacca

SEQ ID NO: 222651 - RNA, 63 nt, Human
cagauuuggaaguuccagcgccaugaccugaucgaggaguaccacggccgccccgccgcgccg

SEQ ID NO: 222652 - RNA, 63 nt, Human
augcuuaaaaaaccuggaggaauacuuaccaaagaggaguaaccaucucugagggugggauuc

SEQ ID NO: 222653 - RNA, 63 nt, Human
cuccuaaaugaacacauaaguuuagaucgcaaugaggaguagcaggguagcugguugcuagag

SEQ ID NO: 222654 - RNA, 63 nt, Human
guggaagaggugaagaacagccugcagcucuuugaggaguauuuucugcaggauaagauguuc

SEQ ID NO: 222655 - RNA, 63 nt, Human
uuuauuaaaaccugaauuaauccuuuuuggagggaggaguagagauauauaaccugaaaauac

SEQ ID NO: 222656 - RNA, 63 nt, Human
gugcuugucucagucaaacuuaauugggaaaaggaggaguaagagcaggcccuuucugacaug

SEQ ID NO: 222657 - RNA, 63 nt, Human
ccugucccuaucucuaccacuauagaugagggugaggaguagggagugcagcccugagccugc

SEQ ID NO: 222658 - RNA, 63 nt, Human
auagauuuauauaaauaucuaaaugucucaguagaggaguagaauucaucugguuaucaccug

SEQ ID NO: 222659 - RNA, 63 nt, Human
aggaugccaccuccgcccccacccccgccgccagaggaguacaagagccagaggcccgucucc

SEQ ID NO: 222660 - RNA, 63 nt, Human
uggcacaugcucaaugguauauugcagggaggagaggaguagauuuagauuugaguaaaugcc

SEQ ID NO: 222661 - RNA, 63 nt, Human
uuaacuuggauuuaggcaggaagugaaauaugggaggaguaaagaaaacugaagaauuuaaag

SEQ ID NO: 222662 - RNA, 63 nt, Human
aagggagccgcugugcuggugggguacacugcagaggaguaagucuugugucaaagcaggaau

SEQ ID NO: 222663 - RNA, 63 nt, Human
acuuccccgucuucuccagaacuugugucuccagaggaguacgccgacuucagcagcuuccug

SEQ ID NO: 222664 - RNA, 64 nt, Human
ccgggcacaguggcucacgccuguaauccaagcacuuggggaggccgaggcgggcagaucacga

SEQ ID NO: 222665 - RNA, 64 nt, Human
ggaagaaaugagagagcaggggcaccccccuaggccagcacagccugagggguacagcaaaggg

SEQ ID NO: 222666 - RNA, 64 nt, Human
gcacagcuaccucugguggcaggagaagagaggcccagcacagcagcaggccaggccuuccugu

SEQ ID NO: 222667 - RNA, 64 nt, Human
ggcagaggcuggggcagaauguuuacagccagugccagcacaagguaguaaucuagugacagag

SEQ ID NO: 222668 - RNA, 64 nt, Human
uuuuuucagaguguuuuggggaggaguuuuagggcuuggggagagggaggacacaucuggagga

SEQ ID NO: 222669 - RNA, 64 nt, Human
acaggagucuccugcugaugcgugauagcuuaagcuuggggagaaggucuuuuccacugccuag

SEQ ID NO: 222670 - RNA, 64 nt, Human
ccugauucuauuuccuggcaccucccugccuguccuuggggauucuacuucuuccuguguggga

SEQ ID NO: 222671 - RNA, 64 nt, Human
gcccugggguucucccccuuucucuccagccugacuuggggagauggaguucuugugccauagu

SEQ ID NO: 222672 - RNA, 64 nt, Human
agcccccuccagcucaugacacuguuuggccuuucuuggggagaaggcgggguauucccacuca

SEQ ID NO: 222673 - RNA, 64 nt, Human
gcugccaccuuaugcagugcaucgaaaccuuuugcuuggggaugugcuuggagaggcagauaac

SEQ ID NO: 222674 - RNA, 64 nt, Human
uacuaagaggggaagacuggcaauuugccaagcacuuggggauuauuauaacaauuaacuagga

SEQ ID NO: 222675 - RNA, 64 nt, Human
uagagaaaaugaaaaaagauccaccagaggacaucuuggggagggggagggagcugggggggag

SEQ ID NO: 222676 - RNA, 64 nt, Human
uugccaguccagcuggguagucccaggcuccugucuuggggauguuuccccugucagcaaguaa

SEQ ID NO: 222677 - RNA, 64 nt, Human
ggagcaggcagcaguguucuuccccucagagugacuuggggagggagaaauaggaggagacguc

SEQ ID NO: 222678 - RNA, 64 nt, Human
gcugaacccucagccuugacuaugucuagagccucuuggggaaggggcaccucucuugaacccc

SEQ ID NO: 222679 - RNA, 64 nt, Human
acuucaguuacugaugaauuuuguugggaucugacuuggggaaaggguuaucagagccuagagg

SEQ ID NO: 222680 - RNA, 64 nt, Human
gugaugggaagggauccaauaguaucuucaaggccuuggggaaacuugcagugggucagugguc

SEQ ID NO: 222681 - RNA, 64 nt, Human
gcccucccacuccugccccagcuguucuccagggcuuggggaaacagaaaccacucacauaggg

SEQ ID NO: 222682 - RNA, 64 nt, Human
cucugcggaccugccggcguaguugcagcgggggcuuggggaggggcuggggguuggacgggau

SEQ ID NO: 222683 - RNA, 64 nt, Human
ucugcaugucaaguucugagcgcggacauguuuaccagcacacggcucuucuucccacggcacu

SEQ ID NO: 222684 - RNA, 64 nt, Human
guuggaaauugguaagggaacugaguacuucaaaccagcacagggaacuuagguuaguguggca

SEQ ID NO: 222685 - RNA, 64 nt, Human
cuugugauuuuuaucuggaaaaggaagaaacaccccagcacagcaagcucagccuuuuagagaa

SEQ ID NO: 222686 - RNA, 64 nt, Human
cugucccacacccaugccaaugugccaagucucccuuggggacccagcugagucuggguguucc

SEQ ID NO: 222687 - RNA, 64 nt, Human
gggugcaguaguauguacccaagggcagaugccucuuggggaaggccauggggaccugaaacau

SEQ ID NO: 222688 - RNA, 64 nt, Human
ccagacagauacagccccaaaccagggugcauggcuuggggagcagaguauaggauggauugca

SEQ ID NO: 222689 - RNA, 64 nt, Human
ggugaggaucugguauuuccuggacuaaauuccccuuggggaagacgaagggaugcugcaguuc

SEQ ID NO: 222690 - RNA, 64 nt, Human
agggaagaucugguauuuccuggccuaaauuccccuuggggaggacagggagaugcugcaguuc

SEQ ID NO: 222691 - RNA, 64 nt, Human
agaugggcccaaaggucuaucuacuaaacuagcucuuggggaaauagcuucaggauacuguagu

SEQ ID NO: 222692 - RNA, 64 nt, Human
ccuggcgagguuuuggccaggaggacgugaaguccuuggggaagaaaaacaagggaggagggca

SEQ ID NO: 222693 - RNA, 64 nt, Human
uggauaguggaaagauuuuuagauuuuuuuuuuccuuggggaaacuggcaggcaauggggguua

SEQ ID NO: 222694 - RNA, 64 nt, Human
ggugacugggaagggcugcuucucucguaagggucuuggggagaaguaagcccgcagccugccu

SEQ ID NO: 222695 - RNA, 64 nt, Human
acugacuguuauuaaaaucuuccuauuuaacuagcuuggggacuucaguugaaaauuagguucu

SEQ ID NO: 222696 - RNA, 64 nt, Human
gccaccuccccccacaagugcccuccaggcuuuucuuggggaagauaccccuuuucugaggaau

SEQ ID NO: 222697 - RNA, 64 nt, Human
ugauaaacacugaagcuggagcuguuaaauuuaucuuggggaaaccucagaacuggucuauuug

SEQ ID NO: 222698 - RNA, 64 nt, Human
ccccgaugugcacagcugccacagggagggaggucuuggggagaugggcagucagguggcccgu

SEQ ID NO: 222699 - RNA, 64 nt, Human
gggcggguggaaaccuuccuucgaaggguagugccuuggggagcagcagaccugcucugagucc

SEQ ID NO: 222700 - RNA, 64 nt, Human
gaccuugucuguaucagauuuggcagugaggaggcuuggggagcaccuaccuuacuuucaggga

SEQ ID NO: 222701 - RNA, 64 nt, Human
caugguuaagacauccuuuauaaaccaaagauggccagcacacugcuaaccagucaccaaaugu

SEQ ID NO: 222702 - RNA, 64 nt, Human
ugcaaugauuuugauggaaccaacccugaucuaaccagcacacuaaauaaaguauuugagcaau

SEQ ID NO: 222703 - RNA, 64 nt, Human
uguuuucccccagagagcuggagguuaaauacuaccagcacaucccuagauacuacucaaguua

SEQ ID NO: 222704 - RNA, 64 nt, Human
caguguggauuaguucuuuuguuaaccccacugucuuggggaaugaugccagcugggaaauuga

SEQ ID NO: 222705 - RNA, 64 nt, Human
aaaucccagcucugcuguucacugguuguaugaucuuggggaagacaucuuccuucucugccuc

SEQ ID NO: 222706 - RNA, 64 nt, Human
agcuggguugagugaggcuaucagcacagccuuccuuggggacucugaagguguccccacgaag

SEQ ID NO: 222707 - RNA, 64 nt, Human
gauuggaaggaacguccccuguccccgcacugggcuuggggaccagagcugccaccugccuguu

SEQ ID NO: 222708 - RNA, 64 nt, Human
gguugccagggcuugcagaucgcagugaauuuuccuuggggaacaucgcuguuuuguccuagag

SEQ ID NO: 222709 - RNA, 64 nt, Human
gacuccacagacugaaaagugaguuugcagaaaccuuggggaaaagggcccuuucaaagaagug

SEQ ID NO: 222710 - RNA, 64 nt, Human
cucuaaaagaagguaauuuccuccccaaauugaccuuggggaauuauucuuuuaacccuuugca

SEQ ID NO: 222711 - RNA, 64 nt, Human
caggaugggugaggggguuuagucccugccucaccuuggggauggaccuucagcugaaaccaua

SEQ ID NO: 222712 - RNA, 64 nt, Human
guggaaagucagaggaaaaaugauccaguggacacuuggggauuaucugucauucaagauccuu

SEQ ID NO: 222713 - RNA, 64 nt, Human
auuucuccuccucaaaaacugauucagaaacugacuuggggaaggaauuuaauacuuugaaguc

SEQ ID NO: 222714 - RNA, 64 nt, Human
ucuucccuguaacugaaaguuuuaagaauuguuccuuggggaaaaauuuuuuuaaaauucaccu

SEQ ID NO: 222715 - RNA, 64 nt, Human
uuauggcaguuuauaauauaggaacaaauuuguacuuggggauugguaaagauugugaguaaau

SEQ ID NO: 222716 - RNA, 64 nt, Human
uaguuuuagauuugugguaaugcuuugguauuuucuuggggaagaccuucaccuuugcaaacuu

SEQ ID NO: 222717 - RNA, 64 nt, Human
ccuuucucucuaauucaguguuuuggaggccugacuuggggacaacguauuauugauauuauug

SEQ ID NO: 222718 - RNA, 64 nt, Human
aaauaagcauccucaaaucuuuugggauuuggcacuuggggacaugaguaguugucugggauac

SEQ ID NO: 222719 - RNA, 64 nt, Human
augcaggggcucccuccagcacacagcccucaccccagcacagccagcaaggacacgcucuccc

SEQ ID NO: 222720 - RNA, 64 nt, Human
aggaagcccaccgugccccaugcaggggcucccuccagcacacagcccucaccccagcacagcc

SEQ ID NO: 222721 - RNA, 64 nt, Human
ggggagauggccagccugaagucacgguccuggcccagcacaggugggcagcagcgagcuggca

SEQ ID NO: 222722 - RNA, 64 nt, Human
uccccuccuuccacauuuguaucaccuuugcuaucuuggggaaagugcaaaggacaaacaucuc

SEQ ID NO: 222723 - RNA, 64 nt, Human
guuuggugugugggggugggaggugggcagaagucuuggggaggaaugggcaaaggagguucuc

SEQ ID NO: 222724 - RNA, 64 nt, Human
cuaaaaauguuguacaacugaccgaaagaaaacccuuggggauaaguuuagugaggggauugga

SEQ ID NO: 222725 - RNA, 64 nt, Human
aucacccacacucccuauuuugggcccucacuuccuuggggaccuggcuucauucugcucucuc

SEQ ID NO: 222726 - RNA, 64 nt, Human
gaaauaccucauugcauuucccuuugggcuucggcuuggggagauggaucaagcucagagacug

SEQ ID NO: 222727 - RNA, 64 nt, Human
gggaggauugaaacuagguccugccuuucuguaucuuggggaaauaagaccgaucuccugaccc

SEQ ID NO: 222728 - RNA, 64 nt, Human
ugccccacugaagaacauuacugagggggcuaaccuuggggacuccaauuugccaaugaugagg

SEQ ID NO: 222729 - RNA, 64 nt, Human
gaaugagaaggaggacgcugcaggaacaagugggcuuggggaauugaauagcagagagcaaacc

SEQ ID NO: 222730 - RNA, 64 nt, Human
auggugguggcacuuauggugguggcuugagagccuuggggaaauuagggcccuaacagcuaga

SEQ ID NO: 222731 - RNA, 64 nt, Human
uggccuuauggaggagcugcuccuuccuuacagccuuggggauggacuugcccacaccuccacc

SEQ ID NO: 222732 - RNA, 64 nt, Human
cuuuguccaucucagcccccagaguauaucugugcuuggggaaucucacacagaaacucaggag

SEQ ID NO: 222733 - RNA, 64 nt, Human
ccgggcaugguggcucaugccuguaaucccagcacuuggggaggccaaggcaggcggaucacau

SEQ ID NO: 222734 - RNA, 64 nt, Human
ccaaauaauugguuauuaaugguaaaauguuggacuuggggauuacugagauuaguaugugggu

SEQ ID NO: 222735 - RNA, 64 nt, Human
aguggccccucaggacccagggucccagcugcugcuuggggaugugcacugcuggccgccggcc

SEQ ID NO: 222736 - RNA, 64 nt, Human
gcuuggaaucaugggcuugauugaauuaauuacucuuggggaaaaaagacaccuuguggcauua

SEQ ID NO: 222737 - RNA, 58 nt, Human
augagaagcggcuuuucugaaaagggauccagcacaccuccucgguuuuuuuuucaau

SEQ ID NO: 222738 - RNA, 64 nt, Human
uaaccugcaccccucccugcaagggguucagagcccagcacaggagcuuucucuggcagaauug

SEQ ID NO: 222739 - RNA, 64 nt, Human
ugcagcaaccauuaauaaaugccaccacauucuaccagcacaaggaaacauaggcagcacugaa

SEQ ID NO: 222740 - RNA, 64 nt, Human
cuuuccaaccccuggggaagacauuugcaacugacuuggggaggacacagcuucagcacagccu

SEQ ID NO: 222741 - RNA, 64 nt, Human
uuugcacaaagucuaagggaccauggcugccugccuuggggaggaaccauaucucccucugggc

SEQ ID NO: 222742 - RNA, 64 nt, Human
cuuugacuggaaaggucaaguuuuauucuggugucuuggggaagcuuuguuaaauuuuuguuaa

SEQ ID NO: 222743 - RNA, 64 nt, Human
gauucauuuauaagaagagaaccagccauauacacuuggggagauuugccacaucuuaaacuug

SEQ ID NO: 222744 - RNA, 64 nt, Human
agguuauaacaguguuuaaagucucaguuucuugcuuggggaacuugugucccuaauguguuua

SEQ ID NO: 222745 - RNA, 64 nt, Human
uuaagaaaugcuauauuuugugagugcaagcuggcuuggggagcccucucuuguguaaaugucc

SEQ ID NO: 222746 - RNA, 64 nt, Human
uguucuguuguaaaaaauauaauugcucuuaauucuuggggagguuacuaauagcaguaggaua

SEQ ID NO: 222747 - RNA, 64 nt, Human
aucuuugccccacuaggaaauguaaacaggagggcuuggggagcgugggcacuuuucucaugag

SEQ ID NO: 222748 - RNA, 64 nt, Human
uaucugugaaaguuuuaaugaucugccauaaugucuuggggaccuuugucuucuguguaaaugg

SEQ ID NO: 222749 - RNA, 64 nt, Human
agcucuguaauuauaguaucacuuagacauuucacuuggggaaauccacaagguuccuggagga

SEQ ID NO: 222750 - RNA, 64 nt, Human
acucaauuucacaucaccaaauuccucauuuauacuuggggaaaaaacaaggccauauguaaaa

SEQ ID NO: 222751 - RNA, 64 nt, Human
ugcccgcccccauauuuauucacugauagagaaucuuggggaugcuggggucuggagugaacau

SEQ ID NO: 222752 - RNA, 64 nt, Human
gcccuccucuggucacuucaaacaugcccucaggcuuggggaugcccuucuuccauucccagac

SEQ ID NO: 222753 - RNA, 64 nt, Human
agacuucgucucaaaauaaauaaauaaaguggcucuuggggaaaagcaauuuaauguaccacga

SEQ ID NO: 222754 - RNA, 64 nt, Human
agucuucccagcaauuauuacaauucuugaauuccuuggggauuuuuuacugcccuuucaaagc

SEQ ID NO: 222755 - RNA, 64 nt, Human
aguaacgaagcuaagaauaugagagugcuugucaccagcacaccuguuuuuuuucuuuuucuuu

SEQ ID NO: 222756 - RNA, 64 nt, Human
acaaagacaauacucuggugacacaugucuagacccagcacaggcuguaggcccaggagugacu

SEQ ID NO: 222757 - RNA, 64 nt, Human
gcauuugccugucaugcgcaacuggagccagcaaccagcacauccaucagcaccccaguggagg

SEQ ID NO: 222758 - RNA, 64 nt, Human
agacggaagaagcacgccaugggaaguguuuacacuuggggacaagugcuaaguauuguggagc

SEQ ID NO: 222759 - RNA, 64 nt, Human
ccaguguccccagcacuuuuaggucauuuggacacuuggggaaaagugaggccagucugcccgg

SEQ ID NO: 222760 - RNA, 64 nt, Human
caggguguuuggaucagaucaaauuuuguccucucuuggggacugcuuuuuaucugaauuauca

SEQ ID NO: 222761 - RNA, 64 nt, Human
gaauuccagugaagcagcagcugcacguccgaggcuuggggaggacccaggacuguguggguuu

SEQ ID NO: 222762 - RNA, 64 nt, Human
gucaguggcuagaccagguucaugucuguuuccccuuggggacuucugaaccuuccugcccggg

SEQ ID NO: 222763 - RNA, 64 nt, Human
acaaggaaaaaagcaaaauuggccugaauauucucuuggggaaagagggcaccaaagaaaaggg

SEQ ID NO: 222764 - RNA, 64 nt, Human
cucaugccuaaccuauguguggcucagggaccagcuuggggaaggaaaggagguuuguucugcu

SEQ ID NO: 222765 - RNA, 64 nt, Human
ugggcuuguucuuguggcuucugaugauuucugacuuggggaaaaauggggaagaguugaaaua

SEQ ID NO: 222766 - RNA, 64 nt, Human
uggagggugagggcugagugcccuggcuuccucacuuggggagaccaugggucucuguagaaau

SEQ ID NO: 222767 - RNA, 64 nt, Human
cuagccacuugucagaggaaggagagaacagugucuuggggaugcugauggguuggagugccua

SEQ ID NO: 222768 - RNA, 64 nt, Human
aagggaggaggggcgauugaggguucaccucugccuuggggaggcugauuucucacacacuggc

SEQ ID NO: 222769 - RNA, 64 nt, Human
agaauagcuuguuuguuuguuugggaaaaggagacuuggggaagaguuguguauguggguguuu

SEQ ID NO: 222770 - RNA, 64 nt, Human
aauguaggaaacccuaugggguuuaugaaaaauacuuggggaucauucucugaauggucuaagg

SEQ ID NO: 222771 - RNA, 64 nt, Human
acaaagagugggaaauuccacugggccuaccuuccuuggggauguucaugggccccaguuucca

SEQ ID NO: 222772 - RNA, 62 nt, Human
caccaacggcaauggcaugagaacucuuguuucuuggggaaggagaggagggaaaaggacca

SEQ ID NO: 222773 - RNA, 64 nt, Human
uugaaacaaccugaucacugaagccaacuuugucccagcacauuccuuaaguccuaauugggaa

SEQ ID NO: 222774 - RNA, 64 nt, Human
gagagauggacaaccaaagucagugggacaaacuccagcacagaagccugcgaggaagccuaug

SEQ ID NO: 222775 - RNA, 64 nt, Human
gaugagcaaaggauugguaugugacucugaugccccagcacaguuaccccagcgagcagaauga

SEQ ID NO: 222776 - RNA, 64 nt, Human
caaaacagaaauugggugggaaaggagucuuuaucuuggggagcaaaagcugacuuuuaaacuu

SEQ ID NO: 222777 - RNA, 64 nt, Human
agcagauuuggaaugguuuacuauuuuggcugcucuuggggacugcgagaagcagagagaauga

SEQ ID NO: 222778 - RNA, 64 nt, Human
uaggccaccacuccaggccguggacuucccccaacuuggggacagccuuauucccaaaugucuc

SEQ ID NO: 222779 - RNA, 64 nt, Human
ggauauucuucucuugcuuuauacuacucacguccuuggggagggaaaugcacaauuuuuuuuu

SEQ ID NO: 222780 - RNA, 64 nt, Human
uguauuugccuuuaagcgaacaaaugcugggguccuuggggaccagcuugucagaggguagccc

SEQ ID NO: 222781 - RNA, 64 nt, Human
auucauuauauuccuuuugguagauuuuauaccccuuggggaaauaauacaacaaaaacaucuc

SEQ ID NO: 222782 - RNA, 64 nt, Human
gguuuuuguacgaagcuauuuaaugagccugugucuuggggacucagcaggcuggagcuugggg

SEQ ID NO: 222783 - RNA, 64 nt, Human
agggaggccucaugcgucugcuccuaggaccucccuuggggaaagaggugcuucuggggaagug

SEQ ID NO: 222784 - RNA, 64 nt, Human
uagccauggugagggcuaucugcugcaggggggucuuggggagaguggugacuccauugaccca

SEQ ID NO: 222785 - RNA, 64 nt, Human
gacucacaguagggcugcuaugccuguguguaaacuuggggauggcugagggaacauagacuca

SEQ ID NO: 222786 - RNA, 64 nt, Human
agacuggguuaggcccagccuugaugccauaugccuuggggaggacaaaacuucuugucagaca

SEQ ID NO: 222787 - RNA, 64 nt, Human
ugcaagcucugugcuucuauaaugugggaaauggcuuggggaggauggccccuagcuuaggaag

SEQ ID NO: 222788 - RNA, 64 nt, Human
gcuagcaccccguaagaagagccuaccugaccgacuuggggagggaacacagagguguugggaa

SEQ ID NO: 222789 - RNA, 64 nt, Human
gggaauguugaaguuacuuaauguugaucuaucccuuggggaaaguaaaagugacugugagugg

SEQ ID NO: 222790 - RNA, 64 nt, Human
ggaagaaaauggagauuuaauccuaaaacugugacuuggggaggucagucauuuacaguuaguc

SEQ ID NO: 222791 - RNA, 64 nt, Human; identical to SEQ ID NO: 167144

SEQ ID NO: 222792 - RNA, 64 nt, Human; identical to SEQ ID NO: 167145

SEQ ID NO: 222793 - RNA, 64 nt, Human; identical to SEQ ID NO: 167185

SEQ ID NO: 222794 - RNA, 64 nt, Human
acuuuuauaagaaauaggaaauauuuuaauguuucuuggggaauauguuagagaauuuccuuac

SEQ ID NO: 222795 - RNA, 64 nt, Human
auuuuucuauuuuuaguacuguauggauguuacugagcacuacacaugauccuucugugcuugc

SEQ ID NO: 222796 - RNA, 59 nt, Human
aucagucaaaccuugcuuagguagagaaggagcacuaaauagcuacuccagauauaaaa

SEQ ID NO: 222797 - RNA, 64 nt, Human
aaaugagaucaggcccccccaggguccacccacagagcacuacagagccucugaaagaccauag

SEQ ID NO: 222798 - RNA, 64 nt, Human
agaaaagucugcgccagguugaaagugaaacuuugagcacuaccagaagaaaaggaaaccucgg

SEQ ID NO: 222799 - RNA, 64 nt, Human
cguaaaauuaauauuuacucuagugaagugguuugagcacuaaccuuguacacauuguuaagag

SEQ ID NO: 222800 - RNA, 64 nt, Human
cugcaacgccccccacuccauagucugguauucugagcacuagcuuaauauuucuucacuugaa

SEQ ID NO: 222801 - RNA, 64 nt, Human
uuuaucuuggaagaacuagugguaaaacauccaagagcacuaggauugugauacagaauuugug

SEQ ID NO: 222802 - RNA, 64 nt, Human
uucaggaauacacagagagaaggccuagagguuagagcacuagaaugcaaaagaggauuuauuu

SEQ ID NO: 222803 - RNA, 64 nt, Human
uggguuuuaacaaauucuagucuucacgcugagagagcacuacuugagagagcaguugaaaguu

SEQ ID NO: 222804 - RNA, 64 nt, Human
uuaagcaucccuggcaucagacuauggccuucaagagcacuagggcauaugcuuuuggcagcau

SEQ ID NO: 222805 - RNA, 64 nt, Human
uaggcauuuccuaucaccuauuuccauucaacaagagcacuacauucauuuagcuaaacggauu

SEQ ID NO: 222806 - RNA, 64 nt, Human; identical to SEQ ID NO: 167187

SEQ ID NO: 222807 - RNA, 64 nt, Human; identical to SEQ ID NO: 167188

SEQ ID NO: 222808 - RNA, 64 nt, Human; identical to SEQ ID NO: 167189

SEQ ID NO: 222809 - RNA, 64 nt, Human
agaggggguuuuaugcaaacgcacucaccuccgccuuggggaaugaaagggucacuucugcauc

SEQ ID NO: 222810 - RNA, 64 nt, Human
guguaugcaguauucuugcacugagguuuuuuugcuuggggauuauuuuaaauaauugguuuuu

SEQ ID NO: 222811 - RNA, 64 nt, Human
agaacgucauuguguuuuuuguugguugccacagcuuggggaaaaauagaaaaaaauuaaugac

SEQ ID NO: 222812 - RNA, 64 nt, Human
cacuaccuguuugccuccaagagacuaucaguuccuuggggacagggaccaugucuuauucauc

SEQ ID NO: 222813 - RNA, 64 nt, Human
gauagcuaugacuuguggcaaucaggcuucguagcuuggggagguagaguuacuugacauguau

SEQ ID NO: 222814 - RNA, 64 nt, Human
uuuuucuuuugccauuuucuauuuuaguaauuuccuuggggaacuaaauaauuuugcagaauuu

SEQ ID NO: 222815 - RNA, 64 nt, Human
cuguuacuuguuuaauuguuuuguuuucaauauucuuggggauuagacaggggaagguauuuua

SEQ ID NO: 222816 - RNA, 64 nt, Human
accuucgugucaggugcuguguguaaguggagaacuuggggauagaggaggaagcuccucgugg

SEQ ID NO: 222817 - RNA, 64 nt, Human
gucaguggaauggauagguaacuugggugggcaacuuggggagcugaccauucucuuuugguaa

SEQ ID NO: 222818 - RNA, 64 nt, Human
cagcuauuacuuaaacucguauuugaauaagucucuuggggagaauuauagaauguuuguuuuu

SEQ ID NO: 222819 - RNA, 64 nt, Human
acugaaaaaugaucuggauuucuauagcaaggcccuuggggagggcacucucccaugcccuugg

SEQ ID NO: 222820 - RNA, 64 nt, Human
agaccccaggaaacagcaugagaugcucagucggcuuggggaaggacugaagggcagcugccaa

SEQ ID NO: 222821 - RNA, 64 nt, Human
gccacgggauuguaacuggagcagauggagaccccuuggggagcaggcucgggcuccccagccc

SEQ ID NO: 222822 - RNA, 64 nt, Human
uuaaauuauuauuuauagaaagaaucuauaaauucuuggggaaguguguuauaagcuuuaauaa

SEQ ID NO: 222823 - RNA, 64 nt, Human
cugcucugaaaugucauuuaucuacucacacauucuuggggaaaaaaaucaaaugucaguccua

SEQ ID NO: 222824 - RNA, 64 nt, Human
gaacggaagcaggcaccacuaacuuaugaaaaggaggaggaacaggaccaaggggugagcugca

SEQ ID NO: 222825 - RNA, 64 nt, Human
aagcuggagcagagagcuggcaugaguauagggaaggaggaaggacacauuuucaauccucugc

SEQ ID NO: 222826 - RNA, 64 nt, Human
agaggccaaagccuuuguguuuuucacugguggcaggaggaaaauugauaaaucagaggugcua

SEQ ID NO: 222827 - RNA, 64 nt, Human
gaaaguaccugugguuuuuggaaaacauuucuagcuuggggaaugugacaacauuccccagugu

SEQ ID NO: 222828 - RNA, 64 nt, Human
ggguucucaguaauguagccauuugagaaacuuacuuggggacaaagucucaauccuuauuuua

SEQ ID NO: 222829 - RNA, 64 nt, Human
gcccaaaaugcaaaugaacuagacaugccaacagcuuggggaagagaauuccauacugaaagaa

SEQ ID NO: 222830 - RNA, 64 nt, Human
uccucggguggccaacuugcuaucuggugggugacuuggggacuagaaagaauaaagccuuuuc

SEQ ID NO: 222831 - RNA, 64 nt, Human
cccaucucacuccaccccacuuugucccugaugucuuggggaagguguagaacacccuagcagu

SEQ ID NO: 222832 - RNA, 64 nt, Human
uaauaauuacuagaaacccaauuaauuugauaagcuuggggacaacaucccaauagauaaaaau

SEQ ID NO: 222833 - RNA, 64 nt, Human
acccagggccuccagacgugcgggcggcacaugccuuggggacauccugccuucaggaccgugg

SEQ ID NO: 222834 - RNA, 64 nt, Human
gaaaugaaucuuugacugaagccgugccuguagccuuggggaggcccaucccccaccugccagc

SEQ ID NO: 222835 - RNA, 64 nt, Human
acagacuccugaggacagcuguccucuucugcaucuuggggacaucucuuugaauuuucugugu

SEQ ID NO: 222836 - RNA, 64 nt, Human
gccccugccccguuccugcugcggccuggccguucuuggggaaucugaccacggcgugcaaacu

SEQ ID NO: 222837 - RNA, 64 nt, Human
aggaaguuuuaguuccuucuacuaccugugugaucuuggggaaauuauuuaaccucucaguccu

SEQ ID NO: 222838 - RNA, 64 nt, Human
ucuguguuacccaguaacucaucugucaccaagccuuggggauucuuccaucugauugugaugu

SEQ ID NO: 222839 - RNA, 64 nt, Human
gguggaggagagccugguugcccagggauuuguccuuggggacaucucauccaucaaguugcac

SEQ ID NO: 222840 - RNA, 64 nt, Human
ggaugggauccucuccacccuccucuagccaucccuuggggaaggguggggagaaauauaggau

SEQ ID NO: 222841 - RNA, 64 nt, Human
accccaugagggcggggagcuggaagaaaagucucuuggggaccucuggggcaaggagcugaga

SEQ ID NO: 222842 - RNA, 64 nt, Human
aacugacagucacguuuuacugguaacuuauuuuccagcacaugaagccaccaguuucauucca

SEQ ID NO: 222843 - RNA, 64 nt, Human
auuuguucuuuccagagcuaacugauaagaguggaggaggaaugccuucuccuaagagucaguu

SEQ ID NO: 222844 - RNA, 64 nt, Human
uggcaggcagagaacugucucguacuagaauucaaggaggaaagaagaagaaauaaaagaagcu

SEQ ID NO: 222845 - RNA, 64 nt, Human
ugcccuaguuuucuuuccuccuuuccuccucugacuuggggaccuuuugggggagggcugcgac

SEQ ID NO: 222846 - RNA, 64 nt, Human
gggcagccagggcuggggaacacugugaaaguuacuuggggagggugggccgguggggccguag

SEQ ID NO: 222847 - RNA, 64 nt, Human
ugcagcuguuggcaugagaccuccuucuccccgucuuggggagguggggaccagcagauaaauc

SEQ ID NO: 222848 - RNA, 64 nt, Human
agcuguugcccuccaggggccuggcacagcuggccuuggggacgagggagaggacugauucagg

SEQ ID NO: 222849 - RNA, 64 nt, Human
ccaggagagcuaugaggccucacugggggcagaacuuggggagaccgaagccggcccuuccacu

SEQ ID NO: 222850 - RNA, 64 nt, Human
uuaauuuguucucaacacuuauuucagguaauagcuuggggauauuuaucuaaagguaccccca

SEQ ID NO: 222851 - RNA, 64 nt, Human
uguugcuaaguccugguaugauggugugagcuuccuuggggaaguacuucuugaguuauguaac

SEQ ID NO: 222852 - RNA, 64 nt, Human
acaguauaugauggggcaugugccauagugcaggcuuggggagcuuuaagccucaguuauauaa

SEQ ID NO: 222853 - RNA, 64 nt, Human
ccauaguaaugucuaauauucacaggcagaucugcuuggggaagcuaguuaugugaaaggcaaa

SEQ ID NO: 222854 - RNA, 64 nt, Human
caaaacacagccaaaaauucucaagaugcagguucuuggggaaugggauggggacagcauuuga

SEQ ID NO: 222855 - RNA, 64 nt, Human
acaauuccuauucauucuuagcacuuugacaugucuuggggaaaagcuuacauuuuaauuuaaa

SEQ ID NO: 222856 - RNA, 64 nt, Human
guuuggaucuaauagagcucaugaaauacuguaacuuggggauuguaaaugaauggauacaaua

SEQ ID NO: 222857 - RNA, 64 nt, Human
uacaaacuuuggacgagacucucaucugaacuaacuuggggaaacaauuucuagguugaagcug

SEQ ID NO: 222858 - RNA, 64 nt, Human
ugggagguggugucccuuucacacuguggugucucuuggggaaggaucuccccgaaucucaaua

SEQ ID NO: 222859 - RNA, 64 nt, Human
cuucccgccgcccccccuaucucuuccugucuaacuuggggaaggggccugggcugugaggaca

SEQ ID NO: 222860 - RNA, 64 nt, Human
uucuaauccgcccaaaagcggcagccaaucggagcgcgaggacguggucuggagguaccgccgg

SEQ ID NO: 222861 - RNA, 64 nt, Human
ggaaugacacagaggagauuagcauggcccccugcgcgaggaagauccgcagauucaugcagca

SEQ ID NO: 222862 - RNA, 64 nt, Human; identical to SEQ ID NO: 9083

SEQ ID NO: 222863 - RNA, 64 nt, Human
ucacagccgcuucuucagcauggaccaagugggccuuggggauugcagcguucucgaaguggcu

SEQ ID NO: 222864 - RNA, 64 nt, Human
uuugaauugaggaguuugaaggcauaaacaguuacuuggggauuugcgaaaauccuacuuaguu

SEQ ID NO: 222865 - RNA, 64 nt, Human
ccuuaauuguuuaaaaucucuggcuucaaaguuucuuggggaaaggucgguuuaccucacauuu

SEQ ID NO: 222866 - RNA, 64 nt, Human
uuguauuuucuuaaagcaauauucacuguuacaccuuggggacuucuuuguuuauccauucuuu

SEQ ID NO: 222867 - RNA, 64 nt, Human
gauuucauugcauuuauuguguucauaucauuuucuuggggauuauuuguaggacaaccaaccu

SEQ ID NO: 222868 - RNA, 64 nt, Human
cugacucagggaggugucaccauccgaagggaaccuuggggaacugguggccucugcauauccu

SEQ ID NO: 222869 - RNA, 64 nt, Human
uuggggccaccuggcuccaagaagcaucgcuggucuuggggacgggaagggaacccucuuccag

SEQ ID NO: 222870 - RNA, 64 nt, Human
gugguguaccugcuggaagaauucuagcaugcuacuuggggacauaauuucagugggaaauaug

SEQ ID NO: 222871 - RNA, 64 nt, Human
cuguguguuuucaagagaacaauagagugugucucuuggggaaacguaauaaaaaugaacuuuu

SEQ ID NO: 222872 - RNA, 64 nt, Human
gcaggaggaggaaagguagcccccgagggauguccuuggggaggggucagcucuggccacaauc

SEQ ID NO: 222873 - RNA, 64 nt, Human
aucacaaaaauaaguuaaaaagaaauauuugugccuuggggagaagaaacauggugaaaacagg

SEQ ID NO: 222874 - RNA, 64 nt, Human
agaggacugcagcugucuaggucugcggccacaucuuggggacacacuggacuguucccaugug

SEQ ID NO: 222875 - RNA, 64 nt, Human
uggugaccacuugccugugggcauuucuaugggccuuggggaugguggaggugcuaaugcuuug

SEQ ID NO: 222876 - RNA, 64 nt, Human
uuuucuagauauuauauacaacacaggcuuugaucuuggggacuuuucccauauauuucacacu

SEQ ID NO: 222877 - RNA, 64 nt, Human
uuuacauuuuaagaguuguagaaguuguuccuaacuuggggacuggaccuacccucuaggaggg

SEQ ID NO: 222878 - RNA, 64 nt, Human
gugggaaugcaguggguggggcuguacacacccuccagcacagacuguucccuccaagguccuc

SEQ ID NO: 222879 - RNA, 64 nt, Human
uccuuagcagcucaggcgcagcccuagugggagcccagcacacugcuucucggaggccaggccc

SEQ ID NO: 222880 - RNA, 64 nt, Human
uacuuggaguuagagccaagcugucagacggugcccagcacacauuaauguuagcuucuuucug

SEQ ID NO: 222881 - RNA, 64 nt, Human
uaacugcucccuccucaagguugucuucagacgucuuggggacguuccuaaacacugaggggga

SEQ ID NO: 222882 - RNA, 64 nt, Human
ccacaccucaagccuggaccagccaccucaaggccuuggggagcuuaggggaccuggugggaga

SEQ ID NO: 222883 - RNA, 64 nt, Human
cagcacggugcucgccgacaguggugucugaacccuuggggacgagggccugggccgcggugag

SEQ ID NO: 222884 - RNA, 64 nt, Human
uaaaaaagcugugugcucuccaagcccaguucagcuuggggacaggggcaggaggaagggguag

SEQ ID NO: 222885 - RNA, 64 nt, Human
gaagaauguuuaugucuucaagugaccuguacugcuuggggacuauuggagaaaauaaggugga

SEQ ID NO: 222886 - RNA, 64 nt, Human
guuggcaaaacuugacuccggcccaguccccacucuuggggacuuagaaccccugcuguccugg

SEQ ID NO: 222887 - RNA, 64 nt, Human
caggcccugcagccacaguguucuguuggagaaacuuggggaaguguuuucugaaccaguucuu

SEQ ID NO: 222888 - RNA, 64 nt, Human
uaaaauagugcuuuuuugaaauggagaggaaaaacuuggggaggaagaggccugcugugggggc

SEQ ID NO: 222889 - RNA, 64 nt, Human
cagaggcucuccucagucugaacuaaggcuuggccuuggggagggcuccuagugcugagcuugg

SEQ ID NO: 222890 - RNA, 64 nt, Human
aggagcugguggugcuccucacggaaccuugccgcuuggggaaccugacgucuaaguguccaga

SEQ ID NO: 222891 - RNA, 64 nt, Human
cacaccgcagggacaagcccuggagaaaugggagcuuggggagaggaugggagugggcagaggu

SEQ ID NO: 222892 - RNA, 64 nt, Human
uccacuuccucccaugagacagagugauggccagcuuggggacauuugcuuuaaaugggaaaga

SEQ ID NO: 222893 - RNA, 64 nt, Human
gugcauggugagagguugaugcagguacuuagcccuuggggaacacagguaguuccuuuucacu

SEQ ID NO: 222894 - RNA, 64 nt, Human
gaaauugccaacuaggcaggcacaaaucuugggucuuggggacuaacccaaugccugugaagca

SEQ ID NO: 222895 - RNA, 64 nt, Human
agccgcccacccccacccccagugcagggcuggucuuggggaggcagggcagccucgcggucuu

SEQ ID NO: 222896 - RNA, 64 nt, Human
uauaaccaguugcacccuguauuucuuuuugcagccagcacaaugugacccaacuuaaaauuug

SEQ ID NO: 222897 - RNA, 64 nt, Human
aacgaaucauuggcuauaaccuccagccuccugcccagcacaggaaucgguggucuccaccugu

SEQ ID NO: 222898 - RNA, 64 nt, Human
gguauccucagcacuacccacccccgccagcuccccagcacaaaggacccuuucgacaagacgu

SEQ ID NO: 222899 - RNA, 64 nt, Human
gaaacuaagccaggccuggcuggaggagcagcagcuuggggagagggauuucccugcagaccuc

SEQ ID NO: 222900 - RNA, 64 nt, Human
acuccuccgagacccaggagacaaacagcccuuccuuggggaaacuugggaaucauucuggcuu

SEQ ID NO: 222901 - RNA, 64 nt, Human
aggcacaacuucagcaggggauggcgcuaggggacuuggggauuucuggucaaccccacaagca

SEQ ID NO: 222902 - RNA, 64 nt, Human
cugucucucugggaugagucaggaggccuggaggcuuggggagagguguggagaaggagagaac

SEQ ID NO: 222903 - RNA, 64 nt, Human
cugggcugcgugcaugucgauaagcagagcuguucuuggggagaaggagggaggucucgggagu

SEQ ID NO: 222904 - RNA, 64 nt, Human
gcucaaauggagccagcggcugugguugaccugccuuggggagcagggcugaggggcgaagagg

SEQ ID NO: 222905 - RNA, 64 nt, Human
aguagcaaaaacauuuguacugagugguacaagccuuggggacugaaaaaaaaaagauuaaaac

SEQ ID NO: 222906 - RNA, 64 nt, Human
cacacacuaaaaucauuuuggcuccuggggcaagcuuggggaaugaauguggaagaugccuaua

SEQ ID NO: 222907 - RNA, 64 nt, Human
cucugugguuaaagcuacagcuugaguugacugccuuggggaugucaguuaauuaaggggugau

SEQ ID NO: 222908 - RNA, 64 nt, Human
ucuguucuugaacaacauacaaaguuuaaaguaacuuggggauggcuacaaaaaguuaacacag

SEQ ID NO: 222909 - RNA, 64 nt, Human
uuucacaggcuucagcucauggguuccacccuaacuuggggaaacaaaagccuucucuagaauc

SEQ ID NO: 222910 - RNA, 64 nt, Human
ggauggcagaaacugcugagaccuauuucccuuucuuggggagagaauaagugacagcugauua

SEQ ID NO: 222911 - RNA, 64 nt, Human
gcaggaaagguagggcagaguuguuuuguucuggcuuggggagagugggauccauccucauccu

SEQ ID NO: 222912 - RNA, 64 nt, Human
agcccaacuucccuugugggaaacugaggcccagcuuggggaaggccaggaccaugcagggaga

SEQ ID NO: 222913 - RNA, 64 nt, Human
uuucaaacaggaaguauauugggacaaaagggcucuuggggauuagauaucccuuuaaucugug

SEQ ID NO: 222914 - RNA, 64 nt, Human
cauauugugaauucauuuuuauuuugaauauaguccagcacagagcuguucaaauuuuuaguuc

SEQ ID NO: 222915 - RNA, 64 nt, Human
gcccccagccaguucucagaaacguggcuggggcccagcacagcagccugcaagggccccuguu

SEQ ID NO: 222916 - RNA, 64 nt, Human
agaguauggaggcugagccaggccuuggguuuccccagcacagccuccugucgcugcaugcgac

SEQ ID NO: 222917 - RNA, 64 nt, Human
ccaaauuacagcuauuucagguuuccuguguuagcuuggggauaggaugguggcuggagacagg

SEQ ID NO: 222918 - RNA, 64 nt, Human
gcucaaacuugcuugaccuccacuuuucaggagacuuggggacgacagcccucaucggcgucuu

SEQ ID NO: 222919 - RNA, 64 nt, Human
cugauggaaaccuccagggcaaagcugaagguuucuuggggaagccaggaaagccaguauuucc

SEQ ID NO: 222920 - RNA, 64 nt, Human
aaggaugaacuuugugugcauucaauaaaaucaucuuggggaagaggcuggcauccccgugucc

SEQ ID NO: 222921 - RNA, 64 nt, Human
gggaaggggacagauuugaggacugaagcuggggcuuggggauugccacuaaguacagcugacg

SEQ ID NO: 222922 - RNA, 64 nt, Human
cagcauggcccgaagcgugcggggccccggaugacuuggggacaccccagaauccccuggggag

SEQ ID NO: 222923 - RNA, 64 nt, Human
agguauaaccucaccuucccuggcucaucuuggccuuggggaguugccuuuaggcuugaguccu

SEQ ID NO: 222924 - RNA, 64 nt, Human
cugauggggggccuccgaaagggcuggagucagccuuggggagcugccuagcagccucuccucg

SEQ ID NO: 222925 - RNA, 64 nt, Human
aguagcuugaggcaagguggaggggcaagaaguccuuggggaagcugcuggucugggugcugcu

SEQ ID NO: 222926 - RNA, 64 nt, Human
uucuuuauuugagggacuuucccaacaccaggugcuuggggauuucuuagagaucaccaaccga

SEQ ID NO: 222927 - RNA, 50 nt, Human
aaagagcaacucaguuguaacuuggggaaguuaacgauccgcccgagugc

SEQ ID NO: 222928 - RNA, 64 nt, Human
uucuccagccagacagaugccucagcaugaagggcuuggggacuuguggaucauuccuuccucc

SEQ ID NO: 222929 - RNA, 64 nt, Human
uuuuaaagaaaacuagaaaguuuuaauguuuuaacuuggggaaaaauacaucucuuuaauguuu

SEQ ID NO: 222930 - RNA, 64 nt, Human
gcugggggccauggaggaaaggccuaaaguuucacuuggggacagagagcagagcacacucggg

SEQ ID NO: 222931 - RNA, 64 nt, Human
agggccggucgggggggacccuccaaggccaggccuuggggacaaccuuggcuuggcccuggca

SEQ ID NO: 222932 - RNA, 64 nt, Human
auuccaucuuuagauuauccuuggacuucagcuaccagcacagcaugcauuagccuugguccug

SEQ ID NO: 222933 - RNA, 64 nt, Human
ucagcucugcuggcgcaguacagcagcagcagccccagcacagcuguguuccugcggagucccc

SEQ ID NO: 222934 - RNA, 64 nt, Human
uagaauaguguuugucaacugucuuuucucugucccagcacaugccguacucuuauauguacca

SEQ ID NO: 222935 - RNA, 64 nt, Human
gagucuguguuugagagggggucugccauuccugcuuggggacugguggggaagagggccagga

SEQ ID NO: 222936 - RNA, 64 nt, Human
gaggcuccaccuccaagcucagacagggcccaggcuuggggaacagagagagcagguguacacc

SEQ ID NO: 222937 - RNA, 64 nt, Human
uuggcugaguccuucagcguuaaguggaggaaagcuuggggaagccccaauagcuggacagacc

SEQ ID NO: 222938 - RNA, 64 nt, Human
cgggcaucaguggcuaguccaaauaaaauaugggcuuggggauggaauggguggugguaaguuc

SEQ ID NO: 222939 - RNA, 64 nt, Human
cuugcaguugcugucagagaugggcucauaucugcuuggggaagccaauggggcacaauccuuc

SEQ ID NO: 222940 - RNA, 64 nt, Human
ucucuucuccagcauuuccacucaccuccguguucuuggggagugcguggugucagaucccauc

SEQ ID NO: 222941 - RNA, 64 nt, Human
acuuguuugauuaacagcagcugauccugaaagucuuggggagaucuugagaguccugaagcag

SEQ ID NO: 222942 - RNA, 64 nt, Human
gcaaaacugcaaaaaaguacuaagauguacgggucuuggggauaucugccuuauauguuauauu

SEQ ID NO: 222943 - RNA, 64 nt, Human
agagagguggaggaggccagcucgcuccaaaacccuuggggaguagagggaaggagcaggccgc

SEQ ID NO: 222944 - RNA, 64 nt, Human
cgcccccauccucucacgucccgccccgccuccacuuggggacccugccucgugucgucuuuau

SEQ ID NO: 222945 - RNA, 64 nt, Human
ggucucgugguggagccaugaucugggcugcucucuuggggacacuggguggugguuacacagu

SEQ ID NO: 222946 - RNA, 64 nt, Human
uuuuugagagaaaugucuacuuuuccuguuuucucuuggggacuuuugacccuagaguagcccu

SEQ ID NO: 222947 - RNA, 64 nt, Human
augugucuuggggugggcacaguacccggugacucuuggggauauuuauuuauuuucccugagc

SEQ ID NO: 222948 - RNA, 64 nt, Human
agauauugauggacuccuaagccaggcucuccugcuuggggaacuggguccggccguggagcug

SEQ ID NO: 222949 - RNA, 64 nt, Human
cuacgccucccugggggcuggagggauccaagagcuuggggauucaguaguccagaucucugga

SEQ ID NO: 222950 - RNA, 64 nt, Human
uaacucuucacuuagucgacaucaugaaauacacaggaggaacgccuuccgaaauaagguguaa

SEQ ID NO: 222951 - RNA, 64 nt, Human
cccaccgaagaaggccugagcaagggggaggaagaggaggaagguuggaccuucaucagaccac

SEQ ID NO: 222952 - RNA, 64 nt, Human
ugccucagaggcaguaagaaagagaggccgacccaggaggaaacaaagggugaaugaagaagaa

SEQ ID NO: 222953 - RNA, 64 nt, Human
ucaagaauucagcucugcucugagcguccuggagcuuggggaugcagccagcuggccugcacug

SEQ ID NO: 222954 - RNA, 64 nt, Human
uagguggcguguaugaguggagacgggccugggucuuggggacuggagggcagggguccuucug

SEQ ID NO: 222955 - RNA, 64 nt, Human
uggaggaucaaagaacugaaagcacuagagcagccuuggggacugcuaggaugaagcccuaaag

SEQ ID NO: 222956 - RNA, 64 nt, Human
ucucacuucagacacauacaucacuuucacaccacuuggggauggaaauaccuacaagagugaa

SEQ ID NO: 222957 - RNA, 64 nt, Human
uuaguauuucugaguaacaagauggugacuucuccuuggggaucugggagcugagcacuugucu

SEQ ID NO: 222958 - RNA, 64 nt, Human
acaggaacaagacuugccuagaucuuuguuguaucuuggggacuuuuacuuuguuguuugaugc

SEQ ID NO: 222959 - RNA, 64 nt, Human
agagugggcugccuggggauugggagggacagggcuuggggagcaggucucuggcagagaagga

SEQ ID NO: 222960 - RNA, 64 nt, Human
agaggaugaggaguguuuucuaaaaugcaguaggcuuggggagucggagaguuggggcccugag

SEQ ID NO: 222961 - RNA, 64 nt, Human
ggugucaugucaggcauuuugcaaggaaaagccacuuggggaaagauggaaaaggacaaaaaaa

SEQ ID NO: 222962 - RNA, 64 nt, Human
ugcagcuuccguggugccuuugcugccggcagcccuuggggaccacaggccugaccagggccug

SEQ ID NO: 222963 - RNA, 64 nt, Human
ucccuuccugaagugacaaaggaaacucagucuucuuggggaagaaggauugccauuagugacu

SEQ ID NO: 222964 - RNA, 64 nt, Human
ugcuauucacugcuccccucgcuccucuuaacagcuuggggaggugaccagugguucaggaggg

SEQ ID NO: 222965 - RNA, 64 nt, Human
ggccacaggaccuggaaaacacucuugguggugucuuggggauuuggugcacacaagaccaagg

SEQ ID NO: 222966 - RNA, 64 nt, Human
aaacugaauuuuucauuguacagaaaauguaucucuuggggagggccuguguacccccauucuc

SEQ ID NO: 222967 - RNA, 64 nt, Human
acacccuggcacuguucugauccaagcauauuugcuuggggaacuaagugcugacuaguuuguu

SEQ ID NO: 222968 - RNA, 64 nt, Human
agaaucuacagaccuggcuccucggaucugaagcccagcacaaaauaaucuccccguccaagga

SEQ ID NO: 222969 - RNA, 64 nt, Human
aucaaguauccuaaggacaggggauaucaagaugccagcacaaaaauucgagaaaucuuccacc

SEQ ID NO: 222970 - RNA, 64 nt, Human
aggacccaggagucugggaccccuccugggauccccagcacauucuccugcuccugggagaggc

SEQ ID NO: 222971 - RNA, 64 nt, Human
aggcagaacacuaaucagauuucaaggcccacaacuuggggacuagaccaccuuauguugaggg

SEQ ID NO: 222972 - RNA, 64 nt, Human
gcccagaccagcugggggagcauugaaaggacagcuuggggauggaauuuuuuuuuuuuuaucu

SEQ ID NO: 222973 - RNA, 64 nt, Human
gacacuacuucagagcaggaggauucuacgaagccuuggggaucagggucagugugagcagcua

SEQ ID NO: 222974 - RNA, 64 nt, Human
uggugccaguaugacccacuuggacucacccccucuuggggagggaguucugggccuggccagg

SEQ ID NO: 222975 - RNA, 64 nt, Human
acuguguuaucugcgccuucgaugaagugagacccuuggggagaacgggcuguggaugaaggag

SEQ ID NO: 222976 - RNA, 64 nt, Human
augcguguguguguuguggggaucuggccuggcccuuggggauggggcugcuggggacugcccc

SEQ ID NO: 222977 - RNA, 64 nt, Human
uauuguuuuuaucuuaaaaucaguuucuauuauccuuggggagaccaucccuaacaaaguacag

SEQ ID NO: 222978 - RNA, 64 nt, Human
ccuuccuggggaucccucuuccugcagccuuguccuuggggaguacagggaaguaccugcagug

SEQ ID NO: 222979 - RNA, 64 nt, Human
ugugacuaccuucaauauagaugaucaguacuugcuuggggaugcguugcugguucacccugua

SEQ ID NO: 222980 - RNA, 64 nt, Human
guccuggggucaggccagaccauguuucgucagccuuggggacuaggccaguguugggcaccuc

SEQ ID NO: 222981 - RNA, 64 nt, Human
gguugucuagaggugagaccaaaggauccagagacuuggggaccagaggugacaguggaugacg

SEQ ID NO: 222982 - RNA, 64 nt, Human
ucuuaccuugccuuaggcguucuaaucaugagaucuuggggacaaauugacuaugucacagguu

SEQ ID NO: 222983 - RNA, 64 nt, Human
aaucccccagcacuucccacagugccuauugauacuuggggagggugcuuggcacuuauugaau

SEQ ID NO: 222984 - RNA, 64 nt, Human
auuuuaccaaaaauuauacugaauauaauuuaaccuuggggaauccagaauacuuaguauuuuc

SEQ ID NO: 222985 - RNA, 64 nt, Human
gauaaagcagagccugcugccugcugaggggacacuuggggaaauagcagacucagaauggaca

SEQ ID NO: 222986 - RNA, 64 nt, Human
gaccaccagagaauggacaccauccaggaagaccccagcacagacucacauauggacgaggaug

SEQ ID NO: 222987 - RNA, 64 nt, Human
aaacaucuuuucuagcuucaacagagagguuucaccagcacauuuaccagaagaaucugggaau

SEQ ID NO: 222988 - RNA, 64 nt, Human
ccaucuucuaaauggcaaaggaagguggauggccccagcacagcuugaccugaggcugugguca

SEQ ID NO: 222989 - RNA, 64 nt, Human
uauuaucagcaucauaguuucucuaaaaagaaaacuuggggaucauagccgauagagagacuug

SEQ ID NO: 222990 - RNA, 64 nt, Human
auuugggaauauuugcauguacauaaugagguaucuuggggaugagauccaagucuaaacacaa

SEQ ID NO: 222991 - RNA, 64 nt, Human
uuauuucaguauuagcuauaggugcuaccuaccucuuggggacauggcccuguuugcgcuaacc

SEQ ID NO: 222992 - RNA, 64 nt, Human
ccgagugcucccuaugccuuuccaagcauuucuacuuggggaauugggccacagagguagugag

SEQ ID NO: 222993 - RNA, 64 nt, Human
gcugaucggauccauguuucucucugcgagucuccuuggggagguugggcugguaaauauuugc

SEQ ID NO: 222994 - RNA, 64 nt, Human
aacagcaagcucucugucccugcacccccaccaucuuggggaccuacaagggccuggacucaga

SEQ ID NO: 222995 - RNA, 64 nt, Human
augccuucugacagaguucagccucuuggagagucuuggggauuguuggcaccuaaacagaauc

SEQ ID NO: 222996 - RNA, 64 nt, Human
gcucuggcuuagacaccaccuggagugaucaccucuuggggacccugccuaucccacuucacag

SEQ ID NO: 222997 - RNA, 64 nt, Human
ucuccucagcuuuacuugcucccccgcccuuagccuuggggagaaauggcccguggugggcuga

SEQ ID NO: 222998 - RNA, 64 nt, Human
augaaaaaccuaucuuuuuuguaauguuggcauacuuggggaauuuaguggcaaauacauuccc

SEQ ID NO: 222999 - RNA, 64 nt, Human
gggagcggggagcuuccuggaggcuucccagggccuuggggaagggucagagaugccagccccc

SEQ ID NO: 223000 - RNA, 64 nt, Human
ccaccucuucugccuuccuuugagcucuguugggcuuggggaucuuaguuuucuuuuguuuauu

SEQ ID NO: 223001 - RNA, 64 nt, Human
gucaugaucacagugucagagacgcguccucuuucuuggggaaguugaggagugcccuucagag

SEQ ID NO: 223002 - RNA, 64 nt, Human
gcugaguuguaguguauuuuauaaauggaauaaucuuggggaaaaauugcgauucuucauuaaa

SEQ ID NO: 223003 - RNA, 64 nt, Human
acaugcaguaaaaacuaggagaaugacuuuuacccuuggggacagccaaguuuuguugauaaac

SEQ ID NO: 223004 - RNA, 64 nt, Human
cagggaagcuucaugcccacggguucugccagccccagcacagacccaaacuggggcugggccu

SEQ ID NO: 223005 - RNA, 64 nt, Human
cuuagggccauuucuaacaaagccuuggccacucccagcacaauuuggagugucaagggugaga

SEQ ID NO: 223006 - RNA, 64 nt, Human
aagggcugccgcgcucuggccuggagggacaaggccagcacacggugccucaaccaacuggaca

SEQ ID NO: 223007 - RNA, 64 nt, Human
ucugcuagcccugagccuauuuuuggaaccagcacuuggggaaacugaucuugugaggauggau

SEQ ID NO: 223008 - RNA, 58 nt, Human
agcagcugucugggaaguaggggguuagcuuggggaccugaacuguccuggaggcccc

SEQ ID NO: 223009 - RNA, 64 nt, Human
ggccuacucuggcauaauucaagugucuucuugccuuggggauccuuaguggcaucaaauggca

SEQ ID NO: 223010 - RNA, 64 nt, Human
ugaagcaaaacacucaaaccuuuaagggacuguccuuggggaggcaggcggggcugacagcuca

SEQ ID NO: 223011 - RNA, 64 nt, Human
uguaaaaggaugcucgcaccaaguguucuguaggcuuggggagggaucguuucucuguuuuguu

SEQ ID NO: 223012 - RNA, 64 nt, Human
gggcaggcccuuggauggugccugugugccuggccuuggggauggcuguggagggaacguggca

SEQ ID NO: 223013 - RNA, 64 nt, Human
cauuuuuugaauauuuguauacacauaaugagaccuuggggaugggacccaagucugaacgugg

SEQ ID NO: 223014 - RNA, 64 nt, Human
cagacugugcugaggucuugccaccaccccuccccuuggggagguggggaggcacugcuggccu

SEQ ID NO: 223015 - RNA, 64 nt, Human
cuggaaaguacguuaugauagugucccacggugccuuggggacaagagcagguggauugugcgu

SEQ ID NO: 223016 - RNA, 64 nt, Human
uauguaaaacuucuaaagcagaaucaaagcuccucuuggggaaauggcaagucuuuaggauagg

SEQ ID NO: 223017 - RNA, 64 nt, Human
cucucuggccucuugucuccccuuuuccaauaaacuuggggaccugcuuugugugcugcaaugu

SEQ ID NO: 223018 - RNA, 64 nt, Human
aaggccccaaguuaaaggguuaaagccgcuggagcuuggggagagaacauuguggaauggaagg

SEQ ID NO: 223019 - RNA, 64 nt, Human
gauccaaaagaagcccccagcuaagaaccuggaacuuggggaguuaagaccuggcagcucugga

SEQ ID NO: 223020 - RNA, 64 nt, Human
gaggaucucuaaccccucugaucguggcgcauggcuuggggauuaaacuacccuugaagaggac

SEQ ID NO: 223021 - RNA, 64 nt, Human
cacauauacuaaauaugagacaggguaaugaaaacuuggggaacugguaaguuuuugcaugcua

SEQ ID NO: 223022 - RNA, 64 nt, Human
cccucccugcaguugaggaagagccacuuuccugccagcacauguuucugggucuuggagguca

SEQ ID NO: 223023 - RNA, 64 nt, Human
uaaugucugcucuuguguagcucaggagacaauuccagcacagacacuacaguuaacgcugaac

SEQ ID NO: 223024 - RNA, 64 nt, Human
gagcugacuguggacuggugggcuccccucugggccagcacaguccccucaccucuggcagggc

SEQ ID NO: 223025 - RNA, 53 nt, Human
aggccagaucucuuacuuaaugacuuggggaaggcacaaaacaugagagaaag

SEQ ID NO: 223026 - RNA, 64 nt, Human
ggauaaauuugauuuuugcuuugggugggcuccucuuggggauggauuauggaauuuaaaccau

SEQ ID NO: 223027 - RNA, 64 nt, Human
guuaaaaugugguuuuauugagucacaguucuuucuuggggaugaaggcugugccgaguggggu

SEQ ID NO: 223028 - RNA, 64 nt, Human
acaaggugguaugguuguauacacaugcugccuucuuggggauucaaaaacagguuuuugauuu

SEQ ID NO: 223029 - RNA, 64 nt, Human
auugagcacugcugguggccaggagugcggucuacuuggggaacuggaauggagagacccaggu

SEQ ID NO: 223030 - RNA, 64 nt, Human
uuuuauucccccaaagcgggcuugcugcuucacccuuggggaugaaauaauggaagcugguuaa

SEQ ID NO: 223031 - RNA, 64 nt, Human
uuuuacagaaacucacaaauggagauugcaaagucuuggggaacuccacguguuaguuggcauc

SEQ ID NO: 223032 - RNA, 64 nt, Human
accaaacuccacacuucaucugaucccccauagacuuggggauggacagcuguucuuuggccau

SEQ ID NO: 223033 - RNA, 64 nt, Human
uuuuacaugcuguuugccaaaucuuguuucuuagcuuggggagaugauggacuuagcuuccuca

SEQ ID NO: 223034 - RNA, 64 nt, Human
cuggacacgguggcucacaccuauaauccuagcacuuggggaggcugaggcagacggauuaccu

SEQ ID NO: 223035 - RNA, 64 nt, Human
gagaucggugcguucuccugauguuuugccguggcuuggggauuguacacgggaccagcucacg

SEQ ID NO: 223036 - RNA, 64 nt, Human
cuauuuuuuuaaaguuuguaagaaugugucauuucuuggggaguagccauccaucaacaaauau

SEQ ID NO: 223037 - RNA, 64 nt, Human
guccgucaguaauuguguccucucuuuaugcuugcuuggggaauguuguuuucugacuaggcug

SEQ ID NO: 223038 - RNA, 64 nt, Human
gugucugccauguuuucauuccugagcagaagagcuuggggaaaugaacuuuugcuaaguaaac

SEQ ID NO: 223039 - RNA, 64 nt, Human
gcccugaaguuuccuagggguugccucaggaguccuuggggagaugaaggggguggggagcuga

SEQ ID NO: 223040 - RNA, 63 nt, Human; identical to SEQ ID NO: 167186

SEQ ID NO: 223041 - RNA, 64 nt, Human; identical to SEQ ID NO: 167190

SEQ ID NO: 223042 - RNA, 64 nt, Human
ggugaaugaagaagaacaaucaugaaauggaagaaggaggaagagcaugaaggaucuuauaaga

SEQ ID NO: 223043 - RNA, 64 nt, Human
auuuaagagaccgccaugguagguuucucuguagcuuggggaacuugcuguuucuaaacaugca

SEQ ID NO: 223044 - RNA, 64 nt, Human
acagccauuucuguucacacuuuucaccccacaacuuggggaucuagcugagacauuucuaccu

SEQ ID NO: 223045 - RNA, 64 nt, Human
uagcaggaagaaagaccugcauccugcaucuguacuuggggaagccagcggagaggacggggag

SEQ ID NO: 223046 - RNA, 64 nt, Human
aauggucacacagaccauuucauuuuuaccagggcuuggggacccaaugcaaagaugaugacua

SEQ ID NO: 223047 - RNA, 64 nt, Human
ccccucccaggccagccucuguaaguuggccacacuuggggagugaguguggguaugacuuuac

SEQ ID NO: 223048 - RNA, 64 nt, Human
ugcuuccacccacacgacugcaacauacaggugccuuggggaaauguggagaacauucaaucuu

SEQ ID NO: 223049 - RNA, 64 nt, Human
ugguuacauuuuccaaaguuucauugcauucucccuuggggaggcugugagagagggcuuguau

SEQ ID NO: 223050 - RNA, 64 nt, Human
gguuggguguccauggugcccugggcuguguuuccuuggggaugaggguugggugcuauggcau

SEQ ID NO: 223051 - RNA, 64 nt, Human
agucugagucaggauuggaucaacagccuccucucuuggggacucucaagagccuguguucauc

SEQ ID NO: 223052 - RNA, 64 nt, Human
cagaaucuguggagcaagaaaggauuuggggaagcuuggggacugacuccagagcccccuccua

SEQ ID NO: 223053 - RNA, 64 nt, Human
auuaguauuccaaagagauucugaaauuucuuuucuuggggaaaugacgguacauuaaaucaaa

SEQ ID NO: 223054 - RNA, 64 nt, Human
cucugccuccugccagccagaauugguggcgggacuuggggauacagcgugaagguggggaagu

SEQ ID NO: 223055 - RNA, 64 nt, Human
ugcuggguaccugguccccacugcugagcuggcccuuggggagaggugauucucagggcuggag

SEQ ID NO: 223056 - RNA, 64 nt, Human
cuuaaagcugucccuggcuggaggagcacuccaccuuggggauaguggagggggccuucagccc

SEQ ID NO: 223057 - RNA, 64 nt, Human
agaggaucugggagguggaagccaggccagaggacuuggggaaaaugagauggaggaaggaaaa

SEQ ID NO: 223058 - RNA, 64 nt, Human
gggaaaacauuguuaccucggaucuccugguuacccagcacauaguaguacuggauuccagcuc

SEQ ID NO: 223059 - RNA, 64 nt, Human
cugggagugaggguggagagucuuuccucacgcuccagcacaguggccaggaaaagaaauacug

SEQ ID NO: 223060 - RNA, 64 nt, Human
ugauuucagaaauguuaaaauagacuaaccucuaccagcacauuaaaagugauuguuucugggu

SEQ ID NO: 223061 - RNA, 64 nt, Human
cuaaagauccaggugaaguggggucaaggguggucuuggggacucugguuuggcagggcucagg

SEQ ID NO: 223062 - RNA, 64 nt, Human
acuggguagagguauguuugugaaagacauguaacuuggggauuuguuacuuuagguuuguucc

SEQ ID NO: 223063 - RNA, 64 nt, Human
cuuagagacaucaaguaugguaggggagggcaggcuuggggaaaauggccaugcaggaggugga

SEQ ID NO: 223064 - RNA, 64 nt, Human
gaggaccugugaaagaaaguuggucacugagugccuuggggacuggcaaaacauuccagaauga

SEQ ID NO: 223065 - RNA, 64 nt, Human
cacaggauuaggagcugggguagaacuggcuauccuuggggaagaggcaagcccugccucuggc

SEQ ID NO: 223066 - RNA, 64 nt, Human
aacuaacuggagaaggugcacgaaggagacaccacuuggggaccucucugagcaggcucucgug

SEQ ID NO: 223067 - RNA, 64 nt, Human
uaauauauggccccacaagcucuugacuucuguccuuggggaaagccauuuuguuaaccacacu

SEQ ID NO: 223068 - RNA, 64 nt, Human
ccccgcacccacccccaaccagagaagcacagaucuuggggagcugccccacaagccccgcugg

SEQ ID NO: 223069 - RNA, 64 nt, Human
gacguggcuuuaauuggagcacucggcugggcugcuuggggagacucuuccgugcguucuuccu

SEQ ID NO: 223070 - RNA, 64 nt, Human
gcgccuguguaggggcagcucggccucuggucgccuuggggagaccaaaagucggacaggaaac

SEQ ID NO: 223071 - RNA, 64 nt, Human
aaaaaggucugcuuuauagggguucucacucuagcuuggggagccaggguucuagcccuguauc

SEQ ID NO: 223072 - RNA, 64 nt, Human
acaccccacucccuguuugacggcccagccuggacuuggggagaaugacuuucccuuuuuugcc

SEQ ID NO: 223073 - RNA, 64 nt, Human
accuuagcaguccccacgggagauggcagggcaccuuggggaaggccaagugggaggcugggag

SEQ ID NO: 223074 - RNA, 64 nt, Human
uggacggacucccgggcugggcuuuugaauuggccuuggggacuacucggcucucacucagcuc

SEQ ID NO: 223075 - RNA, 64 nt, Human
cagccccagugccggguccucccucccuuccuggcuuggggagaccaguuucuggggagcuucc

SEQ ID NO: 223076 - RNA, 64 nt, Human
augaaaaauaauuccuuuguauugauuucacuuaccagcacauucucuacaauggugacuuaga

SEQ ID NO: 223077 - RNA, 64 nt, Human
ccuugcaacgguauccagggacuaugaugagaggccagcacauuaucuucauaugucaccuuug

SEQ ID NO: 223078 - RNA, 64 nt, Human
cucccugaccuccccaugcccuccccagccucucccagcacaaguggggcaaagccagcaugca

SEQ ID NO: 223079 - RNA, 64 nt, Human
ugugcauucaggcucuccuacuuggcagaaugaucuuggggaaacgacuucaucugaacuucag

SEQ ID NO: 223080 - RNA, 64 nt, Human
ccugggggcuccaucccuuucagccacucguggccuuggggauuucugguuguccccagcuggg

SEQ ID NO: 223081 - RNA, 64 nt, Human
uuucccuugcaggggggccagccauugucucccacuuggggaguuucuuccuggcaucaugccu

SEQ ID NO: 223082 - RNA, 64 nt, Human
ucgcccaccaagugaaagcggacugagagcagcccuuggggacggcccggugccuggcugcaag

SEQ ID NO: 223083 - RNA, 64 nt, Human
cgugugacacccucagccaagggacagugccauccuuggggacaggaggaaaagcagccugucu

SEQ ID NO: 223084 - RNA, 64 nt, Human
ucacuguguaccggggaggaggcuacgugguccccuuggggacugaucgccaaagcacgucaag

SEQ ID NO: 223085 - RNA, 64 nt, Human
agagaacguccuucuguccaucguggguaacagccuuggggagggugcagagcucugcagagcc

SEQ ID NO: 223086 - RNA, 64 nt, Human
gccaccaagccugccagaggggucucauucauggcuuggggacacagggcuccuagcaagcagg

SEQ ID NO: 223087 - RNA, 64 nt, Human
gcagucugagagaggccauucuuucccaacaccucuuggggaguuuaggguggggggggggcgc

SEQ ID NO: 223088 - RNA, 64 nt, Human
cccccucugucucagugucccuggauccuuuuuccuuggggaggggcacaggcucagccuccuc

SEQ ID NO: 223089 - RNA, 64 nt, Human
aaggcgcugaagcacugcaugauguugcugagaacuuggggacucgguucugugagggggaaaa

SEQ ID NO: 223090 - RNA, 64 nt, Human
cuggcuagcugcggugcuccuugcugguuuuuaacuuggggagaaacaccggguuucagcuuuc

SEQ ID NO: 223091 - RNA, 64 nt, Human
gcuguuuuucuacuuuguaauugugagacauuuucuuggggagggaaaauuggaaugguucccu

SEQ ID NO: 223092 - RNA, 64 nt, Human
cuuucaugguacuaguguuuuuuagauacagagacuuggggaaauugcuuuuccucuugaacca

SEQ ID NO: 223093 - RNA, 64 nt, Human
gaccugacugagccaacccaugaacucuucacuccuuggggaagccaccucccaucacaccccu

SEQ ID NO: 223094 - RNA, 64 nt, Human
aacugguacccacacuugcccuuucucccucucuccagcacacuccccucuaagaaaguaaaag

SEQ ID NO: 223095 - RNA, 64 nt, Human
ucagcuucggggccggugaggggaggggccucccccagcacagaugaggagcagcugggguagg

SEQ ID NO: 223096 - RNA, 64 nt, Human
ugaaaaguaaacgauaaaauguggauuaaagugcccagcacaaagcagauccucaauaaacauu

SEQ ID NO: 223097 - RNA, 64 nt, Human
augaggaacaaguuuccgugucuucugccuuccucuuggggaaaggugccuuguugugaugaau

SEQ ID NO: 223098 - RNA, 64 nt, Human
guugguggagaacagagagaugagaagcagagggcuuggggaaagccuguuccucucugacuca

SEQ ID NO: 223099 - RNA, 64 nt, Human
aagcaauuucuaucuguccccuucacuuucaggccuuggggagucucugcuccuaccugacucu

SEQ ID NO: 223100 - RNA, 64 nt, Human
gggggcagcagcagccuccugaccaaugcccgcucuuggggagugaggauucugcacguggaug

SEQ ID NO: 223101 - RNA, 64 nt, Human
cgaggaaccagagccauggacucuacacugugaacuuggggaacaaggguggcaucccaguggc

SEQ ID NO: 223102 - RNA, 64 nt, Human
auggaaacacuaucccagcaaucugaauuccuuacuuggggaauguugcugaggagguucagug

SEQ ID NO: 223103 - RNA, 64 nt, Human
aguuuccaaggggaccaaugugccacuguucuuccuuggggaugaggccuuugacuguuggaug

SEQ ID NO: 223104 - RNA, 64 nt, Human
gggacugaaggugggcaaggugagaguuaaggaucuuggggagguggccgggugcaguggcucg

SEQ ID NO: 223105 - RNA, 64 nt, Human
caccuuucguccugguuccuccgccacucuuccucuuggggacaacaggaagugucugauucca

SEQ ID NO: 223106 - RNA, 64 nt, Human
agcuucaagccucacaaaccuucuagccucugcccuuggggauuugcuucauuaauuucaggca

SEQ ID NO: 223107 - RNA, 64 nt, Human
aaagugacuuuguuucugcacaguuguaacugcucuuggggaugucagugaggcugggagcagg

SEQ ID NO: 223108 - RNA, 64 nt, Human
ucacauggggccugugcccaccccucuugagugucuuggggacagcucuuuccaccccuggaag

SEQ ID NO: 223109 - RNA, 64 nt, Human
ccucccagagaacuccuugaggagaacaagugcccuuggggacagccggcaggcgccccuguac

SEQ ID NO: 223110 - RNA, 64 nt, Human
uggcuaccagugugugugugggggucaucacugccuuggggaggaguggggcagggcagagaau

SEQ ID NO: 223111 - RNA, 64 nt, Human
gcgugggcugccccagugccuuggaaccugcugccuuggggacccuggacgugccgacauaugg

SEQ ID NO: 223112 - RNA, 64 nt, Human
aaucuaauuuuacucaucuugauggcuucaugauccagcacagugccucacacaaagaacuauu

SEQ ID NO: 223113 - RNA, 64 nt, Human
ugugucuucugggucaguccuaggcacaugcugcccagcacauguccaccugggaaaugagaug

SEQ ID NO: 223114 - RNA, 64 nt, Human
cuucuggccugccccauguuacuaugugauggaaccagcacaccucaaccaaaauuuuuuuaau

SEQ ID NO: 223115 - RNA, 64 nt, Human
ccccaacgcucaccccucaaccccaaguccucugcuuggggaguucuccaggagcuccggaccc

SEQ ID NO: 223116 - RNA, 64 nt, Human
gugggagagggauaccucucagagucaagggugacuuggggacuugguggagagggacuacgug

SEQ ID NO: 223117 - RNA, 64 nt, Human
gaauuugcugauucucaguuuggucacugcuuuucuuggggagaaaacagagaagaggcaauuu

SEQ ID NO: 223118 - RNA, 64 nt, Human
aagccauagcauggacaccccauggggagcuugucuuggggaggguucuggguggaagcuggca

SEQ ID NO: 223119 - RNA, 64 nt, Human
gcccacccucuguguucaugaaccugggcuggagcuuggggaccccucccugccccuggcuucc

SEQ ID NO: 223120 - RNA, 64 nt, Human
gccugagcugugggcagaugcaguuuucugugggcuuggggaaccucucacguugcuguguccu

SEQ ID NO: 223121 - RNA, 64 nt, Human
uugucccccuacccuaaaugccccccugccauaacuuggggagggcaguuuuguaaaauaggag

SEQ ID NO: 223122 - RNA, 64 nt, Human
cacaccugcggcccaauccaaggugggguggaagcuuggggaagacccauuccuucccagaggg

SEQ ID NO: 223123 - RNA, 64 nt, Human
acuuaugaggagcaagccuguugcugccaggagacuuggggagcaggacacuugugggcccuca

SEQ ID NO: 223124 - RNA, 64 nt, Human
ccguuagggcugcccaaacacuguggaaaggggacuuggggagcauuuucaauuccacauuccu

SEQ ID NO: 223125 - RNA, 64 nt, Human
ccucugggaauuucuggaaucucguauuugggggcuuggggaagggggcucagagccgucccua

SEQ ID NO: 223126 - RNA, 64 nt, Human
ccgccacaucgcggcccuccagccuggccuaacacuuggggagccccagcaugcggagugccca

SEQ ID NO: 223127 - RNA, 64 nt, Human
cuacccuaccccucccaucggggcugugcuggggcuuggggaggggagggggcgccuuguucuc

SEQ ID NO: 223128 - RNA, 64 nt, Human
caugccuaugugcccaagagcugcccagcuucagcuuggggacuggaggaccagcuguuggccu

SEQ ID NO: 223129 - RNA, 64 nt, Human
ccuagauguaucggcaagcaguguaaacggaggacuuggggaaaaaggaccacauaguccaucg

SEQ ID NO: 223130 - RNA, 64 nt, Human
ccagagcgugaccucggcaggcuggacacacugcccagcacaggcagacccaccaggcuccuag

SEQ ID NO: 223131 - RNA, 64 nt, Human
ggguccagccugagcccccaccaggggucucugcccagcacaggaagcugacccuggcccagcu

SEQ ID NO: 223132 - RNA, 64 nt, Human
acggaaggacaugcuguccagacugugaugacugccagcacagggcaucucgggcuuggcuggu

SEQ ID NO: 223133 - RNA, 64 nt, Human
ucccuggacagggcuguggagauggcuccggcggcuuggggaaagccaaauugccaaaacucaa

SEQ ID NO: 223134 - RNA, 64 nt, Human
aucccacucauucaggaaaugccaagagguauuccuuggggaaauggugccucuuacaguguaa

SEQ ID NO: 223135 - RNA, 64 nt, Human
auuccaucgauuuuguccaacaaacaauuucuggcuuggggaggagucccucuagguagaacac

SEQ ID NO: 223136 - RNA, 64 nt, Human
cuccuuggcugcccuuugaaaccaaaucacuugccuuggggauaaagugcucaauuggcauuag

SEQ ID NO: 223137 - RNA, 64 nt, Human
gccagcacuaagggcugaggucaauaccgcagaccuuggggaggaagcugagcaucccccggga

SEQ ID NO: 223138 - RNA, 64 nt, Human
agucuuauuuuaagcuuucaggcuuucuuaaaaacuuggggaccagaauuucaauguauguuuc

SEQ ID NO: 223139 - RNA, 64 nt, Human
uguagauguacgaauuaaauauguucuucaaaaucuuggggagaauuauguucuuagaacauag

SEQ ID NO: 223140 - RNA, 64 nt, Human
cuaagcaguaauguacuuucucccuuuguaaagacuuggggaguaaggacauuaccaacuaaau

SEQ ID NO: 223141 - RNA, 64 nt, Human
gcugcucuugucagccucugguucuccucgaguccuuggggacguggcagaugccagcgaccau

SEQ ID NO: 223142 - RNA, 64 nt, Human
ccacggacacuccuuagagcccggauucggaccacuuggggaucccagaaccucccugacgaua

SEQ ID NO: 223143 - RNA, 64 nt, Human
gggggaaccugguggucucuucugagcuuuuggacuuggggaugccaaacacgugcucacccuc

SEQ ID NO: 223144 - RNA, 64 nt, Human
ugaggagguggcgucacaaggguggggagggggccuuggggaagggcggccuuggaucagaggc

SEQ ID NO: 223145 - RNA, 64 nt, Human
gacuaugcucccaggccccucugcccaggggugccuuggggaugcugcacugggcagcuaccca

SEQ ID NO: 223146 - RNA, 64 nt, Human
cuccugcaucugucucccuucauugcugugugaccuuggggaaaggcagugcccucucugggca

SEQ ID NO: 223147 - RNA, 64 nt, Human
caucuacagaggggcuuacagcgcccauucuggucuuggggaacccaucacaaaauaggcuuuu

SEQ ID NO: 223148 - RNA, 64 nt, Human
ccccguucccugucagaggcuaagaugagauuugccagcacaggggccccagaucugccugggc

SEQ ID NO: 223149 - RNA, 64 nt, Human
cauucuggcccccaaacaagggaagauaaaguccccagcacacagcaggagucaaaaauucuuc

SEQ ID NO: 223150 - RNA, 64 nt, Human
cuaccgcauggcagcugggcccacagcccccaccccagcacagcuccuccccugccgccucccg

SEQ ID NO: 223151 - RNA, 64 nt, Human
cgaaugucagaaccagccagcggugcuucacccucuuggggauaacuugcuuaguuuuuuaaua

SEQ ID NO: 223152 - RNA, 64 nt, Human
cagucaagcuucacaggcauugugauggggcagccuuggggaauauaaaauuuugugaagacuu

SEQ ID NO: 223153 - RNA, 64 nt, Human
cugggguguggccaggaaaagacaagcucuucagcuuggggauccgaucuggaagagagauucu

SEQ ID NO: 223154 - RNA, 64 nt, Human
cuguuauuuauuauuaauuuauuggggugaccuucuuggggacucgggggcuggucugauggaa

SEQ ID NO: 223155 - RNA, 64 nt, Human
agaggaccagugcgccccaucccagggaggguuccuuggggacaagggugguuggcagcuccaa

SEQ ID NO: 223156 - RNA, 64 nt, Human
gggauucugacacagacaccggacaaaccauugucuuggggagcccagaagagaaagugggcag

SEQ ID NO: 223157 - RNA, 64 nt, Human
augcauucauaaguugaagcccuccccagauccccuuggggagccucugcccuccuccagcccg

SEQ ID NO: 223158 - RNA, 64 nt, Human
ucauauacucugcagcuguuagaaugugcaagcacuuggggacagcaugagcuugcuguuguac

SEQ ID NO: 223159 - RNA, 64 nt, Human
acagugauaagggccuauuguggcagucuuuacucuuggggauuuuguuacuguguagagugga

SEQ ID NO: 223160 - RNA, 64 nt, Human
cucagagaagcaaaccucuguacucucccauuugcuuggggaaauuauuaauagcccaagcaug

SEQ ID NO: 223161 - RNA, 58 nt, Human
ccaaggcgguccccagcugaccagggugcuuggggaggguggggcuuuuuguagaaac

SEQ ID NO: 223162 - RNA, 64 nt, Human
ucuguauagggccauaauggaauucugaagaaaucuuggggagggaaggggaguuggaacaaau

SEQ ID NO: 223163 - RNA, 64 nt, Human
cccaccccacccccgcacgccuguaaucccagcacuuggggaggccaaggcgggaggaucgcuu

SEQ ID NO: 223164 - RNA, 64 nt, Human
uuacagcuagaaagcugcacuggugcuaaugccccuuggggaaauggggcugugaggaggagga

SEQ ID NO: 223165 - RNA, 64 nt, Human
guguguguguguguguauucccccugggcuccuucuuggggaaccuuggggucuuuugggaaag

SEQ ID NO: 223166 - RNA, 64 nt, Human
uauuucaccucuuaagagggaaucuuccacaagcccagcacaagcugccaggccugagcuacuu

SEQ ID NO: 223167 - RNA, 64 nt, Human
aaugaaccccccucuaaagucauuuaacuaauagccagcacaucccuuccccaaacugucaauu

SEQ ID NO: 223168 - RNA, 64 nt, Human
uugaauugggaacuuuggagucuugucucccaucccagcacauugaggauguaguuggugaaug

SEQ ID NO: 223169 - RNA, 64 nt, Human
cccuucuuucccuuccacuucuagagcagggaggcuuggggaggggaaaauuuagcucugggua

SEQ ID NO: 223170 - RNA, 64 nt, Human
gccggguuucagggggacaguggaggauccaggucuuggggagcucaggacuugggcuguuugu

SEQ ID NO: 223171 - RNA, 64 nt, Human
ugggggacgggaggaggggcacggguuuaagggacuuggggagccacuggaagaauaauaaaag

SEQ ID NO: 223172 - RNA, 64 nt, Human
ugaggauuguuuuggaagaaaggaauauuuuuaucuuggggaccagcuaagucucugcaguagu

SEQ ID NO: 223173 - RNA, 64 nt, Human
gaggccugaggagcugggcgggcagggagagggucuuggggacagcccuccugggaaucuacau

SEQ ID NO: 223174 - RNA, 64 nt, Human
gagucaggagaacuguuccuugugguuuccgucccuuggggaccacaggcaucagcagucccau

SEQ ID NO: 223175 - RNA, 64 nt, Human
gguuaucaccagacugugaguuucuggcaaguagcuuggggaagcugaauaaacucuaggccca

SEQ ID NO: 223176 - RNA, 64 nt, Human
cagaaaagcuguauuuaacucuugcuauuuguaacuuggggauggucuccccugccccagggca

SEQ ID NO: 223177 - RNA, 64 nt, Human
ccuugacgcccugcucuggauaacaagacuuugacuuggggagaccucuacugccuuggacaac

SEQ ID NO: 223178 - RNA, 64 nt, Human
ugggagaaggcgcggaaaggagaggagcuggggccuuggggacccccagguaguccaugcggcc

SEQ ID NO: 223179 - RNA, 64 nt, Human
aaaugacacccuuccucgccuguuggugcuggcccuuggggagcuggagcccagcaugcugggg

SEQ ID NO: 223180 - RNA, 64 nt, Human
cagcgcccagguccaagucugagccugaccuccccuuggggaccuagccuggagucaggacaaa

SEQ ID NO: 223181 - RNA, 64 nt, Human
ccucaaaccacuguauuuuucuguugagccuguacuuggggagagaucaguagcauuugaggaa

SEQ ID NO: 223182 - RNA, 64 nt, Human
ucugacagccguguccccggacaguucagacacccuuggggauggcacuccacacacgacagag

SEQ ID NO: 223183 - RNA, 64 nt, Human
ggugaugacuuaaauggcaggggguggggauuaucuuggggagaggcugaaaagcacaaaagau

SEQ ID NO: 223184 - RNA, 64 nt, Human
acaugagccuugccacuuccuuuuucucuuacuuccagcacacuagacauagcaaaaguguuug

SEQ ID NO: 223185 - RNA, 64 nt, Human
cccugaaacaaagagaaacaggaucugucccuacccagcacagcaaaugguuguaguaauugcc

SEQ ID NO: 223186 - RNA, 64 nt, Human
ugcccuucccacaggugagcagggcuccuguccaccagcacacucaguucucuucccugcagug

SEQ ID NO: 223187 - RNA, 64 nt, Human
ccuguauucccaccccuggacugguggccccugccuuggggaaggucuccccaugugccugcac

SEQ ID NO: 223188 - RNA, 64 nt, Human
agcccugucugcuaggcgcuggggagacugauaacuuggggaggcaagagacugggagccacuu

SEQ ID NO: 223189 - RNA, 64 nt, Human
aggcccccaaacauagccccugccccggaggaagcuuggggaacccaugaguugucagcuuuga

SEQ ID NO: 223190 - RNA, 64 nt, Human
ugcuuaaacucuucagcgggguagcaucaaaguucuuggggaaggaucguauaugugggucccu

SEQ ID NO: 223191 - RNA, 64 nt, Human
auuuauauaagaucuaccuaucuuaggauggaaccuuggggaaaaauaaaauugaggggaagua

SEQ ID NO: 223192 - RNA, 64 nt, Human
ucacuggaucagccgcuggaacugagggagugagcuuggggacuuccuucgucagcacuggcuu

SEQ ID NO: 223193 - RNA, 64 nt, Human
uuguaagcauggaaauaugguguccacguggcagcuuggggaccuaauauagccccacaggacu

SEQ ID NO: 223194 - RNA, 64 nt, Human
uuuugauggccaggaguagaugacagggaguugccuuggggaaccuuuggugugccaagaggag

SEQ ID NO: 223195 - RNA, 64 nt, Human
ugggcccugcucugggaccugccccucacguucucuuggggacacccgagccaggacacuacgc

SEQ ID NO: 223196 - RNA, 64 nt, Human
ccgucuuccuccaaccccucuauguagugccgcucuuggggacaugggucgcccaugagagcgc

SEQ ID NO: 223197 - RNA, 64 nt, Human
gggcaccccccaccccccagccucgcacuguguccuuggggaaggcccgcccccauccuggccg

SEQ ID NO: 223198 - RNA, 64 nt, Human
uugacacccucagaagguggggcaggcucuuugucuuggggaccaggaugcucccccaguccuu

SEQ ID NO: 223199 - RNA, 64 nt, Human
gaaccucacaucugaacugggggcaggugcauaccuuggggagggaguagggggacacggggga

SEQ ID NO: 223200 - RNA, 64 nt, Human
uggaguucacugauuguuuucauagaugaugcuucuuggggaaaaauaguauaggaugugaaag

SEQ ID NO: 223201 - RNA, 64 nt, Human
uuuugguucuaguacaugcuggaaaaaaguacuucuuggggagguaauuucagauacgaaugag

SEQ ID NO: 223202 - RNA, 64 nt, Human
ugagcuuccaaagaguauguaaacccuagcugugccagcacauguucaucuuuacaauuuauau

SEQ ID NO: 223203 - RNA, 57 nt, Human
ucagcagccccuguggcuagaggaacaccagcacaaacgacagccucaagucuccuu

SEQ ID NO: 223204 - RNA, 64 nt, Human
gacacuagggcuaucagaaggucuccuuuuuagcccagcacaggcccaggccacuuugucgugu

SEQ ID NO: 223205 - RNA, 64 nt, Human
ggcgagcccccucaggucgcuggagugcaccagucuuggggaagaggugcaggagaagcugugu

SEQ ID NO: 223206 - RNA, 64 nt, Human
ggguuagguuagcuuuccugcuuuuaucuucugccuuggggaccugccaaacgaaaucccacac

SEQ ID NO: 223207 - RNA, 64 nt, Human
cuuucuuguuguggcugccaugaagccacagcuccuuggggaagugaccugcucuccuuugggu

SEQ ID NO: 223208 - RNA, 64 nt, Human
ccaugaagagaccagugggguggugcaggguggacuuggggacccuaccccugaagacugaggc

SEQ ID NO: 223209 - RNA, 64 nt, Human
gggcuugggucccccugcugcucugcccgugacccuuggggauggguugaugcgagggucccac

SEQ ID NO: 223210 - RNA, 64 nt, Human
aucuuggcauccauguuuugugccugcccucccucuuggggaggccaugcuugacucugcugaa

SEQ ID NO: 223211 - RNA, 64 nt, Human
uugggugcaguggcuuauaccuguaauuucagcacuuggggaggccaaggcaggaggcuugcuu

SEQ ID NO: 223212 - RNA, 64 nt, Human
ucuauuuccugaccuuuuccucguccacccugggcuuggggacccccccaccggacucuccacu

SEQ ID NO: 223213 - RNA, 64 nt, Human
ugggccacuccaggaugggacacggccccucuuucuuggggacccaguauguccucuccucuag

SEQ ID NO: 223214 - RNA, 64 nt, Human
cuucugccaaggccagcccacacagcccgagccccuuggggagcaguggccgggcuggggaggc

SEQ ID NO: 223215 - RNA, 64 nt, Human
gcagccugcagcaagugcuuccgucuccggaauccuuggggagcacuuguccacgucuuuucuc

SEQ ID NO: 223216 - RNA, 64 nt, Human
ucagcugggcgcuuggaaaguguuuggcuggggccuuggggaucucuuuaguccuggcuucccu

SEQ ID NO: 223217 - RNA, 64 nt, Human
aguuuccagaaggaggucacuuggcauucaggcucuuggggaggcagagaagccaccuucaggc

SEQ ID NO: 223218 - RNA, 64 nt, Human
ggccagcagccuuccaguggcuucucccaacacucuuggggaccaaauauauuuaaugguuaag

SEQ ID NO: 223219 - RNA, 64 nt, Human
cucuucaaggacgugcccucuuugcucucagaaccuuggggaagguggcuggacugcugggcgg

SEQ ID NO: 223220 - RNA, 64 nt, Human
acccugcuuuuuuguuuguuuguuuuuucaucccccagcacacuauaauauagugaacuggaaa

SEQ ID NO: 223221 - RNA, 64 nt, Human
agacuggugaaaaaaaaaaaaagguguucacugaccagcacaagucugcagaucaucuuugagu

SEQ ID NO: 223222 - RNA, 64 nt, Human
ccacuucaggccaaaacaugcuaaagauaacacaccagcacauugacucucucuuugauaacua

SEQ ID NO: 223223 - RNA, 64 nt, Human
auuuccuuccagcccauccaaacacugaggcagccuuggggaaccccgagcugggggguuggca

SEQ ID NO: 223224 - RNA, 64 nt, Human
ccacguggaacagacagccccugugucucugucucuuggggaccugaguuugggugggguggca

SEQ ID NO: 223225 - RNA, 64 nt, Human
acuucagcugcugguguucugauggagccagaggcuuggggaaucuggaacuugccugcuaaau

SEQ ID NO: 223226 - RNA, 64 nt, Human
acucguggacguugggaagaaagauuguagguggcuuggggaauguggguggcuuagaggaucu

SEQ ID NO: 223227 - RNA, 64 nt, Human
ggggguggugccugcuggggccuagagggggaugcuuggggaaacagagaaggggagauccagg

SEQ ID NO: 223228 - RNA, 64 nt, Human
ccuguuauaacucugcacuacuccucugcagugccuuggggaauuuccucuauugauguacagu

SEQ ID NO: 223229 - RNA, 64 nt, Human
ggcccccaggucugaucuggguuuugccucugcccuuggggaaaugcuaucagaaauucgcccc

SEQ ID NO: 223230 - RNA, 64 nt, Human
uagaaaaauuaugcaggagauggcuaggauuagccuuggggaugugaugaaaacacuuggcagg

SEQ ID NO: 223231 - RNA, 64 nt, Human
uauuguggcuauuguugauguugaaaauuuuaaacuuggggaagauuaagaaaagaaccaauag

SEQ ID NO: 223232 - RNA, 64 nt, Human
augucaguguguguuuuucauuugauuuauuuaucuuggggaaagugaaaaauguaaucugcaa

SEQ ID NO: 223233 - RNA, 64 nt, Human
augccaauuccaaggccagccacaacccugccaccuuggggaauccagccuggaggcauccccu

SEQ ID NO: 223234 - RNA, 64 nt, Human
aucagauuuuaccuuggagaaaugaaaauuauuucuuggggaugccuuuuaauauuugauccua

SEQ ID NO: 223235 - RNA, 64 nt, Human
aggcuggcuguaaaguaaguguaagguccacauccuuggggaaguaguuaaauaaaauaguuau

SEQ ID NO: 223236 - RNA, 64 nt, Human
cagauuuuggaauauuugcauauacaugcgauaucuuggggaugagacucaagacuaaacauga

SEQ ID NO: 223237 - RNA, 64 nt, Human
gaacgaccuuucuuucuuuauuucucagccugcccuuggggagaugagggagcccugucugcgu

SEQ ID NO: 223238 - RNA, 64 nt, Human
uccaggauuagcucccaagugcgcugagacccagccagcacacuucuggcccuucucccugccu

SEQ ID NO: 223239 - RNA, 64 nt, Human
agcauaagcaagacaaaaacagagagaccgcagaaggaggaagauacugugguacugucauaaa

SEQ ID NO: 223240 - RNA, 64 nt, Human
aggccccauucucccacaggauggugaggcugggaggaggaagacugagguagagauuccaggc

SEQ ID NO: 223241 - RNA, 55 nt, Human
cugaggaagaugaugaguaacuccccuuggggauaugacacaugcccaugaugag

SEQ ID NO: 223242 - RNA, 64 nt, Human
accuaaccuaggagggcucugagccaaccuugcucuuggggaaggggacagauuaugaaauuuc

SEQ ID NO: 223243 - RNA, 64 nt, Human
ucagggguuccuuuagcccauuugcuuucucuaccuuggggaccccaggggccaagcaguucuc

SEQ ID NO: 223244 - RNA, 64 nt, Human
uauuuuaauuauagaaaucaguagcaaaaagaaucuuggggauuuuccaucugacuucccuggc

SEQ ID NO: 223245 - RNA, 64 nt, Human
acguccucuaguuuguggccuucagaaaucagaucuuggggagagucccuuccuaccugacuga

SEQ ID NO: 223246 - RNA, 64 nt, Human
cauuugcuuuagucucucuauccagcuaaauaggcuuggggaaagcuguggugcuacagaaagu

SEQ ID NO: 223247 - RNA, 64 nt, Human
ugacaaacccaggagcacugggaguuaagcuuuccuuggggagggaagagccuugauguccagc

SEQ ID NO: 223248 - RNA, 64 nt, Human
uauuguggcuauuguugauguugaaaauuguaaacuuggggaagauuaagaaaagaaccaauag

SEQ ID NO: 223249 - RNA, 64 nt, Human
uuucaauucaguuucucaaauuaucuucccuucucuuggggacaacaucugaaggguauguugc

SEQ ID NO: 223250 - RNA, 64 nt, Human
gaauggaauuuauucacccauuuuaaauugguuacuuggggaucagagauuugucucuccaaca

SEQ ID NO: 223251 - RNA, 64 nt, Human
auaucuaauuacaggagaauuuacaacaucucaaguacguaaauuaaguugucauugagugaaa

SEQ ID NO: 223252 - RNA, 64 nt, Human
agaggaaaaguagaacuuaaaacuccaaacuagaguacguaacauugaaaaaugaggcauaaaa

SEQ ID NO: 223253 - RNA, 64 nt, Human
cuucuucaucuugacauguaaugaauggucaguuguacguaauguauuuauauguuaauuuguu

SEQ ID NO: 223254 - RNA, 64 nt, Human
aaaucucuccacuuucagcugucuuuuggaggacguacguaauaagguuuuaauuuaguaaacc

SEQ ID NO: 223255 - RNA, 64 nt, Human
gugccaaauaauuacuuuuuauuuauuuuauuuaguacguaauuuugaaguacauuuuuuccug

SEQ ID NO: 223256 - RNA, 64 nt, Human
uuggcauggguugcccuacaggcccacagggccaccagcacacccccgcacgcugggcaccaac

SEQ ID NO: 223257 - RNA, 57 nt, Human
uggccaaauacucagcguagaaaacuuccagcacauugggguggagggccugccuca

SEQ ID NO: 223258 - RNA, 64 nt, Human
gccccugucagggugaguguaauuaggaacgauaccagcacauaaggcuccccccaaucucuuc

SEQ ID NO: 223259 - RNA, 64 nt, Human
guuucacguauguggaugccaguuaauuaaaugaguacguaaauaaauuaauuaaaacacauag

SEQ ID NO: 223260 - RNA, 64 nt, Human
uguuugaaauuauuuauugugauguaauauuuuuguacguaaaaugauucuauuaugacugccu

SEQ ID NO: 223261 - RNA, 64 nt, Human
uguacuagugucacagcauaaaaucauauuacaaguacguaaggauucagggucucuugauaga

SEQ ID NO: 223262 - RNA, 64 nt, Human
gcauuguuauuguggaagauuuaccuuuucuguuguacguaaagcuuaaauugcuuuuguugug

SEQ ID NO: 223263 - RNA, 64 nt, Human
auacuagacaauuuuguuuuuuauguauguguauguacguaaauacauacauauuaauuuacau

SEQ ID NO: 223264 - RNA, 64 nt, Human
guucugguuucauguucucuugaaacauugaauuguacguaaauauaaaggaucuacuguugcg

SEQ ID NO: 223265 - RNA, 64 nt, Human
aaacaauacuaugcauucucuauggcuauauaauguacguaaaucuauuuuuaaagguucagag

SEQ ID NO: 223266 - RNA, 64 nt, Human
uauuuauguacguccuccuaggugauggagauguguacguaauauuuauuuuaacuuaugcaag

SEQ ID NO: 223267 - RNA, 64 nt, Human
ucaaaagcuuguguguugacccuuuguagccuaaguacguaaacaaauuaauguuaucuaaguu

SEQ ID NO: 223268 - RNA, 64 nt, Human
aucugcucagauuuuacucaacauuagagaguuaguacguaauaaaagcauuauaaaugcaauu

SEQ ID NO: 223269 - RNA, 64 nt, Human
uuucuccauauucuucaagacgauugugaguaugguacguaacaggaauuacaucugguaaguu

SEQ ID NO: 223270 - RNA, 64 nt, Human
ucugguaguagaugauuuccuuaauuuuuauuagguacguaacuauuuccaaauccucuaauug

SEQ ID NO: 223271 - RNA, 64 nt, Human
agguuuacgugucucaaagcacacugucuucccaguacguaaguuaaaaaauaccaguucaccc

SEQ ID NO: 223272 - RNA, 64 nt, Human
auaguuaauauagucacaguucaaaauucuaaauguacguaagguaaagacuaaagucacccuu

SEQ ID NO: 223273 - RNA, 64 nt, Human
caccucugaaggaaaucauuugaauuuuguuuuuguacguaaaguuaaccuuccaauugucuga

SEQ ID NO: 223274 - RNA, 64 nt, Human
gaugcagcuguccagccacugcccuuuaacaugcccagcacacaugggaggccuguggcccugu

SEQ ID NO: 223275 - RNA, 64 nt, Human
uggcaacugcagguaaccccagucagccaugucgccagcacaggucuaugucgagggaaugggu

SEQ ID NO: 223276 - RNA, 64 nt, Human
gagcuuagcacagcgggauuaaacaguccuuuaaccagcacagccaguuaaaagaugcagccuc

SEQ ID NO: 223277 - RNA, 64 nt, Human
ggggucgggaugagguugaagggucuuggucaauguacguaaugagcagggugggccccacgcu

SEQ ID NO: 223278 - RNA, 64 nt, Human
cccuuguguuuggaauuauaaaauauagguaaaaguacguaauuaaauaauguuuuugguauuu

SEQ ID NO: 223279 - RNA, 64 nt, Human
cccugugucauucuucuaauccaauguagaaauuguacguaauguauuuaaaucaacgcaaaug

SEQ ID NO: 223280 - RNA, 63 nt, Human
uuguaauugcuuacauuuuuacaauaaauaaucuguacguaagaacagagaugguauuuucuu

SEQ ID NO: 223281 - RNA, 64 nt, Human
augaagccucugauacuuaaacagcauggcgcugguacguaaauagaccaaugcaguuaggugg

SEQ ID NO: 223282 - RNA, 64 nt, Human
cuaccguugaccugaguuaaauucauuuagucguguacguaaaaacucuccuuuuaguguguua

SEQ ID NO: 223283 - RNA, 64 nt, Human
augcuaaagggaugguacaagucuaacacaaauuguacguaaugauacaucuacuagaaacaua

SEQ ID NO: 223284 - RNA, 64 nt, Human
gaccagguaaauaauuucauagaaguucaguauaguacguaauucuuguaagaguaucguaugc

SEQ ID NO: 223285 - RNA, 64 nt, Human
aguggccauuguaguuuaucccgaagacgccuauguacguaaguuugcauuuccucccuucugg

SEQ ID NO: 223286 - RNA, 64 nt, Human
caaauuguggcaaauucuaaacagcaauucuuuuguacguaauaggacauuucauccuagaaaa

SEQ ID NO: 223287 - RNA, 64 nt, Human
guuaucuuuaaguuuaugccaucuucuuaaauaaguacguaauguuccaaucuaaauaaaaaac

SEQ ID NO: 223288 - RNA, 64 nt, Human
agacuggcuugcuuugauuuuuagugaagggaauguacguaaaacaaaauagggcuuggcuggu

SEQ ID NO: 223289 - RNA, 64 nt, Human
acagacauuaaccuauuccaccuuacucaaggguguacguaaaacaugguaacaguauacuauu

SEQ ID NO: 223290 - RNA, 64 nt, Human
uuuucauaauaaucaugaauacuuuuccaggucaguacguaaagauguaacccauucuuuguaa

SEQ ID NO: 223291 - RNA, 57 nt, Human
caucuaggcaaccccuuugaucauguuguacguaaacaguauuuauuauaaauuacu

SEQ ID NO: 223292 - RNA, 64 nt, Human
cuccccagauaccagaccugaggcaauucacuugccagcacagauggccaacccaccuccagau

SEQ ID NO: 223293 - RNA, 64 nt, Human
cuccgucuguuuuugcaacuagguauuucuaacgccagcacacuauuuacaagauggacuuacc

SEQ ID NO: 223294 - RNA, 64 nt, Human
uccacuaaaaaaagauauguaaaaaagauacuuuccagcacauaaauaaaggcuggaauuuuac

SEQ ID NO: 223295 - RNA, 64 nt, Human
aaugaagagcccuguaguagggaguuuccaccuuguacguaagcaaacacugaaucaacuuuuu

SEQ ID NO: 223296 - RNA, 64 nt, Human
cuguuguguggaacacuucacauauuggcgcacaguacguaaggaggucucaugugcuguagga

SEQ ID NO: 223297 - RNA, 64 nt, Human
ugaaaugggucccugggugacaugucagaucuuuguacguaauuaaaaauauuguggcaggauu

SEQ ID NO: 223298 - RNA, 64 nt, Human
uaauauuucagcaagaggagguggucaugggaagccagcacagcagaggcucccugaccgggag

SEQ ID NO: 223299 - RNA, 64 nt, Human
gaaaagaccuccagcaguuacacauucauaucaaccagcacaacacgggauggcgcccaaacuc

SEQ ID NO: 223300 - RNA, 64 nt, Human
auucaaccgggugugguggcucacgccuguaaucccagcacauugggaggccaaggcaggugga

SEQ ID NO: 223301 - RNA, 64 nt, Human
ccuccagccugugcgcaccugcccuccuugcagcccagcacaccugcagguguaagggacgauu

SEQ ID NO: 223302 - RNA, 64 nt, Human
uaaggagauauccaaagcuacccagucccuugacccagcacaguuggccgacccgugucacucc

SEQ ID NO: 223303 - RNA, 64 nt, Human
acguuggagccgagccugaacaugccccucggccccagcacauggaaaacccccuuccuugccu

SEQ ID NO: 223304 - RNA, 64 nt, Human
cccagcugcccagcccugcccccccuccccauagccagcacagcuaucccgcggggacaccagc

SEQ ID NO: 223305 - RNA, 64 nt, Human
gcuguuggauuucagugauuuuuccccccaccccccagcacaggagagcacccacagccgcaga

SEQ ID NO: 223306 - RNA, 64 nt, Human
gcugccugucucuuagaugcacuuucuuuuuccaccagcacauccuucaacacacagaauuuca

SEQ ID NO: 223307 - RNA, 64 nt, Human
aacagaagggccuguaggcccuggugaacugaauccagcacaggccuccccuguaacacaacag

SEQ ID NO: 223308 - RNA, 64 nt, Human
caaggagagcagcaaguuuccauuuggcauuagcccagcacagagccaccggaacaucaagauc

SEQ ID NO: 223309 - RNA, 64 nt, Human
ccaaagugacauauggagggaacuuuagcacuucccagcacagccagaauugcauccucuggga

SEQ ID NO: 223310 - RNA, 64 nt, Human
gccuuugugaguugucugcaacucagcucuucccccagcacagaucuguuccccuuauccugca

SEQ ID NO: 223311 - RNA, 64 nt, Human
agacaaacacgugcucguccuuuaauggaguucaccagcacacuuguuaaccaguccuguuugc

SEQ ID NO: 223312 - RNA, 64 nt, Human
caucacugaucuaagcaguggcaucugagugggcccagcacauggccauagaggcccaggcacc

SEQ ID NO: 223313 - RNA, 64 nt, Human
gggugcagccagcuguccugcagcucuggggagaccagcacagaacugaggaacaucugcagga

SEQ ID NO: 223314 - RNA, 64 nt, Human
gaggcuucaagccuuaaagucagugugcccucaaccagcacagccugccccaauucccccagcc

SEQ ID NO: 223315 - RNA, 64 nt, Human
ccguccuagcgccacugccaagcacaccucgcucccagcacaccacagcccgcgaccucagggc

SEQ ID NO: 223316 - RNA, 64 nt, Human
aggacccugaauuugagauccccggggcuggggcccagcacaacugcuguuuagugaacagguu

SEQ ID NO: 223317 - RNA, 64 nt, Human
acagaaucaggaccagcaugugcagagcuggccaccagcacaggcuuagggcaguucagaaccc

SEQ ID NO: 223318 - RNA, 64 nt, Human
ugcauuccccccuccacaccauccuagcgaggcaccagcacaccuaaucacagcaaagcccaga

SEQ ID NO: 223319 - RNA, 64 nt, Human
acaugagacaaagcugacuguucacacugauugcccagcacauaccgucuugccaguuucuucu

SEQ ID NO: 223320 - RNA, 64 nt, Human
cuuuucuuguugaguuaguaucuuaauuuuuacuccagcacaaguauuuaaucaaagaaaagau

SEQ ID NO: 223321 - RNA, 64 nt, Human
caccaagauggucaaauuacuacacaaaucagcaccagcacagucugauagcugcaaaugucca

SEQ ID NO: 223322 - RNA, 64 nt, Human
gagcugcugcgcugaccugcagagguugguggucccagcacagagcugugcccaugggcuuguu

SEQ ID NO: 223323 - RNA, 64 nt, Human
guguagcuggcgaggaauuacuuccacuucuggcccagcacaagcccugcuuuggccaccuguc

SEQ ID NO: 223324 - RNA, 64 nt, Human
ccugaccccucccugcaggggcuacguuagcagcccagcacauagcuugccuaauggcuuucac

SEQ ID NO: 223325 - RNA, 64 nt, Human
gacuaacucuuguuuaccauucauguaacaaaacccagcacauuaucugcacuauaagcucaaa

SEQ ID NO: 223326 - RNA, 64 nt, Human
ggccugagcgaguguccagccaagggcugaguguccagcacaccugccgucuucacuuccccac

SEQ ID NO: 223327 - RNA, 64 nt, Human
gaaaguguuuggccuagcacaauuacugcuaggcccagcacaaugaacagauuuaccaucccga

SEQ ID NO: 223328 - RNA, 64 nt, Human
cuuccucaaggaauuaacuugugcaagcugacucccagcacaucaaagaaugcaauuaacugau

SEQ ID NO: 223329 - RNA, 64 nt, Human
ggcauggagaagccucagggaaaggccugcccccccagcacauacucccauaguguccuagguc

SEQ ID NO: 223330 - RNA, 64 nt, Human
gucuucugucacgccauaguuggcuacucucaagccagcacauuguuagacccaucuuaauuaa

SEQ ID NO: 223331 - RNA, 64 nt, Human
cauaggcugggcaugguggcucaugccuguaaucccagcacauugggaagaucacuugaggcaa

SEQ ID NO: 223332 - RNA, 64 nt, Human
gucacacccuccgaaagaugaguagaaaccagcaccagcacagcccagaucuucucuuuccucu

SEQ ID NO: 223333 - RNA, 64 nt, Human
ugcucaccucuucuuuaccagaacgguucuuugaccagcacauuaacuucuggacugccggcuc

SEQ ID NO: 223334 - RNA, 64 nt, Human
uggaacgaggagacgggagcgagugggcucuccaccagcacaucacuaugcaucuguuccagga

SEQ ID NO: 223335 - RNA, 64 nt, Human
gacuaaggaaaagagcagaagcuccuugguuuaaccagcacagagaaaauaauauaaaucccau

SEQ ID NO: 223336 - RNA, 64 nt, Human
ggucgagugaagauugaaaauuaaccucugagggccagcacagcagcucaugccuguaauccua

SEQ ID NO: 223337 - RNA, 64 nt, Human
cugguuugccaggccaauguugcugauggccccuccagcacacacacauaagcacugaaaucac

SEQ ID NO: 223338 - RNA, 64 nt, Human
ucucaggacagcagugacgagguuucugauugucccagcacagccuugucccaggacccuuggg

SEQ ID NO: 223339 - RNA, 64 nt, Human
cuccccauguauuccccaccuguguuccguuugaccagcacagaaauauuaaacguccucuauu

SEQ ID NO: 223340 - RNA, 64 nt, Human
aagccaaagauggccccugacaccucccccagccccagcacaccagccugcaccucuuaucccg

SEQ ID NO: 223341 - RNA, 64 nt, Human
cccccacccgcagccggccacacuggagcagcucccagcacagccuuacgcgcccgacgcgcgc

SEQ ID NO: 223342 - RNA, 64 nt, Human
auaagaaauuuaggaagauuaggugccaaaauacccagcacaauacuuguauauuuuuaguacc

SEQ ID NO: 223343 - RNA, 64 nt, Human
ugauguauucugugauaagagguacuaauaguauccagcacagauuugcuuuucuuugcuagca

SEQ ID NO: 223344 - RNA, 64 nt, Human
gaauaaacuugugguuguccuuuaacuggaggucccagcacauguguuuucaagaggccacuag

SEQ ID NO: 223345 - RNA, 64 nt, Human
cugucggaaaagucaccacuuuagucccuggccaccagcacaccccaggagggugaguggccug

SEQ ID NO: 223346 - RNA, 64 nt, Human
ccugggacaaccuccuuauugaagggaagagggaccagcacaugaggcugaggcugaggggcag

SEQ ID NO: 223347 - RNA, 64 nt, Human
gauuuggggugauuucucacccucuguccuucccccagcacaaagcacuggccuugccuccagg

SEQ ID NO: 223348 - RNA, 64 nt, Human
caggcccaggacccaggaggccuccccaccuaccccagcacacacacucccugccacuguucug

SEQ ID NO: 223349 - RNA, 64 nt, Human
ugacccccgccaggggagaccaggcuggcuggauccagcacaucuccccaguggcagccucgcc

SEQ ID NO: 223350 - RNA, 64 nt, Human
uccccccuccaccuucgccaccucccgcucgugcccagcacaagugagccugguguggaaacca

SEQ ID NO: 223351 - RNA, 64 nt, Human
auuucccuccucagugugcacccuuugaagggacccagcacagggucuugggccugggcagucu

SEQ ID NO: 223352 - RNA, 64 nt, Human
gagcugccuuauauuccuacauuccaggccagaaccagcacaggacugaacacaucccugguug

SEQ ID NO: 223353 - RNA, 64 nt, Human
cuauggucuugauacauccucaaacuuucccuucccagcacagaggaauauuggcuggcaugca

SEQ ID NO: 223354 - RNA, 64 nt, Human
ucugcuuucguucccacaaagaaagcaccucaccccagcacagugccaccccuguucaucuggg

SEQ ID NO: 223355 - RNA, 64 nt, Human
gguuuuguuuucuucacuaugggaucuucugugcccagcacagugccugacacauagaaaacaa

SEQ ID NO: 223356 - RNA, 64 nt, Human
gcacuugccaagcuuggucaucuaugacaccacaccagcacaguaggaccucagaaaaguaccc

SEQ ID NO: 223357 - RNA, 64 nt, Human
aggcccccucagggcuccuugccuuucccccccaccagcacaccccguacccugccuggaaucc

SEQ ID NO: 223358 - RNA, 64 nt, Human
gauucgguugucaagggauauauuucuaucccugccagcacagugcuggacauagugaguacug

SEQ ID NO: 223359 - RNA, 64 nt, Human
agguggcccaagugcucuugguggcccagcuuggccagcacacacuuuccuccugcagcacccc

SEQ ID NO: 223360 - RNA, 64 nt, Human
gggcaucacgcccaccuccuuuggcagagggaccccagcacacuaacucuggguggcugucccc

SEQ ID NO: 223361 - RNA, 64 nt, Human
augcaguuguugcccacagcuguaugauucccagccagcacagccucuuagaugcaguucugaa

SEQ ID NO: 223362 - RNA, 64 nt, Human
caagugcagcacaugggugaugucagaauucuucccagcacaguguucugggcagccaguacca

SEQ ID NO: 223363 - RNA, 64 nt, Human
ucacagcacauuuuuaaucaagcaguuauuucaaccagcacauucguuuuguucauauucacua

SEQ ID NO: 223364 - RNA, 64 nt, Human
uaaauaaugaguaggaucuuguuuuguuuuaucaccagcacacagauugcuauaaacuguuacu

SEQ ID NO: 223365 - RNA, 64 nt, Human
uuaccccuacacaucucuccacggagcccagaccccagcacagauauccacacaccccagcccu

SEQ ID NO: 223366 - RNA, 64 nt, Human
aacaacgggcaguggucucugugcuccuaggcauccagcacagguucuggcagggcaccccugc

SEQ ID NO: 223367 - RNA, 64 nt, Human
uuuccucccgaguuuggcuggcacgagagcuagcccagcacaugaagcaggugauguuaaguca

SEQ ID NO: 223368 - RNA, 64 nt, Human
gcaggagcugccaccccaaggggagugaccccugccagcacacccugcagccaagggccaggaa

SEQ ID NO: 223369 - RNA, 64 nt, Human
gacugaucucuucaauuauugucaucuguagccaccagcacaucacucuuauguaauccccaaa

SEQ ID NO: 223370 - RNA, 64 nt, Human
cuggugacagacaaaaucuguuuuaaaaucauauccagcacaaaaacuauuucuggcugaauag

SEQ ID NO: 223371 - RNA, 64 nt, Human
uuacagugcagacaggccaugugagccaccgcugccagcacagagcguccuucccccuguagac

SEQ ID NO: 223372 - RNA, 64 nt, Human
ugccacgugcugcugacaccgaccggaguacuagccagcacaaaaggcaggguagccugaauug

SEQ ID NO: 223373 - RNA, 64 nt, Human
caccucugccuugcccuuuaacucaacccgcuucccagcacagcggcuuucuuuuuaaaaccug

SEQ ID NO: 223374 - RNA, 64 nt, Human
ugaguggcuaaugagaagagggacagaccgaccaccagcacaguagggcagaucuggacagcag

SEQ ID NO: 223375 - RNA, 64 nt, Human
agggcgaguggcuucucugggccggguucguacuccagcacagcgcccuucuaacgggcgggag

SEQ ID NO: 223376 - RNA, 53 nt, Human
ucaacuuguucaaguucugaaucccagcacaugacaacacuucagaagggucc

SEQ ID NO: 223377 - RNA, 64 nt, Human
ggaagaugggcagagacuugaguggcgauuaccuccagcacagagacgugccaggcgguguugg

SEQ ID NO: 223378 - RNA, 64 nt, Human
cagcuuccugagucaccccucugucuaaccagccccagcacaaauggaacucccgagggccucu

SEQ ID NO: 223379 - RNA, 64 nt, Human
ccgcccacuucuagccccguggaugccgucaccaccagcacacggaacuaccucccacccccuu

SEQ ID NO: 223380 - RNA, 64 nt, Human
cuaggaaacaguuuaagaaaucauuggccccuucccagcacauugaauggguaagcagacaggc

SEQ ID NO: 223381 - RNA, 64 nt, Human
cgugagcuccgugcacuucaccaaagcccccaucccagcacacaggacccguguguaugagacg

SEQ ID NO: 223382 - RNA, 64 nt, Human
gucagccacugggguguugugcucacuucagggcccagcacaaaaauccuuguuugacaucuca

SEQ ID NO: 223383 - RNA, 64 nt, Human
gggagguaaagcaggacccuugcagacauguugcccagcacacaguaggcccucaauaaaagcc

SEQ ID NO: 223384 - RNA, 61 nt, Human
cugacaaggagcaggccugagcgaggccggcccagcacagcaagcagcaggaccgcugccc

SEQ ID NO: 223385 - RNA, 64 nt, Human
ggguggggccucagugggggcugcugccugacccccagcacaauaaaaaugaaacgugagcugc

SEQ ID NO: 223386 - RNA, 64 nt, Human
gugguggcauuggccgagggucuucgggugcuucccagcacaagcugcccuugcuguccugugc

SEQ ID NO: 223387 - RNA, 64 nt, Human
ccaccuccugcacugcacuucugccguccacaucccagcacacuggcgaccugacuagcagccc

SEQ ID NO: 223388 - RNA, 64 nt, Human
ucagaggaaaaacagaggaugcugaaguacagucccagcacauuuccucucuaucuuuuuuuua

SEQ ID NO: 223389 - RNA, 64 nt, Human
gccaguagugccuucaucaguuaagggaggugucccagcacagaucauucucaaaagcgagcag

SEQ ID NO: 223390 - RNA, 64 nt, Human
ugaggugugggcucccucaucucguaaccagagaccagcacaugucagggaagcacccaguguc

SEQ ID NO: 223391 - RNA, 64 nt, Human
aacaccaaggucagguagccaggcggugaggaguccagcacaaccuuuuccucaccagucccau

SEQ ID NO: 223392 - RNA, 64 nt, Human
uggaccugcaggcccuccuaggcccacuuccuccccagcacaguguguguucccgggcgugugu

SEQ ID NO: 223393 - RNA, 64 nt, Human
gcugaucaacagaaggaaauggucugaagucugaccagcacaaggaaggaggcuggcuggcuca

SEQ ID NO: 223394 - RNA, 64 nt, Human
ugucgcauaguuccaccuccacaccucucugcugccagcacauucaugcagaaaagucuuuuca

SEQ ID NO: 223395 - RNA, 64 nt, Human
ucccuacagccggggguguggcccagagaagcuuccagcacagcccucuacccagaacauccgg

SEQ ID NO: 223396 - RNA, 64 nt, Human
agaagaaaauaauaagcccucuauacauaaaugcccagcacaauucauuguuaaaaaacaacca

SEQ ID NO: 223397 - RNA, 64 nt, Human
gugcugagccucggcauuuccacagacaaggccuccagcacagauggccacaggccucucuaua

SEQ ID NO: 223398 - RNA, 64 nt, Human
ggcccgcauaguuccucaccaggagggucucccuccagcacaggucccgccugcucagucccug

SEQ ID NO: 223399 - RNA, 64 nt, Human
agccagucccuccccaccugcccagagcuccaggccagcacagaaauuccugaggccaacguca

SEQ ID NO: 223400 - RNA, 64 nt, Human
ggaugaggcugccagccccuucucugcuuccccuccagcacagggaccaagugggggagccugc

SEQ ID NO: 223401 - RNA, 64 nt, Human
ugccuugcagccugcacuuugcacaugcucacccccagcacagucccacuggccccucaccucc

SEQ ID NO: 223402 - RNA, 64 nt, Human
cagcuuuuaccagccucaguguggaggcuccaucccagcacacaggccuggggcuuggcagggg

SEQ ID NO: 223403 - RNA, 64 nt, Human
uaaggacaccggcagcccuuaguuucacuguuugccagcacagaccuuugaugggugcaggcuu

SEQ ID NO: 223404 - RNA, 64 nt, Human
uuugauaugcaguuuccagcccuccaaugaguccccagcacagaucucaggcuuguggcuggga

SEQ ID NO: 223405 - RNA, 64 nt, Human
uuccuuuuugguacuuauuacugcuaaguauuucccagcacaugaaaccuuauuuuuucccaaa

SEQ ID NO: 223406 - RNA, 64 nt, Human
gaagccugaggcgggccucugccucucccugcccccagcacaauuggcagagaugaggcgggug

SEQ ID NO: 223407 - RNA, 64 nt, Human
acacagacucauccugaacagcauggcacucccuccagcacaaacacaaggucauggccacacu

SEQ ID NO: 223408 - RNA, 64 nt, Human
gaggcagaugacaucuaaaauaugugcuuuccaaccagcacagcuggcgcucuuagcuccugau

SEQ ID NO: 223409 - RNA, 64 nt, Human
aagaagaucaagccaagcugaccuuggacccuguccagcacagcuucuggcacaggaugcuugg

SEQ ID NO: 223410 - RNA, 64 nt, Human
cccacagcagaaucaccaacacucuccgcuucccccagcacacacacauacaacacagaucauu

SEQ ID NO: 223411 - RNA, 64 nt, Human
gaagugcugggauuccaggcgugagccacugcggccagcacauuuccacuuuuagauccuacuc

SEQ ID NO: 223412 - RNA, 64 nt, Human
uccacuccagccaucagucagcacggcccuuucuccagcacagcagacuauuguccgugcccug

SEQ ID NO: 223413 - RNA, 50 nt, Human
guaagccaacaaaaaauuaaccagcacauuuagcuucucuuuuuucuuuu

SEQ ID NO: 223414 - RNA, 64 nt, Human
aauccugcaggcaguccaacaaacagggcuggcuccagcacaaacucucccuuccaccuuuacg

SEQ ID NO: 223415 - RNA, 64 nt, Human
uuaaaaucuccagacuugcuuacaucuagauuauccagcacaaucauaaagugaaugacaaacc

SEQ ID NO: 223416 - RNA, 64 nt, Human
aaaguguuggaaaaucaaaagaggcucacucaaaccagcacagggaguccucagaguugcaguu

SEQ ID NO: 223417 - RNA, 64 nt, Human
cuggcgaggcugaaggcgagggguggaggaggccccagcacagccucaucuccauguguacacg

SEQ ID NO: 223418 - RNA, 64 nt, Human
uauaccuaaaggaugaccugcuccagaaacagcaccagcacagcauguauuuucuucucuucug

SEQ ID NO: 223419 - RNA, 64 nt, Human
ugucagcuuccccaggagcucucugcugagcagcccagcacaacccccaggaaacacaaauggg

SEQ ID NO: 223420 - RNA, 64 nt, Human
auggcccggccccggggcccguacacaggcggggccagcacaguagugaaggcggucuccugga

SEQ ID NO: 223421 - RNA, 64 nt, Human
agaggccucccgguccagcucagggaugcuccugccagcacaggggccagggacuccuggagca

SEQ ID NO: 223422 - RNA, 64 nt, Human
aguuuuauaaagaucuguauaauugccugaaucaccagcacauucacugacaugauauuauuug

SEQ ID NO: 223423 - RNA, 64 nt, Human
acccuggcccugcugaggcauacagagcuucagcccagcacagaagcaagacaaaaucaguggc

SEQ ID NO: 223424 - RNA, 64 nt, Human
acucuccuccccucauuaaaccauccaccugacaccagcacaucaggccugguucaccucuggg

SEQ ID NO: 223425 - RNA, 64 nt, Human
gcgcuguuugugccgccgcugccucugggcccucccagcacacgcauggucucuucaccgcugc

SEQ ID NO: 223426 - RNA, 64 nt, Human
cugaggcugauaccccugaccuaucugcagucccccagcacacaaggaagaccagauguagcua

SEQ ID NO: 223427 - RNA, 64 nt, Human
augaugcuccugccucugccucccagccccucacccagcacagcucugccuggacuuggagaga

SEQ ID NO: 223428 - RNA, 64 nt, Human
uccugcgggaguaguuggaaaguuggaaccguguccagcacagaaggaaucugugcagaugagc

SEQ ID NO: 223429 - RNA, 64 nt, Human
aggagaugcagagccgccaggaaaauucugaguuccagcacaauuuucuuuggaaucuaacagg

SEQ ID NO: 223430 - RNA, 64 nt, Human
acacggggccgugauugacccuaaaaauugcagaccagcacauacacuggacacugcaggcaag

SEQ ID NO: 223431 - RNA, 64 nt, Human
ugaggugcaggguuauuugcauuuaaauugcaauccagcacacgugugagaaagaagaggcacu

SEQ ID NO: 223432 - RNA, 64 nt, Human
gaaguuacuuccaagacagacuuuuaagauguaaccagcacaaagcaaugucagggaggaguga

SEQ ID NO: 223433 - RNA, 64 nt, Human
uggggaggaaccauaaacccagcccucacagcucccagcacagggccucccugagccaguggca

SEQ ID NO: 223434 - RNA, 64 nt, Human
ccagugagcuuuacucacguggcccuugcuucauccagcacagcucucaggugggcacugcagg

SEQ ID NO: 223435 - RNA, 64 nt, Human
gcugcccgccucuaguucccaaggcguccgcgcgccagcacagaaacagaggagagucccagag

SEQ ID NO: 223436 - RNA, 64 nt, Human
ccguuagucccugaucccaaccuucucccuccugccagcacaccgaugcacacaccggaagugg

SEQ ID NO: 223437 - RNA, 64 nt, Human
agguguuuggugucugccuuuuuuguucuuuuuuccagcacaacauaacuuaccacugauacuc

SEQ ID NO: 223438 - RNA, 64 nt, Human
agcaaggaaacauuaaugcuuagaauucugagauccagcacaacucagucugugggagcucagc

SEQ ID NO: 223439 - RNA, 64 nt, Human
augcacaugggccgcaaaacacacagucaggcuuccagcacauucucccccauuuggaggauac

SEQ ID NO: 223440 - RNA, 64 nt, Human
aagggaauuccgaguguccagcacugccguauugccagcacagacggauuuucucuaaucagug

SEQ ID NO: 223441 - RNA, 64 nt, Human
agauauacagaugacuuuuuaaggguccuucuuuccagcacauuuuuuuuaaaaacucagguua

SEQ ID NO: 223442 - RNA, 64 nt, Human
aauaucccaggcacauacaaaacuuaugaauuacccagcacaacugugaaacucuguauugcuu

SEQ ID NO: 223443 - RNA, 64 nt, Human
uuuugguuccuguuguuucuauaauuacaaaaccccagcacagguauuuaagagccaaaggcca

SEQ ID NO: 223444 - RNA, 64 nt, Human
uuucuguuccaaauucaguuucauaaaaggagaaccagcacagcuuagauuucauaguucagaa

SEQ ID NO: 223445 - RNA, 64 nt, Human
aggcaauaguugaaggacuccuguuccguuggggccagcacaccgggauggauggagggagagc

SEQ ID NO: 223446 - RNA, 64 nt, Human
uauuagauucuagacaagcaacaccccucuggagccagcacagugcuccuccauaucaccaguc

SEQ ID NO: 223447 - RNA, 64 nt, Human
gcaaacucaacucggcaauccaagcaccuagauaccagcacaagucgguuaaucccugucugga

SEQ ID NO: 223448 - RNA, 64 nt, Human
gguacgaaaguaggaugagagccuucaaagucuaccagcacaaagaccccugagccccgcaauu

SEQ ID NO: 223449 - RNA, 64 nt, Human
gaggggguaaggaugcaggggccaugcauucaucccagcacaggcagcgcauggcuccggaagc

SEQ ID NO: 223450 - RNA, 64 nt, Human
uccuccagcaguggcaaagggguaggcucuagagccagcacaggucacugccugaccuggacua

SEQ ID NO: 223451 - RNA, 64 nt, Human
accaaagaggccaauggauuuuucaaagugugccccagcacaagaggcacugguguucggucua

SEQ ID NO: 223452 - RNA, 64 nt, Human
caagagggacccuggagcaccuuagacaaacuacccagcacaggcggggcuggaauucuggcgg

SEQ ID NO: 223453 - RNA, 64 nt, Human
caaacagauugacuugucaaagacucucuucaagccagcacaacauuuagacacaacacuguag

SEQ ID NO: 223454 - RNA, 64 nt, Human
gucuguguccacuuuuucuaaaguaaccccacccccagcacaccauuguuggcaccucucaagg

SEQ ID NO: 223455 - RNA, 64 nt, Human
ggagacacucaguuucacaagugagcccucuugcccagcacacaccuauggcuggcugggcaag

SEQ ID NO: 223456 - RNA, 64 nt, Human
ugcugaggaaaugguagaaugcugccuaucaccuccagcacaaucccagugaaaaaggugugaa

SEQ ID NO: 223457 - RNA, 64 nt, Human
agacagagucucacacuguggcccaggcuggacuccagcacaguggcaugaucucagcuccgcc

SEQ ID NO: 223458 - RNA, 64 nt, Human
ugacuugacuugacuuuggggguaaagucuuucaccagcacacaagaguuugauuguacaaaua

SEQ ID NO: 223459 - RNA, 64 nt, Human
gccugccggccucccugcagcucacggggcagaaccagcacaucuggagccacacagcuugggg

SEQ ID NO: 223460 - RNA, 64 nt, Human
ugcuucuccaguuuuugaggagccagccagggguccagcacagcccuaccccgccccaguauca

SEQ ID NO: 223461 - RNA, 64 nt, Human
aagaauugacccugggggcuugaacagggacugaccagcacaguggaggccccaggcaacagag

SEQ ID NO: 223462 - RNA, 59 nt, Human
aggaagaacuuagugauuaaaaucuugccccagcacaguaauaaaaaucaagauuuguu

SEQ ID NO: 223463 - RNA, 64 nt, Human
uuuagccuguagauuuauuuccauuuuccaaauuccagcacacagagaucccagccccuaugag

SEQ ID NO: 223464 - RNA, 64 nt, Human
cuagcuaaaaucaucuuauguaccacuaauaugcccagcacauuuuguaaaacaguccugauuu

SEQ ID NO: 223465 - RNA, 64 nt, Human
gauagucacaaauuugaaaccgugcuucagaaucccagcacauaguaaaagacaacacugauaa

SEQ ID NO: 223466 - RNA, 64 nt, Human
uuuugauuacauagaauuuguauuucuuuuuuagccagcacauuaaauuuuagauuuuauuuuu

SEQ ID NO: 223467 - RNA, 64 nt, Human
gcgcccuguccugguuguguuguuacguguuugaccagcacagggguccgguggggaaaaugua

SEQ ID NO: 223468 - RNA, 64 nt, Human
guucuuuagaagaucuggccauuugguacauaauccagcacagauaagcugggugguaaugaua

SEQ ID NO: 223469 - RNA, 64 nt, Human
acucauuaacuuugcuuauaaugcuuuuuauagcccagcacagaauuuaaagccauaccaccaa

SEQ ID NO: 223470 - RNA, 64 nt, Human
auacuuugcauuuaaaaacccuguccaccugucaccagcacaagagaauuagagcuucagugag

SEQ ID NO: 223471 - RNA, 64 nt, Human
auggggcuacuguuguuacagucucauauguaucccagcacauguaauuuuuuaaauaguuucu

SEQ ID NO: 223472 - RNA, 64 nt, Human
cgaccugugucaaauccguccauugaucugcccuccagcacacauuuacugagcuucuguuacg

SEQ ID NO: 223473 - RNA, 64 nt, Human
uuagugagugaauguuuguaaaacaggauagugcccagcacauacuaguaacaaauguaaaaua

SEQ ID NO: 223474 - RNA, 64 nt, Human
aauguuuacauucaauuaaggggaaaaaguagaaccagcacaaaugaguggcaguugcuggagc

SEQ ID NO: 223475 - RNA, 64 nt, Human
gaagacagggagugaggggccuuugugcccaacuccagcacagcugcguucuggggugugugag

SEQ ID NO: 223476 - RNA, 64 nt, Human
cagaagaaugcagggcccauucagcauggggaucccagcacaucacuguagaauuugagugauc

SEQ ID NO: 223477 - RNA, 64 nt, Human
acugugcaggacguggaccagcuggagcugcugcccagcacagaggagagucgccgcagaugac

SEQ ID NO: 223478 - RNA, 64 nt, Human
cuugaggcugaacuggucacagacaaacugggauccagcacaguccagcaguucucaaaaugag

SEQ ID NO: 223479 - RNA, 64 nt, Human
cucuuccucuuuucccauccccugcuacccuggcccagcacaggcacuuucuagauauuucccc

SEQ ID NO: 223480 - RNA, 64 nt, Human
agcagcauguggcccauggcaccacccccacggcccagcacaaccccuagagcaggaaagaggg

SEQ ID NO: 223481 - RNA, 64 nt, Human
ccucuccacacccagccugucccacuggcuccucccagcacaggcaccuauguggcauguggug

SEQ ID NO: 223482 - RNA, 64 nt, Human
gugauaacuggggcguuguuuuuuaaaauaaacuccagcacagggaugcugugcaugccugagu

SEQ ID NO: 223483 - RNA, 64 nt, Human
auucgccucuggaucugcugcauccaggacugugccagcacaaagugggagcccgauaaauauu

SEQ ID NO: 223484 - RNA, 64 nt, Human
acgaaaccauaucgcaaaccagagcugcuggaaaccagcacacgcaaaagaugacgcccagcac

SEQ ID NO: 223485 - RNA, 64 nt, Human
gcugcuggaaaccagcacacgcaaaagaugacgcccagcacagcagcaggacacaccaugugcc

SEQ ID NO: 223486 - RNA, 64 nt, Human
gugcucggcaccugagcauguccacagguggccuccagcacaccccucaggaagcuguggaggc

SEQ ID NO: 223487 - RNA, 64 nt, Human
ggugacccuuaauuacccguaucaugguucuugaccagcacauucaauccuccaaccuacccua

SEQ ID NO: 223488 - RNA, 64 nt, Human
aaggagcaguccccugcuaucccugcagccacucccagcacacccgcacacagccagcaccacc

SEQ ID NO: 223489 - RNA, 64 nt, Human
cucacauuauucugguuugaauauguccauaagcccagcacagaaacagcuggauucuucuacg

SEQ ID NO: 223490 - RNA, 64 nt, Human
uuuaagaaagcugagcagaggugucucauauuucccagcacaugauucugaacuugaugcuucg

SEQ ID NO: 223491 - RNA, 64 nt, Human
augccauaagacccaaucaaaugaagaaauaaacccagcacaaccuuggacauccauuagcuga

SEQ ID NO: 223492 - RNA, 64 nt, Human
uccccuucagccugggaccaggcuuuccuagaucccagcacagcucugagcuuguuccuuugag

SEQ ID NO: 223493 - RNA, 64 nt, Human
cucgcuucuucccaauuuaguaacuuagaugcuuccagcacauacguagguagcuaccccagcc

SEQ ID NO: 223494 - RNA, 64 nt, Human
uaaugauuggucccuggggaaggucuggcuggcuccagcacagugaggcauuuagguaucucuc

SEQ ID NO: 223495 - RNA, 64 nt, Human
caccuuccuccacucuaagggauaucaacacugcccagcacaggggcccugaauuuaugugguu

SEQ ID NO: 223496 - RNA, 64 nt, Human
cgcugccagcuugacacuggggaauccagccaguccagcacacucuuccauccuguccugucca

SEQ ID NO: 223497 - RNA, 64 nt, Human
ucugagcauucgauggccuuagcaccucaucaagccagcacauccugccugcuguugcagccug

SEQ ID NO: 223498 - RNA, 64 nt, Human
auagaaagguguaugcaaguugaauuugcugacuccagcacaguuaaaaggucaauauucuuuu

SEQ ID NO: 223499 - RNA, 64 nt, Human
gcagaauaaggcaaaagggaaaguguucuagguuccagcacaccugcaaagauaaagugugcca

SEQ ID NO: 223500 - RNA, 64 nt, Human
ccauacacuugucaaaucuggaucauucguagugccagcacaguccuaaaagggcuggaguacc

SEQ ID NO: 223501 - RNA, 64 nt, Human
ccgccggcggggagcaggaugcccuggaccuguaccagcacagccugggggagcuacugcuguu

SEQ ID NO: 223502 - RNA, 64 nt, Human
uuuccgugggugccuuaugugguggugguugugcccagcacagaccuggcaggguucuugccgu

SEQ ID NO: 223503 - RNA, 64 nt, Human
cugaagccauggaucaacuucuuucuugugucucccagcacacgugugcacgcaaggcagccuu

SEQ ID NO: 223504 - RNA, 64 nt, Human
agccaccaacuucagugccuuucuguaccccaagccagcacaagauuggaccaauccuuuuugc

SEQ ID NO: 223505 - RNA, 64 nt, Human
uccucuaaaggggaggcauuaaaauucacugugcccagcacaugggugguacacuaauuaugac

SEQ ID NO: 223506 - RNA, 64 nt, Human
cugucccucggcccggcccugccagagagggaccccagcacaucgugggcacgggcagggcuca

SEQ ID NO: 223507 - RNA, 64 nt, Human
guggagacugucccauggaacaaacccucaggcaccagcacagggcucugggugacucaguaaa

SEQ ID NO: 223508 - RNA, 64 nt, Human
acuuccaggcuuucuaccucgacucucaccacagccagcacauacaccuaggcuguuuuuccuu

SEQ ID NO: 223509 - RNA, 64 nt, Human
ccgucugaacugaccucugaccucugccccacgcccagcacagccuugggggaaguguacagag

SEQ ID NO: 223510 - RNA, 64 nt, Human
cuuucacuucccaccucucuaccuaaguuccuucccagcacaucgccagcccugggccugggga

SEQ ID NO: 223511 - RNA, 64 nt, Human
caggccuucagcccuuuaacgucucugccaaaaaccagcacaaggagacaaagcagagccuugu

SEQ ID NO: 223512 - RNA, 64 nt, Human
uccagagagcugccggaauuccagguuugacucuccagcacagagcagagcuacacagagguga

SEQ ID NO: 223513 - RNA, 64 nt, Human
gggcuggcucacauccagucacucccaacagcguccagcacacaaauaaaagacccuugggccc

SEQ ID NO: 223514 - RNA, 64 nt, Human
cagcacugggucagcgacuccaaucuuccaguggccagcacacccuagacaccccgaggaggga

SEQ ID NO: 223515 - RNA, 64 nt, Human
gcaggacugagcuguccggguucuccccacacuuccagcacagcugugcucuguguccugccuc

SEQ ID NO: 223516 - RNA, 64 nt, Human
gccagacuccugccggccucagaggacaccuggcccagcacaggcagcuagaagggccgguggg

SEQ ID NO: 223517 - RNA, 64 nt, Human
gcuuaggaaagcggcuguugcuccauaacucuaaccagcacagggcugaggccugcagugcaca

SEQ ID NO: 223518 - RNA, 64 nt, Human
gggaccagggauggggcagcgcacaggcccgggcccagcacagaacugcccaucgggacgcccg

SEQ ID NO: 223519 - RNA, 64 nt, Human
accaagagagccagggcugcuguuucgcgacucaccagcacagauuugcucagaaacucugccc

SEQ ID NO: 223520 - RNA, 64 nt, Human
ccagggccacacagcagagguagaggguccuuggccagcacacuaucuaccacucuaccccacc

SEQ ID NO: 223521 - RNA, 64 nt, Human
uguguguguguguguacuuguaugcacguaggcaccagcacaaagaucugaaugaugcacccca

SEQ ID NO: 223522 - RNA, 64 nt, Human
uaauacccucuuggaaaaagagcuugccccuccuccagcacacuagagcucuggccuugugugu

SEQ ID NO: 223523 - RNA, 64 nt, Human
gccugggucucugucccagacucgccacucucgaccagcacaagcuuugcccaaggacuaagcu

SEQ ID NO: 223524 - RNA, 64 nt, Human
gggaccccagcgccuaccaccucaacagacaccuccagcacagcuucaccaggggcuuuucagg

SEQ ID NO: 223525 - RNA, 64 nt, Human
cuucugcuugaggacgucugcagcuccuccuacaccagcacacuggugggaggcuggcggaguc

SEQ ID NO: 223526 - RNA, 64 nt, Human
aaacaugacaaagggccccgcagcccuucugcacccagcacagccugcccagcccagcccugcc

SEQ ID NO: 223527 - RNA, 64 nt, Human
cccccuguauucccccucccagggcagccccugcccagcacaaaaccccaggacccuggcucug

SEQ ID NO: 223528 - RNA, 64 nt, Human
gagacagugggcacuaaggguggagaguugggggccagcacagcugaggacccucagccccagg

SEQ ID NO: 223529 - RNA, 64 nt, Human
acuccaugugcccagccccgccacaaccucuccuccagcacauuccagcucuauuuaaaaagua

SEQ ID NO: 223530 - RNA, 64 nt, Human
ggacugauguauguugguggauccauguauguguccagcacagcggccugcuggacucugagaa

SEQ ID NO: 223531 - RNA, 64 nt, Human
cccggguuccuuccuagaaauguggcagcccauuccagcacacaggcuucugcagcaaucucug

SEQ ID NO: 223532 - RNA, 64 nt, Human
aaaguuuuccaagaaaaugccccgacaggggugcccagcacacugccugagggacaacagacau

SEQ ID NO: 223533 - RNA, 64 nt, Human
uacuaacaccccccuggaggcaugccccuuuucuccagcacacaagcacauuggggcaccugga

SEQ ID NO: 223534 - RNA, 64 nt, Human
ucaccauccucagaggcugagcccuguacccaccccagcacagccaccuccgccagaccccgug

SEQ ID NO: 223535 - RNA, 64 nt, Human
caucucacgagcuuuccuacaucuuccgugguucccagcacagcccaagauuauuuggcagcca

SEQ ID NO: 223536 - RNA, 52 nt, Human
ccaccggcgagguggccugaccccagcacaccucuggcuaacccauacccca

SEQ ID NO: 223537 - RNA, 64 nt, Human
cccgaggcccagaaaagaaaacaaaaacaaaaacccagcacauacaagaaacauacaguguacc

SEQ ID NO: 223538 - RNA, 64 nt, Human
acaucauacaaacugggcccugagcugugagagaccagcacagcagcguccagguuaaaagccg

SEQ ID NO: 223539 - RNA, 64 nt, Human
gcccauguguuucaucaaucagaaguccuccuccccagcacauucggauuuaaauuucuggucu

SEQ ID NO: 223540 - RNA, 64 nt, Human
caguucccuucaauuaaagagauacccgguagacccagcacaaggguccuuccagaaccaagug

SEQ ID NO: 223541 - RNA, 64 nt, Human
cagagcagaaugagcccucacccuggcuggggguccagcacaggcuguaucugcagaggguccc

SEQ ID NO: 223542 - RNA, 64 nt, Human
ggaaguaaggaaacauguaaugauaggcggacucccagcacagaaaaaaagguagaucugaaug

SEQ ID NO: 223543 - RNA, 64 nt, Human
aggcccgagggagcagccaucacaaacucacagaccagcacaucccuuuugagacaccgccuuc

SEQ ID NO: 223544 - RNA, 64 nt, Human
ugcuggaagacuuagaucugagcccucccucuucccagcacaggcagggguagaagcaaaggca

SEQ ID NO: 223545 - RNA, 64 nt, Human
agucagacugcucccggggagagagccccggcccccagcacauaaagaacugcagccuugguac

SEQ ID NO: 223546 - RNA, 64 nt, Human
cauuuugguggccuagugacucagggcagaguggccagcacaccucucauccgccccuccugcu

SEQ ID NO: 223547 - RNA, 64 nt, Human
ccacugugaccugccgaaguccacugccuuugccccagcacagaagaggccccugccacccuag

SEQ ID NO: 223548 - RNA, 64 nt, Human
gggaggcaggcucacuggccauuuucccuagaguccagcacacugcaggaggcguucggaggag

SEQ ID NO: 223549 - RNA, 64 nt, Human
gcuuucuggcugcucuucauugaccuguguguucccagcacacgaacagugccccuaacggaga

SEQ ID NO: 223550 - RNA, 64 nt, Human
uccuuuuugggggacuuugacagccauaucccucccagcacaccaggcgccaggugagcugguu

SEQ ID NO: 223551 - RNA, 64 nt, Human
cgcucuuuccagcaaagcugcucagagaggguguccagcacaguggagaggccggaagugagac

SEQ ID NO: 223552 - RNA, 64 nt, Human
augccaaagauaccucuaguuauguugaacacagccagcacaguuucgacaugucaaggaagag

SEQ ID NO: 223553 - RNA, 64 nt, Human
uaaugcaaucuugaaaugacugaaagguagauugccagcacagugaguuucccagccugcuccc

SEQ ID NO: 223554 - RNA, 64 nt, Human
acagguuccaucauggagaauggagugagcucuuccagcacagcugacaagucccagaagcagu

SEQ ID NO: 223555 - RNA, 64 nt, Human
uaagcaggacagugugcgugcacgagcuccgagcccagcacagacaugccuggaacccccgccg

SEQ ID NO: 223556 - RNA, 64 nt, Human
caguccuuguucccccaggaagggccugguggccccagcacacacuugggauuauguguauaca

SEQ ID NO: 223557 - RNA, 64 nt, Human
uccugccugucagcuccagguccuggagccacguccagcacagaguggacggauucaccguggc

SEQ ID NO: 223558 - RNA, 64 nt, Human
aaaaaauacaauaaauauuugaacccccucccccccagcacaacccccccaaaacaacccaacc

SEQ ID NO: 223559 - RNA, 64 nt, Human
agagaggccuguggcuaguuugcccugggggggcccagcacagccccagcccggagcccagccc

SEQ ID NO: 223560 - RNA, 64 nt, Human
gacgcuguccgacgaaggcggccacggacggacgccagcacacgaagucacgugcaagugccuu

SEQ ID NO: 223561 - RNA, 64 nt, Human
cgauugccggaagguugcauggcuggucccagggccagcacaggcccgaggccgggcugccugg

SEQ ID NO: 223562 - RNA, 64 nt, Human
auaagaagacaucagagaugcugcuaagucggcuccagcacacaggagccccccacaacgaaga

SEQ ID NO: 223563 - RNA, 64 nt, Human
ucuggggaaggaacaaaguccccaaacaaagcaaccagcacaauucugaaggggccuggccucc

SEQ ID NO: 223564 - RNA, 64 nt, Human
ggggcgucgaccuggcccagcuggguccccagggccagcacauggaauaaaauagccagggcca

SEQ ID NO: 223565 - RNA, 64 nt, Human
aucuguuccgcuguaacagaacugaauuuggaccccagcacaguggcucacgccuguaauccca

SEQ ID NO: 223566 - RNA, 64 nt, Human
gccucaccuuggacagaggucaauccuugaugcuccagcacaggugacgucacuaauugucacu

SEQ ID NO: 223567 - RNA, 64 nt, Human
agggagacggggaugucacgccgucccgcagggcccagcacagccccagacccgaaaaaagugu

SEQ ID NO: 223568 - RNA, 64 nt, Human
aaauaaauaaaugugaagcacuuagaacugauggccagcacaugagggcucaccaaguguaagc

SEQ ID NO: 223569 - RNA, 64 nt, Human
auugggccaggugcaguggaucacgccuguaaucccagcacauugggaggccaaggcacauagg

SEQ ID NO: 223570 - RNA, 64 nt, Human
uccagccggccggggaugugagucaucccuugguccagcacauccacgcuguauacgccaccca

SEQ ID NO: 223571 - RNA, 64 nt, Human
acugggccaaaggcucacuaccccugugcguuguccagcacacagacacuaugugcauuauuug

SEQ ID NO: 223572 - RNA, 64 nt, Human
caagcuaagauccacuggcuuggaauucucccugccagcacagcagucugaagucaaccuggga

SEQ ID NO: 223573 - RNA, 64 nt, Human
cugccugccagcucugaagagagcagcaguucuuccagcacagcgcuugagcucugcuaaggga

SEQ ID NO: 223574 - RNA, 64 nt, Human
auucccaaaaccaaaggacaacugaggagacugcccagcacauaaugaauaaauaagaaaauga

SEQ ID NO: 223575 - RNA, 64 nt, Human
ucugaacucuggcugagaggaugcugcucaggagccagcacaggacaccccccaccccacccca

SEQ ID NO: 223576 - RNA, 64 nt, Human
cacaagcugccaccaccagccacccacacccaccccagcacaccucacacgggaccacagccgc

SEQ ID NO: 223577 - RNA, 64 nt, Human
ggugaagcugaaggggccugugucccugaaagggccagcacaucacugguuuucuaggagggac

SEQ ID NO: 223578 - RNA, 64 nt, Human
ugccuguuuauggccagauuuggggggccuguucccagcacauuuuccuguaagcacucaggaa

SEQ ID NO: 223579 - RNA, 64 nt, Human
ccugacuccuuaaccccugaugacaacucuuaugccagcacaacuuugaccugaugaccucauc

SEQ ID NO: 223580 - RNA, 64 nt, Human
guggggaugauguuuggggaacaagauacuugacccagcacaucccccgccugguccaauacca

SEQ ID NO: 223581 - RNA, 64 nt, Human
agaucuucccugggccucugcccuggccugcuucccagcacacacuucuuuggccuaagggcuu

SEQ ID NO: 223582 - RNA, 64 nt, Human
accccaaccaggagcucuaguuaauggagagcucccagcacacucggagcuugugcuuugucuc

SEQ ID NO: 223583 - RNA, 64 nt, Human
uggccucccagaaugcuggguuuauagaugugagccagcacaccgggccaagugaagaaucuaa

SEQ ID NO: 223584 - RNA, 64 nt, Human
ucucacccccaacgaugccaaucacgacaacuuuccagcacacucccccgacccucgcggacac

SEQ ID NO: 223585 - RNA, 64 nt, Human
cugccugagucccagcucccagcuggagaauccaccagcacaagaagaggaggcaggggcagaa

SEQ ID NO: 223586 - RNA, 64 nt, Human
ucucccaaggcugccagacauggaccuccaggcuccagcacaucccccucuccucucccccagg

SEQ ID NO: 223587 - RNA, 64 nt, Human
guugguguugcuuaugaggaagguucagccuuauccagcacagccuucacguuuugcccucugc

SEQ ID NO: 223588 - RNA, 64 nt, Human
ugcuacuuuggggaguugauggccaggaaagaagccagcacaggguuaaaguaacuccuggcau

SEQ ID NO: 223589 - RNA, 64 nt, Human
ucucauuugauuuugcuugugcagaaaauaguuuccagcacauggauugaucugagagagaaug

SEQ ID NO: 223590 - RNA, 64 nt, Human
acaauggcuucaacgagaagcagguuuauuuuuuccagcacauaaaagaaaaauaauguuucgg

SEQ ID NO: 223591 - RNA, 64 nt, Human
auguggcagaaaucagcuggggcuuguuuagcuuccagcacacucucagucauagcauguguag

SEQ ID NO: 223592 - RNA, 64 nt, Human
gugcccaagggccaccaaccccagggaaacagggccagcacagaggggccuuccucccccacag

SEQ ID NO: 223593 - RNA, 64 nt, Human
ggcucaaggugcugagaagccaccgggaaagcagccagcacaaagggcccaggaagccagcccc

SEQ ID NO: 223594 - RNA, 64 nt, Human
cccucccaucuugaggucguucuccacauuccuuccagcacaccuguccuuuccauagcccuuu

SEQ ID NO: 223595 - RNA, 64 nt, Human
caaaccuucccagcagcccuugagccaaguaaaaccagcacaaccagccaccagugguugguga

SEQ ID NO: 223596 - RNA, 64 nt, Human
cugauacuuucacauguaauuaaauuccaggcaaccagcacaagagccgugagcuuggcacaug

SEQ ID NO: 223597 - RNA, 64 nt, Human
aggauuguguuacuaucacuaaguagcaaauugcccagcacauuaguccuaaacgucccaugua

SEQ ID NO: 223598 - RNA, 64 nt, Human
aaacauuucuuuacauuugcauuccuccauuucgccagcacaagucuugcuaaaugugauacug

SEQ ID NO: 223599 - RNA, 64 nt, Human
ggcauugccaucuccauuccucugcccucuugagccagcacaggaaggugaggcccugggauag

SEQ ID NO: 223600 - RNA, 64 nt, Human
gcccccagaggccucugaaccccaggcugggaccccagcacagaggcaauaaaggcaguggucc

SEQ ID NO: 223601 - RNA, 64 nt, Human
aaugacuggugugccuucuguggccuggacacaaccagcacagagcugucagugguggagagug

SEQ ID NO: 223602 - RNA, 64 nt, Human
cucucccuuaggggaagccccgagugagagucccccagcacacacuccccaacccccuccagca

SEQ ID NO: 223603 - RNA, 64 nt, Human
acaguuuuuauuuagcauggggauugcagagugaccagcacacuggacuccgaggugguucaga

SEQ ID NO: 223604 - RNA, 64 nt, Human
agcugggugggguggguguugagacccccucagaccagcacagagaccuguccuugugcagucu

SEQ ID NO: 223605 - RNA, 64 nt, Human
ucgcccugccgucggggcgcggcugcucacccgcccagcacacgccggggccccaggacaacgc

SEQ ID NO: 223606 - RNA, 64 nt, Human
uuuacugcuguaacuccaguuccuagaacaauuuccagcacauagcaaguguucaguaaauauu

SEQ ID NO: 223607 - RNA, 64 nt, Human
cugcccucccccuugccaguguuuagaacaguguccagcacaaacaggcacucaaccacuauuu

SEQ ID NO: 223608 - RNA, 64 nt, Human
ccacccacugagucaccuccgugccugcuuugcuccagcacagcagagaccagcaggcccccca

SEQ ID NO: 223609 - RNA, 64 nt, Human
uguauacgcuucaguuuuuccacauuguccacggccagcacaugaaagcaucacuucuuuuuua

SEQ ID NO: 223610 - RNA, 64 nt, Human
ccagcggcuuuaggcagaaagugcucgcucucacccagcacaucucucuccuugucccuggagu

SEQ ID NO: 223611 - RNA, 64 nt, Human
gggucuggguggacaccguccccacuccggacucccagcacaggggaggauaccugagccugua

SEQ ID NO: 223612 - RNA, 64 nt, Human
aaagaggcugaggcuggcacaggacaugcgguagccagcacacagggcagugagggagggcugu

SEQ ID NO: 223613 - RNA, 64 nt, Human
guccccggcgggacugucaauggaggcagggguuccagcacaaaguuuacuucugggcaauuuu

SEQ ID NO: 223614 - RNA, 64 nt, Human
agcaggcccgaaagaggcacccuuccaucugauuccagcacaaccuucaagcugcuuuuuguuu

SEQ ID NO: 223615 - RNA, 64 nt, Human
guccccugggcucuagaaagaacauucugugucaccagcacaggcucuugcugggugccugugc

SEQ ID NO: 223616 - RNA, 56 nt, Human
cuagauuugaaaacaacuaaagcgcuccagcacaucagucccgacgcuuccuguga

SEQ ID NO: 223617 - RNA, 64 nt, Human
ucgcggcugcaggauccuugccuccaacgugccuccagcacaugcggcuuccgagggcacuacc

SEQ ID NO: 223618 - RNA, 64 nt, Human
gaugggccgggcacgguggcucacgccuguaaucccagcacacugggaggccgaggcaggugga

SEQ ID NO: 223619 - RNA, 64 nt, Human
ccuuaacuugaguucuguuuugcaccuggauuuaccagcacaucaaagcugcuucgcaagcccc

SEQ ID NO: 223620 - RNA, 64 nt, Human
cccugggggccagccagggcccuuugugccccucccagcacaggccugaugcagguguccacuc

SEQ ID NO: 223621 - RNA, 64 nt, Human
uggggccugguccccuaaacaaucucuuccucagccagcacagggaaauccagacucaggguuc

SEQ ID NO: 223622 - RNA, 64 nt, Human
ucugguucagcugccucugcacccccucccacccccagcacacacacaaguuggcccccagcug

SEQ ID NO: 223623 - RNA, 64 nt, Human
gauaucaauaucaggcugccccacuccacguuccccagcacaucccagguggugggagcagagg

SEQ ID NO: 223624 - RNA, 64 nt, Human
aggccuagaagggaggagugguccacccacggucccagcacaaggcagagcugggaugaaaaca

SEQ ID NO: 223625 - RNA, 64 nt, Human
cucugcccacgccgggccccaaagugaccagacuccagcacaccugucuccuccugccuggggu

SEQ ID NO: 223626 - RNA, 64 nt, Human
aggcccucuaggccuggcagggaugucccugugcccagcacagggugccuggcagggggagacc

SEQ ID NO: 223627 - RNA, 56 nt, Human
ucuuccaucgcccugccuagcacccgccagcacacccuuagccuccagcacccccc

SEQ ID NO: 223628 - RNA, 64 nt, Human
ccugcgcuagucucccccgaggguuuaggcuggcccagcacauccuguccuccugagcucgcgu

SEQ ID NO: 223629 - RNA, 64 nt, Human
cauuuuugguuuuuagcuuguucaaaaacagaggccagcacagaugacauuuuagauacacucu

SEQ ID NO: 223630 - RNA, 64 nt, Human
ugcaggugagccggcguguccuggggagaugcugccagcacacaggggcccuccugcugccagc

SEQ ID NO: 223631 - RNA, 64 nt, Human
ccgacagcugcccagccuguucacaugcuggggaccagcacagcaccugaagccaugugggaca

SEQ ID NO: 223632 - RNA, 64 nt, Human
aaaaauaaaccacucaaaagaacaacaaaaaaacccagcacaaaaccgacgauggaguuuguuu

SEQ ID NO: 223633 - RNA, 64 nt, Human
uuuugaagacguggacuccucuugguggguguggccagcacaccaaguggcugggugcccucuc

SEQ ID NO: 223634 - RNA, 64 nt, Human
cucuguccuaaaccguccccuccuucccucacccccagcacagggggauucugagcagugccuc

SEQ ID NO: 223635 - RNA, 64 nt, Human
cugccuguccgaccccaucuuacagacgagaaaaccagcacacaggcaccaaggaacuguccgg

SEQ ID NO: 223636 - RNA, 64 nt, Human
ggagcuguuaucacuaccaguuucuggcacaauuccagcacaauuaugacaauucagagaagca

SEQ ID NO: 223637 - RNA, 64 nt, Human
guuuggucggguucacagugaccgagagucagguccagcacacaccugggaaagggaugcugcc

SEQ ID NO: 223638 - RNA, 64 nt, Human
aggacaggauuuaauucgaugguaucauuagaacccagcacauggcccuuagacugagauucag

SEQ ID NO: 223639 - RNA, 64 nt, Human
caucccacccugcucagcauuuacauuuuugccaccagcacacuuguucccagaccugcgcaca

SEQ ID NO: 223640 - RNA, 64 nt, Human
caccagucuaggcaugacuggcuucugaaaaauuccagcacaccuccucgaaccucauugucag

SEQ ID NO: 223641 - RNA, 64 nt, Human
aucuuuugggguggaguagaaagggucuuggauaccagcacauuggagggagauagccugaccu

SEQ ID NO: 223642 - RNA, 64 nt, Human
cauauggcugugcagccuugcucuguggcuuuucccagcacaaucagugcuagugcuggggaag

SEQ ID NO: 223643 - RNA, 64 nt, Human
aggugcuggagaggaaagcagggagccacugcauccagcacauggggugccugggccucagaug

SEQ ID NO: 223644 - RNA, 64 nt, Human
uguucuucucugagcagcuccuccccggagucccccagcacagucccaggagaugacaggaagg

SEQ ID NO: 223645 - RNA, 64 nt, Human
accaacucucgcguguuggagagaaggggcccucccagcacaaaguugcauuccuccccccuaa

SEQ ID NO: 223646 - RNA, 64 nt, Human
uccuuaagugaagaaagagucaaugagauuuugcccagcacauggagcuguaauccagagagaa

SEQ ID NO: 223647 - RNA, 64 nt, Human
aacagguuccuugaguaagauaguccaucaguuaccagcacauuuugaaccccugcucugugua

SEQ ID NO: 223648 - RNA, 64 nt, Human
ucagcaccacucaagaccaaauggaaacagaggaccagcacacucccgagacggcacugagaga

SEQ ID NO: 223649 - RNA, 64 nt, Human
gagccaggccccaccccuucccuauaggaacagcccagcacagguauuucaggugugaaagaau

SEQ ID NO: 223650 - RNA, 64 nt, Human
gaaucaggggaaagugauuuuaaaggugguuucuccagcacauuuuaagaaaagggaccaaaag

SEQ ID NO: 223651 - RNA, 61 nt, Human
ucuucuuccuggugcacugacugccuggugcccagcacaugugcugcccuacagcacccug

SEQ ID NO: 223652 - RNA, 64 nt, Human
uaagcuuuccuuggggagggaagagccuugauguccagcacacagccuggcuauaaagacacga

SEQ ID NO: 223653 - RNA, 59 nt, Human
gcgauuuuuuaugugccaaauacccccgucccccccaugaauccugcugucccugcugc

SEQ ID NO: 223654 - RNA, 59 nt, Human
ggacaggggaggacccuucuuuuggacagcccccccacccagagcccggucccuugggg

SEQ ID NO: 223655 - RNA, 52 nt, Human
aagagggggcugaggacugaggcccccccaacucuuccuccccucucauccc

SEQ ID NO: 223656 - RNA, 59 nt, Human
ccugugaccucaggguuuggcccauggggcccccccaggccccugccccaacugauucu

SEQ ID NO: 223657 - RNA, 59 nt, Human
cuacccauuuggcucuggaagcugcuuggcccccccagaucagggccugggugaacucc

SEQ ID NO: 223658 - RNA, 59 nt, Human
gagggcgucugaugcucucucucugccuccccccccauccugucaggcacaggugacgg

SEQ ID NO: 223659 - RNA, 59 nt, Human
gagcaggaggggacaccccuccauaugcccccccccaucuccugcuuucaugucccugg

SEQ ID NO: 223660 - RNA, 59 nt, Human
ucggaaguuaccagccugugagauccaagcccccccacccaggcccccuaaaaaucagg

SEQ ID NO: 223661 - RNA, 59 nt, Human
ugcgagaucagcagauaagaucaacaggucccccccacaugaggccacccaggaaaaaa

SEQ ID NO: 223662 - RNA, 59 nt, Human
ccccaccuaaggccaucuagugccaacuccccccccaccauuccccucacugcacuuug

SEQ ID NO: 223663 - RNA, 59 nt, Human
ccuugggguucuuucugcuuauguuuuuucccccccaucugguaauaguccucuucuga

SEQ ID NO: 223664 - RNA, 59 nt, Human
gaguacugggucacagggauuccuccuuucccccccaaauauuaacuccagaaacuagg

SEQ ID NO: 223665 - RNA, 59 nt, Human
acacugcauugucuuuugagcucuuuuuucccccccaacaaaguuuuuuuguuuuuugu

SEQ ID NO: 223666 - RNA, 59 nt, Human
uuccuccuuacccucccucccuuacucuccccccccaccaccacccuccacccccaacu

SEQ ID NO: 223667 - RNA, 59 nt, Human
ggugucccgaguagcugggauuacagguucccccccaccuucccccacacccagcuaau

SEQ ID NO: 223668 - RNA, 59 nt, Human
ggguaucccagaccccucucaacacccgccccccccauguuuaaacuuugugccuuuga

SEQ ID NO: 223669 - RNA, 59 nt, Human
gcuaaccaggccgagaggccacacacuugcccccccauccccacaaaccagguaaugcc

SEQ ID NO: 223670 - RNA, 59 nt, Human
cuuucagggacagugggcaagaggacacccccccccaccaccucaguggaacacaccau

SEQ ID NO: 223671 - RNA, 59 nt, Human
guuuuuuaaaaguuuaugacaguuggcuccccccccacccccagcaaccccaucccaga

SEQ ID NO: 223672 - RNA, 59 nt, Human
ugggccugaacucggacaagugaucgccacccccccaccccaggcccugccagagcagg

SEQ ID NO: 223673 - RNA, 59 nt, Human
gacagccaaguuauacccaaccccagaugcccccccauccugcucagcugcgucauggg

SEQ ID NO: 223674 - RNA, 59 nt, Human
gauuuuucuaucuucuguggucgcccgcccccccccaaaaaaauaccauuuaugguucu

SEQ ID NO: 223675 - RNA, 59 nt, Human
cacuucaggagcuuuuaaaaauacugagacccccccauaaccagagauucagauucaaa

SEQ ID NO: 223676 - RNA, 59 nt, Human
ccaccggccugugggucucugaagggacccccccccaaucggacugccaaauucuccgg

SEQ ID NO: 223677 - RNA, 59 nt, Human
ccuugaugguggaaaaaagaaaacaaccacccccccacugcccaaaaaaaaaagcccug

SEQ ID NO: 223678 - RNA, 59 nt, Human
uccuugggcuucuccugagguaaugauuacccccccacccacagcugagucugugaggc

SEQ ID NO: 223679 - RNA, 59 nt, Human
ccacuauuguuuuaauggaaagcaaaaaacccccccaaacuuaucagaauccucguucu

SEQ ID NO: 223680 - RNA, 59 nt, Human
ccccacuaagcuaauuccacaccccuguacccccccagggggcccucugccucauggca

SEQ ID NO: 223681 - RNA, 59 nt, Human
gggcacagccgcgacucugcaggcagcuucccccccaugccagggcucugcgccgucau

SEQ ID NO: 223682 - RNA, 59 nt, Human
agucuuauagcacaauauacccaaaucagcccccccaguccgagggcugggcccgaggu

SEQ ID NO: 223683 - RNA, 59 nt, Human
uagccaauuuuagacucuuuucaauaccucccccccauuuuaauuaguauugaucauau

SEQ ID NO: 223684 - RNA, 59 nt, Human
ugcauguuuucccuccuccccccaauucccccccccaucaccuuaucucccaggacaca

SEQ ID NO: 223685 - RNA, 59 nt, Human
uucuaucuuuagcccaucaucauuuucugcccccccaaaaucuguugaaaugauucacu

SEQ ID NO: 223686 - RNA, 59 nt, Human
cuugugguguuuucguuucuuuuucaucucccccccacccacaaagagcacggagccag

SEQ ID NO: 223687 - RNA, 59 nt, Human
uuuuaaaauuaaaauacuguguacccccccccccccaugaaaugcagguucacuaaaug

SEQ ID NO: 223688 - RNA, 56 nt, Human
acagcagcaacguugagugaugcguccccccccaaccuuucccucacccccuccca

SEQ ID NO: 223689 - RNA, 59 nt, Human
ucugugugaauaugcauaaccagagugaccccccccagcacccagcaugcccggcugug

SEQ ID NO: 223690 - RNA, 59 nt, Human
uaaaacugucagauccugaccagcaagcccccccccagccccccuuccaagugacuccg

SEQ ID NO: 223691 - RNA, 59 nt, Human
aagggggcagaucccagagccccucucaccccccccaccacaggccugcuccuuccuua

SEQ ID NO: 223692 - RNA, 59 nt, Human
aagcagaagcagcauccaagugccccuggcccccccauguguugauucaacccgguucc

SEQ ID NO: 223693 - RNA, 59 nt, Human
ccccagcucccugaugaugcucacccccgcccccccaccucaggugcugcuggugugag

SEQ ID NO: 223694 - RNA, 59 nt, Human
aaaugcaagcugggcugggucuagucccucccccccacaggugacaugaguacagaccc

SEQ ID NO: 223695 - RNA, 59 nt, Human
caagaaagccuggguauuguccaagguuucccccccacugagacagccugagauauggc

SEQ ID NO: 223696 - RNA, 59 nt, Human
caagagggcagggccgggguuuguggucccccccccaccacaaacacagcacuucggcu

SEQ ID NO: 223697 - RNA, 59 nt, Human
uuucauauaacauauauauuuauuuauuucccccccauagaaggcaaaauggcuuucag

SEQ ID NO: 223698 - RNA, 59 nt, Human
uggggaaaggugucuuucuuucugcccuccccccccaaaauaauucuguucacuuuugu

SEQ ID NO: 223699 - RNA, 59 nt, Human
caucucaaucccguaucuacgcacccccccccccccaggcaaagcagugcucugaguau

SEQ ID NO: 223700 - RNA, 59 nt, Human
cuuagaagccugcucugcauccauuuacccccccccaagggcuuuguuucacuguuuau

SEQ ID NO: 223701 - RNA, 59 nt, Human
aaaaauuacauuacaagauccagguucuucccccccacacucaaucaagccagcccucu

SEQ ID NO: 223702 - RNA, 59 nt, Human
acugggacagugucugauucccccuucaccccccccacccccgccuugccacacacagc

SEQ ID NO: 223703 - RNA, 59 nt, Human
cccucuucccuucaacaugaaaauauauacccccccaugcagucuaaaaugcuucagua

SEQ ID NO: 223704 - RNA, 59 nt, Human
caaagacacauacauucaccgcccccccgcccccccaacgcgcacacacacguccucuc

SEQ ID NO: 223705 - RNA, 59 nt, Human
cauucaaauauuuacccgggacacacacccccccccacacacacacacagacacacuca

SEQ ID NO: 223706 - RNA, 59 nt, Human
cccuauccuuuuucucuccaccccauccccccccccauuucguuuugcuuuugguugcc

SEQ ID NO: 223707 - RNA, 59 nt, Human
cacccggcaaggggcgcgcgcccccaggacccccccaguccgccccgugcuccucugcc

SEQ ID NO: 223708 - RNA, 59 nt, Human
gggcaacagagcaagaccccauccuccaccccccccaaaaaauagaaagaaaaaaaaag

SEQ ID NO: 223709 - RNA, 59 nt, Human
acaggccccacccccacaguuccacgccccccccccaaggccacacccucccucccuag

SEQ ID NO: 223710 - RNA, 59 nt, Human
guccucuuuguuaugcuuggaagcucccccccccccaacagugugucgagucuuugcaa

SEQ ID NO: 223711 - RNA, 59 nt, Human
auaugugaauauagagcuaggaaaaaaagcccccccaaauaccuuuuuaaccccucuga

SEQ ID NO: 223712 - RNA, 59 nt, Human
gcuuuugaaauuaaauuaucuauucuucccccccccaaaaaaaaguauuguaaauccuu

SEQ ID NO: 223713 - RNA, 59 nt, Human
aacaagugcccagucagcaccuaccccuucccccccaggggguugaauaugcaaaagca

SEQ ID NO: 223714 - RNA, 59 nt, Human
aaagcaguuuuucuacuuuuaaagacccccccccccaacagaacacuaaacagacuauu

SEQ ID NO: 223715 - RNA, 59 nt, Human
cuaugcagcccacaagaaggcccugcgggcccccccauugcccagcacugucucauaga

SEQ ID NO: 223716 - RNA, 59 nt, Human
aacccaacaaugaagauacaguucugucacccccccagcauucuccuguggcccucuag

SEQ ID NO: 223717 - RNA, 59 nt, Human
uacaaacuuuaagugcucugauaugacuucccccccaaauuuuauuaugaacauuuuua

SEQ ID NO: 223718 - RNA, 59 nt, Human
cgacugcuucuugcagaggcugagagucccccccccaccuuuuuuuucauuuagaugua

SEQ ID NO: 223719 - RNA, 59 nt, Human
ggcauggagaagccucagggaaaggccugcccccccagcacauacucccauaguguccu

SEQ ID NO: 223720 - RNA, 59 nt, Human
ggggcagaguuucugcaguuccaucaggucccccccaggugcaggugcugacaauacug

SEQ ID NO: 223721 - RNA, 59 nt, Human
guugugauuguggcauggagaguccccaucccccccaugugagcgugucccgggcgggu

SEQ ID NO: 223722 - RNA, 59 nt, Human
cgacccuguggccugcugcccgccccccccccccccacaguggccauacgggcacagga

SEQ ID NO: 223723 - RNA, 59 nt, Human
ucccuccucugugugcucaugcugugaaucccccccauucuaccacuucuccccucauc

SEQ ID NO: 223724 - RNA, 59 nt, Human
agacaccucccccaccgcccgccccccgccccccccaaucaaaguguggucccaaaaca

SEQ ID NO: 223725 - RNA, 59 nt, Human
acugccucaaggacccuggacucugcucacccccccaccacucugccuggccuccugcu

SEQ ID NO: 223726 - RNA, 59 nt, Human
cucauuuccguuuccuaccuguuugcuuccccccccaguccuccgcaugagcuguugcc

SEQ ID NO: 223727 - RNA, 59 nt, Human
aucuguacuauccagugagguaauuucuucccccccaagauagagucaagcucugucac

SEQ ID NO: 223728 - RNA, 59 nt, Human
aguggacucauccauucuuuggaacaaaucccccccacuccaaaguccauggauucaau

SEQ ID NO: 223729 - RNA, 59 nt, Human
auccauucuucuugcccuggcucacuugucccccccaccgccccgcgcuggagccacug

SEQ ID NO: 223730 - RNA, 59 nt, Human
ucgcccgcccauucuacuacucaaccccucccccccaagguauuuccagaacuaaaccc

SEQ ID NO: 223731 - RNA, 59 nt, Human
uugcagagaugaugagagcuguguggccacccccccaaccuugcccccggcacaccaaa

SEQ ID NO: 223732 - RNA, 59 nt, Human
uacauacaccagcauuccuuuugaacgcccccccccaccccugggggcucucauguuuu

SEQ ID NO: 223733 - RNA, 59 nt, Human
gcuuguugcggcauugaucuaaccuuuuucccccccauuucaguugcaguuuuuguaga

SEQ ID NO: 223734 - RNA, 59 nt, Human
acuccagccugggcaacaggaguaaaacucccccccacccaaaaaaaaaaacaacaaca

SEQ ID NO: 223735 - RNA, 59 nt, Human
acuuucaaguuggcugucccccccgccgccccccccacccccauauguacagaugauaa

SEQ ID NO: 223736 - RNA, 59 nt, Human
gucagaaggaaaaauaaugcauuuaucuucccccccaccccccgccccauggaauauuu

SEQ ID NO: 223737 - RNA, 59 nt, Human
cuucuuaaagccuuauuuuucaaaagcgccccccccauucuuguucagauuaagaguug

SEQ ID NO: 223738 - RNA, 59 nt, Human
cacaggcccccucagggcuccuugccuuucccccccaccagcacaccccguacccugcc

SEQ ID NO: 223739 - RNA, 59 nt, Human
ccuggcuuccuuccuccacccaguggagacccccccaaggcaugaggggaaagccauua

SEQ ID NO: 223740 - RNA, 59 nt, Human
ucuccccuucuuugugacagcuccucccacccccccaaaaaauaaaaaaaccacaaaaa

SEQ ID NO: 223741 - RNA, 59 nt, Human
aaauaccacugaagaggacacacucugcacccccccaccccacgaccuuggcccgagcc

SEQ ID NO: 223742 - RNA, 59 nt, Human
ggugauauugccagcagacccccugccaucccccccaguuguccuggggcugaaugggc

SEQ ID NO: 223743 - RNA, 59 nt, Human
cucccccuuccuccugugcccuccccuuccccccccaacagcugcuaugggggggcuaa

SEQ ID NO: 223744 - RNA, 59 nt, Human
uugcugaguccccugccaagcgcucggagcccccccaggacacucugcacccccucacc

SEQ ID NO: 223745 - RNA, 59 nt, Human
cugagggguugaugugggguucaggauggcccccccaugggggguggaugauuugcacu

SEQ ID NO: 223746 - RNA, 59 nt, Human
ggcuaccagcucucaccuacacccacgcacccccccacacacuaugcucucucaagaau

SEQ ID NO: 223747 - RNA, 59 nt, Human
ugcucucucaagaauguaauuuauuggggcccccccagcugcuuuccucaccugccccu

SEQ ID NO: 223748 - RNA, 59 nt, Human
aucaccagcccgggcuggcccaaggaguacccccccaacaagaacugcaucuggcagcu

SEQ ID NO: 223749 - RNA, 59 nt, Human
gccuggcccacccugcuccacccacugggcccccccaguuauugauaccccucugugcu

SEQ ID NO: 223750 - RNA, 59 nt, Human
cccagccuggcguagagcaccccuccccucccccccaccccccuggagugcugcccucu

SEQ ID NO: 223751 - RNA, 59 nt, Human
uaaaacguugcaaauuccuuuacuguuaucccccccaccaccaggaccauguagggugc

SEQ ID NO: 223752 - RNA, 59 nt, Human
ggcccugucccaggccggcccagaugugucccccccaggccuuguccuacguccaaggu

SEQ ID NO: 223753 - RNA, 59 nt, Human
gcuggcucccccuccccaggcuggagacccccccccaacuccaggaaagagcagucaga

SEQ ID NO: 223754 - RNA, 59 nt, Human
ugacacguggacaaaugcgggcucaucagcccccccagagagggucaggccgaacccca

SEQ ID NO: 223755 - RNA, 59 nt, Human
gugccccagacgggggccgagggccugagcccccccaucccuccucugccaggguuucu

SEQ ID NO: 223756 - RNA, 59 nt, Human
agugccuuuccuccccacuggagggcaagcccccccacccacccaggauguccuggcuc

SEQ ID NO: 223757 - RNA, 59 nt, Human
auuuaugcuuuucgccuggcaguuauuuucccccccaagcuauccuguuucagauaaua

SEQ ID NO: 223758 - RNA, 59 nt, Human
uuuaaaaugucaacaauauggagaauaaccccccccaacacaccuauaaaaacccaaau

SEQ ID NO: 223759 - RNA, 59 nt, Human
uguggcccugagacaccagggaaaaucuccccccccacaggacauacuaguucccuggc

SEQ ID NO: 223760 - RNA, 59 nt, Human
ggaacagaaacaccagcugcucccucacccccccccaugccuuccuggucccucugugc

SEQ ID NO: 223761 - RNA, 59 nt, Human
uucagggggucccugagauaguuuagaugcccccccaucuuagaccucagcucccacag

SEQ ID NO: 223762 - RNA, 59 nt, Human
gcaucagaugcagcagugcccaccgcccccccccccaccccccgcccugcccacagagc

SEQ ID NO: 223763 - RNA, 59 nt, Human
gcccccuucccuccagcggcacuccaagucccccccauguuggaaagaggaacagggcu

SEQ ID NO: 223764 - RNA, 59 nt, Human
guuccucaguagcuuuacuuucuuccuuucccccccaaaugguugcguccuuugaaccu

SEQ ID NO: 223765 - RNA, 59 nt, Human
ccgaugcaugugggucagggaucugggggcccccccagcuggcgggaaccccaaaugga

SEQ ID NO: 223766 - RNA, 59 nt, Human
cucgcccaucccccccgcggcuccuggcucccccccacuccccucgcucccccuccccc

SEQ ID NO: 223767 - RNA, 59 nt, Human
gacccugcuggccaggcaaggggccagaccccccccaacccccagcugccaucgcucuc

SEQ ID NO: 223768 - RNA, 59 nt, Human
ccuccaaggcaaaguuuggcaaacuguggcccccccacugucauauuuuguuaauaaaa

SEQ ID NO: 223769 - RNA, 59 nt, Human; identical to SEQ ID NO: 223768

SEQ ID NO: 223770 - RNA, 59 nt, Human
gggcgggcaggcaggaggcccucccuccacccccccacccucagcccggcaacuucugg

SEQ ID NO: 223771 - RNA, 59 nt, Human
gcucucccuuucuucugagacacauccagcccccccacgucucccucauauacacagac

SEQ ID NO: 223772 - RNA, 59 nt, Human
uuuuuuguuuuuugcacuucgcuguguuucccccccaucuuuaaaaauaauuaguaaua

SEQ ID NO: 223773 - RNA, 59 nt, Human
ccucucaucaggaucugccccccagagaccccccccagacacugcagggccuggugaug

SEQ ID NO: 223774 - RNA, 59 nt, Human
gcaaagggcuccuugauucauaagcaccucccccccaaaaaaaccaaauugguaaaaau

SEQ ID NO: 223775 - RNA, 59 nt, Human
cuugugaucauucugaagugccaaaggagcccccccauuccugggccuuucugagggca

SEQ ID NO: 223776 - RNA, 59 nt, Human
gguagcaccaucuggcuggaggggggcaccccccccauggaugcccuucaggugaguuu

SEQ ID NO: 223777 - RNA, 59 nt, Human
gacucucugggggcaggugccaagauuugcccccccaguggcccugggcugggccuggc

SEQ ID NO: 223778 - RNA, 59 nt, Human
accugcacugccccccacauucucccagccccccccaaggacccccucuccuugacccc

SEQ ID NO: 223779 - RNA, 59 nt, Human
ggcacagccugugcagagagggugggucacccccccagauccaaggagaaacugcaggu

SEQ ID NO: 223780 - RNA, 59 nt, Human
ugucucaccccugauauugguuccugaugcccccccaacaaaaauaaauaaauaaauua

SEQ ID NO: 223781 - RNA, 59 nt, Human
uacaaacauuuugcuaagucugcccaaagcccccccaaugcauuccuucaacaaaauac

SEQ ID NO: 223782 - RNA, 59 nt, Human
uuucacccccuucuuccugucacaugacccccccccauguuuuauuaaagggggugcug

SEQ ID NO: 223783 - RNA, 59 nt, Human
cccuucccucacuuccauccaucucuagacccccccaaggcuuucugugucgcugcccc

SEQ ID NO: 223784 - RNA, 59 nt, Human
ccaacccccaaacugcugcugcggggaaccccccccaccccgccuucagagcccucccc

SEQ ID NO: 223785 - RNA, 59 nt, Human
cacggggaaggggaguagggaugucuuuucccccccagcagugaugaguggggcuagcu

SEQ ID NO: 223786 - RNA, 59 nt, Human
gcaagaaaggaauggacccuguguguggccccccccaccccuggcggcugggugauccu

SEQ ID NO: 223787 - RNA, 59 nt, Human
agcgacacuaccuggggcucaggccuggacccccccaguucacgguugcuccugggagc

SEQ ID NO: 223788 - RNA, 59 nt, Human
gggcgccugaaguagggucccgccccccccccccccauucagacacauggauguugggu

SEQ ID NO: 223789 - RNA, 59 nt, Human
auguguaccccgcucaccacgggaacggccccccccaaccacaggcaucaggcaaccau

SEQ ID NO: 223790 - RNA, 59 nt, Human
gggacccagacuuuuggccccagcgcuggcccccccagccccacacccuauaucuccgu

SEQ ID NO: 223791 - RNA, 59 nt, Human
uggcccuccagguggcagcacuaaggacacccccccacaacaagaguuagcagcgaggu

SEQ ID NO: 223792 - RNA, 59 nt, Human
uggcacguguucacacacccuccuguguacccccccagggucaccgaaguccccacacg

SEQ ID NO: 223793 - RNA, 59 nt, Human
gccccacccccaugcagccucuuccccaccccccccaccacgugcucaaucaugaguac

SEQ ID NO: 223794 - RNA, 59 nt, Human
gcuacugugcaaugcauaccuccucaacacccccccacacucaguaaagaauuuuccaa

SEQ ID NO: 223795 - RNA, 59 nt, Human
gcaaaugacacugcagagcauuguuuucucccccccacguaggagauuuuauucaacua

SEQ ID NO: 223796 - RNA, 59 nt, Human
cccuccaaccucccauuggcucgcucccccccccccaccgugcccuccaucacgcccug

SEQ ID NO: 223797 - RNA, 59 nt, Human
agugacggauaguuuagcuuacuauguuucccccccaauucaaugaucuauaacaacag

SEQ ID NO: 223798 - RNA, 59 nt, Human
cccuugagcccuccaccccuggcccaagacccccccaaacugucugacucuguguuucc

SEQ ID NO: 223799 - RNA, 59 nt, Human
ugucagacagcugugacccuggacagggccccccccaccaucuguaaaacggggacagu

SEQ ID NO: 223800 - RNA, 59 nt, Human
ccauucuuuuguaauuuaaauggcugcaucccccccaccucucccugacccuguauaua

SEQ ID NO: 223801 - RNA, 59 nt, Human
gccauacauuagaaaugagacaaucaaagcccccccaggguggcacacccaucuguuug

SEQ ID NO: 223802 - RNA, 59 nt, Human
ccaguuccaucuguaguccuaaccaggagcccccccauggaacugcagcccccugucuc

SEQ ID NO: 223803 - RNA, 59 nt, Human
aacauagcaaagcaaagacagaaugcccccccccccaaauauuguccugucccugucug

SEQ ID NO: 223804 - RNA, 59 nt, Human
agccauugcagggggcagggaaguucacccccccccaccacccccccgcccccccgaag

SEQ ID NO: 223805 - RNA, 59 nt, Human
cucaauaagugagucuuggauuuagcaggcccccccaccuuuuuuuuuuguuuuuggag

SEQ ID NO: 223806 - RNA, 59 nt, Human
gcccagguccccaucuccaugucccgggucccccccagccugcucuagcugcccaccgc

SEQ ID NO: 223807 - RNA, 59 nt, Human
ggaagagaagagacagaaagaccccaugacccccccauguggauccccaucugugucuc

SEQ ID NO: 223808 - RNA, 59 nt, Human
gguaugagaggcuguccucgucuuugauucccccccaaccccaccucgggccucacgac

SEQ ID NO: 223809 - RNA, 59 nt, Human
uaugauuguguaugugccgcuaccaccaccccccccauggggggguggagaggggugca

SEQ ID NO: 223810 - RNA, 59 nt, Human
uccagccugcggacagaccaagacuucaucccccccaaaaaaaaaagauuggaggugau

SEQ ID NO: 223811 - RNA, 59 nt, Human
cggcacucccuaaaugaucucuccuuccccccccccaccccgagauacgggguuccagg

SEQ ID NO: 223812 - RNA, 59 nt, Human
gccaggggggugaggagcuggggaucccucccccccaugcacugugaaggacccuuguu

SEQ ID NO: 223813 - RNA, 59 nt, Human
cugaggcuccaccacccacccuuucauuucccccccagaagccuaaggccuaauagcug

SEQ ID NO: 223814 - RNA, 59 nt, Human
cacagaguuaaaacuugggauuccccuggcccccccagaacacuuguauauuguuuguu

SEQ ID NO: 223815 - RNA, 59 nt, Human
gggagagaggugggggcaagggggaaaugcccccccaucuccuuggaggcaguggugug

SEQ ID NO: 223816 - RNA, 59 nt, Human
aucagaacccugccugcccaccugcaacucccccccaacaaugccauucccacuugccc

SEQ ID NO: 223817 - RNA, 59 nt, Human
gcuguugauuguguuuuccuuguuuucagcccccccacuccagcccgcagcacauuucc

SEQ ID NO: 223818 - RNA, 59 nt, Human
ugacaauuugugauaucuaauaauaaccccccccccaauauugauuaagccuccuccuu

SEQ ID NO: 223819 - RNA, 59 nt, Human
uuauuuuucuacacuucaauaugaacugccccccccacauuaauauaaaaacuacuaau

SEQ ID NO: 223820 - RNA, 59 nt, Human
aguccauuaaauucuccugucuagaaugacccccccaccaguacuugaccaauuucaug

SEQ ID NO: 223821 - RNA, 59 nt, Human
aguugcuaugguccgaauaucugggccugcccccccaaauuaugcugaaaccuaaucac

SEQ ID NO: 223822 - RNA, 59 nt, Human
gucacuucuuuucugcuaucccccagccccccccccaaaauccucauguuucugcuuca

SEQ ID NO: 223823 - RNA, 59 nt, Human
cucccaaaucccaaaugccacuccaaguacccccccagauaccaugucaggauauuuuu

SEQ ID NO: 223824 - RNA, 59 nt, Human
caccucuccaccuguacccgcccccccaccccccccaccccugccccuuggaagaguug

SEQ ID NO: 223825 - RNA, 59 nt, Human
ucccgguggcaccucuccaccuguacccgcccccccaccccccccaccccugccccuug

SEQ ID NO: 223826 - RNA, 59 nt, Human
accccaccccgccccgcccugcccgcccccccccccaccaguccugcccccgcauggag

SEQ ID NO: 223827 - RNA, 59 nt, Human
agguuuuauuuugauuguguucguuuccccccccccaauaguaaaauuucuccuccuuu

SEQ ID NO: 223828 - RNA, 59 nt, Human
gucugggucacuuuuuaagcuuguaaccgcccccccagacuuauaaucuuaaauguauu

SEQ ID NO: 223829 - RNA, 59 nt, Human
gccagaggugggcaggugguggcacugagcccccccaacacugugcccugguggagaaa

SEQ ID NO: 223830 - RNA, 59 nt, Human
gggaauccuagggggcuccaugacaccuucccccccagacccagacuugggccguugcu

SEQ ID NO: 223831 - RNA, 59 nt, Human
cuuugggcaaaucauuucacuccucaaagcccccccacacaagcuggauucccacuucu

SEQ ID NO: 223832 - RNA, 59 nt, Human
guccuuuccuacuccagaaaugcuccccacccccccaaagagggaaaagcagauaaccc

SEQ ID NO: 223833 - RNA, 59 nt, Human
gcauccacgcuacugcccccugccccccgcccccccaguuuguacgguugcaacagugu

SEQ ID NO: 223834 - RNA, 59 nt, Human
ccucuccagcgaccaaagcuuccccggggcccccccagccugcaagacaggugaguggc

SEQ ID NO: 223835 - RNA, 59 nt, Human
uaucugcugucccuccccugccccccugccccccccaccgccuucccuuuuucccuguc

SEQ ID NO: 223836 - RNA, 59 nt, Human
cacuaggagggcuggcccuaagauacagacccccccaacuccccaaagcggggaggaga

SEQ ID NO: 223837 - RNA, 59 nt, Human
aaccuuuuccuuaaggucuuuuaccaccucccccccaaaaaaaucccccaaaacugauu

SEQ ID NO: 223838 - RNA, 59 nt, Human
agugccuggccucuucccucuccccaccccccccccaacuuuuuuuuuuuuuuauggca

SEQ ID NO: 223839 - RNA, 59 nt, Human
uuuuauacuuugcuagguagacuuuauuacccccccacuaugcccucauuuuuuuaaaa

SEQ ID NO: 223840 - RNA, 59 nt, Human
cuggucucgaacuccugaccucaggugaucccccccaccucagccucccaaagugcugg

SEQ ID NO: 223841 - RNA, 59 nt, Human
gaggucccugcugccagcuucaggugacccccccccaucccccggcaccucccuugggc

SEQ ID NO: 223842 - RNA, 59 nt, Human
ccgaggagggagggcuccuuucuagccugcccccccacccccacuucaccccuccccag

SEQ ID NO: 223843 - RNA, 59 nt, Human
ccgccacacccgcucugucuucccacugucccccccaucccgggcagggcccaguggga

SEQ ID NO: 223844 - RNA, 59 nt, Human
agggccugaugggguggaaggcauggcggcccccccagcugucaucaauuaaaggcaaa

SEQ ID NO: 223845 - RNA, 59 nt, Human
ugggcauggccgcuucuagagccucgacacccccccaacccccgcaccaagcagacaaa

SEQ ID NO: 223846 - RNA, 53 nt, Human
gggacggggagcuucccugacuacccccccagcccuccucucccuucuggggg

SEQ ID NO: 223847 - RNA, 52 nt, Human
gggggacgcugggcuuguaggccccccccacccuucucucucccagacccuu

SEQ ID NO: 223848 - RNA, 59 nt, Human
gcuucuuuuuuuucuuucuuguuuuucuucccccccaccccccacccccuucgguuaac

SEQ ID NO: 223849 - RNA, 59 nt, Human
ucagagccaagacuaggccaggguggggacccccccaguacccucccuacaucaaugug

SEQ ID NO: 223850 - RNA, 59 nt, Human
accaggccuaaagcccaccccuacccucacccccccaauccucuccugaaacuuaaaaa

SEQ ID NO: 223851 - RNA, 59 nt, Human
uucuuaggccugaaaaggggcugggcacccccccccaccaaggauggacgaagaccccc

SEQ ID NO: 223852 - RNA, 59 nt, Human
gcacaccucccucagcaccaagaccgggacccccccacccacgugucucauuguggcug

SEQ ID NO: 223853 - RNA, 59 nt, Human
ugggaaggagguugugauugcuggcaagucccccccaacuguaccacgggcaugaggag

SEQ ID NO: 223854 - RNA, 59 nt, Human
agguuuuugcuucuccaguggugaccacccccccccauccccgcucacaacuuggguuc

SEQ ID NO: 223855 - RNA, 59 nt, Human
ggccuuugaacaacuggggggcguuuucucccccccauugggacaccagucuucggugu

SEQ ID NO: 223856 - RNA, 59 nt, Human
uuauuaaaugugacgaacugccccccccccccccccagcaggagagcagcaaaauuuau

SEQ ID NO: 223857 - RNA, 59 nt, Human
ggacaccucuaacaucucggcccccugugcccccccagccccuucacuccucccggcug

SEQ ID NO: 223858 - RNA, 59 nt, Human
agagagcuccucccuggguugucuguggacccccccaggagcugcuaauuggcagcacc

SEQ ID NO: 223859 - RNA, 59 nt, Human
aaggcuaaauccacccuuaccccuccugacccccccaaguggagggaacagauccuggc

SEQ ID NO: 223860 - RNA, 59 nt, Human
gaaggggcagagcugggggcugagggagacccccccacaccccuucucuccuuccucuc

SEQ ID NO: 223861 - RNA, 59 nt, Human
ggguauuuuguuuuuguucucaccugcugcccccccaccccaccaccccagggauaaau

SEQ ID NO: 223862 - RNA, 59 nt, Human
cugcucauccagaggauauucccccaucccccccccaucaaguuuggugggcagagcua

SEQ ID NO: 223863 - RNA, 59 nt, Human
ucagacuugcggccacagcacuagagucacccccccaggccuccagaaccuuacuggca

SEQ ID NO: 223864 - RNA, 59 nt, Human
cuggaaggaggaugcagacuuccagagagcccccccaacggacgugcugagaagggaga

SEQ ID NO: 223865 - RNA, 59 nt, Human
ugagcccuggcugcuuguccuccucgcaacccccccaggccggagcuuccuuccuuagc

SEQ ID NO: 223866 - RNA, 59 nt, Human
acgccugccccaggaugcccccuuucccucccccccaugcccagagccccgccugccuc

SEQ ID NO: 223867 - RNA, 59 nt, Human
cgggauccugcccccaagucauuuccguccccccccaggcccucccaccaccccauuuu

SEQ ID NO: 223868 - RNA, 59 nt, Human
uccacacauuccagccaggcccaggccagcccccccacccacccccaggccuccuaggg

SEQ ID NO: 223869 - RNA, 59 nt, Human
gagcuggcagcauacccagagauccggggcccccccacccccaaaucacgagugcagcu

SEQ ID NO: 223870 - RNA, 59 nt, Human
cuaauguuaagugggguacagaucagcugcccccccacguagccuggacaucgucuuau

SEQ ID NO: 223871 - RNA, 59 nt, Human
cgccaaaggugacccgcgccaaccucccucccccccagugccuaugacggcggcacagc

SEQ ID NO: 223872 - RNA, 59 nt, Human
cacugcccuguuugcugccaugaggcccccccccccagcaauaucccaggggcgggccc

SEQ ID NO: 223873 - RNA, 59 nt, Human
ugugcaccugucuuacauucucuguugcucccccccacacucuugcucagucugucacc

SEQ ID NO: 223874 - RNA, 59 nt, Human
gggcuuucucuuccccuuccuguuucagacccccccauuucccgcacaugguguggggg

SEQ ID NO: 223875 - RNA, 59 nt, Human
agaaaugacaauagagggccacggggaggcccccccagaagcaagauucaaaucucuug

SEQ ID NO: 223876 - RNA, 59 nt, Human
cacccucgcgggcugggccuuccacgcaucccccccaccccccauggaacagaaagcca

SEQ ID NO: 223877 - RNA, 59 nt, Human
gaaucacuggugcuauagaaauugagaugcccccccaggccagcaaauguuccuuuuug

SEQ ID NO: 223878 - RNA, 59 nt, Human
uccucuuggagaagcuguugcugagaccccccccccaagucaaucagaaccacaacagg

SEQ ID NO: 223879 - RNA, 59 nt, Human
aagacaaaguauauuaauaagcuuuucagcccccccacucccguuccguaguguagaag

SEQ ID NO: 223880 - RNA, 59 nt, Human
cucagcugagucuuuuuggucugcacccacccccccacccccccccccccgcccacaug

SEQ ID NO: 223881 - RNA, 59 nt, Human
gucucagcgggcagugcccagagcccacgcccccccaagagcccucgauggacagccuc

SEQ ID NO: 223882 - RNA, 59 nt, Human
acggacggacgacggacaggcggaugugucccccccagccccuccccuccccauaccaa

SEQ ID NO: 223883 - RNA, 59 nt, Human
cuuuucauuggaaaaacagaaacaacccucccccccauuuuuuccccucuauucaucaa

SEQ ID NO: 223884 - RNA, 59 nt, Human
uuacccaaguguucagcuuauucaccccacccccccaccccccaucacacgugcuccug

SEQ ID NO: 223885 - RNA, 59 nt, Human
ccagcacucccccuucaccccacacccggcccccccaccuaaccacagcgccucuccag

SEQ ID NO: 223886 - RNA, 59 nt, Human
ggccacgcccagcuuccuccccccgacuccccccccagagacacggucccaccauguua

SEQ ID NO: 223887 - RNA, 59 nt, Human
uuuccugucgggaagggagaggggaacuacccccccagccugcccuccgccccgcccca

SEQ ID NO: 223888 - RNA, 59 nt, Human
agacaaaaucucaccuggcaggcccaacccccccccaccccucccccgccguguguggc

SEQ ID NO: 223889 - RNA, 59 nt, Human
aaaaaauacaauaaauauuugaacccccucccccccagcacaacccccccaaaacaacc

SEQ ID NO: 223890 - RNA, 59 nt, Human
auauuugaacccccucccccccagcacaacccccccaaaacaacccaacccacgaggac

SEQ ID NO: 223891 - RNA, 59 nt, Human
cggcuccucuuuucauccccccccuuccccccccccaacaagggggacaugguggaggg

SEQ ID NO: 223892 - RNA, 59 nt, Human
uggggccugagcugagcacugcccccucacccccccaccaccccuucccauuucaucgg

SEQ ID NO: 223893 - RNA, 59 nt, Human
uucuuuccauucauuccaucugggaggaacccccccaacuccugccagcuuccccuagc

SEQ ID NO: 223894 - RNA, 59 nt, Human
guccccgagccccugcagguccccccccgcccccccacucaagaguuagagcagguggc

SEQ ID NO: 223895 - RNA, 59 nt, Human
caauuguccccagggacaaaacacugugucccccccagugcagggaaccgugauaagcc

SEQ ID NO: 223896 - RNA, 59 nt, Human
acccccucggggcagaguuugcacaaagucccccccauaauacagggggagccacuugg

SEQ ID NO: 223897 - RNA, 59 nt, Human
cuccauccuccgaaaaaccccugaggacccccccccauccucuucuaggaugaggggaa

SEQ ID NO: 223898 - RNA, 59 nt, Human
uuugguaacacaccacaggaaguagcucucccccccagcccccuccucccucaagggag

SEQ ID NO: 223899 - RNA, 59 nt, Human
acucccccacccugaccgugcugaacagacccccccacacgagagaaaauaaaggagca

SEQ ID NO: 223900 - RNA, 59 nt, Human
ccgaggggcaccccagccccgccucugcucccccccaccccacccacccucggggcgcc

SEQ ID NO: 223901 - RNA, 59 nt, Human
cuaugacucagggcccaccacaccccacccccccccaacuggcugaaccccuggcaggc

SEQ ID NO: 223902 - RNA, 59 nt, Human
ggugacagaugagguccucuguuuaccuccccccccaaaaaaaaaauucaguaggaauu

SEQ ID NO: 223903 - RNA, 59 nt, Human
aucuacuucugaaguugauagucuucccccccccccacuuuuuucuuuuuugagacagg

SEQ ID NO: 223904 - RNA, 59 nt, Human
acuaggcccugcuucagugcccaccugggcccccccagggaccuggaaacagugcuggg

SEQ ID NO: 223905 - RNA, 59 nt, Human
uauuuaagagguggggucccaggugggaacccccccacaauaaagucugucaauguuug

SEQ ID NO: 223906 - RNA, 59 nt, Human
cucugggguccuugacacacauaaaggugcccccccaccuuccaccucuuagcacuggu

SEQ ID NO: 223907 - RNA, 59 nt, Human
ggaaacugugaagaucucacucugccccccccccccaucuucgggaccaggauuugcac

SEQ ID NO: 223908 - RNA, 59 nt, Human
gauagcauuucagugacaucuucuuuggccccccccauuaggugcugugcccacuucuu

SEQ ID NO: 223909 - RNA, 59 nt, Human
cuucuagggagcacccucccaccccccaccccccccacacacaccaucuuuccauccca

SEQ ID NO: 223910 - RNA, 59 nt, Human
gguuagggggagucccccucccucccuuucccccccaagcacagaggggagaggggcca

SEQ ID NO: 223911 - RNA, 59 nt, Human
uccauggagucuggaaugcaugggagcugcccccccaguggacaccauuggaccccacc

SEQ ID NO: 223912 - RNA, 59 nt, Human
accucaguuuucuaaaggucaaauuaaggcccccccaaaaauacaguauguagcugaau

SEQ ID NO: 223913 - RNA, 59 nt, Human
aaucaugaauauuuucaaggacuuccccccccccccacuucacccccuaccauugaggg

SEQ ID NO: 223914 - RNA, 59 nt, Human
cagccccaggccaucaucugcugcuggggcccccccaccacgcggugccaggcccagug

SEQ ID NO: 223915 - RNA, 59 nt, Human
guaccaaaaugcauccccaugacccacagcccccccacacccguccuuggguaggguac

SEQ ID NO: 223916 - RNA, 59 nt, Human
gccuugcaggcugggcucagggacaaagucccccccaaaacccgcagguccucaugucc

SEQ ID NO: 223917 - RNA, 59 nt, Human
ccggcgggggggugucucccugcccccgacccccccauacccccuucucugugacacac

SEQ ID NO: 223918 - RNA, 59 nt, Human
gggacccccagggaccaccccucagggcgcccccccacccccgcccgguccaccuagac

SEQ ID NO: 223919 - RNA, 59 nt, Human
cagagagagagaaaaaaaaucacccaccacccccccaaaaacacaaaaaaagaaaaucu

SEQ ID NO: 223920 - RNA, 59 nt, Human
ucuccgaggugccgguuaggaguuugaaccccccccacucugcagagggaagcggggac

SEQ ID NO: 223921 - RNA, 59 nt, Human
cauuuccgaggacgacgcagccccucgagcccccccaccggccccggccgccccagcga

SEQ ID NO: 223922 - RNA, 59 nt, Human
gcuucuaacucagagcugaugaacaaaagcccccccacccccaaugccugccuccucac

SEQ ID NO: 223923 - RNA, 59 nt, Human
ccagagagggggcaccuccccacacaccccccccccaccgaggccuaggccccugccac

SEQ ID NO: 223924 - RNA, 59 nt, Human
uggcgucacggugggcuggaggcagcccccccccccacaacacuugaggccaaaggaca

SEQ ID NO: 223925 - RNA, 59 nt, Human
ggggcccauucagucccagggagcagagacccccccaaccccuucacaaaccccaacac

SEQ ID NO: 223926 - RNA, 59 nt, Human
caggccuaggccugggccugggcuggggucccccccacugccagcugcaaggaaccagc

SEQ ID NO: 223927 - RNA, 59 nt, Human
auaaacgaggcaaaagcauuuaauucccacccccccaccccccgcucccuucugcuccu

SEQ ID NO: 223928 - RNA, 59 nt, Human
gauucucuggggggggccucaguaaugggcccccccaaccccuuucucugguacagugc

SEQ ID NO: 223929 - RNA, 59 nt, Human
ucccaucuccuccucuucccucuccuccucccccccaacuccugaccucagcuuggugu

SEQ ID NO: 223930 - RNA, 59 nt, Human
ccccaaagucucccuuccccuagugaccccccccccacuucaccccaugucccagagcc

SEQ ID NO: 223931 - RNA, 59 nt, Human
accucagaggccuaagcaacuggggccaucccccccauuagaggggcccccaaaacuug

SEQ ID NO: 223932 - RNA, 59 nt, Human
uucuggaggagccucccuccccccccacccccccccacugcuccuggaguucucaucgg

SEQ ID NO: 223933 - RNA, 59 nt, Human
ccuuagaaucuucuggaggagccucccuccccccccacccccccccacugcuccuggag

SEQ ID NO: 223934 - RNA, 59 nt, Human
gacagaggaagaugggagggugcucaucacccccccagcauaaugaucagccuccuucc

SEQ ID NO: 223935 - RNA, 59 nt, Human
caguggacuggccccuuaauucccacaggcccccccagcaaggccaaagggaggccccu

SEQ ID NO: 223936 - RNA, 59 nt, Human
cagugaugaggucuugccgccuuaacugucccccccagucacuucucccacaggcccag

SEQ ID NO: 223937 - RNA, 59 nt, Human
uguuucauuuguaaaaggaaauacagaaacccccccaagaaugugugagggucuugagg

SEQ ID NO: 223938 - RNA, 59 nt, Human
gccagucaucugugaagcuagggcgccuacccccccacccggaggaccccugcggcccc

SEQ ID NO: 223939 - RNA, 59 nt, Human
cucaggggaccccacuccccucacacacacccccccacaaggaacccucaggccacccu

SEQ ID NO: 223940 - RNA, 59 nt, Human
acccaaagaguccccacuuaacaauaccccccccccacggcaagaaugcccaaauccga

SEQ ID NO: 223941 - RNA, 59 nt, Human
uuuauccuaauaucgguagcauauaaugccccccccaaaauaucuguuuuccaugcaaa

SEQ ID NO: 223942 - RNA, 59 nt, Human
cuucuaauagcccugguacaugguacacacccccccaccuccugcaauuaaacaguagc

SEQ ID NO: 223943 - RNA, 59 nt, Human
cugggagcuggcuucugucccuuucuucccccccccacgagucuugcccuugacuucug

SEQ ID NO: 223944 - RNA, 59 nt, Human
agacaaagggguagagggucugucuugggcccccccagacucuagccugagcagugcag

SEQ ID NO: 223945 - RNA, 59 nt, Human
accaguauggccccaccugcucuuuccuccccccccaagguguggccccaccuguucuu

SEQ ID NO: 223946 - RNA, 59 nt, Human
gugccaggacugggagggaaaguccagggcccccccacccuccccaccacccuccgcca

SEQ ID NO: 223947 - RNA, 59 nt, Human
augaggguguuuuuuuuuuuucuuuuugucccccccaucccccuuuuuuuuuguuuugu

SEQ ID NO: 223948 - RNA, 59 nt, Human
ggagggaggacccucggggcuaccgcgcgcccccccaucccacagaucaggagccaagg

SEQ ID NO: 223949 - RNA, 59 nt, Human
uucauccuauauacaucaggcuguaagaccccccccagucaucauuaauacaauguguu

SEQ ID NO: 223950 - RNA, 59 nt, Human
agauaucuuuuuagaugauaaaauguacacccccccaucaccaaccucacaacuuagaa

SEQ ID NO: 223951 - RNA, 59 nt, Human
acucuuguggucucugugcgccccccccccccccccacccgucugccaagcauggguau

SEQ ID NO: 223952 - RNA, 59 nt, Human
cccccugccccaggccccgggaucagcugcccccccauccccgcucccgccgcuacucc

SEQ ID NO: 223953 - RNA, 59 nt, Human
caccgcugcccugucuguugcgacacccucccccccacauacacacgcagcguuuugau

SEQ ID NO: 223954 - RNA, 59 nt, Human
cuuuuccucguccacccugggcuuggggacccccccaccggacucuccacucuccggca

SEQ ID NO: 223955 - RNA, 59 nt, Human
aaauagaaaaaucgcgcacuugcgcgucccccccccacccccuuuuuuaaacaaguguu

SEQ ID NO: 223956 - RNA, 59 nt, Human
cgguccccauccugggcccccacucuagacccccccaccaccugguuaagucucgagug

SEQ ID NO: 223957 - RNA, 59 nt, Human
gcaccucucagccucugccgccgggcacccccccccaggcuccuggugccagaugauga

SEQ ID NO: 223958 - RNA, 59 nt, Human
ccaagccugacuuuggggacacccuccugcccccccaccccacuccccccauccuaccu

SEQ ID NO: 223959 - RNA, 59 nt, Human
ugagugggaguggggggccuugcuccacccccccccauccccuacugugacuugcuuua

SEQ ID NO: 223960 - RNA, 51 nt, Human
ccgggacuccuggggccugagcccccccagugggcaggagcccaugcagac

SEQ ID NO: 223961 - RNA, 59 nt, Human
gagaagaaacagcagcuccacuaccgacccccccccagguuugauguccuuccaagaau

SEQ ID NO: 223962 - RNA, 59 nt, Human
ucuucuuaacuuuacuucucuuuuugucccccccccaucuuacagaaguugaggccaag

SEQ ID NO: 223963 - RNA, 59 nt, Human
cagaccacugcaucucacugggccagcagcccccccagcccccagccuugguggggacc

SEQ ID NO: 223964 - RNA, 59 nt, Human
ggcagugggaucucgauggagccuccccccccccccacccaugccucccucuuccuccu

SEQ ID NO: 223965 - RNA, 59 nt, Human
ggcccuuccugucuuggccggccccacugcccccccauucuaugccccaaccaccaagg

SEQ ID NO: 223966 - RNA, 59 nt, Human
acaucacauuuuggugucucucaggcuuucccccccaacuaugguuucuuugcuuuuug

SEQ ID NO: 223967 - RNA, 59 nt, Human
ccugggcaaacagagggagacuccaucgccccccccaacaaaaaaaaaaguuucccaua

SEQ ID NO: 223968 - RNA, 59 nt, Human
caggggagaccaugguggccccggccgcacccccccacccuggugccaccacugcaacu

SEQ ID NO: 223969 - RNA, 59 nt, Human
ccuugggcuucuccugagguaaugauuuacccccccacccacagcugagucugugaggc

SEQ ID NO: 223970 - RNA, 59 nt, Human
uauuaggucaguuuagcaagaacaccuaacccccccauaucuguucaaccucaguaucu

SEQ ID NO: 223971 - RNA, 50 nt, Human
guccggucacuguguugugacccccccaugguucaagugacaguggguga

SEQ ID NO: 223972 - RNA, 59 nt, Human
gcacagcgaagacugcuaaaugcacugaccccccccauuagaaugugauuuuuguuccu

SEQ ID NO: 223973 - RNA, 59 nt, Human
ggcuuugccucagggccuuuagccuaugucccccccacauaaagagagcuucucagagc

SEQ ID NO: 223974 - RNA, 59 nt, Human
gugauguggcaugcguuuuuuuuuaacugcccccccagcccugacauguucuuuuuuug

SEQ ID NO: 223975 - RNA, 59 nt, Human
ggggcgggggaaaugggggaaugacacaucccccccaaccuacccccaccccaaaagca

SEQ ID NO: 223976 - RNA, 59 nt, Human
ugucccagugagguuaccacuuaaaucuucccccccaccccccacccuuuugcugauug

SEQ ID NO: 223977 - RNA, 59 nt, Human
aauggaaaaucagcucaaaugagaucaggcccccccaggguccacccacagagcacuac

SEQ ID NO: 223978 - RNA, 59 nt, Human
cugggcauccuggaucccugaauuauccccccccccaugaaguacuucaagggccaagc

SEQ ID NO: 223979 - RNA, 59 nt, Human
uguaguggccuuuggagaugcccccaccucccccccaccaacucucgcguguuggagag

SEQ ID NO: 223980 - RNA, 59 nt, Human
cagccugggcaacauagugagacgccccccccccccaucucuacaaaaaauuuaaaaaa

SEQ ID NO: 223981 - RNA, 59 nt, Human
agaggggcaggcuugggcaccccuucugccccccccacugagaacuaugcaauggaguu

SEQ ID NO: 223982 - RNA, 59 nt, Human
cacgccucugggcccccuggcacagccaacccccccagugcaaaccccaaggccaagcc

SEQ ID NO: 223983 - RNA, 59 nt, Human
cuccuaaccuugugauccgcccuccuuagcccccccaaaaaauuacaauaauuuuguca

SEQ ID NO: 223984 - RNA, 59 nt, Human
cugaucccuuccaccugcucugcugaugacccccccagcuucacuucugacucuucccc

SEQ ID NO: 223985 - RNA, 59 nt, Human
cugugcccugcugccugagcgucccccuacccccccagggccugcugccuuuugggacu

SEQ ID NO: 223986 - RNA, 59 nt, Human
agguuccauaugauaauucuuuacaccuccccccccaagagaaaguacacagggcuauu

SEQ ID NO: 223987 - RNA, 62 nt, Human
ucucccaacgcugaagcggucagacuggaggucgaagcaaucagcaaacacaauaagagucu

SEQ ID NO: 223988 - RNA, 62 nt, Human
uaucuaacuucgaauauaucuguaaagauaaucgaagcaaaaguaaucacuuaaaggcacaa

SEQ ID NO: 223989 - RNA, 62 nt, Human
uuuaaauucacauguuuguaugaguacuuuugcgaagcaaggcaugaacugcuagguauuau

SEQ ID NO: 223990 - RNA, 62 nt, Human
aaggugugaaggaaagaagacaccgaccacggcgaagcaauagagggggugcuggagcgcga

SEQ ID NO: 223991 - RNA, 62 nt, Human
cccggcugugccccucacuaucagagacugggcgaagcaaaccugucggagucaauuauuuc

SEQ ID NO: 223992 - RNA, 62 nt, Human
guucagaauuuaggcaacacucaauuuaccugcgaagcaauacacccagacacaccagucuu

SEQ ID NO: 223993 - RNA, 62 nt, Human
guggcccugcugugaucauaccuugagcacgacgaagcaaccuuguuucugaggaagcuuga

SEQ ID NO: 223994 - RNA, 62 nt, Human
cacacaaugcuuuuuuugguuaaauguugauacgaagcaauguuuuggaauuacuuuaauug

SEQ ID NO: 223995 - RNA, 62 nt, Human
aaaugaguuucaaauuuaagauguuuauugaucgaagcaauugaaguaucauggauuggauu

SEQ ID NO: 223996 - RNA, 62 nt, Human
gcaguuguaaaacagguggauaccaacuaccucgaagcaaauuggugaaagaaaaggcaaag

SEQ ID NO: 223997 - RNA, 62 nt, Human
uuguguguccuuuauaggugaaaagcucuuaccgaagcaacaaaauucagcagacaccucuu

SEQ ID NO: 223998 - RNA, 62 nt, Human
ucauuucucaugggcaacagaggccaaagaaacgaagcaagacaaacagcaaacaggcauuu

SEQ ID NO: 223999 - RNA, 62 nt, Human
agaaaggcauugcacagagugaacuuaauggacgaagcaacaaauaugucaagaacaggaca

SEQ ID NO: 224000 - RNA, 62 nt, Human
acaaaaauaguaaaggucuugaagaaugccagcgaagcaauucuuuuuuauuugaggacacu

SEQ ID NO: 224001 - RNA, 62 nt, Human
gugagguagggaagugaggaggaaagccaugccgaagcaaauguuagaaucuuaggcauccu

SEQ ID NO: 224002 - RNA, 62 nt, Human
aagguguauaguaaccuauuuaucacauuuuacgaagcaauuuuaaucuuaaacacauccag

SEQ ID NO: 224003 - RNA, 62 nt, Human
ggcaaaaagccagagauucugcaacacgaauucgaagcaaacaaacacaacacaacagaauu

SEQ ID NO: 224004 - RNA, 62 nt, Human
gcuuggccuccugggggcaaagccccucugcccgaagcaauaacaacagcagcagaagcaau

SEQ ID NO: 224005 - RNA, 62 nt, Human
gaagggaaauaauguaucaccucuuuccagaacgaagcaaaguugcuggcuuaguagagccc

SEQ ID NO: 224006 - RNA, 62 nt, Human
guaaaaauuaauuucagcuucauuucguauuucgaagcaaucuagacuguugugaugagugu

SEQ ID NO: 224007 - RNA, 62 nt, Human
guuagcauguaugaauguaaggaugagggaagcgaagcaagaggaaccucucgccaugauca

SEQ ID NO: 224008 - RNA, 62 nt, Human
ucaguacugguguagugugucagcucuguuuacgaagcaauacuguccaguuuucuugcugu

SEQ ID NO: 224009 - RNA, 62 nt, Human
gacucggcuccuggcagccgccucuucccucucgaagcaauaaacccaggcuggccggccgg

SEQ ID NO: 224010 - RNA, 62 nt, Human
acaguuguuccuguugugugguuuauagauuucgaagcaacaugucacaacaauaaccucca

SEQ ID NO: 224011 - RNA, 62 nt, Human
ugccuccauugaugucucuagaccugcagauacgaagcaaaccugggauugcuucuuccagg

SEQ ID NO: 224012 - RNA, 62 nt, Human
agguguccucagcaugcccuauggccuaugugcgaagcaagaagaauugacugauuuacagg

SEQ ID NO: 224013 - RNA, 62 nt, Human
ugaugaguucagaaagaucaagccaaagaaugcgaagcaaccagagcgugaagaaaagcggg

SEQ ID NO: 224014 - RNA, 62 nt, Human
gcaucaucagaugacaaggacaacccucaugacgaagcaacaugaauuagggggccucuugg

SEQ ID NO: 224015 - RNA, 62 nt, Human
guccgucuuuaaacagaaagucaaaggagccacgaagcaagcggccguccgggcguccgccu

SEQ ID NO: 224016 - RNA, 62 nt, Human
ucuaugccguaugauuucaguagaacagggagcgaagcaaaaccacccggcccacaagagac

SEQ ID NO: 224017 - RNA, 62 nt, Human
cagucuccuccguggcuagugugucuaguucacgaagcaauuaacugggucuuacuaucauu

SEQ ID NO: 224018 - RNA, 62 nt, Human
aggcucaaaauaaaaggauggaggaagaucuacgaagcaaauggaaaacaaacaaaaaaaga

SEQ ID NO: 224019 - RNA, 62 nt, Human
ucuuucugucuguggguucuguauucauggaucgaagcaaccauggaucaaaaguauuugga

SEQ ID NO: 224020 - RNA, 62 nt, Human
gcuccccuguucaaaguggccacagcgcagaccgaagcaaaauucuuguauacauuggcgcc

SEQ ID NO: 224021 - RNA, 62 nt, Human
caccagggccccaggcucguuuuccuuuauagcgaagcaaaaaacacaagacccuccgcccg

SEQ ID NO: 224022 - RNA, 62 nt, Human
ucagguuucucuaauuuccuccacucccaguucgaagcaaacagcuuacugccuaguccccg

SEQ ID NO: 224023 - RNA, 62 nt, Human
gauguuucgaguaaacuugaaaaggguaggcacgaagcaauuuguugcugcuugucaccccc

SEQ ID NO: 224024 - RNA, 62 nt, Human
aggucaugaagguggagauaagcugcaaggggcgaagcaacuuuaugucaguggaaaacgug

SEQ ID NO: 224025 - RNA, 62 nt, Human
cugcacagccuuuauaaagagagagagagcuccgaagcaauaacaacaccugggggugguca

SEQ ID NO: 224026 - RNA, 62 nt, Human
uaguccuacaaagagaaaaauauacaugucaccgaagcaaguguacccuuuauaggaacccu

SEQ ID NO: 224027 - RNA, 62 nt, Human
agcaucagcgaauaguauagugucucaggguccgaagcaaguuuaaaugccaccuaggagga

SEQ ID NO: 224028 - RNA, 60 nt, Human
cccaaaauuuaaggggacaaguagcuccccccacgacaugucucccuuucuuagaauaua

SEQ ID NO: 224029 - RNA, 60 nt, Human
ucccccagccccugccaccccagagggcggccacgacagggagagguguagaugccacca

SEQ ID NO: 224030 - RNA, 60 nt, Human
ugcuggacuacaugcuggccacugcugugaccacgacacugcuggggcagcuucuuccac

SEQ ID NO: 224031 - RNA, 60 nt, Human
caugccacguguccccagagcuuuacagugccacgacauggcugggcuacgugaauagcg

SEQ ID NO: 224032 - RNA, 60 nt, Human
aguguuauugguagugucuagccuuuuccuccacgacauuccuugacuuaauccauuugg

SEQ ID NO: 224033 - RNA, 60 nt, Human
gcagagugaacagugaguucccccgacagcccacgacagccaggacugcccuccccaccc

SEQ ID NO: 224034 - RNA, 60 nt, Human
gugauucaauuaccucccacuuggucccacccacgacacgugggaauugugggagcuaca

SEQ ID NO: 224035 - RNA, 60 nt, Human
agugugguuuugggagagaagugcaaaaucccacgacaggugaguugaaggaaugggaua

SEQ ID NO: 224036 - RNA, 60 nt, Human
gugucccguucacggaagcgcaggcagcucccacgacacacggagagacugacugauacg

SEQ ID NO: 224037 - RNA, 60 nt, Human
cugucucacccucuccuguuguauccagcuccacgacaaacuucugccuuccccaacacc

SEQ ID NO: 224038 - RNA, 60 nt, Human
caccagggagugccuauacauccuguccagccacgacauugagcagcacgcccccuaucg

SEQ ID NO: 224039 - RNA, 60 nt, Human
uaaauuuaaaauguugcaacugggaauauaccacgacaugagaccagguuauagcacaaa

SEQ ID NO: 224040 - RNA, 60 nt, Human
gguggagcgcgccagccucagccagagcagccacgacagccacagugugugcacucgaug

SEQ ID NO: 224041 - RNA, 60 nt, Human
ccucacauuccaguccuuugagauugagcgccacgacagcugugccuacgacuaucugga

SEQ ID NO: 224042 - RNA, 60 nt, Human
gauuugauaaaaaguaugauuauaagauauccacgacaaucucauaguuucuugugccaa

SEQ ID NO: 224043 - RNA, 60 nt, Human
cccuggagacgacacacggcagcccacaggccacgacagacgcuggaugcccuccuaccg

SEQ ID NO: 224044 - RNA, 60 nt, Human
gggcgcugagggccacucacacagcugcuaccacgacacacgcucgggcuucugguaugu

SEQ ID NO: 224045 - RNA, 60 nt, Human
cggcuaugaucaugacaaccacgguccccaccacgacacaaucacguucacaaccacaac

SEQ ID NO: 224046 - RNA, 60 nt, Human
gagauggugccaaagugcagcugacucuucccacgacagcccugcccuucccaugaggca

SEQ ID NO: 224047 - RNA, 60 nt, Human
ccccuaaccuggguuguugcagaguaaaucccacgacauaagcugguaucagugguucgg

SEQ ID NO: 224048 - RNA, 60 nt, Human
uaccaauaagaaauuaaggaaagaaacaaaccacgacacccaaaugccguaaucuuaaag

SEQ ID NO: 224049 - RNA, 60 nt, Human
gccacauaugucugugccaugggcugagugccacgacaggcccgugugacagcugcugcc

SEQ ID NO: 224050 - RNA, 60 nt, Human
ccagcauguucaccacuggucguucagcagccacgacagcaccaugugagauggcgaggu

SEQ ID NO: 224051 - RNA, 60 nt, Human
uguguuuccuggcgcaggagauggacagggccacgacagggcucugagaggcucaucccu

SEQ ID NO: 224052 - RNA, 60 nt, Human
acuccuuguggccucaagaaauuuagacgcccacgacagcacuacacagcaucuccaggu

SEQ ID NO: 224053 - RNA, 57 nt, Human
aagcccuggauggccucugagaggagcccacgacacugcagccccacccagaugccc

SEQ ID NO: 224054 - RNA, 60 nt, Human
auggggcuagagacugccaugcaaccaccaccacgacagcccuuccuccaucagaagaca

SEQ ID NO: 224055 - RNA, 60 nt, Human
aaacacguuaaauguccuucagccucccuaccacgacauccaacagcuggaacuuccauc

SEQ ID NO: 224056 - RNA, 60 nt, Human
aguaguggccugauuuuuuuccauguauugccacgacaaacuaaaaaugaacuguguuua

SEQ ID NO: 224057 - RNA, 60 nt, Human
uuucgaauaccgaaaagucaacccuguggaccacgacagggcagaaggaguuucuccgga

SEQ ID NO: 224058 - RNA, 60 nt, Human
ugcccuaccugcauccugcugcacccccacccacgacacucgagugcaagaucgccucac

SEQ ID NO: 224059 - RNA, 60 nt, Human
ugaacaagaagaggcuggggaggguuuuccccacgacagccccacggcacagcagaucau

SEQ ID NO: 224060 - RNA, 60 nt, Human
cuggauuggacuaaaagcacugaucagaggccacgacauaaaaauucagucccuuugucc

SEQ ID NO: 224061 - RNA, 60 nt, Human
caccuucugccaccaccugcaccugccuacccacgacaaggagacagaggagcugguagc

SEQ ID NO: 224062 - RNA, 60 nt, Human
gaaguguuauauaccaaaaugccaacauuuccacgacagacuuaacuguauaauuucguu

SEQ ID NO: 224063 - RNA, 60 nt, Human
cucucgagcagcuggaauuacaggcacgugccacgacacccagcuaauuuuuguauuuuu

SEQ ID NO: 224064 - RNA, 60 nt, Human
aggcagcucccugaccauuuggacacauugccacgacaggagccuccaaguaugugggag

SEQ ID NO: 224065 - RNA, 60 nt, Human
ggacucuuggccucacuccuugcccccuccccacgacacccaugagccgaaaggauguca

SEQ ID NO: 224066 - RNA, 60 nt, Human
ucacuggguucggaggagagucaggaagggccacgacaaagcagaaacaucggauuuggg

SEQ ID NO: 224067 - RNA, 60 nt, Human
uguaaucuuuuucuccacccaaaccccuucccacgacaaaaacaagacugccucccucuc

SEQ ID NO: 224068 - RNA, 60 nt, Human
uaaaggaaagguacuggcuugaagucacaaccacgacaggaguaaggauuuggaauaagg

SEQ ID NO: 224069 - RNA, 60 nt, Human
ugaggaguccuugcagaccugcugccucccccacgacaggcccaaagauggacccccccu

SEQ ID NO: 224070 - RNA, 60 nt, Human
agcaaagggaggaggugcacagcacacguuccacgacagaugaggcgacggcuuccaucu

SEQ ID NO: 224071 - RNA, 60 nt, Human
ucuugucugagccaggccaccaaagccaugccacgacaaggacaagaugagcagcaaaca

SEQ ID NO: 224072 - RNA, 60 nt, Human
gccucucccugcccauccucaccacugaggccacgacaaagcacagcuccagcucggaca

SEQ ID NO: 224073 - RNA, 60 nt, Human
gggacacguguccacgcaccacagacacacccacgacaccugaucucguaucacuagcuu

SEQ ID NO: 224074 - RNA, 60 nt, Human
ugcccagcgcccagcgugcacgggacggccccacgacagagggagucagcccgggagguc

SEQ ID NO: 224075 - RNA, 60 nt, Human
agacugcauuauuuuacuacuguaauuucuccacgacauagcauuauguacauagaugag

SEQ ID NO: 224076 - RNA, 60 nt, Human
agccagcaggggaggugagccauacacaggccacgacaaaaugcaggcauuuuauuaggg

SEQ ID NO: 224077 - RNA, 60 nt, Human
cauuuagaucagguacccagugucugucucccacgacaggccaagggaugugauaguguu

SEQ ID NO: 224078 - RNA, 60 nt, Human
gaguagaggacauggcugucuucuaaaaagccacgacaugaaaaugacaaucccuuucgu

SEQ ID NO: 224079 - RNA, 60 nt, Human; identical to SEQ ID NO: 224028

SEQ ID NO: 224080 - RNA, 60 nt, Human; identical to SEQ ID NO: 224029

SEQ ID NO: 224081 - RNA, 60 nt, Human; identical to SEQ ID NO: 224030

SEQ ID NO: 224082 - RNA, 60 nt, Human; identical to SEQ ID NO: 224031

SEQ ID NO: 224083 - RNA, 60 nt, Human; identical to SEQ ID NO: 224032

SEQ ID NO: 224084 - RNA, 60 nt, Human; identical to SEQ ID NO: 224033

SEQ ID NO: 224085 - RNA, 60 nt, Human; identical to SEQ ID NO: 224034

SEQ ID NO: 224086 - RNA, 60 nt, Human; identical to SEQ ID NO: 224035

SEQ ID NO: 224087 - RNA, 60 nt, Human; identical to SEQ ID NO: 224036

SEQ ID NO: 224088 - RNA, 60 nt, Human; identical to SEQ ID NO: 224037

SEQ ID NO: 224089 - RNA, 60 nt, Human; identical to SEQ ID NO: 224038

SEQ ID NO: 224090 - RNA, 60 nt, Human; identical to SEQ ID NO: 224039

SEQ ID NO: 224091 - RNA, 60 nt, Human; identical to SEQ ID NO: 224040

SEQ ID NO: 224092 - RNA, 60 nt, Human; identical to SEQ ID NO: 224041

SEQ ID NO: 224093 - RNA, 60 nt, Human; identical to SEQ ID NO: 224042

SEQ ID NO: 224094 - RNA, 60 nt, Human; identical to SEQ ID NO: 224043

SEQ ID NO: 224095 - RNA, 60 nt, Human; identical to SEQ ID NO: 224044

SEQ ID NO: 224096 - RNA, 60 nt, Human; identical to SEQ ID NO: 224045

SEQ ID NO: 224097 - RNA, 60 nt, Human; identical to SEQ ID NO: 224046

SEQ ID NO: 224098 - RNA, 60 nt, Human; identical to SEQ ID NO: 224047

SEQ ID NO: 224099 - RNA, 60 nt, Human; identical to SEQ ID NO: 224048

SEQ ID NO: 224100 - RNA, 60 nt, Human; identical to SEQ ID NO: 224049

SEQ ID NO: 224101 - RNA, 60 nt, Human; identical to SEQ ID NO: 224050

SEQ ID NO: 224102 - RNA, 60 nt, Human; identical to SEQ ID NO: 224051

SEQ ID NO: 224103 - RNA, 60 nt, Human; identical to SEQ ID NO: 224052

SEQ ID NO: 224104 - RNA, 57 nt, Human; identical to SEQ ID NO: 224053

SEQ ID NO: 224105 - RNA, 60 nt, Human; identical to SEQ ID NO: 224054

SEQ ID NO: 224106 - RNA, 60 nt, Human; identical to SEQ ID NO: 224055

SEQ ID NO: 224107 - RNA, 60 nt, Human; identical to SEQ ID NO: 224056

SEQ ID NO: 224108 - RNA, 60 nt, Human; identical to SEQ ID NO: 224057

SEQ ID NO: 224109 - RNA, 60 nt, Human; identical to SEQ ID NO: 224058

SEQ ID NO: 224110 - RNA, 60 nt, Human; identical to SEQ ID NO: 224059

SEQ ID NO: 224111 - RNA, 60 nt, Human; identical to SEQ ID NO: 224060

SEQ ID NO: 224112 - RNA, 60 nt, Human; identical to SEQ ID NO: 224061

SEQ ID NO: 224113 - RNA, 60 nt, Human; identical to SEQ ID NO: 224062

SEQ ID NO: 224114 - RNA, 60 nt, Human; identical to SEQ ID NO: 224063

SEQ ID NO: 224115 - RNA, 60 nt, Human; identical to SEQ ID NO: 224064

SEQ ID NO: 224116 - RNA, 60 nt, Human; identical to SEQ ID NO: 224065

SEQ ID NO: 224117 - RNA, 60 nt, Human; identical to SEQ ID NO: 224066

SEQ ID NO: 224118 - RNA, 60 nt, Human; identical to SEQ ID NO: 224067

SEQ ID NO: 224119 - RNA, 60 nt, Human; identical to SEQ ID NO: 224068

SEQ ID NO: 224120 - RNA, 60 nt, Human; identical to SEQ ID NO: 224069

SEQ ID NO: 224121 - RNA, 60 nt, Human; identical to SEQ ID NO: 224070

SEQ ID NO: 224122 - RNA, 60 nt, Human; identical to SEQ ID NO: 224071

SEQ ID NO: 224123 - RNA, 60 nt, Human; identical to SEQ ID NO: 224072

SEQ ID NO: 224124 - RNA, 60 nt, Human; identical to SEQ ID NO: 224073

SEQ ID NO: 224125 - RNA, 60 nt, Human; identical to SEQ ID NO: 224074

SEQ ID NO: 224126 - RNA, 60 nt, Human; identical to SEQ ID NO: 224075

SEQ ID NO: 224127 - RNA, 60 nt, Human; identical to SEQ ID NO: 224076

SEQ ID NO: 224128 - RNA, 60 nt, Human; identical to SEQ ID NO: 224077

SEQ ID NO: 224129 - RNA, 60 nt, Human; identical to SEQ ID NO: 224078

SEQ ID NO: 224130 - RNA, 64 nt, Human
aaaaaauccuucuaaucugcuaugcuugaaugccacgcgguacaaaggaaaaaguaucauggaa

SEQ ID NO: 224131 - RNA, 63 nt, Human
agagcgaaacuaccgucuaagguggggcgggcgacgcgguagacgggcuggccacgcggcucg

SEQ ID NO: 224132 - RNA, 64 nt, Human
aaacucccaggguugggcugggaguauuuggugcacgcgguauggggagggcugagcucagugc

SEQ ID NO: 224133 - RNA, 64 nt, Human
ugacacuuuuauaucuucuuuauucgucguuaaaacgcgguaggaaauuacccugaaaugucgc

SEQ ID NO: 224134 - RNA, 59 nt, Human
gggcggcauacgccaugugagcacaggacucaggccacccucgcuuguccuggcgcccg

SEQ ID NO: 224135 - RNA, 62 nt, Human
uugaauaaugcacuuuaaaacaaggaaccguaucaggccagcaugguggcucaugccuguaa

SEQ ID NO: 224136 - RNA, 62 nt, Human
ccucuuaguuggugugugaggucuuggugggcucaggccagcuguuugcgagugugggaacu

SEQ ID NO: 224137 - RNA, 62 nt, Human
gaaauggagucugcuccugagaagcuucaaauucaggccaggagagaagucuuaagaaaaga

SEQ ID NO: 224138 - RNA, 62 nt, Human
gcuuuuagcagcccacaggugauccuaacauaucaggccauggacucaggaccugcccggug

SEQ ID NO: 224139 - RNA, 62 nt, Human
gucugugugcccuccugggagucagucagcgcucaggccaggacugugcagggccagccagc

SEQ ID NO: 224140 - RNA, 62 nt, Human
aaguuagcucaggaggcuuggaaagcaucaccucaggccaggugcaguggcucacgccuaug

SEQ ID NO: 224141 - RNA, 62 nt, Human
aucugccaauuuuuuaaaaaaguaaguaccacucaggccaacaagccaacgacaaagccaaa

SEQ ID NO: 224142 - RNA, 62 nt, Human
gugaggagacaagacuuggagacucagcgaugucaggccagggccauggccacacuggccca

SEQ ID NO: 224143 - RNA, 62 nt, Human
ccccacaaugucugaagcugccccugggauucucaggccaaccugccaacagcaagcggauu

SEQ ID NO: 224144 - RNA, 62 nt, Human
acaaaggcucaggacggcuggcucugggggacucaggccaagccccuuggcaccauccuggc

SEQ ID NO: 224145 - RNA, 62 nt, Human
cuuugcucacagcuccauccaugucuagaccuucaggccagucugcagaugagguucccuac

SEQ ID NO: 224146 - RNA, 62 nt, Human
gggccuggaaggacugaaaggugggauuagagucaggccagaaagagaacauucauccagag

SEQ ID NO: 224147 - RNA, 62 nt, Human
auuaucagaaaaugaagcaacacuugagcuguucaggccaguucccuguugaagaaacaguu

SEQ ID NO: 224148 - RNA, 62 nt, Human
gcuguucccuguagccacugcccagcaccuccucaggccagccuggugccacagucacgugg

SEQ ID NO: 224149 - RNA, 62 nt, Human
aaggugguccagaagcuucgggcaccacgcacucaggccauggaggagcagcuggucagcac

SEQ ID NO: 224150 - RNA, 62 nt, Human
aucuuucuacaguauuuccuacagcuaaagccucaggccauugccuaauuaacaaugaagau

SEQ ID NO: 224151 - RNA, 62 nt, Human
acugggguaccuaggagucaggacuuuugacuucaggccagucauuuccucccgauggggaa

SEQ ID NO: 224152 - RNA, 62 nt, Human
uauuagccccccguccugcacgccguggagcaucaggccacacacucugcauccgacaccca

SEQ ID NO: 224153 - RNA, 62 nt, Human
cagcuugcaccauccccaccugccaccuacagucaggccacaugccuggucacugaaucaug

SEQ ID NO: 224154 - RNA, 62 nt, Human
auauauuuguucacuugagucuuaagaguaggucaggccaaggcagguggaucaccugaggu

SEQ ID NO: 224155 - RNA, 62 nt, Human
gcuaguuugggugaaguucacuccagcaagucucaggccacaauggggugguuugguuuggu

SEQ ID NO: 224156 - RNA, 62 nt, Human
gggcugacuuuggugacacugcccauucccucucaggccagcucaggucacccgggccucug

SEQ ID NO: 224157 - RNA, 62 nt, Human
ugaagcuagaggcuacagccacuaaacuugcuucaggccaacgauaguuacucacaaguaag

SEQ ID NO: 224158 - RNA, 62 nt, Human
gauucagggcugaaucugcccaguucccacacucaggccagcccucuugggaaggugggucc

SEQ ID NO: 224159 - RNA, 62 nt, Human
caaagcugacaugaaccuuuugucgugggacuucaggccacauuggcuugaaggcauucguu

SEQ ID NO: 224160 - RNA, 62 nt, Human
uggacuccagcccaccguggccacuggagaccucaggccaguuguuuacccuccagccucca

SEQ ID NO: 224161 - RNA, 62 nt, Human
auagccaaggccaaaggaagcacaugccucucucaggccaaacucaccugccccucaacucu

SEQ ID NO: 224162 - RNA, 62 nt, Human
cugcccuuaccugccaggaagccagcaggcucucaggccagcugcuugggcuucauccuccu

SEQ ID NO: 224163 - RNA, 62 nt, Human
uuugccacccccugugagcagggauuagguguucaggccaguaucuugggcaugggggagcc

SEQ ID NO: 224164 - RNA, 62 nt, Human
uguggggaguucacugugaccuaguccccccaucaggccacacugcugccaccucucacacg

SEQ ID NO: 224165 - RNA, 62 nt, Human
ucuguauccugggacagucagauucuucuaaaucaggccaggaaggaggggaaaagagugag

SEQ ID NO: 224166 - RNA, 62 nt, Human
caugugguucaaauaauauuuuccaauccacuucaggccaaaacaugcuaaagauaacacac

SEQ ID NO: 224167 - RNA, 62 nt, Human
aaucuagacacuaugcuggguucccugagucgucaggccagacauuucaacaaggcuguggg

SEQ ID NO: 224168 - RNA, 62 nt, Human
ugugagucacugcuaagagacagagcacauuuucaggccagcaacuauccuugccagaguuu

SEQ ID NO: 224169 - RNA, 62 nt, Human
gcacaggaagacucuuuaacacccuuaggaccucaggccaucuucuccuaugaagaugaaaa

SEQ ID NO: 224170 - RNA, 62 nt, Human
gauaccuaggcugcauuuagaucaccgugugcucaggccaggugugaauccugagguccaug

SEQ ID NO: 224171 - RNA, 62 nt, Human
ggauuggggugggguggguuggugaaucuaucucaggccacugcacugcaaggugcauuucu

SEQ ID NO: 224172 - RNA, 62 nt, Human
augaucugaagauuguguuacaaaaaauauuaucaggccaaaauuuguucggaauacacuaa

SEQ ID NO: 224173 - RNA, 62 nt, Human
uaauacucccaaacaucccacuuuuuacuguuucaggccaucauaucauucuuaagcuacuu

SEQ ID NO: 224174 - RNA, 62 nt, Human
guaaaauuaugaaauugaaguucugcagcaugucaggccaggauuauuagggagauuccucg

SEQ ID NO: 224175 - RNA, 62 nt, Human
ccacacacagcugggcugugguagggggugucucaggccacaccggccuugcauugccugcc

SEQ ID NO: 224176 - RNA, 62 nt, Human
uuuuuucauuuuuccaggacaguuggauauugucaggccacuugugaccccagccauguagu

SEQ ID NO: 224177 - RNA, 62 nt, Human
cccucauuccaccuucccaugcccuggauccaucaggccacuugaugacccccaaccaagug

SEQ ID NO: 224178 - RNA, 62 nt, Human
ggggccauuuggcauaccuuucacagcuuuuaucaggccaaguuaaaggcugacuacauuuu

SEQ ID NO: 224179 - RNA, 62 nt, Human
uggacaagcaugugcagucacgggagcucagcucaggccagggcugggcugugcaccugccu

SEQ ID NO: 224180 - RNA, 62 nt, Human
uaucucuucuuucucuaggagguauaaauauuucaggccaagguucaauuauuucagcgcag

SEQ ID NO: 224181 - RNA, 62 nt, Human
ucucggcucaccgcaagcuccgccucccggguucaggccauucuccugccucagccucccga

SEQ ID NO: 224182 - RNA, 62 nt, Human
auguguaaugggcuaacguuuauuuaaaaaguucaggccaggugcaguggcuuaugccuaua

SEQ ID NO: 224183 - RNA, 62 nt, Human
guggcugccugcaccccaggaaaggagggggcucaggccauccagccaccaccuacagccca

SEQ ID NO: 224184 - RNA, 62 nt, Human
aaauagaacauuagccacgagccauaggcauuucaggccaaauccaugaaagggggaccagu

SEQ ID NO: 224185 - RNA, 62 nt, Human
ucacugagcuaaucuggaacaaaccucucaccucaggccagaaggggaugaccuccauuugc

SEQ ID NO: 224186 - RNA, 62 nt, Human
aaggcuacauuugugggaguguugucauauucucaggccaacuguuuugaaauucgguaucu

SEQ ID NO: 224187 - RNA, 62 nt, Human
gauuauucuucagacagugagcagucaaguguucaggccacacagucagcccaggaaaaaga

SEQ ID NO: 224188 - RNA, 62 nt, Human
ggccugaguggccguggccaggcugagaccugucaggccauacugacaagcagaggucagag

SEQ ID NO: 224189 - RNA, 62 nt, Human
cccccuccccggcuccuuggggcucucuggucucaggccagcuggcgauggguggcuagagu

SEQ ID NO: 224190 - RNA, 62 nt, Human
guggggcuuucugacaguuccaugcugauguaucaggccaucugugucaugcuuauguauua

SEQ ID NO: 224191 - RNA, 62 nt, Human
cugcugacgacccuugagaagcugccauaucuucaggccauggguucaccagcccugaaggc

SEQ ID NO: 224192 - RNA, 62 nt, Human
cuagacucccaagcuggacuauggcucuacuuucaggccacauggcuaaagaagguuucaga

SEQ ID NO: 224193 - RNA, 62 nt, Human
acagaagguaaugggaacuguagcuggaggccucaggccaugggucaaaccugggagggaaa

SEQ ID NO: 224194 - RNA, 62 nt, Human
auucuacaccaggggcagcuacugcgagaacuucaggccaaugucucagcccaggugagugg

SEQ ID NO: 224195 - RNA, 56 nt, Human
ggaggccguggcggaacugagggggcucaggccaccccuccuccuaaacuccccaa

SEQ ID NO: 224196 - RNA, 62 nt, Human
uuuuaccaauucuccaaugcugccauuuuaauucaggccaucaaccuaccuaaauuauagca

SEQ ID NO: 224197 - RNA, 62 nt, Human
gaggcuccuuaaggaugaccaaaaccaaugucucaggccaggaaggcagaagagaagcccug

SEQ ID NO: 224198 - RNA, 62 nt, Human
cacucagcccuguggccccuuccuguccugucucaggccaggcuaaauaugugccuuccuca

SEQ ID NO: 224199 - RNA, 62 nt, Human
agcugggaaaauacaagaaccaaggaaucaugucaggccaucaaggaguauauggacacuac

SEQ ID NO: 224200 - RNA, 62 nt, Human
aagagagagagcuguagggccagcugccgggcucaggccacugcccacccuggccuggacag

SEQ ID NO: 224201 - RNA, 62 nt, Human
augaaaacaucggcuggugaugugacuucucuucaggccaugagccuaacacccugccgguu

SEQ ID NO: 224202 - RNA, 62 nt, Human
ucuccugcauggcaacaaaaugugugucaccaucaggccaacaggccagcccuugaaugggg

SEQ ID NO: 224203 - RNA, 62 nt, Human
cacaccccacucaccaguucugcugccucaggucaggccagggcagugcugcugcagagcua

SEQ ID NO: 224204 - RNA, 62 nt, Human
cccaaggagggacgucuugagggguccgagccucaggccaaggaccccugaugcagacucug

SEQ ID NO: 224205 - RNA, 62 nt, Human
caggagaggccuuucccgccuggagagaagcuucaggccagcuccucacaccacagccagga

SEQ ID NO: 224206 - RNA, 62 nt, Human
auguuauuauaauuacagucaaauguagacuaucaggccaaauuaaaggggagcauggcaga

SEQ ID NO: 224207 - RNA, 62 nt, Human
gaaaauucuuuuugugcauuugagggcaaaauucaggccaucuucuuauacauauacuauca

SEQ ID NO: 224208 - RNA, 62 nt, Human
augagcucauagggcugaggcaggauuuggaaucaggccaugucuucuccagagcccacauc

SEQ ID NO: 224209 - RNA, 62 nt, Human
cauucuuaugaaacaagucaaaaaaguuuuuuucaggccaguuuuuauauaucaaagacuuu

SEQ ID NO: 224210 - RNA, 62 nt, Human
ggaccaauuucauauaguacaaguuucguaagucaggccaagugucaauuucaaaagacaag

SEQ ID NO: 224211 - RNA, 62 nt, Human
acccaggaggcggagcuugcagugagccgagaucaggccauugcacuucagccugggugaca

SEQ ID NO: 224212 - RNA, 62 nt, Human
gaaauaaaagauacuaucuuuaccguaguaguucaggccaagauuaugcuuaguuuuaguuc

SEQ ID NO: 224213 - RNA, 62 nt, Human
gguuucauuccuccccuggcucuucucccucuucaggccauaauuucccuggugccaauuuc

SEQ ID NO: 224214 - RNA, 62 nt, Human
uauuuauuagugguguauaugguccacugguuucaggccaaaucuagaauuuagugauacug

SEQ ID NO: 224215 - RNA, 62 nt, Human
ucucagguguauuucuugguacccccaagauaucaggccagaaagagaugagucaguugcug

SEQ ID NO: 224216 - RNA, 62 nt, Human
ugaaacaggggugguagauuuauucccuugugucaggccaaagaaguucuuacaaaguacag

SEQ ID NO: 224217 - RNA, 62 nt, Human
ugugguugaguuuaugguaauggguacaugggucaggccauguauuaacagaugccagugcg

SEQ ID NO: 224218 - RNA, 62 nt, Human
gggaaggcugggccccaggaguauccacaggcucaggccaugccccuccccgcacccaccuc

SEQ ID NO: 224219 - RNA, 62 nt, Human
cuggcccugggcagggucuguggcugcgccccucaggccagcaguugagguccaucgggcug

SEQ ID NO: 224220 - RNA, 62 nt, Human
gcaggggcugcugccuuguuucaccuuccaugucaggccagccugucccugaaagagaagau

SEQ ID NO: 224221 - RNA, 62 nt, Human
gcagccgccgccgugccgcuccucccuugcccucaggccaggucccugcuggaagcggcugc

SEQ ID NO: 224222 - RNA, 62 nt, Human
aucacuugagaauccuuuaaaaauuccaaagcucaggccauaucccaggccuauuaaaucac

SEQ ID NO: 224223 - RNA, 62 nt, Human
gcugauggagaugcucaaggccagcaagccccucaggccagcacuucgcuugcagaagccau

SEQ ID NO: 224224 - RNA, 62 nt, Human
aucaguuggaaacaguagcacuuugaaaacuuucaggccagcuuuaauuuaauggcccuacu

SEQ ID NO: 224225 - RNA, 62 nt, Human
ggaugugguugaugaagguuuccaauaugguuucaggccaaaaccagggaagauucuagcuu

SEQ ID NO: 224226 - RNA, 62 nt, Human
uacgacuauuucuucuuuuuaauacacuuaacucaggccauuuuuuaaguugguuacuucaa

SEQ ID NO: 224227 - RNA, 54 nt, Human
gugauucagacucaggcuaaggggucaggccagauggggcaggaaggcuccgca

SEQ ID NO: 224228 - RNA, 62 nt, Human
uacccagcugauggggguuggggugcuuccuuucaggccaaggcuaugaagggacagcugcu

SEQ ID NO: 224229 - RNA, 62 nt, Human
cagguauuauucugaggcugccuuggauggccucaggccagguaaccccaggcugaaggggc

SEQ ID NO: 224230 - RNA, 62 nt, Human
uuguuuccaggagaaagccgggggaggggcccucaggccauuccccaacgggguggggaggg

SEQ ID NO: 224231 - RNA, 62 nt, Human
ccugagaaguggagauugcaauugagcuaggaucaggccacugcacuccagccuggguaaca

SEQ ID NO: 224232 - RNA, 62 nt, Human
ccucaaaaugaucuuuagugccuuuauuccuuucaggccaauaauccacccaaaaauuagaa

SEQ ID NO: 224233 - RNA, 62 nt, Human
gcucuaccaggaaggauucgagguagauaggcucaggccacacuuuaaaaacaaacacacaa

SEQ ID NO: 224234 - RNA, 62 nt, Human
cagauaaaggaacuuuuauuaaagccugagacucaggccagaauuaggagggagcuuuuuga

SEQ ID NO: 224235 - RNA, 62 nt, Human
gagaggacaauuucugauugauuguuuucucuucaggccaucucaccucuucauucucuugu

SEQ ID NO: 224236 - RNA, 62 nt, Human
gcagacgaugaggacauugucggcucaacaucucaggccacucauuaccuucgcucaugauc

SEQ ID NO: 224237 - RNA, 62 nt, Human
ccccagacccugccacacauggaagagacagcucaggccaaauacaggcaugauuucuuugc

SEQ ID NO: 224238 - RNA, 62 nt, Human
uuccauggagaccuccccuugaggaggugaauucaggccaaaagggcuguuggcuguaaucc

SEQ ID NO: 224239 - RNA, 62 nt, Human
cuuccugaagguccucacuguuugcauaucgcucaggccaccuccaaaccccaccuagguuu

SEQ ID NO: 224240 - RNA, 62 nt, Human
aauaaagccaaaaaucuuucucuuucucccccucaggccaccuccuguccucacuccugucc

SEQ ID NO: 224241 - RNA, 62 nt, Human
cagguauucugaaccaggaacacaaucagguuucaggccaguuugauacuggcuguccuuaa

SEQ ID NO: 224242 - RNA, 62 nt, Human
ucaaacuguugacucacugagagggacccugcucaggccaccugccuggcuccugccccaag

SEQ ID NO: 224243 - RNA, 62 nt, Human
guguggguggcggcguuugcugugaaccacgcucaggccacacagagacacauacuugguuu

SEQ ID NO: 224244 - RNA, 62 nt, Human
cagggugcuaugacugcucuggcacccuuggaucaggccaagcuagacuuuuucugagccuu

SEQ ID NO: 224245 - RNA, 62 nt, Human
uccaccauccccgcacaaagcggcucuaaaccucaggccacaucuuuuccaaggcaaacccu

SEQ ID NO: 224246 - RNA, 62 nt, Human
gauaucacaggaggccagagagaggcaaaggcucaggccaagagccaacgcugugggaggcc

SEQ ID NO: 224247 - RNA, 62 nt, Human
aacagauguugacuucucauccccgaguucuuucaggccaaaaagcaaauggauuuccaccu

SEQ ID NO: 224248 - RNA, 62 nt, Human
ccaucucagauacugucaacuccauccuucugucaggccaaaauccuuggagccauccucaa

SEQ ID NO: 224249 - RNA, 51 nt, Human
agaagcccuccagccucuaggucaggccaugcagcagucacgcagucggcu

SEQ ID NO: 224250 - RNA, 62 nt, Human
ccagccugcagagggcgcgccucugcacuaacucaggccagguagcccuggcagcaggaggc

SEQ ID NO: 224251 - RNA, 62 nt, Human
cuaagacuggguaguuuauaaagaacagacauucaggccaggcacggugacucacgccugua

SEQ ID NO: 224252 - RNA, 62 nt, Human
aggccaugcuggcugcugucacugagcgggacucaggccaagaggcgugaccucgggccagc

SEQ ID NO: 224253 - RNA, 62 nt, Human
gcccuggagaggaacugagugucacccugaucucaggccaccagccucugccggccucccag

SEQ ID NO: 224254 - RNA, 62 nt, Human
ccugggcagugcuccuccguguggacugugccucaggccagggcucaccagcugggguccug

SEQ ID NO: 224255 - RNA, 62 nt, Human
augaaucuaccuuuccauugauugauuuaaguucaggccacuuuucugucuuuuauuugguu

SEQ ID NO: 224256 - RNA, 62 nt, Human
agaagacauacugcuugauuuuaauacauugaucaggccauccaggacaccacgauucuccc

SEQ ID NO: 224257 - RNA, 62 nt, Human
cguauaaaauuugaagucaacuucuaucaacuucaggccaggcccguggcucaugccuguau

SEQ ID NO: 224258 - RNA, 62 nt, Human
ugaagugaucaccccccgcccccagcccugcaucaggccacaggucuuggcuuucuccuuau

SEQ ID NO: 224259 - RNA, 62 nt, Human
aguaaagaagccugcguggucaacuccugucuucaggccacaccacaucuuccaugggacuu

SEQ ID NO: 224260 - RNA, 62 nt, Human
ggucuggaagcaugaggggagggggagagaggucaggccaggcccguggguaggucccuggc

SEQ ID NO: 224261 - RNA, 62 nt, Human
guccaccaacuccccaagaugaagaagccccuucaggccagucgugguggcucaugccugua

SEQ ID NO: 224262 - RNA, 62 nt, Human
gccauggaaaaacuuccuaguaagcaucuacuucaggccaacaagguuauaugaauauauag

SEQ ID NO: 224263 - RNA, 62 nt, Human
ucuuuccggccuggaccccacccuccacacucucaggccaucacagaacaccccagcuuccu

SEQ ID NO: 224264 - RNA, 62 nt, Human
agguguguucaguaguuccaggacucagggacucaggccagucacccugugaccgcagguug

SEQ ID NO: 224265 - RNA, 62 nt, Human
ucccuugccuuaccuggaggaagaaugugccuucaggccacagucgugcugcuagaacaguc

SEQ ID NO: 224266 - RNA, 62 nt, Human
cuccuucagugccccuguacugcccugccaucucaggccaaagggaggggagcaagugggga

SEQ ID NO: 224267 - RNA, 62 nt, Human
gcccagccccguuuuaaggacauuaaaagcuaucaggccaagaccccagcuucauuaugcag

SEQ ID NO: 224268 - RNA, 62 nt, Human
ggauauacuaggauuaauuaucagaagacagcucaggccaaguuuugaucguuccauacagu

SEQ ID NO: 224269 - RNA, 62 nt, Human
acaggaagccagguccaccgcccaccacccuuucaggccauguuucuacucagugugcuuuu

SEQ ID NO: 224270 - RNA, 62 nt, Human
cuguggguggaggcuggggugucugcacgaagucaggccagcguccuccuccacagccuguc

SEQ ID NO: 224271 - RNA, 62 nt, Human
uggcugggcaggagccuggggccgcuugugagucaggccagagcgagaggacaguaucugug

SEQ ID NO: 224272 - RNA, 62 nt, Human
cugccuguuuuaaacgaguuucucagcucuauucaggccaggucuugcuguuguaucaaggg

SEQ ID NO: 224273 - RNA, 62 nt, Human
gcuucuggacgucggggacccagcgguugggcucaggccacaacggccugagauugccccgg

SEQ ID NO: 224274 - RNA, 62 nt, Human
gggcaaggaaugaccuguuccaggcgcccuccucaggccaaccacagcgucuugggugggca

SEQ ID NO: 224275 - RNA, 62 nt, Human
cauuugggcagacccugagcagaauacuggucucaggccaagcccaauacagccauuaaaga

SEQ ID NO: 224276 - RNA, 62 nt, Human
agcugggcaggaagggagaacuugaaacagauucaggccagcccagccaggccaacagcacc

SEQ ID NO: 224277 - RNA, 62 nt, Human
ucgcacguagguggcguuguuccacucggcuaucaggccacagcagcccccuggugcggccc

SEQ ID NO: 224278 - RNA, 62 nt, Human
ugugaggggcagaggccuccgcccagucaccaucaggccacucccucugcaccgggaccugg

SEQ ID NO: 224279 - RNA, 62 nt, Human
aucauuugcuguaauccuuaaauggcaaacggucaggccacgugacuaaaaacuguccuguu

SEQ ID NO: 224280 - RNA, 62 nt, Human
cuauaugcgaaauuguuaauuuuaaaauaaccucaggccacagacuuguaguaaucauuuga

SEQ ID NO: 224281 - RNA, 62 nt, Human
cacauuagggucacuauucaaaaaacagauaaucaggccaggcucaguggcucaugccuaua

SEQ ID NO: 224282 - RNA, 62 nt, Human
aaagaugugugaaauguucucugcaaaauaauucaggccacugucuccuuuuauauauuauu

SEQ ID NO: 224283 - RNA, 62 nt, Human
ccuuguuuacacauguauugacaccauuugcuucaggccauggagcacuguuucucccuuuu

SEQ ID NO: 224284 - RNA, 62 nt, Human
caaauaaaaacuuuuguuacaucucauuauuuucaggccaaggugggaguauagugcauaau

SEQ ID NO: 224285 - RNA, 62 nt, Human
gaaacuaacagcuuucucaaagcggugaccacucaggccagcccagacaaaucugagggaug

SEQ ID NO: 224286 - RNA, 62 nt, Human
cacuucuggcuguccugcgggccacaagcucuucaggccaagucagagcugcuguugcugcc

SEQ ID NO: 224287 - RNA, 62 nt, Human
gcaccccgccgcuggcuaagccuugugacccaucaggccagugagugggcaaaugcggaccc

SEQ ID NO: 224288 - RNA, 62 nt, Human
agaugccuuccaggcagacacagcugucugguucaggccaagccccuuugcaaugcaagccc

SEQ ID NO: 224289 - RNA, 62 nt, Human
uacugaucagcgcauguguguaaggaaccaccucaggccagagaaagagccaugugagaaga

SEQ ID NO: 224290 - RNA, 62 nt, Human
cugugguuuuuuuuuuuuuaaccaaaguguugucaggccaacugaaugaugaugugguugcu

SEQ ID NO: 224291 - RNA, 62 nt, Human
cuugcaggaagcaaaccuccuuguuuacaucuucaggccaagaugacugauuugggggcuac

SEQ ID NO: 224292 - RNA, 62 nt, Human
gaguccuugggacaccagccucucugggguucucaggccaucccguuggggcugucgcccag

SEQ ID NO: 224293 - RNA, 62 nt, Human
auugauucccagagggucuuaguccuggaaagucaggccaacaagcaacguuugcaucaugu

SEQ ID NO: 224294 - RNA, 62 nt, Human
caacccuucucacccuguggguuggagccgagucaggccacuauggggaagcaguugcccca

SEQ ID NO: 224295 - RNA, 62 nt, Human
auuacucuguguuuacagauucauugcuguggucaggccauuuuuaagggaagaguuauuua

SEQ ID NO: 224296 - RNA, 62 nt, Human
ugucaagggaagcuuccugugaaccaaaguucucaggccaaggucucgcccaccaaagccag

SEQ ID NO: 224297 - RNA, 62 nt, Human
agaaucucaguugauuuucuggauuccccaucucaggccagagccaaggggcuucaggucca

SEQ ID NO: 224298 - RNA, 62 nt, Human
ccagggcccugguggaggcugcugugggacggucaggccaccaccgcaaagaggcagccgga

SEQ ID NO: 224299 - RNA, 62 nt, Human
ggcccaggacuggagcuuucucuggccaaguuucaggccaaugauccccgcaugguguuggg

SEQ ID NO: 224300 - RNA, 62 nt, Human
ugugcagccccgcccucugcgucccccagcccucaggccagugccaggacagcuggcugcug

SEQ ID NO: 224301 - RNA, 62 nt, Human
gagcgggcguccgaggggcccuggcaucugacucaggccacaccauggaaucacugcaucca

SEQ ID NO: 224302 - RNA, 62 nt, Human
ugggacucugggguguguggugcucaccagagucaggccacccacugggcucggcaggagau

SEQ ID NO: 224303 - RNA, 62 nt, Human
ggggagcgggggacagggucuuacucugucacucaggccagaguacaauaguaugaucucgg

SEQ ID NO: 224304 - RNA, 62 nt, Human
uaguguuuugcuauaagacagcaugagggcuaucaggccaaaauucauuauuguauuuccaa

SEQ ID NO: 224305 - RNA, 62 nt, Human
uggacacccgaggcugccacuggaaugucuucucaggccaugagcugcagugacugguaggg

SEQ ID NO: 224306 - RNA, 62 nt, Human
aagucaucuuccagaguaaaaugcaaaucccaucaggccacuuggaugaaaacccuucaagg

SEQ ID NO: 224307 - RNA, 62 nt, Human
acuuucuucacuguguucaagugucauagcuaucaggccacuaucauggauaucauguaucc

SEQ ID NO: 224308 - RNA, 62 nt, Human
uguccuagaagguuuuaggaauagugacagagucaggccaccccaagggccaugggagccag

SEQ ID NO: 224309 - RNA, 62 nt, Human
cuggcagcaucagcauccuacuccuggcaacaucaggccaacguccaccccagccucacauu

SEQ ID NO: 224310 - RNA, 62 nt, Human
aaaaaccauucuuaguuugugggccuuacaaaucaggccacuggcccauugcuuguaguuag

SEQ ID NO: 224311 - RNA, 62 nt, Human
ccccuaaucugagaagucagccucuuggcuccucaggccaccauuuaggccugacuggggua

SEQ ID NO: 224312 - RNA, 62 nt, Human
gcccgcccuaagcagccccuggcuucacccugucaggccagcuccacuccaggacugaauaa

SEQ ID NO: 224313 - RNA, 62 nt, Human
cccaguguuccuccucaccccacguccuggggucaggccagaccauguuucgucagccuugg

SEQ ID NO: 224314 - RNA, 62 nt, Human
ggacuggggagagauccaggacugagccagccucaggccagggcgggaaagcaggcugucca

SEQ ID NO: 224315 - RNA, 62 nt, Human
gugggucaccugaccucugaagagcugaguacucaggccacuccaaucacccuacaagaugc

SEQ ID NO: 224316 - RNA, 62 nt, Human
ccuuccucucccaccaugcgaugagcauccuuucaggccagugucugcagagccucaguuac

SEQ ID NO: 224317 - RNA, 62 nt, Human
uggcccuaaauuguuuuuuguucccaucaguuucaggccaggacuggagaggccacauuacc

SEQ ID NO: 224318 - RNA, 62 nt, Human
cugcaaguucuuguauaaugaagucaaugccaucaggccaaggaaauaaaauaauugcuuac

SEQ ID NO: 224319 - RNA, 62 nt, Human
guuuaagauuacaagguacuuucccucuucucucaggccaugcauuugaauaaagugccucc

SEQ ID NO: 224320 - RNA, 62 nt, Human
ugugcagcucuugcagccccugcagacgagagucaggccagcacccugcgaccagcuucucc

SEQ ID NO: 224321 - RNA, 62 nt, Human
cacacaggaagcugccccacugggcagugcccucaggccaggauccccuuagcaggguccuu

SEQ ID NO: 224322 - RNA, 62 nt, Human
agugguaaugagugcuuggaauggauugggccucaggccagguggucuucaaggggaccagc

SEQ ID NO: 224323 - RNA, 62 nt, Human
ccacccaagaagugcuggcaccgauguuuaacucaggccaccuucuguucuaaagaaagauu

SEQ ID NO: 224324 - RNA, 62 nt, Human
aagacgucucugcaagaagccuggagucuguuucaggccaggaggaggggauuugcugaggg

SEQ ID NO: 224325 - RNA, 62 nt, Human
ccagguguguaugaggcgcucugguaaggugcucaggccaguugcaaugucugucaguaacg

SEQ ID NO: 224326 - RNA, 62 nt, Human
cgugacucuuucuuaaugccacuggguuuuagucaggccacagugagaaggaacagcccuaa

SEQ ID NO: 224327 - RNA, 62 nt, Human
ucagcuugggcuggagcagucaauauaggaucucaggccaggcccgcuuuucuagaaugugu

SEQ ID NO: 224328 - RNA, 62 nt, Human
agagauaugacuaaaaccuuaucuccuugugcucaggccagugucuucccauuaacccccug

SEQ ID NO: 224329 - RNA, 62 nt, Human
gaaaaggaaauaugauccaucuuaacugaggcucaggccacauaauuggacucugucacaaa

SEQ ID NO: 224330 - RNA, 53 nt, Human
uucagagugacuauguaugacuaucaggccaugugcaaacccucgagucacca

SEQ ID NO: 224331 - RNA, 62 nt, Human
acguuuacuuucaaguaacacaaacucuuccaucaggccaugaucuauaggaccuccuaaug

SEQ ID NO: 224332 - RNA, 62 nt, Human
ugaaaggcauuugccuucauaaggaucaagguucaggccacuacauguaaaaacuaugcaag

SEQ ID NO: 224333 - RNA, 62 nt, Human
ucuuucuccugagcucacauuggcaggugaugucaggccaaugccuagaacaaagggcaaag

SEQ ID NO: 224334 - RNA, 62 nt, Human
gggaugauuguaaaauuugcuccucaaaggaaucaggccagacucaauuuuggagggcaaga

SEQ ID NO: 224335 - RNA, 62 nt, Human
uacaaaaacugcccaccagccagaugugacccucaggccaucauuugccaaucacugagaau

SEQ ID NO: 224336 - RNA, 62 nt, Human
gagauccuaaaccguucuggguuuugaaagccucaggccaaccuucccaacugcugcgugag

SEQ ID NO: 224337 - RNA, 62 nt, Human
aaggucggaggagacaggggaugaggaaggccucaggccacugcccagcggcccaggcaucc

SEQ ID NO: 224338 - RNA, 62 nt, Human
gcauccucuacuacgggggccaccuugucaucucaggccagaugaccagcggcaaccucauc

SEQ ID NO: 224339 - RNA, 62 nt, Human
gccuggagcccaggccaguguuguuuccagccucaggccacgggcuggacgggccuggccgc

SEQ ID NO: 224340 - RNA, 62 nt, Human
cagggugaguagcugcuugacaccccagugagucaggccaaaacugagauguguuuaaugaa

SEQ ID NO: 224341 - RNA, 62 nt, Human
ugccccagccaacgagauugcuggaaaccaagucaggccaggugggcggacaaaagggccag

SEQ ID NO: 224342 - RNA, 62 nt, Human
ccuguuguuagacuguggccacagccaguaaaucaggccagagugucucaaacuggacaaga

SEQ ID NO: 224343 - RNA, 62 nt, Human
uugcuucuagagcuuagcauaucugauuguugucaggccauauuaucaauguuuacuuuuuu

SEQ ID NO: 224344 - RNA, 62 nt, Human
agcacaguccagcaguucucaaaaugagguccucaggccacagugcgugagaacuugcuugg

SEQ ID NO: 224345 - RNA, 62 nt, Human
aacaaaccggcgcccucuucacacguagcuccucaggccauuccccaugagucccccacacc

SEQ ID NO: 224346 - RNA, 62 nt, Human
ugcagggcucaagccaccaaucuaugaagaccucaggccagggggugaggaauuagugcugg

SEQ ID NO: 224347 - RNA, 62 nt, Human
gggcaaggagagcccuggggucagugacacugucaggccaaccaugcacuccacaaagggga

SEQ ID NO: 224348 - RNA, 62 nt, Human
uaggaaauaccucuuaggaagcauuagcggucucaggccaauuacuguggagcagcuuucau

SEQ ID NO: 224349 - RNA, 62 nt, Human
caacaggaagcaaagcaaucucccuuuguuuuucaggccauucaccugccuccugucaguag

SEQ ID NO: 224350 - RNA, 62 nt, Human
gaugauuuccuagcugggaagacaccgugacaucaggccagagguuuccaaucagccuugcc

SEQ ID NO: 224351 - RNA, 62 nt, Human
ugcacacagggcaguccuuacucccccaccacucaggccacaguggggcugcaggcaggcgg

SEQ ID NO: 224352 - RNA, 62 nt, Human
aacucaagauaauccuagagucuuaaagcauuucaggccaguguggugucuugcgccuguac

SEQ ID NO: 224353 - RNA, 62 nt, Human
uauagaaggggagggggcaaagggcuucuuccucaggccagcucuucugaggaggcucugcc

SEQ ID NO: 224354 - RNA, 62 nt, Human
ugcagguaagucagagcagcuuuaccacagcuucaggccacgagagccccuucacccgcccu

SEQ ID NO: 224355 - RNA, 62 nt, Human
cuaccugggcagcccauuugccagggcuugccucaggccaugcagcauuggcgcucuggcug

SEQ ID NO: 224356 - RNA, 62 nt, Human
gagauaagagguuguuaccucaguaaaaaccuucaggccacaaagcaaaaaguugcauagcc

SEQ ID NO: 224357 - RNA, 62 nt, Human
uacagaagcaaauucaccagaagggaaacaucucaggccaacauaggcaaaugaaaagggcu

SEQ ID NO: 224358 - RNA, 62 nt, Human
cucugcuuggccacagcuuugcucuuugguccucaggccaccagaccccucacagcauggcc

SEQ ID NO: 224359 - RNA, 62 nt, Human
ucgcaugcucccugcaugagacucacccaugcucaggccauuccaguuccgaaagcucucuc

SEQ ID NO: 224360 - RNA, 62 nt, Human
ggacacagaugaaacacaaacaauaguaauucucaggccaucaucaguggagccauguuaau

SEQ ID NO: 224361 - RNA, 62 nt, Human
gacugcuggcccagggccccugcugaggggcgucaggccaggcuugacccauucccucccag

SEQ ID NO: 224362 - RNA, 62 nt, Human
cgucucuagaggguuaggauaccaggccgaguucaggccacugcuagcuuucucauacuccc

SEQ ID NO: 224363 - RNA, 62 nt, Human
ugcaguguuccuccaccccaggaccaauauguucaggccacaccgauggccugaaccccaug

SEQ ID NO: 224364 - RNA, 62 nt, Human
uccccaggcugugugcucaaagcggacaaaacucaggccagagccacagcugggagaccugc

SEQ ID NO: 224365 - RNA, 62 nt, Human
agguccguuuccuagcuaaaaauguaagagcaucaggccagaugauaugagggcacaggaau

SEQ ID NO: 224366 - RNA, 62 nt, Human
guacuacaguccucccaucucacacaugagcaucaggccaggcccucugcccacucccugca

SEQ ID NO: 224367 - RNA, 62 nt, Human
ugcagcuugccugcuucagcaaaaacggagauucaggccagcagcuggauaugggggucucu

SEQ ID NO: 224368 - RNA, 62 nt, Human
aggcgugagaguguggguuuuaaauucgaagcucaggccauaguuucagagaaucacccuua

SEQ ID NO: 224369 - RNA, 62 nt, Human
ggcggccugccugcagggcuggggaccaaacgucaggccacagagcaucuccaaggggucuc

SEQ ID NO: 224370 - RNA, 62 nt, Human
uugaaaugucuuuaauuaccuccccuucaucgucaggccacgugugacuucuguucuuagca

SEQ ID NO: 224371 - RNA, 62 nt, Human
aucccugucccccgacauugaagagaucucauucaggccagagacacagagaccacauagcc

SEQ ID NO: 224372 - RNA, 62 nt, Human
cucugguuacccaacuacagaaccuccuuugaucaggccaguagguugugaugcaggcugga

SEQ ID NO: 224373 - RNA, 62 nt, Human
gggcacugcucuccuccuugcaccggugaaacucaggccacacucaagggcugacuguccag

SEQ ID NO: 224374 - RNA, 62 nt, Human
cggcuccugcaaaaggaggugaaaucccugccucaggccaagggaccagguuugcaggagcc

SEQ ID NO: 224375 - RNA, 62 nt, Human
acagcucccguccuggccacccuggaagcucaucaggccaagacccggacagagcuucagag

SEQ ID NO: 224376 - RNA, 62 nt, Human
acucccagcuccguuugaugugaguugagccuucaggccagcuggguuuagcccgaggcugg

SEQ ID NO: 224377 - RNA, 62 nt, Human
gugaugucaaagguauaugauacuugaggaaaucaggccaaguguagcugagcaauuaauaa

SEQ ID NO: 224378 - RNA, 62 nt, Human
gguuccucccgcugggguucauauggccucacucaggccaucccuguuagaaggugguaccu

SEQ ID NO: 224379 - RNA, 62 nt, Human
gugccucuggucccacuagcaccugcgcagacucaggccaggccuagaaucuccgguuggcc

SEQ ID NO: 224380 - RNA, 62 nt, Human
cgaccuuucugauaacuaagaguagaauaccuucaggccaggcgcgguggcucacgccugua

SEQ ID NO: 224381 - RNA, 62 nt, Human
cagcaauaagucucacccuucuccccuacaggucaggccaagaagggugaaggccucuugca

SEQ ID NO: 224382 - RNA, 62 nt, Human
auuaauaauguuuauaagcugggcauggucgcucaggccaguaaucccagugacuuaggagg

SEQ ID NO: 224383 - RNA, 62 nt, Human
uuauggggaaggcucugacacuccaccccagcucaggccaugggcagcagggcuccauucuc

SEQ ID NO: 224384 - RNA, 62 nt, Human
cucccugcuagguuugcugucuucccucucccucaggccauacucuccuuuaccauacuacu

SEQ ID NO: 224385 - RNA, 62 nt, Human
cuacauaggggccccauucaccuggaggcaucucaggccaggccaugccaggcucagccacu

SEQ ID NO: 224386 - RNA, 62 nt, Human
gggcacuugugcuugagccuguauuaaaggaaucaggccaggcacaguggcucacgccugua

SEQ ID NO: 224387 - RNA, 62 nt, Human
ucauuaccucagugagaagccagcuuuccucaucaggccauugucccugaagagaagggcag

SEQ ID NO: 224388 - RNA, 62 nt, Human
gaauagaagcagaaaaacauuuagggauaacaucaggccaguagaauuaagccucuccaccu

SEQ ID NO: 224389 - RNA, 62 nt, Human
cuccccaacccugccccugccccgucaccaucucaggccaccugcccccuucucccacacug

SEQ ID NO: 224390 - RNA, 62 nt, Human
aacaugcugccccaguuaaucagcaaccugacucaggccagugugucucugaaacggaucca

SEQ ID NO: 224391 - RNA, 62 nt, Human
uuuuccuccuggaacagaagacagcugcugggucaggccaccccuaggaacucaguccugua

SEQ ID NO: 224392 - RNA, 62 nt, Human
aauuggaaccuugaggcuaguuaguaucacacucaggccacacucagcacuugcccacucuu

SEQ ID NO: 224393 - RNA, 62 nt, Human
uuuaugagaaaccauaaaauuguuuuuauuuuucaggccagacauagcuuccuaaugaaaga

SEQ ID NO: 224394 - RNA, 62 nt, Human
cucugcagagcugggcucuaccccaaaaggcuucaggccagcugccacggcuggaagcagag

SEQ ID NO: 224395 - RNA, 62 nt, Human
gcuccuacgggucccuggggcagcuguccccaucaggccaagagcgagcgagaggcgcugcc

SEQ ID NO: 224396 - RNA, 52 nt, Human
gccuggacaucaaguggugaagucaggccagggccuuccagcugcucuuggg

SEQ ID NO: 224397 - RNA, 62 nt, Human
gggauccauucccuguccccugcccacuaccuucaggccauuuagaguuguaaauuuacaaa

SEQ ID NO: 224398 - RNA, 62 nt, Human
cuuaucucgaagggaccagaagugcugcguguucaggccaucucuggcugucuuccugucuc

SEQ ID NO: 224399 - RNA, 62 nt, Human
ggggagugagaugaguggugcuguccauggaaucaggccacagcaggaacugccccacuggc

SEQ ID NO: 224400 - RNA, 62 nt, Human
ggagaaacgucccuugccacuccccacucucaucaggccaaguggaggacuggccagagggc

SEQ ID NO: 224401 - RNA, 62 nt, Human
ggacaaggaguuuccagcugcuggcuggagucucaggccaaauugcagaggguccuccaggg

SEQ ID NO: 224402 - RNA, 62 nt, Human
ccauaccauucccauggaguugccaacuauucucaggccaagggccauggggaagauggagc

SEQ ID NO: 224403 - RNA, 62 nt, Human
ugugguugacuuaugggcccagccagccaggcucaggccauggcuccccuuuuucuuccuca

SEQ ID NO: 224404 - RNA, 62 nt, Human
uuuuaaugcuuuaaaaaaauggcaaaaagacgucaggccacccucauaguaagugguguagu

SEQ ID NO: 224405 - RNA, 62 nt, Human
accccuccccugauggucuuguucucuugugcucaggccagagacuugcucacuuccugcau

SEQ ID NO: 224406 - RNA, 62 nt, Human
cucagcugaugaaaauuugggucuggcccauuucaggccaucuucaguugaagaaacacccu

SEQ ID NO: 224407 - RNA, 62 nt, Human
cauacacgaggaagaagaugcggucagcagucucaggccagcuucucugugaccccuuuacu

SEQ ID NO: 224408 - RNA, 62 nt, Human
gagccuugcugguggccccaagacacgcaaugucaggccauggcugggucaaggcagaaggc

SEQ ID NO: 224409 - RNA, 62 nt, Human
aggcucuggugcagagcacuucaaauauguccucaggccagauacugauugcuaguagagag

SEQ ID NO: 224410 - RNA, 62 nt, Human
aaauuuauuaaacauuauuaaacuugaucaggucaggccaaauaaaguuuuauuggaacaca

SEQ ID NO: 224411 - RNA, 62 nt, Human
aacugcacuccaguguggacgugccuuugucuucaggccaugccgaaggguguuuaaagcag

SEQ ID NO: 224412 - RNA, 62 nt, Human
uuuuccuaggcuuggcacugccuuuuccuuucucaggccaauggcaacugccauuugagucc

SEQ ID NO: 224413 - RNA, 62 nt, Human
cuaaugccugcggaguugugcacguaguagggucaggccacggcagccuaccggcaauuucc

SEQ ID NO: 224414 - RNA, 62 nt, Human
gcccuagggaccuccagccuggugcccagugcucaggccaccuccugguccagucaccaccu

SEQ ID NO: 224415 - RNA, 62 nt, Human
ccccgcccccaggauccuacggauugagguccucaggccacgccccugcagauccaggucuc

SEQ ID NO: 224416 - RNA, 62 nt, Human
gcaccuggcuucagguagguuugauccaggcaucaggccauugcaucuauuuuuucagugua

SEQ ID NO: 224417 - RNA, 62 nt, Human
caaagccuuuagugaccagucaacacuuaccaucaggccauucaugguguagggaaacuuga

SEQ ID NO: 224418 - RNA, 62 nt, Human
cucuggggagcucuggcccuguguguugucauucaggccaugucaucaaaacucugcauguc

SEQ ID NO: 224419 - RNA, 62 nt, Human
uuaugaagucaguuucuuugaacagcauauacucaggccaugcuuuuuuuauucauucugca

SEQ ID NO: 224420 - RNA, 62 nt, Human
cauuugaggaacccugaugagcacaaggugauucaggccagcuggagaagcuuccagaaggg

SEQ ID NO: 224421 - RNA, 62 nt, Human
agccacagccucuggggagccagucauuucuuucaggccagcugacguuggagagccagcca

SEQ ID NO: 224422 - RNA, 62 nt, Human
cacagugggguguggggcccgugggaugggccucaggccaccaggcaauaaccacagggccu

SEQ ID NO: 224423 - RNA, 62 nt, Human
ccauaucagcagcccagaguguggguccccugucaggccacagugugaccagcccuggccau

SEQ ID NO: 224424 - RNA, 62 nt, Human
uguuuguuuguuuuuaaucugccuuaaugagcucaggccacuaucacaaaauaccacagacc

SEQ ID NO: 224425 - RNA, 62 nt, Human
gcaccugucccggcccccuccucuccagccugucaggccagccuccccagcccccuucccuc

SEQ ID NO: 224426 - RNA, 61 nt, Human
cugcagguccugccagauaagcuguaggggcucaggccacccucccugccacguggagacg

SEQ ID NO: 224427 - RNA, 62 nt, Human
caccuuggccccgauuccggaucucuccguucucaggccagaccccuggugcugccguugau

SEQ ID NO: 224428 - RNA, 62 nt, Human
ugcagauacacgaacuggauccaaaaaaccauucaggccaagugacccugacaugugacauc

SEQ ID NO: 224429 - RNA, 62 nt, Human
cuuuuuugauauaguacuuuauaaaagggagaucaggccaggcacggaggcucauguaagua

SEQ ID NO: 224430 - RNA, 62 nt, Human
aaaauacauaguaagaaugcgagaaauauaaaucaggccaggcacgguggcucacaccugua

SEQ ID NO: 224431 - RNA, 62 nt, Human
ccagugugcaccacucacccaucccaguguauucaggccauggaccugacccaguuuggccc

SEQ ID NO: 224432 - RNA, 62 nt, Human
uuggcccugagaauuugggagagaacagugcaucaggccaggcucagcaauauguuugcuca

SEQ ID NO: 224433 - RNA, 62 nt, Human
cccaaccugcacggggcauuccugcuucucucucaggccaccacagagggcaggggaugguu

SEQ ID NO: 224434 - RNA, 62 nt, Human
cucucuuccuuguucugaaucauuucuucuucucaggccaaaguagccaugguaaggaggcu

SEQ ID NO: 224435 - RNA, 62 nt, Human
gguggcugcuggaaggggagagguucucagcaucaggccaccuccaccccaaugccaggaua

SEQ ID NO: 224436 - RNA, 62 nt, Human
uccccucacacacacccccccacaaggaacccucaggccacccuccacgaggugugacuaac

SEQ ID NO: 224437 - RNA, 62 nt, Human
guggaaggggagaaggaagugauccacagcauucaggccacuuggggucuagaccauggugg

SEQ ID NO: 224438 - RNA, 62 nt, Human
cagggcaggucccgucccugucugggugggccucaggccaucuggccgccuagcgagggucc

SEQ ID NO: 224439 - RNA, 62 nt, Human
cuugccucuaguucauggagaugugucucuguucaggccaagauacagccagccaggccugu

SEQ ID NO: 224440 - RNA, 62 nt, Human
agggagaaacaaacuugcaaaaaaaaaaaaucucaggccauguugggguaacccagcaaggg

SEQ ID NO: 224441 - RNA, 62 nt, Human
ucaucugggucaguuuggccauaauucuggggucaggccaggccuggguccugcccucccau

SEQ ID NO: 224442 - RNA, 62 nt, Human
uuugggggaauggaccuggcauggggauggguucaggccaggucuuuugauggccaggagua

SEQ ID NO: 224443 - RNA, 62 nt, Human
ucauguauuucucuguacauguuugaucauuaucaggccauucuguuuaaguuugaaacuaa

SEQ ID NO: 224444 - RNA, 62 nt, Human
aaugucucuggguuuuguaccagucccugcucucaggccacccugcccaggacccaggcccg

SEQ ID NO: 224445 - RNA, 62 nt, Human
aggggacccucagcccugugccccccaccacuucaggccacaccagguucccucugcaaggg

SEQ ID NO: 224446 - RNA, 62 nt, Human
cacuuuugggaggccaagacaggaggaucacuucaggccaggaguucaagaucaaccaaccu

SEQ ID NO: 224447 - RNA, 59 nt, Human
gcucccgccuggccugcugaggccucugcucaggccaggaguccagcugcugaugggca

SEQ ID NO: 224448 - RNA, 59 nt, Human
guucccgccuggccugcugaggccucugcucaggccagaaguccagcugcugccaggca

SEQ ID NO: 224449 - RNA, 62 nt, Human
uuucauucuggaugggcuuggccaaaacaggcucaggccaaagaccucccaagcuguaugua

SEQ ID NO: 224450 - RNA, 62 nt, Human
gucacucacacgguccauuaccaaucggugucucaggccacugggcccuuaguggauguuuc

SEQ ID NO: 224451 - RNA, 59 nt, Human
gcucccgcccggccugcugaggccucugcucaggccaggaguccagcugcugaugggca

SEQ ID NO: 224452 - RNA, 59 nt, Human
gcucccgccuggccugcugaggccucugcucaggccaggaguccaguugcugaugugca

SEQ ID NO: 224453 - RNA, 62 nt, Human
aggaacgcaggugcugggcugucggggaggccucaggccaccuccaggaacagaacacaguu

SEQ ID NO: 224454 - RNA, 62 nt, Human
agugugaaacuuauuucacuuucacacugccuucaggccagaagcaaaccaaauuuaccagg

SEQ ID NO: 224455 - RNA, 62 nt, Human
gagcagcuaugaccgccacccagcccucccgcucaggccacagccggagccuccgcauugcc

SEQ ID NO: 224456 - RNA, 62 nt, Human
aacagagcccaggagccagggaggaaaagcagucaggccacacaccauugcucccaaaaugg

SEQ ID NO: 224457 - RNA, 62 nt, Human
uuagcugucaccugccgaggcuucugggccacucaggccagugcaccccugggcagagcccc

SEQ ID NO: 224458 - RNA, 62 nt, Human
acagugucuccacgugccuuaccccuucuccuucaggccaaguuucgcgggguguuuuauua

SEQ ID NO: 224459 - RNA, 62 nt, Human
aguucccacgugccuuucguggcagucuaaccucaggccauucucuuccccugugugccuca

SEQ ID NO: 224460 - RNA, 62 nt, Human
guggccccuuccccaugggccuccacaagcacucaggccacuggcacguugggccaggcaga

SEQ ID NO: 224461 - RNA, 62 nt, Human
cagggguugucuugggccagccucaguuuuugucaggccaugaaucccugggucuugagggu

SEQ ID NO: 224462 - RNA, 62 nt, Human
uaccccuucauagcugcauuuaaaaaugguguucaggccacuauggcugcugugguuugaau

SEQ ID NO: 224463 - RNA, 62 nt, Human
uccuuauguguagugucccuggcaggcauuugucaggccauauguuuuaaccuuaugguaau

SEQ ID NO: 224464 - RNA, 62 nt, Human
aaaccaugaaaaguuuucaagcauugcuaaagucaggccauucagucuaugcugugugcaga

SEQ ID NO: 224465 - RNA, 62 nt, Human
acacagcagcgcagccgagccccaggagcccgucaggccacagccccuggcacugcaggugg

SEQ ID NO: 224466 - RNA, 62 nt, Human
cauuccgaauucauuguuucauagagcuaugaucaggccauuucugcaagcaauguaugacc

SEQ ID NO: 224467 - RNA, 62 nt, Human
acauggagcugcuuucuggggaacaguaagguucaggccacuauuuaggggacugagaaagc

SEQ ID NO: 224468 - RNA, 62 nt, Human
ggauuaagcuuuguugugauugugaccaacauucaggccacgugagcacugucuuaucacau

SEQ ID NO: 224469 - RNA, 62 nt, Human
gggccccacagccacggggucccuucccugggucaggccacuaggcggggcgugcauguugc

SEQ ID NO: 224470 - RNA, 62 nt, Human
agccaccuacauccagccccaaaacuggggcuucaggccagagcauccauggccaauuucaa

SEQ ID NO: 224471 - RNA, 62 nt, Human
agcauuccaucccagccagagcacccccaccaucaggccagucaacugcacaauacacaacu

SEQ ID NO: 224472 - RNA, 62 nt, Human
ugaauuccuuaccugcuauucuuguacuugucucaggccaaaucuaugcugugguucuuaug

SEQ ID NO: 224473 - RNA, 62 nt, Human
caucuacuccucuacuccaaauuucucauucuucaggccaggaaaccgagacacagagguaa

SEQ ID NO: 224474 - RNA, 62 nt, Human
auaaagaauggugggaggccugauuuuaaacuucaggccagaacccccaaugacuccaccca

SEQ ID NO: 224475 - RNA, 62 nt, Human
gugugucuaucuuugcuagcagcuuguauaccucaggccaggugagcuccccaaauuucuuu

SEQ ID NO: 224476 - RNA, 62 nt, Human
gcuaaaaaucaggcuaaaaaucaggccaaaaaucaggccaaaugacuuggcaaauaauugac

SEQ ID NO: 224477 - RNA, 62 nt, Human
gggaagaguccugcuaaaaaucaggcuaaaaaucaggccaaaaaucaggccaaaugacuugg

SEQ ID NO: 224478 - RNA, 62 nt, Human
aggccaccagcagcagcugugcagcauggaacucaggccaggcuccgaggcugggggaucug

SEQ ID NO: 224479 - RNA, 62 nt, Human
gccuuuggaguccugucccuggauacagaugcucaggccacccaccuagcacuccucucauu

SEQ ID NO: 224480 - RNA, 62 nt, Human
accaaaugaauuuuuuuuauccuccugacucuucaggccagguagcagcaaauagcaaauga

SEQ ID NO: 224481 - RNA, 55 nt, Human
uucugcaucucuacucuuaagagacucaggccaagaaacgucuucuaaacuuccc

SEQ ID NO: 224482 - RNA, 64 nt, Human
agaauaucucugccuucuuaccuuaaauuaaaaagagcacuaagauaacaccuucaagagacuu

SEQ ID NO: 224483 - RNA, 64 nt, Human
uuuuuaaaagagagaaauuaucacuacaacucccgagcacuaaguagacgggguagagucagcc

SEQ ID NO: 224484 - RNA, 64 nt, Human
ugggaguggcuuuuccucugguagccacacaccugagcacuacggacagggaggcaggugccac

SEQ ID NO: 224485 - RNA, 64 nt, Human
caugcuugauuugaccacugacagccuccaccuugagcacuauucuaaggagcaaauaccuuag

SEQ ID NO: 224486 - RNA, 64 nt, Human
uagccacuuuaagaaucaugucaugaucuuaagagagcacuaaucauuucuguuugaguuccac

SEQ ID NO: 224487 - RNA, 64 nt, Human
auggaggcuuugagucccacaguguggugauacagagcacuaguugucacugccuggcuuuauu

SEQ ID NO: 224488 - RNA, 64 nt, Human
acuggauaaaaguaaacuucaaaccuuagggcgggagcacuaaaaccaaaauacauguauuauu

SEQ ID NO: 224489 - RNA, 64 nt, Human
gguuuccuucuuggaagucuuugauugacucagagagcacuauggugguggguccagcacuaug

SEQ ID NO: 224490 - RNA, 64 nt, Human
gugguuuuucagaaugcuauguaaggaccgauuugagcacuaacuauagguacucugaauauau

SEQ ID NO: 224491 - RNA, 64 nt, Human
agugcguaguacccauuagacagcuggagaugcagagcacuauggagcaauacuggcuaaugcu

SEQ ID NO: 224492 - RNA, 64 nt, Human
uggaaaggggagagccugcuggcacccaccguggaggaggaaggcaagaggggguggaggggug

SEQ ID NO: 224493 - RNA, 64 nt, Human
aacugcauaucggaggugguggaggaggaggaggaggaggaaggcaaagccccuggaaaugugc

SEQ ID NO: 224494 - RNA, 64 nt, Human
gagcauuuuaaacuuuucuacauaaauaauaaaugagcacuaaugaaaguauuuuagugaauga

SEQ ID NO: 224495 - RNA, 64 nt, Human
auccucaccacaugaugaccugcugugucccucugagcacuacccaguggcugaaaacucugca

SEQ ID NO: 224496 - RNA, 64 nt, Human
ucauucuggucuuugaaagaaauguacuacuaaagagcacuaguugugaauuuaggguguuaaa

SEQ ID NO: 224497 - RNA, 64 nt, Human
gaaaauauagcccuuguuuggauuacugcugucugagcacuagaaauuucuaauggaaagaggc

SEQ ID NO: 224498 - RNA, 64 nt, Human
aaagcacauaagcuagaagaagaaauauuucuaggagcacuaccaucuguuuucaacaugaaau

SEQ ID NO: 224499 - RNA, 64 nt, Human
gcaagaaauacaaaccuucauuccuugaaucaaggagcacuacuggauucaacugccaaaauuu

SEQ ID NO: 224500 - RNA, 64 nt, Human
uaaaaggagaaguuuaacuuugcuauuuauuuucgagcacuaggaaaacuauuccaguaauuuu

SEQ ID NO: 224501 - RNA, 64 nt, Human
auaacaaccuuuuagcaguaagugucaagugagugagcacuaugauuaucaaggugacuuugga

SEQ ID NO: 224502 - RNA, 64 nt, Human
gcguagccaggugggcccaagggugccuggcagggagcacuaccccuggaccccuccugcucgc

SEQ ID NO: 224503 - RNA, 64 nt, Human
ugcaaauccuaagggaaaagcaagucccugcagugagcacuagggacagucuaauuuggggauu

SEQ ID NO: 224504 - RNA, 63 nt, Human
agggagugacgucaaccugaaagucguggugaagagcacuaacagugacuguuugaauauaau

SEQ ID NO: 224505 - RNA, 64 nt, Human
uguggaauuuuagaacaaacuauugcugacucaugagcacuauaauaaccaucaggaagcuccc

SEQ ID NO: 224506 - RNA, 64 nt, Human
caggaacuucucuuuauauacgcuaccaauuuaugagcacuauucacugucaauuucauuucuu

SEQ ID NO: 224507 - RNA, 64 nt, Human
aaucaggagauuagggaaaacaggauggauaccugagcacuaacagcaguagacguagaccucu

SEQ ID NO: 224508 - RNA, 64 nt, Human; identical to SEQ ID NO: 167143

SEQ ID NO: 224509 - RNA, 64 nt, Human; identical to SEQ ID NO: 167184

SEQ ID NO: 224510 - RNA, 64 nt, Human
agagcuauuuauauauauuauuuuuuuuuaagaaaggaggaaaagaaaccaaaaguuuuuuuua

SEQ ID NO: 224511 - RNA, 64 nt, Human
uauuagacauucaggcuccacaauaaauuuuaaugagcacuacaaauuuagaauauauaaaaau

SEQ ID NO: 224512 - RNA, 64 nt, Human
uaugacuugaacugggcuuauaucuaauaauacagagcacuaucucuaaccucaacaguugaca

SEQ ID NO: 224513 - RNA, 64 nt, Human
ucucaucacccugcuuaucaauauucaguuugaugagcacuauuaacuaaaauaugaaacuuaa

SEQ ID NO: 224514 - RNA, 64 nt, Human
ugaaacaacaauacauuuugcacuguaguaaugggagcacuaacucuuacaacaguuagugaau

SEQ ID NO: 224515 - RNA, 64 nt, Human
uguccuguuucucaccauuggguuaaggggugccgagcacuagcuagacuuccacauaguccca

SEQ ID NO: 224516 - RNA, 64 nt, Human
ccaauuaugaaauauuuuaaugucuacuuuuagagagcacuagccaguauaugaccaugugauu

SEQ ID NO: 224517 - RNA, 64 nt, Human
aaucuagccccuucuucagggccgagagaauuuugagcacuagccgucucucggucgcuggcua

SEQ ID NO: 224518 - RNA, 64 nt, Human
uuaauuauacauuauucuacaaaugcauucuguugagcacuaaauauuuuaguugguuuuaugu

SEQ ID NO: 224519 - RNA, 64 nt, Human
aggagcuacauuaguuacauucaggcauaccccagagcacuacaauucucugagacauugucug

SEQ ID NO: 224520 - RNA, 64 nt, Human
cagcagcagagagcccugggugacuucagguggagagcacuagaagugguuuccugauaacaag

SEQ ID NO: 224521 - RNA, 64 nt, Human
acuuauauacacgcagguguaaaaguauaaaggugagcacuagacugcucuuagaagcucuaau

SEQ ID NO: 224522 - RNA, 64 nt, Human
uccacaggugugcggccgccugagcccgagccaggagcacuagagagggagggggaagagcaga

SEQ ID NO: 224523 - RNA, 64 nt, Human
agguguucaugccucccuguggcuaguacaggcugagcacuaagaugcuuagugcucagacaac

SEQ ID NO: 224524 - RNA, 64 nt, Human
uacacagaagcuucaaauuccucauguuuuaaaugagcacuagagggagguuuaucaccuuuuu

SEQ ID NO: 224525 - RNA, 64 nt, Human
gugaacauagcacacgcccuccuggcugggccucaggaggaacagccaaggagaagaauggccc

SEQ ID NO: 224526 - RNA, 64 nt, Human
gaguugccacgaacaccacuccuggaugaggaagaggaggaaaauccugacaaggcuucuaagu

SEQ ID NO: 224527 - RNA, 64 nt, Human
uuaggacagauucucagaugggaugaucuggaggaggaggaaaaagauacacucccuuggggcu

SEQ ID NO: 224528 - RNA, 64 nt, Human
aaguuacauuucuggaggugaugaagcaaggagggagcacuaggaagagaaaagcuacaauuuu

SEQ ID NO: 224529 - RNA, 64 nt, Human
auuugugaugucacuugaccccauuuauguguaggagcacuacaccauugguuuccaauacugc

SEQ ID NO: 224530 - RNA, 64 nt, Human
agccaaaauaucucccaacugacugauagacucugagcacuaauaucauagugcugugaugaug

SEQ ID NO: 224531 - RNA, 64 nt, Human
uaauaaauugggaaugggagaagggaggauauaagagcacuaaugcccucuuauuuucauagca

SEQ ID NO: 224532 - RNA, 64 nt, Human
ccccugccuccuucaccagccuggcuuuugccuggagcacuauuuguuuaguucucuuugcagg

SEQ ID NO: 224533 - RNA, 64 nt, Human
aaccgcauggaacagugcaggacggaauauagaggagcacuauuauggaugaaggacgugucuc

SEQ ID NO: 224534 - RNA, 64 nt, Human
acugcaaagugaauuuuauaaaggcaaaauacuggagcacuaaugcccaugagauugaaggcac

SEQ ID NO: 224535 - RNA, 64 nt, Human
cauccauaacaucuuaagcgggcagagguggauugagcacuauggagagauugucaucaagaac

SEQ ID NO: 224536 - RNA, 64 nt, Human
auaccuucagaaauaaggaaauaggggaaaaaaagagcacuauaaaccacauguuuucauuucu

SEQ ID NO: 224537 - RNA, 64 nt, Human
gguggcacaggagcacugagccagggaauacugagagcacuaacuaugcacuaaccuagauuuu

SEQ ID NO: 224538 - RNA, 64 nt, Human
cccagcgcaguccugcucuccugugaccuguggagagcacuaaugaucacguguguugauggaa

SEQ ID NO: 224539 - RNA, 64 nt, Human
ugagauggacauuuaaagcaccagccaucguguggagcacuaccaaggggccccucagggccuu

SEQ ID NO: 224540 - RNA, 64 nt, Human
gagaaugcacagguguuggugagggcguguggcugagcacuacaugucaaguccagagucaguu

SEQ ID NO: 224541 - RNA, 64 nt, Human
ccuaaaauagagaauguugucuuuugccgaccaggagcacuacagauugagcuuuaucgaaagc

SEQ ID NO: 224542 - RNA, 64 nt, Human
cuuuggauaaagaacuauaauuuuucucaaaagaaggaggaaaaggugucuugcuggcuugccu

SEQ ID NO: 224543 - RNA, 64 nt, Human
cuguauguccagcaaacucuugcauguggccacuaggaggaauguguaagaauguucauaguua

SEQ ID NO: 224544 - RNA, 64 nt, Human
uaaaccaaaauugagcauaguaauuacccacagaaggaggaaguggaagggacaggagcacaua

SEQ ID NO: 224545 - RNA, 64 nt, Human
guuuugccuuguuuaaaugaaaugcauguuuagugagcacuaauacaaucuuauuccagaagac

SEQ ID NO: 224546 - RNA, 64 nt, Human
auuccuugcugaguuuauagcuuaaaggccuaaggagcacuagcaacauuuggcuauauugguu

SEQ ID NO: 224547 - RNA, 64 nt, Human
ucugcuuuggggcuuaucagaacuccuuucuaaggagcacuagaaugagaaaucauguuguucg

SEQ ID NO: 224548 - RNA, 64 nt, Human
gggagcccgccuuguggauccaccacaccccaccgagcacuagaagcugcauaagcuacacagg

SEQ ID NO: 224549 - RNA, 64 nt, Human
aggugggauugccucuuggagacauggaauugaagagcacuagaaacaacuuccuggacaagga

SEQ ID NO: 224550 - RNA, 64 nt, Human
cuagggguuuucaggaggcccaacugcaauaauggagcacuagugcuuuuaugugcaauggugu

SEQ ID NO: 224551 - RNA, 64 nt, Human
gaggaagccgcuuauccuguuuucauggacagcugagcacuaaaggaauuucuaaggacauuug

SEQ ID NO: 224552 - RNA, 64 nt, Human
ccuuucugacggccccccucagagggacggcgaugagcacuaaaugcuuuuuugacuauuuucc

SEQ ID NO: 224553 - RNA, 64 nt, Human
uuugccauguugcucaggcuggucucaaacuccugagcacuagcaauccacccaccucuguuuc

SEQ ID NO: 224554 - RNA, 64 nt, Human
uacuguagagugccaauuacuguacaaacugggugagcacuacugcaucauuguucagcuauca

SEQ ID NO: 224555 - RNA, 64 nt, Human
gggcccacggaccccugggaagaggccccgccuggagcacuaggcccccacccugcugcugccu

SEQ ID NO: 224556 - RNA, 64 nt, Human
uucuuuuuaaaaacaauuuuauaaacaaaucaaggagcacuagagcuuuagugucuacaugagu

SEQ ID NO: 224557 - RNA, 64 nt, Human
ggugcgagaacauggcgccuccagggggcgggaggagcacuaggggcuggggcaggaggcuccu

SEQ ID NO: 224558 - RNA, 64 nt, Human
gguuaccuucaggacagugcagcugcauuuaucagagcacuauugcuaaguuuucuuuucuggc

SEQ ID NO: 224559 - RNA, 64 nt, Human
gacaaaacgcacacaucaacccacagaccuuaggaggaggaaggcgagggcggggugacuucug

SEQ ID NO: 224560 - RNA, 64 nt, Human
uuuauaauagccuaacacuaccccacccccaacuaggaggaaccucuguuuucaagagagaugc

SEQ ID NO: 224561 - RNA, 64 nt, Human
cagacacugaccuucugcugggaaagcagcccugaggaggaagaggaggcgagggaaucagaaa

SEQ ID NO: 224562 - RNA, 64 nt, Human
uuauguacucuguuggaauuugugcuagcaguuugagcacuaguucugugugccuaggaaguua

SEQ ID NO: 224563 - RNA, 64 nt, Human
uauagaggugucauaggcauuaguguaguaauuggagcacuaacucucgagccaacugccuggg

SEQ ID NO: 224564 - RNA, 64 nt, Human
ucugggagcuaggaagaggugaauuaaauuuucugagcacuaugacuucuuucuuucuaaagcc

SEQ ID NO: 224565 - RNA, 64 nt, Human
ucugauucagaaugcuuuucucagcugacauacagagcacuaaauauuuuaaggcaaguccaua

SEQ ID NO: 224566 - RNA, 64 nt, Human
uaacauuacuaacaauugcaaaaauaauacugaggagcacuacuuugcauuguuuguaguugga

SEQ ID NO: 224567 - RNA, 64 nt, Human
uucuguagccaagccagacuugacuguuucuguagagcacuaucucgggcaggccauucugugc

SEQ ID NO: 224568 - RNA, 64 nt, Human
cucuagagcauggcuugguaaccuguuugccauggagcacuagaugguccuuuucacuccucaa

SEQ ID NO: 224569 - RNA, 64 nt, Human
agacugugacuuuaacauuaauuuggaauccugugagcacuacucugaagguuuguguuuuggc

SEQ ID NO: 224570 - RNA, 64 nt, Human
uuaguaacuuuccucuuuuuauuuuuuccauauagagcacuauguaaauuuagcauaucaauua

SEQ ID NO: 224571 - RNA, 64 nt, Human
ucccagagaccaggccaggaaggcccgagauggagagcacuaaauucacggcuuucauguuuuu

SEQ ID NO: 224572 - RNA, 64 nt, Human
ugaugcauugaaauaaggaaaauuauuuaucucugagcacuaaacuuauuuuugcauauuucug

SEQ ID NO: 224573 - RNA, 64 nt, Human
ccgugaugagcguuuagugagccugcuggcugcagagcacuaugaaaucaugguacguaguccc

SEQ ID NO: 224574 - RNA, 64 nt, Human
guuugcagggcaaacauucuaugcauuugaaacugagcacuaaacugggcuagcuuucugguag

SEQ ID NO: 224575 - RNA, 64 nt, Human
uagaauucugguguuuauaagcagguaacuagcugagcacuaguugauaacuuuggaguuagug

SEQ ID NO: 224576 - RNA, 64 nt, Human; identical to SEQ ID NO: 9089

SEQ ID NO: 224577 - RNA, 64 nt, Human; identical to SEQ ID NO: 9095

SEQ ID NO: 224578 - RNA, 64 nt, Human; identical to SEQ ID NO: 9100

SEQ ID NO: 224579 - RNA, 61 nt, Human; identical to SEQ ID NO: 9105

SEQ ID NO: 224580 - RNA, 64 nt, Human
ggagaggucuugcucacagggacucuccauaugugagcacuaucuuucaggaaauuuuugcaug

SEQ ID NO: 224581 - RNA, 64 nt, Human
uuuguucuaacuucagcuucacugacacuggguugagcacuacuguauguggaggguuugguga

SEQ ID NO: 224582 - RNA, 64 nt, Human
gccaggguacaacagcccuggaaaacaguaguaggagcacuaggcuuucugggaguccauccag

SEQ ID NO: 224583 - RNA, 64 nt, Human
gccaugggccuccugugugugcgccuacaggagugagcacuaaggugugcucugaucauccacu

SEQ ID NO: 224584 - RNA, 64 nt, Human
acucaccgaccgggaccucagacgcgagggaaaggagcacuaaguggggcucgccgccugcagc

SEQ ID NO: 224585 - RNA, 64 nt, Human
ggccacgugaggcuccgcaucagcagccaggggcgagcacuaguggacaaagccagcaaaugcg

SEQ ID NO: 224586 - RNA, 64 nt, Human
aaacuuguggccauacuaauaaaauuauuaaaaggagcacuaaaggaaaacugugugccaagca

SEQ ID NO: 224587 - RNA, 64 nt, Human
guagguuuaagagaauuuuuagccaugacuuuuggagcacuauuccauugucaguuauuaauaa

SEQ ID NO: 224588 - RNA, 64 nt, Human
ucgucuguguguggugugaccaauggugugcccagagcacuacucucaaaaucacuaguguuag

SEQ ID NO: 224589 - RNA, 64 nt, Human
ggaugccgugggccgccagaucugcaccaccuucgagcacuauguggagcucagcaacaaggcu

SEQ ID NO: 224590 - RNA, 64 nt, Human
ugcuucagucucccaaguagcuuggauuacaggugagcacuaccacgcccggcuaauuuuugua

SEQ ID NO: 224591 - RNA, 64 nt, Human
gagcugcaaauugccugcaaaaaugaaauccagugagcacuagaauauuuaaaacaucauuacu

SEQ ID NO: 224592 - RNA, 64 nt, Human
caaaacuacauuuuaaagggaauguguaugugaagagcacuaccaacaucgcuuuuguuuuguu

SEQ ID NO: 224593 - RNA, 64 nt, Human
uggauuuaaaacuuuuuuggaagugagagaccaggagcacuacagagaauuuccagaggcaaau

SEQ ID NO: 224594 - RNA, 64 nt, Human; identical to SEQ ID NO: 9110

SEQ ID NO: 224595 - RNA, 64 nt, Human; identical to SEQ ID NO: 9116

SEQ ID NO: 224596 - RNA, 64 nt, Human; identical to SEQ ID NO: 9122

SEQ ID NO: 224597 - RNA, 64 nt, Human; identical to SEQ ID NO: 9127

SEQ ID NO: 224598 - RNA, 64 nt, Human
ucagaaaagaaacauuucaguaauuuauaauaaagagcacuauuuuuuaaugaaaaacaugacu

SEQ ID NO: 224599 - RNA, 64 nt, Human
aaagcguuucugugacuucagguaccagcuuaaagagcacuagggauggggaacgaaugccaaa

SEQ ID NO: 224600 - RNA, 64 nt, Human
gggcaguaacuucugggcugugguuguaaacugugagcacuacaaaauguuuuuccuuauugau

SEQ ID NO: 224601 - RNA, 64 nt, Human
caucaagcuguccggcucucugguggccaagcuggagcacuacgacuugcaggccacccauucc

SEQ ID NO: 224602 - RNA, 64 nt, Human
gccuggagcaccuuuccuucaagccagcaacacagagcacuagguucaauucccugaagguggc

SEQ ID NO: 224603 - RNA, 64 nt, Human
ccaggaggaucugcgcacggugcacagcccaccagagcacuacagccuuuuauugaguggggca

SEQ ID NO: 224604 - RNA, 64 nt, Human
uuaccaaaaguuacuguagcuuaaaagguuuugugagcacuaacuauuggcagaaacugcauuu

SEQ ID NO: 224605 - RNA, 64 nt, Human
cagggaagcuauuagaaacucaggugacuuguuagagcacuaacuuggucagagccaaauccug

SEQ ID NO: 224606 - RNA, 64 nt, Human
cccccaacucccaacacacacucccuuucauuccgagcacuaaauagguagcuuacuugacaag

SEQ ID NO: 224607 - RNA, 64 nt, Human
uuaauaaaucauuaauaguuaaaauguuuacauugagcacuagaacauguuuggccuuuuuuuu

SEQ ID NO: 224608 - RNA, 64 nt, Human
gggucccuuuugcauugccaagugccauaaccaugagcacuacucuaccaugguucugccuccu

SEQ ID NO: 224609 - RNA, 64 nt, Human
acaucauugcuuaauauuucaaaaauagguauuagagcacuaucagugguccaaaauuaguuuu

SEQ ID NO: 224610 - RNA, 64 nt, Human
gaguuaacugugcuuucuucuccuggcccugacagagcacuacagcaucaaaguaaaucuuugg

SEQ ID NO: 224611 - RNA, 64 nt, Human
guugcuuguccauggccaacaccagaaauccccugagcacuaccugggucucauuccaagaagg

SEQ ID NO: 224612 - RNA, 64 nt, Human; identical to SEQ ID NO: 9133

SEQ ID NO: 224613 - RNA, 64 nt, Human; identical to SEQ ID NO: 9139

SEQ ID NO: 224614 - RNA, 64 nt, Human; identical to SEQ ID NO: 9144

SEQ ID NO: 224615 - RNA, 64 nt, Human; identical to SEQ ID NO: 9149

SEQ ID NO: 224616 - RNA, 64 nt, Human
ccuggaucgccuucuucaccacggccagcgucuacgacggcaaguaccugccugcggccaacau

SEQ ID NO: 224617 - RNA, 64 nt, Human
gaaaggaaaauaaacucuuuguaugauauuuauuaggaggaaagaggacugaaaauguucuugu

SEQ ID NO: 224618 - RNA, 64 nt, Human
uaguuguuaucucuguagggcucaggaagcuggaaggaggaagggaggguaaguggccugguga

SEQ ID NO: 224619 - RNA, 64 nt, Human
acaccugcuucuaaugagaaaugaagucagugcaaggaggaaugagagguggggaggggagauu

SEQ ID NO: 224620 - RNA, 64 nt, Human
uuugucagaacccuuaaaggugggugacguuuucaggaggaaccugggauguccugaugcucaa

SEQ ID NO: 224621 - RNA, 64 nt, Human
gagcaggaggaggaagaggaggaggaggaggaggaggaggaaggcgaggacaguggcacuucag

SEQ ID NO: 224622 - RNA, 64 nt, Human
cugcagagccuggaagaggaggaggaugagcaggaggaggaagaggaggaggaggaggaggagg

SEQ ID NO: 224623 - RNA, 64 nt, Human
ucgcugagcccugcaaggcagaaaugacagugcaaggaggaaaugcagggaaacucccgagguc

SEQ ID NO: 224624 - RNA, 64 nt, Human
aaucaugacucacaaagauaugaggcugggugugguggcucacgccuguaaucccagcucuuug

SEQ ID NO: 224625 - RNA, 64 nt, Human
uuuuuacuuauaauaccaauuuaggcugggcgcaguggcucacgccuguaaucccagcacuuug

SEQ ID NO: 224626 - RNA, 64 nt, Human
aaaaaaaaacaaaaaccaguuuaggcuggguaugguggcucaccagcacuuugggaggcugagg

SEQ ID NO: 224627 - RNA, 64 nt, Human
cagaauuuuggaagagcaaauggggcugagugcaguggcucaugccuguaaucccagcacuuag

SEQ ID NO: 224628 - RNA, 64 nt, Human
agccuauuaaaaaaugcuguccaggccaggcacaguggcucacaccuguaaucccaggacuucg

SEQ ID NO: 224629 - RNA, 64 nt, Human
ugguuaacuauuaaauguugaccuagccagcgcaguggcucaugccuguaaucccagcacuuug

SEQ ID NO: 224630 - RNA, 64 nt, Human
uuaagaaacuaugacuuguaguaagccgggcgcgguggcucacgccuguaaucccaacacuuug

SEQ ID NO: 224631 - RNA, 64 nt, Human
ucuucauaaaaaauguuaacgugggcugggcaugguggcucaugccuguaaucccagcacucug

SEQ ID NO: 224632 - RNA, 64 nt, Human; identical to SEQ ID NO: 9154

SEQ ID NO: 224633 - RNA, 64 nt, Human; identical to SEQ ID NO: 9158

SEQ ID NO: 224634 - RNA, 64 nt, Human; identical to SEQ ID NO: 9163

SEQ ID NO: 224635 - RNA, 64 nt, Human
uccuaguccucaacuccagccaccugccccagcucgacggcacugggccaguucccccucugcu

SEQ ID NO: 224636 - RNA, 64 nt, Human
ugcccaagacucaccucccuuccccucugcaggccgacggcaggaggacagucgggugauggug

SEQ ID NO: 224637 - RNA, 64 nt, Human
gaacacuuggauuccaucucuucucugaggagcucgacggcauaaaucagaagcaagcacagag

SEQ ID NO: 224638 - RNA, 64 nt, Human
cagcauuuaugaauggggugaauggggcuauugucgacggcacagcuaaugcccgaacccagcc

SEQ ID NO: 224639 - RNA, 64 nt, Human
ugggcucuuucuuuacagagguggggaccucaggcgacggcagcugggugagauucagcucaca

SEQ ID NO: 224640 - RNA, 64 nt, Human
gggugcccgcgauggcccucaugaagccaugccucgacggcauucaggaagcccugcaaacgug

SEQ ID NO: 224641 - RNA, 64 nt, Human
cuucaccucuaaaacacuaaaguguuuccguuuccgacggcacuguuucaugucuguggucugc

SEQ ID NO: 224642 - RNA, 64 nt, Human
guuguucccuuugcucgggaugcccacuucacgucgacggcauucauugguaguacuucuugcu

SEQ ID NO: 224643 - RNA, 64 nt, Human
ccgcgcccgggaacccugacgcucagcucccgcccgacggcagcgccgccgccgcccagaaucc

SEQ ID NO: 224644 - RNA, 64 nt, Human
caggcaccucuguuuccugcuguuuauugacagccgacggcagcgccuugcccagaccuccccu

SEQ ID NO: 224645 - RNA, 64 nt, Human
caugccucaaggauacagggagccggcggccucucgacggcacgcacuugccuguuggcugcug

SEQ ID NO: 224646 - RNA, 64 nt, Human
cuuuugguaauccauaaaauggauucugagacugcgacggcaaggcuguccugucccccaggca

SEQ ID NO: 224647 - RNA, 64 nt, Human
ucacccugcccugccccuggccagaggguacugccgacggcacuuugcacucugaugaccucaa

SEQ ID NO: 224648 - RNA, 64 nt, Human
cacucggccggcgcggcggccacuccccccgccucgacggcaccacuggccggccccgcgaaag

SEQ ID NO: 224649 - RNA, 64 nt, Human
ccuccccgggguggcguggggcuggggcacccuccgacggcagagccuccuucagaaagugcag

SEQ ID NO: 224650 - RNA, 64 nt, Human
cugugaaauccuaacgccccuguguccuacagaccgacggcacaacagacagcugcccauccca

SEQ ID NO: 224651 - RNA, 64 nt, Human; identical to SEQ ID NO: 9168

SEQ ID NO: 224652 - RNA, 64 nt, Human; identical to SEQ ID NO: 9173

SEQ ID NO: 224653 - RNA, 64 nt, Human; identical to SEQ ID NO: 9176

SEQ ID NO: 224654 - RNA, 64 nt, Human
cagccugugggacucuaggaugcuucagaagaagcgacggcaccgucaacccucuguuuuuuaa

SEQ ID NO: 224655 - RNA, 56 nt, Human
uaauauacuuucaguauugaaacucacgacggcaccacuaggccagaggcguggcu

SEQ ID NO: 224656 - RNA, 64 nt, Human
auccuuaauucccuccugcccauaucccuacaggcgacggcagacagugcaauggcccuccugc

SEQ ID NO: 224657 - RNA, 58 nt, Human; identical to SEQ ID NO: 167130

SEQ ID NO: 224658 - RNA, 64 nt, Human; identical to SEQ ID NO: 167131

SEQ ID NO: 224659 - RNA, 64 nt, Human; identical to SEQ ID NO: 167132

SEQ ID NO: 224660 - RNA, 64 nt, Human; identical to SEQ ID NO: 167133

SEQ ID NO: 224661 - RNA, 64 nt, Human; identical to SEQ ID NO: 167134

SEQ ID NO: 224662 - RNA, 64 nt, Human; identical to SEQ ID NO: 167135

SEQ ID NO: 224663 - RNA, 64 nt, Human; identical to SEQ ID NO: 167136

SEQ ID NO: 224664 - RNA, 64 nt, Human; identical to SEQ ID NO: 167137

SEQ ID NO: 224665 - RNA, 64 nt, Human; identical to SEQ ID NO: 167138

SEQ ID NO: 224666 - RNA, 64 nt, Human; identical to SEQ ID NO: 167139

SEQ ID NO: 224667 - RNA, 64 nt, Human; identical to SEQ ID NO: 167140

SEQ ID NO: 224668 - RNA, 64 nt, Human; identical to SEQ ID NO: 167141

SEQ ID NO: 224669 - RNA, 64 nt, Human; identical to SEQ ID NO: 167142

SEQ ID NO: 224670 - RNA, 64 nt, Human; identical to SEQ ID NO: 167146

SEQ ID NO: 224671 - RNA, 64 nt, Human; identical to SEQ ID NO: 167147

SEQ ID NO: 224672 - RNA, 64 nt, Human; identical to SEQ ID NO: 167148

SEQ ID NO: 224673 - RNA, 64 nt, Human; identical to SEQ ID NO: 167149

SEQ ID NO: 224674 - RNA, 64 nt, Human; identical to SEQ ID NO: 167150

SEQ ID NO: 224675 - RNA, 64 nt, Human; identical to SEQ ID NO: 167151

SEQ ID NO: 224676 - RNA, 64 nt, Human; identical to SEQ ID NO: 167152

SEQ ID NO: 224677 - RNA, 64 nt, Human; identical to SEQ ID NO: 167153

SEQ ID NO: 224678 - RNA, 64 nt, Human; identical to SEQ ID NO: 167154

SEQ ID NO: 224679 - RNA, 64 nt, Human; identical to SEQ ID NO: 167155

SEQ ID NO: 224680 - RNA, 64 nt, Human; identical to SEQ ID NO: 167156

SEQ ID NO: 224681 - RNA, 64 nt, Human; identical to SEQ ID NO: 167157

SEQ ID NO: 224682 - RNA, 64 nt, Human; identical to SEQ ID NO: 167158

SEQ ID NO: 224683 - RNA, 64 nt, Human; identical to SEQ ID NO: 167159

SEQ ID NO: 224684 - RNA, 64 nt, Human; identical to SEQ ID NO: 167160

SEQ ID NO: 224685 - RNA, 64 nt, Human; identical to SEQ ID NO: 167161

SEQ ID NO: 224686 - RNA, 64 nt, Human; identical to SEQ ID NO: 167162

SEQ ID NO: 224687 - RNA, 64 nt, Human; identical to SEQ ID NO: 9181

SEQ ID NO: 224688 - RNA, 64 nt, Human; identical to SEQ ID NO: 9186

SEQ ID NO: 224689 - RNA, 64 nt, Human; identical to SEQ ID NO: 9191

SEQ ID NO: 224690 - RNA, 64 nt, Human; identical to SEQ ID NO: 167163

SEQ ID NO: 224691 - RNA, 64 nt, Human; identical to SEQ ID NO: 167164

SEQ ID NO: 224692 - RNA, 64 nt, Human; identical to SEQ ID NO: 167165

SEQ ID NO: 224693 - RNA, 64 nt, Human; identical to SEQ ID NO: 167166

SEQ ID NO: 224694 - RNA, 64 nt, Human; identical to SEQ ID NO: 167167

SEQ ID NO: 224695 - RNA, 64 nt, Human; identical to SEQ ID NO: 167168

SEQ ID NO: 224696 - RNA, 64 nt, Human; identical to SEQ ID NO: 167169

SEQ ID NO: 224697 - RNA, 64 nt, Human; identical to SEQ ID NO: 167170

SEQ ID NO: 224698 - RNA, 64 nt, Human; identical to SEQ ID NO: 167171

SEQ ID NO: 224699 - RNA, 64 nt, Human; identical to SEQ ID NO: 167172

SEQ ID NO: 224700 - RNA, 64 nt, Human; identical to SEQ ID NO: 167173

SEQ ID NO: 224701 - RNA, 64 nt, Human; identical to SEQ ID NO: 167174

SEQ ID NO: 224702 - RNA, 64 nt, Human; identical to SEQ ID NO: 167175

SEQ ID NO: 224703 - RNA, 64 nt, Human; identical to SEQ ID NO: 167176

SEQ ID NO: 224704 - RNA, 64 nt, Human; identical to SEQ ID NO: 167177

SEQ ID NO: 224705 - RNA, 64 nt, Human; identical to SEQ ID NO: 167178

SEQ ID NO: 224706 - RNA, 64 nt, Human; identical to SEQ ID NO: 167179

SEQ ID NO: 224707 - RNA, 64 nt, Human; identical to SEQ ID NO: 167181

SEQ ID NO: 224708 - RNA, 64 nt, Human; identical to SEQ ID NO: 167182

SEQ ID NO: 224709 - RNA, 64 nt, Human; identical to SEQ ID NO: 167183

SEQ ID NO: 224710 - RNA, 64 nt, Human; identical to SEQ ID NO: 167191

SEQ ID NO: 224711 - RNA, 64 nt, Human; identical to SEQ ID NO: 167192

SEQ ID NO: 224712 - RNA, 64 nt, Human; identical to SEQ ID NO: 167193

SEQ ID NO: 224713 - RNA, 64 nt, Human; identical to SEQ ID NO: 167194

SEQ ID NO: 224714 - RNA, 64 nt, Human; identical to SEQ ID NO: 167195

SEQ ID NO: 224715 - RNA, 64 nt, Human; identical to SEQ ID NO: 167196

SEQ ID NO: 224716 - RNA, 64 nt, Human; identical to SEQ ID NO: 167197

SEQ ID NO: 224717 - RNA, 64 nt, Human; identical to SEQ ID NO: 167198

SEQ ID NO: 224718 - RNA, 64 nt, Human; identical to SEQ ID NO: 167199

SEQ ID NO: 224719 - RNA, 64 nt, Human; identical to SEQ ID NO: 167200

SEQ ID NO: 224720 - RNA, 64 nt, Human; identical to SEQ ID NO: 167201

SEQ ID NO: 224721 - RNA, 64 nt, Human; identical to SEQ ID NO: 167202

SEQ ID NO: 224722 - RNA, 64 nt, Human; identical to SEQ ID NO: 167203

SEQ ID NO: 224723 - RNA, 64 nt, Human; identical to SEQ ID NO: 167204

SEQ ID NO: 224724 - RNA, 64 nt, Human; identical to SEQ ID NO: 167205

SEQ ID NO: 224725 - RNA, 64 nt, Human; identical to SEQ ID NO: 167206

SEQ ID NO: 224726 - RNA, 64 nt, Human; identical to SEQ ID NO: 167207

SEQ ID NO: 224727 - RNA, 64 nt, Human; identical to SEQ ID NO: 167208

SEQ ID NO: 224728 - RNA, 64 nt, Human; identical to SEQ ID NO: 167209

SEQ ID NO: 224729 - RNA, 64 nt, Human; identical to SEQ ID NO: 9194

SEQ ID NO: 224730 - RNA, 64 nt, Human; identical to SEQ ID NO: 167210

SEQ ID NO: 224731 - RNA, 64 nt, Human; identical to SEQ ID NO: 167211

SEQ ID NO: 224732 - RNA, 64 nt, Human; identical to SEQ ID NO: 167212

SEQ ID NO: 224733 - RNA, 64 nt, Human; identical to SEQ ID NO: 167213

SEQ ID NO: 224734 - RNA, 64 nt, Human
uggguuacuugcguuugaaggcagcaguggucucaggaggaagaaacgggggcgggagagagug

SEQ ID NO: 224735 - RNA, 64 nt, Human
agcuccuaccccuccacggugggugcggaggcucaggaggaauuccugcggguccucggcucca

SEQ ID NO: 224736 - RNA, 64 nt, Human
aucuucuguuggaucacgggaaaucaagacacccaggaggaauugaaagaggcuuccucuucuc

SEQ ID NO: 224737 - RNA, 64 nt, Human
cuccaucugguguggaaacacugcccagggagaaaggaggaagcucacuguggacagucuucuu

SEQ ID NO: 224738 - RNA, 64 nt, Human
ucccagcuucgcuccuuaucacugcauugugaagaggaggaaaagugaaucacggagagagaaa

SEQ ID NO: 224739 - RNA, 64 nt, Human
gagaugggcgcucccgacacagcgcagacccaccaggaggaaagaggcccagcucucagcugac

SEQ ID NO: 224740 - RNA, 64 nt, Human
guuagcugcgggcugcccugugggcuggugcuucaggaggaauccagagaaguguucagaugcc

SEQ ID NO: 224741 - RNA, 64 nt, Human
ccacuccaggacuguugaugaaagggacagauugaggaggaagugggcucugaggcugcagggc

SEQ ID NO: 224742 - RNA, 64 nt, Human
gggauuggaguggggcucccagucugaaagaucuaggaggaacugggaucaaagcuacaaaguc

SEQ ID NO: 224743 - RNA, 64 nt, Human
uaacaagagauuuaaguuuuaagggcauuuaaucaggaggaaagguuuggaaaacuaacucagg

SEQ ID NO: 224744 - RNA, 64 nt, Human
uagcauagauggcaacugauucccaguuuaagauaggaggaaggagagcaauuucuaaguuuca

SEQ ID NO: 224745 - RNA, 64 nt, Human
uuagguggggaaaaaaugaaaaagcagggacaacaggaggaaaugaaggcagagaaauauaguu

SEQ ID NO: 224746 - RNA, 64 nt, Human
cuaucagaaauagauuuccuuccaguggaaagaaaggaggaagggagaauugagaaaauauauu

SEQ ID NO: 224747 - RNA, 64 nt, Human
guuuguuuguuuaagauuuuggggaagagauuugaggaggaaagaaaggagauggggugagagg

SEQ ID NO: 224748 - RNA, 64 nt, Human
cccugggaggaagggggagucauuuauauucugcaggaggaaggggccccagcugucgccuuuc

SEQ ID NO: 224749 - RNA, 64 nt, Human
caguauuccuacuuauaguuggugagcaugagggaggaggaaucauggcuaccuucuccuggcc

SEQ ID NO: 224750 - RNA, 64 nt, Human
cagaagacaugaucauuagccauaagaaacucaaaggaggaagacauaauuagggaaagaaguc

SEQ ID NO: 224751 - RNA, 64 nt, Human
gcugucagccuugcccacugugacuucaaacccaaggaggaacucuugaucaagaugccgaacc

SEQ ID NO: 224752 - RNA, 64 nt, Human
ccggauggggagagucaacaggaaaaaaggagggaggaggaaaagccacaagagacauucugua

SEQ ID NO: 224753 - RNA, 64 nt, Human
agaacugcagagccuucagccucuccaaacauguaggaggaaaugaggaaaucgcuguguuguu

SEQ ID NO: 224754 - RNA, 64 nt, Human
cagccacugccaauccugccuuacucaggaaggcaggaggaaagagacugccucuccagagcaa

SEQ ID NO: 224755 - RNA, 64 nt, Human
agagaaaucaggaggguaguuagagguauaaaacaggaggaaauauuauggaaaaugaaaauag

SEQ ID NO: 224756 - RNA, 64 nt, Human
guaaaagaugaaaauguugaguuugacucugaugaggaggaaccaccugaucuccccuuggacu

SEQ ID NO: 224757 - RNA, 64 nt, Human
ucccaggccaccaaggacggcaagaaggacaagaaggaggaagacaagaagugagacuggaggg

SEQ ID NO: 224758 - RNA, 64 nt, Human
auuuccuaagcagguuguauagggagccgguggcaggaggaaggcuguuuucacaaaugacuug

SEQ ID NO: 224759 - RNA, 64 nt, Human
aggccuugguggacagaggauggggaaaggggucaggaggaaaaagcuugcauuucuguguguu

SEQ ID NO: 224760 - RNA, 64 nt, Human
acuuuguuuagcccaaaaccaagucaagugaaaaaggaggaagagaaaaaauauuuuccugcca

SEQ ID NO: 224761 - RNA, 64 nt, Human
acuuggauaggcaguagauauuuuugcccaccugaggaggaacucagucaagcuguugcuuaac

SEQ ID NO: 224762 - RNA, 64 nt, Human
caaacaaagcaggcuguuugcucacuucuucaaaaggaggaaugauaacccaaaucugcccaag

SEQ ID NO: 224763 - RNA, 64 nt, Human
ucaacuuacucuguugcuggcuuuagcagagaauaggaggaaccauaugaaaaagaucaggcuu

SEQ ID NO: 224764 - RNA, 64 nt, Human
agacagggaccccuucuacugaaccuuugaggaaaggaggaaggaagaaaugcguuuagaucuu

SEQ ID NO: 224765 - RNA, 64 nt, Human
ucuuggaauuuccagguauggggguagccccaaaaggaggaaucuccuauggccaauaagguau

SEQ ID NO: 224766 - RNA, 64 nt, Human
cccucuugaccuaccccagauauuuguguggaagaggaggaaucaccauuuacaagguggacaa

SEQ ID NO: 224767 - RNA, 64 nt, Human
agacccugacuccagcagauucuggcccagggacaggaggaagagaugccaccagggcuggucu

SEQ ID NO: 224768 - RNA, 64 nt, Human
gagggcccaaauggcagggauacccagugaugucaggaggaauaguacagacagaaggugcuaa

SEQ ID NO: 224769 - RNA, 64 nt, Human
aaaaucauuaugucauuccauaaugacugaaucaaggaggaaaauaugguguuuggaauguuag

SEQ ID NO: 224770 - RNA, 64 nt, Human
gugagacaaaggagaagaaauuacucccugcaacaggaggaauagaaaugaagcagugaguguu

SEQ ID NO: 224771 - RNA, 64 nt, Human
augauccaaaacagcccuauaagaagguuggaaaaggaggaacuauauagcagccuuugcuauu

SEQ ID NO: 224772 - RNA, 64 nt, Human
accuuuccuugaaaauauaucuucagcuuuggguaggaggaaucuugguguaugaaaucauugc

SEQ ID NO: 224773 - RNA, 64 nt, Human
uaguuaagcagagagugggcaggauauuccugauaggaggaacuacaugaauaaagggguaaga

SEQ ID NO: 224774 - RNA, 64 nt, Human
uggaggaagcuggggaaagugguuagggagggagaggaggaagacugagaaaucucugcauccc

SEQ ID NO: 224775 - RNA, 64 nt, Human
gcccucugccaaccucccugcuggcccaggugagaggaggaagaggggucuggaaagaaaccca

SEQ ID NO: 224776 - RNA, 64 nt, Human
ucaggaggcugaggcaggagaauugcuugaacccaggaggaagagguugcagugagccaagauc

SEQ ID NO: 224777 - RNA, 64 nt, Human
gccguguagacacuaaaccucaugcccuaaggacaggaggaaagacccucuguuuggagcauua

SEQ ID NO: 224778 - RNA, 64 nt, Human
aaguuggguggacauaaaugagucaagugacaacaggaggaaauagacuuagacgaaagaaagg

SEQ ID NO: 224779 - RNA, 64 nt, Human
aagugaaagaaggcaaggagguaggaagagagggaggaggaaaggaaggagagaugccucaggc

SEQ ID NO: 224780 - RNA, 64 nt, Human
acugugggggagaugccccuucuuauagcacuggaggaggaaaacaaauucuugucccccucag

SEQ ID NO: 224781 - RNA, 64 nt, Human
cuuuuuggugggaacuguuggaaauuccaggguaaggaggaagaugccuguucucccugucuga

SEQ ID NO: 224782 - RNA, 64 nt, Human
ugggguggggcagaaauauuuucugggcugggguaggaggaagguuguugcagccaucuacugc

SEQ ID NO: 224783 - RNA, 64 nt, Human
accaugaagaggagaagaugggggucuuggaggaaggaggaaaaggcaaggaggcugcaggcag

SEQ ID NO: 224784 - RNA, 64 nt, Human
cccaaaaaaaagaaaaagaaaaggaggcagaaagaggaggaagaagcuacagcaucugaaagga

SEQ ID NO: 224785 - RNA, 64 nt, Human
uagacagggcuggcucugcugccccaaccuuucaaggaggaaaccagacaccugagacaggagc

SEQ ID NO: 224786 - RNA, 64 nt, Human
ccuuccuuuuucccauuugucaaacccucuucaaaggaggaacagauaagacugggucagccua

SEQ ID NO: 224787 - RNA, 64 nt, Human
gcccuggguggugaggcucacaguacugguuuccaggaggaagagccuuugugcauuugacuga

SEQ ID NO: 224788 - RNA, 64 nt, Human
gaaacauguggauaaagggaaccaugaaaaugagaggaggaaagacauccagaucagcuguuuu

SEQ ID NO: 224789 - RNA, 64 nt, Human
cacccuucucugagccuucccaccugcgggguggaggaggaacuucccaagugcuuuuaaaaau

SEQ ID NO: 224790 - RNA, 64 nt, Human
acuuccagagguggucuuauggagauggcaagaaaggaggaaaugauuucuucagaucucaaag

SEQ ID NO: 224791 - RNA, 64 nt, Human
agcuccacccaccuggagacgaauguagccagagaggaggaaggagggaaacugaagacaccgu

SEQ ID NO: 224792 - RNA, 64 nt, Human
ugcuguugccaucagaggaggaugaccgugcuugaggaggaagaauggguucaagaucaucaua

SEQ ID NO: 224793 - RNA, 64 nt, Human
gaccugggaggagggaguguguccuuugagcaagaggaggaacuccuggugccuuucugagccu

SEQ ID NO: 224794 - RNA, 64 nt, Human
cugcaugaucaacuucaaaucugugauugcuuacaggaggaagauaagcuacuaauugaaaaug

SEQ ID NO: 224795 - RNA, 64 nt, Human
ggugucauccugugaagggacacagagaacaggcaggaggaaaggcaggagccaguccgugcag

SEQ ID NO: 224796 - RNA, 64 nt, Human
gagccggggccugacuaggaaaaguugggaguuaaggaggaaauuagcauuccuuaauguuuug

SEQ ID NO: 224797 - RNA, 64 nt, Human
aagauacuucagaagggcuguucugaaauuccuaaggaggaauucuuaggaauuccuaaggaga

SEQ ID NO: 224798 - RNA, 64 nt, Human
cugcaaagguucagacgguuucuccuuugcacccaggaggaacuuuggcugcgagaaugggggg

SEQ ID NO: 224799 - RNA, 64 nt, Human
gcaugugacagucccaguccuaugguaaugacuuaggaggaaugcagauaaaaguaccuuguaa

SEQ ID NO: 224800 - RNA, 64 nt, Human
ugccccaugaugaguuucuggccuaauugagggaaggaggaaauucauaccagcaguuuucaaa

SEQ ID NO: 224801 - RNA, 64 nt, Human
cagcuuccuucagagagcagugcuuuuggcggggaggaggaaaucccuucauacuugaacguuu

SEQ ID NO: 224802 - RNA, 64 nt, Human
uaggacagacugaauuaucauaacuuauggcaucaggaggaaacuuuaaaauaucaaggaauca

SEQ ID NO: 224803 - RNA, 64 nt, Human
cccuccaccuggggcagcagcaggaggccuggggaggaggaaaaucaggcagucggccuggagu

SEQ ID NO: 224804 - RNA, 64 nt, Human
ugggaaugaccccuaggcaaggggaugagaccgcaggaggaaauggcggggaggaggcauucuu

SEQ ID NO: 224805 - RNA, 64 nt, Human
ccgaagguauggacaggacagaaaagcgagucgcaggaggaagggagaugcagccgcacagggg

SEQ ID NO: 224806 - RNA, 63 nt, Human
agacguuuucaucccgcuaaucuugggaauaagaggaggaagcggcuggcaacugaaggcugg

SEQ ID NO: 224807 - RNA, 64 nt, Human
gacacuguacaggcccucccuccccuuggccucuaggaggaaacaguuuuuuagacuggaaaaa

SEQ ID NO: 224808 - RNA, 64 nt, Human
aaugaucuggccucaggggacaggccaccuggucaggaggaauauuuuuccugcacuuuuucuc

SEQ ID NO: 224809 - RNA, 64 nt, Human
ggcuggguggaccacugcccguccacucuucaacaggaggaacagcaugccaccauaguaacac

SEQ ID NO: 224810 - RNA, 64 nt, Human
gggaagagguuucuguaaccccugcccuggugugaggaggaaauggcucuggccuggcugccug

SEQ ID NO: 224811 - RNA, 64 nt, Human
ucagcuuugaauacacuauaaacucacuggcugaaggaggaaauuuuagaaggaagcuacuaaa

SEQ ID NO: 224812 - RNA, 64 nt, Human
aaugcgucguagaugucgcguguuggaagggagcaggaggaaggacugauacuggcaaaucagu

SEQ ID NO: 224813 - RNA, 64 nt, Human
gcaguaguugauguugugugcuguaaaggauuuuaggaggaauuugaaacaggauauuuaagag

SEQ ID NO: 224814 - RNA, 64 nt, Human
aauuuuggagcaguuccccaacaaaagaagcuacaggaggaacuuucugacuuaucagcaaugg

SEQ ID NO: 224815 - RNA, 64 nt, Human
caaaaacuugggcuuucuaaucagaauuuccaggaggaggaaagugugugcugaauauuuuaaa

SEQ ID NO: 224816 - RNA, 64 nt, Human
aucaggaucugaguuauuuugcuaaacuugggggaggaggaacaaauaaauggagucuuuauug

SEQ ID NO: 224817 - RNA, 64 nt, Human
cuuaacuuagggaugaacagacuauaacuaggaaaggaggaaagguaucagggauuuuuaaguc

SEQ ID NO: 224818 - RNA, 64 nt, Human
gucuucuugugcugccuuugggcuuccauggagcaggaggaacauaccacagaacauggaucua

SEQ ID NO: 224819 - RNA, 64 nt, Human
auacauaucauguacaguuuuauuuuauaacgugaggaggaaaaacagucuuuggauuaacccu

SEQ ID NO: 224820 - RNA, 64 nt, Human
ucuggagauuucuagaguggaucucuuaugaaugaggaggaauguggaaaguuucacauuuagu

SEQ ID NO: 224821 - RNA, 64 nt, Human
ggcuuugaucucuuccaaccugcccagucacagaaggaggaaugacucaaaugcccaaaaccaa

SEQ ID NO: 224822 - RNA, 64 nt, Human
caucuccgacgacugaggcaagagggcgccagugaggaggaagggaaggcgguucagagauguu

SEQ ID NO: 224823 - RNA, 64 nt, Human
uggccucuggccugggaaaagggcaggagccuagaggaggaaaaaggcugguggacagacccag

SEQ ID NO: 224824 - RNA, 64 nt, Human
ucucggugcccucagaaccucagccagaaaggcaaggaggaaaucagagcaggagccucauacu

SEQ ID NO: 224825 - RNA, 64 nt, Human
cuuuguuuggacauuuaaauucacucugcugaauaggaggaagcuuuucuuuuuccugggaaaa

SEQ ID NO: 224826 - RNA, 64 nt, Human
caugugccugaccagguaagaaacugaaagcaagaggaggaagauaaaugcccggagauuccaa

SEQ ID NO: 224827 - RNA, 64 nt, Human
ucccugcuucuucccuugugccucauguaugggcaggaggaaaggugggagggggagugggaau

SEQ ID NO: 224828 - RNA, 64 nt, Human
ucuuggugggugacuuggcuaccugaaaaaucuuaggaggaauagcucacaauacaauaaaucu

SEQ ID NO: 224829 - RNA, 64 nt, Human
ugaacauuagagggaaagacugaaagagaaagauaggaggaaccacaauguuucuucauuucuc

SEQ ID NO: 224830 - RNA, 64 nt, Human
cguucuuucccuucccaagucucuggggguggaaaggaggaagagauacuaguuaaagauuuua

SEQ ID NO: 224831 - RNA, 64 nt, Human
auuauagugccuccuaagggguuaauauaaaucaaggaggaaguuuauauuuaaggaagaauug

SEQ ID NO: 224832 - RNA, 64 nt, Human
guguacauuucaagaauuuggguuuuuuggagggaggaggaaacuguuuacuuuuuuccuccac

SEQ ID NO: 224833 - RNA, 64 nt, Human
gcucuggaguggguggagggagggagcuacgggcaggaggaagaauuuuguagagcugccagcg

SEQ ID NO: 224834 - RNA, 64 nt, Human
uuacaaagaauguggcaacuugcuugugccuaaaaggaggaauuggaacuagaaugugugacuc

SEQ ID NO: 224835 - RNA, 64 nt, Human
uuugccuuucauccuguaaaaguaagcauguagaaggaggaaguugugcuaaaaugccuuuguu

SEQ ID NO: 224836 - RNA, 64 nt, Human
guuaucuaaccuguuccauuccauggaaccauggaggaggaagacccucaguuauuuugucacc

SEQ ID NO: 224837 - RNA, 64 nt, Human
agauggcggugaucagcagagagauugaacuuugaggaggaagcagaaucuuugcaagaaaguc

SEQ ID NO: 224838 - RNA, 64 nt, Human
cuccuguggcuucuggaccccuccucugccccgcaggaggaaguuccacggcagguggugcguu

SEQ ID NO: 224839 - RNA, 64 nt, Human
uccagaguguucucagcuagauuugauuugguugaggaggaacuguggcccuccguaaguuauu

SEQ ID NO: 224840 - RNA, 64 nt, Human
gccucuggcuuguugcagcccuccuuuaacccaaaggaggaaaggacugcuucagaaacuccca

SEQ ID NO: 224841 - RNA, 64 nt, Human
auggucaaauuuaagaaacuguguucucaacucaaggaggaauaaaacucauaaaacaaaagcc

SEQ ID NO: 224842 - RNA, 64 nt, Human
aggaggcacagacuucggguuggauuugucagcaaggaggaaaguuauggaaacuuuggccacu

SEQ ID NO: 224843 - RNA, 64 nt, Human
uuguauuuuaguaagagauuccugagccagugucaggaggaaggcuuacacccacaguggaaag

SEQ ID NO: 224844 - RNA, 64 nt, Human
uuaaucugcuuuuugucccauuugacaagguaccaggaggaaauuuuuuaagggaucaacugua

SEQ ID NO: 224845 - RNA, 64 nt, Human
cauguacuucugcccugccuccuccuuucguuguaggaggaaucugugcucuacuuaccucuca

SEQ ID NO: 224846 - RNA, 64 nt, Human
uucagaaagugaacuugaacaugagagaagcagaaggaggaaacauaagaggaggccaaaaguu

SEQ ID NO: 224847 - RNA, 64 nt, Human
aauaccucacagagcuucaccaaaucacagauucaggaggaauuuggcuuucacacuggacuca

SEQ ID NO: 224848 - RNA, 64 nt, Human
ccagaggaucaugaagacugggcuuccaauggggaggaggaaagaugcaauaugucucuuacac

SEQ ID NO: 224849 - RNA, 64 nt, Human
uuuaauaugaaucaaagcuuauauguaaacuucaaggaggaaugguaaaauguucagcccuccu

SEQ ID NO: 224850 - RNA, 64 nt, Human
ccuggucuacuugaauuugacacaagagaaaagcaggaggaaaaggggccauucuccaaaggac

SEQ ID NO: 224851 - RNA, 64 nt, Human
gaaaauagaugugguauugcucugaggaccaggcaggaggaacucuacaaccugaguuugccuu

SEQ ID NO: 224852 - RNA, 64 nt, Human
cucacgccuguaauccuagcacuuugggaggcugaggaggaaggaucacuugagcccagaaguu

SEQ ID NO: 224853 - RNA, 64 nt, Human
aucauugcagcuucuucuuucuucugcucauaaaaggaggaacacuuuagauagagggcaaaua

SEQ ID NO: 224854 - RNA, 64 nt, Human
uuaaacagagaguuaucuuaauuuuuauugcaguaggaggaaauauauuuaaaauauuuguaga

SEQ ID NO: 224855 - RNA, 59 nt, Human
gagguaguaugagaaacuaaaagcccucaaggaggaagaauagucuuagccaguuuucc

SEQ ID NO: 224856 - RNA, 64 nt, Human
uggcuuucaaccuacaagacuuacuauuuaaauaaggaggaauauuaugugaauauacauauca

SEQ ID NO: 224857 - RNA, 64 nt, Human
uccuaacaauagagauugcuuuggugaccaugauaggaggaaacgaaacuuguaagauuggaac

SEQ ID NO: 224858 - RNA, 64 nt, Human
uaccaaagagauauugauauugaaggaauuugggaggaggaaaagaaaccuggggugaauacuu

SEQ ID NO: 224859 - RNA, 64 nt, Human
ccuuuauuccaggcccagggauguaggagggggaaggaggaaacaggaagcccagagagggcaa

SEQ ID NO: 224860 - RNA, 64 nt, Human
ggagaaguuccuuagcagggaggaggaagaggagaggaggaagcaaagaaucacaaggaaccuc

SEQ ID NO: 224861 - RNA, 64 nt, Human
acauuuguaccccuggagaaguuccuuagcagggaggaggaagaggagaggaggaagcaaagaa

SEQ ID NO: 224862 - RNA, 64 nt, Human
cccccagcccgacaccuguaaagggucggugcugaggaggaauagugaaggagggaggccucuu

SEQ ID NO: 224863 - RNA, 64 nt, Human
uguauaacuguagacacucucuaaugguucucaaaggaggaaauguagccuucagucuccucau

SEQ ID NO: 224864 - RNA, 64 nt, Human
ccuguacccugaaccucaugagccucuaagggaaaggaggaacaauuaggacguggcaaugaga

SEQ ID NO: 224865 - RNA, 64 nt, Human
gcugggaggucagcuggucaaggcagaggaggagaggaggaaaggaugggggcugaagagcaga

SEQ ID NO: 224866 - RNA, 64 nt, Human
ggugguccaggcucuggugaagcccucugagcccaggaggaagagaaagcauuguccagaggua

SEQ ID NO: 224867 - RNA, 64 nt, Human
gagcccagcacaggagcuuucucuggcagaauugaggaggaagagguggcccucugacuugaca

SEQ ID NO: 224868 - RNA, 64 nt, Human
auaaugaguauuacauuggccuugggggacagaaaggaggaaguucugacuuuucagggcuacc

SEQ ID NO: 224869 - RNA, 64 nt, Human
gagagauuaugagcaaauguauugcuucuuuuagaggaggaagcauacaaccucuuuuguguga

SEQ ID NO: 224870 - RNA, 64 nt, Human
uaauagcugccucaugacaaguacauguuauuuaaggaggaaaaaauauuaaauuuugaauuga

SEQ ID NO: 224871 - RNA, 64 nt, Human
gacgaaugauuuagguacgucaaagcaguagucaaggaggaaagggauaguccaaagacuuaac

SEQ ID NO: 224872 - RNA, 64 nt, Human
cucccaggccagugagcuuuacuugccguguaaaaggaggaaagggguggaaaaaaaccgacuu

SEQ ID NO: 224873 - RNA, 64 nt, Human
aagauaucccucaugacaguugcccuuucaaagcaggaggaagaaaaggaagaaagaaaaacug

SEQ ID NO: 224874 - RNA, 64 nt, Human
gaaaggagaauagugguugccagggacugcagggaggaggaaauggggggugggguuauuguuu

SEQ ID NO: 224875 - RNA, 64 nt, Human
cucacacguguaaucccaacacuuugggaggcugaggaggaaggauagcuugaggccaggaguu

SEQ ID NO: 224876 - RNA, 64 nt, Human
cggagcugcagacgaaggcaggggacccauggcgaggaggaauggccagcaccccaggcagucu

SEQ ID NO: 224877 - RNA, 64 nt, Human
ucagaagcacucggcuucccaauguuagagaaggaggaggaagcccauagacccccaagcccca

SEQ ID NO: 224878 - RNA, 64 nt, Human
aauaggaagcaugggugcuuagaaaguuuauuucaggaggaaaauggguucacacaaaaagcaa

SEQ ID NO: 224879 - RNA, 64 nt, Human
aaaaccucucuccucagccuuccaccuccaagagaggaggaaaaacaguugucugcugucugua

SEQ ID NO: 224880 - RNA, 59 nt, Human
gcagugacaaauccaacugaccagaagggaggaggaagcucacugguggcuguuccuga

SEQ ID NO: 224881 - RNA, 64 nt, Human
guuuguuccugaugaaaggaaaaaaauucucuccaggaggaagccuuuuuccuucuugcccuuc

SEQ ID NO: 224882 - RNA, 64 nt, Human
guuuuauucaguuccucauuuuucuaguucccacaggaggaacacaaagggcccaugaugaaag

SEQ ID NO: 224883 - RNA, 64 nt, Human
uuuacuaaauaaaugacuggggcaagcaaaauugaggaggaaauuagaaacuguuugacaaacu

SEQ ID NO: 224884 - RNA, 64 nt, Human
ccuccuuuauaaacaguaauagcuacguuugggaaggaggaaacauuuaaauuauaaaggacug

SEQ ID NO: 224885 - RNA, 64 nt, Human
ggggcuaagaaggcucagggcagacaaagucaagaggaggaaguuuuuguggacaaugaaaagu

SEQ ID NO: 224886 - RNA, 64 nt, Human
agauuuguuaaaggauacaaaguuacagcuugguaggaggaauaauuucugguguucuauacca

SEQ ID NO: 224887 - RNA, 64 nt, Human
guaccuguuuaaccauuagaaauauuucaugucaaggaggaaaacauuagggaaaacaaaaaug

SEQ ID NO: 224888 - RNA, 59 nt, Human
acaguggcaaauccaacugaccagaaggaaggaggaagcuuauugguggcuguuccuga

SEQ ID NO: 224889 - RNA, 64 nt, Human
gggagggaguccuguguguuuguggggagagggaaggaggaagucaguuauuugaguaagccuc

SEQ ID NO: 224890 - RNA, 64 nt, Human
caaaaauauaaaguuauuaauagccauuugaagaaggaggaauuuuagaagagguagagaaaau

SEQ ID NO: 224891 - RNA, 64 nt, Human
gggagucuguggccguccaggugaaucacagcugaggaggaaauccagaugagaccaaugcacu

SEQ ID NO: 224892 - RNA, 61 nt, Human
aaacaacgaaagcugaauaguguuggaacugaggaggaagccauagcucagggucaucaag

SEQ ID NO: 224893 - RNA, 64 nt, Human
uuuauaauauuuugugccuugaagggaaugucacaggaggaaaaggaagacuaaagccugcaua

SEQ ID NO: 224894 - RNA, 64 nt, Human
auacauaagcuucaaggacaauaagauguuaaaaaggaggaaauaauuauuuuuauuuugacac

SEQ ID NO: 224895 - RNA, 64 nt, Human
agguauuaagugacagauacuaaagugaauaugcaggaggaaugcugucuccgauaucucaccg

SEQ ID NO: 224896 - RNA, 64 nt, Human
aggugcuguguguaaguggagaacuuggggauagaggaggaagcuccucguggcccuuccaagg

SEQ ID NO: 224897 - RNA, 64 nt, Human
aaugaaaaaauuacccagauuggcuccauggaaaaggaggaacagcguuuccguaaaauugacu

SEQ ID NO: 224898 - RNA, 64 nt, Human
aaauaauagacuuuuuuuacaggcaaaaugaaagaggaggaagucuggguuuuaugaauagcau

SEQ ID NO: 224899 - RNA, 64 nt, Human
ugcuagaagcccauccugugccagaggaaggaaaaggaggaaauuuccuuucucuuuuaggagg

SEQ ID NO: 224900 - RNA, 64 nt, Human
ccccaucuagccauuucggaagacaccgaggaagaggaggaagaugaagaccaggacuacagcu

SEQ ID NO: 224901 - RNA, 64 nt, Human
acuggacucagaauuguagggauaauaugaaugcaggaggaaacauucugucaggcgguaugac

SEQ ID NO: 224902 - RNA, 64 nt, Human
ccucuguuuacagauaacucucuucacuauuccuaggaggaaaaagaaaugcauucgguacuua

SEQ ID NO: 224903 - RNA, 63 nt, Human
uagagaggaugaagcauuagcuugaagcacuacaggaggaaugcaccacggcagcucuccgcc

SEQ ID NO: 224904 - RNA, 64 nt, Human
cgccccagcuucugccacggcuucagucagggccaggaggaacacgugaaggagaaagagaaau

SEQ ID NO: 224905 - RNA, 64 nt, Human
ucacagguaauaaaggcaauuggaugauaucuguaggaggaaaacaaugacuaauuucuuccuu

SEQ ID NO: 224906 - RNA, 64 nt, Human
uauucaugauagcuggcccacaggucaugaauugaggaggaauuugcuuucaaaaagcaagaau

SEQ ID NO: 224907 - RNA, 64 nt, Human
acugugcgcuagacacugccaggcccgggccucgaggaggaaaagacaguagggaagacauuau

SEQ ID NO: 224908 - RNA, 64 nt, Human
uccccacuuuacagauguggauauuuaggccaaaaggaggaagugacuuguccaggggcagaca

SEQ ID NO: 224909 - RNA, 64 nt, Human
gaaaaaaugcucaggcagaacgggguacauccacaggaggaaucggacgagaggaugugacauu

SEQ ID NO: 224910 - RNA, 64 nt, Human
ugcuaagcagaagauccugcagacccuuaucuggaggaggaagagaagcaggagagagaaagcc

SEQ ID NO: 224911 - RNA, 64 nt, Human
aauaugauugauuugcauucuggaaagcucucccaggaggaagcauuccccaccccaccuugcc

SEQ ID NO: 224912 - RNA, 64 nt, Human
gcuauauacgcuguuguggggaggggggaagaaaaggaggaaccaauuaaauaggaccuuuuaa

SEQ ID NO: 224913 - RNA, 64 nt, Human
cagcuuucaagacauuucuuaaccaucagagcagaggaggaaagacucacuaccucagaaaaau

SEQ ID NO: 224914 - RNA, 64 nt, Human
caacugugugagaguguagaagggaaggcuucucaggaggaacgugacaguggauuggguggcu

SEQ ID NO: 224915 - RNA, 64 nt, Human
acgcaacagauaaugugggaaaaaaagagauaagaggaggaagcuaauaagagacugucaagau

SEQ ID NO: 224916 - RNA, 64 nt, Human
uggggacagaagggcccauguacuuguugggaggaggaggaaagggaaggcuggcagguagguc

SEQ ID NO: 224917 - RNA, 64 nt, Human
guggggagucaggggugggaggagaaggaggaagaggaggaaggccagacuggccugcccuuuc

SEQ ID NO: 224918 - RNA, 64 nt, Human
guugguuggguggggagucaggggugggaggagaaggaggaagaggaggaaggccagacuggcc

SEQ ID NO: 224919 - RNA, 64 nt, Human
cagccccugacagaaaaaggaucucugagccuaaaggaggaaaagucccaccaacuaccagacc

SEQ ID NO: 224920 - RNA, 64 nt, Human
gaacaaaguuucaaugcugcugagagugaaagaaaggaggaaagucugccacucuacccugagc

SEQ ID NO: 224921 - RNA, 64 nt, Human
uuuaaggagaccagagaccgccuacuggagagaaaggaggaaaaaagaaauaaaaauauuuuua

SEQ ID NO: 224922 - RNA, 64 nt, Human
caaggcagauccucucucccagggaauccgacacaggaggaaccccuucucugguugagcuggg

SEQ ID NO: 224923 - RNA, 64 nt, Human
uguguagccugacuucugccggagcucccaguccaggaggaaagagccaaggcccacuuuuggg

SEQ ID NO: 224924 - RNA, 64 nt, Human
gacaaagcauuuguucauuuggagcuuagaguccaggaggaauacauuagauaaugacacaauc

SEQ ID NO: 224925 - RNA, 64 nt, Human
gcuucacuccuggcucuguucagggaggcugcccaggaggaagacuggccauuaugcauccccu

SEQ ID NO: 224926 - RNA, 64 nt, Human
agcauccagcaagucaaugucaccgacagugaugaggaggaagaagaaaaagugcucagggauu

SEQ ID NO: 224927 - RNA, 64 nt, Human
auggaaaaacaaugcuuccaguggccacuuccuaaggaggaacaaccccgucugaucucagaau

SEQ ID NO: 224928 - RNA, 64 nt, Human
cuuugaaaagaccgcuguucauaaggagagagaaaggaggaagagaugagaaaggaagacagag

SEQ ID NO: 224929 - RNA, 64 nt, Human
aggaaauuuuuucuuguugugagguagggaagugaggaggaaagccaugccgaagcaaauguua

SEQ ID NO: 224930 - RNA, 64 nt, Human
cggggacccacucugcccagccggagggacgcggaggaggaagaggguagacaggggcgaccug

SEQ ID NO: 224931 - RNA, 64 nt, Human
gcauaguguuuuccauuguuggugaaaaaugucaaggaggaaagaacaauaaugauuccaucau

SEQ ID NO: 224932 - RNA, 64 nt, Human
ucuccuucacugccucaaguuacagccagaggaaaggaggaacuaaaacuuagcaaaucuauaa

SEQ ID NO: 224933 - RNA, 64 nt, Human
cgggccuuuggcgagagcuccacggaaagugaugaggaggaagaagagggcuguggucauacac

SEQ ID NO: 224934 - RNA, 64 nt, Human
aaaaaucugugagggucugacuugcucaaaccagaggaggaaacagaaaccccugcacaucuuu

SEQ ID NO: 224935 - RNA, 64 nt, Human
uccuagccacgucccuugggaccggugggacuggaggaggaacggucacccuccucccccaugg

SEQ ID NO: 224936 - RNA, 64 nt, Human
aucaggggagagccugcagcugaguucagcagaaaggaggaauccuggcccucaggaagaagau

SEQ ID NO: 224937 - RNA, 64 nt, Human
gagcaggcaagggaaacuggggagauggggauggaggaggaaggcugauauccucuggggagca

SEQ ID NO: 224938 - RNA, 64 nt, Human
uauccucuggggagcacaucaccugaaggugccaaggaggaaggcugagaggggggccacccca

SEQ ID NO: 224939 - RNA, 64 nt, Human
gaggaggugaucgaggacugguacaggaaccaccaggaggaagaccugacugaauuccucugcg

SEQ ID NO: 224940 - RNA, 64 nt, Human
acacacguugacgggccgcaggagggaggcggggaggaggaacgggcagccacaggacugagcc

SEQ ID NO: 224941 - RNA, 57 nt, Human; identical to SEQ ID NO: 199616

SEQ ID NO: 224942 - RNA, 64 nt, Human
aacuccuuccucccuagugccccaaccagucuucaggaggaagagaugcccaugaagcaggucc

SEQ ID NO: 224943 - RNA, 64 nt, Human
guguacaucaugcauuugcaaaaaucuuagcugaaggaggaauacgagggcuuugggcaggcug

SEQ ID NO: 224944 - RNA, 64 nt, Human
aacuucuaaacacaaauaaaaagaaaauauuuauaggaggaaaugauuaauuugauauucuuua

SEQ ID NO: 224945 - RNA, 64 nt, Human
ugagcagagcagguggaagaggaacuuugagcacaggaggaaaugcaaccagucagggcccaga

SEQ ID NO: 224946 - RNA, 64 nt, Human
cacgggcaggcucucccugcuccaggagaagacuaggaggaagaaugaggugcuccugccgugu

SEQ ID NO: 224947 - RNA, 64 nt, Human
gaaugucugaggccugccuccuaauaaagacucaaggaggaagucaauugggcaucugcuaaua

SEQ ID NO: 224948 - RNA, 64 nt, Human
uuaucaccaaaaagugcuucaucaggcgugcuacaggaggaaggagcuagaaauagaacaaucc

SEQ ID NO: 224949 - RNA, 64 nt, Human
ggggcagagaagugaugaagggaaauguucuuagaggaggaaauauccuuuguccuguucagag

SEQ ID NO: 224950 - RNA, 64 nt, Human
ccuuuuuccccucaugucacuacugaauuuugacaggaggaaggaauagaaugauagcuuguuu

SEQ ID NO: 224951 - RNA, 64 nt, Human
ugaaagaaaugguugcugaacccaaaacauguuuaggaggaaaaccagaagaacagagcagugg

SEQ ID NO: 224952 - RNA, 64 nt, Human
ugugugcaacauccuuauucucaucuuuaagguaaggaggaaguagagauagaaggaaauacgu

SEQ ID NO: 224953 - RNA, 64 nt, Human
agaacacgagugacaguuuguuaaaaagcuuuagaggaggaaugaaaacaaagugaaguacacu

SEQ ID NO: 224954 - RNA, 64 nt, Human
uagaugcccccgcgagacggguuagggaaagcggaggaggaaagcgaggggguggggggcuucc

SEQ ID NO: 224955 - RNA, 64 nt, Human
gacccucugcaccggaccauugagacauuugccaaggaggaaccuaaggaagauauugacgucu

SEQ ID NO: 224956 - RNA, 64 nt, Human
uucaaggacuaaccuuauuuauuugggaaaggggaggaggaaggaaaugauaugguacccagac

SEQ ID NO: 224957 - RNA, 64 nt, Human
uucuuggccaguccucuuucccgcagcugcagagaggaggaagacuauuaaaggacaguccuga

SEQ ID NO: 224958 - RNA, 64 nt, Human
agugacuguucccuucccucuguugcagggaaccaggaggaaagggaaagauguugccauauuu

SEQ ID NO: 224959 - RNA, 64 nt, Human
ugggcaguaucuuccugaugucuucuuagcuaagaggaggaaaaaaaggcugaaaaaauaggga

SEQ ID NO: 224960 - RNA, 64 nt, Human
cagauauucugggguuaaagucacaucauaugugaggaggaaaaguuuaacaugaacuaacauu

SEQ ID NO: 224961 - RNA, 64 nt, Human
augcuggugacuaaaauaagguuuacucugaaagaggaggaauuuuauucaaagcauucaaaca

SEQ ID NO: 224962 - RNA, 64 nt, Human
gaagcauccauucauugggaaaucacggggacagaggaggaauucacgggaucagagcacugag

SEQ ID NO: 224963 - RNA, 64 nt, Human
ccagccacguuuacaggaaggugugccccagaggaggaggaaucagcucccucgcuccaguggc

SEQ ID NO: 224964 - RNA, 64 nt, Human
ucuuuagagcacugaaagaaacacaaagccagccaggaggaacaguaacucuuccuucgggugg

SEQ ID NO: 224965 - RNA, 64 nt, Human
auuucucuucagaguucagaauuuucagauacuaaggaggaagaaaggauccacuacuucuugu

SEQ ID NO: 224966 - RNA, 64 nt, Human
acuaguaugugugcgugagcuggucaguugccaaaggaggaaauaagguuagaagccugaaccg

SEQ ID NO: 224967 - RNA, 64 nt, Human
uggugcuguuuacauuggaauaaaaagcucuauaaggaggaaaggccuuuaucuaauucuuauc

SEQ ID NO: 224968 - RNA, 64 nt, Human
aauagacaggagagaggugagaacuauuuuuagaaggaggaaaaguagauacgcaaauugucac

SEQ ID NO: 224969 - RNA, 64 nt, Human
cugagcaguuuuccaggaggccggggggagcaggaggaggaaagguagcccccgagggaugucc

SEQ ID NO: 224970 - RNA, 64 nt, Human
gucuccaccccaugggcccacacccaggugggggaggaggaagccacugcaucuguuggcucag

SEQ ID NO: 224971 - RNA, 64 nt, Human
auguuucucaagcaguuuuucugaguaguuucugaggaggaacaaauuacaaguguacccaaua

SEQ ID NO: 224972 - RNA, 64 nt, Human
acuggccgugaccagagagugcauuuacagaacgaggaggaagaggugaguccugggaaggaga

SEQ ID NO: 224973 - RNA, 64 nt, Human
gcccaggcaggcggccuauccugauccuuggaggaggaggaagaggaggccacuguggcccgug

SEQ ID NO: 224974 - RNA, 64 nt, Human
uugaaagguaauuugagagaaauaugaagaacugaggaggaaaaaaaaaaaaaagaaaagaacc

SEQ ID NO: 224975 - RNA, 64 nt, Human
aaagaacucucccaacccuggggccuagcuguauaggaggaauugccuaaggguggcccacucu

SEQ ID NO: 224976 - RNA, 64 nt, Human
uucauaaacacucaccuggcuggcuuugccuuccaggaggaagcuggcugaagcaagggugugg

SEQ ID NO: 224977 - RNA, 64 nt, Human
ccuccggggaugcuucgcggucuguuaucgcgucaggaggaaagaauugcuccaaaaaucugca

SEQ ID NO: 224978 - RNA, 64 nt, Human
cucuccaagcccaguucagcuuggggacaggggcaggaggaagggguaggauuacuaggugccc

SEQ ID NO: 224979 - RNA, 64 nt, Human
cugagaagcuuugaccuugaagggcuucugggagaggaggaauuucugcauggggcgugaaggc

SEQ ID NO: 224980 - RNA, 64 nt, Human
caauguaaaaaagaauaguaauaucagaacaggaaggaggaauggcuugcuggggagcccaucc

SEQ ID NO: 224981 - RNA, 64 nt, Human
acuacuuuugaaggaaguuaaaagguggcuuugaaggaggaagacaccuugagccaaggaauga

SEQ ID NO: 224982 - RNA, 64 nt, Human
uagaauagaagggcugccaaaugagguuugcugcaggaggaaaguuuaaucccccauuccaaaa

SEQ ID NO: 224983 - RNA, 64 nt, Human
gguccaguuuuccuuucacuggacaaucuugaauaggaggaacgcuguugcuguaauaugcgua

SEQ ID NO: 224984 - RNA, 64 nt, Human
ugauuuccucaguccuuuagguuaaagcagcgccaggaggaagcugacagaagcagcguuccug

SEQ ID NO: 224985 - RNA, 64 nt, Human
ccacugcgcccggcccaagagaauaggggagccaaggaggaaauguggaaacgcaguugugugg

SEQ ID NO: 224986 - RNA, 64 nt, Human
ugcgcccucucccugccccucaccccagagggugaggaggaaugaggggcauuggugguuaggc

SEQ ID NO: 224987 - RNA, 64 nt, Human
gccaggcacagguugccaagaggugacacgaaacaggaggaaacucagugaccucugccucucc

SEQ ID NO: 224988 - RNA, 64 nt, Human
gggauaaggggaaggagaagagggagaauggagcaggaggaaaagcagaguuggucuagagagg

SEQ ID NO: 224989 - RNA, 64 nt, Human
uugcuugauucuucuuccuugguaucauauucaaaggaggaaagaauggaugacacuuagggac

SEQ ID NO: 224990 - RNA, 64 nt, Human
aacaacuugaacaucauaucauauaggauaacaaaggaggaaguuaacuuaauucaccucagac

SEQ ID NO: 224991 - RNA, 64 nt, Human
cuguagugaagaggucugacaccauguguggaggaggaggaacgaucagucaagagauguccug

SEQ ID NO: 224992 - RNA, 64 nt, Human
augugauucuucuaaagcaaagucauuggaugggaggaggaagaaaaagucccauaaaggaacu

SEQ ID NO: 224993 - RNA, 64 nt, Human
uaauauauguacacccauuauguuuucagguaacaggaggaaaaaugcagcacaauuuuuuuuc

SEQ ID NO: 224994 - RNA, 64 nt, Human
uugaaagguauuauaguuuguauauuuaacaguaaggaggaaacuguaaccaaaauuaguauuu

SEQ ID NO: 224995 - RNA, 64 nt, Human
uucuaauugugaauccuucuguuuuuucuucuuaaggaggaaaguuaaaggacacuacagguca

SEQ ID NO: 224996 - RNA, 64 nt, Human
aguaagguuuaauauugccaucggguauugagacaggaggaaguuucuguuuuucuccauuuag

SEQ ID NO: 224997 - RNA, 64 nt, Human
uguaugaaccccgagccauuucccuguuguccugaggaggaacuccaggccucccaucgugugc

SEQ ID NO: 224998 - RNA, 64 nt, Human
agcauuuugaugcaggucugcaggacugaccccaaggaggaacgugggcacaagagguauauca

SEQ ID NO: 224999 - RNA, 64 nt, Human
uuuuuccacuuccuccucuuucuuuccccagcugaggaggaaccuggggcauuuagggcagagg

SEQ ID NO: 225000 - RNA, 64 nt, Human
aaaaagcaaaaauuuuggucacuuccaagcuagaaggaggaaucagauacccuuuaauauuuuu

SEQ ID NO: 225001 - RNA, 64 nt, Human
cccuguccagaccccuacagcugugucuaagcucaggaggaaagggacccucccaucauucaug

SEQ ID NO: 225002 - RNA, 64 nt, Human
aacgugugggcaagagacuuccucugguuuccucaggaggaaaugggcaaggcagaguaagcag

SEQ ID NO: 225003 - RNA, 64 nt, Human
cuugcacccgugagcgucaggaugaggaaaugacaggaggaagacguggguuuggguuaguggc

SEQ ID NO: 225004 - RNA, 64 nt, Human
aggcucaucuugagaagcaggcggguugggugggaggaggaagaaagggaagaauuagguuuga

SEQ ID NO: 225005 - RNA, 64 nt, Human
uuguugccacugagaagcaggcggguugggugggaggaggaagaaagggaagaauuagguuuga

SEQ ID NO: 225006 - RNA, 64 nt, Human
gucuggggcaucuacuggagcaccucagaagacaaggaggaaaacacuggcucauguuuucuuu

SEQ ID NO: 225007 - RNA, 64 nt, Human
ccacaaaauauuucuaagcuuauuucuaacuauuaggaggaaugugcuuuuccaucuaaaauac

SEQ ID NO: 225008 - RNA, 64 nt, Human
augacuucagcaguggcagguguuuucagcuuggaggaggaaguacugcuaucucgcauucuuc

SEQ ID NO: 225009 - RNA, 64 nt, Human
gccuugcaggggaggccuggcugcagagaggcggaggaggaagcuggcgcugggggaggcugag

SEQ ID NO: 225010 - RNA, 64 nt, Human
gaagucuuguguauuugucuguguuaaugcugucaggaggaacugacuaagauguuuuaauaug

SEQ ID NO: 225011 - RNA, 64 nt, Human
caacuaaauuuuaaugaacgaaugaaugacagagaggaggaaaaaagaugaggauugcauacau

SEQ ID NO: 225012 - RNA, 64 nt, Human
uauuuaaguggauugaauaacugagucuacauggaggaggaaaugcuagagaacagcaggucua

SEQ ID NO: 225013 - RNA, 64 nt, Human
guuggugaaaugcgcagccggcuguggacgggggaggaggaaggggacagagggagcagguagg

SEQ ID NO: 225014 - RNA, 64 nt, Human
gggacccgaggauuucugggaccccgcaguugggaggaggaaguaguccagccuuccagguggc

SEQ ID NO: 225015 - RNA, 64 nt, Human
acuguguucucccuggcauucagagaggagggagaggaggaagaggaaggggagggaagcuucc

SEQ ID NO: 225016 - RNA, 64 nt, Human
ggugguaaguuuccuccuuucucaaccuuccacgaggaggaaagaagugugcagucauuccaca

SEQ ID NO: 225017 - RNA, 64 nt, Human
uuucugacgccugccaaggacgcgacgaccagggaggaggaaucggcggacgcgggacaccuga

SEQ ID NO: 225018 - RNA, 64 nt, Human
guagauucaguuacauccaucugucaucugaagaaggaggaaaaaacccaacauuucuuggacc

SEQ ID NO: 225019 - RNA, 64 nt, Human
gcagcuccccucuguaccccaacucauuuaaaauaggaggaaucacuuuuugccuuacuuaacg

SEQ ID NO: 225020 - RNA, 64 nt, Human
auuuuauuucugaaucuagagaacaguauugggcaggaggaaaaggcuuggugucugcgggggg

SEQ ID NO: 225021 - RNA, 64 nt, Human
agcuacaugccuugauaagugcauucagagcaauaggaggaaaaggaaagcguuuuuguagccc

SEQ ID NO: 225022 - RNA, 64 nt, Human
accuccaucucagucuuggccuggcuaugaggggaggaggaaugggagagggggcucaggggcc

SEQ ID NO: 225023 - RNA, 64 nt, Human
guaucucucucuagagcgagcaagagagggagagaggaggaaaaaauacacauaauacaaacau

SEQ ID NO: 225024 - RNA, 64 nt, Human
agugaaauggaccugacagcccaaacugucagagaggaggaaagcaggcauuugauuuugguaa

SEQ ID NO: 225025 - RNA, 64 nt, Human
agacuuucuuugacacccagaagacccggcaacgaggaggaaggccucgcggugaggcagaaac

SEQ ID NO: 225026 - RNA, 64 nt, Human
ccaccaguccuugcacuguucugacacuuuccccaggaggaaaacaaguacaaagguuacggug

SEQ ID NO: 225027 - RNA, 64 nt, Human
accaguggggccuuagcaauuugaaggguugggaaggaggaauuauauuugcaaaggggcuguc

SEQ ID NO: 225028 - RNA, 64 nt, Human
ugcagccccuuccccuucccucucguggcccacaaggaggaaggaagggcaaccuaaaagccca

SEQ ID NO: 225029 - RNA, 64 nt, Human
ccagcuaccccaaugugugagcugauggauggugaggaggaaggacuuaaggacagcaugucug

SEQ ID NO: 225030 - RNA, 64 nt, Human
aaaauuuguaaaauguaauuaauauucaaagaaaaggaggaaaaucuucauuuguuggaaauga

SEQ ID NO: 225031 - RNA, 64 nt, Human
ccugaaagcuuccccgagguuugcagggucagggaggaggaacggugggggugggcagucacug

SEQ ID NO: 225032 - RNA, 64 nt, Human
acuauauaguaguauacacaagagaaaucuuugaaggaggaaacugaugacagauauacagggc

SEQ ID NO: 225033 - RNA, 64 nt, Human
cuuccuucguggaggaaguggacucgaauccuggaggaggaaauaaagggaaagggaagucgug

SEQ ID NO: 225034 - RNA, 64 nt, Human
caagagaugucucuacucaaacugugccugcaggaggaggaacagagaagccugggcugcuggg

SEQ ID NO: 225035 - RNA, 64 nt, Human
cguuuauuguauaaugcaucauuugaaaauaccaaggaggaaauacccuuuguuuuuaaugaug

SEQ ID NO: 225036 - RNA, 64 nt, Human
gcuccuaccccuuuccccaaaagucugaaaguguaggaggaaggaagagauacaaacaaggaga

SEQ ID NO: 225037 - RNA, 64 nt, Human
gcagagggagaggacaggaggaggagccuuccccaggaggaacgaggagagguggccacguggc

SEQ ID NO: 225038 - RNA, 55 nt, Human; identical to SEQ ID NO: 199712

SEQ ID NO: 225039 - RNA, 64 nt, Human
uguagcugaaauacugucuaucucuaauaaaaacaggaggaaacaagaugauggaaucuguuuu

SEQ ID NO: 225040 - RNA, 64 nt, Human
caaagagggauguuuggaaaaaacucugaaggagaggaggaauuaguugggaugccaauuuccu

SEQ ID NO: 225041 - RNA, 64 nt, Human
ugcucucagcuggcagugcaaugcuuguagaaguaggaggaaacaguucucacugggaagaagc

SEQ ID NO: 225042 - RNA, 64 nt, Human
guuccugggaacauguggcacaaguaaugggaugaggaggaauugggggugggggucuucuacc

SEQ ID NO: 225043 - RNA, 64 nt, Human
ggccaaggagauuaagaagaaaacgacuuucugcaggaggaagagcccgcugccgaaucccugg

SEQ ID NO: 225044 - RNA, 64 nt, Human
augguggcccuguucugggggagcaggguaaggcaggaggaagugggugagcuccgagaugaug

SEQ ID NO: 225045 - RNA, 64 nt, Human
gccaccgugcccaacccuaacaauuauuuuuaaaaggaggaauuuaaaugagcuguggauuauu

SEQ ID NO: 225046 - RNA, 64 nt, Human
gaaagaaaaggugcauuucaagaacuuggggggcaggaggaaagcacaauguuucuuagccagg

SEQ ID NO: 225047 - RNA, 64 nt, Human
cagaagagacccccuguguggccugaguccccucaggaggaagguggacaacagagaaaugaga

SEQ ID NO: 225048 - RNA, 64 nt, Human
uuacaaguccuaauuguuggagcucaguaaagguaggaggaagguggcugguugguccucccuu

SEQ ID NO: 225049 - RNA, 64 nt, Human
ggacagacuugaaggugucaugcccggugugugcaggaggaaacuaacaguucaguaaacucug

SEQ ID NO: 225050 - RNA, 64 nt, Human
gucaugcaccacauuugugugcagauaccaaaagaggaggaaagaagaaaaaaauuaaugugug

SEQ ID NO: 225051 - RNA, 64 nt, Human
aaaaaaaaggaaauaaaaugcacauaaauuuggaaggaggaaauacaacugucuuuguucucaa

SEQ ID NO: 225052 - RNA, 64 nt, Human
guccagcaaaucauucuucaacuacauuuuagaaaggaggaaaucuaaaauaagguaagggagg

SEQ ID NO: 225053 - RNA, 64 nt, Human
ggacugaucagaggugaagggacagagagaggagaggaggaagauugagcugggggcaacagcc

SEQ ID NO: 225054 - RNA, 64 nt, Human
aacaaggacugauucaaucugcaugccagccuggaggaggaaagggagccugcucucccucccc

SEQ ID NO: 225055 - RNA, 64 nt, Human
auggaaaagagcaugauuuuaaaaaaucaaucauaggaggaaaagaaauucgcuuuucaaguag

SEQ ID NO: 225056 - RNA, 51 nt, Human; identical to SEQ ID NO: 199730

SEQ ID NO: 225057 - RNA, 64 nt, Human
cucucaggagaagccagaggcccuggccaaagauaggaggaagaaagagaacucuccauagaau

SEQ ID NO: 225058 - RNA, 64 nt, Human
ccaagagcccuccccuuucuccaucccuccagcuaggaggaaauggagcaagaugaacaggcag

SEQ ID NO: 225059 - RNA, 64 nt, Human
auugucccucucugugcucaaggaguuccauuccaggaggaagagaucuauacccuaagcagau

SEQ ID NO: 225060 - RNA, 64 nt, Human
uuaaccuaaaugccucaugccccaguucagcaaaaggaggaaaaugugccugccucacagucau

SEQ ID NO: 225061 - RNA, 64 nt, Human
ucuucuuggaugguucugcuuagaaugagugucaaggaggaaagagagggagauggaggaugug

SEQ ID NO: 225062 - RNA, 64 nt, Human
agaaauagagaaaagagaccauguuuauuuggguaggaggaagccuugccuugcgccuuaggug

SEQ ID NO: 225063 - RNA, 64 nt, Human
ucccuuaucguaugauagaaagacauucuuccccaggaggaauguuuaaaauggaggcaacauu

SEQ ID NO: 225064 - RNA, 64 nt, Human
acauaggugguauuacuguuggucaaaaaucaugaggaggaacaguugaauccagccugaacgu

SEQ ID NO: 225065 - RNA, 64 nt, Human
gaagacugaaaaccauggagauuauuuuuauuggaggaggaagcaucauucaugaaccgaucuu

SEQ ID NO: 225066 - RNA, 64 nt, Human
aggaccuuugacuuuuucuucguugaggcuucugaggaggaaaaacaaaccuaaaauagaaaua

SEQ ID NO: 225067 - RNA, 64 nt, Human
ccucaggcuccuugcucugacgcaggccuccuggaggaggaaguggaggccgcugcguagaccc

SEQ ID NO: 225068 - RNA, 64 nt, Human
gacggacuggaaggacuucuugcuggugaagagcaggaggaacaucaccauggugucauauccu

SEQ ID NO: 225069 - RNA, 64 nt, Human
cuguaugaccuuaacaaggacggcugcaucaccaaggaggaaaugcuugacaucaugaagucca

SEQ ID NO: 225070 - RNA, 64 nt, Human
gggucccuggacuggggguugguguuuucuauagaggaggaaaggcccucccucacccugcucc

SEQ ID NO: 225071 - RNA, 64 nt, Human
cuuugggcuggacgggaacacacguguguggcucaggaggaaaagcucagccuggacuguggca

SEQ ID NO: 225072 - RNA, 64 nt, Human
ccaggcuuuggggaccauugccaaagguggacucaggaggaaagacacuuaaagacacuuuuac

SEQ ID NO: 225073 - RNA, 64 nt, Human
aaaugauggcaacuuugaaugcuaggugaaaucuaggaggaaggcauacuuggcaaaccacaug

SEQ ID NO: 225074 - RNA, 64 nt, Human
acacaaccuguacagauugaaauuucaccuuguaaggaggaagugaaugaaauaaaggaucccc

SEQ ID NO: 225075 - RNA, 64 nt, Human
gcugggucucucuuuguggacuuguaccuggagcaggaggaacuccaguccgucccggcaucca

SEQ ID NO: 225076 - RNA, 64 nt, Human
aacagucuucugcccaugucugggaacacacgccaggaggaaugucugauacccucugcaucaa

SEQ ID NO: 225077 - RNA, 64 nt, Human
gaggaagagacuucuucuguucucuggagaaggcaggaggaaagcaaagaccuccauuuccaga

SEQ ID NO: 225078 - RNA, 64 nt, Human
gcugguggagacggggccugggcucccgggcccgaggaggaaaaggauugccaaggcuccaggg

SEQ ID NO: 225079 - RNA, 64 nt, Human
ugccuguaaucucagcaauuugggaggccaaggaaggaggaaugcuugagcccaagaguuuuag

SEQ ID NO: 225080 - RNA, 64 nt, Human
ggcguauuugcuugucccaauacaagaaugccaaaggaggaaacaggaaaaauugccguccauu

SEQ ID NO: 225081 - RNA, 64 nt, Human
agaaauaaacacugaggacuccaaaaggggggcaaggaggaagaggggcagggguuaaaaagcu

SEQ ID NO: 225082 - RNA, 64 nt, Human
aagcaccaagagaaacaucauuuuagcaaaggccaggaggaaaaauagaaauaaauuugucuug

SEQ ID NO: 225083 - RNA, 64 nt, Human
cugcuuaggccacucgagcaucagagcuuccagcaggaggaagggcuguaggaauggaagcuuc

SEQ ID NO: 225084 - RNA, 64 nt, Human
gaguaugcagaaguuggguagagagguuaagaagaggaggaagugagacggggaagggaggagc

SEQ ID NO: 225085 - RNA, 64 nt, Human
ugaaguuugggauuuggaacuuucuguaucucuuaggaggaacaaguaaaaaccaaaugguuac

SEQ ID NO: 225086 - RNA, 64 nt, Human
gcacuuuugcucuccaaagcacuuuuggauacucaggaggaaagauaagauacauguuugaagu

SEQ ID NO: 225087 - RNA, 64 nt, Human
aaaaaaaaaaaaaaaaagccugaagagaugagauaggaggaaagaccucacagccagaucugcu

SEQ ID NO: 225088 - RNA, 64 nt, Human
ugugcuuucacuguauagccaguucauucagaaaaggaggaaaggguaguuuaauuucaaaaaa

SEQ ID NO: 225089 - RNA, 64 nt, Human
gugccggaugcaggaaggaggugcagacggaaggaggaggaaggaaggacggaagcaaggaagg

SEQ ID NO: 225090 - RNA, 64 nt, Human
ggagagggggaggggugguacuuggcaccaauaaaggaggaaucagacccagacgcugggaguu

SEQ ID NO: 225091 - RNA, 64 nt, Human
ugcccacaagugggucuucuguggaagaugcagaaggaggaaguuagugcuuacauuuuagucu

SEQ ID NO: 225092 - RNA, 64 nt, Human
gccccugcccucccucgggugcugcuggccucaaaggaggaacucguggggggagggugugauu

SEQ ID NO: 225093 - RNA, 64 nt, Human
caggccucauccuccuggacccagcaggggcagaaggaggaagggacugguccaggcauggguc

SEQ ID NO: 225094 - RNA, 64 nt, Human
cugguucuccauccccauguguuucagguggaacaggaggaacugguccaggccaggccucauc

SEQ ID NO: 225095 - RNA, 64 nt, Human
uucaggaccugggaauacaggguucagagaggagaggaggaagauggugacaugauuugguuag

SEQ ID NO: 225096 - RNA, 64 nt, Human
caauggagaccauuguaagugguggggcugggagaggaggaacagaaggaaagccauagcgcuc

SEQ ID NO: 225097 - RNA, 64 nt, Human
uagaccggucccuucucagcguuccagucacuucaggaggaauuuaguuauugacuuagucuau

SEQ ID NO: 225098 - RNA, 64 nt, Human
uguggaagagcugcuggcugcaucagggaacaggaggaggaagagggucaggguggagaggaag

SEQ ID NO: 225099 - RNA, 64 nt, Human
ugccauacccucaguuaagcauguuaacauuuauaggaggaaaaaaaucacuuugggagaaaau

SEQ ID NO: 225100 - RNA, 64 nt, Human
agcagaagaacuggagaaagggaaccacagagccaggaggaaugucugagcagagucaagcaac

SEQ ID NO: 225101 - RNA, 64 nt, Human
gccaauugcuacagagugucuggguguguggcauaggaggaagguuugcuugugaaaugaggcu

SEQ ID NO: 225102 - RNA, 64 nt, Human
caagagaaguucuauuuuuguaaagacugcaaaaaggaggaaaaaaaaccuucaaaaacgcccc

SEQ ID NO: 225103 - RNA, 64 nt, Human
gaccucagcaaugaagaacccuugugaaguaaccaggaggaauggggaaagaagcaaguugggc

SEQ ID NO: 225104 - RNA, 64 nt, Human
cauuuuagacacugggagaagagaaccucaaacuaggaggaaaagacagagccuccacuuaguu

SEQ ID NO: 225105 - RNA, 64 nt, Human
auaacaacagccacccugcccagucuggaagaagaggaggaagacucuggagccaaggcagagg

SEQ ID NO: 225106 - RNA, 64 nt, Human
aagguccuacaggucuccggccacccacacaaggaggaggaagaggaaauggugacccaagugu

SEQ ID NO: 225107 - RNA, 64 nt, Human
auuuucauauuacucugcuuugugcacuuuauggaggaggaagcuagaggaaaaauggaaaugc

SEQ ID NO: 225108 - RNA, 64 nt, Human
gaccgaguucagcuccguaagguggcggcaccugaggaggaagcagccaggaguggcuggggaa

SEQ ID NO: 225109 - RNA, 64 nt, Human
guaaaaggugccagggaaguugugggcaccugagaggaggaacagauguggaggaccugagggu

SEQ ID NO: 225110 - RNA, 64 nt, Human
cccaugaagaccccuucucagccccaaaaccugaaggaggaauuucgcccuacucuggccccuu

SEQ ID NO: 225111 - RNA, 64 nt, Human
ccugucagucucaaagcacaaggagguucagcccaggaggaagccagcugcaauguggagacac

SEQ ID NO: 225112 - RNA, 64 nt, Human
cuucucuuucauacauauaugcgugccuaguucuaggaggaaacggguuaaaaauuguuuuaaa

SEQ ID NO: 225113 - RNA, 64 nt, Human
uaauauauaccacuggugugugugggagggagggaggaggaauacuagcccuuuuuauauauuu

SEQ ID NO: 225114 - RNA, 64 nt, Human
gguaugcaaaauuuugucuauauauauuugugugaggaggaaauucauaacuuuccucagauuu

SEQ ID NO: 225115 - RNA, 64 nt, Human
cugaagcagauugauccguuugauuuuuauuuccaggaggaagacuagugguggauuccaugac

SEQ ID NO: 225116 - RNA, 64 nt, Human
ggggugugggaggaagcuugaguuugaugcagggaggaggaaggcugaggaaugacuuggcucc

SEQ ID NO: 225117 - RNA, 64 nt, Human
acuugaccuuauuuuggaaguuuugaauuggccuaggaggaaacccagaaaugaaccaggggua

SEQ ID NO: 225118 - RNA, 64 nt, Human
ggagagaggacauccuugucuuguucaugaucuuaggaggaaagcauugucuuucaucuuuaag

SEQ ID NO: 225119 - RNA, 64 nt, Human
uugaagucuuuugucccaguuugggaugaaggaaaggaggaagaggcgguggcuguguggcccc

SEQ ID NO: 225120 - RNA, 64 nt, Human
aggagcacuguugaaguccuggaagggagaucgaaggaggaagauugacuugguucuuucuuag

SEQ ID NO: 225121 - RNA, 59 nt, Human
caaaugccacuagcaccugagugugguacaggaggaauguuugguugggagaaucacag

SEQ ID NO: 225122 - RNA, 64 nt, Human
guggagcauuuagcccaggucuuaauucuccaagaggaggaauacauaguaugguaaggcaagg

SEQ ID NO: 225123 - RNA, 64 nt, Human
gccggacgaguucauggggaucugggggguggggaggaggaagccguugaaucugggagggaag

SEQ ID NO: 225124 - RNA, 64 nt, Human
uauuuagcucuguggaauucagugacaaaaugggaggaggaaagagaguuuguaaggucaugcu

SEQ ID NO: 225125 - RNA, 64 nt, Human
ggaucuucugccaccaucagggacaaacgggggcaggaggaaagucacugaugcccagauguuu

SEQ ID NO: 225126 - RNA, 64 nt, Human
aacaccagcaacucgagagcugggaaacucaaggaggaggaagaaaaucaaaaccacccuacuc

SEQ ID NO: 225127 - RNA, 64 nt, Human
auauauagagaugcauucacagggguuggcugggaggaggaagaccauucugugaccaaaauac

SEQ ID NO: 225128 - RNA, 64 nt, Human
cucucccaagaugagaaaguccucaagugaggggaggaggaagcagauagaugguccagcaggc

SEQ ID NO: 225129 - RNA, 64 nt, Human
cagaaacugaauagguuccagagacuuuuggcccaggaggaauauuuacuuuuagcucuggaca

SEQ ID NO: 225130 - RNA, 64 nt, Human
uguucaguaaggccaauguuaacaacacguuuagaggaggaaaaguucaaccucaaguuaaaug

SEQ ID NO: 225131 - RNA, 64 nt, Human
uuuaccaccaugcaggaacagacuuuugguggugaggaggaagaacaaauaauagaagaaaaua

SEQ ID NO: 225132 - RNA, 64 nt, Human
gcagguccuuguguauggaauugcacccguguaaaggaggaaauggucagugugcaugaaaucc

SEQ ID NO: 225133 - RNA, 64 nt, Human
auagggcuaagguuuucaccuuaacugugaaggcaggaggaauaggugacugcuuccucccgcc

SEQ ID NO: 225134 - RNA, 64 nt, Human
cggauccagcugcaagaccguguaaaugagcuccaggaggaagcccaggaggcugaugccugcc

SEQ ID NO: 225135 - RNA, 64 nt, Human
uuuugauugacuucauauucuagaauacuugauuaggaggaagauacaaccaugaugacuuuuu

SEQ ID NO: 225136 - RNA, 64 nt, Human
gcaccaggcacgaacccaccugcugagagacccaaggaggaaaaacagacaaaaacagccucac

SEQ ID NO: 225137 - RNA, 64 nt, Human
gaaaccgcagcugagcaggugucacaagcuguaaaggaggaagggagucugcaggcccuucaca

SEQ ID NO: 225138 - RNA, 64 nt, Human
caucuuccguguuagagcaaagugaagaguuuaaaggaggaagaagaaagaacugucuuacacc

SEQ ID NO: 225139 - RNA, 64 nt, Human
gaaugggucaguggcuggaacaaaguucugguuaaggaggaaauuagugccacccacggugaga

SEQ ID NO: 225140 - RNA, 64 nt, Human
auacaugucuucaaaauuuuaaucugauuuauccaggaggaaggcuguacaguaaaacguaaga

SEQ ID NO: 225141 - RNA, 64 nt, Human
agggugcccuccuauccccaccuacuccugggucaggaggaaaagacuaacaggagaaugcaca

SEQ ID NO: 225142 - RNA, 64 nt, Human
acucauucaguuugauucaguucuuaccucugucaggaggaauacaguuccuguucauccugug

SEQ ID NO: 225143 - RNA, 64 nt, Human
acaagaaggcuaauugguggugagacagcaggggaggaggaagagcugugguuuguaacuuguu

SEQ ID NO: 225144 - RNA, 64 nt, Human
ccaagcauggaacuaccauuuccuccucauaugcaggaggaacaacaucaaagggaacucucuc

SEQ ID NO: 225145 - RNA, 64 nt, Human
ggcuuuccuucgcgccuccgcguccacccagcccaggaggaagacugcucugagcgugcggccu

SEQ ID NO: 225146 - RNA, 64 nt, Human
ucacuuaauucuauccacagucaaaaaucccccaaggaggaaagcugaaagaugcacugccaua

SEQ ID NO: 225147 - RNA, 59 nt, Human
uuuucccccuuaaaucacagaaaacauucaggaggaauacuguugcagcugaaauuggu

SEQ ID NO: 225148 - RNA, 64 nt, Human
ccuguuucccugugcuguccccaugcuguguuggaggaggaaguggcucuccuuccaccaacaa

SEQ ID NO: 225149 - RNA, 64 nt, Human
aacccuggagaucugcaaauggagggaggggugaaggaggaaucuuaagaccgagggagaagag

SEQ ID NO: 225150 - RNA, 64 nt, Human
acuuuguaaccacacucauuccuuucaaacacagaggaggaauuauugcuucaucugacuuuau

SEQ ID NO: 225151 - RNA, 64 nt, Human
auacaguauaccgcaguggcucuagguggaggaaaggaggaaaaagugcuuauuaugugcaaca

SEQ ID NO: 225152 - RNA, 64 nt, Human
agauggggaagcccagaucaccaggcuucuauuaaggaggaaagcaacagaggaaacagugaag

SEQ ID NO: 225153 - RNA, 64 nt, Human
acauguucaaauauauucacaaugguaauaagguaggaggaaucugagacgauugcauugucua

SEQ ID NO: 225154 - RNA, 64 nt, Human
guauuuucaguuguugagucuuaaugagggauacaggaggaaaaaucccuacuagaguccugug

SEQ ID NO: 225155 - RNA, 64 nt, Human
auuuuaccaacugugaaagcuggcuuuaauuuuuaggaggaaaagaaaagccugcauguguucu

SEQ ID NO: 225156 - RNA, 64 nt, Human
cagguucuuggaaagagcuuuuuccuucucuacaaggaggaaucugaugcaacugacauccuca

SEQ ID NO: 225157 - RNA, 64 nt, Human
gggggucugcgccacaguuugguccagaggagggaggaggaagggaagaccccaguggugggac

SEQ ID NO: 225158 - RNA, 64 nt, Human
caagucacuaaucauacucugaugccugaacuugaggaggaaaauacauguauauuuuuguucc

SEQ ID NO: 225159 - RNA, 64 nt, Human
aaacugcagugagaggagauaaauauccuuuuucaggaggaacugauaucucuggcuaaauauu

SEQ ID NO: 225160 - RNA, 64 nt, Human
ucucgggaguccucuagcaggccuaagacaugugaggaggaaaaggaaaaaaagcaaaaagcaa

SEQ ID NO: 225161 - RNA, 64 nt, Human
gauucuuuccauuugcauuuguuuauguaauuucaggaggaauacugaacaucugaguccugga

SEQ ID NO: 225162 - RNA, 57 nt, Human; identical to SEQ ID NO: 199836

SEQ ID NO: 225163 - RNA, 64 nt, Human
cucacuggacucgccucucuccucuccuccccccaggaggaacuugaaaggaggguaaaaagac

SEQ ID NO: 225164 - RNA, 64 nt, Human
uuguguggcuuggaggaaaugguacugcccaaauaggaggaaaacacagccucccugagccugc

SEQ ID NO: 225165 - RNA, 64 nt, Human
uuguguaacuauuuguaccguaggacagaaugugaggaggaaguaacacacagaggaggaugug

SEQ ID NO: 225166 - RNA, 64 nt, Human
ccuaggaggucuuauucaaagcccucauugacagaggaggaaacaggccaaggcaggacauggc

SEQ ID NO: 225167 - RNA, 64 nt, Human
uguaguuacuagucuuuugacauggaugauucugaggaggaagcuguuauugaauguauagaga

SEQ ID NO: 225168 - RNA, 64 nt, Human
agcugcuuucacgguaaaauuauguugguuugaaaggaggaaauagcaagguuaagauguguga

SEQ ID NO: 225169 - RNA, 64 nt, Human
uagaagcgcaaugagagaagcagcaguggguacaaggaggaagaaaaagggcuugcagagagug

SEQ ID NO: 225170 - RNA, 64 nt, Human
ggaguaagggaagauuucuguauacuugcuggagaggaggaauguguauaguuacucauuuaga

SEQ ID NO: 225171 - RNA, 64 nt, Human
gcccacguggugugguuggugaacagugcaugccaggaggaagcagucccuccucaccagcucu

SEQ ID NO: 225172 - RNA, 64 nt, Human
gaagaagugaccaugggcugggaggagguggaggaggaggaagaggagaaggaaaagugacgaa

SEQ ID NO: 225173 - RNA, 64 nt, Human
ccgagcuuuuuugugaaacucagaucagccacccaggaggaagagcgggcugaggaaacccaga

SEQ ID NO: 225174 - RNA, 64 nt, Human
gauuugacccugugugggaaaugcugaaagcaccaggaggaagccgguucccgugagauaaguu

SEQ ID NO: 225175 - RNA, 64 nt, Human
ugacugugcccuuuagggccuccugaguuucaaaaggaggaaguguucgugcuugugucccuga

SEQ ID NO: 225176 - RNA, 64 nt, Human
gagaucauccggugcuaaaacauuacaguugccaaggaggaaaauacugaaugacugcuaagaa

SEQ ID NO: 225177 - RNA, 64 nt, Human
ggcccuaggacccuaggaugccauucuugccaggaggaggaaugagagugauguuggccaacau

SEQ ID NO: 225178 - RNA, 64 nt, Human
guguccuaaggagacuccuggaagcugaauggagaggaggaagaaaaugaagaaggagugauug

SEQ ID NO: 225179 - RNA, 64 nt, Human
gugaugucaggguugggcgcgggaagaaaaggagaggaggaagcugaggcaacuuugggauucu

SEQ ID NO: 225180 - RNA, 64 nt, Human
acuguuuuuguccccauuccccuacuccugagcuaggaggaaaaaaugugaaucuuaccagcag

SEQ ID NO: 225181 - RNA, 64 nt, Human
uguaguuucauuccuugguucugaaacucuguggaggaggaagaugggagcugaugagaaucaa

SEQ ID NO: 225182 - RNA, 64 nt, Human
ccucuuucuucucaugugccagauguuaagaugaaggaggaauacaacacauacucaagccuca

SEQ ID NO: 225183 - RNA, 64 nt, Human
ccaugagaacagcgugagcugguggaucaugacaaggaggaaaaauguccccccaggcauuucu

SEQ ID NO: 225184 - RNA, 64 nt, Human
gcugcauaugaguaaaguuaccccaaccacagugaggaggaagauguucacauacuggaacugu

SEQ ID NO: 225185 - RNA, 64 nt, Human
uauugggugaggggacgagaugggguucaugugaaggaggaagcgaugccgagguaggaaaggc

SEQ ID NO: 225186 - RNA, 64 nt, Human
cacugagugaaggcacauaaagcaauugaggaggaggaggaaccccucgucccccuaggagcag

SEQ ID NO: 225187 - RNA, 64 nt, Human
uuauugauagagaguaguuagaugcuguuaaaagaggaggaaacuacuugaggagggacccaac

SEQ ID NO: 225188 - RNA, 64 nt, Human
gaagcaccgauggaaacagauugaugcagauggaaggaggaagggagacugggcccacugauuu

SEQ ID NO: 225189 - RNA, 64 nt, Human
cuagcgaugggacugcccauuuccucagcugcagaggaggaaagggaaaggguaggccuguaga

SEQ ID NO: 225190 - RNA, 64 nt, Human
gugcuaacauucaugauuagggucucagaagguaaggaggaagagaguggaauggaaaaaguau

SEQ ID NO: 225191 - RNA, 64 nt, Human
uuuggguguuuuuuaaagcaaugugaguccacugaggaggaagagacccugggauuucacccuc

SEQ ID NO: 225192 - RNA, 64 nt, Human
ucugugucucaucaggagcaucuggggugccuguaggaggaaggccacagggcauggaucagcc

SEQ ID NO: 225193 - RNA, 64 nt, Human
accugccccuacacccuguccaacaugaccuacaaggaggaagacuucgagcgccugcugcggc

SEQ ID NO: 225194 - RNA, 64 nt, Human
aaagccagcggggagggacugauuuuuauaggaaaggaggaaaaauaauggaaacacaucucau

SEQ ID NO: 225195 - RNA, 64 nt, Human
gagaucaagaggcuggggguaaggccaagaagguaggaggaaaauggcagaccugggcuggaga

SEQ ID NO: 225196 - RNA, 64 nt, Human
agacucucauuuccccaagcauaacugcaaggagaggaggaauuccuaggagccaaagaguuuu

SEQ ID NO: 225197 - RNA, 64 nt, Human
uuugccuugacagaguggcccaggguuucaagggaggaggaaccucccccuaccuaggacccuu

SEQ ID NO: 225198 - RNA, 64 nt, Human
gcccaucauguggccccacccaaucaagggaagaaggaggaaugcuggacuggaggccccugga

SEQ ID NO: 225199 - RNA, 64 nt, Human
ggagaacucuuggccaaagguuuuugcggggaggaggaggaaaccagcuuucugguuaagguua

SEQ ID NO: 225200 - RNA, 64 nt, Human
auucccagugaccccuucugggugccaacuacugaggaggaauacuugcacuuuggggagaagg

SEQ ID NO: 225201 - RNA, 64 nt, Human
gaacaaggagcaagugaucuggcaaaagagggacaggaggaaaaugaaaccuguucugguggaa

SEQ ID NO: 225202 - RNA, 64 nt, Human
guauggggcacacuuccccaagggcggacccagcaggaggaagcccaggagcuggguccugccg

SEQ ID NO: 225203 - RNA, 64 nt, Human
cagggagcgaggagccccucggaggagccuccagaggaggaaauccccaaggaggaugggaucu

SEQ ID NO: 225204 - RNA, 64 nt, Human
ccaaaucugucucccuucaugggccucccagggaaggaggaagcccugcugugcagacaccucu

SEQ ID NO: 225205 - RNA, 64 nt, Human
aaaguuguggggcauaagacaccgggaaugagggaggaggaagacaguuguguuuucucuuuaa

SEQ ID NO: 225206 - RNA, 64 nt, Human
ugucucaggcuucuguggcaggacuggcccagggaggaggaagccagcagcacaccuggggaau

SEQ ID NO: 225207 - RNA, 64 nt, Human
agccacagggcuagaagcacaggcccgucaccccaggaggaaaagcccagggucuggggcagca

SEQ ID NO: 225208 - RNA, 64 nt, Human
aaaucacugccggcuagucccaagcaaacgggcuaggaggaaagauuaaaaaaacaacaacaac

SEQ ID NO: 225209 - RNA, 64 nt, Human
auuucccuaccaaccaaggagccuccagaaggaaaggaggaagaaauguuuucuuaggggaauu

SEQ ID NO: 225210 - RNA, 64 nt, Human
ccccacugugaggcgugggugugagccaggcugcaggaggaacugggccuccgcuucccagcaa

SEQ ID NO: 225211 - RNA, 64 nt, Human
cacuggcuggccaucugagccugccuggaggagaaggaggaacccccaugccaauguccagguc

SEQ ID NO: 225212 - RNA, 64 nt, Human
caggacugcgccuacugagugacccauuuccuccaggaggaaaggcaagacacgcuuacacggc

SEQ ID NO: 225213 - RNA, 64 nt, Human
gcgcaggcagauuuaauuugcuaaauagacuaacaggaggaaaaaaacaaacagccuagcuuua

SEQ ID NO: 225214 - RNA, 64 nt, Human
uuuuaaaagugcacauuaaaaaggaaaguuugccaggaggaacaaagagauugugguggugcua

SEQ ID NO: 225215 - RNA, 64 nt, Human
aaccagugaacaccagcugugaaggccuugggagaggaggaacaggcccuugggcagaugcagg

SEQ ID NO: 225216 - RNA, 64 nt, Human
aggauccaucagucuugcaaggacauugaauauuaggaggaaaaagucauggaaaaaauaaagc

SEQ ID NO: 225217 - RNA, 64 nt, Human
uguggggcaggaacaggaagugacgggaaccuugaggaggaaacgccuguguuagggagagagu

SEQ ID NO: 225218 - RNA, 64 nt, Human
augcaacugaagcugugauauuuccaacgacuguaggaggaaaaauuaaggggagagaggaaaa

SEQ ID NO: 225219 - RNA, 64 nt, Human
aagacauguacugaugacacaccauggauuucagaggaggaaguacggagucguugcauaaucc

SEQ ID NO: 225220 - RNA, 64 nt, Human
ggacguagaguuauugaaaaugcagaugguucugaggaggaaacggacacucgagacgcagacu

SEQ ID NO: 225221 - RNA, 64 nt, Human
caggcugcaaaccgguuaaucaagaauuuggucaaggaggaacaagaaaaaucggagaaggugu

SEQ ID NO: 225222 - RNA, 64 nt, Human
auuugcacugccgggaauggacacuggaagugccaggaggaaggaaggcugguuugguggggua

SEQ ID NO: 225223 - RNA, 64 nt, Human
gucagauuguagagguccuggcggcugauucuagaggaggaagaggcucugugagaugaauagg

SEQ ID NO: 225224 - RNA, 64 nt, Human
guguugacuggacugcuuggggugggggacgaucaggaggaagugagcagucgccugccugcag

SEQ ID NO: 225225 - RNA, 64 nt, Human
cccucagccaagggacagugccauccuuggggacaggaggaaaagcagccugucucugcuaagg

SEQ ID NO: 225226 - RNA, 64 nt, Human
cccuggugaagggcuggaccugacccauggaggcaggaggaagaccuggcuuucuugguuuguc

SEQ ID NO: 225227 - RNA, 64 nt, Human
guggcccaccuguggagaggacuggcugcccuggaggaggaaagggaggaagucuacacagagg

SEQ ID NO: 225228 - RNA, 64 nt, Human
aucaacagcuuuuucuccgucucccacaacaucgaggaggaagaauucaaugacuaugaggcca

SEQ ID NO: 225229 - RNA, 64 nt, Human
aaugaaacuugaaucugucccucgugacaauuauaggaggaagguauuuaaaaccccagauuua

SEQ ID NO: 225230 - RNA, 64 nt, Human
caaaugaagacuuaucagggcccuagaaagugcuaggaggaagggguuaaaaaaaaaauuuguc

SEQ ID NO: 225231 - RNA, 64 nt, Human
cucugccccgacagaauggggcugaaucagcuccaggaggaaccaggcccugcucuccugugua

SEQ ID NO: 225232 - RNA, 64 nt, Human
gcuggcggagucagugacuauggcccccacguucaggaggaaggugugaugccgucauacaguu

SEQ ID NO: 225233 - RNA, 64 nt, Human
acacagggcuccuagcaagcaggaaguuaagagcaggaggaagcguugcuaccuucacuucucc

SEQ ID NO: 225234 - RNA, 64 nt, Human
gauauugaacaauaaaggagaaugguaccgaugcaggaggaagcaagcgugucuuccccugcag

SEQ ID NO: 225235 - RNA, 64 nt, Human
cccugcagcacacagcgacuugcguugacaaaggaggaggaaacgauuacucuguaaacaaagu

SEQ ID NO: 225236 - RNA, 64 nt, Human
cuguggagaagaagggcgggaagaacuuccuuucaggaggaagcuggaacuuacugacuguaag

SEQ ID NO: 225237 - RNA, 64 nt, Human
acgagacacauugccuucuggagcugggagacaaaggaggaauuuacuuucuucaccaagugca

SEQ ID NO: 225238 - RNA, 64 nt, Human
cagcuucucugacacuuggguugggggcccuuccaggaggaaacccccuugggugccccacaca

SEQ ID NO: 225239 - RNA, 64 nt, Human
uggaauggcagcaugcaaacuuggaucagauagcaggaggaacuuucaaaagucuggcccacug

SEQ ID NO: 225240 - RNA, 64 nt, Human
ccugggaccaggcugggaggggaguguggcagggaggaggaagaggaaggugagaaugaguaga

SEQ ID NO: 225241 - RNA, 64 nt, Human
cauguuggacugagaccuaacucacuggacucagaggaggaaucguggaaaacaagagcaaaac

SEQ ID NO: 225242 - RNA, 64 nt, Human
agccuggcacauaggcacccagccugcaucucccaggaggaaguggaggggacaucgcuguucc

SEQ ID NO: 225243 - RNA, 64 nt, Human
uggacggggacuggggaugugggagggagcagacaggaggaaucaugucaggccugugugugaa

SEQ ID NO: 225244 - RNA, 64 nt, Human
uugagaagggacaagccaccuugaccguaggggaaggaggaaugugggcugggggaagaugccc

SEQ ID NO: 225245 - RNA, 64 nt, Human
agaguggggagaggcacuuaaucuguaacccccaaggaggaaauaacuaagagauucuucuagg

SEQ ID NO: 225246 - RNA, 64 nt, Human
aauagccagcuuucgacacauaccuggcugucugaggaggaaggccuccuggaaacugggagcu

SEQ ID NO: 225247 - RNA, 64 nt, Human
cuuguggggcguccucauuucuuccucaaauauaaggaggaagauaccaauuaaaagcucauag

SEQ ID NO: 225248 - RNA, 64 nt, Human
gcacggggugaacggaggcccagaguacuagggaaggaggaagggaggacaugccucuucuucc

SEQ ID NO: 225249 - RNA, 64 nt, Human
gcaggagaaaauuaaaguguuuucuuuauaucagaggaggaaauaguagaggucagugaagguc

SEQ ID NO: 225250 - RNA, 64 nt, Human
gcagcaggacagacccccacgaggccccccagagaggaggaagaucccacggaggaacacauga

SEQ ID NO: 225251 - RNA, 64 nt, Human
caggauccccagaagcaggcugaagaggaaaggcaggaggaaccugaguaugagaauguuguac

SEQ ID NO: 225252 - RNA, 64 nt, Human
cguguguaggccuggccgcaguccaggggucagcaggaggaaaggguucacauaggcucucagg

SEQ ID NO: 225253 - RNA, 64 nt, Human
gcuuucucagccacuguucaucaccagggguuuuaggaggaaggcuuggcuccugucuucccag

SEQ ID NO: 225254 - RNA, 64 nt, Human
uaaagagugagcuucugccucuccugcccugaaaaggaggaaugauuggggccagcaacuuugc

SEQ ID NO: 225255 - RNA, 64 nt, Human
ccaaguggucuucuguagaggaaagcaugauaagaggaggaagacauaaaguuggggguggaga

SEQ ID NO: 225256 - RNA, 64 nt, Human
cuccuccagcugcuucaggcuaaaacccaggaugaggaggaacagguaagggcaggaugcuggg

SEQ ID NO: 225257 - RNA, 64 nt, Human
aaaggagaaguauuucgaauauuuucucaaucuuaggaggaaauaccaaaguuaagggacgugg

SEQ ID NO: 225258 - RNA, 64 nt, Human
cugccagccccuuugccauagccugauuuuggggaggaggaaggggcgauuugagggagaaggg

SEQ ID NO: 225259 - RNA, 64 nt, Human
ccacaauucaaaagcaccuaaaaagaauaggcugaggaggaagucuucuaccaggcauauucau

SEQ ID NO: 225260 - RNA, 64 nt, Human
ugcuuuuugucucgguugcuauuccaagaacagaaggaggaaguuggccaauuacagcgugugu

SEQ ID NO: 225261 - RNA, 64 nt, Human
uggaggggcauggccagcagcuugcguuagaaugaggaggaaggagagaaggggaggagggcgg

SEQ ID NO: 225262 - RNA, 64 nt, Human
ugaggaagaggggaaggugcguauuuauucagggaggaggaaaaguggugcagggacagggaga

SEQ ID NO: 225263 - RNA, 64 nt, Human
aaacugcucagcgcgucucagcucagugccgaggaggaggaagaaaaacaggccgagugaaggu

SEQ ID NO: 225264 - RNA, 64 nt, Human
aggcaccaggaaaggggugguagucagaggagggaggaggaauaaggggaaggaagagagaggg

SEQ ID NO: 225265 - RNA, 64 nt, Human
uuugaaaauuugaauaaggcuguuugcugacaggaggaggaaguaguggagaucauuucaucuc

SEQ ID NO: 225266 - RNA, 64 nt, Human
agagcugccaggcucccaggagagcauggggacuaggaggaaggguguggcauggcucagucug

SEQ ID NO: 225267 - RNA, 60 nt, Human
aaccaauugagaauuuauaaaauugaguccaggaggaagcucuggcccuuguauuacaca

SEQ ID NO: 225268 - RNA, 64 nt, Human
ccuggaaccagcaagucccagacaaggagagcggaggaggaagucaugggaacgcagccuccag

SEQ ID NO: 225269 - RNA, 64 nt, Human
cuggacgcugcccugcaugcugcccagccacuccaggaggaagucgggaggcguggagggugac

SEQ ID NO: 225270 - RNA, 64 nt, Human
ccccccccccccgcccacaugcuccccagcuugcaggaggaaucggugagguccuguccugagg

SEQ ID NO: 225271 - RNA, 64 nt, Human
gagaaaauaaauuccaaauuaggaaguguuuccuaggaggaaaauuccauuagagaguggcaau

SEQ ID NO: 225272 - RNA, 64 nt, Human
acuggugaugauggagagcccuguggccacacagaggaggaagacagcagccuggcagcagccu

SEQ ID NO: 225273 - RNA, 64 nt, Human
aguugucaauuaaaagguaaccuuuuaaucucguaggaggaaucucauuaagacauuuuuccug

SEQ ID NO: 225274 - RNA, 64 nt, Human
uggaauguauauaaagucaaagugcuccaacagaaggaggaagugaaaacaaacuauuaguauu

SEQ ID NO: 225275 - RNA, 64 nt, Human
uuuccugauuuuucucuuuccuaucuuugauggaaggaggaaguagaaagugguaaagaauuga

SEQ ID NO: 225276 - RNA, 64 nt, Human
cagaacauacuguucucaacauacuguaaucaaaaggaggaauuucagugggucucugugugug

SEQ ID NO: 225277 - RNA, 64 nt, Human
ucagucuaaacaauaaauauuucauaauuuacaaaggaggaacggaagaaaccuauugugaauu

SEQ ID NO: 225278 - RNA, 64 nt, Human
accggaagaccuugccucugugccgcggagguccaggaggaaacggggcggccgcuaggccuca

SEQ ID NO: 225279 - RNA, 64 nt, Human
aaggcacacgcucaaugccccacgugccuucuccaggaggaacgaagcaggguuugaggguugg

SEQ ID NO: 225280 - RNA, 64 nt, Human
gccaaaaagacaaaacacauagacgcacacacucaggaggaaaagaaaaaacaaaggcagaaga

SEQ ID NO: 225281 - RNA, 64 nt, Human
gcuggugccuccccggggucugggcggagagaacaggaggaauggcugggaaguggcugaggga

SEQ ID NO: 225282 - RNA, 64 nt, Human
cagggaccccucccggccucccucgcacacugggaggaggaagccgccgagacugcagggagcc

SEQ ID NO: 225283 - RNA, 61 nt, Human
ucggugaggcaccccuguaacccuggggacuaggaggaagggggcagagagaguuaugacc

SEQ ID NO: 225284 - RNA, 64 nt, Human
acacucugaucacagccccccuaccuuuugcccuaggaggaagcaauaaugguguauacccuca

SEQ ID NO: 225285 - RNA, 64 nt, Human
uagaauuguccuuaaaagcuuucuccuggccgauaggaggaagcauauaucaaggagguucuuu

SEQ ID NO: 225286 - RNA, 64 nt, Human
uuugucuauauucugcucccagccugccaggcccaggaggaaauaaacaugccccaguugcuga

SEQ ID NO: 225287 - RNA, 64 nt, Human
ucccaaggugaugguauuugaagguagggccuuuaggaggaaauuaggucaugaggguggagcc

SEQ ID NO: 225288 - RNA, 64 nt, Human
guagggcaagaaggaaggcugaagcgcugucccuaggaggaauuucuccuucaggggagccuca

SEQ ID NO: 225289 - RNA, 64 nt, Human
uucaagacugaauagaaguauuucagucuugcagaggaggaaaugcucagagcuccgaggugcg

SEQ ID NO: 225290 - RNA, 64 nt, Human
aaggccucuagacuacauccauuccuuccucaacaggaggaaaauuccugguacaguuuaacgu

SEQ ID NO: 225291 - RNA, 64 nt, Human
agcagccgcaucucaaaggcagagcccugccugaaggaggaauccgugaguaaucuucaggucc

SEQ ID NO: 225292 - RNA, 64 nt, Human
ucucaguccucacacaaccaucccuguuuuauagaggaggaaguggcuuagagaauguaacuga

SEQ ID NO: 225293 - RNA, 64 nt, Human
ggcucggcggcgaagcccagccuuggagacacccaggaggaaggccgugcuccuggcucccucc

SEQ ID NO: 225294 - RNA, 64 nt, Human
cugcauagaauucaaacgagauucacccagcgcgaggaggaagaaacagcaguuccugggaacc

SEQ ID NO: 225295 - RNA, 64 nt, Human
acuucuguuccccaaaaagcgagaagggggguucaggaggaagccaucgcaggggaccugggag

SEQ ID NO: 225296 - RNA, 64 nt, Human
caggccuccccagcaccuagguggggccugggguaggaggaacagguuuaaaaauccccaaaaa

SEQ ID NO: 225297 - RNA, 64 nt, Human
gugaccuuugaagauguggcugugaacuucacccaggaggaauggacuuugcuggauccuucac

SEQ ID NO: 225298 - RNA, 64 nt, Human
gcagcccagccagcaggagggacugaggcccucuaggaggaaagcccagagggagggggcccuc

SEQ ID NO: 225299 - RNA, 64 nt, Human
cagacaaugucgagggacaaaagauagaagauggaggaggaaagacauuauacgugggcuuggc

SEQ ID NO: 225300 - RNA, 64 nt, Human
auccccgagguggagcuggucacgcugggcgcccaggaggaagggagggcagagggggcugugg

SEQ ID NO: 225301 - RNA, 64 nt, Human
gucaucucaaccucagacuuuuacauaacaucucaggaggaaauguggcucucuccaucuugca

SEQ ID NO: 225302 - RNA, 64 nt, Human
ucuauaaauguaucuuauaauaaaaaggaaggacaggaggaagacaggcaaauguacuucucac

SEQ ID NO: 225303 - RNA, 61 nt, Human
ccagccagcaguccaaguagcuggacccacgaggaggaaccaggcuacuuuccccaguacu

SEQ ID NO: 225304 - RNA, 64 nt, Human
aggucagcucuagcugagcaucagugcucucuuaaggaggaaaaaaacggugcggcugggagcg

SEQ ID NO: 225305 - RNA, 64 nt, Human
guggccaacccagcaguccuucccucagcugccuaggaggaagggacccagcugggucugggcc

SEQ ID NO: 225306 - RNA, 64 nt, Human
guggggggaggcugacuccugguccuaggcuggaaggaggaagaauagggcccaugggagggag

SEQ ID NO: 225307 - RNA, 64 nt, Human
auuacccagugaccgaugguaagugaggauuccuaggaggaauaacagucucugguuucccugu

SEQ ID NO: 225308 - RNA, 64 nt, Human
gaaaaggaggggagaggaggggaaggggaggcagaggaggaacaucuggaaaaaaagcagccug

SEQ ID NO: 225309 - RNA, 64 nt, Human
ugcuuccccugggaaucuaaacugggaauggccgaggaggaaggggcuccgugcacuugcaggc

SEQ ID NO: 225310 - RNA, 64 nt, Human
uaccugguauucuuugaauuuuuuuuuuuuuuggaggaggaagagagcaacaaauuugauuaua

SEQ ID NO: 225311 - RNA, 64 nt, Human
uuuccacgugagaaauggggagaacgcugcuguuaggaggaaguuguguccaguucagggugcc

SEQ ID NO: 225312 - RNA, 64 nt, Human
caccauggugcccaucguguuacuccauugucagaggaggaaacggggucaggcaggaaagcaa

SEQ ID NO: 225313 - RNA, 64 nt, Human
acuuugauuccuucaggcccuugucagcuaccgaaggaggaagacaguggcuucaccuguccuu

SEQ ID NO: 225314 - RNA, 64 nt, Human
guaggggugggggugggauggcaggaggagccgcaggaggaaggagguugugcagggucuggac

SEQ ID NO: 225315 - RNA, 64 nt, Human
auaauuacaaacgggucacagguacuagucuuggaggaggaacuuuuuuuggucucugcugucu

SEQ ID NO: 225316 - RNA, 64 nt, Human
cccaaaguuuagggauugaaaacaugcuucuuugaggaggaaaccccuuuagguucagaagaau

SEQ ID NO: 225317 - RNA, 64 nt, Human
gccaguuuccuucucauucuuuucuuugggguucaggaggaaaaacacaguccuagggacaaaa

SEQ ID NO: 225318 - RNA, 64 nt, Human
agaacuagaaucucacucacaguaauaagaaucuaggaggaauuccaaaccgaagcaggcaggg

SEQ ID NO: 225319 - RNA, 64 nt, Human
agccuggggaggagaagcuggcagcccucacugcaggaggaaggguggagugggcgcaggcacg

SEQ ID NO: 225320 - RNA, 64 nt, Human
agagugucguuaaaaaugggcaugguuguaauaaaggaggaaagugcgacuuuugaaauguuug

SEQ ID NO: 225321 - RNA, 64 nt, Human
agaaugguuuccacugaggacauucagccugggaaggaggaagucaccagcucgaggcgugugg

SEQ ID NO: 225322 - RNA, 64 nt, Human
agaaaaaaagaaaauuccccacuuggaaagaaagaggaggaacacuggauucuuacuuucugga

SEQ ID NO: 225323 - RNA, 58 nt, Human; identical to SEQ ID NO: 199994

SEQ ID NO: 225324 - RNA, 64 nt, Human
ccaagggaaggccccauuccggggcuguuccccgaggaggaagggaaggggcucugugugcccc

SEQ ID NO: 225325 - RNA, 64 nt, Human
cgaggaggaagggaaggggcucugugugccccccaggaggaagaggcccugaguccugggauca

SEQ ID NO: 225326 - RNA, 64 nt, Human
acaugccagccucuacguuagguucugcggauaaaggaggaauaagacagagucaggagaacug

SEQ ID NO: 225327 - RNA, 64 nt, Human
ggcaugcaguccuggcccagcucuaugggaaacaaggaggaaaguuagccacugaaggccaaaa

SEQ ID NO: 225328 - RNA, 62 nt, Human
cauagaaaccaccaaaagccccaauaaagcauccaggaggaacaguugcuuuucauuucuaa

SEQ ID NO: 225329 - RNA, 64 nt, Human
aagauggguaaacccucacaucagagugacauccaggaggaauaagcucccagggccugucuca

SEQ ID NO: 225330 - RNA, 64 nt, Human
gucuaggccaugguacaggagaacuguggcguguaggaggaauacuucaggaugagugaaggcu

SEQ ID NO: 225331 - RNA, 64 nt, Human
ugaggggcuucacuguuaccaggcauguaacagaaggaggaagacuaacacacacccccugccc

SEQ ID NO: 225332 - RNA, 64 nt, Human
uuuacgucuuguauguauuucuuuucuguucucaaggaggaaaauuggucuaggaagccuucua

SEQ ID NO: 225333 - RNA, 64 nt, Human
cucauuccagagagggugcugccccauacccggaaggaggaacgcugcacagagaggccaagaa

SEQ ID NO: 225334 - RNA, 64 nt, Human
agacuguugcuggacacgacgucuguguggagccaggaggaacacauguggugucuguauggcu

SEQ ID NO: 225335 - RNA, 64 nt, Human
augccgguacuuaaaagcuucauucagaagcuccaggaggaagaagaucgggaaguaaagaagc

SEQ ID NO: 225336 - RNA, 64 nt, Human
cagagggccacacagauaccccacguucuauauaaggaggaaaacgggaaagaauauaaaguua

SEQ ID NO: 225337 - RNA, 64 nt, Human
uuggaagcagagucuggguugguguggauagcaaaggaggaagucugagccccucauuggucuu

SEQ ID NO: 225338 - RNA, 64 nt, Human
acaaggacuccacacugugcucucuaguagcacaaggaggaaguuggacagaacauuggguagu

SEQ ID NO: 225339 - RNA, 64 nt, Human
uacccccuucucuuccaaguuucccacucacuugaggaggaaaaauggcaaaagaaagcugucu

SEQ ID NO: 225340 - RNA, 64 nt, Human
acagcaugaacucagagcauuguuuuaggguuggaggaggaacacgcuuucuuuacaucacuag

SEQ ID NO: 225341 - RNA, 64 nt, Human
ucucccugccugucaaucaccaccuuuccuccagaggaggaaaauuaucuccccugcaaagccc

SEQ ID NO: 225342 - RNA, 64 nt, Human
ggaucucccuggggcaggaaguggguggacuuggaggaggaacggcaagggccgguccccacac

SEQ ID NO: 225343 - RNA, 64 nt, Human
cagaaauugacuggacugucauugugugaagucuaggaggaaauguccauuuuaauuguaugau

SEQ ID NO: 225344 - RNA, 64 nt, Human
gccuuaucgucugcaaguguucuccaagggaaggaggaggaaacugugguguuccuuucuucca

SEQ ID NO: 225345 - RNA, 64 nt, Human
gagcgugugauuguagacagaggggugaagaaggaggaggaagaggcagagaaggaggagacca

SEQ ID NO: 225346 - RNA, 64 nt, Human
uucagacgcucggccgggaacgaaucccaccaccaggaggaaugccaaggcugggcccacagcg

SEQ ID NO: 225347 - RNA, 64 nt, Human
uauacauuuucucauucaaucuucuccugacauuaggaggaaucuacaaaaagcagcaauggga

SEQ ID NO: 225348 - RNA, 64 nt, Human
ggacaggucucugagacaggaucguugucccuacaggaggaacaguggccuugcuucuuagacg

SEQ ID NO: 225349 - RNA, 64 nt, Human
gaagcacuuuuuuauuaauauuuuccuuuguuaaaggaggaaccguaacucuccauagcuguac

SEQ ID NO: 225350 - RNA, 64 nt, Human
ucuccccacacuuucuugggacucccaccuuggaaggaggaagggcugaccuggguucucucca

SEQ ID NO: 225351 - RNA, 64 nt, Human
ugugaagaagaaaaaaaccccuggccuuugggccaggaggaaucuguuacucgaauccacccag

SEQ ID NO: 225352 - RNA, 64 nt, Human
cgcacucccugguguggucagccucucucacacaaggaggaacuugggugaaggcugaguguga

SEQ ID NO: 225353 - RNA, 64 nt, Human
cuccagcccucucacugugucccucucucuggaaaggaggaaggagccuauggcaucuucccca

SEQ ID NO: 225354 - RNA, 64 nt, Human
uugaagggggcgcccugcuccccucagaucagucaggaggaagaugacuaaggggagggauccu

SEQ ID NO: 225355 - RNA, 64 nt, Human
auggccccaaagcugggccagaguuaagggaaagaggaggaaguccuaagcagagaaguagcac

SEQ ID NO: 225356 - RNA, 62 nt, Human
acccagggcucuguaaguagaugcauuuggguccaggaggaagcguggacaccucguaggga

SEQ ID NO: 225357 - RNA, 64 nt, Human
acacuggugcaggacagcccacccuccuacagcuaggaggaacuaccacuuuguguucugguua

SEQ ID NO: 225358 - RNA, 64 nt, Human
uagcuuauucuaucaaucacggaagaggcagucaaggaggaaggagagacauuaggagccgaua

SEQ ID NO: 225359 - RNA, 64 nt, Human
uugaccaaaagugaguggggcgggaggaaggggcaggaggaaggguugagguuacuuggggcga

SEQ ID NO: 225360 - RNA, 64 nt, Human
ggggagcagggucaugaacuuuuuucuuuagugaaggaggaauacaaucaaggguuuuguauuc

SEQ ID NO: 225361 - RNA, 64 nt, Human
gaagugcuuaacacagccgggcuugggggcagucaggaggaagcuggccauccguggaggaggg

SEQ ID NO: 225362 - RNA, 64 nt, Human
ggguuugcauuuuggauuaauucaugcaaaaugaaggaggaagccuggucuaagaagauacugu

SEQ ID NO: 225363 - RNA, 64 nt, Human
cuaagcuugacaucugugagugacugagggagacaggaggaauaccagguuauucauggaauaa

SEQ ID NO: 225364 - RNA, 64 nt, Human
agggggcuaccagacaguguucucaacuugguuaaggaggaagaaaacccagucaaugaaauuc

SEQ ID NO: 225365 - RNA, 64 nt, Human
acuccuccccgaguccugcccuggaaccaaaggaaggaggaacacugaggggaauccugaagua

SEQ ID NO: 225366 - RNA, 64 nt, Human
agaaagagcugggggaagggcagaagacugguuuaggaggaaaaggaaauaaggagaaaagaga

SEQ ID NO: 225367 - RNA, 64 nt, Human
ucuacucaacuauccgaauauguccauuucgcagaggaggaaagugaggcccagggagugcaga

SEQ ID NO: 225368 - RNA, 64 nt, Human
gagucaucuuuguagaguuacuaagcauuagcaaaggaggaaaugcuauguaauagaaauauua

SEQ ID NO: 225369 - RNA, 64 nt, Human
gacugguucugaggccagaaaggugugaggagagaggaggaaaagucuuccuaauugugccccu

SEQ ID NO: 225370 - RNA, 64 nt, Human
uggguggagaagggaggguggccagcacuaguaaaggaggaauagugcuugcuggccacaagga

SEQ ID NO: 225371 - RNA, 64 nt, Human
cucucaggcaagugagcuuuaauuaccauguuaaaggaggaaagagcuagaaaaaaaaaccuca

SEQ ID NO: 225372 - RNA, 64 nt, Human
cuccucuaguuagcugaaacugggaccuaauaaaaggaggaaauguuuucccacaguucuaggg

SEQ ID NO: 225373 - RNA, 64 nt, Human
uggcugugaagggaagucuuuguugcaaaggaggaggaggaaaagggaggacuugguaggguuu

SEQ ID NO: 225374 - RNA, 64 nt, Human
cuccucauccggacugaggaagacgaggacagggaggaggaaaaggaggaagaggaggacaaaa

SEQ ID NO: 225375 - RNA, 64 nt, Human
cggacugaggaagacgaggacagggaggaggaaaaggaggaagaggaggacaaaaagggggagg

SEQ ID NO: 225376 - RNA, 64 nt, Human
gacaaaaagggggaggagaagguucuucguccaaaggaggaaggagaagaaguagaaagugcga

SEQ ID NO: 225377 - RNA, 64 nt, Human
ggagucgagagagugcaguucagggaaaaaggagaggaggaaacagugaggcagggagaaaggc

SEQ ID NO: 225378 - RNA, 64 nt, Human
acauuugcuguagcaucuggucucacggacucugaggaggaauuggaaauuggucucuuuugag

SEQ ID NO: 225379 - RNA, 64 nt, Human
acccagccuuuucauuuucgauugcacagcggggaggaggaauggcuuuguggucgucguugug

SEQ ID NO: 225380 - RNA, 64 nt, Human
ggucuagaauggauuuuucccggagccggaagccaggaggaaacuacaccacacuaaaacauug

SEQ ID NO: 225381 - RNA, 64 nt, Human
caacuggguaugcaucagguaucuaauagcagggaggaggaaggccuguugcugcaaucauugu

SEQ ID NO: 225382 - RNA, 64 nt, Human
auggcccuaaucccaaccccaaccccaugggaggaggaggaagaggaggaggaggaggaggagg

SEQ ID NO: 225383 - RNA, 64 nt, Human
gggauguuucugaacuuugggaguuauaggagacaggaggaacuucuccuccuccuccuccccu

SEQ ID NO: 225384 - RNA, 64 nt, Human
cucccucucccuuccccugacuguuccacccaggaggaggaaacuucacauagccgugcucaca

SEQ ID NO: 225385 - RNA, 64 nt, Human
ggcaccucauuaagaugcugggcagcaguauaacaggaggaagagaucccucuccuuuggucag

SEQ ID NO: 225386 - RNA, 64 nt, Human
uccuacccaucccugcaugaagcagcuuugagagaggaggaagagggagucugagcaugagcug

SEQ ID NO: 225387 - RNA, 64 nt, Human
ggugaccucagcaguaccuggaugauucccaccaaggaggaauggccaaaccagaugggugaga

SEQ ID NO: 225388 - RNA, 64 nt, Human
auccagcggcuucugaaagugccuuggugugagaaggaggaaggggccgcuuggagagcugggc

SEQ ID NO: 225389 - RNA, 64 nt, Human
ggcccagcgcguccuuggaaaucuguggcccuggaggaggaacaggagggcccugggaccaggc

SEQ ID NO: 225390 - RNA, 64 nt, Human
ggaggaugcguaagagacccagaacuuccacagaaggaggaaaauuaaccuccugcuucucuag

SEQ ID NO: 225391 - RNA, 64 nt, Human; identical to SEQ ID NO: 200065

SEQ ID NO: 225392 - RNA, 64 nt, Human; identical to SEQ ID NO: 200066

SEQ ID NO: 225393 - RNA, 53 nt, Human; identical to SEQ ID NO: 200069

SEQ ID NO: 225394 - RNA, 64 nt, Human
uccagcaugggacuggccugccuccuccgcccagcucggcgagcuccuccagaccuccuaggcc

SEQ ID NO: 225395 - RNA, 64 nt, Human
gauuuauuuuuacuuggauuguaagauuuaucuccucggcgauuccuugucauuuuuggagguc

SEQ ID NO: 225396 - RNA, 64 nt, Human; identical to SEQ ID NO: 200067

SEQ ID NO: 225397 - RNA, 64 nt, Human; identical to SEQ ID NO: 200068

SEQ ID NO: 225398 - RNA, 64 nt, Human; identical to SEQ ID NO: 200072

SEQ ID NO: 225399 - RNA, 64 nt, Human; identical to SEQ ID NO: 200073

SEQ ID NO: 225400 - RNA, 64 nt, Human; identical to SEQ ID NO: 200074

SEQ ID NO: 225401 - RNA, 64 nt, Human; identical to SEQ ID NO: 200075

SEQ ID NO: 225402 - RNA, 64 nt, Human; identical to SEQ ID NO: 200076

SEQ ID NO: 225403 - RNA, 64 nt, Human; identical to SEQ ID NO: 200077

SEQ ID NO: 225404 - RNA, 64 nt, Human; identical to SEQ ID NO: 200078

SEQ ID NO: 225405 - RNA, 64 nt, Human; identical to SEQ ID NO: 200079

SEQ ID NO: 225406 - RNA, 64 nt, Human; identical to SEQ ID NO: 200080

SEQ ID NO: 225407 - RNA, 64 nt, Human; identical to SEQ ID NO: 200081

SEQ ID NO: 225408 - RNA, 64 nt, Human; identical to SEQ ID NO: 200082

SEQ ID NO: 225409 - RNA, 64 nt, Human; identical to SEQ ID NO: 200083

SEQ ID NO: 225410 - RNA, 64 nt, Human; identical to SEQ ID NO: 200084

SEQ ID NO: 225411 - RNA, 64 nt, Human; identical to SEQ ID NO: 200085

SEQ ID NO: 225412 - RNA, 64 nt, Human
agcauggggccuggccaggcuauucgccuggaagcucggcgaauucucaggauggcggcugggg

SEQ ID NO: 225413 - RNA, 64 nt, Human
ugugacuaacuaacugccccaccccagccgagaccucggcgagacuguaacuagugauguuugu

SEQ ID NO: 225414 - RNA, 64 nt, Human
uccuaaacucgaaccguuucacugucagccugcccucggcgacccaucacuggguaugcuauug

SEQ ID NO: 225415 - RNA, 64 nt, Human; identical to SEQ ID NO: 200086

SEQ ID NO: 225416 - RNA, 64 nt, Human; identical to SEQ ID NO: 200087

SEQ ID NO: 225417 - RNA, 64 nt, Human; identical to SEQ ID NO: 200092

SEQ ID NO: 225418 - RNA, 64 nt, Human; identical to SEQ ID NO: 200093

SEQ ID NO: 225419 - RNA, 64 nt, Human; identical to SEQ ID NO: 200094

SEQ ID NO: 225420 - RNA, 64 nt, Human; identical to SEQ ID NO: 200095

SEQ ID NO: 225421 - RNA, 64 nt, Human; identical to SEQ ID NO: 200096

SEQ ID NO: 225422 - RNA, 64 nt, Human; identical to SEQ ID NO: 200097

SEQ ID NO: 225423 - RNA, 64 nt, Human; identical to SEQ ID NO: 200098

SEQ ID NO: 225424 - RNA, 64 nt, Human; identical to SEQ ID NO: 200099

SEQ ID NO: 225425 - RNA, 64 nt, Human; identical to SEQ ID NO: 200100

SEQ ID NO: 225426 - RNA, 64 nt, Human; identical to SEQ ID NO: 200101

SEQ ID NO: 225427 - RNA, 64 nt, Human; identical to SEQ ID NO: 200102

SEQ ID NO: 225428 - RNA, 64 nt, Human; identical to SEQ ID NO: 200103

SEQ ID NO: 225429 - RNA, 64 nt, Human; identical to SEQ ID NO: 200104

SEQ ID NO: 225430 - RNA, 64 nt, Human
cgaggccaagacuuugauuuaaaagaaaacacaccucggcgacaaugucuugcugcucggauua

SEQ ID NO: 225431 - RNA, 57 nt, Human
gagaggcagagaagaaaugagcccucccucggcgaagccuccagcaggccacaccag

SEQ ID NO: 225432 - RNA, 64 nt, Human
auggaaugaccaacucuuaaaagccugauaggcucucggcgaggagcuuugaacgugucugaag

SEQ ID NO: 225433 - RNA, 64 nt, Human
aggcccaggacacucaaccccaggaggggagccgcucggcgaaugagcugggugggugcccagg

SEQ ID NO: 225434 - RNA, 64 nt, Human
acccacgaugcugcacgggcccgcccugguggggcucggcgaguaauguguuuuguccccaguu

SEQ ID NO: 225435 - RNA, 64 nt, Human
agccgccuccgcuggaggcccggugugguuccgccucggcgaggcgcgagacaggcgcugcugc

SEQ ID NO: 225436 - RNA, 64 nt, Human
ugggacagaccaaaaccacugacagauggcaaggcucggcgauucugauuucccuucucaaauc

SEQ ID NO: 225437 - RNA, 64 nt, Human
gcaaugaacuaugaucacaccacugcacuccagccucggcgacagagcaagaccuuguuucuca

SEQ ID NO: 225438 - RNA, 64 nt, Human
gcguuuggcagggcugaggggggccucuuuuucucucggcgaccccgccccgcacgcgcccucc

SEQ ID NO: 225439 - RNA, 64 nt, Human
cugcagccaggagagagggggcucaccucuuauccucggcgacccacugcacaagcaggccgcu

SEQ ID NO: 225440 - RNA, 64 nt, Human
ucuggcagccgggcagugcccuccccgucccaugcucggcgagccucccucuacucggcacugu

SEQ ID NO: 225441 - RNA, 64 nt, Human
agagaaagccaggagguaagagccagcugauauccucggcgaacaugucucuccugaguccaga

SEQ ID NO: 225442 - RNA, 64 nt, Human
uggccauauuggcugcagcaggaauggugcccaccucggcgaauugaagggcuaagagucccag

SEQ ID NO: 225443 - RNA, 64 nt, Human
gcagcugguggaugcaucucagaucccgguuccucucggcgaaugcugcuugcgaaugugugcg

SEQ ID NO: 225444 - RNA, 64 nt, Human
uucaagcugcccacagaacuggugcggcucagagcucggcgaguuugcugggagcugggagcag

SEQ ID NO: 225445 - RNA, 64 nt, Human
aaaccaaggucaggaggccguugcagacauaaaucucggcgacucggccccgucuccugagggu

SEQ ID NO: 225446 - RNA, 64 nt, Human; identical to SEQ ID NO: 36852

SEQ ID NO: 225447 - RNA, 64 nt, Human; identical to SEQ ID NO: 36853

SEQ ID NO: 225448 - RNA, 64 nt, Human; identical to SEQ ID NO: 36854

SEQ ID NO: 225449 - RNA, 64 nt, Human; identical to SEQ ID NO: 36855

SEQ ID NO: 225450 - RNA, 64 nt, Human; identical to SEQ ID NO: 36856

SEQ ID NO: 225451 - RNA, 64 nt, Human; identical to SEQ ID NO: 36857

SEQ ID NO: 225452 - RNA, 64 nt, Human; identical to SEQ ID NO: 36858

SEQ ID NO: 225453 - RNA, 64 nt, Human; identical to SEQ ID NO: 36859

SEQ ID NO: 225454 - RNA, 64 nt, Human; identical to SEQ ID NO: 36860

SEQ ID NO: 225455 - RNA, 64 nt, Human; identical to SEQ ID NO: 36861

SEQ ID NO: 225456 - RNA, 64 nt, Human; identical to SEQ ID NO: 36862

SEQ ID NO: 225457 - RNA, 64 nt, Human
aagagacuuuccuuucaaggcuucccauggguccgcgccacacagggccggugcugcuuuauuu

SEQ ID NO: 225458 - RNA, 64 nt, Human
aaucuggggugucuguaaugucaccccuccagcagcgccacaaggacugagguuggguaggugu

SEQ ID NO: 225459 - RNA, 64 nt, Human
acaacaacuaccugcccuaccccauccaccaagugcgccacauggccuuccagcugugccaggc

SEQ ID NO: 225460 - RNA, 64 nt, Human; identical to SEQ ID NO: 36863

SEQ ID NO: 225461 - RNA, 64 nt, Human; identical to SEQ ID NO: 36864

SEQ ID NO: 225462 - RNA, 64 nt, Human; identical to SEQ ID NO: 36865

SEQ ID NO: 225463 - RNA, 64 nt, Human; identical to SEQ ID NO: 36866

SEQ ID NO: 225464 - RNA, 64 nt, Human; identical to SEQ ID NO: 36867

SEQ ID NO: 225465 - RNA, 64 nt, Human; identical to SEQ ID NO: 36868

SEQ ID NO: 225466 - RNA, 64 nt, Human; identical to SEQ ID NO: 36869

SEQ ID NO: 225467 - RNA, 64 nt, Human; identical to SEQ ID NO: 36870

SEQ ID NO: 225468 - RNA, 52 nt, Human; identical to SEQ ID NO: 36871

SEQ ID NO: 225469 - RNA, 63 nt, Human; identical to SEQ ID NO: 36872

SEQ ID NO: 225470 - RNA, 64 nt, Human; identical to SEQ ID NO: 36873

SEQ ID NO: 225471 - RNA, 64 nt, Human; identical to SEQ ID NO: 36874

SEQ ID NO: 225472 - RNA, 64 nt, Human; identical to SEQ ID NO: 36875

SEQ ID NO: 225473 - RNA, 64 nt, Human; identical to SEQ ID NO: 36876

SEQ ID NO: 225474 - RNA, 64 nt, Human; identical to SEQ ID NO: 36877

SEQ ID NO: 225475 - RNA, 64 nt, Human
gcaggggaauguacugaaaggagccugcucuuccgcgccacacuucaauggcacugauagaaca

SEQ ID NO: 225476 - RNA, 64 nt, Human
uucgucuaguaacuuaagugagagagaaagggcagcgccacagaagccccuaaacgccgccucg

SEQ ID NO: 225477 - RNA, 64 nt, Human
ugaugucugucugcugccaggauggagcagaggagcgccacacauggaggaaagccccuguaac

SEQ ID NO: 225478 - RNA, 64 nt, Human; identical to SEQ ID NO: 36878

SEQ ID NO: 225479 - RNA, 64 nt, Human; identical to SEQ ID NO: 36879

SEQ ID NO: 225480 - RNA, 64 nt, Human
gcuugcugugcgucuuccaaacuaaagccugcaagcgccacaauucuaagugccgccuuccauu

SEQ ID NO: 225481 - RNA, 64 nt, Human
cucacaucaggagguagauagcucugaaaugacagcgccacagccauagugacugcaugagcca

SEQ ID NO: 225482 - RNA, 64 nt, Human
guggaaaaaucaauauauaacuuagugcuagcuagcgccacagacucuaguagauaauauuauc

SEQ ID NO: 225483 - RNA, 64 nt, Human
ccgguccccgucgcagacggagugcacgugcccugcgccacauccucacgcucgguggagggac

SEQ ID NO: 225484 - RNA, 64 nt, Human
gcguggauccacggggccaggccacccugcgggagcgccacacgcauccacuucggauucagug

SEQ ID NO: 225485 - RNA, 64 nt, Human
aggucaaagcagagagcuggguguugcauccugggcgccacaugcucauggccagaaucuuaaa

SEQ ID NO: 225486 - RNA, 64 nt, Human
agccgaugugcacuggccaccaccaggguugggggcgccacagcugcgagcccggccccugcug

SEQ ID NO: 225487 - RNA, 64 nt, Human
cgccgaccugugacucgcuugagaugggaaagcggcgccacagaccccgggucuccuuggcugu

SEQ ID NO: 225488 - RNA, 64 nt, Human
uguaaacauaggauuuuagagucuauuuccccaagcgccacauuauaacuguaaacuuaccauc

SEQ ID NO: 225489 - RNA, 64 nt, Human
gcuggccacggagggcuccugccucucuucuucagcgccacaaaauuacauggaggccagcugg

SEQ ID NO: 225490 - RNA, 64 nt, Human
uuccaugaggaacuuuccccuucagaucaccucugcgccacaucucauccaugccuccuccaug

SEQ ID NO: 225491 - RNA, 64 nt, Human
gugccagaaaugucagguauguguccuucccuuggcgccacauaguaguuuacuaauguuuggg

SEQ ID NO: 225492 - RNA, 64 nt, Human
cgaagccccaugagcuccuggcggaaggaacgaggcgccacaccccugcucuuccuccugaccc

SEQ ID NO: 225493 - RNA, 64 nt, Human
gcgcggcccucccgaguuaaggugggcccggcccgcgccacaggacccucgccggacccucuaa

SEQ ID NO: 225494 - RNA, 64 nt, Human
uaaauuauauauauauacauauauauauauauaugcgccacauaaucaacagaaagauggggcu

SEQ ID NO: 225495 - RNA, 64 nt, Human
agagcucggcgccgcugcucccgccgccgccucagcgccacacaucgccgggacacccgcgccg

SEQ ID NO: 225496 - RNA, 64 nt, Human
gcaagcggggcgccuuccaccuggcugggggucugcgccacaguuugguccagaggagggagga

SEQ ID NO: 225497 - RNA, 64 nt, Human
ggaucucugacuucuuauuaccuccgauuggaacgcgccacaaaucauccugcuuucuuuaucc

SEQ ID NO: 225498 - RNA, 64 nt, Human
aagaggggaagaagaugagagaccugcaaauccagcgccacagaagccaggugaccagggaccc

SEQ ID NO: 225499 - RNA, 64 nt, Human
cuccgccggcuaccuuagcuuagcgugucagcgggcgccacagcggaucagcgguuccguguuc

SEQ ID NO: 225500 - RNA, 64 nt, Human
aagggaagucauucuaaagaguccaaagucaguagcgccacaucugguuuauaaaguaagagau

SEQ ID NO: 225501 - RNA, 64 nt, Human
cgagacacuuuauauggcccugcacagaccuggagcgccacacacugcacaucuuuuggugauc

SEQ ID NO: 225502 - RNA, 64 nt, Human
ggcugcgaccgccccggagagcagcuucacacuggcgccacagaggagccccacgugcacuccc

SEQ ID NO: 225503 - RNA, 64 nt, Human
aguaauauuuguauuuggcuguugugcuuuccaagcgccacaguugcccuccccggacguggug

SEQ ID NO: 225504 - RNA, 64 nt, Human
guuucugcugacacaucaacgucuacacaccuaugcgccacauuuuacagcuguaaaguguuag

SEQ ID NO: 225505 - RNA, 64 nt, Human
aagccgaguugcugugggcgugcccggaagcagagcgccacacucgcugcuuaagcucccccag

SEQ ID NO: 225506 - RNA, 64 nt, Human
cacacgcauccgcaucggccucccugcccacaaagcgccacaacggugaccagccggagcagcc

SEQ ID NO: 225507 - RNA, 64 nt, Human
uucuaaaggagcgggcccacucuggacccaccuggcgccacagaggaagcugccugccggagga

SEQ ID NO: 225508 - RNA, 64 nt, Human
acuugcugugggcccaucuggucuugccuucucagcgccacagggaaggccaagcuguucuagu

SEQ ID NO: 225509 - RNA, 62 nt, Human
ugaccgaugacaagcugugacuccagcugggggcgccacagcacccaccaccugccgccuuc

SEQ ID NO: 225510 - RNA, 64 nt, Human
gugagaaggcauuugccaaaccaagccagcuggagcgccacagccgcauacauacagguaacgg

SEQ ID NO: 225511 - RNA, 64 nt, Human
caggggcuugcuagggaaccugcaugccuaguaagcgccacaggugacucugaugcaggcgcca

SEQ ID NO: 225512 - RNA, 64 nt, Human
ugccuaguaagcgccacaggugacucugaugcaggcgccacagccacacuugaagaaacacagc

SEQ ID NO: 225513 - RNA, 64 nt, Human
aaagcacggggccuuucccacccacccucagccagcgccacacggcacccacagacugggugcc

SEQ ID NO: 225514 - RNA, 64 nt, Human
acguggaggagcugggggucgccggaaacaucgugcgccacaucccggaccgcggugagugggg

SEQ ID NO: 225515 - RNA, 64 nt, Human
uaacaagaaaaucaaagcugaggacagggugugagcgccacaucucugaaagcacaggagacac

SEQ ID NO: 225516 - RNA, 64 nt, Human
agacagugccggccagcagagaagcagagagccagcgccacacaacaucaagaaggccgacaac

SEQ ID NO: 225517 - RNA, 64 nt, Human
ucgaagaccccaagacagcccucugcucucagcggcgccacagagagccugggcucagccuucu

SEQ ID NO: 225518 - RNA, 64 nt, Human
auuccugaagcucccagcuggacaccacuccugagcgccacaucccaugaucacuucaaccaca

SEQ ID NO: 225519 - RNA, 64 nt, Human
cucugaccagccgaaccaggaacucaaucaaaaugcgccacagcaggaccacaagggcaaggag

SEQ ID NO: 225520 - RNA, 64 nt, Human
ucuggcagcgagccuucaaugccaccucguuccugcgccacauccggaagcuggggcagauccc

SEQ ID NO: 225521 - RNA, 64 nt, Human
uaaugugguggccugcaagccaggccaucccugggcgccacagacgagcuccgagccaggucag

SEQ ID NO: 225522 - RNA, 64 nt, Human; identical to SEQ ID NO: 225457

SEQ ID NO: 225523 - RNA, 64 nt, Human; identical to SEQ ID NO: 225458

SEQ ID NO: 225524 - RNA, 64 nt, Human; identical to SEQ ID NO: 225459

SEQ ID NO: 225525 - RNA, 64 nt, Human; identical to SEQ ID NO: 225475

SEQ ID NO: 225526 - RNA, 64 nt, Human; identical to SEQ ID NO: 225476

SEQ ID NO: 225527 - RNA, 64 nt, Human; identical to SEQ ID NO: 225477

SEQ ID NO: 225528 - RNA, 64 nt, Human; identical to SEQ ID NO: 225480

SEQ ID NO: 225529 - RNA, 64 nt, Human; identical to SEQ ID NO: 225481

SEQ ID NO: 225530 - RNA, 64 nt, Human; identical to SEQ ID NO: 225482

SEQ ID NO: 225531 - RNA, 64 nt, Human; identical to SEQ ID NO: 225483

SEQ ID NO: 225532 - RNA, 64 nt, Human; identical to SEQ ID NO: 225484

SEQ ID NO: 225533 - RNA, 64 nt, Human; identical to SEQ ID NO: 225485

SEQ ID NO: 225534 - RNA, 64 nt, Human; identical to SEQ ID NO: 225486

SEQ ID NO: 225535 - RNA, 64 nt, Human; identical to SEQ ID NO: 225487

SEQ ID NO: 225536 - RNA, 64 nt, Human; identical to SEQ ID NO: 225488

SEQ ID NO: 225537 - RNA, 64 nt, Human; identical to SEQ ID NO: 225489

SEQ ID NO: 225538 - RNA, 64 nt, Human; identical to SEQ ID NO: 225490

SEQ ID NO: 225539 - RNA, 64 nt, Human; identical to SEQ ID NO: 225491

SEQ ID NO: 225540 - RNA, 64 nt, Human; identical to SEQ ID NO: 225492

SEQ ID NO: 225541 - RNA, 64 nt, Human; identical to SEQ ID NO: 225493

SEQ ID NO: 225542 - RNA, 64 nt, Human; identical to SEQ ID NO: 225494

SEQ ID NO: 225543 - RNA, 64 nt, Human; identical to SEQ ID NO: 225495

SEQ ID NO: 225544 - RNA, 64 nt, Human; identical to SEQ ID NO: 225496

SEQ ID NO: 225545 - RNA, 64 nt, Human; identical to SEQ ID NO: 225497

SEQ ID NO: 225546 - RNA, 64 nt, Human; identical to SEQ ID NO: 225498

SEQ ID NO: 225547 - RNA, 64 nt, Human; identical to SEQ ID NO: 225499

SEQ ID NO: 225548 - RNA, 64 nt, Human; identical to SEQ ID NO: 225500

SEQ ID NO: 225549 - RNA, 64 nt, Human; identical to SEQ ID NO: 225501

SEQ ID NO: 225550 - RNA, 64 nt, Human; identical to SEQ ID NO: 225502

SEQ ID NO: 225551 - RNA, 64 nt, Human; identical to SEQ ID NO: 225503

SEQ ID NO: 225552 - RNA, 64 nt, Human; identical to SEQ ID NO: 225504

SEQ ID NO: 225553 - RNA, 64 nt, Human; identical to SEQ ID NO: 225505

SEQ ID NO: 225554 - RNA, 64 nt, Human; identical to SEQ ID NO: 225506

SEQ ID NO: 225555 - RNA, 64 nt, Human; identical to SEQ ID NO: 225507

SEQ ID NO: 225556 - RNA, 64 nt, Human; identical to SEQ ID NO: 225508

SEQ ID NO: 225557 - RNA, 62 nt, Human; identical to SEQ ID NO: 225509

SEQ ID NO: 225558 - RNA, 64 nt, Human; identical to SEQ ID NO: 225510

SEQ ID NO: 225559 - RNA, 64 nt, Human; identical to SEQ ID NO: 225511

SEQ ID NO: 225560 - RNA, 64 nt, Human; identical to SEQ ID NO: 225512

SEQ ID NO: 225561 - RNA, 64 nt, Human; identical to SEQ ID NO: 225513

SEQ ID NO: 225562 - RNA, 64 nt, Human; identical to SEQ ID NO: 225514

SEQ ID NO: 225563 - RNA, 64 nt, Human; identical to SEQ ID NO: 225515

SEQ ID NO: 225564 - RNA, 64 nt, Human; identical to SEQ ID NO: 225516

SEQ ID NO: 225565 - RNA, 64 nt, Human; identical to SEQ ID NO: 225517

SEQ ID NO: 225566 - RNA, 64 nt, Human; identical to SEQ ID NO: 225518

SEQ ID NO: 225567 - RNA, 64 nt, Human; identical to SEQ ID NO: 225519

SEQ ID NO: 225568 - RNA, 64 nt, Human; identical to SEQ ID NO: 225520

SEQ ID NO: 225569 - RNA, 64 nt, Human; identical to SEQ ID NO: 225521

SEQ ID NO: 225570 - RNA, 58 nt, Human
gcucuuggcuaagaccaggaggcugcaagucuccuagaagcccucugagcuccagagg

SEQ ID NO: 225571 - RNA, 58 nt, Human
augaaaccagccaacugcuuuuugugcggucuccuauaggaaguaucgcaauuguuuu

SEQ ID NO: 225572 - RNA, 58 nt, Human
uucaaaaagaauuagcauagaaauccuggucuccuagccaaaaaaaucaaaggauuuu

SEQ ID NO: 225573 - RNA, 58 nt, Human
uccauucuucucugucucugucuugcaugucuccuaccaugucacugucccugggcca

SEQ ID NO: 225574 - RNA, 58 nt, Human
ggaauauucaagauuauaaagguaucaggucuccuaaaauugaucuauggauuuaaua

SEQ ID NO: 225575 - RNA, 58 nt, Human
aaaugaugaaaccaacccucaaaaaacagucuccuaaccagccauccccuccuguggg

SEQ ID NO: 225576 - RNA, 58 nt, Human
uuguguacccuuugcagaaaugcuuuuggucuccuacccaaauacucacaagggucuu

SEQ ID NO: 225577 - RNA, 58 nt, Human
ucaccuucuuaggcccgggaaaaugccggucuccuacucuucauggccuuuguaccug

SEQ ID NO: 225578 - RNA, 58 nt, Human
ccugggcuuaagugaucugccugccuuggucuccuaaagugcugggauuauaggugug

SEQ ID NO: 225579 - RNA, 58 nt, Human
aaucuagacuucucuuuauagguuucaggucuccuaugggugccugggaaguccuuga

SEQ ID NO: 225580 - RNA, 58 nt, Human
uccaggcucccuaccugcuugucuaccugucuccuacccaccuguaucucuuguuggg

SEQ ID NO: 225581 - RNA, 58 nt, Human
auuacaauuuuaucuguuuccugacauugucuccuauauauuucuauuauuaauugca

SEQ ID NO: 225582 - RNA, 58 nt, Human
auuaucacagacugaauagaucuuaacugucuccuacauguguguuuucaaaugugua

SEQ ID NO: 225583 - RNA, 58 nt, Human
cccuuagcccaacccuccaaggccucaugucuccuaagcaugcugacugcauccgaaa

SEQ ID NO: 225584 - RNA, 58 nt, Human
ggaaucugccuccggugugagggaaccugucuccuaccacuucggagccaugggggca

SEQ ID NO: 225585 - RNA, 58 nt, Human
uuuacagaauugcuuguuugcuucaacugucuccuaccucugcucuuggaggagaugg

SEQ ID NO: 225586 - RNA, 58 nt, Human
aacaagaugagcuaaucgaaaagcccaugucuccuaugcaguacgcacgaucuggucu

SEQ ID NO: 225587 - RNA, 58 nt, Human
ccuccauaaauaugucgguggacggggcgucuccuaauaaaccugauaccaagaagac

SEQ ID NO: 225588 - RNA, 58 nt, Human
auaucacauugccccugauguuuugacagucuccuagugcuccugguagugccacuaa

SEQ ID NO: 225589 - RNA, 58 nt, Human
uaauguuacauguuuaauuguaauauuugucuccuaucauuuucuucccuuucaguca

SEQ ID NO: 225590 - RNA, 58 nt, Human
ccauucuuuauaucaauguauaguuuuagucuccuaaauugaucuguuauuuuccaaa

SEQ ID NO: 225591 - RNA, 58 nt, Human
aaguaugccuaccccuggccagucugaggucuccuagccauagaacugacuccuggaa

SEQ ID NO: 225592 - RNA, 58 nt, Human
gaaaaaacuuuuaaaaauauuucuuauagucuccuaacauuugucucuagccuuugcc

SEQ ID NO: 225593 - RNA, 58 nt, Human
uuucugacacacugauggcaugugacuugucuccuaagucagugaggcaucacuuugu

SEQ ID NO: 225594 - RNA, 58 nt, Human
aaaauuacugaagaauaaguuuccauaagucuccuacauagcaguguuauuuauguac

SEQ ID NO: 225595 - RNA, 58 nt, Human
uuuaacauucuuuuguuuauauuguuuugucuccuaaauuguuguaauugcauuauaa

SEQ ID NO: 225596 - RNA, 58 nt, Human
uacacgcucuauuaacuuugccuaauaagucuccuagguuacuaacuuacuuaccuaa

SEQ ID NO: 225597 - RNA, 58 nt, Human
auuugcaucauuugcauauugauuucaagucuccuaauuuggaauggguaaaguacaa

SEQ ID NO: 225598 - RNA, 58 nt, Human
guaguucucaggaccuguucaagaaggugucuccuaggggcagccugaaugccucccu

SEQ ID NO: 225599 - RNA, 58 nt, Human
ccauuaucaguggaguagugggucccuggucuccuacaaauccugggacauuggaucc

SEQ ID NO: 225600 - RNA, 58 nt, Human
agucaguggcuuugcauagcuuucacaagucuccuagacacuccccacgggaaacuca

SEQ ID NO: 225601 - RNA, 58 nt, Human
uuucccuuuauucaagcugucaauuuuugucuccuaaacaucuucuaguuauauucuc

SEQ ID NO: 225602 - RNA, 58 nt, Human
gaguguguacugguuccugcagguagcagucuccuauuaucuccuguuuagcaccaaa

SEQ ID NO: 225603 - RNA, 58 nt, Human
uguccauugaaaagaaaauaggcgcuuugucuccuacaaucuuagagaaaguuuuaca

SEQ ID NO: 225604 - RNA, 58 nt, Human
guuucucguuaguggcaguagugccuccgucuccuagugauaaugcuccaagucuaug

SEQ ID NO: 225605 - RNA, 58 nt, Human
aaccaaaucaagacacagaacaaggucugucuccuauagucacucaagaagucgaucg

SEQ ID NO: 225606 - RNA, 58 nt, Human
guguggguucaucacaguguugccuuuugucuccuaaagauagggaucuacuuuugaa

SEQ ID NO: 225607 - RNA, 58 nt, Human
ggcacugccaggguucaaugggccagccgucuccuacuccaccuuggauuuuucucuc

SEQ ID NO: 225608 - RNA, 58 nt, Human
ccuauuuaugaaaaccauaugauauuuugucuccuaccugcugcugcuauuauguaac

SEQ ID NO: 225609 - RNA, 58 nt, Human
cuguguaguuucagaccagaccugaauagucuccuaugcccuccaaaagucggguccu

SEQ ID NO: 225610 - RNA, 58 nt, Human
accacgguuaacuggaaaagcacuuucagucuccuauaacccucccaccagcugcugc

SEQ ID NO: 225611 - RNA, 58 nt, Human
acauggcauaaaugaaaggaauuuuauagucuccuaaauggcguguacugcaagaccu

SEQ ID NO: 225612 - RNA, 58 nt, Human
uuacuuuuuauaaaguuuuuuuuccuuagucuccuacuuagagauauucuagaaaaug

SEQ ID NO: 225613 - RNA, 58 nt, Human
ugcugucugcuucugaaucacugggggugucuccuaagaacugugccucggguuuuuc

SEQ ID NO: 225614 - RNA, 58 nt, Human
uagagcacuucaaucuauuuaagccuuugucuccuaacugaaacauuauuucuaaaua

SEQ ID NO: 225615 - RNA, 58 nt, Human
uuaguaagaauaugaacaauuuccugaugucuccuauaaauugugauuguuuauucua

SEQ ID NO: 225616 - RNA, 58 nt, Human
ucucuucaaaaacuucucgaaccgcugugucuccuacguaaaaaaagagauguacaaa

SEQ ID NO: 225617 - RNA, 58 nt, Human
cagcaugugggugucagugucauuauuagucuccuaauaaguuccucugaagacugcu

SEQ ID NO: 225618 - RNA, 58 nt, Human
augucaagaaacugauaagaucaaaaaggucuccuaacucacuagaucagcgcacaag

SEQ ID NO: 225619 - RNA, 58 nt, Human
uugagcaauuuuaagguugagacuccaagucuccuaaaauucuaggagagaaauaaag

SEQ ID NO: 225620 - RNA, 58 nt, Human
auuugguguggccaucuuaccugcuuaugucuccuacacaaagcuaaauauucuagca

SEQ ID NO: 225621 - RNA, 58 nt, Human
cuuuauguuaaacauuuuggggcucaaugucuccuacuauccaaaaugugcaucacag

SEQ ID NO: 225622 - RNA, 58 nt, Human
uucugacucucauuuuuggucucugugugucuccuagucacuuucuuucucacucugu

SEQ ID NO: 225623 - RNA, 58 nt, Human
cagguccucagggccccagagcgggagggucuccuaccuggaagucccccugagcucc

SEQ ID NO: 225624 - RNA, 58 nt, Human
auuagaaaccuugauucagugcucaguggucuccuaguaagaagucaccgacgguagc

SEQ ID NO: 225625 - RNA, 58 nt, Human
aaaugcauauaacguuagcaacacagcagucuccuaauuaaugacagcuugacuuaac

SEQ ID NO: 225626 - RNA, 58 nt, Human
gcacugaacagggagucaggagacuauugucuccuaaacccaggacuagaguucccuc

SEQ ID NO: 225627 - RNA, 58 nt, Human
uggauuucagaguagagauuucuguguugucuccuagaaagcauuacauguaguuuau

SEQ ID NO: 225628 - RNA, 58 nt, Human
cucauggauuggucugaggggucugaacgucuccuagccaaucagaacuggcugugga

SEQ ID NO: 225629 - RNA, 58 nt, Human
auauacuuuauaaauaaguaucuaaaaugucuccuacuuuuuuccuauuucuuugcca

SEQ ID NO: 225630 - RNA, 58 nt, Human
aaucacuuucauuaauaaaggguuaaaagucuccuagucauucaacauagugucacaa

SEQ ID NO: 225631 - RNA, 58 nt, Human
uuauccagguugguuuugcuguugaucggucuccuaggcuaaaugagaaugaaagcga

SEQ ID NO: 225632 - RNA, 58 nt, Human
ccuccagggcaaggggaacgggaaauaggucuccuaggugccugaagcgcugagcaac

SEQ ID NO: 225633 - RNA, 58 nt, Human
aaauaaaauacuugaaauucucuuuugugucuccuaguagcuuccuacucaacuauuu

SEQ ID NO: 225634 - RNA, 58 nt, Human
gucuaaaaguaaaaaaaaauaucagccugucuccuaggucaguccccuccuggaccca

SEQ ID NO: 225635 - RNA, 58 nt, Human
cugcuccccuccccagacaccucuccacgucuccuacccagggggucgcaucccuagc

SEQ ID NO: 225636 - RNA, 58 nt, Human
guauuaaauuagauaucuucauagcaaugucuccuaaagguguuuuguaaaggauauc

SEQ ID NO: 225637 - RNA, 58 nt, Human
gaaacuguaaaaugauacuguagaaccugucuccuacuuugaaaacugaaugucaggg

SEQ ID NO: 225638 - RNA, 58 nt, Human
ugccuuuacuauuucacuuucuacaaaagucuccuagggucuuugagucagcuuuaug

SEQ ID NO: 225639 - RNA, 58 nt, Human
gaagauagcucucugacugcuuuggauagucuccuacgcaccauuuugucagguggga

SEQ ID NO: 225640 - RNA, 58 nt, Human
acugcggcucccucccuccugcaugagggucuccuacugcuccuucuccccuugcaca

SEQ ID NO: 225641 - RNA, 58 nt, Human
ugaacacaagcaaaccuucucaggaggugucuccuacccucuuauuguuccucuuacg

SEQ ID NO: 225642 - RNA, 58 nt, Human
aagguucuggcacuucaaugccaggcaggucuccuaaaugaacagaaugaucugugug

SEQ ID NO: 225643 - RNA, 58 nt, Human
gcgguuuuguaauuugacauuuaggagagucuccuauuuauucucauacuuuacauuc

SEQ ID NO: 225644 - RNA, 58 nt, Human
uugacuuuuaugggaaaaguuauuuuaugucuccuaagcauuagaguuuuucuauuac

SEQ ID NO: 225645 - RNA, 58 nt, Human
gaggccagagguugccaggcugccugaggucuccuauucuacucugaaccauaaaccc

SEQ ID NO: 225646 - RNA, 58 nt, Human
ugcugcauuuuaauuuuaaccaaaacaugucuccuauccugguuuuuguagccuuccu

SEQ ID NO: 225647 - RNA, 58 nt, Human
ucagaauaacuaucucccuuucugaucugucuccuacucuuuagauguucucagucaa

SEQ ID NO: 225648 - RNA, 58 nt, Human
ccaaaggcugagggccccaaagccacuugucuccuaggauccaggccucugggcuucu

SEQ ID NO: 225649 - RNA, 58 nt, Human
caugucccuuggcaaaauucuuucuggugucuccuaacuucagagacagggacucuuu

SEQ ID NO: 225650 - RNA, 58 nt, Human
auaggaaaauguucuggugauugucagggucuccuaauauuuaucucaauucuuuuau

SEQ ID NO: 225651 - RNA, 58 nt, Human
ggaugggcccaugaaggcaaaggugccugucuccuagggaagccuuaaugugguauuc

SEQ ID NO: 225652 - RNA, 58 nt, Human
uaaaagucaauacauauuugaggaauaagucuccuaaaauuuuaagcuucacguaaua

SEQ ID NO: 225653 - RNA, 58 nt, Human
uggcuucucuuuuucuaaacccuccuuagucuccuagaaaaccuuccugugggccagg

SEQ ID NO: 225654 - RNA, 58 nt, Human
uggagagcauaguccagccugggcauuugucuccuagcagccuacacuggcucugcug

SEQ ID NO: 225655 - RNA, 58 nt, Human
auguggcagggguuagagcaggacugaugucuccuaagcaccuguaaugugcgaggga

SEQ ID NO: 225656 - RNA, 58 nt, Human
cuaggauuucucugaaggauccagaguugucuccuaugguccaugcagaauuuucugu

SEQ ID NO: 225657 - RNA, 58 nt, Human
uuauaccagacauuaugaaguuauuaaagucuccuauacucuguacaccagaacugug

SEQ ID NO: 225658 - RNA, 58 nt, Human
cuggcaaaggacccuugaguaagugaaggucuccuaaaacugggauuaagaaaccuug

SEQ ID NO: 225659 - RNA, 58 nt, Human
aucacggggugggugcccccgacaccgggucuccuagcuugaguucccuagaagcgaa

SEQ ID NO: 225660 - RNA, 58 nt, Human
gaauugagcaaaacagaagaaucaugaagucuccuaccuucuacagccuuguaguucu

SEQ ID NO: 225661 - RNA, 58 nt, Human
gaaguacuguaaguagaauucaucaacggucuccuaauuuuugcaucuacaucugggg

SEQ ID NO: 225662 - RNA, 58 nt, Human
aucugacuguugauggccacagaugauggucuccuaugguauaguucacucuguagaa

SEQ ID NO: 225663 - RNA, 58 nt, Human
ugggccaguaugccaguuugaauucucagucuccuagcaucuugugaguugcauauua

SEQ ID NO: 225664 - RNA, 58 nt, Human
acacgcgugcacauguggcucugugggugucuccuagagaggacguggccccugcugc

SEQ ID NO: 225665 - RNA, 58 nt, Human
gccagaggugguuguguuuugacaucuggucuccuagagaugagugcuugggauuucu

SEQ ID NO: 225666 - RNA, 58 nt, Human
caagagacaugagauuccaguuguuuuugucuccuaaacccuagugauuuuuggauaa

SEQ ID NO: 225667 - RNA, 58 nt, Human
ugagcuuuacaggugauagguaccuaaugucuccuacagaaacaccaucugauucaga

SEQ ID NO: 225668 - RNA, 58 nt, Human
cuuauugaccaauuccugacacuugauugucuccuaaugcuuuauccaucaccaccug

SEQ ID NO: 225669 - RNA, 58 nt, Human
aaugccuccaaggguccuugcaucccuagucuccuaaacuccagcucugauucgccau

SEQ ID NO: 225670 - RNA, 58 nt, Human
aauguggacuuuuacucauggaaaaauugucuccuaauuuggggagaugaaccaacca

SEQ ID NO: 225671 - RNA, 58 nt, Human
ucaguagguguuugggaauaugggaagggucuccuauuuauucaauagaguuuucuca

SEQ ID NO: 225672 - RNA, 58 nt, Human
cgcugugagauggauguauuuguagccagucuccuauacccagcagagggauaaccca

SEQ ID NO: 225673 - RNA, 58 nt, Human
gcagcauucauuuaucuucgucugccuugucuccuaccuaagugugugucgccacccg

SEQ ID NO: 225674 - RNA, 58 nt, Human
uuacggcugcauucuguaagugggcauggucuccuaauggaggaguguucauuguaua

SEQ ID NO: 225675 - RNA, 58 nt, Human
cccuguucaugcgaaauccacauccauggucuccuagaccugcuacccugguacuucc

SEQ ID NO: 225676 - RNA, 58 nt, Human
cuucuguccugucuuauacugcaacugugucuccuaggggacagauggccuucuuugu

SEQ ID NO: 225677 - RNA, 58 nt, Human
cgaacccaccuauugccuuugucaccaggucuccuauggagagaugauuggcugugac

SEQ ID NO: 225678 - RNA, 58 nt, Human
uauuucuccacgucuguuuuaguuuaaugucuccuaagcuuuucucucauagcguaga

SEQ ID NO: 225679 - RNA, 58 nt, Human
gacggauuaacuaagcacacugggaugugucuccuacaguuggcuucucucuuugaug

SEQ ID NO: 225680 - RNA, 58 nt, Human
cugucaguuucaaggauuacaaguuugagucuccuaguauucaacaucauucugaacc

SEQ ID NO: 225681 - RNA, 58 nt, Human
uagacagcacaagaaggggugagagugcgucuccuagccuuaaugugggaggguaguu

SEQ ID NO: 225682 - RNA, 58 nt, Human
ccaugugcaccuuuagguuaccuauauagucuccuaggaagaucaggaugaaagaccu

SEQ ID NO: 225683 - RNA, 58 nt, Human
aguaaaugaaagcuauugagaucuuuuugucuccuauaauaccagggaauuugagcuu

SEQ ID NO: 225684 - RNA, 58 nt, Human
guaaauguuuucaucucuuaggcuugcugucuccuaaggucacccaagcagugguugg

SEQ ID NO: 225685 - RNA, 58 nt, Human
ggccacccuaucgcccccuacgcgccuugucuccuacuccugacuccuaccugcccug

SEQ ID NO: 225686 - RNA, 58 nt, Human
cucaguaaauacuuguugaauaaacucagucuccuacauuagcauucuaaugguuuga

SEQ ID NO: 225687 - RNA, 58 nt, Human
uuucuggauccuucccugggagggagaggucuccuaacucgauuggacaggagccuuc

SEQ ID NO: 225688 - RNA, 58 nt, Human
cccuuugucguuucugugccuauuuaaagucuccuaaagguguaauugacuaggaagg

SEQ ID NO: 225689 - RNA, 58 nt, Human
uuuuuuuuuugagacagagucuuccucugucuccuaagcuggagugcaguggcaucau

SEQ ID NO: 225690 - RNA, 58 nt, Human
caucuauagagaucuacuuuucuccuaugucuccuaggcuuuccaugauaauuaggua

SEQ ID NO: 225691 - RNA, 58 nt, Human
gccaagaaaauaaaaaagcuauuaucaggucuccuaacuaccccaguuuguaaggaaa

SEQ ID NO: 225692 - RNA, 58 nt, Human
uaagcauggaauccuaacuccugauuccgucuccuauuucuugcuuggcuacgccagu

SEQ ID NO: 225693 - RNA, 58 nt, Human
ugcugccuguccugccuguccggaucuugucuccuaguccugaggagcggaggcugag

SEQ ID NO: 225694 - RNA, 58 nt, Human
ccugaccucaggcaaucugcccgccugggucuccuaaaguacugggauuacaggcgug

SEQ ID NO: 225695 - RNA, 58 nt, Human
agcuguguaguggcaaagccgagaccgagucuccuaaguccccgucagugugguuuuc

SEQ ID NO: 225696 - RNA, 58 nt, Human
uuuauaguugaguaaacugagaucuuaagucuccuagucuacugaauuucauauggug

SEQ ID NO: 225697 - RNA, 58 nt, Human
gcaaaauuuuccacucugaguaaaacaagucuccuaaguauuguguauguuuaaaacg

SEQ ID NO: 225698 - RNA, 58 nt, Human
agccagggcagaggggccuccccaggaagucuccuacccucucagccaggcagagagc

SEQ ID NO: 225699 - RNA, 58 nt, Human
guggcccccgacuccucagccacaucaagucuccuagaccacuguggacucuaaacug

SEQ ID NO: 225700 - RNA, 58 nt, Human
gcccgcuggacuuauaaugccaccuucugucuccuacgacuccaugagcagcgccagc

SEQ ID NO: 225701 - RNA, 58 nt, Human
cuccucccuccucacucccuaggcccaagucuccuaggggcuugguccuaggguggga

SEQ ID NO: 225702 - RNA, 58 nt, Human
gugucugucccucuucagccaagcccaagucuccuagacccccagggagccagugaac

SEQ ID NO: 225703 - RNA, 58 nt, Human
caccuauagaagcgagcuaccaaaagacgucuccuaagcauuuugguggccuagugac

SEQ ID NO: 225704 - RNA, 58 nt, Human
aggcaguccagagcuuuucagccaauuugucuccuacucuguguaaauauuuuucccu

SEQ ID NO: 225705 - RNA, 58 nt, Human
cuucuuggacaucuugacccagcgaguggucuccuacacgucaccugcaacacucgcu

SEQ ID NO: 225706 - RNA, 58 nt, Human
accuugaccaauaugcuuuggguggacggucuccuacauguucaguggaggccaccag

SEQ ID NO: 225707 - RNA, 58 nt, Human
auugccacaaacacugagggacgcucaggucuccuaagaccucauccugcuggggacc

SEQ ID NO: 225708 - RNA, 58 nt, Human
gaggggcaggaagcgggggagugggcucgucuccuaaauuuaagaucaccuccucagc

SEQ ID NO: 225709 - RNA, 58 nt, Human
ccucuccacgcggggcagacucuggcgggucuccuagcguccgagagauggcuuauuu

SEQ ID NO: 225710 - RNA, 58 nt, Human
gaagcuggagccagggcugccgguccgagucuccuaccucccccaacccugcccgccc

SEQ ID NO: 225711 - RNA, 58 nt, Human
cucccccaccucuucccugcccaaaucugucuccuagaaucuuaugugcugugaauaa

SEQ ID NO: 225712 - RNA, 58 nt, Human
ugugcugguuuguccuuuucauaccuuugucuccuaauugugcuacaauuggaagacc

SEQ ID NO: 225713 - RNA, 58 nt, Human
ucaagauauggucugggcgcugucuugugucuccuacccugaucccuggguucaacuc

SEQ ID NO: 225714 - RNA, 58 nt, Human
uuugucuuaauuuuuauugguuuccaaggucuccuaggaaggagagcagagcugugug

SEQ ID NO: 225715 - RNA, 58 nt, Human
ggggacugucuuggguuuaaaacugcaagucuccuacccugggaucccauccaguucc

SEQ ID NO: 225716 - RNA, 58 nt, Human
accagcugcucagugcaguggccacugugucuccuaaggugcucgcuucagucagcac

SEQ ID NO: 225717 - RNA, 58 nt, Human
aguggcauagccccuuuuccgguauggggucuccuacacccacgcgcaccaccucucc

SEQ ID NO: 225718 - RNA, 58 nt, Human
aagaucucagcuccuuaacauaucaguugucuccuagccuagaaaaccaguguuugga

SEQ ID NO: 225719 - RNA, 58 nt, Human
ggaugaggacagaggaagaccugauggggucuccuauuccagggaauaagccaaauua

SEQ ID NO: 225720 - RNA, 58 nt, Human
uaaacuaccuccuuagagcucugaaggggucuccuaguuccagauuuuaauuugggga

SEQ ID NO: 225721 - RNA, 58 nt, Human
aaagggcucuguccugggagucuggugugucuccuacaugcaauuuccacggacccag

SEQ ID NO: 225722 - RNA, 58 nt, Human
ugucccugcccuguccuguccuugcacagucuccuaugucugagccccagugccuucu

SEQ ID NO: 225723 - RNA, 58 nt, Human
cauugagacuguccugguuaggcugugugucuccuacauuaacagcuggggaggaggg

SEQ ID NO: 225724 - RNA, 58 nt, Human
cacaggaagauaggauggaacgugacuggucuccuaaccaaggugcacugagaagcaa

SEQ ID NO: 225725 - RNA, 58 nt, Human
ggcuccagaugcagggcagucauuggcugucuccuaggaaacccauauccuuacccuc

SEQ ID NO: 225726 - RNA, 58 nt, Human
ggugucccccaaaggugccaccgugcgggucuccuagcucccugccagcuuccugucc

SEQ ID NO: 225727 - RNA, 58 nt, Human
aaaaaauacucgaggcauaaauguaguugucuccuacucugcuucucuuacuauacuc

SEQ ID NO: 225728 - RNA, 58 nt, Human
aagucuuuucuugcggacacucccuccugucuccuauuuucuguaaauaauuuucucc

SEQ ID NO: 225729 - RNA, 58 nt, Human
ucaugcugauuagaaugacaucucuuucgucuccuauuuuguuacccaacucuuccua

SEQ ID NO: 225730 - RNA, 58 nt, Human
gauuucggcugcuggggccaggacaggcgucuccuagguugugccaaaccagccuaca

SEQ ID NO: 225731 - RNA, 58 nt, Human
cugauuggaugaggaaagcuccaacccagucuccuaagcgacuggcccccuuuugaac

SEQ ID NO: 225732 - RNA, 58 nt, Human
auccaggaagguaggagaaggcaucugagucuccuaacccaagauggaagagccagag

SEQ ID NO: 225733 - RNA, 58 nt, Human
gaaacuagaagucuggacagucuccauggucuccuacuaucagaauaugugcccuuuu

SEQ ID NO: 225734 - RNA, 58 nt, Human
cugagcugccuccugcuucucccucaaagucuccuacccuucucuuccucuuuuaagc

SEQ ID NO: 225735 - RNA, 58 nt, Human
aauguuguaaguguuuaccaagccguuggucuccuaagggccuccugauggaagaaca

SEQ ID NO: 225736 - RNA, 58 nt, Human
cuguccuggaugaacgccucuuuccgaggucuccuauuuucuuuuuaacuuuuuaaag

SEQ ID NO: 225737 - RNA, 58 nt, Human
gucagucccccaguggccgcccuuacacgucuccuacuucaaugguaggggcgguuua

SEQ ID NO: 225738 - RNA, 58 nt, Human
ugaaacaacccuugcccaaccccacgaagucuccuauuuaaugugauggaagcacaac

SEQ ID NO: 225739 - RNA, 58 nt, Human
uuugcugaacauuggagaaucucaacaugucuccuacugaggauauggacacuggugc

SEQ ID NO: 225740 - RNA, 58 nt, Human
aagguuaggaucuucuaaguguauaacugucuccuaagcccaucacuguggcacacug

SEQ ID NO: 225741 - RNA, 58 nt, Human
acguuuugauguuaccuauuucuugugggucuccuauuaccagcuucuaaaugaaugu

SEQ ID NO: 225742 - RNA, 58 nt, Human
uuauauucucauaucuguuagcuacacagucuccuauuaucucaauugcuuaugugca

SEQ ID NO: 225743 - RNA, 58 nt, Human
ccaucuggugggucagguccuuggcgccgucuccuaccugcacagccuggggaucgug

SEQ ID NO: 225744 - RNA, 64 nt, Human
agccgagguccaggccguggaggggguccuagcuccgcugcauucugcaucccaagugggcacg

SEQ ID NO: 225745 - RNA, 64 nt, Human
uagcuugaagccugaccuagccagaagugccuguccgcugcagccgcacccuaccuugucuaag

SEQ ID NO: 225746 - RNA, 64 nt, Human
ugugcaguccggucagggcgggaggggaaaugcaccgcugcaugugaaccuuaccagcccaggc

SEQ ID NO: 225747 - RNA, 64 nt, Human
aaaauggaaauguaauaauaaugaaugucaugcaccgcugcagccagcaguuguaaaauuguua

SEQ ID NO: 225748 - RNA, 64 nt, Human
uuauguaaagguauuuaugggccacugcacaugcccgcugcagcccugggaucagcuggaagcu

SEQ ID NO: 225749 - RNA, 64 nt, Human
cggcucugccacuguuuucugagaaauguagcauccgcugcagcuggccacacugagggcccuc

SEQ ID NO: 225750 - RNA, 64 nt, Human
cacaggcccagccacccccaggggccuccacaggccgcugcaugacagcgauacaguacuuaag

SEQ ID NO: 225751 - RNA, 64 nt, Human
uuagaggccugagguucucuaggacucagccaugccgcugcacugacauacuaagcuggaagca

SEQ ID NO: 225752 - RNA, 64 nt, Human
aacccagugaacugacuuucuaguucuagaaguuccgcugcaaggccaggaaagcuugagaaag

SEQ ID NO: 225753 - RNA, 64 nt, Human
cagcaagggggcagaccccgcacucgccacaccgccgcugcagcuugggccccauccgcccucu

SEQ ID NO: 225754 - RNA, 64 nt, Human
caagaggucaaggcugcagugagccauguucacaccgcugcacucaagcuugggugacagaaca

SEQ ID NO: 225755 - RNA, 63 nt, Human
caguucgaacguggucuugaccgucagcacaucccgcugcagagggcauucccuuuaaggcuu

SEQ ID NO: 225756 - RNA, 64 nt, Human
cacagugaugccgggcgccaggacagcagcacucccgcugcacacagacggccuagggguggcg

SEQ ID NO: 225757 - RNA, 64 nt, Human
ugugcccuuggcuaucccugaaagagggaggacuccgcugcagcuccaccaauaaacuuguguc

SEQ ID NO: 225758 - RNA, 64 nt, Human
aggccagaggugaacauucauguguaggaagaggccgcugcaggguggcaucuuaggguagggg

SEQ ID NO: 225759 - RNA, 64 nt, Human
cagagccagggcagaggaugcacgguggcuagagccgcugcacuauccuuuucagagcacuuca

SEQ ID NO: 225760 - RNA, 64 nt, Human
caugugccgaucucuagagcagugggaaacuaccccgcugcaccaaaucaaguagcuucaccuu

SEQ ID NO: 225761 - RNA, 64 nt, Human
cguugccaccgacucccaccuccagcacccaugcccgcugcaccgcugccauccucagauucac

SEQ ID NO: 225762 - RNA, 64 nt, Human
ccuguggcucggggaaggagagucgaugcuguucccgcugcacggcccaccggcggcguaagug

SEQ ID NO: 225763 - RNA, 64 nt, Human
acgugcaagugagccccgugugcacaccacccucccgcugcaagucagauugcugggaggacug

SEQ ID NO: 225764 - RNA, 64 nt, Human
ggccaugagccuaacacccugccgguuuucaugcccgcugcaguaauggacguuugugugaaga

SEQ ID NO: 225765 - RNA, 64 nt, Human
auucaagaugauuuggaugaugggaaguuugagaccgcugcauuuuguuuuuaaauuaugcacc

SEQ ID NO: 225766 - RNA, 64 nt, Human
auggaggccagugccagcaccugcccagugggccccgcugcagcuguguguccuucuccaucua

SEQ ID NO: 225767 - RNA, 64 nt, Human
ccuuccccucaguuguuucuaagagcagagucucccgcugcaaucugggugguaacugccagcc

SEQ ID NO: 225768 - RNA, 64 nt, Human
ggucgggcggggacgccacacaccucagggccguccgcugcauugccauagaggagcccucccu

SEQ ID NO: 225769 - RNA, 64 nt, Human
gugaacaggggaugucaaaucgauucuugaauucccgcugcaagcuagagccgcaggcacccuc

SEQ ID NO: 225770 - RNA, 64 nt, Human
aggagguggggacugcucggccuccaccgcuguuccgcugcagccccgcccugccccacccacc

SEQ ID NO: 225771 - RNA, 64 nt, Human
ggacacagaggacggcuuccccaucgccuucuggccgcugcagucagcacagagagcggcuucc

SEQ ID NO: 225772 - RNA, 64 nt, Human
acaccaggucaggccugugcagaccccugcccugccgcugcagaaauccagaagcauccuuaau

SEQ ID NO: 225773 - RNA, 64 nt, Human
gcugacccggcacagccagccggccacgcccacgccgcugcagagccgcaccuccauugugcag

SEQ ID NO: 225774 - RNA, 64 nt, Human
aagcugccgcuccugcgagagcucggcggugacgccgcugcacgagagcgaggcugaagaacuu

SEQ ID NO: 225775 - RNA, 64 nt, Human
accaaccuccccgcagagcucccuuccugacccuccgcugcagaggauugaggcuuaauucuga

SEQ ID NO: 225776 - RNA, 64 nt, Human
ugugcccucaccaccacacuacacagcacaccagccgcugcagggcucccaugggcugaguggg

SEQ ID NO: 225777 - RNA, 64 nt, Human
ugcucuucccacccuccacccaccagaguggaacccgcugcaaaauccccagccuuaauucuug

SEQ ID NO: 225778 - RNA, 64 nt, Human
acacccaagucacagaaauaaaaaacugacuuuaccgcugcaauuuuucuguuuuccuccuuac

SEQ ID NO: 225779 - RNA, 64 nt, Human
aacccucccggaggcauacuugguuuccugacagccgcugcaauacacagucuugacggugcca

SEQ ID NO: 225780 - RNA, 64 nt, Human
agccgauccugagcacagccauuuugccccauccccgcugcagaaggacucaaccacuccccua

SEQ ID NO: 225781 - RNA, 64 nt, Human
cugucacccagcuccuccccgccaacccugccugccgcugcaccugccugccgcugcaggaaac

SEQ ID NO: 225782 - RNA, 64 nt, Human
ccccgccaacccugccugccgcugcaccugccugccgcugcaggaaacauuucugacaccgucg

SEQ ID NO: 225783 - RNA, 64 nt, Human
uggagcggcagggcgugacggccacagggucugcccgcugcacguucugccaaggugguggugg

SEQ ID NO: 225784 - RNA, 64 nt, Human
cucugcugugucucgcccacccugugcccuggcgccgcugcaacagccccucauggccaggagc

SEQ ID NO: 225785 - RNA, 64 nt, Human
ccaggcugcuggagugcaguggcacaaucucggcccgcugcagccucugccucuuggguucaag

SEQ ID NO: 225786 - RNA, 63 nt, Human
ggggacccggccagcucuaggcucuggggggccccgcugcagcccacacuggguguggugccc

SEQ ID NO: 225787 - RNA, 64 nt, Human
cagagggucuccugcagcccucugcuccucccggccgcugcacagcaacaccacagaacaagca

SEQ ID NO: 225788 - RNA, 64 nt, Human
ugaaggaggcucaugucagacuguacccauccagccgcugcacaucacaacauuuacuuaacag

SEQ ID NO: 225789 - RNA, 64 nt, Human
gcccugcccuggcgcagccagagccgccgggugcccgcugcaguuucuugggacauaggagcgc

SEQ ID NO: 225790 - RNA, 64 nt, Human
cgggaggcggagauugcagugagccaagaucgcaccgcugcacuccagccugggugacagagcg

SEQ ID NO: 225791 - RNA, 64 nt, Human
ggagaggaaggggcucccacagcccccacugaugccgcugcaggccccugucgagcuggggucc

SEQ ID NO: 225792 - RNA, 64 nt, Human
gccuggacaaggaagacccuuagggaugacguccccgcugcauauuuauucaaggugacucuug

SEQ ID NO: 225793 - RNA, 64 nt, Human
gucugaaugguccugggggcuggggcuggagaggccgcugcaccaccacccgagccugggagcc

SEQ ID NO: 225794 - RNA, 64 nt, Human
uccccagcccugcacgcccuggcuggcacuguugccgcugcauucucguguucagugaugcccu

SEQ ID NO: 225795 - RNA, 64 nt, Human
gggaugggaggaggaggagaaggggggccuugggccgcugcagucacaucuguccagagaaauu

SEQ ID NO: 225796 - RNA, 64 nt, Human
aguuucucguuucuuccucugaccuccgagguccccgcugcaccacgggguugcucuguucucc

SEQ ID NO: 225797 - RNA, 64 nt, Human
ccuuccuuccauugcucccagugccaaacuugggccgcugcaccgcggcgccuccgcccaaauc

SEQ ID NO: 225798 - RNA, 64 nt, Human
cagagccacgggcuguggggcggggagcccucccccgcugcagcccucucagaacagaggggua

SEQ ID NO: 225799 - RNA, 64 nt, Human
uguccacuaucacugcucaggggccccugccgcaccgcugcagugagcucagccacaggugcac

SEQ ID NO: 225800 - RNA, 64 nt, Human
cugauccagcugggaaucacccacguugugaaugccgcugcaggcaaguuccagguggacacag

SEQ ID NO: 225801 - RNA, 64 nt, Human
ggacaggccggugagggcgggcaaggggccccagccgcugcagcagcggagacagucgccagca

SEQ ID NO: 225802 - RNA, 64 nt, Human
aagcccaucagggcgugugagcagacugaaggggccgcugcagccccuggcccucaauacccag

SEQ ID NO: 225803 - RNA, 64 nt, Human
uaaaacacacaaacacacacaaaaaagcacaagcccgcugcaugacccgucucuccuuucuggg

SEQ ID NO: 225804 - RNA, 64 nt, Human
ugcccuuguauccuccuugucaauaaaggaaguuccgcugcagaaggggugugugcuguguucu

SEQ ID NO: 225805 - RNA, 64 nt, Human
gugguuuccuuuuuccacggagguucaauagaagccgcugcaggagaguuuuaccaaccauugu

SEQ ID NO: 225806 - RNA, 64 nt, Human
cccucaggguuuguagaggacugcaggggggcauccgcugcagacucagccuuucucugcagcc

SEQ ID NO: 225807 - RNA, 64 nt, Human
uccgcccgcagcccacaaacacaagaagcaggacccgcugcagcccugcgacacggaguacccc

SEQ ID NO: 225808 - RNA, 64 nt, Human
uucuggguugucucgaucuguguuucaauaaaugccgcugcaaugcaagagcguguggucuugu

SEQ ID NO: 225809 - RNA, 64 nt, Human
ugggaggucgaggcugcagcgagccgagaucgcgccgcugcauuccagccugggugacagagcg

SEQ ID NO: 225810 - RNA, 64 nt, Human
cucauucucuccgacagguugucagccucuguccccgcugcacagggucuugccccuucuccgg

SEQ ID NO: 225811 - RNA, 64 nt, Human
aaugaagcggagguugcagugagccgagagcaugccgcugcacuccagccugggagacugcauc

SEQ ID NO: 225812 - RNA, 64 nt, Human
cuuuuuuguuuuugugcacauaguaaucauaucaccgcugcauaacaacacagugcaucuuuuu

SEQ ID NO: 225813 - RNA, 64 nt, Human
cacuaacugcggugguggccuccagcaggcccccccgcugcagacccucuguccugccucugcc

SEQ ID NO: 225814 - RNA, 64 nt, Human
gggaaacugaggcucaggagagaggcgcuccaggccgcugcagccaacaaaccggcgcccucuu

SEQ ID NO: 225815 - RNA, 64 nt, Human
ccccuccacgccuccuggccagacgcugccgcugccgcugcaccacggcguuuuuuuacaacau

SEQ ID NO: 225816 - RNA, 64 nt, Human
ccuggguguucagaccccaaggccagggccuuucccgcugcaucaagaugccaaucccuuugug

SEQ ID NO: 225817 - RNA, 64 nt, Human
cuguacuugcugggucuugccaagaucauuuauuccgcugcauugccaaagugucuucauacca

SEQ ID NO: 225818 - RNA, 64 nt, Human
auuaagacauaaauuacuuuuucauucuuuuauaccgcugcauaguauuccauugugugagugu

SEQ ID NO: 225819 - RNA, 64 nt, Human
auuggcagucacuucccaugagggccuggcccacccgcugcaguugcccuaaggaaaaauaaag

SEQ ID NO: 225820 - RNA, 64 nt, Human
gagugauaaaaauaguuuaugaauugaaaauuugccgcugcauguuguaugaucaaauaguuca

SEQ ID NO: 225821 - RNA, 64 nt, Human
cacuuuggcagcacuugaggagcccuucaacccgccgcugcacuguaggagccccuuucugggc

SEQ ID NO: 225822 - RNA, 64 nt, Human
ccccgcgccucugaaggggcuuggaaccaguccgccgcugcacauccuucuuggcuuccuggcg

SEQ ID NO: 225823 - RNA, 64 nt, Human
aauguucuguguuguuuccuuagaccugugguguccgcugcaacagcuacuagccacguguagc

SEQ ID NO: 225824 - RNA, 64 nt, Human
caggaggcggagguaguggugagcaaagaucguaccgcugcacuccagccugggugauagagca

SEQ ID NO: 225825 - RNA, 64 nt, Human
ccuuggugaccauugauugcugcuucugcccaggccgcugcaaagguuaggacuuuguccacuc

SEQ ID NO: 225826 - RNA, 64 nt, Human
ugaagaccuuuauucaccccugccccguugcuucccgcugcacauggacagacuucacagcguc

SEQ ID NO: 225827 - RNA, 64 nt, Human
ccgggaaggaggcaacugccucacuuaacauccuccgcugcaaggugguggcgccgagaggcgu

SEQ ID NO: 225828 - RNA, 64 nt, Human
ugcagccgggugagccaagggcacuuugcugccaccgcugcauucccagagaucaagcagcccg

SEQ ID NO: 225829 - RNA, 64 nt, Human
gaacaccacgcuugacaggacagcauggugcaugccgcugcauccgugagcagugugucuccug

SEQ ID NO: 225830 - RNA, 64 nt, Human
acccugggcccugggccgcccauuccuggcccucccgcugcaucucagaccugacacccaacgg

SEQ ID NO: 225831 - RNA, 64 nt, Human
cucuguccuuccugcucuuucuucucugcccaggccgcugcagcugcacagccucugcuacacc

SEQ ID NO: 225832 - RNA, 64 nt, Human
agaagggaggcuggcugggggagaaacccggaucccgcugcaucuccgcgccugugggugcaug

SEQ ID NO: 225833 - RNA, 64 nt, Human
acauuccagaagucagggcccccucgaggagcacccgcugcagggaugcagggccacaggccuc

SEQ ID NO: 225834 - RNA, 64 nt, Human
cagcccaccuuagaaccugacuagcgagggaccuccgcugcaucucagcaaagccccucccagg

SEQ ID NO: 225835 - RNA, 64 nt, Human
cugggcuggacccaguucuugcacauacaagacaccgcugcagucagcuaggaccuuuccgcca

SEQ ID NO: 225836 - RNA, 64 nt, Human
gaagcgcagugagccggggcgggggcggaaucccccgcugcagggacacccacgcccuucucuc

SEQ ID NO: 225837 - RNA, 64 nt, Human
gggauuacaggugugagccaccacgucuugucccccgcugcauauuauuuaacagcaaaggcau

SEQ ID NO: 225838 - RNA, 64 nt, Human
agcacuaaacauggaaaggaacaacugauaccagccgcugcaaaaucaugccaaaauguaaaga

SEQ ID NO: 225839 - RNA, 64 nt, Human
ggaaugagccgccccacccaccccaaggcuggagccgcugcacccugcugucccucuccaggcc

SEQ ID NO: 225840 - RNA, 64 nt, Human
caggaggcggagguugcagugagccaagauggugccgcugcacuccagucugggugacacagca

SEQ ID NO: 225841 - RNA, 64 nt, Human
gccuuguggaccccugggcuggcuguguucauccccgcugcaggucgggcgucuccccccgugc

SEQ ID NO: 225842 - RNA, 64 nt, Human
uuuuguaucaaagaacaagcaaauggacccccgcccgcugcaggcgcccauagccaucgggucu

SEQ ID NO: 225843 - RNA, 64 nt, Human
gagacaccaaguuugucuccauggaaacacguagccgcugcaguuggacagcugcgugcuggag

SEQ ID NO: 225844 - RNA, 64 nt, Human
aaauauuuucuugcuuuacuggacugauuuuaacccgcugcacaacaccaacuaaaaguaguaa

SEQ ID NO: 225845 - RNA, 64 nt, Human
acuuaucuuugccaacauuugagggagccuugggccgcugcaugucguuaugcagaucagacuc

SEQ ID NO: 225846 - RNA, 64 nt, Human
uuuauaagugggugcuagggucuugacuuuaucuccgcugcacaagcaguguguugaacuuucu

SEQ ID NO: 225847 - RNA, 64 nt, Human
cacagcuccccgucccucacagcagaagccagagccgcugcagugcccagcuggucuucaucac

SEQ ID NO: 225848 - RNA, 64 nt, Human
ucgugguacagaagaaggacggcugcgacuggauccgcugcaccgucugccacaccgagaucug

SEQ ID NO: 225849 - RNA, 64 nt, Human
uccucuagggcccaggagacaccagcgggggcugccgcugcaggguaaaugggauuccuugcca

SEQ ID NO: 225850 - RNA, 64 nt, Human
cccugugugacucaguucuuuccaucuguuugucccgcugcaagccucuuucugcgcugacugu

SEQ ID NO: 225851 - RNA, 64 nt, Human
aucccgcaccuuucuaagccugugguugcuucacccgcugcagagcacacgcaacccagccuca

SEQ ID NO: 225852 - RNA, 64 nt, Human
agugggccugguuucugcagaauguccaugguggccgcugcagaguugcagaggucccuguaga

SEQ ID NO: 225853 - RNA, 64 nt, Human
cccuuaagcagcuguguuggagguacugcccagaccgcugcaggucccuggggaucugcauuuc

SEQ ID NO: 225854 - RNA, 64 nt, Human
ggggcaccuucucuucagcuugacugggcgucuuccgcugcauaacacucaaggugucugcucu

SEQ ID NO: 225855 - RNA, 64 nt, Human
accccaacacccccaagacagcagucuucuucacccgcugcagccguuccgucccaaacagagg

SEQ ID NO: 225856 - RNA, 64 nt, Human
gcccuggacaccccugcucuacccaugagccugcccgcugcaaugccuagacuucccaacagcc

SEQ ID NO: 225857 - RNA, 64 nt, Human
cuugugaguacugguuggacuguggggcauguggccgcugcaguuccagugguuauuucuaagu

SEQ ID NO: 225858 - RNA, 64 nt, Human
uggccucccaaaaugcugggauuauaggcaugagccgcugcacuuggccugauacugauuuuua

SEQ ID NO: 225859 - RNA, 64 nt, Human
uguguuucuccuguucucauaccgcccuucguguccgcugcaucuuccucuaggagcaucugug

SEQ ID NO: 225860 - RNA, 64 nt, Human
uugcaggcuuagucguggcuacuguucuccugugccgcugcaucgcucucucccgggaaagaac

SEQ ID NO: 225861 - RNA, 64 nt, Human
uggccucccaaagcgcuaggauuagaggugugagccgcugcacccugccccaguacaaucuuuu

SEQ ID NO: 225862 - RNA, 64 nt, Human
cccuggaccuccugacuccgaguucauguagucuccgcugcaccaacuccaaaaccgugggauu

SEQ ID NO: 225863 - RNA, 64 nt, Human
gcacucaccccuuccacccaccuccccccauggcccgcugcacgccucugggcccccuggcaca

SEQ ID NO: 225864 - RNA, 64 nt, Human
cucggagcauggggaggugcccaacgccaggcuaccgcugcaugucgcacuaaguguguucucc

SEQ ID NO: 225865 - RNA, 61 nt, Human
ccugucaugcccacccccugaggaagcauggggacccuaacacccuggugcccugcaccag

SEQ ID NO: 225866 - RNA, 61 nt, Human
ugccaaaggccccgcagucccucucccaggaggacccuagaggcaauuaaaugauguccug

SEQ ID NO: 225867 - RNA, 61 nt, Human
ucuguuccuuguccucaccuuacuccccucaggacccuaccccacccucuuugaaaagaca

SEQ ID NO: 225868 - RNA, 61 nt, Human
uuacagagcuaauguuuguccuaaauuuucaggacccuagaggagagcuuuauacaauuac

SEQ ID NO: 225869 - RNA, 61 nt, Human
cuugccuuaggauggaccagcaagcccccguggacccuaaguuguucaccgggauuuauca

SEQ ID NO: 225870 - RNA, 61 nt, Human
ccggggauucgagagccaugcgugggacacuggacccuacugucuacacgggcuugcacac

SEQ ID NO: 225871 - RNA, 61 nt, Human
cuacucuacagcauuaaagacugugggaccaggacccuaagucuccuuuccuucugggugg

SEQ ID NO: 225872 - RNA, 61 nt, Human
ucaagagacccuaaaaaaccugccugucccaggacccuaugguaaugaacaccaaacaucu

SEQ ID NO: 225873 - RNA, 61 nt, Human
augucuucaacucagcagagauggcccucugggacccuauacggacuccgccacuugagag

SEQ ID NO: 225874 - RNA, 61 nt, Human
ccgccacgaucgucgcugugcuugguguguaggacccuaggcuccccgcccacccucugcc

SEQ ID NO: 225875 - RNA, 61 nt, Human
cgcccugguggacuccucccgcuggaggcggggacccuaacaaccuucaagaccagugaug

SEQ ID NO: 225876 - RNA, 61 nt, Human
aaaggaagagcuuuauguuucucuguuguuuggacccuacuuggcaugaaaaaggaagcuc

SEQ ID NO: 225877 - RNA, 61 nt, Human
uugcagaguucuucucaccauuuaaacugaaggacccuauauuauauuucccuaacucuga

SEQ ID NO: 225878 - RNA, 61 nt, Human
ggccccucugugagaucucaaugcugucuggggacccuaagaguuuucucaccuguucagu

SEQ ID NO: 225879 - RNA, 61 nt, Human
uagagcuggagggggucccuggcugcugaggggacccuaccagaugagcccugccucuggg

SEQ ID NO: 225880 - RNA, 61 nt, Human
cagcuagagguggcuggcuuuggccagacauggacccuaaaucaacagacaauggcauugu

SEQ ID NO: 225881 - RNA, 61 nt, Human
ucaaaugcuaaauagaaccugugggucacaaggacccuaggcccagcggcccucuccucca

SEQ ID NO: 225882 - RNA, 61 nt, Human
cuuaggugucugugccccaggacagacccuaggacccuaaauccaauagaaaaugcauauc

SEQ ID NO: 225883 - RNA, 61 nt, Human
cuuaaguuguggagagugcaacaguagcauaggacccuacccucugggccaagucaaagac

SEQ ID NO: 225884 - RNA, 61 nt, Human
agcccuagcugccuugcagccccaaaccccaggacccuaucagcccccugggacucccugg

SEQ ID NO: 225885 - RNA, 61 nt, Human
ccuuuucaauuucuuauuucuguguuacugaggacccuaaucacuuagggauguaauuuua

SEQ ID NO: 225886 - RNA, 61 nt, Human
uuaaacagaaagcaauuuccaaagaggccagggacccuaaucuuugaagagaugaagaaac

SEQ ID NO: 225887 - RNA, 61 nt, Human
aguuauaugaggagagugagaaucaagacgaggacccuaaugaugagggaucugugcuguc

SEQ ID NO: 225888 - RNA, 61 nt, Human
caauaaaauuugauuguuaagauacaguaguggacccuacuuauucagucaauuaagagua

SEQ ID NO: 225889 - RNA, 61 nt, Human
cugcuguauccugugagcacuggucccauggggacccuauggcucccucaaucuucaccca

SEQ ID NO: 225890 - RNA, 61 nt, Human
gaaguaacagcuacgaugggaugggaacaguggacccuaagcaggccaagggugcguaggg

SEQ ID NO: 225891 - RNA, 61 nt, Human
gaaacagacucagggagguaggggcuggcagggacccuagaauccuugugauuuuucuuag

SEQ ID NO: 225892 - RNA, 61 nt, Human
uuggggaugacaguauggaacugucugcauuggacccuaaacuggacuagaagaggcaucu

SEQ ID NO: 225893 - RNA, 61 nt, Human
gcaaauaauggcuagaaaguaugguuuaacuggacccuauuaugccuuuuaaaaauaauuu

SEQ ID NO: 225894 - RNA, 61 nt, Human
uucucaugaacuuugaacccauguuaauuuuggacccuauaacuaauuuccuuucuguauc

SEQ ID NO: 225895 - RNA, 61 nt, Human
caaugccacacugccucugagcccauccuugggacccuacucugugccagguuccuguccc

SEQ ID NO: 225896 - RNA, 61 nt, Human
ugaugaaacuacugaugucagcuggucugaaggacccuaccagaagcuaaaucaucaaaga

SEQ ID NO: 225897 - RNA, 61 nt, Human
uacaaagauguaacugaaagacuuuucgaauggacccuaugggacuccucuuuuccacugu

SEQ ID NO: 225898 - RNA, 61 nt, Human
ucuggaaucaaauuuccuuguuugaauccugggacccuauugcauuaaaguacaaauacua

SEQ ID NO: 225899 - RNA, 61 nt, Human
uggaccaaggagaaagcccuuuggagaaacuggacccuaguucaguuuagaucucaaauau

SEQ ID NO: 225900 - RNA, 61 nt, Human
ucacagauccuucucuugaccggaaacccugggacccuaagaaccccugaagcuuggggug

SEQ ID NO: 225901 - RNA, 61 nt, Human
aaucaugaaaggcacugaguuuuguaaaucaggacccuaaauguuuaauuguaaauaaguu

SEQ ID NO: 225902 - RNA, 61 nt, Human
guguaccauacugccuuucuuugcauggcuuggacccuaucugugaccaugcucuucuccc

SEQ ID NO: 225903 - RNA, 61 nt, Human
aaaaaaucuaacaguaacacaccccugcuugggacccuagcuauaugcauuuuaugugacc

SEQ ID NO: 225904 - RNA, 61 nt, Human
cgaaccacccaaccacauccauaggggugcaggacccuaaguagacuggguagaaacccca

SEQ ID NO: 225905 - RNA, 61 nt, Human
cucggugggcccagguucugcucuucccuggggacccuaaccucgccuccagcugaccugc

SEQ ID NO: 225906 - RNA, 61 nt, Human
ugucagguggcaccgagcaggaugcggggauggacccuagauaccacagccugcccccucc

SEQ ID NO: 225907 - RNA, 61 nt, Human
uauuucgcucaucuggacccugcagugucagggacccuauggaggcaagccaguaauaaag

SEQ ID NO: 225908 - RNA, 61 nt, Human
ucuuucccuaauacaggguugcgcuugcauuggacccuagggauuugcacuaaaauuauau

SEQ ID NO: 225909 - RNA, 61 nt, Human
cuaucaagcuguguaaaaauuuacuuucacuggacccuaaauuauugucucugcuaucuga

SEQ ID NO: 225910 - RNA, 61 nt, Human
ugacugggaagaggccuguggcagcgccgcuggacccuaggaggcucagaggcaguggugu

SEQ ID NO: 225911 - RNA, 61 nt, Human
cccucuucuguuugucuugcaccuugucuaaggacccuaaaugaacgauaaacagagaugg

SEQ ID NO: 225912 - RNA, 61 nt, Human
uuuaacuuuuuuucauuauaaaaugguuagaggacccuacccccucuagauucccugauuu

SEQ ID NO: 225913 - RNA, 61 nt, Human
cccaacuuuccaaagacccugagacaagucaggacccuacuacucuccccugcugcuuucc

SEQ ID NO: 225914 - RNA, 61 nt, Human
cagagcagguucaagggaaauuaaaugauauggacccuaauuuguaucauucugaguugau

SEQ ID NO: 225915 - RNA, 61 nt, Human
aaggcccaggucagggcaucuggagucugaaggacccuaguuccuagaggcaucuggcagc

SEQ ID NO: 225916 - RNA, 61 nt, Human
agggugaaauaaagucuugucuuagaaaccaggacccuaaaccccacacuauguaauagaa

SEQ ID NO: 225917 - RNA, 61 nt, Human
agcugccuugucugaacagaacguagugguaggacccuagcugggauucuggcaucugccu

SEQ ID NO: 225918 - RNA, 61 nt, Human
gaaucuuuaaucuuguuaauacuuguuauauggacccuaagauauuuuauuacagaguuuu

SEQ ID NO: 225919 - RNA, 61 nt, Human
aaaaagagcacuuugcccguacuuaggcuguggacccuaaaacagcaguguuucaacaaga

SEQ ID NO: 225920 - RNA, 61 nt, Human
ucauuucuccuaccauagcacaaauccuagcggacccuaggagcaaagaggggggcagccc

SEQ ID NO: 225921 - RNA, 61 nt, Human
cuacuugcaguacaucaaaggaauggaugguggacccuacuauucauguuuugagacauaa

SEQ ID NO: 225922 - RNA, 61 nt, Human
uaucuucucagcaauaacuccaugggcucugggacccuaccccuuccaaccuucccugcuu

SEQ ID NO: 225923 - RNA, 61 nt, Human
ccaaguaggaaacuuccuuuccccugccccgggacccuaucugccuauccccuccccugcu

SEQ ID NO: 225924 - RNA, 61 nt, Human
ggggaagagaaguccucagcuggggcucaugggacccuaccacccucccugcuccuuccug

SEQ ID NO: 225925 - RNA, 61 nt, Human
ccaagaugccuucuaaaggcugacauaccuuggacccuaauggggcagagaguauagcccu

SEQ ID NO: 225926 - RNA, 61 nt, Human
caccccggcuucccgcgcgcccucaccaaaaggacccuacagcaaacgggugucuuucgac

SEQ ID NO: 225927 - RNA, 61 nt, Human
guaauagaaagcuccauuacucaacuggaaaggacccuaaugacagggcaacugaacagau

SEQ ID NO: 225928 - RNA, 61 nt, Human
uuuuaguaccaacacucuugggugauuucauggacccuaaagcagaccugacacugaucca

SEQ ID NO: 225929 - RNA, 61 nt, Human
guaaaguguucugccagaucuuagguauagaggacccuaacacaguauaucccaagugcac

SEQ ID NO: 225930 - RNA, 61 nt, Human
gggaaaaacuggugaaaaagaaauauaaaaaggacccuaaaaagaauucugcaaaauaaga

SEQ ID NO: 225931 - RNA, 61 nt, Human
agucacugccccauaaucaccaugucagaagggacccuagggcauucguguccuauuuauc

SEQ ID NO: 225932 - RNA, 61 nt, Human
uuuagaauucuugcaucacucgcgggcccuaggacccuaggaugccauucuugccaggagg

SEQ ID NO: 225933 - RNA, 61 nt, Human
aaggaagacuuggaguuuacaaucagaaccuggacccuaaagaacagugacugcaaaggca

SEQ ID NO: 225934 - RNA, 61 nt, Human
ggcucugcccuagguuggaaagaguuggauuggacccuacuugccuucccgggcaaggaua

SEQ ID NO: 225935 - RNA, 61 nt, Human
gcuccuccugccuccugggguccagugacugggacccuacucuagaacuguguaccaucca

SEQ ID NO: 225936 - RNA, 61 nt, Human
cagcgugguggugacuucuagguagaccgauggacccuaaauugggcaguggcauuguuuc

SEQ ID NO: 225937 - RNA, 61 nt, Human
caguaauuaggggugagggaaaggagauaggggacccuaggagguagagugggaccauguc

SEQ ID NO: 225938 - RNA, 61 nt, Human
uuuucucaaaaaguaacuaaaaaauugugucggacccuacuuuugagaaaucuacguuucc

SEQ ID NO: 225939 - RNA, 61 nt, Human
ucccgggcacauccaggaaggaccuugcuuuggacccuacacacuucggcucucuggacac

SEQ ID NO: 225940 - RNA, 61 nt, Human
ccguguugcaguucaggacuccuugcuucuuggacccuacuauuuauccuggacuagcuug

SEQ ID NO: 225941 - RNA, 61 nt, Human
gagacugucucuaaaaaaaaaagacucaaguggacccuacaaugaagccuacacaucccaa

SEQ ID NO: 225942 - RNA, 61 nt, Human
gaguuuugcaugagauucuaauacuucaguaggacccuaccuacgugguucaucuacaaug

SEQ ID NO: 225943 - RNA, 61 nt, Human
uacaaaauuauuuuuauggucccuuuaacgaggacccuauggcaaaugcacaauuauucag

SEQ ID NO: 225944 - RNA, 61 nt, Human
aaguacuuauaaacauacuaauccucuuucaggacccuaaaguugcagguuaguaggucuu

SEQ ID NO: 225945 - RNA, 61 nt, Human
ucuccccuggacacaggagacccacagggcaggacccuaagaucuggggaaaggagguccu

SEQ ID NO: 225946 - RNA, 61 nt, Human
gcucuagcaggacaguucuuuuguagccaggggacccuagaagugggguggggcggcucca

SEQ ID NO: 225947 - RNA, 61 nt, Human
acccacugcuucgccucugcuggaacaagcaggacccuaacuaccuggccaccauggccau

SEQ ID NO: 225948 - RNA, 61 nt, Human
gggacauccagcaaaugccccgagccauugaggacccuauccuggccuacacagcugaagg

SEQ ID NO: 225949 - RNA, 61 nt, Human
auaaaaagccugucauuucaaacacugcuguggacccuacuggguuuuuaaaauauuguca

SEQ ID NO: 225950 - RNA, 61 nt, Human
agaggagggaagcggccagcucacccuuccgggacccuaguguggggcgaaucucacggac

SEQ ID NO: 225951 - RNA, 61 nt, Human
agagcaagacccagggaaugggcccagggcaggacccuauucccuuggggucaagugaaag

SEQ ID NO: 225952 - RNA, 61 nt, Human
guaauucuaggagauccuaagggguucagggggacccuacccccaccucagguugggcuuc

SEQ ID NO: 225953 - RNA, 61 nt, Human
acauuaacaauuaggaucaguuguguggccgggacccuacucucacugaugagcugcugaa

SEQ ID NO: 225954 - RNA, 61 nt, Human
cucuuguauuugagggaccucaagagagugaggacccuaccauccacuguccauauucagu

SEQ ID NO: 225955 - RNA, 61 nt, Human
agccagagcccacauccugugcacugcugaaggacccuacgcucgguggccuggcaccuca

SEQ ID NO: 225956 - RNA, 61 nt, Human
gugcauuuucucgucucacgcaguucgaggaggacccuagaaagccaggagcugugauuga

SEQ ID NO: 225957 - RNA, 61 nt, Human
acuuaaaauuagucuuuuguaauaucaagcaggacccuaagaugaagcugagcuuuugaug

SEQ ID NO: 225958 - RNA, 61 nt, Human
cccacguucucugcugacaucccccaauaaaggacccuaacuuucgauacugacuuccugg

SEQ ID NO: 225959 - RNA, 61 nt, Human
ccuguccccgccccagccguccuccugggguggacccuaguuuaauaaagauucaccaagu

SEQ ID NO: 225960 - RNA, 61 nt, Human
uccgguggagggaagacccccccucaccccaggacccuaggagggggugggggcagguagg

SEQ ID NO: 225961 - RNA, 61 nt, Human
agcaggagucaggcugccacccccuaaggagggacccuaacguucugcccuugccugguuc

SEQ ID NO: 225962 - RNA, 61 nt, Human
uggaggcaaccucccauuuuagauguuuaaaggacccuauauguggcauuccuuucuuuaa

SEQ ID NO: 225963 - RNA, 61 nt, Human
uuccucugcuugacauccucccugucacuuuggacccuaugggagugggcaucuccacgca

SEQ ID NO: 225964 - RNA, 61 nt, Human
cugcagugugaggacagcgucucgggaggcaggacccuagggagacccgggugugcgccgc

SEQ ID NO: 225965 - RNA, 61 nt, Human
gcccugggucugucucugggguaaugaaaaaggacccuaauaaacaccugcucacuggcug

SEQ ID NO: 225966 - RNA, 61 nt, Human
acugugagacccucauugaccaguauuuaagggacccuaaccuccaaaagagguacccauu

SEQ ID NO: 225967 - RNA, 61 nt, Human
cggugaaggcaggugcgguaacugccgcacuggacccuaggaagccccagguauucgcaau

SEQ ID NO: 225968 - RNA, 61 nt, Human
caggguuccccacaguuucagaggugguccaggacccuaugauauuucucuucuuucguuc

SEQ ID NO: 225969 - RNA, 61 nt, Human
agaccagugggguggugcaggguggacuuggggacccuaccccugaagacugaggcccugc

SEQ ID NO: 225970 - RNA, 61 nt, Human
cucaucacuuggguagcagguacccauuuuaggacccuacacucaaaugugcaaaauaaaa

SEQ ID NO: 225971 - RNA, 61 nt, Human
ggaccagcaacuagcccuggggcuggacaguggacccuaccagccugcgggaaggugguau

SEQ ID NO: 225972 - RNA, 61 nt, Human
ugaagggcaacaaacaaccauccacacugccggacccuaggcuguucagggaggcagcuca

SEQ ID NO: 225973 - RNA, 61 nt, Human
cugccgaagcagccacuggaaagaacccuggggacccuaauguuggacucucggcgcgaca

SEQ ID NO: 225974 - RNA, 61 nt, Human
uaagccgaaaggaugaagaguuagaccccauggacccuagcucauacucagacgccccccg

SEQ ID NO: 225975 - RNA, 61 nt, Human
cuggcggaggcuggggggggcucugucagcaggacccuagaggagacucucauucgauuuu

SEQ ID NO: 225976 - RNA, 61 nt, Human
gagcagggggcccaccagagcuguggagaggggacccuaagacuccucggccuggcuccua

SEQ ID NO: 225977 - RNA, 61 nt, Human
uucuuuuuuuuuuuuuuuuuuuugggugaggggacccuacucuguuaucccaagugcucuu

SEQ ID NO: 225978 - RNA, 61 nt, Human
cugaggcuugcugggagugggguggccugggggacccuagacagccgggaaggcuguugug

SEQ ID NO: 225979 - RNA, 64 nt, Human
aacuaguuuuuuaauccucaggcagugcauccccccacccuacaacugagcacaaccucuuucc

SEQ ID NO: 225980 - RNA, 64 nt, Human
gccuugauuuaggcuacggccucacucucuauggccacccuaagaggaaaggcuacuucaccuc

SEQ ID NO: 225981 - RNA, 54 nt, Human
agcggaacucccgcacaugaccucccacccuaggagggagggaaggacaccguc

SEQ ID NO: 225982 - RNA, 64 nt, Human
gaagcuucuugcuccuguuuaacucccuaguuacccacccuaauuugcccuucaggacccuucu

SEQ ID NO: 225983 - RNA, 64 nt, Human
aaacuccugaacaauguuucugauggucuucuauccacccuacuugguaacaaaguucucagau

SEQ ID NO: 225984 - RNA, 63 nt, Human
uggaucauccuccuuuuuaaacuucucuccuccccacccuaccugccccccuggcuugagaga

SEQ ID NO: 225985 - RNA, 64 nt, Human
caugacaguggugcucugucucccugggugacacccacccuaggcuuccuccuggaugugaugg

SEQ ID NO: 225986 - RNA, 64 nt, Human
gcacuuucuuccugccuuagguaguugggcuugcccacccuaguuugcuuuuguagugguuugg

SEQ ID NO: 225987 - RNA, 64 nt, Human
uaacgaaccucgguaggaauguauuuccauccucccacccuacagauauaagagguuaaaauaa

SEQ ID NO: 225988 - RNA, 64 nt, Human
uggcucugcucagaagccauuucauuccccggcuccacccuaggccacuuuuucuaacagagga

SEQ ID NO: 225989 - RNA, 64 nt, Human
cugggggcauccaggcacucagaaggcaaaggaaccacccuacccauuuggccucuggaggggg

SEQ ID NO: 225990 - RNA, 64 nt, Human
ggccaagucuacaaugucccaauaucaaggacaaccacccuagcuucuuagugaagacaaugua

SEQ ID NO: 225991 - RNA, 64 nt, Human
acacaauagccucuguagguuaggcugccccaucccacccuacucuguguggcugcuuucuuug

SEQ ID NO: 225992 - RNA, 64 nt, Human
gcgcucucuuccagaagaugcccuccaauccuuuccacccuauucccuaacucucgggaccucg

SEQ ID NO: 225993 - RNA, 64 nt, Human
ccagaaugauaacugcacaguggcagaacaaacuccacccuaauguggguggaccccguccagu

SEQ ID NO: 225994 - RNA, 64 nt, Human
gccugaacauuuucccuuugacuuguuaaagguaccacccuacaucaugguugacacccuccuu

SEQ ID NO: 225995 - RNA, 64 nt, Human
aggggcugaguuaucagagcagcaacccuucuacccacccuacugaguccccauucuaccuucg

SEQ ID NO: 225996 - RNA, 64 nt, Human
cuguucccagaccuggggucccuuggcuuuucgaccacccuagcacuggcccuaggaggggcug

SEQ ID NO: 225997 - RNA, 64 nt, Human
acagcacuugucaucaucccuauccucgucagccccacccuacugccucagcuggacccagggc

SEQ ID NO: 225998 - RNA, 64 nt, Human
gugcuggcccaguuggugggaccccuguccacacccacccuauuuauuuccguugucucucugc

SEQ ID NO: 225999 - RNA, 64 nt, Human
cgccccgucccaugcccgcucuugaguaucuuccccacccuauuaaauuacauccggugcuucg

SEQ ID NO: 226000 - RNA, 64 nt, Human
uuaaccuggaagccccccuggcuggaggccaccgccacccuaggaagggggcagggacgugacc

SEQ ID NO: 226001 - RNA, 64 nt, Human
ugcacacagacggccuagggguggcgcucagaccccacccuacgcucaucucuggaaggggcag

SEQ ID NO: 226002 - RNA, 64 nt, Human
gccuugggguggggagugguagggggaagagcucccacccuaaggggcacacacugaguugcuu

SEQ ID NO: 226003 - RNA, 64 nt, Human
ucuacacaugccuuuuuugcaguccuuuaacuguccacccuaccaagagcuuauaaccaguauc

SEQ ID NO: 226004 - RNA, 64 nt, Human
ugaugacauuccaccauugugauuuguuccugccccacccuaacugaucaauugaccuugugac

SEQ ID NO: 226005 - RNA, 64 nt, Human
ucguacccagccauguguuggggagacaucaaaaccacccuaaccucgcucgaugacugugaac

SEQ ID NO: 226006 - RNA, 64 nt, Human
cagcagcauaggcuuuaucucccuacuuccucccccacccuaccgcguucaauuuguguaucuc

SEQ ID NO: 226007 - RNA, 64 nt, Human
aaauucuaccacuucccagauccuuuccaggguaccacccuauuaagcauuaauuucuucauuu

SEQ ID NO: 226008 - RNA, 64 nt, Human
ccucuccuugccugcaggcugcccucucccauggccacccuagacagagacccacccgugauac

SEQ ID NO: 226009 - RNA, 64 nt, Human
cacagaagguucucgaguucccauugcugaaaggccacccuaaccucuguguucaggucagaaa

SEQ ID NO: 226010 - RNA, 64 nt, Human
cuccuauaauauggaacaaauaucugaaugaaauccacccuaggagacggagucaaacuaaacu

SEQ ID NO: 226011 - RNA, 64 nt, Human
ccuggaauguaggaucucccccaugccuggccuaccacccuaaugugucuggaauugguggguu

SEQ ID NO: 226012 - RNA, 64 nt, Human
uguaguaucuggggcgaguguuggggguaaaagcccacccuacagaaaguggaacagcccggag

SEQ ID NO: 226013 - RNA, 64 nt, Human
ugaugacauuccaccauugugauuuguuccugccccacccuaacugaucaauguacuuuguaau

SEQ ID NO: 226014 - RNA, 64 nt, Human
ccaucucuaccccaaagaauuccugaagccagauccacccuaucccuguacagaguaaguucuc

SEQ ID NO: 226015 - RNA, 64 nt, Human
accucacucccucccgaggucucugguucaaagaccacccuaccagccccuauuugcuucaggu

SEQ ID NO: 226016 - RNA, 64 nt, Human
gggccccaggcuccuccauauggcccagggcuuaccacccuaucacacguggccuugucuagac

SEQ ID NO: 226017 - RNA, 64 nt, Human
cuaguucugaaagugucaagaauagcuucccuuuccacccuaccuagguucccuccuugcuggc

SEQ ID NO: 226018 - RNA, 64 nt, Human
cuggccacagagccaccucaggauauucuuuucuccacccuaguuuauuuauuuauagauaucu

SEQ ID NO: 226019 - RNA, 64 nt, Human
uuucuucccucucucccuccaucucugaccacccccacccuaaccccccacccccaccauccua

SEQ ID NO: 226020 - RNA, 64 nt, Human
cccaccuccuacaaucucagcccacaaguccucuccacccuagggggcuugcugcauggcaaua

SEQ ID NO: 226021 - RNA, 64 nt, Human
cgaggaagaguaauauuuagcauucaggacccacccacccuaugccggcuucugugccaggcac

SEQ ID NO: 226022 - RNA, 64 nt, Human
aaucaccacauucugucucugcuuggcuuccccuccacccuaaagucucaggugacggacucag

SEQ ID NO: 226023 - RNA, 64 nt, Human
cuuccaccugucccccagacccaaagcucucuccccacccuaccugcccaccuggggcuccugu

SEQ ID NO: 226024 - RNA, 64 nt, Human
cuggggcuccugugcccccuccccacuccagaggccacccuacaaguuguccucaaggucaucc

SEQ ID NO: 226025 - RNA, 64 nt, Human
ggcauuuuauuaaauuaauuuuuuaaauuauuuuccacccuacaucaguauauugguugugcuu

SEQ ID NO: 226026 - RNA, 64 nt, Human
cuaacaaccaaccaaccaaccaaccaaccacaaaccacccuaaaaugacagccgcugaugucug

SEQ ID NO: 226027 - RNA, 64 nt, Human
cauuuuaaaaaucugcccuaugaguaucaaccugccacccuaaauuucccaguggcacuacccu

SEQ ID NO: 226028 - RNA, 64 nt, Human
agccaguacuccugcucugcuaacccugcgugcaccacccuaagcggcuaggcugacagggcca

SEQ ID NO: 226029 - RNA, 64 nt, Human
ugucaaagaagcacucacuuaagcauuccuggagccacccuaccucagggccucuugauauuug

SEQ ID NO: 226030 - RNA, 64 nt, Human
uuggcugccgcuuucucuccccacagccucaaggccacccuaccgucauauauaucacucaggc

SEQ ID NO: 226031 - RNA, 64 nt, Human
uuuccugauggauagcugugaagcauucucuuacccacccuacugcauguugcaaaguauuccu

SEQ ID NO: 226032 - RNA, 62 nt, Human
gucccuuucuaucaauaaaaggcccuuuucagggccacccuacuuucucagcugaagagugg

SEQ ID NO: 226033 - RNA, 64 nt, Human
cuccucuuuuaacaacagucauuggauuuagggcccacccuaauccugugugaucuuaucuuga

SEQ ID NO: 226034 - RNA, 64 nt, Human
cugaggcaagcugaagcuuuggguucugacugacccacccuacaggacugcugaacagagagcc

SEQ ID NO: 226035 - RNA, 64 nt, Human
cucagagaugaggauuggaacaccauguucuuucccacccuaacaacaacaaagggcaguaaau

SEQ ID NO: 226036 - RNA, 64 nt, Human
aaagaguugcaaaaaacugcauuuauuuuauuagccacccuaaaugcgucaguuauuuagggau

SEQ ID NO: 226037 - RNA, 64 nt, Human
ccgugugauguauuugaaugucuguuauuuccagccacccuaacauucuucuuccuguguggau

SEQ ID NO: 226038 - RNA, 64 nt, Human
ccuuugcagaugccuuccugggggauacuccuccccacccuaaagggucgccugcaacuuaggc

SEQ ID NO: 226039 - RNA, 64 nt, Human
ccugggcagucugaagacugauaacuuccccacuccacccuacaagcagugggacuccugagaa

SEQ ID NO: 226040 - RNA, 64 nt, Human
cauguccacccaaacuaaagacuacauuuuccauccacccuagaggcugggugcagcuauauga

SEQ ID NO: 226041 - RNA, 64 nt, Human
gcccaggacccaucuuucucacacggauuuagucccacccuauggccacuggccguaucugagg

SEQ ID NO: 226042 - RNA, 64 nt, Human
auuucuagcaggggcggggccucuuuauuucucuccacccuaacucagaccucaccuuccuccc

SEQ ID NO: 226043 - RNA, 64 nt, Human
ucuugugcuagaaaaagcauucucuaacucuaccccacccuacaaaaugcauauggagguaggc

SEQ ID NO: 226044 - RNA, 64 nt, Human
cuggaucccagcugccuuccugggcuugugccauccacccuacugguuaucugauagaacaagc

SEQ ID NO: 226045 - RNA, 64 nt, Human
gcuuccugaccuaccgccaguggccccuugcuggccacccuauaggguccuccuucccuggcag

SEQ ID NO: 226046 - RNA, 64 nt, Human
cuaugugaucaucuaaaaaagggggagcuggccuccacccuauguuccauggauucggaacaag

SEQ ID NO: 226047 - RNA, 64 nt, Human
aaaaaaaaaaauggccacaacaguugcacagugcccacccuauggccuagcuucagguacuuca

SEQ ID NO: 226048 - RNA, 63 nt, Human
ugcaacccaagcaggacugacgcccgacagacuccacccuaacagucucaagccccuuuccau

SEQ ID NO: 226049 - RNA, 64 nt, Human
gaacgucuccuagccaaucagaacuggcuguggaccacccuagcacggccaccucucagggcca

SEQ ID NO: 226050 - RNA, 64 nt, Human
uaaauuuaaugaaacaaaaaauuccuaagaaauaccacccuaccacuaacaaaaugguauaaag

SEQ ID NO: 226051 - RNA, 64 nt, Human
ccgucccccuuccgccuucucccuucucucacccccacccuagccuccaccauccccgcacaaa

SEQ ID NO: 226052 - RNA, 64 nt, Human
cucuucugaacaagccccaucauuuggugaaccuccacccuaacaaaguaggaugggguugggg

SEQ ID NO: 226053 - RNA, 64 nt, Human
auaccccugacuggacaccacagcuuagccucguccacccuaaauguacucagaacacuuagaa

SEQ ID NO: 226054 - RNA, 64 nt, Human
gacucacgaacaaauccaccugagaucagcagagccacccuagaucagcugaaacucuaagcac

SEQ ID NO: 226055 - RNA, 64 nt, Human
uggaaagaggauuuuaaauauugugggaguucucccacccuaagucuuacauaaugccaccagu

SEQ ID NO: 226056 - RNA, 64 nt, Human
gugucuccuuuccauacccagucucaccuucuccccacccuaccucaccucuucucaggcaccc

SEQ ID NO: 226057 - RNA, 64 nt, Human
ucacaauguugcuaguuuuuugcuucucuuucccccacccuacucccuccaauucccccuuaaa

SEQ ID NO: 226058 - RNA, 64 nt, Human
gucauccgaaagugaggaaauguuuuggaaggguccacccuagccuagaacaagccagagccgc

SEQ ID NO: 226059 - RNA, 64 nt, Human
uagaacaaauaauaauacuauuuuugggcaaaauccacccuacuugaugaggaccauuugcuug

SEQ ID NO: 226060 - RNA, 64 nt, Human
gucuucugguuucacaggcuucagcucauggguuccacccuaacuuggggaaacaaaagccuuc

SEQ ID NO: 226061 - RNA, 64 nt, Human
agcacagcagcccccgggucugcaccuccagagcccacccuaccaccagacacagagcccggac

SEQ ID NO: 226062 - RNA, 64 nt, Human
gguggggggcuacuggagaggagagacagcaaguccacccuaacuuguuacacagcacauacca

SEQ ID NO: 226063 - RNA, 64 nt, Human
acgucauccgccuuuuuuuaauccauuucuuuugccacccuauaugucuguucagagaugggcu

SEQ ID NO: 226064 - RNA, 64 nt, Human
uuccuggucugaacccucucccaguccucaucuuccacccuaaaacuagagugaucuuccuaaa

SEQ ID NO: 226065 - RNA, 64 nt, Human
ggcuggaggcccagggaaucgguuacugauguggccacccuauucccacauggggagcaccagg

SEQ ID NO: 226066 - RNA, 64 nt, Human
agcacagcagcccccgggucugcaccuccagagcccacccuaccaccagacacagagccuggac

SEQ ID NO: 226067 - RNA, 64 nt, Human
uccucuuuaucacaaguuuuccaaaccuccuuccccacccuaucuaaaguguuccuuaccuuuc

SEQ ID NO: 226068 - RNA, 64 nt, Human
uggaaccuggagcuagaauuaauugcccacucucccacccuaccagugcagcccggcaagggca

SEQ ID NO: 226069 - RNA, 64 nt, Human
ccuguguccuguacugcccucgcugucucccccaccacccuacuugacagcgugggcaucuuca

SEQ ID NO: 226070 - RNA, 64 nt, Human
gauuuaacauuugcuugggaaugugauuuugcucccacccuaaggaauuuuuaucaccaaaaug

SEQ ID NO: 226071 - RNA, 64 nt, Human
gcugacacaggaccuaggguagggccuguucccaccacccuagcuggaaaaccucaugauuuau

SEQ ID NO: 226072 - RNA, 64 nt, Human
ggagauguggacggccugucuccuccugcagggcccacccuaagaauguauuuuuaaacacaug

SEQ ID NO: 226073 - RNA, 64 nt, Human
gccacugaggucuggguuguguaaggguuagcuaccacccuauaaccucccuaccagguaauaa

SEQ ID NO: 226074 - RNA, 64 nt, Human
aucuguuucuaugguugucaaaugaauucuucacccacccuacaguuugcuaacuccuugaagc

SEQ ID NO: 226075 - RNA, 64 nt, Human
uguucauuaaagcaugaaugguauggaacucucuccacccuauauguaguauaaagaaaaguag

SEQ ID NO: 226076 - RNA, 64 nt, Human
ggagacuuuugccaugccugaguucuuuccuaucccacccuaacacuuaacauauuacuuaguc

SEQ ID NO: 226077 - RNA, 64 nt, Human
ggacugcaccugguuuaauguugcuucacuuaucccacccuacagagaccagcaagguucugcc

SEQ ID NO: 226078 - RNA, 64 nt, Human
guagcaccuaaaggcuguaacucacagccccuguccacccuauguggccccacaacacagauuu

SEQ ID NO: 226079 - RNA, 64 nt, Human
agaaugaagccuugaggucugucaccacccacagccacccuacagcagccuuaacugugacacu

SEQ ID NO: 226080 - RNA, 64 nt, Human
uuccuuaagcuggugauuccuaaucaaggacaagccacccuagugucucauguuuguauuuggu

SEQ ID NO: 226081 - RNA, 64 nt, Human
gcaugaggccauagacagaucuaaaaaguuuccaccacccuacagaaguacacacagauaccug

SEQ ID NO: 226082 - RNA, 64 nt, Human
ugaauuuuuucucaagaucauucugagaguugccccacccuaccugccuuuuauaguaugccca

SEQ ID NO: 226083 - RNA, 64 nt, Human
gcaccguuccuaaggaaggggccucuggggcugcccacccuaccugcccugccugccugcugcc

SEQ ID NO: 226084 - RNA, 64 nt, Human
aagccauaucugccugccuuuuccuaaggagaguccacccuaauuaauguccauucccuccuaa

SEQ ID NO: 226085 - RNA, 64 nt, Human
cuaguaugguccccauuugcccuuccacuccaccccacccuaaaccaugcgcucccaaucuucc

SEQ ID NO: 226086 - RNA, 64 nt, Human
gggcuccuggaaggaggaggaggcucuccacuguccacccuaacacauacccucccacccaccu

SEQ ID NO: 226087 - RNA, 64 nt, Human
ccaugguugcugagcaugggcagaccaguggaggccacccuacuguguuaucugcgccuucgau

SEQ ID NO: 226088 - RNA, 64 nt, Human
caggaauccccuguauguucagggcugugagcugccacccuauuccgccugcuccgucuuugug

SEQ ID NO: 226089 - RNA, 64 nt, Human
augccauaucuggcugccuuuuccuaagaagaguccacccuaauuaauguccauugucucuccu

SEQ ID NO: 226090 - RNA, 64 nt, Human
ccccucugcccagcuugggcccagcugggcucugccacccuaccuguucagugucccgggcccg

SEQ ID NO: 226091 - RNA, 58 nt, Human
cccuggauggggaggacuaagaaagcuaccacccuaaccagagaggcuuggaauuggg

SEQ ID NO: 226092 - RNA, 64 nt, Human
ccccaggacaggagucccucuaguugucucccuaccacccuauacacacugacagagacagcaa

SEQ ID NO: 226093 - RNA, 64 nt, Human
uugugaggcgccugagcccuacucccugcagaugccacccuagccaaugucuccuccccuuccc

SEQ ID NO: 226094 - RNA, 64 nt, Human
uuuccccaggagaagccaagaacuugugugucccccacccuauccccucuaacaccauuccucc

SEQ ID NO: 226095 - RNA, 64 nt, Human
cugggaaacucaaggaggaggaagaaaaucaaaaccacccuacucccuggggugaggaaagaac

SEQ ID NO: 226096 - RNA, 64 nt, Human
aaaauguuaacacaaagcuaagauucaucagagcccacccuauucuaaggaaccacaauaacuu

SEQ ID NO: 226097 - RNA, 64 nt, Human
uccauggucuccuagaccugcuacccugguacuuccacccuaccccaccccgagaagggcagag

SEQ ID NO: 226098 - RNA, 64 nt, Human
aagugcccucuugguuugguucgggcggcggcugccacccuacucaccgcucuccucccugccc

SEQ ID NO: 226099 - RNA, 64 nt, Human
gcuuccuuagcuugccccucagcuuugcaaagagccacccuaggccccagcugaccgcaugggu

SEQ ID NO: 226100 - RNA, 64 nt, Human
cagucaucauuuuccuaucucaccccccgaaacaccacccuaaaguuggauuuuuacauauaaa

SEQ ID NO: 226101 - RNA, 64 nt, Human
acuucugggcucugccaccccacagugggaaaggccacccuagaaagaaguccgcuggcaccca

SEQ ID NO: 226102 - RNA, 64 nt, Human
gguaggggacuaauucacuggcgaggugcggccaccacccuacuucauuuucagagugacaccc

SEQ ID NO: 226103 - RNA, 64 nt, Human
uuccucuuucuguucccccauugacuucugugccccacccuagccuuuuccauaaccuuaggua

SEQ ID NO: 226104 - RNA, 64 nt, Human
ccuaauauugcaggaggggccucucuuccaagccccacccuaaggguuagcccuuggccaaauc

SEQ ID NO: 226105 - RNA, 64 nt, Human
aacagaaguuauauuuuuaaaggaaaaaucauaaccacccuagcuuuauauuuuguuguuaguu

SEQ ID NO: 226106 - RNA, 64 nt, Human
ccacucuucuagggauaugaaaaucucuuaacacccacccuacauacacagacacacacacaca

SEQ ID NO: 226107 - RNA, 64 nt, Human
cacccgcaggccuuaccgcucuguuuauagugacccacccuagaucuuccccaagagggacugg

SEQ ID NO: 226108 - RNA, 64 nt, Human
ccugagacagugugaggggguggggacugccaagccacccuaagaccuugggaggaaaacucag

SEQ ID NO: 226109 - RNA, 64 nt, Human
accacaguguagaguuaaggccucugcacguaugccacccuaggucaucagagcuaaaggggcu

SEQ ID NO: 226110 - RNA, 64 nt, Human
caucacauauauuauagaagcaagcgaggacauuccacccuagaaaugguucagaaacucauag

SEQ ID NO: 226111 - RNA, 64 nt, Human
uagggaggcagccuccagccugcccaagcccaggccacccuaucgcccccuacgcgccuugucu

SEQ ID NO: 226112 - RNA, 64 nt, Human
ggccggccggaccucugagcacauaguguccugcccacccuaccagcuccuccagcccugccgg

SEQ ID NO: 226113 - RNA, 64 nt, Human
aaaggcugcagccuccccagcucuccucugccagccacccuaaauuccagccaaccucaccucc

SEQ ID NO: 226114 - RNA, 64 nt, Human
agaaccacacagcuaagggagggccuggggagccccacccuagcccuugcugccacaccacauu

SEQ ID NO: 226115 - RNA, 64 nt, Human
ggcaaguuugcaguggggccggaaaauaugguggccacccuaccaugagagucagccguagggg

SEQ ID NO: 226116 - RNA, 64 nt, Human
aggggccccaggaguggcaggagaggauccccgaccacccuagggaaacuucgugcgauaauug

SEQ ID NO: 226117 - RNA, 64 nt, Human
gccccggcccacccuccauccccacccuccauccccacccuagauggagcgagggccuuuuuac

SEQ ID NO: 226118 - RNA, 64 nt, Human
cggugggcaguccugguguagagcacaagccucuccacccuagagaaaugccucuguaccacgg

SEQ ID NO: 226119 - RNA, 64 nt, Human
ugaugacauugcaccauugugauauguuacugccccacccuaacugaucaauguacuuuguaau

SEQ ID NO: 226120 - RNA, 64 nt, Human
cuuguaagauauuuuguuuuccacuugaauuacaccacccuagugugaaaucggggacuucaaa

SEQ ID NO: 226121 - RNA, 64 nt, Human
cucaggaagucgcccgccccaggacacgcagggaccacccuaagggcuggguggcugucucaag

SEQ ID NO: 226122 - RNA, 64 nt, Human
gucccggggauggugaggaacgccacagacagagccacccuaggagugaguauagugcugguga

SEQ ID NO: 226123 - RNA, 64 nt, Human
gggccaugccugccccccucaucucauucaaaccccacccuaguuucccugaaggaacauuccu

SEQ ID NO: 226124 - RNA, 64 nt, Human
agccaucuacugagggaggcagaaaggccacaacccacccuagguugauguaugggagcuagga

SEQ ID NO: 226125 - RNA, 64 nt, Human
ugggucugggcauggggaggccgugccucaaagcccacccuaccccaugccuuggugcugugcc

SEQ ID NO: 226126 - RNA, 64 nt, Human
uaaauugugaaggcgcuggaauuacaugaacauaccacccuaguaaaggcaaguucuguaagcu

SEQ ID NO: 226127 - RNA, 64 nt, Human
aguuauucacucucccagaggcuccuggagccagccacccuaacugagcugccaguggggucgu

SEQ ID NO: 226128 - RNA, 64 nt, Human
ugggccuuuuuuuauagcuggaaaaaacaaaauaccacccuacaaaccuguauuuaaaaagaaa

SEQ ID NO: 226129 - RNA, 64 nt, Human
aacaauggcagaggagacaucucugguguucccaccacccuagaugaaaauccacagcacagac

SEQ ID NO: 226130 - RNA, 64 nt, Human
gcugcucuugaauuccugggcucaagcaguccucccacccuaccacagcgucccgcguagcugg

SEQ ID NO: 226131 - RNA, 64 nt, Human
gcccgccccuucccccaaaugcugcuugcagcacccacccuaaagcccccuccaaauagccaua

SEQ ID NO: 226132 - RNA, 64 nt, Human
agccagcagacucucuagcuccaucuccccugugccacccuaggucauaugaccuuggccaccu

SEQ ID NO: 226133 - RNA, 59 nt, Human
ugaagaaggccaagcagugaccugaggggccacccuaggacuugaaaggaccgugcagc

SEQ ID NO: 226134 - RNA, 64 nt, Human
gguguguaacagggucauacccccucccucuuguccacccuacccccaggguaaggggagccuc

SEQ ID NO: 226135 - RNA, 64 nt, Human
uguccugcuuccucacuguggaccccugucugggccacccuagugugcuaagcugagcagugca

SEQ ID NO: 226136 - RNA, 64 nt, Human
ccacaccaaagcaggacacgccauuuuccacugaccacccuauacccugaggaaagggagacuu

SEQ ID NO: 226137 - RNA, 64 nt, Human
gacacaacaccauguggucuggaggucccagcccccacccuaaaaagguuaucccugagaacuc

SEQ ID NO: 226138 - RNA, 64 nt, Human
ggacgugugaggauguggauggaggugaugaaaaccacccuaucaucaguuaggauuagguuua

SEQ ID NO: 226139 - RNA, 64 nt, Human
ggacuuuaauauguaaaaauaauugucuucuaugccacccuacagauuuuauuuuaaugugaau

SEQ ID NO: 226140 - RNA, 64 nt, Human
uuucuccccucucuuccuucaucuccaccccaccccacccuacucuccagacgcccugaggggu

SEQ ID NO: 226141 - RNA, 64 nt, Human
ccauuucucccgcaggccugaguuccuaaggaaaccacccuaccgggguggaagggagggucag

SEQ ID NO: 226142 - RNA, 64 nt, Human
guuucuaaguuggaucuuuuuuguuuucuccuugccacccuaauuugacaucaaaauucucucu

SEQ ID NO: 226143 - RNA, 64 nt, Human
cacugccuuugccccagcacagaagaggccccugccacccuagggacgggccaagggcugguca

SEQ ID NO: 226144 - RNA, 64 nt, Human
aucaucuuucaagaaagaggcuccucccauucaaccacccuagagaacugccuuuguuaaauag

SEQ ID NO: 226145 - RNA, 64 nt, Human
uugccugucucuugccuuaucaguucuuccuccaccacccuacaccccccuccccccggcccca

SEQ ID NO: 226146 - RNA, 64 nt, Human
ugagagacuuccauuuuuaguuccuuuacacucaccacccuagcaagugcccugcacagaguaa

SEQ ID NO: 226147 - RNA, 64 nt, Human
aaacauagccucaccaaggugacacauuacaaagccacccuaccaugaauccgcucccaagggu

SEQ ID NO: 226148 - RNA, 64 nt, Human
uucccgcugccuccagacagcaccuggguccucgccacccuaagccccgggacaccuguuggag

SEQ ID NO: 226149 - RNA, 64 nt, Human
ugggacacuuuuuuacacgauguugccgccguccccacccuaacccccaccucccggcccugag

SEQ ID NO: 226150 - RNA, 64 nt, Human
cgagugaugccaggaagccaggccaccgaagcccccacccuacccuuauuccaugaaaguuuua

SEQ ID NO: 226151 - RNA, 64 nt, Human
ccuguuauuuauuaccuggaggccuguccagcacccacccuacccccauaaagcauuguuuaca

SEQ ID NO: 226152 - RNA, 64 nt, Human
augcacccacagugaaguuccucacacccugcuaccacccuaacguggacacccaggguaacau

SEQ ID NO: 226153 - RNA, 64 nt, Human
aggcagccaccuccucucccuggcugaaccccugccacccuacuccucaccagaauugucagug

SEQ ID NO: 226154 - RNA, 64 nt, Human
cugaaaacagcacgccccaggcccacagaaccccccacccuacauuugccuuggguggagcugg

SEQ ID NO: 226155 - RNA, 64 nt, Human
guccccagggccucccuucugggcccccuacagcccacccuaccccuccuccaugggcccugca

SEQ ID NO: 226156 - RNA, 64 nt, Human
cuauggaccaaacagcucuggccuagggauugggccacccuacccaggaucuccacccugggga

SEQ ID NO: 226157 - RNA, 64 nt, Human
cuucccucaacucuaggggcagcauagccccaggccacccuagcccagccccugcauugccguu

SEQ ID NO: 226158 - RNA, 62 nt, Human
accccaagguggcccuguagggggugcaccccccacccuauggaccagucaaauaaaagccu

SEQ ID NO: 226159 - RNA, 64 nt, Human
ucagggucagugcagguuaugagauccuugggguccacccuagucucugacaccugggacaggg

SEQ ID NO: 226160 - RNA, 64 nt, Human
auaugccccucccaaaccgggaaccucaagaucuccacccuaaaauaguucuguugaauuucac

SEQ ID NO: 226161 - RNA, 52 nt, Human
aagugguucuguauggcuaggaccacccuacuacacgcucagcugccaacag

SEQ ID NO: 226162 - RNA, 64 nt, Human
cauggugugggugggaccaccaugguuuuacaccccacccuaccuuagggaagaagaaaacauu

SEQ ID NO: 226163 - RNA, 64 nt, Human
cacugucuccaccucaguuccucagggcuguuggccacccuaugacuaacuggaagaggacacg

SEQ ID NO: 226164 - RNA, 64 nt, Human
ucgauuccccuuuccuccucacugccucccaagcccacccuacuccaaaauaaugugucacuug

SEQ ID NO: 226165 - RNA, 64 nt, Human
gagcagccugggcccuucagccccugugcucgucccacccuagggacucagccacuugcagaac

SEQ ID NO: 226166 - RNA, 64 nt, Human
cccugccugagcccaggacccacuggagccagccccacccuaggcaggaagaccccugcugagg

SEQ ID NO: 226167 - RNA, 64 nt, Human
augccaaagcuaggguggcccuugcaguucagcaccacccuagucccuuccccucccuggcucc

SEQ ID NO: 226168 - RNA, 64 nt, Human
cuccagccucugccagcaaugagcugucccccucccacccuacacaguagcuggucagggcuga

SEQ ID NO: 226169 - RNA, 64 nt, Human
ccccaccagggcuuugcagauguccuugaaagacccacccuagagcccuuuggagugcuggccc

SEQ ID NO: 226170 - RNA, 64 nt, Human
uccgcaaauauccuccacuuucaggagggaaaacccacccuaccacaguccgcucuuccaagug

SEQ ID NO: 226171 - RNA, 64 nt, Human
agcggcucugguccucggagcugguuccucucucccacccuaagggcagcccuccaugguccug

SEQ ID NO: 226172 - RNA, 64 nt, Human
ugcaggcccagaccacgugggacagaacuccugcccacccuaccccgagggaggcgaacccgca

SEQ ID NO: 226173 - RNA, 64 nt, Human
cugaugguacagggcacucgcugucccccuccggccacccuagaccaggguccgagaggcaggc

SEQ ID NO: 226174 - RNA, 64 nt, Human
ggaaagacccuggccuaggggucuuagccacuccccacccuaggguauaguucagggguaucca

SEQ ID NO: 226175 - RNA, 64 nt, Human
cuccaucuuggguguuugugacaggcccugccugccacccuaggcagggaaagcugucaagacu

SEQ ID NO: 226176 - RNA, 64 nt, Human
ucgucugacaugucugugugcaccccccuccucuccacccuaccuuccaucaaccagggcagau

SEQ ID NO: 226177 - RNA, 64 nt, Human
uacaacuuccgcguguagugggcguugucaccacccacccuaccugcagaguuacuaacuucuc

SEQ ID NO: 226178 - RNA, 64 nt, Human
caucaggcuuugucugacuugcacgcucagcuucccacccuaacccacuucccuuguugcacau

SEQ ID NO: 226179 - RNA, 64 nt, Human
cccaguugcugucacaaaggagugagugaaacucccacccuacccccuuuuuuauauaauaaaa

SEQ ID NO: 226180 - RNA, 64 nt, Human
ucagucccuggaugggugguuaccuccccuuccuccacccuaagcccuggggcccugaaauggg

SEQ ID NO: 226181 - RNA, 64 nt, Human
agcuaggucggggccccaguuaagcugugccccaccacccuaggcaaugaggggcaggaaaggg

SEQ ID NO: 226182 - RNA, 64 nt, Human
ccucaaagucauuugacugcccccauccaccccaccacccuaaucuuccaccaccucuccggcu

SEQ ID NO: 226183 - RNA, 64 nt, Human
ugacaucagaggugccaccaccaaagcacucuucccacccuagucuuuguguccagcggccaag

SEQ ID NO: 226184 - RNA, 64 nt, Human
uucaaccugucccuuucccugccagcaaaccccaccacccuaagagaaauuuuagcuuauauau

SEQ ID NO: 226185 - RNA, 64 nt, Human
aaucuugaacccuggaccaaagcuuuuccagaccccacccuaccuuccaacccaggucaagaca

SEQ ID NO: 226186 - RNA, 64 nt, Human
ugcccaguauugccaaggaccgggcccugccccgccacccuaccucccaccccagcagcccucu

SEQ ID NO: 226187 - RNA, 64 nt, Human
gccuugauccacaguauuguaccugcauuuucuaccacccuaaaauugugugagacuucuccca

SEQ ID NO: 226188 - RNA, 64 nt, Human
auaaucccuccugucccacuccucucuaccaaccccacccuacuagcuaggucuucaguguuuu

SEQ ID NO: 226189 - RNA, 64 nt, Human
cagcauccuucggaccucaccacgcgaaacuacgcccgccgacagaaacaucugcaaagauaca

SEQ ID NO: 226190 - RNA, 64 nt, Human
uggccaguagccaggcaagucauagaauugauuacccgccgaauucauuaauuuacuguagugu

SEQ ID NO: 226191 - RNA, 64 nt, Human
agcccaagcagcaagauaaacccgcuccacccgacccgccgaccuucagcuuugugggacuauc

SEQ ID NO: 226192 - RNA, 64 nt, Human
agcgacaggcggcagcacagcaccugcacgaacacccgccgaaacugcugcgaggacaccgugu

SEQ ID NO: 226193 - RNA, 64 nt, Human
aauuuuuaacuuauugacaaccgagaagguuuaucccgccgauagagggacggccaagaaugua

SEQ ID NO: 226194 - RNA, 64 nt, Human
cgcugcgcugucccggccgcaagagcggggccgccccgccgagguuuguagcagccgggaugug

SEQ ID NO: 226195 - RNA, 64 nt, Human
ugcagacggugucugaccggaggauguggccgugcccgccgagcacucuugaucugagcugacc

SEQ ID NO: 226196 - RNA, 64 nt, Human
guggcaccagggcccgggguucggggauagaagccccgccgagaccccacagggaccucaguca

SEQ ID NO: 226197 - RNA, 64 nt, Human
aaagugcugagauuacaggugugagcuaccgcaccccgccgagguuagcacuuucaucaccaaa

SEQ ID NO: 226198 - RNA, 64 nt, Human
cgcgcaagacagcccaacagcuguuccuccccuccccgccgacuccaacucuucggaaucugcc

SEQ ID NO: 226199 - RNA, 64 nt, Human
cacugccaccgccacacuagugcugaacguggugcccgccgaccugcggcccccgugguuccug

SEQ ID NO: 226200 - RNA, 64 nt, Human
ugguggugggacccagguaacccccucucccacccccgccgacuucuccccuuuccccagccuc

SEQ ID NO: 226201 - RNA, 64 nt, Human
ggagcugcacuacagcccuggccuccacccccaccccgccgaccauccaagggagagugagacc

SEQ ID NO: 226202 - RNA, 64 nt, Human
aaagacuaacuccugcaacuggaaagcgggggcgcccgccgacgaggaggccaccgugccaagc

SEQ ID NO: 226203 - RNA, 64 nt, Human
ccggccaaggcgccuggaccuggcgaggacgcugcccgccgagcggacugauucgcagagucug

SEQ ID NO: 226204 - RNA, 64 nt, Human
gcagagacgaagccuuucuguaacaugcggccgucccgccgagaggggcaguuuugcucuuuug

SEQ ID NO: 226205 - RNA, 64 nt, Human
cucgcgcgucaggcgaaccagcguccggcagcgucccgccgaaugacguugcgguggcacuggc

SEQ ID NO: 226206 - RNA, 64 nt, Human
uccgaauccccgugugacccugucccagcauuuucccgccgacccugcguguccccguggcgcu

SEQ ID NO: 226207 - RNA, 64 nt, Human
ccuuccaaagcaggcccugcuccccgggcagccucccgccgaggggcccagcccccaacccaca

SEQ ID NO: 226208 - RNA, 64 nt, Human
gguaaauccaccagagggccgguuagaugcuggccccgccgagagaacugcugucacuuucagg

SEQ ID NO: 226209 - RNA, 64 nt, Human
ggagccggugcgcaaguucacgggcaaggcgguccccgccgacguccuggaggcgcuaugcaag

SEQ ID NO: 226210 - RNA, 64 nt, Human
aggggucuuggaggcagggcugucccacagggcgcccgccgaccugcaccugucugugaaguau

SEQ ID NO: 226211 - RNA, 64 nt, Human
uuuuuuuuuuuucaguuuuuguuuuuacuuuugucccgccgaguacuauguauuaccagccccc

SEQ ID NO: 226212 - RNA, 64 nt, Human
gggguggggagggggcccacaagcacgcccagcccccgccgaauucuuuuagcuucguaauugg

SEQ ID NO: 226213 - RNA, 64 nt, Human
gaguccugcggccgcccaggugucaggagagguccccgccgagugcuucagcugcccuaagcug

SEQ ID NO: 226214 - RNA, 64 nt, Human
gcugaccagagaucuugcagccccuguggaugcccccgccgaggucccccgauccccgcacccg

SEQ ID NO: 226215 - RNA, 64 nt, Human
cccuagacucagaggcgccgcggggagggguggccccgccgaggcuucaggggcccccucccca

SEQ ID NO: 226216 - RNA, 64 nt, Human
cagagccaccugggccccgggugcagccggagaccccgccgagccccuccucccaguauuccca

SEQ ID NO: 226217 - RNA, 64 nt, Human
cuuucugcggggcaucaggcugcugggguagccgcccgccgagccuggaagcugcucguucucc

SEQ ID NO: 226218 - RNA, 64 nt, Human
ucacaaccugucaggcugcaccaccucauccuggcccgccgaaccuugaccucaccccugcccc

SEQ ID NO: 226219 - RNA, 64 nt, Human
aaaaaauguauuuauuaaaaaaaaauuuuuuuaacccgccgaauaauucccauaagaguaacaa

SEQ ID NO: 226220 - RNA, 64 nt, Human
uacgcagucugugggagcccggccgcgcccagcccccgccgaccguggcguuggcccugcuguc

SEQ ID NO: 226221 - RNA, 64 nt, Human
gacgaggccugaccccauccccauccucgcugggcccgccgaccccgguguuagcaagaauccu

SEQ ID NO: 226222 - RNA, 64 nt, Human
gacccacgccgggcgggaccggccagggaucacccccgccgacggccccgggccccgacggccc

SEQ ID NO: 226223 - RNA, 64 nt, Human
gaugccagaucuaugugucugucuguguguccaucccgccgaccccccagacuaaccuccaggc

SEQ ID NO: 226224 - RNA, 63 nt, Human
ccagcagagugagcuguugacucgaucgaaaccccggcgaaagaaaucaaacccccaacuucu

SEQ ID NO: 226225 - RNA, 64 nt, Human
aauucuuuuuuaaaaucugcugaagcagccccauccggcgaaguucuuggcauuggcuacucca

SEQ ID NO: 226226 - RNA, 64 nt, Human
cuaaacaacuagaaggagagagccacgugaacauccggcgaaggggacccaggcagagagaaaa

SEQ ID NO: 226227 - RNA, 64 nt, Human
uaugaaguuacaaaaucuucagcuucagccaggcaacgcuaagcucugaagaacucccuuuggc

SEQ ID NO: 226228 - RNA, 64 nt, Human
gaggggguggagggguguggcagugguuuuggcaaacgcuaaagagcccuugccuccccauuuc

SEQ ID NO: 226229 - RNA, 64 nt, Human
aggaagaaaaaaaguacucugaacugcuccaaguaacgcuaauuaaaaacuugcuuuaaagaua

SEQ ID NO: 226230 - RNA, 64 nt, Human
aacauaaaaagacuagaauuugugaguuuuagcaaacgcuaaaauugaucacuguaacuaaccc

SEQ ID NO: 226231 - RNA, 64 nt, Human
cucugccuauugcaggacaaugauggcuauucuaaacgcuaaggaaaaaaaacaaacacagaac

SEQ ID NO: 226232 - RNA, 64 nt, Human
gaaauccaaaaucuuggugcauuauuuuuucauaaacgcuaaaacauuugaagaaacaauuuaa

SEQ ID NO: 226233 - RNA, 64 nt, Human
uuguggugaggggugugggaagaccaaaggaaggaacgcuaacaauuucucauacuuagaaaca

SEQ ID NO: 226234 - RNA, 64 nt, Human
ugugcauuuuauuacuucuguauauagagguaacaacgcuaagcuuuuuugagaugucuguuuc

SEQ ID NO: 226235 - RNA, 64 nt, Human
uaugcuaagccuuuuaauguaaacaagcaccucuaacgcuaaaagcacccuugcaagaaaggua

SEQ ID NO: 226236 - RNA, 64 nt, Human
aaugcugcaaacuuaauguucuuaugcaaaauggaacgcuaaugaaacacagcuuacaaucgca

SEQ ID NO: 226237 - RNA, 64 nt, Human
cagagcuuuggacuguucaacccacacaagaacaaacgcuaacuaauauuuuuuuuaagagauu

SEQ ID NO: 226238 - RNA, 64 nt, Human
ggugggggccggggcuggcccugggacccccaggaacgcuaagacacaggcuccaguaggggcu

SEQ ID NO: 226239 - RNA, 64 nt, Human
ggcaguuauauuuuugagcguaaaagggucgucaaacgcuaaaucuaaguaacgaauugaaagu

SEQ ID NO: 226240 - RNA, 64 nt, Human
agugcuuaguacaauauccugccaucucuguaaaaacgcuaauugauaaccgagucauuuacau

SEQ ID NO: 226241 - RNA, 64 nt, Human
gacugauaagccauuagcuagacccugacuauguaacgcuaaagauuuuaccaugccuggaaau

SEQ ID NO: 226242 - RNA, 64 nt, Human
ugccccaccccacccccacucccacggacacuaaaacgcuaauaauuuauuagaucuaaagccc

SEQ ID NO: 226243 - RNA, 64 nt, Human
gaguugcugguagcaggcucccuccuucugcagcccggcgaaugggggcgcugggcucuguucc

SEQ ID NO: 226244 - RNA, 64 nt, Human
cagcccccucgccccugccucccuugccccuaccccggcgaagcauguuccccccgacgccccc

SEQ ID NO: 226245 - RNA, 64 nt, Human
cgcgucccccaugccagcccccaacgcagggcgcccggcgaagccacgggacuggcgggaggag

SEQ ID NO: 226246 - RNA, 64 nt, Human
uuuggaaaauaaacauaagacuaaacaugagaaaaacgcuaacuuauuggaagaaaaucggaga

SEQ ID NO: 226247 - RNA, 64 nt, Human
auuuuuagucggguuaucaaauuugauuuacaaaaacgcuaacuuuguuugaaaugcaaacagg

SEQ ID NO: 226248 - RNA, 64 nt, Human
gcuauuaagaguacuuuguguuagcacucuuaaaaacgcuaacagagaucaucauuagcuguga

SEQ ID NO: 226249 - RNA, 64 nt, Human
uaaacugucuaccucauauaauacaaguauuuacaacgcuaaaguuaccagaggucaaugaaua

SEQ ID NO: 226250 - RNA, 64 nt, Human
uccauuaacaguuccagcucuauguguuuccucuaacgcuaaaggcacagcccccgggaaucua

SEQ ID NO: 226251 - RNA, 64 nt, Human
uaacuucuuccacuuuuuccagaauuugaauauuaacgcuaaagguguaagacuucagauuuca

SEQ ID NO: 226252 - RNA, 64 nt, Human
aaauaaaaucaaaagggaaaucaaaaauaaagaaaacgcuaaagaaaaaacaauagcccacauu

SEQ ID NO: 226253 - RNA, 64 nt, Human
auaggauuccuuacuuuuaguuagaaaccccuaaaacgcuaauauugauuuuccugauagcugu

SEQ ID NO: 226254 - RNA, 64 nt, Human
agauuuaacccuaagguaagaugcugggguauagaacgcuaagaauuuucccccaaggacucuu

SEQ ID NO: 226255 - RNA, 64 nt, Human
acucauuuauuguguuacuauuaaauaugcugaaaacgcuaaaaguauacguauugguucuuua

SEQ ID NO: 226256 - RNA, 64 nt, Human
guuuuguuaauuaauccaagauuuacaauagcacaacgcuaaaucacacaguaacuacaaaagg

SEQ ID NO: 226257 - RNA, 64 nt, Human
ccuccaucccugucccccaucuuggugcugaaccaacgcuaagggcaccuucuuagacucaccu

SEQ ID NO: 226258 - RNA, 64 nt, Human
acguaacaugcuugaaacugccuggcauauacuaaacgcuaaauaaauacaugcuaacugcgau

SEQ ID NO: 226259 - RNA, 64 nt, Human
acuguuuugauuuuugugggaaaauauuccaggaaacgcuaauucucuuuagacuccuuguucu

SEQ ID NO: 226260 - RNA, 64 nt, Human
ccuaugugaaaagaucccaagauggagaggaagaaacgcuaauucagcauguguucauucugca

SEQ ID NO: 226261 - RNA, 64 nt, Human
cuccccugcugccuucacuccuuucugaccaagcaacgcuaacuuuuguacagaucgauuugau

SEQ ID NO: 226262 - RNA, 64 nt, Human
cuagcggccggggagggaggggccggguccgcggccggcgaacggggcucgaaggguccuugua

SEQ ID NO: 226263 - RNA, 64 nt, Human
uucgcuccugugucuugcaauggcagccuuggcaaacgcuaaaugaaaaucgugacaacacuug

SEQ ID NO: 226264 - RNA, 64 nt, Human
gacagggugucuuaugcaaaggcugacuugccugaacgcuaagaacaugacuucugucugagcu

SEQ ID NO: 226265 - RNA, 64 nt, Human
gaacuauguaaugcuucacccugaaaggcaagcuaacgcuaacuucccaggugacaguagcagg

SEQ ID NO: 226266 - RNA, 64 nt, Human
uacggucagccuuauuccccuucaccucccagugaacgcuaagaaguuucagacaagcagagag

SEQ ID NO: 226267 - RNA, 64 nt, Human
accaguuuauaucacggucuucauuuuuaaaaguaacgcuaacuuuguacggacgaugucucau

SEQ ID NO: 226268 - RNA, 64 nt, Human
uguagugugauuucuuuguauuagcaaagacaaaaacgcuaacauugaaaaaguaugucagauu

SEQ ID NO: 226269 - RNA, 64 nt, Human
uuuacuaagaauuugccuguuugaauaagaacaaaacgcuaagguggguagccuaagcugauuu

SEQ ID NO: 226270 - RNA, 64 nt, Human
acaugaacugaacgguuaaaagcacagucuauggaacgcuaauggagucagccccuaaagcugu

SEQ ID NO: 226271 - RNA, 64 nt, Human
guuugggcuuuuuuauacucuucucaguuugugaaacgcuaacugcacacgaagccgccugacg

SEQ ID NO: 226272 - RNA, 64 nt, Human
uagugagacccccaucucuaaauaaaaauagaccaacgcuaaagccugugcuccagagccucca

SEQ ID NO: 226273 - RNA, 64 nt, Human
gauccuuccgguggagugucggagaagagagcuugccgacgaugccuuccugugcagagcuugg

SEQ ID NO: 226274 - RNA, 64 nt, Human
cgcgcugaacgaggccaagcagaugaucgccgucgccgacgagaaccagaaccaccaccuggag

SEQ ID NO: 226275 - RNA, 64 nt, Human
ugucucaaccucccaaguaggauuacaagcaugcgccgacgaugcccagaauccagaacuuugu

SEQ ID NO: 226276 - RNA, 64 nt, Human
gcugcucacccugcggcacgugguggacgagggugccgacgaguacaaggucaucaugcuccac

SEQ ID NO: 226277 - RNA, 64 nt, Human
gaugcagggacgcgcgacgccggccccggucgcagccgacgacgccgccgccagccugaccuca

SEQ ID NO: 226278 - RNA, 64 nt, Human
cugccauuccacccauggucccucacccugcccugccgacgagcuugucucugcagccccaggu

SEQ ID NO: 226279 - RNA, 64 nt, Human
cugauuggcaucacauugaucuagaacugguccagccgacgaagaguaggaaaagagaagggcu

SEQ ID NO: 226280 - RNA, 64 nt, Human
cauggccgaggagacaaggcagaagcaacuucuggccgacgagaagaugaagcagcucacagag

SEQ ID NO: 226281 - RNA, 64 nt, Human
cuaccaguuugcuaaguacagaucauucaagguggccgacgaggcggagaaguacaaucugguc

SEQ ID NO: 226282 - RNA, 64 nt, Human
gacuaacuccugcaacuggaaagcgggggcgcccgccgacgaggaggccaccgugccaagccgg

SEQ ID NO: 226283 - RNA, 64 nt, Human
ccuacacaggggcauugacagacuggaguugaaagccgacgaaccgacacgcggcagagucaau

SEQ ID NO: 226284 - RNA, 64 nt, Human
ccguggcccucggccuccagauggccacaccucugccgacgacggaccagcucccucucccuuc

SEQ ID NO: 226285 - RNA, 64 nt, Human
ggaaaagcagaggaagguggaggucuacgcagaugccgacgaaauccuccaggaggagaucaag

SEQ ID NO: 226286 - RNA, 64 nt, Human
ugcaagcauugaagcccacgcucugagucucagcgccgacgagaccauggaagagccaucuguc

SEQ ID NO: 226287 - RNA, 64 nt, Human
guccagcaacgaggaugagggcagcagcuccgaggccgacgagauggccaaggcgcuggaggcg

SEQ ID NO: 226288 - RNA, 64 nt, Human
ggggcugugacccucuucccccaggcccuccccagccgacgacagccaccggagaggagaucgg

SEQ ID NO: 226289 - RNA, 64 nt, Human
cgugacuggggcaacgccucguccugcagagggagccgacgaccucuuuucugcagaaaagcuc

SEQ ID NO: 226290 - RNA, 64 nt, Human
uaucgccagccguugcuuuguuacugaacgugccgccgacgaccucagaaaacccagaugggug

SEQ ID NO: 226291 - RNA, 64 nt, Human
uagagaauccaugucgcucugacaccccaaggaagccgacgauccaaaugccgugugucaccaa

SEQ ID NO: 226292 - RNA, 64 nt, Human
aaaaugugugaaauggaaaguugauggcagcagggccgacgaugucaccuggugccucgcgggc

SEQ ID NO: 226293 - RNA, 64 nt, Human
uuauggaaccaagaaaacaaguaaacaugcagcugccgacgaggcuuugaaaauucuucaaaaa

SEQ ID NO: 226294 - RNA, 64 nt, Human
aucucuuuggacaguggccacccugcacaauggggccgacgaggccuagggcccuccuaccugc

SEQ ID NO: 226295 - RNA, 59 nt, Human
agcggcuccgguguccuccacguggcugcccuggggagcaaucccagcggaucgcuccg

SEQ ID NO: 226296 - RNA, 59 nt, Human
cugacaggcaauggugacuguguguguuuccuggggaggagguuagcagggacgguugc

SEQ ID NO: 226297 - RNA, 59 nt, Human
acagcccagcccacccucuccuggugcugccuggggaggcaaaucaugcucacuccggc

SEQ ID NO: 226298 - RNA, 59 nt, Human
guaaacaugaauuuuuuuucaauguagccccuggggaaugaaugaaauuuugagcuucu

SEQ ID NO: 226299 - RNA, 59 nt, Human
gacugggcuagcucuguaggcucggagagccuggggagggugccaaccccaccucuagu

SEQ ID NO: 226300 - RNA, 59 nt, Human
gaauugcucccccuucauucugaugccucccuggggaacaaggauaaugacuuugcauc

SEQ ID NO: 226301 - RNA, 59 nt, Human
aaucugauggggaagacauggccccucccccuggggagugcccugugugauggaggcga

SEQ ID NO: 226302 - RNA, 59 nt, Human
uggagaacuucauaaagaugucucacagcccuggggacaccugcccagugggccccagc

SEQ ID NO: 226303 - RNA, 59 nt, Human
ucacucuaguguguggucccucucaggguccuggggaucugccucucuguggucuccau

SEQ ID NO: 226304 - RNA, 59 nt, Human
gacucuuuagagcagcuuugggaucccacccuggggacccccacgauuggccaccugua

SEQ ID NO: 226305 - RNA, 59 nt, Human
uacuuggcuccagcccuccagcugcagccccuggggaaaagcagccucccuucuccucu

SEQ ID NO: 226306 - RNA, 59 nt, Human
ggauuccaucuggcccagccccugaagguccuggggaagcaggucucaauucugaauag

SEQ ID NO: 226307 - RNA, 59 nt, Human
uccugcuacauccuucuccgucccccaucccuggggaggcucccaccaucucgccacug

SEQ ID NO: 226308 - RNA, 59 nt, Human
gcuggaguccagugcuuucuuuccgucacccuggggauaguccuuccuggcaucguggu

SEQ ID NO: 226309 - RNA, 59 nt, Human
gcccuuuggggagccuacucagcauucuaccuggggaaauggaaaacagaggccaccac

SEQ ID NO: 226310 - RNA, 59 nt, Human
ccuacaaugaugcagcacuucucacaguuccuggggaagaggccaugguuuguuggaga

SEQ ID NO: 226311 - RNA, 59 nt, Human
ucacaggcuuauccccaggaagccucacuccuggggaaagacagauaauuucacugccc

SEQ ID NO: 226312 - RNA, 59 nt, Human
gggggccaccauccaguguagggcacaacccuggggacugcccuccauagccugucccg

SEQ ID NO: 226313 - RNA, 59 nt, Human
agugccuuagcaaauucuguuuuucuaggccuggggacggcuuuuacuuaaaccgccaa

SEQ ID NO: 226314 - RNA, 59 nt, Human
uaaaaguggggucccuguccccagcugcuccuggggaguagaagcaauaauguauuucu

SEQ ID NO: 226315 - RNA, 59 nt, Human
ucaagccagcugggggcccaggcugaagaccuggggacaggucgauugcuggaccaggg

SEQ ID NO: 226316 - RNA, 59 nt, Human
gaauaagggaaaggcccaagguauccaagccuggggaagggcaggccagccagcaccuc

SEQ ID NO: 226317 - RNA, 59 nt, Human
ucagugaaugguggaagucagagaccaacccuggggauugggugccaucucucuagggg

SEQ ID NO: 226318 - RNA, 59 nt, Human
acugaccucugaguacagcaauaaaauaaccuggggaucuuuuguguuggguggagcug

SEQ ID NO: 226319 - RNA, 59 nt, Human
ugcagccaugcagggacccaggacuguaaccuggggaggacgcgggucccugcaaggaa

SEQ ID NO: 226320 - RNA, 59 nt, Human
ucucucagugcuuggcagaggggugaggcccuggggaggcagggguuggugcccugacu

SEQ ID NO: 226321 - RNA, 59 nt, Human
ggaaacaaugccagcucuguggcuucugcccuggggaugggccggguuggggggugggu

SEQ ID NO: 226322 - RNA, 54 nt, Human
cuggccacccugcagccugaaccaccuggggaggaggcgggagagggagcugcc

SEQ ID NO: 226323 - RNA, 59 nt, Human
gcugugagaccacacuagggcauuguuucccuggggaagcagugggagagcagacucau

SEQ ID NO: 226324 - RNA, 59 nt, Human
cacacuagcagcccugacuccacacuccuccuggggacccaagaggcaguguugcuguc

SEQ ID NO: 226325 - RNA, 59 nt, Human
cugcagacaccuggacugagccaaggaggccuggggaggcccuaggggagcaccgugau

SEQ ID NO: 226326 - RNA, 59 nt, Human
gcaguccagagcuucagggcugggcagguccuggggaggcugagacugcagaggagcca

SEQ ID NO: 226327 - RNA, 59 nt, Human
ugauauuugcuggagugcuggcuccacgcccuggggagugagcuuggugcgguaggugc

SEQ ID NO: 226328 - RNA, 59 nt, Human
ccgugacaacaggccaccacauaccucaaccuggggaacuguauuuuuaaaugaagagc

SEQ ID NO: 226329 - RNA, 59 nt, Human
cagcccggagguaagguucagaaagucccccuggggacuccuccaucuucggcagcucu

SEQ ID NO: 226330 - RNA, 59 nt, Human
gcagaggccagaaaccuugagcuuaggugccuggggaccagcuucgacauucucuccag

SEQ ID NO: 226331 - RNA, 59 nt, Human
uaccccacagcuuaguggccaguaaacacccuggggacuaggaaaaggaaccaacugua

SEQ ID NO: 226332 - RNA, 59 nt, Human
ggcucugauuagccaggccuggucaggguccuggggacggcacccagauaugcagaguc

SEQ ID NO: 226333 - RNA, 59 nt, Human
cuguuguccuuggucagggguucugucuaccuggggaccccugucugcacaccagggau

SEQ ID NO: 226334 - RNA, 59 nt, Human
gauggggaggggcucugcguuggcuucucccuggggacggggcuccccuggacagaggc

SEQ ID NO: 226335 - RNA, 59 nt, Human
uuugaccacccaccugaccaggggcccuaccuggggaaagccugaagggccucccagcc

SEQ ID NO: 226336 - RNA, 59 nt, Human
ccuggcucacaguccugcacaccugcuggccuggggagcuccagccaggcagcgagucc

SEQ ID NO: 226337 - RNA, 59 nt, Human
cccagccgccaccucugcccucucccaucccuggggacagaggccuugugucaccugcc

SEQ ID NO: 226338 - RNA, 59 nt, Human
uugcacaagcaaguuugugucagccacgcccuggggaggauccacuggaucaccgccgu

SEQ ID NO: 226339 - RNA, 59 nt, Human
gcaauauuccacagcgcccuccagaguuaccuggggaggaccgaggccacacgccacug

SEQ ID NO: 226340 - RNA, 59 nt, Human
ccgcaugucccgggccgagugaggucgggccuggggagcugagugacaucccaagcuug

SEQ ID NO: 226341 - RNA, 59 nt, Human
cggagacccuggccaugguugugguagagccuggggacacgcuguccucccccgaguuc

SEQ ID NO: 226342 - RNA, 59 nt, Human
cuuguguugcugguuccuauucaguauuuccuggggauuguuugcuuuuuaaguaaaac

SEQ ID NO: 226343 - RNA, 59 nt, Human
gcucaggggccuggaggucuggcugagccccuggggaaaggugaguucuuucaucuccc

SEQ ID NO: 226344 - RNA, 59 nt, Human
cuacacuccucccccgagaccacccccacccuggggaagcguugacuacuguccccuac

SEQ ID NO: 226345 - RNA, 59 nt, Human
gcccuccacugggcccaguggcucagggaccuggggaaaggagauggagcagcucuugg

SEQ ID NO: 226346 - RNA, 59 nt, Human
aaacucugagccccuugcccaccugaagcccuggggaugauguggaaauaggggcacac

SEQ ID NO: 226347 - RNA, 59 nt, Human
ccccagggagaggcugcuggauggugaccccuggggaaugccccauggcccagaaugau

SEQ ID NO: 226348 - RNA, 59 nt, Human
gcccuuggagcugcugguuuagccuugcaccuggggaaaggauguauuuauuuguauuu

SEQ ID NO: 226349 - RNA, 59 nt, Human
aguucacgugcugcacccccagggaggggccuggggaaagcugguccagcagcaggggu

SEQ ID NO: 226350 - RNA, 59 nt, Human
gcaugcccaccuagcucccuggccagggcccuggggaggcagaggguacccaggggacu

SEQ ID NO: 226351 - RNA, 59 nt, Human
caggaaacccagucgcccuuacuucuugcccuggggaucaaaguucugcuuucucccca

SEQ ID NO: 226352 - RNA, 59 nt, Human
cugaaagggccaggucccagugcugggccccuggggaggagggagggugggcgguaugg

SEQ ID NO: 226353 - RNA, 59 nt, Human
acgccuaugcccugcccuuccucagggccccuggggaucuugcccccuuugaccuuccc

SEQ ID NO: 226354 - RNA, 59 nt, Human
uuccuuuaauuagaucauaaauaaaugauccuggggaaaaagcaucugucaaauaggaa

SEQ ID NO: 226355 - RNA, 59 nt, Human
uggguuugaaucugcacuuauccccaccaccuggggacccccuuguuguguccaggacu

SEQ ID NO: 226356 - RNA, 59 nt, Human
aguugggcucuaagaaugaggggaaagagccuggggaggagcuuaaaacucaaccacuc

SEQ ID NO: 226357 - RNA, 59 nt, Human
uuuaccucugauagaggucagaaugagguccuggggagaaucuaagcccuccgaugugu

SEQ ID NO: 226358 - RNA, 59 nt, Human
agaggcaggaguggcagcuguccccucucccuggggauaugcaacccuuagagauugcc

SEQ ID NO: 226359 - RNA, 59 nt, Human
ggauguuucaguguccuuucuucucugucccuggggaugggguggucugugaauaugug

SEQ ID NO: 226360 - RNA, 59 nt, Human
gcaccagggaaggggacaaggacuaggguccuggggaaccugaccccugaccccucaua

SEQ ID NO: 226361 - RNA, 59 nt, Human
aggccaccucccacuccugcugcacaggcccuggggagcuuuugcccacacacuuucca

SEQ ID NO: 226362 - RNA, 59 nt, Human
ggccugauuuuuuuggugggaaaggcugcccuggggaucaacuuuccuucugugugugg

SEQ ID NO: 226363 - RNA, 59 nt, Human
ccuaggaaggcuggcagacacccuggaacccuggggagcuacuggcaaacucuccugga

SEQ ID NO: 226364 - RNA, 59 nt, Human
aggguaaaagucaguacggauuuuaauagccuggggaggaaaacacauucuuugccaca

SEQ ID NO: 226365 - RNA, 59 nt, Human
gaaacaaaggaaaacaggugccugaauuuccuggggaaacauggcuuguuuaaggacuu

SEQ ID NO: 226366 - RNA, 59 nt, Human
agcugggggucgaggguccugcauaugcaccuggggaguccccacacacccgcaccaaa

SEQ ID NO: 226367 - RNA, 59 nt, Human
gccuuauauguguguuuaccccuuccuggccuggggaaggaggcggggagggcuccuuu

SEQ ID NO: 226368 - RNA, 59 nt, Human
cagauggggguccagagcuaagugacccaccuggggaagcucugauuauucauccaggg

SEQ ID NO: 226369 - RNA, 59 nt, Human
gaaucaugucgauccuggggcccucagcuccuggggaccccacucccugcucuaacacc

SEQ ID NO: 226370 - RNA, 59 nt, Human
ccagagcuugcuguccccugagaccccauccuggggagaggggaggacuccucucccua

SEQ ID NO: 226371 - RNA, 59 nt, Human
cugggcuucagcucuaagaacuucauugcccuggggaucagacagccccuaccuacccc

SEQ ID NO: 226372 - RNA, 59 nt, Human
gagagugggcgugggcuucuucacauaagccuggggaaggaagaaaaaacggcuuucau

SEQ ID NO: 226373 - RNA, 59 nt, Human
guccucaaacuggucauaggcucuagucaccuggggagcuguagaaaacacuugcagag

SEQ ID NO: 226374 - RNA, 59 nt, Human
gcuggccgccggccuugcagucucucuacccuggggaggaacaguggcuucucagagcc

SEQ ID NO: 226375 - RNA, 59 nt, Human
uuggugacucuguccuucgcccugugcacccuggggaggagagcucugggaacagccgc

SEQ ID NO: 226376 - RNA, 59 nt, Human
uuugaucuugccaucauuccccaguaaaaccuggggaguucugcguugaguggacggac

SEQ ID NO: 226377 - RNA, 59 nt, Human
uggcauguguucacuaagaggccuuuaauccuggggaguaaggggcgaaggcccuuaga

SEQ ID NO: 226378 - RNA, 59 nt, Human
gccacauaagggguuugccauuugauaccccuggggaacauuucuguaaauaccauuga

SEQ ID NO: 226379 - RNA, 59 nt, Human
augaacaggacuugaccaucuuuccaaccccuggggaagacauuugcaacugacuuggg

SEQ ID NO: 226380 - RNA, 59 nt, Human
cggggcgguggugccgggaccucugagguccuggggauuuggggacccuugggguccac

SEQ ID NO: 226381 - RNA, 59 nt, Human
gaagcuauguuaauuucuggugaguaagaccuggggaauguuuggcaaugacaaaagaa

SEQ ID NO: 226382 - RNA, 59 nt, Human
uuggagaagaaagagcauuucuuuaaguaccuggggaauacagcucucagugaucagca

SEQ ID NO: 226383 - RNA, 59 nt, Human
caacugcacucccuccucaggagccccuuccuggggacagugaggacaaugacccuaca

SEQ ID NO: 226384 - RNA, 59 nt, Human
uggcaaaaggccagagaugggccuccuucccuggggaggugugauguaguuaucacauu

SEQ ID NO: 226385 - RNA, 59 nt, Human
cuggaaaguugugucuucugggaaagagaccuggggaggccaggaguagcugagggucc

SEQ ID NO: 226386 - RNA, 59 nt, Human
cuugggcccaguagccccaauaugguggcccuggggaagaggccuugggggucugcucu

SEQ ID NO: 226387 - RNA, 59 nt, Human
ccggcugaccaacauucaaaagcacaaacccuggggacucugcuuggcuguccccucca

SEQ ID NO: 226388 - RNA, 59 nt, Human
uggucuugcucugggaauuaggugaccuuccuggggaggccccaggagagugaaucagg

SEQ ID NO: 226389 - RNA, 59 nt, Human
ugggaaggcagaggaucucugaggaguucccuggggacaacugagcagccucuggagag

SEQ ID NO: 226390 - RNA, 59 nt, Human
uucccuccaccuggggcagcagcaggaggccuggggaggaggaaaaucaggcagucggc

SEQ ID NO: 226391 - RNA, 59 nt, Human
cccagccugggauccuucgugcuucaaggccuggggagccuguccuuccaugcccuugu

SEQ ID NO: 226392 - RNA, 59 nt, Human
gcacccggaggggucaucgcugcccagagccuggggauuccagcugucuugucuuuuuc

SEQ ID NO: 226393 - RNA, 59 nt, Human
uucccauuuuacaggugagagauuugaagccuggggaggcuaguaacucaccccaaggu

SEQ ID NO: 226394 - RNA, 59 nt, Human
auauaugauuuauucacaguuccucaaggccuggggaugaugaucaguuauaccuauuu

SEQ ID NO: 226395 - RNA, 59 nt, Human
gaaugaccugaugucagauuuagauucuuccuggggauuacacagcuaugaauguauuu

SEQ ID NO: 226396 - RNA, 59 nt, Human
ggacuacaggcaugaaauacugugccuggccuggggaccaggugcauuuuaagguuccu

SEQ ID NO: 226397 - RNA, 59 nt, Human
gccuucauuuauagaugaggcagcugaggccuggggaugugaacaaccugcucacaguc

SEQ ID NO: 226398 - RNA, 59 nt, Human
agucaggucuucccagauuaucugaaggcccuggggauuccacuccaguaaaguagaau

SEQ ID NO: 226399 - RNA, 59 nt, Human
uaccuacaguuugagucaacuagaauaugccuggggaccuugaagaauggcccuucagu

SEQ ID NO: 226400 - RNA, 59 nt, Human
cucucuuccuuggguguuuggugcuggcuccuggggacuacaaaucccagagugcggug

SEQ ID NO: 226401 - RNA, 59 nt, Human
cacagaugaacugccucuccuccucccugccuggggagcccaguggccagggaggggag

SEQ ID NO: 226402 - RNA, 59 nt, Human
cgucacaugccggggagcaauguggauggccuggggacuccuggguuuucucccucccg

SEQ ID NO: 226403 - RNA, 59 nt, Human
ugcgcuacgaucacaccacugcacaccagccuggggauagagugagaucccaucucuaa

SEQ ID NO: 226404 - RNA, 59 nt, Human
agcccaguggguaccaggcaggcucccuuccuggggaaaagaagcacccagaccccgcg

SEQ ID NO: 226405 - RNA, 59 nt, Human
ugccauggaaccuuccccucccggugcacccuggggaccgagcccuugacaccacgccc

SEQ ID NO: 226406 - RNA, 59 nt, Human
gaugauggugccagagggcagggagcucgccuggggagagggcugugccccguagggac

SEQ ID NO: 226407 - RNA, 59 nt, Human
ucccuccugugccccagcugccaggcggcccuggggagggguggugugguguugggaag

SEQ ID NO: 226408 - RNA, 59 nt, Human
gcaggggacacagggagaggaugguugucccuggggagggcccucuggccccaggcaac

SEQ ID NO: 226409 - RNA, 59 nt, Human
agcaaacagacccugcaagguccuccaggccuggggacaggaaagccacugacccagcc

SEQ ID NO: 226410 - RNA, 59 nt, Human
uucaguggcuuggacucuuucccaucuccccuggggagccugaggagcccagcguccac

SEQ ID NO: 226411 - RNA, 59 nt, Human
uggaguuucuucuccacauuaucuuuguuccuggggaauaaaaacuaccauuggaccua

SEQ ID NO: 226412 - RNA, 59 nt, Human
uaggucuguucagagucugugccccuggaccuggggaguggauaucagaugggauaucu

SEQ ID NO: 226413 - RNA, 59 nt, Human
aguaggucuccuggcguucugccagcuggccuggggauucugaguggugucugcuuaga

SEQ ID NO: 226414 - RNA, 59 nt, Human
gccuauuucccgaccaucuucuccuauuuccuggggagcccugaggcuuuucuucuccu

SEQ ID NO: 226415 - RNA, 59 nt, Human
agcccuggcccgucugugcacucuuggcuccuggggagauauaucugccuucuaagaag

SEQ ID NO: 226416 - RNA, 59 nt, Human
guuuugaguguuggcaauuugggaugccuccuggggaagguuuccgggcguuuggugag

SEQ ID NO: 226417 - RNA, 59 nt, Human
caacaagggguugugaguguggucagcggccuggggacggagcacugugcagccgggga

SEQ ID NO: 226418 - RNA, 59 nt, Human
aagagcugucuaugcagccugcucuugggccuggggaugagacacacaauucauuggcu

SEQ ID NO: 226419 - RNA, 59 nt, Human
cccagggccuggagcccaagcccuguguuccuggggaagcuggggacuugggaagugau

SEQ ID NO: 226420 - RNA, 59 nt, Human
cucuucuggcugcccccaaugccccgaggccuggggagcccccagcucacccaucugua

SEQ ID NO: 226421 - RNA, 59 nt, Human
gacuucuuaauaauggcaagugacguggcccuggggaaaggugcuuuauguaccgugug

SEQ ID NO: 226422 - RNA, 59 nt, Human
ucuuugacagccaggccuagacagacaggccuggggacacuggccccaugaggggagga

SEQ ID NO: 226423 - RNA, 59 nt, Human
uucugcagggucccuguguuggaauucucccuggggaaccuacuuucugcucagugagg

SEQ ID NO: 226424 - RNA, 59 nt, Human
augugacaacuauggaccugugggugugcccuggggaccccugacccaucccaaaacac

SEQ ID NO: 226425 - RNA, 59 nt, Human
gucacaaugauuucuuuaugcaugcagagccuggggaagucaugggauuaacuugaggg

SEQ ID NO: 226426 - RNA, 59 nt, Human
ggagcuaauggcgaucaucuuugccaccaccuggggagagccugcuugggaaugaaauu

SEQ ID NO: 226427 - RNA, 59 nt, Human
uuaugaagucccugcuugaaggcaauggaccuggggaagagacuaucacaaaaagucuc

SEQ ID NO: 226428 - RNA, 59 nt, Human
acuguauguauuuccaccugaggagaaggccuggggaggccacagugcaccauugcaca

SEQ ID NO: 226429 - RNA, 59 nt, Human
cgcuugguccagaacaucaaacuccaaacccuggggacaaacgacaugaaauaaaugua

SEQ ID NO: 226430 - RNA, 59 nt, Human
ucucaaccagccggcuccucgucuguacaccuggggauuucuuuugauuucaagaacag

SEQ ID NO: 226431 - RNA, 59 nt, Human
agagaccccuguccugucccuucaccaguccuggggaggcugggacucccccugccaca

SEQ ID NO: 226432 - RNA, 59 nt, Human
gggaaggaggugaucugccaggugcugcaccuggggacugugaccgacuuuaagcaaac

SEQ ID NO: 226433 - RNA, 59 nt, Human
uucucuugaagaacugacuagugagauggccuggggaagcugugaaagaaccaaaagag

SEQ ID NO: 226434 - RNA, 57 nt, Human
aggaugacccuggcccaugaccagcauccuggggacggccugcacccucugcccgcc

SEQ ID NO: 226435 - RNA, 59 nt, Human
uuugggggacuauuuuuguacagagaaaaccuggggaggguggggagggcgggggaaug

SEQ ID NO: 226436 - RNA, 59 nt, Human
uuaaaaaaaucauaugcuauguucccaguccuggggagcuucacaaacaugaccagaua

SEQ ID NO: 226437 - RNA, 59 nt, Human
gcccuguucccuucgccucuacugcgaggccuggggagauguuguuuucaugcugcuuc

SEQ ID NO: 226438 - RNA, 59 nt, Human
acggcaccuguggggaugggcuccugcagccuggggaggagugugacgacgguaacagc

SEQ ID NO: 226439 - RNA, 59 nt, Human
agcccuaacauagugucugcugcugccucccuggggaccaggagcuagcccagucccug

SEQ ID NO: 226440 - RNA, 59 nt, Human
guuaaggcuagguuaggcccugcacuccaccuggggacggccccucaucaccugaaguc

SEQ ID NO: 226441 - RNA, 59 nt, Human
aaauaccccaucauucaugcuacugccaaccuggggagccagggcuaugggagcagcuu

SEQ ID NO: 226442 - RNA, 59 nt, Human
ucaagaacuccuagccuucccaaaugcccccuggggaguucuggcuggggcuucagccu

SEQ ID NO: 226443 - RNA, 59 nt, Human
agcuuaaaaacaacacauuagcuuauaguccuggggaucagaauuccaaaauggauguc

SEQ ID NO: 226444 - RNA, 59 nt, Human
ucccaccgcaggauuugggcucuuggaauccuggggaacauagaacucaugacggaaga

SEQ ID NO: 226445 - RNA, 59 nt, Human
ucagcacugugcuacugaugauacaucacccuggggaauucaacccugcagaugucaac

SEQ ID NO: 226446 - RNA, 59 nt, Human
cagagaguggcuggaagagacuccaggccccuggggagacuguacuguuccugaacacu

SEQ ID NO: 226447 - RNA, 59 nt, Human
guugcuggcugacucuuuuuugucuggggccuggggaaagggcuuggacugugaaaaga

SEQ ID NO: 226448 - RNA, 59 nt, Human
cuuacucaacuagaaagcuugaaaacaucccuggggauucugaaggcuuaauuuugcaa

SEQ ID NO: 226449 - RNA, 59 nt, Human
cagauggacgagggcucuccaagggaaugccuggggauucacccagugguccccagagg

SEQ ID NO: 226450 - RNA, 59 nt, Human
ggugcuuccccaacagcugauaccgccguccuggggacuugggcuucuugccuucauaa

SEQ ID NO: 226451 - RNA, 59 nt, Human
uucugggccacagcucagcccagaggguuccuggggaugggaggccucucucuccccac

SEQ ID NO: 226452 - RNA, 59 nt, Human
cacaccuucccugagacucaugacaugagccuggggagaccucauuugguuuccguuca

SEQ ID NO: 226453 - RNA, 59 nt, Human
uacccuagcagguuggguauucagaggugccuggggagcuuguuaaaaguguagauucc

SEQ ID NO: 226454 - RNA, 59 nt, Human
ccuggagaccacacugcacacagugacuuccuggggaugucauagccaaagccaggccu

SEQ ID NO: 226455 - RNA, 59 nt, Human
ggccugagagaagcagggacaggagggagccuggggauugugguuugggaaggcagaca

SEQ ID NO: 226456 - RNA, 59 nt, Human
agauagauccaacuggccauggcaaaagcccuggggauuuccgauucauaccccugggc

SEQ ID NO: 226457 - RNA, 59 nt, Human
gcgaggaggcgugugcugcagcuacgggcccuggggagaguuucgugaaggcuggcacg

SEQ ID NO: 226458 - RNA, 59 nt, Human
ucucagcgggggguggggugacaucguucccuggggacauugggaaggugggcaggggc

SEQ ID NO: 226459 - RNA, 59 nt, Human
gaagaggguguggcccaacccucacuucaccuggggaggggcuucuuccggacaguaga

SEQ ID NO: 226460 - RNA, 59 nt, Human
cccacguggcgguccgcuggcaggcugguccuggggagcauucugcggacccggucacg

SEQ ID NO: 226461 - RNA, 59 nt, Human
agggccucgugcaguguguucagauugccccuggggaucuucugugucuucagcgccca

SEQ ID NO: 226462 - RNA, 59 nt, Human
cugggcuuggccaggggcccgaauuuccgccuggggaguguuggauccacaucccggug

SEQ ID NO: 226463 - RNA, 59 nt, Human
gcggggagcacguggaaaguuggcugcugccuggggaagcuucuccuccccaaggcggc

SEQ ID NO: 226464 - RNA, 59 nt, Human
uaaccuaugauaacauaauaauguggacgccuggggaaacccuccucauguuugucauc

SEQ ID NO: 226465 - RNA, 59 nt, Human
uaaacacuacacauuugaaacaagcuaacccuggggagucuauggucucuucacucagg

SEQ ID NO: 226466 - RNA, 59 nt, Human
uguacuuugcuuuuccagagcccuuuuuaccuggggauuucagugugcuuaaguaaaau

SEQ ID NO: 226467 - RNA, 59 nt, Human
uuccucccucaguggaggagaucccugugccuggggaagcagucccggcccccaccccu

SEQ ID NO: 226468 - RNA, 59 nt, Human
ccucuccgcccacgcggcugcugcuucucccuggggaggaccccugcccucggccauug

SEQ ID NO: 226469 - RNA, 59 nt, Human
caagagcugcacucuugugccacagcugcccuggggaaaccggggaaccccaacuggga

SEQ ID NO: 226470 - RNA, 59 nt, Human
ccaggccugcccagcagccucugcucccuccuggggacccacagcagacgucugcaagc

SEQ ID NO: 226471 - RNA, 59 nt, Human
cagcgugcccgcugcccaucgacgucuguccuggggacguggaggguggcagcgucccc

SEQ ID NO: 226472 - RNA, 59 nt, Human
auggccccauccucaaagaaguagcaguaccuggggagcugacacuucuguaaaacuag

SEQ ID NO: 226473 - RNA, 59 nt, Human
accagcagaguagccgccgcugcugugagccuggggacgacauggcaggcugguccccc

SEQ ID NO: 226474 - RNA, 59 nt, Human
ggauauuuuuaaaaacuccuuuugguuuaccuggggauccaauugauguauauguuuau

SEQ ID NO: 226475 - RNA, 59 nt, Human
gccacaaaugacucuggacacagacagauccuggggaguuacuuacauguucaucugcu

SEQ ID NO: 226476 - RNA, 59 nt, Human
ggaaccauuuucaccuauuaccaguguucccuggggacuccucuuaauguuuccaaaug

SEQ ID NO: 226477 - RNA, 59 nt, Human
cugccuagcagucucccagcucccaacagccuggggaagcucugcacagagugaccuga

SEQ ID NO: 226478 - RNA, 59 nt, Human
cauuuugcuaccaagccucuucccaacgcccuggggaccagucuucuguuuuguuuuuc

SEQ ID NO: 226479 - RNA, 59 nt, Human
gccccaugcccagccugugcgccgggggaccuggggacucgggugcugggaguguggcu

SEQ ID NO: 226480 - RNA, 59 nt, Human
ggcuacagaggcucuugaggcuccgaggcccuggggaucaaaggucaaugaguuaggug

SEQ ID NO: 226481 - RNA, 59 nt, Human
agcagagguccauuccguucccagcugcuccuggggaggccgcuuccugguaggaggga

SEQ ID NO: 226482 - RNA, 59 nt, Human
gcugcaugccugaaggcugggccuucgacccuggggaugggccacagggcaccaaacac

SEQ ID NO: 226483 - RNA, 59 nt, Human
ucccaaaacauggguguguuucaaaauuaccuggggauguuguuccaaauccagacaac

SEQ ID NO: 226484 - RNA, 59 nt, Human
uuuagggcccccgugcgcagcuuucuuucccuggggaggaaaacaucgugggggggagg

SEQ ID NO: 226485 - RNA, 59 nt, Human
gggaggaaggucuggcauugggaugccgcccuggggacauacgaaccgccuccuuccac

SEQ ID NO: 226486 - RNA, 59 nt, Human
aucuuccccauuguccacucaagucguggccuggggaacacagacggagcuguccccag

SEQ ID NO: 226487 - RNA, 59 nt, Human
agcaacuacuuuggaccaaaagcccauggccuggggagcugggcagguagagcccaagc

SEQ ID NO: 226488 - RNA, 59 nt, Human
gguagagcuggguaauaaaugucuauucuccuggggaggagggauucuaaacuuuccuu

SEQ ID NO: 226489 - RNA, 59 nt, Human
cacuccauuuggcaagcucugagggggagccuggggacggguuuggguccccaggagga

SEQ ID NO: 226490 - RNA, 59 nt, Human
guggcuccuuuaggaugucaccucaccggccuggggaaggcggggggugcccaagccca

SEQ ID NO: 226491 - RNA, 59 nt, Human
agucuaccugcggaugagccugcggcaguccuggggaaacuuuuccagagccuguuagc

SEQ ID NO: 226492 - RNA, 59 nt, Human
cuggggagaagccggcgcuccugcucccuccuggggaggcugacggguguggccacccg

SEQ ID NO: 226493 - RNA, 59 nt, Human
cccaggcggcccgcccuugccugucugcaccuggggagaagccggcgcuccugcucccu

SEQ ID NO: 226494 - RNA, 59 nt, Human
cagguaaucccucuccuuccgcuggguccccuggggaggugugaacucaagggccuagc

SEQ ID NO: 226495 - RNA, 59 nt, Human
auuuauauguggaacuucucaaggagccuccuggggacuggaaaguaagucaucagcca

SEQ ID NO: 226496 - RNA, 59 nt, Human
gcaaacuauacacggucguccaucaaaauccuggggaagagaauaacucauuuaauauu

SEQ ID NO: 226497 - RNA, 59 nt, Human
ccaaagaacuacccccuuuucagcugagcccuggggacuguuccaaagccagugaaaug

SEQ ID NO: 226498 - RNA, 59 nt, Human
auuucugugccaagcugcacaccgagugaccuggggacaucauggaaccaagggauccu

SEQ ID NO: 226499 - RNA, 59 nt, Human
caagcguaucugcucuaaaaugacuuguuccuggggaaugccuucaaccaaaacacagc

SEQ ID NO: 226500 - RNA, 59 nt, Human
gaaaccuuauacccagaggaaaauacacaccuggggaguacauuugacaaauuucccuu

SEQ ID NO: 226501 - RNA, 59 nt, Human
ggaaguccauuugcaagcugagcgccaggccuggggaggaagaggcuugggcugcagau

SEQ ID NO: 226502 - RNA, 59 nt, Human
gauuuccuccccucagucaacccccauaaccuggggauugggcaguguggaagaacgug

SEQ ID NO: 226503 - RNA, 59 nt, Human
gcugcaguguauggagccucuugccuuccccuggggaggcaccccuguaccccagcuuc

SEQ ID NO: 226504 - RNA, 51 nt, Human
acaacaccguguucagcuaacccuggggacaaagcagcgucuggcucgagu

SEQ ID NO: 226505 - RNA, 59 nt, Human
cuauguaacucaucuuuuaguuuacacuuccuggggaaauugucuuugguguuuagagg

SEQ ID NO: 226506 - RNA, 59 nt, Human
uccuccuugucuuggcagccuacuagggaccuggggaagcaaaaacgaaagcugggcaa

SEQ ID NO: 226507 - RNA, 59 nt, Human
aggccagcccuggacauuguccaggaaggccuggggaggaggagugaagucugugcaua

SEQ ID NO: 226508 - RNA, 59 nt, Human
ucacucaguaacguuguuuaauucucugcccuggggaaggaggauggauugagagaaug

SEQ ID NO: 226509 - RNA, 59 nt, Human
gcucccaggaccugccucuucccaggcuuccuggggaagaguuguacgcccaggcaaca

SEQ ID NO: 226510 - RNA, 59 nt, Human
accauuccucuguccucuucucuggccugccuggggagcccgugaaggccgcacgggug

SEQ ID NO: 226511 - RNA, 59 nt, Human
uacacauggaagaggaccaggacauaccaccuggggaugggcugacucagggucccgag

SEQ ID NO: 226512 - RNA, 59 nt, Human
caccauaguaugguuuuucauuuguaucuccuggggagcuuuuaaagaguacuggugaa

SEQ ID NO: 226513 - RNA, 50 nt, Human
uaaaccggcuaaauuauugaccuggggaacuagccacacaggaggccggg

SEQ ID NO: 226514 - RNA, 59 nt, Human
gagcacuaagaugcuuagugcucagacaaccuggggaugccuguccccuaccugcuccu

SEQ ID NO: 226515 - RNA, 59 nt, Human
ccaacucugccacucaucugccaacuuugccuggggagggcuaggcuugggaugagcug

SEQ ID NO: 226516 - RNA, 59 nt, Human
cgucccccucccugcccaaacuccccuucccuggggagcccucaggcuccccagaacug

SEQ ID NO: 226517 - RNA, 59 nt, Human
cccucaggcuccccagaacuggcugggccccuggggacagagccaccccaugagcucgg

SEQ ID NO: 226518 - RNA, 59 nt, Human
cggcgugugcugggcccggaucuccaggcccuggggagggagccucuggacggacagug

SEQ ID NO: 226519 - RNA, 59 nt, Human
cuauacaguaguuuugugauuagaauucaccuggggacacacacucacacgcacaguca

SEQ ID NO: 226520 - RNA, 59 nt, Human
cuccuggcaaucugucagaacggugucauccuggggaagagaaggagcuugggugcauu

SEQ ID NO: 226521 - RNA, 59 nt, Human
uucuuaacucuggcuguguguuagucuucccuggggagccuuuauaagacacugauacu

SEQ ID NO: 226522 - RNA, 59 nt, Human
aacaucucauuggaccucagaaaacccacccuggggagaagccccagcaagugugaaaa

SEQ ID NO: 226523 - RNA, 59 nt, Human
gacaucaggugcugcacucacuucugcccccuggggaguuggggaaaggaacgaacccu

SEQ ID NO: 226524 - RNA, 59 nt, Human
aucccugggguguguguguagauuucccaccuggggacucugcugucccugggcuugca

SEQ ID NO: 226525 - RNA, 59 nt, Human
ucauuuuggguuuucucuucuccugcuuuccuggggagagauuaagcgcucauuaagca

SEQ ID NO: 226526 - RNA, 59 nt, Human
ucuacugaccuggagugacuggaauagcaccuggggauaaaugugacaacugugcauug

SEQ ID NO: 226527 - RNA, 59 nt, Human
cagcccaguguucuccuugggggcaggaaccuggggaggggcccagagcaaagggcauc

SEQ ID NO: 226528 - RNA, 59 nt, Human
cuuucguuuguuuaccagcaagcaacuucccuggggaagccaaacacauauucauaaaa

SEQ ID NO: 226529 - RNA, 59 nt, Human
ccucuaaaagccauucacuccagauuuuaccuggggaauauucuacauacugcuuacuu

SEQ ID NO: 226530 - RNA, 59 nt, Human
ggcggcugugguggcugcuccugugcuccccuggggagguccccaccccuccccuccag

SEQ ID NO: 226531 - RNA, 59 nt, Human
gcaggugcuggcguaggcggcccagcccuccuggggagacgugacucugguggacgcag

SEQ ID NO: 226532 - RNA, 59 nt, Human
ccacagccucguugggaggacaggguggcccuggggacaagagggaggagcccaggggc

SEQ ID NO: 226533 - RNA, 59 nt, Human
ucucuuucuguuuccuggccucagagcuuccuggggaccaagauuuaccaauucaccca

SEQ ID NO: 226534 - RNA, 59 nt, Human
ugcuaccucucccuuucccacuugaggacccuggggagagaugggggcggggaaaaugg

SEQ ID NO: 226535 - RNA, 59 nt, Human
gucacaccuggcaagcuggaagaaaguucccuggggaugggagagcgggugggugcugc

SEQ ID NO: 226536 - RNA, 59 nt, Human
uucagcugcagagcgggggaggucugcacccuggggaaccacacccaaggcugcuuucc

SEQ ID NO: 226537 - RNA, 51 nt, Human
gccaagugauggaacccugacccuggggaaagacgccuucaucugggacaa

SEQ ID NO: 226538 - RNA, 53 nt, Human
ugcgagaccaccccuauuagggcccuggggaagaaacaagagccauuaaaauc

SEQ ID NO: 226539 - RNA, 59 nt, Human
ucuucccagucuucccagccagcccgggcccuggggagcccugggcacagcagcggccg

SEQ ID NO: 226540 - RNA, 59 nt, Human
aaggaacagggguccuguagaacagggguccuggggaagguguccagggcaggguccug

SEQ ID NO: 226541 - RNA, 59 nt, Human
gggacccggacagccaggugacuaccaguccuggggacacacucaccauaaacacaucc

SEQ ID NO: 226542 - RNA, 59 nt, Human
ggugauggagccccggggggacagucgugccuggggaggagcaggguacagcccauucc

SEQ ID NO: 226543 - RNA, 59 nt, Human
uuuccuucuucugaccaacccaggugugaccuggggaugcagagcuuucuguuuugggu

SEQ ID NO: 226544 - RNA, 59 nt, Human
gggcacugagccucucaggagcaugcaccccuggggagcacagggaggcagaggcuugg

SEQ ID NO: 226545 - RNA, 59 nt, Human
uggugaagccccucuaaagagaucucgacccuggggagcagaauucuugucaucuauga

SEQ ID NO: 226546 - RNA, 59 nt, Human
agggcucccgcuggacaggcacguacugcccuggggaguaaaugcggagaguucacgaa

SEQ ID NO: 226547 - RNA, 59 nt, Human
guuggugaagaacacacaucgauucugcaccuggggacccagagcgagauggguuuguu

SEQ ID NO: 226548 - RNA, 59 nt, Human
uaacucggugggcccagguucugcucuucccuggggacccuaaccucgccuccagcuga

SEQ ID NO: 226549 - RNA, 59 nt, Human
cccccaaauaagggcgcccagggaucuugccuggggaaaguggggugcagaaggcauga

SEQ ID NO: 226550 - RNA, 59 nt, Human
cccuuuccccuccuccccccucagcugggccuggggaggagucgaagggggcugcagag

SEQ ID NO: 226551 - RNA, 53 nt, Human
acauugauaacaacuucugaggcccuggggauccucacauccccgucccccag

SEQ ID NO: 226552 - RNA, 59 nt, Human
uugacauuuugcuuuuugugcacugugauccuggggaaggguagucuuuugucuucagc

SEQ ID NO: 226553 - RNA, 59 nt, Human
aggaacugggaagcuuagucuaauuagugccuggggaugaccuaugcaaucacaccgcu

SEQ ID NO: 226554 - RNA, 59 nt, Human
accccaccuccuuugagguccaagaugcuccuggggaguugaccgacauuugggaagau

SEQ ID NO: 226555 - RNA, 59 nt, Human
guuugccauguaccuggaugcgacgggccccuggggacaggcccuugccccauccaucc

SEQ ID NO: 226556 - RNA, 59 nt, Human
gggugugacauacaagugacugaacacuuccuggggagcuacaggggcacuuaacccac

SEQ ID NO: 226557 - RNA, 59 nt, Human
uuuuuucuguuccccuccgcuuucugaagccuggggagaaaucagugacagagguguuu

SEQ ID NO: 226558 - RNA, 59 nt, Human
gcaaacuuaagaguaguuuauuuauauacccuggggacagaaagucagguugaaacagg

SEQ ID NO: 226559 - RNA, 59 nt, Human
uaggauugaaguggcuggaaagagugaugccuggggaaggagauggaguuaugagggua

SEQ ID NO: 226560 - RNA, 59 nt, Human
ugauccugcaaguucaagggcucuuucucccuggggaugugcuuuguggcuucucuuua

SEQ ID NO: 226561 - RNA, 59 nt, Human
cgcagggccgugcgcacuguguuccgugcccuggggacccccggaaaagcagcccaguc

SEQ ID NO: 226562 - RNA, 59 nt, Human
gcccaggcccuggcagagaaacagggaggccuggggagagcuacccgccagcuugggcu

SEQ ID NO: 226563 - RNA, 59 nt, Human
cgcagcaccaugucccugccccccgggcuccuggggaacagcuggggcgaaggagcacc

SEQ ID NO: 226564 - RNA, 59 nt, Human
ggaagcugcuccaauggaugggggagaagccuggggaggagggggaggaagacaagaag

SEQ ID NO: 226565 - RNA, 55 nt, Human
acaucagcgugggccgcuagggacuccuggggagcuggggggcgagggagagaug

SEQ ID NO: 226566 - RNA, 59 nt, Human
ggcaucaaaucuaccuccaaaagacccauccuggggagcccucuggccccucguugccu

SEQ ID NO: 226567 - RNA, 59 nt, Human
ugggacauggaaaagaaggcagccuaggcccuggggagcccaguccacugagcaagcaa

SEQ ID NO: 226568 - RNA, 59 nt, Human
gcugcuggccuccugcccagguggaggguccuggggacggcagaggauaaagcccccuc

SEQ ID NO: 226569 - RNA, 59 nt, Human
aguccuccccaaagaguugcgcaucagcaccuggggaucuggacccugcgggugaaggg

SEQ ID NO: 226570 - RNA, 59 nt, Human
uagguggaccucugaaaaccaaaccaguaccuggggagguuagauguguguuucaggcu

SEQ ID NO: 226571 - RNA, 59 nt, Human
ugacucauguuucccuguuucaaagggauccuggggaaggaggggaacaugcuugcagu

SEQ ID NO: 226572 - RNA, 59 nt, Human
uguuggguccucugcuuccugugcuguccccuggggaaggucccgaggaugcugucagg

SEQ ID NO: 226573 - RNA, 59 nt, Human
ccaggaaaccaggccaucugggcaggaggccuggggaugaggguggggggggaccccca

SEQ ID NO: 226574 - RNA, 59 nt, Human
uguauucucugcaugcauguauguaggugccuggggaguguguguggguccuuggcucu

SEQ ID NO: 226575 - RNA, 59 nt, Human
acccaugugucugucacaccaugaauguaccuggggaaaucaacugaccucccugaaca

SEQ ID NO: 226576 - RNA, 59 nt, Human
gcagucauuccacauggccuguuggaaggccuggggagggaacuuuggguuugggacag

SEQ ID NO: 226577 - RNA, 59 nt, Human
auguuuaauuacauaugguaacccuaaggccuggggagaaaagcuuuuaaaucuugccu

SEQ ID NO: 226578 - RNA, 59 nt, Human
ccacuuucagguuuaguuuaccuggcuuaccuggggaaguugacaacuuguugguaguu

SEQ ID NO: 226579 - RNA, 59 nt, Human
ucagcuggccucacugacaccccggccucccuggggacauuguucauaaccaugacuaa

SEQ ID NO: 226580 - RNA, 59 nt, Human
gugaccuugguccaggaguucuauuuguuccuggggagggagguuuuuuuguuuguuuu

SEQ ID NO: 226581 - RNA, 59 nt, Human
aagacacagacugacagauggggugaaggccuggggaccucagagaacucugccuugcc

SEQ ID NO: 226582 - RNA, 59 nt, Human
uuuaggccagcuuacccccaaaccuggcuccuggggacggaugaggaaggagcucuuug

SEQ ID NO: 226583 - RNA, 59 nt, Human
gcagggcccccacuucccaguggcugcuuccuggggacccagggcaccccggcaccuuc

SEQ ID NO: 226584 - RNA, 59 nt, Human
aucauguaaccgcagauaggaagggcucgccuggggaaacucugguuuccgaugggaca

SEQ ID NO: 226585 - RNA, 59 nt, Human
cccuggggcggggggcgugccugucacugccuggggaggcauuugccucuguaccaucg

SEQ ID NO: 226586 - RNA, 59 nt, Human
cgagucaagcauugugaauuauuaccuaaccuggggaaccgaggaccagaaggaaggac

SEQ ID NO: 226587 - RNA, 59 nt, Human
gccaggcagggggucuggcagcacggcguccuggggagcaggacacauggucaucccca

SEQ ID NO: 226588 - RNA, 59 nt, Human; identical to SEQ ID NO: 226522

SEQ ID NO: 226589 - RNA, 59 nt, Human
ugagcugagauugcaccacugcacuccagccuggggacagagcaagacucuugucucaa

SEQ ID NO: 226590 - RNA, 59 nt, Human
agaaacacaacucuacuaguacaggcuagccuggggaguuugauaaacugagugauugg

SEQ ID NO: 226591 - RNA, 59 nt, Human
uguuuauuauuuauuucccuccccaugccccuggggaccccaaggccccagcuucccuc

SEQ ID NO: 226592 - RNA, 59 nt, Human
cuccacacugcccaucucugaugucuggcccuggggaauggcaccaguuccagccuggg

SEQ ID NO: 226593 - RNA, 59 nt, Human
acaggccaccccgagguccucagugguugccuggggagccggacggggcuccugagggg

SEQ ID NO: 226594 - RNA, 59 nt, Human
ccggaugacuuggggacaccccagaauccccuggggagaacccuuccugcgcgcuuuca

SEQ ID NO: 226595 - RNA, 59 nt, Human
aggaggauguauccuccagccaaucagggccuggggaaucuguuggcgaaucagggauu

SEQ ID NO: 226596 - RNA, 59 nt, Human
accccacaaagccuucuggaccuggaaagccuggggaaggacugacagaccccaggacc

SEQ ID NO: 226597 - RNA, 59 nt, Human
uucacaccucauugcuuuacccccuggggccuggggaaaugucuguacuuugggaaguc

SEQ ID NO: 226598 - RNA, 59 nt, Human
ucucaucggacacuuguggagcgcaggggccuggggagcagcgcuaacccuggaggcag

SEQ ID NO: 226599 - RNA, 59 nt, Human
gcggcaaggcacacagggcucuggcagccccuggggacugggcgcugccccugggaggg

SEQ ID NO: 226600 - RNA, 59 nt, Human
acucggccaggugcugaucggugagguggccuggggagggcagaggcaagguuaccagg

SEQ ID NO: 226601 - RNA, 59 nt, Human
accaugggccaagagccgccguggcuauaccuggggacuugauguuccuuccagauugu

SEQ ID NO: 226602 - RNA, 59 nt, Human
gugggccguguggcacacaccguggccuaccuggggaagcugcgggcacccauccgcuc

SEQ ID NO: 226603 - RNA, 59 nt, Human
gcauggcauuuguuccacaggagggcaucccuggggauguggcuggagcaugagccagc

SEQ ID NO: 226604 - RNA, 59 nt, Human
agcuccugugaccgagagcgccacggaagccuggggaugacgucgggcagcuuuauucu

SEQ ID NO: 226605 - RNA, 59 nt, Human
auuuugguuugacgcccuguuuucaguggccuggggagguccacacuggaagucgaauu

SEQ ID NO: 226606 - RNA, 59 nt, Human
ccgcccggcauguguguucagggacugagccuggggacgcccacccacacccacugcuu

SEQ ID NO: 226607 - RNA, 59 nt, Human
ccccaggccacugggccccucccacaccaccuggggagcugagaagaggaggcuggagu

SEQ ID NO: 226608 - RNA, 59 nt, Human
ccaguagcccagaccacggcagggcaugaccuggggagggcagguggaagccgauggcu

SEQ ID NO: 226609 - RNA, 59 nt, Human
cagccacuuuuuauauucauguacauucaccuggggaaaaaaacggagggacuuugcua

SEQ ID NO: 226610 - RNA, 59 nt, Human
gcagcucuggaaucugugcccaccuggggccuggggaacaaggcccuccuuucuccagg

SEQ ID NO: 226611 - RNA, 59 nt, Human
cacaguggcucccaccuuuaaucccagcaccuggggaggcugaggugaguggaucacua

SEQ ID NO: 226612 - RNA, 59 nt, Human
uccaucuggcuuaccacucuccagggccuccuggggagccuguccuguguucacuuugu

SEQ ID NO: 226613 - RNA, 59 nt, Human
aaaugaagucuuaaguacugaauaacuccccuggggauagcuggggcauuugucuagcu

SEQ ID NO: 226614 - RNA, 59 nt, Human
aaauauugucagagacuggugggaggaagccuggggaguggggugcaggaaaagccaga

SEQ ID NO: 226615 - RNA, 59 nt, Human
cuuacccaggccaguggaggugccacagcccuggggagccagacaggcuuugguaucgu

SEQ ID NO: 226616 - RNA, 59 nt, Human
cagggcuucggaucgcagcucacucgaggccuggggaaggggacucaggggcgaggagg

SEQ ID NO: 226617 - RNA, 59 nt, Human
ucuuugucaagagcuugggaacgggccagccuggggagguaagacugcaucacuccccu

SEQ ID NO: 226618 - RNA, 59 nt, Human
ggucaccccacugaggaugcugcuggcagccuggggaaggagccaguuuuuuuugguuu

SEQ ID NO: 226619 - RNA, 59 nt, Human
caggaggugaaagcagccauccggaaggcccuggggacccuugugccuguugcucgccu

SEQ ID NO: 226620 - RNA, 59 nt, Human
gccaagagccccucaagagaagggcugaaccuggggagaugucacugccagggugaggu

SEQ ID NO: 226621 - RNA, 59 nt, Human
ccaggcaccccagugcccgcugggcccagccuggggacagggaaccugccgggcucaca

SEQ ID NO: 226622 - RNA, 59 nt, Human
ccguuaucaaggccccuccgcccccgaacccuggggagcuggaccaggagguggaggcu

SEQ ID NO: 226623 - RNA, 59 nt, Human
gggagagaugguguuuuuccucuccaccaccuggggauacgaugagaagauggccaccu

SEQ ID NO: 226624 - RNA, 59 nt, Human
uaagaaaauucuuuaucauguuugccuucccuggggaaacauucaggcaguaaaaugac

SEQ ID NO: 226625 - RNA, 59 nt, Human
auagcaggugcgucuucuaguuuauuccuccuggggacauuuccucaaagcaguuuugc

SEQ ID NO: 226626 - RNA, 59 nt, Human
gacguagcuuccuccgaguggaacugcagccuggggacuugauuaggugcuaugcauca

SEQ ID NO: 226627 - RNA, 59 nt, Human
agagccugaagacauugggaaaggcugggccuggggaggaggcagcccugggcccgcug

SEQ ID NO: 226628 - RNA, 59 nt, Human
ugagcuguguucgagccacuacacuccagccuggggacggagcaaaacuuugccucaaa

SEQ ID NO: 226629 - RNA, 59 nt, Human
cugcuucaccaaagcccgagcccucagccccuggggagaacaaauggcugagcuuugau

SEQ ID NO: 226630 - RNA, 59 nt, Human
ggguggggguuguuaaggaugcuggggggccuggggaaggaaggaguucagaggaaggg

SEQ ID NO: 226631 - RNA, 59 nt, Human
guguuuuuaaguugguuuuacaauucuuuccuggggaaauuauuucuggaggggaaaaa

SEQ ID NO: 226632 - RNA, 59 nt, Human
uucucaaucuuuaauguguauccaaaucaccuggggaauagaugccgauucugaaacag

SEQ ID NO: 226633 - RNA, 59 nt, Human
auggcagugucuucccucuugccaaaaggccuggggaggugaaggaagagagacuuuag

SEQ ID NO: 226634 - RNA, 59 nt, Human
aacacacaggaauggaauggacaggcucaccuggggauuugggggugggguggucagcu

SEQ ID NO: 226635 - RNA, 59 nt, Human
cugcaggaucuucuucccucccaggucucccuggggagguagaggcacgggauaagggg

SEQ ID NO: 226636 - RNA, 59 nt, Human
gguacccucuaugccaauagcugggccugccuggggaaagguggaaggagaaacagcug

SEQ ID NO: 226637 - RNA, 59 nt, Human
ggccugauacaagcaaguuuguuuacaucccuggggaaucuuuuacaucaaacuuuugg

SEQ ID NO: 226638 - RNA, 59 nt, Human
guggccuugggaucucacccucuccauguccuggggacagccucgcccucagccggacu

SEQ ID NO: 226639 - RNA, 59 nt, Human
ugcuuccagagacuuccuugggguugcaaccuggggaagccacaucccacuggauccac

SEQ ID NO: 226640 - RNA, 59 nt, Human
cacacaagcucgguggugacucuucggccccuggggaaaaacaaaaagauauugcugag

SEQ ID NO: 226641 - RNA, 59 nt, Human
ggccagugagggacggcguggcugugcuuccuggggaaaugaacccccuccccacagac

SEQ ID NO: 226642 - RNA, 59 nt, Human
uuuucaagucuccucagucaucaauaguuccuggggaaaaacagagcugguagacuuga

SEQ ID NO: 226643 - RNA, 59 nt, Human
ugcaguugcuauuuaggaugaguuaagugccuggggagucccucaaaagguuaaaggga

SEQ ID NO: 226644 - RNA, 59 nt, Human
gauucaucuauggagggcagagugggcugccuggggauugggagggacagggcuugggg

SEQ ID NO: 226645 - RNA, 59 nt, Human
ugcuggugcuaagugugauuaggaagaagccuggggagaggugagucuggaauuuuggu

SEQ ID NO: 226646 - RNA, 59 nt, Human
cgguggggcgaagcucugagucauucagcccuggggacaccccuaggcaacgauuccga

SEQ ID NO: 226647 - RNA, 53 nt, Human
uaaaauccacacaguuuuagccuccuggggaaccugcgaugggacggucagag

SEQ ID NO: 226648 - RNA, 59 nt, Human
ccauaugugucauguagaagaugccuagcccuggggaccuugugaaauacgcaggaacc

SEQ ID NO: 226649 - RNA, 59 nt, Human
cccugccccuuggccgcagaggccucagcccuggggagggagggggcacuggugccccc

SEQ ID NO: 226650 - RNA, 59 nt, Human
agaagugucucuguugggggacagaggaaccuggggaguccaucgcauguccuacaauc

SEQ ID NO: 226651 - RNA, 59 nt, Human
cagccaguggcagaacugggucucucagcccuggggaucagaaaggugggcuugcugga

SEQ ID NO: 226652 - RNA, 59 nt, Human
cgccaaaacccacaucccagccucuggauccuggggaagguuccagucccuggagaaua

SEQ ID NO: 226653 - RNA, 59 nt, Human
cucagcuggagagacucgggaugggguaaccuggggaccagucuagccccugcacccuc

SEQ ID NO: 226654 - RNA, 59 nt, Human
ugacaugaggaaaagaaaccuauuccugcccuggggaccacccugggacucuaaccaag

SEQ ID NO: 226655 - RNA, 59 nt, Human
cugguacccaugauaacaauugagcugaaccuggggaccccugguuggggaacagguga

SEQ ID NO: 226656 - RNA, 59 nt, Human
gagcugcuuccuguuuucuucugauugcuccuggggaaaacacgccuuguccugaagaa

SEQ ID NO: 226657 - RNA, 59 nt, Human
uucauuuguaggaaacugggaaauaaaaaccuggggaacuuuagguuauuuauacaaag

SEQ ID NO: 226658 - RNA, 59 nt, Human
ugggagccgcuuccuuccugcccugcccaccuggggaucccccaaagucagacacagag

SEQ ID NO: 226659 - RNA, 59 nt, Human
gguuuucugucuaggucaccacucccaauccuggggauuggagaggccuggggcugugg

SEQ ID NO: 226660 - RNA, 59 nt, Human
ugcuggugggaggacagugccaaccuccuccuggggaucccauguuggagacucuaagg

SEQ ID NO: 226661 - RNA, 59 nt, Human
gaguguggauuauauuacaugauaaccuaccuggggaacaguccagaaagcuauagaac

SEQ ID NO: 226662 - RNA, 59 nt, Human
ggccucaccauggauggucuuccuaguugccuggggaaacccuggaaugggcaucagga

SEQ ID NO: 226663 - RNA, 59 nt, Human
uucacaaucucagccagccugcggugugaccuggggagaaaguugagugucaggggaca

SEQ ID NO: 226664 - RNA, 59 nt, Human
acuaguucacuggaucccuccucuaggggccuggggacuuucacugaugcucuuccuga

SEQ ID NO: 226665 - RNA, 59 nt, Human
uguuccaaucuucugccucccagucacucccuggggacuaugggaucacugucccccca

SEQ ID NO: 226666 - RNA, 59 nt, Human
ccgucacacacuguccucagcccacugcaccuggggaagccccucgugcagccccuccu

SEQ ID NO: 226667 - RNA, 59 nt, Human
agcagccuucuccccaaccaggauguuggccuggggaggccacagcagggcugagggaa

SEQ ID NO: 226668 - RNA, 59 nt, Human
gcuuucauuugccagggacugcguuaggcccuggggaaacaucagugaauaaaacacgg

SEQ ID NO: 226669 - RNA, 59 nt, Human
cagaguccagugccuugcagagccugaagccuggggagaaggcccagccugggacccuc

SEQ ID NO: 226670 - RNA, 59 nt, Human
gugugacuuuccuuugcaaauggauuucuccuggggaauuuucuuggcuguucuggaaa

SEQ ID NO: 226671 - RNA, 59 nt, Human
uccaagaucaauucccucucucagcacagccuggggagggggucauuguucuccucguc

SEQ ID NO: 226672 - RNA, 59 nt, Human
ugcacacaccggaaguggcgagcccaagcccuggggacagguguagggagaaaagcagc

SEQ ID NO: 226673 - RNA, 59 nt, Human
ucccacugucucguagaauuacacuccuuccuggggaucccucuuccugcagccuuguc

SEQ ID NO: 226674 - RNA, 59 nt, Human
ucugcagugccucagugaccaggcuggcuccuggggauggccagguauguaccacccga

SEQ ID NO: 226675 - RNA, 59 nt, Human
gaaucccccuagggcucaggcacugagggccuggggacaguggagcauaugggugggag

SEQ ID NO: 226676 - RNA, 59 nt, Human
gccagcccccaccuuccaggcgccuucgcccuggggauccaaccaacuuguaucgagug

SEQ ID NO: 226677 - RNA, 59 nt, Human
ggagggugccacccucucccugccaggggccuggggacccucucccuggcugccucagg

SEQ ID NO: 226678 - RNA, 59 nt, Human
ucagaaguaauccugagaaauguuucaggccuggggagggaggggagcccccgacgccu

SEQ ID NO: 226679 - RNA, 59 nt, Human
cccccauuauacaggugacaaaacugaguccuggggaaagugacugguccgugguagag

SEQ ID NO: 226680 - RNA, 59 nt, Human
gaaaguggacacuggcuccgcccuggccaccuggggacuggcacuguggugcacagugg

SEQ ID NO: 226681 - RNA, 59 nt, Human
guggaccuguuagaggaguggaggggcugccuggggaaugggacagagggauucucuuu

SEQ ID NO: 226682 - RNA, 59 nt, Human
gggcagcucagugcucugcagagaggggcccuggggagaagcaggaugggauugauggg

SEQ ID NO: 226683 - RNA, 59 nt, Human
aacugguucaguggcuggaguauuaggggccuggggauuggagaacggagaagaaguug

SEQ ID NO: 226684 - RNA, 59 nt, Human
gagggcugggacgguggaagaccaagacaccuggggauugcgucuggggccuccagaac

SEQ ID NO: 226685 - RNA, 59 nt, Human
aaggcccccuccacgcaaacacccucccuccuggggaccucuggagccucagccagaag

SEQ ID NO: 226686 - RNA, 59 nt, Human
gauuccaggcccagggcuucuacucugccccuggggaauguguccccugcauaucuucu

SEQ ID NO: 226687 - RNA, 59 nt, Human
gcccgaauaaaccccugauguuagagaggccuggggagagcagccgauggggcucagac

SEQ ID NO: 226688 - RNA, 59 nt, Human
aaaccugccaugcucugggacgugugggcccuggggagaggagagaaagggcucccacc

SEQ ID NO: 226689 - RNA, 59 nt, Human
cuuucuacugugagucccuaucccaagauccuggggaaaggagagaccauggugugaau

SEQ ID NO: 226690 - RNA, 59 nt, Human
ugaaggccuucuucccugggcaccugguaccuggggaccuacaagguggugagggaagg

SEQ ID NO: 226691 - RNA, 59 nt, Human
agucgaauugaaaggacugucguuuccucccuggggauguggggucccagcugccugcc

SEQ ID NO: 226692 - RNA, 59 nt, Human
gugcacaggcuagccuggagcucaccaggccuggggagcugggacggggccccgcugcc

SEQ ID NO: 226693 - RNA, 59 nt, Human
ggaaaggggacuugugguaguggaccauaccuggggaccaaaagagacccacuguaauu

SEQ ID NO: 226694 - RNA, 59 nt, Human
uuuccuccuuauccuuauuaagucaucugccuggggaaggaguuccacuguuucuuucc

SEQ ID NO: 226695 - RNA, 59 nt, Human
gaggggauucucuacugccaagccccugcccuggggagaaaguaguuggcuaguacuuu

SEQ ID NO: 226696 - RNA, 59 nt, Human
acgcaucccaucucucccacuuccuccuaccuggggacuccucaaaccacuugccuggg

SEQ ID NO: 226697 - RNA, 59 nt, Human
ggggcccccagcugccuccucacaucugcccuggggacuccccacacuccggggcagau

SEQ ID NO: 226698 - RNA, 59 nt, Human
acaccuguaagguacuaauuacugcccagccuggggagaucaggagaggucugcauagu

SEQ ID NO: 226699 - RNA, 59 nt, Human
cagggagacccuggcccccaguaguguguccuggggacuuccucagagcgagaaaccuc

SEQ ID NO: 226700 - RNA, 59 nt, Human
cgacaccagcuggguuagggucaagggugccuggggagggugaguaauccugcauugcu

SEQ ID NO: 226701 - RNA, 59 nt, Human
ggaagggaaauuuggggauuauuuauccuccuggggacaguuuggggaggauuauuuau

SEQ ID NO: 226702 - RNA, 59 nt, Human
cugguaaacauuccuccagccuccccuccccuggggacgccaaggaggugggccacacc

SEQ ID NO: 226703 - RNA, 59 nt, Human
gguagacugggaguccugaccacgcaggcccuggggacucaagaccccugguuaccccc

SEQ ID NO: 226704 - RNA, 59 nt, Human
guauauaaccaucgcacaacauacagaacccuggggaauacagccaagggcacugcuca

SEQ ID NO: 226705 - RNA, 59 nt, Human
ucuaaaggauaagguacuguagccuugguccuggggaccaccugccuggggcaguggac

SEQ ID NO: 226706 - RNA, 59 nt, Human
ucagagacugggcggcccggcgggggcucccuggggaccccagaugggcucagugcugc

SEQ ID NO: 226707 - RNA, 55 nt, Human
uuauuccucugcaaagaugauugucccuggggaacaguaacaggaaagcaucuuc

SEQ ID NO: 226708 - RNA, 59 nt, Human
cuguugacacagaaggaguuugggccaacccuggggaacugccaggugggaaccgagug

SEQ ID NO: 226709 - RNA, 59 nt, Human
cuggagucuucucccugccugccugccugccuggggaguggggcugcucugacugaggu

SEQ ID NO: 226710 - RNA, 59 nt, Human
aucagcugcagcucugcaccaggccggucccuggggacuggggcgcuccucccucaggc

SEQ ID NO: 226711 - RNA, 59 nt, Human
acugcuggaggaauuuugucaacuacccaccuggggaugaagcucacuggccacaauac

SEQ ID NO: 226712 - RNA, 59 nt, Human
cccucaccuucuccuucuugauuccaaagccuggggaacgguuagggagcucugccugu

SEQ ID NO: 226713 - RNA, 59 nt, Human
cgggcacaccuauggcuccuucgguaucaccuggggaagccccggaaucuuaguucuuc

SEQ ID NO: 226714 - RNA, 59 nt, Human
cagagagguggguggucaggcccugauguccuggggauuucuuguccucagugccaccc

SEQ ID NO: 226715 - RNA, 59 nt, Human
agcccucagcccaccuggggaguuuacuaccuggggaccccccuugcccaugccuccag

SEQ ID NO: 226716 - RNA, 59 nt, Human
ccugaggcucagcccuagcccucagcccaccuggggaguuuacuaccuggggacccccc

SEQ ID NO: 226717 - RNA, 59 nt, Human
uguuccuuuuccuauaccuccccaggcagccuggggaacgugguuggcucaggguuuga

SEQ ID NO: 226718 - RNA, 59 nt, Human
caggcugugccgugucucacccacaccccccuggggacuucaguuccauuucagguuac

SEQ ID NO: 226719 - RNA, 59 nt, Human
cuccuguccucucccugcguaagacuugaccuggggaaucuguguucccuaaguguugu

SEQ ID NO: 226720 - RNA, 59 nt, Human
guugguuuccaggauagaggcccauauauccuggggagcuuuggucuauuaguuuguga

SEQ ID NO: 226721 - RNA, 59 nt, Human
uguacauaaagacaaacuaguaagcaugaccuggggaaauggucagaccuuguauugug

SEQ ID NO: 226722 - RNA, 59 nt, Human
uuguuacgggcgaaaggccacuggccauuccuggggaaguucuuucugcaccagugaug

SEQ ID NO: 226723 - RNA, 59 nt, Human
gagcugucuacaguggaauagggggucucccuggggaaugcaggccaaguccuuuuauu

SEQ ID NO: 226724 - RNA, 59 nt, Human
uuccacagcucugggcuuccucggagaccccuggggauggggaucuucagggaaggaac

SEQ ID NO: 226725 - RNA, 59 nt, Human
ggcaccgagaggguguguggcuccggggcccuggggaccgggacagccgcuccagcuuc

SEQ ID NO: 226726 - RNA, 59 nt, Human
ccacccagguucccaaggcccugccguacccuggggaaucaaccaaggaguucuuguuc

SEQ ID NO: 226727 - RNA, 59 nt, Human
caugccugaauucccccgccccucaguuaccuggggaagaguaaaggcaagaauucuua

SEQ ID NO: 226728 - RNA, 59 nt, Human
gcccugcaagccccuuggggccauguuuuccuggggauccucuugagccuugaucaccu

SEQ ID NO: 226729 - RNA, 59 nt, Human
cauauuuaacuggugcacuuuguaaauucccuggggaaaacuugcagcuaaggagggga

SEQ ID NO: 226730 - RNA, 59 nt, Human
auccuuaugagugauuuuccccaguggccccuggggaugugccacugucacucagaagg

SEQ ID NO: 226731 - RNA, 59 nt, Human
accacuaauucuuccaugccuggaagaaaccuggggacuuaguuagguagauuaauauc

SEQ ID NO: 226732 - RNA, 59 nt, Human
uuguccagauuucacaugcacaugaauugccuggggaucuugugaaacugcagacucug

SEQ ID NO: 226733 - RNA, 59 nt, Human
cauugguugaaaccacugaggagcaucacccuggggauuucauguuuucacucuguucu

SEQ ID NO: 226734 - RNA, 59 nt, Human
gaggccccaucgugaauuaaagaugcugaccuggggauuguuaagugcugccuuaguug

SEQ ID NO: 226735 - RNA, 59 nt, Human
uuucugaccagagacacuuaccuaaauauccuggggaccaaggaacuauguacaaaaac

SEQ ID NO: 226736 - RNA, 59 nt, Human
ucaaauuguauucaucauuauuaacauguccuggggaaggaagggaaacuuucuaggac

SEQ ID NO: 226737 - RNA, 59 nt, Human
cagcggcuccaguguaaauuccccuucccccuggggaaaugcacuaccuuguuuugggg

SEQ ID NO: 226738 - RNA, 59 nt, Human
gcacaagcccucccucuggauccuccacuccuggggauuaugaagauauucuggaaaga

SEQ ID NO: 226739 - RNA, 59 nt, Human
ggugguagcugggaugucccaccuacgugccuggggagagaagcaagagcaggcuggag

SEQ ID NO: 226740 - RNA, 59 nt, Human
cccuagugcugguauacuauagagaaaccccuggggaccaugugauuaaguuccuaucu

SEQ ID NO: 226741 - RNA, 59 nt, Human
ugucuuaugaaaauugccaaacaacugucccuggggauucugcuuugauuggcauuuuu

SEQ ID NO: 226742 - RNA, 59 nt, Human
gccccagggagagagaaaaagcugagacuccuggggaaugacguuggggugauggaguc

SEQ ID NO: 226743 - RNA, 59 nt, Human
gucagccugccccucucacgagaaaagaaccuggggauaccucucagccuccagcguug

SEQ ID NO: 226744 - RNA, 59 nt, Human
uguuaaugguggccuggguugugucuuccccuggggaugaggguuggguguccauggug

SEQ ID NO: 226745 - RNA, 59 nt, Human
uguccaagaugcccugggcuguguccuucccuggggaugaggguuggauguccaagaug

SEQ ID NO: 226746 - RNA, 59 nt, Human
uguccaagauacccugggcuguguccuccccuggggaugaggguuggguguccauggug

SEQ ID NO: 226747 - RNA, 59 nt, Human
uguccauggugcccugggcuguguccuccccuggggaugacgguuggguguccauggug

SEQ ID NO: 226748 - RNA, 59 nt, Human
ccaagugcucggggacccuuugaaaagugccuggggaccugaagagcaccggggaauuu

SEQ ID NO: 226749 - RNA, 59 nt, Human
gaaagcgagagcugaucaaguucuuuguuccuggggaauucacuucucuuccucccuca

SEQ ID NO: 226750 - RNA, 59 nt, Human
uuggcucuucccuccaugccugucagcugccuggggagugagccucccugguccuuccu

SEQ ID NO: 226751 - RNA, 59 nt, Human
ugaaggcucagcacggugaggccugacauccuggggaagggcaacagggagaccuacag

SEQ ID NO: 226752 - RNA, 59 nt, Human
gagugagaagucuccgcugcucgggcccuccuggggagcccccgcuccagggcucgcuc

SEQ ID NO: 226753 - RNA, 59 nt, Human
cgucaccuuuccuaguucugacccugagcccuggggaacaggaaagcguggcuggccuc

SEQ ID NO: 226754 - RNA, 59 nt, Human
agaccuauuguggguauagguauuuucuuccuggggaagaauucaguucccgucucagc

SEQ ID NO: 226755 - RNA, 59 nt, Human
cuggggcagaggagggcugcaccaggcguccuggggaaugugcucagugaagacgacac

SEQ ID NO: 226756 - RNA, 59 nt, Human
cugguucugacuuuguguuuuugugcccuccuggggaccagaaucuccuuucggaauga

SEQ ID NO: 226757 - RNA, 59 nt, Human
ugauaggaagguccuaggcugccguggccccuggggaugugugcuucauugugcccuuu

SEQ ID NO: 226758 - RNA, 59 nt, Human
gccuucaccucugucagcagguggccuugccuggggagccccauguguggcccacccca

SEQ ID NO: 226759 - RNA, 59 nt, Human
agcugaggcugagaaggguggagcuuggcccuggggaaggcagaccagggucugauggc

SEQ ID NO: 226760 - RNA, 59 nt, Human
aaaggcaaccuuugcacacucaccugagcccuggggacccuuggagaaauuagguguca

SEQ ID NO: 226761 - RNA, 59 nt, Human
ccccgucucucuuggacccaccuguggggccuggggagcccacugaggggccagggagg

SEQ ID NO: 226762 - RNA, 59 nt, Human
agcagagggcaugucaguaaugauuggucccuggggaaggucuggcuggcuccagcaca

SEQ ID NO: 226763 - RNA, 59 nt, Human
ugggaaagaaccacacagcuaagggagggccuggggagccccacccuagcccuugcugc

SEQ ID NO: 226764 - RNA, 59 nt, Human
aggcguggagcugccugauauuucccuccccuggggacagcaagggcuaucccuuucca

SEQ ID NO: 226765 - RNA, 59 nt, Human
aaguuguccucagggggauuuguuccuguccuggggauuuaccugggaugguggcugcc

SEQ ID NO: 226766 - RNA, 59 nt, Human
gaggcugauucacugggucugggaaggagccuggggauuuuaauuuuucacaagugccc

SEQ ID NO: 226767 - RNA, 59 nt, Human
cagggcucaggccucacccauugcccacuccuggggagaccaucaccuggcucaucguu

SEQ ID NO: 226768 - RNA, 59 nt, Human
uauagguugucugugaaaucgcaguccugccuggggagggagcuguuggccauuucugu

SEQ ID NO: 226769 - RNA, 59 nt, Human
aggcagauccuggcacuaccucacagcucccuggggacggccacucccuggcugagggc

SEQ ID NO: 226770 - RNA, 59 nt, Human
uaaacccagcugacacuugagcccagcauccuggggauccagcggauggacagcuuggc

SEQ ID NO: 226771 - RNA, 59 nt, Human
ugaccagugccucccaggaguccucaggcccuggggacucugacucaauuguaccugca

SEQ ID NO: 226772 - RNA, 59 nt, Human
agauuuuuacuauacaaagccaccuagggccuggggauuugggucaguuguaguugccu

SEQ ID NO: 226773 - RNA, 59 nt, Human
ccccagaaaggggcugcccuggggugugcccuggggagccucagaagccugcgaccuug

SEQ ID NO: 226774 - RNA, 59 nt, Human
uccaagaagaggucccuguggcgaaguuaccuggggauccuggcuggcccaccuuccug

SEQ ID NO: 226775 - RNA, 59 nt, Human
cugcuaagagggcaaggagaaggaaguacccuggggagggaagggacagaggaagcuau

SEQ ID NO: 226776 - RNA, 59 nt, Human
uccuucuaccaggaccucagaagcccagaccuggggaccccaccuacacaggggcauug

SEQ ID NO: 226777 - RNA, 59 nt, Human
caguguuaaaggucuuggauaagaaggguccuggggaagaagacucuguggacaagaua

SEQ ID NO: 226778 - RNA, 59 nt, Human
ccucuuuggcugcauucagccccuacuuaccuggggaccccggcuggggcacaagagca

SEQ ID NO: 226779 - RNA, 59 nt, Human
ggcgagcguugccacuuucaaagugguccccuggggagcucagccucauccugaugaug

SEQ ID NO: 226780 - RNA, 59 nt, Human
ccucuguggccccccaggagugugaguggccuggggagggggccguggcacugaggccg

SEQ ID NO: 226781 - RNA, 59 nt, Human
acgugugucccuagccuggaauggacuggccuggggaaggcuuuccccucuugggccac

SEQ ID NO: 226782 - RNA, 59 nt, Human
aaagggagccugggagccagcagcccacgccuggggagccugccuggggccaugugacc

SEQ ID NO: 226783 - RNA, 59 nt, Human
ggcccagggaggaggaagccagcagcacaccuggggaauggggucccggccgggaggcu

SEQ ID NO: 226784 - RNA, 59 nt, Human
uggcucuggagggcugcccugcagcugggccuggggacaggucggcuguggggcagcuc

SEQ ID NO: 226785 - RNA, 59 nt, Human
ugaagaugagaaucaccccucucagugcaccuggggaucccccuaaacugugaauucug

SEQ ID NO: 226786 - RNA, 59 nt, Human
cccauucugccugcccaggccccugccacccuggggagaaaguacuucuuuuuuuuuau

SEQ ID NO: 226787 - RNA, 59 nt, Human
uuucuuccguucacuggcuccacacguuuccuggggaguagccuggaauuuaaaguugg

SEQ ID NO: 226788 - RNA, 59 nt, Human
ucuugaaucugcuugagcucuaagaugaaccuggggacaaagugagccagucagcaccu

SEQ ID NO: 226789 - RNA, 59 nt, Human
aauuccuuugugcucaucagagaccccagccuggggaacacgcugcccgcacugcccag

SEQ ID NO: 226790 - RNA, 59 nt, Human
cagcaggagaugaccaacagggggcaggaccuggggaccugggcuggagggaagggcag

SEQ ID NO: 226791 - RNA, 59 nt, Human
ugggcggaccaaaggccggagggguggggccuggggauagcgagaggcuugagaauggg

SEQ ID NO: 226792 - RNA, 59 nt, Human
uuccuucccagcacaucgccagcccugggccuggggauguccccaaugcuguaccuggc

SEQ ID NO: 226793 - RNA, 59 nt, Human
ccuccagcaccaguuccgucauucucguuccuggggaacccccacucugaccuguuauu

SEQ ID NO: 226794 - RNA, 59 nt, Human
cacaggcagaaaauaggagcaggauuuccccuggggaaaaguucuccugggacaucuuc

SEQ ID NO: 226795 - RNA, 59 nt, Human
ucuuucucccacucacccccagcaaggugccuggggagacuugagcagauguuucauuu

SEQ ID NO: 226796 - RNA, 59 nt, Human
cuguauuaggcggccgaggucacucugggccuggggacccaaacccccugcagcccagg

SEQ ID NO: 226797 - RNA, 59 nt, Human
cccuugagucuggggcacccuucagcugcccuggggacaggaaggacaggagcuaagca

SEQ ID NO: 226798 - RNA, 59 nt, Human
gggacccagacugucugaccuggggguugccuggggaccucucccacccgaccccuaca

SEQ ID NO: 226799 - RNA, 59 nt, Human
uuuuuagcuggcucacagggcucccucagccuggggaacauuaaagguuuucuacaaau

SEQ ID NO: 226800 - RNA, 59 nt, Human
ggugguuaaagggagccccacugcugcuaccuggggaauggggcaccugggggccaagg

SEQ ID NO: 226801 - RNA, 59 nt, Human
ccauuucuuccucuggcucaaaauucuucccuggggagagaguuauauucccuuauuua

SEQ ID NO: 226802 - RNA, 56 nt, Human
auguugaaaagaaaaaauaaagcccuccuggggacuuggaaucagucggcagucau

SEQ ID NO: 226803 - RNA, 59 nt, Human
gacccagacaccuguccccacagucaaagccuggggacccagacauccuguccccacag

SEQ ID NO: 226804 - RNA, 59 nt, Human
acgccugggcuuaccuggggggcaggaugccuggggacaguucaggacacacacacagu

SEQ ID NO: 226805 - RNA, 56 nt, Human
aacuguacgcagugacgugacacuggccuggggacagcugcugcucugaugaccuc

SEQ ID NO: 226806 - RNA, 59 nt, Human
guccaaguuuacacacgacacuaaucuccccuggggaggaagcgggaagccagccaggu

SEQ ID NO: 226807 - RNA, 59 nt, Human
cugccgcacugccaaagagucucccuccuccuggggaaggggcugccaacgaaccagac

SEQ ID NO: 226808 - RNA, 59 nt, Human
aucaaaauacccuuugugcuagcccaggcccuggggaaucaggugacucacacaaaugc

SEQ ID NO: 226809 - RNA, 59 nt, Human
ggcacugugaagcucuaggccugcuacugccuggggacacggacuucugcugcugccac

SEQ ID NO: 226810 - RNA, 59 nt, Human
ccaccauggaccagcccauuggccgagcuccuggggagcuccugggacccuuggcuaug

SEQ ID NO: 226811 - RNA, 59 nt, Human
uucauuguugauuguguauuuucuucauuccuggggaguacuaacccaaaagcgucugu

SEQ ID NO: 226812 - RNA, 59 nt, Human
ccucucagcauuuccuugucccgucuggaccuggggagugguuaggcagcaagcuuugg

SEQ ID NO: 226813 - RNA, 59 nt, Human
gggggagaaggccagcuuuaagacguaggccuggggacugggagggcagagggugaguc

SEQ ID NO: 226814 - RNA, 59 nt, Human
ccuccucuuccugcuccaacuucuguccaccuggggacagucugugccuguagccucau

SEQ ID NO: 226815 - RNA, 59 nt, Human
gaagaccuggcuuucuugguuuguccggcccuggggagcagccuucccuacucacuuuc

SEQ ID NO: 226816 - RNA, 59 nt, Human
acaccucucugguucgggaccaaucccucccuggggacgugccccaccugcgugccggc

SEQ ID NO: 226817 - RNA, 59 nt, Human
aucgcuugaucccaggaggucgagaccagccuggggaacacauccugucucuacaaaaa

SEQ ID NO: 226818 - RNA, 59 nt, Human
gauccuuggugcugugugccccacuccagccuggggaccccacuucagaagguaggggc

SEQ ID NO: 226819 - RNA, 59 nt, Human
cagcgucugcucauaggaccugcauccuuccuggggacgaauuccacucguccaaggga

SEQ ID NO: 226820 - RNA, 59 nt, Human
ucagcgaugaacaucuggcuggggcagcuccuggggagcaucagggaagagggggccau

SEQ ID NO: 226821 - RNA, 59 nt, Human
uggggcugguguuccuacgucaguccccaccuggggaauaaacuccagccucuccugcu

SEQ ID NO: 226822 - RNA, 59 nt, Human
cggggcgagcugagaagcggucaugagcaccuggggauuuuaguaagugugucuuccua

SEQ ID NO: 226823 - RNA, 59 nt, Human
gcagcggcucuguccugugccuuaccagcccuggggaggggggcauuuggcuggaagac

SEQ ID NO: 226824 - RNA, 59 nt, Human
gagcugaaguuccaggggagcccaggaccccuggggaccuguacacuagcaggaugggu

SEQ ID NO: 226825 - RNA, 59 nt, Human
caacaauaagucaguucuaguggcugucgccuggggacuagugagaaagcuacucuucu

SEQ ID NO: 226826 - RNA, 59 nt, Human
acaaggucccgacagggguagacguuccaccuggggagaucccaccugccguaggcaca

SEQ ID NO: 226827 - RNA, 59 nt, Human
ccuccggcgagggugggagacggcuuuguccuggggacacuuucccucuggaaucucaa

SEQ ID NO: 226828 - RNA, 59 nt, Human
ccgggccucccgcccaccugccucgucucccuggggagguggucccacugggacacaca

SEQ ID NO: 226829 - RNA, 59 nt, Human
ucccuuguggccaggaguugggagaccagccuggggaccauagcgagaccgcugucucc

SEQ ID NO: 226830 - RNA, 59 nt, Human
ggcucagcuuuggcugugcauuggaaucaccuggggagauuuguaagcuucugcugucu

SEQ ID NO: 226831 - RNA, 59 nt, Human
ccuucuuuguccccugggucuguguggucccuggggauggggcggcgguagcagcugug

SEQ ID NO: 226832 - RNA, 51 nt, Human
caaaggaccggagaaagugagccuggggaagaaggggguuugaagcccacc

SEQ ID NO: 226833 - RNA, 59 nt, Human
uccuuccucccaucggagggagaagggguccuggggagagagaauuuauccagaggccu

SEQ ID NO: 226834 - RNA, 59 nt, Human
aacucaccugcuggccccucaccugggcaccuggggagugggacagagucuggguguau

SEQ ID NO: 226835 - RNA, 59 nt, Human
ucgucaagagcaugcacaugcugucuggcccuggggaucuucccacaggagggccagcg

SEQ ID NO: 226836 - RNA, 59 nt, Human
uguuaggaagagggugggugcccuccagaccuggggacugaguggggaaaggaguuaca

SEQ ID NO: 226837 - RNA, 59 nt, Human
ugcuaaauggcaccucugggauuggccuaccuggggauuucuugguuugugaaaacagg

SEQ ID NO: 226838 - RNA, 59 nt, Human
ugcgcugucccggggccagcuucccucgaccuggggaggccguggccuguggaggaggc

SEQ ID NO: 226839 - RNA, 59 nt, Human
cugaaauggcaccugguacucuugugggaccuggggaauauaaggaacucugugcauga

SEQ ID NO: 226840 - RNA, 59 nt, Human
gggaccucccaggcaggcuccgguucucuccuggggacucacagaagcaucguggccaa

SEQ ID NO: 226841 - RNA, 59 nt, Human
ccuuccugcuuccuguuaccugucuugcuccuggggagaaagaggggccugaugagacu

SEQ ID NO: 226842 - RNA, 59 nt, Human
uaaauauucugcaguuguuacuuaggaagccuggggagggcaggggugccccauggcuc

SEQ ID NO: 226843 - RNA, 59 nt, Human
ugucccccuucccccgaccccucccagauccuggggaccaauaaagcccgcagcggguc

SEQ ID NO: 226844 - RNA, 59 nt, Human
agcucagugccuuucugcaccccuucucuccuggggagcugucugcauccgccaccccc

SEQ ID NO: 226845 - RNA, 59 nt, Human
aucacggaagaccuggcccucccagccguccuggggaugcucagggugcaggcagaggc

SEQ ID NO: 226846 - RNA, 59 nt, Human
cauuccaaggcugagggagggccuucucgccuggggacgcagccacuuucuccagugga

SEQ ID NO: 226847 - RNA, 59 nt, Human
agcccuguuucuuccuggccuucgguuucccuggggaacuuaucgacaaugcaagcucc

SEQ ID NO: 226848 - RNA, 59 nt, Human
guguguaugaaggggggugacaaggucccccuggggaggggaccaaccuugucuggugg

SEQ ID NO: 226849 - RNA, 59 nt, Human
ccagcucugcauuaucugaggucacagggccuggggagauggaggaaagugauaucccc

SEQ ID NO: 226850 - RNA, 59 nt, Human
gccaccucucuugcccaaggugagccagcccuggggacccagcucagggaggcucugcu

SEQ ID NO: 226851 - RNA, 59 nt, Human
cggaugcuuuuguucagggcugugaucggccuggggaaauaauaaagaugcucuuuuaa

SEQ ID NO: 226852 - RNA, 59 nt, Human
cagaugcuuuuguucagggcugugaucggccuggggaaauaauaaagauguucuuuuaa

SEQ ID NO: 226853 - RNA, 59 nt, Human
cccuggggccuggcuggggaagguccgcaccuggggagagcugggagcuguugaagguu

SEQ ID NO: 226854 - RNA, 59 nt, Human
cugggcugaguccagcccuggggaagauuccuggggaauuuauuugcugcuucucccag

SEQ ID NO: 226855 - RNA, 59 nt, Human
cccagucuacuugcugggcugaguccagcccuggggaagauuccuggggaauuuauuug

SEQ ID NO: 226856 - RNA, 59 nt, Human
ucauuguuuuaagggauugggggagggagccuggggacacaaaccuuuuauacaauaca

SEQ ID NO: 226857 - RNA, 59 nt, Human
gugccauuggguggggcagccccaagccuccuggggaggcagggcaaaaacaggugccc

SEQ ID NO: 226858 - RNA, 59 nt, Human
ccaacacaguccugggccacuuuccccacccuggggagcacauaaagaagcuugccaag

SEQ ID NO: 226859 - RNA, 59 nt, Human
ccucccuccuggggccuuuuguuuuggauccuggggauggugagaauggagguucuaga

SEQ ID NO: 226860 - RNA, 59 nt, Human
gcccaccuccgccugccagcccaccccagccuggggagaggucgcggcggcggguuugc

SEQ ID NO: 226861 - RNA, 59 nt, Human
agcaagaagggagcgcugaggcaugaagcccuggggaaacuggcaguagguuuugguuu

SEQ ID NO: 226862 - RNA, 59 nt, Human
ggaacuaagcuggguguguucugucuggaccuggggaggccccugaaggcaaagaggga

SEQ ID NO: 226863 - RNA, 59 nt, Human
gccccaucccugagugggcaggagccuggccuggggagggcuugggccugugaggauuc

SEQ ID NO: 226864 - RNA, 59 nt, Human
cugggugggaggagcgaaaguggggguguccuggggagaccaggaaccugccaagccca

SEQ ID NO: 226865 - RNA, 59 nt, Human
acuaccaacccagcuccacccagcaguguccuggggagaaggaaggcugagccucuccc

SEQ ID NO: 226866 - RNA, 59 nt, Human
ggauguuggggguguuugugguuaucuuaccuggggaaguucuuauguuuaucuugcuu

SEQ ID NO: 226867 - RNA, 59 nt, Human
gaucagcuccugggugugucagaggccagccuggggagcucuggccacugcuucccaug

SEQ ID NO: 226868 - RNA, 59 nt, Human
uggcugcucuuccagcgucucuccucccuccuggggaaggucgcccuugcgcgcaaggu

SEQ ID NO: 226869 - RNA, 59 nt, Human
uauugcauggucacgagugagggcaggccccuggggacacaucugcccacagcugcaca

SEQ ID NO: 226870 - RNA, 59 nt, Human
aucccacacguguccguguggccggccagccuggggaguaguggcaacagcccuuccgu

SEQ ID NO: 226871 - RNA, 59 nt, Human
uggggacacuggugugggaaggggcagcaccuggggagucccugccucuccucccuggg

SEQ ID NO: 226872 - RNA, 59 nt, Human
uccucacacugacgggggcuccauacggaccuggggacugggcugagaggguggacgag

SEQ ID NO: 226873 - RNA, 59 nt, Human
cccaaggccucccugggcugcugugggcuccuggggagguggcccucguggcccacgcu

SEQ ID NO: 226874 - RNA, 59 nt, Human
uguguguguguguguguguguuggaaccuccuggggacauguuauauuuugaagugauu

SEQ ID NO: 226875 - RNA, 59 nt, Human
gcacuaaaucacaucagggagugauuaguccuggggaaauucaguggaggcacaagccu

SEQ ID NO: 226876 - RNA, 59 nt, Human
agcugaggggaggaucuuacugaaagcacccuggggagauugauuguccuuaaaccuaa

SEQ ID NO: 226877 - RNA, 59 nt, Human
cugcugggccacaccccaagaucaggggcccuggggacggcaagugaauaaagcacauu

SEQ ID NO: 226878 - RNA, 59 nt, Human
ccaggaauuagagaagcugaaaggaugauccuggggaagguggagcagcugcaggccug

SEQ ID NO: 226879 - RNA, 59 nt, Human
uccugcagccacacacccacccgggguguccuggggacccaaggggugggggggucaca

SEQ ID NO: 226880 - RNA, 59 nt, Human
ggcccagccagcuccuggggucccggccaccuggggaagccgcgccugccaaggaggcc

SEQ ID NO: 226881 - RNA, 59 nt, Human
agccucgcccccuccccacgugcaccauaccuggggaguuccugguccaggguauccug

SEQ ID NO: 226882 - RNA, 59 nt, Human
ccaggcuuugccacggccaguugguccucccuggggaacugggugcggguggaguacug

SEQ ID NO: 226883 - RNA, 59 nt, Human
uuggggaugcugcacugggcagcuacccaccuggggaugggacgugaggccaagacccc

SEQ ID NO: 226884 - RNA, 59 nt, Human
gcugaaggagacgccggcauccucgggggccuggggaaguuguguguugugcagucagu

SEQ ID NO: 226885 - RNA, 59 nt, Human
aagagauggagccaggacuccuggguucuccuggggaucagggagagucuugggaagua

SEQ ID NO: 226886 - RNA, 59 nt, Human
auggugcuggugcuguuguguguagguccccuggggacacaagcaggcgccaaugguau

SEQ ID NO: 226887 - RNA, 59 nt, Human
ugagucaugaucgcaccacugcacccaaaccuggggagagagcuagacucuugucucaa

SEQ ID NO: 226888 - RNA, 51 nt, Human
ucggugaggcaccccuguaacccuggggacuaggaggaagggggcagagag

SEQ ID NO: 226889 - RNA, 59 nt, Human
cccaaguuccaggcucagucuuccagccgccuggggagucucuaccugggcccaagcag

SEQ ID NO: 226890 - RNA, 59 nt, Human
uaagucucugcccuaggcacaucagaucaccuggggaccacuccagagugaguagacaa

SEQ ID NO: 226891 - RNA, 59 nt, Human
cagaccucccuauaggucaacagggacaaccuggggaucucuggagcagggcccuccuc

SEQ ID NO: 226892 - RNA, 59 nt, Human
ccuacugcaugccagcaacagggcuuggcccuggggaauugggaggaaccaagcccucu

SEQ ID NO: 226893 - RNA, 59 nt, Human
auucaagacagugacagcauuacgucaccccuggggacagaggucagccuaaggugaca

SEQ ID NO: 226894 - RNA, 59 nt, Human
ucccagucccaccccuugccccacggaguccuggggacgcagugccccagcugggaaga

SEQ ID NO: 226895 - RNA, 59 nt, Human
ccuuucccaugccuccucuggagccuucgccuggggagacagaacccagagagaaacaa

SEQ ID NO: 226896 - RNA, 59 nt, Human
gagcuggaccugagcuauucucacucggaccuggggaaacggcccaccaaggacagcua

SEQ ID NO: 226897 - RNA, 59 nt, Human
aaaggccccagccggggugaaucaucaguccuggggaagaacccaggcgccugagcccc

SEQ ID NO: 226898 - RNA, 59 nt, Human
cccuccugccucagccuccugaguacccuccuggggacuacaggugcgugcuaccauac

SEQ ID NO: 226899 - RNA, 59 nt, Human
ccccugcaugcuucuggcuggagcaccucccuggggagucgggggauuggguugugggc

SEQ ID NO: 226900 - RNA, 59 nt, Human
guugauggagcgucccugaagcccccagcccuggggauggggaaggacauggagccuga

SEQ ID NO: 226901 - RNA, 59 nt, Human
accagcucugaguccugaggagacacaggccuggggacaggaagggaugggggucccug

SEQ ID NO: 226902 - RNA, 59 nt, Human
guugauggagaguccccaaggcccccagcccuggggauggggaaggacaugaagccuga

SEQ ID NO: 226903 - RNA, 59 nt, Human
gggaucuagggcccugggaggagguugagccuggggaaggaaaaagcaggaaacugaag

SEQ ID NO: 226904 - RNA, 59 nt, Human
gucucauccccacauaacacaaaaagcagccuggggaagacaaucaagcuacaggcacu

SEQ ID NO: 226905 - RNA, 59 nt, Human
cacuugcaugggagccacagaggagcgucccuggggauuguugggaccaugcugccccc

SEQ ID NO: 226906 - RNA, 59 nt, Human
cgggacagucggguguccgcccucagccuccuggggacucgagccggggauccccugac

SEQ ID NO: 226907 - RNA, 59 nt, Human
ucgccuggagcccuccgccuucacauuccccuggggacccacguggcugcgugccccug

SEQ ID NO: 226908 - RNA, 59 nt, Human
guggagcacugaccuggccaaggccucauccuggggaggauacugaggcacacagaggg

SEQ ID NO: 226909 - RNA, 59 nt, Human
cccaggugacacgcuucugagcaggggccccuggggacuucaacugcccagcaacaugg

SEQ ID NO: 226910 - RNA, 59 nt, Human
gccugccucggcuuugaguuccggaagcaccuggggaaucccgccaaagauggagggug

SEQ ID NO: 226911 - RNA, 59 nt, Human
gagggaaagggagaggaugaggaagccccccuggggauuugguuuggucuugugaucag

SEQ ID NO: 226912 - RNA, 59 nt, Human
uaacugccuguuggguacuaugcugauuaccuggggacaaaauuaacuguacaccaaac

SEQ ID NO: 226913 - RNA, 59 nt, Human
uaguucugugccuccccccagaccccgccccuggggaaauagccucacgggguuggcug

SEQ ID NO: 226914 - RNA, 59 nt, Human
accuccccggagagaaacuggacauggggccuggggaggggagcuggccagaggaggac

SEQ ID NO: 226915 - RNA, 59 nt, Human
agcagaugagcaccguauauucauuccacccuggggagauuccugauaagcaccacaua

SEQ ID NO: 226916 - RNA, 59 nt, Human
ucacagugacaccucaggaagauguccuuccuggggaagaagaagcaccagccacaggg

SEQ ID NO: 226917 - RNA, 59 nt, Human
ccugcagacaggagggcccuggcugugcaccuggggaagugguugcccuggggccaggg

SEQ ID NO: 226918 - RNA, 59 nt, Human
accgcuccccugugacugcaucccgccucccuggggaccugccuguggcaggaaggaau

SEQ ID NO: 226919 - RNA, 59 nt, Human
caaggccaacagggcaggggaggggaagaccuggggaaggaagaaugaggacagucccg

SEQ ID NO: 226920 - RNA, 59 nt, Human
ggccucucccaccucaggcccugcccgacccuggggagagagggcaucugcaauaggag

SEQ ID NO: 226921 - RNA, 59 nt, Human
gaacugcccccagggaacacugggcgaugccuggggacauugugguugucacgaugggg

SEQ ID NO: 226922 - RNA, 59 nt, Human
gggaugcgcccaagcccccgagggagaggccuggggacaccaacaaaucuaagcccucc

SEQ ID NO: 226923 - RNA, 59 nt, Human
cagaaugaccgcguguccuugccugaccaccuggggaacaccccuggacccaggcaucg

SEQ ID NO: 226924 - RNA, 59 nt, Human
gacuugggauuucuggucuaagugggccuccuggggauggggugguacacugagcuucu

SEQ ID NO: 226925 - RNA, 59 nt, Human
accugcagccacgucaucguugcgcagccccuggggagggucuuuggggagggggugcc

SEQ ID NO: 226926 - RNA, 59 nt, Human
ugcggaagccuggccugcuggggaugucuccuggggacuuugccuacuggggaccucgg

SEQ ID NO: 226927 - RNA, 59 nt, Human
gggacggucaccuguugcagcuucaccugccuggggauucaccuaccuggguccucacu

SEQ ID NO: 226928 - RNA, 59 nt, Human
uggggaccucacccuggagggcccugggcccuggggaacuggcuuacuuggggccccac

SEQ ID NO: 226929 - RNA, 59 nt, Human
gauugggccacccuacccaggaucuccacccuggggacaguagaaggggaaagccuuca

SEQ ID NO: 226930 - RNA, 59 nt, Human
gagccccgggccggcgcaggugggcgucaccuggggacuccccacugucagcagcagcc

SEQ ID NO: 226931 - RNA, 59 nt, Human
cuggggagcagauuuugggucuggaucucccuggggaguggguccugggcuuggaucuu

SEQ ID NO: 226932 - RNA, 59 nt, Human
ugagccucguugacagccagcauggggcuccuggggacuggugggaucuaagaaaggga

SEQ ID NO: 226933 - RNA, 59 nt, Human
cacaugcaguugugggaccgcaguuugguccuggggaccauucauacccacacacccag

SEQ ID NO: 226934 - RNA, 59 nt, Human
gggcgccccggacuuggagagggugcggcccuggggacccccccuccccgagugugccc

SEQ ID NO: 226935 - RNA, 59 nt, Human
acugucaccaaacagaccaucuucccaggccuggggaccgguaagauccaugucacuag

SEQ ID NO: 226936 - RNA, 59 nt, Human
gacucuguuuacgugcccagucagcccuaccuggggaagcggggguuggguguuuuaga

SEQ ID NO: 226937 - RNA, 59 nt, Human
cuaaccauguccucgugaaccaguaucugccuggggagggcaucaugguaaccacacac

SEQ ID NO: 226938 - RNA, 59 nt, Human
accagcucugaguccugaggagacacaggccuggggacagggagggaugggagucccug

SEQ ID NO: 226939 - RNA, 59 nt, Human
guugauggagcguccccaaagcucccagcccuggggacggggaaggacauggagccuga

SEQ ID NO: 226940 - RNA, 59 nt, Human
cccaacggcugccuuccccaagcauccagccuggggaugggccccuuucaggaaucacc

SEQ ID NO: 226941 - RNA, 59 nt, Human
cuccccagggaaccacccccaguaaccauccuggggaguuuaaggucucucuccuuggu

SEQ ID NO: 226942 - RNA, 59 nt, Human
agcccauccuguuggugaccgucuauaucccuggggaaauuuccaccccaguccccucc

SEQ ID NO: 226943 - RNA, 59 nt, Human
aaggggaaacugaggugcgggugcgcgggccuggggacggccgucccauggcuuccauc

SEQ ID NO: 226944 - RNA, 59 nt, Human
ugugugccuccugccaucccugcacacagccuggggagaagccugugccuccccgugug

SEQ ID NO: 226945 - RNA, 59 nt, Human
uugagcuguugaagaucccgugaucauuaccuggggagggguuccugaaaccuuccaca

SEQ ID NO: 226946 - RNA, 59 nt, Human
uuugugguuuuuagaguugcaucuaugaaccuggggagauuaugugcuuucccaagcgu

SEQ ID NO: 226947 - RNA, 59 nt, Human
ccuggaaaaagcgcucccccgucgugcuuccuggggaagggggcguucgcugcgcucgg

SEQ ID NO: 226948 - RNA, 59 nt, Human
cuuacgauacuacuaccucauaggguuguccuggggauccaguaugaugaagugcgcca

SEQ ID NO: 226949 - RNA, 59 nt, Human
uucccaggaagaggaaguaaaucugcaacccuggggaggaccccaacucaccugggaau

SEQ ID NO: 226950 - RNA, 59 nt, Human
ggucacauuuggcagcaaaauggauuucuccuggggagaacaaaguuaagggacacuga

SEQ ID NO: 226951 - RNA, 59 nt, Human
uagucuccgugugauggaggagggagaugccuggggaggggcuccuggaauccaggcca

SEQ ID NO: 226952 - RNA, 59 nt, Human
uaaaccaucccuucuuggggcuuuaagucccuggggagcuuucccuguaggucuccugg

SEQ ID NO: 226953 - RNA, 59 nt, Human
ccuggagcaccgggucucucuaagucucaccuggggaauucggucccaccuggggcacc

SEQ ID NO: 226954 - RNA, 59 nt, Human
gugccauguaaauccccacugggaccaacccuggggaaggagccaguuugccggauaca

SEQ ID NO: 226955 - RNA, 59 nt, Human
uccuccauuaccauccagacugcucgccuccuggggauucucaggggcuccauuauggc

SEQ ID NO: 226956 - RNA, 59 nt, Human
uggagguacugcccagaccgcugcaggucccuggggaucugcauuucuaacaggcuccu

SEQ ID NO: 226957 - RNA, 59 nt, Human
uauuuauuuaucgaggccucuuuggugagccuggggaaucagcaaaggggaggaggggu

SEQ ID NO: 226958 - RNA, 59 nt, Human
guagagcugacaggugggucacacucagaccuggggacagaggugaaaugcacaagcug

SEQ ID NO: 226959 - RNA, 59 nt, Human
gagagaaagggcuuccaggccccuccaagccuggggaaggacguggcauccaagcugag

SEQ ID NO: 226960 - RNA, 59 nt, Human
gagugugcccuucggcccucacaagagccccuggggaguaggugguggccugugccguc

SEQ ID NO: 226961 - RNA, 59 nt, Human
aagcauuccuuaagugacacaggaggacgccuggggacuuuuuauauauuugcagauua

SEQ ID NO: 226962 - RNA, 59 nt, Human
ccuuuaggggcugcaggacggaauggccgccuggggagccuguguggcugugccgggca

SEQ ID NO: 226963 - RNA, 59 nt, Human
uucucuuugacccugcugaguguaagcugccuggggaggggcuacaaggaguaauugug

SEQ ID NO: 226964 - RNA, 59 nt, Human
aggcccccaugucugcacccagccaggucccuggggacguuacuaacucaugacuuggg

SEQ ID NO: 226965 - RNA, 59 nt, Human
aagcaaucaacgggucggucguggccaguccuggggaggucugagugguggucuuuggg

SEQ ID NO: 226966 - RNA, 59 nt, Human
aguaugauggcaggagaaucagccuggggccuggggauguaaccaagcuguacccuuga

SEQ ID NO: 226967 - RNA, 59 nt, Human
uugguucuuacuuugcugcucguuuagucccuggggauuucagaucuuaggcuguuguu

SEQ ID NO: 226968 - RNA, 59 nt, Human
ccgagggggcucccagaaggaccccaggcccuggggaggguggcugugggaggccaagu

SEQ ID NO: 226969 - RNA, 59 nt, Human
gaacauaauuaggcaucgggccuaaguguccuggggagauuggaggggacggcagcguu

SEQ ID NO: 226970 - RNA, 59 nt, Human
uuguuucuuuguuuauauuuucaguaagcccuggggaauauagcauggaauugagcuac

SEQ ID NO: 226971 - RNA, 59 nt, Human
cuggcgacuuuccugggcaggccuuuccaccuggggagcuggcucauccugcacagcug

SEQ ID NO: 226972 - RNA, 59 nt, Human
ccccucugcucacagagcccccucaccucccuggggaugaggggccaggccaugacccu

SEQ ID NO: 226973 - RNA, 59 nt, Human
agcgacagagcgacacauccacaggcgccccuggggaaaugggaccagccuaaucucgc

SEQ ID NO: 226974 - RNA, 59 nt, Human
aguugggggcugggaagggcggggcccugccuggggaucucaaggaugaggccccagca

SEQ ID NO: 226975 - RNA, 59 nt, Human
gcaaggucagaggcccagccagauuccauccuggggaagcaaaugaauucucagaggaa

SEQ ID NO: 226976 - RNA, 59 nt, Human
ucagcguccuggguggcaaauguggccaaccuggggacucuggccggacggccaauggg

SEQ ID NO: 226977 - RNA, 59 nt, Human
ccaagggagaagggagugagcgugggucaccuggggaaaaucucaucugauucccuccu

SEQ ID NO: 226978 - RNA, 59 nt, Human
gccuguucugccccagcuguuccuccuccccuggggacagccccaccuccgggucccuc

SEQ ID NO: 226979 - RNA, 59 nt, Human
cucgcuccuucuguuggcagaggacagccccuggggaaccccaggcccaacucuguccg

SEQ ID NO: 226980 - RNA, 59 nt, Human
cuucccccuguccuguuucucacccagcaccuggggagaucggugcuaccaaggaagag

SEQ ID NO: 226981 - RNA, 59 nt, Human
gcaccugucuguuguagaaaacaccggucccuggggagacuugaaaggccccuguccca

SEQ ID NO: 226982 - RNA, 59 nt, Human
augacggcaaccucugagccaucccagagccuggggaggccaggguagaggcugacggc

SEQ ID NO: 226983 - RNA, 59 nt, Human
ccagccacgccugcgaggcguuggauaagccuggggagccccgcauggaccgcggcuuc

SEQ ID NO: 226984 - RNA, 59 nt, Human
caggcucccgggcaucugguugaccccagccuggggaggagggcuggucuccgcuccuc

SEQ ID NO: 226985 - RNA, 59 nt, Human
acgcugugggugcaggugagccggcguguccuggggagaugcugccagcacacaggggc

SEQ ID NO: 226986 - RNA, 59 nt, Human
aggggugagguucuuggccucagcuccucccuggggaaggaacuagucuuucuccaaga

SEQ ID NO: 226987 - RNA, 59 nt, Human
cucuggaaagccaaagcagcucaucccuuccuggggaccacacugcucugcuccaccag

SEQ ID NO: 226988 - RNA, 59 nt, Human
ucauuccaagaaggaagagggucaggagaccuggggagucucauauuccaaguucuucu

SEQ ID NO: 226989 - RNA, 59 nt, Human
gugacguuagugaguacagaaagagaugcccuggggaaaacucaucuacuguggucaga

SEQ ID NO: 226990 - RNA, 59 nt, Human
gcggggacagggccagauuucauguugacccuggggaugcugugaauuucuccugcagg

SEQ ID NO: 226991 - RNA, 59 nt, Human
aaccugucccaguuuaucaggaacgcaggccuggggagcccccaguggcggggacaggg

SEQ ID NO: 226992 - RNA, 52 nt, Human
ugcgcaucagcuaccuguagggccuggggaaagccaggauggcccgaggaag

SEQ ID NO: 226993 - RNA, 59 nt, Human
aggccuggacugccucucgccucaguaggccuggggaccaggcuugggucuggagguuu

SEQ ID NO: 226994 - RNA, 59 nt, Human
ugaguggggcagaggcccagaagugccagccuggggagccguuugggggcagccccuuc

SEQ ID NO: 226995 - RNA, 59 nt, Human
ugaacuuucuggacaagaccucuggccgaccuggggauggccucugaucccuggagcag

SEQ ID NO: 226996 - RNA, 59 nt, Human
ggauccuggacgaccccuccccaccucagccuggggaggagaagcuggcagcccucacu

SEQ ID NO: 226997 - RNA, 55 nt, Human
auaagagacugagccgcuagcagcgccuggggaccagacagacgcauguggcaaa

SEQ ID NO: 226998 - RNA, 59 nt, Human
cuuuguggcccaugaaagucuuacugggcccuggggaagguauccuacccuggugaagc

SEQ ID NO: 226999 - RNA, 59 nt, Human
gccaguucugaaaggcgagcagaacucccccuggggaggaagcucaccaaaaguuuuuc

SEQ ID NO: 227000 - RNA, 59 nt, Human
aagcugccgaagcagccacuggaaagaacccuggggacccuaauguuggacucucggcg

SEQ ID NO: 227001 - RNA, 59 nt, Human
ggguugugcccagguguugcccccuaucuccuggggagggugaggcagggcagggacag

SEQ ID NO: 227002 - RNA, 59 nt, Human
uggagcaggcccagcugaaccaauggaggccuggggacaucuggcauggucaccccugc

SEQ ID NO: 227003 - RNA, 59 nt, Human
acgguaauuaaugucuuaauuggcuguugccuggggaacaggagagcugcugcaggcag

SEQ ID NO: 227004 - RNA, 59 nt, Human
ccugaagucucuaaugugacuguugagggccuggggaaaccauggcaaaguggauccag

SEQ ID NO: 227005 - RNA, 59 nt, Human
uccauuuauugcuuuugguauaauuuuucccuggggaaggaggggaaauuaugaaagaa

SEQ ID NO: 227006 - RNA, 59 nt, Human
aucauuuucaacucugguuaggccuccuaccuggggaggccaggucacugcacugggag

SEQ ID NO: 227007 - RNA, 59 nt, Human
ggaacagacacguguguggcaugguuuggccuggggaucuuagaugucugaccugaacu

SEQ ID NO: 227008 - RNA, 59 nt, Human
aggaggcugagaugagaggaucacuugagccuggggagguccaggccgcagugauccga

SEQ ID NO: 227009 - RNA, 59 nt, Human
uaaaucaucgccaaagaggacuucagagcccuggggaggcagcugagggucucaagggu

SEQ ID NO: 227010 - RNA, 59 nt, Human
ggagaaggacaugagaucagggccugcccccuggggaucacagccucaccccugccccu

SEQ ID NO: 227011 - RNA, 59 nt, Human
ucgcuggggcaggggcacccagcaucagcccuggggagagaggcucccaaagggccacc

SEQ ID NO: 227012 - RNA, 59 nt, Human
uccgugggguuuuuuuuaccauuguuggaccuggggaggggggaguuaaaaaaagaacc

SEQ ID NO: 227013 - RNA, 59 nt, Human
ccaggaacuuaugaugccuccgaaaaccaccuggggacucacguagcuggagagcauua

SEQ ID NO: 227014 - RNA, 59 nt, Human
ugaggcucagaugcccccugcucuguaacccuggggaaugucagaggcagguaauaaag

SEQ ID NO: 227015 - RNA, 59 nt, Human
guccuuggcgccgucuccuaccugcacagccuggggaucgugcaccgggaccucaaggu

SEQ ID NO: 227016 - RNA, 59 nt, Human
gcagcaguggaagaccucgggccaugcggccuggggaggacuugguggcgauccgcaac

SEQ ID NO: 227017 - RNA, 59 nt, Human
cgcuuccuuuccuccccgcugccgcccacccuggggagagacuuuugcggggagggaag

SEQ ID NO: 227018 - RNA, 59 nt, Human
cagaggccugcggggugggggcaucgcugccuggggagcugaggcguuaccgcuguguu

SEQ ID NO: 227019 - RNA, 64 nt, Human; identical to SEQ ID NO: 9199

SEQ ID NO: 227020 - RNA, 64 nt, Human; identical to SEQ ID NO: 9204

SEQ ID NO: 227021 - RNA, 64 nt, Human
acuuuaaaacaaggaaccguaucaggccagcaugguggcucaugccuguaaucccagcauuuug

SEQ ID NO: 227022 - RNA, 64 nt, Human
agguuguuucccauguucagcguggacugcagaaguggcucacgcuccuguggugagggcaggg

SEQ ID NO: 227023 - RNA, 64 nt, Human
cacugagggagaaagacacagacuuuaucgcucuguggcucauuguuacuggaauauucuaaaa

SEQ ID NO: 227024 - RNA, 64 nt, Human
agcuuaaaaguuuaguaaaaaucgucugggcacaguggcucacgccuguaaucccagcacuuug

SEQ ID NO: 227025 - RNA, 64 nt, Human
aucucaaagagaaaaaaaaaaaagaccgggugugguggcucacaccuguaaucccagcacuuug

SEQ ID NO: 227026 - RNA, 64 nt, Human
uaugauuaagauaaugccgggcaggccgggcacaguggcucacgccuguaauccaagcacuugg

SEQ ID NO: 227027 - RNA, 64 nt, Human
uuaaccugccucuugaaagauucaaccgggugugguggcucacgccuguaaucccagcacauug

SEQ ID NO: 227028 - RNA, 64 nt, Human
uuuuguuguaauaaauguuuucaggccgggcacuguggcucacgccuguaaucccagcacuuug

SEQ ID NO: 227029 - RNA, 64 nt, Human
gaggcuuggaaagcaucaccucaggccaggugcaguggcucacgccuaugaucccagcacuuug

SEQ ID NO: 227030 - RNA, 64 nt, Human
ucccuuaaaaagugccuuuuagaggcugggcaugguggcucacgcuuguaaucccagcacuuug

SEQ ID NO: 227031 - RNA, 64 nt, Human
cuccuguaaagaauaaaacugugggccgggcgcgguggcucacgccuggaaucccagcacuuug

SEQ ID NO: 227032 - RNA, 64 nt, Human
auauuggauagcucagaaaaucugggaaaucaaaguggcucaauagcugugaggaacugugggu

SEQ ID NO: 227033 - RNA, 64 nt, Human
cacuguauuaagaggggaaaccgggccaagcgcaguggcucacaccucuaaucccagcacuuug

SEQ ID NO: 227034 - RNA, 64 nt, Human
cagaauccaaauugguuagaugaggccaggcgcgguggcucacgccuguaaucccagcacuuug

SEQ ID NO: 227035 - RNA, 64 nt, Human
aaaucuccaaagaucucuuuaagggcugggcaugguggcucacuuugggagauggauugcuuga

SEQ ID NO: 227036 - RNA, 64 nt, Human
ccucuccagcuacccuuuuaccucaucagaagcaguggcucagcuaagugcucccccuagcucc

SEQ ID NO: 227037 - RNA, 64 nt, Human
cguucugcauagaauucaaacgagauucacccagcgcgaggaggaagaaacagcaguuccuggg

SEQ ID NO: 227038 - RNA, 64 nt, Human; identical to SEQ ID NO: 9209

SEQ ID NO: 227039 - RNA, 64 nt, Human; identical to SEQ ID NO: 9214

SEQ ID NO: 227040 - RNA, 64 nt, Human
cugggccuuucuuucaucccaaaugacaaggaauguggcucagagaaggguuuuucuuuuuuga

SEQ ID NO: 227041 - RNA, 64 nt, Human
ucaauccaaauuuguggauaaggggccgggugcaguggcucacaccuguaaucccagcacuuug

SEQ ID NO: 227042 - RNA, 64 nt, Human
gaggcuuaagaagcuggaucuccugccgggcgugguggcucaugccuguaaucccaccacuuuu

SEQ ID NO: 227043 - RNA, 64 nt, Human
gggaauggacauuauuaaaagaacaggggcagaaguggcucauuuaugacccauucacuagccc

SEQ ID NO: 227044 - RNA, 64 nt, Human
caagauguagaaaauagaaaauaggcuaggcacaguggcucacgccuguaaucucaacacuuug

SEQ ID NO: 227045 - RNA, 64 nt, Human
gugcuguuuaaagucugaagcucggccaggugcgguggcucacgccuguaaucccaaaacuuug

SEQ ID NO: 227046 - RNA, 64 nt, Human
cucccuuucaaagcugugugaccggcugggcaugguggcucacaccuguaaucccagcacuuug

SEQ ID NO: 227047 - RNA, 64 nt, Human
cuuccucaucaugaaaacugggaggccgggcaugguggcucaugccuguaaucccagcauuuug

SEQ ID NO: 227048 - RNA, 64 nt, Human
uuuccuuuaaaauagaaucauuaggccaggcgugguggcucaugcuuguaaucccagcacuuug

SEQ ID NO: 227049 - RNA, 64 nt, Human
ggugucuggcuguuuugucaacucucauccacugguggcucagagccauaagguggguugauua

SEQ ID NO: 227050 - RNA, 64 nt, Human
uggcaagaauucuuucauugcuauauaauauucaguggcucauuuauaccuaauaaaauaaugg

SEQ ID NO: 227051 - RNA, 64 nt, Human
cggacacccucacgaagggucgcaagucacucuuguggcucagauugcucuuaggaccuggagg

SEQ ID NO: 227052 - RNA, 64 nt, Human
uucuuguuccucauucuucaaaugugggccaguuguggcucaaauccucuauauuuuuagccaa

SEQ ID NO: 227053 - RNA, 64 nt, Human
gcuucaguaaaguucaaaaagcgggccaggugugguggcucaugccuguaaucccgacacuuug

SEQ ID NO: 227054 - RNA, 64 nt, Human
aaggagcauugaggaggcccaagaggaaaaggauguggcucaggcugggagggacuucaguuag

SEQ ID NO: 227055 - RNA, 64 nt, Human
ugcuuguguaagaaacugaaauaagcugcgugugguggcucacaccuguaaucccaacacuuug

SEQ ID NO: 227056 - RNA, 64 nt, Human; identical to SEQ ID NO: 9219

SEQ ID NO: 227057 - RNA, 64 nt, Human; identical to SEQ ID NO: 9223

SEQ ID NO: 227058 - RNA, 64 nt, Human; identical to SEQ ID NO: 9228

SEQ ID NO: 227059 - RNA, 64 nt, Human
aucucaaaggaaaaaggaaacuaggccaggcgugguggcucacgccuguaaucccaacacuuug

SEQ ID NO: 227060 - RNA, 64 nt, Human
caaaacaaauguggauuaaguguuuaggcucuauguggcucacgcagccagaauccuuaagucu

SEQ ID NO: 227061 - RNA, 64 nt, Human
uuagguuggcaaaaaggcaggauggccgggcgcgguggcucacgccuguaauccuagcacuuug

SEQ ID NO: 227062 - RNA, 64 nt, Human
aaucuuuagaauaugccuuaaaaggccgggcgcgguggcucacgccuguaaucccagcacuuug

SEQ ID NO: 227063 - RNA, 64 nt, Human
ccauggauaauagguaaacuuggggccgggcgcaguggcucacgccuguaaucccaguauuuug

SEQ ID NO: 227064 - RNA, 64 nt, Human
cugugacccuucccugccauugggcccuccaccuguggcucacaucucgccagccccacagagc

SEQ ID NO: 227065 - RNA, 64 nt, Human
aaaaauacuaagagauuugcuuuuucugggugcgguggcucaugccuguaaucccagcacuuug

SEQ ID NO: 227066 - RNA, 64 nt, Human
agauauuuauuaagaaccuaugcggcccggcaugguggcucacaccuguaaucccagcacuuug

SEQ ID NO: 227067 - RNA, 64 nt, Human
guauguuagaaaaacaaaaaggaggcugggcaugguggcucaugccucuaaucucagcacuuug

SEQ ID NO: 227068 - RNA, 64 nt, Human
aacuuugguuaacaagaauauuugggcaggugcaguggcucacaccuguaaucccaacaccuug

SEQ ID NO: 227069 - RNA, 64 nt, Human
cucaugcgcagucucagucacccguguuaucuucguggcucaaaggacaaugcaaaaucgccga

SEQ ID NO: 227070 - RNA, 64 nt, Human
ucuuggaaugggggcuccuuggggccagcccaguguggcucaccacacucuucuuuuuuuuuuu

SEQ ID NO: 227071 - RNA, 64 nt, Human
gcuguaauucaagaucccaauuccaccaggugcaguggcucaugccuguaaucccagcacuuca

SEQ ID NO: 227072 - RNA, 64 nt, Human
agucuugaugcugcugccaugaucccuuugagagguggcucaaaagcuacagggaacuccaggu

SEQ ID NO: 227073 - RNA, 64 nt, Human
gaggagguggauaagaugcucccggccgggcgcgguggcucacgccuguaaucccagcacuuug

SEQ ID NO: 227074 - RNA, 64 nt, Human
uuccauuuuaaagaguguaggcaggccaggugcaguggcucaugccuguaaucccagcauuuug

SEQ ID NO: 227075 - RNA, 64 nt, Human; identical to SEQ ID NO: 9232

SEQ ID NO: 227076 - RNA, 64 nt, Human; identical to SEQ ID NO: 9235

SEQ ID NO: 227077 - RNA, 64 nt, Human; identical to SEQ ID NO: 9239

SEQ ID NO: 227078 - RNA, 64 nt, Human
gcaaacacaagaacuauacacauggccaggcgcgguggcucacacccguaaucccagcacuuug

SEQ ID NO: 227079 - RNA, 64 nt, Human
cuuugagauugugaaauuauuaaucauccucuguguggcucauguuuuugcuuuucaacacaca

SEQ ID NO: 227080 - RNA, 64 nt, Human
gacuaaacuguuucucugacucgccccagaggucguggcucaaaggcacuuaggacgccuuaaa

SEQ ID NO: 227081 - RNA, 64 nt, Human
aaaaagcuucuaaaaagcuauuucgccaggcacgguggcucaugccuauaaucccagcacuuug

SEQ ID NO: 227082 - RNA, 64 nt, Human
uauauaauuuaaguacaaguuuaggcugggcgugguggcucacgccuguaaucccagcacuuug

SEQ ID NO: 227083 - RNA, 64 nt, Human
auuuacuaguuauaagaccuuaaggcugggugcaguggcucacgccuguaaucccagcacuuug

SEQ ID NO: 227084 - RNA, 64 nt, Human
guggugaugaggcuuagcggggccagugacggccguggcucaggauccauaagucgggguuugg

SEQ ID NO: 227085 - RNA, 64 nt, Human
cuauauggauucuucagggcccuccacaucugagguggcucauucccaucacacacagauuguc

SEQ ID NO: 227086 - RNA, 64 nt, Human
uucaaucaagguuuaauagauagggcugggcaugguggcucaugcacaccuguaauccuagcac

SEQ ID NO: 227087 - RNA, 64 nt, Human
uucaaaaguaauuggcagugauuggccaggcgcaguggcucacgccuguaaucccagcacuggg

SEQ ID NO: 227088 - RNA, 64 nt, Human
ccgucuuaaaaaagcccauggcaggcugggcgcgguggcucacgccuguaaucccagcacuuug

SEQ ID NO: 227089 - RNA, 64 nt, Human
aauuccauuuaaaaaacaaaaaccagcaggugugguggcucauggcguaaugggccugcccaau

SEQ ID NO: 227090 - RNA, 64 nt, Human
uggcagguucucccucugcccuccacugggcccaguggcucagggaccuggggaaaggagaugg

SEQ ID NO: 227091 - RNA, 57 nt, Human
gucccaacuacuucaucuaagcucauuguggcucaggcugcccaaggcuuuucuguc

SEQ ID NO: 227092 - RNA, 64 nt, Human
cugccauauaaagauaaagucuaggccaggcaugguggcucaugccuguaaucccaacacuuag

SEQ ID NO: 227093 - RNA, 64 nt, Human
ucucauuucuaaaauagggacguggccaggcacgguggcucaugccuguaaucccagcacuuug

SEQ ID NO: 227094 - RNA, 64 nt, Human; identical to SEQ ID NO: 9243

SEQ ID NO: 227095 - RNA, 64 nt, Human; identical to SEQ ID NO: 9248

SEQ ID NO: 227096 - RNA, 64 nt, Human; identical to SEQ ID NO: 9253

SEQ ID NO: 227097 - RNA, 64 nt, Human
gccagaaccugucgcuggaaaccagggcaaagcaguggcucagggcuccuugggugcaugugua

SEQ ID NO: 227098 - RNA, 64 nt, Human
agccuuggcuggaaaacugugguagagccgggcuguggcucagguaauuuuugccauuuggcca

SEQ ID NO: 227099 - RNA, 64 nt, Human
gucuugucaagaugucuaggcccggcugggcgugguggcucacaccuguaaucccagcacuuug

SEQ ID NO: 227100 - RNA, 64 nt, Human
ggcuuugaaaacaccuucauccaggcugggcgagguggcucacgccuguaaucccaguaguuug

SEQ ID NO: 227101 - RNA, 64 nt, Human
gaccccaucuuaaaaauaaagaaggcugggcgugguggcucaugccuguaaucccaacacuuug

SEQ ID NO: 227102 - RNA, 64 nt, Human
ugcagcaacuacaguuucucaacagaugguuucaguggcucaggagguaguggcagccaugguu

SEQ ID NO: 227103 - RNA, 64 nt, Human
ggcaucggucuaaagcuuugggggagugggcgcaguggcucacaccuguaaucccagcacuuug

SEQ ID NO: 227104 - RNA, 64 nt, Human
uuugaaagagauguaagguguauucauagggaugguggcucaacaaaucaagcaaacuggaauc

SEQ ID NO: 227105 - RNA, 64 nt, Human
uuuuuuaccauaccaacuucucucccaucucuagguggcucaguccauggccacucccugcccc

SEQ ID NO: 227106 - RNA, 64 nt, Human
gugcuguuuaaaaagucucagguggcugcgugugguggcucaugccuguaaucccaacauucug

SEQ ID NO: 227107 - RNA, 64 nt, Human
ccuguggucccaguuacuugggaggcugacguggguggcucacuugagcacaggaguuugaggc

SEQ ID NO: 227108 - RNA, 64 nt, Human
acaggcauuuaaaaaauuaaaaugaccaggcacaguggcucacgccuguaaucucggcacuuug

SEQ ID NO: 227109 - RNA, 64 nt, Human
ggguaguaaaaacuagagauuggggccaggcgcaguggcucacgccuguaaucccagcacuuug

SEQ ID NO: 227110 - RNA, 64 nt, Human
aguuggcacauaacauggaaccuggccaggcaugguggcucacaccuauaaccccagcacuuug

SEQ ID NO: 227111 - RNA, 64 nt, Human
gaacccacaagggaagagguggaggucaggcacgguggcucacgcuuguaaucccagcacuuug

SEQ ID NO: 227112 - RNA, 64 nt, Human
ccuagaaauuucucccuuuuuuaggcugggcaugguggcucacaccuguaaucccagcacuuug

SEQ ID NO: 227113 - RNA, 64 nt, Human; identical to SEQ ID NO: 9258

SEQ ID NO: 227114 - RNA, 64 nt, Human; identical to SEQ ID NO: 9263

SEQ ID NO: 227115 - RNA, 64 nt, Human; identical to SEQ ID NO: 9268

SEQ ID NO: 227116 - RNA, 64 nt, Human
aacacacuuaagagaaaaggauuggccgggcgcgguggcucacgccuguaaucccagcacuuug

SEQ ID NO: 227117 - RNA, 64 nt, Human
gauuuauccacauacaggaaacaggcgggacacaguggcucacgccuguaaucccaccacuuug

SEQ ID NO: 227118 - RNA, 64 nt, Human
ucuuuaaaaaucucuuguauuucauccgggcgcaguggcucacaccuguaaucccagcacuuug

SEQ ID NO: 227119 - RNA, 64 nt, Human
caucucaaaaaacauuauuuuuaaaauuagccugguggcucacgccuguaaucccagcacuuug

SEQ ID NO: 227120 - RNA, 64 nt, Human
aacuggcaagauuaacaaaauuaggccgggcaugguggcucacgccuguaaucccagcacuuug

SEQ ID NO: 227121 - RNA, 64 nt, Human
ccaugcuauaaaaacucauccauggccgggcuugguggcucacgccuguaaucccagcacuuug

SEQ ID NO: 227122 - RNA, 64 nt, Human
ccaacaguucuuagcaccccgcaggcugggcgcuguggcucacgccuguaaucccagcacuuug

SEQ ID NO: 227123 - RNA, 64 nt, Human
uuuguacagaagaggauucaaaacgccacguguaguggcucaugccuguaaucccaacacuuug

SEQ ID NO: 227124 - RNA, 64 nt, Human
acuaauuagaaaauauaguuugaggccgggcacgguggcucacgccuguaaucccaguacuugg

SEQ ID NO: 227125 - RNA, 64 nt, Human
ugcgagcauaucgacaacucucgggccaggcgcuguggcucacaccuauaaucccagcacuuua

SEQ ID NO: 227126 - RNA, 64 nt, Human
cccugcugggucucuccaacccucaccagccaagguggcucagcaccuugugucccccuccccu

SEQ ID NO: 227127 - RNA, 64 nt, Human
uuaaggaacaaaugaaaacucugggcuggguggaguggcucauaccuguaaucccagcacuuug

SEQ ID NO: 227128 - RNA, 64 nt, Human
cucuuucuaaaaugaaucuucuaggcugggcaugguggcucacaccuguaaucccuguacuuug

SEQ ID NO: 227129 - RNA, 64 nt, Human
gggaauuacagauaaacggaagccggcuggggugguggcucacgccuguaaucccaacacuuug

SEQ ID NO: 227130 - RNA, 64 nt, Human
gcucuaaagaaaagaaaacuggaggcugggcgcaguggcucacgccuauaaucccagaggcuga

SEQ ID NO: 227131 - RNA, 64 nt, Human
cuuucccuggagcugagguuuagaugugcaaccuguggcucaggggagcaagcuuacacaagaa

SEQ ID NO: 227132 - RNA, 64 nt, Human; identical to SEQ ID NO: 9273

SEQ ID NO: 227133 - RNA, 64 nt, Human; identical to SEQ ID NO: 9277

SEQ ID NO: 227134 - RNA, 64 nt, Human; identical to SEQ ID NO: 9282

SEQ ID NO: 227135 - RNA, 64 nt, Human
augaugcagagguuggaggagagagguggagacuguggcucagacccaggugugcgggcauagc

SEQ ID NO: 227136 - RNA, 64 nt, Human
ggugaauuuagcaacacuuaugaaguuucuuaaaguggcucauacacacuuaaaaggcuuaaug

SEQ ID NO: 227137 - RNA, 64 nt, Human
aaggcugcccuggggaucaacuuuccuucuguguguggcucaggaguucuucugcagagauggc

SEQ ID NO: 227138 - RNA, 64 nt, Human
aagaggaaaaaaaaaaaaaaagaggccaggcaugguggcucacgccuguaaucucagcacuuug

SEQ ID NO: 227139 - RNA, 64 nt, Human
uguuuuaagauuuuuggguccugagccagccgugguggcucacaccuguaaucccagcacuuug

SEQ ID NO: 227140 - RNA, 64 nt, Human
caucaagaauagucaaguuuuuuggccgggcaugguggcucaugccuguaaucccagcacuugg

SEQ ID NO: 227141 - RNA, 64 nt, Human
auaacaaccuaaauuugguucuaggccgggcgcgguggcucacgccuguaaucccagcacuuug

SEQ ID NO: 227142 - RNA, 64 nt, Human
uuccuuaaaggaaaguuucauuuggccgggcgcgguggcucaugccuguaaucccagcacuuug

SEQ ID NO: 227143 - RNA, 64 nt, Human
ucuccgcauccagaagggagaauuggucccuggaguggcucacuaagcucuuaaucagcaaacg

SEQ ID NO: 227144 - RNA, 64 nt, Human
ugaaaauuaugugaaaccuaaaguaguugccaaaguggcucaggguuguaaaauucauugacuu

SEQ ID NO: 227145 - RNA, 64 nt, Human
aacaugagugcacuuuacuaauccucauggcacaguggcucacgccuguaaucccagcacuugg

SEQ ID NO: 227146 - RNA, 64 nt, Human
gucuauuucauuggcauaucuccccccaguuuuuguggcucaaggcuggaauauuuaugccuua

SEQ ID NO: 227147 - RNA, 64 nt, Human
agagcaaaaggcaaaggggugggggcugggugcaguggcucacaccuguauucccaacacuuuu

SEQ ID NO: 227148 - RNA, 64 nt, Human
ugugaacagcuggccugagcugucgcuguggcuuguggcucaugcgccauuccugguugucugu

SEQ ID NO: 227149 - RNA, 64 nt, Human
uuuauuuuaaaaaguaaacaugcggcugggcgugguggcucaugccuguaaucccagcacuuug

SEQ ID NO: 227150 - RNA, 64 nt, Human
caagcuaauaaauaaaaaguugaggccgggcacgguggcucacgccuguaaucccagcacuuug

SEQ ID NO: 227151 - RNA, 64 nt, Human; identical to SEQ ID NO: 9286

SEQ ID NO: 227152 - RNA, 64 nt, Human; identical to SEQ ID NO: 9290

SEQ ID NO: 227153 - RNA, 64 nt, Human; identical to SEQ ID NO: 9295

SEQ ID NO: 227154 - RNA, 64 nt, Human
auauguuuucaaaaccauuuucaggccgggcacgguggcucaccuguaaucccagcacuuuggg

SEQ ID NO: 227155 - RNA, 64 nt, Human; identical to SEQ ID NO: 9299

SEQ ID NO: 227156 - RNA, 64 nt, Human; identical to SEQ ID NO: 9303

SEQ ID NO: 227157 - RNA, 64 nt, Human; identical to SEQ ID NO: 9308

SEQ ID NO: 227158 - RNA, 64 nt, Human; identical to SEQ ID NO: 9312

SEQ ID NO: 227159 - RNA, 64 nt, Human; identical to SEQ ID NO: 9317

SEQ ID NO: 227160 - RNA, 64 nt, Human; identical to SEQ ID NO: 9322

SEQ ID NO: 227161 - RNA, 64 nt, Human; identical to SEQ ID NO: 9327

SEQ ID NO: 227162 - RNA, 64 nt, Human; identical to SEQ ID NO: 9332

SEQ ID NO: 227163 - RNA, 64 nt, Human; identical to SEQ ID NO: 9336

SEQ ID NO: 227164 - RNA, 64 nt, Human; identical to SEQ ID NO: 9339

SEQ ID NO: 227165 - RNA, 64 nt, Human
ccccgagaagccgggggcagggugggauggggaagaccaggagcagagucgagccucacagaag

SEQ ID NO: 227166 - RNA, 64 nt, Human
ucaugcugcuccugucacccuccacgauuccacagaccaggacauuccaugugccucauggcac

SEQ ID NO: 227167 - RNA, 64 nt, Human
gccaccaugcccucugcccuugccucuugggacugaccaggagcugcucaugugcgugagagug

SEQ ID NO: 227168 - RNA, 64 nt, Human
cagacccugaguccuugggccagcucuuggcuaagaccaggaggcugcaagucuccuagaagcc

SEQ ID NO: 227169 - RNA, 64 nt, Human
ugugacaacagcagaggguacaccagggacaacagaccaggaggggcccccaccugauggaccu

SEQ ID NO: 227170 - RNA, 64 nt, Human
uucagcagauacuguccaaggcagggguacggcugaccaggaaugaagguugaacucugcuccu

SEQ ID NO: 227171 - RNA, 64 nt, Human
aagcagggguuugcaugugcuaccaacacaugauacggggaagacccacccagggagcgguuuc

SEQ ID NO: 227172 - RNA, 64 nt, Human
ggauuaaaaugccuggcgugcucaccguaacaccacggggaaggcugugugccuuuucucaucc

SEQ ID NO: 227173 - RNA, 64 nt, Human
accacccaaccuguccuuacucagagcugcgggcugagggcaucucugagugucucugccugga

SEQ ID NO: 227174 - RNA, 64 nt, Human
uccucucccauccuugaugcaagugcaaccucgcugagggcagacuggggcauccugugccacu

SEQ ID NO: 227175 - RNA, 64 nt, Human
gaagaucuuuuaaaaaggcaguaggcccggugugguggcucacgccuauaaucccagcacuuug

SEQ ID NO: 227176 - RNA, 64 nt, Human
aauuuguuuaaagauggaugaaaggccaggcaugguggcucaugccuguaaucccagcacuuug

SEQ ID NO: 227177 - RNA, 64 nt, Human
accacuuuaaaaacauaaauacuggccaggugcaguggcucaugccuguaaucccagcacuaug

SEQ ID NO: 227178 - RNA, 64 nt, Human
aucauuucaagauaggcuuagcaggaugggcgcaguggcucacgccacuaaucccaacauuuua

SEQ ID NO: 227179 - RNA, 64 nt, Human
ucucuauuuuauaaauuaaaaaaggcugggugugguggcucacacccauaaucccaacacuuug

SEQ ID NO: 227180 - RNA, 64 nt, Human
aauagugaauuauaaauaagucaggccgggcgugguggcucacaccuguaaucccagcacacug

SEQ ID NO: 227181 - RNA, 64 nt, Human
agcgugagaagccauaagagagagaccgaauucuguggcucagcacacaggacugacccacagc

SEQ ID NO: 227182 - RNA, 64 nt, Human
auccuuuaaaacuuggagaagcuggcugggcgcgguggcucacgccuguaaucccagcacuuug

SEQ ID NO: 227183 - RNA, 64 nt, Human
uauguaauguuguguacauauuauuuauaugguuguggcucaaauaaaguuuaauuccaacaca

SEQ ID NO: 227184 - RNA, 64 nt, Human
ugugguagauaguaugcaagaaaagccgggugcgguggcucaggccuguaaucccagcacuuug

SEQ ID NO: 227185 - RNA, 64 nt, Human
aguaaagucuuccauccaaaaggggcagggcacgguggcucacgccuguaaucccagcacuuug

SEQ ID NO: 227186 - RNA, 64 nt, Human
cuccuacacauaagaaaccaaaaggcugggcguaguggcucacaccuguaaucccagcacuuug

SEQ ID NO: 227187 - RNA, 64 nt, Human
ccacauuaaaaaaauuagaaaguagccacguaugguggcucaugucuauaaucccagcacuuug

SEQ ID NO: 227188 - RNA, 64 nt, Human
ucaaaauuauuugaguacuaugggaccuggcgcaguggcucaugcuuguaaucccagcacuuug

SEQ ID NO: 227189 - RNA, 64 nt, Human
uuagguuauaauuucucauuuggagccgggcgcaguggcucacgccuguaaucccagcacuuug

SEQ ID NO: 227190 - RNA, 64 nt, Human
cuacuaagaaauguuaagaaauaggccaagugcgguggcucacgccuauaauccuaucacuuug

SEQ ID NO: 227191 - RNA, 64 nt, Human; identical to SEQ ID NO: 9340

SEQ ID NO: 227192 - RNA, 64 nt, Human; identical to SEQ ID NO: 9341

SEQ ID NO: 227193 - RNA, 64 nt, Human; identical to SEQ ID NO: 9342

SEQ ID NO: 227194 - RNA, 64 nt, Human
ugcaaccuccaccucacagguucaagcgauucucguggcucagccucccuaguagcugggauua

SEQ ID NO: 227195 - RNA, 64 nt, Human
acagucauuuuuuaaauguuuuuggccgggcgugguggcucaugccuguaaucucaguacauug

SEQ ID NO: 227196 - RNA, 64 nt, Human
guggacugggccuugucacuggaggucguaggcaguggcucaucacccugguagggcugauagg

SEQ ID NO: 227197 - RNA, 64 nt, Human
gacgaggccuccccagcccugcccggugcaggagguggcucaguuauugaaccuuuugggaagc

SEQ ID NO: 227198 - RNA, 64 nt, Human
uucccaugcauugaaauuauguuggcugagcaugguggcucacaccuguaauccuagcacuuug

SEQ ID NO: 227199 - RNA, 64 nt, Human
augcucuuagaaaauucacuauuggcugggagugguggcucaugccuguaaucccagcacuugg

SEQ ID NO: 227200 - RNA, 64 nt, Human
aguccaucaaguaccucaucugcacccgguacaaguggcucaucaucaagaucgugcuggcgcu

SEQ ID NO: 227201 - RNA, 64 nt, Human
caaggaauaccacagacacccuaccgauagaacaguggcucagaucuuacuugcuccugcuuac

SEQ ID NO: 227202 - RNA, 64 nt, Human
cuauauuuguaaaccaagagaccggcugggugugguggcucacgccuguaaucccagcacuuug

SEQ ID NO: 227203 - RNA, 64 nt, Human
aagguuuaaaguggcuuuuugggggcugggugccguggcucacgccuguaaucccagcauuuug

SEQ ID NO: 227204 - RNA, 64 nt, Human
cguccuuuaaagugcugcaguauggccagacgugguggcucacaccugcaaucccagcaccuua

SEQ ID NO: 227205 - RNA, 64 nt, Human
ggguuagacuugcuggucagacccaggagcaccuguggcucacaccuucuguuccccuccuggc

SEQ ID NO: 227206 - RNA, 64 nt, Human
uaaacauuaaaauuacuaaaauaggcugggcgcgguggcucacgccuguaaccucagcacuuug

SEQ ID NO: 227207 - RNA, 64 nt, Human
ccugcucugcucagcacgggcacugccacuugguguggcucaccagggcaccagccucgcagaa

SEQ ID NO: 227208 - RNA, 64 nt, Human
aacaugguaugaagguguuuccaggccaggcgcgguggcucacgccuguaaucccaacacuuug

SEQ ID NO: 227209 - RNA, 64 nt, Human
uccccgccuggccuggcccuccccaggcggcucaguggcucaugcuguccugugagagccccug

SEQ ID NO: 227210 - RNA, 64 nt, Human
ggccaaaucucuaacacguuuuuuacuucaguagugagggcaaugagaagcuuuauuaagaaag

SEQ ID NO: 227211 - RNA, 64 nt, Human
ccuaauaagaaauccauucaagagcuaggagaucugagggcaggcgggcagcugcagggaggag

SEQ ID NO: 227212 - RNA, 64 nt, Human
guccugggcugguggcucccggagggcccugagcugagggcauugcuuacacggaugccuuccc

SEQ ID NO: 227213 - RNA, 64 nt, Human
cauuuaauuuuaggucaaauaacauuuuauuuauguggcucauuuuauauuuccuaauuuuauu

SEQ ID NO: 227214 - RNA, 64 nt, Human
uguauuaaaaagccugcauucugagcuggacaugguggcucagcuucuaaucccagcacuuugg

SEQ ID NO: 227215 - RNA, 64 nt, Human
uaguacucauuuaaaaacuagagggcuaggcuuaguggcucacgccuguaaucucagcacuuug

SEQ ID NO: 227216 - RNA, 64 nt, Human
agucccuuauauaaaaugguguaggccgggcaugguggcucacgccuguaaucccaguacuuug

SEQ ID NO: 227217 - RNA, 64 nt, Human
gccucaaaaaaugcuaaaacuuuggcugggcaugguggcucacgccuguaaucccagcacuuug

SEQ ID NO: 227218 - RNA, 64 nt, Human
uuccauaagaagacauuuugacuggcugggugcgguggcucacgcuuguaaucccagcacuuug

SEQ ID NO: 227219 - RNA, 64 nt, Human
uauuauuuaauuguaaagguagaggccagacgcaguggcucacgccuguaauuccagcacuuug

SEQ ID NO: 227220 - RNA, 64 nt, Human
agcuguugagcucggggugucuuccccaaggcauguggcucagcagcaagaaaggcaaguugcu

SEQ ID NO: 227221 - RNA, 64 nt, Human
aguuaagugggcacugaaagguaggccgggcaugguggcucaugccuguaaucccagcacuuug

SEQ ID NO: 227222 - RNA, 64 nt, Human
caugggggaaaaaaaaguccuaggagaaagcgacguggcucauuaguguugccucuucagugcu

SEQ ID NO: 227223 - RNA, 64 nt, Human
ccaguagaaauagcuaacaaaggcugggugcgcuguggcucaugccuguaauccuagcacuuug

SEQ ID NO: 227224 - RNA, 64 nt, Human
cucuacuaaaaauacaaaaauuaggccggguacaguggcucaugccuauaauuccagcacuuug

SEQ ID NO: 227225 - RNA, 64 nt, Human
ugcugagucaagauuuauauuaaggcuggaagcuguggcucacaccuguaaucccagcauuuug

SEQ ID NO: 227226 - RNA, 64 nt, Human
agacagguguuaaugcaucuaugggccaggugcaguggcucacuccuguaauccgagcaauuug

SEQ ID NO: 227227 - RNA, 64 nt, Human
gcuuccuguaguuaguccguccccugguuccccuguggcucagaggccgcgucccuggcuugua

SEQ ID NO: 227228 - RNA, 64 nt, Human
gauggaauuuaaaaguuuuaugagaccaggcacaguggcucacgacuguaauuccagcaguuua

SEQ ID NO: 227229 - RNA, 64 nt, Human
guuccucccaagaggccaggguggccagggguggugagggcaguucugcacccagccaaacaca

SEQ ID NO: 227230 - RNA, 64 nt, Human
cagcacuuugggaggccauggcggguggaacauuugagggcaugaguucgagaccagccuggcc

SEQ ID NO: 227231 - RNA, 64 nt, Human
auauaacuuuaguaaacuaaccacugucaaugauugagggcagguggcacguggggaagagggg

SEQ ID NO: 227232 - RNA, 64 nt, Human
aaagcuaaauaaaaauguagacauggcuggcgcaguggcucaugcuuguaauccuagcacuuuu

SEQ ID NO: 227233 - RNA, 64 nt, Human
uccacaaaaaaaaugaaaaauaaaccugggugcgguggcucacaccuguaaucccagcacuuug

SEQ ID NO: 227234 - RNA, 64 nt, Human
aggucaauaugugaaugcuuuuagaagcuaagcuguggcucaacucauccggacacacaccugg

SEQ ID NO: 227235 - RNA, 64 nt, Human
uguucacaguugagaaacucuccugccgggcgcgguggcucaugccuguaauuccagcacuuug

SEQ ID NO: 227236 - RNA, 64 nt, Human
uuuuugacccaguuuggaauguaucugcaauuguguggcucaacacuuuaggaaacaauagauu

SEQ ID NO: 227237 - RNA, 64 nt, Human
cccgcccuacacucagcucaugccuaaccuauguguggcucagggaccagcuuggggaaggaaa

SEQ ID NO: 227238 - RNA, 64 nt, Human
agugacaaaauccugcagauagguuuaagaccuaguggcucagagcaguagcuacugggaaguu

SEQ ID NO: 227239 - RNA, 64 nt, Human
uagcauauagaagaaaguuaauaggccgggcuugguggcucaugccuguaaucccagcacuuug

SEQ ID NO: 227240 - RNA, 64 nt, Human
agcaacaauaaaaaguagacaugggcugggugcaguggcucacuccuguagucccaggacuuug

SEQ ID NO: 227241 - RNA, 64 nt, Human
gggguguuguugucucugguggugcugcaugucuguggcucaccuuuauucuugaaacugaggu

SEQ ID NO: 227242 - RNA, 64 nt, Human
auucccagguauuggagccucuguggccuuaaauguggcucaguggagggagacccagcauagc

SEQ ID NO: 227243 - RNA, 64 nt, Human
cccauaaaaauuuuuccugaguuggccaggcaugguggcucacgccuguaaucccaacacuuug

SEQ ID NO: 227244 - RNA, 64 nt, Human
uuuguuuuuuaauucaagaaguaggcugggcccgguggcucaugccuguaauccuggcacuuug

SEQ ID NO: 227245 - RNA, 64 nt, Human
uuuucaaaagguucucugaaugugcacagaacacguggcucaaaugagaacauuugauggcuua

SEQ ID NO: 227246 - RNA, 64 nt, Human
cuauugagaaaucuaccugucguggccgggcgcaguggcucacgccuguaaucccagcacuuug

SEQ ID NO: 227247 - RNA, 64 nt, Human
caccaguaauaaagaaacauaagggcugggggugguggcucaugccuguaaucccagcacuuug

SEQ ID NO: 227248 - RNA, 64 nt, Human; identical to SEQ ID NO: 9345

SEQ ID NO: 227249 - RNA, 64 nt, Human; identical to SEQ ID NO: 9346

SEQ ID NO: 227250 - RNA, 64 nt, Human; identical to SEQ ID NO: 9347

SEQ ID NO: 227251 - RNA, 64 nt, Human
ggacauagaaaauguuuugaauaggccaggcgcaguggcucacaccuguaaucccagcacguug

SEQ ID NO: 227252 - RNA, 64 nt, Human
gccuccgcccuggcuuucucccugucuggauucaguggcucacguuggugcuacacagcuagaa

SEQ ID NO: 227253 - RNA, 64 nt, Human
aguugauuaagaaaggaaguauaggccaggcacaguggcucacaccuguaauccuugcauuuug

SEQ ID NO: 227254 - RNA, 64 nt, Human
aagccauguaaaaaguaaauaaugucugggcacaguggcucacgccuguaauccuagcacuuug

SEQ ID NO: 227255 - RNA, 64 nt, Human
agaaagucccuggucaggucucagguagugcgguguggcucagcuggguuuuuaauuagcgcau

SEQ ID NO: 227256 - RNA, 64 nt, Human
uuaaccuuaaauuuucgaguuuuggccaggcgcgguggcucacggcuguaaucccaacacuuug

SEQ ID NO: 227257 - RNA, 64 nt, Human
cugccuuuuaaauugagcaucugggccgggcaugguggcucacgccuguaaucccagcacucug

SEQ ID NO: 227258 - RNA, 64 nt, Human
auuucaauuaacaauacuuccuuggacgggugcgguggcucacgucuguaaucccagcacuuug

SEQ ID NO: 227259 - RNA, 64 nt, Human
caccugcacuaugaagugcugcuggcugggcuugguggcucagaacaaggcacugucacugccc

SEQ ID NO: 227260 - RNA, 64 nt, Human
ccguuauaaauaagaauaaaauaggccaggcacaguggcucacaccuguaaucccagcacuuug

SEQ ID NO: 227261 - RNA, 64 nt, Human
gacaauuaauuccuggucuaguuuccugggccuuguggcucagcugccacuaaagagcuuuuug

SEQ ID NO: 227262 - RNA, 64 nt, Human
accugcaggaugggccgcgccgccguggcccgcuguggcucaccacggcccaggguggccuugg

SEQ ID NO: 227263 - RNA, 64 nt, Human
gcuuuuuccuuugcuucuugagaccgggguguguguggcucagcuuccacggcguguuugguuc

SEQ ID NO: 227264 - RNA, 64 nt, Human
caccuuaagaauagguuuagcuaggcugggugugguggcucaugccuguaaucccagcacuuug

SEQ ID NO: 227265 - RNA, 64 nt, Human
ccacaaagcagggaagugggcacguucucucgggguggcucacagcuuugaaccugccaaagga

SEQ ID NO: 227266 - RNA, 64 nt, Human
uggcauggcccgaucacuguccauaagggagaaaguggcucauuccugguagaaguaugggugg

SEQ ID NO: 227267 - RNA, 64 nt, Human; identical to SEQ ID NO: 9348

SEQ ID NO: 227268 - RNA, 64 nt, Human; identical to SEQ ID NO: 9349

SEQ ID NO: 227269 - RNA, 64 nt, Human; identical to SEQ ID NO: 9350

SEQ ID NO: 227270 - RNA, 64 nt, Human
aauuuuaggauugaaauaguucaggccgggcgcaguggcucaugccuguaaucccagcacuuug

SEQ ID NO: 227271 - RNA, 64 nt, Human
aggugagaaugaaaguggaucucagcugggcacgguggcucacgccuguaauccuagcaccuug

SEQ ID NO: 227272 - RNA, 64 nt, Human
aauaagcuuaaacaaauaacuuuggccgggcacgguggcucacaccuauaaucccagcacuaug

SEQ ID NO: 227273 - RNA, 64 nt, Human
uuucaggaaucaaaagauaaaggggccgggugugguggcucacaccuguaaucccagcacuuug

SEQ ID NO: 227274 - RNA, 64 nt, Human
acaccaguggaacuggagccucuggcugggcacaguggcucacuuugggaggcugaggcaggaa

SEQ ID NO: 227275 - RNA, 64 nt, Human
uacagaggaacgccggaaguuguuugagcaagagguggcucaacgggaggcucagaaacaacag

SEQ ID NO: 227276 - RNA, 64 nt, Human
cuucuucaagaagaagcuugccaggccgggcacgguggcucacgccuauaaucccagcacuuug

SEQ ID NO: 227277 - RNA, 64 nt, Human
aguaugucuuggaccuggaaaguuggacauguguguggcucaacaguuuucucgggggaguuca

SEQ ID NO: 227278 - RNA, 64 nt, Human
uguaaauuaguaguugaaauucuaggccggugcgguggcucaugccuguaaucccagcacugua

SEQ ID NO: 227279 - RNA, 64 nt, Human
agaaauuagaaaaucaagcuuugggccaggugcgguggcucaugccuguaaucccagcacuaug

SEQ ID NO: 227280 - RNA, 64 nt, Human
cacuaaucauuaccuauguuaaagcucccaccugguggcucauuuuucauagcauuccuugugu

SEQ ID NO: 227281 - RNA, 64 nt, Human
gaauuuuaaauacaagaguuugagauuggguauaguggcucacaccuguaaucacagcacuuug

SEQ ID NO: 227282 - RNA, 64 nt, Human
uucacaagccagcuguuggguuugcuaugucacuguggcucagucacaucccugcguguauacu

SEQ ID NO: 227283 - RNA, 64 nt, Human
ggggaugugggaagcagcauuguccucugggcauguggcucagagguaucacagugacaaaaga

SEQ ID NO: 227284 - RNA, 64 nt, Human
aguucaaaaauuccaugaaucuuggccaggcaugguggcucaugccuguaaucccaccacuuug

SEQ ID NO: 227285 - RNA, 64 nt, Human
gcagugaaagaguuuuauuuuccagccaggcgcaguggcucaaaucccagcacuucgggaggcu

SEQ ID NO: 227286 - RNA, 64 nt, Human; identical to SEQ ID NO: 9351

SEQ ID NO: 227287 - RNA, 64 nt, Human; identical to SEQ ID NO: 9352

SEQ ID NO: 227288 - RNA, 64 nt, Human; identical to SEQ ID NO: 9353

SEQ ID NO: 227289 - RNA, 64 nt, Human
aaggacagggccucaggucucccccuuacaaggcguggcucauggccugcauuccagagaccaa

SEQ ID NO: 227290 - RNA, 64 nt, Human
acugaggucauaaucagaagcuaagcugggugcaguggcucaugccaguuaucccagcacuuug

SEQ ID NO: 227291 - RNA, 64 nt, Human
uaaauuaauuuguacaaaaagaacucuuuauaagguggcucauuguaggaaauccugugccuuc

SEQ ID NO: 227292 - RNA, 64 nt, Human
ggcaccacuaaaagaucgcaguuugccuggugcaguggcucacaccuguaaucccaacauuuug

SEQ ID NO: 227293 - RNA, 64 nt, Human
auggauaugauuucaaaaaauagggccgggcgcgguggcucacgccuguaaucccagcacuuug

SEQ ID NO: 227294 - RNA, 64 nt, Human
uucagccauaaaaagaaauaaagggccaggcacaguggcucacaccuguaaucccagcacuuug

SEQ ID NO: 227295 - RNA, 64 nt, Human
gccuccuagaaaaugcuguuuguggccgggcgcgguggcucacgccuguaaucccagcacuuug

SEQ ID NO: 227296 - RNA, 64 nt, Human
uuccacugaacaaaaccuacgcacauaccuucauguggcucagugccuuccucucucuaccagu

SEQ ID NO: 227297 - RNA, 64 nt, Human
ggccucaggaucuugugccuggaaauagccugagguggcucaggaagcggagaaagggugccag

SEQ ID NO: 227298 - RNA, 64 nt, Human
gauagccuaauaaauggagguggggccaggcaugguggcucacacguguaaucccaacacuuug

SEQ ID NO: 227299 - RNA, 64 nt, Human
agccccaagccugagaggcuggagcccauggcuaguggcucauccccacugcauucucccccug

SEQ ID NO: 227300 - RNA, 64 nt, Human
ugugccugggccugcccugugccugcacacaggaguggcucauggcguuugcccuacacggaug

SEQ ID NO: 227301 - RNA, 64 nt, Human
ccacugcaucugcugcacaguugaacgaugggcaguggcucacccccacuccuuuauuucagca

SEQ ID NO: 227302 - RNA, 64 nt, Human
ggcugggggucuccugccucuccuggugucgccgguggcucauuuucuggcaaauggaggcacg

SEQ ID NO: 227303 - RNA, 64 nt, Human
ugcuuaaaaaaaaaaaugucaauagccaggcauaguggcucacgccuguaaucccagcacuuua

SEQ ID NO: 227304 - RNA, 64 nt, Human
aaaguauaaaaguauaugggguaggccgggugcaguggcucacgccuguaaucccagcacuuug

SEQ ID NO: 227305 - RNA, 64 nt, Human; identical to SEQ ID NO: 9354

SEQ ID NO: 227306 - RNA, 64 nt, Human; identical to SEQ ID NO: 9355

SEQ ID NO: 227307 - RNA, 64 nt, Human; identical to SEQ ID NO: 9356

SEQ ID NO: 227308 - RNA, 64 nt, Human
uauagauuaagaauugaugagguagcugggcacaguggcucacaccuacgaucacagcacuucg

SEQ ID NO: 227309 - RNA, 64 nt, Human
ggaaauccgaaauuacuaauccaggccaggugugguggcucaugccuguaaucccagcacuuug

SEQ ID NO: 227310 - RNA, 64 nt, Human
caguuuuuaaaaaauugcuuguaggcugagcgcgguggcucacgccuguaaucccagcacuuug

SEQ ID NO: 227311 - RNA, 64 nt, Human
cucuuuaaagagaauaaauagagggccaggugugguggcucacgccugugaucccagcacuuug

SEQ ID NO: 227312 - RNA, 64 nt, Human
agaaauauauuugucacuuauaccuaaaauaugaguggcucauuuuugcauuacucucuucuag

SEQ ID NO: 227313 - RNA, 64 nt, Human
ugaaagcauaaaagaaaaaucuaggccgggugcaguggcucaugccuauauucccugcacuuug

SEQ ID NO: 227314 - RNA, 64 nt, Human
cacaguuauaaaagaaacccugaggccgggcgcgguggcucaagccuguaaccccagcacuuug

SEQ ID NO: 227315 - RNA, 64 nt, Human
ggaagcgagaacgaaaucucucauugugugccguguggcucaaaaccgaaaacaaugaagcuug

SEQ ID NO: 227316 - RNA, 64 nt, Human
uuuauuuaaaacacaauuuauuuggccgggcacgguggcucacaccuguaaucucagcacuuug

SEQ ID NO: 227317 - RNA, 64 nt, Human
ggccgugagggcgauugcuuuguggugauucucaguggcucaucuaauauuuuggcuggaauaa

SEQ ID NO: 227318 - RNA, 64 nt, Human
gucaggccuugcccuucccaccagcaugucccucguggcucagggugccccaggccugcccagc

SEQ ID NO: 227319 - RNA, 64 nt, Human
cuagagggaauaccagaguuagcuggguauagagguggcucaaaggaaguguccgugggcaggg

SEQ ID NO: 227320 - RNA, 64 nt, Human
aauuaauguaagagauaggaagaggccagguguaguggcucaugccuguaauccuagcacuuug

SEQ ID NO: 227321 - RNA, 64 nt, Human
uuaaaagaugaaagagggaaauaggccauggacgguggcucacgccuguaaucccagcacuuua

SEQ ID NO: 227322 - RNA, 64 nt, Human
ugugacgagacugcacaagacaaagcucaggcaaguggcucaguaguuggccagcccagcaggg

SEQ ID NO: 227323 - RNA, 64 nt, Human
uuuuuuuuuuuuaagugaaagcaggccaggugcgguggcucacgccuguaaucccagcccuuug

SEQ ID NO: 227324 - RNA, 64 nt, Human; identical to SEQ ID NO: 9357

SEQ ID NO: 227325 - RNA, 64 nt, Human; identical to SEQ ID NO: 9358

SEQ ID NO: 227326 - RNA, 64 nt, Human; identical to SEQ ID NO: 9359

SEQ ID NO: 227327 - RNA, 64 nt, Human
acagcaguaugaaaagauaaauaggccaggcaugguggcucacgccugugaucccagcacuuug

SEQ ID NO: 227328 - RNA, 64 nt, Human
aaugacuuuauuaaaauaauuuccaagauuauuuguggcucaccugaaggcuuugcaaaauuug

SEQ ID NO: 227329 - RNA, 64 nt, Human
aaccaugcaaaagaaauuaauuuggccaggcacaguggcucaugccuguaaucccagcacuuug

SEQ ID NO: 227330 - RNA, 64 nt, Human
agguaccgcuuaagccauuuuuuucuuaacaucgguggcucaguuaaggaaugagaagauagag

SEQ ID NO: 227331 - RNA, 64 nt, Human
aucuuuaugaagaaauuaaacuagguugggcaugguggcucacaccuauaaucccagcacuuug

SEQ ID NO: 227332 - RNA, 64 nt, Human
cacugcauuaaaaaaugaguuugggcugggcaugguggcucacaccuauaaucccaacacuuuc

SEQ ID NO: 227333 - RNA, 64 nt, Human
acggagucuccugaccuaaucuuagcccggcgcaguggcucacgucuguaaucccagcacuuug

SEQ ID NO: 227334 - RNA, 64 nt, Human
ucauuggucuugaaaguaauuuuggcuggucgcgguggcucacgccuguaaucccagcacuuug

SEQ ID NO: 227335 - RNA, 64 nt, Human
augacuccuccaagaugaaaauggaccagccgcaguggcucacgccuguaauaccagcacuuug

SEQ ID NO: 227336 - RNA, 64 nt, Human
uuuaaaaaauaauagccauguugggccaggcgugguggcucaugccuguaaucugagcacuuug

SEQ ID NO: 227337 - RNA, 64 nt, Human
aauuccuuuuaaauuuucuuagagaaauuucucuguggcucaguuuuaccacccauaaagcgga

SEQ ID NO: 227338 - RNA, 64 nt, Human
gcaaauguuuauuuaaaagagcaggccaggcgcgguggcucacgccuguaaucccagcacuuug

SEQ ID NO: 227339 - RNA, 64 nt, Human
auuuuuuauaaguagaaagaauuggccaggcaugguggcucaugccuguaaucccagcacuuug

SEQ ID NO: 227340 - RNA, 64 nt, Human
aacacuucaaagggauacaucauggccaggcaugguggcucacaccuguaauccaagcacuuug

SEQ ID NO: 227341 - RNA, 64 nt, Human
aacacugccaaaguaaaacauuaggucaggcaugguggcucaggccuguaaucccagcauuuug

SEQ ID NO: 227342 - RNA, 64 nt, Human
uuaaauggucaauagaaaaaguaggcugggcgcgguggcucacgccuguaaucccagcacuuug

SEQ ID NO: 227343 - RNA, 61 nt, Human; identical to SEQ ID NO: 9321

SEQ ID NO: 227344 - RNA, 64 nt, Human; identical to SEQ ID NO: 9360

SEQ ID NO: 227345 - RNA, 64 nt, Human; identical to SEQ ID NO: 9361

SEQ ID NO: 227346 - RNA, 64 nt, Human
uuuuaaggauaaaaacuaacauuggccaggcacgguggcucacgccuguaaucccaacacuuua

SEQ ID NO: 227347 - RNA, 64 nt, Human
gucagguauuuaaaauguuacauaugccggcgcaguggcucauguguguaaucccagcacucug

SEQ ID NO: 227348 - RNA, 64 nt, Human
aaauacaaaaaauacaaaaaauuagccgggcgcgguggcucacaccuguaaucccagcacuuug

SEQ ID NO: 227349 - RNA, 64 nt, Human
aauccaaagaaaaagggcugccgggccaggcgcgguggcucacgccuguaaucccagcacuuug

SEQ ID NO: 227350 - RNA, 64 nt, Human
ggauagcugauuuuaaaacacucggcugggcacaguggcucacaccuguaaucccagcacuuug

SEQ ID NO: 227351 - RNA, 64 nt, Human
cuuucuagauauaaggucuuugaggcagggcucaguggcucauuccuguaaucccagcacuuug

SEQ ID NO: 227352 - RNA, 64 nt, Human
auuucguagcuaaagaaugccauggccgggugcaguggcucacgccuauaaucccagcacuuug

SEQ ID NO: 227353 - RNA, 64 nt, Human
ggauuuacauuggaagugcuguagacuucuuuauguggcucaguggagagagggaaagaauguu

SEQ ID NO: 227354 - RNA, 64 nt, Human
ucuguauuauuaauagcaaccagggccgggugucguggcucacgccugucaucccagcacuuug

SEQ ID NO: 227355 - RNA, 64 nt, Human
uuuggccccauuaagaauuaagaggcugggugcgguggcucacgucuguaaucccagcaccuug

SEQ ID NO: 227356 - RNA, 64 nt, Human
ucugcugaagacuuucuauggaacccagcaucauguggcucagucucugauugccaacucuucc

SEQ ID NO: 227357 - RNA, 64 nt, Human
acccuuagaaggauggcucugguggccgggcgcgguggcucaaaccuguaaucccagcacuuug

SEQ ID NO: 227358 - RNA, 64 nt, Human
acuguuuuaaaauuacggugauuggccaggugcaguggcucacaccuguaaucccagcacuuug

SEQ ID NO: 227359 - RNA, 64 nt, Human
gcauuuaagaauggcaaacacucggcugggcacaguggcucacgucuguaaucuuugggagcac

SEQ ID NO: 227360 - RNA, 64 nt, Human
acagaaugguggagagaaaagagaaugcugaaaaguggcucagaugcagaguguucuguggaga

SEQ ID NO: 227361 - RNA, 64 nt, Human
augcugucaaaaucauggacaaaggcugggugcaguggcucaugccuauaaucccagcacuuug

SEQ ID NO: 227362 - RNA, 64 nt, Human
cggccgauggagacaccaaccgacaggcccuggcugagggcagcugcgcgggcuuauuuauuaa

SEQ ID NO: 227363 - RNA, 64 nt, Human
ccuuagccagaccccuguugauagaccagauacuugagggcaaacuguuugcuccuccucuuga

SEQ ID NO: 227364 - RNA, 64 nt, Human
ucacuggagccaggugacuuccuccuugcgugagugagggcacaggaaucucaaaauuaaaccu

SEQ ID NO: 227365 - RNA, 64 nt, Human
uaaagauccaaacugagaaagcaggccgggcaugguggcucaugccuguaaucccaacacuuug

SEQ ID NO: 227366 - RNA, 64 nt, Human
ucaagggcaauaagaaaauuugaggccgggugugguggcucacgccuguaaucccagcacuuug

SEQ ID NO: 227367 - RNA, 64 nt, Human
gacccccauauaaacaacccuugaggccggugugguggcucacggcuguaauccuggcacuuug

SEQ ID NO: 227368 - RNA, 64 nt, Human
aaacucauuucaagaugaaaauggaccagccgcaguggcucacgccuguaauaccagcacuuug

SEQ ID NO: 227369 - RNA, 64 nt, Human
cauuuguuuagaaaaccacuuaugacugggugcgguggcucacaccuguaaucccagcacuuug

SEQ ID NO: 227370 - RNA, 64 nt, Human
auuuaucaauacuuaugaaauuaggcugggcgcuguggcucacaccuguaaucccaacacuuug

SEQ ID NO: 227371 - RNA, 64 nt, Human
agagagaaaauaaaagaaaaaccagccaggcacaguggcucacaccuguaaucccagcgcuuug

SEQ ID NO: 227372 - RNA, 64 nt, Human
uuaccguuuagaaauucuaguccucaauaaguggguggcucaugcuauuguuguuccuaaagcu

SEQ ID NO: 227373 - RNA, 64 nt, Human
aggccuuucuaagauacuccuccagccgggcgcgguggcucacgccuguaaucccagcacuuug

SEQ ID NO: 227374 - RNA, 64 nt, Human
aaauacagugcauuuaagacauaggcugggcaugguggcucaugccuguaaucccagcacauug

SEQ ID NO: 227375 - RNA, 64 nt, Human
uggacacucugcuuuugauugccuaucccuauaaguggcucauuuuacugucuucugauccugg

SEQ ID NO: 227376 - RNA, 64 nt, Human
gcgcuuuagaaagcauuguuuuaguccaggcacaguggcucacgccuguaaucccagcacuuug

SEQ ID NO: 227377 - RNA, 64 nt, Human
cucuacaaaaaaaauuuaaaauuagccaggcgugguggcucaugcuuguggucccagcuguuca

SEQ ID NO: 227378 - RNA, 64 nt, Human
cucccuuaaaucaccccaaccuuggccaggcaugguggcucacaccuguaaucccagcacuuug

SEQ ID NO: 227379 - RNA, 64 nt, Human
auugaaaacagccucuagcuucaggcugggcacgguggcucacagcuauaaucucagcacuuug

SEQ ID NO: 227380 - RNA, 64 nt, Human
ccccuuacaagaccucuggcuugggccgggcgugguggcucacaccuguaaucccaacacuuug

SEQ ID NO: 227381 - RNA, 64 nt, Human
uagaucuacacucucgaguuaaagauggggaaacugagggcagagagguuaacagauuuaucua

SEQ ID NO: 227382 - RNA, 64 nt, Human
uuaaaugcgguguagcaaaguuauggggucugcuugagggcacuaaccucaacagauuauuccu

SEQ ID NO: 227383 - RNA, 64 nt, Human
gccgagauaggcggauugcuugagcccaggaguuugagggcagccugggaaacauggcuaaauc

SEQ ID NO: 227384 - RNA, 64 nt, Human
uucuauuaagaauacaaaugcugggcugggcacaguggcucacgccuguaaucccaacaccuug

SEQ ID NO: 227385 - RNA, 64 nt, Human
uuagaguugacauaaaaauugauggccaggcaugguggcucacgccuguaaucccagaacuaug

SEQ ID NO: 227386 - RNA, 64 nt, Human
uuuuaaaugaagaaagugaaguaggccgggcacgguggcucacgccuguaaucccagcacuuug

SEQ ID NO: 227387 - RNA, 64 nt, Human
uuauauguaaauaauaagccaucuaaguguaaaaguggcucauaucuucuccagccaaaucagc

SEQ ID NO: 227388 - RNA, 64 nt, Human
uaauuaauaaagauacgaguuuuggccgggugcgguggcucacgccuguaaucccagcacuuug

SEQ ID NO: 227389 - RNA, 64 nt, Human
auuacagaauaaacuuggauuuuggccaggcgcgguggcucaggccuguaaucccagcucugga

SEQ ID NO: 227390 - RNA, 64 nt, Human
aggagcuguagacugggaagagaggccaggcgugguggcucacuccuguaaucccagcacuuug

SEQ ID NO: 227391 - RNA, 64 nt, Human
cuacuuaaauacaaaacuggacaggccaggcaugguggcucaugccuguaaucccagcacuuug

SEQ ID NO: 227392 - RNA, 64 nt, Human
uacuacaggacagaaaccacuuaguuuuuaauaaguggcucaguauuacaauugcagcgaugcc

SEQ ID NO: 227393 - RNA, 64 nt, Human
gaguaacuaaaaacuguauugcuggccgggcgcgguggcucacgccuguaaucccagcacuuug

SEQ ID NO: 227394 - RNA, 64 nt, Human
caucucagaaaauaaaaaauaggggccaggcacaguggcucauaccuguaaugccagcacuuug

SEQ ID NO: 227395 - RNA, 64 nt, Human
aggcuuuuuaaaaagcacauacagaccaggcgugguggcucaugccuauaaucccagcacuuug

SEQ ID NO: 227396 - RNA, 64 nt, Human
cuuacaaauuaaaaugacuuuuaggcugggugcaguggcucacaccuguaaucccagcacuuug

SEQ ID NO: 227397 - RNA, 64 nt, Human
ccuggaacaggucuccaaucuauguuagcacuauguggcucagccucuguuaccccuuggauua

SEQ ID NO: 227398 - RNA, 64 nt, Human
guccaauuacuaguuaaaacacuggcggggugcgguggcucacgccuguaauccuagcacuuug

SEQ ID NO: 227399 - RNA, 64 nt, Human
agcugucucaauuugagaauaccagcugggcacgguggcucacgccuguaaucccagcacuuac

SEQ ID NO: 227400 - RNA, 64 nt, Human
gcugucucaucacauaaaaggcuucacuuuugacugagggcagcuuugcaaaaugagacuuucu

SEQ ID NO: 227401 - RNA, 64 nt, Human
cucaucaagcuccucuccucaucuuuuuugugugugagggcaggucuugacucuaggucucagc

SEQ ID NO: 227402 - RNA, 64 nt, Human
aagagacaacgaaugugaaucaugcuugcagguuugagggcacaguguuugcuaaugauguguu

SEQ ID NO: 227403 - RNA, 64 nt, Human
uauuugaagaauaaguaauucuuggcugggcaugguggcucacgccuguaauuccagugcuuug

SEQ ID NO: 227404 - RNA, 64 nt, Human
aaccaucaaaguuacuaaaacauggccaggcgcaguggcucaugccuguaaucccagcacuuug

SEQ ID NO: 227405 - RNA, 64 nt, Human
ugagggacucccuccucuucagagaagcccuccuguggcucaggggcagcugcagggccagaug

SEQ ID NO: 227406 - RNA, 64 nt, Human
cauguuaggaagguacugucaugggcuaggcaugguggcucacaccuguaaucccagcauuuug

SEQ ID NO: 227407 - RNA, 64 nt, Human
cugcauuuaacagucuaauuugaggcugggugcaguggcucacaccuguaaucucaacacuuug

SEQ ID NO: 227408 - RNA, 64 nt, Human
uuuugugguaaaaaaagguuuuaggccaggcgccguggcucacgccuguaauccaacacuuuga

SEQ ID NO: 227409 - RNA, 64 nt, Human
ugucacccugucccacugaggucagaguccuacaguggcucaugcagccacaggucaccuucug

SEQ ID NO: 227410 - RNA, 64 nt, Human
auccuuuuaaaaguacaggcauuggccuggugcaguggcucauuccuguaaucccagcacuuug

SEQ ID NO: 227411 - RNA, 64 nt, Human
cacgccucugcccaucuggaggccugaguaaggaguggcucagccccacguucccacacugcuc

SEQ ID NO: 227412 - RNA, 64 nt, Human
aguggaaagaauugugaaaauuggguugggcgccguggcucacaccuguaauccuagcgcuuug

SEQ ID NO: 227413 - RNA, 64 nt, Human
gcuuuugaaaaucgcacaaagcaggccaggcacgguggcucacgccuguaaucccagcauuuug

SEQ ID NO: 227414 - RNA, 64 nt, Human
accacaccaccccuaaagugccaggugaucuccuguggcucaucgguggaagcagugggguagg

SEQ ID NO: 227415 - RNA, 64 nt, Human
caggaaauaaagcaaaagaagagggucaggcuugguggcucaugccuauaauccuggcauuuua

SEQ ID NO: 227416 - RNA, 64 nt, Human
gugcagauauuuaugaaguggugaaauuucaaguguggcucacuagguacuucaggccuucuug

SEQ ID NO: 227417 - RNA, 64 nt, Human
ccugcaaaagaaaaaugcgaagcggccgggcacgguggcucaugccuguaaucccagcacuuug

SEQ ID NO: 227418 - RNA, 64 nt, Human
caaggaaagacagcagugaugacacugucugucuguggcucaauuucagucuucacagggauag

SEQ ID NO: 227419 - RNA, 64 nt, Human; identical to SEQ ID NO: 9338

SEQ ID NO: 227420 - RNA, 64 nt, Human; identical to SEQ ID NO: 9343

SEQ ID NO: 227421 - RNA, 64 nt, Human; identical to SEQ ID NO: 9344

SEQ ID NO: 227422 - RNA, 64 nt, Human
aucacaguaaaaaggcuacugucgacuggacacaguggcucacacauguaaucacagcacuuug

SEQ ID NO: 227423 - RNA, 64 nt, Human
cucaaacucuauauagaacucucggccgggcgcgguggcucacaccuguaaucaaaacacuuug

SEQ ID NO: 227424 - RNA, 64 nt, Human
cguuuguuauauaaaaauaccccggccaggcacgguggcucacgccuguaaucccagcacuuug

SEQ ID NO: 227425 - RNA, 64 nt, Human
gggcuguauuuuugaaauacucuacaagaaagcuguggcucaacacaugagaagaagcacgaag

SEQ ID NO: 227426 - RNA, 64 nt, Human
accuauacuuaaaaacauaugguggccaggcaugguggcucacgccuguaaugcuagcacuuug

SEQ ID NO: 227427 - RNA, 64 nt, Human
gcaagagugcacugacuccgagccgagggcaggaguggcucaacuuggucucgucuugcacuua

SEQ ID NO: 227428 - RNA, 64 nt, Human
gcaguggcaaaaauggaaacacugacccggugcgguggcucaugccuguaaucccagcacuuug

SEQ ID NO: 227429 - RNA, 64 nt, Human
gggggagggccugugggcacacauggcagagagaguggcucacacgucgugaggucuccccugu

SEQ ID NO: 227430 - RNA, 64 nt, Human
cuuauuugucuuuugaaaauuaaggcugggcgcgguggcucacaccuguaaucccagcacuuug

SEQ ID NO: 227431 - RNA, 64 nt, Human
ggaauauugaaaauguaggcagcaacugggcaugguggcucacugucuguaauguauuaccuga

SEQ ID NO: 227432 - RNA, 64 nt, Human
ccaacccucugccaguuuggccccucagagcuugguggcucaagacuguuagccuggcagagcc

SEQ ID NO: 227433 - RNA, 64 nt, Human
ugcaguaaaaaaaaaguucucugggccgggcgugguggcucacaccuguaaucccagcaccuug

SEQ ID NO: 227434 - RNA, 64 nt, Human
ggccucucagcccgccccguguggccgcccggguguggcucagccauguccccuccccaggucc

SEQ ID NO: 227435 - RNA, 64 nt, Human
ggugaucuaaaauaacuuuuuugggcugggugcaguggcucaugccuauaaucuuagcacuuug

SEQ ID NO: 227436 - RNA, 64 nt, Human
auaacuuuaauaauauucaaaaguugacucuccuguggcucaugccacaggaucccagcacuuu

SEQ ID NO: 227437 - RNA, 64 nt, Human
gucaacaguaaaaaauaaccaguggccaggcaugguggcucaugccuguaaucccagcacuuuu

SEQ ID NO: 227438 - RNA, 64 nt, Human; identical to SEQ ID NO: 9335

SEQ ID NO: 227439 - RNA, 64 nt, Human
uggugcuguucuccaguucacgucugccagcuggugagggcagaggcagaccuggucagaccca

SEQ ID NO: 227440 - RNA, 64 nt, Human
uuuuagacugcaaguugaaaaaaauaaaaagaaaugagggcagguuccagggccugaaauguag

SEQ ID NO: 227441 - RNA, 64 nt, Human
cacaaauuaaaacuggguuuccaggccuggugugguggcucacgccuguagccccagcuauugc

SEQ ID NO: 227442 - RNA, 64 nt, Human
aggcuuuuaaaaacuuucaucuaggccacgugcgguggcucaugccuguaaucccggcacuuug

SEQ ID NO: 227443 - RNA, 64 nt, Human
gguaaacauaaagaagauacacaggccgggcaugguggcucacaccuguaaucccagcacuuug

SEQ ID NO: 227444 - RNA, 64 nt, Human
uuugcccucuagaaagcaacugaggccaggugcgguggcucacgccuguaaucccagcacuuug

SEQ ID NO: 227445 - RNA, 64 nt, Human
auugcaagagggagcucaaucuuggccgggcgccguggcucacgccuguaaucgcagcacuuug

SEQ ID NO: 227446 - RNA, 64 nt, Human
aguauuaaaaaaaaaccaggcucugccaggcgcaguggcucaugccuauaaucccggcacuuug

SEQ ID NO: 227447 - RNA, 64 nt, Human
gcguauuagaagacuuguauuuuuugaaacucuuguggcucagagauaacccuuggagauguga

SEQ ID NO: 227448 - RNA, 64 nt, Human
caucucgcuaaagagugaauguaggccaggcgcgguggcucaugccuguaaucccagcacuuug

SEQ ID NO: 227449 - RNA, 64 nt, Human
auugauuucaaguaccauacuguaguacagauaaguggcucaguugagcacagcuauauuuuaa

SEQ ID NO: 227450 - RNA, 64 nt, Human
uuugaaaaaucucauuauuucugggccgggcaugguggcucaccccuguaaucccagcacuuug

SEQ ID NO: 227451 - RNA, 64 nt, Human
ugaauccaaacuaauccaucaccggggugguuuaguggcucaacauuguguucccauuucagcu

SEQ ID NO: 227452 - RNA, 64 nt, Human
cuuaaaaaaaaaaaaaaaaguuuggccgggugcgguggcucacgccuguaaucccagcacuuug

SEQ ID NO: 227453 - RNA, 64 nt, Human
auugccugggcaaggccuguuuaggccgguugcgguggcucaugccuguaauccuagcacuuug

SEQ ID NO: 227454 - RNA, 64 nt, Human
caacuacagaaauauauuuuauuggccgggugcgguggcucaugccuauaaucccagcacuuug

SEQ ID NO: 227455 - RNA, 64 nt, Human
cuguucauuuuaacaacauacagggcugggcacgguggcucacgccuguaaucccagcacuuug

SEQ ID NO: 227456 - RNA, 64 nt, Human
aaagcguccucuuaauuggcacccgaauguugcuguggcucagucacauaucccagggcccucg

SEQ ID NO: 227457 - RNA, 64 nt, Human; identical to SEQ ID NO: 9291

SEQ ID NO: 227458 - RNA, 64 nt, Human; identical to SEQ ID NO: 9292

SEQ ID NO: 227459 - RNA, 64 nt, Human; identical to SEQ ID NO: 9293

SEQ ID NO: 227460 - RNA, 64 nt, Human
uucuagauugggaaacgaagcucugcugggcgugguggcucacaccugugaguggcucccagca

SEQ ID NO: 227461 - RNA, 64 nt, Human
cugucucaucaaaaacugaaguuagcugggugugguggcucaugccuguaaucccagcacuuug

SEQ ID NO: 227462 - RNA, 64 nt, Human
cugaaguuagaaacaagguuaauagccaggcaugguggcucaugccuguaaucccagcacuuug

SEQ ID NO: 227463 - RNA, 64 nt, Human
ucccuuuaagaaauuacagggccagccgggcaugguggcucacgcccguaaucccagggcuuug

SEQ ID NO: 227464 - RNA, 64 nt, Human
uuuggaggcauauggagaagggggcccaggcgagguggcucacaccuguaaucccagcacuuug

SEQ ID NO: 227465 - RNA, 64 nt, Human
cuaagaguugcuggcaagaagauggccgggcgugguggcucaugccuguaauuccagcacuuug

SEQ ID NO: 227466 - RNA, 64 nt, Human
uauguucccaauuaccaagggguggccgggcacaguggcucacgccuguaaucccagcacuuug

SEQ ID NO: 227467 - RNA, 64 nt, Human
uguccuuaaaaaugaauugaccuggccgggcgcgguggcucacgccuguaaucccagcacuuug

SEQ ID NO: 227468 - RNA, 64 nt, Human
agauuucuuaaaauauuacuuuuggccgagcaugguggcucaccccuguaauuccagcacuuug

SEQ ID NO: 227469 - RNA, 64 nt, Human
auucccgugaaguuccacaaccaggccgggcaugguggcucaugccuguaaucccagcacuuug

SEQ ID NO: 227470 - RNA, 64 nt, Human
cauaguuuaauuaugccuuuuuugaucaggcacaguggcucacgccuguaauccuagcaguuug

SEQ ID NO: 227471 - RNA, 64 nt, Human
cugcuccucgcuugaaugauucagggucagggagguggcucagaguccaccucucauugcugau

SEQ ID NO: 227472 - RNA, 64 nt, Human
agugcacguccacagugccauaccacggggcaugguggcucaugccuguaaucccagcacuuug

SEQ ID NO: 227473 - RNA, 64 nt, Human
gagacaaaaaauuugaagugccuggcugggcgugguggcucacgccuguaaucccagcacuuug

SEQ ID NO: 227474 - RNA, 64 nt, Human
aucucaaaaaaaaaagaguucuagcccaggagcgguggcucacacuuguaaucccagcacuuug

SEQ ID NO: 227475 - RNA, 64 nt, Human
cuucauucucuauaagaguucuaggcggggcgugguggcucacacuuguaaucccagcacuuug

SEQ ID NO: 227476 - RNA, 64 nt, Human; identical to SEQ ID NO: 9294

SEQ ID NO: 227477 - RNA, 64 nt, Human; identical to SEQ ID NO: 9296

SEQ ID NO: 227478 - RNA, 64 nt, Human; identical to SEQ ID NO: 9297

SEQ ID NO: 227479 - RNA, 64 nt, Human
uagugguuuaauaggcuugcuauguaaguagaacguggcucaacuagauaucuuuauauguaug

SEQ ID NO: 227480 - RNA, 64 nt, Human
guguucauaacaaagaaagguugugccgggcacgguggcucacaccuguaaucccagcccuuug

SEQ ID NO: 227481 - RNA, 64 nt, Human
ccugucucaaaaaaaugcagacuggccaggcacaguggcucacaccuguaauccgacuguaagc

SEQ ID NO: 227482 - RNA, 64 nt, Human
uugggcugcuuguuaaaaaugcaggccaggugcgguggcucacaccuguaaucccagcgcuuug

SEQ ID NO: 227483 - RNA, 64 nt, Human
cagccauaaaaaggaacaagacugacugggcgugguggcucaugccugugauccuagcacuuug

SEQ ID NO: 227484 - RNA, 64 nt, Human
uucagauuaaaauagaagcagcuggccgggugcgguggcucacgccuguaaucccagcacuuug

SEQ ID NO: 227485 - RNA, 64 nt, Human
gcuucccagcguaugaaauucuaagcugggugggguggcucacacccgacguaaucccagcacg

SEQ ID NO: 227486 - RNA, 64 nt, Human
ccuguccuugugggugaugaucacugugcugcuuguggcucauggcagagcauucagugccacg

SEQ ID NO: 227487 - RNA, 64 nt, Human
ggaagaaagcccauucaugacuuagaguccugccguggcucagguggaucuaaaacucaagaac

SEQ ID NO: 227488 - RNA, 64 nt, Human
uggugauugauuuggaggggggaaaaagggcaggguggcucaggcuuuaggcccagguacuggg

SEQ ID NO: 227489 - RNA, 64 nt, Human
gacccagaggguggagcucuucuuaccagccaccguggcucagccagagaggagcugagcccug

SEQ ID NO: 227490 - RNA, 64 nt, Human
uucagaagguggucauuucccuuggccgggcgcgguggcucacaccuguaaucccagcacuuug

SEQ ID NO: 227491 - RNA, 64 nt, Human
guuauaaauaaaaauacuaugcuggccgggcgcgguggcucacaccuguaaucccagcacuuug

SEQ ID NO: 227492 - RNA, 64 nt, Human
ugcagaucauuuaagaaguaacaggccgggcgcgguggcucacgccuguaaucccagcacuuug

SEQ ID NO: 227493 - RNA, 64 nt, Human
gggaauuaaaaaguaaaauaauaggccaggcaugguggcucaugccuauaagcacccugggagg

SEQ ID NO: 227494 - RNA, 64 nt, Human
uauaaaaguaaaggagaauaacuggccgggcacgguggcucaugccuauaaaauuccagcacuu

SEQ ID NO: 227495 - RNA, 64 nt, Human; identical to SEQ ID NO: 9316

SEQ ID NO: 227496 - RNA, 64 nt, Human
ugcucucaugggucuagauauugaggaguuuuucugagggcagagauuggacaucaacaaggcu

SEQ ID NO: 227497 - RNA, 64 nt, Human
acacaggugugaagaggccauccuggaacccaggugagggcaagaugaaggcuuccaggcagaa

SEQ ID NO: 227498 - RNA, 64 nt, Human
augcuuagaaagcauacaggaggggccaggcgugguggcucaugccuguaaucccagaacuuug

SEQ ID NO: 227499 - RNA, 64 nt, Human
cucaagcuuaguuggcagcacucuccacacuucuguggcucagugauuacugcuauuacuauau

SEQ ID NO: 227500 - RNA, 64 nt, Human
ugaagucaacuucuaucaacuucaggccaggcccguggcucaugccuguauaaucccagcacuu

SEQ ID NO: 227501 - RNA, 64 nt, Human
gccagcgcuccuggguggugcugccuccucugggguggcucaccgggccccggcaccgugcccc

SEQ ID NO: 227502 - RNA, 64 nt, Human
uuuuguauuuuuuguagagacagguucuugccagguggcucaggcuggucuccaacuccugagc

SEQ ID NO: 227503 - RNA, 64 nt, Human
uucaagagaauaugcacagucuaggccgggcacgguggcucacgccuguaaucccagcacuuug

SEQ ID NO: 227504 - RNA, 64 nt, Human
auuguguauuaagggucguuuuaggccacaugcgguggcucaugccuguaaucccagcacuuug

SEQ ID NO: 227505 - RNA, 64 nt, Human
acauguauacaaaguaaauucuuagccagguguaguggcucaugccuguaaucccagcacuuug

SEQ ID NO: 227506 - RNA, 64 nt, Human
ccuccaaacaaaaacaaaaugcaggccgagcgcgguggcucacgccuguaaucccagcacuuug

SEQ ID NO: 227507 - RNA, 64 nt, Human
gaacucugaaaauguacauguauggcuggacgcgguggcucacgccuguaaucccagcacuuug

SEQ ID NO: 227508 - RNA, 64 nt, Human
cccaagaugaagaagccccuucaggccagucgugguggcucaugccuguaaucccagcacuuug

SEQ ID NO: 227509 - RNA, 64 nt, Human
uguacuguuaaaaaaaucuaugcagcugggugcaguggcucacgccuguaaucccagcauuuug

SEQ ID NO: 227510 - RNA, 64 nt, Human
agaagaauuaagaugaaaaacauggccgggcgggguggcucacgccuguaauccuagcacuuug

SEQ ID NO: 227511 - RNA, 64 nt, Human
ccaugagcugcccugagcuuuggucguuggggagguggcucaaauggagccagcggcugugguu

SEQ ID NO: 227512 - RNA, 64 nt, Human
aauuuaacugcauauagauaauuauccaggauguguggcucauucuuuucagcuuguuucuaua

SEQ ID NO: 227513 - RNA, 64 nt, Human
uugucaaauuaagauauguauuuguaaguuauugguggcucauuuaaacuguaucauacaguaa

SEQ ID NO: 227514 - RNA, 64 nt, Human; identical to SEQ ID NO: 9298

SEQ ID NO: 227515 - RNA, 64 nt, Human; identical to SEQ ID NO: 9300

SEQ ID NO: 227516 - RNA, 64 nt, Human; identical to SEQ ID NO: 9301

SEQ ID NO: 227517 - RNA, 64 nt, Human
cacaguagugaaaauagaagguaggccgggcacaguggcucaugccuguaaucccagcacuuug

SEQ ID NO: 227518 - RNA, 64 nt, Human
caaagauuuucacagaaacuugaggccaggugccguggcucacaccuguaaucugaacacuuug

SEQ ID NO: 227519 - RNA, 64 nt, Human
guugauuuccaggcgaugcucgugugccccuggcguggcucacccaaguuccucgacugagggc

SEQ ID NO: 227520 - RNA, 64 nt, Human
agccccuaauaaaugaagcugcuggccgggcgcgguggcucacgccuguaaucccaacacuuug

SEQ ID NO: 227521 - RNA, 64 nt, Human
agcacccagaacuccauaccaucggccgggugugguggcucaugccuuaaucccagcacuuugg

SEQ ID NO: 227522 - RNA, 64 nt, Human
uauguauguuuugaaaagaaaagguccggggaugguggcucacaccugaaaucccagcacuuug

SEQ ID NO: 227523 - RNA, 64 nt, Human
uguuaaguaauaaaaaguuaauguggugggugcaguggcucacgccuguaaucccagcacuuug

SEQ ID NO: 227524 - RNA, 64 nt, Human
cagcaguaaauucuucucuacucggccaggcgcaguggcucaugccuguaaucccagcacuuug

SEQ ID NO: 227525 - RNA, 64 nt, Human
augugaaaauaauagccauccuuggccuggcgcgguggcucacaccuguaaucccagcacuuuu

SEQ ID NO: 227526 - RNA, 64 nt, Human
uuaauaucacuguauuaaaagucugccgggcacaguggcucacgccuguaaucccaacacuuug

SEQ ID NO: 227527 - RNA, 64 nt, Human
cuccacuaaaaguacaaaaaauuagcugggcgugguggcucaugccuguaaucccagcuacuca

SEQ ID NO: 227528 - RNA, 64 nt, Human
uucacaaauuagaagucaaacauggccaggcacaguggcucacaccuguaaucuucaggauuuc

SEQ ID NO: 227529 - RNA, 64 nt, Human
acuggauuaagaaaacaacaacaggcugggcgcaguggcucacaccuguaaucccagcacuuug

SEQ ID NO: 227530 - RNA, 64 nt, Human
cuauuaugaaaauaaaugaaacuggcuggguaugguggcucaugccuauaaucccagcacuuug

SEQ ID NO: 227531 - RNA, 64 nt, Human
ucgguaagauguaaagaacucuuggccaggugugguggcucaugccuauaaucccagcacuuug

SEQ ID NO: 227532 - RNA, 64 nt, Human
aaaguauaagcuaauacccaucaggcugggugugguggcucacgccuguaauccuagcacuuug

SEQ ID NO: 227533 - RNA, 64 nt, Human; identical to SEQ ID NO: 9304

SEQ ID NO: 227534 - RNA, 64 nt, Human; identical to SEQ ID NO: 9305

SEQ ID NO: 227535 - RNA, 64 nt, Human; identical to SEQ ID NO: 9306

SEQ ID NO: 227536 - RNA, 64 nt, Human
uacaucaaaagauagaaacucugggcugggcacaguggcucacacacuuugggaggccaagcgg

SEQ ID NO: 227537 - RNA, 64 nt, Human
uuguuuuuauuaaucuuuuguuuggccgggcgugguggcucacgccuguaauccuagcacuuug

SEQ ID NO: 227538 - RNA, 64 nt, Human
caggagugaagacugugaugugugguccccauauguggcucagcaaagacucgagagaucaucc

SEQ ID NO: 227539 - RNA, 64 nt, Human
ggaagaauaaaguuaaccaagcaggccaggcacgguggcucacgccuauaaucccagcacuuag

SEQ ID NO: 227540 - RNA, 64 nt, Human
cuucagcagcaucggaaauuuccagcugggcaugguggcucacaccuguaaucucagcacucug

SEQ ID NO: 227541 - RNA, 64 nt, Human
aauuuauucuauuauugaguggccacaauguagaguggcucaaaguacuucaggauuaggaauu

SEQ ID NO: 227542 - RNA, 64 nt, Human
acgggucucacucugucacccaggcuggagugcaguggcucaaugcaaccucugccccccaagu

SEQ ID NO: 227543 - RNA, 64 nt, Human
aguuugcauuaauaauccuuccaggccgggcacaguggcucacgccuguaaucccagcacuuug

SEQ ID NO: 227544 - RNA, 64 nt, Human
gcuuauaaaaguaaaugcauuaaggccaagugcaguggcucacaccgguaaucccagcacuuug

SEQ ID NO: 227545 - RNA, 64 nt, Human
agaaucggggcugcuggaacugggacagcugccuguggcucagagccuucuucaaaagcuucaa

SEQ ID NO: 227546 - RNA, 64 nt, Human
aauuccugauaaagaauuggccuggcugggugcaguggcucacaccugugaucccagcacuuug

SEQ ID NO: 227547 - RNA, 64 nt, Human
ggucgggaguuugaaaccagucucaccaggcgcaguggcucacgccuguaauuccagcauguug

SEQ ID NO: 227548 - RNA, 64 nt, Human
guccagagaauaggggaagacugggccagacgcaguggcucaugccuguaaucccagcacucug

SEQ ID NO: 227549 - RNA, 64 nt, Human
ucuaaagaauaacuccaagucuuggccaggcgcaguggcucacaccuguaaucccaacacuuug

SEQ ID NO: 227550 - RNA, 64 nt, Human
ugucacugaaauugaaugggggaggcccaaugagguggcucaugccuguaaucccagcacuuug

SEQ ID NO: 227551 - RNA, 64 nt, Human
augguauaaaaguuaugaaaaaaggccaggugcaguggcucacgccuguaaucccagcacuuuu

SEQ ID NO: 227552 - RNA, 64 nt, Human; identical to SEQ ID NO: 9307

SEQ ID NO: 227553 - RNA, 64 nt, Human; identical to SEQ ID NO: 9309

SEQ ID NO: 227554 - RNA, 64 nt, Human; identical to SEQ ID NO: 9310

SEQ ID NO: 227555 - RNA, 64 nt, Human
uuccaaggaagaaggggaagaaaaggaccuguggguggcucaggcccaagcagaccccgggcuc

SEQ ID NO: 227556 - RNA, 64 nt, Human
auuuacuaaaccccaauucauagaauaggaaacuguggcucagaggucaucuaccuaaagacac

SEQ ID NO: 227557 - RNA, 64 nt, Human
ccuggacuuaaaaagccagggcaggccgggcacaguggcucacgccuguaaucccagcacuuug

SEQ ID NO: 227558 - RNA, 64 nt, Human
accgcaucggagauaucaccuccugcucggugcuguggcucaacaaugccuuccaggugcgugc

SEQ ID NO: 227559 - RNA, 64 nt, Human
ggcaguguaaaguuuuuugauaaggccauuuuagguggcucacuuucucauuaagauauauaua

SEQ ID NO: 227560 - RNA, 64 nt, Human
auaacaaaaaaagaaagugugauggcugggugcaguggcucacgccuguaaucccagcacuuug

SEQ ID NO: 227561 - RNA, 64 nt, Human
cuuguuuuaaaagaaagaaaacaggccgggcacaguggcucaugccuguaaucccagcacuuug

SEQ ID NO: 227562 - RNA, 64 nt, Human
ccaaaauugcagaauggggggccaggccugugugguggcucacaccugugaucccagcacuuug

SEQ ID NO: 227563 - RNA, 64 nt, Human
ucgccuccauguuacucccuuucucuuccuaccuguggcucaugccaugccaugaagugccuag

SEQ ID NO: 227564 - RNA, 64 nt, Human
ggagcuuucaaaaagcacaaauaggcuggacaugguggcucaugccuguaaucccaguacuuug

SEQ ID NO: 227565 - RNA, 64 nt, Human
accugacaguaagaaaauacucuggcuggucucaguggcucaugucuguaauucuagcauguua

SEQ ID NO: 227566 - RNA, 64 nt, Human
acuauucaaaaaacagauaaucaggccaggcucaguggcucaugccuauaauuccagcacuuug

SEQ ID NO: 227567 - RNA, 64 nt, Human
cagcacaccccacagccaaguagaggcgaaagcaguggcucauccuaccuguuaggagcaggua

SEQ ID NO: 227568 - RNA, 64 nt, Human
uacuagggccuauugaccguagaggccaggugcgguggcucauaccuguaaucccagcaguugg

SEQ ID NO: 227569 - RNA, 64 nt, Human
cugucucaaaaaaaaaaaaauaaagccgggcgugguggcucacgccuguaaucccggcacuuug

SEQ ID NO: 227570 - RNA, 64 nt, Human
acauuuuuaaagaguuguuuuuuggccgggcgcaguggcucaugccuguaaucccagcacuuug

SEQ ID NO: 227571 - RNA, 64 nt, Human; identical to SEQ ID NO: 9313

SEQ ID NO: 227572 - RNA, 64 nt, Human; identical to SEQ ID NO: 9314

SEQ ID NO: 227573 - RNA, 64 nt, Human; identical to SEQ ID NO: 9315

SEQ ID NO: 227574 - RNA, 64 nt, Human
ugaaucugcaguggaaaaaaagcccacauuugagguggcucaucuagaccuggcaagaauguau

SEQ ID NO: 227575 - RNA, 64 nt, Human
gauuuuaaaagaauauauauaucagccgggcgcgguggcucaugccuguaaucccagcacuuug

SEQ ID NO: 227576 - RNA, 64 nt, Human
aaugcauuuuucaagagaaaugauguugucacugguggcucauucagggaagcucaucaaagcc

SEQ ID NO: 227577 - RNA, 64 nt, Human
acaguucugaaaagcaaccgcaaagccgggcgcgguggcucacaccuguaaucccaacaguuug

SEQ ID NO: 227578 - RNA, 64 nt, Human
guuucuuaaaaaugagauuuaagggcugggcacgguggcucaugccuguaaucccagcacuuug

SEQ ID NO: 227579 - RNA, 64 nt, Human
auuacuuaaagguaccgaaggaaggccaggugcaguggcucacgcccagcacuuugggaggcug

SEQ ID NO: 227580 - RNA, 64 nt, Human
auuuuuaaaguaccccauuuucaggccgggugugguggcucaugccuguaaucccagcacuuug

SEQ ID NO: 227581 - RNA, 64 nt, Human
ccacaacuucaaaauuuagucugggccuagugcaguggcucacaccuauaaucccaacacuuug

SEQ ID NO: 227582 - RNA, 64 nt, Human
uuuuguuaaaaauucaguguucaggccgggugcuguggcucacgccuguaaucccagcacuuug

SEQ ID NO: 227583 - RNA, 64 nt, Human
agcuagacaaauaaaccccagcaggccgggcgcgguggcucaccucuguaaucccagcacuuuu

SEQ ID NO: 227584 - RNA, 64 nt, Human
ggaaccauuaaagaauuccugggggccgguugcgguggcucaugccuguaaucccagcacuuug

SEQ ID NO: 227585 - RNA, 64 nt, Human
uaaccacggaaaagagcgcaucaggccuggcacgguggcucaggccuauaaccccagcucccua

SEQ ID NO: 227586 - RNA, 64 nt, Human
ggcccuuauaagaagagacauggggccaggugcaguggcucacaccuguaaucccaacauuuug

SEQ ID NO: 227587 - RNA, 64 nt, Human
aagcacauugcgauccauucaguguuuaacugucguggcucauuuucuguucguuagcacuugu

SEQ ID NO: 227588 - RNA, 64 nt, Human
agacccuguuuaaaaaagaaaaaggccaggcacgguggcucaugccuguaaucccagcuacgca

SEQ ID NO: 227589 - RNA, 64 nt, Human
acuuaaaaauguucaaauaaccugguugggugugguggcucacacuuguaaucccagcacuuug

SEQ ID NO: 227590 - RNA, 64 nt, Human; identical to SEQ ID NO: 9267

SEQ ID NO: 227591 - RNA, 64 nt, Human; identical to SEQ ID NO: 9276

SEQ ID NO: 227592 - RNA, 64 nt, Human; identical to SEQ ID NO: 9302

SEQ ID NO: 227593 - RNA, 64 nt, Human
cugugcucucugaaagagccugaggccgggcgugguggcucacgccuguaaucccagcacuuug

SEQ ID NO: 227594 - RNA, 64 nt, Human
gacauuaaaaauuguugaacaacggccaggcacaguggcucaugccuguaauccuaacacuuug

SEQ ID NO: 227595 - RNA, 64 nt, Human
cauggauagaaucaauauuuguaggccaggcgugguggcucaccccccuguauucucagcacuu

SEQ ID NO: 227596 - RNA, 64 nt, Human
cugccuccauguuacucccuuucucuuacuaccuguggcucaucccaugccaugaacugccugg

SEQ ID NO: 227597 - RNA, 64 nt, Human
uagcaggccacccucacucauguacucauuccugguggcucaucucaggacagaaggcaauugc

SEQ ID NO: 227598 - RNA, 64 nt, Human
uaaggaaaaauaauauaaagauaccauuggggcaguggcucacaccuguaaucucagcacuuug

SEQ ID NO: 227599 - RNA, 64 nt, Human
uuucuuuguaaaacuguacugugggccgggcgcgguggcucacaccuguaaucccagcacuuug

SEQ ID NO: 227600 - RNA, 64 nt, Human
gucaaaauaaagacccaaucugaggccgggcacgguggcucacgccgguaaucccagcacuuug

SEQ ID NO: 227601 - RNA, 64 nt, Human
ugucauucacauugaauggggaugaggucggacaguggcucauagagccgaguaugagcccuag

SEQ ID NO: 227602 - RNA, 64 nt, Human
aggaguauguaugagguccauccuggcaugagcaguggcucacccaccggccuugaagagguga

SEQ ID NO: 227603 - RNA, 64 nt, Human
aagagacccgggucuggcaccgucgggauggcaaguggcucaauguccacuaucacugcucagg

SEQ ID NO: 227604 - RNA, 64 nt, Human
auucuauuaaaauuuguaguuugggcugggugcuguggcucauaccuauaaucccagcacuuug

SEQ ID NO: 227605 - RNA, 60 nt, Human
ucugugguggcaaugacugaacagugacugguggcucacuucugcccaccugccggcaac

SEQ ID NO: 227606 - RNA, 64 nt, Human
cguggugauacagauagcaugugaggcaggcaugguggcucauguuuguaaaucccagcacuuu

SEQ ID NO: 227607 - RNA, 64 nt, Human
cagcaguaagugguuccgaagacaggcagggacaguggcucaaagucagaucagucugggguca

SEQ ID NO: 227608 - RNA, 64 nt, Human
cuacagaacaugcauuagugugggcuauauagcuguggcucaugcuacccaauuccagauuucu

SEQ ID NO: 227609 - RNA, 64 nt, Human; identical to SEQ ID NO: 9318

SEQ ID NO: 227610 - RNA, 64 nt, Human; identical to SEQ ID NO: 9319

SEQ ID NO: 227611 - RNA, 64 nt, Human; identical to SEQ ID NO: 9320

SEQ ID NO: 227612 - RNA, 64 nt, Human
auaguuucugagucuguguugcagccucugacacguggcucaccgcugucauuugggggaugga

SEQ ID NO: 227613 - RNA, 64 nt, Human
gcaaacaauagcaauugggcuggcuuaggagcaaguggcucauuuucccauaaggcuaaaaaua

SEQ ID NO: 227614 - RNA, 64 nt, Human
cucuccccuuugggcuggacgggaacacacguguguggcucaggaggaaaagcucagccuggac

SEQ ID NO: 227615 - RNA, 64 nt, Human
ucugucuaguuguccuuaagucugacugacuucaguggcucauaaccgugagccaaguauuugu

SEQ ID NO: 227616 - RNA, 64 nt, Human
aagacaaaagaaacagcuuugggggccgggcgugguggcucacgccuguaaucccagcacuuug

SEQ ID NO: 227617 - RNA, 64 nt, Human
gaauuuagauauuccaauuugcaucagucuuucuguggcucaaauaaugaugauuauggaauga

SEQ ID NO: 227618 - RNA, 64 nt, Human
gguguuccuuauaagagaagauagggcgggcaugguggcucacgccuguaaucccagcacugug

SEQ ID NO: 227619 - RNA, 64 nt, Human
uaagaaauuuguguuauuugauaggccgggcaugguggcucaugccuguaaucccagcacuuug

SEQ ID NO: 227620 - RNA, 64 nt, Human
accauuaagauuauccaaagucaggcugggcgcaguggcucacgccuguaaucccagcacuuug

SEQ ID NO: 227621 - RNA, 64 nt, Human
guaugaaaaauuggggaggagggggccgggcgcgguggcucacgccuguaaucccagcacuuug

SEQ ID NO: 227622 - RNA, 64 nt, Human
uauuguuuaaaaauggccuucuuggcugggcgcgguggcucacuccuguaaucccagcacuuug

SEQ ID NO: 227623 - RNA, 64 nt, Human
aaaaucuagaaaauaaauaacaaggcugggugcgguggcucacgccuguaaucccagcaccuug

SEQ ID NO: 227624 - RNA, 64 nt, Human
acuguaaacuuuaaagaauaaucagcugggcgcaguggcucaugcuuguaaucacagcacuuua

SEQ ID NO: 227625 - RNA, 64 nt, Human
gagcccccugagcccaggccugugucuagccccaguggcucacugaacuuucagggcagucagg

SEQ ID NO: 227626 - RNA, 64 nt, Human
uuuuuuuuuuuuuaaugaacuugagccgggugcaguggcucacaccuguaagcccagcugucag

SEQ ID NO: 227627 - RNA, 64 nt, Human
gaagcuucuuagaagaggcagggggcgaagugcaguggcucaugccuguaaucucagcaauuug

SEQ ID NO: 227628 - RNA, 56 nt, Human; identical to SEQ ID NO: 9323

SEQ ID NO: 227629 - RNA, 64 nt, Human; identical to SEQ ID NO: 9324

SEQ ID NO: 227630 - RNA, 64 nt, Human; identical to SEQ ID NO: 9325

SEQ ID NO: 227631 - RNA, 64 nt, Human
uucuaggugguggcuaaaucugggccuaaucuggguggcucagcuaaccucucuucuucccuuc

SEQ ID NO: 227632 - RNA, 64 nt, Human
guggacagugguuaagauuguggggccgggcgagguggcucacgccuguaaucccagcacuuug

SEQ ID NO: 227633 - RNA, 64 nt, Human
gggaugauuauuauauugaggcuaaaaccacaaaguggcucaggcuuuaaaaaaaaaacacugu

SEQ ID NO: 227634 - RNA, 64 nt, Human
uaaacgugaaaacuaacauuuuuggccagacacaguggcucaugcauguaauucuagcacuuug

SEQ ID NO: 227635 - RNA, 64 nt, Human
gacuuuaaaauaauacaaaacagggccgggcgcaguggcucacaccuguaaucccagcacuuug

SEQ ID NO: 227636 - RNA, 64 nt, Human
uuccuuacaaaaucuucauuuaaggcugagugugguggcucaugccuguaauuccagcacuuug

SEQ ID NO: 227637 - RNA, 64 nt, Human
cgagauggaaauuuagacaacuuggccagccgugguggcucacgucuguaaucccagcacuuug

SEQ ID NO: 227638 - RNA, 64 nt, Human
aauaaauaaauaaauaaauaaauagcugggcauaguggcucaugccuguacucucagcuacuug

SEQ ID NO: 227639 - RNA, 64 nt, Human
cuccuugggaggccccacuggggaaauaacagcuguggcucacgugagagugucuucacggcag

SEQ ID NO: 227640 - RNA, 64 nt, Human
ucugauccuaagaaguuacuucuggccaggcgcgguggcucaugccuguaauccuagcacuuug

SEQ ID NO: 227641 - RNA, 64 nt, Human
ucauggauuuaagaaacuugaaaagcugggcacgguggcucacgccuguaaucccagcacuuug

SEQ ID NO: 227642 - RNA, 64 nt, Human
ccugaagggauggggaguagcaacauaaaaagaaguggcucaagucuucuuggaguuuguucau

SEQ ID NO: 227643 - RNA, 64 nt, Human
aggccgccuggcagaggcaggaaaugcuccagcaguggcucagugcucccuggugucugcugca

SEQ ID NO: 227644 - RNA, 64 nt, Human
ucacuuggccaguuugcuuuucuaccauccggcuguggcucagugagacuccugcugggagggu

SEQ ID NO: 227645 - RNA, 64 nt, Human
ugucaguuugaaagcugagaccuggccaggugcgguggcucacuccuguaaucccagcacuuug

SEQ ID NO: 227646 - RNA, 64 nt, Human
aauuugauauuuaaguaaaaugggacugggugcaguggcucaggccuguaaucccaacccuuug

SEQ ID NO: 227647 - RNA, 64 nt, Human; identical to SEQ ID NO: 9328

SEQ ID NO: 227648 - RNA, 64 nt, Human; identical to SEQ ID NO: 9329

SEQ ID NO: 227649 - RNA, 64 nt, Human; identical to SEQ ID NO: 9330

SEQ ID NO: 227650 - RNA, 64 nt, Human
accguuaacaaaaaaguaagucuggccgggcaugguggcucaagccuguaaucccagcacuuug

SEQ ID NO: 227651 - RNA, 64 nt, Human
uugauuugcgucaacauuauaaaagagcacuucuguggcucauuuaaaagaaaaaaaagguuaa

SEQ ID NO: 227652 - RNA, 64 nt, Human
ugccuuuucagcagcagauacuggugagauggggguggcucaggcuguucuuccuccuccuaga

SEQ ID NO: 227653 - RNA, 64 nt, Human
uagguguauuaaccucaucagucuugaagaacauguggcucaugaguauaacacuucuguagag

SEQ ID NO: 227654 - RNA, 64 nt, Human
auacuuguuucuuuucacguuuucccauuucccuguggcucacugucuuacaaucacugcugug

SEQ ID NO: 227655 - RNA, 64 nt, Human
ccuggguaggaaaauuagaagcaagcuggaugcaguggcucaugccuguaaucccaacacuuuu

SEQ ID NO: 227656 - RNA, 64 nt, Human
ccuucuuuaaagauguaaaacccggccgggcgcgguggcucacgccuguaaucccagcacuuug

SEQ ID NO: 227657 - RNA, 64 nt, Human
uucaggguguggccaccaggugcugugaguuucuguggcucauggccucugggcuggucccuug

SEQ ID NO: 227658 - RNA, 64 nt, Human
cuaggagaggaaagacgggccugggcugggugcgguggcucaugccuguaaucccagcacuuug

SEQ ID NO: 227659 - RNA, 64 nt, Human
cuucgacuacugcuccuguggcaggaggcuuuggguggcucacuacugaacacauguguaugau

SEQ ID NO: 227660 - RNA, 64 nt, Human
guuuaauagagaaaugcuguuuaggcugggcuugguggcucacaucuguaauaccagcgcuuug

SEQ ID NO: 227661 - RNA, 64 nt, Human
uuuuuuacaaaaagucacuuuugggcugggcgcaguggcucacgccuguaaucccagcacuuug

SEQ ID NO: 227662 - RNA, 64 nt, Human
auggcuuaucaaaugcuuguccuggcccgaugcaguggcucaugccuguaaucccagcacuuug

SEQ ID NO: 227663 - RNA, 64 nt, Human
ccaaauuuuaaaauauguacucuggccgguugcaguggcucacgccuguaaucccagcacuuug

SEQ ID NO: 227664 - RNA, 64 nt, Human
gaagacuagcuauuaaaauuucaugccgggcgcaguggcucacgccuguaaucccagcccuuug

SEQ ID NO: 227665 - RNA, 56 nt, Human
gccuggcuccgcaacgguagcaguggguggcucaagggccagccuccagcgcugcu

SEQ ID NO: 227666 - RNA, 64 nt, Human; identical to SEQ ID NO: 9331

SEQ ID NO: 227667 - RNA, 64 nt, Human; identical to SEQ ID NO: 9333

SEQ ID NO: 227668 - RNA, 64 nt, Human; identical to SEQ ID NO: 9334

SEQ ID NO: 227669 - RNA, 64 nt, Human
uggggacaaaagugacaauuguaggccaggcacaguggcucacgccuguaaucccagcacuuug

SEQ ID NO: 227670 - RNA, 64 nt, Human
auuccuuaaaagauacgugccggggccaggugugguggcucacgccuguaaucccagcacuuug

SEQ ID NO: 227671 - RNA, 64 nt, Human
acauguuuaagaaauauggauggggccggccacaguggcucacgccuguaaucccagaacucug

SEQ ID NO: 227672 - RNA, 64 nt, Human
cucuuuuuuuuaaaaaaaaaaaaggccgggcacuguggcucacgccuguaaucccagcacuuug

SEQ ID NO: 227673 - RNA, 64 nt, Human
gcaaaaucugguccuccccccucccaguguagcuguggcucagaguuuuuucuuuuuguuguca

SEQ ID NO: 227674 - RNA, 64 nt, Human
auuaggcucaggauccagccugggcucacccuguguggcucauucccacccaggaaacugaaga

SEQ ID NO: 227675 - RNA, 64 nt, Human
auccaauuaaaaauggucaaaggggcugggcaugguggcucacgccuguaaucucagcacuuug

SEQ ID NO: 227676 - RNA, 64 nt, Human
acugugagauaaugggucacauuggcuggaugugguggcucauaccuguaaaucccagcacuuu

SEQ ID NO: 227677 - RNA, 64 nt, Human
gaguuaaagaaacugcuugcaggggcugggcgugguggcucaugccuguaaucccagcacuuug

SEQ ID NO: 227678 - RNA, 64 nt, Human
uaauuaaaguuuaaaaaaaaaaagguugggcguuguggcucaugccuguaaucccagcacuuug

SEQ ID NO: 227679 - RNA, 64 nt, Human
uuaucucauuuuacacaaagggaagucgggcaugguggcucaugccuguaaucucagcacuuug

SEQ ID NO: 227680 - RNA, 64 nt, Human
aaaaaaaaaaaaaaaaacuuuagaacugggugcaguggcucaugccuguaaucccagccagcac

SEQ ID NO: 227681 - RNA, 64 nt, Human
uuugauucauaaaguuaauucacugcuuaagcauguggcucauauuuaggaagcuauauaaaau

SEQ ID NO: 227682 - RNA, 64 nt, Human
acuguuaacugugcguuaaauaagcaaauaaacaguggcucauaaaaauaaaagucgcauucca

SEQ ID NO: 227683 - RNA, 64 nt, Human
aaguuauuaaaaaaaaaaaauugggccaggcacgguggcucacgccuguaaucccagcacuuug

SEQ ID NO: 227684 - RNA, 64 nt, Human
uuugcuuuagaaugguuaccuuagaagaauuuggguggcucauguugaauuucacuucugcaau

SEQ ID NO: 227685 - RNA, 64 nt, Human; identical to SEQ ID NO: 9244

SEQ ID NO: 227686 - RNA, 64 nt, Human; identical to SEQ ID NO: 9245

SEQ ID NO: 227687 - RNA, 64 nt, Human; identical to SEQ ID NO: 9246

SEQ ID NO: 227688 - RNA, 64 nt, Human
gucgccccucccucccagagcaccugcugucuggguggcucacucagcacuugguguggccuuc

SEQ ID NO: 227689 - RNA, 64 nt, Human
gcugaagcaccgcauuuagagccuuggggcugcaguggcucaauguccuggcugguccagcugu

SEQ ID NO: 227690 - RNA, 64 nt, Human
ugcacuccuccccuaguuuacacaucuugaugcuguggcucaguuugccuuccugaauuuuuau

SEQ ID NO: 227691 - RNA, 64 nt, Human
guggcuucaagaguccuuacugaagccaggcaccguggcucacgucuguaaucccagcgcuuug

SEQ ID NO: 227692 - RNA, 64 nt, Human
ccauuuaaaagucugccuauccuggccaggugugguggcucacaccuguaaucccagcacuuug

SEQ ID NO: 227693 - RNA, 64 nt, Human
ugguccuuauggagugccgcguucucuguacuacguggcucauggaaaaagugacaacauggcu

SEQ ID NO: 227694 - RNA, 64 nt, Human
acuuaacuggggcucuuaacauugcuaauaaccuguggcucaauuuccucaacuguauaaugag

SEQ ID NO: 227695 - RNA, 64 nt, Human
ccgccgcaucgacaucaccgccaagcucugcgauguggcucagcagcgcaacugcgaggacaug

SEQ ID NO: 227696 - RNA, 64 nt, Human
uuuaguaaaaccuggaggugaugggccgggcgcaguggcucacgccuguaaucccaacaccuua

SEQ ID NO: 227697 - RNA, 64 nt, Human
ugaauaaaaaugcacguagcugaggccggaugcgguggcucacgccuguaaucccagcacuuug

SEQ ID NO: 227698 - RNA, 64 nt, Human
aaaaaaaaaaaagaaagagagagggccgggcgugguggcucacgccuguaaucccagcacuuug

SEQ ID NO: 227699 - RNA, 64 nt, Human
gaagguuaaauuuaucuuaguacugcugggcgcaguggcucaugccuguaaucugagcacuuug

SEQ ID NO: 227700 - RNA, 64 nt, Human
aaauggaggugagcaaauuaacgguagugugacuguggcucaacuuuccaugguacgcgcgaau

SEQ ID NO: 227701 - RNA, 64 nt, Human
uuuagaauacaaaaagagaagcaagccagacaugguggcucacaccuguaaucccaauacuggg

SEQ ID NO: 227702 - RNA, 64 nt, Human
cagcuguauuuaaaaacccauggagccgggugcgguggcucacgccuaugaucccagcacuuug

SEQ ID NO: 227703 - RNA, 64 nt, Human
cuagcuagaagugggccaggacaggcccggcgcgguggcucacgccuguaaucccagcaguuug

SEQ ID NO: 227704 - RNA, 63 nt, Human; identical to SEQ ID NO: 9249

SEQ ID NO: 227705 - RNA, 64 nt, Human; identical to SEQ ID NO: 9250

SEQ ID NO: 227706 - RNA, 64 nt, Human; identical to SEQ ID NO: 9251

SEQ ID NO: 227707 - RNA, 64 nt, Human
aaucccuucuagaaagcauuuuaggccagccaugguggcucacgucuguaaucccaggacuuug

SEQ ID NO: 227708 - RNA, 64 nt, Human
aguccagugaaaugauauauucuggcugggcacaguggcucacaccuguaauccuagcacuuug

SEQ ID NO: 227709 - RNA, 64 nt, Human
cugaguucaagaaaaguacuucaggcugggcacaguggcucaugccugaaauccuagcacuuug

SEQ ID NO: 227710 - RNA, 64 nt, Human
cugucgcugagugcuacugccuaguccagaugucguggcucaggguguaaauauuccuaagaau

SEQ ID NO: 227711 - RNA, 64 nt, Human
cugcauucccucccagccuuugaggccgggugcaguggcucacgccuguaaucccagcacuuug

SEQ ID NO: 227712 - RNA, 64 nt, Human
aguacuuucaauaaauagcuauuagccaggugcgguggcucacgccuguaaucccagcacugug

SEQ ID NO: 227713 - RNA, 64 nt, Human
ugaaaugguauuuagaaagcagcagucaggcacgguggcucaugccuguaaucccagcacuuug

SEQ ID NO: 227714 - RNA, 64 nt, Human
gcaaguaacuaaagguugguguuggccaggcaugguggcucaugccuguaaucccagcauuuug

SEQ ID NO: 227715 - RNA, 64 nt, Human
cuacauacaagacuucaccauaaggccaggagcaguggcucacaccuuguaaucccagcacuuu

SEQ ID NO: 227716 - RNA, 64 nt, Human
cacccagccuucagcugucaccuuaaacuugacaguggcucaugcugauuuaguucauuuuccc

SEQ ID NO: 227717 - RNA, 64 nt, Human
guuuuaaaaauuaagugaggggaggccgggugcgguggcucacgcauguaaucccagcacuuug

SEQ ID NO: 227718 - RNA, 64 nt, Human
ucucuagaugguuuacuuaaauaggccaggcgcaguggcucacaccuguaauccuagcacuuug

SEQ ID NO: 227719 - RNA, 64 nt, Human
uuggauuaaagauucacaaguuaggccgggcgcgguggcucaugccuguaaucccagcacuuug

SEQ ID NO: 227720 - RNA, 64 nt, Human
cgcuuuaaaaauaagcacaugauggcugggcaccguggcucacgccuguaaucccagcacuuug

SEQ ID NO: 227721 - RNA, 64 nt, Human
ggcacugcuacgccagcagcugccacaugggaugguggcucaggcgcucccuccaggauucugc

SEQ ID NO: 227722 - RNA, 64 nt, Human
uaagaaccuugccaacuucuggggguugggcaugguggcucacgcuugugaucccagcacuuug

SEQ ID NO: 227723 - RNA, 64 nt, Human; identical to SEQ ID NO: 9254

SEQ ID NO: 227724 - RNA, 64 nt, Human; identical to SEQ ID NO: 9255

SEQ ID NO: 227725 - RNA, 64 nt, Human; identical to SEQ ID NO: 9256

SEQ ID NO: 227726 - RNA, 64 nt, Human
cuaauguuaaaaaucaagcucuuggccaggcaugguggcucaugccuguaauuccagcacuuug

SEQ ID NO: 227727 - RNA, 64 nt, Human
ggacauuuaagcgaaguaaaagaggccgggugcgguggcucacgccuguaaucccaacacuuua

SEQ ID NO: 227728 - RNA, 64 nt, Human
acuuugucaaaguuguauggcugaggcccacacgguggcucacuucuguaaucccaucacuuug

SEQ ID NO: 227729 - RNA, 64 nt, Human
uaaccuaagaaacugcuaugcaaggcugggugcuguggcucaugccuguaaucccagcacuuug

SEQ ID NO: 227730 - RNA, 64 nt, Human
ugugcauauaaaauacauauuuacgccaggcgugguggcucacgccuguaaucccagcacuuug

SEQ ID NO: 227731 - RNA, 64 nt, Human
aacuaaucaagaaaaacaucuuuggcugagcucgguggcucaugccuguaaucccaacacuuug

SEQ ID NO: 227732 - RNA, 64 nt, Human
auuaccuagaagugcaagaaaugaccgacaucacguggcucaacucccccagucagguggcggu

SEQ ID NO: 227733 - RNA, 64 nt, Human
aaauaggugaagacagcauagaauuaugaccaggguggcucaacccacaaaucaacugaucuac

SEQ ID NO: 227734 - RNA, 64 nt, Human
uaacuauauguuaacaauauggaggcugggcgugguggcucacaccuguaaucccagcacuuug

SEQ ID NO: 227735 - RNA, 64 nt, Human
gaacuuugagaugcacuaaaguuuuguuucagcaguggcucaaaaaauuucagaaauuacuuuu

SEQ ID NO: 227736 - RNA, 64 nt, Human
uagucuaucaaacaagaaaugcuggcuuggcccgguggcucaugccuguaaucccagcacugug

SEQ ID NO: 227737 - RNA, 64 nt, Human
agagguuuuaaaaucaaauuugaggccaggugcaguggcucaugggcggaggagggcagauuac

SEQ ID NO: 227738 - RNA, 64 nt, Human
uagguuaaaaaaaaggaucagcuggcugggcaggguggcucaugucuauaaucucagcauucua

SEQ ID NO: 227739 - RNA, 64 nt, Human
ucaaacuaugcuuaaaaaguuccggcuggacacgguggcucacaccuauaauccuagcacuugg

SEQ ID NO: 227740 - RNA, 64 nt, Human
auugaaguucauugaagaauuacuagguugccauguggcucacuuauuuaaaaaaaaaaaaaaa

SEQ ID NO: 227741 - RNA, 64 nt, Human
uuuuuguauuacaaguugacaguugcuggguguaguggcucaugccuguaauccuagcaacucg

SEQ ID NO: 227742 - RNA, 64 nt, Human; identical to SEQ ID NO: 9234

SEQ ID NO: 227743 - RNA, 64 nt, Human; identical to SEQ ID NO: 9257

SEQ ID NO: 227744 - RNA, 64 nt, Human; identical to SEQ ID NO: 9326

SEQ ID NO: 227745 - RNA, 64 nt, Human
ucuucuaugaagaaaaaaaugcaggcugggcgcgguggcucacgccuguaauccuagcacuuug

SEQ ID NO: 227746 - RNA, 64 nt, Human
guuuuauaaauuuuagaaucaauuucucuuuaagguggcucagauuuuucaacucuugugcaca

SEQ ID NO: 227747 - RNA, 64 nt, Human
ccaaccauuuaaaaaaguuugccggcuaggugcgguggcucaugccuguaauccuagcauuuug

SEQ ID NO: 227748 - RNA, 64 nt, Human
aaaaauagaaagguugcaauuauauaggccauggguggcucaaaacuuugaacauuugagcuua

SEQ ID NO: 227749 - RNA, 64 nt, Human
cucuacuaaaaaauacaaaaauuagccaggugugguggcucacgcuuauguagucccaguuacu

SEQ ID NO: 227750 - RNA, 64 nt, Human
uucaucaaagagaagaccauguuggccgggcgcgguggcucacgccugcagucccagcacuuug

SEQ ID NO: 227751 - RNA, 64 nt, Human
ugaauuauagauuuuaaaaucaaggccgggcgugguggcucacaccuguaaucccagcauuuug

SEQ ID NO: 227752 - RNA, 64 nt, Human
uugcuuuaaaauuuuuaccuccuagcugggugcgguggcucacgccuguaaucccagcacuuug

SEQ ID NO: 227753 - RNA, 64 nt, Human
aggcaguuuuaaaagaauaaacaagcuaggugugguggcucaugccuguaauccuagcacuuug

SEQ ID NO: 227754 - RNA, 64 nt, Human
uucuugauuuaaagacaucuuuagaccgggcacaguggcucacgccaguaaucccagcacuuug

SEQ ID NO: 227755 - RNA, 64 nt, Human
ucacaccaacucugccuacacacuuccagugauaguggcucauugucuguuaaggcaaacuguu

SEQ ID NO: 227756 - RNA, 64 nt, Human
gagugcaucauauguagaaaauaaauauucagacguggcucauuaauguuacuaaguuggaagu

SEQ ID NO: 227757 - RNA, 64 nt, Human
gcgaagggcgcacagugucuagaaauacuugaucguggcucaaaccugaccagacagcagaggg

SEQ ID NO: 227758 - RNA, 64 nt, Human
uccaaaaccuuucguguaugcauucacauugaguguggcucauuuucuuuccccgaacgccaug

SEQ ID NO: 227759 - RNA, 64 nt, Human
uuuuucuuaauuucauuccuuuuuuuggacacugguggcucauuaccuaaagcagucuauuuau

SEQ ID NO: 227760 - RNA, 64 nt, Human
aggcacaaagaaguuaaauaacuugccgggugcgguggcucaccccuguaaucccagcacuuug

SEQ ID NO: 227761 - RNA, 64 nt, Human; identical to SEQ ID NO: 9259

SEQ ID NO: 227762 - RNA, 64 nt, Human; identical to SEQ ID NO: 9260

SEQ ID NO: 227763 - RNA, 64 nt, Human; identical to SEQ ID NO: 9261

SEQ ID NO: 227764 - RNA, 64 nt, Human
cccacacugccucgcaagcgcucgccacccucacguggcucaccugcuguugagccuugugcug

SEQ ID NO: 227765 - RNA, 64 nt, Human
accucaccaagccuagccacucucgcggcucugaguggcucacaggcuugugagggccccgucg

SEQ ID NO: 227766 - RNA, 64 nt, Human
uuuucucagaacuacccagaggaggccgggcaugguggcucacgcuuguaaucccagcacuuug

SEQ ID NO: 227767 - RNA, 64 nt, Human
uaugcaaaacaggcaugcuaguaagcagucagucguggcucagaacuuaaccccauagcucaga

SEQ ID NO: 227768 - RNA, 64 nt, Human
ggucgaauuucgaccugugguacacagcugugcuguggcucagucagcaaccucagaacucuga

SEQ ID NO: 227769 - RNA, 64 nt, Human
aacuuuuuccuuuuaccucauguuguaaacuuaaguggcucaauaaaaauugauccacugucuu

SEQ ID NO: 227770 - RNA, 64 nt, Human
cauggaaaagagaaacgagauugggccgggcacgguggcucaugccuggaaucuuugggaggcc

SEQ ID NO: 227771 - RNA, 64 nt, Human
ccccucuccaaaguaaggaacccagcugggcgugguggcucacuccuguaaucccagcauuuug

SEQ ID NO: 227772 - RNA, 64 nt, Human
guuuuuaaaaauuagccugguaaggccgggugcaguggcucacgccuguaaucccagcacuuug

SEQ ID NO: 227773 - RNA, 64 nt, Human
cugacuuaccaaaccaggaaaacagcaggagaggguggcucaggacuuagggacaggguauagc

SEQ ID NO: 227774 - RNA, 64 nt, Human
ucauuuauuaaaauaauaacugagacugggagagguggcucaugccuguaaaucccagcacuuu

SEQ ID NO: 227775 - RNA, 64 nt, Human
gcuuauuuuuugaaaggauauuaggccggaugugguggcucacgccuguaaucccagcacuuug

SEQ ID NO: 227776 - RNA, 64 nt, Human
gaaguacauacaaaguuuguucugacagggcgcgguggcucacgccuguaaucccagcgcuuug

SEQ ID NO: 227777 - RNA, 64 nt, Human
aguguauguaaagaaaauguuccagccaggcgcgguggcucacgccuguaauuccaucauuuug

SEQ ID NO: 227778 - RNA, 64 nt, Human
ccuguaauccuagcacuuugggaggcugaggcagguggcucacuugaggucaggaauucaagac

SEQ ID NO: 227779 - RNA, 64 nt, Human
caguguaugaaagucauguuacaggccgagugcgguggcucacaccuguaauccuagcacuuug

SEQ ID NO: 227780 - RNA, 64 nt, Human; identical to SEQ ID NO: 9264

SEQ ID NO: 227781 - RNA, 64 nt, Human; identical to SEQ ID NO: 9265

SEQ ID NO: 227782 - RNA, 64 nt, Human; identical to SEQ ID NO: 9266

SEQ ID NO: 227783 - RNA, 64 nt, Human
ggagggaaacuuuaaaacaaaaacacccaguacuguggcucaggauaugaugcgugaggagagg

SEQ ID NO: 227784 - RNA, 64 nt, Human
aaucuuguaaaaguuccuuucugggccgggcacaguggcucacgccuguaaucccagcacuuug

SEQ ID NO: 227785 - RNA, 64 nt, Human
ggcuuauaaagaaauggguucugggccaggugugguggcucaagccuguaaucccagcacuuug

SEQ ID NO: 227786 - RNA, 64 nt, Human
aauauacuuaaaaguauuucuuaggccgggcaugguggcucacaccuguaaucccagcacuuug

SEQ ID NO: 227787 - RNA, 64 nt, Human
gagugauuaaaaaaaaauaauuuggcugggugcuguggcucacaccucuaaucccagcacuuug

SEQ ID NO: 227788 - RNA, 64 nt, Human
guaaauguaaaagauucauuuugggccgggcucaguggcucaugccuguaaucccagcacuuug

SEQ ID NO: 227789 - RNA, 64 nt, Human
cuuguaaaaaauucuugaagugaggccgggugcgguggcucaugccuguaaucccaacgcuuug

SEQ ID NO: 227790 - RNA, 64 nt, Human
gccauuuaauacccugcaauguaauugucccucuguggcucacauuucauuagugagccaugaa

SEQ ID NO: 227791 - RNA, 64 nt, Human
gauaaguaauaaaagaggaagucagccaggcgcgguggcucaugccuguaaucccagcacuuug

SEQ ID NO: 227792 - RNA, 64 nt, Human
aacgaaugaaugaaugaaucuguggcuggaugcaguggcucaugccuguaaucccagcacuuug

SEQ ID NO: 227793 - RNA, 64 nt, Human
uugauauaauaauuacuuaauguggccgggcacgguggcucacaccuguaaucccagcacuuug

SEQ ID NO: 227794 - RNA, 64 nt, Human
ggggccacguagggugggcaccccaugggacucaguggcucacauuuccugccagcuacaccac

SEQ ID NO: 227795 - RNA, 64 nt, Human
ggucacuuaagaaguaagcaacuagcugggcacaguggcucaugccuguaauccuagcacuuug

SEQ ID NO: 227796 - RNA, 64 nt, Human
aaaugucaagaauuaaucuaggaggccgggccugguggcucacaccuguaaucccagcucuuug

SEQ ID NO: 227797 - RNA, 64 nt, Human
uggauccucaaaacucagaacguggccgggcgugguggcucacgccuguaaucccagcacuuug

SEQ ID NO: 227798 - RNA, 64 nt, Human
ucuccuuauaaaugccuaacacaggccgggucugguggcucaugccuguaaucccagcacuuug

SEQ ID NO: 227799 - RNA, 64 nt, Human; identical to SEQ ID NO: 9269

SEQ ID NO: 227800 - RNA, 64 nt, Human; identical to SEQ ID NO: 9270

SEQ ID NO: 227801 - RNA, 64 nt, Human; identical to SEQ ID NO: 9271

SEQ ID NO: 227802 - RNA, 64 nt, Human
uaacauagaauaugaaacaaauuggccgggugcgguggcucacgccuguaaucccagcacuuug

SEQ ID NO: 227803 - RNA, 64 nt, Human
ugaauugaacugaaaauuuauguggccagacacaguggcucaugccuguaaucucagcauuugg

SEQ ID NO: 227804 - RNA, 64 nt, Human
uuguccauauaaauuauauucauggccgggcgcgguggcucacgcuuguaaucccagcacuuug

SEQ ID NO: 227805 - RNA, 64 nt, Human
uuagacauuucaagagcaggguuggccaggcgcgguggcucacaccuguaaucccagcacuuug

SEQ ID NO: 227806 - RNA, 64 nt, Human
caguucaagagaacccacccagagacugggagugguggcucacgccuauaaucccugcgcuuug

SEQ ID NO: 227807 - RNA, 64 nt, Human
cucucaagagagggcagagggggggccaggugcaguggcucacgccuguaaucccagcaguuug

SEQ ID NO: 227808 - RNA, 64 nt, Human
cuccacaaaauuuaaaaauuagcggccgggcgcaguggcucacgccuguaaucccagcacuuug

SEQ ID NO: 227809 - RNA, 64 nt, Human
cugcauaaagagggaguuuugggggcugggcgccguggcucacucuuguaaucccaaaacuuua

SEQ ID NO: 227810 - RNA, 64 nt, Human
agcaaauaaaaauaguaaaauuuggccgggcacaguggcucacgccuguaaucccaacacuuug

SEQ ID NO: 227811 - RNA, 64 nt, Human
aauaaaauauaaauuaaaaaaguugccgggggugguggcucaugccuguaaucccagcacuuug

SEQ ID NO: 227812 - RNA, 64 nt, Human
cucagaugggagagagccagagagaggagugaggguggcucaaccuaauggaauuuuuaaauug

SEQ ID NO: 227813 - RNA, 64 nt, Human
ugucuuaagaaaacaaggaaggaggccgggcgcaguggcucacgccuguaaucccagcacuuug

SEQ ID NO: 227814 - RNA, 64 nt, Human
uaugcaaguccugucaagaaaacaggugggcaugguggcucaggucuguagucuuugggucuuu

SEQ ID NO: 227815 - RNA, 64 nt, Human
ccuuuaauuagaaaccauuuauuggccggacgcgguggcucacgccuguaaucgcagcacuuug

SEQ ID NO: 227816 - RNA, 64 nt, Human
ggaguuucacucuugcugcccaggcuggagugcaguggcucaaucucgggucacugcaaccucc

SEQ ID NO: 227817 - RNA, 64 nt, Human
ccugcugccuuaacaguggaguuggccaggcgcaguggcucacaccuguaaucccagcacuuug

SEQ ID NO: 227818 - RNA, 64 nt, Human; identical to SEQ ID NO: 9231

SEQ ID NO: 227819 - RNA, 64 nt, Human; identical to SEQ ID NO: 9272

SEQ ID NO: 227820 - RNA, 64 nt, Human; identical to SEQ ID NO: 9289

SEQ ID NO: 227821 - RNA, 64 nt, Human
cauauccauuaaaaguaucaacuggccaggcaggguggcucacgccuguacucccagcauuuug

SEQ ID NO: 227822 - RNA, 64 nt, Human
ucaagaauaaaguaugauuuuugagucaggcacaguggcucaugucugcaaucccagcgauuug

SEQ ID NO: 227823 - RNA, 64 nt, Human
ucuagagaagggagaggggcgugugcaugggaguguggcucaucucgggggccauggggccucc

SEQ ID NO: 227824 - RNA, 64 nt, Human
gugcgagugugugcaugugugugcucaggggcguguggcucacgugugugacucagaugucucu

SEQ ID NO: 227825 - RNA, 64 nt, Human
cuuuccuacaaaauggaauuggaggccgggcgcaguggcucacgccuguaaucccagcacuuug

SEQ ID NO: 227826 - RNA, 64 nt, Human
uuccuggaugagaaggaagucugggcugggcaugguggcucacgccuguaacccuagcacuuua

SEQ ID NO: 227827 - RNA, 64 nt, Human
cacacuucaggcucuucuccuuucacaaccuucuguggcucacagaacccuuggagccaaugga

SEQ ID NO: 227828 - RNA, 64 nt, Human
gacuuaagucaagaaggagcauuagccuggugugguggcucaugccuguaaucccugcaauuug

SEQ ID NO: 227829 - RNA, 64 nt, Human
ccccuccguguggagcacguggagauagugccagguggcucagugccaccuaugccugugguga

SEQ ID NO: 227830 - RNA, 64 nt, Human
auaaaaauaaaaagagaauaauaggccaggcacuguggcucaugccccuaaucccagcacuuuu

SEQ ID NO: 227831 - RNA, 64 nt, Human
uuuuuuaaaaaauucugauuuagggcuaggugugguggcucaggccuguaauccuggcacuuug

SEQ ID NO: 227832 - RNA, 64 nt, Human
cauaauaugaauaaggauggauaggccgggcgugguggcucaugccuauaaucccagcacguug

SEQ ID NO: 227833 - RNA, 64 nt, Human
uuuaaaaauauuucaaacauaagggcggggugugguggcucaugccuguaaucccagcacuuug

SEQ ID NO: 227834 - RNA, 64 nt, Human
auaaggcacuuuuaccagguguguguuggaauugguggcucaggauaggucuuaaauuuuaaau

SEQ ID NO: 227835 - RNA, 64 nt, Human
acuuuugucauuaagaaagacuggggugggugugguggcucacgccuguaaccccagcacuuug

SEQ ID NO: 227836 - RNA, 64 nt, Human
agccgccccagccugaggucugcaacaccaagaaguggcucaggcaacucuggacaucucugcc

SEQ ID NO: 227837 - RNA, 64 nt, Human; identical to SEQ ID NO: 9262

SEQ ID NO: 227838 - RNA, 64 nt, Human; identical to SEQ ID NO: 9274

SEQ ID NO: 227839 - RNA, 64 nt, Human; identical to SEQ ID NO: 9275

SEQ ID NO: 227840 - RNA, 64 nt, Human
auuuuuuaaaaccuccauaaguaguccaggggcgguggcucacgccuguaaucccagcacuuug

SEQ ID NO: 227841 - RNA, 64 nt, Human
acacaauuaaaaucuuaauuguuggcugggcacaguggcucacgccuguaaucccagcacuuug

SEQ ID NO: 227842 - RNA, 64 nt, Human
gguugccucaaaagucacagcuuagcugggcacaguggcucaugccgauaaucccagcaauuca

SEQ ID NO: 227843 - RNA, 64 nt, Human
cuuucaccuucuuuaaaacucucggcugggcgcaguggcucaugccuguaaucccagcauuuug

SEQ ID NO: 227844 - RNA, 64 nt, Human
guuacuuuaaaaagacuugguucagcuggucacgguggcucacgccuguaaucccagcacuuug

SEQ ID NO: 227845 - RNA, 64 nt, Human
cauucacuuaacaaguaguuauuggcugugcacaguggcucacgccuauaaucccagcauuuug

SEQ ID NO: 227846 - RNA, 64 nt, Human
gccuguggcuggccucagaaucaggcugggugcaguggcucacaccuguaaucccagcauuuug

SEQ ID NO: 227847 - RNA, 64 nt, Human
aucccgcgggguggcccaugcagaccaggcgcacguggcucauggggcagaauugccaaggaca

SEQ ID NO: 227848 - RNA, 64 nt, Human
gaagccauucuaaagagaagagagaccaggugugguggcucacgcauguaaucccagcacucug

SEQ ID NO: 227849 - RNA, 64 nt, Human
aaaauaaaaauagaagaagaaaaggccgggcaugguggcucaugccuguaaucccaacacuuug

SEQ ID NO: 227850 - RNA, 64 nt, Human
gugguccucauaaaaaucuugagggccgggcaugguggcucacgccuguaaucucagcacuuug

SEQ ID NO: 227851 - RNA, 64 nt, Human
aucaaucaaucaaucacuguccuggccaguugcaguggcucacgccuauaaucccaacacuucg

SEQ ID NO: 227852 - RNA, 64 nt, Human
guaucaccaccuaugcuaucaacgugagccugauguggcucaguuuccggaagguccaagaacc

SEQ ID NO: 227853 - RNA, 64 nt, Human
augauuaaaaacaagguauuuuucgggccaggcgguggcucacgcuuguaaucgcagcacuuug

SEQ ID NO: 227854 - RNA, 64 nt, Human
guuaguuuacuccauucuuugugacacgagucaaguggcucacaaccuccucagggcaccagag

SEQ ID NO: 227855 - RNA, 64 nt, Human
uucaaggauagaaaauacuucacugccgggcaugguggcucaugccuauaaucccagugcuuug

SEQ ID NO: 227856 - RNA, 64 nt, Human; identical to SEQ ID NO: 9278

SEQ ID NO: 227857 - RNA, 64 nt, Human; identical to SEQ ID NO: 9279

SEQ ID NO: 227858 - RNA, 64 nt, Human; identical to SEQ ID NO: 9280

SEQ ID NO: 227859 - RNA, 64 nt, Human
gugcguguguguguauguggucugugacaagccuguggcucaccugccuguccgggguguagua

SEQ ID NO: 227860 - RNA, 64 nt, Human
uaaauuaaauuaaaugugugccaggccgggugcgguggcucaugccuguaaucccagcauuuug

SEQ ID NO: 227861 - RNA, 64 nt, Human
uucuguccaaaaagccaaaagguggccaggcuugguggcucaggccuguaaucccagcacuuug

SEQ ID NO: 227862 - RNA, 64 nt, Human
ucauuaagaaugugggaaauaggggccgagugcgguggcucacaccuguaaucccagcaguuug

SEQ ID NO: 227863 - RNA, 53 nt, Human
gcccggaguucucagugugaggcguggcucaucagacugaaacuugcucacag

SEQ ID NO: 227864 - RNA, 64 nt, Human
auuucuugggcugaauuuagacucucucacagagguggcucacagagaaggauggcagauggug

SEQ ID NO: 227865 - RNA, 64 nt, Human
uaacuaagaguagaauaccuucaggccaggcgcgguggcucacgccuguaaucccagcacuuug

SEQ ID NO: 227866 - RNA, 64 nt, Human
agaaaggauaaagaaaaugugguggcagggagugguggcucaugucuguaaucccagcacuuug

SEQ ID NO: 227867 - RNA, 64 nt, Human
uaugaggucaagaaaugugacuuggccgggcgcgguggcucacgccuguaaucccagcacuuug

SEQ ID NO: 227868 - RNA, 64 nt, Human
caccaagaaguggcugccaaagagacugggcgcaguggcucaugcccauaaucccagcacuuug

SEQ ID NO: 227869 - RNA, 64 nt, Human
aaaaauuaaaaguauaauuauucggccgggcaugguggcucacaccuguaauuccagcacuuug

SEQ ID NO: 227870 - RNA, 64 nt, Human
aacuggcauuuaaaaaauacuguggccgggcgugguggcucaugccuguaaucccagcacuuug

SEQ ID NO: 227871 - RNA, 64 nt, Human
cuugccauaaaaaggcugaaggcagccgggcgcaguggcucacgccuguaaucccagcacuuug

SEQ ID NO: 227872 - RNA, 64 nt, Human
agcccaguuagaaaauaagucugggccggcggcgguggcucacaccugcauaggcagugcuuug

SEQ ID NO: 227873 - RNA, 64 nt, Human
uguuaaaaauucucuuugcugggggccgggugugguggcucacaccuguaaucucggcacuuug

SEQ ID NO: 227874 - RNA, 64 nt, Human
ucugaccuauuaaaacaugaacaggccaggcaugguggcucacgccuguaauccuagcacuugg

SEQ ID NO: 227875 - RNA, 64 nt, Human; identical to SEQ ID NO: 9218

SEQ ID NO: 227876 - RNA, 64 nt, Human; identical to SEQ ID NO: 9283

SEQ ID NO: 227877 - RNA, 64 nt, Human; identical to SEQ ID NO: 9284

SEQ ID NO: 227878 - RNA, 64 nt, Human
agauuaggucaugcaggccuuuaccggcauugauguggcucauguuucaggcagacuugggguc

SEQ ID NO: 227879 - RNA, 64 nt, Human
gccaaaauccccaucuucuugcaccucaacgucuguggcucagggcugggguggcagagggagg

SEQ ID NO: 227880 - RNA, 56 nt, Human
ugaagguucauggguuuuaagugcuuguggcucacugaagcuuaagugaggauuuc

SEQ ID NO: 227881 - RNA, 64 nt, Human
ucuguuuuaaaucccccaccccuggcugggcucaguggcucaccccuguaaucccagcacuuug

SEQ ID NO: 227882 - RNA, 64 nt, Human
cucuuguuaagaagguucugccaggccgggcgcgguggcucacaccuguaaucccagcacuuug

SEQ ID NO: 227883 - RNA, 64 nt, Human
uugagccuguauuaaaggaaucaggccaggcacaguggcucacgccuguaaucucagcacauug

SEQ ID NO: 227884 - RNA, 64 nt, Human
aagaaaaauaagagcagcuccgagggcaggcaugguggcucaugccuguaaucccagcacuuug

SEQ ID NO: 227885 - RNA, 64 nt, Human
gacuucuuuuacaaguaacucuaggcugggugugguggcucacgccuauaaucccagcacuuug

SEQ ID NO: 227886 - RNA, 64 nt, Human
ugaucuuaauauucaugaccacuggccaggcgagguggcucacaccuguaaucccagcacuuug

SEQ ID NO: 227887 - RNA, 64 nt, Human
cagacaacaguugcacagugccucaagccccagaguggcucacccuguccagaccuuugaggau

SEQ ID NO: 227888 - RNA, 64 nt, Human
guaauuauaaccuucagcuacuaagacaggugugguggcucacgccugugauuauaaucuucag

SEQ ID NO: 227889 - RNA, 64 nt, Human
ugggucaaagugcggcugccauuggagccaauguguggcucagugccuggacaaaugaugccau

SEQ ID NO: 227890 - RNA, 64 nt, Human
acuauuggauacauuuggcauugggcugagugugguggcucaugccuguaaucccagcacuuug

SEQ ID NO: 227891 - RNA, 64 nt, Human
ggucuucgcuuuaaucuuaguuccgccaggcacgguggcucacaccuguaaucccagcacuuug

SEQ ID NO: 227892 - RNA, 64 nt, Human
gaagguauuuaauaacugggcgaggaugggugugguggcucacaccuguaaucccagcauuuug

SEQ ID NO: 227893 - RNA, 64 nt, Human
caaagcuucuuccugcguggcuccaggaaaagauguggcucacguagguggcaccugccaauag

SEQ ID NO: 227894 - RNA, 64 nt, Human; identical to SEQ ID NO: 9200

SEQ ID NO: 227895 - RNA, 64 nt, Human; identical to SEQ ID NO: 9201

SEQ ID NO: 227896 - RNA, 64 nt, Human; identical to SEQ ID NO: 9202

SEQ ID NO: 227897 - RNA, 64 nt, Human
uauguaggaguaaauaguauauaaaauagcucugguggcucaugccuguaauccagcacuuugg

SEQ ID NO: 227898 - RNA, 64 nt, Human
agcccaguguaggccaucuccucugugcccucugguggcucauuguccucagagcccagacagu

SEQ ID NO: 227899 - RNA, 64 nt, Human
gugcuuugaaaaaauguugaaccggcugggcgcgguggcucacgucuguaaucccagcacuuug

SEQ ID NO: 227900 - RNA, 64 nt, Human
ucugccuuaagaauguccuuuuaggcugggcaugguggcucacgccuguaaccccagcacuuug

SEQ ID NO: 227901 - RNA, 64 nt, Human
ccaucucaaaaaaaaaaauaagaggccgggugcgguggcucaagccuguaaucccagcacuuug

SEQ ID NO: 227902 - RNA, 64 nt, Human
acacaaguuaaagagguuuugcuggccagguaugguggcucacgccuguaaucccagcacuuug

SEQ ID NO: 227903 - RNA, 64 nt, Human
gagcugagaucacaccaaaaugggguggggcgcaguggcucacgccuguaaucccagcacuuug

SEQ ID NO: 227904 - RNA, 64 nt, Human
cugcaugucuaaaagaaaauaugggccuggugugguggcucacaccuguaaucccaacacuuug

SEQ ID NO: 227905 - RNA, 64 nt, Human
ccucucaugcguguuuuaccuuuugauguucagaguggcucacuggcugggaguccuuaccucg

SEQ ID NO: 227906 - RNA, 64 nt, Human
ugggagccccagccaaauccugggcucccugccuguggcucagccccagcucccaaggccugcc

SEQ ID NO: 227907 - RNA, 64 nt, Human
guaggguagaagaaaacagcuguggucgggcacgguggcucacgccuauaaucccagcacuuug

SEQ ID NO: 227908 - RNA, 64 nt, Human
uuaaauaacucuuuacaaauaagggucgggcacgguggcucacgccuguaaucccagcucuuug

SEQ ID NO: 227909 - RNA, 64 nt, Human
ucauugcuuuaauaaagaacccaggccgggugcaguggcucaugccuguaaucccagcacuuug

SEQ ID NO: 227910 - RNA, 64 nt, Human
aaaaggccccuggaguuguucaggcuguugggagguggcucagccucgaaggacagacugcaca

SEQ ID NO: 227911 - RNA, 64 nt, Human
agcaguuacaaaaaccuuccccaggcuggacgugguggcucacgccuguaaucccagcacuuug

SEQ ID NO: 227912 - RNA, 64 nt, Human
gugggcuuuaggggauaagauugcaucuuccauaguggcucaaacugcagguaucccaacucuu

SEQ ID NO: 227913 - RNA, 64 nt, Human; identical to SEQ ID NO: 9205

SEQ ID NO: 227914 - RNA, 64 nt, Human; identical to SEQ ID NO: 9206

SEQ ID NO: 227915 - RNA, 64 nt, Human; identical to SEQ ID NO: 9207

SEQ ID NO: 227916 - RNA, 64 nt, Human
agcaucugaagaagagggucgugggcugggcgcgguggcucacaccuguaaucucaacgcuuug

SEQ ID NO: 227917 - RNA, 64 nt, Human
gcuuagaaaguccuucacuacauggccaggugcaguggcucacgccuguagucccagguacuug

SEQ ID NO: 227918 - RNA, 64 nt, Human
ccuagacucacaagcugguccuuggccaggugcaguggcucacgccuguaaucccagcacuuug

SEQ ID NO: 227919 - RNA, 64 nt, Human
uucaaguagaaaacccaagagcuggccaggugugguggcucaugccuguaaucccagcacuuug

SEQ ID NO: 227920 - RNA, 64 nt, Human
uaugcccucaguggcuggauugcagccacccaugguggcucagaauaucuggauuggagaggca

SEQ ID NO: 227921 - RNA, 64 nt, Human
ccaucuuuaaaaaaaaacaagacgggccggcacgguggcucacgccuguaaucccagcacugag

SEQ ID NO: 227922 - RNA, 64 nt, Human
cuauuuauuaaaaacuuaagaugggccaggugcgguggcucacaccuguaaucccagcauuuug

SEQ ID NO: 227923 - RNA, 64 nt, Human
uucuguauuuaagaaacuuaagcagccgggcaugguggcucacgccuguaaucccagcacuuug

SEQ ID NO: 227924 - RNA, 64 nt, Human
ucugcugaccccgcucugaaagccgggggugaguguggcucagccaucccggcuggguuugcca

SEQ ID NO: 227925 - RNA, 64 nt, Human
uuuauuuaaaaagaaaaauuagcagccaggugcaguggcucacgccuguaaucccagcacuuua

SEQ ID NO: 227926 - RNA, 64 nt, Human
ucuucuucaguuguaguuuggaagguuccuugguguggcucaugaaaucacagagcucagagau

SEQ ID NO: 227927 - RNA, 64 nt, Human
agagucuuaagggucacuggccucuccccaggaaguggcucagaccccucagccccagcccaga

SEQ ID NO: 227928 - RNA, 64 nt, Human
uuagggaaagaguauaaauagccagccaggggcgguggcucaugccuguaaucccagcacuuug

SEQ ID NO: 227929 - RNA, 64 nt, Human
cccuggcccuccugcugcugcugguccaggggguguggcucaguggcuggugguggaccuggag

SEQ ID NO: 227930 - RNA, 64 nt, Human
ggcuuccugagaaagcccaccugggcugggcgcgguggcucacgccuguaaucccagcacuuug

SEQ ID NO: 227931 - RNA, 64 nt, Human
gggcagaaauagccccgucccagagccggccaugguggcucauaccuguuauaccagcacuuug

SEQ ID NO: 227932 - RNA, 64 nt, Human; identical to SEQ ID NO: 9285

SEQ ID NO: 227933 - RNA, 64 nt, Human; identical to SEQ ID NO: 9311

SEQ ID NO: 227934 - RNA, 64 nt, Human; identical to SEQ ID NO: 9337

SEQ ID NO: 227935 - RNA, 64 nt, Human
ugguuccaagggugucugcuuuuggccaggcgcaguggcucacgcuuguaaucccagcacuuug

SEQ ID NO: 227936 - RNA, 64 nt, Human
ugugcgguuaagaaggagcucuuggccgggcgcgguggcucacgccuguaaucccagcacuuug

SEQ ID NO: 227937 - RNA, 64 nt, Human
ccuuucuuaauuccccaaaucuuggcugggcacgguggcucacgccuguaaucccagcacuuug

SEQ ID NO: 227938 - RNA, 64 nt, Human
gggagguggcccucguggcccacgcuccaugccaguggcucacgcucugcuccuggcuacccca

SEQ ID NO: 227939 - RNA, 64 nt, Human
auuuuuaaaaauuuuuauuuguuggccgggcaugguggcucacgccugaaaucccagcacuuug

SEQ ID NO: 227940 - RNA, 64 nt, Human
uacauuaaaaccacacuggauccggauacguaugguggcucacgccuguaaucccaacacuuug

SEQ ID NO: 227941 - RNA, 64 nt, Human
cucauccuuaaagagaagucaccggccgggcacgguggcucacgccuguaaucccagcacuuug

SEQ ID NO: 227942 - RNA, 64 nt, Human
ugaaccaccaaaaagaaauaaagggcugagugcgguggcucacgccuguaaucccagcacuuug

SEQ ID NO: 227943 - RNA, 64 nt, Human
cuuuccuggcaucagucugcaggaccaagcggugguggcucacuugggaagagccuugugcucu

SEQ ID NO: 227944 - RNA, 64 nt, Human
uguacccuuaaaaguacagauguggccgggcacaguggcucacaccuguaaucccagcacuuug

SEQ ID NO: 227945 - RNA, 64 nt, Human
aauacagaaauguaccuguuggcggccgggugcaguggcucacgccuguaaucccagcacuucg

SEQ ID NO: 227946 - RNA, 64 nt, Human
gcgaaaccugcacccucucuucugagucacgccuguggcucaucggcuucccucuuaaccuuua

SEQ ID NO: 227947 - RNA, 64 nt, Human
ucucagacugcaagagcgaauccagccgggcgugguggcucacaccuguaaccccagcacuuug

SEQ ID NO: 227948 - RNA, 64 nt, Human
uuuaaauuuauuauagagugggaggcagggugcgguggcucaugccuauaauccuaacacuuua

SEQ ID NO: 227949 - RNA, 64 nt, Human
guucagaaaauucacagcaggagggccgggcgcaguggcucacgccuguaaucccagcacuuug

SEQ ID NO: 227950 - RNA, 64 nt, Human
gaccgcuggaaaacacugucacuuucagagcucgguggcucacagcguguccugccccgguuug

SEQ ID NO: 227951 - RNA, 64 nt, Human; identical to SEQ ID NO: 9210

SEQ ID NO: 227952 - RNA, 64 nt, Human; identical to SEQ ID NO: 9211

SEQ ID NO: 227953 - RNA, 64 nt, Human; identical to SEQ ID NO: 9212

SEQ ID NO: 227954 - RNA, 64 nt, Human
ugucucaaaaaaaauaaaaaauaaucagggcacaguggcucaugccuguaaucccagcacucug

SEQ ID NO: 227955 - RNA, 64 nt, Human
ccccgugguggcccguggcagcccguggcauggcguggcucagcugucuguugaaguuguugca

SEQ ID NO: 227956 - RNA, 64 nt, Human
aaaugcugacguaaagguaucagggccgggcgcuguggcucaugacuauaaucccagcuguuug

SEQ ID NO: 227957 - RNA, 64 nt, Human
uaaucuuuccuaaagaagugcuuggcuggggaugguggcucacgcuuguaaucccaguacuuug

SEQ ID NO: 227958 - RNA, 64 nt, Human
uguguuuaaaacaugcacggugaggccgggcgcaguggcucacgccuguaaucccagcacuuug

SEQ ID NO: 227959 - RNA, 64 nt, Human
ccaacaauaaaagacuuggccuuggcugggcaugguggcucacgccuguaaucccagcacuuug

SEQ ID NO: 227960 - RNA, 64 nt, Human
cacaaaaaaagacuuggccuuagggccgagugcgguggcucacgccuauaaucccagcacuuug

SEQ ID NO: 227961 - RNA, 64 nt, Human
ucaacaguaaaagacuuggcauuggcugggcaugguggcucacgccuguaaucccagcacuuug

SEQ ID NO: 227962 - RNA, 64 nt, Human
auuugaacagauguuuuggcucuggcugggugugguggcucacaccuguaaucccagcacuuug

SEQ ID NO: 227963 - RNA, 64 nt, Human
aaauguagaagcuauauguauauuuuguuaauuaguggcucauauuuaaaauaguucucugacu

SEQ ID NO: 227964 - RNA, 64 nt, Human
gcggacgccgcgcucugggucccagaggggccggguggcucagacgacccaccacucccccacc

SEQ ID NO: 227965 - RNA, 64 nt, Human
cgcuguaacagaacugaauuuggaccccagcacaguggcucacgccuguaaucccagcacuuug

SEQ ID NO: 227966 - RNA, 64 nt, Human
cuauuaaaaagcuuccaucucccggcugggcacgguggcucaugccucuaaucccagcacuuug

SEQ ID NO: 227967 - RNA, 64 nt, Human
cuguugucuaaaagcacacugcaagccgggcucaguggcucaugccuguagucccagcacucug

SEQ ID NO: 227968 - RNA, 64 nt, Human
uuccuucuuuaaaauugcaucuugaccaggcacaguggcucaugccuauaauccuagcacuuug

SEQ ID NO: 227969 - RNA, 64 nt, Human
gguguccucauaagauaaggagaggccaggccugguggcucacgccuguaaucccagcacuuua

SEQ ID NO: 227970 - RNA, 64 nt, Human; identical to SEQ ID NO: 9215

SEQ ID NO: 227971 - RNA, 64 nt, Human; identical to SEQ ID NO: 9216

SEQ ID NO: 227972 - RNA, 64 nt, Human; identical to SEQ ID NO: 9217

SEQ ID NO: 227973 - RNA, 64 nt, Human
auuuuaaaaagacgaaaagugacggccaggugcaguggcucacgccuauaaucucagcacucug

SEQ ID NO: 227974 - RNA, 64 nt, Human
aauuaaaaaaagaagacgagagauagugggugugguggcucacaccugcaaucccagcacuuug

SEQ ID NO: 227975 - RNA, 64 nt, Human
caggacggcccagacaucccuacuggcuucgcugguggcucaucucgaacauccacgccagccu

SEQ ID NO: 227976 - RNA, 64 nt, Human
ccgaaaaaauaauuaaacucgcaggccaggcacgguggcucaugccuguaaucccagcacuuug

SEQ ID NO: 227977 - RNA, 64 nt, Human
caaggaaauuggaacugccacccagcccagcaugguggcucaauugguugguugcguugucagu

SEQ ID NO: 227978 - RNA, 64 nt, Human
cuuaccagacauaagauaauucuggcugggugcgguggcucacaccuguaaucccagcacuuug

SEQ ID NO: 227979 - RNA, 64 nt, Human
gauagcuauuaaaauaaucaguagccugggcauaguggcucacaccuguaaucccaauacuuua

SEQ ID NO: 227980 - RNA, 64 nt, Human
uauauauaaaaauaccaaaaagaggcugggcgugguggcucacgccuguaaucccagcacuuug

SEQ ID NO: 227981 - RNA, 64 nt, Human
uaagagucugaggagugugggaagugcuucguguguggcucaaacauuguugaacaucggggaa

SEQ ID NO: 227982 - RNA, 64 nt, Human
aauacaacuucaaaaggauuucaggcugagugugguggcucacgccuauacacccagcacuuug

SEQ ID NO: 227983 - RNA, 64 nt, Human
aaugaccuugaaaauggaguucuggccaggugcgguggcucacgccuguaaucccagcacuuug

SEQ ID NO: 227984 - RNA, 64 nt, Human
uugacacauaaaacugaccaucgggccgggggcgguggcucacgccuguaaucccaacacuuug

SEQ ID NO: 227985 - RNA, 64 nt, Human
ccuauuuuaaaauguuggcuccuagcggggcgcaguggcucacgccuguaaucccagcacuuug

SEQ ID NO: 227986 - RNA, 64 nt, Human
uucucuaaaaugcaauaauaaugggccaggugaaguggcucacaccuguaaucccagcacugug

SEQ ID NO: 227987 - RNA, 64 nt, Human
ucuaaauaaauaaauaaaaugcgggccaggcacaguggcucacaccuguaaucccagcacuaug

SEQ ID NO: 227988 - RNA, 64 nt, Human
uuguauagauuuuuaaaacugguggcugggcgugguggcucacgccuguaaucccagcacuuug

SEQ ID NO: 227989 - RNA, 64 nt, Human; identical to SEQ ID NO: 9242

SEQ ID NO: 227990 - RNA, 64 nt, Human; identical to SEQ ID NO: 9247

SEQ ID NO: 227991 - RNA, 64 nt, Human; identical to SEQ ID NO: 9281

SEQ ID NO: 227992 - RNA, 64 nt, Human
gaaaauaaaaauaaaaauaaacuggccaggugcgguggcucacgcuugcaaucccagugcuuug

SEQ ID NO: 227993 - RNA, 64 nt, Human
guaccuauuuaagaauuuaagagggucgggugcgguggcucaugccuauaauccuagcacuuug

SEQ ID NO: 227994 - RNA, 64 nt, Human
caccucccucaaaccuugagauaggcugggugcgguggcucacgccuguaaucccaacacuuug

SEQ ID NO: 227995 - RNA, 64 nt, Human
aguuaauuuaaaaaagaaaauuaggcugagagcaguggcucacgccuguaaucccagaacuuug

SEQ ID NO: 227996 - RNA, 64 nt, Human
ucucaauaauaacaacaacaaaaauaacccaggaguggcucaagaguccagugugggaugaaaa

SEQ ID NO: 227997 - RNA, 64 nt, Human
uaacagaaaucucagugaacaguggccuggcgugguggcucaugccuguaaugcucgcacuuug

SEQ ID NO: 227998 - RNA, 64 nt, Human
uugucagcucuggguguuuguucccugccacuaaguggcucagucacaccuuugcugaaacaca

SEQ ID NO: 227999 - RNA, 64 nt, Human
ucaggguucccacuacccccucuuuggggguagaguggcucauggaacucagagaaacauuuau

SEQ ID NO: 228000 - RNA, 64 nt, Human
uuaaccuuggucacauugagucauuccaggaugaguggcucaaguauuuccucagggaaaauac

SEQ ID NO: 228001 - RNA, 64 nt, Human
auauuucauggaaauaaacucagggcccggagcgguggcucacaccuguaaucccagcacuuug

SEQ ID NO: 228002 - RNA, 64 nt, Human
uggcuuuccuauaagaaauuuagggcagggcacgguggcucacgccuguaauuccagcacuuug

SEQ ID NO: 228003 - RNA, 64 nt, Human
guguguauuaauaugcuauguaaggcugggcgugguggcucacgccuguaacccagcacuaugg

SEQ ID NO: 228004 - RNA, 64 nt, Human
uguuauuuuaacaaauuucucuaggcugggcaugguggcucaugccuauaaucccagcacuuua

SEQ ID NO: 228005 - RNA, 64 nt, Human
ugucuuagaaauauguguguauaggcugggugcgguggcucaugccuguaaucccagcacuuug

SEQ ID NO: 228006 - RNA, 64 nt, Human
auugcuuagaauaugacaugcugaaccaggcaugguggcucaugcuuguaaaccugaugcuuug

SEQ ID NO: 228007 - RNA, 64 nt, Human
uagcuuuaagaaguaccugcaagggucaggcgcaguggcucacaccuguaaucccagcacuuug

SEQ ID NO: 228008 - RNA, 64 nt, Human; identical to SEQ ID NO: 9185

SEQ ID NO: 228009 - RNA, 64 nt, Human; identical to SEQ ID NO: 9220

SEQ ID NO: 228010 - RNA, 64 nt, Human; identical to SEQ ID NO: 9221

SEQ ID NO: 228011 - RNA, 64 nt, Human
gcaguuucuaaaaucacacaggugagugggcaugguggcucaugccuguaaucccagcacuuug

SEQ ID NO: 228012 - RNA, 64 nt, Human
cauuagggauacaaaaaugaacaggcugggagugguggcucagccuacaaucccaacacuuugg

SEQ ID NO: 228013 - RNA, 64 nt, Human
gccuuaacaggaugggaucgaggguccccaugggguggcucagagauaggacccugguuuuaaa

SEQ ID NO: 228014 - RNA, 64 nt, Human
uuuucauaauuauuuaaaagacaggccgggcgcgguggcucacgucuguaaucccagcacuuug

SEQ ID NO: 228015 - RNA, 64 nt, Human
ccuuguuaaauaucaggaauauaggccgggugcgguggcucacaccuguaaucccagcacuuug

SEQ ID NO: 228016 - RNA, 64 nt, Human
ccugucucacuugauugacagccggccaggcgcgguggcucacgccuguaaucccagcacuuug

SEQ ID NO: 228017 - RNA, 64 nt, Human
acugcaaagaaaaccgaugaugaggccgggugcgguggcucacaccuguaaucccagcacuuug

SEQ ID NO: 228018 - RNA, 64 nt, Human
gcugucuacaaaaugccaaggguggacaggcgcuguggcucacgccuguaaucccagcacuuug

SEQ ID NO: 228019 - RNA, 64 nt, Human
caggagcccaaguuguucuggccacaccuucuuuguggcucagugccaaugugucccacagaac

SEQ ID NO: 228020 - RNA, 64 nt, Human
ucuacaaaaaaauuaaaaaauuuggccuggugugguggcucaugccugugauccuagcacuuug

SEQ ID NO: 228021 - RNA, 64 nt, Human
gccgggacuuaaaaagauaaggaggccaggugugguggcucaugccugcaaucccagcacugua

SEQ ID NO: 228022 - RNA, 64 nt, Human
gucauaaaaaaaauacgagguuuggccgggugcaguggcucaugccuauaaucccagcacuuug

SEQ ID NO: 228023 - RNA, 64 nt, Human
uuugguaacuuaaaaguacaugaggcugggcacaguggcucacgccuguaaucccagcacuuag

SEQ ID NO: 228024 - RNA, 64 nt, Human
ucacauuggaaauaaacucuauggcuugggcacgguggcucaugccuguaaucccuaacacuuu

SEQ ID NO: 228025 - RNA, 64 nt, Human
aaaaaaaagggggggcgggggacgggugggugcaguggcucacaucuguaaccccagcacuuug

SEQ ID NO: 228026 - RNA, 64 nt, Human
agcuuauaagaucuaacccuuauggccaggugcaguggcucacguauguaaucccagcacuuug

SEQ ID NO: 228027 - RNA, 64 nt, Human; identical to SEQ ID NO: 9224

SEQ ID NO: 228028 - RNA, 64 nt, Human; identical to SEQ ID NO: 9225

SEQ ID NO: 228029 - RNA, 64 nt, Human; identical to SEQ ID NO: 9226

SEQ ID NO: 228030 - RNA, 64 nt, Human
uugccuauuaaaccucugcuccuggccaggcacaguggcucacgccuauaaucccagcacuuug

SEQ ID NO: 228031 - RNA, 64 nt, Human
ucuuuggucaagagucaguuuggggccaggcgugguggcucaugccuguaaucucagcacuuug

SEQ ID NO: 228032 - RNA, 64 nt, Human
aacguuuaaaaacaaaguuccccggccaggcacaguggcucacaccuguaaucccagcacuuug

SEQ ID NO: 228033 - RNA, 64 nt, Human
cacaguggaaauaucuaagguagggccgggcaugguggcucacgccuguaaugccagcacuuug

SEQ ID NO: 228034 - RNA, 64 nt, Human
acccaaguaaagaacagccaaguggccaggugcgguggcucaugccuguaaucccagcacuuug

SEQ ID NO: 228035 - RNA, 64 nt, Human
uguggaugaaaauuaucaaaauuggccaggcuugguggcucaugccuguaaucccagcacuuug

SEQ ID NO: 228036 - RNA, 64 nt, Human
gaauuauuuuaaaaaaaauuucuggcugggcccgguggcucaugccuguaaucccagcacuuug

SEQ ID NO: 228037 - RNA, 64 nt, Human
uugucagucaagaccagccuugcagccaggugcaguggcucacaccuguggaaucccagcacuu

SEQ ID NO: 228038 - RNA, 64 nt, Human
ccgucucaaaaagaaaaaguuuggaucaggcaggguggcucacaccuguaaucccugcacuuug

SEQ ID NO: 228039 - RNA, 64 nt, Human
cuacguuaaaaaaaaaaaguuugggccaggcacaguggcucaugccuguaaucccagcacuuug

SEQ ID NO: 228040 - RNA, 64 nt, Human
uaugcugcuugauuaaaauggguaggcuucucauguggcucauucuuuaaucuauucucuuuua

SEQ ID NO: 228041 - RNA, 64 nt, Human
caaaguuuuggauuagaaagcucggccgggcucgguggcucacuccuguaaucccagcacuuug

SEQ ID NO: 228042 - RNA, 64 nt, Human
gccuauaucaaaacaucauggaaggacaggcacaguggcucaugccuguaguccuagcacuuug

SEQ ID NO: 228043 - RNA, 64 nt, Human
ucccuguacagaagggaaacaaacgccaggcacgguggcucaugccuguaaucccaacacuuug

SEQ ID NO: 228044 - RNA, 64 nt, Human
cuuaaggaggaaaaaaacggugcggcugggagcgguggcucacgccuguaauccuagcaccuug

SEQ ID NO: 228045 - RNA, 64 nt, Human
uguguugcccaggcuggagugcaguagugcagucguggcucacugcagccuccaccuccugggc

SEQ ID NO: 228046 - RNA, 64 nt, Human; identical to SEQ ID NO: 9227

SEQ ID NO: 228047 - RNA, 64 nt, Human; identical to SEQ ID NO: 9229

SEQ ID NO: 228048 - RNA, 64 nt, Human; identical to SEQ ID NO: 9230

SEQ ID NO: 228049 - RNA, 64 nt, Human
aaaucuuuuaaaacuuggcuguuggccgggcacgguggcucacgccuguaaucccagcacuuug

SEQ ID NO: 228050 - RNA, 64 nt, Human
ccacaauagaaaaaggcagaaaaggccgggcgcgguggcucaugccuguaaccccagcacuuug

SEQ ID NO: 228051 - RNA, 64 nt, Human
accaaauguaagagaaccuccaagucagggcgcaguggcucaccccuguaaucucagcacuuug

SEQ ID NO: 228052 - RNA, 64 nt, Human
ugaacauuuaaaaaaaaaaaaaaggcugggcaugguggcucacgccuguaaucucaacacuuug

SEQ ID NO: 228053 - RNA, 64 nt, Human
ucucucuuuuaaaaaaacaucuggccagggcacaguggcucacgccuguaaucccagcacuuug

SEQ ID NO: 228054 - RNA, 64 nt, Human
aaauuauauaaauuaaccuaccuggccaggcacaguggcucacaccuguaaucucagcacuuug

SEQ ID NO: 228055 - RNA, 64 nt, Human
aaaaaaaaaaaaaaaaggauaucaaagcuggaugguggcucaucccugcaaucacaacacuuug

SEQ ID NO: 228056 - RNA, 64 nt, Human
aacuguuuauguuaagaggacugggcugggcacuguggcucacgccugcaaugccagcacuuug

SEQ ID NO: 228057 - RNA, 64 nt, Human
gaugauguugaaagugaugcacaggacaggugugguggcucacaccuguaaucccagcacuuug

SEQ ID NO: 228058 - RNA, 64 nt, Human
aagaaacaucaaauuugcgaugagaccagaugcuguggcucaggccuguaaucccauaauuuuc

SEQ ID NO: 228059 - RNA, 64 nt, Human
aagaaugcgagaaauauaaaucaggccaggcacgguggcucacaccuguaaucccaguacuuug

SEQ ID NO: 228060 - RNA, 64 nt, Human
cuuguuuugaaauugaagagagaggccaggcgcgguggcucacaccuguaaucccagcacuuug

SEQ ID NO: 228061 - RNA, 64 nt, Human
gauuccuugaaaaugcaaugacuggcugggugcaguggcucaugccuguaaucccaacacuuug

SEQ ID NO: 228062 - RNA, 64 nt, Human
gguaugggaagaaauucucuacuggccgggcacaguggcucacgccuguaaugccagcacuuug

SEQ ID NO: 228063 - RNA, 64 nt, Human
guggauagaaaccuuacaaaggacgccgggcgugguggcucacgccuguaaucccagcacuuug

SEQ ID NO: 228064 - RNA, 64 nt, Human
ucaaauuaauguuugacagagcuggccaggcgugguggcucauguauguaauccuagcacuucg

SEQ ID NO: 228065 - RNA, 64 nt, Human; identical to SEQ ID NO: 9198

SEQ ID NO: 228066 - RNA, 64 nt, Human; identical to SEQ ID NO: 9203

SEQ ID NO: 228067 - RNA, 64 nt, Human; identical to SEQ ID NO: 9222

SEQ ID NO: 228068 - RNA, 64 nt, Human
gcaccugaauuucagaaacaaaaggccgggcgcgguggcucacaccugucauccuagcacuuug

SEQ ID NO: 228069 - RNA, 64 nt, Human
auauagaaagauauccugacauuggccaggcaugguggcucacgccuguaauccuggcacuuug

SEQ ID NO: 228070 - RNA, 64 nt, Human
aacguuuaaaagacuauacuuuuggccaggcgugguggcucaaaugccuguaaucccaguacuu

SEQ ID NO: 228071 - RNA, 64 nt, Human
cucuauuuaaaaaaagaaguuauggccgggcgcgguggcucaugccuguaauaccagcacuuug

SEQ ID NO: 228072 - RNA, 64 nt, Human
ccuugugaauauaaaguuacauuggcugggugugguggcucaugccuauaaucccaguacuuua

SEQ ID NO: 228073 - RNA, 64 nt, Human
uccucuuaagacugaaacaagcaggccagaugugguggcucacgccuguaauccuagcacuuug

SEQ ID NO: 228074 - RNA, 64 nt, Human
acaaagaugcauggacuucaugacagcucuuuugguggcucagaagccauuuuuuauagaauca

SEQ ID NO: 228075 - RNA, 64 nt, Human
ccuguaucucaccggcguguguucacccucccggguggcucacacacucucauucacacacaca

SEQ ID NO: 228076 - RNA, 64 nt, Human
cucagcgggcuccgccguggugagagaacuggccguggcucagccccggguagcaccuguaguu

SEQ ID NO: 228077 - RNA, 64 nt, Human
ccaaaagcauugaaagccaauaugaggccaggugguggcucaugccuguaaucccagcacuuug

SEQ ID NO: 228078 - RNA, 64 nt, Human
uguuuuccuauuaugagaauuuaggccaagugugguggcucaugccuguaaucccagcacuuug

SEQ ID NO: 228079 - RNA, 64 nt, Human
auuguuuuaagaaguuaaccuagggccgggcaugguggcucauaccuguaauccuagcacucug

SEQ ID NO: 228080 - RNA, 64 nt, Human
cauuuagaaauaugugcacuaucagcugggugcaguggcucacgucuguaaucccagcacuuug

SEQ ID NO: 228081 - RNA, 64 nt, Human
cucagguuuuuaaagucauuguuucuugcucaugguggcucauuuauuacauaguccccucacc

SEQ ID NO: 228082 - RNA, 64 nt, Human
gugugcagggggaugggccagggccaggcuaaggguggcucaguuccaucaucuggaggucaga

SEQ ID NO: 228083 - RNA, 64 nt, Human
gauggggcaggcugggguguggguguggccugggguggcucagggcuggaacugcugccugauu

SEQ ID NO: 228084 - RNA, 64 nt, Human; identical to SEQ ID NO: 9082

SEQ ID NO: 228085 - RNA, 64 nt, Human; identical to SEQ ID NO: 9208

SEQ ID NO: 228086 - RNA, 64 nt, Human; identical to SEQ ID NO: 9252

SEQ ID NO: 228087 - RNA, 64 nt, Human
gauuagaaacuguuuuaaggaggggcugggcucgguggcucacgccuguaaucccagacuuuga

SEQ ID NO: 228088 - RNA, 64 nt, Human
aacaaacaaacaaaaacagaacauucugggcacgguggcucaugccuguagucccagcacuuug

SEQ ID NO: 228089 - RNA, 64 nt, Human
uguucuuagaaaagccccagcauggccgggcaugguggcucaugccuauuaucccagcacuuug

SEQ ID NO: 228090 - RNA, 64 nt, Human
uccgcauaccccccuguccagcagggcacuguggguggcucacccuagauuguggcccagaucu

SEQ ID NO: 228091 - RNA, 64 nt, Human
caaggcugaccugagagguuccuggcgcccugagguggcucagcaccugcccaggguaggccug

SEQ ID NO: 228092 - RNA, 64 nt, Human
aagucaaaagaaagacauguuggcuauaggcgugguggcucaugccuauaaucccagcacuuug

SEQ ID NO: 228093 - RNA, 64 nt, Human
acuuccucagaaaaccuuuuuuuggcugggugugguggcucaugccuguaaucccagcacugug

SEQ ID NO: 228094 - RNA, 64 nt, Human
gguugcugaaugaagaacagaaucuuggugcuuuguggcucaccacagccaucuguggggcagg

SEQ ID NO: 228095 - RNA, 64 nt, Human
aguagcugcauuacaaaaaagaagccugggcacuguggcucacuccuguaaucucagaacuuug

SEQ ID NO: 228096 - RNA, 64 nt, Human
cccuccaauuaaugcagcccugaggugucuggcuguggcucaagauuuggccccaugcagaccc

SEQ ID NO: 228097 - RNA, 64 nt, Human
ccuuuuaaaaauacuaauaguccggccaggcgcuguggcucacgccuguaaucccaggacuuug

SEQ ID NO: 228098 - RNA, 64 nt, Human
agagagaagagucuauuaugagcugguuacuacuguggcucaauccuauuggggaccuuuuaaa

SEQ ID NO: 228099 - RNA, 64 nt, Human
uuggauaaggaugcacuggaagaacugccagaauguggcucaugcucugaguacuguuccugua

SEQ ID NO: 228100 - RNA, 64 nt, Human
aauucauaucaaaacauaaucccaacugggugcaguggcucacgccuguaaucccagcacuuug

SEQ ID NO: 228101 - RNA, 64 nt, Human
ucugcccuggaggugcugggcccuccugggauggguggcucagccucgaaucccaggccccagc

SEQ ID NO: 228102 - RNA, 64 nt, Human
uuuuuugguuuaaaagaagaauaggcggggcacgguggcucaugccuguaaucccagcacuuug

SEQ ID NO: 228103 - RNA, 64 nt, Human; identical to SEQ ID NO: 9159

SEQ ID NO: 228104 - RNA, 64 nt, Human; identical to SEQ ID NO: 9160

SEQ ID NO: 228105 - RNA, 64 nt, Human; identical to SEQ ID NO: 9161

SEQ ID NO: 228106 - RNA, 64 nt, Human
aaaugaacuaaaagccagcauccugccgggcgugguggcucacgcccauaauccagcacuuugg

SEQ ID NO: 228107 - RNA, 64 nt, Human
uaccauugaaaacagagcuuuuaggccaggugugguggcucacaccuguaaucccagcacuuug

SEQ ID NO: 228108 - RNA, 64 nt, Human
ccucucuuuaaauagcaccaggcugcugggugugguggcucauaccuguaaccccagcacuuug

SEQ ID NO: 228109 - RNA, 64 nt, Human
cauguuuuaauugugagaaacagggccgagcacaguggcucacgccuguaauaccagcaccuua

SEQ ID NO: 228110 - RNA, 64 nt, Human
acuauuuaaaaaugaaauuacaggcccgggcacgguggcucacaccuguaaucccagcacuuug

SEQ ID NO: 228111 - RNA, 64 nt, Human
uuacuuuuaaaaauauaaguuagggcuaggcacaguggcucaugccuauaaucucagcacuuuu

SEQ ID NO: 228112 - RNA, 64 nt, Human
uuccauuuugaaaguagauuucaggcuaggugcgguggcucacaccuguaaucucagcacuuug

SEQ ID NO: 228113 - RNA, 64 nt, Human
ugggaacaucuugcugccaaaagaauccuaggcaguggcucauuguaugugagguugaaccacg

SEQ ID NO: 228114 - RNA, 64 nt, Human
aaggaacuuaaaaagacaagcguggccaggcacaguggcucacaccuguaaucccagcacuuug

SEQ ID NO: 228115 - RNA, 64 nt, Human
uccagggcccccaucucaugccccuggcugggacguggcucagccagcacuuguccagcugagc

SEQ ID NO: 228116 - RNA, 64 nt, Human
agaagaguccaggaaggggcggggagaagccuggguggcucagcauccuccacgggcugcgccg

SEQ ID NO: 228117 - RNA, 64 nt, Human
aaggggcucauuuaaaauuuggaggcugggugcuguggcucacgccugcaaucccagcacuuug

SEQ ID NO: 228118 - RNA, 64 nt, Human
ggacacguuaaacgaacaggaugggccgggcacgguggcucacgccuguaaucccagcacacug

SEQ ID NO: 228119 - RNA, 64 nt, Human
cugcugcuggaaacccuucugaguuggcccuggaguggcucacgggcagagaaggguagcccug

SEQ ID NO: 228120 - RNA, 64 nt, Human
uaaaguuuaaaaaauaaaguucuugcugggcacaguggcucacaccuguaaucccagcacuuug

SEQ ID NO: 228121 - RNA, 64 nt, Human
uuagacuaaagaauauauuggggggccggguguaguggcucaugccuguaauccgagcacuuug

SEQ ID NO: 228122 - RNA, 64 nt, Human; identical to SEQ ID NO: 9164

SEQ ID NO: 228123 - RNA, 64 nt, Human; identical to SEQ ID NO: 9165

SEQ ID NO: 228124 - RNA, 64 nt, Human; identical to SEQ ID NO: 9166

SEQ ID NO: 228125 - RNA, 64 nt, Human
gguuuuuuuaaaaaaggaaaaauaggccgggcugguggcucacgccuguaaucccagcacuuug

SEQ ID NO: 228126 - RNA, 64 nt, Human
agagcaacaacaaaaaauguuuaagccgggcgcgguggcucacaucuguaaucccagcacuuug

SEQ ID NO: 228127 - RNA, 64 nt, Human
ucucuacaaaaaauacaaaaauuagccaugcaugguggcucaugccuguagucccagcuacuug

SEQ ID NO: 228128 - RNA, 64 nt, Human
uagauuuuuaaaaaaucagagugggccgggcgcgguggcucacgccuguaaucccagcacuuug

SEQ ID NO: 228129 - RNA, 64 nt, Human
uuucacauaaaacauuggaaggaggcugggugcgguggcucaugcuuguaaucccagcacuggg

SEQ ID NO: 228130 - RNA, 64 nt, Human
aagaaaagaaaaaaaugauuucuggccgggcgugguggcucaagccuguaaucccagcacuuug

SEQ ID NO: 228131 - RNA, 64 nt, Human
guccguuuugguuuuuguaaucaggcuaggcacaguggcucacacauggaaucccagcacuuug

SEQ ID NO: 228132 - RNA, 64 nt, Human
ugcucuggccaaaaucuccgcucggccaggccccguggcucacaccuguaauccuagcacauug

SEQ ID NO: 228133 - RNA, 64 nt, Human
gguucaguugaaaaccaaacuggggccgggugcgguggcucacgccuguaaucccagcacuuug

SEQ ID NO: 228134 - RNA, 64 nt, Human
agcugaggacgugugugagccuuauccgaccccuguggcucauuuuucucuucugaccuggcag

SEQ ID NO: 228135 - RNA, 64 nt, Human
accaccaccugccuacccaugggcccaaguuucuguggcucauuacagggcaucugaccccugc

SEQ ID NO: 228136 - RNA, 64 nt, Human
cacuggauggaaaauuggaaauggacugggcgugguggcucacgccuauaaucccagcaguuug

SEQ ID NO: 228137 - RNA, 64 nt, Human
uggagucucgcucuaucgcccaggauggagugcaguggcucaaucucggcucacugcaaacucc

SEQ ID NO: 228138 - RNA, 64 nt, Human
guccccuuccuccacugcugccuaaugcaaggcaguggcucagcagcaagaaugcugguucuac

SEQ ID NO: 228139 - RNA, 64 nt, Human
uuacuuuuaaaaaauguauuuauggcugggcgugguggcucacaccuguaaucccagcacuuug

SEQ ID NO: 228140 - RNA, 64 nt, Human
ugucagaaucuuaagagcugagaggccgggcacgguggcucacgccuguaaucccagcacuuug

SEQ ID NO: 228141 - RNA, 64 nt, Human
ggaaugacacagaggagauuagcauggcccccugcgcgaggaagaucugcagauucaugcagca

SEQ ID NO: 228142 - RNA, 64 nt, Human; identical to SEQ ID NO: 9193

SEQ ID NO: 228143 - RNA, 64 nt, Human; identical to SEQ ID NO: 9233

SEQ ID NO: 228144 - RNA, 64 nt, Human
ggugggccugaggugcccagcucagggcagccagguggcucaugggcuguagugagccagcucc

SEQ ID NO: 228145 - RNA, 64 nt, Human
cuuacucagcccuuuauggcccauggggaacuccguggcucagggagagcugaacuccaggggu

SEQ ID NO: 228146 - RNA, 64 nt, Human
uauuuuaaguuagaaauagacuuagcugggugcaguggcucacaccuguaauccuagcaucuug

SEQ ID NO: 228147 - RNA, 64 nt, Human
aaacccccuuuaagacauauuggggcugggcgcaguggcucacgccuguaaucccagcacuuug

SEQ ID NO: 228148 - RNA, 64 nt, Human
cuucuuuugaaaauccuaucaauggcugggcgcgguggcucacaccuguaaucccagcacuuug

SEQ ID NO: 228149 - RNA, 64 nt, Human
auugucccugguaaauguuucccggcugggcgcgguggcucacgccuguaaucccagcacuuug

SEQ ID NO: 228150 - RNA, 64 nt, Human
gagagacacgggaaaggggucgggacaggagcacguggcucagacaccgacgccgggaggccgc

SEQ ID NO: 228151 - RNA, 64 nt, Human
gagcucugaggggagguuucacaaaagguccccaguggcucauaaagacucaaagcuguauagg

SEQ ID NO: 228152 - RNA, 64 nt, Human
uuuacauuaagaaauacugugcaggccaugcgugguggcucaggccuguaaucccagcacuuug

SEQ ID NO: 228153 - RNA, 64 nt, Human
agacagcccuuuauagguguuugggccaggugcgguggcucacgccuguaaucccagcucuuug

SEQ ID NO: 228154 - RNA, 64 nt, Human
gaaaaugaauaaauaaaaaaccaggccaggcgugguggcucacgccuguaaucccagcacuuug

SEQ ID NO: 228155 - RNA, 64 nt, Human
aaaaaaaguaaucucagaauguuggccgagcaugguggcucacaccuguaaucccaguuaugca

SEQ ID NO: 228156 - RNA, 64 nt, Human
uucaccacaaaaauggaaauauuggccgggcgcgguggcucacgccuguaaucccagcacuuug

SEQ ID NO: 228157 - RNA, 64 nt, Human
ucuugauguauuaggaaauuuccggccaggcgugguggcucacaccuguaaucucagcacucug

SEQ ID NO: 228158 - RNA, 64 nt, Human
gguaaucauuuagaaaggacagaaaauauuuaaaguggcucauagguaaugaauauuucugacu

SEQ ID NO: 228159 - RNA, 64 nt, Human
auuaaaacucuuuuaacagucugggcuggguccgguggcucacgccuguaaucccagcaauuug

SEQ ID NO: 228160 - RNA, 64 nt, Human; identical to SEQ ID NO: 9169

SEQ ID NO: 228161 - RNA, 64 nt, Human; identical to SEQ ID NO: 9170

SEQ ID NO: 228162 - RNA, 64 nt, Human; identical to SEQ ID NO: 9171

SEQ ID NO: 228163 - RNA, 64 nt, Human
guuagagaaaugaaauaaaauggggcugggcucaguggcucacgccuguaaucccagcacuuug

SEQ ID NO: 228164 - RNA, 64 nt, Human
agcggccaagcuuaagccaugaagucauggauuuguggcucagcaccagguccugaggggagcg

SEQ ID NO: 228165 - RNA, 64 nt, Human
agucuuaaaagucugcauuuucagguggggcaagguggcucaugccuuuaaucccagcauuuug

SEQ ID NO: 228166 - RNA, 64 nt, Human
uauaauuuuaaaauaguuuaccuggccaggcaugguggcucacgccuguaaucccagcacuuug

SEQ ID NO: 228167 - RNA, 64 nt, Human
auggaaaucgggagugaaggagcacugcuucauuguggcucagcccuuccuaggggccucugcc

SEQ ID NO: 228168 - RNA, 64 nt, Human
cucaucaagaaugugccccuacaggccgggcgcaguggcucacgccuguaaucccagcauuuug

SEQ ID NO: 228169 - RNA, 64 nt, Human
uuuuuaacaaaaaauuuuuaggccaggcacagugguggcucaugccuguaaucccagcacuuug

SEQ ID NO: 228170 - RNA, 64 nt, Human
accauuauaaauucuuaguucagggcugggcgcgguggcucaugccuguaacccuagcacuuug

SEQ ID NO: 228171 - RNA, 64 nt, Human
uuuuuuuaaaaccuuaaaugucuggccgggugugguggcucaucccuauaauccuacacuuugg

SEQ ID NO: 228172 - RNA, 64 nt, Human
ggcuaauucccccuucucuggugccauaaauuauguggcucauaguaggugcaccauccaagga

SEQ ID NO: 228173 - RNA, 64 nt, Human
ucucuacuaaaaauaugaaaauuagcugggcuugguggcucaugccuauaauccuagcuacuug

SEQ ID NO: 228174 - RNA, 64 nt, Human
ugaacucaagggacugugaccccugcacacuggaguggcucauuguggcagguuucugccaaua

SEQ ID NO: 228175 - RNA, 64 nt, Human
cugcuuacaauuuggaaaaguguggccgggugcgguggcucacgccuguaaucccagcacuuug

SEQ ID NO: 228176 - RNA, 64 nt, Human
accaguggcuauggccugugcgaucccacccgugguggcucaagucuggccccacaccagcccc

SEQ ID NO: 228177 - RNA, 64 nt, Human
uuauuuaaaaacaugacauuuggggccaggcgcgguggcucacgccuguaaucccagcacuuug

SEQ ID NO: 228178 - RNA, 64 nt, Human
agugagacuccgucucaaaacaaaacaaaaguggguggcucacggguccggagguuaugucuuc

SEQ ID NO: 228179 - RNA, 64 nt, Human; identical to SEQ ID NO: 9143

SEQ ID NO: 228180 - RNA, 64 nt, Human; identical to SEQ ID NO: 9172

SEQ ID NO: 228181 - RNA, 64 nt, Human; identical to SEQ ID NO: 9174

SEQ ID NO: 228182 - RNA, 64 nt, Human
guugguccuuaaaacugggcgguggccgggcgugguggcucacgcugaggucaggaguucgaga

SEQ ID NO: 228183 - RNA, 64 nt, Human
ccagguggcuggagccagcagccaggaccagggucguugacagcagguucugcagcauccugcc

SEQ ID NO: 228184 - RNA, 64 nt, Human
ccucgcacuccagaaaagccaugccagcugggcucguugacaaaggguaaaacaugcucacucc

SEQ ID NO: 228185 - RNA, 64 nt, Human
ggcugcaucuucccuaaccucugucuggcuugagcguugacagagaaaaggcuuaguucugaaa

SEQ ID NO: 228186 - RNA, 64 nt, Human
uuuaucuugcugugagagcauauguugugacugucguugacaguuuuauuuacugguuucuuug

SEQ ID NO: 228187 - RNA, 64 nt, Human
cuuagugcggugauaggaagcuaaaagugucaagcguugacagcuuggaagcguuuauuuauac

SEQ ID NO: 228188 - RNA, 64 nt, Human
aacuuagcuggaaagacauacaaauuuagacucucguugacauugucguuuuaaaaggaaguug

SEQ ID NO: 228189 - RNA, 64 nt, Human
auugcauuuccagaaaucugccuccuucacccuccguugacaguauaugucaugccucacuuuc

SEQ ID NO: 228190 - RNA, 64 nt, Human
uguuguuacuguuuugauaccucggaaacaccuccguugacaguuguuuuggauagguugggug

SEQ ID NO: 228191 - RNA, 64 nt, Human
acugggagaguggggaggggccagggaccuauuucguugacagaaacagugaggucuauuggaa

SEQ ID NO: 228192 - RNA, 64 nt, Human
cacaguccuuaacugaagguaaaccaaagcaucacguugacauuagaccaaauacuuuugauuc

SEQ ID NO: 228193 - RNA, 64 nt, Human
gcaguuucuaaacaacacuuagacuggggucuaacguugacaaauccuucuagaauuugccucu

SEQ ID NO: 228194 - RNA, 64 nt, Human
cugacagcgacagaaaaccucaagggcuuucccacguugacaccaagaaaccacugggcauaau

SEQ ID NO: 228195 - RNA, 64 nt, Human
uuuugagguuugcacucaugcaauuugagaacaccguugacaagaaggcugaguuuacauaaau

SEQ ID NO: 228196 - RNA, 64 nt, Human; identical to SEQ ID NO: 9177

SEQ ID NO: 228197 - RNA, 64 nt, Human; identical to SEQ ID NO: 9178

SEQ ID NO: 228198 - RNA, 64 nt, Human; identical to SEQ ID NO: 9179

SEQ ID NO: 228199 - RNA, 64 nt, Human
accaacuuuugcuuauaacuacaauuuaauuucacguugacaaaacacagugaaaagacaacuu

SEQ ID NO: 228200 - RNA, 64 nt, Human
cauuuaaaauggacuuuuguucaugggagaaccucguugacaugcacaguuugcaaucuuaugu

SEQ ID NO: 228201 - RNA, 64 nt, Human
gcagggcagggucccaaggccccagccaaccucucguugacauguaauguaagaagaugucaac

SEQ ID NO: 228202 - RNA, 64 nt, Human
ggaacuauauugaauuuuauauuucugagcaaagcguugacaaaucagaugaucagcuuuaucc

SEQ ID NO: 228203 - RNA, 64 nt, Human
ucagucuacuuuuuaguaaaauauuuuuggauagcguugacacgauagaucuuauuccauacuu

SEQ ID NO: 228204 - RNA, 64 nt, Human
uaaaaguaauuggacuuuuuuucuuuuuuugacucguugacaagugucuuuguaauauguuuuu

SEQ ID NO: 228205 - RNA, 64 nt, Human
auauauauauauaaauaucuuucccaauaugccccguugacaguguuuaaauuccagacuagga

SEQ ID NO: 228206 - RNA, 64 nt, Human
caucugauagaacuuugauggauuuucaaaaagccguugacaaggcucugcuauacagucuaua

SEQ ID NO: 228207 - RNA, 64 nt, Human
auauauuuuauuuuaaaacaacaaaaagggagggcguugacaccauuccccacagagauaguca

SEQ ID NO: 228208 - RNA, 64 nt, Human
cgcacacugcauguccaaggcccuaaacauugcccguugacauaaacuuuccagggccccagcc

SEQ ID NO: 228209 - RNA, 64 nt, Human
cugcuaagaagcuaaagucauccauccuuauucacguugacaguaccuagcuguaauguuucac

SEQ ID NO: 228210 - RNA, 64 nt, Human
cugugcagcugauuucaaggcaugagcugaacagcguugacacagccgugacuuacaauuaaac

SEQ ID NO: 228211 - RNA, 64 nt, Human
ggagacccauuaccaccuccuauggcuacagccccguugacaugcaugaaacucaguaccugcu

SEQ ID NO: 228212 - RNA, 64 nt, Human
cauaaccacuguggcuucuugugcugcagaagcucguugacaagacugaggaggauuucaagag

SEQ ID NO: 228213 - RNA, 64 nt, Human
uaaaaaaaaagcgcuugccuaacucauacuuucccguugacacuugauccacgcagcguggcac

SEQ ID NO: 228214 - RNA, 64 nt, Human
aagcgugucuuccccugcagcacacagcgacuugcguugacaaaggaggaggaaacgauuacuc

SEQ ID NO: 228215 - RNA, 64 nt, Human; identical to SEQ ID NO: 9180

SEQ ID NO: 228216 - RNA, 64 nt, Human; identical to SEQ ID NO: 9236

SEQ ID NO: 228217 - RNA, 64 nt, Human; identical to SEQ ID NO: 9237

SEQ ID NO: 228218 - RNA, 64 nt, Human
uuaguggcaguggcuggaacgacaaucgaugugacguugacaauuacuggaucugcaaaaagcc

SEQ ID NO: 228219 - RNA, 64 nt, Human
aaacaaaacuaugcugacaccucugcuugagccucguugacagccagcauggggcuccugggga

SEQ ID NO: 228220 - RNA, 64 nt, Human
ugcuaagaggucaggacccagccgaaguccucggcguugacaggcagcuggggggacaugaucc

SEQ ID NO: 228221 - RNA, 64 nt, Human
agcccuucucgagcagaugacacgagcuaguccacguugacagcuuaagacagugcuagcucug

SEQ ID NO: 228222 - RNA, 64 nt, Human
acaaugaaaagacgauucugcuguauuuguuaaacguugacauuugguucuagggccuugagua

SEQ ID NO: 228223 - RNA, 64 nt, Human
ucuuacuggugcuauuuuguagaauaaggaacaacguugacaaguuuuguggggcuuuuuauac

SEQ ID NO: 228224 - RNA, 64 nt, Human
cagagugaguugucucaggaccccgucacugcgacguugacacuccucucccuucccuuccucc

SEQ ID NO: 228225 - RNA, 64 nt, Human
cugcagccuugggcccuccccggcccacguccuccguugacacagcuucucuggagacccuaga

SEQ ID NO: 228226 - RNA, 64 nt, Human
uaagacugaaauucagaauaccacaucuguacagcguugacaacucuaacuaaaaggauuacag

SEQ ID NO: 228227 - RNA, 64 nt, Human
ucucugcuuuaaauccuaacaggacuuccuagagcguugacagaaauucuacucguggacguug

SEQ ID NO: 228228 - RNA, 64 nt, Human
uucugcaguugggagugaaaugugauagcacauacguugacauuaugcauuuagagauguuaua

SEQ ID NO: 228229 - RNA, 64 nt, Human
auuggugccaagacugggugagaaauguacauuacccccuuauuauuuugacgguuuuuuuuuu

SEQ ID NO: 228230 - RNA, 64 nt, Human
gcccuggaagccccuccccucucacacugaccuccccccuuacggcccaccaggguauguaaau

SEQ ID NO: 228231 - RNA, 64 nt, Human
gacacaggcuggguuggucugccccucagucaggcccccuuacccacccaccagccccaaggcc

SEQ ID NO: 228232 - RNA, 64 nt, Human
aagaaauuugcaaaaauccaagagcaccuuugcucccccuuauccuccuuccucuuccccuuuc

SEQ ID NO: 228233 - RNA, 64 nt, Human
cccaccaucuacccacuuacuaaccugguccuaacccccuuacugugcgcgugugugugcgugu

SEQ ID NO: 228234 - RNA, 64 nt, Human; identical to SEQ ID NO: 9182

SEQ ID NO: 228235 - RNA, 64 nt, Human; identical to SEQ ID NO: 9183

SEQ ID NO: 228236 - RNA, 64 nt, Human; identical to SEQ ID NO: 9184

SEQ ID NO: 228237 - RNA, 64 nt, Human
uucuuggguuauuccacauaugaaugcaggacuacccccuuaccauuuuaagaagguacuuuau

SEQ ID NO: 228238 - RNA, 64 nt, Human
gugguggcaaaagaaugaacuggguaugacccugcccccuuacugggcuuggauauugaggacc

SEQ ID NO: 228239 - RNA, 64 nt, Human
uuucacauauguguuuuuuuacauacguacuuuucccccuuaguuuguuuccuuuuauuuuaua

SEQ ID NO: 228240 - RNA, 64 nt, Human
ucacggugggcgcucggggggagccugaggaaaacccccuuagguaccugugcgaggcugugga

SEQ ID NO: 228241 - RNA, 64 nt, Human
aggaagcuccccucccaauuucuuaugcucccuucccccuuacacuccucuccuucgacugcuc

SEQ ID NO: 228242 - RNA, 64 nt, Human
ccgagcccuccaaaccuggacucugggacuuaggcccccuuaaaucuagacuucucuuuauagg

SEQ ID NO: 228243 - RNA, 64 nt, Human
acgaggucuugguuccaggguuccuggccaggugcccccuuagcauuuguucuucaucuccugu

SEQ ID NO: 228244 - RNA, 64 nt, Human
gaagggcuuuuggucuugaaguccagguaccauccccccuuagcauacagggggaagggccuga

SEQ ID NO: 228245 - RNA, 64 nt, Human
gcaagaacucaucacuguggcugucuggaaagcccccccuuauaguuugggcuucagccuagug

SEQ ID NO: 228246 - RNA, 64 nt, Human
agaaaaauugacuugcuugccuaaaacuacagugcccccuuagccuccauuacuuaguaucucu

SEQ ID NO: 228247 - RNA, 64 nt, Human
acccccucacaacugcuuacagaauggaucaugucccccuuauguugaggugaccacuuaauug

SEQ ID NO: 228248 - RNA, 64 nt, Human
accaaugacgucauguggcuuuugcaauucacgccccccuuaaguccuuaaugaagagccagcc

SEQ ID NO: 228249 - RNA, 64 nt, Human
aaaaucugcuuguauuccaagcauauaaaauuuucccccuuagugaauuaguuuuaaaaugaua

SEQ ID NO: 228250 - RNA, 64 nt, Human
uagcuuccugcauugauugccccugggcguucuucccccuuaacugugaaagcagagucuauaa

SEQ ID NO: 228251 - RNA, 64 nt, Human
agcuugacuuuuacugcucagaugcuuucuuucccccccuuagacgcuguaauucucuugggaa

SEQ ID NO: 228252 - RNA, 64 nt, Human
cagcaggacuugcuccaucucugaacuggucuuacccccuuaaaccugccuuuauaucuaggag

SEQ ID NO: 228253 - RNA, 64 nt, Human; identical to SEQ ID NO: 9187

SEQ ID NO: 228254 - RNA, 64 nt, Human; identical to SEQ ID NO: 9188

SEQ ID NO: 228255 - RNA, 64 nt, Human; identical to SEQ ID NO: 9189

SEQ ID NO: 228256 - RNA, 64 nt, Human
cuaauguuuuguccaugacuugcagguccccugacccccuuacucccagguagcacuggggcaa

SEQ ID NO: 228257 - RNA, 64 nt, Human
aacuugaugacuuagguuugcauugaucuuuuuucccccuuaaacauaauguacuauguauuaa

SEQ ID NO: 228258 - RNA, 64 nt, Human
aggggguagggaaaauuaguucccauucuuucaacccccuuaacuguauagcucuuuuccuaga

SEQ ID NO: 228259 - RNA, 64 nt, Human
uauuuuugccaaaguucuggccuuccaaaacucacccccuuauuuaaaugugugcuaugaccca

SEQ ID NO: 228260 - RNA, 64 nt, Human
acacccgacgucauguauuugagcauaucaguaacccccuuaaauuuaauaccagauaccuuau

SEQ ID NO: 228261 - RNA, 64 nt, Human
uuuaaaaguuuggaaagauacacaucuuucauaccccccuuaggcagguuggcuuucauaucac

SEQ ID NO: 228262 - RNA, 64 nt, Human
caggucaauauaauacugccagagacagaaaauacccccuuaucagucccuuagugccucuuuc

SEQ ID NO: 228263 - RNA, 64 nt, Human
uacacugaggagccaaggacagggccucaggucucccccuuacaaggcguggcucauggccugc

SEQ ID NO: 228264 - RNA, 64 nt, Human
ucuauucauggagcacuccauagucucaaacugucccccuuaugaccaacagcacauuugugaa

SEQ ID NO: 228265 - RNA, 64 nt, Human
accacccaggagcacccuaggugaggggugagggcccccuuaugugaaccucuugccucuuccu

SEQ ID NO: 228266 - RNA, 64 nt, Human
cccacgggcaacauggaacccugggaacugcccucccccuuagcucacagugccugcgguagcc

SEQ ID NO: 228267 - RNA, 64 nt, Human
gugucaaccaaaggcaugugauugauuaaugauucccccuuagaaagcaaguguuaccaaaguu

SEQ ID NO: 228268 - RNA, 64 nt, Human
aaaaccgcaguuggaacucuuuccucuccccagccccccuuaccuucacucccauacuggacaa

SEQ ID NO: 228269 - RNA, 64 nt, Human
aauuagcguucuucacccccacccccacccccaccccccuuauuuuccuuuugucuccugguga

SEQ ID NO: 228270 - RNA, 64 nt, Human
ugcuuagccaccuguggccgagggcucucagagacccccuuaaccucccaaauacuaagaagcu

SEQ ID NO: 228271 - RNA, 64 nt, Human
uaccauuuggggaggggaaaucuuuucuuucuuucccccuuaaaaaaaaacacaucugccccga

SEQ ID NO: 228272 - RNA, 64 nt, Human; identical to SEQ ID NO: 9126

SEQ ID NO: 228273 - RNA, 64 nt, Human; identical to SEQ ID NO: 9138

SEQ ID NO: 228274 - RNA, 64 nt, Human; identical to SEQ ID NO: 9175

SEQ ID NO: 228275 - RNA, 64 nt, Human
caccacgaagaucauguucauuaccaccaccacccccccuuauuuuuuuuauccuaaaccagca

SEQ ID NO: 228276 - RNA, 64 nt, Human
uggacugauauuaaaagucauauuuauucuuuuacccccuuacuguguuuugugauuuucauuu

SEQ ID NO: 228277 - RNA, 64 nt, Human
ucucuugaauccaaaacuggauauuaagaacuuucccccuuacuaaguuuaagacuuuugucau

SEQ ID NO: 228278 - RNA, 64 nt, Human
cugcucuugcuucuacuaaaagauacagcaguuacccccuuauccacaggggauacaguggaua

SEQ ID NO: 228279 - RNA, 64 nt, Human
cuccccgguggugaccccucaccccugcacugagcccccuuagaucuacugccccugcccugac

SEQ ID NO: 228280 - RNA, 64 nt, Human
ugauuucuucuauuauuuguggaaugaauuauaccccccuuaaauaucuuuguuuaugccuuau

SEQ ID NO: 228281 - RNA, 64 nt, Human
caucuuuggaguaguuaugacuucucaguuuuuccccccuuaaacugcauugccuauucuuuuu

SEQ ID NO: 228282 - RNA, 64 nt, Human
ucacuccuaccaaauacuuuccacguuggacuuucccccuuauugggucucgaaguuuacuuau

SEQ ID NO: 228283 - RNA, 64 nt, Human
ugggcuuucccccucccaggccuccugggugucacccccuuacuuuaauucuugggccuccaau

SEQ ID NO: 228284 - RNA, 64 nt, Human
uaaaaaaauaggaucauucugaacuuuggaaugacccccuuauauauuuucugaaaaugaaaac

SEQ ID NO: 228285 - RNA, 64 nt, Human
caaggccagaccaaggaggcagcaaccugccuuucccccuuaccugcccugcugccugcacacu

SEQ ID NO: 228286 - RNA, 64 nt, Human
gaugaggaaaguagcuguacacucacugaaugcucccccuuacuagauauuuccuggagccaga

SEQ ID NO: 228287 - RNA, 64 nt, Human
ucucuucugauggcccccaccugcuccgggacggcccccuuaccccugcugcuucaggguuuuu

SEQ ID NO: 228288 - RNA, 64 nt, Human
uguggggaggaaaccuuauaaauuaaacacauggcccccuuagagaccacaggugaugucuguc

SEQ ID NO: 228289 - RNA, 64 nt, Human
uguuguauagcuuucgauuuugcuuacaguaguucccccuuaucuucgggagauacauuccaag

SEQ ID NO: 228290 - RNA, 64 nt, Human
ccuuucugggccuacagcaccacaggccgcuguacccccuuagagcugccccucucuggccugg

SEQ ID NO: 228291 - RNA, 64 nt, Human
gaggacuggccugcgcugggcucgggagcucugucgcgaggaggggcgcaggaccauggacugg

SEQ ID NO: 228292 - RNA, 64 nt, Human
ccccagcccugcccggcgggcccggagccagagccgcgaggagcaggcugugcugcuugugcgc

SEQ ID NO: 228293 - RNA, 64 nt, Human
cuuauauggccagcgggacuccaaccgggguagccgcgaggaaggcgcuggcagaggacagaaa

SEQ ID NO: 228294 - RNA, 64 nt, Human
cucugccuacagccagguuuagcggcaaaccuuucccccuuagcaccuucagggcugaguucug

SEQ ID NO: 228295 - RNA, 64 nt, Human
cacucugggcacaagcagggcacucuguuccccucccccuuaagccaacaaccacagugccacc

SEQ ID NO: 228296 - RNA, 64 nt, Human
ugcuucucuuucccccacccuacucccuccaauucccccuuaaacuuccaaagcuucgucuugu

SEQ ID NO: 228297 - RNA, 64 nt, Human
guuugauuuuuuuaaaguaguuccuauuuucuaucccccuuaaagaaaauugcaugaaacuagg

SEQ ID NO: 228298 - RNA, 64 nt, Human
cucucccaggucgcugcugcagccaacccaguagcccccuuagcgcccccgcggaccccgcagc

SEQ ID NO: 228299 - RNA, 64 nt, Human
uggcaccugcucccugugcucaguauuaauuacgcccccuuaacugucccagugaccuugucca

SEQ ID NO: 228300 - RNA, 64 nt, Human
caucuauuagaagacugcaucaccauuucuuuggcccccuuacucuguuguccuuucccuuuuc

SEQ ID NO: 228301 - RNA, 64 nt, Human
uuaugugagcaaaauuuaagcuuauacaguaguccccccuuaucuguauuuucacuuuacgcaa

SEQ ID NO: 228302 - RNA, 64 nt, Human
aauauugcucuaauucuuuucaaaauuguugcaucccccuuagaauguuucuauuuccauaagg

SEQ ID NO: 228303 - RNA, 64 nt, Human
cauucuucuuuuucaugcauuuguccuucucccacccccuuacuacacccuagcagaucagcug

SEQ ID NO: 228304 - RNA, 64 nt, Human
caucugaugucacuuuucaugaucuucucauuggcccccuuaaccuggucugaaguucugggau

SEQ ID NO: 228305 - RNA, 64 nt, Human
aaaaaugggagagagagagguauuaaacaaauaccccccuuagaggauacuuucuggguuugga

SEQ ID NO: 228306 - RNA, 64 nt, Human
uucuccccaccgccccuguacgcgucauccuagccccccuuaggaaaggaguuagggucucagu

SEQ ID NO: 228307 - RNA, 64 nt, Human
aauaucugggguacuuuuagaaguuuucaguacacccccuuagagaauagcuuaugaguuauuu

SEQ ID NO: 228308 - RNA, 64 nt, Human
ggccucacagucagcuuccucauggcuaguuuuucccccuuauauuacaauuuuuguuuuauaa

SEQ ID NO: 228309 - RNA, 64 nt, Human
gcugcaaggauuuccugccuucagacugaagaagcccccuuaucauuuuagauuuauacuuggg

SEQ ID NO: 228310 - RNA, 64 nt, Human; identical to SEQ ID NO: 9157

SEQ ID NO: 228311 - RNA, 64 nt, Human; identical to SEQ ID NO: 9162

SEQ ID NO: 228312 - RNA, 64 nt, Human; identical to SEQ ID NO: 9192

SEQ ID NO: 228313 - RNA, 64 nt, Human
cccaucccugccuccugccccugacgcccauuuccccccuuagagcagcgaaacugcccccucc

SEQ ID NO: 228314 - RNA, 64 nt, Human
gggacagaagcagaggaggcugccugcugugauacccccuuaccucccccagugccuucuucag

SEQ ID NO: 228315 - RNA, 64 nt, Human
gaaaaagacuacuagccacuuuugcuuucccaaccccccuuaaugccauccuucauugucuuuc

SEQ ID NO: 228316 - RNA, 64 nt, Human
aucuucaaccuucuucagaagcucacugcuuuggcccccuuacucuuucauugacugcagugug

SEQ ID NO: 228317 - RNA, 64 nt, Human
aaaacaaggacuaagcaaaaaagaaagacccccccccccuuagcaacucccuugaaguuucguu

SEQ ID NO: 228318 - RNA, 64 nt, Human
ugacaugugugugaugaggaccaugacccuugaacccccuuaccuaacguaacuaauaaaauga

SEQ ID NO: 228319 - RNA, 64 nt, Human
gcuccuuuauaagccaacauguauccaaauuaagcccccuuaccuuuauccagacccuuucaca

SEQ ID NO: 228320 - RNA, 64 nt, Human
gaaaauuuagaggaaaaugaagagcccuucguugcccccuuaggauugagcgucccgucugacg

SEQ ID NO: 228321 - RNA, 64 nt, Human
gucuugcaacaacccugugagggcaguauuaaugcccccuuacagcagaagacacugcagcucg

SEQ ID NO: 228322 - RNA, 64 nt, Human
cugaguuuaggauagaagauucagagccucauaucccccuuauugaugacacugaugccgaaga

SEQ ID NO: 228323 - RNA, 64 nt, Human
aaauuaauuuucugaaguuggaguguagucuuuucccccuuaggcuaugcauuaaucgaagcuu

SEQ ID NO: 228324 - RNA, 64 nt, Human
uggaaaaguggccauccuuuuccccccaaacacacccccuuaaccuaucucuugggacuuagcc

SEQ ID NO: 228325 - RNA, 64 nt, Human
uaccuucuccaccugcccccaggaaaaagagucucccccuuaaauuuccugguacccccucacc

SEQ ID NO: 228326 - RNA, 64 nt, Human
ggaaauguugcuuucuguacucccucuucccuuacccccuuacaaaucucuggcaacagagagg

SEQ ID NO: 228327 - RNA, 64 nt, Human
accccuugguuuccuuggaaacaacauaccucuucccccuuauccccaguccuuuuucauaccu

SEQ ID NO: 228328 - RNA, 64 nt, Human
auaagauuauauuguauuuuagauuacaguaguccccccuuaucuucaggauauauguuccaag

SEQ ID NO: 228329 - RNA, 64 nt, Human; identical to SEQ ID NO: 9109

SEQ ID NO: 228330 - RNA, 64 nt, Human; identical to SEQ ID NO: 9153

SEQ ID NO: 228331 - RNA, 64 nt, Human; identical to SEQ ID NO: 9167

SEQ ID NO: 228332 - RNA, 64 nt, Human
ggcuaggaaagggcugcuugagaugacugugguccccccuuagacucccuaagcccgagugagc

SEQ ID NO: 228333 - RNA, 64 nt, Human
gugugccacguggcagcugcugcuuggcuucuggcccccuuaucugcccccgccccacgcgccc

SEQ ID NO: 228334 - RNA, 64 nt, Human
auaucuuuaaaaucuucugauuucuuacuuuuuucccccuuagaugccuggaagugguauuuug

SEQ ID NO: 228335 - RNA, 64 nt, Human
uuagauucacacggaagguguuuguguuucuccucccccuuacuugcauguaaaucacaaaaac

SEQ ID NO: 228336 - RNA, 64 nt, Human
gcgggccuccacucuauucccacccuugagggagcccccuuacugggggaggguccuugcaauu

SEQ ID NO: 228337 - RNA, 64 nt, Human
cgcugggggcuguaaucacggagggaaguggcugcccccuuaacacaccuuuaauaaacagucu

SEQ ID NO: 228338 - RNA, 64 nt, Human
ugcaggaggccaacugcugagaccucuucuccaucccccuuauucaguggaagaugacggggga

SEQ ID NO: 228339 - RNA, 64 nt, Human
ugacaagauucacuuucuugagagccaucagcaccccccuuauuuccggggcacuggagccagg

SEQ ID NO: 228340 - RNA, 64 nt, Human
gcuugcucaaucgaucacgacccucucacguggacccccuuagaguugugagcccuuaaaaggg

SEQ ID NO: 228341 - RNA, 64 nt, Human
gacuuccuccucugccugccccacugcacccucucccccuuaucuaucuccuucucggcucccc

SEQ ID NO: 228342 - RNA, 64 nt, Human
gccuucccuccccugaccccacauggucucagggcccccuuagggcccccuaccccacugauag

SEQ ID NO: 228343 - RNA, 64 nt, Human
gcuucagggugcuaggcugagggauguuuuuccucccccuuaccgcccaugcccuugaaagaaa

SEQ ID NO: 228344 - RNA, 64 nt, Human
agaacaggccuggugggaaaggcuuugggggcugcccccuuaggaggaggcuagugcuaagagg

SEQ ID NO: 228345 - RNA, 64 nt, Human
cugauugaaugauaaugugcuaaauugauuaccucccccuuaaagcgaacacugaaaugcaggu

SEQ ID NO: 228346 - RNA, 64 nt, Human
ucccaaucacccaggaaagcuguccacaguaguccccccuuauccacggugucacuuuccaugg

SEQ ID NO: 228347 - RNA, 64 nt, Human
ccagaaucugcuucaccucuuuuuaccugcaauacccccuuaccccaauaccaagaccaacugg

SEQ ID NO: 228348 - RNA, 64 nt, Human; identical to SEQ ID NO: 9096

SEQ ID NO: 228349 - RNA, 64 nt, Human; identical to SEQ ID NO: 9097

SEQ ID NO: 228350 - RNA, 64 nt, Human; identical to SEQ ID NO: 9098

SEQ ID NO: 228351 - RNA, 64 nt, Human
cgguugaccugaacucgugccuuaggaauuaaugcccccuuauggaaccugccugaauugcacc

SEQ ID NO: 228352 - RNA, 64 nt, Human
cucuauauauaguacuaauggauuuggugugcuucccccuuagcgucccccucccucugcuccu

SEQ ID NO: 228353 - RNA, 64 nt, Human
ugagauccucuuuacucugggcagaagugagccccccccuuaaagggaauucgaugccccccua

SEQ ID NO: 228354 - RNA, 64 nt, Human
agggcuggcugggggcuucuccccacucccgccccccccuuaucccccucugaagacgaugggc

SEQ ID NO: 228355 - RNA, 64 nt, Human
uacaggaugguuuugguucccuucccuucccacccccccuuaagccugucagcccccuccaaau

SEQ ID NO: 228356 - RNA, 64 nt, Human
gggguuaagacucaggggcaccugagggucugagcccccuuaugaguacccaagaaggacuguc

SEQ ID NO: 228357 - RNA, 64 nt, Human
cuucccaguuggccagaaaacugggccuugcagacccccuuagcauuuuuucccuuuuuuuccu

SEQ ID NO: 228358 - RNA, 64 nt, Human
uuuccuucccagacuccuccuacccccaggugugcccccuuagccuccggaggcgggggcuggg

SEQ ID NO: 228359 - RNA, 64 nt, Human
cucauuccagauugguucccaguggcuugccccacccccuuauagcaucucccuccaggaagcu

SEQ ID NO: 228360 - RNA, 64 nt, Human
uugcauuucaacacaugccagaugcagauuuuuucccccuuacuguuucaaugaccuuuauuuu

SEQ ID NO: 228361 - RNA, 64 nt, Human
cauuguuccuuaccuuuacauaauugcaauauuucccccuuacuacuucuuggaaaaaaauuac

SEQ ID NO: 228362 - RNA, 64 nt, Human
ccuggcucugggaaaacuucccauucuuagucaacccccuuauuguaagauuaacaaauaggua

SEQ ID NO: 228363 - RNA, 64 nt, Human
cauacacuucaaggcgagcagaucaaagaaaaaucccccuuauuuagaaauguuccugggggau

SEQ ID NO: 228364 - RNA, 64 nt, Human
cuccugucuaaaaugucacccucauuacucuccacccccuuacucugcuauaauuucuccuuaa

SEQ ID NO: 228365 - RNA, 64 nt, Human
uguuaccaacuaaauugugcaguuuggggcuuuucccccuuaccauagaagugcagaggaguuc

SEQ ID NO: 228366 - RNA, 64 nt, Human
augagauuccaccccaauaucaucaggcaccuuucccccuuauccaacuagcccuagccuauac

SEQ ID NO: 228367 - RNA, 64 nt, Human; identical to SEQ ID NO: 9101

SEQ ID NO: 228368 - RNA, 64 nt, Human; identical to SEQ ID NO: 9102

SEQ ID NO: 228369 - RNA, 64 nt, Human; identical to SEQ ID NO: 9103

SEQ ID NO: 228370 - RNA, 64 nt, Human
guguugggagaagcggcuggaguucauucucucacccccuuauguugguguuuggcgugugaca

SEQ ID NO: 228371 - RNA, 64 nt, Human
caucaggguucaccucggugggggaccccacucacccccuuagggucgccaccccucacggcaa

SEQ ID NO: 228372 - RNA, 64 nt, Human
gcacaguacauaauacacuugcccugcucccucucccccuuaccccacaacgugcaacugacac

SEQ ID NO: 228373 - RNA, 64 nt, Human
cuaauuuggagacauuucucacugguugugacuacccccuuaugauccuucacauucauuuuau

SEQ ID NO: 228374 - RNA, 64 nt, Human
aucuuugcaaugugucauaaauucucuucuuuuucccccuuaaguaguauauauguuaggauua

SEQ ID NO: 228375 - RNA, 64 nt, Human
gcgcaacagagcugggccucccuuucucuaauuucccccuuaacaugccuggggggcauacaau

SEQ ID NO: 228376 - RNA, 64 nt, Human
uucuaccagcccugcaaguuuccucauggacgcucgcgaggagcaggcugcagguuuccugccu

SEQ ID NO: 228377 - RNA, 64 nt, Human
gcgccacccgcggccccagcuuuccgccugcacccgcgaggacgcgcgcgagcacacgcggcgc

SEQ ID NO: 228378 - RNA, 64 nt, Human
guggacccagcugcuggggaagagccagggggaccgcgaggagccgagcguccucgggcaccgc

SEQ ID NO: 228379 - RNA, 64 nt, Human
ucagaaaaguggcaacuuugguggcagccuagaccgcgaggaaguggaaucuuccuuaaaggug

SEQ ID NO: 228380 - RNA, 64 nt, Human
agggcaggagccccagcuuagcccugagcgccagcgcgaggaccagggccugccacuaagcccg

SEQ ID NO: 228381 - RNA, 64 nt, Human
gguggcauuggaggcguggcgcagccggcgggaccgcgaggagauccuccugcaggagcuggag

SEQ ID NO: 228382 - RNA, 64 nt, Human
uuccccgcccaggcaccgccuccaggacaacgugcgcgaggaccucuaugaggcugcugacaag

SEQ ID NO: 228383 - RNA, 64 nt, Human
gaggcggggagaggaggcggcgagggucccggggcgcgaggaaggcgccugcccucucccagcu

SEQ ID NO: 228384 - RNA, 64 nt, Human
uacgcugccgcgcuaugaccccgcggggccgccucgcgaggaccggugugcacacguguacaua

SEQ ID NO: 228385 - RNA, 51 nt, Human
accccacgacggagcagugagcgcgaggaucccgaugaggggauggaccgc

SEQ ID NO: 228386 - RNA, 64 nt, Human
ugagcuucuaccuacgagugaaacucuguccucccgcgaggaccaggcaucgcugugugaggac

SEQ ID NO: 228387 - RNA, 64 nt, Human
ucagcugcuuuugugcuacgagucagcguccgugcgcgaggacacugagccgggcuggcucucc

SEQ ID NO: 228388 - RNA, 64 nt, Human
gggaguuacucuugcauggaugguuguaaagaaacaaucagaaauaaaggaaaacugagcagaa

SEQ ID NO: 228389 - RNA, 64 nt, Human
gcucugccagguccccugggaccaacuacagcuccaaucagaaacccugcgcuuccuugagugu

SEQ ID NO: 228390 - RNA, 64 nt, Human
cggggaucacagcguuucaggaacguugccacaccaaucagagagccuagaacaucccugggca

SEQ ID NO: 228391 - RNA, 64 nt, Human
gcuucuuggauacagacacacccagggcagcugccaaucagaaaugcaaauugcuaaauuccaa

SEQ ID NO: 228392 - RNA, 64 nt, Human
aaugcugaaacugaacucuauuacuaaugccuuccaaucagaguuccugauggggaugccugug

SEQ ID NO: 228393 - RNA, 64 nt, Human
gaaugguuuuccaccuuuucccccuaaucucuaccaaucagacacauuuuauuauuuaaaucug

SEQ ID NO: 228394 - RNA, 64 nt, Human; identical to SEQ ID NO: 9106

SEQ ID NO: 228395 - RNA, 64 nt, Human; identical to SEQ ID NO: 9107

SEQ ID NO: 228396 - RNA, 64 nt, Human; identical to SEQ ID NO: 9108

SEQ ID NO: 228397 - RNA, 64 nt, Human
ucuagaugagaaguuauaucaagaaagauguggccaaucagauugagucauccaggcauaccuu

SEQ ID NO: 228398 - RNA, 64 nt, Human
auuggggugaugaccccauagaccuaacugugaacaaucagauuagacacuauguguuagaguc

SEQ ID NO: 228399 - RNA, 64 nt, Human
cucaaaaaaaaaacaauucucggcccaaagaaaacaaucagaagaauucacugauuugacuaga

SEQ ID NO: 228400 - RNA, 64 nt, Human
gguaauuauaucuguuuuguuucuugacucuguccaaucagagaauaaacaucauaguuucuug

SEQ ID NO: 228401 - RNA, 64 nt, Human
uucuauuuucaaaacaaauauuuacuucauuugccaaucagaggauguuuuaagaaacaaaaca

SEQ ID NO: 228402 - RNA, 64 nt, Human
caccaugcauuaucagagaagaggaaguaaaggacaaucagaacaccagucaaacccaccaaau

SEQ ID NO: 228403 - RNA, 64 nt, Human
cauauaagagaugaacauccaugugagaucaucccaaucagaauauaagacucaaggaguuuga

SEQ ID NO: 228404 - RNA, 64 nt, Human
gugcaaaagucuagccuugcccgagcuuuccuuacaaucagagccccucucaccuuguaaagug

SEQ ID NO: 228405 - RNA, 64 nt, Human
acuuuaccaauguuaucaaaauuacuuuugaagacaaucagaaggauuuuagcuggauaacuua

SEQ ID NO: 228406 - RNA, 64 nt, Human
aggauccagccucacuucuaggguaugggaaauccaaucagagaccaggcccuggcuaagaccc

SEQ ID NO: 228407 - RNA, 64 nt, Human
guuuugcuauuuagcaauaacauggucaaaaaggcaaucagaaauuuuaaauacaguuaaugga

SEQ ID NO: 228408 - RNA, 64 nt, Human
ggaucuuucagaucaugugcaauuuuuaucuaaccaaucagaaauacuaguuuaaaaugaauuu

SEQ ID NO: 228409 - RNA, 64 nt, Human
uacauuuucccaauaucuuuucuauuccuuggaccaaucagagaugcuguagcuccuuggggca

SEQ ID NO: 228410 - RNA, 64 nt, Human
cauuccuaagauuacacuuuuccccauuuauguccaaucagaaaaagaaggcaucuuuguacca

SEQ ID NO: 228411 - RNA, 64 nt, Human
gcauuuaauugaagaauaugugauacagccucuucaaucagauuguaaguuaccugaaagcugc

SEQ ID NO: 228412 - RNA, 64 nt, Human; identical to SEQ ID NO: 9213

SEQ ID NO: 228413 - RNA, 64 nt, Human; identical to SEQ ID NO: 9238

SEQ ID NO: 228414 - RNA, 64 nt, Human; identical to SEQ ID NO: 9240

SEQ ID NO: 228415 - RNA, 64 nt, Human; identical to SEQ ID NO: 9241

SEQ ID NO: 228416 - RNA, 64 nt, Human
auuaauuaagauaucuucagcuuguagucagacacaaucagaaucacagaaaaauccugccuaa

SEQ ID NO: 228417 - RNA, 64 nt, Human
auauuucaccauugccagagaagaugugacaggccaaucagacagggcccagagcaucucuuug

SEQ ID NO: 228418 - RNA, 64 nt, Human
aaacguugaguuccuuggguuggggaaccugaaucaaucagaaacugcuucuagaauuacaugc

SEQ ID NO: 228419 - RNA, 64 nt, Human
uggaagaaaaccagcuuguuuuuaaaacuuaacacaaucagaaauuuuucuuuuuguguuugaa

SEQ ID NO: 228420 - RNA, 64 nt, Human
uuuagcggggugaauauuuuauacuguaagugagcaaucagaguauaauguuuauggugacaaa

SEQ ID NO: 228421 - RNA, 64 nt, Human
gauugugugacuccuuguaguuacacuuguguuucaaucagaucagauuguuguauuuauucca

SEQ ID NO: 228422 - RNA, 64 nt, Human
ucacagauuauucauaagaaauugagaaaaggaacaaucagaaguugcaaaagaugguauagcc

SEQ ID NO: 228423 - RNA, 64 nt, Human
agacaucuucugugauuguuauggcauauuacaccaaucagagaaauagaguuuuaaaguagug

SEQ ID NO: 228424 - RNA, 64 nt, Human
ucauuuagagaccacaguaacaacagcagcccaccaaucagagaagcugguuguuauuaaccaa

SEQ ID NO: 228425 - RNA, 64 nt, Human
agagucuccaguuuacccuucagguugguuuaaucaaucagaauuagagcaugggaggucauca

SEQ ID NO: 228426 - RNA, 64 nt, Human
uacugugaaggauuauuugucuaacaguucauuccaaucagaccagguaggagcuuuccuguuu

SEQ ID NO: 228427 - RNA, 64 nt, Human
agaugcagauucuagggaccacuccagaccuacacaaucagaaacucuugggggagggcccgaa

SEQ ID NO: 228428 - RNA, 64 nt, Human
guuugauuucuugugacuauucuaagaaugaaugcaaucagauuuuaaaaguaacuaaauauac

SEQ ID NO: 228429 - RNA, 64 nt, Human
aaaggaccagaguggccgcuugagccagaugacucaaucagaugaaaugugccugaggccaacg

SEQ ID NO: 228430 - RNA, 64 nt, Human
cacccuucacagauaaaauaugaugcuggcauggcaaucagaccaaagcacuguccccaauugu

SEQ ID NO: 228431 - RNA, 64 nt, Human; identical to SEQ ID NO: 9111

SEQ ID NO: 228432 - RNA, 64 nt, Human; identical to SEQ ID NO: 9112

SEQ ID NO: 228433 - RNA, 64 nt, Human; identical to SEQ ID NO: 9113

SEQ ID NO: 228434 - RNA, 64 nt, Human; identical to SEQ ID NO: 9114

SEQ ID NO: 228435 - RNA, 64 nt, Human
uuuugccaggcuggugcaaaguaauuaaagaugucaaucagaaaugucaaugagacuaaagugg

SEQ ID NO: 228436 - RNA, 64 nt, Human
aagugaagagugguuaccuauaccuagcauaguacaaucagaaccucguggagaccaccgggga

SEQ ID NO: 228437 - RNA, 64 nt, Human
ugaauaaguuuccagaacaaauuuccuaauaacacaaucagauugguuuuauucuuuuauuuua

SEQ ID NO: 228438 - RNA, 64 nt, Human
ucccucgguuauaaagauucccauggaaaguguccaaucagauccccaaaacgguauccacugc

SEQ ID NO: 228439 - RNA, 64 nt, Human
aaacuauuccugaaauauauacagucuuaugucccaaucagagucuuuuaaccuaugauuuaaa

SEQ ID NO: 228440 - RNA, 64 nt, Human
gucguuccucaacucuccccaaggcaccugucuccaaucagagcccucucgcccagccagcccu

SEQ ID NO: 228441 - RNA, 64 nt, Human
auaaggacgcaaaucuucaggacaguaagcagaacaaucagaauggaauuaaaucucuaaaaac

SEQ ID NO: 228442 - RNA, 64 nt, Human
augcuacugggaacaaguuuuuguacaaaagcuucaaucagaaucacugugcauuacugagacu

SEQ ID NO: 228443 - RNA, 64 nt, Human
uucuuccuggcaagauacccauuaagcauuucgccaaucagaaucucauuuuauaguuuuuccc

SEQ ID NO: 228444 - RNA, 64 nt, Human
acuuuugucuuccacccugcccuggcagugcagccaaucagaaauggcucuugugacuuaacug

SEQ ID NO: 228445 - RNA, 64 nt, Human
aagccaguuacaguuugccuuaacucauagacaucaaucagagagugucacagauuuaaccuug

SEQ ID NO: 228446 - RNA, 64 nt, Human
aguagaaaaaucuguugccugauauacauaacaccaaucagaccguguggauuuuucucugaau

SEQ ID NO: 228447 - RNA, 64 nt, Human
uagcaaucugccacaacugccagaugaaaagcaacaaucagaguagaaaaaucuguugccugau

SEQ ID NO: 228448 - RNA, 64 nt, Human
cauaccccucuccauguaugagaucuggugcuagcaaucagauucaacccgaaggaacaagugc

SEQ ID NO: 228449 - RNA, 64 nt, Human
acuuguggccccucaaggaccucacgcugacgagcaaucagagguacucccuggucagggacaa

SEQ ID NO: 228450 - RNA, 64 nt, Human; identical to SEQ ID NO: 9117

SEQ ID NO: 228451 - RNA, 64 nt, Human; identical to SEQ ID NO: 9118

SEQ ID NO: 228452 - RNA, 64 nt, Human; identical to SEQ ID NO: 9119

SEQ ID NO: 228453 - RNA, 64 nt, Human; identical to SEQ ID NO: 9120

SEQ ID NO: 228454 - RNA, 64 nt, Human
agaugacacaugacgccagauaaaauguucagugcaaucagaguguacaaauugucguuuuuau

SEQ ID NO: 228455 - RNA, 64 nt, Human
uuagauaaaucagaacucuccuuaaaaugcauuucaaucagaagcaaaguacacccauuauuua

SEQ ID NO: 228456 - RNA, 64 nt, Human
aaacccaugcugaaaagauuguacuuugugaucccaaucagagggauggagcuaaucuuuuugc

SEQ ID NO: 228457 - RNA, 64 nt, Human
ucugccauugcaaugcagagagccaguguuuguacaaucagaccagcagggugggcaacuccuc

SEQ ID NO: 228458 - RNA, 64 nt, Human
cacugaggcugcagcgggaauucgcacucggcaccaaucagagccccaugccgcggccccucug

SEQ ID NO: 228459 - RNA, 64 nt, Human
caguguucugaggucacauggguuuggacugucucaaucagaaagauuaaugacuguuaucaag

SEQ ID NO: 228460 - RNA, 64 nt, Human
aaguccauuuugaaugaccuaaaaugaaguaacacaaucagaaaucccaugugcccauaagcac

SEQ ID NO: 228461 - RNA, 64 nt, Human
cauguuuuguauguuaaauucaaaaguaaugcuucaaucagauaguucuuuuucacaaguucaa

SEQ ID NO: 228462 - RNA, 64 nt, Human
uugguuuuauuucagucugacauagaguuaacugcaaucagauuguagucugauuuauaugaau

SEQ ID NO: 228463 - RNA, 64 nt, Human
agcucacaaauacuuuuuuuucuuuuuccuuauucaaucagauuuuccaaaguaccuuuccacc

SEQ ID NO: 228464 - RNA, 64 nt, Human
uaucuuaacagugaacaacuguguuagucuguaucaaucagaagacagaaacaagguaguaauu

SEQ ID NO: 228465 - RNA, 64 nt, Human
caaaaacagaaauacagucuuccugaaugaaugacaaucagaauuccacugcccaaaggagucc

SEQ ID NO: 228466 - RNA, 64 nt, Human
ucaacugcuagaggcuaccccauuuuccuuuccacaaucagagccauuuuuguuaaaguggcag

SEQ ID NO: 228467 - RNA, 64 nt, Human
aauuucuuucauguccucccuacuuccucagugucaaucagauuaaaguguguaauccuauuuu

SEQ ID NO: 228468 - RNA, 64 nt, Human
aaaauaugaaauacucagaaguaaagugugugggcaaucagaagcauagccuugaaggaccuga

SEQ ID NO: 228469 - RNA, 64 nt, Human; identical to SEQ ID NO: 9115

SEQ ID NO: 228470 - RNA, 64 nt, Human; identical to SEQ ID NO: 9123

SEQ ID NO: 228471 - RNA, 64 nt, Human; identical to SEQ ID NO: 9124

SEQ ID NO: 228472 - RNA, 64 nt, Human; identical to SEQ ID NO: 9125

SEQ ID NO: 228473 - RNA, 64 nt, Human
agacuuuaaaacauuuuuaaugcauauacaaaaacaaucagacuuacuggaaauaaauuaccua

SEQ ID NO: 228474 - RNA, 64 nt, Human
agagaugacuaaggucauugauagcgucucugaacaaucagacggaucaccuuaucucuacaca

SEQ ID NO: 228475 - RNA, 64 nt, Human
uuuuuguuuguuuuauuuauagucugauuuaaaacaaucagauucaaguugguuaauuuuaguu

SEQ ID NO: 228476 - RNA, 64 nt, Human
uaaaggugaaaaaagcuuuuaugagcucauguagcaaucagauuuuccuguggauugauaauaa

SEQ ID NO: 228477 - RNA, 64 nt, Human
cacugccccucccccuguuccugccccaagccgucaaucagauuguggagcaguacacagucag

SEQ ID NO: 228478 - RNA, 64 nt, Human
gcguuugauucugcccacagggccugugccaaggcaaucagaucuuuaugagagcaguauuuuc

SEQ ID NO: 228479 - RNA, 64 nt, Human
aaguuaaguauaauuauuuuaaugcaaucuaauacaaucagauuacucaguugccuuaccucau

SEQ ID NO: 228480 - RNA, 64 nt, Human
agauuaaugggcaugcaaugaagucuccagcagacaaucagauguuguuggaugucuagauuau

SEQ ID NO: 228481 - RNA, 59 nt, Human
ggacuuggacuaaagucugaugaacuucccaaucagaugagcauggaugauuggccaga

SEQ ID NO: 228482 - RNA, 64 nt, Human
guucauagaaauguucaguaaugaaaaauauauccaaucagagccaucccuaaagaguguucuc

SEQ ID NO: 228483 - RNA, 64 nt, Human
cuuuccuuuuuuauaccugccuuaaauaauuuggcaaucagaauuaaaaaguuuuuuuuuuuuu

SEQ ID NO: 228484 - RNA, 64 nt, Human
ugccaaggagacccuggaggggcucugaggauagcaaucagagguugggcuggcuggacugagc

SEQ ID NO: 228485 - RNA, 64 nt, Human
uuguuugacuccccuccccccauuuacaugcaugcaaucagacaggccacuaagguaaaagagu

SEQ ID NO: 228486 - RNA, 64 nt, Human
ggcucacucuaccucuaggcauguuucaucccaacaaucagacugugccaaagcaggggacuuu

SEQ ID NO: 228487 - RNA, 64 nt, Human
uucuuuuauuuuuaaaaaacucacauagaggagacaaucagaaauuuaccauagucccaagaau

SEQ ID NO: 228488 - RNA, 64 nt, Human; identical to SEQ ID NO: 9128

SEQ ID NO: 228489 - RNA, 64 nt, Human; identical to SEQ ID NO: 9129

SEQ ID NO: 228490 - RNA, 64 nt, Human; identical to SEQ ID NO: 9130

SEQ ID NO: 228491 - RNA, 64 nt, Human; identical to SEQ ID NO: 9131

SEQ ID NO: 228492 - RNA, 64 nt, Human
auagaaggcaacuccuacuuguguguggacugagcaaucagagucuguggcgauaauauugcug

SEQ ID NO: 228493 - RNA, 64 nt, Human
agcuuuguggauuuagaaaggaagccuucaguuccaaucagaauccucuuuccuuacaaaaaaa

SEQ ID NO: 228494 - RNA, 64 nt, Human
augcucuggaaucuguggagacgccagcccugcccaaucagagaugccaaaaauggggacauga

SEQ ID NO: 228495 - RNA, 64 nt, Human
gaugaaguucugagauacugaaaugugaaaagagcaaucagaauugugcuuuuucuccccuccu

SEQ ID NO: 228496 - RNA, 64 nt, Human
gguaggcugcugcccugcuguggaagaggagcaacaaucagacaugaguccacccuuuggagac

SEQ ID NO: 228497 - RNA, 64 nt, Human
gauuaagaucauccuuauuguuucuaaauuauuucaaucagaugaaagugauacgauugaaaug

SEQ ID NO: 228498 - RNA, 64 nt, Human
uucugagaguggaucucaagcaaguucaugccuucaaucagauguuacuuaggguggguauacc

SEQ ID NO: 228499 - RNA, 64 nt, Human
cuccuggaugcuauuaaagcuuuguuuuguugaacaaucagaugcccaacucuguugccuugug

SEQ ID NO: 228500 - RNA, 64 nt, Human
auguuagugagaaguaaugugcagcauuaugguccaaucagauacaauauugugucuacaauug

SEQ ID NO: 228501 - RNA, 64 nt, Human
agccuccuuaagugagcugaggggacaggaaauccaaucagaugaccuuuguguucguaaucgg

SEQ ID NO: 228502 - RNA, 64 nt, Human
aacaaacagccccuccccaccuccaguuuuacaacaaucagaaagggcacugauuuauuuggua

SEQ ID NO: 228503 - RNA, 64 nt, Human
uggauuggucugaggggucugaacgucuccuagccaaucagaacuggcuguggaccacccuagc

SEQ ID NO: 228504 - RNA, 64 nt, Human
accccagaguuuuaaggacuuggaaaggaaagcacaaucagagaagaaaacagcccccgaacca

SEQ ID NO: 228505 - RNA, 64 nt, Human
uugaaauaaguaauacuuucuuguuuaaucugugcaaucagaaggugucuugaccuucaauuca

SEQ ID NO: 228506 - RNA, 64 nt, Human
aucacuauggacuuucucuauuuuaaaaugguaacaaucagaggaacuauaagaacaccuuuag

SEQ ID NO: 228507 - RNA, 64 nt, Human; identical to SEQ ID NO: 9190

SEQ ID NO: 228508 - RNA, 64 nt, Human; identical to SEQ ID NO: 9195

SEQ ID NO: 228509 - RNA, 64 nt, Human; identical to SEQ ID NO: 9196

SEQ ID NO: 228510 - RNA, 64 nt, Human; identical to SEQ ID NO: 9197

SEQ ID NO: 228511 - RNA, 64 nt, Human
uauaggugaaagaaaaaauucccucauuuaaacccaaucagaugccucagaggguagccuugau

SEQ ID NO: 228512 - RNA, 64 nt, Human
uuuuaagaacuugauccauuguaucaguaccucacaaucagaguuggcaaaugauggaugagug

SEQ ID NO: 228513 - RNA, 64 nt, Human
uaagcagcaacagccuacaaagagaugcuuggagcaaucagaacuucaggugugacucuagcaa

SEQ ID NO: 228514 - RNA, 64 nt, Human
aaacacggggcuugcaacuuagcucacaccugaccaaucagagagcucacuaaaaugcuaauua

SEQ ID NO: 228515 - RNA, 64 nt, Human
cuaauuugagcaaaaucuaaaaucaauuauuaggcaaucagaaaaauuugaacacagacuagau

SEQ ID NO: 228516 - RNA, 64 nt, Human
uuuuuuuccuggagucucuuagcucuaaauauaucaaucagauuuauaauuuuuuuuaccugau

SEQ ID NO: 228517 - RNA, 64 nt, Human
gacaggaagaaaacaaaaaccagacugugucccacaaucagaaaccuccguuguggcagagggg

SEQ ID NO: 228518 - RNA, 64 nt, Human
uuaacaugaaucagaaucaccuggagggcucaugcaaucagauugccagaucucgccucagcgu

SEQ ID NO: 228519 - RNA, 64 nt, Human
caauauaaacuguaaaacuuauuaggcaugaaaucaaucagaagagaaagaaaaaugcuggaac

SEQ ID NO: 228520 - RNA, 64 nt, Human
gauguguaaagaaugauauauauauuaaauaggucaaucagacuaugacagcuauguacgacca

SEQ ID NO: 228521 - RNA, 64 nt, Human
acuuugauauuuaugcuggaaauggauagaaguucaaucagacaguucagcuucacgaacugau

SEQ ID NO: 228522 - RNA, 64 nt, Human
gaucaugagcuguuucuugggcgaugaauguucucaaucagaaaacugacaguagaaaucucac

SEQ ID NO: 228523 - RNA, 64 nt, Human
gaaccauuagaacagaucccuucuuuuccuuuugcaaucagauaaauaaauaucacugaaugca

SEQ ID NO: 228524 - RNA, 64 nt, Human
uggguuagcaucaaguucuccccaggguagaauucaaucagagcuccaguuugcauuuggaugu

SEQ ID NO: 228525 - RNA, 64 nt, Human
guuaggucaacuggcaaauuggaauauagacagucaaucagauaagaaguauacuuugauuaag

SEQ ID NO: 228526 - RNA, 64 nt, Human; identical to SEQ ID NO: 9134

SEQ ID NO: 228527 - RNA, 64 nt, Human; identical to SEQ ID NO: 9135

SEQ ID NO: 228528 - RNA, 64 nt, Human; identical to SEQ ID NO: 9136

SEQ ID NO: 228529 - RNA, 64 nt, Human; identical to SEQ ID NO: 9137

SEQ ID NO: 228530 - RNA, 64 nt, Human
agauaggaagaagaaugauggauuccuuuuggaucaaucagaaaggaaacacgaaagaaaaguc

SEQ ID NO: 228531 - RNA, 64 nt, Human
uggccaaggggugggccugugaaucaauccugggcaaucagacacccucuccuuaaaaacuggc

SEQ ID NO: 228532 - RNA, 64 nt, Human
aauggccuggagggacuuuuaaucagugaagaugcaaucagacaaguguuuuggaaagagcacc

SEQ ID NO: 228533 - RNA, 64 nt, Human
gccaagcccuugucuucacaaauucgcaacacaacaaucagauggcaccagggacuggcagcuc

SEQ ID NO: 228534 - RNA, 64 nt, Human
aggcagaaagcuucuguguaagccaggcuuaagucaaucagagggcacaaaccuuauuaggagg

SEQ ID NO: 228535 - RNA, 64 nt, Human
ucugggacagggaggugacaguggaacaggcuaccaaucagaacuagaugacuuuuaaggcucc

SEQ ID NO: 228536 - RNA, 64 nt, Human
aaucuuccucauuuauacuauuauuuguuacguucaaucagaauccccgaaaccuccuauaaag

SEQ ID NO: 228537 - RNA, 64 nt, Human
ccuagacacuagaacuaaaggauugguaauaaaccaaucagaaagaaauccucuguggggucac

SEQ ID NO: 228538 - RNA, 64 nt, Human
uggagacccugcaggccagaguccaaauauuuaacaaucagaaggggcaaggcucugaccagug

SEQ ID NO: 228539 - RNA, 64 nt, Human
uucuuuccuacacuuaaauaccucguguauggugcaaucagaccacaaaaucagaagcugggua

SEQ ID NO: 228540 - RNA, 64 nt, Human
acacccacuucccucuguccuaguucucuuuguccaaucagauggcaagggcagugcguggaaa

SEQ ID NO: 228541 - RNA, 64 nt, Human
auaugauuuaggaugcauaucaguucuaacaauucaaucagaagucaagcucauuggaauuccu

SEQ ID NO: 228542 - RNA, 64 nt, Human
aauccacauauagggcugaguuccuaguccuacacaaucagaauuugccuuuuuaagucacgcu

SEQ ID NO: 228543 - RNA, 64 nt, Human
guucugaguuacuuaggaaacagacuucgcauuucaaucagagaggccacagagcaaggucuaa

SEQ ID NO: 228544 - RNA, 64 nt, Human
guguauagagcaggagaguuucuacugcaagugacaaucagaggugacuaucuauauuugcacu

SEQ ID NO: 228545 - RNA, 64 nt, Human; identical to SEQ ID NO: 9132

SEQ ID NO: 228546 - RNA, 64 nt, Human; identical to SEQ ID NO: 9140

SEQ ID NO: 228547 - RNA, 64 nt, Human; identical to SEQ ID NO: 9141

SEQ ID NO: 228548 - RNA, 64 nt, Human; identical to SEQ ID NO: 9142

SEQ ID NO: 228549 - RNA, 64 nt, Human
auuuuuggacugguguuuuucacaaaguauuuuucaaucagaguuuucagaaccugacauuguu

SEQ ID NO: 228550 - RNA, 64 nt, Human
gggaaauucucuugacugaauuaauccuucaaaacaaucagauaauucacacaagagguacacc

SEQ ID NO: 228551 - RNA, 64 nt, Human
aaccaauauaaauccacaagcagcuugauuccaccaaucagagaaguugaagaugaauguugac

SEQ ID NO: 228552 - RNA, 64 nt, Human
gggacggggguccugagguccccaccuaugccagcaaucagagaagcccucuuggcauccccag

SEQ ID NO: 228553 - RNA, 64 nt, Human
uucgugcuaccuaggcaauccauugacauuucuccaaucagagcauguggaccuuggagccagg

SEQ ID NO: 228554 - RNA, 64 nt, Human
cagugacaccagcacugauuggacugcccuacaccaaucagaagcucagugcccaaugggccac

SEQ ID NO: 228555 - RNA, 64 nt, Human
ugcugugguguggacugggugcuacuuauagacccaaucagaauacggugguugagaaggaacc

SEQ ID NO: 228556 - RNA, 64 nt, Human
caugaaauguauagggcaaaccucaggggaccugcaaucagaagacgugaaggcagauuuucau

SEQ ID NO: 228557 - RNA, 64 nt, Human
gucaaagacuccuggaaaggaguugccucuucuccaaucagagcguggaggcgaguugggcgac

SEQ ID NO: 228558 - RNA, 64 nt, Human
gucagaaauuuuauucagauaaucuguaccucaucaaucagaugaugacaauuuacuucccagg

SEQ ID NO: 228559 - RNA, 64 nt, Human
acaguauuauuuuaauuggccucaaugguugcagcaaucagagucccagcguuuguacucacag

SEQ ID NO: 228560 - RNA, 64 nt, Human
ugugcgcuugucagaccaucagaccagggccaaccaaucagaaggcaacuuacuguauaaauua

SEQ ID NO: 228561 - RNA, 64 nt, Human
ccaacacaacagcaauggcaacaccgacagcaaccaaucagauauauacaaaugaaauuagaag

SEQ ID NO: 228562 - RNA, 64 nt, Human
ucaagcucauuuuauggauuucugucuuuuaaaacaaucagauugcaauagacauucgaaaggc

SEQ ID NO: 228563 - RNA, 64 nt, Human
ccuucaccaucugcacuacauuucuggcugaucccaaucagauucccgcuaauggaagaaguuu

SEQ ID NO: 228564 - RNA, 64 nt, Human; identical to SEQ ID NO: 9121

SEQ ID NO: 228565 - RNA, 64 nt, Human; identical to SEQ ID NO: 9145

SEQ ID NO: 228566 - RNA, 64 nt, Human; identical to SEQ ID NO: 9146

SEQ ID NO: 228567 - RNA, 64 nt, Human; identical to SEQ ID NO: 9147

SEQ ID NO: 228568 - RNA, 64 nt, Human
caaucagaccuucucccugaacuuaagauagccacaaucagaaaaaggacaaggacaugagaca

SEQ ID NO: 228569 - RNA, 64 nt, Human
aguuucugggguuaagcacuaaggacacaagaaucaaucagaccuucucccugaacuuaagaua

SEQ ID NO: 228570 - RNA, 64 nt, Human
ucauucauucauuggauuguauaucauuguugcacaaucagaauugauaagcacuguuccucca

SEQ ID NO: 228571 - RNA, 64 nt, Human
acucuauuguucaauucucuaaaaucccagaacacaaucagaaauagcucaggcagacacuaau

SEQ ID NO: 228572 - RNA, 51 nt, Human
aggaggguauaugggcauagccaaucagaggcuuaguucagccauuuuguu

SEQ ID NO: 228573 - RNA, 64 nt, Human
ugcaaaacugguuuuacccaccacugucacacaccaaucagaacuugccagcuccucaaaacuu

SEQ ID NO: 228574 - RNA, 64 nt, Human
guccuccuuucacugagcuuuauucaaauuuugacaaucagagcacugggaagaaauaaauucc

SEQ ID NO: 228575 - RNA, 64 nt, Human
uccaguucaguauuuggaguucaacacugucucucaaucagaucaucuugaucuuuuucuuuau

SEQ ID NO: 228576 - RNA, 64 nt, Human
gaauauuuuaaaaauaaaccagaucaaauuaauacaaucagaagguuucgaaauguaaauauuc

SEQ ID NO: 228577 - RNA, 64 nt, Human
uaugcacuguaaaggguggggugauguggcuuaacaaucagacuucuucuauuuuugcugcuau

SEQ ID NO: 228578 - RNA, 64 nt, Human
aauucaauaguauagccaucacuuauuauaauggcaaucagaagagugaggcuucuuuuuucaa

SEQ ID NO: 228579 - RNA, 64 nt, Human
ccuuguaaauaagugccuuacgugagugugucaucaaucagaaccuaagcacagcaguaaacua

SEQ ID NO: 228580 - RNA, 64 nt, Human
ucuagcggcuaaguaccuccuacacauuucccaucaaucagaaaauagacagguacacuaaagg

SEQ ID NO: 228581 - RNA, 64 nt, Human
gaucgaauuuaauuuccuuucccucauucugcagcaaucagaauacacaaucuuaaccacucgg

SEQ ID NO: 228582 - RNA, 51 nt, Human
ccaaagucggaaucuacugaacaaucagaaaagaaaaaaauguaaugcaaa

SEQ ID NO: 228583 - RNA, 64 nt, Human; identical to SEQ ID NO: 9148

SEQ ID NO: 228584 - RNA, 64 nt, Human; identical to SEQ ID NO: 9150

SEQ ID NO: 228585 - RNA, 64 nt, Human; identical to SEQ ID NO: 9151

SEQ ID NO: 228586 - RNA, 64 nt, Human; identical to SEQ ID NO: 9152

SEQ ID NO: 228587 - RNA, 64 nt, Human
uuuaaaacauuugaaaccaaguacuguuuaauuucaaucagaagaugcaaauacauacuuugau

SEQ ID NO: 228588 - RNA, 64 nt, Human
cuuguacuuggaugcguaguacaucauauguauacaaucagauaaaagcauagaaguaaaucau

SEQ ID NO: 228589 - RNA, 64 nt, Human
aaguacaguaauguaaaggaagacuuggaguuuacaaucagaaccuggacccuaaagaacagug

SEQ ID NO: 228590 - RNA, 64 nt, Human
uaaguggaacucuggauugacuggucaguugcuacaaucagaauaugcuuucuuggaccauguu

SEQ ID NO: 228591 - RNA, 64 nt, Human
caacuuccuuuccuuucaguucugccaaaugcuacaaucagaagugcaguaucuuuugugcugg

SEQ ID NO: 228592 - RNA, 64 nt, Human
aaucuuuuguugcaagcagugugucgcuucugcacaaucagagacugucucgaucucuccacuc

SEQ ID NO: 228593 - RNA, 64 nt, Human
auuauguguaugaacaauucuaguuucauuuguucaaucagaagagcaaauaaccauuccuuuc

SEQ ID NO: 228594 - RNA, 64 nt, Human
aacaaauauagauagguagaacuauauuuucccccaaucagaaucaucauaucauagguacaau

SEQ ID NO: 228595 - RNA, 64 nt, Human
ugagaaagcaaaaaguacuuuguaaaguguuauacaaucagaaggugcuuugugcugaccguca

SEQ ID NO: 228596 - RNA, 64 nt, Human
auuagggggccucuuggccuugguccaaaauugucaaucagaaaugaacauaaaggacuccaga

SEQ ID NO: 228597 - RNA, 64 nt, Human
gaucuaggcucccagcaggcuacuuugaagggaacaaucagaugcaaaagcucuuggguguuua

SEQ ID NO: 228598 - RNA, 64 nt, Human
cucccacccagucugccccuggucucugcccauccaaucagagcccacccuccuggaagagacc

SEQ ID NO: 228599 - RNA, 64 nt, Human
gcuucuguuuuauucagggauuuuuuuaaaaagucaaucagaaaagggauacuggagcuucuuc

SEQ ID NO: 228600 - RNA, 64 nt, Human
ugaguacucuacucuugcucaagaaguaauacgacaaucagaauacaaaccaguaaggcaacac

SEQ ID NO: 228601 - RNA, 64 nt, Human
ugcucgggccucacccaaggccaaacuccaaacacaaucagaaccagccaaagaagcacuuccu

SEQ ID NO: 228602 - RNA, 64 nt, Human; identical to SEQ ID NO: 9094

SEQ ID NO: 228603 - RNA, 64 nt, Human; identical to SEQ ID NO: 9099

SEQ ID NO: 228604 - RNA, 64 nt, Human; identical to SEQ ID NO: 9287

SEQ ID NO: 228605 - RNA, 64 nt, Human; identical to SEQ ID NO: 9288

SEQ ID NO: 228606 - RNA, 64 nt, Human
gggucagaguugaauucuuaugucuauagacuuccaaucagaagucucacugguggggcugggg

SEQ ID NO: 228607 - RNA, 64 nt, Human
acaaaauguaaacccaaccuuuauaccacaaaggcaaucagaucccauccuccuccuucauacc

SEQ ID NO: 228608 - RNA, 64 nt, Human
uuuauuuucaaguugcauucuuugucuuuuuaagcaaucagauuucaagagagcucaagcuuuc

SEQ ID NO: 228609 - RNA, 64 nt, Human
uuaguccuagcauaugcaccugagccaaccuggccaaucagauuguuuugucaauaauuugaaa

SEQ ID NO: 228610 - RNA, 64 nt, Human
uugcaaauaaucacagauuagcuguaauuuuaaccaaucagaugacaacaaagauugauagaaa

SEQ ID NO: 228611 - RNA, 64 nt, Human
acccguauuagcaaguacguggcaauguucauuccaaucagaugcagcuuucuccuccgucugg

SEQ ID NO: 228612 - RNA, 64 nt, Human
ccccauaugggagaugcuugcccauguguuucaucaaucagaaguccuccuccccagcacauuc

SEQ ID NO: 228613 - RNA, 64 nt, Human
uggagaagcuguugcugagaccccccccccaagucaaucagaaccacaacagguuggucaucag

SEQ ID NO: 228614 - RNA, 64 nt, Human
gaggcacugggaugugauaugccccucucucucccaaucagagccuguugauauuacaacaggg

SEQ ID NO: 228615 - RNA, 64 nt, Human
uuguagcuuuggagugcagaguguaacucugggacaaucagauuucacauauucugucaucuug

SEQ ID NO: 228616 - RNA, 64 nt, Human
gagauuuuucaguucuccauauaauaauuuucuacaaucagaucuaugcuguggcauauuuugc

SEQ ID NO: 228617 - RNA, 64 nt, Human
auauagaaaucauucuaacaacccagguuauuuucaaucagaccaggcauucgauaacacacua

SEQ ID NO: 228618 - RNA, 64 nt, Human
auacaaauuaugucuuccaaaguauggaacacuccaaucagaaaaagguuaucauuggucguug

SEQ ID NO: 228619 - RNA, 64 nt, Human
acuaagguacaaaagacacuggacaaccauauugcaaucagaucuacagcuccuggauaauugc

SEQ ID NO: 228620 - RNA, 64 nt, Human
auacaauucuacauugucaagcuuaugaagguuccaaucagaucuuuauuguuauucaauuugg

SEQ ID NO: 228621 - RNA, 64 nt, Human; identical to SEQ ID NO: 9084

SEQ ID NO: 228622 - RNA, 64 nt, Human; identical to SEQ ID NO: 9085

SEQ ID NO: 228623 - RNA, 64 nt, Human; identical to SEQ ID NO: 9086

SEQ ID NO: 228624 - RNA, 64 nt, Human; identical to SEQ ID NO: 9087

SEQ ID NO: 228625 - RNA, 64 nt, Human
ccuuugaaaaaaaaaucuguaaaacaucaacccccaaucagaagauggcaaauggggaauaaaa

SEQ ID NO: 228626 - RNA, 64 nt, Human
agagaaacccuauaaagaaugauacaauauguuucaaucagaaccuucacauccaauaagcaau

SEQ ID NO: 228627 - RNA, 64 nt, Human
auuucacaccuugcaaaaggagaucuaaaaaacacaaucagaaaugacaaaggggacauuacca

SEQ ID NO: 228628 - RNA, 64 nt, Human
accaacugaugcagaaacaggaggugugagccagcaaucagauggagauucuagugcucaugaa

SEQ ID NO: 228629 - RNA, 64 nt, Human
gcuuuaggagugcuuugaauacaacaggacucaucaaucagauguugaauuucauguaucugaa

SEQ ID NO: 228630 - RNA, 64 nt, Human
aagaaguggacaccacguggcaugauccuugauccaaucagauugagcccuggcgugauccagu

SEQ ID NO: 228631 - RNA, 62 nt, Human
aagauuguggacaaauuugagucacuucucaccaaucagacuuuauggagaacagaagggag

SEQ ID NO: 228632 - RNA, 64 nt, Human
gcucuaagcuucagagguaguaacugucauucuucaaucagauaguggaaauagaacuugcucc

SEQ ID NO: 228633 - RNA, 64 nt, Human
auggucacccugaagcccuuagauuccaaccccucaaucagagacuuccuucauuaacaaagac

SEQ ID NO: 228634 - RNA, 64 nt, Human
gagggugguuuauccagaaaccaagaaaaaaaaucaaucagaauaaacucaaaaaaaaaaggua

SEQ ID NO: 228635 - RNA, 64 nt, Human
ugggcuguuccuucucugauacgggaagagaccccaaucagauuuuucaaauuaaagccagucc

SEQ ID NO: 228636 - RNA, 64 nt, Human
ugguccauugcuacucuugcugcacuuauguaaacaaucagaccacauuugaagaaacuccacc

SEQ ID NO: 228637 - RNA, 64 nt, Human
cgggagauccuggagcuggagcaugagugucugacaaucagaagcaucauguccaauguccaga

SEQ ID NO: 228638 - RNA, 64 nt, Human
auagucacaaccucuccucagcccuaacccuuggcaaucagaaaucuuuucaucuuuaguuuug

SEQ ID NO: 228639 - RNA, 64 nt, Human
cucuuagucuuuaaguucaaagacuaaccuguagcaaucagacuuuccaaaaggggguucucca

SEQ ID NO: 228640 - RNA, 64 nt, Human; identical to SEQ ID NO: 9088

SEQ ID NO: 228641 - RNA, 64 nt, Human; identical to SEQ ID NO: 9104

SEQ ID NO: 228642 - RNA, 64 nt, Human; identical to SEQ ID NO: 9155

SEQ ID NO: 228643 - RNA, 64 nt, Human; identical to SEQ ID NO: 9156

SEQ ID NO: 228644 - RNA, 64 nt, Human
aaauaguugagcugauauauguuaagcagauauucaaucagaaugaacagguuccggugguuau

SEQ ID NO: 228645 - RNA, 64 nt, Human
aaagugauucuaaacuaagauguguaauaaaaaucaaucagauuuauuguaccuacaaaaaggu

SEQ ID NO: 228646 - RNA, 64 nt, Human
gcaaccugaaacccaggaaagcagucuccauagucaaucagaaaaacaaugaucauucugugac

SEQ ID NO: 228647 - RNA, 64 nt, Human
caaagaagucuguuaaaucaugacugaaaaaaaucaaucagauguaucuucaaaaaguggaguc

SEQ ID NO: 228648 - RNA, 64 nt, Human
aggcuucuggugacaucauucaagggagugaagacaaucagaacuuugagaguucagaguucca

SEQ ID NO: 228649 - RNA, 64 nt, Human
cacuaauaaaggaguauuuuuuuugucagcuuaucaaucagacugaucuaaugugaaauguaag

SEQ ID NO: 228650 - RNA, 64 nt, Human
acagaauguaguauuuugauaucauuaaguaaaccaaucagaaaacuccuugagcaauaguugu

SEQ ID NO: 228651 - RNA, 64 nt, Human
agggucagguaagagauggccuucuuggcugccacaaucagaaaucacgcaggcauuuugggua

SEQ ID NO: 228652 - RNA, 64 nt, Human
gauccucagagaguuuacaaugugcuuuuuccgccaaucagaacuguggacaaaacuuccuauu

SEQ ID NO: 228653 - RNA, 64 nt, Human
aucugcagggaugaaucuguaacuuaaauugggccaaucagaauuguuaucuuuguucagguaa

SEQ ID NO: 228654 - RNA, 64 nt, Human
ugucagcuuagcuaggccacagucaccaguaauucaaucagacacuaaucuagguauuucugug

SEQ ID NO: 228655 - RNA, 64 nt, Human
ucuguccaaucagguaggcugggccugaacuagccaaucagaucaacucugucuugggcguuug

SEQ ID NO: 228656 - RNA, 64 nt, Human
aggcaccuuguagcauguacuccccgugccugggcaaucagaugggcugccuuuguccaaggga

SEQ ID NO: 228657 - RNA, 64 nt, Human
ggucucucuggcucuaggacccccagugcucacacaaucagaccaaggaacaagacccccagga

SEQ ID NO: 228658 - RNA, 64 nt, Human
gauugauuuuccaaaaccacagcuucagcagcaacaaucagaauguccaaaugcuguccuuucc

SEQ ID NO: 228659 - RNA, 64 nt, Human; identical to SEQ ID NO: 9090

SEQ ID NO: 228660 - RNA, 64 nt, Human; identical to SEQ ID NO: 9091

SEQ ID NO: 228661 - RNA, 64 nt, Human; identical to SEQ ID NO: 9092

SEQ ID NO: 228662 - RNA, 64 nt, Human; identical to SEQ ID NO: 9093

SEQ ID NO: 228663 - RNA, 64 nt, Human
ucucuuucacccacaugccuaagaccugcccugacaaucagaguagggacuacaagaguguaug

SEQ ID NO: 228664 - RNA, 64 nt, Human
uuagagauggcaucucaucgaugagagagaaucacaaucagaauggaagcacuuugaguaucug

SEQ ID NO: 228665 - RNA, 64 nt, Human
uggaccaaauacauuuuuaaaagaaaacugagaccaaucagauggaaauggaguuuuaaggcaa

SEQ ID NO: 228666 - RNA, 64 nt, Human
uacauauuacaagaaaacuacaggguccacacggcaaucagaagaaaggagcugagaugagguu

SEQ ID NO: 228667 - RNA, 64 nt, Human
uuuauggggagcuuuuguugcacccaugcaggggcaaucagaucagcaucuucaugcaaaaaaa

SEQ ID NO: 228668 - RNA, 64 nt, Human
ccucccaaguccaggacccauuaauuuccugagccaaucagaaauauauuuuucaauaaugcua

SEQ ID NO: 228669 - RNA, 64 nt, Human
ggaacuaggcauaucaugccuuuguuuaaaaguacaaucagaggugguaagaugccuuuggcuu

SEQ ID NO: 228670 - RNA, 64 nt, Human
cacgauuuagauuuaaugaugcuucaguggaaaucaaucagaagguauucugaccuugugaaca

SEQ ID NO: 228671 - RNA, 64 nt, Human
uguucucaacuuuguuugauucuccacucauuuucaaucagaguugaagccuucuuugccuuuc

SEQ ID NO: 228672 - RNA, 64 nt, Human
auuaguacuuuguuauuuuuccaucacuaaaggccaaucagaauuuggaaccaugcugcuaccc

SEQ ID NO: 228673 - RNA, 64 nt, Human
gugaugugccuaaauaaguuauaaagauuuaggccaaucagaagcuaacagcaguuucagguag

SEQ ID NO: 228674 - RNA, 64 nt, Human; identical to SEQ ID NO: 9076

SEQ ID NO: 228675 - RNA, 64 nt, Human; identical to SEQ ID NO: 9077

SEQ ID NO: 228676 - RNA, 64 nt, Human; identical to SEQ ID NO: 9078

SEQ ID NO: 228677 - RNA, 64 nt, Human; identical to SEQ ID NO: 9079

SEQ ID NO: 228678 - RNA, 64 nt, Human; identical to SEQ ID NO: 9080

SEQ ID NO: 228679 - RNA, 64 nt, Human; identical to SEQ ID NO: 9081

SEQ ID NO: 228680 - RNA, 64 nt, Human; identical to SEQ ID NO: 9362

SEQ ID NO: 228681 - RNA, 64 nt, Human; identical to SEQ ID NO: 9363

SEQ ID NO: 228682 - RNA, 64 nt, Human; identical to SEQ ID NO: 9364

SEQ ID NO: 228683 - RNA, 64 nt, Human; identical to SEQ ID NO: 9365

SEQ ID NO: 228684 - RNA, 64 nt, Human; identical to SEQ ID NO: 9366

SEQ ID NO: 228685 - RNA, 60 nt, Human; identical to SEQ ID NO: 9367

SEQ ID NO: 228686 - RNA, 64 nt, Human; identical to SEQ ID NO: 9368

SEQ ID NO: 228687 - RNA, 64 nt, Human; identical to SEQ ID NO: 9369

SEQ ID NO: 228688 - RNA, 64 nt, Human; identical to SEQ ID NO: 9370

SEQ ID NO: 228689 - RNA, 64 nt, Human; identical to SEQ ID NO: 9371

SEQ ID NO: 228690 - RNA, 64 nt, Human; identical to SEQ ID NO: 9372

SEQ ID NO: 228691 - RNA, 64 nt, Human; identical to SEQ ID NO: 9373

SEQ ID NO: 228692 - RNA, 64 nt, Human; identical to SEQ ID NO: 9374

SEQ ID NO: 228693 - RNA, 64 nt, Human; identical to SEQ ID NO: 9375

SEQ ID NO: 228694 - RNA, 64 nt, Human; identical to SEQ ID NO: 9376

SEQ ID NO: 228695 - RNA, 64 nt, Human; identical to SEQ ID NO: 9377

SEQ ID NO: 228696 - RNA, 64 nt, Human; identical to SEQ ID NO: 9378

SEQ ID NO: 228697 - RNA, 64 nt, Human; identical to SEQ ID NO: 9379

SEQ ID NO: 228698 - RNA, 51 nt, Human; identical to SEQ ID NO: 9380

SEQ ID NO: 228699 - RNA, 64 nt, Human; identical to SEQ ID NO: 9381

SEQ ID NO: 228700 - RNA, 64 nt, Human; identical to SEQ ID NO: 9382

SEQ ID NO: 228701 - RNA, 64 nt, Human; identical to SEQ ID NO: 9383

SEQ ID NO: 228702 - RNA, 64 nt, Human; identical to SEQ ID NO: 9384

SEQ ID NO: 228703 - RNA, 64 nt, Human; identical to SEQ ID NO: 9385

SEQ ID NO: 228704 - RNA, 64 nt, Human; identical to SEQ ID NO: 9386

SEQ ID NO: 228705 - RNA, 64 nt, Human; identical to SEQ ID NO: 9387

SEQ ID NO: 228706 - RNA, 64 nt, Human; identical to SEQ ID NO: 9388

SEQ ID NO: 228707 - RNA, 64 nt, Human; identical to SEQ ID NO: 9389

SEQ ID NO: 228708 - RNA, 64 nt, Human; identical to SEQ ID NO: 9390

SEQ ID NO: 228709 - RNA, 64 nt, Human; identical to SEQ ID NO: 9391

SEQ ID NO: 228710 - RNA, 64 nt, Human; identical to SEQ ID NO: 9392

SEQ ID NO: 228711 - RNA, 64 nt, Human; identical to SEQ ID NO: 9393

SEQ ID NO: 228712 - RNA, 64 nt, Human; identical to SEQ ID NO: 9394

SEQ ID NO: 228713 - RNA, 64 nt, Human; identical to SEQ ID NO: 9395

SEQ ID NO: 228714 - RNA, 64 nt, Human; identical to SEQ ID NO: 9396

SEQ ID NO: 228715 - RNA, 64 nt, Human; identical to SEQ ID NO: 9397

SEQ ID NO: 228716 - RNA, 64 nt, Human; identical to SEQ ID NO: 9398

SEQ ID NO: 228717 - RNA, 64 nt, Human; identical to SEQ ID NO: 9399

SEQ ID NO: 228718 - RNA, 64 nt, Human; identical to SEQ ID NO: 9400

SEQ ID NO: 228719 - RNA, 64 nt, Human; identical to SEQ ID NO: 9401

SEQ ID NO: 228720 - RNA, 64 nt, Human; identical to SEQ ID NO: 9402

SEQ ID NO: 228721 - RNA, 64 nt, Human; identical to SEQ ID NO: 9403

SEQ ID NO: 228722 - RNA, 64 nt, Human; identical to SEQ ID NO: 9404

SEQ ID NO: 228723 - RNA, 64 nt, Human; identical to SEQ ID NO: 9405

SEQ ID NO: 228724 - RNA, 64 nt, Human; identical to SEQ ID NO: 9406

SEQ ID NO: 228725 - RNA, 64 nt, Human; identical to SEQ ID NO: 9407

SEQ ID NO: 228726 - RNA, 64 nt, Human; identical to SEQ ID NO: 9408

SEQ ID NO: 228727 - RNA, 64 nt, Human; identical to SEQ ID NO: 9409

SEQ ID NO: 228728 - RNA, 64 nt, Human; identical to SEQ ID NO: 9410

SEQ ID NO: 228729 - RNA, 64 nt, Human; identical to SEQ ID NO: 9411

SEQ ID NO: 228730 - RNA, 64 nt, Human; identical to SEQ ID NO: 9412

SEQ ID NO: 228731 - RNA, 64 nt, Human; identical to SEQ ID NO: 9413

SEQ ID NO: 228732 - RNA, 64 nt, Human; identical to SEQ ID NO: 9414

SEQ ID NO: 228733 - RNA, 64 nt, Human; identical to SEQ ID NO: 9415

SEQ ID NO: 228734 - RNA, 64 nt, Human; identical to SEQ ID NO: 9416

SEQ ID NO: 228735 - RNA, 64 nt, Human; identical to SEQ ID NO: 9417

SEQ ID NO: 228736 - RNA, 64 nt, Human; identical to SEQ ID NO: 9418

SEQ ID NO: 228737 - RNA, 64 nt, Human; identical to SEQ ID NO: 9419

SEQ ID NO: 228738 - RNA, 64 nt, Human; identical to SEQ ID NO: 9420

SEQ ID NO: 228739 - RNA, 64 nt, Human; identical to SEQ ID NO: 9421

SEQ ID NO: 228740 - RNA, 64 nt, Human; identical to SEQ ID NO: 9422

SEQ ID NO: 228741 - RNA, 64 nt, Human; identical to SEQ ID NO: 9423

SEQ ID NO: 228742 - RNA, 64 nt, Human; identical to SEQ ID NO: 9424

SEQ ID NO: 228743 - RNA, 64 nt, Human; identical to SEQ ID NO: 9425

SEQ ID NO: 228744 - RNA, 64 nt, Human; identical to SEQ ID NO: 9426

SEQ ID NO: 228745 - RNA, 64 nt, Human; identical to SEQ ID NO: 9427

SEQ ID NO: 228746 - RNA, 64 nt, Human; identical to SEQ ID NO: 9428

SEQ ID NO: 228747 - RNA, 64 nt, Human; identical to SEQ ID NO: 9429

SEQ ID NO: 228748 - RNA, 64 nt, Human; identical to SEQ ID NO: 9430

SEQ ID NO: 228749 - RNA, 64 nt, Human; identical to SEQ ID NO: 9431

SEQ ID NO: 228750 - RNA, 64 nt, Human; identical to SEQ ID NO: 9432

SEQ ID NO: 228751 - RNA, 64 nt, Human; identical to SEQ ID NO: 9433

SEQ ID NO: 228752 - RNA, 64 nt, Human; identical to SEQ ID NO: 9434

SEQ ID NO: 228753 - RNA, 64 nt, Human; identical to SEQ ID NO: 9435

SEQ ID NO: 228754 - RNA, 64 nt, Human; identical to SEQ ID NO: 9436

SEQ ID NO: 228755 - RNA, 64 nt, Human; identical to SEQ ID NO: 9437

SEQ ID NO: 228756 - RNA, 64 nt, Human; identical to SEQ ID NO: 9438

SEQ ID NO: 228757 - RNA, 64 nt, Human; identical to SEQ ID NO: 9439

SEQ ID NO: 228758 - RNA, 64 nt, Human; identical to SEQ ID NO: 9440

SEQ ID NO: 228759 - RNA, 64 nt, Human; identical to SEQ ID NO: 9441

SEQ ID NO: 228760 - RNA, 64 nt, Human; identical to SEQ ID NO: 9442

SEQ ID NO: 228761 - RNA, 64 nt, Human; identical to SEQ ID NO: 9443

SEQ ID NO: 228762 - RNA, 64 nt, Human; identical to SEQ ID NO: 9444

SEQ ID NO: 228763 - RNA, 64 nt, Human; identical to SEQ ID NO: 9445

SEQ ID NO: 228764 - RNA, 64 nt, Human; identical to SEQ ID NO: 9446

SEQ ID NO: 228765 - RNA, 64 nt, Human; identical to SEQ ID NO: 9447

SEQ ID NO: 228766 - RNA, 64 nt, Human; identical to SEQ ID NO: 9448

SEQ ID NO: 228767 - RNA, 64 nt, Human; identical to SEQ ID NO: 9449

SEQ ID NO: 228768 - RNA, 64 nt, Human; identical to SEQ ID NO: 9450

SEQ ID NO: 228769 - RNA, 64 nt, Human; identical to SEQ ID NO: 9451

SEQ ID NO: 228770 - RNA, 64 nt, Human; identical to SEQ ID NO: 9452

SEQ ID NO: 228771 - RNA, 64 nt, Human; identical to SEQ ID NO: 9453

SEQ ID NO: 228772 - RNA, 64 nt, Human; identical to SEQ ID NO: 9454

SEQ ID NO: 228773 - RNA, 64 nt, Human; identical to SEQ ID NO: 9455

SEQ ID NO: 228774 - RNA, 64 nt, Human; identical to SEQ ID NO: 9456

SEQ ID NO: 228775 - RNA, 64 nt, Human; identical to SEQ ID NO: 9457

SEQ ID NO: 228776 - RNA, 64 nt, Human; identical to SEQ ID NO: 9458

SEQ ID NO: 228777 - RNA, 64 nt, Human; identical to SEQ ID NO: 9459

SEQ ID NO: 228778 - RNA, 64 nt, Human; identical to SEQ ID NO: 9460

SEQ ID NO: 228779 - RNA, 64 nt, Human; identical to SEQ ID NO: 9461

SEQ ID NO: 228780 - RNA, 64 nt, Human; identical to SEQ ID NO: 9462

SEQ ID NO: 228781 - RNA, 64 nt, Human; identical to SEQ ID NO: 9463

SEQ ID NO: 228782 - RNA, 64 nt, Human; identical to SEQ ID NO: 9464

SEQ ID NO: 228783 - RNA, 64 nt, Human; identical to SEQ ID NO: 9465

SEQ ID NO: 228784 - RNA, 64 nt, Human; identical to SEQ ID NO: 9466

SEQ ID NO: 228785 - RNA, 64 nt, Human; identical to SEQ ID NO: 9467

SEQ ID NO: 228786 - RNA, 64 nt, Human; identical to SEQ ID NO: 9468

SEQ ID NO: 228787 - RNA, 64 nt, Human; identical to SEQ ID NO: 9469

SEQ ID NO: 228788 - RNA, 64 nt, Human; identical to SEQ ID NO: 9470

SEQ ID NO: 228789 - RNA, 64 nt, Human; identical to SEQ ID NO: 9471

SEQ ID NO: 228790 - RNA, 64 nt, Human; identical to SEQ ID NO: 9472

SEQ ID NO: 228791 - RNA, 64 nt, Human; identical to SEQ ID NO: 9473

SEQ ID NO: 228792 - RNA, 64 nt, Human; identical to SEQ ID NO: 9474

SEQ ID NO: 228793 - RNA, 64 nt, Human; identical to SEQ ID NO: 9475

SEQ ID NO: 228794 - RNA, 64 nt, Human; identical to SEQ ID NO: 9476

SEQ ID NO: 228795 - RNA, 64 nt, Human; identical to SEQ ID NO: 9477

SEQ ID NO: 228796 - RNA, 64 nt, Human; identical to SEQ ID NO: 9478

SEQ ID NO: 228797 - RNA, 64 nt, Human; identical to SEQ ID NO: 9479

SEQ ID NO: 228798 - RNA, 64 nt, Human; identical to SEQ ID NO: 9480

SEQ ID NO: 228799 - RNA, 64 nt, Human; identical to SEQ ID NO: 9481

SEQ ID NO: 228800 - RNA, 64 nt, Human; identical to SEQ ID NO: 9482

SEQ ID NO: 228801 - RNA, 64 nt, Human; identical to SEQ ID NO: 9483

SEQ ID NO: 228802 - RNA, 64 nt, Human; identical to SEQ ID NO: 9484

SEQ ID NO: 228803 - RNA, 64 nt, Human; identical to SEQ ID NO: 9485

SEQ ID NO: 228804 - RNA, 64 nt, Human; identical to SEQ ID NO: 9486

SEQ ID NO: 228805 - RNA, 64 nt, Human; identical to SEQ ID NO: 9487

SEQ ID NO: 228806 - RNA, 64 nt, Human; identical to SEQ ID NO: 9488

SEQ ID NO: 228807 - RNA, 64 nt, Human; identical to SEQ ID NO: 9489

SEQ ID NO: 228808 - RNA, 64 nt, Human; identical to SEQ ID NO: 9490

SEQ ID NO: 228809 - RNA, 64 nt, Human; identical to SEQ ID NO: 9491

SEQ ID NO: 228810 - RNA, 64 nt, Human; identical to SEQ ID NO: 9492

SEQ ID NO: 228811 - RNA, 64 nt, Human; identical to SEQ ID NO: 9493

SEQ ID NO: 228812 - RNA, 64 nt, Human; identical to SEQ ID NO: 9494

SEQ ID NO: 228813 - RNA, 64 nt, Human; identical to SEQ ID NO: 9495

SEQ ID NO: 228814 - RNA, 64 nt, Human; identical to SEQ ID NO: 9496

SEQ ID NO: 228815 - RNA, 64 nt, Human; identical to SEQ ID NO: 9497

SEQ ID NO: 228816 - RNA, 64 nt, Human; identical to SEQ ID NO: 9498

SEQ ID NO: 228817 - RNA, 64 nt, Human; identical to SEQ ID NO: 9499

SEQ ID NO: 228818 - RNA, 64 nt, Human; identical to SEQ ID NO: 9500

SEQ ID NO: 228819 - RNA, 64 nt, Human; identical to SEQ ID NO: 9501

SEQ ID NO: 228820 - RNA, 64 nt, Human; identical to SEQ ID NO: 9502

SEQ ID NO: 228821 - RNA, 64 nt, Human; identical to SEQ ID NO: 9503

SEQ ID NO: 228822 - RNA, 64 nt, Human; identical to SEQ ID NO: 9504

SEQ ID NO: 228823 - RNA, 64 nt, Human; identical to SEQ ID NO: 9505

SEQ ID NO: 228824 - RNA, 64 nt, Human; identical to SEQ ID NO: 9506

SEQ ID NO: 228825 - RNA, 64 nt, Human; identical to SEQ ID NO: 9507

SEQ ID NO: 228826 - RNA, 64 nt, Human; identical to SEQ ID NO: 9508

SEQ ID NO: 228827 - RNA, 64 nt, Human; identical to SEQ ID NO: 9509

SEQ ID NO: 228828 - RNA, 64 nt, Human; identical to SEQ ID NO: 9510

SEQ ID NO: 228829 - RNA, 64 nt, Human; identical to SEQ ID NO: 9511

SEQ ID NO: 228830 - RNA, 64 nt, Human; identical to SEQ ID NO: 9512

SEQ ID NO: 228831 - RNA, 64 nt, Human; identical to SEQ ID NO: 9513

SEQ ID NO: 228832 - RNA, 64 nt, Human; identical to SEQ ID NO: 9514

SEQ ID NO: 228833 - RNA, 64 nt, Human; identical to SEQ ID NO: 9515

SEQ ID NO: 228834 - RNA, 64 nt, Human; identical to SEQ ID NO: 9516

SEQ ID NO: 228835 - RNA, 64 nt, Human; identical to SEQ ID NO: 9517

SEQ ID NO: 228836 - RNA, 64 nt, Human; identical to SEQ ID NO: 9518

SEQ ID NO: 228837 - RNA, 64 nt, Human; identical to SEQ ID NO: 9519

SEQ ID NO: 228838 - RNA, 64 nt, Human; identical to SEQ ID NO: 9520

SEQ ID NO: 228839 - RNA, 64 nt, Human; identical to SEQ ID NO: 9521

SEQ ID NO: 228840 - RNA, 64 nt, Human; identical to SEQ ID NO: 9522

SEQ ID NO: 228841 - RNA, 64 nt, Human; identical to SEQ ID NO: 9523

SEQ ID NO: 228842 - RNA, 56 nt, Human; identical to SEQ ID NO: 9524

SEQ ID NO: 228843 - RNA, 64 nt, Human; identical to SEQ ID NO: 9525

SEQ ID NO: 228844 - RNA, 64 nt, Human; identical to SEQ ID NO: 9526

SEQ ID NO: 228845 - RNA, 64 nt, Human; identical to SEQ ID NO: 9527

SEQ ID NO: 228846 - RNA, 64 nt, Human; identical to SEQ ID NO: 9528

SEQ ID NO: 228847 - RNA, 62 nt, Human; identical to SEQ ID NO: 9529

SEQ ID NO: 228848 - RNA, 64 nt, Human; identical to SEQ ID NO: 9530

SEQ ID NO: 228849 - RNA, 64 nt, Human; identical to SEQ ID NO: 9531

SEQ ID NO: 228850 - RNA, 64 nt, Human; identical to SEQ ID NO: 9532

SEQ ID NO: 228851 - RNA, 64 nt, Human; identical to SEQ ID NO: 9533

SEQ ID NO: 228852 - RNA, 64 nt, Human; identical to SEQ ID NO: 9534

SEQ ID NO: 228853 - RNA, 64 nt, Human; identical to SEQ ID NO: 9535

SEQ ID NO: 228854 - RNA, 64 nt, Human; identical to SEQ ID NO: 9536

SEQ ID NO: 228855 - RNA, 64 nt, Human; identical to SEQ ID NO: 9537

SEQ ID NO: 228856 - RNA, 64 nt, Human; identical to SEQ ID NO: 9538

SEQ ID NO: 228857 - RNA, 64 nt, Human; identical to SEQ ID NO: 9539

SEQ ID NO: 228858 - RNA, 64 nt, Human; identical to SEQ ID NO: 9540

SEQ ID NO: 228859 - RNA, 64 nt, Human; identical to SEQ ID NO: 9541

SEQ ID NO: 228860 - RNA, 64 nt, Human; identical to SEQ ID NO: 9542

SEQ ID NO: 228861 - RNA, 64 nt, Human; identical to SEQ ID NO: 9543

SEQ ID NO: 228862 - RNA, 64 nt, Human; identical to SEQ ID NO: 9544

SEQ ID NO: 228863 - RNA, 64 nt, Human; identical to SEQ ID NO: 9545

SEQ ID NO: 228864 - RNA, 64 nt, Human; identical to SEQ ID NO: 9546

SEQ ID NO: 228865 - RNA, 64 nt, Human; identical to SEQ ID NO: 9547

SEQ ID NO: 228866 - RNA, 64 nt, Human; identical to SEQ ID NO: 9548

SEQ ID NO: 228867 - RNA, 64 nt, Human; identical to SEQ ID NO: 9549

SEQ ID NO: 228868 - RNA, 64 nt, Human; identical to SEQ ID NO: 9550

SEQ ID NO: 228869 - RNA, 64 nt, Human; identical to SEQ ID NO: 9551

SEQ ID NO: 228870 - RNA, 64 nt, Human; identical to SEQ ID NO: 9552

SEQ ID NO: 228871 - RNA, 64 nt, Human; identical to SEQ ID NO: 9553

SEQ ID NO: 228872 - RNA, 64 nt, Human; identical to SEQ ID NO: 9554

SEQ ID NO: 228873 - RNA, 64 nt, Human; identical to SEQ ID NO: 9555

SEQ ID NO: 228874 - RNA, 64 nt, Human; identical to SEQ ID NO: 9556

SEQ ID NO: 228875 - RNA, 64 nt, Human; identical to SEQ ID NO: 9557

SEQ ID NO: 228876 - RNA, 64 nt, Human; identical to SEQ ID NO: 9558

SEQ ID NO: 228877 - RNA, 64 nt, Human; identical to SEQ ID NO: 9559

SEQ ID NO: 228878 - RNA, 64 nt, Human; identical to SEQ ID NO: 9560

SEQ ID NO: 228879 - RNA, 64 nt, Human; identical to SEQ ID NO: 9561

SEQ ID NO: 228880 - RNA, 64 nt, Human; identical to SEQ ID NO: 9562

SEQ ID NO: 228881 - RNA, 64 nt, Human; identical to SEQ ID NO: 9563

SEQ ID NO: 228882 - RNA, 64 nt, Human; identical to SEQ ID NO: 9564

SEQ ID NO: 228883 - RNA, 64 nt, Human; identical to SEQ ID NO: 9565

SEQ ID NO: 228884 - RNA, 55 nt, Human; identical to SEQ ID NO: 9566

SEQ ID NO: 228885 - RNA, 64 nt, Human; identical to SEQ ID NO: 9567

SEQ ID NO: 228886 - RNA, 64 nt, Human; identical to SEQ ID NO: 9568

SEQ ID NO: 228887 - RNA, 64 nt, Human; identical to SEQ ID NO: 9569

SEQ ID NO: 228888 - RNA, 64 nt, Human; identical to SEQ ID NO: 9570

SEQ ID NO: 228889 - RNA, 64 nt, Human; identical to SEQ ID NO: 9571

SEQ ID NO: 228890 - RNA, 64 nt, Human; identical to SEQ ID NO: 9572

SEQ ID NO: 228891 - RNA, 64 nt, Human; identical to SEQ ID NO: 9573

SEQ ID NO: 228892 - RNA, 64 nt, Human; identical to SEQ ID NO: 9574

SEQ ID NO: 228893 - RNA, 64 nt, Human; identical to SEQ ID NO: 9575

SEQ ID NO: 228894 - RNA, 64 nt, Human; identical to SEQ ID NO: 9576

SEQ ID NO: 228895 - RNA, 64 nt, Human; identical to SEQ ID NO: 9577

SEQ ID NO: 228896 - RNA, 64 nt, Human; identical to SEQ ID NO: 9578

SEQ ID NO: 228897 - RNA, 61 nt, Human; identical to SEQ ID NO: 9579

SEQ ID NO: 228898 - RNA, 64 nt, Human; identical to SEQ ID NO: 9580

SEQ ID NO: 228899 - RNA, 64 nt, Human; identical to SEQ ID NO: 9581

SEQ ID NO: 228900 - RNA, 64 nt, Human; identical to SEQ ID NO: 9582

SEQ ID NO: 228901 - RNA, 64 nt, Human; identical to SEQ ID NO: 9583

SEQ ID NO: 228902 - RNA, 64 nt, Human; identical to SEQ ID NO: 9584

SEQ ID NO: 228903 - RNA, 64 nt, Human; identical to SEQ ID NO: 9585

SEQ ID NO: 228904 - RNA, 64 nt, Human; identical to SEQ ID NO: 9586

SEQ ID NO: 228905 - RNA, 64 nt, Human; identical to SEQ ID NO: 9587

SEQ ID NO: 228906 - RNA, 64 nt, Human; identical to SEQ ID NO: 9588

SEQ ID NO: 228907 - RNA, 64 nt, Human; identical to SEQ ID NO: 9589

SEQ ID NO: 228908 - RNA, 64 nt, Human; identical to SEQ ID NO: 9590

SEQ ID NO: 228909 - RNA, 64 nt, Human; identical to SEQ ID NO: 9591

SEQ ID NO: 228910 - RNA, 64 nt, Human; identical to SEQ ID NO: 9592

SEQ ID NO: 228911 - RNA, 64 nt, Human; identical to SEQ ID NO: 9593

SEQ ID NO: 228912 - RNA, 64 nt, Human; identical to SEQ ID NO: 9594

SEQ ID NO: 228913 - RNA, 64 nt, Human; identical to SEQ ID NO: 9595

SEQ ID NO: 228914 - RNA, 64 nt, Human; identical to SEQ ID NO: 9596

SEQ ID NO: 228915 - RNA, 64 nt, Human; identical to SEQ ID NO: 9597

SEQ ID NO: 228916 - RNA, 64 nt, Human; identical to SEQ ID NO: 9598

SEQ ID NO: 228917 - RNA, 64 nt, Human; identical to SEQ ID NO: 9599

SEQ ID NO: 228918 - RNA, 64 nt, Human; identical to SEQ ID NO: 9600

SEQ ID NO: 228919 - RNA, 64 nt, Human; identical to SEQ ID NO: 9601

SEQ ID NO: 228920 - RNA, 64 nt, Human; identical to SEQ ID NO: 9602

SEQ ID NO: 228921 - RNA, 64 nt, Human; identical to SEQ ID NO: 9603

SEQ ID NO: 228922 - RNA, 64 nt, Human; identical to SEQ ID NO: 9604

SEQ ID NO: 228923 - RNA, 64 nt, Human; identical to SEQ ID NO: 9605

SEQ ID NO: 228924 - RNA, 64 nt, Human; identical to SEQ ID NO: 9606

SEQ ID NO: 228925 - RNA, 64 nt, Human; identical to SEQ ID NO: 9607

SEQ ID NO: 228926 - RNA, 57 nt, Human; identical to SEQ ID NO: 9608

SEQ ID NO: 228927 - RNA, 64 nt, Human; identical to SEQ ID NO: 9609

SEQ ID NO: 228928 - RNA, 64 nt, Human; identical to SEQ ID NO: 9610

SEQ ID NO: 228929 - RNA, 64 nt, Human; identical to SEQ ID NO: 9611

SEQ ID NO: 228930 - RNA, 64 nt, Human; identical to SEQ ID NO: 9612

SEQ ID NO: 228931 - RNA, 64 nt, Human; identical to SEQ ID NO: 9613

SEQ ID NO: 228932 - RNA, 64 nt, Human; identical to SEQ ID NO: 9614

SEQ ID NO: 228933 - RNA, 64 nt, Human; identical to SEQ ID NO: 9615

SEQ ID NO: 228934 - RNA, 64 nt, Human; identical to SEQ ID NO: 9616

SEQ ID NO: 228935 - RNA, 64 nt, Human; identical to SEQ ID NO: 9617

SEQ ID NO: 228936 - RNA, 64 nt, Human; identical to SEQ ID NO: 9618

SEQ ID NO: 228937 - RNA, 64 nt, Human; identical to SEQ ID NO: 9619

SEQ ID NO: 228938 - RNA, 64 nt, Human; identical to SEQ ID NO: 9620

SEQ ID NO: 228939 - RNA, 64 nt, Human; identical to SEQ ID NO: 9621

SEQ ID NO: 228940 - RNA, 64 nt, Human; identical to SEQ ID NO: 9622

SEQ ID NO: 228941 - RNA, 64 nt, Human; identical to SEQ ID NO: 9623

SEQ ID NO: 228942 - RNA, 64 nt, Human; identical to SEQ ID NO: 9624

SEQ ID NO: 228943 - RNA, 64 nt, Human; identical to SEQ ID NO: 9625

SEQ ID NO: 228944 - RNA, 64 nt, Human; identical to SEQ ID NO: 9626

SEQ ID NO: 228945 - RNA, 64 nt, Human; identical to SEQ ID NO: 9627

SEQ ID NO: 228946 - RNA, 64 nt, Human; identical to SEQ ID NO: 9628

SEQ ID NO: 228947 - RNA, 64 nt, Human; identical to SEQ ID NO: 9629

SEQ ID NO: 228948 - RNA, 64 nt, Human; identical to SEQ ID NO: 9630

SEQ ID NO: 228949 - RNA, 64 nt, Human; identical to SEQ ID NO: 9631

SEQ ID NO: 228950 - RNA, 64 nt, Human; identical to SEQ ID NO: 9632

SEQ ID NO: 228951 - RNA, 64 nt, Human; identical to SEQ ID NO: 9633

SEQ ID NO: 228952 - RNA, 64 nt, Human; identical to SEQ ID NO: 9634

SEQ ID NO: 228953 - RNA, 64 nt, Human; identical to SEQ ID NO: 9635

SEQ ID NO: 228954 - RNA, 64 nt, Human; identical to SEQ ID NO: 9636

SEQ ID NO: 228955 - RNA, 64 nt, Human; identical to SEQ ID NO: 9637

SEQ ID NO: 228956 - RNA, 64 nt, Human; identical to SEQ ID NO: 9638

SEQ ID NO: 228957 - RNA, 64 nt, Human; identical to SEQ ID NO: 9639

SEQ ID NO: 228958 - RNA, 64 nt, Human; identical to SEQ ID NO: 9640

SEQ ID NO: 228959 - RNA, 64 nt, Human; identical to SEQ ID NO: 9641

SEQ ID NO: 228960 - RNA, 64 nt, Human; identical to SEQ ID NO: 9642

SEQ ID NO: 228961 - RNA, 64 nt, Human; identical to SEQ ID NO: 9643

SEQ ID NO: 228962 - RNA, 64 nt, Human; identical to SEQ ID NO: 9644

SEQ ID NO: 228963 - RNA, 64 nt, Human; identical to SEQ ID NO: 9645

SEQ ID NO: 228964 - RNA, 64 nt, Human; identical to SEQ ID NO: 9646

SEQ ID NO: 228965 - RNA, 64 nt, Human; identical to SEQ ID NO: 9647

SEQ ID NO: 228966 - RNA, 64 nt, Human; identical to SEQ ID NO: 9648

SEQ ID NO: 228967 - RNA, 64 nt, Human; identical to SEQ ID NO: 9649

SEQ ID NO: 228968 - RNA, 64 nt, Human; identical to SEQ ID NO: 9650

SEQ ID NO: 228969 - RNA, 64 nt, Human; identical to SEQ ID NO: 9651

SEQ ID NO: 228970 - RNA, 64 nt, Human; identical to SEQ ID NO: 9652

SEQ ID NO: 228971 - RNA, 64 nt, Human; identical to SEQ ID NO: 9653

SEQ ID NO: 228972 - RNA, 64 nt, Human; identical to SEQ ID NO: 9654

SEQ ID NO: 228973 - RNA, 64 nt, Human; identical to SEQ ID NO: 9655

SEQ ID NO: 228974 - RNA, 64 nt, Human; identical to SEQ ID NO: 9656

SEQ ID NO: 228975 - RNA, 64 nt, Human; identical to SEQ ID NO: 9657

SEQ ID NO: 228976 - RNA, 64 nt, Human; identical to SEQ ID NO: 9658

SEQ ID NO: 228977 - RNA, 64 nt, Human; identical to SEQ ID NO: 9659

SEQ ID NO: 228978 - RNA, 64 nt, Human; identical to SEQ ID NO: 9660

SEQ ID NO: 228979 - RNA, 64 nt, Human; identical to SEQ ID NO: 9661

SEQ ID NO: 228980 - RNA, 64 nt, Human; identical to SEQ ID NO: 9662

SEQ ID NO: 228981 - RNA, 51 nt, Human; identical to SEQ ID NO: 9663

SEQ ID NO: 228982 - RNA, 64 nt, Human; identical to SEQ ID NO: 9664

SEQ ID NO: 228983 - RNA, 64 nt, Human; identical to SEQ ID NO: 9665

SEQ ID NO: 228984 - RNA, 64 nt, Human; identical to SEQ ID NO: 9666

SEQ ID NO: 228985 - RNA, 64 nt, Human; identical to SEQ ID NO: 9667

SEQ ID NO: 228986 - RNA, 64 nt, Human; identical to SEQ ID NO: 9668

SEQ ID NO: 228987 - RNA, 64 nt, Human; identical to SEQ ID NO: 9669

SEQ ID NO: 228988 - RNA, 64 nt, Human; identical to SEQ ID NO: 9669

SEQ ID NO: 228989 - RNA, 64 nt, Human; identical to SEQ ID NO: 9671

SEQ ID NO: 228990 - RNA, 64 nt, Human; identical to SEQ ID NO: 9672

SEQ ID NO: 228991 - RNA, 64 nt, Human; identical to SEQ ID NO: 9673

SEQ ID NO: 228992 - RNA, 64 nt, Human; identical to SEQ ID NO: 9674

SEQ ID NO: 228993 - RNA, 64 nt, Human; identical to SEQ ID NO: 9675

SEQ ID NO: 228994 - RNA, 64 nt, Human; identical to SEQ ID NO: 9676

SEQ ID NO: 228995 - RNA, 64 nt, Human; identical to SEQ ID NO: 9677

SEQ ID NO: 228996 - RNA, 64 nt, Human; identical to SEQ ID NO: 9678

SEQ ID NO: 228997 - RNA, 64 nt, Human; identical to SEQ ID NO: 9679

SEQ ID NO: 228998 - RNA, 64 nt, Human; identical to SEQ ID NO: 9680

SEQ ID NO: 228999 - RNA, 64 nt, Human; identical to SEQ ID NO: 9681

SEQ ID NO: 229000 - RNA, 64 nt, Human; identical to SEQ ID NO: 9682

SEQ ID NO: 229001 - RNA, 64 nt, Human; identical to SEQ ID NO: 9683

SEQ ID NO: 229002 - RNA, 64 nt, Human; identical to SEQ ID NO: 9684

SEQ ID NO: 229003 - RNA, 52 nt, Human; identical to SEQ ID NO: 9685

SEQ ID NO: 229004 - RNA, 64 nt, Human; identical to SEQ ID NO: 9686

SEQ ID NO: 229005 - RNA, 64 nt, Human; identical to SEQ ID NO: 9687

SEQ ID NO: 229006 - RNA, 64 nt, Human; identical to SEQ ID NO: 9688

SEQ ID NO: 229007 - RNA, 64 nt, Human; identical to SEQ ID NO: 9689

SEQ ID NO: 229008 - RNA, 64 nt, Human; identical to SEQ ID NO: 9690

SEQ ID NO: 229009 - RNA, 64 nt, Human; identical to SEQ ID NO: 9691

SEQ ID NO: 229010 - RNA, 64 nt, Human; identical to SEQ ID NO: 9692

SEQ ID NO: 229011 - RNA, 64 nt, Human; identical to SEQ ID NO: 9693

SEQ ID NO: 229012 - RNA, 64 nt, Human; identical to SEQ ID NO: 9694

SEQ ID NO: 229013 - RNA, 64 nt, Human; identical to SEQ ID NO: 9695

SEQ ID NO: 229014 - RNA, 52 nt, Human; identical to SEQ ID NO: 9696

SEQ ID NO: 229015 - RNA, 64 nt, Human; identical to SEQ ID NO: 9697

SEQ ID NO: 229016 - RNA, 64 nt, Human; identical to SEQ ID NO: 9698

SEQ ID NO: 229017 - RNA, 64 nt, Human; identical to SEQ ID NO: 9699

SEQ ID NO: 229018 - RNA, 64 nt, Human; identical to SEQ ID NO: 9700

SEQ ID NO: 229019 - RNA, 64 nt, Human; identical to SEQ ID NO: 9701

SEQ ID NO: 229020 - RNA, 59 nt, Human; identical to SEQ ID NO: 9702

SEQ ID NO: 229021 - RNA, 64 nt, Human; identical to SEQ ID NO: 9703

SEQ ID NO: 229022 - RNA, 64 nt, Human; identical to SEQ ID NO: 9704

SEQ ID NO: 229023 - RNA, 64 nt, Human; identical to SEQ ID NO: 9705

SEQ ID NO: 229024 - RNA, 64 nt, Human; identical to SEQ ID NO: 9706

SEQ ID NO: 229025 - RNA, 64 nt, Human; identical to SEQ ID NO: 9707

SEQ ID NO: 229026 - RNA, 64 nt, Human; identical to SEQ ID NO: 9708

SEQ ID NO: 229027 - RNA, 64 nt, Human; identical to SEQ ID NO: 9709

SEQ ID NO: 229028 - RNA, 64 nt, Human; identical to SEQ ID NO: 9710

SEQ ID NO: 229029 - RNA, 64 nt, Human; identical to SEQ ID NO: 9711

SEQ ID NO: 229030 - RNA, 64 nt, Human; identical to SEQ ID NO: 9712

SEQ ID NO: 229031 - RNA, 56 nt, Human; identical to SEQ ID NO: 9713

SEQ ID NO: 229032 - RNA, 64 nt, Human; identical to SEQ ID NO: 9714

SEQ ID NO: 229033 - RNA, 64 nt, Human; identical to SEQ ID NO: 9715

SEQ ID NO: 229034 - RNA, 64 nt, Human; identical to SEQ ID NO: 9716

SEQ ID NO: 229035 - RNA, 64 nt, Human; identical to SEQ ID NO: 9717

SEQ ID NO: 229036 - RNA, 64 nt, Human; identical to SEQ ID NO: 9718

SEQ ID NO: 229037 - RNA, 64 nt, Human; identical to SEQ ID NO: 9719

SEQ ID NO: 229038 - RNA, 64 nt, Human; identical to SEQ ID NO: 9720

SEQ ID NO: 229039 - RNA, 64 nt, Human; identical to SEQ ID NO: 9721

SEQ ID NO: 229040 - RNA, 64 nt, Human; identical to SEQ ID NO: 9722

SEQ ID NO: 229041 - RNA, 64 nt, Human; identical to SEQ ID NO: 9723

SEQ ID NO: 229042 - RNA, 64 nt, Human; identical to SEQ ID NO: 9724

SEQ ID NO: 229043 - RNA, 64 nt, Human; identical to SEQ ID NO: 9725

SEQ ID NO: 229044 - RNA, 64 nt, Human; identical to SEQ ID NO: 9726

SEQ ID NO: 229045 - RNA, 64 nt, Human; identical to SEQ ID NO: 9727

SEQ ID NO: 229046 - RNA, 64 nt, Human; identical to SEQ ID NO: 9728

SEQ ID NO: 229047 - RNA, 64 nt, Human; identical to SEQ ID NO: 9729

SEQ ID NO: 229048 - RNA, 64 nt, Human; identical to SEQ ID NO: 9730

SEQ ID NO: 229049 - RNA, 64 nt, Human; identical to SEQ ID NO: 9731

SEQ ID NO: 229050 - RNA, 64 nt, Human; identical to SEQ ID NO: 9732

SEQ ID NO: 229051 - RNA, 64 nt, Human; identical to SEQ ID NO: 9733

SEQ ID NO: 229052 - RNA, 64 nt, Human; identical to SEQ ID NO: 9734

SEQ ID NO: 229053 - RNA, 64 nt, Human; identical to SEQ ID NO: 9735

SEQ ID NO: 229054 - RNA, 64 nt, Human; identical to SEQ ID NO: 9736

SEQ ID NO: 229055 - RNA, 64 nt, Human; identical to SEQ ID NO: 9737

SEQ ID NO: 229056 - RNA, 52 nt, Human; identical to SEQ ID NO: 9738

SEQ ID NO: 229057 - RNA, 64 nt, Human; identical to SEQ ID NO: 9739

SEQ ID NO: 229058 - RNA, 64 nt, Human; identical to SEQ ID NO: 9740

SEQ ID NO: 229059 - RNA, 64 nt, Human; identical to SEQ ID NO: 9741

SEQ ID NO: 229060 - RNA, 64 nt, Human; identical to SEQ ID NO: 9742

SEQ ID NO: 229061 - RNA, 55 nt, Human; identical to SEQ ID NO: 9743

SEQ ID NO: 229062 - RNA, 64 nt, Human; identical to SEQ ID NO: 9744

SEQ ID NO: 229063 - RNA, 64 nt, Human; identical to SEQ ID NO: 9745

SEQ ID NO: 229064 - RNA, 63 nt, Human; identical to SEQ ID NO: 9746

SEQ ID NO: 229065 - RNA, 64 nt, Human; identical to SEQ ID NO: 9747

SEQ ID NO: 229066 - RNA, 64 nt, Human; identical to SEQ ID NO: 9748

SEQ ID NO: 229067 - RNA, 64 nt, Human; identical to SEQ ID NO: 9749

SEQ ID NO: 229068 - RNA, 64 nt, Human; identical to SEQ ID NO: 9750

SEQ ID NO: 229069 - RNA, 64 nt, Human; identical to SEQ ID NO: 9751

SEQ ID NO: 229070 - RNA, 64 nt, Human; identical to SEQ ID NO: 9752

SEQ ID NO: 229071 - RNA, 64 nt, Human; identical to SEQ ID NO: 9753

SEQ ID NO: 229072 - RNA, 64 nt, Human; identical to SEQ ID NO: 9754

SEQ ID NO: 229073 - RNA, 64 nt, Human; identical to SEQ ID NO: 9755

SEQ ID NO: 229074 - RNA, 64 nt, Human; identical to SEQ ID NO: 9756

SEQ ID NO: 229075 - RNA, 64 nt, Human; identical to SEQ ID NO: 9757

SEQ ID NO: 229076 - RNA, 64 nt, Human; identical to SEQ ID NO: 9758

SEQ ID NO: 229077 - RNA, 64 nt, Human; identical to SEQ ID NO: 9759

SEQ ID NO: 229078 - RNA, 64 nt, Human; identical to SEQ ID NO: 9760

SEQ ID NO: 229079 - RNA, 64 nt, Human; identical to SEQ ID NO: 9761

SEQ ID NO: 229080 - RNA, 64 nt, Human; identical to SEQ ID NO: 9762

SEQ ID NO: 229081 - RNA, 64 nt, Human; identical to SEQ ID NO: 9763

SEQ ID NO: 229082 - RNA, 64 nt, Human; identical to SEQ ID NO: 9764

SEQ ID NO: 229083 - RNA, 64 nt, Human; identical to SEQ ID NO: 9765

SEQ ID NO: 229084 - RNA, 64 nt, Human; identical to SEQ ID NO: 9766

SEQ ID NO: 229085 - RNA, 64 nt, Human; identical to SEQ ID NO: 9767

SEQ ID NO: 229086 - RNA, 64 nt, Human; identical to SEQ ID NO: 9768

SEQ ID NO: 229087 - RNA, 64 nt, Human; identical to SEQ ID NO: 9769

SEQ ID NO: 229088 - RNA, 64 nt, Human; identical to SEQ ID NO: 9770

SEQ ID NO: 229089 - RNA, 64 nt, Human; identical to SEQ ID NO: 9771

SEQ ID NO: 229090 - RNA, 64 nt, Human; identical to SEQ ID NO: 9772

SEQ ID NO: 229091 - RNA, 64 nt, Human; identical to SEQ ID NO: 9773

SEQ ID NO: 229092 - RNA, 64 nt, Human; identical to SEQ ID NO: 9774

SEQ ID NO: 229093 - RNA, 64 nt, Human; identical to SEQ ID NO: 9775

SEQ ID NO: 229094 - RNA, 64 nt, Human; identical to SEQ ID NO: 9776

SEQ ID NO: 229095 - RNA, 64 nt, Human; identical to SEQ ID NO: 9777

SEQ ID NO: 229096 - RNA, 64 nt, Human; identical to SEQ ID NO: 9778

SEQ ID NO: 229097 - RNA, 64 nt, Human; identical to SEQ ID NO: 9779

SEQ ID NO: 229098 - RNA, 64 nt, Human; identical to SEQ ID NO: 9780

SEQ ID NO: 229099 - RNA, 64 nt, Human; identical to SEQ ID NO: 9781

SEQ ID NO: 229100 - RNA, 64 nt, Human; identical to SEQ ID NO: 9782

SEQ ID NO: 229101 - RNA, 64 nt, Human; identical to SEQ ID NO: 9783

SEQ ID NO: 229102 - RNA, 64 nt, Human; identical to SEQ ID NO: 9784

SEQ ID NO: 229103 - RNA, 64 nt, Human; identical to SEQ ID NO: 9785

SEQ ID NO: 229104 - RNA, 64 nt, Human; identical to SEQ ID NO: 9786

SEQ ID NO: 229105 - RNA, 64 nt, Human; identical to SEQ ID NO: 9787

SEQ ID NO: 229106 - RNA, 64 nt, Human; identical to SEQ ID NO: 9788

SEQ ID NO: 229107 - RNA, 64 nt, Human; identical to SEQ ID NO: 9789

SEQ ID NO: 229108 - RNA, 64 nt, Human; identical to SEQ ID NO: 9790

SEQ ID NO: 229109 - RNA, 64 nt, Human; identical to SEQ ID NO: 9791

SEQ ID NO: 229110 - RNA, 64 nt, Human; identical to SEQ ID NO: 9792

SEQ ID NO: 229111 - RNA, 64 nt, Human; identical to SEQ ID NO: 9793

SEQ ID NO: 229112 - RNA, 64 nt, Human; identical to SEQ ID NO: 9794

SEQ ID NO: 229113 - RNA, 64 nt, Human; identical to SEQ ID NO: 9795

SEQ ID NO: 229114 - RNA, 64 nt, Human; identical to SEQ ID NO: 9796

SEQ ID NO: 229115 - RNA, 64 nt, Human; identical to SEQ ID NO: 9797

SEQ ID NO: 229116 - RNA, 64 nt, Human; identical to SEQ ID NO: 9798

SEQ ID NO: 229117 - RNA, 64 nt, Human; identical to SEQ ID NO: 9799

SEQ ID NO: 229118 - RNA, 64 nt, Human; identical to SEQ ID NO: 9800

SEQ ID NO: 229119 - RNA, 64 nt, Human; identical to SEQ ID NO: 9801

SEQ ID NO: 229120 - RNA, 64 nt, Human; identical to SEQ ID NO: 9802

SEQ ID NO: 229121 - RNA, 64 nt, Human; identical to SEQ ID NO: 9803

SEQ ID NO: 229122 - RNA, 64 nt, Human; identical to SEQ ID NO: 9804

SEQ ID NO: 229123 - RNA, 64 nt, Human; identical to SEQ ID NO: 9805

SEQ ID NO: 229124 - RNA, 64 nt, Human; identical to SEQ ID NO: 9806

SEQ ID NO: 229125 - RNA, 64 nt, Human; identical to SEQ ID NO: 9807

SEQ ID NO: 229126 - RNA, 64 nt, Human; identical to SEQ ID NO: 9808

SEQ ID NO: 229127 - RNA, 64 nt, Human; identical to SEQ ID NO: 9809

SEQ ID NO: 229128 - RNA, 64 nt, Human; identical to SEQ ID NO: 9810

SEQ ID NO: 229129 - RNA, 50 nt, Human; identical to SEQ ID NO: 9811

SEQ ID NO: 229130 - RNA, 64 nt, Human; identical to SEQ ID NO: 9812

SEQ ID NO: 229131 - RNA, 64 nt, Human; identical to SEQ ID NO: 9813

SEQ ID NO: 229132 - RNA, 64 nt, Human; identical to SEQ ID NO: 9814

SEQ ID NO: 229133 - RNA, 64 nt, Human; identical to SEQ ID NO: 9815

SEQ ID NO: 229134 - RNA, 64 nt, Human; identical to SEQ ID NO: 9816

SEQ ID NO: 229135 - RNA, 64 nt, Human; identical to SEQ ID NO: 9817

SEQ ID NO: 229136 - RNA, 64 nt, Human; identical to SEQ ID NO: 9818

SEQ ID NO: 229137 - RNA, 64 nt, Human; identical to SEQ ID NO: 9819

SEQ ID NO: 229138 - RNA, 64 nt, Human; identical to SEQ ID NO: 9820

SEQ ID NO: 229139 - RNA, 64 nt, Human; identical to SEQ ID NO: 9821

SEQ ID NO: 229140 - RNA, 64 nt, Human; identical to SEQ ID NO: 9822

SEQ ID NO: 229141 - RNA, 64 nt, Human; identical to SEQ ID NO: 9823

SEQ ID NO: 229142 - RNA, 64 nt, Human; identical to SEQ ID NO: 9824

SEQ ID NO: 229143 - RNA, 64 nt, Human; identical to SEQ ID NO: 9825

SEQ ID NO: 229144 - RNA, 64 nt, Human; identical to SEQ ID NO: 9826

SEQ ID NO: 229145 - RNA, 64 nt, Human; identical to SEQ ID NO: 9827

SEQ ID NO: 229146 - RNA, 64 nt, Human; identical to SEQ ID NO: 9828

SEQ ID NO: 229147 - RNA, 64 nt, Human; identical to SEQ ID NO: 9829

SEQ ID NO: 229148 - RNA, 64 nt, Human; identical to SEQ ID NO: 9830

SEQ ID NO: 229149 - RNA, 64 nt, Human; identical to SEQ ID NO: 9831

SEQ ID NO: 229150 - RNA, 64 nt, Human; identical to SEQ ID NO: 9832

SEQ ID NO: 229151 - RNA, 64 nt, Human; identical to SEQ ID NO: 9833

SEQ ID NO: 229152 - RNA, 64 nt, Human; identical to SEQ ID NO: 9834

SEQ ID NO: 229153 - RNA, 64 nt, Human; identical to SEQ ID NO: 9835

SEQ ID NO: 229154 - RNA, 64 nt, Human; identical to SEQ ID NO: 9836

SEQ ID NO: 229155 - RNA, 64 nt, Human; identical to SEQ ID NO: 9837

SEQ ID NO: 229156 - RNA, 64 nt, Human; identical to SEQ ID NO: 9838

SEQ ID NO: 229157 - RNA, 64 nt, Human; identical to SEQ ID NO: 9839

SEQ ID NO: 229158 - RNA, 64 nt, Human; identical to SEQ ID NO: 9840

SEQ ID NO: 229159 - RNA, 64 nt, Human; identical to SEQ ID NO: 9841

SEQ ID NO: 229160 - RNA, 64 nt, Human; identical to SEQ ID NO: 9842

SEQ ID NO: 229161 - RNA, 64 nt, Human; identical to SEQ ID NO: 9843

SEQ ID NO: 229162 - RNA, 64 nt, Human; identical to SEQ ID NO: 9844

SEQ ID NO: 229163 - RNA, 64 nt, Human; identical to SEQ ID NO: 9845

SEQ ID NO: 229164 - RNA, 64 nt, Human; identical to SEQ ID NO: 9846

SEQ ID NO: 229165 - RNA, 64 nt, Human; identical to SEQ ID NO: 9847

SEQ ID NO: 229166 - RNA, 64 nt, Human; identical to SEQ ID NO: 9848

SEQ ID NO: 229167 - RNA, 64 nt, Human; identical to SEQ ID NO: 9849

SEQ ID NO: 229168 - RNA, 64 nt, Human; identical to SEQ ID NO: 9850

SEQ ID NO: 229169 - RNA, 64 nt, Human; identical to SEQ ID NO: 9851

SEQ ID NO: 229170 - RNA, 64 nt, Human; identical to SEQ ID NO: 9852

SEQ ID NO: 229171 - RNA, 64 nt, Human; identical to SEQ ID NO: 9853

SEQ ID NO: 229172 - RNA, 64 nt, Human; identical to SEQ ID NO: 9854

SEQ ID NO: 229173 - RNA, 64 nt, Human; identical to SEQ ID NO: 9855

SEQ ID NO: 229174 - RNA, 64 nt, Human; identical to SEQ ID NO: 9856

SEQ ID NO: 229175 - RNA, 64 nt, Human; identical to SEQ ID NO: 9857

SEQ ID NO: 229176 - RNA, 64 nt, Human; identical to SEQ ID NO: 9858

SEQ ID NO: 229177 - RNA, 64 nt, Human; identical to SEQ ID NO: 9859

SEQ ID NO: 229178 - RNA, 64 nt, Human; identical to SEQ ID NO: 9860

SEQ ID NO: 229179 - RNA, 64 nt, Human; identical to SEQ ID NO: 9861

SEQ ID NO: 229180 - RNA, 64 nt, Human; identical to SEQ ID NO: 9862

SEQ ID NO: 229181 - RNA, 64 nt, Human; identical to SEQ ID NO: 9863

SEQ ID NO: 229182 - RNA, 64 nt, Human; identical to SEQ ID NO: 9864

SEQ ID NO: 229183 - RNA, 64 nt, Human; identical to SEQ ID NO: 9865

SEQ ID NO: 229184 - RNA, 64 nt, Human; identical to SEQ ID NO: 9866

SEQ ID NO: 229185 - RNA, 64 nt, Human; identical to SEQ ID NO: 9867

SEQ ID NO: 229186 - RNA, 64 nt, Human; identical to SEQ ID NO: 9868

SEQ ID NO: 229187 - RNA, 64 nt, Human; identical to SEQ ID NO: 9869

SEQ ID NO: 229188 - RNA, 64 nt, Human; identical to SEQ ID NO: 9870

SEQ ID NO: 229189 - RNA, 64 nt, Human; identical to SEQ ID NO: 9871

SEQ ID NO: 229190 - RNA, 64 nt, Human; identical to SEQ ID NO: 9872

SEQ ID NO: 229191 - RNA, 64 nt, Human; identical to SEQ ID NO: 9873

SEQ ID NO: 229192 - RNA, 64 nt, Human; identical to SEQ ID NO: 9874

SEQ ID NO: 229193 - RNA, 64 nt, Human; identical to SEQ ID NO: 9875

SEQ ID NO: 229194 - RNA, 64 nt, Human; identical to SEQ ID NO: 9876

SEQ ID NO: 229195 - RNA, 64 nt, Human; identical to SEQ ID NO: 9877

SEQ ID NO: 229196 - RNA, 64 nt, Human; identical to SEQ ID NO: 9878

SEQ ID NO: 229197 - RNA, 64 nt, Human; identical to SEQ ID NO: 9879

SEQ ID NO: 229198 - RNA, 64 nt, Human; identical to SEQ ID NO: 9880

SEQ ID NO: 229199 - RNA, 64 nt, Human; identical to SEQ ID NO: 9881

SEQ ID NO: 229200 - RNA, 64 nt, Human; identical to SEQ ID NO: 9882

SEQ ID NO: 229201 - RNA, 64 nt, Human; identical to SEQ ID NO: 9883

SEQ ID NO: 229202 - RNA, 64 nt, Human; identical to SEQ ID NO: 9884

SEQ ID NO: 229203 - RNA, 64 nt, Human; identical to SEQ ID NO: 9885

SEQ ID NO: 229204 - RNA, 64 nt, Human; identical to SEQ ID NO: 9886

SEQ ID NO: 229205 - RNA, 64 nt, Human; identical to SEQ ID NO: 9887

SEQ ID NO: 229206 - RNA, 64 nt, Human; identical to SEQ ID NO: 9888

SEQ ID NO: 229207 - RNA, 64 nt, Human; identical to SEQ ID NO: 9889

SEQ ID NO: 229208 - RNA, 64 nt, Human; identical to SEQ ID NO: 9890

SEQ ID NO: 229209 - RNA, 64 nt, Human; identical to SEQ ID NO: 9891

SEQ ID NO: 229210 - RNA, 64 nt, Human; identical to SEQ ID NO: 9892

SEQ ID NO: 229211 - RNA, 64 nt, Human; identical to SEQ ID NO: 9893

SEQ ID NO: 229212 - RNA, 64 nt, Human; identical to SEQ ID NO: 9894

SEQ ID NO: 229213 - RNA, 64 nt, Human; identical to SEQ ID NO: 9895

SEQ ID NO: 229214 - RNA, 64 nt, Human; identical to SEQ ID NO: 9896

SEQ ID NO: 229215 - RNA, 64 nt, Human; identical to SEQ ID NO: 9897

SEQ ID NO: 229216 - RNA, 64 nt, Human; identical to SEQ ID NO: 9898

SEQ ID NO: 229217 - RNA, 64 nt, Human; identical to SEQ ID NO: 9899

SEQ ID NO: 229218 - RNA, 64 nt, Human; identical to SEQ ID NO: 9900

SEQ ID NO: 229219 - RNA, 64 nt, Human; identical to SEQ ID NO: 9901

SEQ ID NO: 229220 - RNA, 64 nt, Human; identical to SEQ ID NO: 9902

SEQ ID NO: 229221 - RNA, 64 nt, Human; identical to SEQ ID NO: 9903

SEQ ID NO: 229222 - RNA, 64 nt, Human; identical to SEQ ID NO: 9904

SEQ ID NO: 229223 - RNA, 64 nt, Human; identical to SEQ ID NO: 9905

SEQ ID NO: 229224 - RNA, 64 nt, Human; identical to SEQ ID NO: 9906

SEQ ID NO: 229225 - RNA, 55 nt, Human; identical to SEQ ID NO: 9907

SEQ ID NO: 229226 - RNA, 64 nt, Human; identical to SEQ ID NO: 9908

SEQ ID NO: 229227 - RNA, 64 nt, Human; identical to SEQ ID NO: 9909

SEQ ID NO: 229228 - RNA, 64 nt, Human; identical to SEQ ID NO: 9910

SEQ ID NO: 229229 - RNA, 64 nt, Human; identical to SEQ ID NO: 9911

SEQ ID NO: 229230 - RNA, 64 nt, Human; identical to SEQ ID NO: 9912

SEQ ID NO: 229231 - RNA, 64 nt, Human; identical to SEQ ID NO: 9913

SEQ ID NO: 229232 - RNA, 64 nt, Human; identical to SEQ ID NO: 9914

SEQ ID NO: 229233 - RNA, 64 nt, Human; identical to SEQ ID NO: 9915

SEQ ID NO: 229234 - RNA, 64 nt, Human; identical to SEQ ID NO: 9916

SEQ ID NO: 229235 - RNA, 64 nt, Human; identical to SEQ ID NO: 9917

SEQ ID NO: 229236 - RNA, 64 nt, Human; identical to SEQ ID NO: 9918

SEQ ID NO: 229237 - RNA, 64 nt, Human; identical to SEQ ID NO: 9919

SEQ ID NO: 229238 - RNA, 64 nt, Human; identical to SEQ ID NO: 9920

SEQ ID NO: 229239 - RNA, 64 nt, Human; identical to SEQ ID NO: 9921

SEQ ID NO: 229240 - RNA, 64 nt, Human; identical to SEQ ID NO: 9922

SEQ ID NO: 229241 - RNA, 64 nt, Human; identical to SEQ ID NO: 9923

SEQ ID NO: 229242 - RNA, 64 nt, Human; identical to SEQ ID NO: 9924

SEQ ID NO: 229243 - RNA, 64 nt, Human; identical to SEQ ID NO: 9925

SEQ ID NO: 229244 - RNA, 64 nt, Human; identical to SEQ ID NO: 9926

SEQ ID NO: 229245 - RNA, 64 nt, Human; identical to SEQ ID NO: 9927

SEQ ID NO: 229246 - RNA, 64 nt, Human; identical to SEQ ID NO: 9928

SEQ ID NO: 229247 - RNA, 64 nt, Human; identical to SEQ ID NO: 9929

SEQ ID NO: 229248 - RNA, 64 nt, Human; identical to SEQ ID NO: 9930

SEQ ID NO: 229249 - RNA, 64 nt, Human; identical to SEQ ID NO: 9931

SEQ ID NO: 229250 - RNA, 64 nt, Human; identical to SEQ ID NO: 9932

SEQ ID NO: 229251 - RNA, 64 nt, Human; identical to SEQ ID NO: 9933

SEQ ID NO: 229252 - RNA, 64 nt, Human; identical to SEQ ID NO: 9934

SEQ ID NO: 229253 - RNA, 64 nt, Human; identical to SEQ ID NO: 9935

SEQ ID NO: 229254 - RNA, 64 nt, Human; identical to SEQ ID NO: 9936

SEQ ID NO: 229255 - RNA, 64 nt, Human; identical to SEQ ID NO: 9937

SEQ ID NO: 229256 - RNA, 60 nt, Human
gcagccuggagaagcccuaggggggcgacccgcggagaccccagcagaggucgcagccca

SEQ ID NO: 229257 - RNA, 63 nt, Human
uggccagugugccacauuaaauacccgugcaggcgcggagaagcaaccggcacccccuuccgg

SEQ ID NO: 229258 - RNA, 63 nt, Human
ccugggcgcgccccgccgcgggcccuugaggcgcgcggagacaccagcgcuggcuucccgggc

SEQ ID NO: 229259 - RNA, 63 nt, Human
gugccugugguuugcacccaccacugaaaaagccgcggagaugcgcagcgcguacacugacuu

SEQ ID NO: 229260 - RNA, 63 nt, Human
agccucuuuuugcaaauaaaguuggugcagcuucgcggagaggagaggcgcugcagucugugc

SEQ ID NO: 229261 - RNA, 63 nt, Human
ggcggugugcuggugggugccgucggcuccaugcgcggagagucuggcuacucucucguuucc

SEQ ID NO: 229262 - RNA, 63 nt, Human
uuggggguuggguggggcuggacggggacgaggcgcggagaggcggcgggaaagagcuucggc

SEQ ID NO: 229263 - RNA, 63 nt, Human
guuuauacuuagaacugaccaccuccccggccacgcggagagcuguacaguguguaaaucugc

SEQ ID NO: 229264 - RNA, 63 nt, Human
gaccggcugcgugauccagccugugccaaaacccgcggagaaggcugccauggcaccgugcau

SEQ ID NO: 229265 - RNA, 63 nt, Human
aaaaucaacaucaggaacccagcuucagggcaucgcggagacgcgucagauggcagauuugga

SEQ ID NO: 229266 - RNA, 63 nt, Human
gguucugagaacauuucacagaagugccugagacgcggagacauggcugguguuaaauggagc

SEQ ID NO: 229267 - RNA, 63 nt, Human
uucacacgcggggucgguuuaauggaguguccacgcggagauaacugcgauauuggaacaccu

SEQ ID NO: 229268 - RNA, 63 nt, Human
uggguuucugcucucuagauggagcuuugggaacgcggagaacagugggguuacagggaguca

SEQ ID NO: 229269 - RNA, 63 nt, Human
ugccugcgcgccgccgacagucagcgcugugcgcgcggagagaggugcgccgugggcucaaga

SEQ ID NO: 229270 - RNA, 63 nt, Human
cauggcccucugccacugacccaccgccaccuccgcggagaaacugcacuuugcaauggggcc

SEQ ID NO: 229271 - RNA, 63 nt, Human
gcugagcuaguugccuggcacccaccugucgcgcgcggagaggggguucccuguugcuuuugu

SEQ ID NO: 229272 - RNA, 63 nt, Human
ccagaagucucagaggcaccucacgccagccaucgcggagagcucagagggccguccccaccc

SEQ ID NO: 229273 - RNA, 63 nt, Human
cagugcaccugccucagcuaccuaaugauuccgcgcggagaccuccugacaacgucucuucaa

SEQ ID NO: 229274 - RNA, 63 nt, Human
gcacauuccguugccuuacccgauggcuugugacgcggagagaaccgauuaaaaccguuugag

SEQ ID NO: 229275 - RNA, 63 nt, Human
gcucugugugagcggugagggguggagggaugucgcggagaggggaagggggaaacugaccaa

SEQ ID NO: 229276 - RNA, 63 nt, Human
gcucgggcgucuccucgguuuccuugccucacccgcggagagcgcugaaccuggacaagcagc

SEQ ID NO: 229277 - RNA, 63 nt, Human
gagcgagcagccuauggagguggagcuguggcccgcggagaagcagucaucaucauccaugga

SEQ ID NO: 229278 - RNA, 63 nt, Human
acaccauuuauauaccuacacgcacgcaagagacgcggagagauaggcgaugcagacucgcga

SEQ ID NO: 229279 - RNA, 63 nt, Human
gcgccucacgaucccucacccagagcacacggccgcggagaugacgucacgcaagcaacggcg

SEQ ID NO: 229280 - RNA, 63 nt, Human
acagcagaaaccaacuuuucuaacgacugaguucgcggagauagcaucaucccugaucaagga

SEQ ID NO: 229281 - RNA, 63 nt, Human
agagccggcccugaggacaguccugcccauccacgcggagauguggcugccgcguuugcauga

SEQ ID NO: 229282 - RNA, 63 nt, Human
cuguuuccuugucauuugacccucgucugugcccgcggagaccuccucugaccaaggggcacu

SEQ ID NO: 229283 - RNA, 63 nt, Human
agggcacaugccuggccggcugggguccccacccgcggagacgguccuagacccaguggggag

SEQ ID NO: 229284 - RNA, 63 nt, Human
acggcucugcaggaucagggcucgggcaggccccgcggagaugaagaauuugcagggagccuc

SEQ ID NO: 229285 - RNA, 63 nt, Human
cgggaccguccacgcacgacccagccagacccucgcggagauggugcagaaggcggagcgggu

SEQ ID NO: 229286 - RNA, 64 nt, Human
cugcagggccagccacucgccaggaggccacgggccacgggaagaaccaagcggugccagccac

SEQ ID NO: 229287 - RNA, 64 nt, Human
aucucggaugaaagggcucccuuguccucaggcuccacgggagcggggcugcuggagagagcgg

SEQ ID NO: 229288 - RNA, 64 nt, Human
ggcucuggcccacugagccaccgcgcccuccugcccacgggaggacaagcaauaacucucuaca

SEQ ID NO: 229289 - RNA, 64 nt, Human
guacucagaaauugaacucucagucacguggaagccacgggacugcuccgaagccgccauaaua

SEQ ID NO: 229290 - RNA, 64 nt, Human
cuccccugugagccguggcuugucuggucuucgcccacgggaggcuggacagaggcuguagcca

SEQ ID NO: 229291 - RNA, 64 nt, Human
ucacuuucuguucuccagugucacuguucuguuuccacgggauggaaagcgcaugggccugugu

SEQ ID NO: 229292 - RNA, 64 nt, Human
auguucuaccacucgcaggggcaaagguggugagccacgggacguccaaggggaggcuggcccc

SEQ ID NO: 229293 - RNA, 64 nt, Human
uccaccagaaaucaccacauauuuggaaucucuuccacgggaccagcccagagcuaugccaugg

SEQ ID NO: 229294 - RNA, 64 nt, Human
ucauaucagagucaagugaacugugguguaugugccacgggauuugagugguugcgugggcaac

SEQ ID NO: 229295 - RNA, 64 nt, Human
ccaccccggggucucuggggaacugucaaccugcccacgggacauguacauuuccccuuuugug

SEQ ID NO: 229296 - RNA, 64 nt, Human
ucaagcuccacaucacugaggucaaugucauccuccacgggaagcugggagacgacagaaagcc

SEQ ID NO: 229297 - RNA, 64 nt, Human
cugccacuaaauaucucugauguuuccaugagucugagggcagagacucugguauaugaaaacg

SEQ ID NO: 229298 - RNA, 64 nt, Human
cagaacuauuuaggguguuuguguuuauggacagugagggcacugcucuuggauucaccagcug

SEQ ID NO: 229299 - RNA, 64 nt, Human
gggguggaggcugcuggaggugggagugaggagaugagggcagggucucaaacaguccugacuc

SEQ ID NO: 229300 - RNA, 64 nt, Human
gaaccauucuuuggaauuggcgugguauauuuaaccacgggagcgugucuggaaacgcaaacua

SEQ ID NO: 229301 - RNA, 64 nt, Human
ucccagcccugccaggaggcugcggccuagggguccacgggaagccuccgucaggagagacgca

SEQ ID NO: 229302 - RNA, 64 nt, Human
uguaaguccucagccaccagacuguuauacugcaccacgggagugcugcugagaaggcuagaag

SEQ ID NO: 229303 - RNA, 64 nt, Human
aucuggaugacaaacggaagauccacuaaaacguccacgggauuaacagaacguccuugcagac

SEQ ID NO: 229304 - RNA, 64 nt, Human
uuugcauagcuuucacaagucuccuagacacuccccacgggaaacucaaggagguggugaauuu

SEQ ID NO: 229305 - RNA, 64 nt, Human
cuuggagcacccagggacacccagcgugcaacagccacgggaagccuuucugccgcccaggccc

SEQ ID NO: 229306 - RNA, 64 nt, Human
uugauuugggggauauuuuguacaaaaagaaaacccacgggaagauguccguggagaggcagag

SEQ ID NO: 229307 - RNA, 64 nt, Human
uacguggcuuccugcugggggagauggccuucacccacgggaugccggguucuccuuucuuucc

SEQ ID NO: 229308 - RNA, 64 nt, Human
guucuuucccagauuuuauggagagcaugcuaucccacgggaaaggagcugcuuucuucccuca

SEQ ID NO: 229309 - RNA, 64 nt, Human
uuuuaaaaauaaagcaagguugacuaaccuacggccacgggaacaggaccaugguuaagcaacc

SEQ ID NO: 229310 - RNA, 64 nt, Human
cgagugccugcagaagaucaugaccacgguggacccacgggagaagcuggaggugcuggagagg

SEQ ID NO: 229311 - RNA, 64 nt, Human
ugcuuuguaugaguuucuuuuaugaaacuugauaccacgggaguccaguaauauuggccacaaa

SEQ ID NO: 229312 - RNA, 64 nt, Human
ugcauaguuguguuaaacuacaggcaaacauagcccacgggaauaucuccaccauuucucuaug

SEQ ID NO: 229313 - RNA, 64 nt, Human
cugccuuuuccucuaucuugagcccuauaaaugcccacgggacccccaccaccagccucuugaa

SEQ ID NO: 229314 - RNA, 64 nt, Human
uacuuccugcuucgagaauguauaacguggaaauccacgggaccaaauuucugcagaggccuug

SEQ ID NO: 229315 - RNA, 64 nt, Human
ccuuccggcccuuaaaacugggcugggagagaagacggggaagugugugagacaaaacaaagcc

SEQ ID NO: 229316 - RNA, 64 nt, Human
uugucugacuucucaggaagaucgugaacauaacugagggcaugagucucacuagcacauggag

SEQ ID NO: 229317 - RNA, 64 nt, Human
uguggacuguuugaucuuguauuacccacaggaaugagggcagcuaaacccauagaaggaguug

SEQ ID NO: 229318 - RNA, 64 nt, Human
ugggcccgacauggcuccggccucugccuuugcaccacgggacaucacagggugggccucggcc

SEQ ID NO: 229319 - RNA, 64 nt, Human
gauaaauccaagcccgcccaggcccacggggggcccacgggaccccccgggacuccccggacau

SEQ ID NO: 229320 - RNA, 64 nt, Human
gauuucagugugcuuaaguaaaauccucugaaaaccacgggagccucugccuccucagccacag

SEQ ID NO: 229321 - RNA, 64 nt, Human
accugccucacagcuggccgucacuuguggggguccacgggacgauggcuuugccagcuuaaag

SEQ ID NO: 229322 - RNA, 64 nt, Human
cucccugcuugaagaucuggccuugccccugaguccacgggauguucauggaaagcaggacaga

SEQ ID NO: 229323 - RNA, 64 nt, Human
agcccccagcagcugccccagggacaugggaagaccacgggaccucuuucacuacccacgauga

SEQ ID NO: 229324 - RNA, 54 nt, Human
cgaccucucccagcugcugaaaggccacgggaggugaggcucuucacaucccau

SEQ ID NO: 229325 - RNA, 64 nt, Human
uagccaggauaccugauggccacgugugccuuggccacgggaggcugcugagauuggccacgug

SEQ ID NO: 229326 - RNA, 64 nt, Human
aaagcagagggaaugugaaagaaaauaagagaauccacgggauuugaugccuggaagauucucc

SEQ ID NO: 229327 - RNA, 64 nt, Human
cugauuagacauagaggguuguuuuaggagcaugccacgggaaagacugagggaucaugaucau

SEQ ID NO: 229328 - RNA, 64 nt, Human
gccaggggaggggugaagugguugccuggacaccccacgggaggaguggcaucuggggcucuug

SEQ ID NO: 229329 - RNA, 64 nt, Human
uugacaccaagaaaccacugggcauaaugcuuccccacgggaacauuauuccugcacucacagg

SEQ ID NO: 229330 - RNA, 64 nt, Human
ggccgggagggaagagggaggcugcacgcucggcccacgggagggcaggcuccggggcccgcag

SEQ ID NO: 229331 - RNA, 64 nt, Human
aggaggucgugcagcacagcgcagaagccccugcccacgggauccggccccccagacaccgacc

SEQ ID NO: 229332 - RNA, 64 nt, Human
aacgaggacacgacggccaagguggcaguuugucccacgggaggacagucguuucuuuuccagc

SEQ ID NO: 229333 - RNA, 64 nt, Human
guucauguugcuuucuccuuuguccucuuggacuugagggcauugugaaaagcuuugcugugau

SEQ ID NO: 229334 - RNA, 64 nt, Human
ucuucagcacauuucccccaaaacaaaauaaaauugagggcauguugcauauuguugaauugua

SEQ ID NO: 229335 - RNA, 64 nt, Human
gcaacugacggccucgcacggaacugccauccugugagggcagcgguggcgcccggcaaaguug

SEQ ID NO: 229336 - RNA, 64 nt, Human
cgacccagggcuguaggaagccauaggagagugaccacgggauucccugagaaacagggccggc

SEQ ID NO: 229337 - RNA, 64 nt, Human
gguggccacagugucacuggucaggugcuucucaccacgggaaagccgccgaccugugacucgc

SEQ ID NO: 229338 - RNA, 64 nt, Human
caagacccaucucccuagucucagccuuacaacaccacgggacuaaggaagagcacuuccuugc

SEQ ID NO: 229339 - RNA, 51 nt, Human
ccggccucagccugucuugagccacgggacugccacagacugagccuuccg

SEQ ID NO: 229340 - RNA, 64 nt, Human
gggaaggaaggaaagaucaaggaaccaagcgccuccacgggaggcgagggaggcucuguaugaa

SEQ ID NO: 229341 - RNA, 64 nt, Human
cccagcagugccgggcugggcucugcggugcgguccacgggagagcaggccuccagcuggaaag

SEQ ID NO: 229342 - RNA, 64 nt, Human
cgccgcacuuucuaccccgggcagaggcgcuugcccacgggacguuuggggauggaccucggcc

SEQ ID NO: 229343 - RNA, 64 nt, Human
aaggggccgcgauggucagggccacggccaagggccacgggaacuuggagagggagcuuggaga

SEQ ID NO: 229344 - RNA, 64 nt, Human
agcaccaagugagaugaacggagugucggcuaggccacgggacagauggccaggaagggcccug

SEQ ID NO: 229345 - RNA, 64 nt, Human
acugccuguuccccacugccuguguucgcaggagccacgggacagaagacgguggccucugcug

SEQ ID NO: 229346 - RNA, 64 nt, Human
gugaaguaagccugagccagugcguggacuggugccacgggagugccuuguccacugucccccu

SEQ ID NO: 229347 - RNA, 64 nt, Human
augcagucgauacaaugcguagauagaagaagccccacgggagccaggaugggacuggucgugu

SEQ ID NO: 229348 - RNA, 64 nt, Human
uucccauccauuguuccuggaaaggugaucccuaccacgggaucccaaacuuggauagagccag

SEQ ID NO: 229349 - RNA, 64 nt, Human
gucauggccuccugggggcagaaggcgauguggaccacgggauuuguagccagccagcucccag

SEQ ID NO: 229350 - RNA, 64 nt, Human
ccaggagaggcguuucuggggcuccagagaagugccacgggaggcagaaguccagaacugccca

SEQ ID NO: 229351 - RNA, 64 nt, Human
uacgugucugccuaagccuucaagugggcggagcugagggcagcagcuugacuuugcagacauc

SEQ ID NO: 229352 - RNA, 64 nt, Human
ugcggagugggggucuuaucccugugcugagcccugagggcagagaggauggcauguuucaggg

SEQ ID NO: 229353 - RNA, 64 nt, Human
cacuaauauuuugcauguaauuugcucauuugagugagggcacuuuuuuuguacauaugauggg

SEQ ID NO: 229354 - RNA, 64 nt, Human
acccccgugccugcccuggcuggauccuaggagcccacgggauucucuguaucaucagaggcug

SEQ ID NO: 229355 - RNA, 64 nt, Human
gguugaugguuuuucucucagcaugucuccuccaccacgggaccccagcccugaccaacccaug

SEQ ID NO: 229356 - RNA, 64 nt, Human
uugcccuguucucaauaacaugcaaacaaacaagccacgggaaauauguaauaucuacuaguga

SEQ ID NO: 229357 - RNA, 64 nt, Human
aagagacuaaauaacagagccccucuaggagaagccacgggaucccggcggcaaggagaacaga

SEQ ID NO: 229358 - RNA, 64 nt, Human
cuaccaguucccaaguccauguguaccccgcucaccacgggaacggccccccccaaccacaggc

SEQ ID NO: 229359 - RNA, 64 nt, Human
ccaagagaggucagacuggcucuuguuaccggagccacgggaagaaagcagccggagucacgca

SEQ ID NO: 229360 - RNA, 64 nt, Human
ugccucagccccacuagcuggcaccaacuuaauuccacgggaccaucugcugaacauuccccag

SEQ ID NO: 229361 - RNA, 64 nt, Human
cgcacccacucaccucuccgauccgcaccccgccccacgggagcacuuccuacccccacgaggg

SEQ ID NO: 229362 - RNA, 64 nt, Human
gggaaggagugcugugauugacuaguaauggcuaccacgggaaagggaaggggaagcaguagca

SEQ ID NO: 229363 - RNA, 64 nt, Human
gcuggugauucugggacaggccuucacuuuggagccacgggauggggugggggagccccauggg

SEQ ID NO: 229364 - RNA, 64 nt, Human
guaugguuaagcccaaaggggcagaacaagaaagccacgggauuguaugaaaucaaacaugagu

SEQ ID NO: 229365 - RNA, 54 nt, Human
uggagcccgccgcagccuaggcccccacgggacgcggcaggcuucucagucucu

SEQ ID NO: 229366 - RNA, 64 nt, Human
ggccaggggcccuccugugcacuguuagcuauggccacgggagccuccagagcugccugguagc

SEQ ID NO: 229367 - RNA, 64 nt, Human
ccggccuggcuucacuggcgcccuuuggccgcgaccacgggaaccagcggugaggccugaccca

SEQ ID NO: 229368 - RNA, 64 nt, Human
aaccagugaaaagaagagagaagacccuucucgaccacgggaagcaucuuccagaagugugauu

SEQ ID NO: 229369 - RNA, 64 nt, Human
ccucagaaccaaacucacuguccccacuguggcaugagggcaguggagcaccauguuugagggc

SEQ ID NO: 229370 - RNA, 64 nt, Human
agcaguaccucucauggcuuuuugguuccagcagugagggcauuggugagaucaaugguaaacu

SEQ ID NO: 229371 - RNA, 64 nt, Human
ucaagaaggcuuuuuuuuuuuucuuuuuuaaaccugagggcaaaaaggaauggauaaaguagug

SEQ ID NO: 229372 - RNA, 64 nt, Human
ugauaucacugguucccaacuagaugcuuguuggccacgggaagggaaaugacuuguucuaauu

SEQ ID NO: 229373 - RNA, 64 nt, Human
aauuugauucaucaguggcaggccaugcauagagccacgggaggugcguccuuguuuuccaggg

SEQ ID NO: 229374 - RNA, 64 nt, Human
ccucuggaagcuugggugaccggggcccuggcucccacgggauggagggugugguccugugguc

SEQ ID NO: 229375 - RNA, 64 nt, Human
cuugaggaaugcauguguucuuagugauucacauccacgggacaaaaacucaagaagaaauaag

SEQ ID NO: 229376 - RNA, 64 nt, Human
ugggguggugggccgacuugaaccuuagcaguccccacgggagauggcagggcaccuuggggaa

SEQ ID NO: 229377 - RNA, 64 nt, Human
uggccuuggggacuacucggcucucacucagcucccacgggacucagaagugcgccgccaugcu

SEQ ID NO: 229378 - RNA, 64 nt, Human
agccaaugaagguuugucuaagcugccuggguauccacgggacaaaaacagcaaacucccucag

SEQ ID NO: 229379 - RNA, 64 nt, Human
aucaugagggacuuggagggagcugggaguucauccacgggagacccugccccgaugagaaggg

SEQ ID NO: 229380 - RNA, 64 nt, Human
aagaucagggcaggcgugugggaggucccucacuccacgggacagaggccccugggcagcagag

SEQ ID NO: 229381 - RNA, 64 nt, Human
uuccuucugcggcuauugcugaaccccuguccauccacgggacccugaaacuccacuuggccua

SEQ ID NO: 229382 - RNA, 64 nt, Human
caacacauccucuucuuucugccaauccucucccccacgggacaccucucugguucgggaccaa

SEQ ID NO: 229383 - RNA, 64 nt, Human
uaacauuugacaaacuggaguugaacuaaaggcuccacgggaaaguuucuggucuuacuagugu

SEQ ID NO: 229384 - RNA, 64 nt, Human
acagccugagucacaacgugggaaggaaucucugccacgggaaaggugggcggaagcagcuggc

SEQ ID NO: 229385 - RNA, 64 nt, Human
aucugacaucuuucccguggagcaacuuccugcuccacgggaaagaggucgauggauuuacccc

SEQ ID NO: 229386 - RNA, 64 nt, Human
cucgaugcucccaucugguggcggccucaggaacccacgggaaccuggaaggaggcucuuugug

SEQ ID NO: 229387 - RNA, 64 nt, Human
ggacacagagguggaagauugaucuugccaagagugagggcagaugucuccagccaggacugcc

SEQ ID NO: 229388 - RNA, 64 nt, Human
gcuggagcagcagacguuugccauuucucacgccugagggcaggcguuggagcagcucagccgg

SEQ ID NO: 229389 - RNA, 64 nt, Human
aaccugccugacauuuggaguguuccccuuccacugagggcagucgauagagcuguauuaagcc

SEQ ID NO: 229390 - RNA, 64 nt, Human
ucuuggggaugucagugaggcugggagcagggagccacgggaugcugagagaggaggcccgaga

SEQ ID NO: 229391 - RNA, 64 nt, Human
agguggcuucauucuggcggugagaggcccacgaccacgggagugagagcugguguggcgaggc

SEQ ID NO: 229392 - RNA, 64 nt, Human
caugccagcccccaacgcagggcgcccggcgaagccacgggacuggcgggaggagcacgcgggg

SEQ ID NO: 229393 - RNA, 64 nt, Human
cuugcugaccucccagccuuucuaaggcucagccccacgggacucugguggcugccagcuugug

SEQ ID NO: 229394 - RNA, 64 nt, Human
uuuuaaggguuugaggguacagucccuuaaccugccacgggagggggcccccaaacuuucuucc

SEQ ID NO: 229395 - RNA, 57 nt, Human
uccggcucuacgacauguagacugcgcccacgggaugcacagcggccaugccugaug

SEQ ID NO: 229396 - RNA, 64 nt, Human
ccuuaaugauggccacaucugggcugcucugcacccacgggagaggcuggcccagcugcagacu

SEQ ID NO: 229397 - RNA, 64 nt, Human
ggccgcaggacuggagggccaggccccgccacccccacgggagacccgggacagggcgucuucc

SEQ ID NO: 229398 - RNA, 64 nt, Human
cgccagacaccccgguggaagcauuuagaggggaccacgggagggacaaggcuucucuguccgc

SEQ ID NO: 229399 - RNA, 64 nt, Human
acguggcugcgugccccugcugcugucaccucucccacgggaccuggggcuuucguccacagcu

SEQ ID NO: 229400 - RNA, 64 nt, Human
ccgcuccaggccuggaauguuccguggcugggccccacgggaagccugauguucaggguugggg

SEQ ID NO: 229401 - RNA, 64 nt, Human
cagggaagcuuaccccuccugugcuggguggaggccacgggacaccucaggugccacccaccuu

SEQ ID NO: 229402 - RNA, 64 nt, Human
ggccgggggccccccgaugccuuggcagugccagccacgggaaccaggagcgagagacggugcc

SEQ ID NO: 229403 - RNA, 64 nt, Human
guuucuguuacguaacgaaaaggauaaacaucucccacgggagaggccacagauggccacuucc

SEQ ID NO: 229404 - RNA, 61 nt, Human
ucagccuggaugacuguuagcccugaggccuccacgggacuucauuuaagaauacgugcau

SEQ ID NO: 229405 - RNA, 64 nt, Human
uuaauucuuuguucuguuuugugagaacuaauuuugagggcaugaagcugcauaugauagauga

SEQ ID NO: 229406 - RNA, 64 nt, Human
gggaggaguuggagagcacaguugccccguugugugagggcaguaguaggcaucuggaaugcuc

SEQ ID NO: 229407 - RNA, 64 nt, Human
cacaggugccaauggugacaagacuggcaagacgugagggcaugaaugguucauucaggcagcu

SEQ ID NO: 229408 - RNA, 63 nt, Human
acaacccauacccugugugagggcacaaccaggccacgggaccuucuauccucuguauuuguc

SEQ ID NO: 229409 - RNA, 64 nt, Human
cacugccagugucuuccagagucacacccagggaccacgggaggauccugaccccugcagggcu

SEQ ID NO: 229410 - RNA, 64 nt, Human
gauuuuuguccccugaguccgccucugcguggagccacgggaucagcugagucaugagucucag

SEQ ID NO: 229411 - RNA, 64 nt, Human
gcuccacaccuugcgcugagcagcugugauugugccacgggagcaugagcccuuuuccccacgg

SEQ ID NO: 229412 - RNA, 64 nt, Human
agcuucacuggacauauucuuuaugccacaccuaccacgggauaauaaaagggaaaauaauuug

SEQ ID NO: 229413 - RNA, 64 nt, Human
caggguuggauggucaucggcuuucagaaggagaccacgggaauguucagggaaacaaugucag

SEQ ID NO: 229414 - RNA, 55 nt, Human
uuuggugauuucuaagcagauaaccccacgggaagauauugaugaggacagcagu

SEQ ID NO: 229415 - RNA, 64 nt, Human
ugugccagccacacaaacguuuacuuaucuuaugccacgggaaguuuagagagcuaagauuauc

SEQ ID NO: 229416 - RNA, 64 nt, Human
cugcauccucucccccacaagagccccaaagaucccacgggagaggggagagggacgcacagca

SEQ ID NO: 229417 - RNA, 64 nt, Human
cuuguaugaagaugcccugauuuguacagauugaccacgggaauacuacugccauguaaucugu

SEQ ID NO: 229418 - RNA, 64 nt, Human
aacacacucaggcuucccugacucaggacaaggaccacgggaggcccaggugcggaaaggaggc

SEQ ID NO: 229419 - RNA, 64 nt, Human
ggauguuauuugcuuauauucuuauaauuuuaaaugagggcacagugaaaugaaaauuuuauac

SEQ ID NO: 229420 - RNA, 64 nt, Human
gggaugggggugggauaugaggguggcaugcagcugagggcagggccagggcuggugucccuaa

SEQ ID NO: 229421 - RNA, 64 nt, Human
acucugguauuuguuucaggaagcucuucuaagcugagggcacuugagcaacugacuuaauuuu

SEQ ID NO: 229422 - RNA, 64 nt, Human
ggugggauuugcuccuggguucccuaggcccuagugagggcagaagagaaaccauccucucccu

SEQ ID NO: 229423 - RNA, 64 nt, Human
uacggguaacagugaggcugggaaggggaacacagaccaggaagcucggugagugauggcagaa

SEQ ID NO: 229424 - RNA, 64 nt, Human
gcccuggggccuguacugccugcuuggggggugaugagggcagcagccagcccugccuggagga

SEQ ID NO: 229425 - RNA, 64 nt, Human
caucuuugccugacacagcacucuuccugugggcugagggcaucuccaaagcugccugaugccu

SEQ ID NO: 229426 - RNA, 64 nt, Human
ccgggucaugacagagcucuuuuggggcaggaggugagggcagggggccccgcuccuugguaag

SEQ ID NO: 229427 - RNA, 64 nt, Human
ucuaagucaagagccuuucagugcucccucauauugagggcaguggcagaaaagugaccacucu

SEQ ID NO: 229428 - RNA, 64 nt, Human
guagaccugucuuugggaaacauuaaaggauguuugagggcagcaggaaaauaauacaaaacuu

SEQ ID NO: 229429 - RNA, 64 nt, Human
ugacacaaaucugguagaaagaagccugauaaauugagggcacuuguacccucccugugccccc

SEQ ID NO: 229430 - RNA, 64 nt, Human
acgaggagacuuggucacugugaaggagaaagagugagggcaaugaagggcgaugguggggaga

SEQ ID NO: 229431 - RNA, 64 nt, Human
caggucaucuccccguugccaaguggguucagggugagggcaauuuguaagcucaauuucucug

SEQ ID NO: 229432 - RNA, 64 nt, Human
ucugucuguacauguuuaacaugacgcaauaauuugagggcaaacuuaguagugaguguguaug

SEQ ID NO: 229433 - RNA, 64 nt, Human
ucaggcuucaguaacuguagucuugugagcauauugagggcagaggaggacuuaguuuuucaua

SEQ ID NO: 229434 - RNA, 64 nt, Human
gaucccccuucuaauagucugaaggaagaggcugugagggcaguucagggccagggcccacagg

SEQ ID NO: 229435 - RNA, 64 nt, Human
cugaagcuuuguuccuucggucauuuggaauuccugagggcagccagagcuccuugguccuuuc

SEQ ID NO: 229436 - RNA, 64 nt, Human
caagaguugcaggagacccaggaaagggaguugcugagggcagguccccgagggggaugagacc

SEQ ID NO: 229437 - RNA, 64 nt, Human
aggagagaggggcucgggaagggagcuggggcggugagggcauggggugaggcauggcgauggg

SEQ ID NO: 229438 - RNA, 64 nt, Human
agcacugauuugggacuguuccuaaggcauaucagugcuucauugucauuguguuuuuaaacuu

SEQ ID NO: 229439 - RNA, 63 nt, Human
uguuuuagguaacgcgguagcgaagagagaggugugcuucaauccuggaggggcagcaggagg

SEQ ID NO: 229440 - RNA, 64 nt, Human
aagucuuaggcagcagcccagacauguauagaggggcaguuagagggagaacaggggugggaaa

SEQ ID NO: 229441 - RNA, 64 nt, Human
uguucuagacaaauacccaagcaacaacuccgcaggcaguuaccaaguacggcuggcuacaacu

SEQ ID NO: 229442 - RNA, 64 nt, Human
guucucaguguuugggacucuuaugcagaaucgaggcaguuaacucuuccaagaacagaagcgg

SEQ ID NO: 229443 - RNA, 64 nt, Human
cuuucaguuacuugaguuuggagucagaaagcaagaccaggaagcaaauagcagcucaggaaau

SEQ ID NO: 229444 - RNA, 64 nt, Human
ccccucuccuacucuacagcauuaaagacugugggaccaggacccuaagucuccuuuccuucug

SEQ ID NO: 229445 - RNA, 64 nt, Human
ccuacccccucacucuccccgucuccauggucccgaccaggaagggaagccaucgguaccuucu

SEQ ID NO: 229446 - RNA, 64 nt, Human
cacuuugggaggccaaggcagaaggaucacuugagaccaggaguucaagaccagccugagaaac

SEQ ID NO: 229447 - RNA, 64 nt, Human
ggccacagggcucagguucacacuucugcuuugagaccaggaugggguguaagccauagaguaa

SEQ ID NO: 229448 - RNA, 64 nt, Human
aaaacuauuugugaucuacuguuugcauguaagagaccaggauauguaacucuuauauuuuaag

SEQ ID NO: 229449 - RNA, 64 nt, Human
gacccagccuggucugcacugcaaccuccaccaggaccaggauccugggccacaggcugggaug

SEQ ID NO: 229450 - RNA, 57 nt, Human
agaaauucuacaagcucugaaugucuagaccaggaccucccucccccuggcacuggu

SEQ ID NO: 229451 - RNA, 64 nt, Human
gaccuuuacauggcagcuaacagugcuuuuugcugaccaggauugguuuauaugauuaaauuaa

SEQ ID NO: 229452 - RNA, 64 nt, Human
aaacuacccaguggugucuacugaagaucccuuugaccaggaugacuggggagcuuggcagaag

SEQ ID NO: 229453 - RNA, 64 nt, Human
cguggacaucagccagcacugcacagacagcugcgaccaggacgucagccagcacugcacagac

SEQ ID NO: 229454 - RNA, 64 nt, Human
uuagcccaccaggcaugaggccaagggcuccacugaccaggaggccgaggucucuaacucuuau

SEQ ID NO: 229455 - RNA, 64 nt, Human
uggcacgcaagccugaggacccuccccuaccaaggaccaggaaaagcagcagcugccugcucuc

SEQ ID NO: 229456 - RNA, 64 nt, Human
gaacucccagcgccagauucaucaugucuguugugaccaggaaagcugcccccaucugcaggaa

SEQ ID NO: 229457 - RNA, 64 nt, Human
cacuuugggagacugaggugggagcaucacuugagaccaggaguuugggaccaggcugggcaac

SEQ ID NO: 229458 - RNA, 64 nt, Human
uucaguuauugguggaaucuuuagcgcucaauaggaccaggauccagccucacuucuaggguau

SEQ ID NO: 229459 - RNA, 64 nt, Human
ucaccacucaaccaguggcuguuucacaaggauuugagggcacuugccugucuugugaggucug

SEQ ID NO: 229460 - RNA, 64 nt, Human
cccugagaacugaaagaggggaaaggaguacauuugagggcacuuaauacaaaguuaaugucag

SEQ ID NO: 229461 - RNA, 64 nt, Human
acagugauuguuuauaguuuuuuguuuucagaaaugagggcagcuguuaauuuuuucacucaug

SEQ ID NO: 229462 - RNA, 64 nt, Human
ggaauauugaggaaucaucuagaacaauuaagccgaccaggaaaccucauuccuaccuacacug

SEQ ID NO: 229463 - RNA, 64 nt, Human
cccucgaccugcuaucuccucugaaagccuggcugaccaggaauggggucuccccucacauugg

SEQ ID NO: 229464 - RNA, 64 nt, Human
ggauggaauggccucugaaagacuucacuaaaaugaccaggauccacaguuaagagaagacccu

SEQ ID NO: 229465 - RNA, 64 nt, Human
ugaaggcuuuuguugaauccuaugcuacugauaggaccaggaagagaggaacucggaggacaau

SEQ ID NO: 229466 - RNA, 64 nt, Human
uuggacagguaaggcuuggccgaugucugauugggaccaggaggggucaacacuuucauaucag

SEQ ID NO: 229467 - RNA, 64 nt, Human
aauguguuaaggagggaauguauaugucuugguagaccaggaggccuuugccagcaauuuaagc

SEQ ID NO: 229468 - RNA, 64 nt, Human
cacuuugggaggccaaggcggguggaucacuugagaccaggaauucgagaccagccuggccaac

SEQ ID NO: 229469 - RNA, 64 nt, Human
aacaaccauaucguguuagugaauuuucaauauggaccaggaaggcauauguauuuugaacuug

SEQ ID NO: 229470 - RNA, 64 nt, Human
cuaagccauuccagucuccugugaagccaaaagggaccaggaaccgugcaaaggaaacuggaaa

SEQ ID NO: 229471 - RNA, 64 nt, Human
aaacgucauauaagacuuuaccagccccugagaggaccaggaggagcauccuugaccuucauuu

SEQ ID NO: 229472 - RNA, 64 nt, Human
cauggaccucuguccggcagagguguggacuggagaccaggauucaugcuggucuggaacagug

SEQ ID NO: 229473 - RNA, 64 nt, Human
cuugcugcuggcucccaucucccucccauuugcagaccaggaaggaagagcaagcuguacaaag

SEQ ID NO: 229474 - RNA, 64 nt, Human
gagggcguggcccagccugccuucugcaugagaggaccaggagacuggaauccagggcaguucc

SEQ ID NO: 229475 - RNA, 64 nt, Human
ccuuccuaucuguguuuucucaaagucaggagcugaccaggagcacacuaagguguggucaugc

SEQ ID NO: 229476 - RNA, 64 nt, Human
uggaggugguucaaauccucuggaacauagccaagaccaggagaagagagagcacuuucuuccc

SEQ ID NO: 229477 - RNA, 64 nt, Human
ugugcucagggucaccauagcccauuaguggaaggaccaggacuagaccuuuagucuucugagg

SEQ ID NO: 229478 - RNA, 64 nt, Human
cacgucuggcucccugccccuuaaccccaaggacugagggcagugcccuuugagaucuggggag

SEQ ID NO: 229479 - RNA, 64 nt, Human
cuuacucaguacauuugcuccaaacuuuucaacuugagggcaauacuaaacuuaaaaauaagag

SEQ ID NO: 229480 - RNA, 64 nt, Human
ccucagccccaggagaagggacaaaagguacuggugagggcaagaggugccugggaggaguggc

SEQ ID NO: 229481 - RNA, 64 nt, Human
cuaccacuugcacuuacucaucuucuagccuuaugaccaggaaccuuuguuuugggcucaagua

SEQ ID NO: 229482 - RNA, 64 nt, Human
gccuggugaaccugcagggaggguaugauugccugaccaggacagccagucuuuacucuuuuuc

SEQ ID NO: 229483 - RNA, 64 nt, Human
gucuccggaccaucaggguagggugguggguugagaccaggaagucagggaagaucggaauuca

SEQ ID NO: 229484 - RNA, 64 nt, Human
gacggcacccaggcugugaucuguccugggcggggaccaggagggagcggggucgggaucaccu

SEQ ID NO: 229485 - RNA, 64 nt, Human
acccggaaguaaucacauaggaaaugauaaggaagaccaggaggagcucuucguaguccagaaa

SEQ ID NO: 229486 - RNA, 64 nt, Human
ucuugguggaacagaccagccacugcagcagacagaccaggaacacaaugagacugacauuuca

SEQ ID NO: 229487 - RNA, 64 nt, Human
uccuaccauguucagcccagacuccugccacauggaccaggaugaagagggaucaaagagauaa

SEQ ID NO: 229488 - RNA, 64 nt, Human
ggggagggguagccagcuugggcuguccccuugagaccaggacaagaggcugggggugucagca

SEQ ID NO: 229489 - RNA, 64 nt, Human
uugugacuggaccacugcccaggugcuugaugaugaccaggagugugcucugggaaugcuggag

SEQ ID NO: 229490 - RNA, 64 nt, Human
cuccuggcuccccaggacacucaguucuuucaaagaccaggaugugguaccaacuuuggaaacg

SEQ ID NO: 229491 - RNA, 64 nt, Human
ugucccuagaaaacaaugcaaaaccuuugagguagaccaggauuucuaaucaaaagggaaaaga

SEQ ID NO: 229492 - RNA, 64 nt, Human
ucuuuacauucagaaaugagauacuguauuaucagaccaggaggcauugcugugaaagauaauu

SEQ ID NO: 229493 - RNA, 64 nt, Human
agcccccagcgaggggaggcccagccuccgaggagaccaggaacccugcuucagcagccccuca

SEQ ID NO: 229494 - RNA, 64 nt, Human
gcccuaacauagugucugcugcugccucccuggggaccaggagcuagcccagucccuggagcug

SEQ ID NO: 229495 - RNA, 51 nt, Human
uggagccugugccggugugaggaccaggaugucuuuucccagccccaagag

SEQ ID NO: 229496 - RNA, 64 nt, Human
guggguaggccaaguguguugcuucagcaaaccggaccaggagggccagggccggaugugggga

SEQ ID NO: 229497 - RNA, 64 nt, Human
acauugugaucaguuugcccagaauuggggauggggcaguuagcauguuggggccaggaaggga

SEQ ID NO: 229498 - RNA, 64 nt, Human
ccuaucugcuuccuagcugauaaagcuuagaaaaggcaguuauuccuucuuuccaaccagcuuu

SEQ ID NO: 229499 - RNA, 64 nt, Human
cauccacucauaagcuugguacaaaaacuucucuggcaguuacuuuugaagcuucacucugcuu

SEQ ID NO: 229500 - RNA, 64 nt, Human
ccaauugauuuuaaaccauaaaaagcugaccacaggcaguuacuucugagggcaucuuggucca

SEQ ID NO: 229501 - RNA, 64 nt, Human
ucagcuacuagggaggcugaggcaagaggcuugagaccaggagcucgaggcuguaaugugccau

SEQ ID NO: 229502 - RNA, 64 nt, Human
gcugcuggccuggaggaguucgggaaggaggauagaccaggaaauaaagggucaacagagcugu

SEQ ID NO: 229503 - RNA, 64 nt, Human
cagggggugaaggcaggaguugggggcaggucaggaccaggacccagggagaggcugugucccu

SEQ ID NO: 229504 - RNA, 64 nt, Human
gaagauaguaaaacaagggaggaagcaguggauggaccaggauuaauuccuuucauuucuuagu

SEQ ID NO: 229505 - RNA, 64 nt, Human
aaaggggaaagagggauucuaggguuucaucagggaccaggaaugcauuccucugucagguucc

SEQ ID NO: 229506 - RNA, 64 nt, Human
agccaacucagcuuugggacaaacccagccaagugaccaggacacuuuagugcaaagagcugag

SEQ ID NO: 229507 - RNA, 64 nt, Human
ugaugggggugcuacuggccuucugcugccaugggaccaggaugcuaaaugucaagguaguccu

SEQ ID NO: 229508 - RNA, 64 nt, Human
cuuggagcaccuggaggauguaccagaagcacuagaccaggacgaccuccagcgcgaucuccag

SEQ ID NO: 229509 - RNA, 64 nt, Human
uucggaagacaccgaggaagaggaggaagaugaagaccaggacuacagcuuuccuauaucuucu

SEQ ID NO: 229510 - RNA, 64 nt, Human
uagaugaacaaauacuuucuugaucauucuguaagaccaggagguugguaagagugacuaacca

SEQ ID NO: 229511 - RNA, 64 nt, Human
uggauggaagacagggauuggccugugcuucagcgaccaggauggccaggccagagcugcagcu

SEQ ID NO: 229512 - RNA, 64 nt, Human
cuguucuaugguggacucuuaacaggugcuaugugaccaggaaucuagccgggaguagcagagg

SEQ ID NO: 229513 - RNA, 64 nt, Human
ucccaccccaagugggcggcaguguuccuggcaugaccaggauuccugugaaagcaggagcagc

SEQ ID NO: 229514 - RNA, 64 nt, Human
auagcauuuaacugcaucagaaccaguaugaaaagaccaggaauccagauuucuggcuuuuaaa

SEQ ID NO: 229515 - RNA, 64 nt, Human
ugcagacuggugggaucauaggagccuucugaaugaccaggacugcuuucuuuggagcugauga

SEQ ID NO: 229516 - RNA, 64 nt, Human
uauuugauaacaguuacuccaguauaugcugauggaccaggaagcccugaauccauaaaggcau

SEQ ID NO: 229517 - RNA, 64 nt, Human
gggaagaacgucccacuacagacuuccuaucacuggcaguuauauuuuugagcguaaaaggguc

SEQ ID NO: 229518 - RNA, 64 nt, Human
auuauacacuaaaaaauaggaagucaucuugaaaggcaguuaauguacugcaaaugucccuaug

SEQ ID NO: 229519 - RNA, 64 nt, Human
uucaaugagcaugucccuaagauaaaccagaauuggcaguuaauuuaggcgucuagaaaaucuc

SEQ ID NO: 229520 - RNA, 64 nt, Human
ugucuuccuagggaguagagaaaggcagugaaauggcaguuagaccaacagaggcuugaaggau

SEQ ID NO: 229521 - RNA, 64 nt, Human
cuuugcuaauuuggccaccuucaccuacugacaugaccaggauuuuccuuugccauuaaggaau

SEQ ID NO: 229522 - RNA, 64 nt, Human
uuugcccugacggaguggcccggaagcagaggcugaccaggagcaggggccucccucccgaacu

SEQ ID NO: 229523 - RNA, 64 nt, Human
caccugagagaaaggggaggggucaacaaugagagaccaggaguagguccuaucagugcccccc

SEQ ID NO: 229524 - RNA, 64 nt, Human
cgaaucuccuccaaggaagucccaggaggauggggaccaggaaggcuguggacccccaucucca

SEQ ID NO: 229525 - RNA, 64 nt, Human
agcaugagguggagcagugaccagguggagcagugaccaggacgccucuggcccagugcugccc

SEQ ID NO: 229526 - RNA, 64 nt, Human
cugcuaaacgcuuguugaaggagugaaauugagagaccaggaagggccugcaggcauuguggug

SEQ ID NO: 229527 - RNA, 64 nt, Human
uauccaugcguagaaucaacaacuccagucaugggaccaggaggagcucugggacgcagacaca

SEQ ID NO: 229528 - RNA, 64 nt, Human
uacaguucucggccccggcuuucuuccaagaguugaccaggaacccuaaagcauccagaguaga

SEQ ID NO: 229529 - RNA, 64 nt, Human
cauccuguuauccccugguguacacauggaagaggaccaggacauaccaccuggggaugggcug

SEQ ID NO: 229530 - RNA, 64 nt, Human
gucucuuggcccacuggucccacuugggggucuagaccaggauuauagaggacacagcaaguga

SEQ ID NO: 229531 - RNA, 64 nt, Human
uucuccgaaugacaaucagcucgugccagguggggaccaggauaugacuccuggugcccaggcc

SEQ ID NO: 229532 - RNA, 64 nt, Human
ucaguaccccccaccccuccccagcuaguagcaugaccaggagaggguuaaugagagccaagag

SEQ ID NO: 229533 - RNA, 64 nt, Human
aggauuacuugagaguuaucagggcugccuaacagaccaggagaucuggggguugcaccaggga

SEQ ID NO: 229534 - RNA, 64 nt, Human
acaaagcauuccaguagcuaugaccugccgcccugaccaggauagggcgggugggaaggagagg

SEQ ID NO: 229535 - RNA, 64 nt, Human
ggacuucagaccucagggauccuuuugaugcacugaccaggaauugugauaauccuuuucauuu

SEQ ID NO: 229536 - RNA, 64 nt, Human
uuaccuauccaagguugcaguuggguaguggugggaccaggauggacaacucauuggcccugcc

SEQ ID NO: 229537 - RNA, 64 nt, Human
uugucacugcacaacaguggccuggucccccacaggcaguuagggccccaggucagaccucacc

SEQ ID NO: 229538 - RNA, 64 nt, Human
uucaucuccacuuugugcuaacccauucauaguuggcaguuaaacacauacuccaaaagacugc

SEQ ID NO: 229539 - RNA, 64 nt, Human
gaggggcucuuucuuaccguaaauaaggggaaaaggcaguuagcucaaggacuugugacggauc

SEQ ID NO: 229540 - RNA, 64 nt, Human
aauacaagaccauugcaauuuaugcuuuucgccuggcaguuauuuucccccccaagcuauccug

SEQ ID NO: 229541 - RNA, 64 nt, Human
gaggaggagcccuagggaagaagucagggacagggaccaggauaccacucugucacugugugac

SEQ ID NO: 229542 - RNA, 64 nt, Human
gguaauuuuucaccuugcuuuucaguuagacaaggaccaggauugcacugacauggcgcugagg

SEQ ID NO: 229543 - RNA, 64 nt, Human
uggucaucuaugacgccacaucagcacauggccugaccaggaacuacugcaggaauccagauuc

SEQ ID NO: 229544 - RNA, 64 nt, Human
agugaccgucaagaccggggaagugcccuguggugaccaggagaacaaggagcuccuccagcaa

SEQ ID NO: 229545 - RNA, 64 nt, Human
gccugccgcugcaggaaacauuucugacaccgucgaccaggaaagccacacggagaggccacug

SEQ ID NO: 229546 - RNA, 64 nt, Human
cggaugcuuucaugcacccuuuacugcacuuucugaccaggagcuacuuugaguuugguguuac

SEQ ID NO: 229547 - RNA, 64 nt, Human
ggccuggggguuuuccaagcccucagcugguccugaccaggauggagcaagcucuucccuugcu

SEQ ID NO: 229548 - RNA, 64 nt, Human
gguagucuuuccuugaggcugauagcuagggcuugaccaggaagucccgagaaguuuugucacc

SEQ ID NO: 229549 - RNA, 64 nt, Human
gccgcggacaaucccccaccccgaucccucgccagaccaggacgcuuccucaagcccagccuuc

SEQ ID NO: 229550 - RNA, 64 nt, Human
ucugaaucugggcaggaagaguccucagucccaagaccaggagggggcaaugggcccagccuuu

SEQ ID NO: 229551 - RNA, 64 nt, Human
ccaaauccuccaggaaaaacuacuacacuaaauggaccaggaaccucagagucaagauccaaga

SEQ ID NO: 229552 - RNA, 64 nt, Human
aauacauaagaccauaacagccaacagguggcaggaccaggacuauagcccagguccucugaua

SEQ ID NO: 229553 - RNA, 64 nt, Human
uucuuacuccucucuucccuuuguuauucagugugaccaggauggcgggaggggaucuguguca

SEQ ID NO: 229554 - RNA, 64 nt, Human
uccgggagagcggcugcccgacucagguccgcccgaccaggaucagccccgcuccuccccucuu

SEQ ID NO: 229555 - RNA, 64 nt, Human
aauuucuuucaggucucauaaaagcgaugaaagagaccaggauaacauucuaauauuuaaauaa

SEQ ID NO: 229556 - RNA, 64 nt, Human
ggucuggggccuggagagacccucccacccagcagaccaggagauagcugggggacaagggcag

SEQ ID NO: 229557 - RNA, 64 nt, Human
uugggcccaaaucagaaaggagagagggggccaaugagggcagggccuccugugggcuggaaaa

SEQ ID NO: 229558 - RNA, 64 nt, Human
ugaauggcguuucucuccauauuugcccagaagaggcaguuaugauuccacuucuccuacauuu

SEQ ID NO: 229559 - RNA, 64 nt, Human
agcuccacaaccaggccgugaggcuggagaaacuggcaguuauugcugucaaaagccuguucuc

SEQ ID NO: 229560 - RNA, 64 nt, Human
uuaacuuguuuucauggaguggcuauucagcauuggcaguuaccacauucuguucaauuuaacc

SEQ ID NO: 229561 - RNA, 64 nt, Human
aauucucuggggacauaaaaccaggcuggaaagggaccaggaaguuugaaauagugacauauca

SEQ ID NO: 229562 - RNA, 64 nt, Human
cccgauuccuuuuugcuucugguuuggagcuccggaccaggaccuucguccuggucaguuuuua

SEQ ID NO: 229563 - RNA, 64 nt, Human
agagggaagccagucagggccccccugacguuaggaccaggagaaaucaacaggagggcagccc

SEQ ID NO: 229564 - RNA, 64 nt, Human
uguuaccauccucucugcagacgaggaaaccgaggaccaggagguucaguaaaugguccaagua

SEQ ID NO: 229565 - RNA, 64 nt, Human
uaaucccagcacuuugggaggcugaggcaguugagaccaggaguucgaguccagccugaccaac

SEQ ID NO: 229566 - RNA, 64 nt, Human
uuucuacuuuauuuauuguucccuugaaaugacugaccaggaaaaagaucauccuuaaauuuug

SEQ ID NO: 229567 - RNA, 64 nt, Human
uaccuagacuggauucgugacaacaugcgaccgugaccaggaacacccgacuccucaaaagcaa

SEQ ID NO: 229568 - RNA, 64 nt, Human
cucccaccuaaaauagagaauguugucuuuugccgaccaggagcacuacagauugagcuuuauc

SEQ ID NO: 229569 - RNA, 64 nt, Human
caaagaagaggaaccacagaaagagagacaucaugaccaggagaaaaaugugacuagacaugcu

SEQ ID NO: 229570 - RNA, 64 nt, Human
caaugaacauauucugaaugugguuucugucuuagaccaggaggacagaguuugcuuucauauu

SEQ ID NO: 229571 - RNA, 64 nt, Human
gguaaccagagggcagcguagugucaacaccagagaccaggauccaaauuguggggaaucaguu

SEQ ID NO: 229572 - RNA, 64 nt, Human
auaagagauaccagcaaugugugcacagaacaaagaccaggagaggacacagugagaaggcagu

SEQ ID NO: 229573 - RNA, 64 nt, Human
cgcugaguggacuggaguggagcauuggcugagagaccaggagggcacuggagcugucuugucc

SEQ ID NO: 229574 - RNA, 64 nt, Human
uuugccccagacccuuauuccagaugcugagagugaccaggacagcagcuccugaggcccagug

SEQ ID NO: 229575 - RNA, 64 nt, Human
gugcuguuccaccuuuuagggagguuacugaggggaccaggaugggagaaugaggaguaaaaug

SEQ ID NO: 229576 - RNA, 64 nt, Human
gcuccuuuuucucucugguuuuccuggacuaugugaccaggaggacugucuuuucaaagggaau

SEQ ID NO: 229577 - RNA, 64 nt, Human
auuaguuuaagcugaauaaauaauuucaauuuggggcaguuauucugcuuuuuguaaagccgug

SEQ ID NO: 229578 - RNA, 64 nt, Human
agagagauuucaaaaccugagcaggaucaugucuggcaguuacuaaacagggacuuuguccaug

SEQ ID NO: 229579 - RNA, 64 nt, Human
uucaaaaguguucuugaaagaaacaaagcgaauaggcaguuagcacagcacagcuaccccuuac

SEQ ID NO: 229580 - RNA, 64 nt, Human
gucucgggagaaggggaacuugugccccagaaagggcaguuacccggccagggucacaucaacc

SEQ ID NO: 229581 - RNA, 64 nt, Human
ccaauaaaaagaauuuacaugauagguuaacaaggaccaggaaagugaguuuccugaaggaguu

SEQ ID NO: 229582 - RNA, 64 nt, Human
ccccuucgcucaucauucagauggcuuuccagaugaccaggacgagugggauauuuugccccca

SEQ ID NO: 229583 - RNA, 64 nt, Human
ugagaggauggccugaacugaguggagagagacagaccaggaccaaaccaugcagaggucaagg

SEQ ID NO: 229584 - RNA, 64 nt, Human
uuuuaucuguugugugaagugguucacccuugaggaccaggagccuccauauccugacugaaaa

SEQ ID NO: 229585 - RNA, 64 nt, Human
gaggagagagggucuccaguguuccccccauagagaccaggagggagagccucuguuuuguaaa

SEQ ID NO: 229586 - RNA, 64 nt, Human
agccagcuuuggcgcuguuggggagacuccuccagaccaggaaccccagaaggagacagagccu

SEQ ID NO: 229587 - RNA, 64 nt, Human
augauuucagacuugacccuaauugaccauauaugaccaggaaacacuucugaguuuacagcuc

SEQ ID NO: 229588 - RNA, 64 nt, Human
gccauuaugcuucuuugaaaggacaugauaaugggaccaggaugguuuuuuggaguaccaagca

SEQ ID NO: 229589 - RNA, 64 nt, Human
cacuuugggaggccaaggcagaaggaucacuugagaccaggaguucgagaccagccugagaaac

SEQ ID NO: 229590 - RNA, 64 nt, Human
agccucgcacagcucagccccaacacagaggugagaccaggaauaaggccacaaguaucucacu

SEQ ID NO: 229591 - RNA, 64 nt, Human
gugaggaggcuguccaccuugcuuggcucacugggaccaggaaagccugucuuugguuaggcuc

SEQ ID NO: 229592 - RNA, 64 nt, Human
gaggacgauggccccgacccuggcagcgagaggagaccaggaggcuaggacccuggccgcgcuu

SEQ ID NO: 229593 - RNA, 55 nt, Human
gaguacagguggggccgugaggcuggaccaggacuagagaagcuugagcaccccc

SEQ ID NO: 229594 - RNA, 64 nt, Human
acaaaagcuggaggaggguagggagagaagcugagaccaggaccggugggguacaaaggggccc

SEQ ID NO: 229595 - RNA, 64 nt, Human
auaccugcagcaacgugggagaaagaaguugcuggaccaggagaaaaggcaguuaugaagccaa

SEQ ID NO: 229596 - RNA, 64 nt, Human
ucuguuuucacgcugcugauaaagacauaccugagaccaggaagaaaaagagguuuaauuggac

SEQ ID NO: 229597 - RNA, 64 nt, Human
aacccgcuccacuacccggcaggguacacauucgcaccccuacuucacagaggaagaaaccugg

SEQ ID NO: 229598 - RNA, 64 nt, Human
gccacagccaaacccccacugcacccuacccacccaccccuagcccaggucagcuuuccuggag

SEQ ID NO: 229599 - RNA, 64 nt, Human
auguaccauaagcuaaagaccagagccuuccugucaccccuaaccaaggcauaauugaaacaau

SEQ ID NO: 229600 - RNA, 64 nt, Human
caaggccccuccgcccccgaacccuggggagcuggaccaggagguggaggcucaggggacccca

SEQ ID NO: 229601 - RNA, 64 nt, Human
uggcgagucaaaaacucagaucuaucuuaagagugaccaggaagagguucauugaaauaaucau

SEQ ID NO: 229602 - RNA, 64 nt, Human
cuguauccuuucggcuucccaguugagcucccaagaccaggacccacuggggcauauaaaaaag

SEQ ID NO: 229603 - RNA, 64 nt, Human
cuguguccuuucggcuucccaguugagcucccaagaccaggacccacuggggcauauaaaaucu

SEQ ID NO: 229604 - RNA, 64 nt, Human
aggacaguuugcaugggcugaguuauaccagcuagaccaggaauagaacaaagaauucuauacc

SEQ ID NO: 229605 - RNA, 64 nt, Human
uauauuucuaaucaaguguugauugugcgcgacugaccaggauugugaaagaguucuucuguuu

SEQ ID NO: 229606 - RNA, 64 nt, Human
ugccccuguggcagggcaucaaccuggugcuccugaccaggagccccagcgcgccccuggcccu

SEQ ID NO: 229607 - RNA, 64 nt, Human
gucccccucuguccuggggccuggcuuggacagagaccaggauuuggggcugagcugguuuccc

SEQ ID NO: 229608 - RNA, 64 nt, Human
aucuuuccuuaagggaagccccauccucucccaggaccaggaguuuaugaccaggcgagcacaa

SEQ ID NO: 229609 - RNA, 64 nt, Human
cuguguuguagucucucauauuuacucaaggagggaccaggaugauacagucaucugagguuau

SEQ ID NO: 229610 - RNA, 64 nt, Human
gccccucguggcaggacuugacaagggcaagcuugaccaggaagcugccaucagggaucuuccc

SEQ ID NO: 229611 - RNA, 64 nt, Human
aacgcccccucuguccuucccuggcccugcugccgaccaggagcugcccagccugugggcgguc

SEQ ID NO: 229612 - RNA, 64 nt, Human
agccugugcagguuuauauugggaagcuguagaggaccaggacuugugcagacgccacagucuc

SEQ ID NO: 229613 - RNA, 64 nt, Human
cugcuugccucucccuagcccacacgcagacuuugaccaggaguauccagccaggggcacacau

SEQ ID NO: 229614 - RNA, 64 nt, Human
uuccagucaugaucgggugggggacaugugggcugaccaggaccucugacccuggagcuucuac

SEQ ID NO: 229615 - RNA, 64 nt, Human
ccuccauuaugcaguacacggacaccuggcuacagaccaggacguggcuuguguucuguuccuu

SEQ ID NO: 229616 - RNA, 64 nt, Human
cccguuccuaccaaccaccagaacuggaugguggcaccccuaaugugcaugaggcauccuggga

SEQ ID NO: 229617 - RNA, 64 nt, Human
aguugcaaauagcaccaggaauuagauuucuguacaccccuaaucuagccuugugagcuucgcu

SEQ ID NO: 229618 - RNA, 64 nt, Human
aauucucuagaccuuggguacuuucaguacacaacaccccuaagauuucccagugguccgagca

SEQ ID NO: 229619 - RNA, 64 nt, Human
cuuuugauuuuagccaugccugcuccucugccuggaccaggaggagggccccuggggcagaagu

SEQ ID NO: 229620 - RNA, 64 nt, Human
auagcugagccaguugcccuccuagggcauguuugaccaggacugagucuggaaucuccaaguu

SEQ ID NO: 229621 - RNA, 64 nt, Human
accuaaauaucaaggccaggauuuucuaccuaaagaccaggacuuuuuaucuagagaccagcau

SEQ ID NO: 229622 - RNA, 64 nt, Human
ccccaaagacuggaauauucuacccaaaugucaggaccaggauuuucuacccagagaccaaggu

SEQ ID NO: 229623 - RNA, 64 nt, Human
ucccaaagaccaaaauauucuacccauaugucaggaccaggauuuucuacccagagaccaaggu

SEQ ID NO: 229624 - RNA, 64 nt, Human
ggcagacuaucaguguuugccucccaaaucccaggaccaggaugacaucaaaaaucagguagag

SEQ ID NO: 229625 - RNA, 64 nt, Human
ugggccgcugccuguucuccuguggcccaagugugaccaggaaggucucuuuccuuccuguugu

SEQ ID NO: 229626 - RNA, 64 nt, Human
cacuuugggaggccgaggcgggcggaucacuugagaccaggaguucgagaccagccuggccaac

SEQ ID NO: 229627 - RNA, 64 nt, Human
ucacucacagugcagggaaaggaggcagggaaaagaccaggauucugugaguucugagguugcc

SEQ ID NO: 229628 - RNA, 64 nt, Human
gcuagucacauaucaagucccgaggcagcaacaggaccaggagccagguguccugacuguccua

SEQ ID NO: 229629 - RNA, 64 nt, Human
gcacugggaacagagccacggguccuggguccuagaccaggacuuccugugugacccuggacaa

SEQ ID NO: 229630 - RNA, 64 nt, Human
cugaaggauugcgcacccugcacaaguacagauugaccaggaaaagacaagugucuucugugug

SEQ ID NO: 229631 - RNA, 64 nt, Human
uacugguugaguaucccucaucugaaaugcuuaggaccaggaguguuucaggcuucagauuuuu

SEQ ID NO: 229632 - RNA, 64 nt, Human
ggcccuagagugaacauuugguccauaugaaaaugaccaggaagacaauuaggugaagguuuuu

SEQ ID NO: 229633 - RNA, 64 nt, Human
gccuuggggcaugacccagugaagaugcagguuugaccaggaaagcagcgcuaguggaggguug

SEQ ID NO: 229634 - RNA, 64 nt, Human
aguaagggaaagcaggaguccaaaucuauuuguugaccaggaccuguggugagaagguugggga

SEQ ID NO: 229635 - RNA, 64 nt, Human
auucuagacauagacagggaugauccacuguuacugagggcaucagugcuauaaguuaaggcuu

SEQ ID NO: 229636 - RNA, 64 nt, Human
caggcccacugcacuccugucugggaggcccuuaugagggcagcccagcccccgcacccacccc

SEQ ID NO: 229637 - RNA, 64 nt, Human
aagggggcuuugggaggccaaggcgggcagaucaugagggcaggagauugagacccuccuggcc

SEQ ID NO: 229638 - RNA, 64 nt, Human
ccaugauugacaacagucaagcuguggaugaaaugaccaggaacggagaaugaaguauguaaau

SEQ ID NO: 229639 - RNA, 64 nt, Human
ccaaauauguaagugcagggggaaacacauuucagaccaggaauccacauugaaaaguuaacac

SEQ ID NO: 229640 - RNA, 64 nt, Human
ggaauauaaguagguguuggaugccuuuuuccuagaccaggaauggggaauauauaacaccugu

SEQ ID NO: 229641 - RNA, 64 nt, Human
gccaggaagcuucuuaacaugugacaggaccagggaccaggagcauggugaagccaaguggcag

SEQ ID NO: 229642 - RNA, 64 nt, Human
agacaccaccaaguucucugccugcaaaaccugggaccaggacuccugucugcauucccaaauu

SEQ ID NO: 229643 - RNA, 64 nt, Human
augccccauaauuauuauuuccaguguuugggaugaccaggaucccaagccuccugcugccaca

SEQ ID NO: 229644 - RNA, 64 nt, Human
uguuagcauuuaaaaguuuaaaaaaaaugcauuugaccaggauaaaugagguauguugaucaug

SEQ ID NO: 229645 - RNA, 64 nt, Human
aaucagcaguugaagccugacaggccucaguggugaccaggaacagaagcagccuuccuguuag

SEQ ID NO: 229646 - RNA, 64 nt, Human
gaucuuccacacgagugggauucuggccuucagagaccaggagggagugucugggccgcaggug

SEQ ID NO: 229647 - RNA, 64 nt, Human
cccuuccagacccagccaugcugugauaccggcggaccaggacugcagcucccgguaugcggcc

SEQ ID NO: 229648 - RNA, 64 nt, Human
guacaaaggaaacaggaauaauaaaggcaucacugaccaggaauaucugggcuuuauugauacc

SEQ ID NO: 229649 - RNA, 64 nt, Human
gaauuccucacucugacaugacaguauuuuuucugaccaggagcugaaagacccugacauucau

SEQ ID NO: 229650 - RNA, 64 nt, Human
uggacaacaagagcgaaacuccgucuuagaaguggaccaggacaggaccagauuuuggagucau

SEQ ID NO: 229651 - RNA, 64 nt, Human
aaacuuuccccuuuguuuagggguaggcuuugaugaccaggaaaaaaaaaaagguauuucugca

SEQ ID NO: 229652 - RNA, 64 nt, Human
ucugcacuauugcauaaucugagccagaguuugggaccaggaccuccugcuuuuccauacuuaa

SEQ ID NO: 229653 - RNA, 64 nt, Human
ugaccucucaccucccauggacagagaagaaaaugaccaggagugucaucuccagaauuauugg

SEQ ID NO: 229654 - RNA, 64 nt, Human
ccagagggugggagugggugcgcguguguguaugugagggcauguuguccauaucccuguggaa

SEQ ID NO: 229655 - RNA, 64 nt, Human
cagaaucgcuuucuguuuaguacuuuaguucuguugagggcaaaauauuauaaaucuauagaaa

SEQ ID NO: 229656 - RNA, 64 nt, Human
ccugucugccugcccagccaugcuccaucggcugugagggcagugcccggagaggccagagggu

SEQ ID NO: 229657 - RNA, 64 nt, Human
ugaguugcccaucauacgcaugguccuggaggaugaccaggacuaaugcaugugguaugaguag

SEQ ID NO: 229658 - RNA, 64 nt, Human
accaugcuguuuuguggcaugaauauagcccacugaccaggaauuauuuaaccaacccacugaa

SEQ ID NO: 229659 - RNA, 64 nt, Human
cuugagccuugggcagggugggugaggugcagaugaccaggagugugugaaugccuuccaggag

SEQ ID NO: 229660 - RNA, 51 nt, Human
agaugcggaagaggaugugaggaccaggacccagccccguggcuccuugau

SEQ ID NO: 229661 - RNA, 64 nt, Human
uuccaaaugagccuuucccuagggcuagaccuaagaccaggaaguuugagaaagcagccgcagc

SEQ ID NO: 229662 - RNA, 64 nt, Human
ggaugaagcagcuguaacugcccuaguguaguuugaccaggacauugucgugcuccuuccaauu

SEQ ID NO: 229663 - RNA, 64 nt, Human
agguggccugcgucuuuuuucucuucccuucccagaccaggaaaggcuuggcugguguaugcac

SEQ ID NO: 229664 - RNA, 64 nt, Human
aaggcaugagggggcucagaggcuccuugacugggaccaggauugggggccagggcuugaguag

SEQ ID NO: 229665 - RNA, 59 nt, Human
cacugcggccuggcugcugagggacgagagaccaggaugauuucgagguuggccuuaga

SEQ ID NO: 229666 - RNA, 64 nt, Human
gggucuggaccagaaucuguguauuucugucugggaccaggaagccgcagcugucccaucaucc

SEQ ID NO: 229667 - RNA, 64 nt, Human
uuaagcccugaggggucccugauaacaaccuggagaccaggauuuuauggcuccccucacugau

SEQ ID NO: 229668 - RNA, 64 nt, Human
uuuuaaagugugauguuuugccuuuccaccuaaagaccaggagagaauuugggcccuuacugac

SEQ ID NO: 229669 - RNA, 64 nt, Human
augagguuuugccuugggcugcuuugguacuucagaccaggacugagucugacacagcuuucau

SEQ ID NO: 229670 - RNA, 64 nt, Human
gccacacuguggcgggucggcggcccucaggagagaccaggaggacugacagcgaagaucgagc

SEQ ID NO: 229671 - RNA, 64 nt, Human
ggacagagcaaacagcaacaaggagcuggguguggaccaggagucagaggagggcaaaggcaaa

SEQ ID NO: 229672 - RNA, 64 nt, Human
aaccaggaaacugcuacuuguggaccucaccagagaccaggaggguuugguuagcucacaggac

SEQ ID NO: 229673 - RNA, 64 nt, Human
agcuaaaaauguaagagcaucaggccagaugauaugagggcacaggaaucagucauggaccuau

SEQ ID NO: 229674 - RNA, 64 nt, Human
guggcuccaguugcucugucucucguggucacccugagggcacucugcauccucugucauuuua

SEQ ID NO: 229675 - RNA, 64 nt, Human
ugcgccggcucauguucccuuuaguuuauuuuugugagggcaaaggggaggaaaugggguucug

SEQ ID NO: 229676 - RNA, 64 nt, Human
ccccucagcucagcacuguugaccacgcugcguaugagggcaucuuggguaucccacuccuucu

SEQ ID NO: 229677 - RNA, 64 nt, Human
gucagucaccaugugugggcucagggacccccaggaccaggaugugucucagccuggagaaaug

SEQ ID NO: 229678 - RNA, 64 nt, Human
agauucauuuaauuuuccugugguugaccuauacgaccaggauguagaaaacuagaaagaacug

SEQ ID NO: 229679 - RNA, 64 nt, Human
agcuuuugcaguuuaaaauguugggaugccugaggaccaggagccaccacccacugggguguug

SEQ ID NO: 229680 - RNA, 64 nt, Human
acucccugggguuggcaggggcuccaucucaguggaccaggaagcaagaggggaagcgggaucc

SEQ ID NO: 229681 - RNA, 64 nt, Human
ugcuucuaauauuuauugcuuuauaaauaaaccagaccaggacuugcaaccuauaaaagccucu

SEQ ID NO: 229682 - RNA, 64 nt, Human
uuccacccaggggacucccagaagccaguagagagaccaggagccaccucaaucagcaggacag

SEQ ID NO: 229683 - RNA, 64 nt, Human
gugacuggcccacacgugcauagaggucugggaggaccaggaaacagccucaguggccagagga

SEQ ID NO: 229684 - RNA, 64 nt, Human
uggaaaagcuuuaaauuaaaaaaaauuuuuaaaagaccaggaccucaagauagcagguuuauac

SEQ ID NO: 229685 - RNA, 64 nt, Human
cagaacaugagaugagccagccgagccagacugugaccaggaaacagcucaucccagagaagga

SEQ ID NO: 229686 - RNA, 64 nt, Human
ucugagauguggagacugauggccaggcaagugggaccaggauacuggacgcuguccugagaug

SEQ ID NO: 229687 - RNA, 64 nt, Human
ccagaccgcccugguggugcaggcugugaagaaagaccaggagggggauucagcagcugccuua

SEQ ID NO: 229688 - RNA, 64 nt, Human
gggcuucuccccaggagaccacgcugcccuccaagaccaggagcagcugugagcuggagacagc

SEQ ID NO: 229689 - RNA, 64 nt, Human
ucgggaggcugagugaggcaggaggaucacuugagaccaggagguuguggcuguagugagugau

SEQ ID NO: 229690 - RNA, 64 nt, Human
cuuccacgagaugcacguggcucuggcccagaaggaccaggagaucgccuuccugcgcuccaug

SEQ ID NO: 229691 - RNA, 64 nt, Human
cuauucaggaggcugaggcaggagaaucacuugagaccaggaaguugaggcugcaaugagccgu

SEQ ID NO: 229692 - RNA, 64 nt, Human
agcuuugggaggccaaggugggaggaucgcuugagaccaggaguucgagaccagccugggcagc

SEQ ID NO: 229693 - RNA, 64 nt, Human
gagucgggaggccccugccuucuguccuccauggugagggcacagaugucuccccagagcccag

SEQ ID NO: 229694 - RNA, 64 nt, Human
ggagucaaggucccccucucccaggcaggcucucugagggcauucuguagucccaggcccacug

SEQ ID NO: 229695 - RNA, 64 nt, Human
uuacguucucucuugcccagggugggccugguccugagggcaggacaggggguuuggagaugug

SEQ ID NO: 229696 - RNA, 64 nt, Human
cauaguguguguuuagaccacagcggauguuguagaccaggaccauagaugauacaugucagug

SEQ ID NO: 229697 - RNA, 64 nt, Human
ucuccagguuaagaagcugccagaccuugccagggaccaggagcucucacuuugccuaagagac

SEQ ID NO: 229698 - RNA, 64 nt, Human
ucaggguggagacacaucgggaucugucauccuggaccaggauacuuguucaggguugccaugc

SEQ ID NO: 229699 - RNA, 64 nt, Human
acuuucuagccaggccugaugaguuaaguuacaugaccaggaagguuaugccacuuugugguca

SEQ ID NO: 229700 - RNA, 64 nt, Human
agagaaugccacugcuugguuauugguccccuuugaccaggaaacccaagaggagacaccucag

SEQ ID NO: 229701 - RNA, 64 nt, Human
guuucgcuggcacucuuccagcucccuggggguugaccaggagccggucagagauggaccuggc

SEQ ID NO: 229702 - RNA, 64 nt, Human
uaggggccgggggcuucugcccagggcuccccuggaccaggacgccagguagggcagggaaccu

SEQ ID NO: 229703 - RNA, 59 nt, Human
gccugggcauccggugguaggggcugcaggaccaggacucccaggaggccguguccaug

SEQ ID NO: 229704 - RNA, 64 nt, Human
cuacugacuacuggaucuuaagacccaugucuaggaccaggagucagcauaaggacgcugaccu

SEQ ID NO: 229705 - RNA, 64 nt, Human
gagcauguaccgcaggccagggcaggccccgcccgaccaggaggcccugcagguaauacaggug

SEQ ID NO: 229706 - RNA, 64 nt, Human
ugcauugaacaguccuguggaaaggccaagcagugaccaggaagagggagaaacuucugcucag

SEQ ID NO: 229707 - RNA, 64 nt, Human
aaugaccaaauaacuauguauauugaucugcuaagaccaggauuuuucugauauggcacaugcu

SEQ ID NO: 229708 - RNA, 64 nt, Human
ccuuucaaccucuagagagaccagcugccuuugagaccaggagcugagcaccgagaaccaucug

SEQ ID NO: 229709 - RNA, 64 nt, Human
cuggguccuugagguuuguacguuucucuuugaugaccaggaagaaaucccagcaccccagcca

SEQ ID NO: 229710 - RNA, 64 nt, Human
ccgugauuuggcgcuccaacagaaaggcuugggugaccaggagcaucuuucaugaaugguucac

SEQ ID NO: 229711 - RNA, 64 nt, Human
ucuuuaugaugaccaccuugggccuugggaucaugaccaggaaucacgugaagcugacaccacu

SEQ ID NO: 229712 - RNA, 64 nt, Human
aggcgccagaagcuacugaggaggcugaagguagugagggcaagugggcugcacuccuuucucu

SEQ ID NO: 229713 - RNA, 64 nt, Human
gccagucacuggucugggggguggaggccugagcugagggcagggugccugaccugugugccgg

SEQ ID NO: 229714 - RNA, 58 nt, Human
aaguuccugacacaugguaaccaagaccugagggcagcaaaccgcuggugcugucgcu

SEQ ID NO: 229715 - RNA, 64 nt, Human
ccuguucccagagucugcagccaucagcaaggaggaccaggaacccggcgacugaggugcuucc

SEQ ID NO: 229716 - RNA, 64 nt, Human
ccagcccuuugggaagcugaggcaggaggauugagaccaggaguucgagaagagccugggcaac

SEQ ID NO: 229717 - RNA, 64 nt, Human
ucccaaacccaccaguucuccacugucucuucuggaccaggaauuaguugcugugggugccaca

SEQ ID NO: 229718 - RNA, 64 nt, Human
gcuuuggccaaccuagccaaggcugcagcauauagaccaggaaaucagguagcccagacuggug

SEQ ID NO: 229719 - RNA, 64 nt, Human
guauauuauauuucaucauuuaggaggcuggcaugaccaggacuuaugggugggaggggagcau

SEQ ID NO: 229720 - RNA, 64 nt, Human
gcugggcuccuguggagggagaauuggugacuuugaccaggagugucagcuuuuagaaggauca

SEQ ID NO: 229721 - RNA, 64 nt, Human
gggaucugaguuucugcaggucauuuguauguaggaccaggaguaucuccucaggugaccaguu

SEQ ID NO: 229722 - RNA, 64 nt, Human
guaaggaaagaggcaggcugagcugggggcucuggaccaggaagaugcucugacagaugccaug

SEQ ID NO: 229723 - RNA, 64 nt, Human
gggagcaaguggccuggucacuucugguucgauugaccaggaucguggugucacuuuuuaaaau

SEQ ID NO: 229724 - RNA, 64 nt, Human
uucagguaaaugucacacugugcccagaauggaugaccaggaaccuuaaagaguggcugaaaag

SEQ ID NO: 229725 - RNA, 64 nt, Human
acccuuccacuguacuucucaaaguugguuauuagaccaggaaaacuuaauguaauauuauuuu

SEQ ID NO: 229726 - RNA, 64 nt, Human
cucuggcuuugccuuggcuuugccagggcucugugaccaggaaggaagucagcaugccucuaga

SEQ ID NO: 229727 - RNA, 64 nt, Human
cucccuuugcugaccaccagcccaagggagcuaagaccaggagggggcugggcgcugucccuuc

SEQ ID NO: 229728 - RNA, 64 nt, Human
ggugggaggagcgaaaguggggguguccuggggagaccaggaaccugccaagcccaggcugggg

SEQ ID NO: 229729 - RNA, 64 nt, Human
uucacuucagugagaggauuggcugugagcuucagaccaggaaaugugucaucuugccaggcac

SEQ ID NO: 229730 - RNA, 64 nt, Human
caaugcaagaugcucugauagcauuugcuaacaggaccaggaggaucuaaaaaggaccagccua

SEQ ID NO: 229731 - RNA, 64 nt, Human
cauuaaggacagacuugaggaauaaaaaugaccuugagggcaccaaucugugagggaaguuagg

SEQ ID NO: 229732 - RNA, 64 nt, Human
ugcuaaugugagaauauaaauugugggaaaugagugagggcaaggugguacuuccuccuucuga

SEQ ID NO: 229733 - RNA, 64 nt, Human
uauuucucuauguuuauucuaguuaaggaaauguugagggcaagccaccaaauuaccuaggcug

SEQ ID NO: 229734 - RNA, 64 nt, Human
cuugcuuggauuuaaaacuuuuuuggaagugagagaccaggagcacuacagagaauuuccagag

SEQ ID NO: 229735 - RNA, 64 nt, Human
cccuccccuaaccuuggugccugauccauccccagaccaggacagcagccacucaguucuuccu

SEQ ID NO: 229736 - RNA, 64 nt, Human
aagaggggccaccuguucucaaaagcauguuggggaccaggagguaaaacuggccauuuauggu

SEQ ID NO: 229737 - RNA, 64 nt, Human
uacuuuuuugguaaaggaacaagcugcuggccuugaccaggaguucauauauaacuguuauuac

SEQ ID NO: 229738 - RNA, 64 nt, Human
uccucgugaaggauaagagaaacaggcccggggggaccaggaugacaccuccauuucucuccag

SEQ ID NO: 229739 - RNA, 64 nt, Human
gccaaggcuccagcuucuucccccagcugcucccgaccaggagggggagagcagccuccacuua

SEQ ID NO: 229740 - RNA, 64 nt, Human
gcggcucccgaggguccaggccccgcccccaaaggaccaggacucgccccaaagaucccgaggg

SEQ ID NO: 229741 - RNA, 64 nt, Human
cucccaaacccugagcaaggcaaccgaucgccaggaccaggaagcaucacccaggagauuuggc

SEQ ID NO: 229742 - RNA, 64 nt, Human
gccucugcccuuguccuguggguugagggggucugaccaggaggccaccuacagcaggaaguga

SEQ ID NO: 229743 - RNA, 64 nt, Human
aagaucucacucugccccccccccccaucuucgggaccaggauuugcacagaagcacaugcacc

SEQ ID NO: 229744 - RNA, 64 nt, Human
ggaggaaggucagggcuccugagcagcaauaaaggaccaggaagaggccugagguguauuugag

SEQ ID NO: 229745 - RNA, 64 nt, Human
uacuacgcuuuucccauggucuucgcaacccacagaccaggagaucccccuugggugccuaugc

SEQ ID NO: 229746 - RNA, 64 nt, Human
gugagcgggcuccgcugcccccugcccugcacuggaccaggagucuggagaugccuggguagcc

SEQ ID NO: 229747 - RNA, 64 nt, Human
cccucuggcgucucuagaaacugcugcugauggagaccaggacagagcccgcccccacccggcc

SEQ ID NO: 229748 - RNA, 64 nt, Human
uguauuuuugguagagacgggguuucaacauguugaccaggauggucucgaucucuugaccucg

SEQ ID NO: 229749 - RNA, 64 nt, Human
uguauuuuuaguagagaugggguuucaccauguugaccaggauggucucaaucuccugaccuug

SEQ ID NO: 229750 - RNA, 64 nt, Human
guaaugaagaggcagcugaugccaugcacuugucugagggcauagcuccaugucuucugacauu

SEQ ID NO: 229751 - RNA, 64 nt, Human
agggagaccuggccggccugagggcuggcagaugugagggcaggacaccugggauggacucgua

SEQ ID NO: 229752 - RNA, 64 nt, Human
gugggaagaagggaggggaugggguugggagaggugagggcaggauuaagauccccacugucaa

SEQ ID NO: 229753 - RNA, 64 nt, Human
cuacucaggaggcuugggugggaggauugccugagaccaggagguugaggcugcagugagccgu

SEQ ID NO: 229754 - RNA, 64 nt, Human
cauuaacauuuauugaaacaagucacucugagaagaccaggaacaaaguucucuuggcagaucu

SEQ ID NO: 229755 - RNA, 64 nt, Human
cucccacuagggacucugcgcuaauuaccugagcgaccaggacuacauuucccaagaggcucug

SEQ ID NO: 229756 - RNA, 64 nt, Human
ugugauccacccugacuaugaugccgccagccaugaccaggacaucaugcuguugcgccuggca

SEQ ID NO: 229757 - RNA, 64 nt, Human
acugaauguggcaaggucuuaagguaaaaucugagaccaggauucuucaaagaauucuugcugg

SEQ ID NO: 229758 - RNA, 64 nt, Human
ggacguugccagaggggaccagggccagagacgggaccaggaaggaacugaggaccaagaagug

SEQ ID NO: 229759 - RNA, 64 nt, Human
caccauagucuucugcucugguccuccacggguggaccaggauggagucuccugccuaccucac

SEQ ID NO: 229760 - RNA, 64 nt, Human
uacuuuaggacauggaagggggaggaucacuugagaccaggaguugugaggucaaccugggcaa

SEQ ID NO: 229761 - RNA, 64 nt, Human
gccaacuucaaguaagcggcaacaaggguccguggaccaggaggauugccuuuaauauuuugua

SEQ ID NO: 229762 - RNA, 64 nt, Human
augccaccugucugccugggcuccaagugggcaggaccaggacagaaccacaggcacacacuga

SEQ ID NO: 229763 - RNA, 64 nt, Human
caaaugaagcaguuauguguuguccaguuuuccagaccaggacugaaauccagagagggucagg

SEQ ID NO: 229764 - RNA, 64 nt, Human
aguuggaccaugugggacccugauggaccugaaagaccaggaucgguccagcucagauauugag

SEQ ID NO: 229765 - RNA, 64 nt, Human
cacccgaggcugugcagaaggguagguucagguugaccaggaagcugccaaaagggacauggau

SEQ ID NO: 229766 - RNA, 64 nt, Human
ucuccguggaugaaauagaaacuccucauugugugaccaggaaugguuaaaucaucuuuacaaa

SEQ ID NO: 229767 - RNA, 64 nt, Human
uagggauucaggcugcuugggauaaagaugcaaggaccaggacucccuccucaccucuggacug

SEQ ID NO: 229768 - RNA, 64 nt, Human
caggagccauggcauaugacaaagaccaaugagggaccaggaaaaaaagugauguccccuuucc

SEQ ID NO: 229769 - RNA, 64 nt, Human
gacuaacacucagaagccugggggccuggcuggcugagggcaguucgcagccacccugaggagu

SEQ ID NO: 229770 - RNA, 64 nt, Human
gucacucuuaccgucaugucuugcaacaacccugugagggcaguauuaaugcccccuuacagca

SEQ ID NO: 229771 - RNA, 64 nt, Human
uuucucuucuuuacauuuucuacagcauucuguaugagggcaccaaauaaauccaucuagcugg

SEQ ID NO: 229772 - RNA, 64 nt, Human
cuggagccuucuggacuggccagcccagcgcaaagaccaggacuugucuccuccuggacuuggg

SEQ ID NO: 229773 - RNA, 51 nt, Human
caucccaagacuucaauugaagaccaggaugagcuguccucucuucuucaa

SEQ ID NO: 229774 - RNA, 64 nt, Human
ggggacaggaacacccagccccagcgagucuggagaccaggacucugccuuccaggcguagggc

SEQ ID NO: 229775 - RNA, 64 nt, Human
ccggggcggccaggcuggcccaacggacagacaggaccaggaucacaccuccaggcgccucugg

SEQ ID NO: 229776 - RNA, 64 nt, Human
uccagcgagaggccagggcuuggagugggccugggaccaggaaggaccucuaggcuguggcugg

SEQ ID NO: 229777 - RNA, 64 nt, Human
cccucagaagguggggcaggcucuuugucuuggggaccaggaugcucccccaguccuucccaga

SEQ ID NO: 229778 - RNA, 64 nt, Human
uucucaccauuccugugguaccugcgaguguuaugaccaggauuccuuaaaccugaacucagac

SEQ ID NO: 229779 - RNA, 64 nt, Human
ugcgaaguucuccaaacccauuuauuacuggcuugaccaggacaaauccuuucagugacaggac

SEQ ID NO: 229780 - RNA, 64 nt, Human
acugacugccacacauccgccauggugccacggggaccaggaccccacagcgcacccccccucc

SEQ ID NO: 229781 - RNA, 64 nt, Human
cugacaagcaauccagggacaagauacucaccaggaccaggaaggggacucugggggacuggcu

SEQ ID NO: 229782 - RNA, 64 nt, Human
cugacaagcaauccagggacaagauacucaccaggaccaggaaggggacucugggggaccggcu

SEQ ID NO: 229783 - RNA, 64 nt, Human
ccagcaaaaaccuucagcucucagaggagauugggaccaggaaaaccugggaggaugggcagac

SEQ ID NO: 229784 - RNA, 64 nt, Human
cccugccuccugccggcuccuugguucuugaggggaccaggaguggguggggaguggggguggg

SEQ ID NO: 229785 - RNA, 64 nt, Human
cacuuugggagguccaggcagguggaucucuugagaccaggaggucaagaccagccuggccaac

SEQ ID NO: 229786 - RNA, 64 nt, Human
gggacccagcuugucucggcagcuaagaagcagugaccaggauguggauuuuggcgaccugugu

SEQ ID NO: 229787 - RNA, 64 nt, Human
aaaaaaacauagacucaagacccaagauucaauggaccaggagaaaggggggcggugaucaggu

SEQ ID NO: 229788 - RNA, 64 nt, Human
uggccagcuaagagccugccucaccccuuaccaaugagggcaggggaagaccaccuggcaugag

SEQ ID NO: 229789 - RNA, 64 nt, Human
agaaugcugacacuuuuucagggcugugauugagugagggcauggguaaaaauauuucuuuaaa

SEQ ID NO: 229790 - RNA, 64 nt, Human
acauggcauauaccacccaucucuggucuggggcugagggcaaggacugcacuaguccagggag

SEQ ID NO: 229791 - RNA, 64 nt, Human
caggauuggccugcugcuaggggccaggggcccugaccaggaagacagguggguuccuguagcc

SEQ ID NO: 229792 - RNA, 64 nt, Human
agcagcugggcacagaggagcgcucuuccaucuugaccaggacugcaccaagaagcaccaggug

SEQ ID NO: 229793 - RNA, 64 nt, Human
ggaggagagggaggcugcagaugccugggacucagaccaggaagcugugggcccuccugcucca

SEQ ID NO: 229794 - RNA, 64 nt, Human
agagagggaggcacguaggaacaagcaaugagaagaccaggaaaagaaagagcugaaaauggag

SEQ ID NO: 229795 - RNA, 64 nt, Human
agggacugucgcugugaucagaguggguuaagcugaccaggaacacccauuuaaccccuuuuuc

SEQ ID NO: 229796 - RNA, 64 nt, Human
cagugagcuccccugggaaaaccgaagccagcaagaccaggagagggccaccucacugggccug

SEQ ID NO: 229797 - RNA, 64 nt, Human
ggauguuugagaugcauggcaagaccagcaacuugaccaggaucugggcugugagcagcagcca

SEQ ID NO: 229798 - RNA, 64 nt, Human
gccuccccccaccccgcccuguccgacuguaacagaccaggaggguggcggaggaacuccugcc

SEQ ID NO: 229799 - RNA, 64 nt, Human
ccuugggacugugucucauguuugugugaauguagaccaggaaagggggcugcaaaaauguuga

SEQ ID NO: 229800 - RNA, 64 nt, Human
ugaaaaggaaauuaccuugcaauaaaguuggugggaccaggaaguagagaaaaaaaaaguaaaa

SEQ ID NO: 229801 - RNA, 64 nt, Human
ggaaucuuccaucgaacauacucaaacacuuuuggaccaggauuugagucucugcaugacauau

SEQ ID NO: 229802 - RNA, 64 nt, Human
uuguuauacaagaggugcuuaugcuuagcuugaugaccaggauguuauuuuuaacaaaaugauu

SEQ ID NO: 229803 - RNA, 64 nt, Human
cauuuugggaggcuaaggcagggagauggcuugagaccaggaguucaagaccagccugggcaac

SEQ ID NO: 229804 - RNA, 64 nt, Human
agagaaggaaagagagagagaaagaaagucuccagaccaggaauguuuuugucccacugacuua

SEQ ID NO: 229805 - RNA, 64 nt, Human
uuguuuccucuuuucaccagccuaaggccuggcugaccaggaagccaacguuaacuugcaggcc

SEQ ID NO: 229806 - RNA, 64 nt, Human
caauaguuaucauucugucuacaugaacaaucaagaccaggacucagggaacuuuacucuguaa

SEQ ID NO: 229807 - RNA, 64 nt, Human
ggcaggcauggcuggugccugaagaccccagaugugagggcaccaccaagaauuuguggccuac

SEQ ID NO: 229808 - RNA, 64 nt, Human
acaaaagggcugucaaagucaccauucuuuuugaugagggcagcguaauuacauugccuuuugu

SEQ ID NO: 229809 - RNA, 64 nt, Human
gacauggucuccucugauuaucagguacuggggcugagggcauuaaaaauaguaagccucccuc

SEQ ID NO: 229810 - RNA, 64 nt, Human
acccucccacgggguggaaauggccuggaggaugugagggcaccccuccucugaagaucccugu

SEQ ID NO: 229811 - RNA, 64 nt, Human
acaguguguuucccugugagcuagcagacacaaugaccaggaaaaaaccuaugaauuccauucu

SEQ ID NO: 229812 - RNA, 64 nt, Human
acgggcacggccuccccacggccuguccgggaaagaccaggaccugcucgagccuccuggccgc

SEQ ID NO: 229813 - RNA, 64 nt, Human
cgguuuuuuuacaugauuuaaggaaagacuuuuaugucagaacuuggugccuguaccgucaacc

SEQ ID NO: 229814 - RNA, 64 nt, Human
uaguggcuuucuggaugguaauuccaucuuaaggugucagaacuauuuucaaaugcugccuuug

SEQ ID NO: 229815 - RNA, 64 nt, Human
cccaucugcugaacccugacugguaaacaacugcugucagaaaagggcugggcuugggaagggg

SEQ ID NO: 229816 - RNA, 64 nt, Human
ccucccaguacuaguuaauuuugaguaauuguauugucagaaaagugauuaguacuauuuuuuu

SEQ ID NO: 229817 - RNA, 64 nt, Human
cccaccaggguauguaaauaucucuuuucuaccaugucagaauauuuuuuccucacuccugaca

SEQ ID NO: 229818 - RNA, 64 nt, Human
cugcucauuccgagggugaaacaaaauccaacccugucagaaucaugcuguucucuuugcugac

SEQ ID NO: 229819 - RNA, 64 nt, Human
ccccugggcugcccccugccccauccccuuugagugucagaagcacucugagccaaggggacag

SEQ ID NO: 229820 - RNA, 64 nt, Human
agaguuacuuucugguacccaguauauuggagucugucagaaacucuauaauaggccaccaguu

SEQ ID NO: 229821 - RNA, 64 nt, Human
acacaugcgggcaccuucaucguguguggcccacugucagaacuuaauaaaagucaacucauuu

SEQ ID NO: 229822 - RNA, 64 nt, Human
caguucuauccaacagaaacuguaucuuucuguuugucagaaguucuccguuaguuccuguauu

SEQ ID NO: 229823 - RNA, 64 nt, Human
cauauuuuuaaauuuuggacuuuaagcaucuuaaugagggcauauaacaaauuaauuuuaguac

SEQ ID NO: 229824 - RNA, 64 nt, Human
cuggcuggaaacgucuguaugcagggagccagggugagggcagaguguggugacagccgaacuu

SEQ ID NO: 229825 - RNA, 64 nt, Human
acaagagucuguguuuucagccucuguauacaauugagggcagucuagcccuuuggaugaaauc

SEQ ID NO: 229826 - RNA, 64 nt, Human
augagauauauagauauauauccauacauuuuauugucagaauuuagacugaaacuacacauug

SEQ ID NO: 229827 - RNA, 64 nt, Human
uccagggcacaccuagacaaacaagggagaagagugucagaaucagaaucauggagaaaauggg

SEQ ID NO: 229828 - RNA, 64 nt, Human
aaauuugguacaaaaccacucgccagagcuguggugucagaaaaauaaaauauauuguuucuua

SEQ ID NO: 229829 - RNA, 64 nt, Human
guucuagcuucuccugccccugguggggaugggcugucagaauugcaagggaggaaggcugggg

SEQ ID NO: 229830 - RNA, 64 nt, Human
uagaacaguuuuaugauuuauuugucuaggaguaugucagaaaaaucaggcuuuuaguaggaau

SEQ ID NO: 229831 - RNA, 64 nt, Human
agcaaagggauaaaacuuagauggcagcuuguacugucagaaucccguguauccauuuguucuu

SEQ ID NO: 229832 - RNA, 64 nt, Human
cuuugacuuugcccaggcaugaaauucuuccuaaugucagaacagagugcaacccagucacacu

SEQ ID NO: 229833 - RNA, 64 nt, Human
aguggaaauguuccauaagggagaguucaaggccugucagaaggcucugguaggccuuccucug

SEQ ID NO: 229834 - RNA, 64 nt, Human
acuugaggagaaaaccuuuacaauuuccuaugggugucagaaguacucucagcgaaaacugaug

SEQ ID NO: 229835 - RNA, 64 nt, Human
caaaugggcauuuauauaaacuugugauguuucuugucagaauucugaguacucugugaagaac

SEQ ID NO: 229836 - RNA, 64 nt, Human
cagcccuacugagugaaauugggauacauuuggcugucagaaauuauaccgagucuacugggua

SEQ ID NO: 229837 - RNA, 64 nt, Human
aaaauauuacuuauuuauccuaguauuccuaaccugucagaauaauaaauauuggaaccaagac

SEQ ID NO: 229838 - RNA, 64 nt, Human
auccagucagagcaaaaugguuaauugcccaguuugucagaaugaaguucuggagucucagauu

SEQ ID NO: 229839 - RNA, 64 nt, Human
cccuuuggcaaaaggcaugcgcucacugcuugcuugucagaaacacugaagccauuugccccag

SEQ ID NO: 229840 - RNA, 64 nt, Human
uaguucuuugauauuuuauacuuuuuauguaccaugucagaaagaguauguuggcguuugucau

SEQ ID NO: 229841 - RNA, 64 nt, Human
gauccuugucugccuucacuucccuaggcugggcugagggcaaccuugccccccacccaagaag

SEQ ID NO: 229842 - RNA, 64 nt, Human
gccauggccgggcucaggggccuuugagcuggccugagggcacuuucgcuuccuggccgguacu

SEQ ID NO: 229843 - RNA, 64 nt, Human
aaagaagacauagcgccugccagggaauaggaaaugagggcacuuacacauuaaugugaauuag

SEQ ID NO: 229844 - RNA, 64 nt, Human
accaggacuccuaucgagagcucuucagacacuuugucagaacccuuaaaggugggugacguuu

SEQ ID NO: 229845 - RNA, 64 nt, Human
uuaaaguggagauucugaaguggaaaauagguacugucagaacaaagcuaccuggaaacagcau

SEQ ID NO: 229846 - RNA, 64 nt, Human
ccuuuuccagaaauaccugucuaggaaggugugaugucagaaacaaugacauccagaaagcuga

SEQ ID NO: 229847 - RNA, 64 nt, Human
gaaccaacuuucuagcugcuguugaagaauauauugucagaaacacaaggcuugauuugguucc

SEQ ID NO: 229848 - RNA, 64 nt, Human
uauaauaaugccuggucguugggugaccugcgauugucagaaagaggggaaggaagccagguug

SEQ ID NO: 229849 - RNA, 64 nt, Human
ggaugcucugguggagcugccgauggggcccuggugucagaacuccccaaaggccugugcgucc

SEQ ID NO: 229850 - RNA, 64 nt, Human
uucacuaguccaagccaaaaauuuuaagaugauuugucagaaagggcacaaaguccuaucaccu

SEQ ID NO: 229851 - RNA, 64 nt, Human
aaccacuaucuuucccuuuuauuugauuauuuuaugucagaaauuugcaaaaguuuuuuucucc

SEQ ID NO: 229852 - RNA, 64 nt, Human
uguugguaagucagugcaguugcauaagcagugcugucagaauugguuuggugcaggcaauaga

SEQ ID NO: 229853 - RNA, 60 nt, Human
cuguggaugaagaagccuaagccccucuggugucagaaaccagggaaaacccuugucuuu

SEQ ID NO: 229854 - RNA, 64 nt, Human
uucuguucuuuuuuuacagauacuuuuaaaguuuugucagaaaagagccacuuucaagguagga

SEQ ID NO: 229855 - RNA, 64 nt, Human
gcucauguuucuuaaggaaguagaguaguccuugugucagaacacauguuaauccacaaaacgc

SEQ ID NO: 229856 - RNA, 64 nt, Human
gagacuuggccauaaagauaaugcugcauuuuucugucagaaucacauaugauguguguucugu

SEQ ID NO: 229857 - RNA, 64 nt, Human
aaggucuaaaugacuaaacuucaaaguaagauuuugucagaauaaauugagaccauuaaucuaa

SEQ ID NO: 229858 - RNA, 64 nt, Human
acuuuacauagcagcgguuccugucauguguucaugucagaauauuuuugguuuuaaacuuucu

SEQ ID NO: 229859 - RNA, 64 nt, Human
gcuuugcucugacaccaugacagcugcccggggcugagggcagcuggcuccacucaaaugagga

SEQ ID NO: 229860 - RNA, 64 nt, Human
acuuaccuacauacacugcauguagaugauuaaaugagggcaggcccugugcucauagcuuuac

SEQ ID NO: 229861 - RNA, 64 nt, Human
uugggacagaguaucccccgcaggcggaaguagcugagggcaagggucccgaugagggucccau

SEQ ID NO: 229862 - RNA, 64 nt, Human
ggaauuucaaugcguuuuguuguagaugcuaacgugucagaauccuuuacauucaacuuuucua

SEQ ID NO: 229863 - RNA, 64 nt, Human
cugguaguacucuaauggugaaaaccuguggagcugucagaagacaugaacuugcuuuuccucu

SEQ ID NO: 229864 - RNA, 64 nt, Human
augugaccugcaguauuuuuuuuucuaauguauuugucagaaaucuguuguagacuguuaacuu

SEQ ID NO: 229865 - RNA, 64 nt, Human
acuugugggacaaaaauccuuucuucuguuaauaugucagaauguaagauuuggcaacucgaua

SEQ ID NO: 229866 - RNA, 64 nt, Human
cuuaauugcucuuuuguuauaggguauggaucauugucagaacuugauuggagggguuuaaaga

SEQ ID NO: 229867 - RNA, 64 nt, Human
guauuuuguaaacguuagcagacuuuccugccagugucagaaaauccuauuuaugaauccuguc

SEQ ID NO: 229868 - RNA, 64 nt, Human
uguuaauuuguuauguauauagaugugcaagucuugucagaauuggccucaguguaguuaaagg

SEQ ID NO: 229869 - RNA, 64 nt, Human
gggucaauaguuucccaauuucaggauauuucgaugucagaaauaacgcaucuuaggaaugacu

SEQ ID NO: 229870 - RNA, 64 nt, Human
aguaaauaauggcugaccagcaugagggcaguacugucagaaauuucuuugagcugugagaugg

SEQ ID NO: 229871 - RNA, 64 nt, Human
ugggugggaauaaaauggaagugcacagaggagaugucagaagaccaaaacuuggugaauaguc

SEQ ID NO: 229872 - RNA, 64 nt, Human
ucaucaucuuguugugggcaugaggaggugcugaugucagaagaaauggcucgagcucagaaga

SEQ ID NO: 229873 - RNA, 64 nt, Human
guguuugaaaacugacaucagauuucuuaaugucugucagaagacacuaauuccuuaaaugaac

SEQ ID NO: 229874 - RNA, 64 nt, Human
ccagguugaguggggcucacacgcuagggugagaugucagaaagcgcuuguauuuuaaacaacc

SEQ ID NO: 229875 - RNA, 64 nt, Human
auauguuuuacuugaauguuacauuagauauuggugucagaauuuuaaaaccaaauuacugcuu

SEQ ID NO: 229876 - RNA, 64 nt, Human
uuuaagcaagguaauguguaaaaucagucucggcugucagaauaacuucuaaaagguauuuuua

SEQ ID NO: 229877 - RNA, 64 nt, Human
cccaagcccucccugagccguucuccugagucccugagggcagacacagcuccagggacccagg

SEQ ID NO: 229878 - RNA, 64 nt, Human
gaaaauaacaugacgcucguccaaggccacuuccugagggcaaguccuaauagcccugagacac

SEQ ID NO: 229879 - RNA, 64 nt, Human
cauuuuuuuucccacaauccaagcugccauauuuugagggcagggggaguuuuauucuacaccc

SEQ ID NO: 229880 - RNA, 64 nt, Human
uuucauuuguccuuuucugcuaucaccuuccucuugucagaaugaauauagacacuguaucuaa

SEQ ID NO: 229881 - RNA, 64 nt, Human
gcuccucuggcccaaggcaugaggagagaggcugugucagaaacugaagcuguucucaggauca

SEQ ID NO: 229882 - RNA, 64 nt, Human
auaacugggcaagcauggaugacauauuaauauuugucagaauuaagugacucaaagugcuauc

SEQ ID NO: 229883 - RNA, 64 nt, Human
ugaugaaagugauuuuucugcuuuaccuuuuuccugucagaaagguuuuccucugugcuacccu

SEQ ID NO: 229884 - RNA, 64 nt, Human
cagaaggaaaauuucagaagaccaguacuggagcugucagaaugcaaccaaaaucagcugaguu

SEQ ID NO: 229885 - RNA, 64 nt, Human
uaucgaauauuuuuuagacuuaaguuuuaucuucugucagaaugugaaaaguucugcccaguuu

SEQ ID NO: 229886 - RNA, 64 nt, Human
ucauuucuaaauguuuuauaauuucucauaucaaugucagaaguauccuggaaacauaugucac

SEQ ID NO: 229887 - RNA, 64 nt, Human
caauaugcugguuucuguaggguauuuuuaauuuugucagaaauuuuagauugugaauauuuug

SEQ ID NO: 229888 - RNA, 52 nt, Human
caacaaaagauguuuuaugaaaugucagaaauauuaacaaaaauucucagca

SEQ ID NO: 229889 - RNA, 64 nt, Human
ggaaagcagccucaaagaauuaccccucccaaaaugucagaagugcugaggcugagaaacccug

SEQ ID NO: 229890 - RNA, 64 nt, Human
ccaagugaaauuguuauaucgucugucuugcgugugucagaacuggguuuuuguggagguucag

SEQ ID NO: 229891 - RNA, 64 nt, Human
uguccagcugggaccuaaugcuggccugacugguugucagaauggaauccaucugucucccucc

SEQ ID NO: 229892 - RNA, 64 nt, Human
aaaaguaugaguuccauaccuucuaauuuuaggcugucagaaauuccuuuauucuuugggauuu

SEQ ID NO: 229893 - RNA, 64 nt, Human
gccuacaaagccuaauuauuuacugucugguuuuugucagaaaaaaguuugucaauccuuguuu

SEQ ID NO: 229894 - RNA, 64 nt, Human
caucacguaaauugguuuuguuugcuauucugugugucagaaccaacgaguguaauggagaggg

SEQ ID NO: 229895 - RNA, 64 nt, Human
ggcuggagcuaguacugacugacauucauugugaugagggcagcuuucugguacaggauucuaa

SEQ ID NO: 229896 - RNA, 64 nt, Human
guacauuugauuuuuaauagccuuuccaaagaaaugagggcaugauuauuguacaguaaguacg

SEQ ID NO: 229897 - RNA, 64 nt, Human
uccaucaaaaauucucagaccucugagagggccuugagggcagagaauacugaccucaccuugg

SEQ ID NO: 229898 - RNA, 64 nt, Human
gaagaaaaggcauuuuaagauuuuuuaaaaaucuugucagaagaucccagaaaaguucuaauuu

SEQ ID NO: 229899 - RNA, 64 nt, Human
gagguagagauauguguauccauaggaagagaucugucagaacaggcagcuguugagcucgggg

SEQ ID NO: 229900 - RNA, 64 nt, Human
uggaaguuuccgagaggagggucuauagaccauuugucagaaaucagaucagcccucaaagaau

SEQ ID NO: 229901 - RNA, 57 nt, Human
augcuguggaugaacgaugaaugucaaugucagaaggaaaagagaauuuuggccauc

SEQ ID NO: 229902 - RNA, 64 nt, Human
gucugcauuuuuagccucuuuucucuucguuaguugucagaauaugccuucgucaaggcucaga

SEQ ID NO: 229903 - RNA, 64 nt, Human
ucaguuucauucaaauguuaccuaaaauuuauggugucagaauaaagggagaucauagugaguu

SEQ ID NO: 229904 - RNA, 64 nt, Human
acaaaacaacacaaaaaaacaaugugcccccagaugucagaaugaggcgacuagggcaccauac

SEQ ID NO: 229905 - RNA, 64 nt, Human
aagauguuugacuugcucaaagucaagcagguaaugucagaauugaaucucaaaucuauaucuu

SEQ ID NO: 229906 - RNA, 64 nt, Human
uaguaaguggugagaacuacucagggaaugaaggugucagaauaauaagaggugcuacugacuu

SEQ ID NO: 229907 - RNA, 64 nt, Human
cccagccuuuugagaguaauuugggaaaagaagcugucagaaguuucuaacuuacaaacugguu

SEQ ID NO: 229908 - RNA, 64 nt, Human
cacccuauagguaagcauuuuugugccaacauguugucagaaauuaauguauguucaucuccuc

SEQ ID NO: 229909 - RNA, 64 nt, Human
gagauucagucacauaauuaucagacauuccauuugucagaaauguauuuggcuuuuuaaacuc

SEQ ID NO: 229910 - RNA, 64 nt, Human
uagagagaugagaagccaggaggccugcaccaaaugucagaagcuuggcaugaccucauuccgg

SEQ ID NO: 229911 - RNA, 64 nt, Human
aaucugcuccaaaaagcuggccacaucucugaggugucagaauuaagcugccucaguaacugcu

SEQ ID NO: 229912 - RNA, 64 nt, Human
ugcauuagacagaugacggcugcucgaagaacaaugucagaaacucgaugaauguguugauuug

SEQ ID NO: 229913 - RNA, 64 nt, Human
gauauuaaauaugcuaacauagcuauggaggaauugagggcaagcacccaggacugaugagguc

SEQ ID NO: 229914 - RNA, 64 nt, Human
ggugguugggguuggggcuggggguggacuggugugagggcagaccagggccagguagacgggg

SEQ ID NO: 229915 - RNA, 64 nt, Human
cuuucggaaugaauguucauggaagaggcuccucugagggcaagagaccuguuuuagugcugca

SEQ ID NO: 229916 - RNA, 64 nt, Human
ugggacuuugauuggcuggcaaacauuuuaucauugucagaauuuaauuuagauuucaaaaaua

SEQ ID NO: 229917 - RNA, 64 nt, Human
acuucaaaucauaaacuuagaauucuguaucucaugucagaaauauguuuauggccuugcuuuu

SEQ ID NO: 229918 - RNA, 64 nt, Human
aaauucgaacuagccacagaaucauuuguuuuuaugucagaauuugcaaagaguggaguggaca

SEQ ID NO: 229919 - RNA, 64 nt, Human
aggagcucacauggauauauuuaugucacugaguugucagaaauuaugucaaaaugaaaacugu

SEQ ID NO: 229920 - RNA, 64 nt, Human
aauuuugcaucauaauuucuacauugucccugagugucagaacuauaauuuauuccauuucucu

SEQ ID NO: 229921 - RNA, 64 nt, Human
aacuccagguccauucuguuuaaaucccuaagaaugucagaauuaaaauaacagggcuaucccg

SEQ ID NO: 229922 - RNA, 64 nt, Human
gccgaguugaacugaagaaacgaguggaugacuaugucagaagacauuugguaugaagcuucug

SEQ ID NO: 229923 - RNA, 64 nt, Human
aaaggauaaauuuuaaaaaaucuuuauaggcuacugucagaaguauccuauccuuguuuacgau

SEQ ID NO: 229924 - RNA, 64 nt, Human
guguuguugaugugaguaucugaugaaaaaacaaugucagaauaaccgacaugaaaauuuuuua

SEQ ID NO: 229925 - RNA, 64 nt, Human
uacucacucugcagcucuggggagcucuuuccugugucagaaccaguccugcccugugaauuac

SEQ ID NO: 229926 - RNA, 64 nt, Human
ggaacugccucuuuccuguuguuguuaaugaaaaugucagaaaccaguuaugugaaugaucucu

SEQ ID NO: 229927 - RNA, 64 nt, Human
guaaaacuugaggcauucacuagaggugaaaacuugucagaauauauaaaagcuuagauuguag

SEQ ID NO: 229928 - RNA, 64 nt, Human
uuuugcagauuuuauccacagugucauuuuuuacugucagaaaagauaccccuuuugucauugc

SEQ ID NO: 229929 - RNA, 64 nt, Human
aggaacaugagcaaacugaaaauuacuaugcacuugucagaaacaauaaaugcaacuuguugug

SEQ ID NO: 229930 - RNA, 64 nt, Human
uguuagaguuggcaauuuccuaucacuauuucagugucagaacaaacugaaaauaauggcucgu

SEQ ID NO: 229931 - RNA, 64 nt, Human
gggggcaggccccccuugugcagagccaggggucugagggcaccuggcuguguucccagcugag

SEQ ID NO: 229932 - RNA, 64 nt, Human
acauccagucuccaucgugcugcagcagcuggacugagggcagagccuguaggugcagaggccc

SEQ ID NO: 229933 - RNA, 64 nt, Human
uccugugucaaguagcuaacugcagcagcuggacugagggcagagucugugggugcagagaccc

SEQ ID NO: 229934 - RNA, 64 nt, Human
uuacagccuguauucauuuguucucuagaaguuuugucagaauuuugacuuguugacauaaauu

SEQ ID NO: 229935 - RNA, 64 nt, Human
cacugugcuuuccaucuuagaaaucugauuguucugucagaauuuauauuuacagguuucaaag

SEQ ID NO: 229936 - RNA, 64 nt, Human
caaugguuuaacaguuauccaugccaagucccauugucagaaauauucuuauuacucagucaaa

SEQ ID NO: 229937 - RNA, 64 nt, Human
gguucaagcgauucuucugccucagccucccaaaugucagaaaagaaagcauacaugcuuaugc

SEQ ID NO: 229938 - RNA, 64 nt, Human
augcguagaaacacgugcauggaggaucaaacacugucagaauugcugaaaucaauacacaaag

SEQ ID NO: 229939 - RNA, 64 nt, Human
aaucuuucuaaaauuguaugcugaccauacuugcugucagaauaaugcuaggcauaugcuuuuu

SEQ ID NO: 229940 - RNA, 64 nt, Human
aggggccagcgcagagcagagugcugaguaaagaugucagaaaaggaaagcaauggucugguac

SEQ ID NO: 229941 - RNA, 62 nt, Human
ccacacauaccaaaaaauaacaccaaaaccucugucagaacacaaaggaaugugcauaaugg

SEQ ID NO: 229942 - RNA, 64 nt, Human
aggugggugguuaagguccuucccacuucgcaggugucagaaccuagggcugggcucucggggc

SEQ ID NO: 229943 - RNA, 64 nt, Human
guauccucauguucuuuauuugcacagagugaaaugucagaaguuacauguaaaugaauucaca

SEQ ID NO: 229944 - RNA, 64 nt, Human
cacuagguugcagagaagcauccuccacauccugugucagaaacccuggucuccguggcacuug

SEQ ID NO: 229945 - RNA, 64 nt, Human
auuauuauuaagguuguaauguuuuucuccgaguugucagaaauaacuggaagaauacaauaua

SEQ ID NO: 229946 - RNA, 64 nt, Human
gauuucccacauucccaugaauaucaagaauaguugucagaauauguauguaccugagcauaug

SEQ ID NO: 229947 - RNA, 64 nt, Human
ggguguuuguuagucucaaaacugugaagugacaugucagaacaguccagacugguaagaaaau

SEQ ID NO: 229948 - RNA, 64 nt, Human
auuaacauauaaacuuuguuguaaaacugaaucaugucagaacugcuuaaaauuaaccuuuacc

SEQ ID NO: 229949 - RNA, 64 nt, Human
uaauuuuaaccugguuucuuguauguaaacuccuugagggcaagaacauguuugaacauagacu

SEQ ID NO: 229950 - RNA, 64 nt, Human
aguguaucugugugagugugugcaacuacuugugugagggcaugguagcuaacguguguaugag

SEQ ID NO: 229951 - RNA, 64 nt, Human
auacacguuucccuaagaaaucauggcagagaugugagggcagaauauacacaacagaugcuga

SEQ ID NO: 229952 - RNA, 64 nt, Human
uacuuuauaagccccaaugggccauggagaccacugucagaaaugggauauuagucuagagaga

SEQ ID NO: 229953 - RNA, 64 nt, Human
cugcaauugacgcacaucugcccuaagcgaaaucugucagaaggaaucaacaaggcuccuugcc

SEQ ID NO: 229954 - RNA, 64 nt, Human
accaaacaauaggcuuuuaaaagcauugagucauugucagaauccacuaugggaagcucugugu

SEQ ID NO: 229955 - RNA, 64 nt, Human
auucccaaacgugguuacauuagccauucauguaugucagaagugcagaauuggggcacuuaau

SEQ ID NO: 229956 - RNA, 64 nt, Human
ggcuggcccagaguuuacauucuaauuugcauugugucagaaacaugaaaugcuuccaagcaug

SEQ ID NO: 229957 - RNA, 64 nt, Human
ucaugcauacccauagagaaguguguaagugauaugucagaagagcuucuuacugauuucaccu

SEQ ID NO: 229958 - RNA, 64 nt, Human
ccuaugguucuaaucagcguuauccggguucugaugucagaauccugggaaccugaacacuaag

SEQ ID NO: 229959 - RNA, 64 nt, Human
uaaggaagacgucaaucaaaaugucaaauaugugugucagaauauaaauaauuuuucacauugu

SEQ ID NO: 229960 - RNA, 64 nt, Human
cauuuaauuggucccuccuccuuuccagcuauuuugucagaaagcaaguagggccauccagcug

SEQ ID NO: 229961 - RNA, 64 nt, Human
ugugaaugauaauggaauggcuggagucugcuguugucagaaggcagggagggugaugaaggac

SEQ ID NO: 229962 - RNA, 64 nt, Human
ggauucugacagagcaagcgaaagagcaaagucaugucagaaggagacagaaugagagagaaaa

SEQ ID NO: 229963 - RNA, 64 nt, Human
agaaugggaaggagaccauuggguaacccucaagugucagaaguuguuucuaaaguaacuauac

SEQ ID NO: 229964 - RNA, 64 nt, Human
uccuguucuaauaaaugcacggcuuuaccuuuccugucagaaauaaaccaaggcucuaaaagau

SEQ ID NO: 229965 - RNA, 64 nt, Human
cuacaggucccgguaccugaggaaccaguguaggugucagaaauacuccuagagccucaagguc

SEQ ID NO: 229966 - RNA, 64 nt, Human
ugaggccagcagagcgagcugacagcagcaacacugucagaaggugcccugagacggccggcuc

SEQ ID NO: 229967 - RNA, 64 nt, Human
gaguaccgacuugaaaacggagagcugucuuggcugagggcagggucuguguggcaggaugggg

SEQ ID NO: 229968 - RNA, 64 nt, Human
cuuccucucccuuccaaagacagugacagcugacugagggcaaagagcaggcaccacucagaac

SEQ ID NO: 229969 - RNA, 64 nt, Human
acucugugcccaggacgguucugagacugaacacugagggcaggagcaagggaggaagccaggg

SEQ ID NO: 229970 - RNA, 53 nt, Human
uggaaagaagagcuaaguaacauugucagaaauaaauaaaaccacaagucuca

SEQ ID NO: 229971 - RNA, 64 nt, Human
uugcugucuuuuucuugcuucauuagaguaagucugucagaaagcuugaauauuuuugacauuc

SEQ ID NO: 229972 - RNA, 64 nt, Human
guuuuuaaacaugguauaaugaauuguguacuucugucagaagaaagcagagguacuaaucucc

SEQ ID NO: 229973 - RNA, 64 nt, Human
auagcaguguuccauagacuuggcuugguuccagugucagaagcaagcauaaucauugcugugu

SEQ ID NO: 229974 - RNA, 64 nt, Human
gugaaaaucccauguuugcuuuauuuuauuuuaaugucagaaggcaguuugcgcuaaugcuuga

SEQ ID NO: 229975 - RNA, 64 nt, Human
gguucugggugaagcaguuccugaaggaguguuuugucagaauauauuguuaggagaauagagg

SEQ ID NO: 229976 - RNA, 64 nt, Human
gcauuuggugguuuuauuuuuguuugagggggauugucagaaaaucccuuuucucucuuacguc

SEQ ID NO: 229977 - RNA, 64 nt, Human
uagaaaaucuguucauugaaauucuguuuacacuugucagaaauaagcauuucuuuguuuaauu

SEQ ID NO: 229978 - RNA, 64 nt, Human
aauuguuucauaaaugugacacugauaaagccuuugucagaaaguauucucacaauuaugagau

SEQ ID NO: 229979 - RNA, 64 nt, Human
acucaaaucucagccccauguuguucuuuguuauugucagaaccuggugaguuguuuugaacag

SEQ ID NO: 229980 - RNA, 64 nt, Human
aauggaaaugggaagagcaacaguaacuccaaagugucagaaaauaguuaacauucaaaaaacu

SEQ ID NO: 229981 - RNA, 64 nt, Human
ccgcauuguacugcuguguuauaugcuauguacaugucagaaaccauuagcauugcaugcaggu

SEQ ID NO: 229982 - RNA, 64 nt, Human
agaggacaaguaguuauggcuaaggacaugaaauugucagaauggcagguggcuucuuaacagc

SEQ ID NO: 229983 - RNA, 64 nt, Human
auccuuaauuuuggcaaccacuagcaaaaaaacuugucagaauaauuuaaccaagccccucucc

SEQ ID NO: 229984 - RNA, 64 nt, Human
ugaaaaaugguaaauucuuaaaugugugugagauugucagaaucaacaaaacuagguugguuaa

SEQ ID NO: 229985 - RNA, 64 nt, Human
ugagaugcacuuuaaacuguugaaauguaagcucugagggcagggaccguaucuuauuuacugu

SEQ ID NO: 229986 - RNA, 64 nt, Human
gagcagggacuuugacucuuaggaagagcacacaugagggcaaggcugcuggcagacgucucca

SEQ ID NO: 229987 - RNA, 64 nt, Human
ugugguuucuccccucuucccuuggcagaguuauugagggcaugaucucagggcugcuaagaua

SEQ ID NO: 229988 - RNA, 64 nt, Human
guacuaaaaggcagaaaggucaucacaacuuuagugucagaaucuauagugguggcaaaguuag

SEQ ID NO: 229989 - RNA, 64 nt, Human
gggucaaagcaauacaccuacauguagaaugugaugucagaacucaaacaggcucaccaggcag

SEQ ID NO: 229990 - RNA, 64 nt, Human
gcaaggacuccagugugaacucaggaggggcaggugucagaacugggcaccaggacuggagccc

SEQ ID NO: 229991 - RNA, 64 nt, Human
uuucccuaguguugaaggaagguguacuuuuucuugucagaaagauaaaaaaaaucaaguugag

SEQ ID NO: 229992 - RNA, 64 nt, Human
caucuaaaagaucucugguuggauggaaaucaacugucagaauuaccucagguaagugguaauu

SEQ ID NO: 229993 - RNA, 64 nt, Human
gugacuuguauggucuccugguuaaagggaauggugucagaauauuugcauaaaauuauuuuuc

SEQ ID NO: 229994 - RNA, 64 nt, Human
auuugcuuuucuuugcuagcacaauguguguugcugucagaauauucuuuuuauauucugugga

SEQ ID NO: 229995 - RNA, 64 nt, Human
aauaaaguugaguuggcuguguuuucucugcucuugucagaacauugggacaauuggucguuca

SEQ ID NO: 229996 - RNA, 64 nt, Human
ccucuaaacuucucacccgcuucuccuggcaaucugucagaacggugucauccuggggaagaga

SEQ ID NO: 229997 - RNA, 64 nt, Human
uaacuuaagguugucauugguaaaaagacuucugugucagaaaaaacaaaaggcucuuuucaga

SEQ ID NO: 229998 - RNA, 64 nt, Human
agcauuggaaaaagccacuuggacuucacagagcugucagaagacuuaggaagcuuugccagua

SEQ ID NO: 229999 - RNA, 64 nt, Human
cucucuggagauagcuaccuggacuuuacagagcugucagaagacuugggaagguuugccagca

SEQ ID NO: 230000 - RNA, 64 nt, Human
caucaccaccacuccugaacccccauuucugauuugucagaauuuuuuuuuaacaaaacuaaaa

SEQ ID NO: 230001 - RNA, 64 nt, Human
uggaucaagacauucacccuaaauucugaauuuuugucagaaaagagauuugauuuucaugaag

SEQ ID NO: 230002 - RNA, 64 nt, Human
cacagaaccguaucagcgaccaagaaaauaggacugucagaagcugccaguuauuacugaacca

SEQ ID NO: 230003 - RNA, 64 nt, Human
gggaaggaagacaaagaagguaggaacggaauuuugagggcaaagaaaccuguguuuccaugga

SEQ ID NO: 230004 - RNA, 64 nt, Human
gagagauccagccaaagagcugcccccagggguaugagggcaccagcuggguucuccagggagc

SEQ ID NO: 230005 - RNA, 64 nt, Human
auccugcaggggccaggcuccaucucacuggcucugagggcaggacaggguaucacacauuucu

SEQ ID NO: 230006 - RNA, 64 nt, Human
uggauugagugcugucagaaaguggauugagugcugucagaaagugggagugauuuugcaacug

SEQ ID NO: 230007 - RNA, 64 nt, Human
ucaagugagcaaggguuucuucuggauugagugcugucagaaaguggauugagugcugucagaa

SEQ ID NO: 230008 - RNA, 64 nt, Human
aaggaauacaggguugaaaaaauauuaauauguuugucagaaggaaaaauaaugcauuuaucuu

SEQ ID NO: 230009 - RNA, 64 nt, Human
uuucccuggguaaaaagucuucucagaaaaacaaugucagaaaauaacagcgugcugcuuagaa

SEQ ID NO: 230010 - RNA, 64 nt, Human
gugugcauuguugaaaaauacuggauacaugucuugucagaauugucguauuaaguaaugucuu

SEQ ID NO: 230011 - RNA, 64 nt, Human
uuggggauuuagggcuauuauaggaauaguuuguugucagaagcacuuucacuugaagaaccua

SEQ ID NO: 230012 - RNA, 64 nt, Human
auucagugaaaacauaucucagaaaacuucauguugucagaaaaacagcugcaggcuccaaaga

SEQ ID NO: 230013 - RNA, 64 nt, Human
cagugacuuuuaaaggauuaauguugaaucacauugucagaauuuuuuccuccucgcuguucaa

SEQ ID NO: 230014 - RNA, 64 nt, Human
uagacuuucuaaacagugaguaaauaccauggaaugucagaaaugacuuuaucaucgucaucuu

SEQ ID NO: 230015 - RNA, 64 nt, Human
uguccuugcagaaagcccgugucugcagaaccccugucagaaugacgggcagugucgggagcag

SEQ ID NO: 230016 - RNA, 64 nt, Human
gaauccuagccuacuaugugaaaauuaagucuaaugucagaauaacuuacagaaaaauagaaaa

SEQ ID NO: 230017 - RNA, 64 nt, Human
guggaauuuuaaaugugugcacagucuggaaaacugucagaaucaguuuucccauaaaagggug

SEQ ID NO: 230018 - RNA, 64 nt, Human
cagacaucaccaaucaagugcagcacaugggugaugucagaauucuucccagcacaguguucug

SEQ ID NO: 230019 - RNA, 64 nt, Human
uucucuuugguaugucaauaaaaguuuauccguaugucagaacggauuuguggaauuuucaguu

SEQ ID NO: 230020 - RNA, 64 nt, Human
uaucuggcuacugaauagccggauuuuucaguucugucagaaacucuaaauuuccaaaaaucua

SEQ ID NO: 230021 - RNA, 64 nt, Human
ucagcacuuugggaggccaaggcaggcaaucaccugagggcaggagaccagccugacuaacaug

SEQ ID NO: 230022 - RNA, 64 nt, Human
accagaacuaagaacauauugagcuggagcuucuugagggcaggagaguauuggaaaaggaauc

SEQ ID NO: 230023 - RNA, 64 nt, Human
ggggagcacagaggaggcuggcagagcuggggacugagggcauuguugcugauucucacucacc

SEQ ID NO: 230024 - RNA, 64 nt, Human
uguuguuguuauuuuguuuuuguuuuuaggaauuugucagaaacucuuuccuguuuugguuugg

SEQ ID NO: 230025 - RNA, 64 nt, Human
uuuuaggccucuuguucacaucaaaagauauuggugucagaauaccagcauuuuccugccaugc

SEQ ID NO: 230026 - RNA, 64 nt, Human
uuggucauuguaaucacuguuggcguggggccuuugucagaacuagaauuugauuauuaacaua

SEQ ID NO: 230027 - RNA, 64 nt, Human
ccugggcucuggcauuaguuggucugugucacauugucagaacagguggcugcuguguggugcc

SEQ ID NO: 230028 - RNA, 64 nt, Human
cuuacaauuuuuuaacaugagauaacacaucaggugucagaacuugcuugaagggaauuaccag

SEQ ID NO: 230029 - RNA, 64 nt, Human
caucucacaccaguccaaauggcuauuauaaaaaugucagaaaauaacagaugcuggugagguu

SEQ ID NO: 230030 - RNA, 64 nt, Human
ugcugaauauauaagcaggacggccgccuucugcugucagaauuugcaaucaagggugacuucu

SEQ ID NO: 230031 - RNA, 64 nt, Human
cuugagcucucaaagcaguuggcuggaauacuuuugucagaauacgguacauuucuauuacauc

SEQ ID NO: 230032 - RNA, 64 nt, Human
gacagcuauguacgaccauuuguauguguaucuaugucagaaagaaucuuuauuaaaauauuuu

SEQ ID NO: 230033 - RNA, 64 nt, Human
acaucuguuucaggaacauggcaguauguuuacaugucagaaguuuuguuuaauucuaugguau

SEQ ID NO: 230034 - RNA, 64 nt, Human
cacuuaaguuuuugacacucacugccaagucaucugucagaauucuaaacuaaagacauguuug

SEQ ID NO: 230035 - RNA, 64 nt, Human
cauauuuucccccuguuuuuagagcuuccaaaugugucagaauaggaaaacauugcaauaaaug

SEQ ID NO: 230036 - RNA, 64 nt, Human
aauuaggauucaugugguuucuaagauuuggacaugucagaauuuugugagucauggauggggc

SEQ ID NO: 230037 - RNA, 64 nt, Human
agugauuacugcuauuacuauauuuacuugcauaugucagaaugaugugauagacuaucucugu

SEQ ID NO: 230038 - RNA, 64 nt, Human
agccauggaauggcuccgaucuaccucacagcagugucagaaggacuucgccaggguuuuggga

SEQ ID NO: 230039 - RNA, 64 nt, Human
agauugcugggcucugguggccagugucugucugugagggcaggaaggagagcugcacauugag

SEQ ID NO: 230040 - RNA, 64 nt, Human
gugccaaaggagcccccccauuccugggccuuucugagggcaggaggggcgaccagauaaggag

SEQ ID NO: 230041 - RNA, 64 nt, Human
cugaaccaggccagagcaaacagaaaaagaagguugagggcaauggacaaggaaggaauaaagg

SEQ ID NO: 230042 - RNA, 64 nt, Human
agacauguggaggggcagccugugccugccuuugugucagaaaaaggaaaccacagugagccug

SEQ ID NO: 230043 - RNA, 64 nt, Human
gacuucguacaggguacuuuuucccaaccucaucugucagaaauccaugugggcuuccuggaaa

SEQ ID NO: 230044 - RNA, 64 nt, Human
uuuauuuuauguuggaagagauggcgcagaugugugucagaagggagaucacggugugaguuuc

SEQ ID NO: 230045 - RNA, 64 nt, Human
gaauagcuaagagauaaauugggcuggggaaacuugucagaaagcacugaacaauuaagaaauu

SEQ ID NO: 230046 - RNA, 64 nt, Human
acuguaaggcagaugaucguccccguaugaugauugucagaagacaggacuaaguagcagagaa

SEQ ID NO: 230047 - RNA, 64 nt, Human
cucagaaauaauugcucuguugaaaauaauccuuugucagaaaagaagguagcuaccacaucau

SEQ ID NO: 230048 - RNA, 64 nt, Human
ugcagaacuguguuuguaauucuaagaaaauguaugucagaaaguauuuuaucagauguuuaaa

SEQ ID NO: 230049 - RNA, 64 nt, Human
aggagcaggccauaacuuuauuuguuagauacacugucagaaacuugagaucuuuuggccuaug

SEQ ID NO: 230050 - RNA, 58 nt, Human
uucgaccuuuagauuuuugaaagcgcaaugucagaagcgauuaugaaagcaacaaaga

SEQ ID NO: 230051 - RNA, 64 nt, Human
ugucugcagcugccugucuggugucugucuuuggugucagaacuuugggggccgggccccuccc

SEQ ID NO: 230052 - RNA, 64 nt, Human
gcagcucuucaugaguccugcagugcuaagcaaaugucagaaauugguguauuagacuauuuau

SEQ ID NO: 230053 - RNA, 64 nt, Human
acugucuuguacugacacauccaaagcaugagugugucagaaaucccuugucuauuccugucug

SEQ ID NO: 230054 - RNA, 64 nt, Human
accuauauccagauuuucuuucugcugaagcuguugucagaaucuuccuuuggacaaaacauca

SEQ ID NO: 230055 - RNA, 64 nt, Human
agcaaaauacaggaaaagaacuauccaguauaaaugucagaagacagauuuccuaaacaaguaa

SEQ ID NO: 230056 - RNA, 64 nt, Human
guuaguguugugcuuugccuucuuuggcgaugaaugucagaaauugaaugccacaugcuuucau

SEQ ID NO: 230057 - RNA, 64 nt, Human
ugcgccaagaggaauguguucagaagcugcugccugagggcagggccuaccugggcacacagaa

SEQ ID NO: 230058 - RNA, 64 nt, Human
ucucccagacagcagcugucuggcccuugcugggugagggcacaccacugccaggggucagccu

SEQ ID NO: 230059 - RNA, 64 nt, Human
ccccuccaucucuagauaagugucauauauuuguugagggcaaaagacuauggacuggaaggca

SEQ ID NO: 230060 - RNA, 64 nt, Human
agugauuuaccuguccauuuccaacccaaaagccugucagaaagcauucuuuagagaaaaccac

SEQ ID NO: 230061 - RNA, 64 nt, Human
ugauucaccuaaaaauguguuaacugaaagaaaaugucagaauguuuccuuucugcucuuacac

SEQ ID NO: 230062 - RNA, 64 nt, Human
cagcaucaggcaacucugaacugaacauuugcuuugucagaaaauaucuuuuuuuuuacuuuga

SEQ ID NO: 230063 - RNA, 64 nt, Human
ccccaugucugugcugucuaguuuguguucaaaaugucagaauaaacacagaauaaauguuccc

SEQ ID NO: 230064 - RNA, 56 nt, Human
caaagauacagaaaccauaaauaugaugucagaauuuguugcuaauuugccacagg

SEQ ID NO: 230065 - RNA, 64 nt, Human
cugaguacuguauuuuuucugugcauuaccuuagugucagaauguuggucuuuauuuuaaaguc

SEQ ID NO: 230066 - RNA, 64 nt, Human
agcaccaaaguaacagauauaaaaccaaauaccaugucagaaaacacuauauaguaagaauuua

SEQ ID NO: 230067 - RNA, 64 nt, Human
uuaaguggaauucaacuaagaucuguuaauaagaugucagaauaacuaauaauuuuauuaggaa

SEQ ID NO: 230068 - RNA, 64 nt, Human
auguuuucucucugaaaguuggcuugagaguuguugucagaaaggugcaggugcuccacaaacg

SEQ ID NO: 230069 - RNA, 64 nt, Human
cuuacuugagaguagccauuuucuugccuguacuugucagaacuagaggaaauagccaagacua

SEQ ID NO: 230070 - RNA, 64 nt, Human
uuaggauguaaagguauauugugaacccuagcugugucagaaucuccaucccugaaauuucuca

SEQ ID NO: 230071 - RNA, 64 nt, Human
ugugcccuugguuggggggcgcgggcauauaaccugucagaagcaaacaggagcggcaacuucu

SEQ ID NO: 230072 - RNA, 64 nt, Human
uuaaaugcuuguagcagaaccccgggucaucucaugucagaaaccuuuaauccaggccuaaauu

SEQ ID NO: 230073 - RNA, 64 nt, Human
auaaaacaguuucgcuucuuuagcucaucuguggugucagaauccuuggagcugaagagagaaa

SEQ ID NO: 230074 - RNA, 64 nt, Human
gggcaccggcuuugguucaugucuaggagcccucugucagaauccuugaagcccuuuaaugguc

SEQ ID NO: 230075 - RNA, 64 nt, Human
agagccuggggggccccccggagacggagcuuccugagggcagggaggcagaugggacaggugg

SEQ ID NO: 230076 - RNA, 64 nt, Human
guucuguggaggagaggcgggguaauggggaggcugagggcaccucuucacugccccucucccu

SEQ ID NO: 230077 - RNA, 64 nt, Human
ccuggccugagccgucuggaaccaccugggccccugagggcacuguggucacacugggcccucc

SEQ ID NO: 230078 - RNA, 64 nt, Human
guuucaaaaaaggagaucagagaaagccaaagaaugucagaaauuuguagaaaaugacuucuug

SEQ ID NO: 230079 - RNA, 64 nt, Human
ucuaggcuucacuauccauuguguuguaaauguuugucagaaaugcagccaguguugugggucu

SEQ ID NO: 230080 - RNA, 64 nt, Human
ccugcaaaaugguggaggcuauuuucauuaaaacugucagaauuugcuuacuauaauuaugaua

SEQ ID NO: 230081 - RNA, 64 nt, Human
acucauacugaagaguacugaaacaaggacuucuugucagaaacagcuucuggaaucuuggguu

SEQ ID NO: 230082 - RNA, 64 nt, Human
cuguugaccuguaaggaagcagucgauccuagagugucagaacagagccauucucuccuccuga

SEQ ID NO: 230083 - RNA, 64 nt, Human
auguucaaggaguguuacuguuccgcccucucuuugucagaagggacacaggugguaauuugga

SEQ ID NO: 230084 - RNA, 64 nt, Human
aaagaucuaggguccugggucucuugcauuuauaugucagaaaaggggcgauaugcugcugagg

SEQ ID NO: 230085 - RNA, 64 nt, Human
ggaggccuugggaucaggaaaucuacugaauuacugucagaacaagagccagcaagcuuuacug

SEQ ID NO: 230086 - RNA, 64 nt, Human
uguaguucaggcacagaaagaauagcaaagcugcugucagaaguuugucaggcagagauguuua

SEQ ID NO: 230087 - RNA, 64 nt, Human
aauaaggaaggaagggaggcagggaggcaaagcaugucagaaacggaccuugguuuccuguuca

SEQ ID NO: 230088 - RNA, 64 nt, Human
ucaugagacuauauuuaugaucagugaauaaaaaugucagaacugugcuuugucuuagcugucu

SEQ ID NO: 230089 - RNA, 64 nt, Human
ugggguaugugcugcacuucccagggagaaaaccugucagaacuuuccauacgaguauaucaga

SEQ ID NO: 230090 - RNA, 64 nt, Human
aagggagacuguugcucaaccaucaggaaacaguugucagaagacaucauugguucuguguuuc

SEQ ID NO: 230091 - RNA, 64 nt, Human
agaaagucgcauaggguuuuuuaaugcagaauuuugucagaagacaauggcgcugcauguuuuu

SEQ ID NO: 230092 - RNA, 64 nt, Human
cuagaaucgaaggcuuacccuauucauuguuuauugucagaaaugcaugauggcucuuggaaag

SEQ ID NO: 230093 - RNA, 64 nt, Human
auucugguccuaacuaaagagaugggaguucaccugagggcaagaaguacccaggaugcccaaa

SEQ ID NO: 230094 - RNA, 64 nt, Human
uuguuggagccggagggagcgugucagcacgugcugagggcauggggccugcccccugggcacc

SEQ ID NO: 230095 - RNA, 64 nt, Human
uuggaauugggaccuuuggaagguuauugggucuugagggcagagcccucacgaaugggauuaa

SEQ ID NO: 230096 - RNA, 64 nt, Human
aggccccacgcccucuccucccccuccuagggggugucagaagcugggaacguguguccaggcu

SEQ ID NO: 230097 - RNA, 64 nt, Human
cacaccccuucagaaggugcccuggguugccgagugucagaauauacucaggacuccagaggug

SEQ ID NO: 230098 - RNA, 64 nt, Human
gcucacuuucuuagcaguguguaagcuuucuccaugucagaagcaagccugcucuuugauaaau

SEQ ID NO: 230099 - RNA, 64 nt, Human
uuguggaaugagcauucucuuguuuuaauguuggugucagaaaauaaauaugaaacauuaaguc

SEQ ID NO: 230100 - RNA, 64 nt, Human
auagcaaaagugauguuauaguuuuuuuuacuuuugucagaaucaaggcuucggccaccugugc

SEQ ID NO: 230101 - RNA, 64 nt, Human
uacuuucuugggcuuuugcucugguguauuuuauugucagaaaguccagacucaagaguacuaa

SEQ ID NO: 230102 - RNA, 64 nt, Human
uguuuccuaaaaacagugauuucuauuaaaaaggugucagaacuggagaaaaugccguguaguu

SEQ ID NO: 230103 - RNA, 64 nt, Human
cuucccaaccguggccuagagggcccuucuuaggugucagaaugagccaagccugaagcacuuc

SEQ ID NO: 230104 - RNA, 64 nt, Human
uuugugcaugaaacaaaguuuguauacauugaacugucagaaagcaaaggugucacuaucuuag

SEQ ID NO: 230105 - RNA, 64 nt, Human
augaacauacuuuccuauuucuguucuuugaaaaugucagaaauauuuuuuucuuucucauuuu

SEQ ID NO: 230106 - RNA, 64 nt, Human
gcguuugcauuuguaaacuuguggucuuccuaugugucagaaacaacugugucuugggggggaa

SEQ ID NO: 230107 - RNA, 64 nt, Human
aacggggacaguaugauguaccuugaagggcuguugucagaauucuacgugauguaagucaagc

SEQ ID NO: 230108 - RNA, 64 nt, Human
cucugcauguuccccuuccugggaggaaaccaauugucagaaggauguaugaugacccccuccc

SEQ ID NO: 230109 - RNA, 64 nt, Human
acaucaauuucuuagcagaggaaaugaauacuauugucagaaccauaucuauauagucaaucau

SEQ ID NO: 230110 - RNA, 64 nt, Human
auucccuaucaguuacuacuaagaguucucuuacugucagaaucucucuugcaguacagcucaa

SEQ ID NO: 230111 - RNA, 64 nt, Human
aacugagcaggaagaggauggaucaacaagggucacggggaauaggggacccacggggugugac

SEQ ID NO: 230112 - RNA, 64 nt, Human
aguugcucaugcauuuguaucuuuuccaucuuccugagggcaagauuuugcacgaugaaggcaa

SEQ ID NO: 230113 - RNA, 64 nt, Human
aggaucaaaucaauaaauuggauuuuuuauuuuuugagggcagcugcccucacuguuuuaaaua

SEQ ID NO: 230114 - RNA, 64 nt, Human
gcacucccccagccguucucaugcaaaauaccugugucagaauacuccuuucauccaucacuca

SEQ ID NO: 230115 - RNA, 64 nt, Human
uggucccaagacagugagacagucuggaaagugaugucagaauagcuuccaauaaagcagccuc

SEQ ID NO: 230116 - RNA, 64 nt, Human
aguuagggguuggagcccccauauaacaucuuccugucagaagacugauggaucuuuuucauuc

SEQ ID NO: 230117 - RNA, 64 nt, Human
ucacuucuauuuugguugaaggcaugauguaugaugucagaaaaaaaauugaaugaauuauuuc

SEQ ID NO: 230118 - RNA, 64 nt, Human
uuggccaaaugagaauuaagccagugccugagacugucagaaguugaccuuugcacuggcauua

SEQ ID NO: 230119 - RNA, 64 nt, Human
caccuagggaagcacuugcucaaaaucugugaccugucagaauaaaaaugugguuuguacauau

SEQ ID NO: 230120 - RNA, 64 nt, Human
aaaaaugauggauagagaaacagaaaucucugaaugucagaacccugucuuuuaaaaaggcagu

SEQ ID NO: 230121 - RNA, 52 nt, Human
augaauguggguguggguaggaugucagaaaugggaauagaaggaguguucu

SEQ ID NO: 230122 - RNA, 64 nt, Human
augccaauagaaaaauucaagagauaauguacaaugucagaaaagggauucuuuauguguaaau

SEQ ID NO: 230123 - RNA, 64 nt, Human
aauguucgcauccuuuuguuuuuaaaagauaugaugucagaauaaaauguggaaaacauacgga

SEQ ID NO: 230124 - RNA, 64 nt, Human
gauccugaagaaagaggucucucuccuaagucucugucagaauugagcuucacaauugcuaaug

SEQ ID NO: 230125 - RNA, 64 nt, Human
ggggaccaacaaagcauuuccaguuguaagaauaugucagaagagugcucgguuagcccacggu

SEQ ID NO: 230126 - RNA, 64 nt, Human
uuagauaaucuauuuugaaucaccuuuaauuacaugucagaaugccuuaacuacccuaacuuga

SEQ ID NO: 230127 - RNA, 64 nt, Human
cacaguaacucauaugccagguacaauaagaacaugucagaaguuccuaauucaguacaacagg

SEQ ID NO: 230128 - RNA, 64 nt, Human
gagauaagaaguggaacgugacaucuuugccaguugucagaagaauccaagcagguauuggcuu

SEQ ID NO: 230129 - RNA, 64 nt, Human
ugucacguucccuccccuuuccccagcgcacuguugagggcagccucuccagcucucuuguuua

SEQ ID NO: 230130 - RNA, 56 nt, Human
uuaaccacauccucaaauaggagcccugagggcagagcuccuggccgguccugagc

SEQ ID NO: 230131 - RNA, 64 nt, Human
acacuuuuuucugacaagaaaaaguaaaaggugaugagggcaauucuguccuacuguuuuuaca

SEQ ID NO: 230132 - RNA, 64 nt, Human
uagggaaaaugugugauuuuguguuuugaauuacugucagaauuacauacacaauuacaacaaa

SEQ ID NO: 230133 - RNA, 58 nt, Human
uucaaugcagcaguccauagaaugccucugucagaaucaaagacuaagcuuaagaguu

SEQ ID NO: 230134 - RNA, 64 nt, Human
aaugggggaccuguccauugugcucuauuaaucuugucagaaaacugucaccaaaacaaaacuu

SEQ ID NO: 230135 - RNA, 64 nt, Human
aagaaaaguaaguauaaaaauagauauuggauucugucagaaggccuagauuugaaauaauguu

SEQ ID NO: 230136 - RNA, 64 nt, Human
ggcugucucagaaaggucgcuaaauguauacuguugucagaauugcugagaucuccccccacuu

SEQ ID NO: 230137 - RNA, 64 nt, Human
uaugaugagcuauguuuggcugaguacuuguaacugucagaagaaggaugguggugaguggucu

SEQ ID NO: 230138 - RNA, 57 nt, Human
gcgacacuucagaugucuaauuccacaugucagaagauuauuccagaagccagcagu

SEQ ID NO: 230139 - RNA, 64 nt, Human
gcccccugccagagucacugccccauaaucaccaugucagaagggacccuagggcauucguguc

SEQ ID NO: 230140 - RNA, 64 nt, Human
uuaauaauuuaaaaguuauguuuguuaaacacccugucagaacagucauuuucaguauuagauu

SEQ ID NO: 230141 - RNA, 64 nt, Human
cuacagaugugcugacaaggcacuucauguaaagugucagaaggagcuacaaaaccuacccuca

SEQ ID NO: 230142 - RNA, 64 nt, Human
uuucauuaaaauauuucuugucgcuuuuagcuauugucagaauccaauaaacagcuuacgcauu

SEQ ID NO: 230143 - RNA, 64 nt, Human
uaaagccuuauuuauguuuucacccuuucuacuuugucagaaacacugaacagaguuuugucuu

SEQ ID NO: 230144 - RNA, 64 nt, Human
auuaaggagacuaaugaaucuggaugcagaaauaugucagaaacuggcauaaacaugauuguag

SEQ ID NO: 230145 - RNA, 64 nt, Human
gguuggugcauaacuuuguuucucaaauuuucguugucagaacaaauggaaggagaauauuauu

SEQ ID NO: 230146 - RNA, 64 nt, Human
ggauaggacuaaaauuuccaauucuccuacacucugucagaagccuagaacucacuaaacuggg

SEQ ID NO: 230147 - RNA, 64 nt, Human
aacugcuccauugaguucucgugcccucaucagcugagggcagggaauggaacuuuaauggaag

SEQ ID NO: 230148 - RNA, 64 nt, Human
aaacauugccuucagcauguucaguucgcagcacugagggcacucuugaggguguuguuaauga

SEQ ID NO: 230149 - RNA, 64 nt, Human
uuuaauuuaaagaaagcaacugaaauugaaaucuugagggcagcugugucuacuaaugagccuu

SEQ ID NO: 230150 - RNA, 64 nt, Human
uacgauggaauacuagauggucauuaaaauuaugugucagaagaaggcuuaaucucaugggaaa

SEQ ID NO: 230151 - RNA, 64 nt, Human
gccuaugaaucuuuggacggugagaucucacagaugucagaacugcuggaacuaugaaaugggg

SEQ ID NO: 230152 - RNA, 64 nt, Human
uuaggauacacaucaaccacuuugcuguugaagcugucagaauaaauuccugguggucagauga

SEQ ID NO: 230153 - RNA, 64 nt, Human
acaaauuucauagccugcugaacugaacugagugugucagaagugcugguuaaugacgagaaga

SEQ ID NO: 230154 - RNA, 64 nt, Human
uuuuaugcaggagaaaagcccagaguucacugugugucagaacaacuuucuaacaaacauuuau

SEQ ID NO: 230155 - RNA, 64 nt, Human
uuggaguggauuuucuucugcuuucauugauacuugucagaaaaaaauauuagaccaaaaugua

SEQ ID NO: 230156 - RNA, 64 nt, Human
gaugaagcaaaccuuugaauuuuugcacagcucuugucagaaagcccugaguucccccuggaua

SEQ ID NO: 230157 - RNA, 64 nt, Human
cacaagagaaagcaaacugcccaagaagucaucaugucagaaacucaaucucaacaaaauaauu

SEQ ID NO: 230158 - RNA, 64 nt, Human
uacaaccaucaugaaugcagauauucuagcauauugucagaaggaaggauggugcaaauuagcu

SEQ ID NO: 230159 - RNA, 64 nt, Human
acacuucaauagcaaucacaucuuauauccuaaaugucagaagauauucugaacuggaugccug

SEQ ID NO: 230160 - RNA, 64 nt, Human
uacaugucacuguuuuuauccuagaaaauguugcugucagaaggcaaaggaaauguuaccagug

SEQ ID NO: 230161 - RNA, 64 nt, Human
uggggcauaugccaaccaaaacuucguuucugcaugucagaaaagugcaguagaagcaaagcua

SEQ ID NO: 230162 - RNA, 64 nt, Human
gaaaaagccaaaauuaccauugcuuccuccagcuugucagaaaccuguggcugaauccgcaggg

SEQ ID NO: 230163 - RNA, 64 nt, Human
augccuuaguuuuugaauagauaagacauucaagugucagaaaguaaaagucaguucaggacug

SEQ ID NO: 230164 - RNA, 64 nt, Human
cucuaaaacacuuuccaaauaucugcacuucugaugucagaaucaaaccagauaauucucuaau

SEQ ID NO: 230165 - RNA, 64 nt, Human
cccagguggcgcacggauggugaggggcugagaaugagggcaccgacugugaagcuggggcauc

SEQ ID NO: 230166 - RNA, 64 nt, Human
ggacgguuuggucagacuauaaauaagauagguuugagggcauaaaauguaugaccacuggggc

SEQ ID NO: 230167 - RNA, 64 nt, Human
auuuaagacaaaacggaagcugggaagcuucccuugagggcaggcaggagguggaguugcagcu

SEQ ID NO: 230168 - RNA, 64 nt, Human
aguaaaauuaauauauuaaguuauaauuggaauaugucagaaguuucuuuuuacauucauaucu

SEQ ID NO: 230169 - RNA, 64 nt, Human
aguaaucaugcccacccucauugucaugccagauugucagaaguuccagacagaugagaaagca

SEQ ID NO: 230170 - RNA, 64 nt, Human
ucugcaggugugggacacauguaccaccuacaagugucagaagacacuggagggccaugauggc

SEQ ID NO: 230171 - RNA, 64 nt, Human
gggcuggaagccgagcgcaugcugggagcgguacugucagaagugagcccaguuaguaccccgc

SEQ ID NO: 230172 - RNA, 64 nt, Human
ucucuuuaguucugucuccaaggcccaggacacuugucagaaggaugcaaaaaaagaaaaaagu

SEQ ID NO: 230173 - RNA, 64 nt, Human
uuucgacucgagcagugccacuuuaaaaaucuuuugucagaauagaugaugugucagaucucuu

SEQ ID NO: 230174 - RNA, 64 nt, Human
ggaguacauuugagggcacuuaauacaaaguuaaugucagaaugugugccuugaaauucuugcu

SEQ ID NO: 230175 - RNA, 64 nt, Human
cuuucaacauaaacagaagauaccuacaaaauacugucagaaguccagguauacugauaacacu

SEQ ID NO: 230176 - RNA, 64 nt, Human
ggugauaaugagcacauagugaggggucagcaaaugucagaaguuaccugggacagccgggcac

SEQ ID NO: 230177 - RNA, 64 nt, Human
guguugggguuuggguaggggaggggagcucggcugucagaacuccauggauauguuucuuugg

SEQ ID NO: 230178 - RNA, 64 nt, Human
aagucgaugaaaaguaaccacugccacugucuugugucagaacuuuuacaguacagaaaauaac

SEQ ID NO: 230179 - RNA, 64 nt, Human
guuggcugggaguucaagaccagccuggccaacaugucagaacuacuaaaaauaaagaaaucag

SEQ ID NO: 230180 - RNA, 64 nt, Human
guaaacugaaaagacaacuggcuacaaagaaggaugucagaauguaaggaaacuauaacuaaua

SEQ ID NO: 230181 - RNA, 64 nt, Human
uuuggaaaccugucucuaaguaaugcauuacuucugucagaagugucuuagggugguuaucuag

SEQ ID NO: 230182 - RNA, 64 nt, Human
gcuggugauggggccagggcccugggcccugugcugucagaauucugccuugggaaaugauccu

SEQ ID NO: 230183 - RNA, 53 nt, Human
acguggagcucauugagugaggcugagggcacaucuugcccuuccccucucag

SEQ ID NO: 230184 - RNA, 64 nt, Human
agguaggcugaccccauggacccacuggagacuuugagggcagagcucgggcaccuuucaucuu

SEQ ID NO: 230185 - RNA, 64 nt, Human
cagcacuuugggaggccaagguggguggaucaccugagggcaggagucugagaccagccuggcc

SEQ ID NO: 230186 - RNA, 64 nt, Human
uugccaaggcauggcagacugagcuggaggaagaugucagaaauguuugcccugaaaucaguua

SEQ ID NO: 230187 - RNA, 64 nt, Human
cgauuuauugccaaaacccuagauuggagcuuggugucagaacucgccuagugggcaucucugu

SEQ ID NO: 230188 - RNA, 64 nt, Human
gcagagcuuccauuaguguagaccuguagccaccugucagaagguggguggcauauuggggacc

SEQ ID NO: 230189 - RNA, 64 nt, Human
caugggagguggggccucaaucuaaggccuucccugucagaaggggguuguggcaaaagccaca

SEQ ID NO: 230190 - RNA, 64 nt, Human
acccaauuggcccaacacugucugccccucggggugucagaaauucuagcgcaaggcacuuuua

SEQ ID NO: 230191 - RNA, 64 nt, Human
aggacccagcugcgucaggaguuuugcuucaagaugucagaaagucaaguucagcuaagagaca

SEQ ID NO: 230192 - RNA, 64 nt, Human
gcagucaagcucucagcuaguguuuagggcugucugucagaaaugguuauacgugggcaaaaga

SEQ ID NO: 230193 - RNA, 64 nt, Human
aacuuuguuucaauuuuguuuugugcauucuaugugucagaacauucagaagaagucugaagaa

SEQ ID NO: 230194 - RNA, 64 nt, Human
ucauucaacaaauauuuguaggguaccuacugugugucagaagauguucaagaucagcaucauc

SEQ ID NO: 230195 - RNA, 64 nt, Human
ccagcaagggccacaguuggaacaguccccugggugucagaaggugggcuagggccuccugcag

SEQ ID NO: 230196 - RNA, 64 nt, Human
cgaguccccuuguuccuccccauuaaaggggguuugucagaagcaagaacagccccucucccca

SEQ ID NO: 230197 - RNA, 64 nt, Human
gggcccacggucaggacugguggggacugcaggaugucagaagagugagaugucuugcacuggc

SEQ ID NO: 230198 - RNA, 64 nt, Human
aggugugggcccuaccccuaagcuagaaugugguugucagaacccugaaaguauuaguucuaaa

SEQ ID NO: 230199 - RNA, 64 nt, Human
gagggcuuaaguccuuaugcuguguuaguuucguugucagaacaaauuaaaauuuucagagacg

SEQ ID NO: 230200 - RNA, 64 nt, Human
aaauuaauguugccaacuuaauuuugugcauuugugucagaauguuuaguuuacaagguugggg

SEQ ID NO: 230201 - RNA, 64 nt, Human
auaggaaagagaaaucguaugaauguaaugaguaugagggcaguuucagucauagcucagaucu

SEQ ID NO: 230202 - RNA, 59 nt, Human
cccugaaucaccccuacuagcagcacgacugagggcaggaggcuccauccuucucccca

SEQ ID NO: 230203 - RNA, 64 nt, Human
uuguucauuucugucuccccuaccaggcuguaaaugagggcagaaaccuuguuuguuuuauuca

SEQ ID NO: 230204 - RNA, 64 nt, Human
aaagauaaagaaaauguugccuuuuucuaggaacugucagaaauccucaugccuuucaagacuu

SEQ ID NO: 230205 - RNA, 64 nt, Human
ugaaaugaugcagaauaguuuuuucccuauugacugucagaaaauccacugggaaauguaaaaa

SEQ ID NO: 230206 - RNA, 64 nt, Human
ugaugagaccagaccagugucuacagauuuucauugucagaaaaaucuauaagucugcccuuuu

SEQ ID NO: 230207 - RNA, 64 nt, Human
cggcauaaaaacagaaauuacccaguaaaaaggaugucagaaauugacauacaaauauuuacaa

SEQ ID NO: 230208 - RNA, 64 nt, Human
uggaggaguugccgugccuucagccugaaucgaaugucagaaccagccagcggugcuucacccu

SEQ ID NO: 230209 - RNA, 64 nt, Human
aaagcauuaaaauucuaauuacucucagaagaucugucagaaaguaugucuuuaaaguauagaa

SEQ ID NO: 230210 - RNA, 64 nt, Human
gucuuccguguucucagagguucuuuucagugucugucagaacuuggcauacuuucuccauagu

SEQ ID NO: 230211 - RNA, 64 nt, Human
uuaugugcuuguauguacauuuauugcuauccagugucagaacaguuaguuuaggaaaaguaug

SEQ ID NO: 230212 - RNA, 64 nt, Human
uuauuuuucuguguaugcauucacugcugcccagugucagaacaguuauacaaacgagggcuug

SEQ ID NO: 230213 - RNA, 64 nt, Human
uaauauccucaaaguucauucauuuuuuagcaugugucagaaauuuuaaggcugagcaauauuu

SEQ ID NO: 230214 - RNA, 64 nt, Human
uaaggucuucacgguucacccauguuguauaaugugucagaauauccuuccuuuuuaggugaaa

SEQ ID NO: 230215 - RNA, 64 nt, Human
gcugggacugccgugcgugucacuccugccauuaugucagaaucccagcagaggggauguugca

SEQ ID NO: 230216 - RNA, 64 nt, Human
cugugggaggucaggaaguucgagauuccuucacugucagaaugggcucaaggagccaucuuuu

SEQ ID NO: 230217 - RNA, 64 nt, Human
caguacuagguaauuuuuaauguaguguaauuaaugucagaaaacaccugucacuuccaucaua

SEQ ID NO: 230218 - RNA, 64 nt, Human
gaugacuucacacuguggacagcuuuucccaagaugucagaauaagacuccccaucaugaugag

SEQ ID NO: 230219 - RNA, 64 nt, Human
uuaucuuucaagguaauacuuuaccuuagaucuuugagggcaugcuucccauacaaagagcauc

SEQ ID NO: 230220 - RNA, 64 nt, Human
ggaagggacugguagggaagggacgagucuaggcugagggcaagaugggaggucagaggugaca

SEQ ID NO: 230221 - RNA, 64 nt, Human
cucuuguauguugaugccacuucuuggaagaagaugagggcaaugaguuagggcuccuuuuccc

SEQ ID NO: 230222 - RNA, 64 nt, Human
gaugacuucacacuguggacaguuuuuccaaagaugucagaacaagacuccccaucaugauaag

SEQ ID NO: 230223 - RNA, 64 nt, Human
ucuccaagucaagacugaggaugaagagggagaaugucagaacucaagugaagggcaaucaggg

SEQ ID NO: 230224 - RNA, 64 nt, Human
ccaauuggugugggagaauuagagaauuuauuugugucagaaaauacuccagaacaaccacccc

SEQ ID NO: 230225 - RNA, 64 nt, Human
acuuguggagucugcacuaacuuggagaaguuagugucagaauugaauuauagaacacccaguu

SEQ ID NO: 230226 - RNA, 64 nt, Human
auccaguguuauucacuaggaugaaugcuaucaaugucagaaaggcuucaacaugaauucaggc

SEQ ID NO: 230227 - RNA, 64 nt, Human
ucagagaaucccuacuggacagaaaucuuacaaaugucagaaguguggcaaggucuugaguccg

SEQ ID NO: 230228 - RNA, 64 nt, Human
gcacccuggagaaaguccuugaguacacagugaaugucagaaagcuucagcugaaggccauauc

SEQ ID NO: 230229 - RNA, 64 nt, Human
cugcaggguaaaugggauuccuugccacccaagcugucagaacugccacugagcuaaagauggu

SEQ ID NO: 230230 - RNA, 64 nt, Human
cuauuacuuugaaaacccugcugauucugaaaagugucagaaguuaccauuugauuugaaaaau

SEQ ID NO: 230231 - RNA, 64 nt, Human
aauguuugacacaauuggaauugucuuuaauuucugucagaaugcuauugaaaaugugaauugc

SEQ ID NO: 230232 - RNA, 64 nt, Human
auucuuuuagcaacuuggauuagaggggcccauaugucagaagcucccagcaccuccuacuugg

SEQ ID NO: 230233 - RNA, 64 nt, Human
augguuucagugaaacaaucuagcagagaauuaaugucagaaccuuuuuaaauaauagucugau

SEQ ID NO: 230234 - RNA, 64 nt, Human
ucguaaagagguaccaacugucgcugaugugauaugucagaacugaagaguaaaucuacuuguu

SEQ ID NO: 230235 - RNA, 64 nt, Human
guggagucgcagaccagagcugucugaacucaugugucagaagccuccaagccugccucccagg

SEQ ID NO: 230236 - RNA, 64 nt, Human
ucccuucagccaggagcuccugggugcauuuccgugucagaaacaguaccgagucccacccccu

SEQ ID NO: 230237 - RNA, 64 nt, Human
ugccuguguuuuucucaacacuacuuuucugauaugagggcagcaccugccucugaaugggaaa

SEQ ID NO: 230238 - RNA, 64 nt, Human
ccgugggaccucuaaggagaccuuugaagcuuuuugagggcaaacuuuaccuuuguggucccca

SEQ ID NO: 230239 - RNA, 64 nt, Human
ccauccaaaacccgugcgccacugcagugaguguugagggcaccucuccuccccucuuacaccu

SEQ ID NO: 230240 - RNA, 64 nt, Human
gccuuuaauauuucaaauaugcucaaauuuaaacugucagaaacuucugugcauguauuuauau

SEQ ID NO: 230241 - RNA, 64 nt, Human
uugccagacuuaaaucacagauggguauuaaacuugucagaauuucuuugucauucaagccugu

SEQ ID NO: 230242 - RNA, 64 nt, Human
caggcauggcuugauccagcuacucaaaaaagguugucagaaaugucuguccguucuucauuua

SEQ ID NO: 230243 - RNA, 64 nt, Human
uacuugugaacaugccuuauauuuguccaacaacugucagaauaaagaacauucuaaaaugaga

SEQ ID NO: 230244 - RNA, 64 nt, Human
aguaggcauaggagcgggaaugaaaaucgagcacugucagaaucuggugggcagccccugacuu

SEQ ID NO: 230245 - RNA, 64 nt, Human
ugaucguuguggaagguuuggagccuuagagguaugucagaaaaaauauguugguauucucccu

SEQ ID NO: 230246 - RNA, 64 nt, Human
auaaaguucccuggagaaauuggucagaaugaucugucagaaccauuugaaaacuugcucaaga

SEQ ID NO: 230247 - RNA, 64 nt, Human
ccaguuuuccuuugagucgcgaacgcugugcguuugucagaaugaaguauacaagucaauguuu

SEQ ID NO: 230248 - RNA, 64 nt, Human
gagacauauuuaagaauuccaagaggauauuaugugucagaauuucagacacugaugagaaguu

SEQ ID NO: 230249 - RNA, 64 nt, Human
uguuuguuuguuuguuuugagacuccagucugggugucagaaugagaccccaucucaaaaaaaa

SEQ ID NO: 230250 - RNA, 64 nt, Human
guacucaaauauuucugauacugcugagucagacugucagaaaaagcuagcacuaacucguguu

SEQ ID NO: 230251 - RNA, 64 nt, Human
uccccuugagucaucaccagcuuccccaagagagugucagaaucuuaagagcugagaggccggg

SEQ ID NO: 230252 - RNA, 64 nt, Human
uggacauuugguuaguaguuuuuuugaauggguaugucagaaaaggaugaguuuguggugacag

SEQ ID NO: 230253 - RNA, 64 nt, Human
agacgggaaacuuuauuucacgagaaagccucauugucagaaguaucuucauucaaugggcaca

SEQ ID NO: 230254 - RNA, 64 nt, Human
uuaacaugaacuuauacuaauguuuggaaucuuaugucagaaauauaagcagcuauguacuuag

SEQ ID NO: 230255 - RNA, 64 nt, Human
ccagagaaggggcuucccugucccggagggagacacggggaacgggauuuuccgucucucccuc

SEQ ID NO: 230256 - RNA, 64 nt, Human
ugaggguagcgagcaacuggcuugagcagacagaacggggaagacuccacucugucccgagggg

SEQ ID NO: 230257 - RNA, 64 nt, Human
ugugcgcugguggucucgugagacaguuccgaggacggggaaauugcaggguggugggggcgug

SEQ ID NO: 230258 - RNA, 64 nt, Human
uguuuaaaaguaaaugauuugggaacugacaaugugucagaaaauauauguucauuuaucauuu

SEQ ID NO: 230259 - RNA, 64 nt, Human
gcuuauaacgacaauguggcacuuaauaaauacuugucagaacuuuaaaaaaagugaauccuau

SEQ ID NO: 230260 - RNA, 64 nt, Human
ucucuauuaccacugaagauagaagaaaaaagaaugucagaaaaacaauaagagcguuugccca

SEQ ID NO: 230261 - RNA, 64 nt, Human
agggccacaggugagggacacuaccacuggaucgugucagaaggugcugcugaggauagacuga

SEQ ID NO: 230262 - RNA, 64 nt, Human
ucuuguuguucauauaggggcaaaaauuugacauugucagaauguuguguugguauuuacugca

SEQ ID NO: 230263 - RNA, 64 nt, Human
aagaguaaauaaguuuuagaguuguucuggaaaaugucagaauaagucaguacuuggguugugu

SEQ ID NO: 230264 - RNA, 64 nt, Human
uucuucuuguagggcuuggugguguuuuaucgauugucagaauuguuuuugaaagccuaagaac

SEQ ID NO: 230265 - RNA, 64 nt, Human
acuugauaacuagccguguuuuuaaaaagaaucgugucagaacuguaaguagugcauauuuaag

SEQ ID NO: 230266 - RNA, 64 nt, Human
acuugauaacuagacauguuuuuaaauaaaaucaugucagaacuguaaguagugcauauuuaau

SEQ ID NO: 230267 - RNA, 64 nt, Human
gaucgauuugcuuagugguauaauaccugaacucugucagaaauauccagauuuaaauuucaua

SEQ ID NO: 230268 - RNA, 64 nt, Human
uggcguuugcaagguuuacccauguuguagcaugugucagaauuucauuccuuucuauggcuga

SEQ ID NO: 230269 - RNA, 64 nt, Human
uggucauguuucuguuagacuguagcugugaaacugucagaauuguuaacugaaacaaauauuu

SEQ ID NO: 230270 - RNA, 64 nt, Human
ucauuuuuggauaggcugcuaucuaauuugcaguugucagaaauacugugcugaaaguuuuaug

SEQ ID NO: 230271 - RNA, 64 nt, Human
gcauaggaaggcucuauguuuguauauuucucuuugucagaauaccccucaacucauuugcucu

SEQ ID NO: 230272 - RNA, 64 nt, Human
uugcuuuugcaauuucuacaaauuaauuuuaaagugucagaaaaaggugacggcaaggacaugc

SEQ ID NO: 230273 - RNA, 64 nt, Human
caagaggaugggccuagaaagccaagugcaaagaugagggcagauucuuuaccugucugcccuc

SEQ ID NO: 230274 - RNA, 64 nt, Human
aagucauugaagugugugaagcucugugcuugcaugagggcaagcaaggaauggcugugccuga

SEQ ID NO: 230275 - RNA, 64 nt, Human
ucauucaccucugcaagugcuacuggcaacagccugagggcagcuguagaaacuuucccucugu

SEQ ID NO: 230276 - RNA, 64 nt, Human
ugugcagugagcaauuuuugugucagaaauucuuugucagaacaaauauauguaacaggcucaa

SEQ ID NO: 230277 - RNA, 64 nt, Human
ucucugagauucugugugcagugagcaauuuuugugucagaaauucuuugucagaacaaauaua

SEQ ID NO: 230278 - RNA, 64 nt, Human
cuagggccccugucuacugauagucaguuugcugugucagaaagcacuucugaaagcagauaug

SEQ ID NO: 230279 - RNA, 64 nt, Human
cgaucaaauuugagaaucacaggucuaggauacgacggggaaaacagaaaugugggguggucag

SEQ ID NO: 230280 - RNA, 64 nt, Human
cagggccggcagggugcuucgggagcccccugcuacggggaaaggcauguguuucuugcuggug

SEQ ID NO: 230281 - RNA, 64 nt, Human
auuuuaaucuaagugguuauaacaguggauucugacggggaagguguagcucuguucucuucgg

SEQ ID NO: 230282 - RNA, 64 nt, Human
ucucaaaucagauuuacaaucuccauuuucauuaacggggaaacauccccgagccacugagugc

SEQ ID NO: 230283 - RNA, 64 nt, Human
gagaaucauccagucuuacugucucaauguacauacggggaaacugaagccaggagaagaagag

SEQ ID NO: 230284 - RNA, 64 nt, Human
uaacuuucugaaccucagagucuucaccuauaagacggggaaaauaauaccacccuuucaagau

SEQ ID NO: 230285 - RNA, 64 nt, Human
ccaacucuggccccuuucucagugcuaucugaugacggggaaacaaaauuauucucugagaggg

SEQ ID NO: 230286 - RNA, 64 nt, Human
guugaaggccagucuguguagaaaggcugaggcaacggggaaagaccugacagcuaguuacaua

SEQ ID NO: 230287 - RNA, 64 nt, Human
caaagauuucaguagaauuuuaguccugaacgcuacggggaaaaugcauuuucuucagaauuau

SEQ ID NO: 230288 - RNA, 64 nt, Human
guuuucuucagguuacuuuuuaauaaugauuaaaacggggaacuucauuaucaugagcaugguu

SEQ ID NO: 230289 - RNA, 64 nt, Human
caggucgggcgcaggauucagccggagggaagggacggggaagccgagcuccagagcaacgacc

SEQ ID NO: 230290 - RNA, 64 nt, Human
cuuaccuaugucccuucucaugccuuucccuccaacggggaaagccaacuccaucucuaagugc

SEQ ID NO: 230291 - RNA, 64 nt, Human
ccaaagccuucagcgaacgugaaaugugcgcuaaacggggaaaccuguuuaauucuagauauag

SEQ ID NO: 230292 - RNA, 64 nt, Human
uguggacccacuaugaaugugaauaacccuuccuacggggaaucuguguaugggcccaguuccc

SEQ ID NO: 230293 - RNA, 64 nt, Human
ccacgggagaagcuggaggugcuggagaggacauacggggaaauugagggcacggugucgaggg

SEQ ID NO: 230294 - RNA, 64 nt, Human
cccauuucacgacuccucugagacuaauugggaaacggggaaauucuuggaauuuuuuuuuuaa

SEQ ID NO: 230295 - RNA, 56 nt, Human
ucuguggagaagaugacuaacgugucacggggaagagcucccugcugugugccugc

SEQ ID NO: 230296 - RNA, 64 nt, Human
cucccccacaaauaaugaacagcagaaagacuggacggggaaaccuaucaauccugcccccagc

SEQ ID NO: 230297 - RNA, 64 nt, Human
uuauggcugcaauaaaaagcauacuuucagacaaacggggaauuuccuaaaauuagucuggcuc

SEQ ID NO: 230298 - RNA, 64 nt, Human
gugacuuucuacucaccaagguugaagaaaggaaacggggaaaaucaaaagggguucaaacccc

SEQ ID NO: 230299 - RNA, 64 nt, Human
uccccuggcccggugggaagcccagacgaggaggacggggaaccggauuacgugaauggggagg

SEQ ID NO: 230300 - RNA, 64 nt, Human
uuaaauauuaaaaguaguucugguuuauuaaucaacggggaaaacaucuucuccaaaaaacuug

SEQ ID NO: 230301 - RNA, 64 nt, Human
uggacagcaucuccucagauggugaauuaugugcacggggaaaccuccugaguggaaguuucau

SEQ ID NO: 230302 - RNA, 64 nt, Human
ccggggcagucugacugucggugcccucccaggaacggggaaggccuccgucugugugaaaggg

SEQ ID NO: 230303 - RNA, 64 nt, Human
ccuuuuauuuuuaggauauuguuuggaaaguaacacggggaaacuuuagaaaugcuguuuucuu

SEQ ID NO: 230304 - RNA, 64 nt, Human
cuauuguuccccagauaauguucccucaaauagcacggggaagcaacugccuuucaaggguaau

SEQ ID NO: 230305 - RNA, 64 nt, Human
aggagcagccucaagcccagagaagacugaggcuacggggaacuucccuugcugcaggcuguug

SEQ ID NO: 230306 - RNA, 64 nt, Human
ucugaauuacuugguauuuagaacuccuagcaccacggggaagaauagagguaucaucaaacgu

SEQ ID NO: 230307 - RNA, 64 nt, Human
gguccauaguucuucacauugugaguauaugaauacggggaaauagaacccccuccccaccacc

SEQ ID NO: 230308 - RNA, 64 nt, Human
caguaaugaucccauuaccagauaagauugacugacggggaaaaaaaaaaaaaaagaauggggu

SEQ ID NO: 230309 - RNA, 64 nt, Human
uuggguagagagguuaagaagaggaggaagugagacggggaagggaggagcaccuugcuucacu

SEQ ID NO: 230310 - RNA, 64 nt, Human
cccuuguuggggcauugagaauaucaugagugccacggggaaggggaguagggaugucuuuucc

SEQ ID NO: 230311 - RNA, 64 nt, Human
gaaauuuuaaugcaaauacauacauuccugaaagacggggaauuaaauuacuaauuuuuuuuuu

SEQ ID NO: 230312 - RNA, 64 nt, Human
ggggggucaccccgaccccucaggcccaccugucacggggaacauggagccuugguguauuuuu

SEQ ID NO: 230313 - RNA, 64 nt, Human
gugauggaugacaacagguuguugacauuggccaacggggaacgcauccggcuccaagcacacu

SEQ ID NO: 230314 - RNA, 64 nt, Human
gcacuccugugaacaguuuuucacuuuugaugaaacggggaaccaagaggaacuuacuugugua

SEQ ID NO: 230315 - RNA, 64 nt, Human
gucacuaauagaauaucucugaagcuggauugauacggggaaaacaucuuucccuucuaguuuu

SEQ ID NO: 230316 - RNA, 64 nt, Human
ucacauacucacacggggcaggggggagggggaaacggggaacuauagcaauauuuaaagaugc

SEQ ID NO: 230317 - RNA, 64 nt, Human
guguacguacauggggaccugucugcauauacacacggggaaugccagaagaaggcccagucug

SEQ ID NO: 230318 - RNA, 64 nt, Human
uaccuguauacguuagugaaagcuguuuacuguaacggggaaaaccagauucuuugcaucuggg

SEQ ID NO: 230319 - RNA, 64 nt, Human
uucaccggaagcagaugccgccaugagcgagaugacggggaauacagcacugcuugcucaggug

SEQ ID NO: 230320 - RNA, 64 nt, Human
cuuguaucuucaguuggagguguaguauucaaaaacggggaaugaaggcaggaaggaggcugga

SEQ ID NO: 230321 - RNA, 64 nt, Human
gacggggauaguaagagauaagugggugggaggcacggggaagguuuuggaguagaaccagggg

SEQ ID NO: 230322 - RNA, 64 nt, Human
uaucuuguucugugacugaagugauacacuaaucacggggaacccagaaugauucaacauuuuc

SEQ ID NO: 230323 - RNA, 64 nt, Human
ggggagggaagcgugccuccccaccccuccccucacggggaagguuuccuuuccucgugcuugu

SEQ ID NO: 230324 - RNA, 64 nt, Human
ugauggagcguccccaaagcucccagcccuggggacggggaaggacauggagccugagccagag

SEQ ID NO: 230325 - RNA, 64 nt, Human
ugauguuaggacagagugagagaagucagcugucacggggaaggugagagagaggaugcuaagc

SEQ ID NO: 230326 - RNA, 64 nt, Human
guccuccugagucccguagccucauuucuuacagacggggaaacugaggcucagagcagcaggu

SEQ ID NO: 230327 - RNA, 64 nt, Human
auccagauccgaccacuagaucauccuuauaccgacggggaaacggaggccagagagggcgugg

SEQ ID NO: 230328 - RNA, 64 nt, Human
uccccaagccaccaauuggauggaugaauguuugacggggaagaggaaggguaggaggaugcau

SEQ ID NO: 230329 - RNA, 64 nt, Human
guuguuucugucugauuuuaauugcugucuaaugacggggaaagcacgaugaaaagauguacaa

SEQ ID NO: 230330 - RNA, 64 nt, Human
accgugggucaccaaugccagaaaaccagacaucacggggaaagaauguugcuuacuuuuuacc

SEQ ID NO: 230331 - RNA, 64 nt, Human
auaauucuagcgggggaccugggagauaauuccuacggggaauucuuaaaacugugcucaacua

SEQ ID NO: 230332 - RNA, 64 nt, Human
agugaagcugucugcuguaagaggaguggccaugugagggcauggagucauuagucucacaaac

SEQ ID NO: 230333 - RNA, 64 nt, Human
uacuugucuauacucugauagaaccaaaguuucuugagggcaggccuguaucuuuuacuucugu

SEQ ID NO: 230334 - RNA, 64 nt, Human
cggaaugggcaacuuucgccccuguggggaggggacggggaaggaagaaagaauuuaaaggacc

SEQ ID NO: 230335 - RNA, 64 nt, Human
ccuguccaccuaugucuuuguaucuacauucuugacggggaaggaacuuccucugggaaccuuu

SEQ ID NO: 230336 - RNA, 64 nt, Human
gaacuuacacuuggagcccgugcaguacaggcaaaacacgcaagggcaucaggcacugguggca

SEQ ID NO: 230337 - RNA, 64 nt, Human
ugggcuacaaaccaggagcaaccgugcagccacgaacacgcaugccucagccagcccuggaggc

SEQ ID NO: 230338 - RNA, 64 nt, Human
cugggccuccucacucaggacuucucuccugaagaacacgcagugcuaaaacugaggaugauuu

SEQ ID NO: 230339 - RNA, 64 nt, Human
ggggucuaugucauugguuucugaugcuuguacaaacacgcacacacaaauggauaaaacagca

SEQ ID NO: 230340 - RNA, 64 nt, Human
gagcacaccccaggacccucacuuuucccuaaugaacacgcaugggcugaaaugaaggcucugg

SEQ ID NO: 230341 - RNA, 64 nt, Human
gugagcuacagagccgagcaauauuuauggaugcaacacgcauggucaacccucaggggaaaac

SEQ ID NO: 230342 - RNA, 64 nt, Human
guaaacugccuauuugcuuaucgggguguauuggaacacgcaauguccuucgaaaccucaacac

SEQ ID NO: 230343 - RNA, 64 nt, Human
aaucagaugucucauauaauaaggugaugucggaaacacgcaaaacaaaacgaaaaaagauuuc

SEQ ID NO: 230344 - RNA, 64 nt, Human
gauuucugcccacuuuaccuacggagacaugauaaacacgcaaaaaaaaccuagaaauuaagca

SEQ ID NO: 230345 - RNA, 64 nt, Human
cagauucuagccaaacuauucuauggccauuacuaacacgcauuguacacuaucuaucugccuu

SEQ ID NO: 230346 - RNA, 64 nt, Human
gcagcuugggcacagguuuacagaccagggaccgaacacgcagccaggggugggaaagcugccu

SEQ ID NO: 230347 - RNA, 64 nt, Human
ggcuugagucuccccgaggccugugcgucucccaaacacgcagcucaagguccacauccgcaaa

SEQ ID NO: 230348 - RNA, 64 nt, Human
uauugacugucuuuccuauagacuguaagcuccaugagggcaggcacauguuguucucauugac

SEQ ID NO: 230349 - RNA, 64 nt, Human
uaacuccucagauuuggaguggcaaggauaaaagugagggcagaaguagcugugggaaaagaug

SEQ ID NO: 230350 - RNA, 64 nt, Human
agacaaaggauuccaaaaagagauguggaggugcugagggcaccucuaucucuuuguuguuuag

SEQ ID NO: 230351 - RNA, 64 nt, Human
augggggcgugccagccuggcaggagugggaagcaacacgcaggggucccggaccucuccagcc

SEQ ID NO: 230352 - RNA, 64 nt, Human
cuuaacuuuguaaaggggauauggacaaguaaguaacacgcaucgcugucccgggcccuggcuu

SEQ ID NO: 230353 - RNA, 64 nt, Human
gcaucccucugggguagcgacagacaaucccagaaacacgcauaauacauuuccguccagcccg

SEQ ID NO: 230354 - RNA, 64 nt, Human
cuaggauuuagaccacuaagaacuugcacagaaaaacacgcauugaaugugugucgaaccucua

SEQ ID NO: 230355 - RNA, 64 nt, Human
ugauaugaagacuugccuuuguguuuuguuaugaaacacgcaagcauaaagcaggacucaagca

SEQ ID NO: 230356 - RNA, 64 nt, Human
uugauggacaguagcauuagaauuguggaaaaggaacacgcaaagggagaagugugagaggaga

SEQ ID NO: 230357 - RNA, 64 nt, Human
ggcagagucccgggaccauggccuccugccacacaacacgcagagaggacucaagacucccgcu

SEQ ID NO: 230358 - RNA, 64 nt, Human
ccugccacccugggccuggcagcucagcuuccccaacacgcaggagcacacccagcccccacau

SEQ ID NO: 230359 - RNA, 64 nt, Human
ggccaaaauagguauauaaaaugugucacagaaaaacacgcauuugcaacguuaaccuaacgaa

SEQ ID NO: 230360 - RNA, 64 nt, Human
ccagggaccacgggcgaggacgugaagccucccgaacacgcacagaaggaaggagccagcuccc

SEQ ID NO: 230361 - RNA, 64 nt, Human
auggguacuguauuugaaagcuguuagcuuugucaacacgcauuguccuugucauuugggcccc

SEQ ID NO: 230362 - RNA, 64 nt, Human
ggaucccgcuucccccucccccaagaagucagccaacacgcagcugaggcgcaugugguggccu

SEQ ID NO: 230363 - RNA, 64 nt, Human
cagcacacgcguuauaguaacucccaucaccucuaacacgcacagcugaaaguucuugcucggg

SEQ ID NO: 230364 - RNA, 64 nt, Human
uggggcugucaauuucuaguuuucacucaugguuaacacgcauuuaaaauuauuucaugagucu

SEQ ID NO: 230365 - RNA, 64 nt, Human
cauugcaggaaccugcucauuaucauguuaaaaaugagggcagaggcuguggcugcaggcagac

SEQ ID NO: 230366 - RNA, 64 nt, Human
auucuguaaauagucccagagagaauucgugggcugagggcaauucugucuuggaggaagaagc

SEQ ID NO: 230367 - RNA, 64 nt, Human
uccugcuucacagacugaguggcaggccuccuccugagggcagccccuggagcaccaggaagcg

SEQ ID NO: 230368 - RNA, 64 nt, Human
acacguacacacagaugcacauggacacaccccaaacacgcacaggcuccuacacacaugcaca

SEQ ID NO: 230369 - RNA, 64 nt, Human
aacuggaagcuaaaaauacagagggugacguagaaacacgcagaaaccauucuaaagaaaguag

SEQ ID NO: 230370 - RNA, 64 nt, Human
uuuuucccccccuuuuagagcauccggaagugauaacacgcaaaaucacaaaguagcauaaauc

SEQ ID NO: 230371 - RNA, 50 nt, Human
gaaaugcccacacuuuuuagaacacgcagauccuuugucuacagagagaa

SEQ ID NO: 230372 - RNA, 64 nt, Human
uauuuauugaaccacuuggucugguuugguuuugaacacgcacuaauucauuuaauuacaacaa

SEQ ID NO: 230373 - RNA, 64 nt, Human
cccucagaaggcuguccugcauuaggaacaagugaacacgcaaaugacaugaaguauuuguugc

SEQ ID NO: 230374 - RNA, 64 nt, Human
uuucucaacgaaugugggaaggaccuggcuuuaaaacacgcacacaaacacacaaauaaacaga

SEQ ID NO: 230375 - RNA, 64 nt, Human
agaagaaauccuuuaagaguuuaaaugucccuggaacacgcauacaggcucuagucaagaauga

SEQ ID NO: 230376 - RNA, 64 nt, Human
agugaucuuuagcuaauaaagaaagagaauagaaaacacgcaugagauauucagaaaauacuag

SEQ ID NO: 230377 - RNA, 64 nt, Human
ugugcugggauagcgcaggaaggugggucccggcaacacgcaggggaugaguggaccuggaacu

SEQ ID NO: 230378 - RNA, 64 nt, Human
ucauaagggcuguugcaaccauaugaacugaaaaaacacgcauuuuguaauccaaauauugaua

SEQ ID NO: 230379 - RNA, 64 nt, Human
acaaugcagugagaucaacagagagaaggagaagaacacgcagcugaagaggaggaucgaggag

SEQ ID NO: 230380 - RNA, 64 nt, Human
agacccaggagagacagagaugcgaaccacccaaaacacgcacacccugccccuggugcccuga

SEQ ID NO: 230381 - RNA, 64 nt, Human
aaauuaaaauccugauguucagguuaauccaagcaacacgcauuggguuuaaaaccagcaccga

SEQ ID NO: 230382 - RNA, 64 nt, Human
aggacagcagcaggaaggaggugcagugcgcagaugagggcacaggagaagcuaaggguuauga

SEQ ID NO: 230383 - RNA, 64 nt, Human
gaagagacacugcagucagggacugaguucuuccugagggcaguuguuugugauugccuucccu

SEQ ID NO: 230384 - RNA, 64 nt, Human
ugccccucuuuguuucugggguggaacuagguccugagggcacagccuagcugagugcaaagaa

SEQ ID NO: 230385 - RNA, 64 nt, Human
aucucuguagccccagaagugaacgccagacaggaacacgcauguguguauauauguguucacg

SEQ ID NO: 230386 - RNA, 64 nt, Human
agucggaauagagccgccccaacucagauccuacaacacgcaaguuccuucuugaacccuggug

SEQ ID NO: 230387 - RNA, 64 nt, Human
gcccuccccucucugcaccguacuguggaaaagaaacacgcacuuagucucuaaagaguuuauu

SEQ ID NO: 230388 - RNA, 64 nt, Human
accucaguguaugguugguauaaggccgcuuacaaacacgcagauggcaagaagauugauggca

SEQ ID NO: 230389 - RNA, 64 nt, Human
ggacuggggaagugcgcacacagcccacacagacaacacgcacccacacagacacagagggaag

SEQ ID NO: 230390 - RNA, 64 nt, Human
uggggcucucuccccuccgcccucugcauucgggaacacgcacguccgcgugggaagcuugcag

SEQ ID NO: 230391 - RNA, 64 nt, Human
accaggucacggagaaacacaaacaccacccaggaacacgcagacauaugcccauagcauccca

SEQ ID NO: 230392 - RNA, 64 nt, Human
aauuaaacuuccaacuucucuaauaaaaaauuaaaacacgcauaacacucgucaagaguauuug

SEQ ID NO: 230393 - RNA, 64 nt, Human
uucuucccuccuggcugcaggcacccccagccagaacacgcagugccagccgugccccccaggc

SEQ ID NO: 230394 - RNA, 64 nt, Human
auuuguuuugugaagaagggaagcuggggcagguaacacgcagagccgccacguggaacggucu

SEQ ID NO: 230395 - RNA, 64 nt, Human
cguccugucaagagcgcuaaugaacguucucauuaacacgcaggaguaccgggagcccugaacc

SEQ ID NO: 230396 - RNA, 64 nt, Human
cgguucguuugaauggaggagguguugagugagcaacacgcagaagcucgccuacaguuucguu

SEQ ID NO: 230397 - RNA, 64 nt, Human
cucagggcagcgccaggcugaccacagcacagccaacacgcaccugccucaggacugcgacgaa

SEQ ID NO: 230398 - RNA, 64 nt, Human
gugggcgauuucuuuuguaaguguaaaauaaaugaacacgcauugaauaccaaacccuccugau

SEQ ID NO: 230399 - RNA, 64 nt, Human
uucccauggugauaacacuaauugaauauaucuaugagggcauguauuaguuaauggaaaaaaa

SEQ ID NO: 230400 - RNA, 64 nt, Human
caccccaugcuucucaccaaauuuuuguugucauugagggcacuuggauaacucaaguugauau

SEQ ID NO: 230401 - RNA, 64 nt, Human
gaaguagaaugcugcuccugcauuaagauuucauugagggcaaggcugguggcagguacuauga

SEQ ID NO: 230402 - RNA, 64 nt, Human
ggauggaaaggacuuggcuaugaacuugacuggaaacacgcagccugcuccuggagcuucacug

SEQ ID NO: 230403 - RNA, 64 nt, Human
aacggccuuuugcuuccagccaaagaacaccgccaacacgcacaccuccaaccugggacauccc

SEQ ID NO: 230404 - RNA, 64 nt, Human
agguuggagaguauugauuucaaauaggaaguugguagacuaggugugaggaugaaauaaugac

SEQ ID NO: 230405 - RNA, 64 nt, Human
uucuuggaauucacuauucuggcaauaaauuuugguagacuaauacaguacagcuagacccaga

SEQ ID NO: 230406 - RNA, 64 nt, Human
guaggauuuuccuacuucuucuguacuuuuaccuguagacuauuuuuacuaaggugcuuuauaa

SEQ ID NO: 230407 - RNA, 64 nt, Human
accagauuuugcauaucuccagguagggaacuaaguagacuaccuuaucaccggcuaagaaaac

SEQ ID NO: 230408 - RNA, 64 nt, Human
ggggucccaggagacuuggacggggggaguuuggguagacuaggaaaggaaagugccauaucag

SEQ ID NO: 230409 - RNA, 64 nt, Human
cuugguggcagcaccacugccugcucccuggaagguagacuauggcauaagugucagcucauug

SEQ ID NO: 230410 - RNA, 64 nt, Human
uggacugccuugauugacauggggaaggggguuaguagacuauguggauugcggcagcagaggc

SEQ ID NO: 230411 - RNA, 64 nt, Human
ucuucuuuuccuuuauccacuuuucuucuuccugguagacuagguuuauuuaucugagcaauaa

SEQ ID NO: 230412 - RNA, 64 nt, Human
gaguuguuuaccuuaccccacacccccucaacauguagacuaaugcagccauuggugguacauu

SEQ ID NO: 230413 - RNA, 64 nt, Human
ugugagaagugcaccaggcagcuuucucucugugguagacuaggcaugucuggggauggccuaa

SEQ ID NO: 230414 - RNA, 64 nt, Human
aauucacuaagugacuaaaguaaguuaaacuuguguagacuaagcauguaauuuuuaaguuuua

SEQ ID NO: 230415 - RNA, 64 nt, Human
gacuucuauagccaucuuuucccuuuuuuggagaguagacuagcaaaacucccuuuuuucucuu

SEQ ID NO: 230416 - RNA, 64 nt, Human
cuucuuuuccaguagaaaauaguuugugaaaugaugagggcauuuuaucugcuugcugugacca

SEQ ID NO: 230417 - RNA, 64 nt, Human
uuauccuaucucuccaaccagauugucagcuccuugagggcaagagccacaguauauuucccug

SEQ ID NO: 230418 - RNA, 64 nt, Human
cacaugauggggaacaacacacacuggggccuguugagggcagggagucggcagagagagagca

SEQ ID NO: 230419 - RNA, 64 nt, Human
uucuucucuuuccaggggaggacccgcagauccuguagacuaucugccagcagcaccucggggg

SEQ ID NO: 230420 - RNA, 64 nt, Human
aaaaccauacagugagccagccuugcaguaggcaguagacuauaagcagaagcacauaugaacu

SEQ ID NO: 230421 - RNA, 64 nt, Human
uuaaaaggugguuaaaauugccuuuaauugcccaguagacuaauuccacagucagaacaugcaa

SEQ ID NO: 230422 - RNA, 64 nt, Human
guccuuucccagugcuuuucuuuuacaagagguaguagacuaguggaaauccccaaauggagcc

SEQ ID NO: 230423 - RNA, 64 nt, Human
ucacaucugcaugauuacagaaaacaugggguauguagacuaguaacacauaagaaaauugcag

SEQ ID NO: 230424 - RNA, 64 nt, Human
cuaaauuauacaucauuguaacuauguagaaaguguagacuaauguauaaucaaaaugcuaagg

SEQ ID NO: 230425 - RNA, 64 nt, Human
gccaccuacaaaaaaacacccaauaucuucucuuguagacuauaugaaucaauuauuacaucug

SEQ ID NO: 230426 - RNA, 64 nt, Human
auaaggacugauucagaaaacgaguuuaugguagguagacuaaaguuucacaucagacuguacc

SEQ ID NO: 230427 - RNA, 64 nt, Human
acauauauacacauauauguguguauguagauauguagacuauccuaaugauguaaaguuuaau

SEQ ID NO: 230428 - RNA, 64 nt, Human
aggagauuauauugguucugccucuggcaugcugguagacuagggccauccuaacuuauuauuu

SEQ ID NO: 230429 - RNA, 64 nt, Human
gaucccucaggaacuuaguagccugagucuuucaguagacuacacugcccagaacccuggccau

SEQ ID NO: 230430 - RNA, 64 nt, Human
agaauuugaauguauuaauugauuuaaacaucauguagacuaaagucuuaaacaucuaagacuc

SEQ ID NO: 230431 - RNA, 64 nt, Human
ugccuuauauuugaaagugccauugcaaucguaaguagacuauguauuuccuauaaugaugucu

SEQ ID NO: 230432 - RNA, 64 nt, Human
uuaauaggaccaaacaauuuggacaugucauucuguagacuagaauuucuuaaaaggguguuac

SEQ ID NO: 230433 - RNA, 64 nt, Human
gaaauuacagauguuauuauaauuacagucaaauguagacuaucaggccaaauuaaaggggagc

SEQ ID NO: 230434 - RNA, 64 nt, Human
uucaguguucaguacaaguuuaaguugcuuucuuugagggcauuuauucugugugacugugggu

SEQ ID NO: 230435 - RNA, 64 nt, Human
uuugugugacuaauugccuagauuguaagcucuuugagggcagggcuugucucuuacacaucuu

SEQ ID NO: 230436 - RNA, 64 nt, Human
ccuggaaucuacaagccaaaagucccucccugccugagggcaguacccuccauugggcacaguc

SEQ ID NO: 230437 - RNA, 64 nt, Human
uuuuucaauaaguauauuuauagugacaaaugugguagacuaaagguaauaaaaaucauugucu

SEQ ID NO: 230438 - RNA, 64 nt, Human
ggguggggggaagagggaaaugacaacugcaaauguagacuauacuguaaaaauucaguuuguu

SEQ ID NO: 230439 - RNA, 64 nt, Human
caaacaaguuuuugaccuuugagccaacccacccguagacuacgaaugucucccuauggcuggu

SEQ ID NO: 230440 - RNA, 64 nt, Human
uuucaacaagugcuaccuuugaguguaaacuaagguagacuacuuugggaaugagaacaugcaa

SEQ ID NO: 230441 - RNA, 64 nt, Human
uugauuaaauucacauuuauauguuuagaaacauguagacuaacgaaugacauaagaaauagug

SEQ ID NO: 230442 - RNA, 64 nt, Human
guauauagagacaauuuuaauggaaauaacuacuguagacuauugaagaaugaucucuuuguga

SEQ ID NO: 230443 - RNA, 64 nt, Human
uacagccaaaggguuggagugugccagugcacagguagacuaaggaaaacauuauagaggagug

SEQ ID NO: 230444 - RNA, 64 nt, Human
aauaaaggaaaaucaaguauaaucccugagauuuguagacuaaaggcaaugaugugggacuacu

SEQ ID NO: 230445 - RNA, 64 nt, Human
caggaggaacgugacaguggauuggguggcuggaguagacuaaagcagucaugugacgaggaag

SEQ ID NO: 230446 - RNA, 64 nt, Human
cuuuaguuaaugaguauuaaauagugcauauucuguagacuauaggguuuacauuguguugcau

SEQ ID NO: 230447 - RNA, 64 nt, Human
ugugcccagcacuccgccccaugccuugcuaaauguagacuaaagaacuuguugaaugcuaagg

SEQ ID NO: 230448 - RNA, 64 nt, Human
uuuuaaacucacauagguagguaucuuuauaguuguagacuauggaaugucaguguucagccaa

SEQ ID NO: 230449 - RNA, 64 nt, Human
acaucuguuaauuuaguguuucuuuguguguuuuguagacuaguguucuuccauccuucaacug

SEQ ID NO: 230450 - RNA, 64 nt, Human
gcggggaguguguggguuggguucguaccagcaaguagacuaggaacugagcccaggaaagggg

SEQ ID NO: 230451 - RNA, 64 nt, Human
uucaaaccaaaugaguacuuauauauggaucucuguagacuagagucuugcagcaacacagaau

SEQ ID NO: 230452 - RNA, 64 nt, Human
caaaggcaucccagccugggggccaguggggaacugagggcaaggggauauagugauggggcuc

SEQ ID NO: 230453 - RNA, 64 nt, Human
uuuaaagauaaaaauaucaucauaguaaaagaaaugagggcauaucggcucacaaagagauaaa

SEQ ID NO: 230454 - RNA, 64 nt, Human
ggcuagaagaaaguaaaaagaacaacacuuguuaugagggcaugugauauuuucacaucuuaau

SEQ ID NO: 230455 - RNA, 64 nt, Human
gauaaaggaauuauuguaugaaauauuacaaagcguagacuaugcauuguuauucauuauaaua

SEQ ID NO: 230456 - RNA, 64 nt, Human
uaucugauggcauuuauugaaaaccuucuaaaaaguagacuaaggaaaccauaaucagaauuac

SEQ ID NO: 230457 - RNA, 64 nt, Human
augagaccgcaaaaauucacuccuggagaucuccguagacuacaaucaaucaaaucaauaguca

SEQ ID NO: 230458 - RNA, 64 nt, Human
gaggggacuucucacguugcucagacugacacauguagacuaaauagaaaccccucagcccuaa

SEQ ID NO: 230459 - RNA, 64 nt, Human
uauccuauuaaauuauuuuugacaagauguccugguagacuaaaggugaacagauuugcucuug

SEQ ID NO: 230460 - RNA, 64 nt, Human
gccaccgcugccagcacagagcguccuucccccuguagacuagugccguagggaguaccugcug

SEQ ID NO: 230461 - RNA, 64 nt, Human
ugagauccucuaccucauaacaaaaggacaguggguagacuaaggcaguagcucaaagggcuuu

SEQ ID NO: 230462 - RNA, 64 nt, Human
cgcggacgcagguccacccucgggcccuagcucuguagacuaacucucggcugcugccccagcc

SEQ ID NO: 230463 - RNA, 64 nt, Human
gcugucucugcuguacagggccucucagccuccaguagacuagacgaaucuucuuuccauagua

SEQ ID NO: 230464 - RNA, 64 nt, Human
ugaaaguugucacccuggaauacgauccugcaggguagacuaaaaaggccccuguggucacuua

SEQ ID NO: 230465 - RNA, 64 nt, Human
ugaugaugauuuuuuuuuuuuuacacaauucucuguagacuaggagaagaaugcuuguguuuuu

SEQ ID NO: 230466 - RNA, 64 nt, Human
auggacaccuccagagccuccaggggaccacacaguagacuaucccuacucuaagcagagacaa

SEQ ID NO: 230467 - RNA, 64 nt, Human
gauauaaccugaaccuuuuuuuggagugggguggguagacuacaguagacacaagggcuggaca

SEQ ID NO: 230468 - RNA, 64 nt, Human
caaguuuucuagcucagacaaacuaugaaaaacuguagacuauucucaagguauuaacucgcag

SEQ ID NO: 230469 - RNA, 64 nt, Human
ggggaccucagccucuauucgcaacucauaauccguagacuacaagaugaaaucucaauaaauu

SEQ ID NO: 230470 - RNA, 64 nt, Human
uguaacaagugccuugugagaaaagcuggagaagugagggcagccagguuauucucuggagguu

SEQ ID NO: 230471 - RNA, 64 nt, Human
aggugaauugcauuuaaauacagucugccuccacugagggcauccugccauucuuuggggacuu

SEQ ID NO: 230472 - RNA, 64 nt, Human
ugccuggcaccuggauacccugggccagguaaccugagggcaggggagaggugggguggcagac

SEQ ID NO: 230473 - RNA, 64 nt, Human
uuuuuacuuaauuucaaaugagugggcugagcauguagacuagcagcuuuuuaucaaaccuggc

SEQ ID NO: 230474 - RNA, 64 nt, Human
cagggccuggacugcacucacagaggcaaguguuguagacuaacaaagauacuccaaaauacaa

SEQ ID NO: 230475 - RNA, 64 nt, Human
cacucgugugcaacagacaagugacuguaucuguguagacuauuugcuuauuuaauaaagacga

SEQ ID NO: 230476 - RNA, 64 nt, Human
cuuggaauuuaauaagucucaggcauuuccaauuguagacuaaaaccacucuuagcaucuccuc

SEQ ID NO: 230477 - RNA, 64 nt, Human
uuuguuuguuuaaaauggcuuucccaaaaucaaaguagacuaaagcagccaucuuuaaaaucca

SEQ ID NO: 230478 - RNA, 64 nt, Human
uuuacuuacagccuuauguuuuuguauuuucuugguagacuagguaauuuuuuuuuaaaggaca

SEQ ID NO: 230479 - RNA, 64 nt, Human
uaaaaagauacaguccauuuuguccugcacacacguagacuaauucacgucauuaaagaagaag

SEQ ID NO: 230480 - RNA, 64 nt, Human
agcccgaaagcugaagcauucagccucugcaaguguagacuacuggacuguaguagaggcauuu

SEQ ID NO: 230481 - RNA, 64 nt, Human
agggaauuuuaagauucaucuuuucaguuugauaguagacuaguuaaggaagaacucuuucauu

SEQ ID NO: 230482 - RNA, 64 nt, Human
aaaauauuucagguaagugaaaguggugcuuaauguagacuauagaaugacuuucagguguuuu

SEQ ID NO: 230483 - RNA, 64 nt, Human
auaaccaaguccuccgaaggcaucucacggaaccguagacuaggaaguacgagccccacagagc

SEQ ID NO: 230484 - RNA, 64 nt, Human
uauuuauagcaugaagaaaaucagacuauauauuguagacuauguauuauucuaacauguaggc

SEQ ID NO: 230485 - RNA, 64 nt, Human
aaagcaaaugcauuaguauguuugccuuaaacuuguagacuaaaccaaguauuguaaaauaaac

SEQ ID NO: 230486 - RNA, 64 nt, Human
auuuuagaaaaucucacuuuauuuuugcuaauaaguagacuaagugcucuguguucucagucuu

SEQ ID NO: 230487 - RNA, 64 nt, Human
gaggcccuguucucaccucaugcugcuccccagaguagacuaacaggcucaguccccuguuguc

SEQ ID NO: 230488 - RNA, 64 nt, Human
aaaucagggcguggcuggacgauuuccuugcaucugagggcagacgcugcuaccggagugaccu

SEQ ID NO: 230489 - RNA, 64 nt, Human
caugggcccuggccugcggggaccugcuggggugugagggcagagggaggguugccaugaagga

SEQ ID NO: 230490 - RNA, 64 nt, Human
gcugaccccucaucacuguggggaucauucucucugagggcagaugaggcgcaggaaaauaguc

SEQ ID NO: 230491 - RNA, 64 nt, Human
cagcugcagaggaggaaagggaaaggguaggccuguagacuaacgcuguuuacacccuuguucu

SEQ ID NO: 230492 - RNA, 64 nt, Human
ggagggauauuagucauuauuuuauucaugacagguagacuacaauucgaacuuaggguuaccu

SEQ ID NO: 230493 - RNA, 64 nt, Human
ugugaggacagcugccgcccggugccaccucgugguagacuaugacggugacucuuggcagcag

SEQ ID NO: 230494 - RNA, 64 nt, Human
ugcauccucacgugcugccucuuuccugugauauguagacuagcacagagugguacauccuaaa

SEQ ID NO: 230495 - RNA, 64 nt, Human
cuaaugaaguacuacaguuuucauucuuucaaggguagacuaaaauauaguuuauaaaucggca

SEQ ID NO: 230496 - RNA, 64 nt, Human
caugcugugugacagaucaacgugcugaugguaaguagacuaggcuuccccaggcaugccgucc

SEQ ID NO: 230497 - RNA, 64 nt, Human
aaucauugcaggaguuguugguauuaggagcaaaguagacuaacuacaacaucaaugccaacaa

SEQ ID NO: 230498 - RNA, 64 nt, Human
gcuguaaauauuagcgauggugccaucuuuugcuguagacuaaacugcaacuucuaaauuccau

SEQ ID NO: 230499 - RNA, 64 nt, Human
uaagucuuaagcuuguuggaaauaauguacccauguagacuagcaaaauaguauguagauguga

SEQ ID NO: 230500 - RNA, 64 nt, Human
ggcagguguauucuaauuugcacaaaggugcuggguagacuaguggcagcucucaugugcugca

SEQ ID NO: 230501 - RNA, 64 nt, Human
uugauaauucuccugaauucacaaucauggacuuguagacuaugaagagauauuuuauuuguuu

SEQ ID NO: 230502 - RNA, 64 nt, Human
gacggugcagggccugggccagccuuacaggucaguagacuagacucgacuacuuggggucagu

SEQ ID NO: 230503 - RNA, 64 nt, Human
gcuuucuaccuguuccaaggcuagaucggaacugguagacuacgcuguaagcaggauuucacua

SEQ ID NO: 230504 - RNA, 64 nt, Human
gauaugacuuccuuuuguaaugcugcugaucccaguagacuaugacuuuugauaauuagcagaa

SEQ ID NO: 230505 - RNA, 64 nt, Human
gauuuucaugccacguuucauagccccacuuuugguagacuaccaccacgcuucuucgcguaag

SEQ ID NO: 230506 - RNA, 64 nt, Human
cagugguccuagugccgcaucagauccaggugggugagggcaggaggccccugcggaggcagcg

SEQ ID NO: 230507 - RNA, 64 nt, Human
ccagcggccaccacccgucaacccugccaggagcugagggcaccacccagcaaccugggccugc

SEQ ID NO: 230508 - RNA, 64 nt, Human
guuuucccaccuguuggcucccgugucugcugacugagggcauucaggaguaaaugcacagguc

SEQ ID NO: 230509 - RNA, 64 nt, Human
uuacuuuaugaacuuaaauggaaauuaauuuauuguagacuacaucucuauuuggaaugaugag

SEQ ID NO: 230510 - RNA, 64 nt, Human
ucugaacuuggugauagcaaugggaacaaaguggguagacuaacagagagcauuaagaaguuaa

SEQ ID NO: 230511 - RNA, 64 nt, Human
uguaauauugaaaacgacgauauaauuauuauaaguagacuauaauauauuuaguaauauauau

SEQ ID NO: 230512 - RNA, 64 nt, Human
guguauaagugcacacagaaauauauauacauauguagacuauauacauguguguauauaugug

SEQ ID NO: 230513 - RNA, 64 nt, Human
gaguggcuuuccauuuugggcagaaugcugacuaguagacuaacauaaaagauauaaaaggcaa

SEQ ID NO: 230514 - RNA, 64 nt, Human
uuucaguuaugacauagaaaaccaaacugcaaguguagacuaugacaaaaaauacacuaauacc

SEQ ID NO: 230515 - RNA, 64 nt, Human
cuuaaauuuauuuaaaacuuuuuuuaauccagauguagacuauauucuaaaaaauaaaaaagca

SEQ ID NO: 230516 - RNA, 64 nt, Human
uugauauugcucuuuugguuaacacuaagcuuaaguagacuauacaguuguaugaauuuguaaa

SEQ ID NO: 230517 - RNA, 64 nt, Human
uuuucccccucccaagaguucucagugucuacauguagacuauuccuuuucuguauaaaguuca

SEQ ID NO: 230518 - RNA, 64 nt, Human
uucucaaauccccagagccuuuaggaacaggagaguagacuaggauuccuucucuuaaaaaggu

SEQ ID NO: 230519 - RNA, 64 nt, Human
uugccuuugaagagugaaauaccauuauuaucaaguagacuacuguucagcuuuuauuccugcc

SEQ ID NO: 230520 - RNA, 64 nt, Human
guaguuguaguagagauaauaauugacauuucucguagacuacccagaaacuuuuuuaauaccu

SEQ ID NO: 230521 - RNA, 64 nt, Human
ugccgggugguccaggcuugcacugaagacgugccacggggaggcuccugcaggaggcucaacc

SEQ ID NO: 230522 - RNA, 64 nt, Human
guguaacuggcugcucccugcucccagggacugacacggggaucaucucugugaccgcccuccg

SEQ ID NO: 230523 - RNA, 64 nt, Human
cuccggacuccucucguacuugaacucacucccucacggggagagagaccacacgcaguauuga

SEQ ID NO: 230524 - RNA, 64 nt, Human
uugccugacaacuuuauguguuaugccagaacucugagggcaaacugcugaaaaacaaaggguu

SEQ ID NO: 230525 - RNA, 64 nt, Human
gacuuuauugcuauaugggaauuacauuuaaauuugagggcauuuuauauaaagaaaaauacag

SEQ ID NO: 230526 - RNA, 64 nt, Human
ucucacagagcuuggaacugcugauagcccuuacugagggcaaaagauggcuauauuguuagcu

SEQ ID NO: 230527 - RNA, 64 nt, Human
ccuacgcagaugcugucacuggcagagcacagcccacggggaucacagcguuucaggaacguug

SEQ ID NO: 230528 - RNA, 64 nt, Human
auaagcagggccagucucagggcccggagacgaacacggggacaauugucaaaggagcggggga

SEQ ID NO: 230529 - RNA, 64 nt, Human
gggagcaggcccaagggcagagcagaggcugaggcacggggagccagccccacucggggaccag

SEQ ID NO: 230530 - RNA, 64 nt, Human
cuuccccccacguagggcacuguaguggaccaagcacggggacagccaugggucccgggcggcc

SEQ ID NO: 230531 - RNA, 64 nt, Human
gugacgugacucagagcuuuucgaacugugcucccacggggaccacugggccccucaggggaag

SEQ ID NO: 230532 - RNA, 64 nt, Human
uucaaguguucuugguuccaggcaccucccggcucacggggagcucagagguccaugccgagga

SEQ ID NO: 230533 - RNA, 64 nt, Human
agugcuccuaggaaagcagaugugaugcuguugucacggggaccugugcugggaggacugagug

SEQ ID NO: 230534 - RNA, 64 nt, Human
acacuacaaaaaggcgcccaucuucaccagcgagcacggggagaagcucuaccucgucagggcc

SEQ ID NO: 230535 - RNA, 64 nt, Human
acgcacuguucaaacgcacuguuuacuuuaagcgcacggggagaaacgaauaaggaggacgugg

SEQ ID NO: 230536 - RNA, 64 nt, Human
ccuaggucccuucccgacccagccagcugcagggcacggggaccuggauaguuaagggcuuuuc

SEQ ID NO: 230537 - RNA, 63 nt, Human
acaucauugagaagugguaguggcggugguggccacggggaggccucuugggggguguggggg

SEQ ID NO: 230538 - RNA, 64 nt, Human
cuugagcccaggaguucgagacaagccuggguaacacggggagacccgucuuuaguaaauaaaa

SEQ ID NO: 230539 - RNA, 63 nt, Human
agccaaaggcacgucccugacagcugaaaauagcacggggaggaauaaugcggacacuuuuga

SEQ ID NO: 230540 - RNA, 60 nt, Human
cgcugccugugcaggucugacaccggcucccacggggacccugaggaccgugcagggaug

SEQ ID NO: 230541 - RNA, 64 nt, Human
ugucguguuuacagagcaaggcuucccugucucccacggggaggggcucgggccucuagucaga

SEQ ID NO: 230542 - RNA, 64 nt, Human
ccacgucugcccaggaaagaacuucagcugacuccacggggaucuggaaauccacgaccaaucc

SEQ ID NO: 230543 - RNA, 64 nt, Human
uuuuaaaauugugguaguucacaagugcagguucugagggcaccgggcaagcacuggccucccc

SEQ ID NO: 230544 - RNA, 64 nt, Human
agaguuauuagagcaagagagagcuuaggaagcaugagggcaacuauagugaggccuuauugcc

SEQ ID NO: 230545 - RNA, 64 nt, Human
ccagcagcugagaacauagcacaggcccacguggugagggcacccacagcuuaaagacgcuucc

SEQ ID NO: 230546 - RNA, 55 nt, Human
ucuguggagaagaugacuaacgugucacggggaagagcucccugcugugugccug

SEQ ID NO: 230547 - RNA, 64 nt, Human
gacgggccugaaggcacaugggggaaagggagcacacggggaggacguuggggacccugggugg

SEQ ID NO: 230548 - RNA, 64 nt, Human
ccucgaggccgcugcgggccaaucuggagugaaacacggggaccugaaggauggagaggcugga

SEQ ID NO: 230549 - RNA, 64 nt, Human
ggccaugugcacuccauccucauguauccuuuuucacggggaccagaacacugguacgucauca

SEQ ID NO: 230550 - RNA, 64 nt, Human
cccacaaacuucaacuccuccauggauggggcgacacggggagaacauacaaacucugccuucg

SEQ ID NO: 230551 - RNA, 64 nt, Human
caggggagucaggguuguagccaagacgcccccgcacggggaggguugggaagggggugcagga

SEQ ID NO: 230552 - RNA, 64 nt, Human
gagguccacagccuuguccagaguuccuguguagcacggggagcaaugauggagggagccccug

SEQ ID NO: 230553 - RNA, 64 nt, Human
gugagguuccuucaagcuaagccagcucagagaacacggggagcgguggugcuacacggacuuc

SEQ ID NO: 230554 - RNA, 64 nt, Human
ggugagaaugggaagcauccauucauugggaaaucacggggacagaggaggaauucacgggauc

SEQ ID NO: 230555 - RNA, 64 nt, Human
gccacaccgcaucuuccggccgucggaccucauccacggggaggugcugggcaagggcugcuuc

SEQ ID NO: 230556 - RNA, 64 nt, Human
aacacucuggagaaggcugagaugccaccauucccacggggacugaagacacauuacguggacc

SEQ ID NO: 230557 - RNA, 64 nt, Human
cuggacagcaucuccucagauggugaauuaugugcacggggaaaccuccugaguggaaguuuca

SEQ ID NO: 230558 - RNA, 64 nt, Human
cccuuuuauuuuuaggauauuguuuggaaaguaacacggggaaacuuuagaaaugcuguuuucu

SEQ ID NO: 230559 - RNA, 64 nt, Human
ccccuugugcggcuuagggcccugucaggaaacacacggggaccucucucucuagcuccagcag

SEQ ID NO: 230560 - RNA, 64 nt, Human
ucuauuguuccccagauaauguucccucaaauagcacggggaagcaacugccuuucaaggguaa

SEQ ID NO: 230561 - RNA, 64 nt, Human
ugggcgccucgcauuugcagucuguugugacagacacggggagcuccgcgugccagccuguggc

SEQ ID NO: 230562 - RNA, 64 nt, Human
acucuguugcucugugaauaaacacccuggcccaugagggcagcccaagcucccagggugaagu

SEQ ID NO: 230563 - RNA, 64 nt, Human
auggcagggucccuguucugagagcucuccagccugagggcauugagcugaggcuccacccuga

SEQ ID NO: 230564 - RNA, 64 nt, Human
auuccgggugccauucccacuaagcuuucuccuuugagggcaguggggagcaugggacugugcc

SEQ ID NO: 230565 - RNA, 64 nt, Human
caccgcguggcugcugcuguccuccuccgggacccacggggaccaaggucacacguuccgugcu

SEQ ID NO: 230566 - RNA, 64 nt, Human
cccuguguguaggcuggggcggggcccaggagaccacggggagcaaaccagcuuguucugggcu

SEQ ID NO: 230567 - RNA, 64 nt, Human
cugccuccaaagaugugcaagggcaggcuggcugcacggggagagggaaguauuuugccgaaau

SEQ ID NO: 230568 - RNA, 64 nt, Human
uucugaauuacuugguauuuagaacuccuagcaccacggggaagaauagagguaucaucaaacg

SEQ ID NO: 230569 - RNA, 64 nt, Human
ccuccacucuaagugauuccuccagggugggaagcacggggagcaauggaaucagauggcucau

SEQ ID NO: 230570 - RNA, 64 nt, Human
ucacuuuggagggggugggguccguuggcaucaacacggggacccucugcuucaccaaagcccg

SEQ ID NO: 230571 - RNA, 64 nt, Human
uggaggaagcgcugcugggcgcccucuuaccgcucacggggagcuggggccauggaugggacag

SEQ ID NO: 230572 - RNA, 64 nt, Human
cgcccaccgcccgcuucucugccaaaaggacgcccacggggagauggccgcacccacagcugcc

SEQ ID NO: 230573 - RNA, 64 nt, Human
acccagcuuauaaaaggauucuuuacugugccagcacggggauuggauccgaagaaacuggcua

SEQ ID NO: 230574 - RNA, 55 nt, Human
gcuccaggagcggcaagugaacagucacggggaggugcugguuccaugccugcuc

SEQ ID NO: 230575 - RNA, 64 nt, Human
acccuuguuggggcauugagaauaucaugagugccacggggaaggggaguagggaugucuuuuc

SEQ ID NO: 230576 - RNA, 64 nt, Human
acaccaaggaggcggccgcuggcccaggagagaacacggggagguuuguuugugugaaaggaaa

SEQ ID NO: 230577 - RNA, 64 nt, Human
gggggggucaccccgaccccucaggcccaccugucacggggaacauggagccuugguguauuuu

SEQ ID NO: 230578 - RNA, 64 nt, Human
gcagaaagcgggugcuguagaggagcacucagcucacggggagggagcucuuggcugagcuucu

SEQ ID NO: 230579 - RNA, 64 nt, Human
ccguucaaaaaggucgcgaauccgugggacugagcacggggaccucacccgcuagccagcgucu

SEQ ID NO: 230580 - RNA, 64 nt, Human
aucccacuaaguuauagccaagaagggaaggagacacggggauuugggguucucugcuugaaug

SEQ ID NO: 230581 - RNA, 64 nt, Human
acagaaaugacugagagaagaaucugcaguuuacugagggcauuucaguuccuccuaccaccuc

SEQ ID NO: 230582 - RNA, 64 nt, Human
cuugugagugggguuuauggggaaagggagggacugagggcagagucucuggguuucaggacag

SEQ ID NO: 230583 - RNA, 64 nt, Human
aacucacgacugcuccugccaacagaagguuugcugagggcauucacuccauggugcucauugg

SEQ ID NO: 230584 - RNA, 64 nt, Human
gggaugccucuuguuagagcguacugcauuuguacacggggagaggagcuauaauuggaacgca

SEQ ID NO: 230585 - RNA, 64 nt, Human
acaacccccuacuuccucccuuggggugcagaggcacggggagagggaggaugagacaauuuag

SEQ ID NO: 230586 - RNA, 64 nt, Human
uccagagaaggggcuucccugucccggagggagacacggggaacgggauuuuccgucucucccu

SEQ ID NO: 230587 - RNA, 61 nt, Human
cccagaaagagccagccugagagacagugggcacggggacagugaucaggcugacagugac

SEQ ID NO: 230588 - RNA, 64 nt, Human
aucaugguguuuucuuaaugccucacauugcuggcacggggaugugcccugccugccagcaccu

SEQ ID NO: 230589 - RNA, 64 nt, Human
caacugagcaggaagaggauggaucaacaagggucacggggaauaggggacccacgggguguga

SEQ ID NO: 230590 - RNA, 64 nt, Human
cggauuaaaaugccuggcgugcucaccguaacaccacggggaaggcugugugccuuuucucauc

SEQ ID NO: 230591 - RNA, 57 nt, Human
aauacgagaacacccaguaacuggggccacggggagagaggaguagccccucagacu

SEQ ID NO: 230592 - RNA, 64 nt, Human
caaacaaaaccacccugacauccuccuucaggaacacggggagcagaggccaaagcacuaaggg

SEQ ID NO: 230593 - RNA, 64 nt, Human
ccauucugaggccagggagcgagugggggccagccacggggacucagcccuuguuucucuuccu

SEQ ID NO: 230594 - RNA, 64 nt, Human
gaacagcccccgaucugcauagccugugaaagcccacggggacaucaguaaccuucugcagcca

SEQ ID NO: 230595 - RNA, 64 nt, Human
uguguacguacauggggaccugucugcauauacacacggggaaugccagaagaaggcccagucu

SEQ ID NO: 230596 - RNA, 64 nt, Human
ucagggacagcuuuguccugagucugccucuguucacggggaugcuuggcuggagucaccccca

SEQ ID NO: 230597 - RNA, 64 nt, Human
cacaguggugcccagggaugugucagcccccagccacggggacgcgggauucaagaaugaagua

SEQ ID NO: 230598 - RNA, 64 nt, Human
uagcagugucgccucgccccucccacugcgggcucacggggagcuggcgucugucagugccuug

SEQ ID NO: 230599 - RNA, 64 nt, Human
ccaucugauuucugcaguucccgccagccuccaacacggggacucugccguaacuggaaucuuc

SEQ ID NO: 230600 - RNA, 64 nt, Human
ggcauuuuuuucuacaguuuuuauuagacuacgaugagggcauucuuucuacauagacugcuug

SEQ ID NO: 230601 - RNA, 64 nt, Human
augcacucacuuuggggcuggaggugacaguaggugagggcagaggaggagaucagaaaauccc

SEQ ID NO: 230602 - RNA, 64 nt, Human
uucauccgccacaaaucuuaauguguugaaagaaugagggcagaaguucagaguaugcaggcuc

SEQ ID NO: 230603 - RNA, 64 nt, Human
caccagggagauccuccauagcuggcuuugaggacacggggaccacagccaugagcggccucua

SEQ ID NO: 230604 - RNA, 64 nt, Human
gugcauaauuccaaguggcuuuuuuuuuuuuuggcacggggacugaucaggaagauauauuccu

SEQ ID NO: 230605 - RNA, 64 nt, Human
uuguuccuacucccacccucagcgaacugggcagcacggggaggguuuggcuaccccugcccau

SEQ ID NO: 230606 - RNA, 64 nt, Human
agacggggauaguaagagauaagugggugggaggcacggggaagguuuuggaguagaaccaggg

SEQ ID NO: 230607 - RNA, 64 nt, Human
guaucuuguucugugacugaagugauacacuaaucacggggaacccagaaugauucaacauuuu

SEQ ID NO: 230608 - RNA, 64 nt, Human
gggggagggaagcgugccuccccaccccuccccucacggggaagguuuccuuuccucgugcuug

SEQ ID NO: 230609 - RNA, 64 nt, Human
ucgucagcguaggcaccugggagcugcugauaugcacggggaguugaaagggugggugccugaa

SEQ ID NO: 230610 - RNA, 64 nt, Human
ggaagcuuuauuuauagaaaugacaauagagggccacggggaggcccccccagaagcaagauuc

SEQ ID NO: 230611 - RNA, 64 nt, Human
uuccagcucacuuuguaccccucaccucugcagacacggggagaaccccggaccccuggcaugc

SEQ ID NO: 230612 - RNA, 64 nt, Human
uuauuucauugcaaaguaauugugucucuccuuucacggggacuugucucacuagcauccuguu

SEQ ID NO: 230613 - RNA, 64 nt, Human
agcauaguucagggccacgcgccugcucccgaugcacggggagaagggcgacuuucaggccuga

SEQ ID NO: 230614 - RNA, 64 nt, Human
aagcugucccugcccagugcaucccccaggucaucacggggacgcaggaggcaggcccugcccu

SEQ ID NO: 230615 - RNA, 64 nt, Human
ggaagaggggggcugucggcugcugcuucugggccacggggagccccaggaccuaugcacuuua

SEQ ID NO: 230616 - RNA, 64 nt, Human
caccccuggggacagaggucagccuaaggugacacacggggacuacugugcuuccggaggcucc

SEQ ID NO: 230617 - RNA, 64 nt, Human
cuugaguccagaaguuuaagaccagccugggcaacacggggagacccugucucuacaagaaauu

SEQ ID NO: 230618 - RNA, 64 nt, Human
cccuccaggagcccccagcauguccugaccugugcacggggauggggggacaacuccuacccuu

SEQ ID NO: 230619 - RNA, 64 nt, Human
cuggucuuacgccaccuucuggacacucccuccuugagggcagaaaggagucccaggccugucc

SEQ ID NO: 230620 - RNA, 64 nt, Human
guggccuugagggagaccccagccccgaggaggaugagggcauccagaaggcauccccucucac

SEQ ID NO: 230621 - RNA, 64 nt, Human
augggaggauuaucuccuaucacagggagcgcucugagggcaaggcugugucuccgauucagac

SEQ ID NO: 230622 - RNA, 64 nt, Human
uuugggggugggggcuccugcacuuugccacaggcacggggaggguuuucuccucacccccucu

SEQ ID NO: 230623 - RNA, 64 nt, Human
gaugcuucugccauccagggguguagugaggacccacggggagccugggccccuuccagccgug

SEQ ID NO: 230624 - RNA, 64 nt, Human
ucagagcauggacagguggauaguaaaucaccaccacggggacagccgugcccagacugugcgu

SEQ ID NO: 230625 - RNA, 64 nt, Human
ccacacagagaaacaaccacgcagacagucacaccacggggacacacggacagacgcagacgga

SEQ ID NO: 230626 - RNA, 64 nt, Human
ggacuggccuguccccgauagaauugaagcaguccacggggaggggaugauacaaggaguaaac

SEQ ID NO: 230627 - RNA, 64 nt, Human
ggcggggcgggggcccgaaagcugagacccucgccacggggagggggacgcgcacacacaccgg

SEQ ID NO: 230628 - RNA, 64 nt, Human
gugauguuaggacagagugagagaagucagcugucacggggaaggugagagagaggaugcuaag

SEQ ID NO: 230629 - RNA, 64 nt, Human
aucuccauccucagcagaugacacugauuggccucacggggacuuggguaagcaacaggcggca

SEQ ID NO: 230630 - RNA, 64 nt, Human
aguuuuaggagacagcuuaggguuuggugcgggccacggggaggggaccgggaagcgcuggggc

SEQ ID NO: 230631 - RNA, 64 nt, Human
ugggggaggccagcccagugcgggcacagcacaacacggggagcagcaagagaugagccagggu

SEQ ID NO: 230632 - RNA, 64 nt, Human
cuggccuggccgcucccauccuguaagcccccaccacggggagacccucaucccugccccugug

SEQ ID NO: 230633 - RNA, 64 nt, Human
caccgugggucaccaaugccagaaaaccagacaucacggggaaagaauguugcuuacuuuuuac

SEQ ID NO: 230634 - RNA, 64 nt, Human
gugaggacugacugccacacauccgccauggugccacggggaccaggaccccacagcgcacccc

SEQ ID NO: 230635 - RNA, 64 nt, Human
accccagcucauccaugugcuuguacccuggccccacggggaggcuugcccuucccugaaucug

SEQ ID NO: 230636 - RNA, 64 nt, Human
agcagagcacacggcaugaggacagagggaggggcacggggagugaaggagggggcccuggggc

SEQ ID NO: 230637 - RNA, 64 nt, Human
ccaugugggacaguugggcuuuguucauucuagccacggggaugaaagggaucuuuugcauugc

SEQ ID NO: 230638 - RNA, 64 nt, Human
uacgcagguacacacguguaccugaguguguucaugagggcaucugguguuuaugugucugagu

SEQ ID NO: 230639 - RNA, 64 nt, Human
cuguggcuagagaacagcaggucugugcagugucugagggcagguugggaaggguagcagagag

SEQ ID NO: 230640 - RNA, 64 nt, Human
auucuaagcacuuacauguggagauacuguaaccugagggcagaaagcccaaugugucauuguu

SEQ ID NO: 230641 - RNA, 64 nt, Human
gucgugaggauggcagagcugcugcauucccccacacggggauuucugugucugcuuggcgacc

SEQ ID NO: 230642 - RNA, 64 nt, Human
cacgugaccccacccgcccaccgccacuaucaggccccgggaccgcacugacaggaaaccuucc

SEQ ID NO: 230643 - RNA, 64 nt, Human
aaaacugccugucuggccgggccgcacuuguggcccccgggaccccaccucuggccccaccucc

SEQ ID NO: 230644 - RNA, 64 nt, Human
ucuccugccugggcagcaacaaccaagaacaaagccccgggacuguuuucuuuuuaauaaagcc

SEQ ID NO: 230645 - RNA, 64 nt, Human
cugccacccccacucucacccccaagcucuaagcccccgggaggccuggacugucuuccucauc

SEQ ID NO: 230646 - RNA, 64 nt, Human
ccauguacagagcccagagaagcccccuacauccccccgggaaaaaaaagaaaacuagacagaa

SEQ ID NO: 230647 - RNA, 64 nt, Human
acaguugcugcaaaguccuggaucugccacucaaccccgggagugguguucccaguguggcucc

SEQ ID NO: 230648 - RNA, 64 nt, Human
agaacgcaggugcuggcgcccguucugccugggaccccgggaaccucuccugccggaagccgga

SEQ ID NO: 230649 - RNA, 64 nt, Human
aagcgacagguaacgcagugcgggguuagggauuccccgggagagaggacgaagcgaggagagu

SEQ ID NO: 230650 - RNA, 64 nt, Human
ggcgaagacagcccgguaggcugcgucgcccgagccccgggagagaggagcgaagauccggaac

SEQ ID NO: 230651 - RNA, 64 nt, Human
agacaagguggcaucucaaccucacccaagaaacccccgggacuuuaccccagcaggcugccac

SEQ ID NO: 230652 - RNA, 64 nt, Human
cuggcugaggcuaggcgcucucaugauccaccugccccgggagggcagcggggaagacagagaa

SEQ ID NO: 230653 - RNA, 64 nt, Human
aggucaaggggccugcuggguuaggcaugcccgaccccgggacaggacuaacccaagggggaaa

SEQ ID NO: 230654 - RNA, 64 nt, Human
gaccaggaccaagaagugaccguggcuccagccaccccgggacauugcuaagaugggagggcug

SEQ ID NO: 230655 - RNA, 64 nt, Human
aggcugggcuggguggcacaccacccgaggggggccccgggacccacggagcccucccuauguc

SEQ ID NO: 230656 - RNA, 64 nt, Human
uaagcacaaguagcagcagcuccugcuugaguucugagggcaucauggcccuaugauuaaccag

SEQ ID NO: 230657 - RNA, 64 nt, Human
ucugauuuccuccuugccuuucuggcugagguucugagggcaccgagacagaggguuaaaugaa

SEQ ID NO: 230658 - RNA, 64 nt, Human
cccugcauuuccugucaugccacagacuggcccuugagggcagccugcuguacuggccaugcug

SEQ ID NO: 230659 - RNA, 64 nt, Human
uucaaguuuagggauugggucgugguggagaaucugagggcacucucugccagcuccacagggu

SEQ ID NO: 230660 - RNA, 64 nt, Human
gcagagaccgcagcaucacccaaaucggcgccggccccgggaggaucucaauaaagaacucgag

SEQ ID NO: 230661 - RNA, 64 nt, Human
cccccccaaucggacugccaaauucuccgguuugccccgggauauuauagaaaauuauuuguau

SEQ ID NO: 230662 - RNA, 64 nt, Human
aaggcagcuuugugagcagagcuccuuccccucuccccgggaacggcagggcacugggaccucu

SEQ ID NO: 230663 - RNA, 64 nt, Human
ugaggggagggugugguggguucuccccugccacccccgggauggcugcuuccaaguuguuugc

SEQ ID NO: 230664 - RNA, 64 nt, Human
gcagggcgaguggccuguccagaccccugugaggccccgggaaagguacagcccugucugcggu

SEQ ID NO: 230665 - RNA, 64 nt, Human
caccuucuggguucaagcgauucucuuuauucagccccgggaguggcgcgcgccaccacgccca

SEQ ID NO: 230666 - RNA, 64 nt, Human
ucccccgccccagccccugacacacacucggaccccccgggaccacaaagccaccgccgcuguu

SEQ ID NO: 230667 - RNA, 64 nt, Human
cuucuuguccacaccccuuauccccaggcuggugccccgggagggcuggagaccaggccauggg

SEQ ID NO: 230668 - RNA, 53 nt, Human
acauccaucagaauuccuagcacccccgggaccccugccgguggcuccaucag

SEQ ID NO: 230669 - RNA, 64 nt, Human
ggacugaggccagagcaaggccaaugucagagacccccgggauggggccucacacuugccaccc

SEQ ID NO: 230670 - RNA, 64 nt, Human
gagaagaaacaggccgaggcccagaguggccugcccccgggagccaaagaccccaguggccaca

SEQ ID NO: 230671 - RNA, 64 nt, Human
uauuuauuaacaggauaacccuugaauguagcagccccgggagggcggcacaggucgggcgcag

SEQ ID NO: 230672 - RNA, 64 nt, Human
uauguuaguaacguguacaaaguuuagguucagaccccgggagucuugggcacgugggucucgg

SEQ ID NO: 230673 - RNA, 64 nt, Human
ccggccccgcgggcggcgggcggcgcuuccugcgccccgggacucaauuaaacccgcccggaga

SEQ ID NO: 230674 - RNA, 64 nt, Human
agcccgcccaggcccacggggggcccacgggaccccccgggacuccccggacauggcccugccc

SEQ ID NO: 230675 - RNA, 64 nt, Human
uuugacagucugcucaacacgacugcaagcuccaugagggcagggacaucaucucuuccaucuu

SEQ ID NO: 230676 - RNA, 64 nt, Human
uggcagacacacaguaaauaauggcugaccagcaugagggcaguacugucagaaauuucuuuga

SEQ ID NO: 230677 - RNA, 64 nt, Human
aacaaacuagcagcuacuaaaauagagaagaaauugagggcaaaguaauaugucuccaaaacug

SEQ ID NO: 230678 - RNA, 64 nt, Human
augccaagagggcguuugggcacugauaugugggugagggcauggaggagggugaguucuccaa

SEQ ID NO: 230679 - RNA, 64 nt, Human
gagcucggggcugggcugccuggcugcuggguggccccgggacaguggcuuuuccucucugaac

SEQ ID NO: 230680 - RNA, 64 nt, Human
cuccacgugcccaaggauucagauggugcacuggccccgggaggagucugaccaaaaauggagc

SEQ ID NO: 230681 - RNA, 64 nt, Human
guagccaugggggaggugggugacaaagauaggaccccgggagggggcgcagguacaugcuagu

SEQ ID NO: 230682 - RNA, 64 nt, Human
ugcugauguuuauuacauuguugguggcacguccccccgggaggggguggucaucacgaggaac

SEQ ID NO: 230683 - RNA, 64 nt, Human
uccugcaccaccuagagccccacccccgaccccaccccgggagggcagagccagaagaaggcuc

SEQ ID NO: 230684 - RNA, 64 nt, Human
gccgaggaccuggccaggccagccacuccugaagccccgggaggagaggaaggcagcggcgaac

SEQ ID NO: 230685 - RNA, 64 nt, Human
ugagauucccaaugccaugggcuuucccccauccccccgggauugggcaaggucagacuuagag

SEQ ID NO: 230686 - RNA, 64 nt, Human
uugccagagcagcaacacuucccugugggcacagccccgggaaauccgguaccaagugagcaag

SEQ ID NO: 230687 - RNA, 64 nt, Human
caucugcaccccugaguugggcagccaggagugcccccgggaauggauaauaaagauacuagag

SEQ ID NO: 230688 - RNA, 64 nt, Human
gagcaguagucauuguuguuuuaaccuccccucuccccgggaccgcgcuagggcuccgaggagc

SEQ ID NO: 230689 - RNA, 64 nt, Human
ccggcuccaugacgcccguggggucaccccccggccccgggacucagccagccucgcuccucgc

SEQ ID NO: 230690 - RNA, 64 nt, Human
caggccccugaugcccggaagcuccugcgugcauccccgggaugaccagacucccggacuccuc

SEQ ID NO: 230691 - RNA, 64 nt, Human
gaaggugggggcacagggcccaccccgcccgggaccccgggagcagaagacgcgccugggcucc

SEQ ID NO: 230692 - RNA, 64 nt, Human
ugccagccccaccacauccuggaagaggagggggccccgggaaggggccuccccuacaucgcug

SEQ ID NO: 230693 - RNA, 51 nt, Human
ccgacuucuguccgcccuaggccccgggacccccggccuccaggcuggggc

SEQ ID NO: 230694 - RNA, 64 nt, Human
ucagauuauggaugauuaaauuugaugacuuauaugagggcagauucaagagccagcaggucaa

SEQ ID NO: 230695 - RNA, 64 nt, Human
gaauugaaaagagacgauaaacauugaaugagggugagggcaucccugcuggggagaaaccucu

SEQ ID NO: 230696 - RNA, 64 nt, Human
caugcaugcauacacacccauacaaacaucugugugagggcaguucuggagaugagcagagaga

SEQ ID NO: 230697 - RNA, 64 nt, Human
guugccacacacagugagggcggagcaggguggcugagggcacaggugccugggucugucccac

SEQ ID NO: 230698 - RNA, 64 nt, Human
gaacaaaucugggcauugagcaagcuaugaggguccccgggagcacacgaacccugccaggccc

SEQ ID NO: 230699 - RNA, 64 nt, Human
aggauaggggcugcccuuuuugucugauaccuggccccgggauagucaggacaggugaauguug

SEQ ID NO: 230700 - RNA, 64 nt, Human
agccucggguggggugggagcgggggggacagugccccgggaacccggugggucacacacacgc

SEQ ID NO: 230701 - RNA, 64 nt, Human
cuuccucgaugggacccgguguaugccaaguggcccccgggaggacgggacccugagccugugu

SEQ ID NO: 230702 - RNA, 64 nt, Human
ugggcccgccccacgcucuguccacacccacgcgccccgggagcggggccaugccuccagcccc

SEQ ID NO: 230703 - RNA, 64 nt, Human
agccucagcggaccacucuucucuccaaggaaauccccgggaagaguuagccuggauagccuug

SEQ ID NO: 230704 - RNA, 64 nt, Human
cucuauguguuuccucuaacgcuaaaggcacagcccccgggaaucuacugcuuccuaagagucu

SEQ ID NO: 230705 - RNA, 64 nt, Human
gggacucagcuccuuucauccugugcucugcccuccccgggagccucagaguuugcuucuggcu

SEQ ID NO: 230706 - RNA, 64 nt, Human
acccaggugcugacgugccgggguugagcuggcaccccgggaugugauguaagaacgcccugcg

SEQ ID NO: 230707 - RNA, 64 nt, Human
ccacagggggccucucugccuccagccccaccuuccccgggagaagcuuuccccaauccccagg

SEQ ID NO: 230708 - RNA, 64 nt, Human
ugcaccgggaccuggggcugggccgccucgugcuccccgggacuguguggcuccggucucgccu

SEQ ID NO: 230709 - RNA, 64 nt, Human
gggaggggcugagagggugggggcuggaaccccuccccgggaggagugccaucugggucuucca

SEQ ID NO: 230710 - RNA, 64 nt, Human
cuuaccuuuuccagugggacaguacagugugagcccccgggaaguacugccugaccuauccuaa

SEQ ID NO: 230711 - RNA, 64 nt, Human
ggagccccugcucugguggggcugccaggggagaccccgggagccggggaaggaggccguccau

SEQ ID NO: 230712 - RNA, 64 nt, Human
acuaccacagggagacagagggagguaagccaucccccgggagaccuugcugcugaccauccua

SEQ ID NO: 230713 - RNA, 64 nt, Human
ggcucaauaacucugaggcugguugcucagccucugagggcaauacaggcauuuaaaaaauuaa

SEQ ID NO: 230714 - RNA, 64 nt, Human
gccugggauaagagucccacagucuagggagaucugagggcauccgacaaggcccaucuccuuc

SEQ ID NO: 230715 - RNA, 64 nt, Human
ggugugcaagaagcccaugggccaggguguggccugagggcaggccagagcugaggggcugcuc

SEQ ID NO: 230716 - RNA, 64 nt, Human
uaauggucaucuccccaguagacuguaagcuccuugagggcaaggauuguguuggaauuuuugu

SEQ ID NO: 230717 - RNA, 64 nt, Human
caugggggugagacccucgcagaccuaagcccugccccgggaugcaccgguuauuugggggggc

SEQ ID NO: 230718 - RNA, 64 nt, Human
acuggucccaagcagaggccuugcccugcugggaccccgggagugagagcagcccaaggaucca

SEQ ID NO: 230719 - RNA, 59 nt, Human
acgccuaccuucacaaaugaagccacagcccccgggacaccguggggaaggggugcagg

SEQ ID NO: 230720 - RNA, 64 nt, Human
uccacgccgacgcccgcccggauugcuccccgagccccgggaccgcuguggaccucgggaccug

SEQ ID NO: 230721 - RNA, 64 nt, Human
uauugucaucaagacguggagccgcucuccacccccccgggacuguuggggggauucugagggc

SEQ ID NO: 230722 - RNA, 64 nt, Human
ugugauuucccguggccccagccuggcccagcucccccgggaggggcccgcuugccucggcucc

SEQ ID NO: 230723 - RNA, 64 nt, Human
uugaaaaagaaaagagagaacagcccauaaugcuccccgggagcagaggccacuaauggagagu

SEQ ID NO: 230724 - RNA, 64 nt, Human
ugccccauucucacugcuaucuggggagugauuaccccgggagacugaacugcaggguucaagc

SEQ ID NO: 230725 - RNA, 64 nt, Human
aaggaaggaaggaagggcugcuggagcccagucaccccgggaccgugggccgaggugacugcag

SEQ ID NO: 230726 - RNA, 64 nt, Human
aggggcgggacccaggcaccugcauuuuaaagcgccccgggagacucugaaucuuuuucagaaa

SEQ ID NO: 230727 - RNA, 64 nt, Human
aggacugucuucucacccuuccccacucccugguccccgggagcagcuccuucugcccgacuca

SEQ ID NO: 230728 - RNA, 64 nt, Human
cacagacagccccaccuggggcgcucagccuggcccccgggaaagaggaaaacccgcugccucc

SEQ ID NO: 230729 - RNA, 64 nt, Human
gauaguccccucuccugcaucccuccaccccaguccccgggaaaggccggugggaagagggcag

SEQ ID NO: 230730 - RNA, 51 nt, Human
ggcuggcggcugcugucugagccccgggagaccaggugggggcaggacugu

SEQ ID NO: 230731 - RNA, 64 nt, Human
cugcugccccagccugacauguguccaggccccuccccgggagguacagcuggcagagggaaag

SEQ ID NO: 230732 - RNA, 64 nt, Human
gugauuccaaauuaaaaguuuucuuucuccaaccugagggcacggccaaaaagaucugguuauu

SEQ ID NO: 230733 - RNA, 64 nt, Human
aaagugaacagcauggauuaacucauccugcugcugagggcagugcaaacaggugcuuauuaga

SEQ ID NO: 230734 - RNA, 64 nt, Human
caccugcaggcaagguacccgaagaagcagaggcugagggcaggcaaagccugugugacugugg

SEQ ID NO: 230735 - RNA, 64 nt, Human
ggugggcaccucuaaucccagcuacuugggaggcugagggcaggagaauugcuugaauccagga

SEQ ID NO: 230736 - RNA, 64 nt, Human
cagaggcacgcgaacugucagucuuuccuaaggcccccgggagacgcaggcaauggggccucgc

SEQ ID NO: 230737 - RNA, 64 nt, Human
acagucuuccaaguaggaaacuuccuuuccccugccccgggacccuaucugccuauccccuccc

SEQ ID NO: 230738 - RNA, 64 nt, Human
ccggggccagagacauaugggccauaccccuuaaccccgggaugcaagguagcauggguccaag

SEQ ID NO: 230739 - RNA, 64 nt, Human
cucacccucuaccucccugugcucaugcacuaggccccgggaagccuguacaucucaacaacuu

SEQ ID NO: 230740 - RNA, 64 nt, Human
gccagagggaggguuuaguacaugggagggcuagccccgggacuuggggccaauacggaaaccc

SEQ ID NO: 230741 - RNA, 64 nt, Human
gcaagagccagggggcccucuucagcgcauccugccccgggagucuccugucuccuuggaccuc

SEQ ID NO: 230742 - RNA, 61 nt, Human
acgcgcccgcuggccccugaggccgguccugccccgggaggucuccccggcccgcaucccg

SEQ ID NO: 230743 - RNA, 64 nt, Human
ugagcaguaggggcugcaucgcacagcgcucgucccccgggacuuacacugcaugauucccuca

SEQ ID NO: 230744 - RNA, 64 nt, Human
ccucuaccacaggacacauaucccuguuagcauuccccgggaccuuuagccaagaggagcugca

SEQ ID NO: 230745 - RNA, 64 nt, Human
accaaacaggugacugucaagcugcccaacugugccccgggagucgaccccuucuacaccuauc

SEQ ID NO: 230746 - RNA, 64 nt, Human
acuucuuuaaacaucuuucagcccagcgcugcggccccgggaagggccacugcgaauagagagg

SEQ ID NO: 230747 - RNA, 64 nt, Human
ccaacaucuauggugucccaggcacagugccaggccccgggaguggggaccaagauguacauaa

SEQ ID NO: 230748 - RNA, 64 nt, Human
aacaggccugcucacaacugccccucaaguucaaccccgggaccgcccagccccgcaaagcaaa

SEQ ID NO: 230749 - RNA, 64 nt, Human
ugcuugugcuucugcgcuucugagggcuguucucccccgggaaccaucuguccccaccuucccu

SEQ ID NO: 230750 - RNA, 64 nt, Human
gcuccauccucuugaaagguggauucagagggacccccgggacaagggucugagacccaaaggc

SEQ ID NO: 230751 - RNA, 64 nt, Human
ccagggaccagcaccuucaagcgcuccagggccgugagggcaagagggggaccugccaccaggg

SEQ ID NO: 230752 - RNA, 64 nt, Human
aguguggguacauuugaaggcaagugacuucaguugagggcaagucucuggaaaagaggcugua

SEQ ID NO: 230753 - RNA, 64 nt, Human
caucggaauucagccaugaaacugacucaucaguugagggcagcuccagugccagcaauagggu

SEQ ID NO: 230754 - RNA, 64 nt, Human
aaccgguggauccucaaacaacacuggugugaccugagggcagaaagguucugcccgggaaggu

SEQ ID NO: 230755 - RNA, 64 nt, Human
uuaggacccuucccacagccccgcugugguccagccccgggacccauggccucucuccaggccc

SEQ ID NO: 230756 - RNA, 64 nt, Human
ucggaguucagacucucagaccugaaguaggcgcccccgggacugggcuaggaguuggacggaa

SEQ ID NO: 230757 - RNA, 64 nt, Human
cagagcggccaucgcguagaaagaaccaggguguccccgggacaggccgucccccaccccaucc

SEQ ID NO: 230758 - RNA, 64 nt, Human
ugagggcugaaaauauccuccccacaagggcaauccccgggaccugccgagcagccaaggcccu

SEQ ID NO: 230759 - RNA, 64 nt, Human
gggagcaaggcccugcagcuccacgagaccuuuaccccgggaagaagccgccacccaugaaagc

SEQ ID NO: 230760 - RNA, 64 nt, Human
ccgguccauggcgguguccugcggaccccagagcccccgggaagggcgcaagucaaagagcacu

SEQ ID NO: 230761 - RNA, 64 nt, Human
gaugcgggaucccgagggccuuccugcccacaugccccgggagaaaccgaggccccucccuccu

SEQ ID NO: 230762 - RNA, 64 nt, Human
cugccguguauuuccuccccagggaguggggccuccccgggagcugacgccaccacccugcuua

SEQ ID NO: 230763 - RNA, 64 nt, Human
gcugggccuccugcccgcgcgggaggggagggcgccccgggaccagggauggggcagcgcacag

SEQ ID NO: 230764 - RNA, 64 nt, Human
cuuccccaaccacaaagguguuugugauuccucaccccgggaaaccaaggagcugcaaagugga

SEQ ID NO: 230765 - RNA, 64 nt, Human
guccggucggaguuguagccagucuuucaggggaccccgggacgcugaugaggcccagggugca

SEQ ID NO: 230766 - RNA, 64 nt, Human
ggccugccugugucugcugccgagaagcccgugcccccgggagggcugccgcacugccaaagag

SEQ ID NO: 230767 - RNA, 64 nt, Human
gcuuuaaucagugugauuaaugcagcacccauugccccgggaaccguuucugcuguacuaucug

SEQ ID NO: 230768 - RNA, 64 nt, Human
uguccaauccccgcgccccacacugcccagcgccccccgggaccuccgcgggugccgcccucgc

SEQ ID NO: 230769 - RNA, 64 nt, Human
aaaggaccuggagucacagcgaauccccgccccgccccgggaagccaccaaaccuugcuuuuuc

SEQ ID NO: 230770 - RNA, 64 nt, Human
uagaaauuguuucaaaucauacucuaacccuuagugagggcaaaguguaguugguagaagaaau

SEQ ID NO: 230771 - RNA, 64 nt, Human
ugcgagugugucugauuucauaacgaagccaggcugagggcaagaggcccgacaggcaggccag

SEQ ID NO: 230772 - RNA, 64 nt, Human
gaaagggacuaccaacucucuggagucucuuuuaugagggcacuaauuccaauuaugaagccuc

SEQ ID NO: 230773 - RNA, 64 nt, Human
ugaaaggaaaucaaaaauaggcuaaacagaauuuugagggcauggcccaaauaacucaugaguu

SEQ ID NO: 230774 - RNA, 64 nt, Human
gcuuguggccucacuaaagguggggucgcuuaguccccgggaguaaaaugagugaccucagaaa

SEQ ID NO: 230775 - RNA, 64 nt, Human
aacaggcuccggagggagccggcgucugaaaggcccccgggaccugcugcagugccagaggggc

SEQ ID NO: 230776 - RNA, 64 nt, Human
ccaccaugaggcauggagcagggcagagcaagggccccgggacagaguuuucccagaccuggcu

SEQ ID NO: 230777 - RNA, 64 nt, Human
agauugggucuaggauaugguggguggacaggggccccgggacuuggaggguugguccucuugc

SEQ ID NO: 230778 - RNA, 64 nt, Human
ccacuggcuuccuuggacauagaucagacaaaagccccgggaucuguuugguagcaggagaaau

SEQ ID NO: 230779 - RNA, 64 nt, Human
ggacugacggaugacucucacgucuccuccauagccccgggaccguguugcuccaguauuaacc

SEQ ID NO: 230780 - RNA, 64 nt, Human
cuaggccugcuccuccacccuucccgggaggcagccccgggaugcugagaguugguggaggggc

SEQ ID NO: 230781 - RNA, 64 nt, Human
gaagccccggagauguagacgccacccugcccacccccgggauccugcccccaagucauuuccg

SEQ ID NO: 230782 - RNA, 64 nt, Human
cgccuuuuccuaagcaccagcggaaggagcugugccccgggauggagugaggguggagggcgcg

SEQ ID NO: 230783 - RNA, 64 nt, Human
ccgucgccgucgccccggcuccccugggcgcccaccccgggacacagaacuagugagcgccccc

SEQ ID NO: 230784 - RNA, 64 nt, Human
acguuggccugggcuagggcugagacgcuucggaccccgggaaaggccauacgaagaaacagca

SEQ ID NO: 230785 - RNA, 64 nt, Human
uggaagucaggaccuugcucuucucuauuggaggccccgggaucucucgcaguguggggauuug

SEQ ID NO: 230786 - RNA, 64 nt, Human
ggauuaggcuggacugaucgcgggucgcaggugaccccgggaccagaugucccuccccucauga

SEQ ID NO: 230787 - RNA, 64 nt, Human
aauaccgcagaccuuggggaggaagcugagcaucccccgggaugucuccaguccugacacaguc

SEQ ID NO: 230788 - RNA, 64 nt, Human
gccuuucucugaggggacaccccgccagagagggccccgggagccggggguggguacugaggcc

SEQ ID NO: 230789 - RNA, 64 nt, Human
gacaccuggauuggcuccaucacaucagaguggcugagggcaguugcucuguguuggugaaauu

SEQ ID NO: 230790 - RNA, 64 nt, Human
agauucauuuagucaaagacaaaagcuuuaacugugagggcacagccuugaagugggagugaug

SEQ ID NO: 230791 - RNA, 64 nt, Human
uacugaaaauggaccugccuuucacugaauuuucugagggcagagucuuagcuguuuucuuuaa

SEQ ID NO: 230792 - RNA, 64 nt, Human
cugcaggggccgcgccuggcucaggcggccccacccccgggacguggggucacuuccuucaugu

SEQ ID NO: 230793 - RNA, 64 nt, Human
gcgcccacuggagacagacagacagacgccugucccccgggaccgaggccugugccguccccac

SEQ ID NO: 230794 - RNA, 64 nt, Human
cuccagacagcaccuggguccucgccacccuaagccccgggacaccuguuggagggcggauggg

SEQ ID NO: 230795 - RNA, 64 nt, Human
aaagacugcgcgugcguagagcacgccggcgcggccccgggacucucgcgauaacuguacugag

SEQ ID NO: 230796 - RNA, 64 nt, Human
ggcggguacacacccugggcacaggguccucagcccccgggaaaugagcucccagggcuggcgu

SEQ ID NO: 230797 - RNA, 64 nt, Human
aauuaaaaccaacauaucagcaauagucugcucuccccgggaaucucuaacaugcucuguuuac

SEQ ID NO: 230798 - RNA, 64 nt, Human
gcuccuugcaaagacagcagcgugcggggcagagccccgggagggcgcgucuguccacgccuac

SEQ ID NO: 230799 - RNA, 64 nt, Human
cucuaccuccacccccaccggccugacgcuguggccccgggacccagcagagcugggggaggga

SEQ ID NO: 230800 - RNA, 55 nt, Human
agcagcagcagccuguguagucugcccccgggaaacugaggaacuaaagaaagcu

SEQ ID NO: 230801 - RNA, 64 nt, Human
gaguacuggccucauuaaggauuauaaauuuucuccccgggaagaaacccugacuaacgcauug

SEQ ID NO: 230802 - RNA, 64 nt, Human
cccgcccuccccgcgugugcgccaggcuugggguccccgggagagcagagcuugcgccucgggc

SEQ ID NO: 230803 - RNA, 64 nt, Human
uccaggagaugcugcuucaggcgccgccacugggccccgggacccccacggcgcugcccgauga

SEQ ID NO: 230804 - RNA, 64 nt, Human
cugcagcagugccccugccagccccgaaucccacccccgggaccagccacauccacagcacaac

SEQ ID NO: 230805 - RNA, 64 nt, Human
ucucucguggucucacuuuguuacuuguuucuguccccgggagccucagggcucugagagcugu

SEQ ID NO: 230806 - RNA, 56 nt, Human
cgcuggccguggaacggugacggccaccccgggacugcaggcggcggaugucaggc

SEQ ID NO: 230807 - RNA, 64 nt, Human
ugugauggcuccugcacaggcccugcacauaggaugagggcaucugcucccacucagccuagcc

SEQ ID NO: 230808 - RNA, 64 nt, Human
agcuggaggugcuggagaggacauacggggaaauugagggcacggugucgaggguauugggccg

SEQ ID NO: 230809 - RNA, 64 nt, Human
cgcuugcuucagcacauugggaugcacagaaacgugagggcaggggggcaguuguggucgcccc

SEQ ID NO: 230810 - RNA, 64 nt, Human
cccauuaggucccucacuccacagagugagccagugagggcaguccugcaacauguauuuaugg

SEQ ID NO: 230811 - RNA, 64 nt, Human
guccaaagcgggaaucaugugccccucagcggagccccgggaguguccaagacagccuggcugg

SEQ ID NO: 230812 - RNA, 64 nt, Human
ccccagacuauggucacagggccguccuguuccuccccgggacuccagaauuucucuccucaaa

SEQ ID NO: 230813 - RNA, 64 nt, Human
gcgucaccuggggacuccccacugucagcagcagccccgggacacccuacccccagcaacccca

SEQ ID NO: 230814 - RNA, 64 nt, Human
cacgcugugcugcgcgcgcucaugcacgcggccgccccgggagccgccgaccugcccugcugcg

SEQ ID NO: 230815 - RNA, 64 nt, Human
accaacugcccccguggucgccugguggcuggacccccgggauugacuagagaccggccguaca

SEQ ID NO: 230816 - RNA, 64 nt, Human
cgccugcgcccacuaucaucccugcuccagcugcccccgggaagccagccuccgcagccaccgu

SEQ ID NO: 230817 - RNA, 64 nt, Human
cccuggcugccgcugggcgggaaccccaacagggccccgggagggaacccugcccccaaccccc

SEQ ID NO: 230818 - RNA, 64 nt, Human
cagccaaguaggagggggcugggccgcgcccgcaccccgggagccuccucaggcucccucuauu

SEQ ID NO: 230819 - RNA, 64 nt, Human
acccucugccccuuccucucugccccaaacucuuccccgggaagggggacagacccaccccagc

SEQ ID NO: 230820 - RNA, 51 nt, Human
agaaggaaucagucauguaaaccccgggagggaccuucccugcccugcugg

SEQ ID NO: 230821 - RNA, 64 nt, Human
uguuucugcugggggcaggcuccucuucccccagccccgggagccucccccagcuuccugcagc

SEQ ID NO: 230822 - RNA, 64 nt, Human
cgacccucgcggacacacccagaugccccagggaccccgggaagggaaggcagccugguuucuc

SEQ ID NO: 230823 - RNA, 64 nt, Human
cugcucuggggaagccgagggacagccauaacacccccgggacaguaggucugggcggcaccac

SEQ ID NO: 230824 - RNA, 64 nt, Human
ugagccccggacccgcuggggccucuggccugcuccccgggaggggcgcucucucccggccaug

SEQ ID NO: 230825 - RNA, 64 nt, Human
ugggauugucugguuucccuuacagggcccccucccccgggaaugcgcccaccaaggcccuaga

SEQ ID NO: 230826 - RNA, 64 nt, Human
cauguacuauguaugcauuggugguaaauggaugugagggcaaguacaucaaguacauucacuc

SEQ ID NO: 230827 - RNA, 64 nt, Human
cuuuccuuccagggccaugcuuggcaagguuggcugagggcacccuccuucucugcacccuugg

SEQ ID NO: 230828 - RNA, 64 nt, Human
cacuaaaacccacuaaaaagaugcgaaaaccugaugagggcaaaccaguuaaaccuaacacccu

SEQ ID NO: 230829 - RNA, 64 nt, Human
ccccaggagaggggagcuguguagugagggauacugagggcaguccuguggcugaggggcacag

SEQ ID NO: 230830 - RNA, 64 nt, Human
caguuuagcugcaucugucuccccaccacccccaccccgggaggggcuuauguuacaaggugau

SEQ ID NO: 230831 - RNA, 64 nt, Human
auaacaacugagccagaccugcacacgccgagggccccgggacccugccugccucccucuggag

SEQ ID NO: 230832 - RNA, 64 nt, Human
uggagcauuguucugccacagcccugcauacugaccccgggaggcugggcagguggacagcccc

SEQ ID NO: 230833 - RNA, 64 nt, Human
ccacgccugggccuggcuucaccucacccuaaucccccgggagggagcugacugaugcaaaaag

SEQ ID NO: 230834 - RNA, 64 nt, Human
gccuccagaaccucagagcuucccuggugggcucccccgggauccccagugucucucugcaccu

SEQ ID NO: 230835 - RNA, 64 nt, Human
cuguccuccugggaguggacggccgggucccgucccccgggagcaucgcucggcucagcaccuu

SEQ ID NO: 230836 - RNA, 64 nt, Human
auuaaacccugccccacuucucuacucuggaaguccccgggagccucuccuugccuggugaccu

SEQ ID NO: 230837 - RNA, 64 nt, Human
ccaaagacccgcgggcgcccucugccaccuugcuccccgggaacccauggaaggagaagcgagg

SEQ ID NO: 230838 - RNA, 64 nt, Human
accccaucugucucuauugucccccugccccaggccccgggaucagcugcccccccauccccgc

SEQ ID NO: 230839 - RNA, 64 nt, Human
ucagcacacacacagcucagacccacggacaggaccccgggacagaaccccgggagcacugccc

SEQ ID NO: 230840 - RNA, 64 nt, Human
agcucagacccacggacaggaccccgggacagaaccccgggagcacugcccuaggagcccggac

SEQ ID NO: 230841 - RNA, 64 nt, Human
aaccccucugaagcugggcagcccucuaccugggccccgggagccgugcuccuuggaacgcaaa

SEQ ID NO: 230842 - RNA, 64 nt, Human
cucaggucuccugacaaacacagccccugaggggccccgggaguggccuuggcucccuggagag

SEQ ID NO: 230843 - RNA, 64 nt, Human
caugaagccacgggugccagaagcuacugcgaugccccgggaguuagcccccugguaauagcug

SEQ ID NO: 230844 - RNA, 64 nt, Human
gccagggcccacagcguggcccuagcccuccccuccccgggauguagaacggggacccucgcag

SEQ ID NO: 230845 - RNA, 64 nt, Human
aaaccauaaaaagcugaccacaggcaguuacuucugagggcaucuugguccaggaaaugugcac

SEQ ID NO: 230846 - RNA, 64 nt, Human
ucaacaucuuuaugaucuauugccuauauaucugugagggcacauauucauaaauauacuguca

SEQ ID NO: 230847 - RNA, 64 nt, Human
ccccacccacccuugggggagcaugaugggcaggugagggcaggauggagaccaagggagucag

SEQ ID NO: 230848 - RNA, 64 nt, Human
aauaaagcccuaaauacauuuuuauucuuucuacugagggcauugucuguuuucuuuguaaaug

SEQ ID NO: 230849 - RNA, 64 nt, Human
caccaaagaacgaggggcccaggucuuguuggcaccccgggagccacugcccagggugauggug

SEQ ID NO: 230850 - RNA, 64 nt, Human
ccagggcuuucuggaggacgcgcuggggccgggaccccgggagacucaaagggagaggucucag

SEQ ID NO: 230851 - RNA, 64 nt, Human
gcucccggaccaccugcccagcguuggcgaggagccccgggaggugcuucugcggcuguacgga

SEQ ID NO: 230852 - RNA, 64 nt, Human
ccgcgucuccuguaggccccaaggcgcugagcagccccgggaaacugucgccgucgccgcaucu

SEQ ID NO: 230853 - RNA, 64 nt, Human
aggguggggguagggaccacgcaugagucgaagcccccgggaagagccaaaggccaaagugccc

SEQ ID NO: 230854 - RNA, 64 nt, Human
ggcccugugccagugaggacaggagacccuaaggccccgggagcccagugccagccagagguug

SEQ ID NO: 230855 - RNA, 64 nt, Human
agcugaggaguccuguguucccccgcaaggagcaccccgggaucauuuucuagguucauuucuc

SEQ ID NO: 230856 - RNA, 64 nt, Human
aaguuuauuuuggugaaguuguucccauucugagccccgggacucuuauucugaugauguguca

SEQ ID NO: 230857 - RNA, 64 nt, Human
gaugggaggaagugcagcaggaauagcacccucuccccgggaggcccuagcuuccgugaggggc

SEQ ID NO: 230858 - RNA, 64 nt, Human
ggaagugcuuggaagugucaucuacccuggccauccccgggaucccuccccugcuaaucugaac

SEQ ID NO: 230859 - RNA, 64 nt, Human
uggagcuccuuccgcggccaccgugcuccgggcaccccgggagcuccugcaagaggccugagga

SEQ ID NO: 230860 - RNA, 64 nt, Human
gcagagcauuggacuuggcuggccagagggucucugagggcaagagacauggccaaccaagggc

SEQ ID NO: 230861 - RNA, 64 nt, Human
aaauaacucuuuggauccuacagagauagccuacugagggcaaagaaaguccuuagauaaagag

SEQ ID NO: 230862 - RNA, 64 nt, Human
ugagaauguguauggaaaauucuuuuugugcauuugagggcaaaauucaggccaucuucuuaua

SEQ ID NO: 230863 - RNA, 58 nt, Human
cagucaccucuggacccugagagcugaaugagggcaucauaggccagacaggcccaag

SEQ ID NO: 230864 - RNA, 64 nt, Human
guuugccugucuccccacccaucagugaaaucccugagggcaggggcugucucauucaucugug

SEQ ID NO: 230865 - RNA, 64 nt, Human
ccgggcugcccccgccagcucuggcuguuuagcuugagggcagcacagaggccccugggacacc

SEQ ID NO: 230866 - RNA, 64 nt, Human
gcguggacugcagaaguggcucacgcuccuguggugagggcagggugcuccacagacaccucca

SEQ ID NO: 230867 - RNA, 64 nt, Human
acggauacagaaacugagacacguggagacuggaugagggcagaugaggacaggaagagagugu

SEQ ID NO: 230868 - RNA, 64 nt, Human
cguuuuaucuauuuucucuacggcuuaggcuaugugagggcaaaacacaaaucccuuugcuaaa

SEQ ID NO: 230869 - RNA, 64 nt, Human
ugguagggucccagggucccuaggccuccacuucugagggcagccccucuggugccaagagcuc

SEQ ID NO: 230870 - RNA, 64 nt, Human
uggcuucucagucugcaucuuggaggcagggaggugagggcaggugccccucagacacuucagg

SEQ ID NO: 230871 - RNA, 64 nt, Human
uccuccccaaaacaccccagcuuucuggcuuuucugagggcaagggcauggugcccaccccuca

SEQ ID NO: 230872 - RNA, 64 nt, Human
uguauacuuauauggaaucugcaugugagguguuugagggcauauguuugaaagagggagcauc

SEQ ID NO: 230873 - RNA, 64 nt, Human
acuucccugaggccucuggacccaucugucuuccugagggcagcccaggaccuuuggccaaucc

SEQ ID NO: 230874 - RNA, 64 nt, Human
gagggcgggcggcuccgaggagcgagagucgggcugagggcaaccuggcgccagggaaaauucu

SEQ ID NO: 230875 - RNA, 64 nt, Human
cugggaacauguaccacugagccugagauggggaugagggcagagagaggggagcccccucuuc

SEQ ID NO: 230876 - RNA, 64 nt, Human
ugccagcaacaccugccguaaguuacuggcugagugagggcauagaaguuaaagguuacuguuu

SEQ ID NO: 230877 - RNA, 64 nt, Human
ugaaaaaugugauuggcuuccucucgccguguugugagggcaaaggagagaagggagaaaaaaa

SEQ ID NO: 230878 - RNA, 64 nt, Human
caccaaacguucccuugcagauggagacugaaucugagggcagcagacuuuuaucagcuugagu

SEQ ID NO: 230879 - RNA, 64 nt, Human
aauccuccaagcuucaaucugcacacacuuucuaugagggcagguacaacuauuaagagauuuu

SEQ ID NO: 230880 - RNA, 64 nt, Human
uuaaugagaugucgacuugguucaggucuaaaaaugagggcaaaacacuaaggcucuagcagug

SEQ ID NO: 230881 - RNA, 64 nt, Human
agugaggcccaggcgccgagacccaaggcgccacugagggcaccgcgcaccagagcgugaccuc

SEQ ID NO: 230882 - RNA, 64 nt, Human
uccugcuggcacuucgcuucuguggccuuggcauugagggcacaggcuggacacaggaaugggg

SEQ ID NO: 230883 - RNA, 64 nt, Human
aaccuggccacugucccuguccuucuacagaaccugagggcaaagaugguggcugugucucucc

SEQ ID NO: 230884 - RNA, 64 nt, Human
cccauuucagugucuggggcucugguagauguguugagggcaaaguagaggacaagcugucuuu

SEQ ID NO: 230885 - RNA, 64 nt, Human
ugugucugucucccccaccagacugugagcuccaugagggcagggaccgugucuuguccguucu

SEQ ID NO: 230886 - RNA, 64 nt, Human
cccaguccuucaccugcccugugucagugucuucugagggcaauugcguugcucaaaucacuag

SEQ ID NO: 230887 - RNA, 55 nt, Human
aucuccaaugugccgcauaaaggugugagggcauaggagaaacacuaggcuggcu

SEQ ID NO: 230888 - RNA, 64 nt, Human
auucacccugggcagugagugccaugcuuuuuggugagggcagaucccagcaccuauugaauua

SEQ ID NO: 230889 - RNA, 64 nt, Human
cucagccccaggggacacagaugcacuuugggggugagggcagguaaugacuccaucgcacccu

SEQ ID NO: 230890 - RNA, 64 nt, Human
ccaccccacccccacauuccuuugaccagccuugugagggcaucgaugcugccccgggcuaccu

SEQ ID NO: 230891 - RNA, 64 nt, Human
guggccggacaguggcugagcacguggaagccauugagggcagcguccaggagagcucgggccc

SEQ ID NO: 230892 - RNA, 64 nt, Human
ggaggcgucgggggccuuagcagaaggggaacaaugagggcauuucaugaaccaucucaggcac

SEQ ID NO: 230893 - RNA, 64 nt, Human
uugaccacuuuggguuugaccugcacaucugcagugagggcagaauucaacaagcacaacucac

SEQ ID NO: 230894 - RNA, 64 nt, Human
aggcacacuccucuucuguuggacaggugagcucugagggcaagcccugggcccagccacgcag

SEQ ID NO: 230895 - RNA, 64 nt, Human
ccauaggaugggaggauagggagccccucaugacugagggcagaagaaauugcuagaagucaga

SEQ ID NO: 230896 - RNA, 64 nt, Human
caggaacccuaaugagaacggggagcugccagggugagggcagcccucagggucggccgcuuuc

SEQ ID NO: 230897 - RNA, 64 nt, Human
cagggauggaaggaagaggguuucuugggcugguugagggcagauugggggugucucaucagag

SEQ ID NO: 230898 - RNA, 64 nt, Human
gccuccguccugucacugauggaagguuugcggaugagggcaugugcggcugaacugagaaggc

SEQ ID NO: 230899 - RNA, 64 nt, Human
acaagacuuuuguccacgugguuccugccaagccugagggcaccuucaaacugguagcuaugcu

SEQ ID NO: 230900 - RNA, 64 nt, Human
aauugcuucguccugucacccccaucaccaauuuugagggcagccagucucaggaccacagugg

SEQ ID NO: 230901 - RNA, 64 nt, Human
ucauccuguguccccugaccuguccaggugagugugagggcagcacugggaagcuggagugcug

SEQ ID NO: 230902 - RNA, 64 nt, Human
cuucggaccacagcaggagccccgacugcccaccugagggcagggagagccugaccccauuggc

SEQ ID NO: 230903 - RNA, 64 nt, Human
auguuuauguugcaggguauugcauggucacgagugagggcaggccccuggggacacaucugcc

SEQ ID NO: 230904 - RNA, 64 nt, Human
uuccugcuuugcaccaucugguggucgcacgcccugagggcaccccgacucugucuccaggagu

SEQ ID NO: 230905 - RNA, 64 nt, Human
ggacugguuugagauugccccaggucugggaagcugagggcaaauccagucccaaugguccuga

SEQ ID NO: 230906 - RNA, 64 nt, Human
ccagcgaguccagcagggaguccagcaacgaggaugagggcagcagcuccgaggccgacgagau

SEQ ID NO: 230907 - RNA, 64 nt, Human
cugccuccucacccuagguguugcuggagaacccugagggcagggcccgagccccgacacaucc

SEQ ID NO: 230908 - RNA, 64 nt, Human
cugcuccuuucccaagugguguugugaggggcaaugagggcaacaggagauguggggacguguu

SEQ ID NO: 230909 - RNA, 64 nt, Human
cuggagacucacugcaaguuccugcccaggaggcugagggcaccccauccucagugcccaaugc

SEQ ID NO: 230910 - RNA, 64 nt, Human
acugcccaggcagagggcagggcuggaccaugggugagggcaggggagcccggagcuuccucug

SEQ ID NO: 230911 - RNA, 64 nt, Human
caaagccucuuuuugccucccggaaucaaggcccugagggcagcaggaugguggccuggguggg

SEQ ID NO: 230912 - RNA, 64 nt, Human
ugcuguguguugggaagacaucaggccugaaagcugagggcauaacugaccauuuuuuggaaac

SEQ ID NO: 230913 - RNA, 64 nt, Human
caguccucugucuggccuccacuccucuugcuccugagggcaguuuguuucuuuuguggauucg

SEQ ID NO: 230914 - RNA, 64 nt, Human
ccuguuguuacagugccuucucccaggggcugggugagggcacauucaggacuagaagccccuc

SEQ ID NO: 230915 - RNA, 64 nt, Human
agugcaacugacaaguuaaaaaggucuaugaucuugagggcagacagcagaauuccucuuauaa

SEQ ID NO: 230916 - RNA, 64 nt, Human
gcugcugcuccgggccaagcuucugguugauuaaugagggcaugggguggucccucaagaccuu

SEQ ID NO: 230917 - RNA, 64 nt, Human
uggccccucacgggcccccacacucuccugaccgugagggcacuggucaguuccgcccccgugg

SEQ ID NO: 230918 - RNA, 64 nt, Human
gaacacaugauaaaaaagucaugcuuuauuuuagugagggcaauuacagagaaaagaguaagca

SEQ ID NO: 230919 - RNA, 64 nt, Human
ugcaggaggggugggguagcugccuugucccuggugagggcaagggucacugucuucacagaaa

SEQ ID NO: 230920 - RNA, 64 nt, Human
aguagagaaaaauguauaaaagauuuuaauuuuaugagggcaauacaacugucacaucagaaac

SEQ ID NO: 230921 - RNA, 64 nt, Human
gggugauugaugaguugucaaaaugauaggugccugagggcagacucgggcugucuaggaacca

SEQ ID NO: 230922 - RNA, 64 nt, Human
gagggagggcaggugcgggcugugugugucugugugagggcagguccuggacuuggcaguuucu

SEQ ID NO: 230923 - RNA, 64 nt, Human
aucucuaaguccagagccaggagaguuggaccauugagggcagcucugccaacauuuaguaaaa

SEQ ID NO: 230924 - RNA, 64 nt, Human
cuuuugcugccuuaagcccccuaugcccuggaggugagggcagcucucuugucucuucccugcc

SEQ ID NO: 230925 - RNA, 64 nt, Human
gcaggggccaaagguccagaccccccaaguccagugagggcaguagggauuggguugggggaag

SEQ ID NO: 230926 - RNA, 64 nt, Human
cccuuagccauaaguuuucaggaaauaaauuccuugagggcauugacuuuuacaaaagagggag

SEQ ID NO: 230927 - RNA, 64 nt, Human
ggccagugucugucugucugucugccucucugucugagggcacccuccauuugggauggaagga

SEQ ID NO: 230928 - RNA, 64 nt, Human
cugcucauuggggaacuccagagacaacuuaggaugagggcagaaaagucuuuggggaugauuc

SEQ ID NO: 230929 - RNA, 64 nt, Human
ccuuaguggcacugccggggggccccagagcgaaugagggcagagaugcccggggcaggggcaa

SEQ ID NO: 230930 - RNA, 64 nt, Human
auuuauccaaagcauugcagaacaugagugcugaugagggcaccucuugugcugaguccccuca

SEQ ID NO: 230931 - RNA, 64 nt, Human
gggagaggucaggugcuagaaaguuugugcacauugagggcaugggcagaaucugcucccaaaa

SEQ ID NO: 230932 - RNA, 64 nt, Human
caagcugaagcuuggagaaaacucugcauucccaugagggcaaaggcagcugcccucccugacc

SEQ ID NO: 230933 - RNA, 64 nt, Human
ccucuuuucuguaagauuaugguacuguggaacaugagggcagaggacaccgggaggcuguuag

SEQ ID NO: 230934 - RNA, 64 nt, Human
gaggucagcagccugggagagugcccccaagagaugagggcaccccguguuccuuggcaaucuu

SEQ ID NO: 230935 - RNA, 64 nt, Human
auuuguaaauccuaauucaaagauggcucaugugugagggcauugaguuugauuuguuuucccu

SEQ ID NO: 230936 - RNA, 64 nt, Human
ucccuggugaaggaggacugaaccaaggacucugugagggcaggugaggcgcucacagccucgc

SEQ ID NO: 230937 - RNA, 64 nt, Human
aauugagacaggguuggucucuguugcccaagcuugagggcaguggugcaaucauaacucauug

SEQ ID NO: 230938 - RNA, 64 nt, Human
ccaggaaugggcaagguggagauggaaccuguguugagggcagaugccacaagauucccgaacc

SEQ ID NO: 230939 - RNA, 64 nt, Human
cuuagaaacuugccugagaugguggacgcaguaaugagggcaccgcgcagcucaguuagagacg

SEQ ID NO: 230940 - RNA, 64 nt, Human
gaaugcaguuaagugguuuaagugguguuagcuuugagggcaaggcaaagugaggaagggcugg

SEQ ID NO: 230941 - RNA, 64 nt, Human
ggcaggggccccagaagcuucugucccucaugccugagggcacgggggacacuuggaggcugcu

SEQ ID NO: 230942 - RNA, 64 nt, Human
ucagccuucugcaucaggacauggccucguccacugagggcacgauuuaaacauuugacaucag

SEQ ID NO: 230943 - RNA, 64 nt, Human
acguugggagaagagagagagugccaggagacccugagggcagccgguuccuacuuuggacuga

SEQ ID NO: 230944 - RNA, 64 nt, Human
ggaggggguacugaugguaacccccauguggauuugagggcagcagucccuggccucacccuag

SEQ ID NO: 230945 - RNA, 64 nt, Human
aggcucugagaggacaugagaguauuuugcaaagugagggcaaggcccaguguggagugauauu

SEQ ID NO: 230946 - RNA, 64 nt, Human
aaauaaaaaacauaaaugauuguucuccaaggccugagggcaagacucaugaugagcaagucaa

SEQ ID NO: 230947 - RNA, 64 nt, Human
gaaaccuguaccaggccaaaggugagggcgugagugagggcaggaguguuuauggcagagugaa

SEQ ID NO: 230948 - RNA, 64 nt, Human
guuaagaguagcuuggagaggacccucaggccucugagggcaccaggcccuggagaagaggugc

SEQ ID NO: 230949 - RNA, 64 nt, Human
gcuguuccuuaacguccccacuagccaggcucuuugagggcagggauugugucugguuaauuuc

SEQ ID NO: 230950 - RNA, 64 nt, Human
ccguccccccaucccguuucccuccagguguuguugagggcauuuggcuuccucugcugcaucc

SEQ ID NO: 230951 - RNA, 64 nt, Human
accugcccugcuuccuggcuccuuaucagugccaugagggcagaggugcuaccuggccuuccug

SEQ ID NO: 230952 - RNA, 64 nt, Human
agcuggagaggaaggagauucuggcauguuggggugagggcagagggacagaugaggggaggag

SEQ ID NO: 230953 - RNA, 64 nt, Human
gggacaagcacgccccccagaacgcagucuccacugagggcaccgccuauugguguccuguggg

SEQ ID NO: 230954 - RNA, 64 nt, Human
gagcuacugcuucuaacaccucuuuucccuugugugagggcaaaccaggcugcaggugggguuu

SEQ ID NO: 230955 - RNA, 64 nt, Human
ucacucuagucacagugaaucuuuaacuguguccugagggcaacaggguuugcugcacuucuuu

SEQ ID NO: 230956 - RNA, 64 nt, Human
agcacuauccucaucucuccccagaugugacuacugagggcaguucugaguguuuaauuucaga

SEQ ID NO: 230957 - RNA, 64 nt, Human
agcacuauccucaucucuccccagaugugacuacugagggcaguccugaguguuuaauuucaga

SEQ ID NO: 230958 - RNA, 64 nt, Human
agcauuacccuccucucuccccagaugugacuacugagggcaguucugaguguuuaauuucaga

SEQ ID NO: 230959 - RNA, 64 nt, Human
agaauucauucacucaacaaacauaauagggcgcugagggcauagaaguaaaaacaccuggucc

SEQ ID NO: 230960 - RNA, 64 nt, Human
aacacuacccuccucucuucccagaugugaccacugagggcaguucugaguguuuaauuucaga

SEQ ID NO: 230961 - RNA, 64 nt, Human
agcacuaccuuccucucuccccacaugugacuacugagggcaguucugaguguuuaauuuccga

SEQ ID NO: 230962 - RNA, 64 nt, Human
agcauuacccuccucucucccuagaugugacuacugagggcaguucugaguguuuaauuucaga

SEQ ID NO: 230963 - RNA, 64 nt, Human
cuagagcauucugggguggggcuuggaagggcgcugagggcaggguucuagaaggggcgaggcu

SEQ ID NO: 230964 - RNA, 64 nt, Human
agcacuacccuccucucuccccagaugugacuacugagggcagaucugaguguuuaauuuccga

SEQ ID NO: 230965 - RNA, 64 nt, Human
uuagagcuggucaggucuucacuaugcuccagacugagggcaagaucccaguggaggccuucaa

SEQ ID NO: 230966 - RNA, 64 nt, Human
acaaguaagagucaaauaauuugcaaccagcuuaugagggcaaugggggcaccuaaacucuuga

SEQ ID NO: 230967 - RNA, 64 nt, Human
uggguuggacugguggugguuuagguaaaucuggugagggcauacgggagccuaucucagugaa

SEQ ID NO: 230968 - RNA, 64 nt, Human
ggugcuuuagagauaauugcuugccagugccaauugagggcauuaguacuuugugcucauaaau

SEQ ID NO: 230969 - RNA, 64 nt, Human
ucuuuaaacgagcuugccucccuccugccaaguuugagggcaaggcuaagaaaugucagccacg

SEQ ID NO: 230970 - RNA, 64 nt, Human
uuucuuuuuuuuaaauuauuauuaagacagaaugugagggcacaagcaggcuucugagccacuu

SEQ ID NO: 230971 - RNA, 54 nt, Human
gccacaaugaaucaacguagccagugagggcaaaagaagggcucuguaacagaa

SEQ ID NO: 230972 - RNA, 64 nt, Human
aggguggguggagcagguggacuggaguuucucuugagggcaauaaaaguugucauggugugua

SEQ ID NO: 230973 - RNA, 64 nt, Human
agugaauccaaaauucacugacgaauucagagauugagggcacuugcuugaaaucaaggugcuc

SEQ ID NO: 230974 - RNA, 64 nt, Human; identical to SEQ ID NO: 50498

SEQ ID NO: 230975 - RNA, 64 nt, Human; identical to SEQ ID NO: 50499

SEQ ID NO: 230976 - RNA, 64 nt, Human; identical to SEQ ID NO: 50500

SEQ ID NO: 230977 - RNA, 64 nt, Human; identical to SEQ ID NO: 50501

SEQ ID NO: 230978 - RNA, 64 nt, Human; identical to SEQ ID NO: 50502

SEQ ID NO: 230979 - RNA, 64 nt, Human
cuauucugcauuuuacucugugaauuuauuguuaggcaguuacugcaagucacucugguuucaa

SEQ ID NO: 230980 - RNA, 64 nt, Human
gaauuacuguaaauaugcuacccucacuuuucuuggcaguuaugucgaugaaaucaagagugug

SEQ ID NO: 230981 - RNA, 64 nt, Human
cauuccucucuuguuuauaguaaucuaaggguugggcaguuaaaacggcuucaggauagaaagc

SEQ ID NO: 230982 - RNA, 64 nt, Human
gaauggggcauguucacucucuuaggggcuauggggcaguuagcagcauuuccuauccucugac

SEQ ID NO: 230983 - RNA, 64 nt, Human; identical to SEQ ID NO: 50503

SEQ ID NO: 230984 - RNA, 64 nt, Human; identical to SEQ ID NO: 50504

SEQ ID NO: 230985 - RNA, 64 nt, Human; identical to SEQ ID NO: 50505

SEQ ID NO: 230986 - RNA, 63 nt, Human; identical to SEQ ID NO: 50506

SEQ ID NO: 230987 - RNA, 64 nt, Human; identical to SEQ ID NO: 50507

SEQ ID NO: 230988 - RNA, 64 nt, Human; identical to SEQ ID NO: 50508

SEQ ID NO: 230989 - RNA, 64 nt, Human; identical to SEQ ID NO: 50509

SEQ ID NO: 230990 - RNA, 64 nt, Human; identical to SEQ ID NO: 50510

SEQ ID NO: 230991 - RNA, 64 nt, Human; identical to SEQ ID NO: 50511

SEQ ID NO: 230992 - RNA, 64 nt, Human; identical to SEQ ID NO: 50512

SEQ ID NO: 230993 - RNA, 64 nt, Human; identical to SEQ ID NO: 50513

SEQ ID NO: 230994 - RNA, 64 nt, Human; identical to SEQ ID NO: 50514

SEQ ID NO: 230995 - RNA, 64 nt, Human; identical to SEQ ID NO: 50515

SEQ ID NO: 230996 - RNA, 57 nt, Human; identical to SEQ ID NO: 50516

SEQ ID NO: 230997 - RNA, 64 nt, Human; identical to SEQ ID NO: 50517

SEQ ID NO: 230998 - RNA, 64 nt, Human
aacuguggaacucaaaaguuugaucacugaauuuggcaguuauuauuaccuagguacccccgcu

SEQ ID NO: 230999 - RNA, 64 nt, Human
aguccagugaggcugaaguaaaggggcaagauagggcaguuaacuaaagagcacuuuauuucuu

SEQ ID NO: 231000 - RNA, 64 nt, Human
cguccauuggaucacucgcugguggucacuguguggcaguuacuaggggaauucugccucugac

SEQ ID NO: 231001 - RNA, 64 nt, Human; identical to SEQ ID NO: 50518

SEQ ID NO: 231002 - RNA, 64 nt, Human; identical to SEQ ID NO: 50519

SEQ ID NO: 231003 - RNA, 64 nt, Human; identical to SEQ ID NO: 50520

SEQ ID NO: 231004 - RNA, 64 nt, Human; identical to SEQ ID NO: 50521

SEQ ID NO: 231005 - RNA, 64 nt, Human; identical to SEQ ID NO: 50522

SEQ ID NO: 231006 - RNA, 64 nt, Human; identical to SEQ ID NO: 50523

SEQ ID NO: 231007 - RNA, 64 nt, Human; identical to SEQ ID NO: 50524

SEQ ID NO: 231008 - RNA, 64 nt, Human; identical to SEQ ID NO: 50525

SEQ ID NO: 231009 - RNA, 64 nt, Human; identical to SEQ ID NO: 50526

SEQ ID NO: 231010 - RNA, 64 nt, Human; identical to SEQ ID NO: 50527

SEQ ID NO: 231011 - RNA, 64 nt, Human; identical to SEQ ID NO: 50528

SEQ ID NO: 231012 - RNA, 64 nt, Human; identical to SEQ ID NO: 50529

SEQ ID NO: 231013 - RNA, 64 nt, Human; identical to SEQ ID NO: 50530

SEQ ID NO: 231014 - RNA, 64 nt, Human; identical to SEQ ID NO: 50531

SEQ ID NO: 231015 - RNA, 64 nt, Human; identical to SEQ ID NO: 50532

SEQ ID NO: 231016 - RNA, 64 nt, Human
aacaaaauacuugacauagucuuaaguagaagaaggcaguuagagaaaacaaaguaucuacugg

SEQ ID NO: 231017 - RNA, 64 nt, Human
acauuuucauggugggagcucuucuuucugauauggcaguuacacuuuuucacuuaagugcuuu

SEQ ID NO: 231018 - RNA, 64 nt, Human
ugacuuaaagucacugaaguggaaacuaagaaguggcaguuaguguuuuacccagcauuucugc

SEQ ID NO: 231019 - RNA, 64 nt, Human; identical to SEQ ID NO: 50533

SEQ ID NO: 231020 - RNA, 64 nt, Human; identical to SEQ ID NO: 50534

SEQ ID NO: 231021 - RNA, 64 nt, Human; identical to SEQ ID NO: 50535

SEQ ID NO: 231022 - RNA, 64 nt, Human; identical to SEQ ID NO: 50536

SEQ ID NO: 231023 - RNA, 64 nt, Human; identical to SEQ ID NO: 50537

SEQ ID NO: 231024 - RNA, 64 nt, Human; identical to SEQ ID NO: 50538

SEQ ID NO: 231025 - RNA, 64 nt, Human; identical to SEQ ID NO: 50539

SEQ ID NO: 231026 - RNA, 64 nt, Human; identical to SEQ ID NO: 50540

SEQ ID NO: 231027 - RNA, 64 nt, Human; identical to SEQ ID NO: 50541

SEQ ID NO: 231028 - RNA, 53 nt, Human; identical to SEQ ID NO: 50542

SEQ ID NO: 231029 - RNA, 64 nt, Human; identical to SEQ ID NO: 50543

SEQ ID NO: 231030 - RNA, 64 nt, Human; identical to SEQ ID NO: 50544

SEQ ID NO: 231031 - RNA, 64 nt, Human; identical to SEQ ID NO: 50545

SEQ ID NO: 231032 - RNA, 64 nt, Human; identical to SEQ ID NO: 50546

SEQ ID NO: 231033 - RNA, 64 nt, Human; identical to SEQ ID NO: 50547

SEQ ID NO: 231034 - RNA, 64 nt, Human
uggcgccuagaacaguuaggucgcucgucacauaggcaguuaaguggagaaccagguuucaaaa

SEQ ID NO: 231035 - RNA, 64 nt, Human
aucuccuccgaccgaggcuucucacccuggagauggcaguuacuccuggccaugguugcugagc

SEQ ID NO: 231036 - RNA, 64 nt, Human
ggacucuauucuuuaacucccauuaccauguaauggcaguuauauuuugcaguucccacauuaa

SEQ ID NO: 231037 - RNA, 64 nt, Human; identical to SEQ ID NO: 50548

SEQ ID NO: 231038 - RNA, 64 nt, Human; identical to SEQ ID NO: 50549

SEQ ID NO: 231039 - RNA, 64 nt, Human
agccugcuugauaacuugucuuaaguucuauuaaggcaguuagacugagauuucuaaugacuuc

SEQ ID NO: 231040 - RNA, 64 nt, Human
aguaucaguguaauuauuuaaaaaaugauuuugaggcaguuaagcaugaccaauuaaugucacu

SEQ ID NO: 231041 - RNA, 64 nt, Human
guucucucaacaagaaauaauagaaaugucucaaggcaguuaauucucauuaauacucuuuauu

SEQ ID NO: 231042 - RNA, 64 nt, Human
uggcuuguguguguccaucucgccuguuggcucagugcuucaucccauuugcagagccucagac

SEQ ID NO: 231043 - RNA, 64 nt, Human
ggaugcugccugagucacccaugaagacaggacagugcuucagccugaggcugagacugcggga

SEQ ID NO: 231044 - RNA, 64 nt, Human
ugaggaaguuagcugcgggcugcccugugggcuggugcuucaggaggaauccagagaaguguuc

SEQ ID NO: 231045 - RNA, 64 nt, Human
cucauagaaacugcuuugacaugacugcaaucaugugcuucauagaaacuuaauuagauuauac

SEQ ID NO: 231046 - RNA, 64 nt, Human
accuguguggggcugaccaaugcaaacucaaauggugcuucaaagggagagacccacugacucu

SEQ ID NO: 231047 - RNA, 64 nt, Human
uacuauuucuccauaugaauuuuaagauauuuuagugcuucaagacugcugaaagcaauccagu

SEQ ID NO: 231048 - RNA, 64 nt, Human
acaugcgcguuugaggguggagggguccuguaaggugcuucaucgucugugauuacugcuuggg

SEQ ID NO: 231049 - RNA, 64 nt, Human
cagcccagguguuugcucaguugcugacccaaaagugcuucauuuuucgugcccgccccgcgcc

SEQ ID NO: 231050 - RNA, 64 nt, Human
gagucaaggccgguucuaauugaggggacccagugugcuucaguguuaagaguggggcaaugaa

SEQ ID NO: 231051 - RNA, 64 nt, Human
ccauauuucccacauuucuaauaccaccaccccugugcuucaggcccuccaaaccccuguguuc

SEQ ID NO: 231052 - RNA, 64 nt, Human
acaauauggucccaaaugaccgacugcaccuucugugcuucagcucuucuugacaucaaggcuc

SEQ ID NO: 231053 - RNA, 64 nt, Human
gauugaucuuuuauaagaccuuauuugaugcuuugugcuucaaggagaugauaccugucaucca

SEQ ID NO: 231054 - RNA, 64 nt, Human
cugcagagucuagugcagacccgugaucaccuuagugcuucaguggauucacugguuagauuaa

SEQ ID NO: 231055 - RNA, 64 nt, Human
ggccaguccuuguugcuggccuccaaggcaaauagugcuucacccugaccucucacuccaggac

SEQ ID NO: 231056 - RNA, 64 nt, Human
ucagaaggucucuucagagcugcugugcccaguggugcuucaacugguaucuaugagguccuag

SEQ ID NO: 231057 - RNA, 64 nt, Human
ccagugacacuugaagccucccgacuuccacagagugcuucaggacacauuuugagugguauuu

SEQ ID NO: 231058 - RNA, 64 nt, Human
cuacuucauuaaaagcugcuaagcuuaccuguagggcaguuaccacagaaacagaaauugaccu

SEQ ID NO: 231059 - RNA, 64 nt, Human
acauguuauuuaaggauaaagguaaaucauucaaggcaguuaccaaccacuaacuauuuguuuu

SEQ ID NO: 231060 - RNA, 64 nt, Human
uuccacuaaugugucuuaaucuaucccuccagcuggcaguuacuguuuuuuuaauccccugaag

SEQ ID NO: 231061 - RNA, 64 nt, Human
guagauugugccagauacaaaugggucccauccagugcuucauacuccuucagucacuauccca

SEQ ID NO: 231062 - RNA, 64 nt, Human
auuuccaaaguguaccaauuuuuuuuuuuuuacugugcuucaaauaaauagaaaaauaguuaua

SEQ ID NO: 231063 - RNA, 64 nt, Human
cuuguucuaaagcccaggguuauggaccaacucagugcuucaggucuuaacgccuccauaccuc

SEQ ID NO: 231064 - RNA, 64 nt, Human
acugagauugucuguucaguuuccccauuuguuugugcuucaaaugauccuuccuacuuugcuu

SEQ ID NO: 231065 - RNA, 64 nt, Human
ggaauuuuguacagucuuugugaaauaaaauaacgugcuucauuugacccccaucccuggaguu

SEQ ID NO: 231066 - RNA, 64 nt, Human
cggcccccaguuccuaccccagaaccaguuaacugugcuucagggguagggcugggcccacaga

SEQ ID NO: 231067 - RNA, 64 nt, Human
auuaauauauugugacuuuaggcccauuuuucaugugcuucacuuugauagaguuaauccauaa

SEQ ID NO: 231068 - RNA, 64 nt, Human
gugacuuuugggcuagaagggacccugguggucugugcuucagccauuugcagggcaggggcau

SEQ ID NO: 231069 - RNA, 64 nt, Human
cguggacucuaguauguaaauguuacuugaaucugugcuucauaauaguguguggcauguaugu

SEQ ID NO: 231070 - RNA, 64 nt, Human
uucuguggccucuggaaccuuauccaaccucuuggugcuucaguuuccucaucugugaaauuag

SEQ ID NO: 231071 - RNA, 64 nt, Human
cgaugucugcuucuuccccagccugggauccuucgugcuucaaggccuggggagccuguccuuc

SEQ ID NO: 231072 - RNA, 64 nt, Human
gcuuuauuagacucugggagagaaaaguaaccaagugcuucagaacagguuuuuaguauuuacu

SEQ ID NO: 231073 - RNA, 64 nt, Human
aaaaaaauguuuaagauaucaaaaaccucuccucgugcuucaaaaugacaggaauccugugcau

SEQ ID NO: 231074 - RNA, 64 nt, Human
ccuuaaccaauaauggucaguccucaucucugucgugcuucauaggugccaccuuguguguuua

SEQ ID NO: 231075 - RNA, 64 nt, Human
uuagaagggaaagcgccagagagggcaggcuacagugcuucacacccuucgccacggcugugaa

SEQ ID NO: 231076 - RNA, 64 nt, Human
auauuugguaucuuuguggcuuuucauauuuuuagugcuucaugaauauuugguaucucuugcu

SEQ ID NO: 231077 - RNA, 64 nt, Human
gcuuccaaauuucugaagaaacuaaucucagauuggcaguuaaagucaaaauguugccaaauau

SEQ ID NO: 231078 - RNA, 64 nt, Human
acuuugcuugcaguagauuuucuuuaaaagaaugggcaguuacaugcauacuucaaaaguauuu

SEQ ID NO: 231079 - RNA, 64 nt, Human
uguuugaguaaucaucuucaagguuaaaccucuuggcaguuacccuuuucacaaagugcacagu

SEQ ID NO: 231080 - RNA, 64 nt, Human
caguucugccccccgguugacuuuuaugccacgugugcuucaugauggaacuuuuaggucaguu

SEQ ID NO: 231081 - RNA, 64 nt, Human
caggguaauagcuuuggcucagagcuccaauaaugugcuucagaucuguccauguggaaaugcu

SEQ ID NO: 231082 - RNA, 64 nt, Human
cuaaaauacagaacaugcuggguuaagugcauuagugcuucaagcagaaaaugcugaaaacaac

SEQ ID NO: 231083 - RNA, 64 nt, Human
gcgagugccauguggacagugguggaugaugugugugcuucaggcugcucccugaccccucuga

SEQ ID NO: 231084 - RNA, 64 nt, Human
uuugggugaagggugauuucuauuagacacaucugugcuucagucauagauguuaauagaggaa

SEQ ID NO: 231085 - RNA, 64 nt, Human
uccaccuggcacaguauuugaaauggcaaaggaugugcuucauccucuaacaguguacacuccc

SEQ ID NO: 231086 - RNA, 64 nt, Human
acccaguuugccuuccauuugggacaugacugaugugcuucagucuuuguauaauaaaugcauc

SEQ ID NO: 231087 - RNA, 64 nt, Human
uuuucuuuuauuaucaguuaaaaucacauuuuaagugcuucacauuuguauguguguagacugu

SEQ ID NO: 231088 - RNA, 64 nt, Human
aaucagguuuuccguaguagauaaagacucucuggugcuucaaauucuguucaaguguuuugac

SEQ ID NO: 231089 - RNA, 64 nt, Human
uccccugucuuccuccaucugagaaguggcccaugugcuucaaggcccaggagggagaucuguc

SEQ ID NO: 231090 - RNA, 64 nt, Human
cguugaagaaaguguucccaauggaguggaagaugugcuucaaacagaugacaacauggagauc

SEQ ID NO: 231091 - RNA, 64 nt, Human
guggaggguggcgaggugcggagacugcagaccagugcuucacuguguggaguggggcaggcag

SEQ ID NO: 231092 - RNA, 64 nt, Human
ugacaaaucuuccaagggacaucuuuuaaaacaagugcuucagauccagaaauuuguuaacaug

SEQ ID NO: 231093 - RNA, 50 nt, Human
ugaguagacuugguguuugagugcuucagauacauuuuucagauacaaug

SEQ ID NO: 231094 - RNA, 64 nt, Human
ggcugaucgaugcaccgaugaaguaaacgccuuagugcuucagacccagcaagaaauuauuggu

SEQ ID NO: 231095 - RNA, 64 nt, Human
uaaagguuagcagacugguguguguggaucugcagugcuucacuggaaauaauuuauucauugc

SEQ ID NO: 231096 - RNA, 64 nt, Human
cuugaugucacccugaucugucaugccccaccgccaccccuacucccuucaacccucccucuuu

SEQ ID NO: 231097 - RNA, 64 nt, Human
ggauauuuauggaccucuccuuuucuguguuuuccaccccuacccccacccgccacccaguaau

SEQ ID NO: 231098 - RNA, 64 nt, Human
aguaaaaugauacacuaucucugugaaauagccucaccccuacauguggauagaaggaaaugaa

SEQ ID NO: 231099 - RNA, 64 nt, Human
ggaauuacuuuugagcaaggggagccauuugggagugcuucaagauacccaauaugauauacac

SEQ ID NO: 231100 - RNA, 64 nt, Human
gaaguguggaaacaguacuuggaacugaggaagcuggacacagcuccuguagaaacaagugccc

SEQ ID NO: 231101 - RNA, 64 nt, Human
uacaaauucaaacauacagaaacacacacagauauggacacaguacaauucuucuuuucaaaug

SEQ ID NO: 231102 - RNA, 64 nt, Human
ccuacucccccagagcgugacccggagcaggugcuggacacagagccugucucagcagaggguc

SEQ ID NO: 231103 - RNA, 64 nt, Human
aacucuucagugcaaauuguaucuuauuauaaaauggacacaaauuuucaaguuuacacuucau

SEQ ID NO: 231104 - RNA, 64 nt, Human
cuuuauaagcgcccgggaggaacaaugagcuugguggacacauuucauugcaguguugcuccau

SEQ ID NO: 231105 - RNA, 64 nt, Human
cucuucaucaccagguacgauucucuuuccacaguggacacagcaggcuauuuucuaguuugug

SEQ ID NO: 231106 - RNA, 64 nt, Human
aaauuuuucuuuuucagaagacagaacacagauguggacacauauccggaaacugcagcugcuu

SEQ ID NO: 231107 - RNA, 64 nt, Human
ggugacagcuguggaacgcgucaacaggacaaacuggacacauggaguuacaguguguacacgg

SEQ ID NO: 231108 - RNA, 64 nt, Human
uucuugaagcaguagccuaacacacuccaagauauggacacacgggagccgcuggcagaaggga

SEQ ID NO: 231109 - RNA, 64 nt, Human
ugcaagaugaguuuuuggagauaaaugaaauaacuggacacacacucacacaaguaacaccaca

SEQ ID NO: 231110 - RNA, 64 nt, Human
cccccagucccagcaccugugucaguaaagaaaguggacacauuaguaaugguuaugggaguaa

SEQ ID NO: 231111 - RNA, 64 nt, Human
ccacccagggagcugaugccccuucuccccuuccuggacacacucucauguccccuuccuguuc

SEQ ID NO: 231112 - RNA, 64 nt, Human
auugaauucccagccccauuggggagugaucucuuggacacagagcccccauucaaaauggggc

SEQ ID NO: 231113 - RNA, 64 nt, Human
cagacagguaaaugggcagugccuccugggaccauggacacauuuucuccuaggagaagcagcc

SEQ ID NO: 231114 - RNA, 64 nt, Human
aauuuaaguacuuuauauuaacucauauaauaaauggacacaacacaaaacucaaaagguacaa

SEQ ID NO: 231115 - RNA, 64 nt, Human
aaugcuggggcagggggugaagaacccucugucccaccccuagccaccaguguccuccaagugc

SEQ ID NO: 231116 - RNA, 64 nt, Human
cuuauuagucuaauguuuuguuccuuucccaccucaccccuaccucuuuuguuuuguuuuguuu

SEQ ID NO: 231117 - RNA, 64 nt, Human
aagcuguguauacacacacacacacacacacacacaccccuaccccacacugacugucuaccga

SEQ ID NO: 231118 - RNA, 64 nt, Human
agucucccucggaugguggccuuaaggccugguagugcuucaagagguccacugguuggaucuc

SEQ ID NO: 231119 - RNA, 58 nt, Human
ugguggagauacugaucugaaggagguggugcuucaggacucugagccauucucuccc

SEQ ID NO: 231120 - RNA, 64 nt, Human
uucuucuagcuuuuagacuauaugaaaaaaccgggugcuucaaaguacaugauaagggaacacu

SEQ ID NO: 231121 - RNA, 64 nt, Human
ccagagccgaucguccucucccccgccccaccccgugcuucagccuugcagggagagugaugcu

SEQ ID NO: 231122 - RNA, 64 nt, Human
cagugagucccucacacauuugacuuuagaacgugugcuucaugacccguuguacagacggagg

SEQ ID NO: 231123 - RNA, 64 nt, Human
uucuucauucuguuuguuggcucuguguucuccugugcuucagauuccuuauguguuguuguuu

SEQ ID NO: 231124 - RNA, 64 nt, Human
auaagggaauaauaggccacagaaggugaacuuugugcuucaaggacauuggugagaguccaac

SEQ ID NO: 231125 - RNA, 64 nt, Human
uuuauuuaauauuuuuuuacauccuuugaagggagugcuucaaaaaugaaagcaucagaagaua

SEQ ID NO: 231126 - RNA, 64 nt, Human
auaaauuucuuuaaucauuuugccucuuuucucugugcuucaauuaauaaaaaauggaaagaau

SEQ ID NO: 231127 - RNA, 64 nt, Human
auuugugauaacuuuguagucauguaaaacuuaagugcuucaugccucuccaaaugugguuauu

SEQ ID NO: 231128 - RNA, 64 nt, Human
ugcaccuucugccuaccgaguucaagcgauucuugugcuucagccuccugaguagcugggacua

SEQ ID NO: 231129 - RNA, 64 nt, Human
uaggaugcaugacaauugucagguuggaguguaagugcuucauuugggaaauucagcuuuugca

SEQ ID NO: 231130 - RNA, 64 nt, Human
aaaagaagucugacuaaauucaguagaaucuuuugugcuucaguaacuugaaguuuaaauuuaa

SEQ ID NO: 231131 - RNA, 64 nt, Human
auguucaaaaaaucuguaauuuuugcugaugaaagugcuucauugacuaaacaguauuaguuug

SEQ ID NO: 231132 - RNA, 64 nt, Human
uuagaaaacguggugaguccugaguuccacugcugugcuucagucaacugaccaaacacugcuu

SEQ ID NO: 231133 - RNA, 64 nt, Human
uaaauguucuuuauuuuacagguagugauuauuagugcuucauccccauuuaaaaaaacacagu

SEQ ID NO: 231134 - RNA, 64 nt, Human
ugcuugagaaccuaaagcugguuauccuggcgaacaccccuacccuucuauugcggguccccac

SEQ ID NO: 231135 - RNA, 64 nt, Human
guaguucuguuguccaucauguuuucccuaugagcaccccuaugcccacucuaauauucaacaa

SEQ ID NO: 231136 - RNA, 64 nt, Human
guguccacugucuagcacagggcaauaaaaaauacaccccuaaaucuauguguaauuggcaucu

SEQ ID NO: 231137 - RNA, 64 nt, Human
uuuauucauauuuucacaugacguaaaauuuuaugugcuucacauaauuguauuuuagcagggu

SEQ ID NO: 231138 - RNA, 64 nt, Human
auuagacaugcuguaaccaguggagcuauucagcgugcuucaagugaagagugcagaaauagug

SEQ ID NO: 231139 - RNA, 64 nt, Human
aauauucugccuuucagaaaguguauuuauaucugugcuucauaaauauuaauguucuucagaa

SEQ ID NO: 231140 - RNA, 64 nt, Human
uauucguaagaaaaguaaagcaaauuguuucuuugugcuucagcucauuuuccauauuuuuaaa

SEQ ID NO: 231141 - RNA, 64 nt, Human
ugcauucguucuguuaagagcaaaucuaggagaagugcuucagcugcccagugcgccgugggga

SEQ ID NO: 231142 - RNA, 64 nt, Human
uggcaguccuucucauucauucuaaucauuguaugugcuucacuacgggggggagaaggaaacg

SEQ ID NO: 231143 - RNA, 64 nt, Human
auuuucauuaaaagcuacaguuuugugaaucuuugugcuucaacauucuuugcaagaugauacg

SEQ ID NO: 231144 - RNA, 64 nt, Human
uucccugauuaaauggauauuaaaauaauugcgggugcuucaggacuuuuugcuucuauauuua

SEQ ID NO: 231145 - RNA, 64 nt, Human
ucucauauuuucucuuuagugcuuaucaugaaaugugcuucacugguucagcucuguuguuucc

SEQ ID NO: 231146 - RNA, 64 nt, Human
aaaacauaaugguacccaaguuuuaaacuuagaugugcuucaucuuagugaaauuuaauucaca

SEQ ID NO: 231147 - RNA, 64 nt, Human
ggugcagcuguggauggaagacagggauuggccugugcuucagcgaccaggauggccaggccag

SEQ ID NO: 231148 - RNA, 58 nt, Human
gcugugacauagauauuuaaauuucuuagugcuucagaguuuguguguauuuguauua

SEQ ID NO: 231149 - RNA, 64 nt, Human
uuguguuuuccuaaacacacuuuucuuuuuaaaugugcuucauuguuugauuugguccugccua

SEQ ID NO: 231150 - RNA, 64 nt, Human
aguaccagauagguagcagagaccaaggcgcagggugcuucagaugagcaagagaacccagucg

SEQ ID NO: 231151 - RNA, 64 nt, Human
uuauuaaaucuucacuguauuuaaugcaggaugugugcuucaguugcucuguguauuuugauau

SEQ ID NO: 231152 - RNA, 64 nt, Human
ucugcuuauccuugcccuucucucuugccaaagugugcuucagaaauauauacugcuuuaaaaa

SEQ ID NO: 231153 - RNA, 64 nt, Human
uacauuuuggcggcugccggccucugggggagguggcaguuaugcuguuacuagugauuuuagg

SEQ ID NO: 231154 - RNA, 64 nt, Human
ccauggaaguuugugauguacggccgacccuacaggcaguuaacaugcaugggcugguuuguuu

SEQ ID NO: 231155 - RNA, 64 nt, Human
ccccggcuuugcaggaugaaaagcuuuccugcuuggcaguuauucuuccacaagagagggcuuu

SEQ ID NO: 231156 - RNA, 64 nt, Human
gcuuuauugcaaagcuuuaaauauaaauuucagagugcuucaguaaaaagcuacuauauauugu

SEQ ID NO: 231157 - RNA, 64 nt, Human
cucugaggaacucaaguuugguugccagaaaaaugugcuucauuccccccugguuaauuuuuac

SEQ ID NO: 231158 - RNA, 64 nt, Human
uaauuucuuaaauagacauuuuccuuuuuucuuugugcuucaugguggagcugucaucuggucc

SEQ ID NO: 231159 - RNA, 64 nt, Human
aggauuauauaauugcuauuggcaauguagccuggugcuucaugagaccuaugcuaaauguuac

SEQ ID NO: 231160 - RNA, 64 nt, Human
aaaacaaauaauucugugugaauuuucuuguagcgugcuucaugaaaauaucuacuuauccagg

SEQ ID NO: 231161 - RNA, 64 nt, Human
aaaugugguacaagcauucugucuugaagggcaggugcuucaggauaccauauacagcucagaa

SEQ ID NO: 231162 - RNA, 64 nt, Human
augcagucacauuuaaucacaucccccuucuagagugcuucaaaaugauguagucccucaacuu

SEQ ID NO: 231163 - RNA, 64 nt, Human
uuucaggggugagagucagagagcacugcaauaugugcuucaugggauuucgauucgaagaucc

SEQ ID NO: 231164 - RNA, 64 nt, Human
ucaucaggaaaugugacgcagagauugugcugcugugcuucauauuguugccuuaugggauuau

SEQ ID NO: 231165 - RNA, 64 nt, Human
aaaacaggaauaagagcaaaauuaucaccaaaaagugcuucaucaggcgugcuacaggaggaag

SEQ ID NO: 231166 - RNA, 64 nt, Human
ucuaaaucauuuucugaagcugacuugcucuagggugcuucaucaccacuuccaucuugcauca

SEQ ID NO: 231167 - RNA, 64 nt, Human
guguauguuuaugcauguuuugccaauagaauuugugcuucaguaacuagaucggggaucuagu

SEQ ID NO: 231168 - RNA, 64 nt, Human
gggcugaaacaguugguauagcaaccccagagaagugcuucauuuucuuuuuauaguagaagca

SEQ ID NO: 231169 - RNA, 64 nt, Human
guugucuacauuaaaucacuugaauccauugaaagugcuucaaggguaaucuuggguuucuagc

SEQ ID NO: 231170 - RNA, 64 nt, Human
guguuuaaauuuugcaaaaacaaauguuaaauuugugcuucaguaccuagauaaauuggaaagg

SEQ ID NO: 231171 - RNA, 64 nt, Human
uuguuggaauuucuuggccuacuaggacaguucugugcuucaccaugagguuugccuuugugga

SEQ ID NO: 231172 - RNA, 64 nt, Human
auugguauuuguaaaaagcaaacaaacauuacaaggcaguuaucucauugcuguuuugggagag

SEQ ID NO: 231173 - RNA, 64 nt, Human
gauugaaauauuuaguuguuaggcugaaagccucggcaguuaagaacuugccugaguuuucuuc

SEQ ID NO: 231174 - RNA, 64 nt, Human
aaaagcuuuaaccuuucaacagaauuuuuaaaaaggcaguuaguucuaaauuauuccuaucuca

SEQ ID NO: 231175 - RNA, 64 nt, Human
uuccugccuaccuuuugcaagucuuaacuuaccugugcuucaguuuccucaccuauaaaauugu

SEQ ID NO: 231176 - RNA, 64 nt, Human
augaauuaauuugauaugcucuaaauacauaaaggugcuucaaaauauguagaaacauuacuau

SEQ ID NO: 231177 - RNA, 64 nt, Human
agucuaaugauugggcacaaugaggauuuaccaagugcuucaaugagagcaguccuguuucauu

SEQ ID NO: 231178 - RNA, 64 nt, Human
auaagggaguuaaaacaaugcuguaauaaauaaagugcuucaugugaucaaaaucaaauuuguu

SEQ ID NO: 231179 - RNA, 64 nt, Human
cggagcacugcuggaaaugauugcagagaauguagugcuucauauauccaugaccaagauugac

SEQ ID NO: 231180 - RNA, 64 nt, Human
acugugaaggaaaaaaugucaguugaacuaaauugugcuucacgccucgguagauuugcauucu

SEQ ID NO: 231181 - RNA, 64 nt, Human
aaauaggagcuauuuauagauggagcagcacuuagugcuucauagaaagcaaugccuauuuuua

SEQ ID NO: 231182 - RNA, 64 nt, Human
guaguggggcgccgccaaucuaacaugagcacaggugcuucaugacaaacauuacuagcauguu

SEQ ID NO: 231183 - RNA, 64 nt, Human
ucccuaacgguaccguuugguaucugcccuuugugugcuucacaagaggcagucccaugggagg

SEQ ID NO: 231184 - RNA, 64 nt, Human
uacguaugaauucuggagaauccugaaaaagacggugcuucaaccagcuugcauagcacagaga

SEQ ID NO: 231185 - RNA, 64 nt, Human
aaauaaaccagaaucgaaguuauuucagcuaaaugugcuucagcaaaggugcauugguugaaac

SEQ ID NO: 231186 - RNA, 64 nt, Human
cauuggccagcauucagcugcacgugugugcugcgugcuucacauccucuauugagaguuacag

SEQ ID NO: 231187 - RNA, 64 nt, Human
agguucauuuugguggcuguccguuugaccugcugugcuucaguuuaauuggcuuggaaagggg

SEQ ID NO: 231188 - RNA, 64 nt, Human
uuucuuacuagcuucuaaauggauuaauaaucaagugcuucaaaugaauuaagaguccaguuuc

SEQ ID NO: 231189 - RNA, 64 nt, Human
auaacuaaaaugcauuccugcaauucuguuugcagugcuucacuaaacauugaaauaaaguugu

SEQ ID NO: 231190 - RNA, 64 nt, Human
uuacagauugaucagggaccaugaaaagaaacuugugcuucaccgaagaaaaauaucuaaacau

SEQ ID NO: 231191 - RNA, 64 nt, Human
ugagacucauguaauuacaauuucuaauuugaaaggcaguuaagaaauagauaaccauuuauuu

SEQ ID NO: 231192 - RNA, 64 nt, Human
gaacaucucaccuuuuuaaauccuaaaaaacacuggcaguuauauuuuaaauuaguuuuuauuu

SEQ ID NO: 231193 - RNA, 64 nt, Human
acggucugcggccaugaggccaggccgccucccgcaccccuaccccguggcagcagcauaccuc

SEQ ID NO: 231194 - RNA, 64 nt, Human
ggcuuuaaaaagggaagaaacugcugagcuugcugugcuucaaacuacuacuggaccuuauuuu

SEQ ID NO: 231195 - RNA, 64 nt, Human
cagauuguaucaugaguagaaucagguucacguggugcuucaaagcccugagaagaauauuucu

SEQ ID NO: 231196 - RNA, 64 nt, Human
aauugaaugccacaugcuuucauaauauaguuuugugcuucaaaguguuugacagaaguugggu

SEQ ID NO: 231197 - RNA, 64 nt, Human
ucgcuuacuguuauugugcugagugagcuccugugugcuucagacaaaaauaaaugagacuuug

SEQ ID NO: 231198 - RNA, 64 nt, Human
ucugucccuugcuguaugcugaucaucgccagaggugcuucacccugaguuuuguuuuguauug

SEQ ID NO: 231199 - RNA, 64 nt, Human
cagugcuugagaugcuuaacagagaaggcauccagugcuucauugaggcuaagucucagggugu

SEQ ID NO: 231200 - RNA, 64 nt, Human
uuaaaguuuuuuguucuguuuugaaggaaaccaugugcuucaugaaaccuacaguugacaagag

SEQ ID NO: 231201 - RNA, 64 nt, Human
ugcccuugauccauuguuuccuuccuacuauaaugugcuucaucugugacacuuucucuugaac

SEQ ID NO: 231202 - RNA, 64 nt, Human
auaagcuaauaucauaaauaagguuguuuaagacgugcuucaaauauccauauuaaccacuauu

SEQ ID NO: 231203 - RNA, 64 nt, Human
cugcuuagcuuggaauaagacuuaggagaaaauggugcuucacuaacccgcuuccgguccaguc

SEQ ID NO: 231204 - RNA, 64 nt, Human
ugcucuuccuggacuuuguagaaaucagucucaagugcuucaagagucuggcuccugcuacuuu

SEQ ID NO: 231205 - RNA, 64 nt, Human
uuuaucuuccaaacacagaccuuggugauaaccugugcuucaaacugucuuaaacaauguuugu

SEQ ID NO: 231206 - RNA, 64 nt, Human
uaguuuuuuaguauuguaaagauacugcugaccugugcuucauuucuaacuguguaaacuuuuu

SEQ ID NO: 231207 - RNA, 64 nt, Human
gggggugagcaggggguuuaucuguguguagugagugcuucauguguggaauauucauuuucuu

SEQ ID NO: 231208 - RNA, 64 nt, Human
augggaugauggaaaagucaaauaacggaucuuugugcuucaugaagaguuggaaaaccugugu

SEQ ID NO: 231209 - RNA, 64 nt, Human
aauuguuuucuuaccuuuuaauguaaugacgagugugcuucaguuuguuuagcaaaaccacucu

SEQ ID NO: 231210 - RNA, 64 nt, Human
guguugauuuguuacuauauuacuaugcaaaacuggcaguuauuuuuauaauauaaauuuauaa

SEQ ID NO: 231211 - RNA, 64 nt, Human
aacccuaaagguuaaaccuuagcccugugggauaggcaguuagggagguguggaaaaucuaugc

SEQ ID NO: 231212 - RNA, 64 nt, Human
uuaacuucagaaggcaucauuuauaagacaguauggcaguuaauuauaaaauuauuuugaugaa

SEQ ID NO: 231213 - RNA, 64 nt, Human
uaugaucauuggcugccauccaggaccccaauuugugcuucagggggauaaucuccuucucucg

SEQ ID NO: 231214 - RNA, 64 nt, Human
ggaauccugccaccugugacugucugacugcuuagugcuucagcugucccuuccuuguguccug

SEQ ID NO: 231215 - RNA, 64 nt, Human
ccauggauggggacccaaagaccugcagccaccagugcuucacuagcgugcagaccagcccugu

SEQ ID NO: 231216 - RNA, 64 nt, Human
gacauuuuuuguuagauuucaugguaauucucaagugcuucaaugaugcagcauuucuugcacu

SEQ ID NO: 231217 - RNA, 64 nt, Human
uuuuccugguuggaauugaguaggaacugaggcugugcuucagguaugguacaaucaagugggg

SEQ ID NO: 231218 - RNA, 64 nt, Human
caccucaucuagaagggaggacacaaggacauuggugcuucagagccuuugaagaugagaagag

SEQ ID NO: 231219 - RNA, 64 nt, Human
gccacauuguaauaguaaacuucauauauaaugagugcuucauauuuuuguuaugggaaagcaa

SEQ ID NO: 231220 - RNA, 64 nt, Human
auucuccaguagugcauucaguucaacacagcaagugcuucauugcauggaaaacacuuugaag

SEQ ID NO: 231221 - RNA, 64 nt, Human
uuuaaaugaacaggaaacucugaugaggaagaaagugcuucagaaucugaacuuuggaaggguc

SEQ ID NO: 231222 - RNA, 64 nt, Human
uuaacucuuccuucuuuccuuuauuuguuuagacgugcuucaucccgaaguggugcuauggucu

SEQ ID NO: 231223 - RNA, 64 nt, Human
auagguuugaucacauucaaggauuauuauacuugugcuucaaccaaucuaaauuggauucuuu

SEQ ID NO: 231224 - RNA, 64 nt, Human
gggcuucccugagcuggauguuguggguguugccgugcuucaggaaguguggcgaccagaaagc

SEQ ID NO: 231225 - RNA, 64 nt, Human
cugcugaccucacagggucagcugggccccccuggugcuucaccaccugcauccucuugcucag

SEQ ID NO: 231226 - RNA, 64 nt, Human
agcaacuuucuuacacugaagaaaggcagaaugagugcuucagaaugugauuuccuacuaaccu

SEQ ID NO: 231227 - RNA, 64 nt, Human
uguggcccaacaaccaucuacagaacagcugcuggugcuucagggaggcgccgugcccuccgcu

SEQ ID NO: 231228 - RNA, 64 nt, Human
ccuugcgugugugaaagcugagaaaaugggagcugugcuucagcuacccuccagacaagggcaa

SEQ ID NO: 231229 - RNA, 64 nt, Human
ugucuauuccccaauauaggacuuuuaugggcucggcaguuagcugccauguagaaggcuccua

SEQ ID NO: 231230 - RNA, 64 nt, Human
cauagacacaugcuaggauaggccccgcugggagggcaguuacaggagagaguaggugguggug

SEQ ID NO: 231231 - RNA, 64 nt, Human
gcagaaggauggaacugaccuuuauuccccagugggcaguuacugagcuuuccuccucagagcc

SEQ ID NO: 231232 - RNA, 64 nt, Human
ugcagacauacuugaaaagcucacuuaaaucuaggugcuucaauucacuuucuugagaggacaa

SEQ ID NO: 231233 - RNA, 64 nt, Human
caugugugcucacaauguucuggcacuauuauaagugcuucacagguuuuauguguucuucgua

SEQ ID NO: 231234 - RNA, 64 nt, Human
uacuaauaaacuugccauacguauuacagcagaagugcuucagucauucacauguguucgugag

SEQ ID NO: 231235 - RNA, 64 nt, Human
ucauggaugccagaggcauucggauucaugacucgugcuucacguaucccagaagugugcuauu

SEQ ID NO: 231236 - RNA, 64 nt, Human
ucuucuccaucccucuaaugagacugaccauauugugcuucacaguagagccagcuuggggcca

SEQ ID NO: 231237 - RNA, 64 nt, Human
gcuuuauuagacucugggagagaaaauuaaccaagugcuucagaacagguuuuuaguauuuaau

SEQ ID NO: 231238 - RNA, 64 nt, Human
accuucacauuguuaguucaugacagacccaggugugcuucauuagagauaacauacauucccu

SEQ ID NO: 231239 - RNA, 64 nt, Human
cacuuugugccaaaugacuuugcaccugcaaauggugcuucaaugucguuuuguaucuuuaagc

SEQ ID NO: 231240 - RNA, 64 nt, Human
caugaggaaucugggaggcccugagacagggauugugcuucauuccaaucuauugcuucaccau

SEQ ID NO: 231241 - RNA, 64 nt, Human
gagauuguauuacacauuaaggaccuugguagcugugcuucagcaaacgucaaccaugguagca

SEQ ID NO: 231242 - RNA, 64 nt, Human
uugcaugggcccgaaccugugaaauguuacguuugugcuucauuuuugccaagguaaaaauguu

SEQ ID NO: 231243 - RNA, 64 nt, Human
gagagcagcccucauucaccaccuggucccagacgugcuucaguccucguccucucuuuguggc

SEQ ID NO: 231244 - RNA, 64 nt, Human
gcccgaggcugcagucagagguauacuucccauagugcuucacacagcuccccugcuucuaaag

SEQ ID NO: 231245 - RNA, 64 nt, Human
ugccaccucauuauuaucuagcuaagcggaacaugugcuucaucugugggaugcugaaggagau

SEQ ID NO: 231246 - RNA, 64 nt, Human
gcuccuuuuuuauuuuauguccucuauaugccaggugcuucaccuguuauuucacuuaauccuc

SEQ ID NO: 231247 - RNA, 64 nt, Human
acuccuuaaagaggacuauuuagccucucccccagugcuucagccccacccgauaauuuuauuu

SEQ ID NO: 231248 - RNA, 64 nt, Human
cuuaggugguagucaugaagagauaauguuuuuaggcaguuaaaauacuucuagaacuccaucu

SEQ ID NO: 231249 - RNA, 64 nt, Human
caaaaggcugaucagaauucacuuuuuggaauguggcaguuaaacacuaccuugaucauucucu

SEQ ID NO: 231250 - RNA, 64 nt, Human
caaacagcugagcaccguagcaugcagaugucaaggcaguuaggaaguaaauggugucuuguag

SEQ ID NO: 231251 - RNA, 64 nt, Human
acggucuuauacuauuguuuguuugugauuaaaagugcuucaacccaccucuacugucucaacc

SEQ ID NO: 231252 - RNA, 64 nt, Human
ugaucaaacauccgauagucacaaauuugaaaccgugcuucagaaucccagcacauaguaaaag

SEQ ID NO: 231253 - RNA, 64 nt, Human
agguaaaugucaaggcacaaucaguuuucaggaagugcuucaagaccccaggugaaaugaaaau

SEQ ID NO: 231254 - RNA, 64 nt, Human
guaccagaauggaauuuugcuucucgguuauccugugcuucagaugauuauaaucuaacccaaa

SEQ ID NO: 231255 - RNA, 64 nt, Human
cuucuuuuuugcuuaagcauuugcaugacuauuagugcuucaaagucaauuuuuaaaaaugcac

SEQ ID NO: 231256 - RNA, 64 nt, Human
gggugucaagagaagaacugucuuuguuucuugugugcuucaauccagggaaaguuucuuggac

SEQ ID NO: 231257 - RNA, 64 nt, Human
uuuaaaauugaucagagaccacgaaaagaaauuugugcuucaccgaagaaaaauaucuaaacau

SEQ ID NO: 231258 - RNA, 64 nt, Human
acuuugaguauuaacaaguagcuuauacugaggugugcuucaagggagcauuauagggcagaaa

SEQ ID NO: 231259 - RNA, 64 nt, Human
uguucucuccuagguuagagagggguggccuggggugcuucaugagaaaugucuuccuggaucu

SEQ ID NO: 231260 - RNA, 64 nt, Human
uuuguagucaccuagauuuuaagcugauagcauagugcuucagcgguucuucuaaccgggguau

SEQ ID NO: 231261 - RNA, 64 nt, Human
ugugugacugggagaaucucucuuuuuauuaaaugugcuucaaguuuuaacaacugacuuuugu

SEQ ID NO: 231262 - RNA, 64 nt, Human
acuuuuagugaaauaaaaugugccauacuaguaugugcuucaaaagggcaaaugugcuuuagug

SEQ ID NO: 231263 - RNA, 64 nt, Human
gcagccaaguagccucuccuguauuuaacaaaaagugcuucauucuuugcaggaggcccaaccu

SEQ ID NO: 231264 - RNA, 64 nt, Human
gccuuagguuuuuucuuuccaaguuuauuuucuugugcuucagcuacuagaaagguuuaauuca

SEQ ID NO: 231265 - RNA, 64 nt, Human
gacagguugaugguaauaaacugcucaaugaccagugcuucaggcuccagagcucuuuggagag

SEQ ID NO: 231266 - RNA, 64 nt, Human
uccuggggauuaugaagauauucuggaaagauuugugcuucagagguagacugcagaaagcaaa

SEQ ID NO: 231267 - RNA, 64 nt, Human
gugcuuuaaaauguuuuuuuuuauguuuaagaggggcaguuauaaauggacacauugcccagaa

SEQ ID NO: 231268 - RNA, 64 nt, Human
uucugcucuagauugucuggacucaggagauuguggcaguuacuggauaguuauuuuuaagaua

SEQ ID NO: 231269 - RNA, 64 nt, Human
ggggcuuguuuuucuuuucuucuuucaaauaaauggcaguuaacuggcuuuacaguaaacauug

SEQ ID NO: 231270 - RNA, 64 nt, Human
aaacugggaauuucuggugacauagaccucaccagugcuucauauaccaugauauaaucugaaa

SEQ ID NO: 231271 - RNA, 64 nt, Human
gagugcccuugagccccuuuuccuuagccugcaggugcuucaauggaucauggggcaaagcagg

SEQ ID NO: 231272 - RNA, 64 nt, Human
uggacaagaaauccccugaaauucagcuguuauagugcuucacuguuuuugcacugauuuuucu

SEQ ID NO: 231273 - RNA, 57 nt, Human
aauuaguggauauugauugaaauagcagugcuucagcucuaaggauauuagcaacaa

SEQ ID NO: 231274 - RNA, 64 nt, Human
ugagauaacauuuuaagacuuccaaaucagagaagugcuucaaauuauuuuguuuggauuaauu

SEQ ID NO: 231275 - RNA, 64 nt, Human
gccugccucuuuggggaacugagcucagaggcaggugcuucagagaaggaaacaaaaugagggg

SEQ ID NO: 231276 - RNA, 64 nt, Human
gaggaaaaccuaaagggaaauuaaacuaaacacugugcuucauauuuguacacuguguuguacu

SEQ ID NO: 231277 - RNA, 64 nt, Human
uucucugccccuccugggaaucugucauucgugggugcuucagaguaaaaucaaugaguuucug

SEQ ID NO: 231278 - RNA, 64 nt, Human
cugcugaguugcaggugggaacugucaucacgcagugcuucagagccucgggcucagguggcac

SEQ ID NO: 231279 - RNA, 64 nt, Human
guuggcugcucuuccuacuccugagucuacacccgugcuucaccagaagacccugcaggccaug

SEQ ID NO: 231280 - RNA, 64 nt, Human
acaagaguauguggcaaaacauauaccacccauagugcuucacaaaaugcacuucuauuuagcc

SEQ ID NO: 231281 - RNA, 64 nt, Human
gaagguccuaggcugccguggccccuggggaugugugcuucauugugcccuuuuucuuauuggu

SEQ ID NO: 231282 - RNA, 64 nt, Human
acuccaaauacgaagugagauccugagucuuugggugcuucaugauuuccuaccauauucaggc

SEQ ID NO: 231283 - RNA, 64 nt, Human
guguccuuuaguuucaaacagaucuuuauaguucgugcuucauaagccaauucuuauuauuauu

SEQ ID NO: 231284 - RNA, 59 nt, Human
auggcucuuuguacauuuagcuguggugugugcuucagaaaggagcagggcuuagaaaa

SEQ ID NO: 231285 - RNA, 64 nt, Human
cucugugugacucuacacacacuucaggugguuugugcuucaaagucauugaugcaacuugaaa

SEQ ID NO: 231286 - RNA, 64 nt, Human
aaaagaguuaauaaaaauuguucuuuauuuuacaggcaguuacugaggcucuucccagaucuca

SEQ ID NO: 231287 - RNA, 64 nt, Human
ccacucuugaccuggagccaucuuccuagugggccaccccuaaucacuauugcuuccuaaaggu

SEQ ID NO: 231288 - RNA, 64 nt, Human
gacccagugucucagugccuucaaaacccacccccaccccuacccuaccccaccacaccccauc

SEQ ID NO: 231289 - RNA, 64 nt, Human
ugcaaaaagccagguuuuggggaugugucuuacugugcuucaacuucccaaggaauugaaaguc

SEQ ID NO: 231290 - RNA, 64 nt, Human
cccuggcuuaucccuggucgagccaggacacggggugcuucagugggucugucacccucucucc

SEQ ID NO: 231291 - RNA, 64 nt, Human
uucagguuaugaggaggaucagccacacaauccagugcuucaguuugaaaauguaaaauucuaa

SEQ ID NO: 231292 - RNA, 64 nt, Human
gacucugucaccccugggcucccccugccaucgugugcuucacguggccccaugcaugcccgcc

SEQ ID NO: 231293 - RNA, 64 nt, Human
uguaguacacccuggcugccaucacucuauaaaagugcuucaugagcccagaccaaaagcccac

SEQ ID NO: 231294 - RNA, 64 nt, Human
cauacagacguaaauuuugagagaaaagucaaaggugcuucagccuuguacuguguauauauau

SEQ ID NO: 231295 - RNA, 64 nt, Human
gcagcuggcacgagggcugcugacggcaugggucgugcuucaggguggcaauaccucuuaggaa

SEQ ID NO: 231296 - RNA, 64 nt, Human
gugcauaaauuacaaaucagagcugaguggggaggugcuucagcagcagcgggaucaauacgau

SEQ ID NO: 231297 - RNA, 64 nt, Human
cagaggagcaccaggacggcuggaauuuccauaugugcuucacauugugaggggagugcacaag

SEQ ID NO: 231298 - RNA, 64 nt, Human
cggccgcccaggugucaggagagguccccgccgagugcuucagcugcccuaagcugcaccagcg

SEQ ID NO: 231299 - RNA, 64 nt, Human
agcaguacaaggguaucuaucccaguaccaaauggugcuucagcucuaacauggaggucagaga

SEQ ID NO: 231300 - RNA, 64 nt, Human
ucccccagccaccacccucaggugccuccaauuggugcuucagcccuggccccuguggggaaca

SEQ ID NO: 231301 - RNA, 64 nt, Human
uuuaugugaggugcccaacacccauucaucucaagugcuucagucuuugguuuauuucaugcac

SEQ ID NO: 231302 - RNA, 64 nt, Human
gaaaggugggcggaagcagcuggcagccuggggcgugcuucaggcuccucccucuaaggggcgc

SEQ ID NO: 231303 - RNA, 64 nt, Human
ucauacagaauaguuucaccacccucaaaauccugugcuucacuuauuuaucccucccgccgug

SEQ ID NO: 231304 - RNA, 64 nt, Human
aagacugaggcuucugccuacugagcaagguugggugcuucauuuguguucagucugaauuaug

SEQ ID NO: 231305 - RNA, 64 nt, Human
cauuuuccuuuguuuauaaugaaaguggcgauuaggcaguuaguuuccauaaaguggccguaug

SEQ ID NO: 231306 - RNA, 64 nt, Human
ggaggcagcagcauugcacagccccaggcacaguggcaguuaggauggcuggagaguaggauag

SEQ ID NO: 231307 - RNA, 64 nt, Human
acagaacaaagaccaggagaggacacagugagaaggcaguuaucugcaagcaaagagagaggcu

SEQ ID NO: 231308 - RNA, 64 nt, Human
gaguagaaacaagguagacauuucuaaaacauaugugcuucauuaugaauccauggauggcuca

SEQ ID NO: 231309 - RNA, 64 nt, Human
gaaaacuugcagacucaggggggucccugaugcagugcuucagaugaagaauguggacuugaaa

SEQ ID NO: 231310 - RNA, 64 nt, Human
cuuugccuucuuacuguguuguguguuuuuccuggugcuucaagagcgugugcagggcaagugc

SEQ ID NO: 231311 - RNA, 64 nt, Human
ugaagggguuuuaaauuguuucauuuugugugcugugcuucaaagccuuaacugucaaaucuug

SEQ ID NO: 231312 - RNA, 64 nt, Human
guggcugccgccucggaacugcggucuccugccugugcuucagugacugaccccuguccugccc

SEQ ID NO: 231313 - RNA, 64 nt, Human
ccucuauaacaauuuaauguauucaguuuugacugugcuucauaucauguaccucucuagucaa

SEQ ID NO: 231314 - RNA, 64 nt, Human
ugguuuuuccauuuucuuuggcauuuauuuauucgugcuucaaaucacagucauauuaaaagcu

SEQ ID NO: 231315 - RNA, 64 nt, Human
ucaaagcuauucuuacauccguacaacucaaaaggugcuucagagacuagauguaucugagagg

SEQ ID NO: 231316 - RNA, 64 nt, Human
ucagcucuggaacaagcacacuugauuccucacugugcuucagaaugagauuaagaucagaugu

SEQ ID NO: 231317 - RNA, 64 nt, Human
agagaugauaaaacagauacuuccagaacauagugugcuucaaaacauuaauuuuguugaagca

SEQ ID NO: 231318 - RNA, 64 nt, Human
cacauuguccuugauccguaagugauguguuaaggugcuucaaaggaacucugaccucugaagu

SEQ ID NO: 231319 - RNA, 64 nt, Human
uggauccaccucugagugagcgcacagugaucaggugcuucaaagccaacagaccagcuccucu

SEQ ID NO: 231320 - RNA, 64 nt, Human
uuucucccuccccaugucuguucuggguuuucacgugcuucagagaagaggggcugccccaccg

SEQ ID NO: 231321 - RNA, 64 nt, Human
uucagccugaaucgaaugucagaaccagccagcggugcuucacccucuuggggauaacuugcuu

SEQ ID NO: 231322 - RNA, 64 nt, Human
cuauaaaaauggcccagaguauuuucaacaaagcgugcuucauuugacacccagagucugacuu

SEQ ID NO: 231323 - RNA, 64 nt, Human
guuuguuuguuuguuuguuuguuuaagcuuucaggugcuucauuagcuuucaguuccuuuggua

SEQ ID NO: 231324 - RNA, 64 nt, Human
aaaccuuugccaacucagguucacagcagcuuugggcaguuauggcaguauggcauuagcugag

SEQ ID NO: 231325 - RNA, 64 nt, Human
caaacauuaacaaaaaaguuaacuuaugugacuuggcaguuauucuauaccauuuccuguccau

SEQ ID NO: 231326 - RNA, 64 nt, Human
gcagccacaauaauuuuaccaaaguuuucacauaggcaguuagccuuuacuuaauaucaagaca

SEQ ID NO: 231327 - RNA, 64 nt, Human
gggugauucuggggguccacuugucuguaauggugugcuucaagguaucacaucauggggcccu

SEQ ID NO: 231328 - RNA, 64 nt, Human
ucgcaggggaccugggagacgccccgagguguuugugcuucacccccagacgucagccucgaag

SEQ ID NO: 231329 - RNA, 64 nt, Human
cuugucucuccuuguuucuucccacugcacuguggugcuucaguggccaccagccucgucacau

SEQ ID NO: 231330 - RNA, 64 nt, Human
ugcaaccuccgccuccuggguucaagugauucucgugcuucagccucccaaguaccugggacua

SEQ ID NO: 231331 - RNA, 64 nt, Human
acgcuggucuucuuuuaauguggaaaaacagcuagugcuucaguccuaggaauuaugucucugc

SEQ ID NO: 231332 - RNA, 64 nt, Human
ucguguuucaauuguaaccaagaaauuuccauuugugcuucaugaaaaaaaacuucugguuuuu

SEQ ID NO: 231333 - RNA, 64 nt, Human
gcaauauguucacuauguuaccaauuugcaacuugugcuucaauaguggaaucuacuuucauug

SEQ ID NO: 231334 - RNA, 64 nt, Human
guggccagcgcgaugaacgccgcaaguggauccagugcuucaacgguaggaugcugugggcuug

SEQ ID NO: 231335 - RNA, 64 nt, Human
cggccgugacuggagcccgugccccucccuccccgugcuucaugugacucuuggccucucugcu

SEQ ID NO: 231336 - RNA, 64 nt, Human
ugcauguccccagaccugccgccuggcuucuggagugcuucaagcagagcauggugggucauug

SEQ ID NO: 231337 - RNA, 64 nt, Human
aauaugcuauuauuucauagaagagacuaaugcugugcuucaaaagguauguuucuagaauaug

SEQ ID NO: 231338 - RNA, 64 nt, Human
agcaacugaggcacgccaaguucaccaucacggagugcuucauaucagacacgucaucggagca

SEQ ID NO: 231339 - RNA, 64 nt, Human
aaccaagauuccagauggggauaguaacuagaaggugcuucagaugcacugccugcgggugcca

SEQ ID NO: 231340 - RNA, 64 nt, Human
aaagaaaaucgcugcugagaauagacuucaucaugugcuucagaagaaagagguacgagugagc

SEQ ID NO: 231341 - RNA, 64 nt, Human
uaauauuuacagaugugcauuucuuagcaugagagugcuucaucagucuuugaggaaggcuauu

SEQ ID NO: 231342 - RNA, 64 nt, Human
cuaucuacacuaaguucguaauguuauuauuauugugcuucauggagaauuuuccccucuguuu

SEQ ID NO: 231343 - RNA, 64 nt, Human
ucauuuguuggccauucacgcacacaggagauggggcaguuaaugcugaaugguauagcaagcc

SEQ ID NO: 231344 - RNA, 64 nt, Human
cgugggagaaagaaguugcuggaccaggagaaaaggcaguuaugaagccaauucauuuugaagg

SEQ ID NO: 231345 - RNA, 64 nt, Human
aaaaauuaaauagaggugaacacaauuauuuuaaggcaguuaaauuaucucuguauugugaacu

SEQ ID NO: 231346 - RNA, 64 nt, Human
auucugagugggaggaaaagcaaacaucaaaacagugcuucagccaaauuccauauguaaugcc

SEQ ID NO: 231347 - RNA, 64 nt, Human
acuagcugguuugggcaaaugaauuuucccuucugugcuucaguuucuucaucuuuaaaaugag

SEQ ID NO: 231348 - RNA, 64 nt, Human
agccgggcagcuuucuuaugccauuuucuacacugugcuucaugaguaggacuuucuugcacua

SEQ ID NO: 231349 - RNA, 64 nt, Human
caguuguugauugcucucacuccccuuggcuguugugcuucauggccagcacucuugaugaggg

SEQ ID NO: 231350 - RNA, 64 nt, Human
auuggguuuugaucucagcauccuggaaauuugugugcuucacacaaagugaaauuaguauuuu

SEQ ID NO: 231351 - RNA, 64 nt, Human
cuuuuuagggagaguccuccaucuacauuugccugugcuucaggguaauuacuaguaguguuac

SEQ ID NO: 231352 - RNA, 64 nt, Human
uaacuuuuauuuuuuuaaaaugagucgugggguagugcuucaccuugagaugcuuugaaagagc

SEQ ID NO: 231353 - RNA, 64 nt, Human
uuugguagcuugguuuuauauuguuuuuagaucagugcuucaacauccaggcugacguuuagcc

SEQ ID NO: 231354 - RNA, 64 nt, Human
ggucgauucuaaccaagaaaaguccaugagaucagugcuucaacauccagguugacguuuaacc

SEQ ID NO: 231355 - RNA, 64 nt, Human
acaaaugguuacuucuguauauuaccucguaccagugcuucauccuauuuguaaaaucuuucuc

SEQ ID NO: 231356 - RNA, 64 nt, Human
ugacuccaauaccugaaauucugacuucucuccugugcuucaaugagaaugauaaauuauccua

SEQ ID NO: 231357 - RNA, 64 nt, Human
cacauuacagcuaccuucuagcuuuaguaugguagugcuucauucaacuuuugcugucagguuu

SEQ ID NO: 231358 - RNA, 64 nt, Human
caucuuaaugucuuuuguuauugagaaguuuuaggugcuucaaaacaauauaaauggauaauag

SEQ ID NO: 231359 - RNA, 64 nt, Human
uuuuguuuuuuugucccugucauaaaauauuuuggugcuucaaaacuuguaccuucauuguaca

SEQ ID NO: 231360 - RNA, 64 nt, Human
acuguucccaaguuagucaaguaugucucaacacuagcaugauauaaaaagggacacugcagcu

SEQ ID NO: 231361 - RNA, 64 nt, Human
aagugaaaaaaguuuaaucccagaagaguaaauguagcaugaugcccuuucuaaaugaaagguu

SEQ ID NO: 231362 - RNA, 64 nt, Human
gcuugggcucaauccugggcacccaggggcagcccaccccuaaccuggcuccuacccaccucgc

SEQ ID NO: 231363 - RNA, 64 nt, Human
gccugggccaguucuccacuccuaggggccaagccaccccuagccuuggugggggaaaggcagg

SEQ ID NO: 231364 - RNA, 64 nt, Human
uaaccaucauugacugacuaguccauccuuaccccaccccuacugauuaugaugucacugcugu

SEQ ID NO: 231365 - RNA, 64 nt, Human
uauuugcuuucaacaguuacugaguaugacauuuuagcaugaaauauaucaaacacaucauuug

SEQ ID NO: 231366 - RNA, 64 nt, Human
uuaaggaaacccuuacgaauccugaaaauuaugcuagcaugauuuuuuuauauauagaaguuua

SEQ ID NO: 231367 - RNA, 64 nt, Human
acuuguuucaucuccggaaaugcaaaaccauuuauagcaugaagcccuacaugaucacugcagg

SEQ ID NO: 231368 - RNA, 64 nt, Human
gggauuuugugcauguaguucagucuaguguugguagcaugacagaaaguggggaaaaugccgc

SEQ ID NO: 231369 - RNA, 64 nt, Human
cuucgugcucugugugaaggggaagcugggggguuagcaugaagucuggccuugugugcauugg

SEQ ID NO: 231370 - RNA, 64 nt, Human
ucuuuaaaaauuguuguuauaugaauuguguuucuagcaugaauguucuauagaguacucuaaa

SEQ ID NO: 231371 - RNA, 64 nt, Human
uucagaagccuugggagaggccaaagagccauucuagcaugaucugagaaaaccuuccugcaga

SEQ ID NO: 231372 - RNA, 64 nt, Human
aguugggauauuaacuuguuuuugcacuuuagaauagcaugagaaucucacuaauuuagcauuc

SEQ ID NO: 231373 - RNA, 64 nt, Human
ugccugaggacgugugggaaccccguucccuacuuagcaugauccuugagucuccucucuggau

SEQ ID NO: 231374 - RNA, 64 nt, Human
uucuauuaacauugaaagguaaaaucugauuauuuagcaugagaaaaaaaaauccaacucugcu

SEQ ID NO: 231375 - RNA, 64 nt, Human
uaaaacauuggcauuugaagaggagaacaaaauguagcaugauguauuuaaaguaaggccuuua

SEQ ID NO: 231376 - RNA, 64 nt, Human
agagacucuacucucuguccccagauccucuuucuagcaugaaugaaggaugccaagaaugaga

SEQ ID NO: 231377 - RNA, 64 nt, Human
acuacaguuaacgcugaacugcagcugcaaguaauagcaugaacagucagaaaaauaccuuaug

SEQ ID NO: 231378 - RNA, 63 nt, Human
gccuugcucagucuuacuaaacggaucaucuuguagcaugaaugcagacuggagucacugcac

SEQ ID NO: 231379 - RNA, 64 nt, Human
ccuaagaugauaccuuuguugaaagaauugugaauagcaugauucauuucuagcagaggcugag

SEQ ID NO: 231380 - RNA, 64 nt, Human
uucccaguuggagcuccagccugacaucaaaaaaggcaguuaccauuaaaccaucucccuggug

SEQ ID NO: 231381 - RNA, 64 nt, Human
uuaaaaaugcccuuggcauaaggcagcaugguguggcaguuaagagaugggcugugcagcccau

SEQ ID NO: 231382 - RNA, 64 nt, Human
ugugauaaauguguagauuagagggaugugaaugggcaguuaguccagugcccucauuuaagag

SEQ ID NO: 231383 - RNA, 64 nt, Human
auuauuaucacugucagaugagcaugcuugaauguagcaugacugccucuuuuugcuuuuccua

SEQ ID NO: 231384 - RNA, 64 nt, Human
cucuuaaggcaacucacugauuuacuucuagcaauagcaugauguuacaggaauauuaccucug

SEQ ID NO: 231385 - RNA, 64 nt, Human
cugcuacaaaauuguauauaguuuuuggaucaaauagcaugaggggagaggaaaccauuaaaag

SEQ ID NO: 231386 - RNA, 64 nt, Human
gugauuuuuuacugugaagaugaaauuacccuaauagcaugaagaucgugggucuguguguccg

SEQ ID NO: 231387 - RNA, 64 nt, Human
aaagaugcuuuuuugggugcaagucuaaccugucuagcaugagaucuucuugauuuucugauua

SEQ ID NO: 231388 - RNA, 64 nt, Human
uuuaccaauaauguuaaauuaguuuugguugugcuagcaugaauuaauaaccaccauuuuauac

SEQ ID NO: 231389 - RNA, 64 nt, Human
acaaacucgcucugucacccaggcuggagugcaguagcaugaucgacagagugaguuugucaaa

SEQ ID NO: 231390 - RNA, 64 nt, Human
aaaacucuccuuggauacguuuucugagaaaaaauagcaugaagccuaaagccauuucuuccaa

SEQ ID NO: 231391 - RNA, 64 nt, Human
cucucaggcugagggaggcagaaagggaaaguauuagcaugagcuuuccaguuagggcuguuga

SEQ ID NO: 231392 - RNA, 64 nt, Human
ugaacuuucauaggaaaaaugacccaacauuucuuagcaugagcuaccucaucucuagaagcug

SEQ ID NO: 231393 - RNA, 64 nt, Human
agaacuggucauagaggaagagcuagaaauccaguagcaugauuuuuaaauaaccugucuuugu

SEQ ID NO: 231394 - RNA, 64 nt, Human
uguuacgaucggaaugcuuuuuauuaaaagcaaguagcaugaaguauugcuuaaauuuuaggua

SEQ ID NO: 231395 - RNA, 64 nt, Human
augacaggaugggguuccccugugcuuuuaccaguagcaugaccccuucugaagccauccguag

SEQ ID NO: 231396 - RNA, 64 nt, Human
augaaagaauaaagcuuuuaaguauagacuaccuuagcaugaagaugcucaugccuaagaauga

SEQ ID NO: 231397 - RNA, 64 nt, Human
ccaggucugcucccuuaccggagcuaggauaagguagcaugagugacaccugagauuagaggcu

SEQ ID NO: 231398 - RNA, 64 nt, Human
cuuucagcaucaugcaggggcuuaucugucuggaggcaguuaccucauaauaaacuauaaaaua

SEQ ID NO: 231399 - RNA, 64 nt, Human
gggacccuuaauuucuuguccccugcccuccaugggcaguuauauucugcaucaagccuuagaa

SEQ ID NO: 231400 - RNA, 64 nt, Human
auuggcuuaggacccaauuuccauagaugcaaauggcaguuacagacagguuaacagaagcuac

SEQ ID NO: 231401 - RNA, 64 nt, Human
cauaugccuuuauagcuagacauuagaauuaugauagcaugaguuuauacauucuauuauuuuu

SEQ ID NO: 231402 - RNA, 64 nt, Human
uuucuuccuaguuuuuguaauuuuuuuuuugaacuagcaugacuguaggguugagcuacaguca

SEQ ID NO: 231403 - RNA, 64 nt, Human
gcguuuuauacaugaggucagugcuacagccaccuagcaugaacuaacccagcuuccaccucca

SEQ ID NO: 231404 - RNA, 64 nt, Human
uaguguuuucucagucacaauuuucuuuacugucuagcaugaucugcaugaccuauaaucuuug

SEQ ID NO: 231405 - RNA, 64 nt, Human
acccaugauuuagcuuugcucaaauuagaauguuuagcaugaguugagguaccagguaguguua

SEQ ID NO: 231406 - RNA, 64 nt, Human
uuacugugccacuccaauauuuaucaaauccaaauagcaugaaugcuucucuguaguaauacua

SEQ ID NO: 231407 - RNA, 64 nt, Human
guuuuuugggcgaaaaucuuggaucauuuuuauguagcaugauuuuccuugggaugcaaaucuu

SEQ ID NO: 231408 - RNA, 64 nt, Human
ugcaaauguucaaaaaagcucucuugaaucuagguagcaugaacaaauuauaaaauuuguuuaa

SEQ ID NO: 231409 - RNA, 64 nt, Human
cagauuuugggcaggacauuccaugcacuggaaauagcaugaacaaaugcaugaaaauugccua

SEQ ID NO: 231410 - RNA, 64 nt, Human
caucuuuagcgcuggcuucauucucagacucugguagcaugauggcuguagcuguuucaugggc

SEQ ID NO: 231411 - RNA, 64 nt, Human
aagguucauguuuuucugaguaaaugugguuuauuagcaugaaauauuaugccuuuuacuuaaa

SEQ ID NO: 231412 - RNA, 64 nt, Human
ccgcaagcaugcuaauuugauggaaguuacaggguagcaugauuaaaacuaccuuugauaaauu

SEQ ID NO: 231413 - RNA, 64 nt, Human
cuguauuuuuauuuuugcacaacuuuugagaguauagcaugaauguuuuuagaggacuauuaca

SEQ ID NO: 231414 - RNA, 64 nt, Human
cuuccauuuauuagaagcacauuaaccauuucuauagcaugauuucuucaaguaaaaggcaaaa

SEQ ID NO: 231415 - RNA, 64 nt, Human
cuuuucaaggacugcaagauuauuugauaaagaguagcaugaaucuugugcucuaauauuacac

SEQ ID NO: 231416 - RNA, 64 nt, Human
gguuuuuguguuauaaagguuuaauuuuacauaaggcaguuacuuaaugugauuuuuaacccuu

SEQ ID NO: 231417 - RNA, 64 nt, Human
cauuuuugugggggcuagaaaaaacauaaaaugaggcaguuaaauaauaauaguuaaugaaggu

SEQ ID NO: 231418 - RNA, 64 nt, Human
gugcugggucucagccccaugugccugcuugcugggcaguuaguauagggcaaagccugccugc

SEQ ID NO: 231419 - RNA, 64 nt, Human
uaaugccuuauauauuguuuguagucauuuuaaguagcaugagccaugucccuguagucgguag

SEQ ID NO: 231420 - RNA, 64 nt, Human
aauaaaaaauaaacuguuugaaaugcauaccuuauagcaugauuugaugccugauaaucacaga

SEQ ID NO: 231421 - RNA, 64 nt, Human
aaccauuuggguuucaaauguuaagaacacuaaauagcaugauuuaaaaaaugaaaaaugcuaa

SEQ ID NO: 231422 - RNA, 64 nt, Human
uuaggauguaaguuucugaggagaaagcuagcucuagcaugaagcuuuuuuggauuggcuucuc

SEQ ID NO: 231423 - RNA, 64 nt, Human
ucaggaauccaguauauuccaaacaucacauauuuagcaugagaaaaauugauuugugauugug

SEQ ID NO: 231424 - RNA, 64 nt, Human
uccccaaaugaacagcagccagaauuaggugaaguagcaugauagcaguguuuaaaaauacuua

SEQ ID NO: 231425 - RNA, 64 nt, Human
uuuguuacaaacuuaauuuuuugaaaguacucuguagcaugacaauuuuuagagcugcagguua

SEQ ID NO: 231426 - RNA, 64 nt, Human
gucuacucuauguuuaugcauaagaaaacauccauagcaugaauggacucagaaaaaugugauu

SEQ ID NO: 231427 - RNA, 64 nt, Human
gguguguuuacauaggauauacauaguugaaaucuagcaugaaagguuaaaaaggagauacugc

SEQ ID NO: 231428 - RNA, 64 nt, Human
agaacuaguuugaaaucguuuauauucauuucuguagcaugacagggauuucaaucaccuuucu

SEQ ID NO: 231429 - RNA, 64 nt, Human
cacccgaucauaccuuccccccucugccacagcuuagcaugaaucuucuuuauuguccugauuu

SEQ ID NO: 231430 - RNA, 64 nt, Human
cagaugcaaagaaaaucuggaaucccuuucucauuagcaugaaugaaccugauacacaauuaug

SEQ ID NO: 231431 - RNA, 64 nt, Human
auuguaguuuaauacaggaacacacagggcuguguagcaugauaccaggcccaggagaucagua

SEQ ID NO: 231432 - RNA, 64 nt, Human
gugggcaggccucgaaaaccaucacaugaccacauagcaugaggccacugcugcuucuccaugg

SEQ ID NO: 231433 - RNA, 64 nt, Human
auacauuuacaacauuuauuaauuuauauuaaaauagcaugaauaagccaauuauagguuaaua

SEQ ID NO: 231434 - RNA, 64 nt, Human
cggaucaaaaccuacaagauucaacugaaaaguuggcaguuaugguuuucuuucaucugaugug

SEQ ID NO: 231435 - RNA, 64 nt, Human
uuuuucacuucuuggagguagaagucgaguaugaggcaguuauuuuuuagaguguggaauuaua

SEQ ID NO: 231436 - RNA, 64 nt, Human
aucuauuuaacuauuagaggcccugugagauguaggcaguuauuuacagaugagaaaacuaaca

SEQ ID NO: 231437 - RNA, 64 nt, Human
ucccugccuuuggauuucauaguuucucugucaguagcaugauccccaccgcuauggucuaucu

SEQ ID NO: 231438 - RNA, 64 nt, Human
aguaaguugcccauuaacaaauggcuuuuaucuuuagcaugaaaacuuuccacaggucuaaaaa

SEQ ID NO: 231439 - RNA, 64 nt, Human
cccagaucaguaccccccaccccuccccagcuaguagcaugaccaggagaggguuaaugagagc

SEQ ID NO: 231440 - RNA, 64 nt, Human
agauguauuuuuuuauuguccuuaaaagaagcucuagcaugaaauuaaaggaaagggaaagaaa

SEQ ID NO: 231441 - RNA, 64 nt, Human
auuugcaaguguucaccuuccaaaucaugaggcauagcaugacuuauucuuguuuggaaaacuc

SEQ ID NO: 231442 - RNA, 64 nt, Human
guaccuuugaaagaaucucaaauuucaaaagaaauagcaugauugaagauacaucucuguuaga

SEQ ID NO: 231443 - RNA, 60 nt, Human
caaaucgugauuuugacugagugagacuucuagcaugaaagucccacuuugauuauugcu

SEQ ID NO: 231444 - RNA, 64 nt, Human
uucaacaaacuuguuuaauuuguuuaaaucaacauagcaugaaacaccaaauaaaauguuugac

SEQ ID NO: 231445 - RNA, 64 nt, Human
cuuauuaguccuagugugaaagcauuaauauuauuagcaugaaauuuuuacuucagauuuuaag

SEQ ID NO: 231446 - RNA, 64 nt, Human
cacauguccaagaaagaaagcuucuugauugagguagcaugaaggaugaggcuucagcccccau

SEQ ID NO: 231447 - RNA, 64 nt, Human
aagcagacaccgucacaggccccucugguuagacuagcaugagugaccgaagccauccaucaac

SEQ ID NO: 231448 - RNA, 64 nt, Human
gauauuggacucugcuuagcauuuucaagccacauagcaugacuguuuuuugaauagguuggaa

SEQ ID NO: 231449 - RNA, 64 nt, Human
ucuauucagggaagcgcacaguaaaagaauuccuuagcaugaugucuguuuugguaccucagca

SEQ ID NO: 231450 - RNA, 64 nt, Human
aaucgccuagcuccaggcuguguuaggacaguauuagcaugaaggcugugcgaccaucaugccu

SEQ ID NO: 231451 - RNA, 64 nt, Human
cuuuuuuccaaaguguaaguuugugaauagauuuuagcaugaugaaacugucauaauggugaau

SEQ ID NO: 231452 - RNA, 64 nt, Human
gaacuauagugccuggauacauucuucagcauuuggcaguuaaucugcugaaaccaaaguaaga

SEQ ID NO: 231453 - RNA, 64 nt, Human
ucuggauagggucagucaccaggccuggacugaaggcaguuauuuuuauuauuauuauuauuug

SEQ ID NO: 231454 - RNA, 64 nt, Human
cuucaagguuuuuuuuuuuuuuuuuuuuugcugaggcaguuauuguccacaggccuuuggguac

SEQ ID NO: 231455 - RNA, 64 nt, Human
gucaucuccccuccuggcgaguucucuuuggaaauagcaugacaggcuguucagccgggagggu

SEQ ID NO: 231456 - RNA, 64 nt, Human
aauggucgucugguagccuuugcauuuaacaaacuagcaugaggcuuuuuauaucuaaaugcua

SEQ ID NO: 231457 - RNA, 64 nt, Human
uguuugaaaaucuauauaaaguacaacuugcuuuuagcaugauuauuuuccuaaauaaaaagac

SEQ ID NO: 231458 - RNA, 64 nt, Human
uccacaaaauuugauccuuauugcuuccagcaaguagcaugaacuucuguguucaccuguauaa

SEQ ID NO: 231459 - RNA, 64 nt, Human
ucucaucucccaggccccaggggagaaagaggaguagcaugaacgccaaggaauguacguugag

SEQ ID NO: 231460 - RNA, 64 nt, Human
auuuuaaaagccagguaacaccuaccaguccaguuagcaugauuugcuuucagaagugagcugg

SEQ ID NO: 231461 - RNA, 64 nt, Human
aucucgaguagauuuucuuggauuucagaacaucuagcaugacucugaaggauaccacauguuu

SEQ ID NO: 231462 - RNA, 64 nt, Human
gccauaaggaagaaaaagaacucuugcaugaaaauagcaugaugcaggaagaaauugccaugcu

SEQ ID NO: 231463 - RNA, 64 nt, Human
ucauuuauaaagcuaaaauaaccggauauauacauagcaugacauuucuuugugcuuuggcuua

SEQ ID NO: 231464 - RNA, 64 nt, Human
gugcugagggggagaggagggguuagggguuggguagcaugagagauggaauauucauucagac

SEQ ID NO: 231465 - RNA, 64 nt, Human
uguucaucuggaaguauuuuccuccaaaguaauguagcaugauuuuucaaggauuguuaacaug

SEQ ID NO: 231466 - RNA, 64 nt, Human
ucuaaauaccagcagaagaggcucccgccucuguuagcaugaucaguacuauugugacauuaaa

SEQ ID NO: 231467 - RNA, 64 nt, Human
agguucuuuugugagccaggaucucagacugccguagcaugaugcuguccaucuuuagcgcaug

SEQ ID NO: 231468 - RNA, 64 nt, Human
ucaugauuuaagagcaguuuuguaaaaaauucauuagcaugaaaggcaagcauauuucuccuca

SEQ ID NO: 231469 - RNA, 64 nt, Human
ggaaguaaauggugucuuguagauaugugcaagguagcaugaugagcaacuugaguuuguugcc

SEQ ID NO: 231470 - RNA, 64 nt, Human
cacgaagucaccagcccauagguccagggaggcaggcaguuaacugagaauuggagaggacagg

SEQ ID NO: 231471 - RNA, 64 nt, Human
gcacauagguuuauuuaugguuugauuuuuuuuaggcaguuauauuacuagauuaagcuuguga

SEQ ID NO: 231472 - RNA, 64 nt, Human
ugcucugagcugcucucaguacucuccucaucauggcaguuaacacauuaccaauuuuguuauu

SEQ ID NO: 231473 - RNA, 64 nt, Human
aaguguaaauccuuuuucuuuauaaacuuuagaguagcaugagagaauuguaucauuugaacaa

SEQ ID NO: 231474 - RNA, 64 nt, Human
acuaaagagaaaugucuuuugugcuacaguuucguagcaugaguuuaaaucaagauuaugauga

SEQ ID NO: 231475 - RNA, 64 nt, Human
acaucaaugaaaaguagcauauucucuuaugaaauagcaugagaaaacacagggcauuucuagg

SEQ ID NO: 231476 - RNA, 64 nt, Human
caaaacugggccacuguuuguacugaugguguauuagcaugagcagcguggcccuggccccaca

SEQ ID NO: 231477 - RNA, 64 nt, Human
ugcaucgacuugcauucccacuuaacacuuugauuagcaugaacuugccaaucaaaaaaugaca

SEQ ID NO: 231478 - RNA, 64 nt, Human
caaguuccgcauccucaggcgccagccuguccaguagcaugaacaccgcgaacagccucugucu

SEQ ID NO: 231479 - RNA, 64 nt, Human
cgcauuuuaaugauccgcuauuauaagcuuuuaauagcaugaaaauuguuaggcuauauaacau

SEQ ID NO: 231480 - RNA, 64 nt, Human
gaguuucacucuuguugcccaggcuggagugcaauagcaugaucucggcucacugcaaccuccg

SEQ ID NO: 231481 - RNA, 64 nt, Human
gcugugcauuggggacacauaccccucaguacuguagcaugaaacaaaggcuuaggggccaaca

SEQ ID NO: 231482 - RNA, 64 nt, Human
ugucuuuggccuuuguuuagcuuuaaggguucguuagcaugaguguccagucgugugcaugaau

SEQ ID NO: 231483 - RNA, 64 nt, Human
uaccaagcuccucugcuccccacuuuguagagccuagcaugagguggcauguacuagaauugga

SEQ ID NO: 231484 - RNA, 64 nt, Human
ccuaaaagcgaauguuugugugugcagacaaucuuagcaugaaaaugguuuaaauaggcugguc

SEQ ID NO: 231485 - RNA, 64 nt, Human
cugaguugaauuugccuuugcacgcugaggaauguagcaugacguuaagauuucagggaggaag

SEQ ID NO: 231486 - RNA, 64 nt, Human
gagguucccaccccuucacaguguugauugcuauuagcaugauaaugaacucuuaaugguaucc

SEQ ID NO: 231487 - RNA, 64 nt, Human
aagaaaagaaaagaaaaccacccacauuuuaauuuagcaugagccaauuuacagagcauggaaa

SEQ ID NO: 231488 - RNA, 64 nt, Human
aagauaaguggggaaggacagcguugcauagaggggcaguuacaggccaugaagaauguguaga

SEQ ID NO: 231489 - RNA, 64 nt, Human
ugaaguagucuguugguucagugcaugcuuaguuggcaguuaccacccugugcuagcauauuuc

SEQ ID NO: 231490 - RNA, 64 nt, Human
agucaagaagcugaggcagaacucacugggggugggcaguuaagguggaggcugauucuaauug

SEQ ID NO: 231491 - RNA, 64 nt, Human
cagccuguuaaugaugucuucauguugaguuuuauagcaugacuguugaccuuaagauccauuc

SEQ ID NO: 231492 - RNA, 64 nt, Human
cauuuagaacuaaccauauuauuuauggaauaauuagcaugaggaagguauaauugcauuuuuu

SEQ ID NO: 231493 - RNA, 64 nt, Human
guagcauuuauaauagaggaaguauuguuaucccuagcaugaguguaauggugauaugaaaaac

SEQ ID NO: 231494 - RNA, 64 nt, Human
acaaaaacaacuauauuuugccaaucacauuaguuagcaugauggcauucccuucauguugcac

SEQ ID NO: 231495 - RNA, 64 nt, Human
uaaagcuccauggagaguuuuaaagaaacauauguagcaugauuuuguaggagaggaaaaagau

SEQ ID NO: 231496 - RNA, 64 nt, Human
aagugcaauuguuuuuuacuggaaaguuacccaauagcaugaggugaacaggacguaguuaggc

SEQ ID NO: 231497 - RNA, 64 nt, Human
uaacuaaauuguucucugcauauagcaggaaaacuagcaugaaauauuguuucaggcccugggu

SEQ ID NO: 231498 - RNA, 64 nt, Human
cuuggauauauaggcuauuuucuaaagacuuguauagcaugaaauaaaauauaucuuauaaagu

SEQ ID NO: 231499 - RNA, 64 nt, Human
aaguguguuuagaaggguucaggacuuugugaguuagcaugacccuaaaauucuaggggauuuc

SEQ ID NO: 231500 - RNA, 64 nt, Human
cuucguaaauuaguaacuuuuagcugggaaaguauagcaugaaaccagagguucucagaaugac

SEQ ID NO: 231501 - RNA, 64 nt, Human
aauccaauuuuguagaauuccuacacaggcaaaauagcaugaucugagcagcagcauccaggcu

SEQ ID NO: 231502 - RNA, 64 nt, Human
guaggcggugauggaacaacugucaaaucaguuuuagcaugaccuuuccuuguggauuuucuua

SEQ ID NO: 231503 - RNA, 64 nt, Human
ucguguacauauuggaacaauccacagcagaucauagcaugauguuuucauagaguaucgaggu

SEQ ID NO: 231504 - RNA, 64 nt, Human
uucuuuucauaucucuugcccuuccuacuccucauagcaugauauuguucuccaaggaugggaa

SEQ ID NO: 231505 - RNA, 64 nt, Human
aucaguuauugaaacugaaagugagucagauugguagcaugacguaagguuuuaacaguucaga

SEQ ID NO: 231506 - RNA, 64 nt, Human
gaauuucucugccagugcaguaagaguugaaaccggcaguuacacuaaguaaguggagggaaug

SEQ ID NO: 231507 - RNA, 64 nt, Human
cccccccauagaaggcaaaauggcuuucagcaauggcaguuaagucuacacagccucucaacug

SEQ ID NO: 231508 - RNA, 64 nt, Human
ccccaugccacuggucggcacuuugccacuguguggcaguuacccgugccuuagucuucuccac

SEQ ID NO: 231509 - RNA, 64 nt, Human
uuacucuuccuuuuaaguuuucuaaguacgucuguagcaugaugguauagauuuucuuguuuca

SEQ ID NO: 231510 - RNA, 64 nt, Human
aaaugagaauggugagcgcacggguugguuguucuagcaugaauacaauucuggaaacuguuau

SEQ ID NO: 231511 - RNA, 64 nt, Human
gguauuuauagugaaucauacuguaaaaaagagguagcaugauaugcuggaaagcauauuagac

SEQ ID NO: 231512 - RNA, 64 nt, Human
gggguuucugucucccuaguguucccauccagauuagcaugagugcuuugguugacuucaaacc

SEQ ID NO: 231513 - RNA, 64 nt, Human
ugguauuacauguauucuauuuuuuucugaaugauagcaugaaaagugucaaagugguuugucc

SEQ ID NO: 231514 - RNA, 64 nt, Human
accgcuucuguacacuaauguuuauagguauuuauagcaugaagaaaaucagacuauauauugu

SEQ ID NO: 231515 - RNA, 64 nt, Human
auuuuguuuugaaugggcaucuccugaggaaauguagcaugacauugguacuaacugcaugugu

SEQ ID NO: 231516 - RNA, 64 nt, Human
uagauggagaaacaaagcucaggguuuguugaauuagcaugagagaaaauuauguaccaacaga

SEQ ID NO: 231517 - RNA, 64 nt, Human
ccacaagcugcauugcuuucuuuuuaacuugaaguagcaugaaggcucaaaaguuuuguugggu

SEQ ID NO: 231518 - RNA, 64 nt, Human
aguaacaaaguucuuguaagguaaauaauguauuuagcaugaagcaugaauuauuuucauauaa

SEQ ID NO: 231519 - RNA, 64 nt, Human
gugaauagagcacauauuacucuuuuuagcaaccuagcaugaugccaacaagacuauucuugaa

SEQ ID NO: 231520 - RNA, 64 nt, Human
ugaagacacacggguucacacuggaguccugccguagcaugauugcgcucauggauguauccuu

SEQ ID NO: 231521 - RNA, 64 nt, Human
uaguguucccauccauguguuccaaaugggagcauagcaugaagugaugcacauauuucaccac

SEQ ID NO: 231522 - RNA, 64 nt, Human
ugauuauuguccaauuaaagacaguugauuuaaguagcaugagguauuauuuuauuuguauucg

SEQ ID NO: 231523 - RNA, 64 nt, Human
aagaaauaaaagaaucacacaacaaggagauuuuuagcaugauacuggaaauaaaauguccaag

SEQ ID NO: 231524 - RNA, 64 nt, Human
uucagguacuaaccacaacuagucugacauuguuggcaguuaaaaucuuauuuugaauuguaaa

SEQ ID NO: 231525 - RNA, 64 nt, Human
uuaagauauaggaccaaaacagaauauuguagauggcaguuaugaauguauauuuauauuuuga

SEQ ID NO: 231526 - RNA, 64 nt, Human
aaaaaugcucauugaaaauuaaauaaaacaaaaaggcaguuauuucaugcuuggucaaaaacau

SEQ ID NO: 231527 - RNA, 64 nt, Human
guaggagcuccucucacaaguaguuguaaugcuguagcaugauacucaggaucaguagcuugag

SEQ ID NO: 231528 - RNA, 64 nt, Human
acucggccugccuuugcccucggccuacuugcccuagcaugaggcucugagagccaccugccca

SEQ ID NO: 231529 - RNA, 64 nt, Human
accagacccaucucaaagaaccaagaaaaggcuuuagcaugaaauaucuuucugagcuggcgag

SEQ ID NO: 231530 - RNA, 64 nt, Human
cacggacucuuugcuguugacguugaucuccugguagcaugaccuuuuggccuuuguaagacac

SEQ ID NO: 231531 - RNA, 64 nt, Human
uaagaaaaugggaacuaauagggaaauuuauuuauagcaugaaaauaaaccugguggcuggagu

SEQ ID NO: 231532 - RNA, 64 nt, Human
agcguguugguguuuugcucggcagcuuggauccuagcaugacuauacauugugacauggucau

SEQ ID NO: 231533 - RNA, 64 nt, Human
aguguguugguguuuugcucggcagcuuggauccuagcaugacuauacauugugacauggucau

SEQ ID NO: 231534 - RNA, 64 nt, Human
cacaaccacuuugcccccaaguuuucagguuaaguagcaugaauuuggucauuccuuaaagaca

SEQ ID NO: 231535 - RNA, 64 nt, Human
ugguaaguguucaagucuuucugaucaccccaaguagcaugacugaucugcaauuuaaaauucc

SEQ ID NO: 231536 - RNA, 64 nt, Human
guacauuuaguuaaacaagauaacacuauuuuuguagcaugauuuuagauuguguccuuuuaau

SEQ ID NO: 231537 - RNA, 64 nt, Human
uuugccuuuguccucaagaguugauacuuggcauuagcaugaaacuugugggugugggaggaug

SEQ ID NO: 231538 - RNA, 64 nt, Human
ggagacuauaaacaguagucuauuggaacaccauuagcaugacuuuuaagcacaguaauagagg

SEQ ID NO: 231539 - RNA, 64 nt, Human
acauguauaaaugucuuguauuuuaauucauuuuuagcaugaauuguuuaaggguaagccacaa

SEQ ID NO: 231540 - RNA, 64 nt, Human
uugcucuagagagaagcaaguggugggaaggagguagcaugacguguggugugcggguuuccuu

SEQ ID NO: 231541 - RNA, 64 nt, Human
ccugaaguuggagugaguguggcuccccucuauuuagcaugacaagccccaggcaggcugugcg

SEQ ID NO: 231542 - RNA, 64 nt, Human
gaccauucuugaccaagcaagcaugcacauuaugggcaguuacauucucaaguuuuuaaaauca

SEQ ID NO: 231543 - RNA, 64 nt, Human
uuaaaucugucuucauccuuauccuuaauauaacggcaguuagauguacuucuuuagagggagu

SEQ ID NO: 231544 - RNA, 64 nt, Human
ccuucccaaggcauugaagcugaaugugccaacuggcaguuagaagcgaaagauggcauuggga

SEQ ID NO: 231545 - RNA, 64 nt, Human
cucuuguagcuucuuacagaaaacagauuuagucuagcaugaaacaccucugcaucucauugaa

SEQ ID NO: 231546 - RNA, 64 nt, Human
uaaauaccccuuccacugcucacuuuguggaugguagcaugagcugucuaccaagaagaaaccu

SEQ ID NO: 231547 - RNA, 64 nt, Human
uuggguacuagauacccuggggccagcagaaguauagcaugaagacagaacuaccaucgguggg

SEQ ID NO: 231548 - RNA, 64 nt, Human
aauacuauucuuuaauugcaauccuagguaucuauagcaugaguggccuuagugaguuuguuga

SEQ ID NO: 231549 - RNA, 64 nt, Human
gcaauuucuucaguaauuuagauuuuuuucacuauagcaugaaauauauucaaauacauaccuu

SEQ ID NO: 231550 - RNA, 64 nt, Human
agauucuugcucugucacccaggcuggagugcaguagcaugaucagggaucacugcaaccucug

SEQ ID NO: 231551 - RNA, 64 nt, Human
augucaugagacguuggacaggcaggauugaugauagcaugaccauagcuuugcuggaauacug

SEQ ID NO: 231552 - RNA, 64 nt, Human
uagcuaauagcuacaggcugagagaauuguaacauagcaugacaaauuuuguguugacuugaaa

SEQ ID NO: 231553 - RNA, 64 nt, Human
ucuacaaaauuauguguuaagaaaauaccauucauagcaugaagauuaggaaacaguuuuaagg

SEQ ID NO: 231554 - RNA, 64 nt, Human
gccucuugcaaugguaggaaaaaaggaucucaaauagcaugaguguaugucuauauccugaaau

SEQ ID NO: 231555 - RNA, 64 nt, Human
ggagcaugaggaauucaggagcagaaggucaggauagcaugagauagucucaauguggccaacc

SEQ ID NO: 231556 - RNA, 64 nt, Human
uguggcccaagacccccaccauaaaucacaucauuagcaugaaccacccagaguggcccaagac

SEQ ID NO: 231557 - RNA, 64 nt, Human
uacaaaaacagggauucaucacaaaucccaucuuuagcaugaagggucuggcauggcccaaggc

SEQ ID NO: 231558 - RNA, 64 nt, Human
ccaauccuaggacagccuuguuccucagcaccccuagcaugaacuugugggauggugggguugg

SEQ ID NO: 231559 - RNA, 64 nt, Human
cagagcaaauuaccugauuucuucaacuaacagguagcaugaaaauacaaggggaagggcaacc

SEQ ID NO: 231560 - RNA, 64 nt, Human
aaauaagagauugucuguaguugauugaaacgagggcaguuaugaauugauuugggcaaucaaa

SEQ ID NO: 231561 - RNA, 64 nt, Human
gaagaugaauuauuucucaugcucauuuucuugcggcaguuaucuuagaaagacccccaaaggc

SEQ ID NO: 231562 - RNA, 64 nt, Human
uguguaaguacaaccauauuucagucaguccagaggcaguuaacccuguagcacuuacuagacu

SEQ ID NO: 231563 - RNA, 64 nt, Human
uuagugaaccaggagaguuuuagaacaacaauuauagcaugaccccauuuuguuaguauguuuu

SEQ ID NO: 231564 - RNA, 64 nt, Human
auguaucagggacuuuugccacauuucagaggcauagcaugaacaaguaauauuaagccaagaa

SEQ ID NO: 231565 - RNA, 64 nt, Human
uuaggaggccccccaauccccacguugagcugucuagcaugagcacccacccccacagcgcccu

SEQ ID NO: 231566 - RNA, 64 nt, Human
auuuagcaggaagcugugagagcaguuugguuucuagcaugaagacagagccccacccucagau

SEQ ID NO: 231567 - RNA, 64 nt, Human
uagggagaaaaagcagcuuauaaaauaauguauauagcaugauacuauuuuuguuuaaaaauau

SEQ ID NO: 231568 - RNA, 64 nt, Human
ucgcucuuacccgguaaguaaacagucagaaaauuagcaugaaagcaguuuagcauugggagga

SEQ ID NO: 231569 - RNA, 64 nt, Human
ccaugugugaucuugugggguggagggaagagaauagcaugaucccacuuccccaugcuguggg

SEQ ID NO: 231570 - RNA, 64 nt, Human
ucgcucuuagccgguaaguaaacagucagaagauuagcaugaaagcaguuuagcauugggagga

SEQ ID NO: 231571 - RNA, 64 nt, Human
ucuuagugaccaaacgugaccuugaaagcagacauagcaugacagaccuuccuagaguguuugg

SEQ ID NO: 231572 - RNA, 64 nt, Human
cugcauuugauaauauuuacagaugugcauuucuuagcaugagagugcuucaucagucuuugag

SEQ ID NO: 231573 - RNA, 64 nt, Human
uuagcucaaaauguugagucauuuacauaugacauagcaugaaucacucuuuacagaaaaugua

SEQ ID NO: 231574 - RNA, 64 nt, Human
aaaugaaaauggcugaagaaacacagcaugcauuuagcaugaguucugcacauacagauggugu

SEQ ID NO: 231575 - RNA, 64 nt, Human
ccagcuaauucuucuugggcuauuuguuugacaguagcaugauguuuuuugagaccaucagggg

SEQ ID NO: 231576 - RNA, 64 nt, Human
uuggaaauguuuuaugcuacaaauuagugccuuguagcaugaacuuaagucaaaacguguuauc

SEQ ID NO: 231577 - RNA, 64 nt, Human
auuuugaucaugacaaagaagauuaaaauuucauuagcaugaaugcaauuuguuaaagcagacu

SEQ ID NO: 231578 - RNA, 64 nt, Human
cccccacacaguuggagaauaauuuguagaccauggcaguuaaaaugcuuuuuacucuggugua

SEQ ID NO: 231579 - RNA, 64 nt, Human
caaagaagcaaggacaguaguuacaaguuauacuggcaguuauugaagauacuuaagauccaag

SEQ ID NO: 231580 - RNA, 64 nt, Human
ugaagcugcugaaguaguguuuaggauccuccauggcaguuagugaauguaagaaguacagugu

SEQ ID NO: 231581 - RNA, 64 nt, Human
uacuacauuaaaggagcauucagcuucuuaagaguagcaugacauuuuuaucucaauagaauag

SEQ ID NO: 231582 - RNA, 64 nt, Human
cuuuucucuucacuguuuuggaaaggauagccauuagcaugacugcuuuguguccuuauggacu

SEQ ID NO: 231583 - RNA, 64 nt, Human
cuguuucuaccaaacauuuccagaaacguauuuauagcaugaagaaacacacauggguagugug

SEQ ID NO: 231584 - RNA, 64 nt, Human
gcaugaugugccgacagcgcucagugggcagaauggcaguuagauaugggacuuggcccacagu

SEQ ID NO: 231585 - RNA, 64 nt, Human
uaccuuggaucugcuaguaaauaacuaauaggcaggcaguuauuuggguaaggaaaaaaggggu

SEQ ID NO: 231586 - RNA, 64 nt, Human
gguacuagcugcuguagcagugcccuucauccagggcaguuaauggagucuuggacccuuucuu

SEQ ID NO: 231587 - RNA, 64 nt, Human
caauuaaggggaaaagcuucccuuuucccucuguggcaguuacgauuuugacuucaguccugag

SEQ ID NO: 231588 - RNA, 64 nt, Human
ucaugcauaguaaaugagaaagcuuuaaguagagggcaguuaaacagugacauguugagcaccu

SEQ ID NO: 231589 - RNA, 64 nt, Human
uucuaaagaucucaccugacaacacuguugcauuggcaguuaaguuuccacguaaacuuucggg

SEQ ID NO: 231590 - RNA, 64 nt, Human
ucuagaaaagcuguuuuucugcuccuuuguggaaggcaguuaugaucaggcugcauggacaaag

SEQ ID NO: 231591 - RNA, 64 nt, Human
uguccccaggucuuguguggguggcacagaucugggcaguuagauagugcucugugccuaaggu

SEQ ID NO: 231592 - RNA, 64 nt, Human
cagguucuauuacccagaacuuuuuuguaaaugcggcaguuacaaauuaacuguggaaguuuuc

SEQ ID NO: 231593 - RNA, 64 nt, Human
uucuuuucugaggauaguaguuaaauaacuguguggcaguuaauuggauguucacugccaguug

SEQ ID NO: 231594 - RNA, 64 nt, Human
uuaaaaacaaccacaggucaugagcaguaggcuuggcaguuauaccccaugcagucauaggaga

SEQ ID NO: 231595 - RNA, 64 nt, Human
uuuuuagaggugauccaggaaucuuuaguuugaaggcaguuaccuuuuuuuuuuuuuuuuuuuu

SEQ ID NO: 231596 - RNA, 64 nt, Human
agcucugacacauugaacugcaguuggggggauuggcaguuagcccucugugcuucucccugca

SEQ ID NO: 231597 - RNA, 64 nt, Human
ugaccuuuuuuguuccuguuccugaagugcuggaggcaguuauggaaggagcugcuuagggaag

SEQ ID NO: 231598 - RNA, 64 nt, Human
uaggggggaucccaacacuccucccuguggaggaggcaguuagggaaacuaggauccagccaag

SEQ ID NO: 231599 - RNA, 64 nt, Human
gcggagguaaaacaaaagaaauauugaaaacugaggcaguuaaccaaaguagcucauauaaaua

SEQ ID NO: 231600 - RNA, 64 nt, Human
uuaauauuucaauauucaaguuacaaauguauaaggcaguuagaaauaauacagucacauguca

SEQ ID NO: 231601 - RNA, 64 nt, Human
guaacuacugacauucaaguggagaggguuaguuggcaguuaguucuauggucaucucuuuugc

SEQ ID NO: 231602 - RNA, 64 nt, Human
cagcagcugaucucugaggaggaggcacugcacaggcaguuauuucugcagauccagcucgugg

SEQ ID NO: 231603 - RNA, 64 nt, Human
gcagacuuauacaugucuaggauccuuuuaucaaggcaguuaugaucaucguuuuccugccuug

SEQ ID NO: 231604 - RNA, 64 nt, Human
ccggacuuuucuaauuuauuaaaaacauggccuuggcaguuauuuuuccaucaccgagagagag

SEQ ID NO: 231605 - RNA, 64 nt, Human
uaaaacuaaugucccuccccucucccugccaaaaggcaguuacauaucaauacagagacucaag

SEQ ID NO: 231606 - RNA, 64 nt, Human
uguuaagcuaggaaaccuaacaggaugucagcagggcaguuaacucuggacucagagcccucaa

SEQ ID NO: 231607 - RNA, 64 nt, Human
acaaaugaccuguucaucuguggccauuccaucaggcaguuaguuccuugaugucaguaguggg

SEQ ID NO: 231608 - RNA, 64 nt, Human
acaguggggggacgggcgcaguauguggcauggcggcaguuacauauuauuauuuuaaaaguau

SEQ ID NO: 231609 - RNA, 64 nt, Human
aucaguuguuacaaggaaaggauguugaacaaaaggcaguuauuugaggacuggcuauacacug

SEQ ID NO: 231610 - RNA, 64 nt, Human
guaccuuugcucuugcagagaagccuugguacuaggcaguuagagaugccucccugacccugca

SEQ ID NO: 231611 - RNA, 64 nt, Human
accugucuuaagauuaaauaaaaaagaguguccuggcaguuaucuugagguggggaaggaggug

SEQ ID NO: 231612 - RNA, 64 nt, Human
ccauugugacagcgauggcaggccugacccacggggcaguuagagcagccucguggagcucgcc

SEQ ID NO: 231613 - RNA, 64 nt, Human
acaguucaccaaauagcuagucauggagaaugcaggcaguuaacuuaauaucccuccaggaaug

SEQ ID NO: 231614 - RNA, 64 nt, Human
gcuuuugcuauuuuuuuuaagugggagaagggugggcaguuaucacuggggaagagaggaccgg

SEQ ID NO: 231615 - RNA, 64 nt, Human
guuagccauuguauggcuaggaaccaaugcacuuggcaguuaauggaucugcuguugcuggagu

SEQ ID NO: 231616 - RNA, 64 nt, Human
uguuuccuuaagguuuuugaaugacuguauauuuggcaguuaagcagugccacacuacagggua

SEQ ID NO: 231617 - RNA, 64 nt, Human
uuuuacuggggcccauuguaugagggugaaguuuggcaguuacccaagagacuuuuccuccacc

SEQ ID NO: 231618 - RNA, 64 nt, Human
ggcucuccaagugauucuguucuucuccauuuuuggcaguuaauuugcagaaguaacugacagc

SEQ ID NO: 231619 - RNA, 64 nt, Human
aggaguugccugacuccugggugggugggguacaggcaguuaggugcugaaugaagcugccauc

SEQ ID NO: 231620 - RNA, 64 nt, Human
guuugcacauuauuauggaacacuuuccuacuuaggcaguuacucuuccauguuuauacuuggc

SEQ ID NO: 231621 - RNA, 64 nt, Human
cuggggauuuaaagagaacccuugugcuacgccaggcaguuaccgagccgaagggagaugaugg

SEQ ID NO: 231622 - RNA, 64 nt, Human
uccuuggagacucugaaaauggcacacaaagaauggcaguuaugaacgugacuucuagauuuug

SEQ ID NO: 231623 - RNA, 64 nt, Human
uuuaagccagcccccaccuagggucuauuuguguggcaguuauuggguuuggucacaaaacauc

SEQ ID NO: 231624 - RNA, 64 nt, Human
cuacagggugaggugcuugcccccauguggguguggcaguuacagggcccaggugagcugaaga

SEQ ID NO: 231625 - RNA, 64 nt, Human
aauugacacgugccaccgccuggcguucgcuuguggcaguuacuaacuuucuacaguuuucuua

SEQ ID NO: 231626 - RNA, 64 nt, Human
aagguacuuuggaaccacuaacaccucugcacagggcaguuagccagcucaaguucuuuuucag

SEQ ID NO: 231627 - RNA, 64 nt, Human
acauccuuggaaucuuuguccacacagcagucaaggcaguuauggccaaucagcugaggguguc

SEQ ID NO: 231628 - RNA, 64 nt, Human
cuauuuuaggaagucaacccccauugcacucuguggcaguuauucugguaaaaauaggcaaaag

SEQ ID NO: 231629 - RNA, 64 nt, Human
caguuuuucuguuguauuucauuuccaguuuucaggcaguuauuuuuauuauuguacuuuaagc

SEQ ID NO: 231630 - RNA, 64 nt, Human
acucagcuuuaguuuuucuaauccaagaaggcagggcaguuaaccuuuuuggugccaaugugaa

SEQ ID NO: 231631 - RNA, 64 nt, Human
gguuuugccaagcaagaacucuugauuacuaagaggcaguuagagacaaaccaauuuaauucca

SEQ ID NO: 231632 - RNA, 64 nt, Human
gggcaaagguacucaggaccucauaggagucuuaggcaguuaccugaaacugccuucauucacu

SEQ ID NO: 231633 - RNA, 64 nt, Human
aaauacuuaaaaauaauagugucaaaaauucaggggcaguuaaggagucauggauggaacuaga

SEQ ID NO: 231634 - RNA, 64 nt, Human
aguucaaaguucugaaguauuuucucacacaaagggcaguuaaacagccaaguuuaugacacua

SEQ ID NO: 231635 - RNA, 64 nt, Human
auuuucuaauguaguuagaaguuucauugucugauggacacaauaugcccuuccgguucuauuc

SEQ ID NO: 231636 - RNA, 64 nt, Human
gauggggagcaggauugggaccugcucugacagcuggacacaugagcccuggaugaguauggua

SEQ ID NO: 231637 - RNA, 57 nt, Human
uacagacgcaggcuugcugagggccucuggacacaggcuggaccagaugcuguggau

SEQ ID NO: 231638 - RNA, 64 nt, Human
uugaaaaaaauguauucacauacaaaucuucacauggacacauguuuucauuucccuuggauaa

SEQ ID NO: 231639 - RNA, 59 nt, Human
cacaguccucacugcacuaaaaauuaaauuggacacagcugcaguaacuuuucacccca

SEQ ID NO: 231640 - RNA, 53 nt, Human
ccauacagcgccacaaaugacucuggacacagacagauccuggggaguuacuu

SEQ ID NO: 231641 - RNA, 64 nt, Human
uggccccuucucccauggggacaucucggcccagcaccccuaucccauuuccagaguucuuccu

SEQ ID NO: 231642 - RNA, 64 nt, Human
gucucaccauggcuccccuuccuugucuggggccuggacacacugaggacaaugcggcuauagc

SEQ ID NO: 231643 - RNA, 64 nt, Human
gcggaaucagcagacauugaugccagcucagcuauggacacaucugagccagccaaggugagac

SEQ ID NO: 231644 - RNA, 64 nt, Human
cccugaguagaggaugcugcuaugcgugaguucauggacacaaguugauuacaugguuuuuaga

SEQ ID NO: 231645 - RNA, 64 nt, Human
agaacagcucauugugccccagugaugaaguugcuggacacaucucuuugcagguagcagcaac

SEQ ID NO: 231646 - RNA, 64 nt, Human
uagcaaaggauaaaugccgaaggucacuucauucuggacacaguuggaucaauacugauuaagu

SEQ ID NO: 231647 - RNA, 64 nt, Human
ucuuuuucccuucugccuucaccuuugccguggguggacacagcaagaaggcccucaucagaug

SEQ ID NO: 231648 - RNA, 64 nt, Human
aaaaaaaaguaggucaauucguaacaguuuauuuuggacacacccugaagcuuuuguuuugaau

SEQ ID NO: 231649 - RNA, 64 nt, Human
agcucugcaggcccuccuggccuuuucugcaggguggacacagggucugugugugggcagcagc

SEQ ID NO: 231650 - RNA, 64 nt, Human
cagauauucacagucacacauagaaacacccacauggacacaaggaauguugcugcagagacug

SEQ ID NO: 231651 - RNA, 64 nt, Human
gggcaccgcgcaccagagcgugaccucggcaggcuggacacacugcccagcacaggcagaccca

SEQ ID NO: 231652 - RNA, 64 nt, Human
cggcacuaccgcugagccggcgcccgggugggccuggacacagaugaccucuacgggagucuga

SEQ ID NO: 231653 - RNA, 64 nt, Human
ucgcuucuguggccuuggcauugagggcacaggcuggacacaggaaugggggcgccuccagagg

SEQ ID NO: 231654 - RNA, 64 nt, Human
gacccgcccucuuuaggcugagcuauaagagggguggacacagggugggcugaggucagagguu

SEQ ID NO: 231655 - RNA, 64 nt, Human
acucagccacaccccacauuggacuuccuugguuuggacacaguguuccagcugccugggaggc

SEQ ID NO: 231656 - RNA, 64 nt, Human
cccucacauaugcacugagugaaggaugaauguauggacacaucugggaguauuuuaaagaaug

SEQ ID NO: 231657 - RNA, 64 nt, Human
acccaugaaggcguguuugauuacuccaggcuucuggacacacauacccaugggugauuuuugc

SEQ ID NO: 231658 - RNA, 64 nt, Human
cccacagccuuggcugugccugccccugcccucucaccccuacccugaccuuguccuacuucac

SEQ ID NO: 231659 - RNA, 64 nt, Human
auccaagugaccagaugcccuacucagcuuccaucaccccuagcaauauguauuaaagucugaa

SEQ ID NO: 231660 - RNA, 64 nt, Human
aucuuuaucccuagggggaaaucaaggagcugggcaccccuaauucuuuauggaaguguuuaaa

SEQ ID NO: 231661 - RNA, 64 nt, Human
aaucugauacugccucacgucaauggugagcugauggacacaagaucaaauaaggcuaugcuua

SEQ ID NO: 231662 - RNA, 64 nt, Human
ccagcuacugacaugcaagcagcuuggggcuggcuggacacagguacuaggcccauuguuucca

SEQ ID NO: 231663 - RNA, 64 nt, Human
ucaauccgucugggugccagaacucaagguucaguggacacaucccccuguuagagacccucau

SEQ ID NO: 231664 - RNA, 64 nt, Human
uauagcuucagaagcauuuuuacuugcaagacgauggacacauuccccuugggcuuuuuguaac

SEQ ID NO: 231665 - RNA, 64 nt, Human
cgcacaaugcaugugcugucuccaugcuggauacuggacacacuaaacucuggggcuuguccug

SEQ ID NO: 231666 - RNA, 64 nt, Human
cagacuuccacggcacccgggggagugguggguguggacacauugguucggcaaucugauucuc

SEQ ID NO: 231667 - RNA, 64 nt, Human
uugacaaaaucuaacuauauuuggugcaucacaauggacacagaaugcugcugcuccucuuaaa

SEQ ID NO: 231668 - RNA, 64 nt, Human
aucccccacacgcucugaaggacccacuuucagcuggacacaggcgcggccucauguaaacauu

SEQ ID NO: 231669 - RNA, 64 nt, Human
ccauugugggcugcaguaauauaaggaccuguucuggacacagcacugggcccgcugggguuuu

SEQ ID NO: 231670 - RNA, 64 nt, Human
uaauaauaggauuuauauuaguacucauuaccauuggacacaaugacauaaguacucuccacag

SEQ ID NO: 231671 - RNA, 64 nt, Human
guuagcauuggaugccuuugccaaaugguucauguggacacacaaaggcaaacagaucugccau

SEQ ID NO: 231672 - RNA, 64 nt, Human
acccagugagggugccuucugcugcccaguccccuggacacauugaagagaggagcaaguagcc

SEQ ID NO: 231673 - RNA, 64 nt, Human
gauuaaguagguaugauacugcauuugaaauaaguggacacaaacuauccuuucuccaccaugg

SEQ ID NO: 231674 - RNA, 64 nt, Human
ggggaugccggggcaggaggacgagggugcgcuguggacacagcaguccgcggaauuccguucu

SEQ ID NO: 231675 - RNA, 64 nt, Human
aacaaguagcauucuucaucauucaaguucuaccuggacacaaaggcgaggacccugggguucc

SEQ ID NO: 231676 - RNA, 64 nt, Human
aauuugaagauuauagaagaagggaaauagcaaauggacacaaauuacaaaugugugugcgugg

SEQ ID NO: 231677 - RNA, 64 nt, Human
aacuccaggggggacaauaugugccaaucaauagcaccccuacucacauacacacacaccuagc

SEQ ID NO: 231678 - RNA, 64 nt, Human
augcuggugagggguccguacagggugggguccccaccccuagccccuuacugaggggggagug

SEQ ID NO: 231679 - RNA, 64 nt, Human
aagugaaggacccccuccccaacaugccccagcccaccccuaagcauggucccuugucaccagg

SEQ ID NO: 231680 - RNA, 64 nt, Human
ugaugucccacccuguucacccagccgccagucauggacacagggcacugcccuugccaacuuu

SEQ ID NO: 231681 - RNA, 64 nt, Human
acaagcagugguaggauugcagccgugggccugcuggacacacacauacaccaaagauguauuu

SEQ ID NO: 231682 - RNA, 64 nt, Human
agagaaaauucagugacguacauggcucugguucuggacacaaaaucuguacuggagaggaaau

SEQ ID NO: 231683 - RNA, 64 nt, Human
gcccaugggccccuguggacccucccuccccaaguggacacauggcugugcaggccaggaggcc

SEQ ID NO: 231684 - RNA, 64 nt, Human
cucuccugucugccgacuauggagucuccaccuuuggacacaacacuuacucaccauuuacucu

SEQ ID NO: 231685 - RNA, 64 nt, Human
auaguuucuggaaauuucacucucgaucuuucuguggacacaaucuauuuugucauugugucua

SEQ ID NO: 231686 - RNA, 64 nt, Human
gcagaggauucuuuucucaaaaugcucuggcauuuggacacacaucacaugucgauauuugcau

SEQ ID NO: 231687 - RNA, 64 nt, Human
gggaaggaggaaugacgcucaaccugcccagguuuggacacaacuacaaagaacagcaggacac

SEQ ID NO: 231688 - RNA, 64 nt, Human
uagugauuaaauguuuuaguauuuugaacugaaauggacacacaaacacacacacgcacacaca

SEQ ID NO: 231689 - RNA, 64 nt, Human
ggacaaagcagcacguaucaccucauucaucacuuggacacaucgccuuugcauugucuuguca

SEQ ID NO: 231690 - RNA, 64 nt, Human
agacauccugacaguguugggcaucugcuccccguggacacagccccacucuccacuuucugag

SEQ ID NO: 231691 - RNA, 64 nt, Human
uucuaauaaacagggaucuccagaacacuggugguggacacagcuuuccugucagcacacaaaa

SEQ ID NO: 231692 - RNA, 64 nt, Human
cagccaacccugaucuggaagacagggccccggcuggacacacguggaaccaagccagggaugg

SEQ ID NO: 231693 - RNA, 64 nt, Human
accacgagacccucaaccagcccaacaucuuccauggacacaugacauugaagaccaucccaag

SEQ ID NO: 231694 - RNA, 64 nt, Human
cagauugguucaugccugggguggaggcuaagccuggacacagucagggcggggcuggccagcu

SEQ ID NO: 231695 - RNA, 64 nt, Human
gcuuccaugcaaaggaauucuucaaguuuaaaucuggacacaaaaauaagauaaauguauggca

SEQ ID NO: 231696 - RNA, 64 nt, Human
ccaaagccauuuaccucaaaggacccagcagcuacaccccuacaggcuuccaggcaccucauca

SEQ ID NO: 231697 - RNA, 64 nt, Human
aaauugcugccugggugaaugcugcuuguucucucaccccuaacccuaguaguuccuccacuaa

SEQ ID NO: 231698 - RNA, 64 nt, Human
gcccggcccacaauuaauuuuagaacauuuucaucaccccuaaaagaaacccugcacccauuag

SEQ ID NO: 231699 - RNA, 64 nt, Human
uucuuuaaaucaugcuaaggaauuucguuuuauguggacacacucaacuuugauauucaggaga

SEQ ID NO: 231700 - RNA, 64 nt, Human
gcucaugauaguuuugccuucauucuacuuucuguggacacagaguaaugaauauuuaauggga

SEQ ID NO: 231701 - RNA, 64 nt, Human
gaaagaagagaaaagggagucaugcauuuugcuuuggacacaguguuuuaucaccuguucauuu

SEQ ID NO: 231702 - RNA, 64 nt, Human
uuuuaaaaccuauucaggauuauuagccuggacuuggacacagaguuuguaaauaaaggugucu

SEQ ID NO: 231703 - RNA, 64 nt, Human
ucaauucaaauucuuuuuuuuacaauguguuuauuggacacacaaaaaaacuuugcaaccauca

SEQ ID NO: 231704 - RNA, 64 nt, Human
cagcuggucacuccccagagaagcugggccuucauggacacauggaacuaagccucccaaaugg

SEQ ID NO: 231705 - RNA, 64 nt, Human
cuuggacacuggccaaggagaccccuucgugcuguggacacagcucucuucacucuuugcucau

SEQ ID NO: 231706 - RNA, 64 nt, Human
ccagcaaagccagagagcuuuguccccggccuccuggacacauaggccauuauccuguauuccu

SEQ ID NO: 231707 - RNA, 64 nt, Human
agaugaaagaucuucauggcuguuuccacugaaauggacacauaugcucauguugcuuuuuuug

SEQ ID NO: 231708 - RNA, 64 nt, Human
aaucgcauagcuguagaaugugcgugcuuuuuuguggacacaggagcuccuccaggagcaggcu

SEQ ID NO: 231709 - RNA, 64 nt, Human
guauaaaaaauucaaggacaaacugugcauuuaauggacacaagaauugacucuaacuccaugu

SEQ ID NO: 231710 - RNA, 64 nt, Human
uuuaggaaauguucaaauaaccaauauguggaaauggacacagggaucuucugaaguugcuuug

SEQ ID NO: 231711 - RNA, 64 nt, Human
uuuuguaaauuacagucucacucagaacuguuuuuggacacauuuaagguguaguauuaauagg

SEQ ID NO: 231712 - RNA, 64 nt, Human
cugaaaauaauuguaguaguagugauauagucaauggacacagugaaauagagcaaacaccuuu

SEQ ID NO: 231713 - RNA, 64 nt, Human
cugguuugggguggucagugcccucugugcuuuauggacacaaaaccagagcacuugaugaacu

SEQ ID NO: 231714 - RNA, 64 nt, Human
guuuuuuuuuauguuuaagaggggcaguuauaaauggacacauugcccagaauguuuuguaaaa

SEQ ID NO: 231715 - RNA, 53 nt, Human
cccuauaccuagcacugugacaccaccccuaaaucacuuugagccugggaaau

SEQ ID NO: 231716 - RNA, 64 nt, Human
gacuccaucucgaagaaaaaaaaaaaaaauuccccaccccuaccaauuguuuuacuuccucuuc

SEQ ID NO: 231717 - RNA, 64 nt, Human
auuuagauagaauaguccuccuugggucucccaccaccccuagcuuuguguguaguguagugau

SEQ ID NO: 231718 - RNA, 64 nt, Human
ugagggcugguggggccggggaccuggagccccauggacacacagauggcccggcuagccgccu

SEQ ID NO: 231719 - RNA, 64 nt, Human
uggagugggcaggcaggccagggcugcgcaucaguggacacauugcugccaggaagagcugcga

SEQ ID NO: 231720 - RNA, 64 nt, Human
auauauuuaugcaucuauauacauauacuagaucuggacacacgcauacuaaguguauauagua

SEQ ID NO: 231721 - RNA, 64 nt, Human
ggggccggacgccuauacaccugucugcugccuguggacacauugguguucuuggagcccuuuu

SEQ ID NO: 231722 - RNA, 64 nt, Human
ugcuccuuaaucccuggagaggaacagagccaacuggacacagcguuggucucuguuuggaauc

SEQ ID NO: 231723 - RNA, 64 nt, Human
uguguauuuuggaguuuuggugacuuuugucaccuggacacacucauuuguuagccauaguggg

SEQ ID NO: 231724 - RNA, 64 nt, Human
cuauugaugggaaugugugcgggcucagccuuccuggacacacuaggugugggaagccauagga

SEQ ID NO: 231725 - RNA, 64 nt, Human
ucaucugcuggaagugaggcugguagugacuggauggacacauugcuguggguagucccuccua

SEQ ID NO: 231726 - RNA, 64 nt, Human
uggaggcauuucauacacacguuucuuaggaaaauggacacauugaaaauguccucuuuuuuau

SEQ ID NO: 231727 - RNA, 64 nt, Human
uuauucaugccauuuggggucacagaugccuagcuggacacagcucccagaacuggcuccaccc

SEQ ID NO: 231728 - RNA, 64 nt, Human
cuaaacaggaacaacuucaucacaguguugauguuggacacauagauggugauggcaaagguuu

SEQ ID NO: 231729 - RNA, 64 nt, Human
acucgccuaguacaagacauggagaagaaaccuuuggacacagagcagaugacaccuccuucug

SEQ ID NO: 231730 - RNA, 64 nt, Human
cucuucuggaaggagucgcugggagcagugcgguuggacacaaguuugcguaggaguguuuucc

SEQ ID NO: 231731 - RNA, 64 nt, Human
ucuuaaucagguauugcaguguucaaacaagguauggacacaucaacauauucaccuuuuggaa

SEQ ID NO: 231732 - RNA, 64 nt, Human
ugaguuguacauuuuugaagugugcagggcagccuggacacaagcuuagauucucuauguauag

SEQ ID NO: 231733 - RNA, 64 nt, Human
uuagagauacaagaguucuacuuagaacuuuucauggacacaauuuccacaaccuuucagaugc

SEQ ID NO: 231734 - RNA, 64 nt, Human
cccuuggcuaugguccugccaggugcaggcccaggcccaugaccccaccuuuacuaagcacaag

SEQ ID NO: 231735 - RNA, 64 nt, Human
gcagacacaggcucugauucucuuacccagagaugcccaugagcugacauuuuacucaucccuc

SEQ ID NO: 231736 - RNA, 64 nt, Human
agaagugagggaaggauguuuagcaguggcuggugcccaugaagaggagauuggccagugagaa

SEQ ID NO: 231737 - RNA, 64 nt, Human
agauucaccauuagagguugauggggcaacugcagcccaugacacaagaucucauuguucucga

SEQ ID NO: 231738 - RNA, 64 nt, Human
cacucauaggugggaauugaacaaugagaacacuuggacacagggcggggaacgucacacgccu

SEQ ID NO: 231739 - RNA, 64 nt, Human
cacacauguacauauguguacacagguagacagauggacacaggccguuucucauccaguuuag

SEQ ID NO: 231740 - RNA, 64 nt, Human
caccccaggcagucugugugugaggcauagccccuggacacacacacacagacacacacacugc

SEQ ID NO: 231741 - RNA, 64 nt, Human
auacacacgcacacccaugcgcagaugugcugccuggacacacacacacacacggauaugcugu

SEQ ID NO: 231742 - RNA, 64 nt, Human
guauccggacacacacgugcacagauaugcugccuggacacacagauaaugcugccuugacaca

SEQ ID NO: 231743 - RNA, 64 nt, Human
ugcugccuugacacacacaugcacggauauugccuggacacacacacacacacgugugcacaga

SEQ ID NO: 231744 - RNA, 64 nt, Human
gucuggacacgcacacacaugcagauaugcugccuggacacacacuuccagacacacgugcaca

SEQ ID NO: 231745 - RNA, 64 nt, Human
ccagacacacgugcacaggcgcagauaugcugccuggacacacgcagauaugcugucuagucac

SEQ ID NO: 231746 - RNA, 64 nt, Human
guccggacacacacacgcacgcagauaugcugccuggacacacacacagauaaugcugccucaa

SEQ ID NO: 231747 - RNA, 64 nt, Human
cugccucaacacucacacacgugcagauauugccuggacacacacaugugcacagauaugcugu

SEQ ID NO: 231748 - RNA, 64 nt, Human
acacacaugcacacacaggugcagauaugcugccuggacacacgcagacugacgugcuuuuggg

SEQ ID NO: 231749 - RNA, 64 nt, Human
uauuugaaguacuuguugcugaaaaucaugaacauggacacaaauucuaccucugucaacuuuu

SEQ ID NO: 231750 - RNA, 64 nt, Human
ccagauuugguggugguuuuguuucuaugcaaacuggacacaaauuacaacaguaaauuuuuuu

SEQ ID NO: 231751 - RNA, 64 nt, Human
uauaggugucuucagaguucugaagaaaaauuacuggacacagcuucagcuauacuuacacugu

SEQ ID NO: 231752 - RNA, 64 nt, Human
uugaauuuacuacuguaagacuaagcaguguuacuggacacaguuuuaacuuguucaaucugcu

SEQ ID NO: 231753 - RNA, 64 nt, Human
aauaggguacagagauagggaucuaaggaugacuuggacacacucccuggcacugaagagucug

SEQ ID NO: 231754 - RNA, 64 nt, Human
aaagccaaaguuucuguugaauuauguuuugacacaccccuaaguacaaggugguaugguugua

SEQ ID NO: 231755 - RNA, 64 nt, Human
gggcuaauucuacaccccugugccccuccuaggggcccaugagucagagaggcuugccccaagu

SEQ ID NO: 231756 - RNA, 57 nt, Human
acaaagccauaaauguaugauauuagugcccaugaugcagcagcuaauuucaaaccu

SEQ ID NO: 231757 - RNA, 64 nt, Human
ucuaccacagaauaacacccugggcugugacaaggcccaugaugacauuucaugaggcccagau

SEQ ID NO: 231758 - RNA, 64 nt, Human
agacacacaacucugcuauaaacagcagaaacucuggacacaaacuuuuauguaagucaccuga

SEQ ID NO: 231759 - RNA, 64 nt, Human
cacugaugaggacagcugcagagguggcaguguguggacacaggaaguuugggcccccucccug

SEQ ID NO: 231760 - RNA, 64 nt, Human
uucacucaaggcauugacagcuuagcugugaggguggacacacauauguguauuuacagugcag

SEQ ID NO: 231761 - RNA, 64 nt, Human
uuaguucaaguccugccucuuaaauaaaccuuuuuggacacacaaauuaucuuaaaacuccugu

SEQ ID NO: 231762 - RNA, 64 nt, Human
uuuugauccguuuguauaaaugauagcaauaucuuggacacaucugaaauacaaaauguuuuug

SEQ ID NO: 231763 - RNA, 64 nt, Human
gaaaauuuucugggagcuaaaugaugagaacacauggacacaugauggggaacaacacacacug

SEQ ID NO: 231764 - RNA, 64 nt, Human
cacuuauaagugggagcuaaauaauguauacacauggacacaccagaguguagaauaauagaca

SEQ ID NO: 231765 - RNA, 64 nt, Human
auugcauuccaagugagcugugcucagcagugcuuggacacagagcugcaagcugcgcuggggu

SEQ ID NO: 231766 - RNA, 64 nt, Human
ucucaccaagaugugacauggauuauuuuucccuuggacacaaaugucuacagcaacugguguu

SEQ ID NO: 231767 - RNA, 64 nt, Human
uucaauauuuuaugugcuuauauuggccaaaauauggacacaaauauagacuaauauggguaau

SEQ ID NO: 231768 - RNA, 64 nt, Human
cuucugaaguaugaaaaucuagucuuuuuaggacuggacacaaggaaaauaaucucuaaacuau

SEQ ID NO: 231769 - RNA, 64 nt, Human
ggccauuggcacuguuugcuuuuuuacaaucauguggacacaagcauaaguaaagaaaauuugu

SEQ ID NO: 231770 - RNA, 64 nt, Human
caggccuccccagucccagugugcgagccccacuuggacacaaguguucagagaggucccccuc

SEQ ID NO: 231771 - RNA, 64 nt, Human
ggcgccuggcacauguguggggaagccggucacauggacacaccugugcacacaugccuacagg

SEQ ID NO: 231772 - RNA, 64 nt, Human
uaaaccgaagucaauuucagggcucuuggcguguuggacacagaagaaauccuagugcagccuu

SEQ ID NO: 231773 - RNA, 64 nt, Human
gacgccaccuuccugcugaggugggacugggcccuggacacaccccucagccccucuguccuca

SEQ ID NO: 231774 - RNA, 64 nt, Human
uuauaguugaagaaccuaagacacagagaccaaggcccaugagcucauagggcugaggcaggau

SEQ ID NO: 231775 - RNA, 64 nt, Human
aaaggagaaaaacaaacagaccaaaugcccaggagcccaugaaguaauagcguaaaguaaagua

SEQ ID NO: 231776 - RNA, 64 nt, Human
gacuaagacccaguggugcucuuugagaguuuacgcccaugagugcagaagacugaacagacau

SEQ ID NO: 231777 - RNA, 64 nt, Human
cuagugccccaaccagucuucaggaggaagagaugcccaugaagcagguccagaacuaaguggg

SEQ ID NO: 231778 - RNA, 64 nt, Human
aaggaaaguaugacagauuucuacuuaacuagaauggacacaugauccacaauuuucucuucaa

SEQ ID NO: 231779 - RNA, 64 nt, Human
aauggagcauguacuuauuugcauuugcuggcaguucaggcauaguuaaagugagaguucuccu

SEQ ID NO: 231780 - RNA, 64 nt, Human
ccucauauugaguggucuguaaacggcugcacacuucaggcacuguaguugcugaagaugcuuu

SEQ ID NO: 231781 - RNA, 64 nt, Human
gagccguuuuuacccagcuggguacggugccacguucaggcacgugcacccggcaagguucagg

SEQ ID NO: 231782 - RNA, 64 nt, Human
caauauauuuucucccagauuuucaguaaagacuuucaggcagugauuuaacgaggauuuuauu

SEQ ID NO: 231783 - RNA, 64 nt, Human
aaagugauugucauuauccugcuuauguacuagauucaggcaagcauuauagacuuuuugguug

SEQ ID NO: 231784 - RNA, 64 nt, Human
gauuaauccugcucuuuuaagaaaaggcaacuuauucaggcagucuggaaaggggguucucaga

SEQ ID NO: 231785 - RNA, 64 nt, Human
ccccaccccucugucccuagauugugugacucccuucaggcaguccuuuaguccccagccucac

SEQ ID NO: 231786 - RNA, 64 nt, Human
cagacauucuuuaucaagaggucggcccuucuuuuucaggcacauaagccaaaugcaggccugu

SEQ ID NO: 231787 - RNA, 64 nt, Human
acauaccuuaauaguuuuauaaaauuguugacauuucaggcaaauuuggccaauauuaucauug

SEQ ID NO: 231788 - RNA, 64 nt, Human
gagaaaacuaucuugacaggauaguggaaaaaccuucaggcagcuuuuaugucaaaaaagugag

SEQ ID NO: 231789 - RNA, 64 nt, Human
ucuucaacacggcauuuagcgcagaaagucgugguucaggcaguaugggccgcugugacaaaac

SEQ ID NO: 231790 - RNA, 64 nt, Human
cucuaaagcugcuuugccuucauguucaaacagauucaggcaccacccccuccaccgcccgcaa

SEQ ID NO: 231791 - RNA, 64 nt, Human
caucugugcuuagucucugacauaggaagcuugcuucaggcaauggcuuuggauugaguuugag

SEQ ID NO: 231792 - RNA, 64 nt, Human
acuccuaagaaacgaaagauuccuucaaagccuuuucaggcacaugguuucaacaaagccuggc

SEQ ID NO: 231793 - RNA, 64 nt, Human
ggccuccugccuuugccucucaaagugcugggauuucaggcaugggucaucaagcccagcugac

SEQ ID NO: 231794 - RNA, 64 nt, Human
ccauggugugucagugucuguguguugauggguggcccaugagugacccccgccaggggagacc

SEQ ID NO: 231795 - RNA, 64 nt, Human
cacggggcuucuaaguuagguugccaguguugcugcccaugaugaguuauuugccucugaguuu

SEQ ID NO: 231796 - RNA, 64 nt, Human
aggcagccugccugguuuaugggagaacucugaagcccaugauguuuuccuggaaggcuguucc

SEQ ID NO: 231797 - RNA, 64 nt, Human
ucucacuuguaagugggagcuaaaugagaacacguggacacauagagggaaacaacacacacug

SEQ ID NO: 231798 - RNA, 64 nt, Human
caaaggcccuggugguuuccacauugcuacccaauggacacacuccaaaauggccagugggcag

SEQ ID NO: 231799 - RNA, 64 nt, Human
aguccguuuuacugugaauauagcaauauaguacuggacacaguacuggugaaacugaggagag

SEQ ID NO: 231800 - RNA, 64 nt, Human
uuauugacaucacaguaaaaaggcuacugucgacuggacacaguggcucacacauguaaucaca

SEQ ID NO: 231801 - RNA, 64 nt, Human
aguuuagaugccuacuuuuaugaguaccaucagcuggacacagugucucauaccuguauuugca

SEQ ID NO: 231802 - RNA, 64 nt, Human
aaaagcaguuagacuacaaucugugcagacagcauggacacaaagaugaccacaaggggcccaa

SEQ ID NO: 231803 - RNA, 64 nt, Human
gggggagaaaagauuuagauuguuuauucuucuguggacacaguuuaaaaucuuaaacuugucu

SEQ ID NO: 231804 - RNA, 64 nt, Human
uauuauaggaaacucugacacagaacgcccaacguggacacaggugccaguucagcagugaccg

SEQ ID NO: 231805 - RNA, 64 nt, Human
ccagggugugacucgggagcugcacacaccuggguggacacaaggcacggccacgucaugucuc

SEQ ID NO: 231806 - RNA, 64 nt, Human
aaaacgcaggagggagacagacuggccaggcugguggacacagauacuguucuggacugugccu

SEQ ID NO: 231807 - RNA, 64 nt, Human
ucauauauuaggaugugagaauaucaucuguuuauggacacaugaaaccuccuaaugaccugga

SEQ ID NO: 231808 - RNA, 64 nt, Human
cagggugggaggaaaacuguugaaguauuaagacuggacacauggcugcuaauucaucagcuua

SEQ ID NO: 231809 - RNA, 62 nt, Human
uagaccucaucacacuguaacugaagagucacuggacacagaaauggaaaacaggagucgau

SEQ ID NO: 231810 - RNA, 64 nt, Human
ugugacacaauccuaauagacaguguccuguaaauggacacaacacaauaaagucaaguuauua

SEQ ID NO: 231811 - RNA, 64 nt, Human
agguccuugcauacaccuugucuguguggauaaguggacacaugcccuuaagaggcuugcuuuc

SEQ ID NO: 231812 - RNA, 64 nt, Human
guaacugcuaacuccuaggaaacagccuuuucccuggacacagaugguccauacgcugagccac

SEQ ID NO: 231813 - RNA, 64 nt, Human
ugaaagagucacaccuuagugcuauaacucuccugcccaugauaguguauucuguuucaggcaa

SEQ ID NO: 231814 - RNA, 64 nt, Human
uaguuucuaaagauucugugaauaguggacaacugcccaugagcauuugacuucccuuacucuu

SEQ ID NO: 231815 - RNA, 64 nt, Human
ugcugacucuguugcucugugaauaaacacccuggcccaugagggcagcccaagcucccagggu

SEQ ID NO: 231816 - RNA, 64 nt, Human
agagcauuguccuauaaaucugcaauauuuucacgcccaugaaacugaacacugauacugcaua

SEQ ID NO: 231817 - RNA, 64 nt, Human
guauuuuuagaauggcagcuauaaaguuaacuccuggacacaaguauauacugugcacugaaaa

SEQ ID NO: 231818 - RNA, 64 nt, Human
auuuuaagcugcuauuauuguauuucaguggcaauggacacauuagccuuuuacaagaggacua

SEQ ID NO: 231819 - RNA, 64 nt, Human
cucaauguucuuuuccaacacaucuauauauauauggacacacagucacgcaagcuaguuccca

SEQ ID NO: 231820 - RNA, 64 nt, Human
ucagggagacucugcccugcugcagaccucgguguggacacacgcugcauagagcucuccuuga

SEQ ID NO: 231821 - RNA, 64 nt, Human
aacuauuugacauuuucuaucuuuguguuaacaguggacacagcaaggcuuuccuacauaagua

SEQ ID NO: 231822 - RNA, 64 nt, Human
ggcugggucccggguccuccacaggugaccccgguggacacacgcguucccauccuggccuccg

SEQ ID NO: 231823 - RNA, 64 nt, Human
uguccaugugcacaagucuugggggucugugcacuggacacacaugugccuugccugacagaau

SEQ ID NO: 231824 - RNA, 64 nt, Human
ccaguugaaaauaccagcuuugguuggacaacuguggacacacaaggugaagaggacuccgaag

SEQ ID NO: 231825 - RNA, 64 nt, Human
cacauccccucuggaagagaauguaaaauaaaccuggacacaagggaccuugucucugcggccu

SEQ ID NO: 231826 - RNA, 64 nt, Human
aagcugugcuugagacuuagguacuuuucucacguggacacacugaucccaucccauauugcau

SEQ ID NO: 231827 - RNA, 64 nt, Human
caggcugcagcuggacagaggggacucugggcuauggacacagggugacggugacaaagauggc

SEQ ID NO: 231828 - RNA, 64 nt, Human
uuuugaaauugcauguuuaucauauauccuuaaguggacacauacagugccauguugaugugcc

SEQ ID NO: 231829 - RNA, 64 nt, Human
auugauggaugguuuuuauaguuuguugauaaaguggacacaguauugucugagcaguuauauu

SEQ ID NO: 231830 - RNA, 64 nt, Human
gaauaagcuaugcaagguauuuuguaauauacuguggacacaacuugcuucugccucauccugc

SEQ ID NO: 231831 - RNA, 64 nt, Human
uaaaaagccuaggcagcucuaacaucaucugauauggacacaaggccaacaguuuccuuauuua

SEQ ID NO: 231832 - RNA, 64 nt, Human
uguacugaaugaaauuaaagaaacuuuuuuugcauggacacagauuagcugaauacuuaaauua

SEQ ID NO: 231833 - RNA, 64 nt, Human
gaucacaucugugugaagccaaagccccgugguugcccaugagaaguguccuuguucauuuuca

SEQ ID NO: 231834 - RNA, 64 nt, Human
cccugauguucagagagaaacgcacacaagguuugcccaugagaauuggggagcagauggccaa

SEQ ID NO: 231835 - RNA, 64 nt, Human
gcaauguuguucuaagcuaucuaucuaacucucagcccaugauaaaguuccuuaagcuggugau

SEQ ID NO: 231836 - RNA, 64 nt, Human
uggaggccaggccguggccagagcagauacguaggcccaugaaauugaugaacugagaguugcu

SEQ ID NO: 231837 - RNA, 64 nt, Human
cccucugcuucucaucccaaccucuuuuuccuccuggacacauuggaaugccuuggaaauagaa

SEQ ID NO: 231838 - RNA, 64 nt, Human
ggaaaaugucaggcucuuugcugcugguuugaauuggacacacugcugcggcuccuccugcagg

SEQ ID NO: 231839 - RNA, 64 nt, Human
uauucagucuucuagaguaauuaucugugauggauggacacaaaaaaauggaaagaaaagaaug

SEQ ID NO: 231840 - RNA, 64 nt, Human
uacacuuugaacuacuagaaaauugugcuggaaauggacacagucuaacaaauuccaaauucuc

SEQ ID NO: 231841 - RNA, 64 nt, Human
gugauucugauauauguacuugucacauugguguuggacacauuugcgccaaaaguaugguaau

SEQ ID NO: 231842 - RNA, 64 nt, Human
guucuuuccaugucuuaguuggaugucccugaaauggacacaggcugugccauugugccagaaa

SEQ ID NO: 231843 - RNA, 64 nt, Human
gauaaggauguugaagauaaugacacuaaaucuauggacacacacacacacacacacacacaca

SEQ ID NO: 231844 - RNA, 64 nt, Human
uacaacauaggccagggccaacaaaguggagagguggacacauuuucauguucauuacuaaaac

SEQ ID NO: 231845 - RNA, 64 nt, Human
ggauccacacacauccucaccccacagaaacugcuggacacacugaagaaacugaauaaaacag

SEQ ID NO: 231846 - RNA, 64 nt, Human
cuccaagucucugccccugcucacaccuggaggcuggacacaagugucaccacuucccugaacc

SEQ ID NO: 231847 - RNA, 64 nt, Human
gacuccacgagggcagggccucuccugucgccucuggacacaaguggcgacagccugcuggggg

SEQ ID NO: 231848 - RNA, 64 nt, Human
cagugcugccuucagcggccgugacggggccagcuggacacacggugagauuuucucguaugua

SEQ ID NO: 231849 - RNA, 64 nt, Human
cugugcugagcuggugacucacuguccugacaaguggacacacagaugcacugcugugcugcuu

SEQ ID NO: 231850 - RNA, 64 nt, Human
cauuccucagcugaaagaacaucucaggaagcacuggacacagugauucugcagagccugagcu

SEQ ID NO: 231851 - RNA, 64 nt, Human
gcacuccuccagggugucaguaacaucaggacauuggacacaccauuccggaagaacugcagcu

SEQ ID NO: 231852 - RNA, 64 nt, Human
ugcucuuucaaugugaugugggaaagcaggaggauggacacaccccacugaaagauguaggcag

SEQ ID NO: 231853 - RNA, 64 nt, Human
ugcuaggggguucuugucgagaucaugucaucagcaccccuaagucaagucacggguuuccaua

SEQ ID NO: 231854 - RNA, 64 nt, Human
aagcauggcuggggggaggggguacacagacagugcccaugacccaguccaaggagucaggaaa

SEQ ID NO: 231855 - RNA, 64 nt, Human
uuggacagggcuuucucucagguaggagaaaugggcccaugaucuccucacagucgcccccagu

SEQ ID NO: 231856 - RNA, 64 nt, Human
aacugucauaugaccagaauucuucuguaauucugcccaugacuccuccagaauuuuaguagau

SEQ ID NO: 231857 - RNA, 64 nt, Human
cuaggaagaucucugcagggccgccagggagaccuggacacaggccugcucucuuuuucuccag

SEQ ID NO: 231858 - RNA, 64 nt, Human
ggugagaccugaaggaccucccccuguguggcccuggacacagcccacccucugugagccguuu

SEQ ID NO: 231859 - RNA, 64 nt, Human
ucugggggcccccccagcuggcgggaaccccaaauggacacaaacuguacauuugccaaugggu

SEQ ID NO: 231860 - RNA, 64 nt, Human
acugcaguggggguuguuuuuauuaaaagcaucauggacacagcaucauuagggcugaucuccc

SEQ ID NO: 231861 - RNA, 64 nt, Human
auggugacacagaggauggcucuaugcuggugacuggacacaucgccucugguuaaaucucucc

SEQ ID NO: 231862 - RNA, 64 nt, Human
auggugaugcagaggaugucucuaugcuggugacuggacacacagccucugguuaaaucccucc

SEQ ID NO: 231863 - RNA, 62 nt, Human
guugucucucuaaacccaaauaaauguguaaauguggacacaucucagccuguggauaauug

SEQ ID NO: 231864 - RNA, 64 nt, Human
cuuauaguaaaccaaaagauuagcaauaauacuauggacacauuagauuauauacuacagacac

SEQ ID NO: 231865 - RNA, 64 nt, Human
auauucaaaucauagucuuauggaacucuguaauuggacacaaacaaaaacuugucauauagga

SEQ ID NO: 231866 - RNA, 64 nt, Human
aaugggagugcuagaagcaaggagccagcaagucuggacacauuacaaaggccacaagggguuu

SEQ ID NO: 231867 - RNA, 64 nt, Human
uuccccaguggccccguggauccugguccuaggcuggacacaggauucagaaagacaccaggcu

SEQ ID NO: 231868 - RNA, 64 nt, Human
uggcuuuuguuuucaaugugaaagauacauuaaauggacacauaucuugcaaaauuuuguugua

SEQ ID NO: 231869 - RNA, 64 nt, Human
ucaagagaauuccuguucuccuugugcuaugauuuggacacaagauucuggauaccuggaacuu

SEQ ID NO: 231870 - RNA, 64 nt, Human
auaaauccauugauuggguauuuucauuauuauuuggacacaugaauuaaaucccaagggaaag

SEQ ID NO: 231871 - RNA, 64 nt, Human
agcugugagggacccacagauuuuggaaacgaccuggacacacuauugggaaggagauguggac

SEQ ID NO: 231872 - RNA, 64 nt, Human
cuugagcugagacaccagaugcucacggagaugcuggacacauaaagcaaguuacagccacagc

SEQ ID NO: 231873 - RNA, 63 nt, Human
cugucaguggggcagccucuccgacucugcacccgccucgaccuccccacccgcucccacacc

SEQ ID NO: 231874 - RNA, 63 nt, Human
gccucccucugcuugcccagguacuccuuccgccgccucgauacacgggacguugagcacaac

SEQ ID NO: 231875 - RNA, 64 nt, Human
caggaaggagccaggacacagcucagcuugcucacgcccagagagagaaaaaguuaagcugcug

SEQ ID NO: 231876 - RNA, 64 nt, Human; identical to SEQ ID NO: 231861

SEQ ID NO: 231877 - RNA, 64 nt, Human
ugaauuuggccugcacuaauuugauguuuacagguggacacacaaggugcaaaucaaugcguac

SEQ ID NO: 231878 - RNA, 64 nt, Human
uuaguggaguccuccagcaauugaaugagagcaguggacacaucucagcaggucggucuagaga

SEQ ID NO: 231879 - RNA, 64 nt, Human
ggcuggcguugcugacucacagucgccauccaucuggacacaaagagagaccugugggagucgu

SEQ ID NO: 231880 - RNA, 64 nt, Human
guuuaaaaagaguccaguuaggguggacuaacuuuggacacaaauuggcuuccauuuccuacau

SEQ ID NO: 231881 - RNA, 64 nt, Human
ccugggccuguggcuacagccagggaaccccaccuggacacauggcccugcuucuaagcccccc

SEQ ID NO: 231882 - RNA, 64 nt, Human
cacguugugaaugccgcugcaggcaaguuccagguggacacaggugccaaauucuaccguggaa

SEQ ID NO: 231883 - RNA, 64 nt, Human
uucucuuuagguucaagaugcagauuucucaauuuggacacaccugcaucacguuggucaaauu

SEQ ID NO: 231884 - RNA, 64 nt, Human
uuuaaguacaacuuuuaaggacuaauuacugugauggacacagaaauguagcuguguucuggaa

SEQ ID NO: 231885 - RNA, 64 nt, Human
guucuguucaguugcuaaugaggcuccuccgcucuggacacaacccuuuuauagauuaauuucu

SEQ ID NO: 231886 - RNA, 64 nt, Human
cuggacagucacgacaaggacuugccuccagcacuggacacaccuguguuaagaccagcccucu

SEQ ID NO: 231887 - RNA, 64 nt, Human
ggcucagccauaggaccugccacacaagcagccguggacacaacgcccacuaccaccucccaca

SEQ ID NO: 231888 - RNA, 64 nt, Human
aaggagauaaggagggggccccagcaaaagccacuggacacacagcucugcuugacgaggccag

SEQ ID NO: 231889 - RNA, 64 nt, Human
ggagagaaaaugaaaacugaagcugccaauacuuuggacacaaaccaaaacacacaccaaauaa

SEQ ID NO: 231890 - RNA, 64 nt, Human
gggcaggccccaucgcuuuccucugauaaccacauggacacauccugaagucagcccaggcgcc

SEQ ID NO: 231891 - RNA, 54 nt, Human
gcucugcugaacgguccuaguguuuggacacaauagugcacuuuaaaaccugcu

SEQ ID NO: 231892 - RNA, 64 nt, Human
uucuguaugagauugagaagcuuuucccaccucucaccccuauuuccuauaaggauauccagag

SEQ ID NO: 231893 - RNA, 64 nt, Human
accuuuaacacagaccccuagggauuuaaagggacaccccuacacacacccaggcccaugccaa

SEQ ID NO: 231894 - RNA, 64 nt, Human
ugcugacagauagaggaggugggacccugacuaucaccccuaaucugcaguggauuuggcucuc

SEQ ID NO: 231895 - RNA, 64 nt, Human
uaaaaucuauuucugcagcugagguuuuauccacuggacacauuugugugugagaacuaggucu

SEQ ID NO: 231896 - RNA, 64 nt, Human
cuaucgucuuccuacacauaggaggcucauucucuggacacacuaucaccuauuacauuuuacu

SEQ ID NO: 231897 - RNA, 64 nt, Human
uacuauaugccagcucuaggaauggaguagacaguggacacaagaaggacuuacgcccugagca

SEQ ID NO: 231898 - RNA, 64 nt, Human
acccuuuccccaaguauaacgucaggcccaaguguggacacacugccgcccaucccaucagguc

SEQ ID NO: 231899 - RNA, 64 nt, Human
uguuauugcuacuuuauagguacauuaaauauacuggacacaaauauauaugggauauuaggcu

SEQ ID NO: 231900 - RNA, 64 nt, Human
uucuagccacaguucuaagacccaaagugggggguggacacagaagucccuaggagggaaggag

SEQ ID NO: 231901 - RNA, 64 nt, Human
ggggugcagaccccccucauggaguauggggcgcuggacacauggccggggcugcaccagggac

SEQ ID NO: 231902 - RNA, 64 nt, Human
aagaauggaagaaaacggugcauccacgcacacauggacacagacccacacauguuuacagaac

SEQ ID NO: 231903 - RNA, 64 nt, Human
gacauaaaguacuugcccuaguuuguggcuaauguggacacacaaaagcucuuuauguuauaaa

SEQ ID NO: 231904 - RNA, 56 nt, Human
cauugcauuaugaugaguaaacauucuggacacauaagaacaguagguguuaaaaa

SEQ ID NO: 231905 - RNA, 64 nt, Human
ugcuaccuaaaaaaagauguuuuauuuugccaguuggacacaggugauuggcuccuggguuuca

SEQ ID NO: 231906 - RNA, 64 nt, Human
gacucacauccugaccuugcacaaacagccccucuggacacagccccauguacacggccucaag

SEQ ID NO: 231907 - RNA, 64 nt, Human
agaauacuacuuuuucuuguuggucuagcauugcuggacacaaaguguagucauuauuguugua

SEQ ID NO: 231908 - RNA, 64 nt, Human
uuccuaaccuuuuuuaaaguuuccuggucuccacuggacacagagcuuuggagacggaggaucc

SEQ ID NO: 231909 - RNA, 64 nt, Human
uuauuuuauuuauguggcagguugcauauuuauguggacacauagguugcacugcuaggcauuc

SEQ ID NO: 231910 - RNA, 64 nt, Human
uccuuucuggaucucggcuucuccagcuguaaaauggacacacaauccuccuccagggacugcu

SEQ ID NO: 231911 - RNA, 64 nt, Human
uguacagcccgugcuuggagaaccauggaagcuacaccccuacaggugcauacuguucugcuuu

SEQ ID NO: 231912 - RNA, 64 nt, Human
agauagaaucuguaccacucagugcuaccauccccaccccuacaccacuuccacacaggggccu

SEQ ID NO: 231913 - RNA, 64 nt, Human
gcagagggggccaggaucuaccuaaccauuuccccaccccuaagucccucagugggcuuugccu

SEQ ID NO: 231914 - RNA, 64 nt, Human
ggaguuacugcagcuuagggaugguuccuggaaguggacacauuuuacaaaaacguuuuuuaaa

SEQ ID NO: 231915 - RNA, 64 nt, Human
acagacacugggcuaaaaaggguauucagacacauggacacacauuccuagaaugucaucauau

SEQ ID NO: 231916 - RNA, 64 nt, Human
ccuuucagucccucucucucugccugugggaaucuggacacauuuugggaggccucccaaggcu

SEQ ID NO: 231917 - RNA, 64 nt, Human
cugagaacguaaaauaucauuacauagugauagcuggacacacaaggaauucacaacuccccaa

SEQ ID NO: 231918 - RNA, 64 nt, Human
uuaugaaaguucagauuuaaaauaauaaaauaaauggacacauucuuuauaaagaugcaucugu

SEQ ID NO: 231919 - RNA, 64 nt, Human
cuuuccacccagguggacaaacacauucggcggcuggacacagaccuggcccguuuugaggcug

SEQ ID NO: 231920 - RNA, 64 nt, Human
uuacacaugaaaaggugaacaucaucaaaaacccuggacacaguucccugagaacugccugccg

SEQ ID NO: 231921 - RNA, 64 nt, Human
accccugggccacugaagaguaacauggcuccacuggacacaaaagagggauggaaucaacagg

SEQ ID NO: 231922 - RNA, 64 nt, Human
cacucacaggugggaauugaacaauaaaaacacuuggacacaggguggggaacaucacacaccg

SEQ ID NO: 231923 - RNA, 64 nt, Human
cacggguaugguugccagcuguguuccuggccccuggacacacaguguggcauccucauguuug

SEQ ID NO: 231924 - RNA, 64 nt, Human
uggugugcugggggugggguuacuuuagaaaaaguggacacagaccagacuaaggaagaagucu

SEQ ID NO: 231925 - RNA, 64 nt, Human
guggauacccagucccagaaccacacuguugaguuggacacacuguaaaccccuggguaacugu

SEQ ID NO: 231926 - RNA, 64 nt, Human
ccugauguucgugucccucucauagggggagcuuuggacacaggaccaguuuggaaaaggguca

SEQ ID NO: 231927 - RNA, 64 nt, Human
ucucuguaguuggaucaagugacuucugcccaccuggacacaacaccaaaaaggcuucuuauuc

SEQ ID NO: 231928 - RNA, 64 nt, Human
cugccaagacuuccuccucuuuguuugcauuuaauggacacagucuuagaaacauuacagaaua

SEQ ID NO: 231929 - RNA, 64 nt, Human
agccuuucuggaacaaggagaaugccugugcagguggacacacaggccuggccugucgcucuca

SEQ ID NO: 231930 - RNA, 64 nt, Human
acuuccuugggcugcugcuuuaguggagucaugucaccccuaccacuuggcuaucugccuagca

SEQ ID NO: 231931 - RNA, 64 nt, Human
aaugugugccuaagcaauucuguccucugauucccaccccuacccaccaaaaaaugguagacau

SEQ ID NO: 231932 - RNA, 64 nt, Human
caugcccugccuugucccucucacuccccagccccaccccuaagugcccaaaguggggagggac

SEQ ID NO: 231933 - RNA, 64 nt, Human
cuggauccuguaugugaggaaaggaaucccccaguggacacagccuuccuccccaagcacgugg

SEQ ID NO: 231934 - RNA, 64 nt, Human
cuuugucuucuguccaccaggccuucucuccagcuggacacaaaccuccuuugaagggaaauaa

SEQ ID NO: 231935 - RNA, 64 nt, Human
cugacauccauacuuauguugucuggaagagccauggacacaucauuauuuucagcaaccagcu

SEQ ID NO: 231936 - RNA, 64 nt, Human
caugugagcucccacacguacacacagaugcacauggacacaccccaaacacgcacaggcuccu

SEQ ID NO: 231937 - RNA, 64 nt, Human
gucuguggccuuccucacgcagaggccuuaaagcuggacacagaagcacgccuaggcugggcag

SEQ ID NO: 231938 - RNA, 64 nt, Human
uugcagaucaccaugugguugaagguuuuaguuguggacacaguggucccuccuuaaugaugaa

SEQ ID NO: 231939 - RNA, 64 nt, Human
aauacuggaggaaaauguuguaaaaauagacuuuuggacacacagcuguuggggcugcacugag

SEQ ID NO: 231940 - RNA, 64 nt, Human
aggaaauaaauggaaagggggcauaugggauuuguggacacagcuguuucuguuccugaacuag

SEQ ID NO: 231941 - RNA, 64 nt, Human
cugggcgaucgcugaauuucuucccucugcuuccuggacacagaggaggucuaacgaccagagu

SEQ ID NO: 231942 - RNA, 64 nt, Human
gugacaucuaucccuuuauuuugacacuaaaacauggacacaacuagaaagagguacaaugcaa

SEQ ID NO: 231943 - RNA, 64 nt, Human
cucucccucugccugcuguggguggugggcacucuggacacauaguccagcuuucuaaaaucca

SEQ ID NO: 231944 - RNA, 64 nt, Human
uuucagaggacugccuaguagcaaagguuauuccuggacacaggaaagacgggcauuacaggga

SEQ ID NO: 231945 - RNA, 64 nt, Human
cucccaccagcaccgugacaguuuacaaaugacauggacacaucaggaaguuacccuauauguc

SEQ ID NO: 231946 - RNA, 64 nt, Human
auuuauagcauguuucuuuuugaaaaacuagugguggacacauuuggaucacauuuauacaguu

SEQ ID NO: 231947 - RNA, 64 nt, Human
cucuugcaguuuguucuguaaugccuuuuacauuuggacacauaguuuaugcuuuuuagauuuu

SEQ ID NO: 231948 - RNA, 64 nt, Human
aggaccugacagagcccaugcagggcuuuagauuuggacacacaagaguugauaacuuccucau

SEQ ID NO: 231949 - RNA, 64 nt, Human
agccuugcugccugggacauagagaucaucuggccaccccuagaggcagaugggcugagauaaa

SEQ ID NO: 231950 - RNA, 64 nt, Human
ggaucauuuggucaguuugguaauuccugcuccacaccccuauuuuccucuuaauaauacguuu

SEQ ID NO: 231951 - RNA, 64 nt, Human
cccuucccccuccaaucccaccaacccucagagccaccccuaaagagauacuuugauauuuuca

SEQ ID NO: 231952 - RNA, 64 nt, Human
caggugccaggagaaggugugagcaugagccuauuggacacaccuggcgacguauaccaggugu

SEQ ID NO: 231953 - RNA, 64 nt, Human
uuccuggauaagaguucuggagauggcagcuuauuggacacauggauuuucuucagauuugcac

SEQ ID NO: 231954 - RNA, 64 nt, Human
ggcaugcugaguaaacugauuucccaccggggacuggacacaaacaggaaugucuggaguggua

SEQ ID NO: 231955 - RNA, 64 nt, Human
uaggggcugguuuuccguacuccaaaccaucagguggacacaguccuaggaaccauuauggaug

SEQ ID NO: 231956 - RNA, 64 nt, Human
ucuugcuggcuaaaaugccagguaaaggguugguuggacacagcgcuuagugcacgcugucauc

SEQ ID NO: 231957 - RNA, 64 nt, Human
aaucccaucucuacaaaaaaugcagaacuuaaucuggacacacuguuacacgugccuguagucc

SEQ ID NO: 231958 - RNA, 64 nt, Human
ugugaaucaaagccugagucacucuauuuaaccuuggacacacuaauaagguuuuauuuugauu

SEQ ID NO: 231959 - RNA, 64 nt, Human
uggaagcuggaugauauggaagaguucaugugccuggacacacaguucccuguaauccugccau

SEQ ID NO: 231960 - RNA, 64 nt, Human
uuuuaaguauauuaauuccucuucagaauugagcuggacacauuuggcauucuuaguuugucau

SEQ ID NO: 231961 - RNA, 64 nt, Human
uccaucuguugguuuugugagcugagagcaucucuggacacauggaagggagccagggauuccu

SEQ ID NO: 231962 - RNA, 64 nt, Human
cauugcuucugacuagauuauuauuugggggaacuggacacaauaggucuuucucucagugaag

SEQ ID NO: 231963 - RNA, 64 nt, Human
cccccagacccagacuugggccguugcucugacauggacacagccaggacaagcugcucagacc

SEQ ID NO: 231964 - RNA, 64 nt, Human
uccuguccuagugugugcagugucuucggcccuguggacacaggugaaugagggaccagcccug

SEQ ID NO: 231965 - RNA, 64 nt, Human
ccuuucacuccucgguccuccggagcccacaaccuggacacagcuccucaagacagguagcaug

SEQ ID NO: 231966 - RNA, 64 nt, Human
gccucggagggugggcaaccuggugcuucccggguggacacacaggaccacucaguggggccug

SEQ ID NO: 231967 - RNA, 64 nt, Human
cacuaaccacgcuggaccuugaacuggguacuuguggacacagcucuucuccaggcuguauccc

SEQ ID NO: 231968 - RNA, 64 nt, Human
ggauuacaggugucagccaccgcacccagccaagcaccccuaucucuagaggaucuggcccccc

SEQ ID NO: 231969 - RNA, 64 nt, Human
ggagcugaucguaauguuuaucauguuacuuccccaccccuacauuuuuugaaauaaaauaagg

SEQ ID NO: 231970 - RNA, 64 nt, Human
uggggcgaagcucugagucauucagcccuggggacaccccuaggcaacgauuccgacagcgcca

SEQ ID NO: 231971 - RNA, 64 nt, Human
ccaaugccacugagcccugcucccucugccacuguggacacauccucuccacccucugggccuc

SEQ ID NO: 231972 - RNA, 64 nt, Human
cucacccucugcagacgccccacccgcucgguccuggacacacugccccccucucuugccucca

SEQ ID NO: 231973 - RNA, 64 nt, Human
cgugggaugccugcuucucacuaccaccugugucuggacacaugcuuaugucucauuuuccuuu

SEQ ID NO: 231974 - RNA, 64 nt, Human
aaacguguguaucaaguaugauguucccccaacguggacacacucaguuccucacaaagccaag

SEQ ID NO: 231975 - RNA, 64 nt, Human
acagugugugugcgugcgugagaccacagaucuguggacacaccauuuguguacguggaauuuu

SEQ ID NO: 231976 - RNA, 64 nt, Human
cucacccuggugcugccucccgcacaaggagaccuggacacaacagacacacaucacaaggcga

SEQ ID NO: 231977 - RNA, 64 nt, Human
acacaacagacacacaucacaaggcgaacacaaauggacacacauaccuggccacgaacccaca

SEQ ID NO: 231978 - RNA, 64 nt, Human
cccaugugcagggugagguuuuuuuuugccacccuggacacauguuggcccccucaaagaauuu

SEQ ID NO: 231979 - RNA, 64 nt, Human
uccuucuuucccuacucuaccuucuaccuuggucuggacacauucuggaacacuggacacccuc

SEQ ID NO: 231980 - RNA, 64 nt, Human
gacucugggccacuguaauguuuguguuuagauuuggacacacaguggagacccuuuucugaaa

SEQ ID NO: 231981 - RNA, 64 nt, Human
cccuucacaauucuacuccccagauccucuccccuggacacaggagacccacagggcaggaccc

SEQ ID NO: 231982 - RNA, 64 nt, Human
cggccacccacuccccgugaccgcccacgccacauggacacagcccucgcccuccgccccggcu

SEQ ID NO: 231983 - RNA, 64 nt, Human
ggacgcacacagcuuuuaguacccaccugagcuuuggacacacacagcuucuagugauuucugg

SEQ ID NO: 231984 - RNA, 64 nt, Human
cuugggcuucaaguucauuuauugaugcauugguuggacacaauaaaaccacaauuguuaucaa

SEQ ID NO: 231985 - RNA, 64 nt, Human
caagcuauacugugcaggacauggccaggccugguggacacaggaagccuacccaacacgcugg

SEQ ID NO: 231986 - RNA, 64 nt, Human
ucucucaugauagaaggcuauggggauagauguguggacacauuggaccuuuccugaggaagag

SEQ ID NO: 231987 - RNA, 64 nt, Human
gcaggggugagaggaggcuagccgggccucaccccaccccuacccgccacagccucagggugug

SEQ ID NO: 231988 - RNA, 64 nt, Human
caucuggaaugcuccaguuugaucucccuucugccaccccuaccucaccccuagucacucauau

SEQ ID NO: 231989 - RNA, 64 nt, Human
cuccaguuugaucucccuucugccaccccuaccucaccccuagucacucauaucggagccugga

SEQ ID NO: 231990 - RNA, 64 nt, Human
agccaucaagaacccacacagacggcagggaagguggacacaguaugaacuacugcugaugucu

SEQ ID NO: 231991 - RNA, 64 nt, Human
uuuuuuagcugagggggacaagaggagaagucaguggacacauggaaguuacucgugaccacca

SEQ ID NO: 231992 - RNA, 54 nt, Human
augacugggucuaugaauaagagguggacacaacagcagucuccuucagcacgg

SEQ ID NO: 231993 - RNA, 64 nt, Human
cagcagucuccuucagcacggcguggugugucccuggacacagcucuucauuccauugacuuag

SEQ ID NO: 231994 - RNA, 64 nt, Human
ugucucaugucuuauuuuugaaccaugcauaugauggacacacaauggauggacacauuauauc

SEQ ID NO: 231995 - RNA, 64 nt, Human
uuuugaaccaugcauaugauggacacacaauggauggacacauuauaucuccaacaaggugugg

SEQ ID NO: 231996 - RNA, 64 nt, Human
ugaaaauaccuuuccaggcagcucccugaccauuuggacacauugccacgacaggagccuccaa

SEQ ID NO: 231997 - RNA, 64 nt, Human
ugcacuugagcacuccccagaccagaucacuuuuuggacacacccaggaaggcuuuugaaguca

SEQ ID NO: 231998 - RNA, 64 nt, Human
uggcuccagggccucccucagagguccccaaagauggacacacaaccccagcggcagcaggaaa

SEQ ID NO: 231999 - RNA, 64 nt, Human
ggagucccccaugcccugccugaaaugacuucacuggacacagcggggcugcagcuaacggggu

SEQ ID NO: 232000 - RNA, 64 nt, Human
guggcuuugugucagacacgcucggcuccccaccuggacacacacucaccaguggccuuucagu

SEQ ID NO: 232001 - RNA, 64 nt, Human
guccacaccgcagugccucugccccucgggggacuggacacacauccugccagaggcgcuacga

SEQ ID NO: 232002 - RNA, 64 nt, Human
gcagccacgucuccaagagcucccgugcguaggcuggacacaagcacaggcuguagcaugguga

SEQ ID NO: 232003 - RNA, 64 nt, Human
gcuaucuaggcccucccucaccugaggcccagaguggacacagcuguuaauuuccacuggcuau

SEQ ID NO: 232004 - RNA, 64 nt, Human
cccugggagcccuacacuccacuuggagucuggauggacacaugggccaggggcucugaagcag

SEQ ID NO: 232005 - RNA, 64 nt, Human
agccccuuugcuggcuuuaucugcucccuuguucuggacacagagcccugggaaaaagaggggg

SEQ ID NO: 232006 - RNA, 64 nt, Human
ccgggaaugagcaggcucagcaggggggcagccccaccccuagucugcccuccccucuccccca

SEQ ID NO: 232007 - RNA, 64 nt, Human
cugaagagccagauuuaggccgggcaaaggggcucaccccuauaaucccaggacuuugggaggc

SEQ ID NO: 232008 - RNA, 64 nt, Human
gauccaccuccgcccaggcccuccaagcucuacucaccccuagggccucaguaaacucagacca

SEQ ID NO: 232009 - RNA, 64 nt, Human
aaagaaagaaagaaaaggaaacccaagagcugccuggacacacggaaacccaacugagaacaaa

SEQ ID NO: 232010 - RNA, 64 nt, Human
cccagccccgcucaggccuaggaggccccccguguggacacagaucccacuggaagauccccuc

SEQ ID NO: 232011 - RNA, 64 nt, Human
acuccaucucaaaaaaaaaaaaaaaaacuuaagauggacacagcugacuggacccccauccugc

SEQ ID NO: 232012 - RNA, 64 nt, Human
ggggaggcagcccccgcaguggacaacccccgcuuggacacaguccgaguggaaugggaaggga

SEQ ID NO: 232013 - RNA, 64 nt, Human
gguuccucacuccuccugccuccacccccuaccauggacacaugggugaggccgggcuccccgc

SEQ ID NO: 232014 - RNA, 64 nt, Human
auccuaaggggaacucccaaauggguguugcugguggacacagaugcuccccccaauggaagcc

SEQ ID NO: 232015 - RNA, 64 nt, Human
gaagagaagggugugaggcugcggcucaccauuguggacacaccagguuuuggggaugcaguca

SEQ ID NO: 232016 - RNA, 64 nt, Human
cacucauaagugggaauugaacaaugagaauacauggacacagggaggggaacaccacacccug

SEQ ID NO: 232017 - RNA, 64 nt, Human
cucaccagauggcaugugguguggcaccuguggcuggacacaggaggccucaggaucacaaaug

SEQ ID NO: 232018 - RNA, 64 nt, Human
ggagacuuuugauggcuuuuggcagggacagacuuggacacaaaaccgauccauagaagggcuu

SEQ ID NO: 232019 - RNA, 64 nt, Human
cagccccaccucgcaucuucaccugcccuugguguggacacacccucucaugcuaccagcacca

SEQ ID NO: 232020 - RNA, 64 nt, Human
acauauuuuaguauauaaaaauagauaaugcucuuggacacauuuuguauuauucaugaucuga

SEQ ID NO: 232021 - RNA, 64 nt, Human
uauuccauggcuuagcuuccuucaaaucaaaauuuggacacacacuauuaagagaagccauuaa

SEQ ID NO: 232022 - RNA, 64 nt, Human
agcauguccucacccuccccaccacauaaacacauggacacacacccaagccacaagaaauccc

SEQ ID NO: 232023 - RNA, 64 nt, Human
ucguccagccucuagacacuucccaaagcaagacuggacacaugccgagggcguugcggauagu

SEQ ID NO: 232024 - RNA, 64 nt, Human
aauauugugaacuauguauuuuaaaauaugaucauggacacacaaugaugaauuuuuuggccau

SEQ ID NO: 232025 - RNA, 64 nt, Human
agugaguaagagacacucacaggcuaugaggguacaccccuagcugaauguucuguguuguuuc

SEQ ID NO: 232026 - RNA, 64 nt, Human
gagcugggccgguuaguguaugucacccccaccccaccccuaaguagucaucaaugcaauaaga

SEQ ID NO: 232027 - RNA, 64 nt, Human
uacccagacucagagaccgugagcgccccgcccccaccccuacagccugcacacaccugccugc

SEQ ID NO: 232028 - RNA, 64 nt, Human
ugacuaguuucuuuuucuugacagcucuucucuuuggacacaugggccuucuuagaggguucag

SEQ ID NO: 232029 - RNA, 64 nt, Human
auaauuuacaugcuuauuuuuaaaauaguauauguggacacauauauaucauuauauuaaaaua

SEQ ID NO: 232030 - RNA, 64 nt, Human
cagcuuauagguuacucacaguccacuuucucacuggacacacaaaguggcucuuuaucuaccu

SEQ ID NO: 232031 - RNA, 64 nt, Human
acacauugggcggccugcaggaaccugcuccagguggacacacgggccagcagccgcgaaccuu

SEQ ID NO: 232032 - RNA, 64 nt, Human
uugaugggauguguucauguccuaucuccucuccuggacacauuaagggguugggacaagaaga

SEQ ID NO: 232033 - RNA, 64 nt, Human
cggccccuugacucuggggacuccggguuugagauggacacacugguguggauuaaccugccag

SEQ ID NO: 232034 - RNA, 64 nt, Human
uggccccagguagggggacuguucuagccagcuguggacacauaggaaugcuggaccaggguac

SEQ ID NO: 232035 - RNA, 64 nt, Human
acaugucacaggguauggugugacagggugccuguggacacaugaaucacuucuaaccugccuc

SEQ ID NO: 232036 - RNA, 52 nt, Human
ggcgggcaguuuaugugugaccuggacacagacagagacagagccaggcccg

SEQ ID NO: 232037 - RNA, 64 nt, Human
uugacccaugccuacuccaugccaggcccagugcuggacacagagacaugaagcucugucugug

SEQ ID NO: 232038 - RNA, 64 nt, Human
cagaggggagucaccagccagaggaugcauagccuggacacagaggaaguuggcuagaggccgg

SEQ ID NO: 232039 - RNA, 64 nt, Human
cuuugcugaaacacaguagucuuaugaaaagcacuggacacauacuuugaauaccuuucauauu

SEQ ID NO: 232040 - RNA, 64 nt, Human
ugcuggcccuccagggggcccugggccucuaugauggacacaccccgccauaugcugccugccu

SEQ ID NO: 232041 - RNA, 64 nt, Human
uaaauaaggcccaaggaacaugucgggagggggguggacacaaaaaccggccuugcccugcagg

SEQ ID NO: 232042 - RNA, 64 nt, Human
ccuggugagagccugaggcugguguucagggcccuggacacagacacagagcagccgcaucuca

SEQ ID NO: 232043 - RNA, 64 nt, Human
cacuuuuauaaggagauaaggauguacauauguuuggacacauuguccacuucagaugcuuguu

SEQ ID NO: 232044 - RNA, 64 nt, Human
uuaaccugggcauuguugagguuaaguuucucuucaccccuacacugugaaggguacagauuag

SEQ ID NO: 232045 - RNA, 64 nt, Human
ccagcacuucccagccuuuccaggagcucugccccaccccuacucaaggagucaggugcccagg

SEQ ID NO: 232046 - RNA, 64 nt, Human
aaguaaaucuggaaggauucucacucguauuucccaccccuaguggccagaggagggaggggca

SEQ ID NO: 232047 - RNA, 64 nt, Human
uguucgugugaguguuuacucaacaaauguuuauuggacacacucagagagagggagugugcac

SEQ ID NO: 232048 - RNA, 64 nt, Human
gguuuguuggguuuuucgucuuuccagauugcaguggacacagcccccgaucucgagccccggc

SEQ ID NO: 232049 - RNA, 64 nt, Human
acagaaagagacagaagcuggggcuacguccauguggacacagaccacagaugugggcacacga

SEQ ID NO: 232050 - RNA, 64 nt, Human
ugccaagccugguacugaguucaugauaccaugguggacacagcugagaaaaucccugcccuca

SEQ ID NO: 232051 - RNA, 64 nt, Human
aaaugugugaaaccaaacugcagccucaacaccauggacacacgucaucaggaccuccugaggu

SEQ ID NO: 232052 - RNA, 64 nt, Human
uagguucagaagaauauggggugcuuugcucccuuggacacagcuggcuuauccuauacaguug

SEQ ID NO: 232053 - RNA, 64 nt, Human
caggcucccucugggcaucccuggaugcagccucuggacacaugccuccuuuaaaguguccggg

SEQ ID NO: 232054 - RNA, 64 nt, Human
uugucaacuuuucuuuaacuggcuacgccacagcuggacacacaugcagccccuggagggcagc

SEQ ID NO: 232055 - RNA, 64 nt, Human
gugggugggaggaacuugcauaaauauauauuuauggacacacaguuugcaucagaacguguuu

SEQ ID NO: 232056 - RNA, 64 nt, Human
cacucaggcaccaggccugguccaggaggagcuguggacacagucgugguucaaguguccacau

SEQ ID NO: 232057 - RNA, 64 nt, Human
ugucuggcugcuggaccuggacaccagggcucgguggacacaagaucuauugacgggccuuggu

SEQ ID NO: 232058 - RNA, 64 nt, Human
augguggugaaugacuggugugccuucuguggccuggacacaaccagcacagagcugucagugg

SEQ ID NO: 232059 - RNA, 64 nt, Human
aggugggauuuagugcacagccucacguggggcuuggacacaggcugggggugggcgcaugcua

SEQ ID NO: 232060 - RNA, 64 nt, Human
gcuggaggccgagggcuccaggugcuaucuuagguggacacagcccugggggcuccuuccagga

SEQ ID NO: 232061 - RNA, 64 nt, Human
cauagcugagugaacuggugaaaucaagccaaccuggacacauacguuccucguucuucuuaga

SEQ ID NO: 232062 - RNA, 64 nt, Human
uauucuaugcauucaaauguggucacaaauauuguggacacauuaucuuauguuuugaaauacc

SEQ ID NO: 232063 - RNA, 64 nt, Human
cacugagucucccaggcccccuugaucuguaccccaccccuaucuaacaccacccuuggcuccc

SEQ ID NO: 232064 - RNA, 64 nt, Human
acagagacccugucucaaccaccaccaccaccaccaccccuacuaccccuguauucaagguaaa

SEQ ID NO: 232065 - RNA, 64 nt, Human
caggacaggauccaggccggcuugccacaccccccaccccuaggacuuauucccgcugacugag

SEQ ID NO: 232066 - RNA, 64 nt, Human
gcuguuugagauucucaaaggagcgagcaugucguggacacacacagacuauuuuuagauuuuc

SEQ ID NO: 232067 - RNA, 64 nt, Human
uguccacagcaagaugacgugauucuuauuuucuuggacacagacuauucugaggcacagagcg

SEQ ID NO: 232068 - RNA, 64 nt, Human
uuuuuauacuuauugggaaagugugaguuaauauuggacacauuuuauccugauccacagugga

SEQ ID NO: 232069 - RNA, 64 nt, Human
agccuuccccaugaaccccaccacuggcuaaaacuggacacauccugccuggcaaccugauuuu

SEQ ID NO: 232070 - RNA, 64 nt, Human
gagcgcuucagaauuuugcugugaacaguccucuuggacacagguuggggugcccuuguuuggg

SEQ ID NO: 232071 - RNA, 64 nt, Human
uugugaggugucuacaggguuuauaguagucuuguggacacagaaaugcacaggggacacuuac

SEQ ID NO: 232072 - RNA, 64 nt, Human
acugaacccucgaggaccugggcacggggucggauggacacacagccagaccguaaacccucac

SEQ ID NO: 232073 - RNA, 64 nt, Human
ugguuguauaugcaguugaccgaaacauuguuauuggacacauaacuauaguugaaagaauaag

SEQ ID NO: 232074 - RNA, 64 nt, Human
auuccccuuugcccacccucuuccugucuccaccuggacacaacuugcucaaaggcuggugacu

SEQ ID NO: 232075 - RNA, 64 nt, Human
cagcaaggccccagcuggcaguagccugaccaucuggacacagcagagccagggcggcccaggg

SEQ ID NO: 232076 - RNA, 64 nt, Human
agguccauagcauuaaauucucaucguuuuugauuggacacaggagagauucagagugauaugu

SEQ ID NO: 232077 - RNA, 64 nt, Human
caaagaaccauuagaaagggcucauuaagccuuuuggacacaggaccccagagaggaaaaagug

SEQ ID NO: 232078 - RNA, 64 nt, Human
agcuguggggcccuuaggagccccccaccgaggguggacacagucccuuuccuuccugcagaug

SEQ ID NO: 232079 - RNA, 64 nt, Human
ucaagaagcagcccuggcucucacgcugggguuuuggacacacggucagggucagggccauuuc

SEQ ID NO: 232080 - RNA, 64 nt, Human
agaaagacccaagacguuggaauggcuguuuccauggacacaaucuccauagugacaauguggg

SEQ ID NO: 232081 - RNA, 64 nt, Human
ggagacugagcguccccagccccaccuggcggcauggacacagaaaagcuacgccggcuggccu

SEQ ID NO: 232082 - RNA, 64 nt, Human
ucuggaagucucuuccuccuccuccucuucucuccaccccuagacccuggcugacuuggacaau

SEQ ID NO: 232083 - RNA, 64 nt, Human
gugcgccccucuccacugucucuccaagccuccucaccccuagucuucaucuccuguggacgaa

SEQ ID NO: 232084 - RNA, 64 nt, Human
gcaacuggacaaccaaguuaaccccaauugaaagcaccccuaggaccauugaacacccacugcc

SEQ ID NO: 232085 - RNA, 64 nt, Human
ggauuaaccaaaggccacccugacuuuguuuuuguggacacacaauaaaagccccguuuauuug

SEQ ID NO: 232086 - RNA, 64 nt, Human
auccaggguacuccuggacaguguccccuuuugauggacacaacugauaccuguucuuucuuuc

SEQ ID NO: 232087 - RNA, 64 nt, Human
uuuaguguauguucuaguuaauaaguuaaaauucuggacacauuauuaaaggcagaaacuucuu

SEQ ID NO: 232088 - RNA, 64 nt, Human
cccucauacccuuaaagggccagccugggcccaguggacacagguaaggcaccaugaccaccug

SEQ ID NO: 232089 - RNA, 64 nt, Human
uaugcaaccuuccaagaauaguaugucaagcaacuggacacagugcugccucugcuucaggacu

SEQ ID NO: 232090 - RNA, 64 nt, Human
cgcacugacaggaaaccuuccgucgugagggagcacuucccaggggccgcagggacgacacucu

SEQ ID NO: 232091 - RNA, 64 nt, Human
uaagacauaggaauucuacagcaugauauuucagacuucccauuuggggaucugaaacaaucug

SEQ ID NO: 232092 - RNA, 64 nt, Human
ucccagggaacccaguccagccuccuggcuguugacuucccauugcucuuggagccaccaauca

SEQ ID NO: 232093 - RNA, 64 nt, Human
ccggcccacagguuuccccaaggccucucaccccacuucccaucuccagggaagcgucgcccca

SEQ ID NO: 232094 - RNA, 64 nt, Human
ugcuuuccugucuguauuugaugcaggauuaaacacuucccagagaggauucuagucugguaaa

SEQ ID NO: 232095 - RNA, 64 nt, Human
caggccggguucccacgcagaggggaggcugcuccaccccuacucuccucccuugcucccagca

SEQ ID NO: 232096 - RNA, 64 nt, Human
cugugcagcgcccguggugaucugggguagggggcaccccuacagugggaccccucccccauua

SEQ ID NO: 232097 - RNA, 62 nt, Human
uggcaaagauagcagccugaaggucccacccccaccccuacagaaaaaaugggagcaagaac

SEQ ID NO: 232098 - RNA, 64 nt, Human
auuugagcccagcaccuaaaaguacaggaauuucacuucccaccaggacuugagcacauaacuc

SEQ ID NO: 232099 - RNA, 64 nt, Human
ggcccgggcacccacaagcccgugacagaugccaacuucccacacggcagccccccccucaagg

SEQ ID NO: 232100 - RNA, 64 nt, Human
ggcucugaggcugcagggcuggaaguccuugcccacuucccacucuccugccccaaucuaucua

SEQ ID NO: 232101 - RNA, 64 nt, Human
ccacuucccacucuccugccccaaucuaucuaguacuucccaggcaaauaggccccuuugaggc

SEQ ID NO: 232102 - RNA, 64 nt, Human
gugcugggauuacaggcaugagccaccaugccagacuucccauuuuacuuucugcaagcuguuu

SEQ ID NO: 232103 - RNA, 64 nt, Human
cuucuccaaagugacauauggagggaacuuuagcacuucccagcacagccagaauugcauccuc

SEQ ID NO: 232104 - RNA, 64 nt, Human
cacuuuuuuugcuauuuauuuaaauggucgaucaacuucccacaaacugaggaaugaauuccac

SEQ ID NO: 232105 - RNA, 64 nt, Human
caaacgccuugaaaacaagccuccacuuccccacacuucccauuuacucuugagacuacuucaa

SEQ ID NO: 232106 - RNA, 64 nt, Human
caauguuuaaguaaugguggaaucugucaauaagacuucccagaguguuaauauauaucagaaa

SEQ ID NO: 232107 - RNA, 64 nt, Human
ccaccgcuggagccccagcugugagaaccugcccacuucccaccagcggcgcuccuggaucaug

SEQ ID NO: 232108 - RNA, 64 nt, Human
aaucaugaucacuacagaugaacccaaugugccaacuucccaacagucuauagaguauuagaag

SEQ ID NO: 232109 - RNA, 64 nt, Human
uuacaagacucuuaugggcccaccguggagcagcacuucccaaaacuuguucacugggguccuc

SEQ ID NO: 232110 - RNA, 64 nt, Human
uauuuugcuuguugaacucuuagagcuauugcaaacuucccaagauccagaugacugaauuuca

SEQ ID NO: 232111 - RNA, 64 nt, Human
uuuuuucuuugguugguuuuugugcccccauucuacuucccacccuccugccccaucuccaucc

SEQ ID NO: 232112 - RNA, 64 nt, Human
cccuuauuauuuuauuuauuacacuggagcaguuacuucccaaagauuauucugaacaucuaac

SEQ ID NO: 232113 - RNA, 64 nt, Human
uugccaucagugaucucacuaaaaauauacagcuacuucccagcuaaucuccacccaaugaaug

SEQ ID NO: 232114 - RNA, 64 nt, Human
uggccuccuuucacuggggauugaaaagcaccuccaccccuacccuagugauguccccugagga

SEQ ID NO: 232115 - RNA, 64 nt, Human
cugcugggggcagcaguaccaucuacaucuccuucaccccuauggugcucagcccugagauccu

SEQ ID NO: 232116 - RNA, 64 nt, Human
cacuuggagggaaaaguucuuuuuuauuccuacucaccccuaccccccaaacuacccucuuccu

SEQ ID NO: 232117 - RNA, 64 nt, Human
augcgcagagcacuggaagggcuggugcagaucuacuucccaugcagaagagaagucacaucuu

SEQ ID NO: 232118 - RNA, 64 nt, Human
cagcugcaaaacaggcugauuucaauuaggcagcacuucccaaagugcacugaggaagguggcc

SEQ ID NO: 232119 - RNA, 64 nt, Human
cuuuauauuuagugggucagugccaagugcuaccacuucccaauaaaggaauggggacccagag

SEQ ID NO: 232120 - RNA, 64 nt, Human
gugucuuucugagguaaauaauuucugccaggaaacuucccagccccaccagcagccccccuaa

SEQ ID NO: 232121 - RNA, 64 nt, Human
cugggcccagguuugagggagaagguugcagagcacuucccaccucucugaauaguguguaugu

SEQ ID NO: 232122 - RNA, 64 nt, Human
uuccagagcucccaguggacaugucagagacaacacuucccagcaucugagaccaaacugcaga

SEQ ID NO: 232123 - RNA, 64 nt, Human
gaugauaccuuaaacucccacugcaagcccaugaacuucccagagaguggaacggcuugcucuu

SEQ ID NO: 232124 - RNA, 64 nt, Human
uaaauguaaugcaaccaaguuccucccagauuaaacuucccagguguucagaauuacuuuugcu

SEQ ID NO: 232125 - RNA, 64 nt, Human
cuggaacguagaaucuacgucugccucugaauggacuucccaccuccucucucuugcucugaug

SEQ ID NO: 232126 - RNA, 64 nt, Human
guuacuucucucaucugggcaaaacccacagaagacuucccagcuucugccacauaaaagacac

SEQ ID NO: 232127 - RNA, 64 nt, Human
agugcauagaugugaauugguuuuuaggggccccacuucccaauucauuagguaugacugugga

SEQ ID NO: 232128 - RNA, 64 nt, Human
agcagagguuucacccggcaggaugacacagaccacuucccagggagcacgggcaugccuugga

SEQ ID NO: 232129 - RNA, 64 nt, Human
ugucagccccacaggaggcucccaggccucccucacuucccauacccagucuaggagcuccuuc

SEQ ID NO: 232130 - RNA, 64 nt, Human
cauguugcugaccaggugcccauaugauuucuacacuucccaagccuuacccuggcaucuuucu

SEQ ID NO: 232131 - RNA, 64 nt, Human
caaacuccugauuucaagcgauccacccaccucgacuucccaaagugcugggauuacagcguga

SEQ ID NO: 232132 - RNA, 64 nt, Human
cucugagccuucccaccugcgggguggaggaggaacuucccaagugcuuuuaaaaauaacuucu

SEQ ID NO: 232133 - RNA, 64 nt, Human
gucagugcauuucaaggaacagccacaaaauacacaccccuaagaaaaggcaagacuugaacgu

SEQ ID NO: 232134 - RNA, 64 nt, Human
uuuggauuccauauuuaucccaaaugcuguugggcaccccuagaaauaccuugauguuuuuucu

SEQ ID NO: 232135 - RNA, 64 nt, Human
cucuggaggugcagggcacccuugagaagccccucaccccuaggccgccuccaggugcuaccca

SEQ ID NO: 232136 - RNA, 64 nt, Human
ugauuuaaagagaucuguguacuguuuacuucccacuucccagaaucccuuguaucuccuuucu

SEQ ID NO: 232137 - RNA, 64 nt, Human
augcuccugauuuaaagagaucuguguacuguuuacuucccacuucccagaaucccuuguaucu

SEQ ID NO: 232138 - RNA, 64 nt, Human
aauaccugcuucauguguucucagagcccucaucacuucccaugccccaucucgacucccaucc

SEQ ID NO: 232139 - RNA, 64 nt, Human
uuauuuccguugucucucugcugugucgcccaacacuucccagggugcugcugccacccgcccc

SEQ ID NO: 232140 - RNA, 64 nt, Human
acuguccacucugauccaacccuguacugauaguacuucccaguaugauauugugauguuucau

SEQ ID NO: 232141 - RNA, 64 nt, Human
agugauuuuguuugcccucuucuauaauauuccuacuucccauaauaaugacugauuuauuugu

SEQ ID NO: 232142 - RNA, 64 nt, Human
ggggcucuucccccagagaaguggcuuggagggaacuucccacucccauugccugcuuucccca

SEQ ID NO: 232143 - RNA, 64 nt, Human
gaaagaccaaagcagaugcugcugacccagcaccacuucccagccaggagccccccaggaacag

SEQ ID NO: 232144 - RNA, 64 nt, Human
aaccuuaguccccucucuuuccucuuccuccuccacuucccacuuauugucacuuuguaauauu

SEQ ID NO: 232145 - RNA, 64 nt, Human
uugggugaucaggaaucaaaccagcaucggaaagacuucccagcaccaagcuugagcugugucg

SEQ ID NO: 232146 - RNA, 64 nt, Human
uaaggucauauauacuauacaauauguuuauugcacuucccauggggauaaaucacucugucau

SEQ ID NO: 232147 - RNA, 64 nt, Human
uauaguacucuaauacugcaagaagguuuuuuaaacuucccacuuuauuuuuuauacacauuaa

SEQ ID NO: 232148 - RNA, 64 nt, Human
uucugccacugcugggcuccacuuggcuccucucacuucccagggggucgccuguccugccugu

SEQ ID NO: 232149 - RNA, 64 nt, Human
uuuagaaauguuauuuucccugugauagaggaugacuucccaguuucaccaaagucuguuuaua

SEQ ID NO: 232150 - RNA, 64 nt, Human
gaccaagacacagaagugaagucugugucugugcacuucccacagacuggaguuuuuggugcug

SEQ ID NO: 232151 - RNA, 64 nt, Human
auguuucugaaaugagcauccuugacgccuguguacuucccaggcuggaugugaagcuacauua

SEQ ID NO: 232152 - RNA, 64 nt, Human
uuauauaaagggaaaccagaccaggccuaaagcccaccccuacccucacccccccaauccucuc

SEQ ID NO: 232153 - RNA, 64 nt, Human
cgccugccaggagugaguccaugcguugucugcccaccccuaccacaguguuugugccuucagc

SEQ ID NO: 232154 - RNA, 64 nt, Human
aggaaucguggaaaacaagagcaaaacuaccccacaccccuauuucaugucugaaauaacccug

SEQ ID NO: 232155 - RNA, 64 nt, Human
uccauuuguaaaaguacagaccagaaauucuaccacuucccagauccuuuccaggguaccaccc

SEQ ID NO: 232156 - RNA, 64 nt, Human
gucuuccuucuaccccaaggccaguaguuuugacacuucccaguggaagauacagagaugcaau

SEQ ID NO: 232157 - RNA, 63 nt, Human
cuaguuaaagauuuuaaaaauguaaauaaaauauacuucccagagacagagucuguguggauu

SEQ ID NO: 232158 - RNA, 64 nt, Human
auguuccuggaaguuggcccccuuuaugaaaaccacuucccacagccagugggaacugccagag

SEQ ID NO: 232159 - RNA, 64 nt, Human
acucugagaucccggggcugggcagucgccccccacuucccagcagcucugugguaguggggcg

SEQ ID NO: 232160 - RNA, 64 nt, Human
aaugcaaagaaugaagaugacuaauaguacuuguacuucccaccacuggaaauguuagcauaaa

SEQ ID NO: 232161 - RNA, 64 nt, Human
aaugaaaccuguuagccacuucucugugccauauacuucccauguuaccaaaauacccccaacu

SEQ ID NO: 232162 - RNA, 64 nt, Human
aaaccacaugagaaaauuuuuguacuccaaauuuacuucccaauaaauauucagcaaaguagua

SEQ ID NO: 232163 - RNA, 64 nt, Human
cccagccaucggcugcguaugacagcaggauggcacuucccauuucucugugguuagugcucga

SEQ ID NO: 232164 - RNA, 64 nt, Human
cuccagaaacccugccaccauggugucuugccguacuucccacagccgccuuuuugcggccugg

SEQ ID NO: 232165 - RNA, 64 nt, Human
cucauuccacuagacugcccccugccacccuggcacuucccagggccuggcaguauggucugau

SEQ ID NO: 232166 - RNA, 64 nt, Human
ugaugguacaugcauuuucuagaauagagcugggacuucccauguggcccacaucugaccuggc

SEQ ID NO: 232167 - RNA, 64 nt, Human
ucacuccuuagcuuugccaacuccauccuccaaaacuucccagaauaccucccuuuccaguucu

SEQ ID NO: 232168 - RNA, 64 nt, Human
cuuuucauugcuaccucuaauaguccugucucccacuucccacucguuccccuccucuuccgag

SEQ ID NO: 232169 - RNA, 64 nt, Human
uguggccccuccaucuuccgucugagacuggaagacuucccagccuucagaacuguaagaaaua

SEQ ID NO: 232170 - RNA, 64 nt, Human
aaaguuauauauuuugucuacgaugggauuaugcacuucccaauugggauuuuacaucuggauu

SEQ ID NO: 232171 - RNA, 64 nt, Human
uaaguccuuguguuuccuuaauuuauuuuguuaacaccccuaauuacaaccaaagugaugaugu

SEQ ID NO: 232172 - RNA, 64 nt, Human
caccuugccauacauucuguuucaacaguggguacaccccuaacagagccagugccaacaaaac

SEQ ID NO: 232173 - RNA, 64 nt, Human
agaaagaaaucuggugccugggggucccuguguucaccccuagaguuuguuuuaaaauuuuuaa

SEQ ID NO: 232174 - RNA, 64 nt, Human
aaacucagcuguuccagccggugccaaccugugaacuucccaccauaucccagaaucugcuauu

SEQ ID NO: 232175 - RNA, 64 nt, Human
ccaccauaucccagaaucugcuauuccccaaaccacuucccaguuuccuuucaguaaucuuucu

SEQ ID NO: 232176 - RNA, 64 nt, Human
guucguuuccucugcccacuaaucccugcgcaggacuucccaggaccccuuuugucucugggac

SEQ ID NO: 232177 - RNA, 64 nt, Human
cagaaugagcucuuccugaacgugggcaccaaggacuucccagacggagagcuucgggggcacg

SEQ ID NO: 232178 - RNA, 64 nt, Human
caccaggucaccacagcccacacuacgcccuaucacuucccacaaugaggcugaguguuuguuu

SEQ ID NO: 232179 - RNA, 64 nt, Human
ccuccugacagguuccccaacagcccauuugcccacuucccacugcucagcccacaccagaccu

SEQ ID NO: 232180 - RNA, 64 nt, Human
uugugaccauuagcauuugucaacaaagucacccacuucccacuauugcuugcacaaaccaauu

SEQ ID NO: 232181 - RNA, 64 nt, Human
ucuccuugggaaaaaaguauccucuuuuaauuuuacuucccauaagcguaaaugccuggacaua

SEQ ID NO: 232182 - RNA, 64 nt, Human
aaguaguuugaagaaugcagcagccuuuuuguaaacuucccagauaucaaaauagacuuugaua

SEQ ID NO: 232183 - RNA, 64 nt, Human
aauguagggguucuggggccacagaggagaggccacuucccaccaggacccccaacaugaaguc

SEQ ID NO: 232184 - RNA, 64 nt, Human
caaaaguaauuuuaaguguaacauaacuguguuuacuucccaugcacuuaauacccuuaugcgc

SEQ ID NO: 232185 - RNA, 64 nt, Human
uugccuaauaaauaugacauggauguucaguggaacuucccaucuauuacgccucauacugaau

SEQ ID NO: 232186 - RNA, 64 nt, Human
cguagggaccuugauuuuggggacacacauugcaacuucccacuucugacgaaaggucuccaug

SEQ ID NO: 232187 - RNA, 64 nt, Human
gaucuugagaaagcuccuuccacucacccaccccacuucccagucuguugggaucagaggaacu

SEQ ID NO: 232188 - RNA, 64 nt, Human
uaguggcaccgccuccccaccuccaggcuuucccacuucccacccugccccucagagacugaaa

SEQ ID NO: 232189 - RNA, 64 nt, Human
guacuccaccgccugcaccaacagccucaguguuacuucccaggauuugcucugccccaaacga

SEQ ID NO: 232190 - RNA, 64 nt, Human
ggacagcuugguuuauuuuugagagugggguaagcaccccuaccugccuuacagagcagcccag

SEQ ID NO: 232191 - RNA, 64 nt, Human
guucccaaugagggugagauugggccuggggucucaccccuaguguggggccccaggucccgug

SEQ ID NO: 232192 - RNA, 64 nt, Human
ccaaggacaggaacacugguccccccaucacacucaccccuaagugggcugggagccaggcagg

SEQ ID NO: 232193 - RNA, 64 nt, Human
gggugcucugcacuccacggcccuucucagccacacuucccaccccagggggugcccccaggcu

SEQ ID NO: 232194 - RNA, 64 nt, Human
aggguugcauggcggcugggcaaaggugcuccccacuucccagauggugcggcggcuggccaga

SEQ ID NO: 232195 - RNA, 64 nt, Human
cagauggugcggcggcuggccagaggcacucuucacuucccagacagaggggcggccgggcaga

SEQ ID NO: 232196 - RNA, 64 nt, Human
cagacagaggggcggccgggcagaggugcuccucacuucccagagggugcaggagccagcucug

SEQ ID NO: 232197 - RNA, 64 nt, Human
ugguuuugacagguuuuccaaaaguaaagaugcuacuucccacuguaugggggagauugaacuu

SEQ ID NO: 232198 - RNA, 64 nt, Human
uauggcuuuaggcggcagaugauauacauaucugacuucccaaaagcuccaggauuugugugcu

SEQ ID NO: 232199 - RNA, 64 nt, Human
auggauuuuuuauguuacuagaagagauuauuugacuucccaggaauuuucugucuguaaucac

SEQ ID NO: 232200 - RNA, 64 nt, Human
cccuccaguggucacuucccaccauugcaggcagacuucccaccauugcaggcagcugggccca

SEQ ID NO: 232201 - RNA, 64 nt, Human
gcauugccauagaggagcccucccuccaguggucacuucccaccauugcaggcagacuucccac

SEQ ID NO: 232202 - RNA, 64 nt, Human
ugaguuugagccuguauaucuauuaaaaauuucaacuucccacauauauuuacuaagaugauua

SEQ ID NO: 232203 - RNA, 64 nt, Human
gcugagcagcuuuucuccccucauaucugcgugcacuucccagagcaucuugcauccaaaccug

SEQ ID NO: 232204 - RNA, 64 nt, Human
guuguuguuuguuguuuugagucagcugauuuucacuucccacugagguugucauaacaugcaa

SEQ ID NO: 232205 - RNA, 64 nt, Human
agccacaaaugcaggccacagaugcaaauauuuaacuucccaguagcccuauuuuaaaaaguaa

SEQ ID NO: 232206 - RNA, 64 nt, Human
uugucaaaugcaaagauuuguuugauuuuuaaccacuucccauguguuauacauaacaccuuuu

SEQ ID NO: 232207 - RNA, 64 nt, Human
aaggcagccuucagucccuaucagcgccuccuuuacuucccagagaacuucacagagacucugu

SEQ ID NO: 232208 - RNA, 64 nt, Human
uuuaguucagugaaccgcccguuaguuuugucaaacuucccacugcaaugccuuuauuuaaaaa

SEQ ID NO: 232209 - RNA, 53 nt, Human
ggacuuggacuaaagucugaugaacuucccaaucagaugagcauggaugauug

SEQ ID NO: 232210 - RNA, 64 nt, Human
gacagcaguguguuuuuuagaaagauaagagaaucaccccuaugcugcugagauguacauuugu

SEQ ID NO: 232211 - RNA, 64 nt, Human
cacucaggccugugcccacucccuaucuccuucccaccccuacacacacacucccugcuugcag

SEQ ID NO: 232212 - RNA, 64 nt, Human
uuagccuggcauucaaggcuaacuugcuaaucacacuucccauuaaaccuugcuuaugauauag

SEQ ID NO: 232213 - RNA, 64 nt, Human
cgcggaccucacaccugcgcagcccccuccucccacuucccacuccggguugguuuuguguuug

SEQ ID NO: 232214 - RNA, 64 nt, Human
uuucuguaucaauucaauaaauggaauugacugaacuucccaacgccacuaauuauuaaaaucc

SEQ ID NO: 232215 - RNA, 64 nt, Human
gugcacaucugcacgcuuucugcgaggccucagaacuucccagggccccucccucaaauugucu

SEQ ID NO: 232216 - RNA, 64 nt, Human
ugcuucccucgcaaacuggggucuucucuaccgaacuucccaggauuucaucucaccauaucug

SEQ ID NO: 232217 - RNA, 64 nt, Human
auuugcuucuuauccccuuaaaagaaugccuuccacuucccaacagcccccaucaagggacccc

SEQ ID NO: 232218 - RNA, 64 nt, Human
gguggcacaggaguguccucuucccucucugcagacuucccagcuaggaagagcaggacuccag

SEQ ID NO: 232219 - RNA, 64 nt, Human
ugcugcugucuuccgguaaacggaccaaguucucacuucccauccuccuccccagucucaccca

SEQ ID NO: 232220 - RNA, 64 nt, Human
cgccuucuuuucuacgugaaaucagugaggugagacuucccagaccccggaggcguggaggaga

SEQ ID NO: 232221 - RNA, 64 nt, Human
uuucuggcauagcuaccgugaguucucagcaggaacuucccagcgaugauaauguacaugaaau

SEQ ID NO: 232222 - RNA, 64 nt, Human
gcuaaugcuaccgcuuaaacgacucagcaucucgacuucccaaaucaaaggcccuuuucagggc

SEQ ID NO: 232223 - RNA, 64 nt, Human
uguagccuuucucaguguccguggcauuuuugugacuucccagcacuagaauaaguuuuccugc

SEQ ID NO: 232224 - RNA, 64 nt, Human
ugagugaggcgcuuggugcccucuggacuuucccacuucccaacaugggagaauugugaacuuu

SEQ ID NO: 232225 - RNA, 64 nt, Human
ggggguagccccgccccagcccucagucacccccacuucccacuugcagucuuguagcuagaac

SEQ ID NO: 232226 - RNA, 64 nt, Human
accaguccucuggggcacaugguuugagcucuggacuucccacauggccagcuuucuugucuau

SEQ ID NO: 232227 - RNA, 64 nt, Human
ccacccacagaccuucccuuuagcuguugacacaacuucccagcucugcaagugugcccccugg

SEQ ID NO: 232228 - RNA, 64 nt, Human
uauguaugccagaccuaauaugagcugccaccaacaccccuagaacuuucagccauggugucuu

SEQ ID NO: 232229 - RNA, 64 nt, Human
uuuuauaaaagcaaaauuaugcauaaauguaaaacaccccuaaacaaagggaacaaaugaauuu

SEQ ID NO: 232230 - RNA, 64 nt, Human
aauaagcaggauggggaacagcuugaccuucauccaccccuaacuccaaaacuaucaagguacg

SEQ ID NO: 232231 - RNA, 64 nt, Human
cucugcccugcccugccuagccucugcuacucccacuucccaacuccagggaaugcauuacuuu

SEQ ID NO: 232232 - RNA, 64 nt, Human
augaaaugccucucacccuuuccccacagcgacuacuucccacucagaggcaacaaguauuaca

SEQ ID NO: 232233 - RNA, 64 nt, Human
ccauccuugauuauuuggcuucuaggaacaguugacuucccagaaugcagugggcugcugggca

SEQ ID NO: 232234 - RNA, 64 nt, Human
gaugaaaaagaccuuuggagcaaagcugaugacaacuucccagugguggguauauucgugcauu

SEQ ID NO: 232235 - RNA, 64 nt, Human
gucaucccugugugcugcagcaucaccacggccuacuucccaauauccacaaagcuucgccuuu

SEQ ID NO: 232236 - RNA, 64 nt, Human
uuagcaaauggaggaaauuaagcaccgauguagcacuucccacugccuggagagaaauaaaccu

SEQ ID NO: 232237 - RNA, 64 nt, Human
ccgggcucagcaggggaggcugcuacggcugcccacuucccagcaccgucugucacgcuugaac

SEQ ID NO: 232238 - RNA, 64 nt, Human
uauuuugcugcuguuuaaugcgcaucuucagaaaacuucccaguggcuucaaggaauuugggga

SEQ ID NO: 232239 - RNA, 64 nt, Human
gauagauagguguuuguccuuuuaccaucgagcuacuucccauaauaaccacuuugcauccaac

SEQ ID NO: 232240 - RNA, 64 nt, Human
cuggaggacuugugcagugcuggacucacccaggacuucccaaacccagaggcugccauccuaa

SEQ ID NO: 232241 - RNA, 64 nt, Human
aagcuuucaggggaaggagagaaugauuuugcugacuucccaagcccuggugaccagaccaagg

SEQ ID NO: 232242 - RNA, 64 nt, Human
aucuucauugcaaaagcacuggcucauccgcccuacuucccaucccacacaaacccaauuguaa

SEQ ID NO: 232243 - RNA, 64 nt, Human
cugagaaacuugucuguucaugucccaaggcauaacuucccaacauuuaagaaaccccaauaga

SEQ ID NO: 232244 - RNA, 64 nt, Human
ccaucuuguaaauucauuugaguagaucauguuuacuucccaguggaaggagcacugaaaaccu

SEQ ID NO: 232245 - RNA, 64 nt, Human
caaacaagcacacuuguacaauuauuuucuggguacuucccauaugcacauagcacuguaaaaa

SEQ ID NO: 232246 - RNA, 64 nt, Human
gaguuaagaacaucaaaacuaaccaucugaagaaacuucccaaguguaagacucugccauuaaa

SEQ ID NO: 232247 - RNA, 64 nt, Human
cugcccgaggcuaguaggcugcaacccugguccccaccccuaaccuccugcucccccucaagcc

SEQ ID NO: 232248 - RNA, 64 nt, Human
gcuucaagcucuguagcaggaccugccccacgcacaccccuaccccucugugaggagcuguggg

SEQ ID NO: 232249 - RNA, 64 nt, Human
cucacagcauuccccauugcuccuggcucuuccccaccccuaggugggacagugaaggggagca

SEQ ID NO: 232250 - RNA, 64 nt, Human
aagaccccagcccaacucaagcuacagcagcagcacuucccaagccugcugaccacagucacau

SEQ ID NO: 232251 - RNA, 64 nt, Human
cucagcucuugucccugggaggccucugcuugucacuucccagagauugcagagguguguccug

SEQ ID NO: 232252 - RNA, 64 nt, Human
uguacacucuguuuguucaauaaacugcauaucaacuucccacaaaagcugacuuuuuuggguc

SEQ ID NO: 232253 - RNA, 62 nt, Human
caucucccaccuuguggaauaaauacauguuagcacuucccagagcagccuccuuugugucu

SEQ ID NO: 232254 - RNA, 64 nt, Human
cagcagccuucagccucucuggcccacucggacaacuucccaaggccgccuccugcuagcaaga

SEQ ID NO: 232255 - RNA, 54 nt, Human
cagaccauuauggcauuugacuagacuucccaaauaauuuuaauauauacuuuu

SEQ ID NO: 232256 - RNA, 64 nt, Human
uuucuauaaaaauacuacaauaguuuuaugcacaacuucccauuaaaaaugagauuucuuauuu

SEQ ID NO: 232257 - RNA, 64 nt, Human
ucaaccuagaaaccuuuaucccugcuuaucugaaacuucccaacuucccuguucuuuaagacuu

SEQ ID NO: 232258 - RNA, 64 nt, Human
gaaguaagcguucccuuuccccuucuuauuuaagacuucccaccuuacuaaauuaccagcaaaa

SEQ ID NO: 232259 - RNA, 64 nt, Human
cugauucuguuccucggcuccacugcuucaggucacuucccauggcugcaguccacugguggga

SEQ ID NO: 232260 - RNA, 64 nt, Human
uuuauacccacaagagagguaugucacucaucuuacuucccaggacauccacccugagaauaau

SEQ ID NO: 232261 - RNA, 64 nt, Human
uggacagcugcuuuugacaauaaugccccucccaacuucccauucauagaaucauaaagcgaua

SEQ ID NO: 232262 - RNA, 64 nt, Human
aucuauagcaacucauuggugguagccaucaagcacuucccaggaucugcuccaacagaauauu

SEQ ID NO: 232263 - RNA, 64 nt, Human
uuguaauauuaaguguuuugaaccucuaacauuuacuucccaaaaucaaacuucaguuucaaaa

SEQ ID NO: 232264 - RNA, 64 nt, Human
uaaaauccaguauuauauuaucauaucucucuuuacuucccaguauaagauuuuugaaaauccu

SEQ ID NO: 232265 - RNA, 64 nt, Human
uccuauuaucaaauuuggauuuccuggccccagaacuucccaaagaccuguaaaauggagggau

SEQ ID NO: 232266 - RNA, 64 nt, Human
uugguuccaaaagccagggugucuauguccaagucaccccuacucagccccacuccccuuccuc

SEQ ID NO: 232267 - RNA, 64 nt, Human
ggcaauucaaacaucugcuugauucccgccccgccaccccuaauuucugagagaauaaugguua

SEQ ID NO: 232268 - RNA, 64 nt, Human
uguuuacuuuuuugguacuauaaaagcuuucugccaccccuaaacuccaggggggacaauaugu

SEQ ID NO: 232269 - RNA, 64 nt, Human
gcugcgagcccggccccugcuguucucagcagccacuucccaggcugccucacuuuaugccaug

SEQ ID NO: 232270 - RNA, 64 nt, Human
caaagagcuucauuccacauucuuuguuaucucuacuucccacccucuuggcaacuacagagca

SEQ ID NO: 232271 - RNA, 64 nt, Human
ugcaguggugugaucacagcucacugcagccucgacuucccaggcucaagugauccucccagcu

SEQ ID NO: 232272 - RNA, 64 nt, Human
cacuucacuaaccaaauuccuacuuuccaguguuacuucccaauuuaugcaggaaaccuccugc

SEQ ID NO: 232273 - RNA, 64 nt, Human
uaaacuuguuuucuguugauuaccucuugguuugacuucccagggucuugggaugggagagugg

SEQ ID NO: 232274 - RNA, 64 nt, Human
auaauugaaguguucccuuuuucauaauuacucuacuucccaguaacccuaaggaaguugcuaa

SEQ ID NO: 232275 - RNA, 64 nt, Human
auauucuaaguuagacucuuccccucccucccacacuucccacccccaggcaaggcugacuucu

SEQ ID NO: 232276 - RNA, 64 nt, Human
aguggcacaaaaaucucggcucacugcagccuugacuucccaggcucaggcucaggugauccuc

SEQ ID NO: 232277 - RNA, 64 nt, Human
uggcagcugcugaugguguuucccaaccccccucacuucccaagacaacccccagcuucagguc

SEQ ID NO: 232278 - RNA, 64 nt, Human
acaucucugcaguuuuucccaaguacccugagauacuucccaaagcccuuauguuuaaucagcg

SEQ ID NO: 232279 - RNA, 64 nt, Human
ccuacaggagagggaagagugcauuuucccagauacuucccauuuuggaaguuuucaggacuug

SEQ ID NO: 232280 - RNA, 64 nt, Human
cuuuucauaaauccccucauaggcaaagaugaaaacuucccacuauuuuuuuccccucuuagga

SEQ ID NO: 232281 - RNA, 64 nt, Human
gaaggccgcugcucgcagggcuagguggagacacacuucccagaucaccgcaggcggguuuuac

SEQ ID NO: 232282 - RNA, 64 nt, Human
gcagacucgaaaaaacaucacauacauucuuggaacuucccagugguuuaaucuaugugcaugg

SEQ ID NO: 232283 - RNA, 64 nt, Human
caacuccucuuuggccauugucucagccucugccacuucccagaccgaaagccuggacucagcu

SEQ ID NO: 232284 - RNA, 64 nt, Human
ggucagagacaaacuguuucagagagucagauggacuucccaagacuuguugagagaugugaca

SEQ ID NO: 232285 - RNA, 64 nt, Human
aagaccaagcccccuccuccuggaaugcuccuuccaccccuaccucucagagaugggccugaca

SEQ ID NO: 232286 - RNA, 64 nt, Human
gaagucaggcuguuggcgugucccagcaccacaccaccccuaaagugccaggugaucuccugug

SEQ ID NO: 232287 - RNA, 64 nt, Human
agcugcuggugaguaugaagccugugcuauagcccaccccuacucacucucaccuucugguuga

SEQ ID NO: 232288 - RNA, 64 nt, Human
gcaguuguggaguuuaauccccuuucuuaaccucacuucccacuugcuauugaauugugaauag

SEQ ID NO: 232289 - RNA, 64 nt, Human
uccuuuugcagcaguguaauaaagucaauuaaaaacuucccaggauuucuuuggacccaggaaa

SEQ ID NO: 232290 - RNA, 64 nt, Human
ugucuuuuuauuaaccauuuguacaauaaaugucacuucccaugccguuauuuuaugguucauu

SEQ ID NO: 232291 - RNA, 64 nt, Human
uacuugcuuccacuugcagagcaccgugccaagcacuucccacacacuuacccguuugauucuc

SEQ ID NO: 232292 - RNA, 64 nt, Human
ggucuuggccucaucccucagguccccccacagcacuucccacuacugcuucugucccugcugg

SEQ ID NO: 232293 - RNA, 64 nt, Human
augaaaggugaggucacguggccucccaggccugacuucccaaccuacagcauugacgccaacu

SEQ ID NO: 232294 - RNA, 64 nt, Human
agacguggcacugagccucggcugucgagaggggacuucccacggcccguggaccuuugugcuc

SEQ ID NO: 232295 - RNA, 64 nt, Human
cggcuggaugaagcggcuuccccgcagggcccccacuucccaguggcugcuuccuggggaccca

SEQ ID NO: 232296 - RNA, 64 nt, Human
gggcuggcccugcccucccccacggccgucccugacuucccagcuggcagcgccucccgccgcc

SEQ ID NO: 232297 - RNA, 64 nt, Human
uugaaggagcacaaugcccuccuguguugaugccacuucccaggguggagacaguggaaaagaa

SEQ ID NO: 232298 - RNA, 64 nt, Human
ucacagucaagccucagaagccaacuccuuugaaacuucccaacagcagggcuuuggccaagcc

SEQ ID NO: 232299 - RNA, 64 nt, Human
caccucuagaagggacuuuggccuccccccaagaacuucccaugguagaauggggugggggagg

SEQ ID NO: 232300 - RNA, 64 nt, Human
augcagcaacuuguuuuaaaaaaaugcacaauuuacuucccaaaaaaguuguuacuugccuuuu

SEQ ID NO: 232301 - RNA, 64 nt, Human
acuugcaaauaacuggccacaucauuaaugacugacuucccaguaaggcucucuaagggguaag

SEQ ID NO: 232302 - RNA, 64 nt, Human
uggcuugggacagauagaagggaugguuggggauacuucccaaaacuuuuuccaagucaacuug

SEQ ID NO: 232303 - RNA, 64 nt, Human
gccuccauaccaauccucuuucucacagagaaccacuucccauauaagaugcuuaaggcucuca

SEQ ID NO: 232304 - RNA, 64 nt, Human
uaugaaucuauaggcucgguguguguaacacacacaccccuaucguuguccuucaaauacucag

SEQ ID NO: 232305 - RNA, 64 nt, Human
gguuccacuuaacaacuaaauacaacaucuuuugcaccccuagaaugucauuuugcccucaacc

SEQ ID NO: 232306 - RNA, 64 nt, Human
ccuucccuugccacuuugcacgacgcccucuccccaccccuaccccuggcuguacugcucaggc

SEQ ID NO: 232307 - RNA, 64 nt, Human
ggagggggugucagcucggucaccaagagaagugacuucccaggagcaccaguccccucacaga

SEQ ID NO: 232308 - RNA, 64 nt, Human
ucuaaaacugagaaaucaucauaauugugcuuucacuucccaggcuccaugugucuuggagccg

SEQ ID NO: 232309 - RNA, 64 nt, Human
uuugguaagaauagagauuuguuuuauuuaaaccacuucccauuacugaccauuaaaagcucac

SEQ ID NO: 232310 - RNA, 64 nt, Human
accaucucuuucagaaaauaaaagcagagauaacacuucccaacucauuuugugaggccaguau

SEQ ID NO: 232311 - RNA, 64 nt, Human
uuagggcaccaaaacuugggauuaaacacuuccuacuucccacucccaacuccugaaaugaagu

SEQ ID NO: 232312 - RNA, 64 nt, Human
gaggcggacagccagaugcagagcgaguggaugcacuucccagcucaucucuggaagccuuugc

SEQ ID NO: 232313 - RNA, 64 nt, Human
ugguccagugcuaugccuggaggcucaacacaaaacuucccauccaaacauucagaugaacuga

SEQ ID NO: 232314 - RNA, 64 nt, Human
uaaagaaaaguagguuuacauucaucucauuccaacuucccaguucaggagucccaaggaaagc

SEQ ID NO: 232315 - RNA, 64 nt, Human
acugucucuuucagaaaauaaaagcagggauaacacuucccaaaucauuuugugaggccaggau

SEQ ID NO: 232316 - RNA, 64 nt, Human
uuacuuauugaucuugcuagacaauaucaaaauaacuucccacauuuuccagugaaacagaugu

SEQ ID NO: 232317 - RNA, 64 nt, Human
cacuaauuugaauaaacucuccccuuucuuugcaacuucccagcaacaauaaugauuuucuugc

SEQ ID NO: 232318 - RNA, 64 nt, Human
uuccagacacuugcuggacagcuaucuuccacauacuucccaguuuacauuuggucuuaaugau

SEQ ID NO: 232319 - RNA, 56 nt, Human
gcaaccauacugcccagugacccacuacuucccagggacucucacaucucgggccc

SEQ ID NO: 232320 - RNA, 64 nt, Human
ugauauucaagcaaguucucuaggaaaaaaaaaaacuucccaacucagauuucugugucagcuc

SEQ ID NO: 232321 - RNA, 64 nt, Human
aaauccaugcaagugggagaaaguuccagugcacacuucccaugcuucugagucuaggcguugu

SEQ ID NO: 232322 - RNA, 64 nt, Human
auguaauauaucugcugucaucuuaguuggaccaacuucccauuuauuuaucuuaaaacuauac

SEQ ID NO: 232323 - RNA, 64 nt, Human
ggacaagcgguuaagcgcgacccaggcacugcagcaccccuacgugcagaggugggggugggag

SEQ ID NO: 232324 - RNA, 64 nt, Human
ucugucccuucccaaucaguguccuuuucuguuccaccccuaccaaaagcaaguagugguuugg

SEQ ID NO: 232325 - RNA, 64 nt, Human
cuucccacccucacaucugcuuagccaguagccacaccccuaaaacaucagacucaccauccag

SEQ ID NO: 232326 - RNA, 64 nt, Human
aggaggaacaucaccaugguguccuaccuagaagacuucccaggcuuggugcacuucaucuaug

SEQ ID NO: 232327 - RNA, 64 nt, Human
caauggcgugaucucagcucacucugcaaccuccacuucccagguucaagcgauucucaugccu

SEQ ID NO: 232328 - RNA, 64 nt, Human
acccugucauuacgucaacgcaacgucuaacuggacuucccaagauaaaugguaccagcguccu

SEQ ID NO: 232329 - RNA, 64 nt, Human
acuggcagagccaguguguugggguaugugcugcacuucccagggagaaaaccugucagaacuu

SEQ ID NO: 232330 - RNA, 64 nt, Human
cccugcucuacagcuaagaaaacaccauuccaugacuucccaccgcgcccucgcuccuaccucc

SEQ ID NO: 232331 - RNA, 64 nt, Human
uccuggagcuucccauuccaggagaaaaggcuccacuucccagcccuuccuugccccugacauu

SEQ ID NO: 232332 - RNA, 64 nt, Human
accuuuucccggggaggagagagcagcuucugccacuucccagguaagcaggaggaggugccaa

SEQ ID NO: 232333 - RNA, 64 nt, Human
gaucaacaaaagguuauggaagaaugguuuaugaacuucccauaggaagcaccugagagauagu

SEQ ID NO: 232334 - RNA, 64 nt, Human
aaucuguaccucaucaaucagaugaugacaauuuacuucccaggucucauacucacuuauguug

SEQ ID NO: 232335 - RNA, 64 nt, Human
cacacaaucccucacacuguggguuuuuuuuagaacuucccagacgaaaacucacgcccuugcc

SEQ ID NO: 232336 - RNA, 64 nt, Human
cuauucugaucauuugucccccuuuuaaaaauaaacuucccaugucuuccauuugugguacuaa

SEQ ID NO: 232337 - RNA, 64 nt, Human
cccgucccccaaccucuccugcucauaaauccagacuucccacagcauuuccugacucucguuu

SEQ ID NO: 232338 - RNA, 64 nt, Human
ggccuggaguaacacaaagugaaacucauaauagacuucccacucuagggcaguggagucggaa

SEQ ID NO: 232339 - RNA, 64 nt, Human
uccuaagacaggcaucaaaagaggcccuaacuuuacuucccaaauggugcuuuuuaaaaaacac

SEQ ID NO: 232340 - RNA, 64 nt, Human
ugauaucuuucauacuugaccaaaguucccaauaacuucccaaccacuguucaaaagcugugau

SEQ ID NO: 232341 - RNA, 64 nt, Human
aaccuuaguccccucucuuuccucuuccuccuccacuucccacuuauugucaccuuguaauauu

SEQ ID NO: 232342 - RNA, 64 nt, Human
uuccuuuaccuacccaaauccuauaaaacggccccaccccuaucucccuucgcugacacucucu

SEQ ID NO: 232343 - RNA, 64 nt, Human
cacuugaaaaaugcaggugguaggggcacugacccaccccuacgccccgcacagucaaaaaucu

SEQ ID NO: 232344 - RNA, 64 nt, Human
ccagggcuccuggauguccuuccucaacucccuccaccccuagacaauccuaccuggucccauc

SEQ ID NO: 232345 - RNA, 64 nt, Human
ugguucauaugcuucuugaaccaagucacagggcacuucccagccacauugccaggcaacagga

SEQ ID NO: 232346 - RNA, 64 nt, Human
cugaucuuugaaaacacuacacagggcugcugucacuucccagggcccaggccucagcccaggc

SEQ ID NO: 232347 - RNA, 64 nt, Human
cuuuuuuucucugcauuuaaaaaaaucccccagcacuucccacagugccuauugauacuugggg

SEQ ID NO: 232348 - RNA, 64 nt, Human
uucuuguugcuguacaaaagcaaugguugaugauacuucccacaccacaaaugggacacauggu

SEQ ID NO: 232349 - RNA, 64 nt, Human
cagagagaagauggaacucuggagcacuucagagacuucccagagcuucuuccaagggagaaga

SEQ ID NO: 232350 - RNA, 64 nt, Human
aaaacuauauauauauguauauguagagaaaaauacuucccauugaucauuuuuaaaaggcuuc

SEQ ID NO: 232351 - RNA, 64 nt, Human
agcugcuggcaaaugccccauucccugccccagcacuucccagccuuuccaggagcucugcccc

SEQ ID NO: 232352 - RNA, 64 nt, Human
uggccccacacugugccaccggacaaucgagaccacuucccauccaggccucuuccccuuucca

SEQ ID NO: 232353 - RNA, 64 nt, Human
guaacacuugcagccaaguucccugguuucugggacuucccaucuuacccauuccuuuuccagg

SEQ ID NO: 232354 - RNA, 64 nt, Human
cuccuguagauuacuccugaaccgugucccugagacuucccagacgggaaucagaaccacuucu

SEQ ID NO: 232355 - RNA, 64 nt, Human
cauuugagcaggugugccuucgcagcuccccuaaacuucccaggugccucauccauaaugagau

SEQ ID NO: 232356 - RNA, 64 nt, Human
ucuguagagucagcacagccccaucaguccaggaacuucccaccaccagcccuugacuguccca

SEQ ID NO: 232357 - RNA, 64 nt, Human
uuauuccuuccagucaggguguguccuauacaaaacuucccaucaguucuccucaauauucccc

SEQ ID NO: 232358 - RNA, 64 nt, Human
ccuccuggcuggaaccaugagaaggaagcucaguacuucccacagugucccuguugauaacugu

SEQ ID NO: 232359 - RNA, 64 nt, Human
cgcauuauuugagauaaacccagaauuguaggaaacuucccaucacaauaacaaagguucaaua

SEQ ID NO: 232360 - RNA, 64 nt, Human
guggaagagucaggacagguuggucuccagccccacuucccaaauaugccucagccccacuagc

SEQ ID NO: 232361 - RNA, 64 nt, Human
uuuggcacucagauucuacucuacuucaccuaaccaccccuagaucugaguuuucagagugcuu

SEQ ID NO: 232362 - RNA, 64 nt, Human
cccuggcaggggauggggacaugaugcccagagccaccccuauacuccagucucccuggcauca

SEQ ID NO: 232363 - RNA, 64 nt, Human
cagcgcaggccccacugauggccggggccccugccaccccuaacucucauucauucccuggcug

SEQ ID NO: 232364 - RNA, 64 nt, Human
gaggguuguggcccgaggcugcagucagagguauacuucccauagugcuucacacagcuccccu

SEQ ID NO: 232365 - RNA, 64 nt, Human
accuccuccccagcuggucccuacagggcugcucacuucccaucaccucucacagccaccugga

SEQ ID NO: 232366 - RNA, 64 nt, Human
acacgugauguccccaaacugcugcuauugaagaacuucccaaaacuucuuuacaaagcccuaa

SEQ ID NO: 232367 - RNA, 64 nt, Human
guccaucacccaauaccaccccaaacacaacucaacuucccacaccaccaugucucucaccaca

SEQ ID NO: 232368 - RNA, 64 nt, Human
ugacagucaaguaguccaucagaaauuggcagucacuucccagauuguaccagcaaauacacaa

SEQ ID NO: 232369 - RNA, 64 nt, Human
gacugugguucccuucuggacagucacaccagggacuucccagugaacaagggggcauaggcuc

SEQ ID NO: 232370 - RNA, 64 nt, Human
gggccauugaggagcuucaucuguauuuauggcuacuucccaucacucgaauuaccaccugaac

SEQ ID NO: 232371 - RNA, 64 nt, Human
cuccaaugcucaagugaagucacaucugccuguuacuucccagcauugacugacuauaagaaag

SEQ ID NO: 232372 - RNA, 64 nt, Human
ccuggucccaccccugccgugaagccccaggcccacuucccaagaaucucacuucucagggccu

SEQ ID NO: 232373 - RNA, 64 nt, Human
ucauuccaugacccggcucuggaucccacacuguacuucccacagcccacucucagcuccaucu

SEQ ID NO: 232374 - RNA, 64 nt, Human
cucuaaaaucucagcacugccccauggguccuagacuucccagggcaagaggaagacccugcca

SEQ ID NO: 232375 - RNA, 64 nt, Human
gucauagcaaauaugggaccaucaccagcuuaccacuucccacucacggauaagacaccaagac

SEQ ID NO: 232376 - RNA, 64 nt, Human
guccuuccucucucuuucauccacacuucuguuaacuucccaccaccaucaaucaucugauuuc

SEQ ID NO: 232377 - RNA, 64 nt, Human
uuuauaaacugcuguauuuggaaaccccuucuuuacuucccaggccagcaagcucuucacugaa

SEQ ID NO: 232378 - RNA, 64 nt, Human
uuguggccucgaaggaagcacaaacccuccauccacuucccauuuccucugcccuuuuccaccu

SEQ ID NO: 232379 - RNA, 64 nt, Human
uacugagugaagaaagacgggaaugaugucccauacuucccagcucucuaaaguguuaugcugu

SEQ ID NO: 232380 - RNA, 64 nt, Human
ucuagcuaaugugugguuucuccuucccugcccccaccccuaggcucaccucugcagucuuuua

SEQ ID NO: 232381 - RNA, 64 nt, Human
cgaauccuuugccccuucaccuuuaccccgcccgcaccccuaggcccucucagccuuccuauca

SEQ ID NO: 232382 - RNA, 64 nt, Human
ucaggcuaagacccuguguccuccaccaugcacucaccccuagcccugguuagcugacagucag

SEQ ID NO: 232383 - RNA, 64 nt, Human
aauaggagucaugggcguuaguucuguaguaauaacuucccagcaccuggacaucucuuccaga

SEQ ID NO: 232384 - RNA, 64 nt, Human
uauucugguacuaucagaacaaauacauaaaauaacuucccauagagaacaggauauagcaaua

SEQ ID NO: 232385 - RNA, 64 nt, Human
augauaguuauuauauuauaugacgacuucauucacuucccaaaucacaggguggugcuucugu

SEQ ID NO: 232386 - RNA, 64 nt, Human
guaacuguugcaguuuuagacucagcauugugacacuucccaagaaggccaaaccucuaaccga

SEQ ID NO: 232387 - RNA, 64 nt, Human
ucagacacugaaucagccagugccuugcucuuggacuucccagcccccagaacugugagaaaua

SEQ ID NO: 232388 - RNA, 64 nt, Human
caugacuuuauaaugucuaguaaacaauauuucuacuucccacaucuuugcuuuacacagucac

SEQ ID NO: 232389 - RNA, 64 nt, Human
ccucagcgcgagauuaggaguucaaacaauggugacuucccagagcccgcuggcagagccgcgg

SEQ ID NO: 232390 - RNA, 64 nt, Human
ccuaaauaaauaauuucguaagcauauacaauccacuucccacuaagaauuagggucaaagaca

SEQ ID NO: 232391 - RNA, 64 nt, Human
aggccacugcaaagauuccagccuggguccaggaacuucccaggagagccagcugggaagcagu

SEQ ID NO: 232392 - RNA, 64 nt, Human
gcccuccucccuagggagcaagugccuuccacuuacuucccauccaggucucagaggucucaag

SEQ ID NO: 232393 - RNA, 64 nt, Human
uuauagcacgucuccuugauuuuugguaguaucaacuucccagugaucuguucaguuaaguucu

SEQ ID NO: 232394 - RNA, 64 nt, Human
aggggaugaguuccaucagaaggugcccagcgcuacuucccagguuuuuauuuuuuuuuuccua

SEQ ID NO: 232395 - RNA, 64 nt, Human
cccgucaccgaaucggacacucauccuuucucacacuucccacacaugauccuucuucccuuca

SEQ ID NO: 232396 - RNA, 64 nt, Human
ugaaucaaagaagcgcgacaauucuggacagucaacuucccaugaaauaaaguccccuuuuuac

SEQ ID NO: 232397 - RNA, 64 nt, Human
gcggcgggggcgggcccgugccugcugugccccgacuucccacaccagccgcgcccaccgcagg

SEQ ID NO: 232398 - RNA, 64 nt, Human
uggguacgggguugcucugccggaggcugccgcaacuucccagauacuuucuggaccaacccuc

SEQ ID NO: 232399 - RNA, 64 nt, Human
caaagaggagccagcccucugcucuccaucuccccaccccuagaaacagggcuggaaaucuccc

SEQ ID NO: 232400 - RNA, 64 nt, Human
gcugaugauggaugccccuaacaccugugccuaacaccccuacugaaccccacagcuccagccu

SEQ ID NO: 232401 - RNA, 64 nt, Human
gucuaggaggggcauuuuggagacugccugacaccaccccuauccccugccucccccucucaga

SEQ ID NO: 232402 - RNA, 64 nt, Human
caaccagcgcuccagauaaccucagggaaccagcacuucccaaaccgcagacuacaucuuuaga

SEQ ID NO: 232403 - RNA, 64 nt, Human
ucugcuucuauugcauauuguaaaauuauuaacuacuucccaaaauaguauuucucucagcaga

SEQ ID NO: 232404 - RNA, 64 nt, Human
acaggaacugcgucugcuggcaccuugaucuugaacuucccagccuccagaacugugagaaaga

SEQ ID NO: 232405 - RNA, 64 nt, Human
uccuauugucuuguaaaucaaacucuaagugaaaacuucccauuugucccuucaaagauuuuuu

SEQ ID NO: 232406 - RNA, 64 nt, Human
cgcccucugcagacugggcuuagcgugagcaggcacuucccauguacgugccaaggguaagcug

SEQ ID NO: 232407 - RNA, 64 nt, Human
uguaaagccagccaugcauuguuaaucauccaucacuucccauuuuauggaauugcuuuuaaaa

SEQ ID NO: 232408 - RNA, 64 nt, Human
gcccggccuccuaaaggccacacccuccccacgcacuucccaggccagaauccaaacaucggga

SEQ ID NO: 232409 - RNA, 64 nt, Human
uaggccuaaaguacucaguuuuaagacaaacacuacuucccaugcgggguacuuuccuuauggu

SEQ ID NO: 232410 - RNA, 64 nt, Human
ucuaacuccugggcucagugauccucccguuucgacuucccaaagugcugggauuacaggugug

SEQ ID NO: 232411 - RNA, 64 nt, Human
ucacaagcaaaaucagccagcacuuugaucacggacuucccagccucuaggacugugagcaaua

SEQ ID NO: 232412 - RNA, 64 nt, Human
ggaaugauugguucuuagaaaucucuccugccagacuucccagaccuggcaaagguuuagaaac

SEQ ID NO: 232413 - RNA, 64 nt, Human
ucauccugguggccuuaacuacaguggagguggaacuucccaggaggggaagggacagaccagc

SEQ ID NO: 232414 - RNA, 64 nt, Human
ccccucuggagggcuauggccucccuaugcuuucacuucccaccucucuaccuaaguuccuucc

SEQ ID NO: 232415 - RNA, 64 nt, Human
ucugccuggggcccacugcaucugauuggcagucacuucccaugagggccuggcccacccgcug

SEQ ID NO: 232416 - RNA, 64 nt, Human
gccagguuuuggggaugugucuuacugugcuucaacuucccaaggaauugaaagucaaccuaac

SEQ ID NO: 232417 - RNA, 64 nt, Human
acacacccccaagccacagggaagcauguacuguacuucccaauugccacauuuuaaauaaaga

SEQ ID NO: 232418 - RNA, 64 nt, Human
cacuaggaggcugaucuuguacuccauaugaccccaccccuaggaacccccagggaaaaccagg

SEQ ID NO: 232419 - RNA, 64 nt, Human
uugagacccugaaucccugggcuguuguuccugucaccccuaauuaauaugugagagacaacag

SEQ ID NO: 232420 - RNA, 64 nt, Human
gugacagaauguucugccuucccuuccaucucuucaccccuagcugucaguuuggcagauuuuc

SEQ ID NO: 232421 - RNA, 64 nt, Human
ccaugcaaugcagagggacaaagggcugugcuacacuucccaguuacauucugaagcucauaaa

SEQ ID NO: 232422 - RNA, 53 nt, Human
agcgcugccgccggaccugacugacuucccaguggaacugccuucuugggcug

SEQ ID NO: 232423 - RNA, 64 nt, Human
gcaccagucucagggcccugggaccagcugcccuacuucccagguuuguagccaggagaagggg

SEQ ID NO: 232424 - RNA, 64 nt, Human
ggacagccuuucagcgaaguaggagaagugaaagacuucccagaccuggcugucuugggcgcag

SEQ ID NO: 232425 - RNA, 64 nt, Human
cauugcuagugcuuccccucaccucccacucuccacuucccaguuugcaaauguggcuuucgcc

SEQ ID NO: 232426 - RNA, 64 nt, Human
auguucauuugauacacaagugaacuggaaagucacuucccauagaagcaaaaguacuuauuuu

SEQ ID NO: 232427 - RNA, 64 nt, Human
aguccagccugaccuuucugcacacuccagacaaacuucccagacaagcuccuuugugccucua

SEQ ID NO: 232428 - RNA, 64 nt, Human
cccuggaggaggcuuugggaccaccccuggggggacuucccaaagggucccaggcugucagggg

SEQ ID NO: 232429 - RNA, 64 nt, Human
ccuccauccuacccccugugccuugucacgccagacuucccacggcuccucgagaucccaacac

SEQ ID NO: 232430 - RNA, 64 nt, Human
ugggaguucccacauggacagccagggcauaaacacuucccaccccggcucagccaguuccugg

SEQ ID NO: 232431 - RNA, 64 nt, Human
cccauucgccuucccagaauauccuucaaguuccacuucccagggagcucugggggaggggcgg

SEQ ID NO: 232432 - RNA, 64 nt, Human
ggaccgagaaggacuuuucccagucuucaguggcacuucccaagaucucccuucccuugugcuc

SEQ ID NO: 232433 - RNA, 64 nt, Human
aaguaccuuccucccacacugccaaguauacacaacuucccaguaaaugguuguggggaggaaa

SEQ ID NO: 232434 - RNA, 64 nt, Human
ccuaucuucucccccacgguauccuaaacuuuagacuucccacuguucugaaaggagacauugc

SEQ ID NO: 232435 - RNA, 64 nt, Human
ggggacucaagaggaaucuguuucucugcugucaacuucccaucuggcucagcauagggucacu

SEQ ID NO: 232436 - RNA, 64 nt, Human
caccaucacugugugaagcuuucaagagcuugguacuucccagggcuaccggcaguccucugua

SEQ ID NO: 232437 - RNA, 64 nt, Human
cugccccuaaggcugugucccuguggucuccagccaccccuaccccagucacucgccccuuccu

SEQ ID NO: 232438 - RNA, 64 nt, Human
cagagacagauaccuccaacccugccgucaccaccaccccuaccacauauguccacaugaccaa

SEQ ID NO: 232439 - RNA, 64 nt, Human
uaguggcuuauaauggugacagguucucauguggcaccccuaggaccugugcagacaguagucu

SEQ ID NO: 232440 - RNA, 64 nt, Human
gguguggggcagucuggguccucucaucauccccacuucccaggcccagccuuuccaacccugc

SEQ ID NO: 232441 - RNA, 64 nt, Human
aucacaccccugagcagaguuagggaggaauucuacuucccauaaaaggaccucuccugagagg

SEQ ID NO: 232442 - RNA, 64 nt, Human
ugaaaaaggcaagccacagaaauguguauagcgcacuucccauuuguguuucagaaaggaguag

SEQ ID NO: 232443 - RNA, 64 nt, Human
aggagcuacugugcucaucuaaaguguuugccccacuucccaccccgucuccagccccuguacu

SEQ ID NO: 232444 - RNA, 64 nt, Human
uauguuucucuggagauuccugcaaccucaagagacuucccaggcgcucaggccuggaucuugc

SEQ ID NO: 232445 - RNA, 64 nt, Human
uacuaggaaggagugagguguguucccaccguacacuucccacacgagcugcggcugccagccu

SEQ ID NO: 232446 - RNA, 64 nt, Human
cagugggaaggggaguguaauggcaaacgaggucacuucccauucacacauguccgucugcugg

SEQ ID NO: 232447 - RNA, 64 nt, Human
augagcaaacucuauaagaguguuuuaaaaauuaacuucccaggaagugaguuaaaaacaauaa

SEQ ID NO: 232448 - RNA, 64 nt, Human
guaaugcuucacccugaaaggcaagcuaacgcuaacuucccaggugacaguagcaggaacaagg

SEQ ID NO: 232449 - RNA, 64 nt, Human
gcauucucuggaaugcaaggaggagacuucauuuacuucccaauaaacuucauuucucuggcau

SEQ ID NO: 232450 - RNA, 64 nt, Human
gguggugggagggauagaaaucacauccgccccaacuucccaaagagcagcaucccucccccga

SEQ ID NO: 232451 - RNA, 64 nt, Human
guccugcguccucuguccccggguuucagagacaacuucccaaagcacaaagcaguuuuucccc

SEQ ID NO: 232452 - RNA, 64 nt, Human
ucaaauuuuauuaauauuuuaagcacuuuuuugaacuucccaaccuuguuugaagcuguuauuu

SEQ ID NO: 232453 - RNA, 64 nt, Human
uugagaccucguucucucggagugagccaaacacacuucccaaaacguccccagccacagcugg

SEQ ID NO: 232454 - RNA, 64 nt, Human
ccagccagggacauagccagggaggggccacaucacuucccacuggaaaucucuguggucugca

SEQ ID NO: 232455 - RNA, 64 nt, Human
gacugguugggauuugcucguccagccucuagacacuucccaaagcaagacuggacacaugccg

SEQ ID NO: 232456 - RNA, 64 nt, Human
aaagucuccaccccuacacaaggacagaacccuccaccccuacccccaacccucagacagacuu

SEQ ID NO: 232457 - RNA, 64 nt, Human
caugcacccuggacuucucuaauagaaaagucuccaccccuacacaaggacagaacccuccacc

SEQ ID NO: 232458 - RNA, 64 nt, Human
gccauuuccccagguccuuccuucugcaucucaccaccccuaguuacaaauaacuccauugaac

SEQ ID NO: 232459 - RNA, 64 nt, Human
ucuucugccuucuuucuugaguuugcuccuguugacuucccacagcacagauaauugacauguc

SEQ ID NO: 232460 - RNA, 64 nt, Human
gcacacuguuucuaaaaguaggagaggaaagaacacuucccaacuuacucuaggucaguauuac

SEQ ID NO: 232461 - RNA, 64 nt, Human
gagcaccugcagcaaucugguccccagucgcacaacuucccacauacccagaggagagcauaug

SEQ ID NO: 232462 - RNA, 64 nt, Human
augguagugacauuggugagacaacagcccuaacacuucccaggaacugaagugccucauguga

SEQ ID NO: 232463 - RNA, 64 nt, Human
cggcagcaucuguccccagaaucaggcagaauccacuucccaaacagagccccacgcagguuca

SEQ ID NO: 232464 - RNA, 64 nt, Human
uccccaggccuugcuggggugcagggguauaucaacuucccauuagcaggagcuccccagcggc

SEQ ID NO: 232465 - RNA, 64 nt, Human
gcaccgagaccaaacucauucaccaaaugaugccacuucccagaggcagagccugagucacugg

SEQ ID NO: 232466 - RNA, 64 nt, Human
acucuuggaccagcccgcccugaccaccagcucuacuucccaacccccacugccugagaggucu

SEQ ID NO: 232467 - RNA, 64 nt, Human
auaucugggaucccgauguucuuaauaaauccugacuucccaagaaaugcuucuuuuuuaaguu

SEQ ID NO: 232468 - RNA, 64 nt, Human
cauuagguauggagagcugggaggaggcauugucacuucccaccaggaugcaggacuugggguu

SEQ ID NO: 232469 - RNA, 64 nt, Human
gaugagugugauaggggugcucuucaagacuuagacuucccauuuuccucagaaaauccacaca

SEQ ID NO: 232470 - RNA, 64 nt, Human
aucguccuccuccaccugcgccucccuugucugaacuucccaacgccuuccuauuccuuuccaa

SEQ ID NO: 232471 - RNA, 64 nt, Human
cugcugcccuggguacccagaagaucaucuguuuacuucccagacacugugcugucucugcucu

SEQ ID NO: 232472 - RNA, 64 nt, Human
uucuuuguggcucagugccaaugugucccacagaacuucccacuguggaucugugacccugggc

SEQ ID NO: 232473 - RNA, 64 nt, Human
ugugauccuagcacuuugggaguuaaaauacaacacuucccagcugcccuuauaguuaaggucu

SEQ ID NO: 232474 - RNA, 64 nt, Human
ccagacauggacuaugccagugccuugauauuggacuucccagccucccaaaccaugagaaaua

SEQ ID NO: 232475 - RNA, 64 nt, Human
ggguugcacaguguaauccuacaccuuuugcuaacaccccuacuaggucccagagggccagaaa

SEQ ID NO: 232476 - RNA, 64 nt, Human
cuggcccagcucccaguucccccugcaccagccccaccccuagagucccuucuauagggagggg

SEQ ID NO: 232477 - RNA, 64 nt, Human
uauuuccuucccuucccugugcagcauucaaaaucaccccuagaaaaagugaguguuuuaauga

SEQ ID NO: 232478 - RNA, 64 nt, Human
aaggggcuccccuagagaggguggggguguaguuacuucccaguuggccagaaaacugggccuu

SEQ ID NO: 232479 - RNA, 64 nt, Human
cauaucauccuuggagaggaaguaaucaaccuuuacuucccaagcuguuuguucuccacaauag

SEQ ID NO: 232480 - RNA, 64 nt, Human
ggcucucagaaauuuuuaguuccuuuuuccaccaacuucccaccccuguuucucccccucccag

SEQ ID NO: 232481 - RNA, 64 nt, Human
aaaguggguggugggcccccuucacgugggacccacuucccaugcuggaugggcagaagacauu

SEQ ID NO: 232482 - RNA, 64 nt, Human
ucagcuccuccccuuucaccaccagcuccucuccacuucccaagggagacuccggcaaccuuca

SEQ ID NO: 232483 - RNA, 64 nt, Human
aacacaucaggcacugcgccaccugcuucacaguacuucccaacaacucuuagagguaggugua

SEQ ID NO: 232484 - RNA, 62 nt, Human
aagaccucaccaccuccuagaagacaggcgggacuucccaguggugcauccaaaggggagcu

SEQ ID NO: 232485 - RNA, 64 nt, Human
uaaaugccuuuauauuucacaggcuguaaauugaacuucccacacgauuagcuuuauuauggcu

SEQ ID NO: 232486 - RNA, 64 nt, Human
aacguggucagaacacagaaucugaguuggucacacuucccacugauccauggggccuuuaagc

SEQ ID NO: 232487 - RNA, 64 nt, Human
cucgaacuccugaccucgugauccgccugccucgacuucccagagugcugggauuacaggcgug

SEQ ID NO: 232488 - RNA, 64 nt, Human
uacaaggauuuacacaugcuuccucuggugcuuuacuucccaaaccuaaaaaagcaaugaaaua

SEQ ID NO: 232489 - RNA, 64 nt, Human
uagaaaauuccgcuugaccuuuggugcacugcccacuucccagcuccacuggcccaagucugag

SEQ ID NO: 232490 - RNA, 64 nt, Human
ggacacgguggccacucgcggucugugucaugacacuucccauucacaucauuggccugcguug

SEQ ID NO: 232491 - RNA, 64 nt, Human
ggacgagcuccaagcaaagccuggcucugggaaaacuucccauucuuagucaacccccuuauug

SEQ ID NO: 232492 - RNA, 64 nt, Human
cagacaacugcaccuacugauguuuugauguugaacuucccagccuccagaacucugggaaaau

SEQ ID NO: 232493 - RNA, 64 nt, Human
uggcuguggggguguaagaaugacugcaacaggcacuucccaacaauggccugcuguucacaug

SEQ ID NO: 232494 - RNA, 64 nt, Human
aaaaauacaaaaaaauuagccaggcgugguggugcaccccuaaaaucccagcuacuugagagac

SEQ ID NO: 232495 - RNA, 64 nt, Human
ugauacauagauaagggcuuuuucuccccgcaaacaccccuaagaaugguucuguguaugugaa

SEQ ID NO: 232496 - RNA, 64 nt, Human
ggcuggaggcaagcuaugaacuugcucgcuggcccaccccuaagacugguacccauuuccuuuu

SEQ ID NO: 232497 - RNA, 64 nt, Human
cucuacccaugagccugcccgcugcaaugccuagacuucccaacagccuuagcugccagugcug

SEQ ID NO: 232498 - RNA, 64 nt, Human
ccagaugcugaaucugcuggugccuugaucuuggacuucccagccucuagaacuguaagaaaua

SEQ ID NO: 232499 - RNA, 64 nt, Human
agcaggagaggggagugggcugguucuucccaccacuucccaggcucugacagccgagacucau

SEQ ID NO: 232500 - RNA, 64 nt, Human
cgaacuccuggacucaagcaauccgcccaccuugacuucccaaagugcugggauuaugggcggg

SEQ ID NO: 232501 - RNA, 64 nt, Human
cuguccaucuuauuacauuuguguaguaaaugguacuucccagccucucuuuugccccauucug

SEQ ID NO: 232502 - RNA, 64 nt, Human
cuuccuuccucccaaguacucaccaaccccuuccacuucccacuucccccaggcuuggggggaa

SEQ ID NO: 232503 - RNA, 64 nt, Human
gugggcccuggugaagcagggugguccugcguccacuucccaagccugagccaagcucaucuuc

SEQ ID NO: 232504 - RNA, 64 nt, Human
guguaacaugacaacgccagggugaacacacgccacuucccagcuaggagugcacuuuauggga

SEQ ID NO: 232505 - RNA, 64 nt, Human
agccgcagagaauaaacgccuucccaaaauggcaacuucccacagccacauuucagaccugcug

SEQ ID NO: 232506 - RNA, 64 nt, Human
gccccggggcuaugggcaaaugccccuccuucuuacuucccagaauccccugacauucccaggg

SEQ ID NO: 232507 - RNA, 64 nt, Human
agcaagcaaccacaaaaccagagcggaaggagggacuucccaccggcauccggccccagugcca

SEQ ID NO: 232508 - RNA, 64 nt, Human
uucccucccagccacgugccaguggccacagcccacuucccaacccacuguuguacccaggccu

SEQ ID NO: 232509 - RNA, 64 nt, Human
cagggggcugcuuuccugggccaggcuguguagcacuucccacccucaggcaugaguacagacu

SEQ ID NO: 232510 - RNA, 64 nt, Human
gcugggaccucugccuccccacugcagcccucgaacuucccaggcacccuccuuucugccccag

SEQ ID NO: 232511 - RNA, 64 nt, Human
cccagcugaggagcaggugucccugagaacccaaacuucccagagaguaugugagaaccaacca

SEQ ID NO: 232512 - RNA, 64 nt, Human
gagaaucccccuacccucgaaggccgcccuaacaacuucccauccgcugaccccuccaacgcca

SEQ ID NO: 232513 - RNA, 64 nt, Human
auguguguauaaaauaaacauacacacacacacacaccccuauguaguuuuuaaaacacuggca

SEQ ID NO: 232514 - RNA, 64 nt, Human
cacacacacacacacacacacacacacacacacacaccccuagagaaaaguacagauuuccagu

SEQ ID NO: 232515 - RNA, 64 nt, Human
uuuuuuccuccacacguuugauuuuugacacauacaccccuaauucccucaacagcagaaccua

SEQ ID NO: 232516 - RNA, 64 nt, Human
ccuccaagacgcugggggucuuggcugcugccuuacuucccagaggcuccugcugacuucggag

SEQ ID NO: 232517 - RNA, 64 nt, Human
aaagacuaguuuacaaaggagaaagaggcccuggacuucccaaggaaagggucagguuagggcu

SEQ ID NO: 232518 - RNA, 64 nt, Human
cccagcugaggagcaggugucccugagaacccaaacuucccagagaguaucugagaaccaacca

SEQ ID NO: 232519 - RNA, 64 nt, Human
gaagaggcagaagccgugggugugccuagggccuacuucccaaggugccacaggcccaugaugg

SEQ ID NO: 232520 - RNA, 64 nt, Human
gagaagguggugggcuaguccuguguccuccuccacuucccaugccucuauguuacccaucugu

SEQ ID NO: 232521 - RNA, 64 nt, Human
gcucccgugucguaacagcaggagcauggccgcaacuucccaggccgaggaagggcccccggcu

SEQ ID NO: 232522 - RNA, 64 nt, Human
cacugcccagccugcacagauuuccauuugaaguacuucccauccacccugacacccaaagggg

SEQ ID NO: 232523 - RNA, 64 nt, Human
aagagaacuccagcauagagccuuauagcaacugacuucccaguuaagucccaguguaaggguu

SEQ ID NO: 232524 - RNA, 64 nt, Human
uuccugcuagaaaugggaaaugccuaagaagaugacuucccaacugcaagucacaaaggaaugg

SEQ ID NO: 232525 - RNA, 64 nt, Human
ugagcccccaaaagguuguuucugaagcucgaguacuucccaaugccgcuacuuugcuguggac

SEQ ID NO: 232526 - RNA, 64 nt, Human
gccugacauccuagcuccugacugaacacuauagacuucccagcagcauuucacccagcagcca

SEQ ID NO: 232527 - RNA, 64 nt, Human
agagaugaccucaaggcccaccaaauagagcacaacuucccauugggagcuuuggcuuuugauc

SEQ ID NO: 232528 - RNA, 64 nt, Human
cccagaacugaggaggggcacugcccugggccuuacuucccagcccuggccuccaauucugacc

SEQ ID NO: 232529 - RNA, 64 nt, Human
ccucuggcuuggagagcauuccaagcccccaccccaccccuagaacugccauucccaagaccuc

SEQ ID NO: 232530 - RNA, 64 nt, Human
cccggcccucccuggcaaucccugggcucucuugcaccccuaacugcccccugccugcuccggc

SEQ ID NO: 232531 - RNA, 64 nt, Human
cagguccagcacccaugggggcgggggagaggcucaccccuacguccccccacaccuggaggcu

SEQ ID NO: 232532 - RNA, 64 nt, Human
aacccgaggggccggggaagcugccagcccagaacaccccuaaugagggugugagaagugccuu

SEQ ID NO: 232533 - RNA, 64 nt, Human
ccuccuggaacagaagacagcugcugggucaggccaccccuaggaacucaguccuguacucugg

SEQ ID NO: 232534 - RNA, 64 nt, Human
gguaccaucccugagcuggcugccuggcccugcucaccccuacgccucgcccuugccaggaggg

SEQ ID NO: 232535 - RNA, 64 nt, Human
gcagcgcugauccauggagacugcgagaccguggcaccccuacugcuggagaccacaguccuga

SEQ ID NO: 232536 - RNA, 64 nt, Human
ccaaauuaugcauuaguaacuuuuuccucagagacaccccuaaaggcucccauuaggucacagc

SEQ ID NO: 232537 - RNA, 64 nt, Human
cccuucccagugggcuguguugacugcugcuccccaccccuaccgauggucccaggaagcaggg

SEQ ID NO: 232538 - RNA, 64 nt, Human
cggaaacccagggaaccucucugaagugacaccucaccccuacacaccguccguucacccccgu

SEQ ID NO: 232539 - RNA, 64 nt, Human
gaaccaccacacccagcagcuccugacagacccccaccccuaaagauguguccugaugacuaua

SEQ ID NO: 232540 - RNA, 64 nt, Human
uuaaaaauguugcagcucauaaagaauugggacucaccccuacugcacuaccaaauucauuuga

SEQ ID NO: 232541 - RNA, 64 nt, Human
uggacgagggcagaaccacaacgugcaaggguuccaccccuaccgacgcuagcccgcggcgccg

SEQ ID NO: 232542 - RNA, 64 nt, Human
ccccuguaccccccuugcccugccauucacccuccaccccuaccccugggcggccugcugcuuu

SEQ ID NO: 232543 - RNA, 64 nt, Human
auaaaagcaaaggaugcagacuuaccccacccuccaccccuagcucagccagauccuuacacgu

SEQ ID NO: 232544 - RNA, 50 nt, Human
uccagcuggagaagccgugacaccccuacuccugccaggcugcccccgcc

SEQ ID NO: 232545 - RNA, 64 nt, Human
ggggaggggguucuuggugcuacagcccucuccccaccccuaaagggacgccgacgcuguuugc

SEQ ID NO: 232546 - RNA, 64 nt, Human
caccaucgcagccaaccccugagugccccugucccaccccuaccucuaguaaauuuaaguccac

SEQ ID NO: 232547 - RNA, 64 nt, Human
ugccaauuucugaggcugaagccauuucacauuucaccccuaccaccuggcaggugcacaccau

SEQ ID NO: 232548 - RNA, 64 nt, Human
gaaacaaggccuggugccugugaggaagagaggucaccccuacccucccuccccgcuucccugc

SEQ ID NO: 232549 - RNA, 64 nt, Human
gaggguccaauccuaggacagccuuguuccucagcaccccuagcaugaacuugugggauggugg

SEQ ID NO: 232550 - RNA, 64 nt, Human
cgaggccccuugauuguuucugugaaacacccugcaccccuaguccuuuccccacugagaucuu

SEQ ID NO: 232551 - RNA, 64 nt, Human
cucaagaagaaacccaccauaaccagcccacugucaccccuaauuuacagacaccaaaacaguc

SEQ ID NO: 232552 - RNA, 64 nt, Human
ccgccugcagaggacagagcuggcugucuucccccaccccuaaccuggcuuauucccaacugcu

SEQ ID NO: 232553 - RNA, 64 nt, Human
uuuuugucucgcggagccccgggucucgguuauccaccccuaccucccagugucuaagccacga

SEQ ID NO: 232554 - RNA, 64 nt, Human
gaacuggauugauaacccucaucugcaauauuuucaccccuaaaauuuuuaacaggguuuccuu

SEQ ID NO: 232555 - RNA, 64 nt, Human
cccaaugacuucugcuuccaucucacuaaccacccaccccuaccuggaauggaggcugggagau

SEQ ID NO: 232556 - RNA, 64 nt, Human
gguaccaauccuggcaggaagucucucccgauaucaccccuaaauccaaaugaggauaucaucu

SEQ ID NO: 232557 - RNA, 64 nt, Human
acugaugagccaguugcucauuugugcugauuaacaccccuaauaagggguuggggugcccaua

SEQ ID NO: 232558 - RNA, 64 nt, Human
aggcaguaguccuagccugguaaagacccuccaccaccccuauaaguuugauugcuaugcaggu

SEQ ID NO: 232559 - RNA, 64 nt, Human
ggguugaccaauuugguauugaauguugcccagccaccccuaggaacaccuguccaucaccucc

SEQ ID NO: 232560 - RNA, 64 nt, Human
aagugcuagccacuggaaaugcaugacuucccuccaccccuacucuauucuguaguuuuuuggu

SEQ ID NO: 232561 - RNA, 64 nt, Human
cucccuaucccugcagccugagggucccuucagccaccccuaaguccccaccugggcuccugcc

SEQ ID NO: 232562 - RNA, 64 nt, Human
ggcgcccgcggucccccagcaccugcccaagccacaccccuagcuucccucccuaucccugcag

SEQ ID NO: 232563 - RNA, 64 nt, Human
uauggcacccugggagcccggcauauacccagggcaccccuacggcugccgccagucucaugcc

SEQ ID NO: 232564 - RNA, 64 nt, Human
ggguguuguuagagcgucucgugugugcuagacgcaccccuacucguuccuauagaacacagag

SEQ ID NO: 232565 - RNA, 54 nt, Human
cugggauaagguuccuguagccgacaccccuacaggagaagcucugggacuggg

SEQ ID NO: 232566 - RNA, 64 nt, Human
cugguccaagcuguguugacugucauccccaccccaccccuaccucacgccugccccacccccu

SEQ ID NO: 232567 - RNA, 64 nt, Human
ucucgucaccaagcccugguccugcggcagcugucaccccuaccauccauaccacugugcugac

SEQ ID NO: 232568 - RNA, 64 nt, Human
gguccucaaggauguacugcgcacugaccgggcccaccccuacuaugcggggccugaggauggc

SEQ ID NO: 232569 - RNA, 64 nt, Human
gguacggcuggggguucuguccugcucauccaaccaccccuaaauacccacccuguggacuuug

SEQ ID NO: 232570 - RNA, 64 nt, Human
gaggguuccucuccuugugugugucucuuccccccaccccuaauucuucugcucuguuugggaa

SEQ ID NO: 232571 - RNA, 64 nt, Human
ggcaagagcucaggagaaggccugccccccuucccaccccuauacccuaggucuccaccccuca

SEQ ID NO: 232572 - RNA, 64 nt, Human
cgggccaguuucucccucuucaccccugcgccuccaccccuaccccgcacauccaacugcacua

SEQ ID NO: 232573 - RNA, 64 nt, Human
gcuuuccuuuggggugccaggcagcgaggccccccaccccuauccugccauguacuucaagcuc

SEQ ID NO: 232574 - RNA, 64 nt, Human
ggcacauuuguucuggccuggcuuggugggaccccaccccuauucugcuucugugagucccuga

SEQ ID NO: 232575 - RNA, 64 nt, Human
auaaaacuuagauggcagcuuguacugucagaaucccguguauccauuuguucuucuguuggag

SEQ ID NO: 232576 - RNA, 64 nt, Human
cuccugaaacaagcucauuucaguuucuggcaaccccguguauuuccguuuucccccuaaagaa

SEQ ID NO: 232577 - RNA, 55 nt, Human
cuccgccucucuuuggcugaagcugcccguguaguccccaaccgugucugucugg

SEQ ID NO: 232578 - RNA, 64 nt, Human
gguacgugacccucugcugaagacuugcccccugcccguguacauagugcauuguuucuguggg

SEQ ID NO: 232579 - RNA, 64 nt, Human
uguauggaaacauuuugugcccuacucuccauaccccguguacucaaauucucuacuguaugaa

SEQ ID NO: 232580 - RNA, 64 nt, Human
ucauauucuaugugcuuccccugaagagugaggacccguguaacuggcaguguuacauugaccc

SEQ ID NO: 232581 - RNA, 64 nt, Human
gucagcaggccauacuguguuggggcaaaggugucccguguagcacucagauaaguauacagcg

SEQ ID NO: 232582 - RNA, 64 nt, Human
cacucuauagccauacuggacaggaaccaggugccccguguaggcaucgucggucgguuugccg

SEQ ID NO: 232583 - RNA, 64 nt, Human
cucuacuagcaaagacaugggcaccggaguaggucccguguagcaugcgggugcuguagagaaa

SEQ ID NO: 232584 - RNA, 64 nt, Human
cacaaaugggcucugugugggucaccccagcugacccguguaugugcagaugcaguuccgaagg

SEQ ID NO: 232585 - RNA, 64 nt, Human
guuguaugauacuaccuuuguaugucugucuuuucccguguauuuuuaaauaacuggugaucua

SEQ ID NO: 232586 - RNA, 64 nt, Human
accagccaucuggggcucuucuuccuuucuuccccccguguauguaaaugaauuccugaacccc

SEQ ID NO: 232587 - RNA, 64 nt, Human
gauccagcugagagcaaucucuugcauuuuuuuacccguguauguacagauaucauuucuugug

SEQ ID NO: 232588 - RNA, 64 nt, Human
uccaguccucaguucccacugccuaacgucugcccccguguagauacugagaggugguggcagu

SEQ ID NO: 232589 - RNA, 64 nt, Human
gcccuccgccuagagguccccucacgugaccagccccguguagccccgggcugacccagugugu

SEQ ID NO: 232590 - RNA, 64 nt, Human
uaaagagauuaauuuuaacguaacucuuucuaugcccguguaaaguaugugaaucgcaaggccu

SEQ ID NO: 232591 - RNA, 64 nt, Human
aucguaauucaauuuuccucuuauucauucaguucccguguauuucuugugcuucuacuuugua

SEQ ID NO: 232592 - RNA, 64 nt, Human
cucccggguucacgccauucuccugccucagccucccguguagcugggacuacaggcacgcgcc

SEQ ID NO: 232593 - RNA, 64 nt, Human
augcaugaaaaaugcuccacauuuaaaggacauacccguguauguuaugaaaacaugguuugau

SEQ ID NO: 232594 - RNA, 64 nt, Human
aacuucaauauaaaguugcauuugccaaaauuuacccguguagccuguuaauuuucuugaaaua

SEQ ID NO: 232595 - RNA, 64 nt, Human
cagcauggugaacauuaccaggcaugcuagcuggcccguguaaucccaagacaaggaaaacauu

SEQ ID NO: 232596 - RNA, 64 nt, Human
gugccaguuccagaugggcugaccggcucuucuccccguguaggggagccccagcauggacuca

SEQ ID NO: 232597 - RNA, 64 nt, Human
aaucacuccucagugugaccucccaggccucuuccccguguacgucaacaccucacccagccua

SEQ ID NO: 232598 - RNA, 51 nt, Human
gcaaggucacugccaaauagacccguguacaaugaggagcuggggccuccu

SEQ ID NO: 232599 - RNA, 64 nt, Human
accucacaagaaguuguaaugaguacagagaauucccguguacccuucaccaagcuuccucuaa

SEQ ID NO: 232600 - RNA, 64 nt, Human
gcucuuaacugaauugggagccucugccaccugccccguguauccuggcucucagcucaugggg

SEQ ID NO: 232601 - RNA, 64 nt, Human
gagggcugagcucagugccuccugggagacuugucccguguacagugacccagaaagaugagau

SEQ ID NO: 232602 - RNA, 64 nt, Human
ucuauauggcagcauuuuugaggcuuuauaucugcccguguacccucaacugccuccuuuuugc

SEQ ID NO: 232603 - RNA, 64 nt, Human
ugaauauuuguauuuuccagauggaauaaaaaggcccguguaauuaaccuucaccaucagcgcc

SEQ ID NO: 232604 - RNA, 64 nt, Human
gugugugguggguugucugugugcauauguccugcccguguauaugcacccacaccaugugccc

SEQ ID NO: 232605 - RNA, 64 nt, Human
cagaggccgaccuccaaggcucuguucuccccuccccguguacauauacucccgguuucccugc

SEQ ID NO: 232606 - RNA, 64 nt, Human
ugagucugugcagguccuuguguauggaauugcacccguguaaaggaggaaauggucagugugc

SEQ ID NO: 232607 - RNA, 64 nt, Human
uggggaauacagccaagggcacugcucacuguggcccguguauucauucccacaggcugcacug

SEQ ID NO: 232608 - RNA, 64 nt, Human
ugcgaaugcauccuaggcgcguccuccucugauccccguguaagacugcccuggugucggcacu

SEQ ID NO: 232609 - RNA, 64 nt, Human
ugucuuuagaauacccuuugauaagcugagcugucccguguagaugcaauucgguuuaauggca

SEQ ID NO: 232610 - RNA, 64 nt, Human
cuaaccuucagcguugcccauggcccugccacaucccguguaacauaaguggugcccaccaugu

SEQ ID NO: 232611 - RNA, 64 nt, Human
acccauggugacgaugacacacccugguggcaugcccguguauguugguuuagcguugucugca

SEQ ID NO: 232612 - RNA, 64 nt, Human
ggcaugacacaccugggggaaauuggcgaugucacccguguacgguacgcagcccagagcagac

SEQ ID NO: 232613 - RNA, 64 nt, Human
cggcugugcaguccuggguccuccuuucugagggcccguguaaauauguacauuucucaggcua

SEQ ID NO: 232614 - RNA, 64 nt, Human
cugacgggaccugccacugcacaccagcccagcucccguguaaauaauuuauuacaagcauaac

SEQ ID NO: 232615 - RNA, 64 nt, Human
uaaaugucucucuggccaccaugcguuacguguacccguguauauguggggaggcugugcacac

SEQ ID NO: 232616 - RNA, 64 nt, Human
uguuggggcuuccccaccacauucaugucccucucccguguagguuucacauuauguccaggug

SEQ ID NO: 232617 - RNA, 64 nt, Human
ccuguuuucucccuccugacccugcaucucccaccccguguaucauagggaacuuucaccuuaa

SEQ ID NO: 232618 - RNA, 64 nt, Human
aaggcccggcugagccccccaugccccuccccuccccguguaaaaagccuccuugugcaauugu

SEQ ID NO: 232619 - RNA, 64 nt, Human
ugugugccgagugccgcccaguguucugugaccacccguguagcuacugaaaauggcuggguaa

SEQ ID NO: 232620 - RNA, 64 nt, Human
ucauauuggcauuuccacgugacuguguuucuaucccguguacagagagauccagagcccuaca

SEQ ID NO: 232621 - RNA, 64 nt, Human
cgggaguccaucccggcccagcacccccagcauccccguguauggccccccugcaccuccuugu

SEQ ID NO: 232622 - RNA, 64 nt, Human
uuuccaucccaggcuuuugaaaaacaaacagaaacccguguaucugggauauuuccauauggca

SEQ ID NO: 232623 - RNA, 64 nt, Human
cccugccuccaugaugcaaacugauguccccuuccccguguaugcccccuuccccaagguagca

SEQ ID NO: 232624 - RNA, 64 nt, Human
ucaaccagaugauuaaacguuguauuaaaaagaccccguguaaaccugagcccccccguccccc

SEQ ID NO: 232625 - RNA, 64 nt, Human
gggagaaggggucagaccaaagauggugguuugucccguguaagggaacagguguggggaagag

SEQ ID NO: 232626 - RNA, 64 nt, Human
uucuguguaccuaguacacaggcaugacugggaucccguguaccgaguacacgacccagguaug

SEQ ID NO: 232627 - RNA, 64 nt, Human
cagugaauucugugauguuucugagaugcagacucccguguaguuucagauucuugguccaugg

SEQ ID NO: 232628 - RNA, 64 nt, Human
ccacucccaccaucugcagguggugaaaacaaaccccguguaucucucaauaaagguggccgaa

SEQ ID NO: 232629 - RNA, 64 nt, Human
gggcauccccagcccccuggccccucccacaucccccguguauucaggaccccaucugcugagc

SEQ ID NO: 232630 - RNA, 64 nt, Human
cuaggucuacacuccuaggacgcacgcauaucagcccguguacccugugacagugacugucccc

SEQ ID NO: 232631 - RNA, 64 nt, Human
aggugaugaagacagcccgauccuccccuggacucccguguaggaaccugcacacgagcagaca

SEQ ID NO: 232632 - RNA, 64 nt, Human
acgcacacacacacccagugcucucuccacccgacccguguacuugcagacagggaagcugagc

SEQ ID NO: 232633 - RNA, 60 nt, Human
augaugagaucgccguguaggugccgagggcgaggagauggaggcggcggcguggcugga

SEQ ID NO: 232634 - RNA, 64 nt, Human
cccggguaggggaugcccagugaaugugcacugccgaggagaaugccagccagggcccgggaga

SEQ ID NO: 232635 - RNA, 64 nt, Human
cuguccacguggccagggcccaugcugccacccucgaggagauggaacccugugaugcaaaagc

SEQ ID NO: 232636 - RNA, 64 nt, Human
ggcgggaggagggggcacacaugccccaggggagcgaggagaacucuugaaaucuccauuuuca

SEQ ID NO: 232637 - RNA, 64 nt, Human
agaggaccacaguggguggcaccuccugagaaggcgaggagagugguuguugccaacuaagccc

SEQ ID NO: 232638 - RNA, 64 nt, Human
ccacgaaggccagaaagggggaaagggaccugggcgaggagaggauuuguggugcuuggaagag

SEQ ID NO: 232639 - RNA, 64 nt, Human
caaaagcugaacagaggcggccguggccuuggcccgaggagacuaacuugcuuucucccugcau

SEQ ID NO: 232640 - RNA, 64 nt, Human
cgggguuagggauuccccgggagagaggacgaagcgaggagaguucuccauccccucuccccgc

SEQ ID NO: 232641 - RNA, 64 nt, Human
uauuugaugaguuccacuuguaucauggccuacccgaggagaagaggaguuuguuaacugggcc

SEQ ID NO: 232642 - RNA, 64 nt, Human
cccagcacuuugggaggcugaggugggcggcucacgaggagaucaagaccauccuggcuaacac

SEQ ID NO: 232643 - RNA, 64 nt, Human
ccucccggcucacggggagcucagagguccaugccgaggagaccaggcaggaccucccgaggcu

SEQ ID NO: 232644 - RNA, 64 nt, Human
ucggggacaugagcuccaugcucaccagccucgccgaggagagcaaguuccugaacaugaugac

SEQ ID NO: 232645 - RNA, 64 nt, Human
gguuuccaccuauuuaaagucagauuuauagacucgaggagacagaaacugaaucccacaccug

SEQ ID NO: 232646 - RNA, 64 nt, Human
cuuggccucaaucugaaaacugcugccgccgcgccgaggagacucgcaugccgccaccaccuca

SEQ ID NO: 232647 - RNA, 64 nt, Human
uuuuauaugaacuuuuuugguuguacuuaaucaacgaggagaaucucugcacuuuuccauuaua

SEQ ID NO: 232648 - RNA, 64 nt, Human
guucccugaauccccgggguccuuggagagccaucgaggagaaugugcaauuggacugaagcuc

SEQ ID NO: 232649 - RNA, 64 nt, Human
ucugugagcccccagcgaggggaggcccagccuccgaggagaccaggaacccugcuucagcagc

SEQ ID NO: 232650 - RNA, 64 nt, Human
ccuggucaccaucagaguacuggaauacgggaaccgaggagaccuugguccuuuuguuuuuguu

SEQ ID NO: 232651 - RNA, 64 nt, Human
augcauauauuaaaagaaaagcaaagaccugagccgaggagaggaugaauucaaguuuccuuac

SEQ ID NO: 232652 - RNA, 64 nt, Human
guauggaagagcaagaaaagagaaaauauuaaaacgaggagagagaaaaauaauauuaacacaa

SEQ ID NO: 232653 - RNA, 64 nt, Human
uccucccucccacuucugcacccuuucaccaccucgaggagauuugcuccccauuagcgaauga

SEQ ID NO: 232654 - RNA, 64 nt, Human
cuuagacucacugugagucuccccggccauuucacgaggagaccacagugcugccaccagugcc

SEQ ID NO: 232655 - RNA, 64 nt, Human
ccauuguccuggaugaugccaccucguuuaaccacgaggagaguuugggccuggaacucauuca

SEQ ID NO: 232656 - RNA, 64 nt, Human
ugcaggaaacgauugccaacuauacgaauggcuucgaggagauaaacugaaauuugcuauauaa

SEQ ID NO: 232657 - RNA, 64 nt, Human
auaguauaaaaaaugguuaaugacaauucagaggcgaggagauucuguaaacuuaaaauuacua

SEQ ID NO: 232658 - RNA, 64 nt, Human
caguggcuccuauaaucccaauauuuugggaggccgaggagagaggaucacuuaagcccaggag

SEQ ID NO: 232659 - RNA, 64 nt, Human
gaaggcggacguuguuuccuaaccauagguggaacgaggagacgggagcgagugggcucuccac

SEQ ID NO: 232660 - RNA, 64 nt, Human
ucaaaucauucuguuaaccaccauuccaacaggucgaggagagcuuaaacaccuucuuccucug

SEQ ID NO: 232661 - RNA, 64 nt, Human
caugaaaaaugaugggcuccuccuaauaggaaggcgaggagaggagaaggccaggggaaugaau

SEQ ID NO: 232662 - RNA, 64 nt, Human
ccaaugggaacucaauuuauuccugggaaccuaacgaggagagcccaggccuaggcaggaggcc

SEQ ID NO: 232663 - RNA, 64 nt, Human
cccaaacucuccagacaucaccaacuguccccugcgaggagaaaucacuccugggggagaacca

SEQ ID NO: 232664 - RNA, 64 nt, Human
aggugauggugaugaaggagcugauccgguucgacgaggagacccagaggacguuccucaagga

SEQ ID NO: 232665 - RNA, 64 nt, Human
aagauggaaagaaccacgcaggauccccugggugcgaggagagugaugccgguaaagaaaaguu

SEQ ID NO: 232666 - RNA, 64 nt, Human
aaagcggggugacucauuucccuuguccagggcccgaggagagugagguguccagccugcaaag

SEQ ID NO: 232667 - RNA, 64 nt, Human
ggaugcuguucagcugcagacuuucuuccugggacgaggagacguccucucuguuaggcuuggc

SEQ ID NO: 232668 - RNA, 64 nt, Human
accugugccugacccuccgcuccagguaccacaccgaggagagcggccggucccagccauggcc

SEQ ID NO: 232669 - RNA, 64 nt, Human
gaugggguugggggcuaaauuaauuggaguggggcgaggagagagccagaaaacauagauccga

SEQ ID NO: 232670 - RNA, 64 nt, Human
caucuccuucaaauacuuuaauaaagaaguauuucgaggagauaucuguccaaaaagguuugac

SEQ ID NO: 232671 - RNA, 64 nt, Human
gaguggaggagcaggccauucuggaugccauggccgaggagacaaggcagaagcaacuucuggc

SEQ ID NO: 232672 - RNA, 64 nt, Human
cuuggagguagagaucaugaacccauuuaacagacgaggagacaggcucagagaggcaccgucc

SEQ ID NO: 232673 - RNA, 64 nt, Human
uggcauuggaggcguggcgcagccggcgggaccgcgaggagauccuccugcaggagcuggagcc

SEQ ID NO: 232674 - RNA, 64 nt, Human
agaggacaggaggaggagccuuccccaggaggaacgaggagagguggccacguggcaggccaca

SEQ ID NO: 232675 - RNA, 64 nt, Human
gggcgcggacuccgggcacggcuucccaggggaacgaggagaucuguguuuacuuaagaccgau

SEQ ID NO: 232676 - RNA, 64 nt, Human
uggugacagggccccaggggugggggucggagagcgaggagaagguugucaccuaugaccacau

SEQ ID NO: 232677 - RNA, 64 nt, Human
gggagggggcgcccaggagggguggggaggggggcgaggagagccaagugcagcgaagggacac

SEQ ID NO: 232678 - RNA, 64 nt, Human
augcaugcacuguucccccugugcagccgcugagcgaggagaugcuccuugggcccuuugagug

SEQ ID NO: 232679 - RNA, 64 nt, Human
gggagcgauucaaagaugugcggaacccugaggccgaggagaugaaggccacauacaucaaccu

SEQ ID NO: 232680 - RNA, 64 nt, Human
ugucgcucaagucuuccgaccgccaaggcucggacgaggagagcgugcauagcgacacucggga

SEQ ID NO: 232681 - RNA, 64 nt, Human
cucccugcccagcccagcuuucacuggggggagacgaggagaggcaaugguggucuuggcaaca

SEQ ID NO: 232682 - RNA, 64 nt, Human
ucaacaggaaaccgaucuuccccugacuccccaccgaggagagccucuccucgacccugcacgg

SEQ ID NO: 232683 - RNA, 64 nt, Human
ggaccgaagaagaacugagcauuuucaaaguucccgaggagagauggaugccgcguccccuucg

SEQ ID NO: 232684 - RNA, 64 nt, Human
agcaacagaaaucuaucauuuacaacaaaagcaacgaggagauuacaugaagcgaaagaggggg

SEQ ID NO: 232685 - RNA, 64 nt, Human
uuaauucaaugaaaucugagguuaaugcgagguucgaggagagguuauagauaaaacuaccagu

SEQ ID NO: 232686 - RNA, 64 nt, Human
gggaugaggaggagagcacagcccucagcaucaacgaggagaugcagcgcaugcucaaccagcu

SEQ ID NO: 232687 - RNA, 64 nt, Human
cugagucacacacaaaacgcucacggaccuugaacgaggagagcacugcugaucagacuaggcc

SEQ ID NO: 232688 - RNA, 64 nt, Human
gggcaccuuucuaguccacggcauuugaagagagcgaggagaaccauucuggaaacucuaggcu

SEQ ID NO: 232689 - RNA, 64 nt, Human
gcggcgcuccacaucugcggacagaguuuccuuacgaggagacuuggucacugugaaggagaaa

SEQ ID NO: 232690 - RNA, 64 nt, Human
ccuucuaccccaucccuggauccacaggggcuaucgaggagacccagugagaauguagcauuuu

SEQ ID NO: 232691 - RNA, 64 nt, Human
agagccagagaacucauggggugaggauggaguccgaggagacugcugggagccgccguguggg

SEQ ID NO: 232692 - RNA, 64 nt, Human
aaucacugaggcaccaauggcugagcaggaagggcgaggagacaccuugaucagcgucccaguu

SEQ ID NO: 232693 - RNA, 64 nt, Human
ccgcagaggccggagaccuccuggacuaguucggcgaggagacuggccacuggggguggcuguu

SEQ ID NO: 232694 - RNA, 64 nt, Human
cagcuacuuggaaggcugaggugagaggaucacucgaggagauuggggcugccaugagccaugg

SEQ ID NO: 232695 - RNA, 64 nt, Human
auaaauaauugauuccuuuccccacuaaagcagucgaggagauuuguaauccacuuuuuagugc

SEQ ID NO: 232696 - RNA, 64 nt, Human
uuuccuuacuggugcugaaaggaaggauggauaacgaggagaaaauaaaacugugaggcucaag

SEQ ID NO: 232697 - RNA, 64 nt, Human
aggaagacgucguuaucuccccuccccacuuacucgaggagagaggugagggggggaugacuug

SEQ ID NO: 232698 - RNA, 64 nt, Human
cugcaagcaguauggcaucacgggcgaaaauguccgaggagaacugcuggcccuggugaaggac

SEQ ID NO: 232699 - RNA, 64 nt, Human
guugagauauuuuaaaauauugccuccguuuuaucgaggagagaaauaauaacuaaaaaauaua

SEQ ID NO: 232700 - RNA, 64 nt, Human
gggguugggccucaggcagggagggggguggagacgaggagaugccaaguggggccagggccaa

SEQ ID NO: 232701 - RNA, 64 nt, Human
gggccugguggcgagcccaagugguugccuccuacgaggagaccaacgaaguggagauucgaua

SEQ ID NO: 232702 - RNA, 61 nt, Human
accccuacgugugggacugagucagcgguggcgaggagaggcgggcggauuuggggagggc

SEQ ID NO: 232703 - RNA, 64 nt, Human
uuguaaaaugaggguggaggugggaauaggaucucgaggagacuauuggcauaugauuccaagg

SEQ ID NO: 232704 - RNA, 64 nt, Human
ccagguccaggcccaucugucuuguuuccucugccgaggagaagacgggccucgguggcgacca

SEQ ID NO: 232705 - RNA, 64 nt, Human
ggaugcuuuuccaucccaagugccugcggagcgccgaggagaggagagagcugacuggacgcuu

SEQ ID NO: 232706 - RNA, 64 nt, Human
agccccauuauucauucucccuuuauugauucaucgaggagaacuugguagauggggagaaaac

SEQ ID NO: 232707 - RNA, 64 nt, Human
ugcucuguauuuugaaccaggaggacgugggcugcgaggagaagcuguacuuuggcuugaguga

SEQ ID NO: 232708 - RNA, 59 nt, Human
guggcaagaaggccaagugaccggaggugcgaggagagccagccggccugugugacuug

SEQ ID NO: 232709 - RNA, 64 nt, Human
ugcauccagccuggggcugaggcugaggcacuggcgaggagagggcgcuccucucugcacaccu

SEQ ID NO: 232710 - RNA, 64 nt, Human
uccagugaggggugacugcagccggucaggugggcgaggagaaggggggcugccccuuuccuac

SEQ ID NO: 232711 - RNA, 64 nt, Human
ggcuuggacacuugccguggugccccuggcuggccgaggagacuggcucuggccaggggccccg

SEQ ID NO: 232712 - RNA, 64 nt, Human
agaccucccuucuugccucuccagacguguuccccgaggagaucuuccuuccguccuuccuggc

SEQ ID NO: 232713 - RNA, 64 nt, Human
ccaaaccugggcccuggauggccuuggccugucccgaggagaaaugagaaaaucccagaucucu

SEQ ID NO: 232714 - RNA, 64 nt, Human
cuucuucagcuugggcaagugugugccugugugccgaggagauggcgucuaccagaaggggaug

SEQ ID NO: 232715 - RNA, 64 nt, Human
gacaaauuaugcuagagcaauuagacacccauggcgaggagaaaaaagaaccucuacuuaaacc

SEQ ID NO: 232716 - RNA, 64 nt, Human
ccaguuuguuuuuggcuccccaagcaucaucucacgaggagaacuuuacaccuagcacagcugg

SEQ ID NO: 232717 - RNA, 64 nt, Human
guagcugacuguggcauuacuacgccuccccacacgcccagaccccucacuccaaaauccuacu

SEQ ID NO: 232718 - RNA, 64 nt, Human
acgcacaguguuaaggagccaagaggagccacuucgcccagacuuuguuuccccaccgccugcg

SEQ ID NO: 232719 - RNA, 64 nt, Human
acgcucagcucccgcccgacggcagcgccgccgccgcccagaaucccagcccagaaucccgacc

SEQ ID NO: 232720 - RNA, 64 nt, Human
uguuacagcucccuuugaucaaagaaauauagcuuucaggcauaaaccuggaagucucccucug

SEQ ID NO: 232721 - RNA, 64 nt, Human
aagggauuccucacugugggcagcugcccugagcuucaggcagcaguguuuaucucuggccagu

SEQ ID NO: 232722 - RNA, 64 nt, Human
ccugggaaacaccagcuuuuggggugauagcacuuucaggcaggagcuaugguuccuuccucag

SEQ ID NO: 232723 - RNA, 64 nt, Human
acaggaggggucucauguccugcuggcuuccagcuucaggcaccagcauccaccuuggcucugc

SEQ ID NO: 232724 - RNA, 64 nt, Human
aggaaguaguugaaaaugaugaggagauagccuuuucaggcaaggacaagccagcuucagagaa

SEQ ID NO: 232725 - RNA, 64 nt, Human
ggcacuucaauuugcaggggacucaaagcaggauuucaggcaauuccccagaguaaucagagua

SEQ ID NO: 232726 - RNA, 64 nt, Human
guagauacuggcuggcauugucaguguucuaaguuucaggcauuuuuauuuuuccuggcuaaac

SEQ ID NO: 232727 - RNA, 64 nt, Human
cuucugggaagugugccugggauucuucagugguuucaggcagauaguugagacuggggcuuug

SEQ ID NO: 232728 - RNA, 64 nt, Human
agguggcauguuuagucuaccaaaaacaauacuuuucaggcacuuuagaaauauccuuuuagaa

SEQ ID NO: 232729 - RNA, 64 nt, Human
uaccuuuacccaguuuguguguuugagcucugcauucaggcagcugcaacauuccaguguuuga

SEQ ID NO: 232730 - RNA, 64 nt, Human
ugaaggguuucagucacauugaaaauuguuuuauuucaggcauguucccuuugugcacuuaggu

SEQ ID NO: 232731 - RNA, 64 nt, Human
auucuacaaaaaaccaggaugcccaccguuaggauucaggcagcagugucuguaccucgggugg

SEQ ID NO: 232732 - RNA, 64 nt, Human
ccaccccacuaugccgcaggccgcccuacccaccuucaggcagccuaugggacgcagggcccca

SEQ ID NO: 232733 - RNA, 64 nt, Human
gggcugauggcgccaccugugccuuacauccagguucaggcaucacuagcuuucccacacucua

SEQ ID NO: 232734 - RNA, 64 nt, Human
auuuaugggcaacaaaguaaggucaggauuagacuucaggcauucauaaggcaggcacuaucag

SEQ ID NO: 232735 - RNA, 64 nt, Human
uucacaaaagcaaaagccuagaaauaacccagaugcccaugagcaagagaguggacaaguaaac

SEQ ID NO: 232736 - RNA, 64 nt, Human
uuugggguuuuuuugaguuggagucucgcugugucgcccagacuggagugcaguggugggaucg

SEQ ID NO: 232737 - RNA, 64 nt, Human
cugaaggugcagucccaccuguacagccccuccccgcccagaacugugaauggccugcuccagg

SEQ ID NO: 232738 - RNA, 64 nt, Human
uguucaggaugcaccaccaccaccucuagauaccuucaggcaacacagcccaguuuuaaccucu

SEQ ID NO: 232739 - RNA, 64 nt, Human
gcuauauugcccaggcuggucuugaaguccuggcuucaggcaauucuccugccuuugccuccag

SEQ ID NO: 232740 - RNA, 64 nt, Human
cuauuagcuaaaguucugcuaaagaugauuaaaguucaggcauccuuauccagcggcugagcag

SEQ ID NO: 232741 - RNA, 64 nt, Human
aggagagaguaaauugagguuuggggauuauaaauucaggcaagagaaccuuauagauaucaca

SEQ ID NO: 232742 - RNA, 64 nt, Human
gcuacagauaaccuguaauugagcagauuuaaaauucaggcauacuuuuccauuuauccaagug

SEQ ID NO: 232743 - RNA, 64 nt, Human
gaagaucagggcagcuuaaguggucuaagaauccuucaggcauucuuuaaggagaaaaaggaua

SEQ ID NO: 232744 - RNA, 64 nt, Human
gggaacauucuugcuguguuuuuucaguaagacuuucaggcacuucuucccuuuugauuucuuu

SEQ ID NO: 232745 - RNA, 64 nt, Human
gccacugauacugguuuuuguuaaacauuggaaguucaggcaauggaauaaauguaggaacaua

SEQ ID NO: 232746 - RNA, 64 nt, Human
auucguugcauauagagguaucaacugcugcauguucaggcauauuauaaaacuuuagucuaug

SEQ ID NO: 232747 - RNA, 64 nt, Human
gccagaauucugacucccuggcagcagcagggcuuucaggcaccagugucuguguuguuagaac

SEQ ID NO: 232748 - RNA, 64 nt, Human
auuggaaaugaauuacaggcagcuguucaaacucuucaggcaggauuccuguggacuuugagau

SEQ ID NO: 232749 - RNA, 64 nt, Human
uuaaaaacaaaauuucugucaucuguccuggccauucaggcaacuccagccugggcucaauccu

SEQ ID NO: 232750 - RNA, 64 nt, Human
uaagaaauagaauuauaacuguaaagauguuuauuucaggcauuggauauuuuuuacuuuagaa

SEQ ID NO: 232751 - RNA, 64 nt, Human
uucacauugaaacccaggaguggauaacacuggcuucaggcaaagcuugaaucaggacucaauc

SEQ ID NO: 232752 - RNA, 64 nt, Human
agaccuggguggaaagcgguuuggaugaaaagauuucaggcaaagacuugcaggaagaugauga

SEQ ID NO: 232753 - RNA, 64 nt, Human
agugacuaagccccgcauaugugagugaaaguacuucaggcacgcugccuccugguaacagcua

SEQ ID NO: 232754 - RNA, 64 nt, Human
gccagcuuggcagggauccccaggaggccugggccgcccagaggcuccucucaggcugggcccc

SEQ ID NO: 232755 - RNA, 64 nt, Human
aauuuucaucccguaucacaguguuuuuauugcucgcccagacaccaugugcaauaagauuggu

SEQ ID NO: 232756 - RNA, 53 nt, Human
gcagcgccuuccagcccugagcccgcccagaggagcccagcggcccaagagcc

SEQ ID NO: 232757 - RNA, 64 nt, Human
aauaccaaauguuugcccuggugguuccuaucucuucaggcaaacauggucaguauucuguaaa

SEQ ID NO: 232758 - RNA, 64 nt, Human
ucgagauaagcuuaaagcugaauuuccuguguguuucaggcauucacagauaaacucauucucu

SEQ ID NO: 232759 - RNA, 64 nt, Human
ugucaugggucaagcauaaaucauauauagcauuuucaggcauguuccugguaguucuuuugag

SEQ ID NO: 232760 - RNA, 64 nt, Human
ugaaaauucacaguuuuaaguuugauggucuccauucaggcaaguguguuucagcaaaucucua

SEQ ID NO: 232761 - RNA, 64 nt, Human
aauaagugcucugucaaaagcacaaaaagaaacuuucaggcacuggagaguggagucgacucac

SEQ ID NO: 232762 - RNA, 64 nt, Human
acuaaguuuagauuaucacaaagaagaacgugcauucaggcagaugcugucccauucagaggaa

SEQ ID NO: 232763 - RNA, 64 nt, Human
cuuaagagcaaaaaaguuuugaugggauuuuaaauucaggcaaagccuacaacgcugagacaau

SEQ ID NO: 232764 - RNA, 64 nt, Human
gaucucuggucagagugaacucuugcuuccuguauucaggcagcucagagcagaaaguaagggg

SEQ ID NO: 232765 - RNA, 64 nt, Human
ucauucaccuuauggcaugcuuugauuacuagacuucaggcagucucauucauuguaucauacu

SEQ ID NO: 232766 - RNA, 64 nt, Human
auucuaaaguuauuuaugaugcuuagccauaguauucaggcaaauguucauuucuccugguacc

SEQ ID NO: 232767 - RNA, 64 nt, Human
ggaaacuucacaucauacuuauuuuuguuugccuuucaggcaucauauuagcuuuuauaaaaaa

SEQ ID NO: 232768 - RNA, 64 nt, Human
uuaugagacugccccacugagaaaacuuacuuacuucaggcauccagugcccccacccaggguu

SEQ ID NO: 232769 - RNA, 64 nt, Human
uuuuuuuuaguuaauuuuugucaaaugaaacgacuucaggcaagucucuuuuauaaugguuuuu

SEQ ID NO: 232770 - RNA, 64 nt, Human
gauagagcuuccugagugaaaccugcuuugauuguucaggcacuuggccaccuucuccucacuc

SEQ ID NO: 232771 - RNA, 64 nt, Human
cugcuuggugguuagaaggaggcuagaagaugaauucaggcacuuucuuccaauaaaacuaauu

SEQ ID NO: 232772 - RNA, 64 nt, Human
gaagaauaugggggccagggggugugguacuaccuucaggcauuugguaacucaaagaaggcug

SEQ ID NO: 232773 - RNA, 64 nt, Human
gcuuccuggggcgacccuggcagugguugggagacgcccagauggagggggaggcugaccaagg

SEQ ID NO: 232774 - RNA, 64 nt, Human
cgcugagucaggcugaguggacugaggccugccccgcccagacugcccaggcagagggcagggc

SEQ ID NO: 232775 - RNA, 64 nt, Human
aucucgcuguaggucaggcccgcgcagccuccugcgcccagaagcccacgccgccgccgucugc

SEQ ID NO: 232776 - RNA, 64 nt, Human
cuuucacugauuucuuauaugguauaaauuaaaguucaggcauuuauggggagaaaaggcccuc

SEQ ID NO: 232777 - RNA, 64 nt, Human
aaucuauuuugggucauuuuuauguaccuuuggguucaggcauuauuugggggguuuuguuucc

SEQ ID NO: 232778 - RNA, 64 nt, Human
ccugauuugaauguacuauuugauccucauuguguucaggcaaaaaauaggaaaugaguaauuu

SEQ ID NO: 232779 - RNA, 64 nt, Human
cuuauacaaucaagaggaaaaaaaauuacacaauuucaggcaagcuacguuuuccuuuguuuca

SEQ ID NO: 232780 - RNA, 64 nt, Human
ccuuucacuaccuuuuuagauugugcuugugauuuucaggcaagcuaaaugucugaugaagacu

SEQ ID NO: 232781 - RNA, 64 nt, Human
cuguuuuaaaaagaacuugauuauguuuuaugauuucaggcaaguauucauuuuuaacuugcua

SEQ ID NO: 232782 - RNA, 64 nt, Human
auugcccaagaaugaggauaugcaguaaacagaauucaggcaagauaccucuaagcuguuuuga

SEQ ID NO: 232783 - RNA, 64 nt, Human
cuauucaaaugaagugagucaugugugauuuaaguucaggcagcacaucaauuucuaaauacuu

SEQ ID NO: 232784 - RNA, 64 nt, Human
acccgccucaccucucacccuccuccagucccacuucaggcagcaggcucgaguuugaggccau

SEQ ID NO: 232785 - RNA, 64 nt, Human
cggaguggccaaacccuagagcuagcaguucccauucaggcaaacaagggcagugguuuuguuu

SEQ ID NO: 232786 - RNA, 64 nt, Human
cuuuuggaaaggaaaucugcuuuggugaugaucuuucaggcaaucucaacuuacuucuuuaauc

SEQ ID NO: 232787 - RNA, 64 nt, Human
cacaaccuuaagccgagguggggggauauggggauucaggcaauuguuuacacacuuugaauaa

SEQ ID NO: 232788 - RNA, 64 nt, Human
uucauuucuagcugcuuucaggguuuuaugaauuuucaggcaaagcuuuaauuuacacuaagcu

SEQ ID NO: 232789 - RNA, 64 nt, Human
uacauuucuaagaauauauuucuugcucaguuguuucaggcaagcccaagacuuuguaauuuuu

SEQ ID NO: 232790 - RNA, 64 nt, Human
uuguugacuugaaaacauggaacugcacagggcauucaggcaagugcaagugguucaggggcca

SEQ ID NO: 232791 - RNA, 64 nt, Human
acgugucauuagaacaugaguccucugcuucugauucaggcauacuuuugggauucuuccaucu

SEQ ID NO: 232792 - RNA, 64 nt, Human
gcuacuccggggacagugacuccucagccuccuccgcccagagcggcccccuugguacccgcag

SEQ ID NO: 232793 - RNA, 64 nt, Human
ugcuaauaagagagagucuuaccugaauggcaaucgcccagauuaacaguggagacaguaaugc

SEQ ID NO: 232794 - RNA, 64 nt, Human
gucuuccuuuccccucaagagaaggagcaauuguuccccugagcaucuggguccaucugaccca

SEQ ID NO: 232795 - RNA, 64 nt, Human
caucauauaguaaguagcagaguugggauuggaauucaggcaugacucaaaccuggauguacuu

SEQ ID NO: 232796 - RNA, 64 nt, Human
cuuggagcagucaguacauaccaguuucugauguuucaggcaggagugggguaaauaaguguga

SEQ ID NO: 232797 - RNA, 64 nt, Human
cucccucugauaaggguucaucucacuggacgaguucaggcagaccuggaagcuguucagcucu

SEQ ID NO: 232798 - RNA, 64 nt, Human
gauaaccaaguaaauguuuucuauuuugcauauuuucaggcaugguaacagaaauuuaccuuuu

SEQ ID NO: 232799 - RNA, 64 nt, Human
acugucucauugugccaugagguaaauguaauguuucaggcauucugcuugcaaaaaaaucuau

SEQ ID NO: 232800 - RNA, 64 nt, Human
uguuuuugcaggugaggaaacaggggcagaguaauucaggcacauguguucagaguuccacagu

SEQ ID NO: 232801 - RNA, 64 nt, Human
gagguuaugagaaaaaaacagcaggggcauuaguuucaggcaaggcagcucccagguuuagaga

SEQ ID NO: 232802 - RNA, 64 nt, Human
uaaaauuacuaaugcaccacgucagucugcuuccuucaggcaucauucucaauucaucaggacu

SEQ ID NO: 232803 - RNA, 64 nt, Human
uuucacucccaggccaagcccuggagcaaucuucuucaggcagcugucuccaccuccaggaugu

SEQ ID NO: 232804 - RNA, 64 nt, Human
auacauuuucuccagugacguguugacuugaaacuucaggcagauuaaaagaaucauuuguuga

SEQ ID NO: 232805 - RNA, 64 nt, Human
caaauuauuuucagccuccuugucauauaaucauuucaggcaaacugaggcaacacuaacagcu

SEQ ID NO: 232806 - RNA, 64 nt, Human
gagggccacagccggacaggggguagccccuggauucaggcacacgaccaccacacgagcacgu

SEQ ID NO: 232807 - RNA, 64 nt, Human
gcaucuuccucagucaguuucugaauauugugaauucaggcagguguguguucucuucugcaug

SEQ ID NO: 232808 - RNA, 64 nt, Human
cccaacagcugucuccaguucuaguuccuugguuuucaggcacagugggggauguucugcaccc

SEQ ID NO: 232809 - RNA, 64 nt, Human
ggccaaggcuucucccugucggugaaggaucauguucaggcacuccaagugaaccaccccucuu

SEQ ID NO: 232810 - RNA, 64 nt, Human
caguauaauuuaacuucagagggaaaguaaauauuucaggcauacugacacuuugccagaaagc

SEQ ID NO: 232811 - RNA, 64 nt, Human
guauagaagguuugggggcuguggggaaggagaguccccugaaggucugacacgucugccuacc

SEQ ID NO: 232812 - RNA, 54 nt, Human
ccucggugccaccccagugagauguccccugacccuccaccgcagaaggaaggc

SEQ ID NO: 232813 - RNA, 64 nt, Human
aaaugacucaugcugaagagaguccccauuucaguccccugagaucuagcugaugcuuagaucc

SEQ ID NO: 232814 - RNA, 64 nt, Human
acacucaggcacaaaaggagcuacauuaguuacauucaggcauaccccagagcacuacaauucu

SEQ ID NO: 232815 - RNA, 64 nt, Human
gcucuaggaagaacuggagacucuugcuuagcuauucaggcacagggcuggagaguacuuuaau

SEQ ID NO: 232816 - RNA, 64 nt, Human
agugugucugacucucucaugacugcacaccccauucaggcagaggccaguacagaggaggagc

SEQ ID NO: 232817 - RNA, 64 nt, Human
auauauagcuugaaagcaguuaaacugauuaguauucaggcacugagaaugauaguaauaggau

SEQ ID NO: 232818 - RNA, 64 nt, Human
uuaaaaaugcacaccucaugagucuaccugagcauucaggcagcacugacaauaguuaugccug

SEQ ID NO: 232819 - RNA, 64 nt, Human
ccacucguugccugauuccguuuccgacuugggguucaggcaggcuguuuucaccucuagacac

SEQ ID NO: 232820 - RNA, 64 nt, Human
gggcaauauaauggguggacucacacuugcucaguucaggcagcucugcuggagggcggugcca

SEQ ID NO: 232821 - RNA, 64 nt, Human
acccacuuuguagaagaggcaugagcccuugaauuucaggcaccuuuuaucuaaugagaguuuu

SEQ ID NO: 232822 - RNA, 64 nt, Human
gucagaggaccggagaagugugagaaggugccccuucaggcaccuaggggagagcgugccugac

SEQ ID NO: 232823 - RNA, 64 nt, Human
gacugccucuggccugcagcugaccuggcaaccauucaggcacaugaagguggagugugaccuu

SEQ ID NO: 232824 - RNA, 64 nt, Human
guucccacccuuggcacugccacccaccccucaauucaggcaacaaugaaauuaauggauaccg

SEQ ID NO: 232825 - RNA, 64 nt, Human
gguggagaagugucguuuucauaacuugcugaauuucaggcauuuuguucuacaugaggacuca

SEQ ID NO: 232826 - RNA, 64 nt, Human
uccccuccccaaguguuucucuccugacccaggguucaggcaggccuugugguuucaggacugc

SEQ ID NO: 232827 - RNA, 64 nt, Human
uauuuugaaauuaugggaguaaacaccuucaaauuucaggcauuucugcuuugugacuaaauac

SEQ ID NO: 232828 - RNA, 64 nt, Human
gguuguucuuaccagccacaaaguaaacuucauuuucaggcaguguuucugggggagguuaugg

SEQ ID NO: 232829 - RNA, 64 nt, Human
acauugucucugagcuaauguuuauauuuuuccauucaggcaccgaaauaguuaauauuugaaa

SEQ ID NO: 232830 - RNA, 64 nt, Human
cucuggggguugugcguuggggaugcaugcgacagcccaugacccgaggcauucucaggguauc

SEQ ID NO: 232831 - RNA, 64 nt, Human
ucucaaccucuuuggaaucuucuucaucuuggcugcccaugaacauuauucuauugauguguuu

SEQ ID NO: 232832 - RNA, 64 nt, Human
aacaaccacaauaacaauaacaacuuagugcuuagcccaugauguaucaggggauaugauguga

SEQ ID NO: 232833 - RNA, 64 nt, Human
uucuuucucugccugaaacccucccucuuuucccuucaggcauaugucucuaaaccaauguuau

SEQ ID NO: 232834 - RNA, 54 nt, Human
aggccaacaugggcuucugaacccuucaggcagggacaguucuauugcuguccc

SEQ ID NO: 232835 - RNA, 64 nt, Human
gcaucuucucccccagaucaucacagaaaucacuuucaggcaaugauuuacaaaaguagcauag

SEQ ID NO: 232836 - RNA, 64 nt, Human
uucuuugugguuucaaaucagccagcucauuugguucaggcauaaauuagagaaaugguucugg

SEQ ID NO: 232837 - RNA, 64 nt, Human
aauauaaauauuuccguguaauagccaccaacuuuucaggcauagguuuuauuacaacuguuaa

SEQ ID NO: 232838 - RNA, 64 nt, Human
agauuuuaaaaaugugauguuuuguccacaguaguucaggcaauuaagaauaugcaacccagag

SEQ ID NO: 232839 - RNA, 64 nt, Human
cggaaguaauuagagcuuugaaaaaaucuguuuguucaggcagagagcuauauuuggaggaagc

SEQ ID NO: 232840 - RNA, 64 nt, Human
gaaagagaaaacuuucuucccuucuacuaaaagauucaggcagcuuaaaaccuuagugcuuucu

SEQ ID NO: 232841 - RNA, 64 nt, Human
acauguuuuaaggaaaaguaacuuaauuggguuuuucaggcaguugauauuugaccuaagcuuu

SEQ ID NO: 232842 - RNA, 64 nt, Human
cagcgagguucuuucugauacuaaaaaccuuucuuucaggcagcaaaugaacuugaaagguugc

SEQ ID NO: 232843 - RNA, 64 nt, Human
auuuguguuuccuaaauccaaccauuuucauuaauucaggcauauuuuaacuccacugcuuacc

SEQ ID NO: 232844 - RNA, 64 nt, Human
ugaacuucaagaaugaagaaagaauuccucaccauucaggcagaaaaagcaagucaccaaggga

SEQ ID NO: 232845 - RNA, 64 nt, Human
uucucaguccuaauuugaacaggucaaagauguguucaggcauuccagguaacagguguguaug

SEQ ID NO: 232846 - RNA, 64 nt, Human
gccuuuuccaucaauuuuagcauggaaaaauaauuucaggcaauaugcuuaaaaauugggggaa

SEQ ID NO: 232847 - RNA, 64 nt, Human
gaaaacuucauuccaacggaaggaauccuguaguuucaggcauaguuuuaaugacacagaaaac

SEQ ID NO: 232848 - RNA, 64 nt, Human
ugugcccuggagcauucugcccaggcuacguggguucaggcagguggcagcuucccaaguauuc

SEQ ID NO: 232849 - RNA, 64 nt, Human
accagccacugguaaccauucuucuacucuguaugcccaugaggucaauugauuuuauuuuuag

SEQ ID NO: 232850 - RNA, 64 nt, Human
gcacccgcccagucccgagggcccggcccugucugcccaugacuucacuggugugagcuugucc

SEQ ID NO: 232851 - RNA, 64 nt, Human
uauguuaaaugauccacuaacuuuuuuuuucuuggcccaugauuaauggaauguauguaacuag

SEQ ID NO: 232852 - RNA, 64 nt, Human
cauaaauaaugcuauuguuuaugauuugaaaacuuucaggcaaaauccaauuuacauuuuuccc

SEQ ID NO: 232853 - RNA, 64 nt, Human
guccuuuaaucugggcugguacaggccucagccuugcccucaaugcacgaaagguggcccagga

SEQ ID NO: 232854 - RNA, 64 nt, Human
ugcuggagaguugaagagguguaagaagagaucgugcccucauuuuucacuuauuuuuuugguu

SEQ ID NO: 232855 - RNA, 64 nt, Human
gggguugaggguacaggcaaccuuguguucucugugcccucagggacuggcagagcaagaggcc

SEQ ID NO: 232856 - RNA, 64 nt, Human
ucuucaauuacauaacagaaaucaauaagauaugugcccucaucauaaauaucaucucuagcac

SEQ ID NO: 232857 - RNA, 64 nt, Human
aucuucauuuaugcagccaaugucuagcuggaccugcccucaucuugcaguucauacaggcacu

SEQ ID NO: 232858 - RNA, 64 nt, Human
cauaauaacucauaaggugcuaucuguucagugaugcccucagagcucuugcuguuagcuggca

SEQ ID NO: 232859 - RNA, 64 nt, Human
ugucuugccuucauuucucuuuuuaucucccccuugcccucauucuugaacagcuggaggaaua

SEQ ID NO: 232860 - RNA, 64 nt, Human
ccagcacugcagggcccugagguggucgugucccugcccucaauucuugaagcaccagcucccu

SEQ ID NO: 232861 - RNA, 64 nt, Human
cccgugcccuugcggccuccuggcccggugcagcugcccucagggacagggugggugcucucag

SEQ ID NO: 232862 - RNA, 64 nt, Human
cuccacggauaagcuugggaggucauuguuuuacugcccucacauuuuguuugaaauuucagaa

SEQ ID NO: 232863 - RNA, 64 nt, Human
uuugaaaggcaucuguuacuucaguggcauaaagugcccucacacugcugugcagccaucacca

SEQ ID NO: 232864 - RNA, 64 nt, Human
cauugaacagccccauuuagagaaacaaauucucugcccucauagaauccuaauuguuucugua

SEQ ID NO: 232865 - RNA, 64 nt, Human
ugcugaguguacagaguggaauaagacagagaccugcccucaagagcaaaguagaucaugcaua

SEQ ID NO: 232866 - RNA, 64 nt, Human
ucgggcugagcaggagaacaucaccggcuccaguuccccugauccauucucacagccugaaaca

SEQ ID NO: 232867 - RNA, 64 nt, Human
ucucuauccucuguggccuucagcuaauuucugcuccccugagauucguccuucagccccauca

SEQ ID NO: 232868 - RNA, 64 nt, Human
ccgugggggagaagucccaccaggaugcccccccuccccugagaagcccgccuucucccucgug

SEQ ID NO: 232869 - RNA, 64 nt, Human
uugauuuaaaugaugugugagauguuucaccauuuucaggcacuguguaauucuauuguaauaa

SEQ ID NO: 232870 - RNA, 64 nt, Human
cuauaacucuccugcccaugauaguguauucuguuucaggcaagcuuauucuuuccuucuuuca

SEQ ID NO: 232871 - RNA, 64 nt, Human
gaugcauuccuaaggagcuuuuaauugcuuaucuuucaggcauaaucaucacuuuaacuuuucc

SEQ ID NO: 232872 - RNA, 64 nt, Human
gagggaaauggucuggacuuauucccagcacuguuucaggcaagaacuuucccuuucaacuuca

SEQ ID NO: 232873 - RNA, 64 nt, Human
cucuaugacauugauuggaauccagccacugacauucaggcaaugucuagaguauggagagaug

SEQ ID NO: 232874 - RNA, 64 nt, Human
gcaguccaagugacuuuucauuuuuuguuuuaacuucaggcaaaaucuuuaaccacucuggccu

SEQ ID NO: 232875 - RNA, 64 nt, Human
auaaauauuuugguaagauuuugaauaauaugaauucaggcagauauacuaaacugcuuuuauu

SEQ ID NO: 232876 - RNA, 64 nt, Human
agacccccccccuaaggugcucguuugggggcucuucaggcagcaccucagccuggcaccccca

SEQ ID NO: 232877 - RNA, 64 nt, Human
gccagcaaaugcuuuuugugcagaauacacuucuuucaggcauugucaggugcuguuuuguuua

SEQ ID NO: 232878 - RNA, 64 nt, Human
aaguauuauagaugccaauccaaaaccucagaauuucaggcaccacaaaaacagguaauuuucu

SEQ ID NO: 232879 - RNA, 64 nt, Human
gcugcuuccuggggacccagggcaccccggcaccuucaggcacgcuccucagcuggucaccucc

SEQ ID NO: 232880 - RNA, 64 nt, Human
acucuugaggcuguagccugugucaagcuguuucuucaggcagccucucaaaugugcuuugucu

SEQ ID NO: 232881 - RNA, 64 nt, Human
aaauuucauagcaauuuaaagcacaagcacaauguucaggcauaaucccuaauaagucacuauu

SEQ ID NO: 232882 - RNA, 64 nt, Human
gugugucuuucaugacacugacauuauuaaagaguucaggcaaguuuguggaaugucccacaau

SEQ ID NO: 232883 - RNA, 64 nt, Human
agugaauggaaugagaaaagccuucuuccuuugcuucaggcagcugucaccuucucuuuauugg

SEQ ID NO: 232884 - RNA, 64 nt, Human
ugaguggcggggccccugcuccgaggggcucauguucaggcagaaccggucccagccugggcuc

SEQ ID NO: 232885 - RNA, 64 nt, Human
ccucuguuuuaaagauuaucccaauguggaagaugcccaugacuggucagcuacuuccuccuau

SEQ ID NO: 232886 - RNA, 64 nt, Human
ggauccggugcuacgggaaacauuuuccuaagaugcccaugagaacagaccaagauguguacag

SEQ ID NO: 232887 - RNA, 64 nt, Human
aagcaauaagagaaagauauuuguaaucucuccagcccaugaucucgguuuucuuacacuguga

SEQ ID NO: 232888 - RNA, 64 nt, Human
cccagcaaccaaguugggggugguuuccuuccucuucaggcagccaggcccauggcuggaaggc

SEQ ID NO: 232889 - RNA, 64 nt, Human
guuuaggugaaggacaaguagguaagaggacgccuucaggcaccacagauaagccugaaacagc

SEQ ID NO: 232890 - RNA, 64 nt, Human
cucugucacccuagcuauaccagcagaaaaccuguucaggcaggcuuucugggugugacugauu

SEQ ID NO: 232891 - RNA, 64 nt, Human
aagucucuagaggucuguaauaguuuuuacauuuuucaggcaguguaaaguuuuuugauaaggc

SEQ ID NO: 232892 - RNA, 64 nt, Human
acuguaauguacauuaacauuacagccucucaauuucaggcagguguaacaguuccuuuccacc

SEQ ID NO: 232893 - RNA, 64 nt, Human
uggcuauagggaagaaccugaauacugaacuugauucaggcagaggaccauaaccuggggguca

SEQ ID NO: 232894 - RNA, 64 nt, Human
caaagggguaccccaaauccagaggugccuacauuucaggcagccuuggaguauuuuaaaagga

SEQ ID NO: 232895 - RNA, 64 nt, Human
cucccccaccacccuacuugacagcgugggcaucuucaggcacagccuugggaguuccuggugu

SEQ ID NO: 232896 - RNA, 56 nt, Human
cuccaccucgggaccuaugacuacccuucaggcaucagaacacucagggccuggag

SEQ ID NO: 232897 - RNA, 64 nt, Human
gacucuuccuguggagucugagggaggggcuccauucaggcaaagggguuuuagcugcagccuu

SEQ ID NO: 232898 - RNA, 64 nt, Human
cacaucuucccuacaucaggaagacaggcccaaauucaggcauggggugaaauaggagaugccc

SEQ ID NO: 232899 - RNA, 64 nt, Human
auucuuuaucauguuugccuucccuggggaaacauucaggcaguaaaaugacauccacguguuc

SEQ ID NO: 232900 - RNA, 64 nt, Human
cuuucuugggcauucacaacucuugaguuugguguucaggcaucauuauuaaaaaguggagucc

SEQ ID NO: 232901 - RNA, 64 nt, Human
gagaaguaaacagagcagaagugaccacugggacuucaggcaagaagcucaccaccaggcacac

SEQ ID NO: 232902 - RNA, 64 nt, Human
gccguggccaauugucuccuguaaugacuguugguucaggcauguuguacuuuguagggacaaa

SEQ ID NO: 232903 - RNA, 64 nt, Human
uccuaaagauccugauguccaugacuucauguaguucaggcacagaaagaauagcaaagcugcu

SEQ ID NO: 232904 - RNA, 64 nt, Human
uuaaacccauuaggaauuuucugucaacuaccaugcccaugagauguuuaucaauacaacugcc

SEQ ID NO: 232905 - RNA, 64 nt, Human
cugaagaacugauguuauuacaaagaaaauacaugcccaugaccaaauauucaaauugugcagg

SEQ ID NO: 232906 - RNA, 64 nt, Human
ccagugccaacaaaacauuuugaauggacuuagggcccaugagguuguggcuggcuuaggcagc

SEQ ID NO: 232907 - RNA, 64 nt, Human
cuaauucuaauaacuccuuagcuaaguuuuauuauucaggcaauaaacauguuuucauguaaua

SEQ ID NO: 232908 - RNA, 64 nt, Human
uuaacgcuuucuaggauaggguaagcacccuuaauucaggcacuguccauuagcuuccuuugca

SEQ ID NO: 232909 - RNA, 64 nt, Human
ccauucuggcuccuccacuaaauugcugugugacuucaggcaagacauugauccucucucagcc

SEQ ID NO: 232910 - RNA, 64 nt, Human
accuuuaaguugccuuuccucuuuguaguuagcguucaggcaggugacguguggaaagucuagg

SEQ ID NO: 232911 - RNA, 64 nt, Human
cccgauuggcacagaccaguuucagagaaauacuuucaggcacuaagacuaaucgaaugaacaa

SEQ ID NO: 232912 - RNA, 64 nt, Human
gacccagggcuggcuucuaaguuuccguccagucuucaggcaaguucuguguuagucaugcaca

SEQ ID NO: 232913 - RNA, 64 nt, Human
aagacuggcaagacgugagggcaugaaugguucauucaggcagcugcugcagauguggucaccu

SEQ ID NO: 232914 - RNA, 64 nt, Human
ugugauggcggccccaccccaacuaccaccucuuuucaggcacagaccuugugggacugggccc

SEQ ID NO: 232915 - RNA, 64 nt, Human
uggagccuccacgaacucucucuuacuccgaccauucaggcagcaaagucucugcuuacaucau

SEQ ID NO: 232916 - RNA, 54 nt, Human
guaauucaagaaagaaauagaaacuucaggcagaacauccauucauucauucau

SEQ ID NO: 232917 - RNA, 64 nt, Human
gacucccaauuacuauuuucuuccuucccagcucuucaggcagugcaggacaacccagcuaugc

SEQ ID NO: 232918 - RNA, 64 nt, Human
uuuucuaagccucuugccacuuuuaaaauuauccuucaggcauaaauauuuuugacagcagaau

SEQ ID NO: 232919 - RNA, 57 nt, Human
gccgggaaacagauuugugaaaggagauucaggcagacugguggcaguggaguaggg

SEQ ID NO: 232920 - RNA, 64 nt, Human
ucaucaaauuuuauuuuuaagugaaaaguaaccuuucaggcauuucagcagcauacauugacaa

SEQ ID NO: 232921 - RNA, 64 nt, Human
ggaaaaagcaaacucauccacaugugguacucauuucaggcacaucugaaaugaucuuaauuac

SEQ ID NO: 232922 - RNA, 64 nt, Human
cauguuguuggggugucuuucuggugcccaaacuuucaggcacuuuucaaauuuaauaaggaac

SEQ ID NO: 232923 - RNA, 64 nt, Human
uucuggaguccuuagucuucauuuccauucuucugcccaugauuacugaucaaaauacugguag

SEQ ID NO: 232924 - RNA, 64 nt, Human
ccuguguuucuagcuacgcaggaggauugcuugagcccaugagauugaggcugcagugagcugu

SEQ ID NO: 232925 - RNA, 64 nt, Human
auggaaacacaauuuaaguauuaauacaggaugggcccaugaaggcaaaggugccugucuccua

SEQ ID NO: 232926 - RNA, 64 nt, Human
ugccuuuauggugaaacaggggagaugugcaccuuucaggcacagcccuaguuuggcgccugcu

SEQ ID NO: 232927 - RNA, 64 nt, Human
ucaagaagugaaguaugucacccuuucagggaaauucaggcaauuacugaaauaggaggguggc

SEQ ID NO: 232928 - RNA, 64 nt, Human
uuggacucaagcugucaucuucaagcacgccaacuucaggcaguguuuucuacugcaaaccucc

SEQ ID NO: 232929 - RNA, 64 nt, Human
ugacuucugauuuucaaaaccauuccucaguaucuucaggcauuugaccuccugaaugugcuug

SEQ ID NO: 232930 - RNA, 64 nt, Human
aaaacuucauucacaaguauuccagacaccaggcuucaggcauggccaugagcaagaccagcaa

SEQ ID NO: 232931 - RNA, 64 nt, Human
gggccccugaccuccccgcuguggggguuggggcuucaggcagcagacugaccaucucccagac

SEQ ID NO: 232932 - RNA, 64 nt, Human
acauaaugaaagaugcuugaaaugcuuuuguuauuucaggcaaaucaaauuaaaucagacuauc

SEQ ID NO: 232933 - RNA, 64 nt, Human
agugcagggugaaacuaacuagcaaagacaaaaauucaggcaguuuguagacaccaguaauuuu

SEQ ID NO: 232934 - RNA, 64 nt, Human
aacuauuuagagcuuccaggauauauuucacagcuucaggcaugugaucaguuagagccgauga

SEQ ID NO: 232935 - RNA, 64 nt, Human
uaggagucggugucgccuaagaugggauaauggcuucaggcaacuccuagccuuccccauaucu

SEQ ID NO: 232936 - RNA, 64 nt, Human
gagcaacuuacgcauccucaagaauccacugcuuuucaggcaaggagggagaaauccugcugca

SEQ ID NO: 232937 - RNA, 64 nt, Human
cuuuuuauacucuuguuaucaaaauggcuuauuuuucaggcacuaaggauuguuaagagaaaag

SEQ ID NO: 232938 - RNA, 64 nt, Human
cgaucucggcucacugcaacuucagccuccuggauucaggcaacacuccugccucagccuccca

SEQ ID NO: 232939 - RNA, 54 nt, Human
augaggagcaguacaucugaugacuucaggcaggcgggccggggcagggacuug

SEQ ID NO: 232940 - RNA, 64 nt, Human
cucagggaucacugggagaagccauggcauuaucuucaggcaauuuagucugucccaaauaaaa

SEQ ID NO: 232941 - RNA, 64 nt, Human
uggaaucaaaggcucugguccuugucagggggcuuucaggcaucuggggguggggaaagcauua

SEQ ID NO: 232942 - RNA, 64 nt, Human
cauuuuucuaguucccacaggaggaacacaaagggcccaugaugaaagccugcacacagugggu

SEQ ID NO: 232943 - RNA, 64 nt, Human
ugccugugagucggccuuacuccguuuccuuagcgcccaugacacgccaagucccguuucgcac

SEQ ID NO: 232944 - RNA, 64 nt, Human
gugcugggauuacaggugugagccaccacgccuggcccaugaaccaaguguuuuuaaggaaaca

SEQ ID NO: 232945 - RNA, 64 nt, Human
aacuaugccaucgccugugagcggaugcugcgucuucaggcaagagaugcagauccugaagugc

SEQ ID NO: 232946 - RNA, 64 nt, Human
ccaccaaaaaugagucagaaacacagaagacuauuucaggcaugugggccuggauaugcuccuu

SEQ ID NO: 232947 - RNA, 64 nt, Human
uugacaggcuuuugaccgugauucaucacaugaguucaggcauggaaauuuucauuuggagcau

SEQ ID NO: 232948 - RNA, 64 nt, Human
gggaaggugaauuaugguaacuuuuaaugaucuauucaggcaguagagcucuuaaggaaaaaaa

SEQ ID NO: 232949 - RNA, 64 nt, Human
gaggcugccuaugaaggcagaagauguggaugaauucaggcacuggggguggggggguuauuua

SEQ ID NO: 232950 - RNA, 64 nt, Human
guuuaauuauaccacugggaaaucaugguuacgcuucaggcauauucuuccccagaguacuacu

SEQ ID NO: 232951 - RNA, 64 nt, Human
ugccaauguugauugcugaggccuuagccaagauuucaggcaucauuugcuccaguccuuucau

SEQ ID NO: 232952 - RNA, 64 nt, Human
gaggccaucucugagcaguggacucaaaagcauuuucaggcaugucagagaagggaggacucac

SEQ ID NO: 232953 - RNA, 64 nt, Human
caaucuuggcucacugcaaccuccgccuccuggguucaggcaauuuuccugccucagccuccca

SEQ ID NO: 232954 - RNA, 64 nt, Human
uagguggaggucuuuuuaaauaaccucauguuacuucaggcaaaucugguacaggagaagccca

SEQ ID NO: 232955 - RNA, 64 nt, Human
uggcacacagcccucugggugcuugggaacuagcuucaggcacagccugauucuggugauccag

SEQ ID NO: 232956 - RNA, 64 nt, Human
gcccccauacaaugggcagugucugcuauagggcuucaggcauuaaauaaaaccgaggguuguu

SEQ ID NO: 232957 - RNA, 64 nt, Human
aaagacgugaugugcaccaccucgaucucgguguuucaggcacuaaagcaacaaaacaacccau

SEQ ID NO: 232958 - RNA, 64 nt, Human
ucagagcucuccagaauaugcuuguuggagauccuucaggcaguaagggagaguuuugccuccu

SEQ ID NO: 232959 - RNA, 64 nt, Human
ccaucagcaccacgugccaaggagcucagcggucuucaggcauuuuuguaaugagccauuaguu

SEQ ID NO: 232960 - RNA, 64 nt, Human
aguaagggagauuguauaccuguuguccacagucuucaggcagcuccccaggucucugaacccc

SEQ ID NO: 232961 - RNA, 64 nt, Human
ccuccauccuaggcucugagccucagaggacccagcccaugagagaacggggaucuggggggcc

SEQ ID NO: 232962 - RNA, 64 nt, Human
aacucccucccuagcuuccgugugucugugcagugcccaugagcugcugccaaugggaucuuuc

SEQ ID NO: 232963 - RNA, 64 nt, Human
ugcugggggucgugguucacugggggcucucucugcccaugagcugccacacagcaccuuugcc

SEQ ID NO: 232964 - RNA, 64 nt, Human
uggggcauccugccagaggugcacaggcuggaguuucaggcacugcaggcugaugacacacagg

SEQ ID NO: 232965 - RNA, 64 nt, Human
agaugcuggccccgccgagagaacugcugucacuuucaggcaaagcucaaagguccuaggccca

SEQ ID NO: 232966 - RNA, 64 nt, Human
gauaaagaugacuucguagcagcaccuacuaugcuucaggcauggugccggccugccucuccau

SEQ ID NO: 232967 - RNA, 64 nt, Human
cuggcugcuguggguaccagugcaggucccgguuuucaggcaccugcucagcugcccgucucug

SEQ ID NO: 232968 - RNA, 64 nt, Human
cuaaugggauggcaaaggugguggugcuuucaucuucaggcagaagccucugcccaucccccuc

SEQ ID NO: 232969 - RNA, 64 nt, Human
ugcucuguccuccccaccccgauagugacacaucuucaggcagagcuguggcacagacccccgu

SEQ ID NO: 232970 - RNA, 64 nt, Human
ccagagggcaacgccaucaguagcagugugguguuucaggcagagcucuggccaggcugugcca

SEQ ID NO: 232971 - RNA, 64 nt, Human
gagacaaugugggugcccagaagugcccugcgcuuucaggcagugucucuguuuucccaaggug

SEQ ID NO: 232972 - RNA, 64 nt, Human
gacuuacuaagaaauauguacagcuaccccuguuuucaggcacuauguuugagaacauuuuagc

SEQ ID NO: 232973 - RNA, 64 nt, Human
caaagugaaaggaaauuuaggaggcauaggccauuucaggcagcauaaguaaucuccuguccuu

SEQ ID NO: 232974 - RNA, 64 nt, Human
ucacguagcuguguacaaagagaugugaaauacuuucaggcaaaaauaaacuguaagugacuca

SEQ ID NO: 232975 - RNA, 64 nt, Human
cuggccaccucucuccuuugcugaggccuccagcuucaggcaggccaaggccuucuccucccca

SEQ ID NO: 232976 - RNA, 64 nt, Human
auccuccucccucagccuugugaauaccugggacuucaggcacgcgccacuacacccagcuaau

SEQ ID NO: 232977 - RNA, 64 nt, Human
gggguauuuauuccucacuagcuggguuaccaucuucaggcacuuuuaacaucuggcauucgga

SEQ ID NO: 232978 - RNA, 64 nt, Human
cauggaaguagcugcuugcuuguacuguccauccuucaggcaucccuaaagcucacucugaaga

SEQ ID NO: 232979 - RNA, 64 nt, Human
cugggaacugccugacucacugaagaaacuacuuuucaggcacuguagggucacccauaugccu

SEQ ID NO: 232980 - RNA, 64 nt, Human
ccagcaaagaugauaccuuaaacucccacugcaagcccaugaacuucccagagaguggaacggc

SEQ ID NO: 232981 - RNA, 64 nt, Human
ggggugggugcucugaaguggagugaagccucaagcccaugaaugccaccccagucaucucugg

SEQ ID NO: 232982 - RNA, 64 nt, Human
uucauuuccugccccuuucagggccugugaggaugcccaugagcuaccgcuguacaguucucgg

SEQ ID NO: 232983 - RNA, 64 nt, Human
ucgccuugacaccgccaucucuuuucuuuaaggcuucaggcagcgcgcacaggcucuggcagcc

SEQ ID NO: 232984 - RNA, 64 nt, Human
uugaagucucauacaagcugucugauagagaacuuucaggcagaucccaccauuagccuguaaa

SEQ ID NO: 232985 - RNA, 64 nt, Human
cucugugggcaaggauggguccagaagaccccacuucaggcacuaagaggggcuggaccuggcg

SEQ ID NO: 232986 - RNA, 64 nt, Human
ggcccuuuuucccuccagccaggugaguguuuucuucaggcagcugaggguccugggggagcug

SEQ ID NO: 232987 - RNA, 64 nt, Human
ggugagauuagaucuucuugguucccugugagguuucaggcacuaaaacucuauguggggaagg

SEQ ID NO: 232988 - RNA, 64 nt, Human
uuuguauaaauucuguuuuguaacaaaauaguuuuucaggcagugcguuucucaggacuuuaua

SEQ ID NO: 232989 - RNA, 64 nt, Human
uagucugcagggcauauuaagaucaucccagagguucaggcaguuccugucaucucugaaaaga

SEQ ID NO: 232990 - RNA, 64 nt, Human
ugcaggccuuuaccggcauugauguggcucauguuucaggcagacuugggguccuuaagguggc

SEQ ID NO: 232991 - RNA, 64 nt, Human
cagccacccagccaggaggggcuguccaaucacauucaggcaugcgaaugagcugggcccuggg

SEQ ID NO: 232992 - RNA, 64 nt, Human
ccuugaauggguuuaaguaugcuacaauauacaguucaggcaaaauuuaagauguaauuaucuu

SEQ ID NO: 232993 - RNA, 64 nt, Human
ccccuccccgcugcucuguagucauguugguccuuucaggcaccucuguggcauagcuccccuu

SEQ ID NO: 232994 - RNA, 64 nt, Human
cuagccucugcccuuggggauuugcuucauuaauuucaggcaagugaggucaauguaagaaggg

SEQ ID NO: 232995 - RNA, 64 nt, Human
agcaggaucagacgguagagccuggggcaugcucuucaggcaugcucuugccugcuggauugcc

SEQ ID NO: 232996 - RNA, 64 nt, Human
gccauuuucggacgcagccguucugugcccauucuucaggcaacuuucgauuccuuacuguagc

SEQ ID NO: 232997 - RNA, 64 nt, Human
cagacucucuuguggccacacuagguugucgccuuucaggcagugucccgccaccuuugcuucc

SEQ ID NO: 232998 - RNA, 64 nt, Human
uugaagucucaugcaaguugucugauagagaacuuucaggcagaucccaccauuagccuguaaa

SEQ ID NO: 232999 - RNA, 64 nt, Human
cccagaggaguguccuggccgcuguccucccggggcccaugauggccauagauuugccuugugg

SEQ ID NO: 233000 - RNA, 64 nt, Human
ugcuguauaggacaagccccuuaccccucucugggcccaugaauuccuggcuugguuuauguuc

SEQ ID NO: 233001 - RNA, 64 nt, Human
acagagaaaaaacuaccaaauauccaauggguaagcccaugauguagccacuaguacaauaaaa

SEQ ID NO: 233002 - RNA, 64 nt, Human
acaaauauuuaucuaaauaaaucuuaaauaaauuuucaggcauagaaauauacagauacugugu

SEQ ID NO: 233003 - RNA, 64 nt, Human
ccuccggacccgauccugcagcucuuucuggaccuucaggcacccccaagcgugcagcucuguc

SEQ ID NO: 233004 - RNA, 64 nt, Human
uguugacuauuuacaacucaguuuuacauuuaaauucaggcaguguuaauaugccaagguaggg

SEQ ID NO: 233005 - RNA, 64 nt, Human
aagaaaucuuguaauaaaacugcagccguagggcuucaggcagcuucccacccgcgccugugag

SEQ ID NO: 233006 - RNA, 64 nt, Human
agaauaugcauuuuaccuuugggaauauguuaauuucaggcagcauucccuaugggaaagguga

SEQ ID NO: 233007 - RNA, 64 nt, Human
uugaagucucauacaagcucuccgauagagaacuuucaggcagaucccaccauuagccuguaaa

SEQ ID NO: 233008 - RNA, 64 nt, Human
acaacuugccuccucuacuccuccaaagcuuuucuucaggcagccggugcacaguggacuuuuu

SEQ ID NO: 233009 - RNA, 64 nt, Human
cgccugugaaauaccaaccugaagacaccguucauucaggcaacgcacaaaacagaaaaugaag

SEQ ID NO: 233010 - RNA, 64 nt, Human
ccccaaaggaagugauggagagccuugagcuaaguucaggcagcagcauguggccagcagcagu

SEQ ID NO: 233011 - RNA, 64 nt, Human
uuccaugcugccaucugguggugauuucggucacuucaggcauugacucaaggccugccuaacu

SEQ ID NO: 233012 - RNA, 64 nt, Human
aggaugcuggagcugaaucagacgcugacaguucuucaggcauuucuauuucacaaucgaauug

SEQ ID NO: 233013 - RNA, 64 nt, Human
cguucaggaguaggaauuaauguccaucuuuucuuucaggcauuuucaucugcuguccacguau

SEQ ID NO: 233014 - RNA, 64 nt, Human
aguuugucuugcccuucugacacagugugugcacuucaggcaauuuuuggaaaauauaaaaaau

SEQ ID NO: 233015 - RNA, 64 nt, Human
gaggcuuacuggagccacaccugcaggcgcuguguucaggcaccaccuuccuccuugagcuuug

SEQ ID NO: 233016 - RNA, 64 nt, Human
ucauugcuguuuccagaagaguggagagugugguuucaggcaagguauuaaugauacaauuccg

SEQ ID NO: 233017 - RNA, 64 nt, Human
auggucuuauaaagacaaguggacuugggcccuauucaggcaagauuaaaaaaaaaaaaagacu

SEQ ID NO: 233018 - RNA, 64 nt, Human
gaaccuuccccuccccgugcgcucuggggacugagcccaugacaccaaaccugccccuuggcug

SEQ ID NO: 233019 - RNA, 64 nt, Human
aaauguagcaauaaugucuuuugaauauucccaagcccaugaguccuugaaaauauuuuuuaua

SEQ ID NO: 233020 - RNA, 64 nt, Human
uaggagggugugaguggcauuugucagggauuuagcccaugacguguuucuugaacccuacuuu

SEQ ID NO: 233021 - RNA, 64 nt, Human
uaugucacauugaagaauuucuucaugauacauuuucaggcacacuuguaggaaaauuaggauc

SEQ ID NO: 233022 - RNA, 64 nt, Human
agacagacacacacacacacaacaauuaacagucuucaggcaaaacgucgaaucagcuauuuac

SEQ ID NO: 233023 - RNA, 64 nt, Human
gaaaaacagaaagaggcagacguuucccagggcguucaggcagcccugauggaccgaaggcucu

SEQ ID NO: 233024 - RNA, 64 nt, Human
ggcugcggcauagcagaugcucguucuugccuccuucaggcaccaaucaggagaaggguucugc

SEQ ID NO: 233025 - RNA, 64 nt, Human
ggaaaaugcugguguacaaauacacacaaagcucuucaggcagcugauagauuucccccagaga

SEQ ID NO: 233026 - RNA, 64 nt, Human
uagacauggcuagaaucccagaagggccuuuauuuucaggcauagacuccucuguggucacagc

SEQ ID NO: 233027 - RNA, 64 nt, Human
aaagagugggggguuucuuuuuaugucugggucauucaggcaguacaucugaauuaagcugaau

SEQ ID NO: 233028 - RNA, 64 nt, Human
auguuuacaaagaacuguuuuguauauagacauuuucaggcacgugcuuugcaccaacccugcg

SEQ ID NO: 233029 - RNA, 64 nt, Human
gcugauucuacugggcugugggcucagaccucauuucaggcaccagauuggucgcuacacccug

SEQ ID NO: 233030 - RNA, 64 nt, Human
gcaaggugaccacggcugcuggaccccuucccuguucaggcaggcccagccccucucagaaccu

SEQ ID NO: 233031 - RNA, 64 nt, Human
acccuccuggccuuccucguugggccgcucugauuucaggcagcaggggcugcugugaugccgu

SEQ ID NO: 233032 - RNA, 64 nt, Human
uguguaucuucuuaucucauuucacaagacuggcuucaggcauagcuggauccaggagcucaau

SEQ ID NO: 233033 - RNA, 64 nt, Human
acaagaugcacaccuugcucauuagugaguucauuucaggcagccagcucuuccucacccacua

SEQ ID NO: 233034 - RNA, 64 nt, Human
auccuccugccucggccucccaaagcacuggaauuucaggcaugcacuaucguacuggcuguuc

SEQ ID NO: 233035 - RNA, 64 nt, Human
acucugcagagggaagcggggacaaugccgggguuucaggcaggagacacgaggagggccugcc

SEQ ID NO: 233036 - RNA, 64 nt, Human
caccaccuguggacagcccuccuguccccaagcuuucaggcaggcacugaaacgcaccgaacuu

SEQ ID NO: 233037 - RNA, 64 nt, Human
cgugucaaugugugcacuuuuuuucuauauuauugcccaugauauaacuuuagaaauaaaccuu

SEQ ID NO: 233038 - RNA, 64 nt, Human
auuuuuuguaagugucauuuguauaacucuaaacgcccaugauaguagcuucaaacuggaaaua

SEQ ID NO: 233039 - RNA, 64 nt, Human
acgucucuccuacccggccucaaauggugcugcugcccaugaugguaccacaccagggccucag

SEQ ID NO: 233040 - RNA, 64 nt, Human
ggcugugcucagagaccugaagugugcacguugcuucaggcaugggggguggggggagcguccc

SEQ ID NO: 233041 - RNA, 64 nt, Human
aaugugaaauaaauugaauuuaauguugaauacuuucaggcauucacuuaauaaagacacuguu

SEQ ID NO: 233042 - RNA, 64 nt, Human
ggcauauguaugcaauggaaagccacuagaaaucuucaggcacacagauaaugacaaugcaggu

SEQ ID NO: 233043 - RNA, 64 nt, Human
ccaguuuccauugguaggaaauuuuuuagguaaguucaggcauauguaugcaauggaaagccac

SEQ ID NO: 233044 - RNA, 64 nt, Human
uagguuaacuuguuuuuguacacgucuuaguuauuucaggcaucucuuugcuuaaaauugaguu

SEQ ID NO: 233045 - RNA, 64 nt, Human
ucaaucucagcuaacauuccauguuucagaagcauucaggcacugccaggcuugcagucuccca

SEQ ID NO: 233046 - RNA, 64 nt, Human
ccuccccagcuccgccucuguccucgcuccacguuucaggcaggcaccuagcaauuccaucacc

SEQ ID NO: 233047 - RNA, 64 nt, Human
ccacauaauccacgcucaucuugcaaagcgcuauuucaggcacaucauuggaauacaggaagua

SEQ ID NO: 233048 - RNA, 64 nt, Human
cuccaaggugugcuagcagugggcccugcccaacuucaggcagaacagggaggcccagagauua

SEQ ID NO: 233049 - RNA, 64 nt, Human
aaugcagaagcgcuccaguaucuccaaggguaccuucaggcagccagugugacacugcuuuaaa

SEQ ID NO: 233050 - RNA, 64 nt, Human
gagcaggagcugcucugacgccaggugccaaggcuucaggcaggcaggcccaggaugggcguuu

SEQ ID NO: 233051 - RNA, 64 nt, Human
ucugccccacucgccuuugccccgucaucgaugauucaggcagagccagauucguuaggucccu

SEQ ID NO: 233052 - RNA, 64 nt, Human
uugguuuucuuuuuccauuuuggguuccuuuuguuucaggcacggauaacagcaaauggaauuc

SEQ ID NO: 233053 - RNA, 64 nt, Human
agugagggaaugggagcagcugugggcgccucauuucaggcaaguccuccccaaaccuucagau

SEQ ID NO: 233054 - RNA, 64 nt, Human
aauuaccagcaagugucuuuccugcggcaccggguucaggcagcuacuccugccccagagauga

SEQ ID NO: 233055 - RNA, 64 nt, Human
cguacaugcugcuuccuccaccaaaaaugcccaauucaggcagacccugaccucucccucaggc

SEQ ID NO: 233056 - RNA, 64 nt, Human
auuugaauccuaggcaaaauacuggagcacuaaugcccaugagauugaaggcacaguguuugac

SEQ ID NO: 233057 - RNA, 64 nt, Human
accucuugaaacccuucccccauggcacaaacucgcccaugauggaaagcaucuagauuucugc

SEQ ID NO: 233058 - RNA, 64 nt, Human
acuuuuuaccaaacuaguaaaccugacauuccaggcccaugaggggaaagaggaucuuccagcu

SEQ ID NO: 233059 - RNA, 64 nt, Human
ccaauuucucuuuuaaaaaagcagacuuacagcuuucaggcaacugaaauucauguuaacaugu

SEQ ID NO: 233060 - RNA, 64 nt, Human
cucaguuauuucaguuuucaggugacuagagaauuucaggcaacagugcccuuugcaauuaccu

SEQ ID NO: 233061 - RNA, 64 nt, Human
aacugcucacuuauuugaaaaauuaaggaaggauuucaggcauggcuugauccagcuacucaaa

SEQ ID NO: 233062 - RNA, 64 nt, Human
gcuauuugcacaaaagaauuuaacaucucagaauuucaggcaauuuuuuuucucuguauaccca

SEQ ID NO: 233063 - RNA, 64 nt, Human
agaggcuccgcugcucucggggguggcgguuguuuucaggcagcgucugugaacccacagcucg

SEQ ID NO: 233064 - RNA, 64 nt, Human
aacucuuuugaccuguaacuuaaagaucauaaacuucaggcaauaauauuuucuguguaagcuu

SEQ ID NO: 233065 - RNA, 64 nt, Human
caucuguauuggagguagcagugcuagcucugccuucaggcaugcaauaugccagaacuacaga

SEQ ID NO: 233066 - RNA, 64 nt, Human
uaccaucagccuuccuugcucggcccaggucuguuucaggcaucugagucggcguuuacccagg

SEQ ID NO: 233067 - RNA, 64 nt, Human
cgaucucagcucagugcaaccuccgccacccggguucaggcaauucucuugcaucagccucgcg

SEQ ID NO: 233068 - RNA, 64 nt, Human
uuacagugagugccaaucuacuagauaaauggccuucaggcagugcuccaggaauccugggggg

SEQ ID NO: 233069 - RNA, 64 nt, Human
cauuaagacuugaaagacuuguagaugugugauguucaggcacaggaugcugaaagcuauguua

SEQ ID NO: 233070 - RNA, 64 nt, Human
auagcucugccuuugggucuuguucauagugcuguucaggcaaaauggaauagucucagguggg

SEQ ID NO: 233071 - RNA, 64 nt, Human
aguuucguuuguaaacugcuugaagucuguggcauucaggcacacgucuggcuggccggcuggg

SEQ ID NO: 233072 - RNA, 64 nt, Human
ugacuuaaaggcuggaagacagaaacgaagugaguucaggcaaauucacuguauuguaauuuau

SEQ ID NO: 233073 - RNA, 64 nt, Human
ugacaaggacuggagugccauuggcuguggacuguucaggcagggaaguacaagaccacucuug

SEQ ID NO: 233074 - RNA, 64 nt, Human
guguuuccuuuucaggagauggggaauaauuuccuucaggcagcugaaauucaccaagaacagc

SEQ ID NO: 233075 - RNA, 64 nt, Human
caaaaauguacuagccaauacgcuuaaguguguggcccaugaauugaacaauuuaaccuugaag

SEQ ID NO: 233076 - RNA, 58 nt, Human
ccucaaagacugguauguaguguggauugcccaugaguuauacacauggcacacagag

SEQ ID NO: 233077 - RNA, 64 nt, Human
cuagaaauaucaagaguugaauccauaguguggggcccaugacucuagcugggcaccuuggacc

SEQ ID NO: 233078 - RNA, 64 nt, Human
uagccccauugcuccauucacucccaggugagaauucaggcaaacguccacaaaggucacaggc

SEQ ID NO: 233079 - RNA, 64 nt, Human
gcuucaguuuuucuguuguauuucauuuccaguuuucaggcaguuauuuuuauuauuguacuuu

SEQ ID NO: 233080 - RNA, 64 nt, Human
aggcaaacauuccugcaaacagguuuuucucagcuucaggcagaggagacaacauggaagaaga

SEQ ID NO: 233081 - RNA, 64 nt, Human
uaguuccuuguuauaaaauacaagaaauaagacauucaggcauuuucccuuuaugaagauguuc

SEQ ID NO: 233082 - RNA, 64 nt, Human
guggugugauuaaaugacuugucugagauuaguuuucaggcaugugaaggacuuauacucacau

SEQ ID NO: 233083 - RNA, 64 nt, Human
uuuuuccauguaaggaaaugaaaagaccaaaaucuucaggcaaaaagcaaguugcaaaauuaga

SEQ ID NO: 233084 - RNA, 64 nt, Human
ucucugguacaauuucuuuugguucauuuucagauucaggcauuuucccccuuggcucucaaug

SEQ ID NO: 233085 - RNA, 64 nt, Human
gcagugggaggggcuguauggagaggagcugggguucaggcauugucuuuuuuccuccuuguau

SEQ ID NO: 233086 - RNA, 64 nt, Human
uggaugcuuaagaggccugcauauagauaagaauuucaggcaaaacuacauuuauuguuaauaa

SEQ ID NO: 233087 - RNA, 64 nt, Human
guccuuucuaucacguuauugucacuacaauugcuucaggcacagguggaauagaagaaaucgu

SEQ ID NO: 233088 - RNA, 64 nt, Human
cacacacgcgcacaugggcgcgcacgaacuaccauucaggcagucagugggcaagaggaaagau

SEQ ID NO: 233089 - RNA, 64 nt, Human
cugugaaagggagugguugguaaaaucaauagauuucaggcaagagggccagauaccuaacagg

SEQ ID NO: 233090 - RNA, 64 nt, Human
guuuuguggaccugcccugggggcuggcagcuccuucaggcagccuggcagaaguggaacuccc

SEQ ID NO: 233091 - RNA, 64 nt, Human
agggaacaugggaaggaaucaaagguaaagcccauucaggcauuauugacaagagggcuuuaaa

SEQ ID NO: 233092 - RNA, 64 nt, Human
ccugcaaucuggaaguaaacagucugcuugcuucuucaggcacgugacagugacaacacaguga

SEQ ID NO: 233093 - RNA, 64 nt, Human
agcaguauguuugaaaaauagaccauucuaaaaagcccaugauaccuuacuguugaugaaaaag

SEQ ID NO: 233094 - RNA, 64 nt, Human
agcuccacaaaugcaaaagauguauuuuccuguggcccaugacauuugcaguuauucccaguga

SEQ ID NO: 233095 - RNA, 64 nt, Human
cggauaaugccuaucccagaaacauucaaaucaagcccaugaguacccacauggcuaaccagau

SEQ ID NO: 233096 - RNA, 64 nt, Human
cugccugucaugcccacccccugaggaagcauggggacccuaacacccuggugcccugcaccag

SEQ ID NO: 233097 - RNA, 64 nt, Human
cucugccaaaggccccgcagucccucucccaggaggacccuagaggcaauuaaaugauguccug

SEQ ID NO: 233098 - RNA, 64 nt, Human
cuuucuguuccuuguccucaccuuacuccccucaggacccuaccccacccucuuugaaaagaca

SEQ ID NO: 233099 - RNA, 64 nt, Human
uauuuacagagcuaauguuuguccuaaauuuucaggacccuagaggagagcuuuauacaauuac

SEQ ID NO: 233100 - RNA, 64 nt, Human
gagcuugccuuaggauggaccagcaagcccccguggacccuaaguuguucaccgggauuuauca

SEQ ID NO: 233101 - RNA, 64 nt, Human
uccccggggauucgagagccaugcgugggacacuggacccuacugucuacacgggcuugcacac

SEQ ID NO: 233102 - RNA, 64 nt, Human
cuccuacucuacagcauuaaagacugugggaccaggacccuaagucuccuuuccuucugggugg

SEQ ID NO: 233103 - RNA, 64 nt, Human
guuucaagagacccuaaaaaaccugccugucccaggacccuaugguaaugaacaccaaacaucu

SEQ ID NO: 233104 - RNA, 64 nt, Human
aacaugucuucaacucagcagagauggcccucugggacccuauacggacuccgccacuugagag

SEQ ID NO: 233105 - RNA, 64 nt, Human
uccccgccacgaucgucgcugugcuugguguguaggacccuaggcuccccgcccacccucugcc

SEQ ID NO: 233106 - RNA, 64 nt, Human
gaccgcccugguggacuccucccgcuggaggcggggacccuaacaaccuucaagaccagugaug

SEQ ID NO: 233107 - RNA, 64 nt, Human
gagaaaggaagagcuuuauguuucucuguuguuuggacccuacuuggcaugaaaaaggaagcuc

SEQ ID NO: 233108 - RNA, 64 nt, Human
ggcuugcagaguucuucucaccauuuaaacugaaggacccuauauuauauuucccuaacucuga

SEQ ID NO: 233109 - RNA, 64 nt, Human
ugcagggucccuccuuccugucaugcucccuccagcccaugacccggggcuaggaggcucacug

SEQ ID NO: 233110 - RNA, 64 nt, Human
acagccacccagcccuccugaagauagccagagagcccaugagaccgucccccagcauccccca

SEQ ID NO: 233111 - RNA, 64 nt, Human
ugccuggugcucuggccccucucguggagcuacugcccaugaugcuuuccuagugccugguuac

SEQ ID NO: 233112 - RNA, 64 nt, Human
agaugaugccuucuguugaauucuguuauuaagggcccaugaugagcuguaacuucucaagagg

SEQ ID NO: 233113 - RNA, 64 nt, Human
uggggccccucugugagaucucaaugcugucuggggacccuaagaguuuucucaccuguucagu

SEQ ID NO: 233114 - RNA, 64 nt, Human
guguagagcuggagggggucccuggcugcugaggggacccuaccagaugagcccugccucuggg

SEQ ID NO: 233115 - RNA, 64 nt, Human
cagcagcuagagguggcuggcuuuggccagacauggacccuaaaucaacagacaauggcauugu

SEQ ID NO: 233116 - RNA, 64 nt, Human
agaucaaaugcuaaauagaaccugugggucacaaggacccuaggcccagcggcccucuccucca

SEQ ID NO: 233117 - RNA, 64 nt, Human
ggucuuaggugucugugccccaggacagacccuaggacccuaaauccaauagaaaaugcauauc

SEQ ID NO: 233118 - RNA, 64 nt, Human
gcucuuaaguuguggagagugcaacaguagcauaggacccuacccucugggccaagucaaagac

SEQ ID NO: 233119 - RNA, 64 nt, Human
gguagcccuagcugccuugcagccccaaaccccaggacccuaucagcccccugggacucccugg

SEQ ID NO: 233120 - RNA, 64 nt, Human
gacccuuuucaauuucuuauuucuguguuacugaggacccuaaucacuuagggauguaauuuua

SEQ ID NO: 233121 - RNA, 64 nt, Human
uacuuaaacagaaagcaauuuccaaagaggccagggacccuaaucuuugaagagaugaagaaac

SEQ ID NO: 233122 - RNA, 64 nt, Human
gucaguuauaugaggagagugagaaucaagacgaggacccuaaugaugagggaucugugcuguc

SEQ ID NO: 233123 - RNA, 64 nt, Human
aagcaauaaaauuugauuguuaagauacaguaguggacccuacuuauucagucaauuaagagua

SEQ ID NO: 233124 - RNA, 64 nt, Human
aaccugcuguauccugugagcacuggucccauggggacccuauggcucccucaaucuucaccca

SEQ ID NO: 233125 - RNA, 64 nt, Human
gaggaaguaacagcuacgaugggaugggaacaguggacccuaagcaggccaagggugcguaggg

SEQ ID NO: 233126 - RNA, 64 nt, Human
aaugaaacagacucagggagguaggggcuggcagggacccuagaauccuugugauuuuucuuag

SEQ ID NO: 233127 - RNA, 64 nt, Human
caaaaauaaaaauaaaaauugcuuucagagaguagcccaugaaauuucccauucuucaaggaca

SEQ ID NO: 233128 - RNA, 64 nt, Human
uaugugguucuuaagugccagggagaucagccuugcccaugaagguugcauaugugugguauac

SEQ ID NO: 233129 - RNA, 64 nt, Human
cugagcuagcuggagaagaggggaggguccauaagcccaugacuaaaaacuaccccagcccagg

SEQ ID NO: 233130 - RNA, 64 nt, Human
uagagggggagaggguagcaaggugcuucucuacgcccaugacuugggagcaggucuuggccuc

SEQ ID NO: 233131 - RNA, 64 nt, Human
ggcuuggggaugacaguauggaacugucugcauuggacccuaaacuggacuagaagaggcaucu

SEQ ID NO: 233132 - RNA, 64 nt, Human
uaugcaaauaauggcuagaaaguaugguuuaacuggacccuauuaugccuuuuaaaaauaauuu

SEQ ID NO: 233133 - RNA, 64 nt, Human
cuauucucaugaacuuugaacccauguuaauuuuggacccuauaacuaauuuccuuucuguauc

SEQ ID NO: 233134 - RNA, 64 nt, Human
uuccaaugccacacugccucugagcccauccuugggacccuacucugugccagguuccuguccc

SEQ ID NO: 233135 - RNA, 64 nt, Human
uacugaugaaacuacugaugucagcuggucugaaggacccuaccagaagcuaaaucaucaaaga

SEQ ID NO: 233136 - RNA, 64 nt, Human
ucuuacaaagauguaacugaaagacuuuucgaauggacccuaugggacuccucuuuuccacugu

SEQ ID NO: 233137 - RNA, 64 nt, Human
aacucuggaaucaaauuuccuuguuugaauccugggacccuauugcauuaaaguacaaauacua

SEQ ID NO: 233138 - RNA, 64 nt, Human
aguuggaccaaggagaaagcccuuuggagaaacuggacccuaguucaguuuagaucucaaauau

SEQ ID NO: 233139 - RNA, 64 nt, Human
cguucacagauccuucucuugaccggaaacccugggacccuaagaaccccugaagcuuggggug

SEQ ID NO: 233140 - RNA, 64 nt, Human
auaaaucaugaaaggcacugaguuuuguaaaucaggacccuaaauguuuaauuguaaauaaguu

SEQ ID NO: 233141 - RNA, 64 nt, Human
auaguguaccauacugccuuucuuugcauggcuuggacccuaucugugaccaugcucuucuccc

SEQ ID NO: 233142 - RNA, 64 nt, Human
ucaaaaaaaucuaacaguaacacaccccugcuugggacccuagcuauaugcauuuuaugugacc

SEQ ID NO: 233143 - RNA, 64 nt, Human
ccccgaaccacccaaccacauccauaggggugcaggacccuaaguagacuggguagaaacccca

SEQ ID NO: 233144 - RNA, 64 nt, Human
uaacucggugggcccagguucugcucuucccuggggacccuaaccucgccuccagcugaccugc

SEQ ID NO: 233145 - RNA, 64 nt, Human
gguagaugaguaggaagauuaggacuccugaguugcccaugauuucaucuaauuuuuggauuca

SEQ ID NO: 233146 - RNA, 64 nt, Human
ggcccggcucacuucugguuaucugucacccugagcccaugagcugccuuuuaggguacagauu

SEQ ID NO: 233147 - RNA, 64 nt, Human
cccccagccugcaccaguauuguuuucaaacauugcccaugaguaggcccuuugaagaguuagc

SEQ ID NO: 233148 - RNA, 64 nt, Human
accuaucuaacccccaaccacagcccccuugguggcccaugaguugcuuccaugaaaucuuagg

SEQ ID NO: 233149 - RNA, 64 nt, Human
aucugucagguggcaccgagcaggaugcggggauggacccuagauaccacagccugcccccucc

SEQ ID NO: 233150 - RNA, 64 nt, Human
auguauuucgcucaucuggacccugcagugucagggacccuauggaggcaagccaguaauaaag

SEQ ID NO: 233151 - RNA, 64 nt, Human
augucuuucccuaauacaggguugcgcuugcauuggacccuagggauuugcacuaaaauuauau

SEQ ID NO: 233152 - RNA, 64 nt, Human
cugcuaucaagcuguguaaaaauuuacuuucacuggacccuaaauuauugucucugcuaucuga

SEQ ID NO: 233153 - RNA, 64 nt, Human
ccaugacugggaagaggccuguggcagcgccgcuggacccuaggaggcucagaggcaguggugu

SEQ ID NO: 233154 - RNA, 64 nt, Human
augcccucuucuguuugucuugcaccuugucuaaggacccuaaaugaacgauaaacagagaugg

SEQ ID NO: 233155 - RNA, 64 nt, Human
auauuuaacuuuuuuucauuauaaaaugguuagaggacccuacccccucuagauucccugauuu

SEQ ID NO: 233156 - RNA, 64 nt, Human
acacccaacuuuccaaagacccugagacaagucaggacccuacuacucuccccugcugcuuucc

SEQ ID NO: 233157 - RNA, 64 nt, Human
uagcagagcagguucaagggaaauuaaaugauauggacccuaauuuguaucauucugaguugau

SEQ ID NO: 233158 - RNA, 64 nt, Human
ccuaaggcccaggucagggcaucuggagucugaaggacccuaguuccuagaggcaucuggcagc

SEQ ID NO: 233159 - RNA, 64 nt, Human
uacagggugaaauaaagucuugucuuagaaaccaggacccuaaaccccacacuauguaauagaa

SEQ ID NO: 233160 - RNA, 64 nt, Human
gccagcugccuugucugaacagaacguagugguaggacccuagcugggauucuggcaucugccu

SEQ ID NO: 233161 - RNA, 64 nt, Human
guggaaucuuuaaucuuguuaauacuuguuauauggacccuaagauauuuuauuacagaguuuu

SEQ ID NO: 233162 - RNA, 64 nt, Human
acuaaaaagagcacuuugcccguacuuaggcuguggacccuaaaacagcaguguuucaacaaga

SEQ ID NO: 233163 - RNA, 64 nt, Human
uggcuacacugcaacuuccguccagugcugugaugcccaugacaccugcaaaauaaguucugcc

SEQ ID NO: 233164 - RNA, 64 nt, Human
auagggcaagaccuuugugcuuuugaucauucuggcccaugaaagcaacuuuggucuccuuucc

SEQ ID NO: 233165 - RNA, 64 nt, Human
ugaucgccugacagaucccaccugccuguccacugcccaugacugagcccagccccagcccggg

SEQ ID NO: 233166 - RNA, 64 nt, Human
cacagggagcuucuuucuccuuagccaguaaucugcccaugaugaucccugacagcaaaaaguu

SEQ ID NO: 233167 - RNA, 64 nt, Human
augucauuucuccuaccauagcacaaauccuagcggacccuaggagcaaagaggggggcagccc

SEQ ID NO: 233168 - RNA, 64 nt, Human
uuccuacuugcaguacaucaaaggaauggaugguggacccuacuauucauguuuugagacauaa

SEQ ID NO: 233169 - RNA, 64 nt, Human
gcauaucuucucagcaauaacuccaugggcucugggacccuaccccuuccaaccuucccugcuu

SEQ ID NO: 233170 - RNA, 64 nt, Human
cuuccaaguaggaaacuuccuuuccccugccccgggacccuaucugccuauccccuccccugcu

SEQ ID NO: 233171 - RNA, 64 nt, Human
gagggggaagagaaguccucagcuggggcucaugggacccuaccacccucccugcuccuuccug

SEQ ID NO: 233172 - RNA, 64 nt, Human
gcaccaagaugccuucuaaaggcugacauaccuuggacccuaauggggcagagaguauagcccu

SEQ ID NO: 233173 - RNA, 64 nt, Human
gagcaccccggcuucccgcgcgcccucaccaaaaggacccuacagcaaacgggugucuuucgac

SEQ ID NO: 233174 - RNA, 64 nt, Human
ggaguaauagaaagcuccauuacucaacuggaaaggacccuaaugacagggcaacugaacagau

SEQ ID NO: 233175 - RNA, 64 nt, Human
cacuuuuaguaccaacacucuugggugauuucauggacccuaaagcagaccugacacugaucca

SEQ ID NO: 233176 - RNA, 64 nt, Human
aaaguaaaguguucugccagaucuuagguauagaggacccuaacacaguauaucccaagugcac

SEQ ID NO: 233177 - RNA, 64 nt, Human
ggggggaaaaacuggugaaaaagaaauauaaaaaggacccuaaaaagaauucugcaaaauaaga

SEQ ID NO: 233178 - RNA, 64 nt, Human
cagagucacugccccauaaucaccaugucagaagggacccuagggcauucguguccuauuuauc

SEQ ID NO: 233179 - RNA, 64 nt, Human
gguuuuagaauucuugcaucacucgcgggcccuaggacccuaggaugccauucuugccaggagg

SEQ ID NO: 233180 - RNA, 64 nt, Human
guaaaggaagacuuggaguuuacaaucagaaccuggacccuaaagaacagugacugcaaaggca

SEQ ID NO: 233181 - RNA, 64 nt, Human
uccaguccuucacuuaucaauaugcauuccuauugcccaugacagguauggaguucacacugug

SEQ ID NO: 233182 - RNA, 64 nt, Human
ucgacuuuuccuuggucuccaguggaagggaaaagcccaugaucuucaagcagggaagccccag

SEQ ID NO: 233183 - RNA, 64 nt, Human
cacucugcucuggucaagccccauuuggucuacagcccaugagaaggaaugaggcugguucugc

SEQ ID NO: 233184 - RNA, 64 nt, Human
guugugauucuuguccauaagcaccaaauuugaugcccaugauuucaaaaggucauuucuuuua

SEQ ID NO: 233185 - RNA, 64 nt, Human
ucuggcucugcccuagguuggaaagaguuggauuggacccuacuugccuucccgggcaaggaua

SEQ ID NO: 233186 - RNA, 64 nt, Human
ccugcuccuccugccuccugggguccagugacugggacccuacucuagaacuguguaccaucca

SEQ ID NO: 233187 - RNA, 64 nt, Human
cgacagcgugguggugacuucuagguagaccgauggacccuaaauugggcaguggcauuguuuc

SEQ ID NO: 233188 - RNA, 64 nt, Human
gggcaguaauuaggggugagggaaaggagauaggggacccuaggagguagagugggaccauguc

SEQ ID NO: 233189 - RNA, 64 nt, Human
aaauuuucucaaaaaguaacuaaaaaauugugucggacccuacuuuugagaaaucuacguuucc

SEQ ID NO: 233190 - RNA, 64 nt, Human
agcucccgggcacauccaggaaggaccuugcuuuggacccuacacacuucggcucucuggacac

SEQ ID NO: 233191 - RNA, 64 nt, Human
gcuccguguugcaguucaggacuccuugcuucuuggacccuacuauuuauccuggacuagcuug

SEQ ID NO: 233192 - RNA, 64 nt, Human
agcgagacugucucuaaaaaaaaaagacucaaguggacccuacaaugaagccuacacaucccaa

SEQ ID NO: 233193 - RNA, 64 nt, Human
uuagaguuuugcaugagauucuaauacuucaguaggacccuaccuacgugguucaucuacaaug

SEQ ID NO: 233194 - RNA, 64 nt, Human
uauuacaaaauuauuuuuauggucccuuuaacgaggacccuauggcaaaugcacaauuauucag

SEQ ID NO: 233195 - RNA, 64 nt, Human
uaaaaguacuuauaaacauacuaauccucuuucaggacccuaaaguugcagguuaguaggucuu

SEQ ID NO: 233196 - RNA, 64 nt, Human
uccucuccccuggacacaggagacccacagggcaggacccuaagaucuggggaaaggagguccu

SEQ ID NO: 233197 - RNA, 64 nt, Human
ugggcucuagcaggacaguucuuuuguagccaggggacccuagaagugggguggggcggcucca

SEQ ID NO: 233198 - RNA, 64 nt, Human
aucacccacugcuucgccucugcuggaacaagcaggacccuaacuaccuggccaccauggccau

SEQ ID NO: 233199 - RNA, 64 nt, Human
gagccuguuaaccucucugugccuuaguuucuuagcccaugaaagagaucauugccugacccag

SEQ ID NO: 233200 - RNA, 64 nt, Human
acagcucuuuuugugaaguuagguucuuaaaagugcccaugauggucacuuaaaaugugcagua

SEQ ID NO: 233201 - RNA, 64 nt, Human
gacaauaaucuguccuguugauuuuguuuuccuugcccaugacuugaacaacuguguuuuaaag

SEQ ID NO: 233202 - RNA, 64 nt, Human
gggugagggcauggaggagggugaguucuccaaggcccaugaggauaugacugcccuggagaag

SEQ ID NO: 233203 - RNA, 64 nt, Human
ucugggacauccagcaaaugccccgagccauugaggacccuauccuggccuacacagcugaagg

SEQ ID NO: 233204 - RNA, 64 nt, Human
gaaauaaaaagccugucauuucaaacacugcuguggacccuacuggguuuuuaaaauauuguca

SEQ ID NO: 233205 - RNA, 64 nt, Human
ggaagaggagggaagcggccagcucacccuuccgggacccuaguguggggcgaaucucacggac

SEQ ID NO: 233206 - RNA, 64 nt, Human
aagagagcaagacccagggaaugggcccagggcaggacccuauucccuuggggucaagugaaag

SEQ ID NO: 233207 - RNA, 64 nt, Human
gcaguaauucuaggagauccuaagggguucagggggacccuacccccaccucagguugggcuuc

SEQ ID NO: 233208 - RNA, 64 nt, Human
uuuacauuaacaauuaggaucaguuguguggccgggacccuacucucacugaugagcugcugaa

SEQ ID NO: 233209 - RNA, 64 nt, Human
ggacucuuguauuugagggaccucaagagagugaggacccuaccauccacuguccauauucagu

SEQ ID NO: 233210 - RNA, 64 nt, Human
agaagccagagcccacauccugugcacugcugaaggacccuacgcucgguggccuggcaccuca

SEQ ID NO: 233211 - RNA, 64 nt, Human
gccgugcauuuucucgucucacgcaguucgaggaggacccuagaaagccaggagcugugauuga

SEQ ID NO: 233212 - RNA, 64 nt, Human
aggacuuaaaauuagucuuuuguaauaucaagcaggacccuaagaugaagcugagcuuuugaug

SEQ ID NO: 233213 - RNA, 64 nt, Human
ugucccacguucucugcugacaucccccaauaaaggacccuaacuuucgauacugacuuccugg

SEQ ID NO: 233214 - RNA, 64 nt, Human
gacccuguccccgccccagccguccuccugggguggacccuaguuuaauaaagauucaccaagu

SEQ ID NO: 233215 - RNA, 64 nt, Human
ugguccgguggagggaagacccccccucaccccaggacccuaggagggggugggggcagguagg

SEQ ID NO: 233216 - RNA, 64 nt, Human
aaaagcaggagucaggcugccacccccuaaggagggacccuaacguucugcccuugccugguuc

SEQ ID NO: 233217 - RNA, 64 nt, Human
uaaaccugaaauuggugugucugcaaucuguuuggcccaugaccuuuuaccuagucccaguuau

SEQ ID NO: 233218 - RNA, 64 nt, Human
gccucccuaguuagcauccaggcuggccagugcugcccaugagcaagccuagguacgaagaggg

SEQ ID NO: 233219 - RNA, 64 nt, Human
gggagaaaaggaauguauuuaaacaauuuccgaugcccaugaugaguuuaaaaaccagcauuga

SEQ ID NO: 233220 - RNA, 64 nt, Human
agaauggagauaacagggguggcaggguuacugagcccaugacaaugcuucucugugacucaaa

SEQ ID NO: 233221 - RNA, 64 nt, Human
ccuuggaggcaaccucccauuuuagauguuuaaaggacccuauauguggcauuccuuucuuuaa

SEQ ID NO: 233222 - RNA, 64 nt, Human
gaauuccucugcuugacauccucccugucacuuuggacccuaugggagugggcaucuccacgca

SEQ ID NO: 233223 - RNA, 64 nt, Human
caacugcagugugaggacagcgucucgggaggcaggacccuagggagacccgggugugcgccgc

SEQ ID NO: 233224 - RNA, 64 nt, Human
ccagcccugggucugucucugggguaaugaaaaaggacccuaauaaacaccugcucacuggcug

SEQ ID NO: 233225 - RNA, 64 nt, Human
uugacugugagacccucauugaccaguauuuaagggacccuaaccuccaaaagagguacccauu

SEQ ID NO: 233226 - RNA, 64 nt, Human
caccggugaaggcaggugcgguaacugccgcacuggacccuaggaagccccagguauucgcaau

SEQ ID NO: 233227 - RNA, 64 nt, Human
gagcaggguuccccacaguuucagaggugguccaggacccuaugauauuucucuucuuucguuc

SEQ ID NO: 233228 - RNA, 64 nt, Human
aagagaccagugggguggugcaggguggacuuggggacccuaccccugaagacugaggcccugc

SEQ ID NO: 233229 - RNA, 64 nt, Human
uagcucaucacuuggguagcagguacccauuuuaggacccuacacucaaaugugcaaaauaaaa

SEQ ID NO: 233230 - RNA, 64 nt, Human
gguggaccagcaacuagcccuggggcuggacaguggacccuaccagccugcgggaaggugguau

SEQ ID NO: 233231 - RNA, 64 nt, Human
cuuugaagggcaacaaacaaccauccacacugccggacccuaggcuguucagggaggcagcuca

SEQ ID NO: 233232 - RNA, 64 nt, Human
aagcugccgaagcagccacuggaaagaacccuggggacccuaauguuggacucucggcgcgaca

SEQ ID NO: 233233 - RNA, 64 nt, Human
caguaagccgaaaggaugaagaguuagaccccauggacccuagcucauacucagacgccccccg

SEQ ID NO: 233234 - RNA, 64 nt, Human
caccuggcggaggcuggggggggcucugucagcaggacccuagaggagacucucauucgauuuu

SEQ ID NO: 233235 - RNA, 64 nt, Human
gcuguuuccagugaaucacauuucgucauuugaagcccaugaggaccauuguguggauccaugg

SEQ ID NO: 233236 - RNA, 60 nt, Human
uaagaaaaaaaggaaguuaagucaucagaggcccaugaaagacaauuuuauuauuuuaga

SEQ ID NO: 233237 - RNA, 64 nt, Human
aucgugcuuuguuuuaugcuacuccucccacccugcccaugauuaaacaucauguauguagaag

SEQ ID NO: 233238 - RNA, 64 nt, Human
ggaauugcucucccagcccuugcauugcagaggggcccaugaaagaggacaggcuaccccuuua

SEQ ID NO: 233239 - RNA, 64 nt, Human
ggggagcagggggcccaccagagcuguggagaggggacccuaagacuccucggccuggcuccua

SEQ ID NO: 233240 - RNA, 64 nt, Human
ggcuucuuuuuuuuuuuuuuuuuuuugggugaggggacccuacucuguuaucccaagugcucuu

SEQ ID NO: 233241 - RNA, 64 nt, Human
acccugaggcuugcugggagugggguggccugggggacccuagacagccgggaaggcuguugug

SEQ ID NO: 233242 - RNA, 64 nt, Human
cuuucaguaaggaagggucuuugggguuuucugugcccaugacuugggggcugcacccccacag

SEQ ID NO: 233243 - RNA, 64 nt, Human
gaaggcacacgccugccaggcagggcagucuggcgcccaugaugggagggauugacauguuuca

SEQ ID NO: 233244 - RNA, 64 nt, Human
gguggggaccuggggggagggacagggcaggcgggcccaugaagaaagccccucguugcccagc

SEQ ID NO: 233245 - RNA, 64 nt, Human
acucuacccagaccucaccucccuuccuccuuuugcccaugaacaagaugcaguggcccuaggg

SEQ ID NO: 233246 - RNA, 64 nt, Human
uagaucaggaggcaucacugaggccaggagcucugcccaugaccuguaucccacguacuccaac

SEQ ID NO: 233247 - RNA, 57 nt, Human
uguccuccagauaccacugagcucacugcccaugauucagagcuuucaaggauaggc

SEQ ID NO: 233248 - RNA, 57 nt, Human
uguccuccagauaccacugagcucacugcccaugaugcagagcuuucaaggauaggc

SEQ ID NO: 233249 - RNA, 64 nt, Human
ucuuuauauaccuucaagcaacccuuuggauuaugcccaugaacaaguuaguuucucauagcuu

SEQ ID NO: 233250 - RNA, 64 nt, Human
cucuuuggacuaggcugacagcaggaagagcagggcccaugaccggguggaaguucaguuuugg

SEQ ID NO: 233251 - RNA, 64 nt, Human
ucuacccagucucaggccugcuuaccuccucacagcccaugaagaccccuucucagccccaaaa

SEQ ID NO: 233252 - RNA, 64 nt, Human
ucccaggaaaagauagacuuuauaaacagugggagcccaugaacaaacauauaaaaguagcaac

SEQ ID NO: 233253 - RNA, 64 nt, Human
cuuccauuagaaugcuacaaguaacucagugaaggcccaugaaggaaauugggacuaguuuaua

SEQ ID NO: 233254 - RNA, 64 nt, Human
uuuuuagcugcaagucaaggacuagguugaugaugcccaugaccuguaauuguaaagaagcuug

SEQ ID NO: 233255 - RNA, 64 nt, Human
gcuaagaacagaauacagacauaaauaagucacggcccaugaccuugaagagcuuacggccuua

SEQ ID NO: 233256 - RNA, 64 nt, Human
cugucugcccuagggagaaggcagguggacaagggcccaugaaaaaauacaggugucuagacug

SEQ ID NO: 233257 - RNA, 64 nt, Human
acaugaaggacuaugcucugaggcuauacucugugcccaugagagcagagacuggaagggcaag

SEQ ID NO: 233258 - RNA, 64 nt, Human
aggaugcugaauguaaugccuggucaauguggaagcccaugagguugcccagggaagccuccaa

SEQ ID NO: 233259 - RNA, 62 nt, Human
cccaggcccugacgcuaugacacacagcgcgagcccaugagaggacagaggcggugggacag

SEQ ID NO: 233260 - RNA, 64 nt, Human
caugaacaaaaugcaagguuuaaccuuugguucugcccaugaagcauguaaucuuucuuacaca

SEQ ID NO: 233261 - RNA, 64 nt, Human
cauaaaauguucuuaaccuuugauucuacuuacagcccaugauagccucuuagauauaauaaau

SEQ ID NO: 233262 - RNA, 64 nt, Human
uuaaaacugguagagucuaaguauuauaugaagugcccaugauucugucaguaaauuugaacau

SEQ ID NO: 233263 - RNA, 64 nt, Human
guucaaauugugggguuuuuguuacaguuaggacgcccaugaagauuuaggggugaaaaaaaca

SEQ ID NO: 233264 - RNA, 64 nt, Human
gaaggggcaagaccucaaccuguugggguuuagggcccaugauggcagacauucuaccccuuuu

SEQ ID NO: 233265 - RNA, 64 nt, Human
caggcagggaggaauaauguuaguacccacaaaugcccaugacugugcccaaugugcuucucac

SEQ ID NO: 233266 - RNA, 64 nt, Human
cugcugucagccuggcuaugccgccaccggccccgcccaugaggacuaggagcccagccuugcg

SEQ ID NO: 233267 - RNA, 64 nt, Human
agaaccaguauguggcauuccugucaaauggccugcccaugaagcccuggaauuccagcuccac

SEQ ID NO: 233268 - RNA, 64 nt, Human
ucaucccuaauguagcagggggaaguauuuaauugcccaugauauguauuuuacuuauacuaug

SEQ ID NO: 233269 - RNA, 64 nt, Human
aaaaggguggcugcgacucaagaauaauaugggagcccaugaggagaaaaaggaagacuggaau

SEQ ID NO: 233270 - RNA, 64 nt, Human
agugaagauaggaagcucaucagauagaacaucagcccaugagauguuugcaacaaaucuuuug

SEQ ID NO: 233271 - RNA, 64 nt, Human
ugacucuagaaucuucugccuggcugaccucugagcccaugaucccuggcuugcugugcuucuc

SEQ ID NO: 233272 - RNA, 64 nt, Human
ucagguuuauuaaugccagaagaagaauaguacagcccaugauugaccagucaaaucgagcagg

SEQ ID NO: 233273 - RNA, 64 nt, Human
cuacuauggagguugaggugggaggaucgcuugagcccaugaggcccagguuacagugagccaa

SEQ ID NO: 233274 - RNA, 64 nt, Human
gcuaugugcacuccagaccccugcccaggcucaggcccaugagguauggagacacccuggcccc

SEQ ID NO: 233275 - RNA, 64 nt, Human
uugaggcccuaacaaauuucaggcccagccaagagcccaugaauggaggcugcaggaggcugag

SEQ ID NO: 233276 - RNA, 64 nt, Human
ccaagggaaucagggacaaaggcccuuccugccagcccaugaucccgggauuggcucucuuccc

SEQ ID NO: 233277 - RNA, 64 nt, Human
gcugaaaacacugaggugcucccaucugugcguggcccaugagcugggaugguccuccagcugc

SEQ ID NO: 233278 - RNA, 64 nt, Human
aggacacauaggacacaggaauuccuggguccuugcccaugacugugccaugugguaggacaca

SEQ ID NO: 233279 - RNA, 64 nt, Human
cauccagaaccugcagaaggugaacaccauccgggcccaugacaacccggugugcacgcugguc

SEQ ID NO: 233280 - RNA, 64 nt, Human
uuguggacugaagcucagccuguuaaucagaccagcccaugaguguauaacaaacagaauugga

SEQ ID NO: 233281 - RNA, 64 nt, Human
uuugcuuucuucagacaaacaagaaaacgggacagcccaugauuaauuuguacacagacaggga

SEQ ID NO: 233282 - RNA, 64 nt, Human
uaccacaggcacuagaaggacgaaucugccuacugcccaugaacggggcccucaagcguccugg

SEQ ID NO: 233283 - RNA, 64 nt, Human
ucagcccccacuccuguuccuugugcacccacuggcccaugagccucugccuggccccugcugc

SEQ ID NO: 233284 - RNA, 64 nt, Human
uuaccccucacugaaucugccuuuauauuguugagcccaugaccccaaacugcucuuuccaauu

SEQ ID NO: 233285 - RNA, 64 nt, Human
uggguccuccuagagucccccuaggucucuggcugcccaugaggcucaugaagcagaggguauc

SEQ ID NO: 233286 - RNA, 64 nt, Human
gcagaccuaagcacaguuuuaugaacacaauuuugcccaugacauugccuacaggauuuccaga

SEQ ID NO: 233287 - RNA, 64 nt, Human
caaguggggcccucggccucuuccuucguuccaggcccaugauuuucccuacacuucucccugg

SEQ ID NO: 233288 - RNA, 64 nt, Human
ggcaugugucuaaacaauagagugcuauuaaaaugcccaugaaccuuuaguuugccuguaauac

SEQ ID NO: 233289 - RNA, 64 nt, Human
ugacaacaugaccagcucagcaaaggcugagacugcccaugaccugaaggcuccagguggcuuu

SEQ ID NO: 233290 - RNA, 64 nt, Human
aaaguccagccacacucauucauccuuuccccaggcccaugaagagaggcaucucauuguagaa

SEQ ID NO: 233291 - RNA, 64 nt, Human
guagaaaaugauugaaagugacuuccguaucucagcccaugacucagcaaggcagaauggccac

SEQ ID NO: 233292 - RNA, 64 nt, Human
uaccauaccucacacagcguugguguugugagcggcccaugaaaagccaaauuaaaaaucaagg

SEQ ID NO: 233293 - RNA, 64 nt, Human
guguguguccccagucucccugaggccuggacucgcccaugaacccaagucggcuucuagacag

SEQ ID NO: 233294 - RNA, 64 nt, Human
guugggaggaaggguaccugguguccccagucaagcccaugaagcccaugcggccugcuacaug

SEQ ID NO: 233295 - RNA, 64 nt, Human
cuagaauggaugugcucacuggggucuguguggugcccaugaggacaaaguguagcagccuccu

SEQ ID NO: 233296 - RNA, 64 nt, Human
gccagggucucugacucugugucaccugacauuugcccaugagagccgcugggccuuagagagg

SEQ ID NO: 233297 - RNA, 64 nt, Human
cccuaggauggcuuuggugggagaggggauagaagcccaugacuucagacagacuuucucuugg

SEQ ID NO: 233298 - RNA, 64 nt, Human
acauacguggucugcggacagggcagcgcccccagcccaugacaagggagucuuguuuucuggc

SEQ ID NO: 233299 - RNA, 64 nt, Human
ucaaaaugacuucagaccacuucuagccuucugggcccaugaguaauaaugagcacacuaggga

SEQ ID NO: 233300 - RNA, 64 nt, Human
ggcccuguccuuugcuacccagggcugcccccaggcccaugaagccaauaggagagcguguggc

SEQ ID NO: 233301 - RNA, 64 nt, Human
ccugcaugcgccccucacgccccuggagcgcaucgcccaugagaacaccugcccccaggcccca

SEQ ID NO: 233302 - RNA, 64 nt, Human
ccaaaugcugagcccugauccaaaguugucuccugcccaugagcaccacagucaggccuugagg

SEQ ID NO: 233303 - RNA, 64 nt, Human
gagcacuugagccaagaguaugaggcugcagugagcccaugagccccaccacuacacuccagcc

SEQ ID NO: 233304 - RNA, 64 nt, Human
ccgacgaccucagaaaacccagaugggugguggugcccaugagccccugcuccucagccaggcc

SEQ ID NO: 233305 - RNA, 64 nt, Human
auaaaauugagacugaugaaacaucaauacuagagcccaugaggaugaaagaaauuaucaaaua

SEQ ID NO: 233306 - RNA, 64 nt, Human
uaaguaaucccagcacuuugggaggccgagacgggcccaugacaaggucaggagaucgagaccg

SEQ ID NO: 233307 - RNA, 64 nt, Human
ggacaguaaugguccuccugcuggccccagcaaggcccaugagugacugcccugacguauucac

SEQ ID NO: 233308 - RNA, 64 nt, Human
ugccagcugggaccuaggcucaguccuguguggugcccaugauccuucuggugggggaagaguu

SEQ ID NO: 233309 - RNA, 64 nt, Human
ccuccccgcacacacccguccauaccagcucccugcccaugacccucgcucagggaucccccuu

SEQ ID NO: 233310 - RNA, 64 nt, Human
cagcgcccucgcccagccccggcugcguuucccugcccaugacccucucguggggacccccggc

SEQ ID NO: 233311 - RNA, 64 nt, Human
ugugugcuugguuuacagguccagugguucuucagcccaugacagaugagaaggggcuauauug

SEQ ID NO: 233312 - RNA, 64 nt, Human
uauaaauaaaagggaggaauauauucugcuggaagcccaugaaccaucgcugagguucugauac

SEQ ID NO: 233313 - RNA, 64 nt, Human
accacggagcagggucaccaacccagaucuccaggcccaugaggauggaacaugaaaggagccg

SEQ ID NO: 233314 - RNA, 64 nt, Human
gcuuguacacauauacauaugaucaaauacuccugcccaugauccauucccuuuuguuauuguu

SEQ ID NO: 233315 - RNA, 64 nt, Human
ggaaaaauauuguuuggacauuacuugggugagugcccaugaaaacaucagugaacuuguaacu

SEQ ID NO: 233316 - RNA, 64 nt, Human
ccucuauguagugccgcucuuggggacaugggucgcccaugagagcgcagcccgcggcaaucaa

SEQ ID NO: 233317 - RNA, 64 nt, Human
ggagcauuuucuauggagccuccguauguuuuaggcccaugaccuucgugaggugacgggcacu

SEQ ID NO: 233318 - RNA, 64 nt, Human
guuugguuuuauaauuaaucagcucguuacuucagcccaugaaaauggcauccagggcugccag

SEQ ID NO: 233319 - RNA, 64 nt, Human
agcuccuggagauugccaccaagcccacguacccgcccaugaacccaauuccagcaccguugcc

SEQ ID NO: 233320 - RNA, 64 nt, Human
cuuccucucacucguucuugaaucagcuccaugugcccaugaaaucaauggccucuguauggag

SEQ ID NO: 233321 - RNA, 64 nt, Human
gucucaagccugaagaggcuccgcccacaagcuggcccaugaaguuagcaaugccuguggcuuc

SEQ ID NO: 233322 - RNA, 64 nt, Human
ggagcugaauauuggcucuggccucuuuagggaggcccaugaucgacuaaugcaguuggccgac

SEQ ID NO: 233323 - RNA, 64 nt, Human
ggcucccuggggggaggcagccagccaagacugggcccaugaacacagagagggccuaaccgag

SEQ ID NO: 233324 - RNA, 64 nt, Human
uuccaaacagagugagggucuuuucaagagggaggcccaugaggccauccagguaagggccugc

SEQ ID NO: 233325 - RNA, 64 nt, Human
gugugccuagggccuacuucccaaggugccacaggcccaugaugggauguugaggggccuggac

SEQ ID NO: 233326 - RNA, 64 nt, Human
gaggguuguggggggucucuaguugaauguuuuggcccaugacuuuggaacauggcuggcagcu

SEQ ID NO: 233327 - RNA, 64 nt, Human
uauuugcccagaguuugcucaauuccaagacagugcccaugaaugggacaccuguaauguaacc

SEQ ID NO: 233328 - RNA, 64 nt, Human
uauuaaaauauauuuaauauguuuugccuuuguggcccaugaaagucuuacugggcccugggga

SEQ ID NO: 233329 - RNA, 64 nt, Human
aauuuagauuuuaaaauguucccuguaaaagucagcccaugacaaggaaauuuacaaaauacua

SEQ ID NO: 233330 - RNA, 64 nt, Human
cucuucuugccucagccucagggauacgacacaugcccaugaugagaagcagaacguggugacc

SEQ ID NO: 233331 - RNA, 64 nt, Human
cucuucucgccucagccugggggauaugacacaugcccaugaugagaagcagaacauggugacc

SEQ ID NO: 233332 - RNA, 64 nt, Human; identical to SEQ ID NO: 233330

SEQ ID NO: 233333 - RNA, 64 nt, Human
cuggugggguaaggggcaggccagggcuguucacgcccaugagggaagaggaaagugccacugg

SEQ ID NO: 233334 - RNA, 64 nt, Human
uguguagcuucuuguagcuuagaaagcgcuuuaugcccaugaugucauuucaggcucaaccaaa

SEQ ID NO: 233335 - RNA, 64 nt, Human
uucaagggccaagcugccccuuucccuccucuccgcccaugaaaaugccuccaaacugagaugc

SEQ ID NO: 233336 - RNA, 64 nt, Human
uggcugcuucuuccccagccaugagucaguuugugcccaugaauaauacacgaccuguuauuuc

SEQ ID NO: 233337 - RNA, 64 nt, Human
cacauuugugauacugacagguaucaacccagaagcccaugaacuguguuuccauccuuugcau

SEQ ID NO: 233338 - RNA, 64 nt, Human
cgcuucuugccucagccucggggauaugacacaugcccaugaugagaagcagaacguggugacc

SEQ ID NO: 233339 - RNA, 64 nt, Human
cucuucuugccucagccucggggauacgacacaugcccaugaugagaagcagaauguggugacc

SEQ ID NO: 233340 - RNA, 64 nt, Human
cucuucuugccucagccuuggggauaugacacaugcccaugaugagaagcagaacguggugacc

SEQ ID NO: 233341 - RNA, 64 nt, Human
cucuucuugccucagccucggggauaugacacaugcccaugaugagaagcagaacguggugacc

SEQ ID NO: 233342 - RNA, 64 nt, Human
cucuucuugccucagccucggggauacgacauaugcccaugaugagaagcagaacguggugacc

SEQ ID NO: 233343 - RNA, 64 nt, Human
cuucuuuaugaggauagaucaaauuggcagucaggcccaugauagucagugcaguuggggcagu

SEQ ID NO: 233344 - RNA, 63 nt, Human
gggcucauccaggccgcccagcagcugcugugugaugagcaggccccacagaggcagaggcug

SEQ ID NO: 233345 - RNA, 63 nt, Human
gcuaucaaacccagagcggaaggagggagcucugaugagcacgguuugucacacgauaaaggg

SEQ ID NO: 233346 - RNA, 63 nt, Human
acacugucugccucagaacauagccgugaucaagaugagcacggaggcucgugucccagcacc

SEQ ID NO: 233347 - RNA, 63 nt, Human
cugaauuauuaaucucacuuagcgaaagugacggaugagcaguaaguaaguaaguguggggau

SEQ ID NO: 233348 - RNA, 63 nt, Human
cacauaggacaguuugggauuauccaaaacugggaugagcagcuugggauaauucacacacua

SEQ ID NO: 233349 - RNA, 63 nt, Human
ugucuuggacaugggauguggggagguggaaaugaugagcaguagcaucauuucucccuguug

SEQ ID NO: 233350 - RNA, 63 nt, Human
cccucucccuguggagaugaacauucuauccuugaugagcaugccagcuaugugguagggcca

SEQ ID NO: 233351 - RNA, 63 nt, Human
ugcugggugcugagacacugaucccccucauuugaugagcaaaugagcuacuuuucccuagac

SEQ ID NO: 233352 - RNA, 63 nt, Human
guuuuuuggcucuuucaaagguaauggcccaucgaugagcauuuuuaacauacuccauagucu

SEQ ID NO: 233353 - RNA, 53 nt, Human
ucugguacaacuguccuuagacugaugagcaaaggaggagucaacuaaugaag

SEQ ID NO: 233354 - RNA, 63 nt, Human
gaagcuucaggacucugcaggucaaggauaugugaugagcaccggccuaaguguuugcucuuc

SEQ ID NO: 233355 - RNA, 63 nt, Human
uguauuuuggggucugguugggccuggaaaauggaugagcacuucagaacaggucauuuuccu

SEQ ID NO: 233356 - RNA, 63 nt, Human
guggauucacugguuagauuaaaaagaggcugagaugagcagugaacuaagaggccacacaaa

SEQ ID NO: 233357 - RNA, 63 nt, Human
caccgaaagcaggcccuuagggcaggaagggacgaugagcaagucugccacaccaccugguga

SEQ ID NO: 233358 - RNA, 63 nt, Human
uuccuuacauguuuaaaaauaauuccaaugacagaugagcagcucacuuuuccaaaguacccc

SEQ ID NO: 233359 - RNA, 63 nt, Human
cuaucccggggguggaugcugaguccaggaggugaugagcaaguguacaaaagaaaaaaggga

SEQ ID NO: 233360 - RNA, 63 nt, Human
gccuagggugcagccaccugccugacacccagggaugagcaguguccagugcaguaccuggac

SEQ ID NO: 233361 - RNA, 63 nt, Human
cagcagccccugcagagccuggaagaggaggaggaugagcaggaggaggaagaggaggaggag

SEQ ID NO: 233362 - RNA, 63 nt, Human
gaguuucucuucuuaaaauguuuacugcugaaagaugagcaggaccagggcguuauaggcaga

SEQ ID NO: 233363 - RNA, 63 nt, Human
cagaguaaggggugagugacccaaggcucaauggaugagcagggucccugcugaggacuucuc

SEQ ID NO: 233364 - RNA, 63 nt, Human
uacucuacccucauucauccuuuugggcuaauugaugagcaucuuauuucuuaucucuaaaaa

SEQ ID NO: 233365 - RNA, 63 nt, Human
accccucaacagguuaguaaugcuggaauucuugaugagcaauaaugauaaccagagagugau

SEQ ID NO: 233366 - RNA, 63 nt, Human
auugcuuuuuuuuuuaauuguuggggagaggaggaugagcagaacuccuaugcagccugagag

SEQ ID NO: 233367 - RNA, 63 nt, Human
ggcuuaguucugaaaaccgauauguuguuggaagaugagcagccagaucacugccuaaucucg

SEQ ID NO: 233368 - RNA, 63 nt, Human
aaggugauggucaucgagauggagcuacgaaaggaugagcagagcccggagcuccggccugcu

SEQ ID NO: 233369 - RNA, 63 nt, Human
agugccuuugauguuuugaaauguauagugggagaugagcaaauguaaaugucaugugcccug

SEQ ID NO: 233370 - RNA, 63 nt, Human
ucuuccucuggagacugaacuuggguugguugugaugagcagccccuuggaggcugugagguu

SEQ ID NO: 233371 - RNA, 63 nt, Human
gucucgaguccuaaggccuuaggggucauguaugaugagcauacacacagguaauuauaaacc

SEQ ID NO: 233372 - RNA, 63 nt, Human
auguccucccucgagaaacagugccgccggugugaugagcacuuacacccacguucucaaggg

SEQ ID NO: 233373 - RNA, 63 nt, Human
agggggcagccacgcggccgaggauccccagcugaugagcagcagcgggccacccugucaccg

SEQ ID NO: 233374 - RNA, 63 nt, Human
acucaacaaauugccuuugcuauaucccuaugagaugagcagaucaaauauuccccgugaguu

SEQ ID NO: 233375 - RNA, 63 nt, Human
augaaguaggcacuguuaccaucugcaucuccagaugagcacccugagguuuagagagauuaa

SEQ ID NO: 233376 - RNA, 63 nt, Human
uggugcauacacaauguauuauuaucacugucagaugagcaugcuugaauguagcaugacugc

SEQ ID NO: 233377 - RNA, 63 nt, Human
cggcucacuaggcagccccagaucuggggaacagaugagcacguggggagcuggagugagcug

SEQ ID NO: 233378 - RNA, 63 nt, Human
ucuguuuugacagguuuuacuggaaguauaugugaugagcagaagagguuaucagcauuaaau

SEQ ID NO: 233379 - RNA, 63 nt, Human
ugguggucaucuuucuuguacuaauuaacuguugaugagcauuuuggauauucuaggagaaag

SEQ ID NO: 233380 - RNA, 63 nt, Human
uguagaaauuauucaagaaguuauugucuaagagaugagcaguagguaagaaaaccucaguca

SEQ ID NO: 233381 - RNA, 63 nt, Human
uaaaggugaauuauauaauuuauaauagcuguggaugagcacaggagagagaggaaagaaaag

SEQ ID NO: 233382 - RNA, 63 nt, Human
acaauaaauacuugaguggaggaaaguuaaaaagaugagcaauagaguagaaaauauaucuua

SEQ ID NO: 233383 - RNA, 63 nt, Human
gcucauugaaggcuaucuccaguugaucauugggaugagcaucuuugugcaugaauccuauug

SEQ ID NO: 233384 - RNA, 63 nt, Human
auuuuuuguacaauguaaagaucaucugagcaagaugagcauuuuguaaaaaugaaaauguga

SEQ ID NO: 233385 - RNA, 63 nt, Human
ugauuuaacugacuuaacaacugacuaaccauugaugagcacuccugauuuuuaucuagaaca

SEQ ID NO: 233386 - RNA, 63 nt, Human
uccaacaaauugcaaauaaaacuguauggaaacgaugagcaagcugccgcuuuuuuaaccuuu

SEQ ID NO: 233387 - RNA, 63 nt, Human
uagauugggaaccucauucagccguauugcacagaugagcaauuacagcagagaaaauucauu

SEQ ID NO: 233388 - RNA, 63 nt, Human
cacagugagacuuaaggaaauguuugguuggcagaugagcaccaaugacugcagcguggagug

SEQ ID NO: 233389 - RNA, 63 nt, Human
uaagaaacccucugucauucgcucccacauucugaugagcaaccgcuucccuauuuauuuauu

SEQ ID NO: 233390 - RNA, 63 nt, Human
gacagacgacagguccacccaagacugucaagggaugagcaucccaaaccugcuccacagagg

SEQ ID NO: 233391 - RNA, 63 nt, Human
uguuaccauucacugaaucuucucucagagggagaugagcaauugucagucaggauaauucug

SEQ ID NO: 233392 - RNA, 63 nt, Human
aagcagaacuaaugcugacuggauguuuaaugggaugagcauuaaagcugcaaucuacuauag

SEQ ID NO: 233393 - RNA, 63 nt, Human
caaccccugcaaccuucccuagcccccucaauagaugagcaggucaggcuguggcccuuaccu

SEQ ID NO: 233394 - RNA, 63 nt, Human
ccaccaggcccagccuauaucuaggagucucuugaugagcauuggucgacagaaagaagucuc

SEQ ID NO: 233395 - RNA, 63 nt, Human
cacagaugaggccgcccuugccugacggagcuugaugagcagcccuuggucuccgguuccagg

SEQ ID NO: 233396 - RNA, 63 nt, Human
auuuuaaauucucuuagccuacugauugguuuggaugagcacaccagcugcaggugugugcug

SEQ ID NO: 233397 - RNA, 63 nt, Human
ugcauaaaauaaacccauuuuaaugugcauucugaugagcacugacaaaggauaugguacuaa

SEQ ID NO: 233398 - RNA, 63 nt, Human
acacagcugaggacccuuguccucaguuggaaagaugagcaucagaucaagaaaaaggucuga

SEQ ID NO: 233399 - RNA, 63 nt, Human
caaagcgagcugagaccacagguucuugcucuggaugagcagcaugacaccaucaaaauuuaa

SEQ ID NO: 233400 - RNA, 63 nt, Human
aucuuuguugaaucuguugugcagauuuuucuugaugagcauucuguuuuuuuuucuuuguga

SEQ ID NO: 233401 - RNA, 63 nt, Human
aaccguagaccaagaaaucaggagaguucaagugaugagcagacgccuagucgggaugaugau

SEQ ID NO: 233402 - RNA, 63 nt, Human
gguuuacucuguggccaaaggagggucaggaaggaugagcauuuagggcaaggagaccaccaa

SEQ ID NO: 233403 - RNA, 63 nt, Human
gacaacaugacucauauauauacauguguauaagaugagcaugugucgaagacuuauucgacu

SEQ ID NO: 233404 - RNA, 63 nt, Human
cuguuugugcugacagguggccuagguccuggagaugagcacccucucucuggccuuuaggga

SEQ ID NO: 233405 - RNA, 63 nt, Human
uuuguggaacucacugccucaguuuggguaaaggaugagcagacaagucaacuaaagaaaaaa

SEQ ID NO: 233406 - RNA, 63 nt, Human
aaccucucaguaguuucuuucaguguacaaaaugaugagcauuuuucuaugaugagguuuuaa

SEQ ID NO: 233407 - RNA, 63 nt, Human
agucuguguauguuuaaauuuucacuuuuuauggaugagcauaaaccuagucuuaguuuaaag

SEQ ID NO: 233408 - RNA, 63 nt, Human
agugcgggaggccagcuccuggcaggcccucgcgaugagcagugggucagcugcgguguggga

SEQ ID NO: 233409 - RNA, 63 nt, Human
caggacaggcccucagaagcagcucuuggaggagaugagcauuuuguuuugcacaggaagaug

SEQ ID NO: 233410 - RNA, 63 nt, Human
cccuucacaguguacuugcggaagcuguuggaugaugagcagccccugcggcugcggcuccug

SEQ ID NO: 233411 - RNA, 63 nt, Human
aaggaaaccaucaagaaguggaaggcugaccaugaugagcaguagaugaauguguaugucuaa

SEQ ID NO: 233412 - RNA, 63 nt, Human
gacuaauagggauaauccagguaacuuugaagagaugagcagugagugaccaggcaguuuuuc

SEQ ID NO: 233413 - RNA, 63 nt, Human
auguguuauaauuuauuucgccaguuccacaaugaugagcauuuggauucuuuccaaucuuuu

SEQ ID NO: 233414 - RNA, 63 nt, Human
ccaaccuguccuccaauuccagcauucacagcugaugagcagugcaggagcagggcgagagga

SEQ ID NO: 233415 - RNA, 63 nt, Human
uggugguuuaacagccgaagacacacgccuagggaugagcacccucuuugugacacuucaucc

SEQ ID NO: 233416 - RNA, 63 nt, Human
cauguuaaugaauguuagcuauuauuacuaaaggaugagcaauuauuauuggcaucaugauuu

SEQ ID NO: 233417 - RNA, 63 nt, Human
accugccucucccaccuccagucuuuccccugugaugagcagaugaccaccgcccuccagggu

SEQ ID NO: 233418 - RNA, 63 nt, Human
ggagaagcuugccuuugaacuggaagauguugggaugagcagggaaagcuuagacuuuggagu

SEQ ID NO: 233419 - RNA, 63 nt, Human
guguguggugaucaaacuaucacaauucagugugaugagcagcauagcaaacagauggauuug

SEQ ID NO: 233420 - RNA, 63 nt, Human
ugagcauuuuacuaggcuuggaagagcugacaugaugagcauuauuguauguuuguauauaca

SEQ ID NO: 233421 - RNA, 63 nt, Human
gguuuacaggaaggcucugguucccccucacaggaugagcaugcucaguugggcgugugugga

SEQ ID NO: 233422 - RNA, 63 nt, Human
uccuuuagagggaugaaacaguuauuuccgucugaugagcauucgguagaauuuuugaaguga

SEQ ID NO: 233423 - RNA, 63 nt, Human
auggugacagcuguacaucaacucugccccuaggaugagcagaaguaccuggagcaucauucu

SEQ ID NO: 233424 - RNA, 63 nt, Human
agagcacauuuguggacuuccagauggucaggagaugagcaaaggauugguaugugacucuga

SEQ ID NO: 233425 - RNA, 63 nt, Human
uuuuguacauacuagaaaauacagcuaucuucugaugagcaauuguguugauuuucuuugcuu

SEQ ID NO: 233426 - RNA, 63 nt, Human
agcucaaacuggccuugguguaaaauguguaaggaugagcagcaggcgugccucguggguucu

SEQ ID NO: 233427 - RNA, 63 nt, Human
uaucucaucacccugcuuaucaauauucaguuugaugagcacuauuaacuaaaauaugaaacu

SEQ ID NO: 233428 - RNA, 63 nt, Human
guaugguuuaaaggaaauuuaucaggugagagagaugagcaacguugucuuuucucucaaagc

SEQ ID NO: 233429 - RNA, 63 nt, Human
auaaaugugugucaucguuauauuguucagcuagaugagcaaguaucuuaggguaguagguag

SEQ ID NO: 233430 - RNA, 63 nt, Human
gagguuugacucgaagcccagaguuuugguguggaugagcagggacaaauugcugagcaugaa

SEQ ID NO: 233431 - RNA, 63 nt, Human
agccugggaacuugggcaucguugggccagcaggaugagcagcaaagggucugaggacagggu

SEQ ID NO: 233432 - RNA, 63 nt, Human
aaguuuaaaaaugggccuuuucugagccccccugaugagcagucagugcuucugggcccagcu

SEQ ID NO: 233433 - RNA, 63 nt, Human
gugaaaugugcuggccucuggugcauuuugcaagaugagcacaaacuuucugggccuccaucc

SEQ ID NO: 233434 - RNA, 63 nt, Human
uagguagcagagaccaaggcgcagggugcuucagaugagcaagagaacccagucgaaccagau

SEQ ID NO: 233435 - RNA, 63 nt, Human
acuuggacuaaagucugaugaacuucccaaucagaugagcauggaugauuggccagaaaugaa

SEQ ID NO: 233436 - RNA, 63 nt, Human
ucuucauuacuauaaauauuucauuucccauuugaugagcaaaaucuacuucuaguguuagga

SEQ ID NO: 233437 - RNA, 63 nt, Human
agggugcccagcuuauaagaaugguguuagggggaugagcaugcuguuuaugaacggaaauca

SEQ ID NO: 233438 - RNA, 63 nt, Human
agauaaagagcagagggcacuugcagggccugggaugagcagucuucaagcugugguaguuag

SEQ ID NO: 233439 - RNA, 63 nt, Human
agcuguggaaaagggagagcagagaggaacugagaugagcagggaugaagggucaggcagaaa

SEQ ID NO: 233440 - RNA, 63 nt, Human
gccaaucugaacauuguuaauggccugugacaugaugagcacaggaacaggcaugaagauauu

SEQ ID NO: 233441 - RNA, 63 nt, Human
ggauauucuucaucagaagcuuuaaucaaagaagaugagcagaagacaaucacuggcucccug

SEQ ID NO: 233442 - RNA, 63 nt, Human
caugucccuccagggggaccccacagccuggcagaugagcagauaccccuggccacccauguc

SEQ ID NO: 233443 - RNA, 63 nt, Human
auuccagugugacaugaggaauuagauuuugaagaugagcauauauuacuaucuuuaagcauu

SEQ ID NO: 233444 - RNA, 63 nt, Human
cccgccagggagggggccugcauuggcugcaaggaugagcagagaacaaggacagaggccagg

SEQ ID NO: 233445 - RNA, 51 nt, Human
cgguggcugggauucguuagugaugagcagcugccagcugagcucugucac

SEQ ID NO: 233446 - RNA, 63 nt, Human
aaggauaauacagaccaacuaggcuacaucugugaugagcagcuagcaaagccgcuggucuuc

SEQ ID NO: 233447 - RNA, 63 nt, Human
uaaagacauauaggucacauauuauuauugccagaugagcauaaauagcuucuguuuggagau

SEQ ID NO: 233448 - RNA, 63 nt, Human
gauugccuauuuaccguuugacagagucccguagaugagcaauggggaacugguugccagggu

SEQ ID NO: 233449 - RNA, 63 nt, Human
uguggacggaaaggguggccaaauggauugagugaugagcagacauguuuaagggucuaaguc

SEQ ID NO: 233450 - RNA, 63 nt, Human
uuuuuucuuugaaaggggccuguucucaguaaagaugagcaaacauuuggaauuuacaugugg

SEQ ID NO: 233451 - RNA, 63 nt, Human
cacacacuuaaaaguuaguguacugaauggaaagaugagcauuccuaguucuacacuucuuuu

SEQ ID NO: 233452 - RNA, 63 nt, Human
uuuccuagcuguucuaauuaagaaaacuauuaagaugagcaaccacauuuagaaauguuuauu

SEQ ID NO: 233453 - RNA, 63 nt, Human
uguuuguuuuauuuggggcugggggagguauaugaugagcagacuucucggaauucauaauaa

SEQ ID NO: 233454 - RNA, 63 nt, Human
cggugcggacugauguggagaugugacagccccgaugagcaccuggcuggcugcaggguccua

SEQ ID NO: 233455 - RNA, 63 nt, Human
uuggcuuuguuuuuugugcuauuaggaaauucugaugagcauuacuauucacugaugcagaaa

SEQ ID NO: 233456 - RNA, 63 nt, Human
acugcugggggagacguuucugccacccugggugaugagcagcuuuuccccccuggcuuucug

SEQ ID NO: 233457 - RNA, 63 nt, Human
uucuuagauuuuguuagacuuuuuaaacucaaggaugagcauaagugcuugaaauaaaaugcu

SEQ ID NO: 233458 - RNA, 63 nt, Human
guaccccccgccgccccccuggaaagcacaagugaugagcaagaaggcauuuuccuugggaga

SEQ ID NO: 233459 - RNA, 63 nt, Human
acuuucccucugugggagacuaugaauauuccugaugagcacaaguaaaacuaaggcuucagc

SEQ ID NO: 233460 - RNA, 63 nt, Human
cuacucgguucacuugcccagaugucuucauaugaugagcaaggccagaagcaaggcuagauu

SEQ ID NO: 233461 - RNA, 63 nt, Human
guguagccaucuuugccuuuugcugcaauagaagaugagcaaaggauuaaacagaggcccaca

SEQ ID NO: 233462 - RNA, 63 nt, Human
ucaucuaggggcagcgcacggucuggggaagaggaugagcagagggaggaagauggcucccaa

SEQ ID NO: 233463 - RNA, 63 nt, Human
aaguaccuugacuuuguucacagcauguagggugaugagcacucacaauuguugacuaaaaug

SEQ ID NO: 233464 - RNA, 63 nt, Human
gggaccugcuugcuguggugguugccuagcccagaugagcauuuaccuaccaccuucccacuu

SEQ ID NO: 233465 - RNA, 63 nt, Human
cuauaaggaauaguccucaauguugggaaaacagaugagcaacccacuacccugaagucaucc

SEQ ID NO: 233466 - RNA, 63 nt, Human
caucccuggcaccgucaugggaguuugcucuuggaugagcauuacgggcaucugcccaaguuu

SEQ ID NO: 233467 - RNA, 63 nt, Human
uaguugguacucuuggauguguuuucucaccaagaugagcaaagaaagguuugcacagaggag

SEQ ID NO: 233468 - RNA, 63 nt, Human
acagugacuuucucagaggugacagagaugauggaugagcagcuggauuuucgugaugaagga

SEQ ID NO: 233469 - RNA, 63 nt, Human
cuguguaucacguaagugugugagugcagugcagaugagcaccauuuaguuauaugugcuagg

SEQ ID NO: 233470 - RNA, 63 nt, Human
aauggugucuuguagauaugugcaagguagcaugaugagcaacuugaguuuguugccacugag

SEQ ID NO: 233471 - RNA, 63 nt, Human
aaccacaucauggaccaaaugugccauacuaaugaugagcauuuagcacaauuugagacugaa

SEQ ID NO: 233472 - RNA, 63 nt, Human
agagccagauugugccaacuauccaaaaacuuagaugagcagaaugacaaaaaaaaaaaggcc

SEQ ID NO: 233473 - RNA, 63 nt, Human
ucacuagggagaaggaugcacaaauaaguaauggaugagcaaacagaauuaccugagcuaacu

SEQ ID NO: 233474 - RNA, 63 nt, Human
auguucuggaugaaaagagcaggaguaacaauugaugagcaauauucagagugaaguaaaucu

SEQ ID NO: 233475 - RNA, 63 nt, Human
ccauacaaacaucugugugagggcaguucuggagaugagcagagagagaccggaauaaacuca

SEQ ID NO: 233476 - RNA, 63 nt, Human
uagcuuaucugccccucccccacuuucaagacagaugagcaggagcuugggucucucucggcc

SEQ ID NO: 233477 - RNA, 63 nt, Human
ggaacacaugggggucucauugaaaagcucucugaugagcaccuccuuuugugcaaaguuaau

SEQ ID NO: 233478 - RNA, 63 nt, Human
auggcuggacucagagaguuggagucguuuugagaugagcauuagccccagcuuuguaaccaa

SEQ ID NO: 233479 - RNA, 63 nt, Human
gaggaucggagggcgcuaugucguggcugggaagaugagcaucuccccuaacaccaccuaccc

SEQ ID NO: 233480 - RNA, 63 nt, Human
gagcaucaggucuucaucucuaagauagagcaagaugagcaccuaaacguuucagggcugaaa

SEQ ID NO: 233481 - RNA, 63 nt, Human
aggccugcuuuccagacuucugagauagccugggaugagcaauccuguuauaguacaucugga

SEQ ID NO: 233482 - RNA, 63 nt, Human
uugaauuggcaauauauauucuagcuguuacuagaugagcaauuuaaaaagguguagcuauua

SEQ ID NO: 233483 - RNA, 63 nt, Human
ugccuuucugacggccccccucagagggacggcgaugagcacuaaaugcuuuuuugacuauuu

SEQ ID NO: 233484 - RNA, 63 nt, Human
cuguuccuauucaucuggaaggagggaggcuuggaugagcaggggaugagagcugcagggaaa

SEQ ID NO: 233485 - RNA, 63 nt, Human
ucuaucagggucuucccauggugguucagaauagaugagcauagcaugguuuuguuuguuuuu

SEQ ID NO: 233486 - RNA, 63 nt, Human
accaugauucccacagccagcucuuggcuccaagaugagcacccacaggaagccgacccaggc

SEQ ID NO: 233487 - RNA, 63 nt, Human
acccacacccacccacucacuuguaagcuccuugaugagcaaaccccuaaggcccccagcuca

SEQ ID NO: 233488 - RNA, 63 nt, Human
ucagagcacaccugaacccuauccugggcuggugaugagcagaaaucagaccuuuuucuaugc

SEQ ID NO: 233489 - RNA, 63 nt, Human
aguugcgguauuuaacguaucugccaauaccaggaugagcaacaacaguaacaaucaaacuac

SEQ ID NO: 233490 - RNA, 63 nt, Human
guaaggcaggaggaagugggugagcuccgagaugaugagcacaugaagccuguggccccuucg

SEQ ID NO: 233491 - RNA, 63 nt, Human
caagccguuauaugccuaguggguaguuccccugaugagcagaaaaaugaacucaaaucaggc

SEQ ID NO: 233492 - RNA, 63 nt, Human
uuguccuuggagacugcaguuuuaguggagucugaugagcaaguuucuggacugggagguaaa

SEQ ID NO: 233493 - RNA, 63 nt, Human
cucugcagcccacugccugcccagugccaucaggaugagcaguaccggccaagcauaaugaca

SEQ ID NO: 233494 - RNA, 63 nt, Human
gucugugccguuugucuucguggccauccugcagaugagcaccguguccagugccacagcaca

SEQ ID NO: 233495 - RNA, 63 nt, Human
uuguuacuuucuuaguauguacagucuucucaggaugagcaguaaaaccuuugaacaaagguc

SEQ ID NO: 233496 - RNA, 63 nt, Human
cccguggaccacagucuuggcugagaucaaagggaugagcaacagggacuucugccacaguga

SEQ ID NO: 233497 - RNA, 63 nt, Human
aacucagaacaggaguaacugcaggggaccagagaugagcaaagaucuguguguguuggggag

SEQ ID NO: 233498 - RNA, 63 nt, Human
ggaaccguguccagcacagaaggaaucugugcagaugagcagucacacuguuacuccacagcg

SEQ ID NO: 233499 - RNA, 63 nt, Human
aggucuaugaacaagcuuagaucagguccuguggaugagcaugugguccccacgaccuccugu

SEQ ID NO: 233500 - RNA, 63 nt, Human
agggaggagugauacaugacaauaaaugagucagaugagcaagaaggccccagaacccaugcc

SEQ ID NO: 233501 - RNA, 63 nt, Human
ccuccaguacaauuuguauaguuugcugcccuugaugagcaaaaaguauuuaucuugggcuua

SEQ ID NO: 233502 - RNA, 63 nt, Human
ucugcuuaauagucuuauagaaaaaggaaaggugaugagcaaauaaaggaacuucuagacuuu

SEQ ID NO: 233503 - RNA, 63 nt, Human
ugcaaaccucagagggauaaggcaguugaaccugaugagcaagaauuauaacagcaaggaaac

SEQ ID NO: 233504 - RNA, 63 nt, Human
gaggcgucauacagaggcaguggggugggcacagaugagcagaguggaugguucggugggucc

SEQ ID NO: 233505 - RNA, 63 nt, Human
cugugcccuccccuggcacucugacugcaugcugaugagcaaggcaggcaggucugagaggcg

SEQ ID NO: 233506 - RNA, 63 nt, Human
uuguuccuucccucccuuccucucccaccaugcgaugagcauccuuucaggccagugucugca

SEQ ID NO: 233507 - RNA, 63 nt, Human
aaguagcagugagcauugcacggaacagauucagaugagcauuuuccuuauacaauaccaaac

SEQ ID NO: 233508 - RNA, 63 nt, Human
ggcagagcuagagggguccuuagacuuuucacugaugagcaguuguugguuuuuucuuucucc

SEQ ID NO: 233509 - RNA, 63 nt, Human
acauuagugaaaauucuguuggugccacgcuuugaugagcauuuguuugaccccaguuucuuc

SEQ ID NO: 233510 - RNA, 63 nt, Human
gucacuaaggagagagggucaggagccagaguugaugagcagaucuguggaagaacaauccag

SEQ ID NO: 233511 - RNA, 63 nt, Human
ggucaagaggaggauuuuguuuuguaguuugcagaugagcauuucuaaagcauuuucccuugc

SEQ ID NO: 233512 - RNA, 63 nt, Human
uugaguuacuguugcuuccucgccugcuggcuugaugagcaccgauggugggaucugaccccg

SEQ ID NO: 233513 - RNA, 63 nt, Human
uuugagauauaaaaauuucuuuugguuuuuuaugaugagcaaauauaaguuaaugccaaacgu

SEQ ID NO: 233514 - RNA, 63 nt, Human
gugccguuauuaccuagcaacccuugcaaugaagaugagcagauccacaggaaaacuugaaug

SEQ ID NO: 233515 - RNA, 63 nt, Human
uuugcaggugcucuuuucuuugaauggagauuugaugagcaagugguuaggaugcagggagag

SEQ ID NO: 233516 - RNA, 63 nt, Human
auuaguucgagaaauucgaaaacauaaagaaaagaugagcaaagaugguaaaaagaagaaaaa

SEQ ID NO: 233517 - RNA, 63 nt, Human
gcugaggcauuugugagucuuccuuauaaaccugaugagcagaucucaacuaucuagcuugug

SEQ ID NO: 233518 - RNA, 63 nt, Human
uggaccuaauagcauuucuuugugcaguuaggugaugagcacugcuuugaggcccaagcacua

SEQ ID NO: 233519 - RNA, 63 nt, Human
uaccuuguaugcaaacgaugauaaacuagucaggaugagcagagcugccugaccucuugauuu

SEQ ID NO: 233520 - RNA, 63 nt, Human
uucaacuccuacaaccaaaugagaaaaaucagggaugagcagcuuuaucccauuugggguauu

SEQ ID NO: 233521 - RNA, 63 nt, Human
ugugccauuuauuuucugugccaucuguuaaaugaugagcauuuaauaaaauugugauaauca

SEQ ID NO: 233522 - RNA, 63 nt, Human
gauuaggcagcagcugaagccaccccugcugaugaugagcaagugccugcugcagguccaaac

SEQ ID NO: 233523 - RNA, 63 nt, Human
aucaucucauucacauuugggaaacgaacaggagaugagcaaagcugcuugcacuucagucag

SEQ ID NO: 233524 - RNA, 63 nt, Human
aacaucuacaugguuuuuuaucuuauuguaauagaugagcauauuuuuuuaccagacauaaau

SEQ ID NO: 233525 - RNA, 63 nt, Human
ggugcgagggccgggagacagauacuuggcugugaugagcagacauccucuguccccguggag

SEQ ID NO: 233526 - RNA, 63 nt, Human
cgaugugcgcacacacagauaugcacacacauggaugagcacacacacaccaaugcgcacaca

SEQ ID NO: 233527 - RNA, 63 nt, Human
accuccaaagcugaaagagccagguauuuaccugaugagcagaggggaccacugauuggcaga

SEQ ID NO: 233528 - RNA, 63 nt, Human
aaucuggacaaagucgacuuaacagauuuuucugaugagcauguuuuaugaauccuccauugu

SEQ ID NO: 233529 - RNA, 63 nt, Human
ccuuacuuuaaauguucugccaucauuucaccugaugagcauucuuggagccugccagauauu

SEQ ID NO: 233530 - RNA, 63 nt, Human
agccccgugccaggagcaaugggacuggagucagaugagcaaggacauugccccaagauaggg

SEQ ID NO: 233531 - RNA, 63 nt, Human
gugucaaggagaagaaucauuuguuuacaaacugaugagcagaucccagaccuucucuaccuu

SEQ ID NO: 233532 - RNA, 63 nt, Human
aaagaacaaugaccacagucaacauccucugaggaugagcaagcugauucugguuuguauauu

SEQ ID NO: 233533 - RNA, 63 nt, Human
ggccuccucacaacauggugucuggauucccaggaugagcaucccaggaucgcaagagccaug

SEQ ID NO: 233534 - RNA, 63 nt, Human
ggguuuucaucaagacuggaagguggggacagggaugagcauggagcuggccgugggccuggg

SEQ ID NO: 233535 - RNA, 63 nt, Human
cugugguuauguagagacuccauguccuggugugaugagcaggaucagagugacucugggagg

SEQ ID NO: 233536 - RNA, 63 nt, Human
uguagauaggcaccaccgaguuuaagauacugggaugagcaugcuucauuggauucauuuuau

SEQ ID NO: 233537 - RNA, 63 nt, Human
acuucagcagggcggcgacuuggcaagacaaaugaugagcaggaaaacaccacuggaucucac

SEQ ID NO: 233538 - RNA, 63 nt, Human
uuuugucuucaccauugucaaccagcagucaaggaugagcaccagguauaguccugguuugau

SEQ ID NO: 233539 - RNA, 63 nt, Human
guauuucagggcagcaaguguuugugaagcaaggaugagcagcaugaagaugucagaucagca

SEQ ID NO: 233540 - RNA, 63 nt, Human
ccuucccuuuccuaggauuuuauggggagguuugaugagcauuugccuuucuccccagagagc

SEQ ID NO: 233541 - RNA, 63 nt, Human
ggcugaucucagggaagcccagcuccagggccagaugagcagaagcucucgauggacaaugaa

SEQ ID NO: 233542 - RNA, 63 nt, Human
uucuagauguuuugguuauacagcuucauuuuagaugagcauucuuauuuuuuguuuuguuug

SEQ ID NO: 233543 - RNA, 63 nt, Human
ucucugcugcagaaagcagacuugcauaucccugaugagcagcucggcuacuuuuguaaacuu

SEQ ID NO: 233544 - RNA, 63 nt, Human
cuggaaggggaggggcgagagggcugucucggugaugagcacacgcgugcuggggugguuugg

SEQ ID NO: 233545 - RNA, 63 nt, Human
ugaagcccgaacccaccugaggacggcagugaggaugagcaccucuagcagccuggacuccgc

SEQ ID NO: 233546 - RNA, 63 nt, Human
acuucccuaggaaguggugagccaaugcucccugaugagcacaaagcccgcucuguugagggc

SEQ ID NO: 233547 - RNA, 63 nt, Human
cugucccuuuggcccagacccagccugaccaacgaugagcauuucuuaggcucagcucuugau

SEQ ID NO: 233548 - RNA, 63 nt, Human
ucagggaagcgguauccugucacugggguaugggaugagcauggagaagaggcaccagccacg

SEQ ID NO: 233549 - RNA, 63 nt, Human
uggaagacugcucccggcccgccugcccagacugaugagcacaucucucugcccucucccugu

SEQ ID NO: 233550 - RNA, 63 nt, Human
agcugaauguugagggagguggaggaaggaggagaugagcagugucaguaaauacugugcauu

SEQ ID NO: 233551 - RNA, 63 nt, Human
aagauaucaagaggcugcgccuguagcugccuggaugagcacaccuggcucaucacacuugca

SEQ ID NO: 233552 - RNA, 63 nt, Human
acaccuggcacuuggcagguacuccuggauguugaugagcaaggaagagcaacggcccuguca

SEQ ID NO: 233553 - RNA, 63 nt, Human
gaugccugcuuucaguugaggguugggggcaaugaugagcauaugaauuuuuucucacucuag

SEQ ID NO: 233554 - RNA, 63 nt, Human
auuauuuauugggcauuuugugccauacauggugaugagcaguuugcauauauuuauuuauga

SEQ ID NO: 233555 - RNA, 63 nt, Human
guuggcaucguuguuuuugaauguagcacaagcgaugagcaaacucuauaagaguguuuuaaa

SEQ ID NO: 233556 - RNA, 63 nt, Human
auguuaugccaggccccaaugcaguuauuuuuagaugagcagugucuucauucgaaggggaca

SEQ ID NO: 233557 - RNA, 63 nt, Human
aaaguagccagauaguaacaagacuggcuggcugaugagcaaagccuuugcucucacgcagag

SEQ ID NO: 233558 - RNA, 63 nt, Human
uaaauaucuauaaagugaauguucaacaacaaugaugagcaauagaaaucuauauaugagaaa

SEQ ID NO: 233559 - RNA, 63 nt, Human
aaucacaaaacuaaguugucaguuaucacuguagaugagcaacucaucuuuuuaaaguauagu

SEQ ID NO: 233560 - RNA, 63 nt, Human
uucacuuauuucauuuccuccccauacaaauuugaugagcagguacacacuuucuuuaaaaca

SEQ ID NO: 233561 - RNA, 63 nt, Human
ggucuucagaagccccccugggagggaggggaggaugagcacgcccagcuccccuccagggug

SEQ ID NO: 233562 - RNA, 63 nt, Human
ggcagacaccccuggagcucagccgacaguuuugaugagcagggaagucugaggcccagagga

SEQ ID NO: 233563 - RNA, 63 nt, Human
auguaaaccagaaacuucaaaugugucacaaaagaugagcagaacuaucccgagguucauuaa

SEQ ID NO: 233564 - RNA, 63 nt, Human
ccugucaucccgggccugccagcuccccugagugaugagcacuuccaagcaccccucugcccu

SEQ ID NO: 233565 - RNA, 63 nt, Human
gguccuccucaaccuuucagacgacaaggacaagaugagcagcaaacaccagcuccucagcuu

SEQ ID NO: 233566 - RNA, 63 nt, Human
aggcuaaaggcggccagguuugcagugcgggaagaugagcaggccagugggaggaggggcagg

SEQ ID NO: 233567 - RNA, 63 nt, Human
auuauuugucaaucaaauauuaauaaaaucaaagaugagcaggucucuuuguuggauauucaa

SEQ ID NO: 233568 - RNA, 63 nt, Human
gaguacccuuugugagggaaccaucagcuagcagaugagcaccguauauucauuccacccugg

SEQ ID NO: 233569 - RNA, 63 nt, Human
ugucuaggaaccacucugcauuugaggaacccugaugagcacaaggugauucaggccagcugg

SEQ ID NO: 233570 - RNA, 63 nt, Human
ccccccucgucagaaguacaugaggggcgcagagaugagcacacagcuuugggcacgguccag

SEQ ID NO: 233571 - RNA, 63 nt, Human
acacuaauuuauucauccauucaucacauaugugaugagcacauacagacacaccucagagau

SEQ ID NO: 233572 - RNA, 63 nt, Human
cagcaaaaagaaugauuaugauggucagaguaagaugagcaauugcaacauaauauucucuaa

SEQ ID NO: 233573 - RNA, 63 nt, Human
ugaguauggucaggaauuuaauaaaaguacagugaugagcaugccuaaauccauguucucuag

SEQ ID NO: 233574 - RNA, 63 nt, Human
gaccacccugcugaggcuggccccaucucagaagaugagcaggagcuccacuacgcuguccua

SEQ ID NO: 233575 - RNA, 63 nt, Human
uacgcgcuuucuugucccacagggagccgccgugaugagcacagccaacccaguucccggagg

SEQ ID NO: 233576 - RNA, 63 nt, Human
aggcugggcuguggcuucaagcuuuggaaacaugaugagcaaggagaagcgagaggcugucag

SEQ ID NO: 233577 - RNA, 63 nt, Human
uguuuaauaucugacugaaauuaaacgagcgaagaugagcaccaccucccgugucugcaguug

SEQ ID NO: 233578 - RNA, 63 nt, Human
cagcucuguucagcggagcagccagccagggcggaugagcagagccggcccugaggacagucc

SEQ ID NO: 233579 - RNA, 63 nt, Human
caggcagauuuacugucccaggagcaaaugcuggaugagcaacuccuguucuuugggcucaag

SEQ ID NO: 233580 - RNA, 63 nt, Human
uuccugcugaguccuuuccaggggccaauuuuggaugagcauggagcugucaccucucagcug

SEQ ID NO: 233581 - RNA, 63 nt, Human
guucagguccuggcuuugccuuugccugauguggaugagcagcucacaugcucagggccaccu

SEQ ID NO: 233582 - RNA, 63 nt, Human
agcucuuaauccccuuagaauuucaucuuucucgaugagcaggcucugcacccacucuuuuuu

SEQ ID NO: 233583 - RNA, 63 nt, Human
uccuugaggaauagggauggggagcccucuggggaugagcaaggccuuccaggacaggcucgg

SEQ ID NO: 233584 - RNA, 63 nt, Human
acagaggauaccaccgagacucggaggggacacgaugagcaccaggccccaccuuuguccccu

SEQ ID NO: 233585 - RNA, 63 nt, Human
gauuguucuccaaggccugagggcaagacucaugaugagcaagucaaccccaaucuggaacaa

SEQ ID NO: 233586 - RNA, 63 nt, Human
aagaccuauuucauuguccccagguaaguaugugaugagcaaugaggaggaguggaaaacaaa

SEQ ID NO: 233587 - RNA, 63 nt, Human
auuuauagucuguuuaugcuaaaucuggccaaagaugagcauuguccaccacuaaaaugccuc

SEQ ID NO: 233588 - RNA, 63 nt, Human
ugugccauucuguuagacauuagcauuuucguugaugagcaagacaugcuuaaugcauauuuc

SEQ ID NO: 233589 - RNA, 63 nt, Human
ugugccauucuguuagauacuauccuuauaauugaugagcaagacauacugaaugcauauuuc

SEQ ID NO: 233590 - RNA, 63 nt, Human
ugugccauucuguuagauacuauccuuuucaaugaugagcaagacauacuuaaugcauauuuc

SEQ ID NO: 233591 - RNA, 63 nt, Human
ugugucauucuguuagauacuaacauuuucauugaugagcaagacauacuuaaugcauauuuu

SEQ ID NO: 233592 - RNA, 63 nt, Human
uccccauuccuacccacuuaggcuuuguagcaagaugagcaaugcuguuggaaaugugaaguc

SEQ ID NO: 233593 - RNA, 63 nt, Human
auugcaucauuuacaagacaacauuguaagagagaugagcacuucuaaguugaguauauuaua

SEQ ID NO: 233594 - RNA, 63 nt, Human
gguuugcagucugagugggaaaguccuguuuuugaugagcacuccuuguuagcuaacauuuaa

SEQ ID NO: 233595 - RNA, 63 nt, Human
ugugccauucuguuagauauuagcguuuucacugaugagcaagacauacuuaaugcauauuuc

SEQ ID NO: 233596 - RNA, 63 nt, Human
ugugcaauucuguuagauauuaauguuuucauugaugagcaagacaugcuuaauguguauuuc

SEQ ID NO: 233597 - RNA, 63 nt, Human
ugugucauucuguuagauauuaacauuuucacugaugagcaagacauacuuaaugcauauuuu

SEQ ID NO: 233598 - RNA, 63 nt, Human
ugugccauucuguuagacauuagcguuuucguugaugagcaagacaugcuuaaugcauauuuc

SEQ ID NO: 233599 - RNA, 63 nt, Human
ugugccauucuguuagauauuagcguuuucauugaugagcaagacaugcuuaauguguauuuc

SEQ ID NO: 233600 - RNA, 63 nt, Human
uucauaggaguuccauuuguauucuggcugggugaugagcaaaaaaaauauauaguagcaaau

SEQ ID NO: 233601 - RNA, 63 nt, Human
ggaagacuauucugccaccugugccccaaguuggaugagcaaaccacuuuggaucaguucaca

SEQ ID NO: 233602 - RNA, 63 nt, Human
uugucuguuuuauuauccaggauuucauacucagaugagcauuagcaucaggaaagccugaaa

SEQ ID NO: 233603 - RNA, 64 nt, Human
cagguggggcagccugaacccugcuucccccuguggccggcaugccccgaucuuucacacacug

SEQ ID NO: 233604 - RNA, 64 nt, Human
ucagggagucuauuuaugaagucuccagaccuugggccggcacgcgugacacggcacuucaggc

SEQ ID NO: 233605 - RNA, 64 nt, Human
cuccuccuccucuuggcucuauugggagccucagggccggcagggugcuucgggagcccccugc

SEQ ID NO: 233606 - RNA, 64 nt, Human
uacggcccggucuagggugucgcucugcuggccuggccggcaaccccaguucugcuccucucca

SEQ ID NO: 233607 - RNA, 64 nt, Human
gcugaagaagggccucccccaggcccccagcugaggccggcaacucacccagccgccaccucug

SEQ ID NO: 233608 - RNA, 64 nt, Human
gaaaaaaaggaaaagguuuuuagcucauuugccuggccggcaaguuuugcaaauagcucuuccc

SEQ ID NO: 233609 - RNA, 64 nt, Human
ccccuuccuaucuaagggagggcugaagacaaggggccggcauucagugggcagcagaaaggag

SEQ ID NO: 233610 - RNA, 64 nt, Human
aggcuguggagggcgaggaaggcgguccagaggcggccggcagguccacguccugggcgaccgc

SEQ ID NO: 233611 - RNA, 64 nt, Human
auaacuucuuccaacuccucgcagaagugggagaggccggcagccugcaccgagaggggcuuuc

SEQ ID NO: 233612 - RNA, 64 nt, Human
agggccagucuguguguguggggacucagcccguggccggcagaugccauccaggauguacaag

SEQ ID NO: 233613 - RNA, 64 nt, Human
agcuugaugcuacuguacagaacuggacagguugggccggcagugguggggccagagggcucug

SEQ ID NO: 233614 - RNA, 60 nt, Human
gcuggggcugcgggugcugaccaggggccgggccggcagacuggggguuccccaccuccu

SEQ ID NO: 233615 - RNA, 64 nt, Human
ggcaggguucugacuggcgugugggagacccuguggccggcacccaccuccacacgaggacuaa

SEQ ID NO: 233616 - RNA, 64 nt, Human
gugagaagggagcucuggagcaggaccagcugggggccggcacugcugcuuagaguggaggagg

SEQ ID NO: 233617 - RNA, 64 nt, Human
cgccgaccaucucugcacugaagggcccucugguggccggcacgggcauugggaaacagccucc

SEQ ID NO: 233618 - RNA, 64 nt, Human
uuaagcagcaaaacgcuccuccaugucuggauggggccggcagguccuguguccccugcaccug

SEQ ID NO: 233619 - RNA, 64 nt, Human
cugugcaauaacuuguggccacuggaaaucccugggccggcauuuguauugggguugcaaugac

SEQ ID NO: 233620 - RNA, 64 nt, Human
gcugggguugcugcccugaacgaacugcguguggggccggcacauccuagcaggcagccccugg

SEQ ID NO: 233621 - RNA, 64 nt, Human
uagcugaaguagaggggacgugagagaagggccaggccggcaggccaacccuccuccaauggaa

SEQ ID NO: 233622 - RNA, 64 nt, Human
acagagaagccucuucugccccugccagauguauggccggcagcuucccccucucaugguaggc

SEQ ID NO: 233623 - RNA, 64 nt, Human
ggccgcgagcugucccgcgugcggguccccuccuggccggcagagggcgcaggagcccaggaga

SEQ ID NO: 233624 - RNA, 64 nt, Human
gaagcagcccugugcucgaugggaggggcucccaggccggcagcccuugccaccucccucugcc

SEQ ID NO: 233625 - RNA, 64 nt, Human
cuggaccagcugcccuggcggagagacagcaaggggccggcaggugcucgaugggccccccagg

SEQ ID NO: 233626 - RNA, 64 nt, Human
ucccagucuguccuauggggagcaguuugggggcggccggcagcaggagccugggaaagaggcc

SEQ ID NO: 233627 - RNA, 64 nt, Human
uguucuagccggcccccucuccaggggucgccguggccggcauuauuuccuaguucuucuugua

SEQ ID NO: 233628 - RNA, 64 nt, Human
gugcuuacugcacagccugaacagacaguucuggggccggcagugcugggcccuuuagcuccuu

SEQ ID NO: 233629 - RNA, 64 nt, Human
ccugcguggcccauggucggggcguccacgccgaggccggcaacaaacgacaguaucucggauu

SEQ ID NO: 233630 - RNA, 64 nt, Human
gcuguacccccuuagagcugccccucucuggccuggccggcaggcgucuucuuaacuccucugu

SEQ ID NO: 233631 - RNA, 64 nt, Human
uggauuuucgugaugaaggacggaagcagcagcgggccggcaaggccauaccucggugagggac

SEQ ID NO: 233632 - RNA, 64 nt, Human
uaagccguugagucucuuccuggaagacccugagggccggcagcuuugccuaggacucuccagg

SEQ ID NO: 233633 - RNA, 64 nt, Human
cgagucucccugcugcuguagagccgggcgcccaggccggcaucccccucguggguggcaggag

SEQ ID NO: 233634 - RNA, 50 nt, Human
cugcagaagugaggaggugaggccggcacacagcuccagugcugagaagu

SEQ ID NO: 233635 - RNA, 64 nt, Human
uugugggggcgguggggaggucccagaggugggaggccggcauccaggucuuggcucugcccug

SEQ ID NO: 233636 - RNA, 64 nt, Human
ccaggugucugcagucagcuccugagacacagcuggccggcacaacagguguuacaucaggggu

SEQ ID NO: 233637 - RNA, 64 nt, Human
ggcuggggaagccgagacgggcacucccucugccggccggcagcguggcccugagcauggcaag

SEQ ID NO: 233638 - RNA, 64 nt, Human
gccccccgacacauguauucucaucugugguccaggccggcaucguccuggccaccccccagau

SEQ ID NO: 233639 - RNA, 64 nt, Human
gcuuuuggcuacagagagggaagggaaagccugaggccggcauaaggggaggccuuggaaccug

SEQ ID NO: 233640 - RNA, 64 nt, Human
cuccaggggcgcggagcucuggggaugggcgucgggccggcaguggugcggcucacuccguccc

SEQ ID NO: 233641 - RNA, 64 nt, Human
uuccucuccucucuucauucccucacagcagauuggccggcaccaaucuuagucaagaguggcu

SEQ ID NO: 233642 - RNA, 64 nt, Human
cuggacuguggccagggcuggcccccaccgcuguggccggcacuccauuccggaaccuccugga

SEQ ID NO: 233643 - RNA, 64 nt, Human
ccuccccagccugcgccugcugcaugcccucucaggccggcagccccagccugcuagcuagcuc

SEQ ID NO: 233644 - RNA, 64 nt, Human
ugccucaggaccuucaagauuccaucugugggcuggccggcaagauggcaccaguggggaccca

SEQ ID NO: 233645 - RNA, 64 nt, Human
uuuaagcauaaaguaacacaacagcauugcacggggccggcacugccgcugccuucacugaagg

SEQ ID NO: 233646 - RNA, 64 nt, Human
acugggcucugcagggacaggaguuccacgugucggccggcacacuggccuucuccgucacccu

SEQ ID NO: 233647 - RNA, 64 nt, Human
ccugcuggggccgccacggccuggcuggugggaaggccggcagcgggcggaggggauccagcca

SEQ ID NO: 233648 - RNA, 64 nt, Human
uccccacugaagaggucuguacagugacaacccgggccggcagcaaggacacagaugcagccac

SEQ ID NO: 233649 - RNA, 64 nt, Human
aauagaaauuaaagaaugugagaaaguucuggugggccggcaggauugccgcacaaguuuauau

SEQ ID NO: 233650 - RNA, 64 nt, Human
uugagggcaggcaggagguggaguugcagcuguuggccggcaucacguugcucguugcucggcu

SEQ ID NO: 233651 - RNA, 64 nt, Human
gagggaagaggcugggagcaaggccgggugcuggggccggcaggcuguguucugagagugccug

SEQ ID NO: 233652 - RNA, 64 nt, Human
gagauuuguauugcugagcucaaagccaagcagaggccggcaguggaggcugagcagggacucu

SEQ ID NO: 233653 - RNA, 64 nt, Human
ccccggccaggccugcgaggaagggcugagguggggccggcagggggcgccaggcagccgugau

SEQ ID NO: 233654 - RNA, 64 nt, Human
accgggcuaucggccucuugggagccagcggcagggccggcaccugcgugccugugcccgugug

SEQ ID NO: 233655 - RNA, 64 nt, Human
agccacaggcuguggcugcucccagcagaggcggggccggcagagaaggggccuccuccaccca

SEQ ID NO: 233656 - RNA, 64 nt, Human
gggggagaaaggaagccuuucugagagcgggcuaggccggcacuggagaggccggagccuuugg

SEQ ID NO: 233657 - RNA, 64 nt, Human
gugccacugaagccugcgucagcagcccgagcggggccggcaucugcuccccgccgucugcucc

SEQ ID NO: 233658 - RNA, 64 nt, Human
cagggugugagggauggggagcagcugggcacugggccggcagccugguucccucuuuccugug

SEQ ID NO: 233659 - RNA, 64 nt, Human
cagguguagcacacgcaugugcagauggcaccacggccggcaccugggggcacacacaugcagg

SEQ ID NO: 233660 - RNA, 62 nt, Human
ccccggaaacaagugucugaguggcugggcggggccggcaggcacagggaggagguacagaa

SEQ ID NO: 233661 - RNA, 64 nt, Human
acagcugcuuuuguggagguggacgaaaggcuguggccggcagacguggagguccaggccgggg

SEQ ID NO: 233662 - RNA, 64 nt, Human
caaggcuucagccccaagggcaucuccagccucaggccggcagguccuauguccuugacacaaa

SEQ ID NO: 233663 - RNA, 64 nt, Human
gagcgagacuccaucuuuaaaaaaaaacaagacgggccggcacgguggcucacgccuguaaucc

SEQ ID NO: 233664 - RNA, 64 nt, Human
gggccgagggcuuuccccaccccacccuccuccuggccggcagucggcccugucuauucaucug

SEQ ID NO: 233665 - RNA, 64 nt, Human
caggcuccgagaaauugcacaaccgaccucagguggccggcaguggcgugccuggugcccuuuc

SEQ ID NO: 233666 - RNA, 64 nt, Human
aguucugagcccuggacucugccccgggggauguggccggcacugggcagccccuuggacugag

SEQ ID NO: 233667 - RNA, 64 nt, Human
ugccccuccugccaggcccucccucccgggugguggccggcaccucugcuccucacgugggucg

SEQ ID NO: 233668 - RNA, 64 nt, Human
acccguguccccgccccgccccuccguccacacuggccggcacccccugcugggucuccugcau

SEQ ID NO: 233669 - RNA, 52 nt, Human
uagcggcuugguucaccugagaggccggcauggugccugggcugccgggaac

SEQ ID NO: 233670 - RNA, 52 nt, Human
uagcggcuugguucaccugagaggccggcauggggccugggcugccgggacc

SEQ ID NO: 233671 - RNA, 64 nt, Human
ucaugccugcaaucccagcacuguagaaggcagaggccggcagaucacuugagcccaggaguug

SEQ ID NO: 233672 - RNA, 64 nt, Human
ucccccagggccugucgacacggcggggcccgguggccggcaucuggcccgcacguguccgagg

SEQ ID NO: 233673 - RNA, 64 nt, Human
agacagggaagaccggggcccuccucccuuauggggccggcacaaucagugggcugggcggagc

SEQ ID NO: 233674 - RNA, 64 nt, Human
cagggcucagagcagaggccagaaccacugggccggccggcauuccagccuccccagacugcug

SEQ ID NO: 233675 - RNA, 64 nt, Human
cugacacgcgguugcauggaguccagguuacucaggccggcacuucugagugacaggugccacc

SEQ ID NO: 233676 - RNA, 64 nt, Human
caggugagaaggagcgguguguccaggcaccgcuggccggcagcccugggcugaggcacagacu

SEQ ID NO: 233677 - RNA, 64 nt, Human
caggagcauccaggaggcucucgcccgcaacgcuggccggcauagcguggcgucagcccagcug

SEQ ID NO: 233678 - RNA, 64 nt, Human
gacccucuggcucaggaggguugggucccugggaggccggcagccaggccacagaauccacacg

SEQ ID NO: 233679 - RNA, 64 nt, Human
gaauccacacguggaccauugugggucccugggaggccggcagccaggccacggaauccacacg

SEQ ID NO: 233680 - RNA, 64 nt, Human
uagagcuguuuggaggauguucucugcgcucccaggccggcaucgagugucaucaauuucuacc

SEQ ID NO: 233681 - RNA, 64 nt, Human
ccaucaggacagcgagccgacgggucacgccaggggccggcacgcacuggcaccuggccccagg

SEQ ID NO: 233682 - RNA, 64 nt, Human
auuguucuccccgagaccgcgucgcccgcggcccggccggcaguugcaguguagacagcccgag

SEQ ID NO: 233683 - RNA, 64 nt, Human
cggcugaggccacauggcuuccugugggagccccggccggcacccggcuggucccaccccaaau

SEQ ID NO: 233684 - RNA, 64 nt, Human
acagugccuuaugccacagccgaagaauccguggggccggcaagcaggcaccuucccccagcug

SEQ ID NO: 233685 - RNA, 64 nt, Human
acgcaugcacacacgcagaggugcagagcgaggaggccggcaaaucccgcagcugccacggucc

SEQ ID NO: 233686 - RNA, 58 nt, Human
ucgagcuggcccccaccuagggccccguggccggcaggccggccccugccccaccccc

SEQ ID NO: 233687 - RNA, 59 nt, Human
ucaguauguagcuuaacaccauccacucacuccaacaaagaacacuuagaaugauaaaa

SEQ ID NO: 233688 - RNA, 59 nt, Human
cuggcuaagccucugcuuccguacuauggcuccaacagaaauaaaauacacaacacaaa

SEQ ID NO: 233689 - RNA, 59 nt, Human
uacgugagaaacgcucaugacagcaaagucuccaacaauaaaauacagccauguaccac

SEQ ID NO: 233690 - RNA, 59 nt, Human
guagcaauuuuguuuuaguaacagacuggcuccaacacugcaacauggggacauuugcc

SEQ ID NO: 233691 - RNA, 59 nt, Human
acucuuaaaacuucucucuguuugccugccuccaacaguacuuuuaacuuuuugcugua

SEQ ID NO: 233692 - RNA, 59 nt, Human
gcaagaauauccuaaaugucauuaaaauccuccaacaugauggaucuacuuauggucuu

SEQ ID NO: 233693 - RNA, 59 nt, Human
uacuugccauuacuuuuccuucccacucucuccaacaucacauucacuuuaaauuuuuc

SEQ ID NO: 233694 - RNA, 59 nt, Human
ggcgggggccaugggggugaugaaugacccuccaacagccccacauggguuguuucugu

SEQ ID NO: 233695 - RNA, 59 nt, Human
acugcuucaggacgcgcuugcugaaacgacuccaacagcuaguucacagcccagcuuug

SEQ ID NO: 233696 - RNA, 59 nt, Human
uugcuggccauuguugcuucuguugucaccuccaacaaaagggcaacucagggaaccua

SEQ ID NO: 233697 - RNA, 59 nt, Human
gagcuuggagggccccuccccuggauuuccuccaacaccugcuuggauacuaggcccac

SEQ ID NO: 233698 - RNA, 59 nt, Human
ucugcugaagaccccugguucuguucugccuccaacauguauaauuuuauuugaaauac

SEQ ID NO: 233699 - RNA, 59 nt, Human
aauuuaaaaaauauauuugaaaugaaaaucuccaacacauuagaagaugaugauguuag

SEQ ID NO: 233700 - RNA, 59 nt, Human
auaagucaaggaaaccagaauuugacacacuccaacaauccgaaggggcauguugcucc

SEQ ID NO: 233701 - RNA, 59 nt, Human
uuacuaacuccaaggggaggguuccccugcuccaacaccccguuccugaguuaaaaguc

SEQ ID NO: 233702 - RNA, 59 nt, Human
ugagagcucgugcccaucuccgaaaccaccuccaacaccaugagaugugcagccaaaua

SEQ ID NO: 233703 - RNA, 59 nt, Human
gccagaaagcagagaauagaaaauguaaucuccaacauccaagcaucgaaacccaaggg

SEQ ID NO: 233704 - RNA, 59 nt, Human
uaagggcugugaaaagaaaucuagucuaacuccaacagaaaucugucucuguuaagugu

SEQ ID NO: 233705 - RNA, 59 nt, Human
acauacagaugggcuaaggugaggccuuccuccaacauggggcccuggcugagagugga

SEQ ID NO: 233706 - RNA, 59 nt, Human
uaauuucgcaacuguccuuuuggguugcccuccaacacauuacuuccauuucagaaacc

SEQ ID NO: 233707 - RNA, 54 nt, Human
agugccucaagcuggccuagcugccuccaacacacuacgucagaaggacccggg

SEQ ID NO: 233708 - RNA, 59 nt, Human
ucaguuuagugucuuguauuucuauaauacuccaacaggaaugguagucacacugucuu

SEQ ID NO: 233709 - RNA, 59 nt, Human
agggggcuaaauuugaugcuuuaacugaucuccaacaguugacaggucauccuugccag

SEQ ID NO: 233710 - RNA, 59 nt, Human
caaucugaauuccacuacauuucuuuuggcuccaacauuccuuuuagcuugaccagucu

SEQ ID NO: 233711 - RNA, 59 nt, Human
auaaaguacuugaguguaauguuuguuaccuccaacagaacuaaauguucuaugguuau

SEQ ID NO: 233712 - RNA, 59 nt, Human
aaacuaucucaucugucagauuuuuaaaacuccaacacagguuuuggcaucuuuugugc

SEQ ID NO: 233713 - RNA, 59 nt, Human
cccuuuccagaguccuccuuugccugauccuccaacagcugucacaacuuguguugagc

SEQ ID NO: 233714 - RNA, 59 nt, Human
augcuugggggugccaagggauucgagaccuccaacauacuugucugaagguggugauu

SEQ ID NO: 233715 - RNA, 59 nt, Human
gagaggcgcucgcucgggaccuuccaccucuccaacauuguccccugggucccuggcgc

SEQ ID NO: 233716 - RNA, 59 nt, Human
acuaaccccagcugccggcagugcugguucuccaacagaguggugucuagauuuaucag

SEQ ID NO: 233717 - RNA, 59 nt, Human
uuucaacaugaaaugccacacacauagaacuccaacaucaauuucauugcacagacuga

SEQ ID NO: 233718 - RNA, 59 nt, Human
cugcucaaagugacuagccaaauugaccccuccaacagaaaguaaucuuuguucccaag

SEQ ID NO: 233719 - RNA, 59 nt, Human
ugcucauggcaugacacagcggagaccgccuccaacaacgaauuuggggcuacgaagag

SEQ ID NO: 233720 - RNA, 59 nt, Human
uguauacaaaaacuaaauagacuucugcccuccaacaucuuuuuauugcauuacuucaa

SEQ ID NO: 233721 - RNA, 59 nt, Human
cccaugcuguaaauacuugucaucauggacuccaacaggguuagagggacaggccuaau

SEQ ID NO: 233722 - RNA, 59 nt, Human
aggcggugcaaacaauccacuucuucaagcuccaacacaaaugcugccuccuuuaggau

SEQ ID NO: 233723 - RNA, 59 nt, Human
aggcacacugcagugguuuuccugcagcucuccaacaaacgccugagucacaggccaga

SEQ ID NO: 233724 - RNA, 59 nt, Human
cuguucuucaugugcuucuaugagauuuacuccaacacaaauaggacugaauuuauugu

SEQ ID NO: 233725 - RNA, 59 nt, Human
ugacccagaccccucccguuaggcuucaccuccaacacugaggaucaaauuucaacaug

SEQ ID NO: 233726 - RNA, 59 nt, Human
caaaaauaacuuuaaaaggaacaaagaaacuccaacauuucacauuaugcauaguuaug

SEQ ID NO: 233727 - RNA, 59 nt, Human
uaucuuaucagcauaucauauccauuucacuccaacacucugucuugaauuuggcccuc

SEQ ID NO: 233728 - RNA, 59 nt, Human
cuaaccagacaacugggaagagcccccaacuccaacaggauuauuuucccaggaggagu

SEQ ID NO: 233729 - RNA, 59 nt, Human
ccucuguggucuccugaagggagcgccuccuccaacaacacguggaucugcaugguuug

SEQ ID NO: 233730 - RNA, 59 nt, Human
uuguuggucugaauacaaacauuucacuucuccaacaaguaccugugaacaguacagua

SEQ ID NO: 233731 - RNA, 59 nt, Human
ugagcaugaagcugagauggaccugggaacuccaacauaugaugaaaaccccaugaagg

SEQ ID NO: 233732 - RNA, 59 nt, Human
uuauaucuuugguucaaaacggcaugucucuccaacaauuuaagugccugauacaaagu

SEQ ID NO: 233733 - RNA, 59 nt, Human
uuuuauuuuuugaaaaacaaaaggcaagucuccaacaauuaacuuuugaugcuuucugu

SEQ ID NO: 233734 - RNA, 59 nt, Human
ucuguuugcaaaaagagaguguuuaaacacuccaacacccagacuuagaauuaaaucag

SEQ ID NO: 233735 - RNA, 59 nt, Human
uaugugugaggaguuaagucuguuucugacuccaacagggaccauugaaugaucagcau

SEQ ID NO: 233736 - RNA, 59 nt, Human
aauugugucaaauauauaugucaaauucccuccaacauuguuuaaaugugccuuucccu

SEQ ID NO: 233737 - RNA, 59 nt, Human
gaaacucuccuuuauacaaacuucauuggcuccaacauuugaaucucauauuuuuguag

SEQ ID NO: 233738 - RNA, 59 nt, Human
agggaggggggacucagcacccacaccuccuccaacaagcuccugcuggggagagggcu

SEQ ID NO: 233739 - RNA, 59 nt, Human
cuucccucuaucccgcuuauaaaaaaauucuccaacaaaaauacuuguugacuugaugu

SEQ ID NO: 233740 - RNA, 59 nt, Human
guaguuaagcucuguaaaugugccacgagcuccaacacgaccaucguagggugaagccc

SEQ ID NO: 233741 - RNA, 59 nt, Human
gagaaauaauauggaauuagcagcuaugacuccaacagacaggauugugugagcagcug

SEQ ID NO: 233742 - RNA, 59 nt, Human
ucugugcucacaauccagagcaauggauccuccaacaccaccagguggauguggagcag

SEQ ID NO: 233743 - RNA, 59 nt, Human
ggcugggccaccgucucggugaucgcgcucuccaacauccuccacgccuccgccagccu

SEQ ID NO: 233744 - RNA, 59 nt, Human
ccccccucugccuuugagcuucuccucugcuccaacagacacccuccacucugaggucu

SEQ ID NO: 233745 - RNA, 59 nt, Human
ccugacuucuaaguguggguuuuucuucucuccaacauaauuauguuaauaugguccuc

SEQ ID NO: 233746 - RNA, 59 nt, Human
ugcuggugcuggccagccauggcuuaggacuccaacagccacucugagggaggggagaa

SEQ ID NO: 233747 - RNA, 59 nt, Human
agcagaguccucgagcaccuggccuguugcuccaacauugcaaagacacauuaucaguc

SEQ ID NO: 233748 - RNA, 52 nt, Human
augaacaagagggaaaguaguccuccaacaggaugaagcagauuaacagaag

SEQ ID NO: 233749 - RNA, 59 nt, Human
agaacccuuuagaaaguauaaaauauugccuccaacaugcugaaaaagaguaucuaugc

SEQ ID NO: 233750 - RNA, 59 nt, Human
gacuuaguuaaggauaguuaacuauuauacuccaacaauucaugagcaacaguauauac

SEQ ID NO: 233751 - RNA, 59 nt, Human
cuuuuuaugacaggauguuugcucagcuucuccaacaauaagaagcacgugguaaaaca

SEQ ID NO: 233752 - RNA, 59 nt, Human
cccuccuuccgcccucuucccuucugagucuccaacaucccuuauaccacuguguaugu

SEQ ID NO: 233753 - RNA, 59 nt, Human
cauggacuucucauccuuucuuuuuucaucuccaacaguuaaaugguaaggagagcaaa

SEQ ID NO: 233754 - RNA, 59 nt, Human
caucccaugccucccuccuccccaccccacuccaacaguuccucuuucccgaguaaggu

SEQ ID NO: 233755 - RNA, 59 nt, Human
gcauagguuugcaauccagaucugauuuucuccaacauaaauaucagcucauguucuua

SEQ ID NO: 233756 - RNA, 59 nt, Human
ccguccgccagaucugcaggcuguuucugcuccaacacugcuugcuugugagcaucucu

SEQ ID NO: 233757 - RNA, 59 nt, Human
uagaagccuacagcaacauucugagacugcuccaacaugcuugaagaucuaagcuuuuc

SEQ ID NO: 233758 - RNA, 59 nt, Human
agaggcuuugggguccuagcccagugcuucuccaacacugaagugcuugcagaucaucu

SEQ ID NO: 233759 - RNA, 59 nt, Human
gcuuucugcuuccuucuggugaaguccaccuccaacauuaaccugcccaccccaccccc

SEQ ID NO: 233760 - RNA, 59 nt, Human
cagauccccguuccugacaucacagcagccuccaacacaaggcuccaagaccuaggcuc

SEQ ID NO: 233761 - RNA, 59 nt, Human
acacauuggucagugggaaaacuaagggccuccaacaggcaaauucagggaggauaggu

SEQ ID NO: 233762 - RNA, 59 nt, Human
gacucaggugcuucucuacacuccacccucuccaacacuguuuggaaucucaggcuugg

SEQ ID NO: 233763 - RNA, 59 nt, Human
guuuucauucucaaacaagaugcuuuguucuccaacaagauguucaucucaucacuugc

SEQ ID NO: 233764 - RNA, 59 nt, Human
gacuccgccucaaaaaaagaauacaaaugcuccaacauuauuuuuuauaacucuggauu

SEQ ID NO: 233765 - RNA, 59 nt, Human
cagacauugcccagugucucuucuagccccuccaacaguucuucauguagcacugcuuu

SEQ ID NO: 233766 - RNA, 59 nt, Human
acuuccuaccuggucagcuuuuucagcuucuccaacaaaugggaguugaggcaguagga

SEQ ID NO: 233767 - RNA, 59 nt, Human
ucuggugcuagaugccacuguagccagaucuccaacagugccuuggaccauggacucau

SEQ ID NO: 233768 - RNA, 59 nt, Human
aaaggagauggcuuauucaaccauagccccuccaacauaucuacuggaaauucugcugg

SEQ ID NO: 233769 - RNA, 59 nt, Human
guaucaaaacaccuguggaguacuuuagacuccaacaaauaauaauguaacuaaaacug

SEQ ID NO: 233770 - RNA, 59 nt, Human
acaugacaacgugaccacaccacacaugccuccaacacacacccacagucuaaacaucu

SEQ ID NO: 233771 - RNA, 59 nt, Human
agugcuccucaccuguguggcccagauggcuccaacaagcaaaaggaaggaugcaguga

SEQ ID NO: 233772 - RNA, 59 nt, Human
auagggaggaugcauuauccuguauucuccuccaacaucaccacuagcguaaaagcaaa

SEQ ID NO: 233773 - RNA, 59 nt, Human
uuugcuggaacagaagccgucuuugaauucuccaacaagaggcaucagccacugugucu

SEQ ID NO: 233774 - RNA, 59 nt, Human
uuuauuaaucucuguauccuuagauaguccuccaacaaccaaagguugggacucugucu

SEQ ID NO: 233775 - RNA, 59 nt, Human
aaguuaaccauuuaaaagaacauuuuucucuccaacauauuuuacaauaaaagcaacuu

SEQ ID NO: 233776 - RNA, 59 nt, Human
uucuguaaauuugagacuaccuuuauauucuccaacacaagaccguguaggugucccuu

SEQ ID NO: 233777 - RNA, 59 nt, Human
cccucauucauguggcuguacuuaaccuucuccaacauacauccugcauuacaugaaug

SEQ ID NO: 233778 - RNA, 59 nt, Human
gauucaaacucaaugaugcuaccaugccucuccaacaucuucaacccccugacauuauc

SEQ ID NO: 233779 - RNA, 59 nt, Human
ugucccaccccaccacgauggccuggucccuccaacaugcauggacaggggacaguggg

SEQ ID NO: 233780 - RNA, 59 nt, Human
caauauguuugcaaacuuguuagaucaaccuccaacaacgacacauucaggaguuaaau

SEQ ID NO: 233781 - RNA, 59 nt, Human
cacugugaguuaccuuuguuucauagcaucuccaacacuuaaguucagacuuaaaaauu

SEQ ID NO: 233782 - RNA, 59 nt, Human
cucccacuucacucucucugucucuccugcuccaacauggccagacgugccugcuuccc

SEQ ID NO: 233783 - RNA, 59 nt, Human
auuucucauuuuacauuuuaaagucguuccuccaacauaguguguauuggucugaaggg

SEQ ID NO: 233784 - RNA, 59 nt, Human
gagaagggacaugugggacgugagccgggcuccaacagccucugugagagaugccccac

SEQ ID NO: 233785 - RNA, 59 nt, Human
aacagaaccagccaccucaccauagaguacuccaacaagacaugcauaccauuggugcc

SEQ ID NO: 233786 - RNA, 59 nt, Human
cugggaacucauccuguguggggaggcagcuccaacagcuugaccagaccuagaccugg

SEQ ID NO: 233787 - RNA, 59 nt, Human
gguagccaucaagcacuucccaggaucugcuccaacagaauauugcuagguuuugcuac

SEQ ID NO: 233788 - RNA, 59 nt, Human
uuuggaugagcuuuuauauauggaacuuacuccaacaggacugagggaccaaggaaaca

SEQ ID NO: 233789 - RNA, 59 nt, Human
uccgccaccucaagugaacugcaggaauccuccaacaaccacaaacacaugcuucgcug

SEQ ID NO: 233790 - RNA, 59 nt, Human
ggugaagguucaggaagcacggagauucucuccaacaaagguccaguuaggaaacgacg

SEQ ID NO: 233791 - RNA, 59 nt, Human
caccauuuaguuauaugugcuaggcaaaucuccaacacaguugauguguagucuugugg

SEQ ID NO: 233792 - RNA, 59 nt, Human
auagaaacaggaccagaaacaccucccuucuccaacaaaagguucauuuugguggcugu

SEQ ID NO: 233793 - RNA, 59 nt, Human
cccgguguuaguaguucuucauuuccugucuccaacagaaaauucacucauuuuagaac

SEQ ID NO: 233794 - RNA, 59 nt, Human
cuccccacuccacgcuccgggcgccccaacuccaacaccacguccugccgcgcagguuc

SEQ ID NO: 233795 - RNA, 59 nt, Human
cuaagccacguccaaaugguggacaguagcuccaacagugacaugacagagggagggcc

SEQ ID NO: 233796 - RNA, 59 nt, Human
gguuuguugauggccagguuuuccucaggcuccaacaacugugcuuauaccaagcagau

SEQ ID NO: 233797 - RNA, 59 nt, Human
ccaucaccaaagccuccguuuuuaacaaccuccaacacgauccauuuagaggccaaaug

SEQ ID NO: 233798 - RNA, 59 nt, Human
gggccugcuggcugaacaugcugaaucaucuccaacaaaacccagccccaacuuucucu

SEQ ID NO: 233799 - RNA, 59 nt, Human
aaaaccauagggucaagauccaugucuuacuccaacacuggcugcuaacaugaucuuac

SEQ ID NO: 233800 - RNA, 59 nt, Human
auuucuuucuuugcaccaaagacaucagucuccaacauguuucuguuuuguuguuugau

SEQ ID NO: 233801 - RNA, 59 nt, Human
cccaauuagggcccagccugccauggcagcuccaacaaggaccgucugggauagcaccu

SEQ ID NO: 233802 - RNA, 59 nt, Human
uccaggguggaggaacuaaucagcuuguucuccaacaguucugaagccaacccacaaau

SEQ ID NO: 233803 - RNA, 59 nt, Human
caugcaggagaugcccuggccaguaggaccuccaacagguuguuucccaggcuggggug

SEQ ID NO: 233804 - RNA, 59 nt, Human
ugcuuccugguggcaaguaacugugcacccuccaacaucccaaccccagaggaaccagu

SEQ ID NO: 233805 - RNA, 59 nt, Human
ggacugaagcugucccgcagguccccacccuccaacacgugcucaccugucccccuccu

SEQ ID NO: 233806 - RNA, 59 nt, Human
gcaucggcuggccuuccagcaccuucucucuccaacacuucauucucucuugcccuguc

SEQ ID NO: 233807 - RNA, 59 nt, Human
acacgugccuucuugcuacucuaaacugucuccaacacauuguuucugagcuccacaaa

SEQ ID NO: 233808 - RNA, 59 nt, Human
ggugguaaacauucaguaauacgcuauuucuccaacaucaagacaacuaaaacaaauga

SEQ ID NO: 233809 - RNA, 59 nt, Human
guacuguagucuugaagagaaaauucagucuccaacagaagaaacagaaaucuuuuauc

SEQ ID NO: 233810 - RNA, 59 nt, Human
guaggacugcaagacacuggaccgaaagccuccaacacaaacccuagcugccaaccugc

SEQ ID NO: 233811 - RNA, 59 nt, Human
aggccgagauccgugagagacccacuuugcuccaacaacuugaaacaagucacuuuacc

SEQ ID NO: 233812 - RNA, 59 nt, Human
cugggcagaaggccccuccagggggacugcuccaacaggaaagagccccucccccacuu

SEQ ID NO: 233813 - RNA, 59 nt, Human
ggccuccagaccaggguaagggcaggccccuccaacaggugcucacagccaccgaggca

SEQ ID NO: 233814 - RNA, 59 nt, Human
cuggcacccaucugcaaauaucucccucucuccaacaaauggaguagcaucccccuggg

SEQ ID NO: 233815 - RNA, 59 nt, Human
gaugcgguuuguagcuuccucccuacucucuccaacaccugcaugcaaagacuacuggg

SEQ ID NO: 233816 - RNA, 59 nt, Human
uauuggggguagggggauggaggaggucccuccaacauguuuggacccagcuccuuugg

SEQ ID NO: 233817 - RNA, 59 nt, Human
acaguuaauuuagguaugggcuuacuggacuccaacaucuuuuguacucuuucaugcuu

SEQ ID NO: 233818 - RNA, 59 nt, Human
uccaaagcagugcauccucaauccacagucuccaacaacaguuaaaacuuugauucuca

SEQ ID NO: 233819 - RNA, 59 nt, Human
gcauauccccacccuccacccacuaccuccuccaacaaaggagucaacucaguugaaaa

SEQ ID NO: 233820 - RNA, 59 nt, Human
gcuccacaguuucagucccaggucauacucuccaacaguuuucagagcuccauauauau

SEQ ID NO: 233821 - RNA, 59 nt, Human
cacacaagcuugucaaugauuucaaaauucuccaacagcugacucucgugcauuucaac

SEQ ID NO: 233822 - RNA, 59 nt, Human
ucucuacaacugaugaguaacaugaauaucuccaacaagaucaggaaccucuccaccac

SEQ ID NO: 233823 - RNA, 59 nt, Human
aaaaacuuccauuugguacaaaauuuuuacuccaacacccccucaacccuuuucucagg

SEQ ID NO: 233824 - RNA, 59 nt, Human
uguaaaagagaauuggagaaugaaaccugcuccaacagagaucaugagacugaaauugg

SEQ ID NO: 233825 - RNA, 59 nt, Human
ucaaagaaauugagccagcacuaucuguacuccaacauuaccggaucuggauuggggag

SEQ ID NO: 233826 - RNA, 59 nt, Human
caaugaggaguuaucaccucauccucaaacuccaacaagaucuaugccuuaguguuguu

SEQ ID NO: 233827 - RNA, 59 nt, Human
uacacccagcugagguagaggccagacuccuccaacagugaaggaaaaggcacagguga

SEQ ID NO: 233828 - RNA, 59 nt, Human
aauaagcaucaugcauccuccccuuaccccuccaacaccccucugccucuggcucaggu

SEQ ID NO: 233829 - RNA, 59 nt, Human
aacccaccuucccucugcugcuggggacccuccaacaccugugcaggccccauggcacc

SEQ ID NO: 233830 - RNA, 59 nt, Human
uaguuuacauugcuuugagaacauuuaaccuccaacagcugcuuuaaauuuaagauuua

SEQ ID NO: 233831 - RNA, 59 nt, Human
gacaaccagaggcuggcauugaggcuaaccuccaacacagugcaucucagaugccucag

SEQ ID NO: 233832 - RNA, 59 nt, Human
ugccuaugaugaaggaccgugcaccuccacuccaacagagugcugaguuuaaaaguuga

SEQ ID NO: 233833 - RNA, 59 nt, Human
uauccaucuacaucagaaccaaacuacuucuccaacacccggcagcacuuggcccugca

SEQ ID NO: 233834 - RNA, 59 nt, Human
ucgaagucuaauuuugguuccuaacaugccuccaacagcaucuaucaauccuguuagcu

SEQ ID NO: 233835 - RNA, 59 nt, Human
ugcaguuuccaggccuggcccauacagaccuccaacaggugcuccccugugcuguuacu

SEQ ID NO: 233836 - RNA, 59 nt, Human
cucccagguccccucccauuugguagcagcuccaacagggguccagccugcaucuuguu

SEQ ID NO: 233837 - RNA, 59 nt, Human
acuuaaguuagccucaucauuuugugcugcuccaacaccagcaggguaucucccaauaa

SEQ ID NO: 233838 - RNA, 59 nt, Human
uuaauucaauucuuaauacuuuaauuuugcuccaacaagggcuuuauguugcugguaag

SEQ ID NO: 233839 - RNA, 59 nt, Human
uuuauaauauuuaacccaccaaaaagucccuccaacagcaauaucuuaugaaagucugg

SEQ ID NO: 233840 - RNA, 59 nt, Human
aggucucaaaaauucaucaagcaauuucccuccaacaagggcugcaguucuagugauaa

SEQ ID NO: 233841 - RNA, 59 nt, Human
gaauuuuuuauagcuuagauauaaaaggucuccaacaaagaccuuugcaauauauuuua

SEQ ID NO: 233842 - RNA, 59 nt, Human
ccuucacaucuucaacgccaucagugggacuccaacaagcacaaugguucacgggauga

SEQ ID NO: 233843 - RNA, 59 nt, Human
ccuaaaugucagcuguugucacacaguagcuccaacacuuugagcauuuuuaagggagu

SEQ ID NO: 233844 - RNA, 59 nt, Human
uggccuaggaacuguggcugggaaggugccuccaacaaugggauccagggaagccaagg

SEQ ID NO: 233845 - RNA, 59 nt, Human
cuaaaagccuuugaacaccacgcuguagucuccaacagaaaaacaccaccaaaacagau

SEQ ID NO: 233846 - RNA, 59 nt, Human
ccaccccaaaucuuuguauuguccacauucuccaacaauaaagcacagaguggauuuaa

SEQ ID NO: 233847 - RNA, 59 nt, Human
ugcauuccgcagcccccacccccaagguucuccaacaucacagcccagcccgcccacug

SEQ ID NO: 233848 - RNA, 59 nt, Human
caucacaaauagccacauucugcucuacucuccaacauaccagauucuacacuguuguu

SEQ ID NO: 233849 - RNA, 59 nt, Human
auugccaucuuaaucacagaccucaggggcuccaacagggagaaaaaacaaucacuggu

SEQ ID NO: 233850 - RNA, 59 nt, Human
ucagcuccucuuugcacuggaauggggcacuccaacaccccucagggaccacccucccc

SEQ ID NO: 233851 - RNA, 59 nt, Human
ggaagguccagccugagcuggauucgggacuccaacacccuggagugguuccgucagac

SEQ ID NO: 233852 - RNA, 59 nt, Human
gagauuugcucccagacccucugaucucccuccaacaaacccuggcuccagcccccuuu

SEQ ID NO: 233853 - RNA, 59 nt, Human
cgugagcauaggaggcuucuguugacguacuccaacagaagaacuguguuucaaguuca

SEQ ID NO: 233854 - RNA, 59 nt, Human
cccaucugauuucugcaguucccgccagccuccaacacggggacucugccguaacugga

SEQ ID NO: 233855 - RNA, 59 nt, Human
ugccagggcugggccccuuccaaaugucccuccaacacagauccgcaagaguaaaggaa

SEQ ID NO: 233856 - RNA, 59 nt, Human
aguauagggauguauuuaauuuuacuaugcuccaacauuaaucaugacucuuuuguaaa

SEQ ID NO: 233857 - RNA, 59 nt, Human
gucccagcuauguagacccccgcccccaccuccaacacugcacccuucugcccugcccc

SEQ ID NO: 233858 - RNA, 59 nt, Human
gugaccugccuagcagccgcugaccaccucuccaacagaagccuaguccuguucagagc

SEQ ID NO: 233859 - RNA, 59 nt, Human
uugaagcccaguuugcccgugauuuggcgcuccaacagaaaggcuugggugaccaggag

SEQ ID NO: 233860 - RNA, 59 nt, Human
cuagccuccaggugggggcuccugcccuccuccaacaacccaggacacccacgccucac

SEQ ID NO: 233861 - RNA, 59 nt, Human
uuucacgcacauauuugcaguuggauuuucuccaacagaaaguggauucacuacuggca

SEQ ID NO: 233862 - RNA, 59 nt, Human
ugacaugucacccuucccaacuuggucuccuccaacaugcugucuucauguggagcccu

SEQ ID NO: 233863 - RNA, 59 nt, Human
uggacacacaauggauggacacauuauaucuccaacaagguguggguggaaagaucaaa

SEQ ID NO: 233864 - RNA, 59 nt, Human
agcauuucucucuuaacguuccugggagacuccaacaaauggagaccagaaacaaggca

SEQ ID NO: 233865 - RNA, 59 nt, Human
uugaaaauguugagacagcacagcagccacuccaacaccagcuguagguucaaugagua

SEQ ID NO: 233866 - RNA, 59 nt, Human
acucagcaggcugcuugagugggagcugacuccaacaugcccugcccuggcugggacua

SEQ ID NO: 233867 - RNA, 59 nt, Human
uaaagagacaaaagaggccagccacccaccuccaacaccuccugugaguuucuuggucu

SEQ ID NO: 233868 - RNA, 59 nt, Human
ccuuugccuaccccaggaaugagcuuggccuccaacaucccuugccugcugccauuagu

SEQ ID NO: 233869 - RNA, 59 nt, Human
ugucuugcugagcccucccccaacccacgcuccaacacacacacacacacacacacaca

SEQ ID NO: 233870 - RNA, 59 nt, Human
acaaucuccuaauaaauugacaaauuguccuccaacauccucccaccucuuugacuuca

SEQ ID NO: 233871 - RNA, 59 nt, Human
uuucugugauuuguagaggagggcuuguucuccaacaccuucucugguauuucaaggca

SEQ ID NO: 233872 - RNA, 59 nt, Human
gguugggcgugcuaccugcaccgccccuucuccaacaaguugccuccaagcuuuggguu

SEQ ID NO: 233873 - RNA, 59 nt, Human
aagccagccuacuccuucuuacauagcuucuccaacagggguagcaaugaccuguccac

SEQ ID NO: 233874 - RNA, 59 nt, Human
gacucuuacaaucauaucacagugggccucuccaacaauuuaaaccucaugaccuaggu

SEQ ID NO: 233875 - RNA, 59 nt, Human
aagacuggaauguauauaaagucaaagugcuccaacagaaggaggaagugaaaacaaac

SEQ ID NO: 233876 - RNA, 59 nt, Human
cugaacauuaauaugugcaaagauuggcucuccaacaagaaggaaagcagggaggaagg

SEQ ID NO: 233877 - RNA, 59 nt, Human
gaaggcugcgagaggacucuaguaugagucuccaacauuuggaacguuuccugggcugu

SEQ ID NO: 233878 - RNA, 59 nt, Human
cuuucccaugagagagagaacuggugauacuccaacaccguccaguuguggcagcucuc

SEQ ID NO: 233879 - RNA, 59 nt, Human
aaguaauuauaaacauaaauuuccuguagcuccaacaugacuuugaucugaguaauagu

SEQ ID NO: 233880 - RNA, 59 nt, Human
gccucagaguucuggaugcuuccgugcggcuccaacaggcaucgucuucccuuccgcag

SEQ ID NO: 233881 - RNA, 59 nt, Human
cucauaugccugguaugugacacgugucucuccaacaauaaaagacuuggccuuggcug

SEQ ID NO: 233882 - RNA, 59 nt, Human
uggcugcaccaaauuggagguguggguuccuccaacacaauuugcuucugcccguuguc

SEQ ID NO: 233883 - RNA, 59 nt, Human
augaccagcaaaauucaagaacaaaacugcuccaacagacuuuuuuaaaggaaaaaaua

SEQ ID NO: 233884 - RNA, 59 nt, Human
ugcugggguacaguugcuuccuuuugaaccuccaacagggaaggcucuguccagaaagg

SEQ ID NO: 233885 - RNA, 59 nt, Human
gcagcccccgccccugggcccuggucuuccuccaacaucacaccugcugcccauucucc

SEQ ID NO: 233886 - RNA, 59 nt, Human
ggcuuucccuugccuuccccuuucucugucuccaacacucuuuccccaugucuuucugg

SEQ ID NO: 233887 - RNA, 59 nt, Human
ggcaguccucaccucugccucccucgcuccuccaacagcugccuucucccggguuccag

SEQ ID NO: 233888 - RNA, 59 nt, Human
agagaaucagugggaaaaaaccuugagaucuccaacacgcugggccccucccuggggcg

SEQ ID NO: 233889 - RNA, 59 nt, Human
aggauguaagccugaccauaggaucuugacuccaacagcggcaacccccacccccauug

SEQ ID NO: 233890 - RNA, 59 nt, Human
ugccaagguugcuugcccucaccccaaugcuccaacagccauugccuaacucaugggcu

SEQ ID NO: 233891 - RNA, 59 nt, Human
ugcuuuuucuucagugcuaagaaaguucccuccaacaggaacucucugaccuguuuauu

SEQ ID NO: 233892 - RNA, 59 nt, Human
gcugucaccuugcucagccaucccgucuucuccaacaccaccucuccagaggccaagga

SEQ ID NO: 233893 - RNA, 59 nt, Human
gagaucaauuuucccgacgaucuuccuggcuccaacacugcugcuccagugcaggagac

SEQ ID NO: 233894 - RNA, 59 nt, Human
agaugggguuuguauuggcgcaccaagaucuccaacagccaguguguguuucccaucuc

SEQ ID NO: 233895 - RNA, 59 nt, Human
ggcaauuauguuuagcuuucaucauuauacuccaacagacccgucugaagggguauuuu

SEQ ID NO: 233896 - RNA, 59 nt, Human
aaauagcuucaggauguaucuuagcugcacuccaacauugcauccuuucuggggugaag

SEQ ID NO: 233897 - RNA, 59 nt, Human
uagugggugggcaggacuggaacucgguucuccaacagcccagagcucacucuuuuaca

SEQ ID NO: 233898 - RNA, 59 nt, Human
cagucagcccauggccuucgugaacuuugcuccaacacacugaugugugggcuucccac

SEQ ID NO: 233899 - RNA, 59 nt, Human
gggagcagccagcccaggccuccugccgucuccaacagggcaugucccgggaggacccu

SEQ ID NO: 233900 - RNA, 59 nt, Human
accaugaauucuggucacauuccauuucucuccaacaugaaggaucaaaaaauguuuuu

SEQ ID NO: 233901 - RNA, 59 nt, Human
cgcacugugacccccagcuccggccuguccuccaacaccaagcacagcagccuggggcu

SEQ ID NO: 233902 - RNA, 59 nt, Human
ucaggcacuggggccugucaccaaggcuccuccaacaugcgggaggaggcuuagcagac

SEQ ID NO: 233903 - RNA, 59 nt, Human
aggcccugccaagucuagcauguuccugucuccaacaccgccuccugcacaugcagagc

SEQ ID NO: 233904 - RNA, 59 nt, Human
acuggccuggcccugagacuggggaguggcuccaacagccuccugccacccacacacca

SEQ ID NO: 233905 - RNA, 59 nt, Human
cccccaaccuacccccaccccaaaagcagcuccaacagaauggccagagggccucaggg

SEQ ID NO: 233906 - RNA, 59 nt, Human
cuacuauugaaguguaauugugagauggacuccaacaagcaugugacugugagauugug

SEQ ID NO: 233907 - RNA, 59 nt, Human
aaauuaaauauguauuauuaaaaguuggucuccaacacuuguuuaaacaugacuuuauu

SEQ ID NO: 233908 - RNA, 59 nt, Human
uaauucauuuucucuuuaguguuaguagacuccaacaacagaaguggcaucuguguauu

SEQ ID NO: 233909 - RNA, 59 nt, Human
ugcccaacucuuugggaugacccccaagccuccaacauccugucuuuccaucaggaacu

SEQ ID NO: 233910 - RNA, 59 nt, Human
uccgugggagggaggcauucaucuacagacuccaacaaggccuccagcggagacaucuc

SEQ ID NO: 233911 - RNA, 59 nt, Human
ugccccugcuacugccaaccucgcuccaacuccaacauccacucucucuuguucuuacu

SEQ ID NO: 233912 - RNA, 59 nt, Human
ucaagggacaauagucuucauguuggauucuccaacaggcugggugcauguaucccccu

SEQ ID NO: 233913 - RNA, 59 nt, Human
uugguuacuuggggaucagagauuugucucuccaacagcuugugguuuucuuauuacuc

SEQ ID NO: 233914 - RNA, 59 nt, Human
ugggcugaggccaggggagacaucacaaccuccaacaacacuuuuuuucaugcuuuaau

SEQ ID NO: 233915 - RNA, 64 nt, Human
ucagcaagagcaacugauggcugccacuuccaggccccgagagacaggccucacguaacuuuac

SEQ ID NO: 233916 - RNA, 64 nt, Human
agaacuaagaagggagggcgagugggucuccauuccccgagaagccgggggcagggugggaugg

SEQ ID NO: 233917 - RNA, 64 nt, Human
ccaacaucucggggcaguuggaccuaucuccauaccccgagagcauuugccugccuguccugga

SEQ ID NO: 233918 - RNA, 64 nt, Human
ggaacaaaugguuggcaugcagcccccucaggcgccccgagaccucaucuuccggugagugccu

SEQ ID NO: 233919 - RNA, 64 nt, Human
cuggugggaacuuacuucucuauagcccacugagccccgagacagagaaccugcccacagcucu

SEQ ID NO: 233920 - RNA, 64 nt, Human
uccaguugguggguaacagcuggaccccuggcuaccccgagacccaggaggcgcucugcccgca

SEQ ID NO: 233921 - RNA, 64 nt, Human
uuaaugagugcaccugccuccaccagcaaggggaccccgagaacccugagcaggguccacagcu

SEQ ID NO: 233922 - RNA, 64 nt, Human
acaucccugagguuggcgacugucuacacuccucccccgagaccacccccacccuggggaagcg

SEQ ID NO: 233923 - RNA, 64 nt, Human
ugaugcaagauggcagaucugauacccauuagagccccgagaauuccucuucuggaucccaguu

SEQ ID NO: 233924 - RNA, 64 nt, Human
uuuuuugugguaugagaacaggcaaaaagagaugccccgagauagaaggggagccuuguguuuc

SEQ ID NO: 233925 - RNA, 64 nt, Human
guuugccgucagagauggcgcaucucgcugcaucccccgagaguacaccgguugcucuagccac

SEQ ID NO: 233926 - RNA, 64 nt, Human
ugccgucuggcuaggacucccuucuuccuuccuuccccgagaaggccucaauguggcgaggaag

SEQ ID NO: 233927 - RNA, 64 nt, Human
cuugcccucugcccacagcugugccucacagaugccccgagaagagaugacuaggcaucuucau

SEQ ID NO: 233928 - RNA, 64 nt, Human
cugcaaaccugccccuucuggguacuucccuugaccccgagaucacucaggagccagacaggaa

SEQ ID NO: 233929 - RNA, 64 nt, Human
ggccccugaagugaccccagcuccaggcaggaaaccccgagaaggaauggugcuuggcaggaac

SEQ ID NO: 233930 - RNA, 64 nt, Human
aggcugcccacuggagacgccucucccugcagucccccgagaggugggagacucgcggaaggcc

SEQ ID NO: 233931 - RNA, 64 nt, Human
ccuagcgcccgccaaaccuggugguccugggcggccccgagaccccaacacaugcuucuucgag

SEQ ID NO: 233932 - RNA, 64 nt, Human
gauugaaugcugcccagggucaguguaucuaauuccccgagacccucguuugauagugcuucuu

SEQ ID NO: 233933 - RNA, 64 nt, Human
acgaggacauggagugacuaucggggcgggccaaccccgagaaugaagauuggaaaaaggaaaa

SEQ ID NO: 233934 - RNA, 64 nt, Human
gagggcucugugcucuaggagcuaagccagcagcccccgagaggggacuuggcugggccuuucc

SEQ ID NO: 233935 - RNA, 64 nt, Human
cgucagagccugcagacaacggagggcagcgcccccccgagaucaggacgaaggaccaccgucg

SEQ ID NO: 233936 - RNA, 64 nt, Human
uggcuucagcggaagucugcugaccccuuauauuccccgagaguauaaagagaucggaaauaac

SEQ ID NO: 233937 - RNA, 64 nt, Human
gcguuuagucuguggccuagaagaccucaucagcccccgagaggaggccuugcauuaccucacu

SEQ ID NO: 233938 - RNA, 64 nt, Human
gaguuacauggaaucacccacaggguuuuggaggccccgagaagcgucuucccuugaguuggcc

SEQ ID NO: 233939 - RNA, 64 nt, Human
ugugagcgugucccgggcgggugggcccggccgcccccgagaguccaugaauaaagcuaaucug

SEQ ID NO: 233940 - RNA, 64 nt, Human
gaguguuaauagcagcaguccucccccuaccccgccccgagaccccaccccgagaccccacccc

SEQ ID NO: 233941 - RNA, 64 nt, Human
agcaguccucccccuaccccgccccgagaccccaccccgagaccccaccccggaccaguuacau

SEQ ID NO: 233942 - RNA, 64 nt, Human
caccccaguaugacugccgagcacugaggggucgccccgagagaagagccaggguccuucacca

SEQ ID NO: 233943 - RNA, 64 nt, Human
cuguuguccauccaguccacugacaagaggguuuccccgagagccgaaguggacugaagcuaca

SEQ ID NO: 233944 - RNA, 64 nt, Human
cgguagcacuccuggcugguuuuuuucuguuccuccccgagaggcccucuggcccccaggaaac

SEQ ID NO: 233945 - RNA, 64 nt, Human
agaguggggcgucgccccugcuggccgccgcgucccccgagauugacccacaauaaagcacagg

SEQ ID NO: 233946 - RNA, 64 nt, Human
agcacacccuuaggcaggcgccccuuccaccuuuccccgagaccgucgucgcuggagggggcag

SEQ ID NO: 233947 - RNA, 64 nt, Human
ucuuccccaucaccgugcgcuguugcgaucuggaccccgagaagaggugagugggguggggccc

SEQ ID NO: 233948 - RNA, 64 nt, Human
gcaccucuucaaugacugucugcugcugucucggccccgagaggguagccgauuccugguauuu

SEQ ID NO: 233949 - RNA, 64 nt, Human
cuccccccagguacagugccuucgagccuacaagccccgagagaaugaugaauuggcacuggag

SEQ ID NO: 233950 - RNA, 64 nt, Human
cggaggccccggcgcccgcacccacccggcccggccccgagagcaggcucgaccgccgccccau

SEQ ID NO: 233951 - RNA, 64 nt, Human
ccggccccccaacuucagggacccaccgcccauuccccgagagcugucggaaccagaugcaacc

SEQ ID NO: 233952 - RNA, 64 nt, Human
uccuguccucguccuggccugcagcucuucccagccccgagagagcuucccgaccuguccccgc

SEQ ID NO: 233953 - RNA, 64 nt, Human
ucuaccgucaccuagcugcugagcagaaaccgcaccccgagagaaaaucccauccucuguucca

SEQ ID NO: 233954 - RNA, 64 nt, Human
cugcucuguuccucagguggggcccagagcccuuccccgagacugcugaugucuguaaccacug

SEQ ID NO: 233955 - RNA, 64 nt, Human
cgaucccugggaccaaccgcauccucagcuucuuccccgagaaaugcuggagcaggcuguucag

SEQ ID NO: 233956 - RNA, 64 nt, Human
gccggcacacagcuccagugcugagaagucagugccccgagagacgaccccaccaguggggugc

SEQ ID NO: 233957 - RNA, 64 nt, Human
ggaguccugacccgcccagacuguccccagacucccccgagaccugccagccccggcauccugg

SEQ ID NO: 233958 - RNA, 64 nt, Human
ccccgagcuuccucgguagcagaggcccugugguccccgagacacaggcacgggucccugccac

SEQ ID NO: 233959 - RNA, 64 nt, Human
augaugggacaggccuaacaacacauguaagcuuccccgagagcuuucagcugguucaccucuu

SEQ ID NO: 233960 - RNA, 64 nt, Human
aaagaaugucuguuucuaacaaauccacaaauagccccgagauucaccguccuagagcuuaggc

SEQ ID NO: 233961 - RNA, 64 nt, Human
caggggacaccuguggagggcauuucccgugggcccccgagacccgccuagauggaggaagcgc

SEQ ID NO: 233962 - RNA, 64 nt, Human
uguucugaugccaccgcgagaugguccccgagcuccccgagaguccucagugaaaggauuccgc

SEQ ID NO: 233963 - RNA, 64 nt, Human
caagggguacugcaggggaagggcuggcugggguccccgagaucucaggaauuuuuguagggga

SEQ ID NO: 233964 - RNA, 64 nt, Human
cagccaugugacacuggcucccgguagacgggcaccccgagauguaccaaccuuuucauguauu

SEQ ID NO: 233965 - RNA, 64 nt, Human
cuccccaggacacgaaagugaacuccaccgucauccccgagacgcaacugcaggcugaggaccg

SEQ ID NO: 233966 - RNA, 64 nt, Human
cagagugguggcaccaccaugguuacagcggaugccccgagacucugcuugguaaacguggcag

SEQ ID NO: 233967 - RNA, 64 nt, Human
cauccacuugaaaccucccucuccaccuccccgcccccgagagcuacagcgugugauggaauca

SEQ ID NO: 233968 - RNA, 64 nt, Human
ggagcugggagcucugcaccacgagcuucagucaccccgagaggagaggagguaacgaggaggg

SEQ ID NO: 233969 - RNA, 64 nt, Human
caguccuaccuuuuucuuucugagagccuccccaccccgagaucacauuucucacugccuucug

SEQ ID NO: 233970 - RNA, 64 nt, Human
agaccugcuacccugguacuuccacccuaccccaccccgagaagggcagagacgcaugugacuc

SEQ ID NO: 233971 - RNA, 64 nt, Human
ugauccucaccaugaaccagacacagggccugugccccgagauuccagaugcgaccacugugug

SEQ ID NO: 233972 - RNA, 64 nt, Human
cauggaguaaauuaguuccagaguauauucaugcccccgagaggaaauucaucaacauccuggg

SEQ ID NO: 233973 - RNA, 64 nt, Human
aauuucuguccuuuggaucacuccucucccuaaaccccgagauggcuuuucucccaguggcuuc

SEQ ID NO: 233974 - RNA, 64 nt, Human
cacucccuaaaugaucucuccuuccccccccccaccccgagauacgggguuccaggaaagggga

SEQ ID NO: 233975 - RNA, 64 nt, Human
gagaacguccccagcuuuggcauccucaaguaucccccgagagcagaauaggguaaggauuguu

SEQ ID NO: 233976 - RNA, 64 nt, Human
cugcaggacaccgaggaaucguaugugggaacguccccgagaaccacacgagcgugcugcucag

SEQ ID NO: 233977 - RNA, 64 nt, Human
accuugcuagggcccagaaccaagcgucccccagccccgagagggagccugucgucucccaggg

SEQ ID NO: 233978 - RNA, 64 nt, Human
gguggccccagggagucacacagucuguacccggccccgagauccucugcuguaacugcagggu

SEQ ID NO: 233979 - RNA, 64 nt, Human
ggaaccgaccccuaguugagagcaccuugcaguuccccgagaacuuucugauucacagucucau

SEQ ID NO: 233980 - RNA, 64 nt, Human
cccauuugcucccugagcuccaagauaagaauggccccgagagaacugcugaacauuuguucau

SEQ ID NO: 233981 - RNA, 64 nt, Human
aggagacagugugggaaacgcuccugcuuuaauuccccgagaaacggcucuuccugccuggaug

SEQ ID NO: 233982 - RNA, 64 nt, Human
ugggaaacagcgauugaccugugcuucugacagcccccgagacaccuugaggaggccgcuccuu

SEQ ID NO: 233983 - RNA, 64 nt, Human
acaagguauggggugggagccacaauugaggauaccccgagacuaccaggagagcccugggcug

SEQ ID NO: 233984 - RNA, 64 nt, Human
caccuucguccccuuugcagggaguuacaggagaccccgagacacccucccuccacucgggagc

SEQ ID NO: 233985 - RNA, 64 nt, Human
ugaggccccgauggacuccugaccauaauccuagccccgagacaccauccugagccagggaaca

SEQ ID NO: 233986 - RNA, 64 nt, Human
gagggagcgcccuguccacccgggcggggagagaccccgagagagacugcacuuggccacagcg

SEQ ID NO: 233987 - RNA, 64 nt, Human
uggcuucagcgaaagucugcuaaccccuuacauuccccgagaguguaaagagaucggaaauaac

SEQ ID NO: 233988 - RNA, 64 nt, Human
ggcacgggagacccgggccgccuucaggccgcucccccgagauucuggggcagucggaagaugu

SEQ ID NO: 233989 - RNA, 64 nt, Human
ggaacgcccuccccagucccgcuguccagcaaggccccgagacuuuucuucugugauuuccaaa

SEQ ID NO: 233990 - RNA, 64 nt, Human
gugcaauaaaguccucgugccugcugcucacagcccccgagagccccuccuccuggagaauaaa

SEQ ID NO: 233991 - RNA, 64 nt, Human
uggggacucggccucagcgucacccugagauuccccccgagacacagugcgcuaguacggcugu

SEQ ID NO: 233992 - RNA, 64 nt, Human
accccugucccacccacacagcugcccuagcugaccccgagaagugcucuuggcugaccccucu

SEQ ID NO: 233993 - RNA, 64 nt, Human
cagccccucuccccagucacagccugaagggaggccccgagagcuuccuccuuccccccaccug

SEQ ID NO: 233994 - RNA, 64 nt, Human
ucccucacuguguugacacuuggcacuuugcuggccccgagaaaggucgaugacacagccgcaa

SEQ ID NO: 233995 - RNA, 64 nt, Human
ucuuucucaggguccucuuuggugggcagccacuccccgagauguugccaucaguuuucugcag

SEQ ID NO: 233996 - RNA, 56 nt, Human
aaugcugcuccaucaugugagccggcccccgagaccccggcccccaccccacacca

SEQ ID NO: 233997 - RNA, 64 nt, Human
gcuuggaccaggguccugggucuucccaaccauaccccgagaucaggccccaccugccagcucu

SEQ ID NO: 233998 - RNA, 64 nt, Human
gcuugcugugaauuccuguccucguguccccgacccccgagaggccaccuccaagccgcgggug

SEQ ID NO: 233999 - RNA, 64 nt, Human
gauugcacuuacucuuucaucacggaaacagaccccccgagagaagccccaacgagauuuuccg

SEQ ID NO: 234000 - RNA, 64 nt, Human
gggacuaggaggaagggggcagagagaguuaugaccccgagagggcgcacagaccaagcgugag

SEQ ID NO: 234001 - RNA, 64 nt, Human
caggaaaggcugggagaagagguggccuggaguaccccgagaucccagcagcgcacacagugga

SEQ ID NO: 234002 - RNA, 64 nt, Human
agcuagcuuagagugcguggcacgggccccccgcccccgagaucuggagcccagggacuuucuu

SEQ ID NO: 234003 - RNA, 64 nt, Human
ggguccucucuuccacaguggcgggcccacucagccccgagaccacccaaccucacccuccuga

SEQ ID NO: 234004 - RNA, 64 nt, Human
uuauaauaguaagccccugugacccucucacuuaccccgagaccucacuuuauuacaagaucuu

SEQ ID NO: 234005 - RNA, 64 nt, Human
accugcucagcccacccccacccauccucagcuaccccgagagguagccccacucuaaggggag

SEQ ID NO: 234006 - RNA, 64 nt, Human
gcguggagacagucuacggaaagcgcuagcagacccccgagagggugcaguggagcccugagca

SEQ ID NO: 234007 - RNA, 62 nt, Human
ugucuuuucugucguucuaguuccagggucacccccgagaggacaacaggcaucuggaagug

SEQ ID NO: 234008 - RNA, 64 nt, Human
ggcgcaugcgcauccgcgauucccugcgaccaggccccgagagggcgagaccagaggggacgga

SEQ ID NO: 234009 - RNA, 64 nt, Human
auuucugugacuuuuuucuggggucaaagagaaaccccgagacacuguacacuguuccuuuuca

SEQ ID NO: 234010 - RNA, 64 nt, Human
acauuccuggcagagaaaacagcacgugcaaaggccccgagacuggaguguguuccugaagagc

SEQ ID NO: 234011 - RNA, 64 nt, Human
uccauccugacgccacagccgcccauggaccagcccccgagagccaccugugggugaggugaag

SEQ ID NO: 234012 - RNA, 64 nt, Human
ggggucucgcagggaaaagggcuggcuucuagguccccgagauaagugugcagggggaugggcc

SEQ ID NO: 234013 - RNA, 64 nt, Human
ugagcaaccuggugccccccguggagcuggccaaccccgagaaccaguucagaguggacuacau

SEQ ID NO: 234014 - RNA, 64 nt, Human
aaagcagccagcacaaagggcccaggaagccagcccccgagagcugagcgugggggucuuugag

SEQ ID NO: 234015 - RNA, 64 nt, Human
gagcccaucucucggagaaacccuguccacccaaccccgagagcccuagcgugcagucagcguc

SEQ ID NO: 234016 - RNA, 64 nt, Human
uugggccccuccucaccccuucuuugccuccuacccccgagaccuccccucucccaacgggauu

SEQ ID NO: 234017 - RNA, 64 nt, Human
gacggggccuccaucacgccuguuaccagaggauccccgagagccacaccagcucuggacauca

SEQ ID NO: 234018 - RNA, 64 nt, Human
gccccaauggcaccgaccccuacaagccuaagugccccgagagcgacgcgacgcagcagaggcc

SEQ ID NO: 234019 - RNA, 64 nt, Human
ccuuuaagcuggugcacagggacaucgugggggaccccgagaccgcgcuggcccucugcuaaag

SEQ ID NO: 234020 - RNA, 64 nt, Human
ggucacugugggagcagggaaaggugcccccacuccccgagagccaggggaaggaguggcucug

SEQ ID NO: 234021 - RNA, 60 nt, Human
uccuccccaaacggcgguaaugccgggcguccccgagacgcggcugccuguccgugccca

SEQ ID NO: 234022 - RNA, 64 nt, Human
gucggaggcggaaggaagugauauuuauuguucuccccgagaccgcgucgcccgcggcccggcc

SEQ ID NO: 234023 - RNA, 64 nt, Human
cccauuucacaggugaggaacccgaggcucagggccccgagacuuggccucaguucuuccuucc

SEQ ID NO: 234024 - RNA, 64 nt, Human
cggccucucaccaagcaguccuccaugugagcaaccccgagacaaaaaugcuaagugggaucaa

SEQ ID NO: 234025 - RNA, 64 nt, Human
aacuguuuucucaugaugccuuuuuauauuuaaaccccgagauagugcuggaacacugcugagg

SEQ ID NO: 234026 - RNA, 64 nt, Human
cccucacacuggcccagccccucacacugccccaccccgagaacccucagcucucaaaggucac

SEQ ID NO: 234027 - RNA, 64 nt, Human
acccucgaacauguggaccuggacccucaggagcccccgagaugacugcagggggcucaaaugc

SEQ ID NO: 234028 - RNA, 64 nt, Human
aggcguuuccaucugcaaggaugcacgguacccuccccgagagcaggccuguccccuacccaac

SEQ ID NO: 234029 - RNA, 64 nt, Human
uuuuuguccaucuuguuucauuugcuugccccgcccccgagacggagucuuacucugucgccca

SEQ ID NO: 234030 - RNA, 64 nt, Human
guuguauaccacacccugggccccuaaucccaggccccgagauaggaaagccagcuagucucuu

SEQ ID NO: 234031 - RNA, 64 nt, Human
uuauuucuauguuuguguuaccauguuaacuuuuccccgagagaaaguguuaacauugagacuc

SEQ ID NO: 234032 - RNA, 64 nt, Human
uaggaauuauuucguuggcugaacguuaccagcaccccgagaacacauuuugauagaaucagag

SEQ ID NO: 234033 - RNA, 64 nt, Human; identical to SEQ ID NO: 131733

SEQ ID NO: 234034 - RNA, 64 nt, Human; identical to SEQ ID NO: 131734

SEQ ID NO: 234035 - RNA, 64 nt, Human; identical to SEQ ID NO: 131735

SEQ ID NO: 234036 - RNA, 64 nt, Human; identical to SEQ ID NO: 131736

SEQ ID NO: 234037 - RNA, 64 nt, Human; identical to SEQ ID NO: 131737

SEQ ID NO: 234038 - RNA, 64 nt, Human; identical to SEQ ID NO: 131738

SEQ ID NO: 234039 - RNA, 64 nt, Human; identical to SEQ ID NO: 131739

SEQ ID NO: 234040 - RNA, 64 nt, Human; identical to SEQ ID NO: 131740

SEQ ID NO: 234041 - RNA, 64 nt, Human; identical to SEQ ID NO: 131741

SEQ ID NO: 234042 - RNA, 64 nt, Human; identical to SEQ ID NO: 131742

SEQ ID NO: 234043 - RNA, 64 nt, Human; identical to SEQ ID NO: 131743

SEQ ID NO: 234044 - RNA, 64 nt, Human; identical to SEQ ID NO: 131744

SEQ ID NO: 234045 - RNA, 64 nt, Human; identical to SEQ ID NO: 131745

SEQ ID NO: 234046 - RNA, 64 nt, Human; identical to SEQ ID NO: 131746

SEQ ID NO: 234047 - RNA, 64 nt, Human; identical to SEQ ID NO: 131747

SEQ ID NO: 234048 - RNA, 64 nt, Human; identical to SEQ ID NO: 131748

SEQ ID NO: 234049 - RNA, 64 nt, Human; identical to SEQ ID NO: 131749

SEQ ID NO: 234050 - RNA, 64 nt, Human; identical to SEQ ID NO: 131750

SEQ ID NO: 234051 - RNA, 64 nt, Human; identical to SEQ ID NO: 131751

SEQ ID NO: 234052 - RNA, 64 nt, Human; identical to SEQ ID NO: 131752

SEQ ID NO: 234053 - RNA, 64 nt, Human; identical to SEQ ID NO: 131753

SEQ ID NO: 234054 - RNA, 59 nt, Human; identical to SEQ ID NO: 131754

SEQ ID NO: 234055 - RNA, 64 nt, Human; identical to SEQ ID NO: 131755

SEQ ID NO: 234056 - RNA, 64 nt, Human; identical to SEQ ID NO: 131756

SEQ ID NO: 234057 - RNA, 64 nt, Human; identical to SEQ ID NO: 131757

SEQ ID NO: 234058 - RNA, 64 nt, Human; identical to SEQ ID NO: 131758

SEQ ID NO: 234059 - RNA, 64 nt, Human; identical to SEQ ID NO: 131759

SEQ ID NO: 234060 - RNA, 64 nt, Human; identical to SEQ ID NO: 131760

SEQ ID NO: 234061 - RNA, 64 nt, Human; identical to SEQ ID NO: 131761

SEQ ID NO: 234062 - RNA, 64 nt, Human; identical to SEQ ID NO: 131762

SEQ ID NO: 234063 - RNA, 64 nt, Human; identical to SEQ ID NO: 131763

SEQ ID NO: 234064 - RNA, 64 nt, Human; identical to SEQ ID NO: 131764

SEQ ID NO: 234065 - RNA, 64 nt, Human; identical to SEQ ID NO: 131765

SEQ ID NO: 234066 - RNA, 64 nt, Human; identical to SEQ ID NO: 131766

SEQ ID NO: 234067 - RNA, 64 nt, Human; identical to SEQ ID NO: 131767

SEQ ID NO: 234068 - RNA, 64 nt, Human; identical to SEQ ID NO: 131768

SEQ ID NO: 234069 - RNA, 64 nt, Human; identical to SEQ ID NO: 131769

SEQ ID NO: 234070 - RNA, 64 nt, Human; identical to SEQ ID NO: 131770

SEQ ID NO: 234071 - RNA, 64 nt, Human; identical to SEQ ID NO: 131771

SEQ ID NO: 234072 - RNA, 64 nt, Human; identical to SEQ ID NO: 131772

SEQ ID NO: 234073 - RNA, 64 nt, Human; identical to SEQ ID NO: 131773

SEQ ID NO: 234074 - RNA, 64 nt, Human; identical to SEQ ID NO: 131774

SEQ ID NO: 234075 - RNA, 64 nt, Human; identical to SEQ ID NO: 131775

SEQ ID NO: 234076 - RNA, 64 nt, Human; identical to SEQ ID NO: 131776

SEQ ID NO: 234077 - RNA, 64 nt, Human; identical to SEQ ID NO: 131777

SEQ ID NO: 234078 - RNA, 64 nt, Human; identical to SEQ ID NO: 131778

SEQ ID NO: 234079 - RNA, 64 nt, Human; identical to SEQ ID NO: 131779

SEQ ID NO: 234080 - RNA, 64 nt, Human; identical to SEQ ID NO: 131780

SEQ ID NO: 234081 - RNA, 64 nt, Human; identical to SEQ ID NO: 131781

SEQ ID NO: 234082 - RNA, 64 nt, Human; identical to SEQ ID NO: 131782

SEQ ID NO: 234083 - RNA, 64 nt, Human; identical to SEQ ID NO: 131783

SEQ ID NO: 234084 - RNA, 64 nt, Human; identical to SEQ ID NO: 131784

SEQ ID NO: 234085 - RNA, 64 nt, Human; identical to SEQ ID NO: 131785

SEQ ID NO: 234086 - RNA, 64 nt, Human; identical to SEQ ID NO: 131786

SEQ ID NO: 234087 - RNA, 64 nt, Human; identical to SEQ ID NO: 131787

SEQ ID NO: 234088 - RNA, 64 nt, Human; identical to SEQ ID NO: 131788

SEQ ID NO: 234089 - RNA, 64 nt, Human; identical to SEQ ID NO: 131789

SEQ ID NO: 234090 - RNA, 64 nt, Human; identical to SEQ ID NO: 131790

SEQ ID NO: 234091 - RNA, 64 nt, Human; identical to SEQ ID NO: 131791

SEQ ID NO: 234092 - RNA, 64 nt, Human; identical to SEQ ID NO: 131792

SEQ ID NO: 234093 - RNA, 64 nt, Human; identical to SEQ ID NO: 131793

SEQ ID NO: 234094 - RNA, 64 nt, Human; identical to SEQ ID NO: 131794

SEQ ID NO: 234095 - RNA, 64 nt, Human; identical to SEQ ID NO: 131795

SEQ ID NO: 234096 - RNA, 64 nt, Human; identical to SEQ ID NO: 131796

SEQ ID NO: 234097 - RNA, 64 nt, Human; identical to SEQ ID NO: 131797

SEQ ID NO: 234098 - RNA, 64 nt, Human; identical to SEQ ID NO: 131798

SEQ ID NO: 234099 - RNA, 64 nt, Human; identical to SEQ ID NO: 131799

SEQ ID NO: 234100 - RNA, 64 nt, Human; identical to SEQ ID NO: 131800

SEQ ID NO: 234101 - RNA, 64 nt, Human; identical to SEQ ID NO: 131801

SEQ ID NO: 234102 - RNA, 64 nt, Human; identical to SEQ ID NO: 131802

SEQ ID NO: 234103 - RNA, 64 nt, Human; identical to SEQ ID NO: 131803

SEQ ID NO: 234104 - RNA, 64 nt, Human; identical to SEQ ID NO: 131804

SEQ ID NO: 234105 - RNA, 64 nt, Human; identical to SEQ ID NO: 131805

SEQ ID NO: 234106 - RNA, 64 nt, Human; identical to SEQ ID NO: 131806

SEQ ID NO: 234107 - RNA, 64 nt, Human; identical to SEQ ID NO: 131807

SEQ ID NO: 234108 - RNA, 64 nt, Human; identical to SEQ ID NO: 131808

SEQ ID NO: 234109 - RNA, 64 nt, Human; identical to SEQ ID NO: 131809

SEQ ID NO: 234110 - RNA, 64 nt, Human; identical to SEQ ID NO: 131810

SEQ ID NO: 234111 - RNA, 64 nt, Human; identical to SEQ ID NO: 131811

SEQ ID NO: 234112 - RNA, 64 nt, Human; identical to SEQ ID NO: 131812

SEQ ID NO: 234113 - RNA, 64 nt, Human; identical to SEQ ID NO: 131813

SEQ ID NO: 234114 - RNA, 64 nt, Human; identical to SEQ ID NO: 131814

SEQ ID NO: 234115 - RNA, 64 nt, Human; identical to SEQ ID NO: 131815

SEQ ID NO: 234116 - RNA, 64 nt, Human; identical to SEQ ID NO: 131816

SEQ ID NO: 234117 - RNA, 64 nt, Human; identical to SEQ ID NO: 131817

SEQ ID NO: 234118 - RNA, 64 nt, Human; identical to SEQ ID NO: 131818

SEQ ID NO: 234119 - RNA, 64 nt, Human; identical to SEQ ID NO: 131819

SEQ ID NO: 234120 - RNA, 64 nt, Human; identical to SEQ ID NO: 131820

SEQ ID NO: 234121 - RNA, 64 nt, Human; identical to SEQ ID NO: 131821

SEQ ID NO: 234122 - RNA, 64 nt, Human; identical to SEQ ID NO: 131822

SEQ ID NO: 234123 - RNA, 64 nt, Human; identical to SEQ ID NO: 131823

SEQ ID NO: 234124 - RNA, 64 nt, Human; identical to SEQ ID NO: 131824

SEQ ID NO: 234125 - RNA, 64 nt, Human; identical to SEQ ID NO: 131825

SEQ ID NO: 234126 - RNA, 64 nt, Human; identical to SEQ ID NO: 131826

SEQ ID NO: 234127 - RNA, 64 nt, Human; identical to SEQ ID NO: 131827

SEQ ID NO: 234128 - RNA, 64 nt, Human; identical to SEQ ID NO: 131828

SEQ ID NO: 234129 - RNA, 64 nt, Human; identical to SEQ ID NO: 131829

SEQ ID NO: 234130 - RNA, 64 nt, Human; identical to SEQ ID NO: 131830

SEQ ID NO: 234131 - RNA, 53 nt, Human; identical to SEQ ID NO: 131831

SEQ ID NO: 234132 - RNA, 64 nt, Human; identical to SEQ ID NO: 131832

SEQ ID NO: 234133 - RNA, 64 nt, Human; identical to SEQ ID NO: 131833

SEQ ID NO: 234134 - RNA, 64 nt, Human; identical to SEQ ID NO: 131834

SEQ ID NO: 234135 - RNA, 64 nt, Human; identical to SEQ ID NO: 131835

SEQ ID NO: 234136 - RNA, 64 nt, Human; identical to SEQ ID NO: 131836

SEQ ID NO: 234137 - RNA, 64 nt, Human; identical to SEQ ID NO: 131837

SEQ ID NO: 234138 - RNA, 57 nt, Human; identical to SEQ ID NO: 131838

SEQ ID NO: 234139 - RNA, 59 nt, Human; identical to SEQ ID NO: 131839

SEQ ID NO: 234140 - RNA, 64 nt, Human; identical to SEQ ID NO: 131840

SEQ ID NO: 234141 - RNA, 64 nt, Human; identical to SEQ ID NO: 131841

SEQ ID NO: 234142 - RNA, 64 nt, Human; identical to SEQ ID NO: 131842

SEQ ID NO: 234143 - RNA, 56 nt, Human; identical to SEQ ID NO: 131843

SEQ ID NO: 234144 - RNA, 64 nt, Human; identical to SEQ ID NO: 131844

SEQ ID NO: 234145 - RNA, 64 nt, Human; identical to SEQ ID NO: 131845

SEQ ID NO: 234146 - RNA, 64 nt, Human; identical to SEQ ID NO: 131846

SEQ ID NO: 234147 - RNA, 64 nt, Human; identical to SEQ ID NO: 131847

SEQ ID NO: 234148 - RNA, 64 nt, Human; identical to SEQ ID NO: 131848

SEQ ID NO: 234149 - RNA, 64 nt, Human; identical to SEQ ID NO: 131849

SEQ ID NO: 234150 - RNA, 64 nt, Human; identical to SEQ ID NO: 131850

SEQ ID NO: 234151 - RNA, 64 nt, Human; identical to SEQ ID NO: 131851

SEQ ID NO: 234152 - RNA, 64 nt, Human; identical to SEQ ID NO: 131852

SEQ ID NO: 234153 - RNA, 64 nt, Human; identical to SEQ ID NO: 131853

SEQ ID NO: 234154 - RNA, 50 nt, Human; identical to SEQ ID NO: 131854

SEQ ID NO: 234155 - RNA, 64 nt, Human; identical to SEQ ID NO: 131855

SEQ ID NO: 234156 - RNA, 64 nt, Human; identical to SEQ ID NO: 131856

SEQ ID NO: 234157 - RNA, 64 nt, Human; identical to SEQ ID NO: 131857

SEQ ID NO: 234158 - RNA, 64 nt, Human; identical to SEQ ID NO: 131858

SEQ ID NO: 234159 - RNA, 64 nt, Human; identical to SEQ ID NO: 131859

SEQ ID NO: 234160 - RNA, 64 nt, Human; identical to SEQ ID NO: 131860

SEQ ID NO: 234161 - RNA, 64 nt, Human; identical to SEQ ID NO: 131861

SEQ ID NO: 234162 - RNA, 64 nt, Human; identical to SEQ ID NO: 131862

SEQ ID NO: 234163 - RNA, 64 nt, Human; identical to SEQ ID NO: 131863

SEQ ID NO: 234164 - RNA, 64 nt, Human; identical to SEQ ID NO: 131864

SEQ ID NO: 234165 - RNA, 64 nt, Human; identical to SEQ ID NO: 131865

SEQ ID NO: 234166 - RNA, 64 nt, Human; identical to SEQ ID NO: 131866

SEQ ID NO: 234167 - RNA, 64 nt, Human; identical to SEQ ID NO: 131867

SEQ ID NO: 234168 - RNA, 64 nt, Human; identical to SEQ ID NO: 131868

SEQ ID NO: 234169 - RNA, 64 nt, Human; identical to SEQ ID NO: 131869

SEQ ID NO: 234170 - RNA, 64 nt, Human; identical to SEQ ID NO: 131870

SEQ ID NO: 234171 - RNA, 64 nt, Human; identical to SEQ ID NO: 131871

SEQ ID NO: 234172 - RNA, 64 nt, Human; identical to SEQ ID NO: 131872

SEQ ID NO: 234173 - RNA, 64 nt, Human; identical to SEQ ID NO: 131873

SEQ ID NO: 234174 - RNA, 64 nt, Human; identical to SEQ ID NO: 131874

SEQ ID NO: 234175 - RNA, 64 nt, Human; identical to SEQ ID NO: 131875

SEQ ID NO: 234176 - RNA, 64 nt, Human; identical to SEQ ID NO: 131876

SEQ ID NO: 234177 - RNA, 64 nt, Human; identical to SEQ ID NO: 131877

SEQ ID NO: 234178 - RNA, 64 nt, Human; identical to SEQ ID NO: 131878

SEQ ID NO: 234179 - RNA, 64 nt, Human; identical to SEQ ID NO: 131879

SEQ ID NO: 234180 - RNA, 64 nt, Human
cgagccagucgaaauacuaagugacucugccgagugcccucacucgccuucgagagauaaagaa

SEQ ID NO: 234181 - RNA, 64 nt, Human
ucccaggcaaauaggccccuuugaggcuccugagugcccucagauggucaaaacccaguuuucc

SEQ ID NO: 234182 - RNA, 64 nt, Human
gaaccaaacacuucuuccaacugacucugcucccugcccucaccaucucaaacucugauuccca

SEQ ID NO: 234183 - RNA, 64 nt, Human
ccugcuauucucugguguauccuucacaucuaggugcccucaagcagcugugugaguguugaga

SEQ ID NO: 234184 - RNA, 64 nt, Human
uccccaagcccagagauguccaccugggcuggacugcccucaagcuuauacuagagaagagcaa

SEQ ID NO: 234185 - RNA, 64 nt, Human
acagcugcuacccccaagacuugccacguuguucugcccucagauggaauuaggugaaugugug

SEQ ID NO: 234186 - RNA, 64 nt, Human
ggguuauuuagaagacacuuucucugccucauccugcccucaagcuuuagucaagaaguuaugg

SEQ ID NO: 234187 - RNA, 64 nt, Human
agcaccccagaccucaccuccaucccccucugucugcccucacaauuaggcuucauugcacuga

SEQ ID NO: 234188 - RNA, 64 nt, Human
aagcccccgauaaucgcucuuuuccacuccaagaugcccucauaaaccaauguggcaagacuac

SEQ ID NO: 234189 - RNA, 64 nt, Human
cuugccuaugcagggcaaacaaaaugugaaauucugcccucagcugagcugaguaagggcuccu

SEQ ID NO: 234190 - RNA, 64 nt, Human
gccuuucaaaaugaaggaacauuguucucuauccuccccugacccccgacggccccaugcuagg

SEQ ID NO: 234191 - RNA, 64 nt, Human
aaaauacagaaaaacauaaaggaaaaaacuccaauccccugagcccaccacuguucaggacccc

SEQ ID NO: 234192 - RNA, 64 nt, Human
uaaaggucaaauggggucaucugcuccuuuuccauccccugacauaccuuaaccucugaacucu

SEQ ID NO: 234193 - RNA, 64 nt, Human
cagaccuuggcaaauguuaucugugggggaaaauugcccucaauugagaaccacuggucuagcu

SEQ ID NO: 234194 - RNA, 64 nt, Human
ccacaaguuugccccccaccuccacuuaccugucugcccucagcuucuuccugggagagagccc

SEQ ID NO: 234195 - RNA, 51 nt, Human
ccagccuccagacccucuagaugcccucaguggccacaucaugcccacucc

SEQ ID NO: 234196 - RNA, 64 nt, Human
cugaguggugaggcuucaagccuuaaagucagugugcccucaaccagcacagccugccccaauu

SEQ ID NO: 234197 - RNA, 64 nt, Human
ugugcagccauaguuuggguauuuuugguuuauaugcccucaaguaaaagaaaagccgaaaggg

SEQ ID NO: 234198 - RNA, 64 nt, Human
cccccucuuuuccauuucucccuccaucaccaccugcccucacauccuggggcagcagcuggac

SEQ ID NO: 234199 - RNA, 64 nt, Human
ugcugguugccaggcgcagaggggaggccagcccugcccucaggaccugccugaccugccagug

SEQ ID NO: 234200 - RNA, 64 nt, Human
ggaaggaaaaaugguaucugucaaugaggauccuugcccucacagagcacgcagccuagaugca

SEQ ID NO: 234201 - RNA, 64 nt, Human
uagcauggaagaggagugaggcagccucacugugugcccucagggauacgagauucucuguugu

SEQ ID NO: 234202 - RNA, 64 nt, Human
gcucuaaggccaagacuucucucucccaucaccuugcccucauugucuucccucucaagccccu

SEQ ID NO: 234203 - RNA, 64 nt, Human
cuuugcuucccacugggauuccuacuuaggugucugcccucagggguccaaaucacuucaggac

SEQ ID NO: 234204 - RNA, 64 nt, Human
uggaaggcuuguacuauggccaugacagugacauugcccucaccaugaucccucuccaaagugg

SEQ ID NO: 234205 - RNA, 64 nt, Human
ggggcugggagugguuagccggaauacuggggccugcccucagcaucccccauagcucccagca

SEQ ID NO: 234206 - RNA, 64 nt, Human
auggggagggaggagggcggggggaggggaggguugcccucagcccuuuccguggcuucucugc

SEQ ID NO: 234207 - RNA, 63 nt, Human
cuggucucgaacuccuggccuaggugauccacccgccucgaccucccaaagugcugggauuac

SEQ ID NO: 234208 - RNA, 64 nt, Human
aauaaaaaagaaguugguuuauuuccaaaauaaauccccugacaaaaaaccuggugauguuaag

SEQ ID NO: 234209 - RNA, 60 nt, Human
ugcgcccacgguaccuggaccugcuagucuccagcccagcuuuuccccaaccaguggguu

SEQ ID NO: 234210 - RNA, 64 nt, Human
gcugagcuuacacuaauuggucagacaugcugucugcccucaugaaauuggcuccaaaugaaug

SEQ ID NO: 234211 - RNA, 64 nt, Human
gauggggccuaaugaggugauuaggugaagucucugcccucaugaaaagauuaaucccauuauc

SEQ ID NO: 234212 - RNA, 64 nt, Human
aaucagaagacagagcuauuucagaggcucugugugcccucacuagauaguuuuucuucugggu

SEQ ID NO: 234213 - RNA, 64 nt, Human
ccaggggcuggugggacaguggugacauagucucugcccucauagaguugauugucuagugagg

SEQ ID NO: 234214 - RNA, 64 nt, Human
ccacuuaugauaauaauaauaaaaaagacugcuuugcccucacgucaguuguacauggcaugga

SEQ ID NO: 234215 - RNA, 64 nt, Human
aauccgacaaccagaggcugaaagaugaaaauggugcccucaucagagucaucagcaaacuguc

SEQ ID NO: 234216 - RNA, 64 nt, Human
uggauaccauggcgcgugaguuagauguggucccugcccucauggggcugacaguccuaaaauc

SEQ ID NO: 234217 - RNA, 64 nt, Human
ucuaagggauuugaucugcucaucuucaguugaaugcccucacuccaagacuggaugcuggauc

SEQ ID NO: 234218 - RNA, 64 nt, Human
uacccuuuacauguuugguuucugaacuuaaaauugcccucauacuuaauaauauggucugcau

SEQ ID NO: 234219 - RNA, 64 nt, Human
ccuggcacaaccaaaaucccacugaugcccaucaugcccucagacccuucugggcucugcccgc

SEQ ID NO: 234220 - RNA, 64 nt, Human
ugaguaacugcucucugaguuuugcacacgaaguugcccucaucugcuggagaucgauaaggaa

SEQ ID NO: 234221 - RNA, 64 nt, Human
ggcgugggugggggccgaggcuggcacgccccucugcccucaccgucuuggugaccuggccucg

SEQ ID NO: 234222 - RNA, 64 nt, Human
cuuggcugggucuggaggugucuguggagcacccugcccucaccacaggagcgugagccacuuc

SEQ ID NO: 234223 - RNA, 63 nt, Human
aaauaaauaaauaaauaaaaauaaagcgagauguugcccucaaacuucaccuggccccggucc

SEQ ID NO: 234224 - RNA, 60 nt, Human
cucuagucacuaaagaaggauuuuacucucccagcccagaaaggugauucuuucuuuacc

SEQ ID NO: 234225 - RNA, 60 nt, Human
cuuuguuuuggcugcucuccaucucuuguaccagcccaggcaauaguguugaggagggga

SEQ ID NO: 234226 - RNA, 60 nt, Human
gugggcgugcugcggguggguaucccaccuccagcccacagugcucaguuguacuuuuua

SEQ ID NO: 234227 - RNA, 64 nt, Human
guggaagguaucauccguguggguucuucccuccugcccucaauuguuuuucugggccuuguuu

SEQ ID NO: 234228 - RNA, 64 nt, Human
cuuucaaaggcuaccuuuaugaaguagacacuauugcccucagaaugagagaacauuaaacuac

SEQ ID NO: 234229 - RNA, 64 nt, Human
cucugccugcacagggacauuggacacuaggugcugcccucagggcauggggucuccucgccuu

SEQ ID NO: 234230 - RNA, 64 nt, Human
ggagccauauucaacuacagccuucuaaaaccugugcccucagccacuucgaaugccagccacc

SEQ ID NO: 234231 - RNA, 64 nt, Human
ugacccuccuuacccaccagaacagggguuuugaugcccucacuaguguugaagccuguuccag

SEQ ID NO: 234232 - RNA, 64 nt, Human
ucuguaaaacagauaugaaaaccuuuucagugcuugcccucagcagcuaagaagacagacagua

SEQ ID NO: 234233 - RNA, 64 nt, Human
cggaguccuccagugaucuccggagcuaguucccugcccucacacccugucugguacccgagaa

SEQ ID NO: 234234 - RNA, 64 nt, Human
accugcuccaagaaggaagcaguagcugagcaccugcccucacauucugcucuuuuccccucuc

SEQ ID NO: 234235 - RNA, 64 nt, Human
accuguggggucugaugugucccuugaugggugcugcccucagggacugcacccugacaagugu

SEQ ID NO: 234236 - RNA, 64 nt, Human
uucauggcacaggagccagggaccgugacaacggugcccucagcagccugguguccucuggcca

SEQ ID NO: 234237 - RNA, 64 nt, Human
ccccagauccuuaauguaguucucauccuccgcaugcccucagccacaagcgggugacugacug

SEQ ID NO: 234238 - RNA, 64 nt, Human
ggagcaccauccugcccuagcagagcccaggccuugcccucaugaagcaucauugaaauagcag

SEQ ID NO: 234239 - RNA, 64 nt, Human
gcuuucuuuaucaaccugcucacucacaaaugugugcccucagccagagaguaagaaagcccaa

SEQ ID NO: 234240 - RNA, 64 nt, Human
uaagcuuuugauuuuuguauuguuugcauccccuugcccucaauaaauaaaguucuuuuuuagu

SEQ ID NO: 234241 - RNA, 60 nt, Human
ggggaaaugcaccgcugcaugugaaccuuaccagcccaggcggaugccccuuccccuuag

SEQ ID NO: 234242 - RNA, 60 nt, Human
gauuugcaguuacggccuggaugccagucgccagcccagcuguuccccucgggaacauga

SEQ ID NO: 234243 - RNA, 60 nt, Human
cucacagaccacacacccagcccuccugggccagcccagagggcccuucagaccccagcu

SEQ ID NO: 234244 - RNA, 64 nt, Human
auauguguguacacgcgcacgccuguaugugcgcugcccucagacaugcaagugaaaggaggag

SEQ ID NO: 234245 - RNA, 64 nt, Human
gacugcauccgaaaggcccccacucaccauggucugcccucaccccacauauguguguacacgc

SEQ ID NO: 234246 - RNA, 64 nt, Human
gccuauguguggcagagugucccagccagaugugugcccucaccccauguccauuuacaugucc

SEQ ID NO: 234247 - RNA, 64 nt, Human
aggugcuuucccucuuugcucccccgcccugcccugcccucaccucccuuugagauguaaguuu

SEQ ID NO: 234248 - RNA, 64 nt, Human
ugguuccucuauccugacaaaguucacuggaaauugcccucagauuuuauaaacugggggauuu

SEQ ID NO: 234249 - RNA, 64 nt, Human
gaucauggugguuucccucaaguuuauguucucaugcccucaaucuguaaauuuuugucuccag

SEQ ID NO: 234250 - RNA, 64 nt, Human
aacacucucugagaugccccucugccugggcuuaugcccucagauggagacauuggauguggag

SEQ ID NO: 234251 - RNA, 64 nt, Human
cugaaggaggccacuccaucucaccucggggggcugcccucaaugugggagugaccccagccag

SEQ ID NO: 234252 - RNA, 64 nt, Human
acuaagguucugccucagccuccugaaacaucacugcccucagaggcugcucccuuccccugga

SEQ ID NO: 234253 - RNA, 64 nt, Human
ggccucucccagccuggcaugauaggggggucugugcccucagauguguugacagcugcucuuc

SEQ ID NO: 234254 - RNA, 64 nt, Human
aaaaauacaucuuguacccagcgcuaauuuugaaugcccucacuauugaugcauuuuuaauaag

SEQ ID NO: 234255 - RNA, 64 nt, Human
gccuuacacauagaagcauucaugccugcugcccugcccucaggcacagccagcugugagcucc

SEQ ID NO: 234256 - RNA, 64 nt, Human
ggccuuugauugcucaccccugcuccccaggcccugcccucacuuuuaccaaagguucucccuc

SEQ ID NO: 234257 - RNA, 64 nt, Human
cuugcugaaguuaguaguacuguacuaagagcucugcccucaugugaauuccugcccuggcgcc

SEQ ID NO: 234258 - RNA, 60 nt, Human
ugguuugagaacacauccaagccaguccccccagcccagcuuccccuccguuccuaacug

SEQ ID NO: 234259 - RNA, 60 nt, Human
cccugcuguccaguccccagccuggccccaccagcccaagccugggacugggccuggaac

SEQ ID NO: 234260 - RNA, 60 nt, Human
ggguccauaagcccaugacuaaaaacuaccccagcccaggcucucaccaucuccagucac

SEQ ID NO: 234261 - RNA, 64 nt, Human
ccagcuucaaucaguagaccugauuuucaaaaucugcccucagaugaaaauaaaauaaacgaaa

SEQ ID NO: 234262 - RNA, 64 nt, Human
uggugcagccagcccugaggaaacauggccugagugcccucacuggugggugggaauaaaaugg

SEQ ID NO: 234263 - RNA, 64 nt, Human
gagcaugcucugcguuguugguuucaccagcuucugcccucacaugcacagggauuuaacaaca

SEQ ID NO: 234264 - RNA, 64 nt, Human
agauuagagggaugugaaugggcaguuaguccagugcccucauuuaagaggccaagauccugau

SEQ ID NO: 234265 - RNA, 64 nt, Human
ugaccauuuuaccaagacuuuagaugcuuucuugugcccucaauuuucuuuuuaaaaauacuuc

SEQ ID NO: 234266 - RNA, 64 nt, Human
ucugcucaccucuggugacccuccaagaugccccugcccucaguuuccccucaugaucuggccu

SEQ ID NO: 234267 - RNA, 64 nt, Human
gagcccacuccuccucccucucguugccucagccugcccucacccucaggacuaggcagaggug

SEQ ID NO: 234268 - RNA, 64 nt, Human
aggaucccugaagagucuuggagaaaagguucugugcccucagguggggcuuacccccucguau

SEQ ID NO: 234269 - RNA, 64 nt, Human
ggcggcuggcuguccuggagcugcugcuggagccugcccucagagugucccuuuccagugcugu

SEQ ID NO: 234270 - RNA, 64 nt, Human
gcguugggaaacccaggcccgccggccacgacucugcccucagcuucacagucaccgaagaaau

SEQ ID NO: 234271 - RNA, 60 nt, Human
aggaacccccccaagccugagccauggcccugcccucaccccacugccaggccgaggcuc

SEQ ID NO: 234272 - RNA, 64 nt, Human
ccccccgagccgccgacuugccgucuccccguaaugcccucaugugaauguucuucgggaaaua

SEQ ID NO: 234273 - RNA, 64 nt, Human
cuaguuccuagguccagcaagucacaccugccagugcccucauccuuaugccuguaacacacau

SEQ ID NO: 234274 - RNA, 64 nt, Human
acucucuggccuaaaaccuuccuuggcucccugcugcccucaggauaaagucuggaccccucag

SEQ ID NO: 234275 - RNA, 56 nt, Human
ccccagugcagacugucuaaaugcccccagcccaccccugcccccauuugcagccu

SEQ ID NO: 234276 - RNA, 60 nt, Human
gcccaccucuuuuuccauucccagucgcucccagcccaccucugccuccaagccccagau

SEQ ID NO: 234277 - RNA, 60 nt, Human
cugccccacagggaauggccuuggccuggcccagcccaagaucccagcguuaucuaacuc

SEQ ID NO: 234278 - RNA, 64 nt, Human
ucccugccuggcccuccucuggucacuucaaacaugcccucaggcuuggggaugcccuucuucc

SEQ ID NO: 234279 - RNA, 64 nt, Human
ugcccccacugguucauuuaacccucugucucggugcccucagaaccucagccagaaaggcaag

SEQ ID NO: 234280 - RNA, 64 nt, Human
aaaguggacaaaaagaaauuucucauauauccccugcccucacacaugcauagccucccaccac

SEQ ID NO: 234281 - RNA, 64 nt, Human
ugccccgcccccgcgucugcaccucugugguuccugcccucagcccugguuccucccucucugg

SEQ ID NO: 234282 - RNA, 64 nt, Human
cauggccagcacugccgacuugaugggagcaguuugcccucauucuccuguuucagguuugcuu

SEQ ID NO: 234283 - RNA, 64 nt, Human
ugcuuucuuccuacuagugacaaucaucuggucuugcccucaagcaacaauugcuagaguaaca

SEQ ID NO: 234284 - RNA, 64 nt, Human
guucuacaguaauuaauaugcagcuaacuccuguugcccucacaagagcaucagccuucuagaa

SEQ ID NO: 234285 - RNA, 64 nt, Human
aaaugcaagcagauagcauaaccugacuguuaugugcccucaggcagcaugcuuagggacaacu

SEQ ID NO: 234286 - RNA, 64 nt, Human
caguagaaccuuuccagguucucuuagagccauaugcccucaucaucccaggggagaacuacau

SEQ ID NO: 234287 - RNA, 64 nt, Human
ugguguuacacauugaggcugucuuuaaggggccugcccucaucaucaacgucucagcccuuca

SEQ ID NO: 234288 - RNA, 64 nt, Human
auggcucucuugaucuccucaaucuggaguccccugcccucaaaacacagugauguucagaaca

SEQ ID NO: 234289 - RNA, 64 nt, Human
cagaggugaagaaaaauccaagucugaacgggaaugcccucauucaaaaaaaagaacuuugaaa

SEQ ID NO: 234290 - RNA, 64 nt, Human
cuguagcucuuggccuguguagagcccccuccugugcccucaguggcugucguuuguuaacauc

SEQ ID NO: 234291 - RNA, 64 nt, Human
ccucggagggcagacacagggaggaaggacccagugcccucaggcguccaucugaugcauggga

SEQ ID NO: 234292 - RNA, 60 nt, Human
gagcagaaugaaguggggaggacccagcuuccagcccaggaagcccacuguaccuggagc

SEQ ID NO: 234293 - RNA, 60 nt, Human
ugcaucccgauaccucagcccuggcccugcccagcccauuugggcucugguuuucuggug

SEQ ID NO: 234294 - RNA, 60 nt, Human
caagugccugauccugcccugggcucagagccagcccagagggaagcaacugcacagccc

SEQ ID NO: 234295 - RNA, 64 nt, Human
ggaggggcugagggccugucccagacaauaaaggugcccucagcggaugugggccaugucacca

SEQ ID NO: 234296 - RNA, 64 nt, Human
uaauucguaaaggguauaagcauaggacagauuuugcccucaaucacaauauuuguauucacuu

SEQ ID NO: 234297 - RNA, 64 nt, Human
accagagggacuggaggccagcgguguccacccuugcccucagcaagagagaaugcauucuuaa

SEQ ID NO: 234298 - RNA, 64 nt, Human
cccucacauccccuggagcacagccuuccugaaaugcccucaccccaugccuuugccauugugu

SEQ ID NO: 234299 - RNA, 64 nt, Human
uucaucauguuggccaggauggucucuuaacuccugcccucaagugauccaccagagaggagau

SEQ ID NO: 234300 - RNA, 64 nt, Human
uucaguugugaccugugggauuuuaaaauuuuccugcccucauaauuuaagcaaaauccacgau

SEQ ID NO: 234301 - RNA, 64 nt, Human
uuuucaagaucuagcauguggauuuuaaaagauuugcccucauuaacaagaauaacauuuaaag

SEQ ID NO: 234302 - RNA, 64 nt, Human
ucaaggcagggaaggggccaugacuuuucugcccugcccucagccuguugccccugccucccaa

SEQ ID NO: 234303 - RNA, 64 nt, Human
cacuuaccuuccccugagucaggcuuacuaaugcugcccucacugccucuuugcaguaggggag

SEQ ID NO: 234304 - RNA, 64 nt, Human
cuuaacucuguagccuggcagucugacccaaaguugcccucacccaaagguucuggcucuuccc

SEQ ID NO: 234305 - RNA, 64 nt, Human
uuaugcugugggugucagcuagcucuuuaauaggugcccucagggcaccacagggcugacugca

SEQ ID NO: 234306 - RNA, 64 nt, Human
gagggugaguguggcacccagagacugcucuuccugcccucacccugccccacuccuacgacug

SEQ ID NO: 234307 - RNA, 64 nt, Human
uguggguguagccagguauggcucugcaccccucugcccucauuacugggccuuagugggccag

SEQ ID NO: 234308 - RNA, 64 nt, Human
aggaaauguuguguucagaaaugaauaaauggaaugcccucauacaagggggaggguggggugg

SEQ ID NO: 234309 - RNA, 60 nt, Human
aaugaaaacuugagacucccaaguucugggccagcccauugcucugggcuguuuuaaagc

SEQ ID NO: 234310 - RNA, 60 nt, Human
caaggagcagaguguguucaccuugagucuccagcccacagccaagguggacguaccucu

SEQ ID NO: 234311 - RNA, 60 nt, Human
ugcagugagccgagaucauaccauugcacuccagcccaggcaacaagagugaaacccugu

SEQ ID NO: 234312 - RNA, 64 nt, Human
aagaaaacccugaaauaaucgaacaggaaaaaguugcccucaagccugaccuggaaccguuccu

SEQ ID NO: 234313 - RNA, 60 nt, Human
gugucuuaucagggaaaaggugcccagcugccagcccagcuccgcugcuaucuuugccuc

SEQ ID NO: 234314 - RNA, 60 nt, Human
uuguccccguggucucuuacuuuccuuuccccagcccaggguggacuuagaaagcagggg

SEQ ID NO: 234315 - RNA, 60 nt, Human
ccacacagacuaacguaggcacuauaaggaccagcccaaccccaugggcgggggggccca

SEQ ID NO: 234316 - RNA, 60 nt, Human
cagucuaacccaagacccacccgccucagcccagcccaggcagcgggguggugguugugg

SEQ ID NO: 234317 - RNA, 60 nt, Human
gggaggccaggacacugaggagcucugaacccagcccacagggaagcagaggaaggugag

SEQ ID NO: 234318 - RNA, 60 nt, Human
uggacaguagguaaccacuguuuucaaggaccagcccaauuucucuggcuugguucggag

SEQ ID NO: 234319 - RNA, 60 nt, Human
accugagcccucccgugacagccggcaggcccagcccauccccucccucauccucgucug

SEQ ID NO: 234320 - RNA, 60 nt, Human
uguuaauaacaauggaauuggagcauuuaaccagcccaguaugacuuccaaaagaagaga

SEQ ID NO: 234321 - RNA, 60 nt, Human
uaaguagagguggcuucagaaauggaacccccagcccagcagacaucaagcucaaggcaa

SEQ ID NO: 234322 - RNA, 60 nt, Human
cuuugacacaucugcccagucccucuccucccagcccaugguaaccagcauuugacucuu

SEQ ID NO: 234323 - RNA, 60 nt, Human
gccccugcacacucccacccaggacagcccccagcccaacuaggaaagggccaugggcag

SEQ ID NO: 234324 - RNA, 60 nt, Human
ccggccugggccaaugauggagggcggccgccagcccagggccugcccauccagaaggga

SEQ ID NO: 234325 - RNA, 60 nt, Human
cugucugaggacuccaucugcuccgggaagccagcccagggcagccagcucaaccacuuc

SEQ ID NO: 234326 - RNA, 60 nt, Human
guagaugccccucucugggguuccccuccuccagcccagcggcccucuuuccugucugug

SEQ ID NO: 234327 - RNA, 60 nt, Human
uugccacuucccucuucuuuguccagagagccagcccacagccaaugcuuauugaucugu

SEQ ID NO: 234328 - RNA, 60 nt, Human
ccauucaucaccucugccuuccuccuauccccagcccaauaaauuaaaacaauuaacuga

SEQ ID NO: 234329 - RNA, 60 nt, Human
cugcaaccucugccuccugggcucaagagaccagcccaccuccgccuccaaguagcuggg

SEQ ID NO: 234330 - RNA, 60 nt, Human
ccucauuccauagagcauuagaagcugccaccagcccaggacccuccagaggcagccugg

SEQ ID NO: 234331 - RNA, 60 nt, Human
gagggacagugccuggagccugggccaggcccagcccaucuguguguguguaugugcgug

SEQ ID NO: 234332 - RNA, 64 nt, Human
ccuuccgguggagcugccucguuccuuugaacuaugcccucacccuucugcccucacuugauuu

SEQ ID NO: 234333 - RNA, 64 nt, Human
ugccucguuccuuugaacuaugcccucacccuucugcccucacuugauuugaaagggucguuaa

SEQ ID NO: 234334 - RNA, 64 nt, Human
ggcagggaugccaccccugcuccuucggaggacgugcccucaccccucacugguccacuggcuu

SEQ ID NO: 234335 - RNA, 64 nt, Human
aguuggugcucaauaaauaugguuugaagugaauugcccucacaugcuucuggcaaaucucugu

SEQ ID NO: 234336 - RNA, 64 nt, Human
agccaacuggcucaggcuugggaaggcuggcugcugcccucagcuccgccucaucagcuaugug

SEQ ID NO: 234337 - RNA, 64 nt, Human
cugacugcccuggaggccgcagccaacccggcacugcccucagacuucaagaccauccuggacu

SEQ ID NO: 234338 - RNA, 64 nt, Human
gcgcaaggcagccgccgccgugccgcuccucccuugcccucaggccaggucccugcuggaagcg

SEQ ID NO: 234339 - RNA, 64 nt, Human
aggaaaaacuaaaaaguguaucuuguauuuucccugcccucagguugccuauguauuuuaccuu

SEQ ID NO: 234340 - RNA, 64 nt, Human
ccaugcaaaguagggucauagagaaauaaaagcaugcccucagcuuuuaaugaacuuaaaugua

SEQ ID NO: 234341 - RNA, 64 nt, Human
uuuacaagucagagucacuuguaguccauuuaaaugcccucauccguauucuuuguguugauaa

SEQ ID NO: 234342 - RNA, 64 nt, Human
gaugcuaauuauaaggcauuaaguaagcaaauagugcccucagcuacugcagaagaaaaguccc

SEQ ID NO: 234343 - RNA, 64 nt, Human
uuucuugugcaucuguccaccuguuccccaguauugcccucaauuccugagagcccuggagcgg

SEQ ID NO: 234344 - RNA, 64 nt, Human
guauuucagugagcugcccccaaaucaaguuuagugcccucauccauuuaugucucagaccacu

SEQ ID NO: 234345 - RNA, 64 nt, Human
accgccucuggccgccacccccaucuuccaccugugcccucaccaccacacuacacagcacacc

SEQ ID NO: 234346 - RNA, 60 nt, Human
gccacuucuuuucauaagcacugacagggcccagcccacagccacaggugcgaucagugc

SEQ ID NO: 234347 - RNA, 60 nt, Human
ccaugaucugguacaggcaugcucaccagcccagcccagcccagcuguccuguccuccuu

SEQ ID NO: 234348 - RNA, 60 nt, Human
uuuuguagagacgggguuucgccaaguugaccagcccaguuucaaacuccugaccucagg

SEQ ID NO: 234349 - RNA, 64 nt, Human
gggaaggugggguccuggagcagaccaccccgccugcccucauggccccucugaccugcacugg

SEQ ID NO: 234350 - RNA, 64 nt, Human
uggaaugagcagcccugcaggggcgcugggcaugugcccucacuguggacagggcccacccacc

SEQ ID NO: 234351 - RNA, 53 nt, Human
uuaagccauuaacacauuagugcugcccucaggcuugccuguaggauuuaaua

SEQ ID NO: 234352 - RNA, 64 nt, Human
uuugagaggcauugagguaggagacucuaugacaugcccucagaauaucagaaucuucuuagaa

SEQ ID NO: 234353 - RNA, 64 nt, Human
uuuguacuacucugagauggauccauucagcucaugcccucaauguuuauauuguguuaucugu

SEQ ID NO: 234354 - RNA, 64 nt, Human
acugacuguagaauuaaaaaacaaagcuacaauuugcccucauacacacugcuuccacagcuug

SEQ ID NO: 234355 - RNA, 64 nt, Human
gaacagagcaagaguguugaacugaagaccaaaaugcccucaagguguaaaauaauccgagggg

SEQ ID NO: 234356 - RNA, 64 nt, Human
cacagaauaacuuuccucuacuuauucuguacuuugcccucaugaguuccaauguugugugaag

SEQ ID NO: 234357 - RNA, 64 nt, Human
cacaguucuggaggcuggaaguccaaggucggggugcccucauggucaggugcuggugaggacc

SEQ ID NO: 234358 - RNA, 64 nt, Human
aagugcaaagaugagggcagauucuuuaccugucugcccucaugauuugccagcaugaauucau

SEQ ID NO: 234359 - RNA, 64 nt, Human
ucauccuggggaagagaaggagcuugggugcauuugcccucauccugagaaggccagaauacug

SEQ ID NO: 234360 - RNA, 64 nt, Human
caguguauuuaaauggccuucuggacuuguuaauugcccucagccagcacuuuaggacaucugg

SEQ ID NO: 234361 - RNA, 64 nt, Human
ugaaagcuaggcguccucucccacaaaaaaguccugcccucaucugagaauacugucuuuccau

SEQ ID NO: 234362 - RNA, 64 nt, Human
ugccacuggucucaaagcugggcagcccauugcaugcccucaacucuugcuuggcagggguacc

SEQ ID NO: 234363 - RNA, 60 nt, Human
ccuccugggccuccagguaaagagagagagccagcccagcccuguuuccccucaguccuc

SEQ ID NO: 234364 - RNA, 60 nt, Human
gccuuaacacagcucuauaccuagaagcagccagcccaggcaugcagucacauuuaauca

SEQ ID NO: 234365 - RNA, 60 nt, Human
ggagugcaggcagagggguccauggcuuccccagcccagggaggguaucaguaucauuca

SEQ ID NO: 234366 - RNA, 64 nt, Human
uugagucugcccuaacugcuccauugaguucucgugcccucaucagcugagggcagggaaugga

SEQ ID NO: 234367 - RNA, 64 nt, Human
cacaguuuugaaauuuuaauuugaguagauuuacugcccucagcucacauaccuuaaaagcagu

SEQ ID NO: 234368 - RNA, 64 nt, Human
ugcaccugccagcguggccgagucacacagugccugcccucaccuguggaauuuggugucagcu

SEQ ID NO: 234369 - RNA, 64 nt, Human
uguuuccauguugucauccucccauggcuuccccugcccucacuccccucuggcuggggaagug

SEQ ID NO: 234370 - RNA, 64 nt, Human
auuuaaccucaguccaaagaacagucucuauacuugcccucauuuacugauaggcugcuacuag

SEQ ID NO: 234371 - RNA, 64 nt, Human
guuucugaaaugauaaaauguagcccuagcccccugcccucaauuguaaagugagcaaccauug

SEQ ID NO: 234372 - RNA, 64 nt, Human
gcccgacugccagagggaggauggacagaccucuugcccucacacucugguaccaggacuguuc

SEQ ID NO: 234373 - RNA, 64 nt, Human
gcucacagcucuuguucuccagaaacuggagaauugcccucaggagaugagagccaucucaccu

SEQ ID NO: 234374 - RNA, 64 nt, Human
guuuuguuuuuaaaugaagguuaaaugugaccugugcccucacauuuaauuccguuucauggag

SEQ ID NO: 234375 - RNA, 64 nt, Human
augcuuugcuuggggccuacaggugaaagguggcugcccucagauuccacaaagccucucuccc

SEQ ID NO: 234376 - RNA, 64 nt, Human
agaagcucacccaauaaacauuaagauugaggccugcccucagggaucuugcauucccaguggu

SEQ ID NO: 234377 - RNA, 64 nt, Human
cucccgaaacccaaguuaugcauccccauccccaugcccucaucccgaccucuuagaaaauaaa

SEQ ID NO: 234378 - RNA, 64 nt, Human
uaauacgaagcugacuagcuuacgugaaugauguugcccucauuuguuuugggugaggacucau

SEQ ID NO: 234379 - RNA, 64 nt, Human
agcaacacgcaggggucccggaccucuccagccuugcccucacgcuuacccgagcucccagugu

SEQ ID NO: 234380 - RNA, 60 nt, Human
ugggucucagaggagcugggggagcgguggccagcccauuuucuggggugaggcuugacu

SEQ ID NO: 234381 - RNA, 60 nt, Human
ccaguacuucaugccuuggauguggucccaccagcccaguggccggggucagcuuaggcu

SEQ ID NO: 234382 - RNA, 60 nt, Human
acugaccagcucccguugggccaggccagcccagcccagagcacaggcuccagcaauaug

SEQ ID NO: 234383 - RNA, 64 nt, Human
uggagucucacugucugcuggcaaagauagagaaugcccucagcucuuagcuggucuaagaaug

SEQ ID NO: 234384 - RNA, 64 nt, Human
ugauguuuccucuugccuucucuggugccuccauugcccucauggaacagagcauaucauagag

SEQ ID NO: 234385 - RNA, 64 nt, Human
cggugucaaagugugggcaggaguggagagcuggugcccucaggaggagaccacagcaugucca

SEQ ID NO: 234386 - RNA, 64 nt, Human
caggguugugggcaaaagaggcugguuauaauaaugcccucauauugaguggucuguaaacggc

SEQ ID NO: 234387 - RNA, 64 nt, Human
aggccgcagguguuguguucugaucacuggucugugcccucacagcaccgcacaucgacacacu

SEQ ID NO: 234388 - RNA, 64 nt, Human
cugacagcccuuuguggccgccguccccauccccugcccucagcacacacaucugcacacacgc

SEQ ID NO: 234389 - RNA, 64 nt, Human
gcgcugugggcccugaaggaagaccugggcccagugcccucaauaaagagaggcccagaggugg

SEQ ID NO: 234390 - RNA, 64 nt, Human
aguuaaacuccagacccugccaaaacaugagcccugcccucaauuacaguaacguagggucagc

SEQ ID NO: 234391 - RNA, 64 nt, Human
gcccagaugcuucaggggcccggcuuuucaggcuugcccucaccagcggccgucagccgacacu

SEQ ID NO: 234392 - RNA, 64 nt, Human
uauguugcacucucucucuucccaaccauaacucugcccucagcuauuaacugugcuguguauu

SEQ ID NO: 234393 - RNA, 64 nt, Human
aagagaauggaaaacuuauacagcuucauucuguugcccucaaaugggcauagcccuauguacu

SEQ ID NO: 234394 - RNA, 64 nt, Human
ucuccuuccugcuguccuucuccggccccgccucugcccucauccucccucucgucuuucgcac

SEQ ID NO: 234395 - RNA, 64 nt, Human
acaaacacaugcuucgcuguuagugucuucuuccugcccucagcaccacagcucaagaaaaccu

SEQ ID NO: 234396 - RNA, 64 nt, Human
auacaacaucuuuugcaccccuagaaugucauuuugcccucaaccuugguauuucuccuggggc

SEQ ID NO: 234397 - RNA, 60 nt, Human
accuuccaucuguguccagcggccccggcuccagcccagccagcacucugcagggucaca

SEQ ID NO: 234398 - RNA, 60 nt, Human
agcccuggcccuugaagggguuggcugugcccagcccaccuggcugcagugggcagcuca

SEQ ID NO: 234399 - RNA, 60 nt, Human
gucuacucauuguugcaugagcccugucugccagcccaccccagggacugggggcagcac

SEQ ID NO: 234400 - RNA, 64 nt, Human
gacggauccacuuugguguucaaggaccugcuuaugcccucagugccaaucggcucuuggugag

SEQ ID NO: 234401 - RNA, 64 nt, Human
aaggaggaguggcauuggcauccugacccagcucugcccucaagguggggauggaugggcaaag

SEQ ID NO: 234402 - RNA, 64 nt, Human
guuggggcuggucccagccugaggcuccagcugaugcccucagcucccagagagggggugcccc

SEQ ID NO: 234403 - RNA, 64 nt, Human
cccagccccugccucugccccaaguggggccagcugcccucacuucugggguggaugaugugac

SEQ ID NO: 234404 - RNA, 64 nt, Human
aagacggagaucacaguagggugaguuaaguaugugcccucaggugugaaggagcacaggugag

SEQ ID NO: 234405 - RNA, 64 nt, Human
ugugccucccugcuugaccuaugcuccaggacccugcccucaacccuugucagcucccuaaguc

SEQ ID NO: 234406 - RNA, 64 nt, Human
ugugaggauguuuucaguggacucagugaagaucugcccucagcgugggcaggcacauccacuu

SEQ ID NO: 234407 - RNA, 64 nt, Human
uccccccaacaacugagucugaacgaaugccacgugcccucacccagcccggcccccacccugu

SEQ ID NO: 234408 - RNA, 64 nt, Human
caguugagcaguuauaaaccuacaaaaugggcccugcccucagagagguuccagucuagaugag

SEQ ID NO: 234409 - RNA, 64 nt, Human
cuacuucccugaaauccugcagucccucacuggcugcccucacaagccaccugaggaguggcau

SEQ ID NO: 234410 - RNA, 64 nt, Human
agguacaugaugaugcgggacugcuggcaugcagugcccucacagagacccaccuucaagcagc

SEQ ID NO: 234411 - RNA, 64 nt, Human
augggcaauuuuaugcauuuauauucaucagugcugcccucacuuuggaucuauuguauucuua

SEQ ID NO: 234412 - RNA, 64 nt, Human
aucccaaggaaauuuucacacaaagcuuggccuuugcccucaauauagguguuuuaggauggug

SEQ ID NO: 234413 - RNA, 64 nt, Human
ucucuuaaacuccugugacaucuucaaugauaugugcccucaguugcagcauagcuucucugcu

SEQ ID NO: 234414 - RNA, 60 nt, Human
ccuacuuucuucuuuguaucucccuccuucccagcccacccgggcagcagacucugaugg

SEQ ID NO: 234415 - RNA, 60 nt, Human
gugguguccccggggccaggcgcgcucugcccagcccagccuacagugcggauaaaggug

SEQ ID NO: 234416 - RNA, 60 nt, Human
caccucuguucuccuugaacagcuuccccuccagcccacugcuuuaggaugacacaauga

SEQ ID NO: 234417 - RNA, 64 nt, Human
ccgcccaacagccucuggaggugaggcgggagcaugcccucagcgaggcugggcggcggguccu

SEQ ID NO: 234418 - RNA, 64 nt, Human
cacuccacuccuggcucagucuuagagauuucuaugcccucauggauucuaccccugccuuccu

SEQ ID NO: 234419 - RNA, 64 nt, Human
cccuguguucuuugaacaucauuugugcagauucugcccucaaugaggaccaaauaaagaugau

SEQ ID NO: 234420 - RNA, 64 nt, Human
ccuggucaccugguuggagggcauggauugaagcugcccucaaguccaggccuugaggcccacc

SEQ ID NO: 234421 - RNA, 64 nt, Human
gagaagcaccugugcuguggaguggcauuuuagaugcccucacgaauaugaagcuuagcacagc

SEQ ID NO: 234422 - RNA, 64 nt, Human
cugccuaugcugagaacaagucagaucugaucccugcccucauggaccugaccacucaacaaac

SEQ ID NO: 234423 - RNA, 64 nt, Human
gauggagccccaccuugucugcuaaauaaacaugugcccucaggccucugagucuacacuguuu

SEQ ID NO: 234424 - RNA, 64 nt, Human
acuguggggacccagaucugugucuugaagcagcugcccucauuccgacuucagaaaaucgaag

SEQ ID NO: 234425 - RNA, 64 nt, Human
augaacacccagcaaccugagcaagucccggcccugcccucagcgagcccggcaggcguccugg

SEQ ID NO: 234426 - RNA, 64 nt, Human
gucugauggagcugcguuuccugugcauggacucugcccucagggugccuguccaggaagagcu

SEQ ID NO: 234427 - RNA, 64 nt, Human
cuuccugcgcuagcugggcgggggaggggcggccugcccucaucucauuucuauuaaacgccuu

SEQ ID NO: 234428 - RNA, 64 nt, Human
acaacugacucacacuuccccagacaggaccaguugcccucauuuccaaagaacugcacucugg

SEQ ID NO: 234429 - RNA, 64 nt, Human
acgcucugucuccaaagaugaaaaaggacuucucugcccucaagggaaccccacaguaucuuag

SEQ ID NO: 234430 - RNA, 64 nt, Human
gugaaaaccaaaguaaaugcugcuuuuagaacugugcccucaugcccucuuccugcucacaugc

SEQ ID NO: 234431 - RNA, 60 nt, Human
gacuuggaggugccagaggccccccaccaaccagcccagccacuguugcuggcugugucg

SEQ ID NO: 234432 - RNA, 60 nt, Human
uggagaauuuuuaaaacaaaaucucucauuccagcccaaccuauuuaacuuuuuguggag

SEQ ID NO: 234433 - RNA, 60 nt, Human
aaaaugggucaguagcccuuccuguucucuccagcccagcauacaggaggaucaaaggag

SEQ ID NO: 234434 - RNA, 64 nt, Human
cugcaggaagguuggagcaagcaaaguccuucucugcccucagggucagcugcccagacugggg

SEQ ID NO: 234435 - RNA, 64 nt, Human
uccacugccccuucugccaaacacauccagaaccugcccucagcccuggaagcuagcaucuucu

SEQ ID NO: 234436 - RNA, 64 nt, Human
uugcaccucauacuaaacauugacccuuucacuaugcccucaaccugggagcaucuggcaggca

SEQ ID NO: 234437 - RNA, 64 nt, Human
uucucaggaacaaaaccugaggcagcccuuuggaugcccucacagccuugcuucucucagccua

SEQ ID NO: 234438 - RNA, 64 nt, Human
cucaggcagggacagacccagaaagaacacagucugcccucagagagcucuuugcaguguagug

SEQ ID NO: 234439 - RNA, 64 nt, Human
gguggcaucuggcugugcaaggaagacccggcuuugcccucacaagucuuaugggcaccacagg

SEQ ID NO: 234440 - RNA, 64 nt, Human
agaguaaaguguugaucgcaagaguccagugucgugcccucagccaguucuuggccaccacaau

SEQ ID NO: 234441 - RNA, 64 nt, Human
ugcucaccaagcuguuccacuucucuagagaacaugcccucagcuaagcccccuacugagaaac

SEQ ID NO: 234442 - RNA, 64 nt, Human
ccccuguccucuuccuucauaugagauucuugucugcccucauaucacgcugccccacaggaau

SEQ ID NO: 234443 - RNA, 64 nt, Human
accccucugcaugcagcacagaagggugugaccaugcccucagcaccacucuuguccccacuga

SEQ ID NO: 234444 - RNA, 64 nt, Human
accuacccaacacacuuuuccaccugggagccugugcccucagaccgccccgcaccagagccac

SEQ ID NO: 234445 - RNA, 64 nt, Human
uuauauguuaugcauugauucuaacaaacuguaaugcccucaacagaacuaauuuuacuaauac

SEQ ID NO: 234446 - RNA, 64 nt, Human
ugucagcauaagcgauggauaauaccuaauaaacugcccucaguaaauccaugguuaauaaaug

SEQ ID NO: 234447 - RNA, 64 nt, Human
acaucuuuucuaaucacaguguugcauaugagccugcccucacucccucugcagaaucccuuug

SEQ ID NO: 234448 - RNA, 60 nt, Human
cucccaccaggucccaggcuguggaaagccccagcccagggauggucagaacucaggggc

SEQ ID NO: 234449 - RNA, 60 nt, Human
caggccagcugggcgccuuccucccaccugccagcccaggguaccccagacuccaguuuc

SEQ ID NO: 234450 - RNA, 60 nt, Human
acccaccagggugcagcugggcuccaggguccagcccacaagcugcaucaggcucucugg

SEQ ID NO: 234451 - RNA, 64 nt, Human
ugaauuuuaagcaauuacuaguuuuaauuagcucugcccucaugaaguauuauuauaauucacc

SEQ ID NO: 234452 - RNA, 64 nt, Human
gacagauaagagaauaccuuggucucaccuauccugcccucacaucuuccaccagcaccuuacu

SEQ ID NO: 234453 - RNA, 64 nt, Human
ucaagaaguaccuuuaagguagaccuuuucagggugcccucaggaaagggcccugcucauguuu

SEQ ID NO: 234454 - RNA, 64 nt, Human
ugagaggcagggaggucgagucagccauguguaaugcccucagugcaggcagacgcaccauuga

SEQ ID NO: 234455 - RNA, 64 nt, Human
ugggcugcggugagucccacuccaccugggcgccugcccucaggagccugggcugcgaggcucc

SEQ ID NO: 234456 - RNA, 64 nt, Human
agaaaguauucauacagaaauuaccuagcaguugugcccucagaguagaacuuugaaacaggac

SEQ ID NO: 234457 - RNA, 64 nt, Human
ucuacuuucugccuguugcucgauacauccgagcugcccucaguguuccccaaggugcacuucu

SEQ ID NO: 234458 - RNA, 64 nt, Human
acagugccagcucccugcgcccggccgaccugcuugcccucauccuccugguucaggaccucua

SEQ ID NO: 234459 - RNA, 64 nt, Human
accacaaauccaaaccuuagccugcugcugcugcugcccucagaggaagaugaggaaggaaaaa

SEQ ID NO: 234460 - RNA, 64 nt, Human
gucagguaggguucagggacugauuggucccauuugcccucaggucaguuguuuaaucucaaga

SEQ ID NO: 234461 - RNA, 64 nt, Human
caucuauuacaccagcugcugaggauuuacuuggugcccucaucaagaaguuugaauuucuccc

SEQ ID NO: 234462 - RNA, 64 nt, Human
agguauaugucgugggacuggggugugggugaccugcccucaaaccuugccugccaccucccca

SEQ ID NO: 234463 - RNA, 64 nt, Human
ccgggggcuuugugaaggagucugggccaagguuugcccucagcuuugcagaaugaagccuuga

SEQ ID NO: 234464 - RNA, 64 nt, Human
auggacgcacugagaacgccugccagcuuccccaugcccucacuugguuuguguuuuagguuaa

SEQ ID NO: 234465 - RNA, 60 nt, Human
ucaggucaacucaggcagacuggcuaaggaccagcccagggcaauuuugcagaaaugauc

SEQ ID NO: 234466 - RNA, 60 nt, Human
caccccuugucaagcauugccugugauugcccagcccagauucaucugugccuuggacau

SEQ ID NO: 234467 - RNA, 60 nt, Human
ggucucccucucugggcaccaggacucaguccagcccaagacuacucugggcagcuccca

SEQ ID NO: 234468 - RNA, 64 nt, Human
gugugagucccaccaggagccacgugcccggccuugcccucaagguuuuuugcuuuucuccugu

SEQ ID NO: 234469 - RNA, 64 nt, Human
agcgucccuggcgcaggugggcuggacuucuaccugcccucaaggguguguauauuguauaggg

SEQ ID NO: 234470 - RNA, 64 nt, Human
uccuuuuucucuucacaucucccccauagcacccugcccucaugggaccugcccucccucagcc

SEQ ID NO: 234471 - RNA, 64 nt, Human
cccagccccagagggcuuuguggaggacaggccuugcccucaagaacgucguaccugacgcuga

SEQ ID NO: 234472 - RNA, 64 nt, Human
aucugcucuuagacacggccuugccaggagagccugcccucagacugcaggaccagaaccccug

SEQ ID NO: 234473 - RNA, 64 nt, Human
guuggaggggccaagccaaggacaggagcaagugugcccucauuuuguuucuacuuuuaauuuc

SEQ ID NO: 234474 - RNA, 64 nt, Human
cccccauaugucugagccaaacugcacugggggcugcccucaugccaagcaagagccuggaauu

SEQ ID NO: 234475 - RNA, 64 nt, Human
gcuccuuggcugaguucaguccucccagacuaccugcccucagcuuggauaaccaggcugggcu

SEQ ID NO: 234476 - RNA, 64 nt, Human
acauaaacuuuccagggccccagccugauggggcugcccucaguccucuagaucaagaugcuga

SEQ ID NO: 234477 - RNA, 64 nt, Human
ccucuacaccagcccaggaagccccaucugugccugcccucaggugguccaccagucucccccu

SEQ ID NO: 234478 - RNA, 64 nt, Human
cuuuaaaacacuggacagaauuucccacagucuuugcccucaaggaguucaccaguuuaugggg

SEQ ID NO: 234479 - RNA, 64 nt, Human
agacucacucuccaucucaggaaauucuagcccuugcccucagggagccacgguugagggugag

SEQ ID NO: 234480 - RNA, 64 nt, Human
auaaugaacacacccuuaguuucucauaagcauuugcccucaccaugguuuauaaaacuuuggg

SEQ ID NO: 234481 - RNA, 64 nt, Human
caauaaauuggauuuuuuauuuuuugagggcagcugcccucacuguuuuaaauaaagaaucuua

SEQ ID NO: 234482 - RNA, 60 nt, Human
ccaccagagaaggugcuugguguucgccugccagcccagagcccuggaggagccggcugc

SEQ ID NO: 234483 - RNA, 60 nt, Human
gggaggcagagccggcucagagcagguccaccagcccaccuauagcaggaagcgugucgg

SEQ ID NO: 234484 - RNA, 60 nt, Human
ccaugaaaugagaucccccagccguguccuccagcccagcccugaccccuugguuucuac

SEQ ID NO: 234485 - RNA, 64 nt, Human
cuccugccuuaugcucaccuguggacaccgaggaugcccucacauuggugcuuucuccucaucc

SEQ ID NO: 234486 - RNA, 64 nt, Human
gcccugguaggcguugggguuaguaucucucgggugcccucagagccaccucugccugugaucg

SEQ ID NO: 234487 - RNA, 64 nt, Human
ucacuuuggauaugaucuuucuuuucccaacauaugcccucagaaaagugacaguggucccaga

SEQ ID NO: 234488 - RNA, 64 nt, Human
agaaggugguggugggcacugugagaacguggccugcccucacuggccaguggccacaggaacc

SEQ ID NO: 234489 - RNA, 64 nt, Human
ucccccaucauaaagauauuuugaaaucccaaggugcccucauaccucuugacauuaaugacuu

SEQ ID NO: 234490 - RNA, 52 nt, Human
guacugaugcagggguauagcuugcccucacuugcucaaaaacaacuaccug

SEQ ID NO: 234491 - RNA, 64 nt, Human
cagagauuucuacggggauagaaaaucgggagucugcccucauuaaucugugauuccaccucuu

SEQ ID NO: 234492 - RNA, 64 nt, Human
agugacugggugugccaaaauaugcccaggguccugcccucagcacuagauuuaauggggccaa

SEQ ID NO: 234493 - RNA, 64 nt, Human
aggcccagggggccgagggcccagguccccaucaugcccucaccacuuuaugcacaacgcccgg

SEQ ID NO: 234494 - RNA, 64 nt, Human
ggaugcgguaucacaugaggccugucccuaacagugcccucaaagugaagguccucaaggagga

SEQ ID NO: 234495 - RNA, 64 nt, Human
aacaccaucuagcagccaccugccugcuccuaugugcccucaccauccaauaaaggccccuugg

SEQ ID NO: 234496 - RNA, 64 nt, Human
ugguuucuaacgaggucuuguugaaauaacgggcugcccucagcucacagaaauaccacagcuc

SEQ ID NO: 234497 - RNA, 64 nt, Human
aaaauacaaaaaauuagcugaguguagugacgcaugcccucaaucccagcuacucaagaggcug

SEQ ID NO: 234498 - RNA, 64 nt, Human
cuccauuccaaaggccaucuuguggucaguuucaugcccucaccugauuuuuuuuuuuuuuuuu

SEQ ID NO: 234499 - RNA, 60 nt, Human
gcuccugcuguugcugccgggcagugaggcccagcccagcgccccguccaccccgcggca

SEQ ID NO: 234500 - RNA, 60 nt, Human
uuuuguugagauggagucucgcucuguugcccagcccagaguacaguggcacuaucucag

SEQ ID NO: 234501 - RNA, 60 nt, Human
auguccagggccccaggcccgcgggcacagccagcccaaaccuugggcccuggaagaguc

SEQ ID NO: 234502 - RNA, 64 nt, Human
gggagaaacucacagcuccuccgggauacauaugugcccucagcagcagcucccaggugaaguu

SEQ ID NO: 234503 - RNA, 64 nt, Human
cuccucccacacaggaagcugccccacugggcagugcccucaggccaggauccccuuagcaggg

SEQ ID NO: 234504 - RNA, 64 nt, Human
aaggguccccuacucccuggacuagugcaguccuugcccucagccccagaccagagaugggugg

SEQ ID NO: 234505 - RNA, 64 nt, Human
ucccugccucacaggauugugacuccccagccccugcccucaaagcuucagaccccucagguag

SEQ ID NO: 234506 - RNA, 64 nt, Human
gccaaagcuuguggaggagggagagcccugucccugcccucaggcuccccagugcuccuggccc

SEQ ID NO: 234507 - RNA, 64 nt, Human
cacgcguguggggagaacaucucccuuccggggcugcccucaagagcuucugaaaaacuaauga

SEQ ID NO: 234508 - RNA, 64 nt, Human
agaaauggggugccgggaugugggguguggugugugcccucauagaugggggugggaguguggc

SEQ ID NO: 234509 - RNA, 64 nt, Human
aggccuggagagaggacacaaggagggugcguggugcccucaccccugcccagagcgagggggc

SEQ ID NO: 234510 - RNA, 64 nt, Human
agaaauuaaaagacagaacaaaacuguggaucauugcccucaacaugaagacugccauauucca

SEQ ID NO: 234511 - RNA, 64 nt, Human
uucgaaugcacacucaaauaaaaaaccaaacagcugcccucauuagcggauuccguuccauuau

SEQ ID NO: 234512 - RNA, 64 nt, Human
aacuucauuucucuuccaacccauuguguuccucugcccucauucuuuaccuuuguuguaagaa

SEQ ID NO: 234513 - RNA, 64 nt, Human
ucuugucagcuugggaaagacccaccuuuauuuuugcccucaccccaaguccccccuggcuggg

SEQ ID NO: 234514 - RNA, 64 nt, Human
ccccgccccacuuucccuucuucaaaggacaaagugcccucaaagggaauugaauuuuuuuuuu

SEQ ID NO: 234515 - RNA, 64 nt, Human
aagauggacauuuuaggaaucaccaauggcuccuugcccucaagcaauauaggccagacuuggu

SEQ ID NO: 234516 - RNA, 60 nt, Human
gccacagggacgccuucccuccccuccccuccagcccaccccugcacagccccuccuccu

SEQ ID NO: 234517 - RNA, 60 nt, Human
ugugguuaugcgauagggucucccuucccuccagcccaugccagaggagcuuguaacucu

SEQ ID NO: 234518 - RNA, 60 nt, Human
gcggggaggagaggguuugcuaaucugcucccagcccaaccuauuaccaccccaccucgc

SEQ ID NO: 234519 - RNA, 64 nt, Human
gcugccuccccugcccuuucucagcugccuccccugcccucagaaggaaaggagagggcucacu

SEQ ID NO: 234520 - RNA, 64 nt, Human
aggcagacccagggcuccucuagccucauacccgugcccucacagagccaugccccggcaccuc

SEQ ID NO: 234521 - RNA, 64 nt, Human
uuccucuuggcaugcagaaguccugaguaugggaugcccucagugaccuuuggcaguguccacc

SEQ ID NO: 234522 - RNA, 64 nt, Human
gucuguuaccaugucacugugguccuaugccgaaugcccucaggggacuugaaucuuuccaaua

SEQ ID NO: 234523 - RNA, 64 nt, Human
cacgugucagucauuuaugaccaacuguguagugugcccucauauaguauuugugagaagaagu

SEQ ID NO: 234524 - RNA, 64 nt, Human
uucuaauuagugggauugaaggaaaaguagucuuugcccucaugacugauugguuuaggaaaau

SEQ ID NO: 234525 - RNA, 64 nt, Human
caucccagcaggcugugcuuggaucaugcucgucugcccucaagcuggaaaacaaggggcuacc

SEQ ID NO: 234526 - RNA, 64 nt, Human
ugacuggggugggcccucaguggugaagcaccgcugcccucaggcuugaggggugcuuggggcc

SEQ ID NO: 234527 - RNA, 64 nt, Human
ccagucuccccugcccucccggguagagcugggaugcccucacuuuucuucucaucaauaccug

SEQ ID NO: 234528 - RNA, 64 nt, Human
gcucuccgagguagagcuggguauggaugcuuagugcccucacuucucucugucuauaccugcc

SEQ ID NO: 234529 - RNA, 64 nt, Human
gcugucccagguagagcuggguauggaugcuuagugcccucacuucuucucucucucucuauac

SEQ ID NO: 234530 - RNA, 64 nt, Human
cugcgcccugggcucgucuuugcagaguggucccugcccucaucucucucccccgaguaccgcc

SEQ ID NO: 234531 - RNA, 64 nt, Human
aacaauauagcccccuacccuuuucccaauccuuugcccucaaaucagugacccaagggagggg

SEQ ID NO: 234532 - RNA, 64 nt, Human
cauuuuguuucauuggugugcuguauauuuuccaugcccucacuccuuuaagaaaaaaaaaaag

SEQ ID NO: 234533 - RNA, 60 nt, Human
guuacauacuaauugcugcagcucuguggcccagcccacugcuucagcugugggccaucu

SEQ ID NO: 234534 - RNA, 60 nt, Human
uuuuuuuuuuuuuuuugagacagucuugcuccagcccaggcuggagugcaguggcaugau

SEQ ID NO: 234535 - RNA, 60 nt, Human
ccccaagcgccugcaccgcggugcaagagcccagcccaggggcgcuggacgugaccauca

SEQ ID NO: 234536 - RNA, 64 nt, Human
gcaggagccagugucuguugucgggacucgcaagugcccucaucacagccacccccaccacgag

SEQ ID NO: 234537 - RNA, 64 nt, Human
uaugagauuguggacauauaacaagaaacagaaaugcccucaugcuuauuuucauggugauugu

SEQ ID NO: 234538 - RNA, 64 nt, Human
ccuugaucagcccugcagcuguaguacagugcugugcccucaccuccacccuuccuguuguucc

SEQ ID NO: 234539 - RNA, 64 nt, Human
cucgcugccucccaggucagggucccggagccggugcccucacaggccaauagggaagccgagg

SEQ ID NO: 234540 - RNA, 64 nt, Human
uuugaaaaaagauucacgcuucugcauccaccucugcccucauucugucaauuguguguggacu

SEQ ID NO: 234541 - RNA, 64 nt, Human
gaaggggguggggagcugagcaggcugggcaauuugcccucaaacagaacagcuccccuuguag

SEQ ID NO: 234542 - RNA, 64 nt, Human
agaagaugcaauguugaacaaacagacaaagcccugcccucagaaggcuguccugcauuaggaa

SEQ ID NO: 234543 - RNA, 64 nt, Human
uuuaguauaacuuacauccuuucaaauaagucuuugcccucaugaagaaucccuagaggaagau

SEQ ID NO: 234544 - RNA, 64 nt, Human
aauugguggaauuccucuuuaacaagggcugcaaugcccucauacccaugcacaguacaauaau

SEQ ID NO: 234545 - RNA, 64 nt, Human
cagcguucggagagguccccgccagcccgguggcugcccucaggucccgucacaugucucaagg

SEQ ID NO: 234546 - RNA, 64 nt, Human
gcauuguaaucaucauagaaggagagcccaggccugcccucacgcucuccaucauaggcugaca

SEQ ID NO: 234547 - RNA, 64 nt, Human
uuuuaguuccaagcagggacccugguuuccauacugcccucagcuggaguuuggauccaaaggc

SEQ ID NO: 234548 - RNA, 64 nt, Human
ggcguguucuaagcagccucuuuguuccagaagcugcccucagccagaguuggauaagccaauc

SEQ ID NO: 234549 - RNA, 64 nt, Human
cucuacagcauuuucuuacacccccuccccagcgugcccucagccaagugcuuuggcccggugc

SEQ ID NO: 234550 - RNA, 60 nt, Human
aagauuauccagggaaugguacaacaaugaccagcccaaugcaggaaaacacuacuucca

SEQ ID NO: 234551 - RNA, 60 nt, Human
cuuccgacccucugggaaccucccagagguccagcccaucucggagcaucccggaggaaa

SEQ ID NO: 234552 - RNA, 60 nt, Human
ugaccagaggguucagagugggaggcggggccagcccaggccaggagcgccucaucuucc

SEQ ID NO: 234553 - RNA, 64 nt, Human
gucuccucggccauccuguggggccccgaggccuugcccucacuucagugccugggugcucagg

SEQ ID NO: 234554 - RNA, 64 nt, Human
aaguaauaaaccguggguggugauagugacccagugcccucacugcccagccccgccuguccuc

SEQ ID NO: 234555 - RNA, 64 nt, Human
cacagauggcccugggaaucaauuccucaggaauugcccucaagaacucugcuucuugcuuugc

SEQ ID NO: 234556 - RNA, 64 nt, Human
augucaaacacccaaggucggauucuggggccccugcccucaggaggcugucagacuguucccc

SEQ ID NO: 234557 - RNA, 64 nt, Human
gugggaccgaccugggaaauuuccacuagaguuuugcccucagcuccucccugccagcauccca

SEQ ID NO: 234558 - RNA, 64 nt, Human
uaaaacauggcaaaaaauaaaauaacuccuauacugcccucaaaauggaguuugcaauuaauau

SEQ ID NO: 234559 - RNA, 64 nt, Human
aaaauacugauauuuuuauuuguuaauaauacuuugcccucagaaagauucugauacccugccu

SEQ ID NO: 234560 - RNA, 64 nt, Human
agcccagccacggacgcuggcuccccaaagggugugcccucaccacccacuugauuuuuuucau

SEQ ID NO: 234561 - RNA, 64 nt, Human
ccagacccaacaggcccuucuguagccucccccuugcccucaaagggggagugggggccagcuu

SEQ ID NO: 234562 - RNA, 64 nt, Human
cuuggggcuucucaggauccuggauggcagagacugcccucagaaguuccuuguccaggguggg

SEQ ID NO: 234563 - RNA, 63 nt, Human
ccagugaccagaaucccugauguuaaugggcucugcccucauccccacagucuugggaucuca

SEQ ID NO: 234564 - RNA, 64 nt, Human
aauugguuaccagugugucaggcaaucuggacuuugcccucaaaagagcagugguuccuguuuc

SEQ ID NO: 234565 - RNA, 64 nt, Human
aauauaaauauauuuuauuugaaaggcugaguguugcccucaaacacuugcuaaaacugccuag

SEQ ID NO: 234566 - RNA, 64 nt, Human
uguaaacguucauccacucugccugcuuacacccugcccucaugcuaauguaauaaacucacca

SEQ ID NO: 234567 - RNA, 60 nt, Human
aauuuacguggauaggacuuuagacaccacccagcccaaacuuccaaauaaaauauggaa

SEQ ID NO: 234568 - RNA, 60 nt, Human
gccuggcacggcugugcuccuccccugcucccagcccagagcagccaucaggcuggaggu

SEQ ID NO: 234569 - RNA, 60 nt, Human
cuaagcugcccugaggguuuccuucggggaccagcccacagcacaccaagguggcccgga

SEQ ID NO: 234570 - RNA, 64 nt, Human
cacagugagcucuucauuagcucaauaugugguuugcccucaauugagcacuguuuauuacuuu

SEQ ID NO: 234571 - RNA, 64 nt, Human
ccccucacagcauggcccuuggcucuuccugcacugcccucacccucagccgucccaaggagug

SEQ ID NO: 234572 - RNA, 64 nt, Human
gguacucacgcaccccgcuuugcacaccacagagugcccucacccacuccauggaccucaagca

SEQ ID NO: 234573 - RNA, 64 nt, Human
cucgccuggccacaccguuggagugaacccucacugcccucaaggacaacagcagggugucacc

SEQ ID NO: 234574 - RNA, 64 nt, Human
ggaaugcaauaaaggcagcauugugugcccugcuugcccucaucuggugugguuggaggucugu

SEQ ID NO: 234575 - RNA, 64 nt, Human
gaucugccucccagaacugugacacacugggcucugcccucauuuucuguuuauugcugcugcu

SEQ ID NO: 234576 - RNA, 64 nt, Human
cacagugagcucuucuauagcucaauaugcgguuugcccucaagugugcacuguuuauuacuuu

SEQ ID NO: 234577 - RNA, 64 nt, Human
gugagagcuucgggacagaccuuggcucagggacugcccucaucugauguccucucucagcuuc

SEQ ID NO: 234578 - RNA, 64 nt, Human
gaucaacuaaguuuugugguacuucacccucuucugcccucauuucaugugacagccauuguga

SEQ ID NO: 234579 - RNA, 64 nt, Human
cccucguaccaccccuguuaccccaggauccaucugcccucauaaaaguguucagguacagcag

SEQ ID NO: 234580 - RNA, 64 nt, Human
guuguggggagauccacugggacccccaacauucugcccucaccucugugcccagccuggaaac

SEQ ID NO: 234581 - RNA, 64 nt, Human
gccugaagagaauggcacgcaccuuguaggcuccugcccucaccccaccgcccucuuaaguuuc

SEQ ID NO: 234582 - RNA, 64 nt, Human
cuucaucauugacacuggagaaagguguccuccaugcccucaggcagcagagaacuggcccaga

SEQ ID NO: 234583 - RNA, 64 nt, Human
cugccagcaaagagugacagucaccuccaugcccugcccucauugcaaagcccucacucaccuu

SEQ ID NO: 234584 - RNA, 60 nt, Human
aagacacacacacauacaugauaaugauucccagcccaggagcugaggggugagggcugg

SEQ ID NO: 234585 - RNA, 60 nt, Human
ucuaaugcuuaaugauggcugagcugggccccagcccagugacuggcucauuugccccuc

SEQ ID NO: 234586 - RNA, 60 nt, Human
uggccuuucccccguggauuggucucuggcccagcccagucucuucucaggggcaggggg

SEQ ID NO: 234587 - RNA, 64 nt, Human
cccugcccacauccccucuccaauaaagcaccugugcccucagcaauggccugccaugugcugu

SEQ ID NO: 234588 - RNA, 64 nt, Human
acuuugcuagguagacuuuauuacccccccacuaugcccucauuuuuuuaaaaaaggaaaaaaa

SEQ ID NO: 234589 - RNA, 64 nt, Human
gguuaauuuuuuguaagauuucuccuuuuauuauugcccucaucauaguuccugauugucucuu

SEQ ID NO: 234590 - RNA, 64 nt, Human
agaugugacauuugggauuccccaucacuugucaugcccucagcacccagcuugugccauuggg

SEQ ID NO: 234591 - RNA, 64 nt, Human
uaccaugaagugugcucacccuuccagccuccucugcccucacccccggaguuaaaguggguaa

SEQ ID NO: 234592 - RNA, 64 nt, Human
aguggcuggggugggggcugaggggcagccccuaugcccucacagugcagcaaccuugguuagc

SEQ ID NO: 234593 - RNA, 64 nt, Human
ugauuuguccccgacagcaggcaaagccucacauugcccucaauuuucccccuuucauuugaag

SEQ ID NO: 234594 - RNA, 64 nt, Human
ccaggccagcuuucugcauggauggucagucucuugcccucaaacacuacagcaaacaagcuac

SEQ ID NO: 234595 - RNA, 64 nt, Human
gcagagaaacaaagucuggacccacuccaugcucugcccucagaccuggccaggugaugcucug

SEQ ID NO: 234596 - RNA, 64 nt, Human
gaagacgcagugacaacucccacccccuccguccugcccucagcccggcccuggccccuucccg

SEQ ID NO: 234597 - RNA, 64 nt, Human
ugaaaaccacccaccucaaggaacagaaagcauuugcccucaucagagaaauccuggguaggca

SEQ ID NO: 234598 - RNA, 64 nt, Human
gccucgaaugggcuucugaggacacaaggugggcugcccucaagccccagagagccccucaucc

SEQ ID NO: 234599 - RNA, 64 nt, Human
uauuuauucacacucauaagcaucaaauauuuaaugcccucagugggaaauuuguguuuaaacu

SEQ ID NO: 234600 - RNA, 64 nt, Human
uaugugggcggaugacgcaagacuacaagauccuugcccucaagcugcuaggaacuuacgguuu

SEQ ID NO: 234601 - RNA, 60 nt, Human
cgagguggguggaucacgaggucaggagauccagcccauccuggccaacauggugaaacc

SEQ ID NO: 234602 - RNA, 60 nt, Human
gauacaacuucaagugcaugcucucugcagccagcccagcccagcuggugggaagcgucu

SEQ ID NO: 234603 - RNA, 60 nt, Human
ugcaagucacugccuuccaagugcagcaacccagcccauggagauugccucuucuaggca

SEQ ID NO: 234604 - RNA, 64 nt, Human
gcuagagaccugggcccugaacccuguagacagaugcccucagaauuggggcaugggagggggg

SEQ ID NO: 234605 - RNA, 64 nt, Human
ggcauggauaugacaagcagggcagccuggacacugcccucacaggacagcgccaauaacaaua

SEQ ID NO: 234606 - RNA, 64 nt, Human
uguauucuacucccuacaagccauuuugaacuucugcccucaccggacucugggcugugacugg

SEQ ID NO: 234607 - RNA, 64 nt, Human
gagucgcuguugcuagcagggagauuucucuuccugcccucacuucuuucaccuugaacuugga

SEQ ID NO: 234608 - RNA, 64 nt, Human
cguaggggaaggaggaaugugggcugggggaagaugcccucaacucacccccuacacacacaug

SEQ ID NO: 234609 - RNA, 64 nt, Human
gucgccuggcuuauucccaugugugacuccagccugcccucagcacagacucuuucagauggag

SEQ ID NO: 234610 - RNA, 64 nt, Human
cugguggaaaggagcccuguggcugccuugggccugcccucagccccacuccuguucugcaacu

SEQ ID NO: 234611 - RNA, 64 nt, Human
uacaaugucuuuauuuuuaacuguuugccacugcugcccucaccccugcccggcucuggaguac

SEQ ID NO: 234612 - RNA, 64 nt, Human
uggaggacuugaguggccccaaaggcugccacggugcccucaccccagcccaugugcucccaua

SEQ ID NO: 234613 - RNA, 64 nt, Human
aaauggaauguggugacauaaacuagacauggggugcccucaaguuuccaaggggaccaaugug

SEQ ID NO: 234614 - RNA, 64 nt, Human
auuuauuguugcaaaaaagacgcuuuuuuauugcugcccucauuugucagcuaauuauuuuuuc

SEQ ID NO: 234615 - RNA, 64 nt, Human
cagcaaggcugauccagaccccuucugcccccacugcccucauccaggccucugaccaguagcc

SEQ ID NO: 234616 - RNA, 64 nt, Human
gggacagcagcccgaccuguggucuccaugccugugcccucacacagguguagcacacgcaugu

SEQ ID NO: 234617 - RNA, 64 nt, Human
ggagcugucugcauccgccacccccuccaaccacugcccucagcccccgaccuuauuuauuacc

SEQ ID NO: 234618 - RNA, 60 nt, Human
ggcugccagugccaugcaagccacagccagccagcccauccacuucuuccacuccucccc

SEQ ID NO: 234619 - RNA, 60 nt, Human
ggagugggcugggggaggggaacaggaugcccagcccagggggcaaggacacagcugcuc

SEQ ID NO: 234620 - RNA, 60 nt, Human
ggcagaucacuugaggccaggaguucaagaccagcccaaccaacauggugaaacccuguc

SEQ ID NO: 234621 - RNA, 64 nt, Human
agacccugcccggcuccucccugaccgguccuugugcccucaccagacacccuguuggccauga

SEQ ID NO: 234622 - RNA, 64 nt, Human
uucuggcucccccaggcucuggcagucgggacacugcccucaucgcgggcagccuugugccucu

SEQ ID NO: 234623 - RNA, 64 nt, Human
cuggggcaccgucgccuaaccugguuucuagcuuugcccucacuccccggaaaaacugacacug

SEQ ID NO: 234624 - RNA, 64 nt, Human
aauaaaccaaacccagccacugccaagcuuccugugcccucaccccaaucccugccacugggcu

SEQ ID NO: 234625 - RNA, 64 nt, Human
cgcucucuccuaaggcagggucuggggucaccccugcccucaucguaauuccccauguuccuug

SEQ ID NO: 234626 - RNA, 64 nt, Human
cucaagcagcaccaauggggaugacccugacaggugcccucaggggucugggaaauccaacucu

SEQ ID NO: 234627 - RNA, 64 nt, Human
uccaagccuggucagcugccugcacaggcagaggugcccucagcccagauuagcaacacucaua

SEQ ID NO: 234628 - RNA, 64 nt, Human
aggaggccaggggaaaaaccccugcucacuuguuugcccucaggcagccaaagcacuuuaaccc

SEQ ID NO: 234629 - RNA, 50 nt, Human
cuaguggcucuugcugcugaugcccucaccuauacucaccugccuuuauu

SEQ ID NO: 234630 - RNA, 64 nt, Human
aggagauugaggcugguugcacuggggucaggagugcccucaccuugcccagucuuccuucaag

SEQ ID NO: 234631 - RNA, 64 nt, Human
cuuuccugcucuugguuuucccaggugagcucuaugcccucaguggcuggauugcagccaccca

SEQ ID NO: 234632 - RNA, 64 nt, Human
cccaagccuccuggggaggcagggcaaaaacaggugcccucaucguggucugugccaugucccg

SEQ ID NO: 234633 - RNA, 64 nt, Human
aggcugcaguucaguuuugggccaccugggguacugcccucaagagaacgugcuguggcccaug

SEQ ID NO: 234634 - RNA, 64 nt, Human
augcaaggggccucuacccacaccuggaccuccgugcccucaccccagcccuaggugugcaccu

SEQ ID NO: 234635 - RNA, 60 nt, Human
uggacucagaaagccaacauguggcuccucccagcccauaaccaguauuuuugcugcuuc

SEQ ID NO: 234636 - RNA, 60 nt, Human
ggcagccccaggugggagcugggaggguccccagcccaggagguggcuggauugcagggc

SEQ ID NO: 234637 - RNA, 60 nt, Human
acucacgagggcagugcaagggagaaccugccagcccagccccaccacagggagagugcg

SEQ ID NO: 234638 - RNA, 64 nt, Human
cuacuggagcgugcccuugcuggggacguggcugugcccucaguugcccccagggcugggugcc

SEQ ID NO: 234639 - RNA, 64 nt, Human
ucagagaaggugauauuuucaggaaaaagacaaaugcccucauaguagugggaagugugaaggu

SEQ ID NO: 234640 - RNA, 64 nt, Human
uccuguccugaggcugcuguccggggccgguggcugcccucaaggucccuucccuagcugcugc

SEQ ID NO: 234641 - RNA, 64 nt, Human
gcacccgacuuaccaggacgcaugccccucccucugcccucaucaaacccacagacccggacuc

SEQ ID NO: 234642 - RNA, 64 nt, Human
cacaugcauuuauggauccaguaucaugcagugcugcccucauccuccagcagugcaauuucuu

SEQ ID NO: 234643 - RNA, 64 nt, Human
cccucugugugccaucuccaaugagaaggaauccugcccucaccucacccuuuuccaacuugcc

SEQ ID NO: 234644 - RNA, 64 nt, Human
uuuguuauuccucagaaauacugcacugaguauaugcccucauuacuggacuucauuuugauac

SEQ ID NO: 234645 - RNA, 64 nt, Human
uauugcagguuucccuguauaacguaaacacacuugcccucaugccucccagaauaugaggucu

SEQ ID NO: 234646 - RNA, 64 nt, Human
uggacaagcugcuccccuggcuaaggcccugcccugcccucagccagaggugccuggccaugcc

SEQ ID NO: 234647 - RNA, 64 nt, Human
acagaugccacgucuucgugcauucgccaacacgugcccucacagggccagcguccuccuuccc

SEQ ID NO: 234648 - RNA, 64 nt, Human
uuucaccauguuggccaggcuggucuccaacuccugcccucaagugauccgccucggucccauu

SEQ ID NO: 234649 - RNA, 64 nt, Human
gcggguugcuacguccccuucuugguccacagucugcccucaucccucuggcagucacgcuguc

SEQ ID NO: 234650 - RNA, 64 nt, Human
ccuccccaaugcugacccuaggauuuuccuucccugcccucaccugcaaaugaguuaaagaaga

SEQ ID NO: 234651 - RNA, 64 nt, Human
ggggacacagugguaaucaagacagccccaacacugcccucauagagcucacaguccaauggag

SEQ ID NO: 234652 - RNA, 60 nt, Human
cacuccuccccacagcgcagaggaaacaggccagcccagugacaugacguuauuaguuuu

SEQ ID NO: 234653 - RNA, 60 nt, Human
aagugauguaucaguaauguaucaauaaucccagcccagucaaagcaccgccaccuguag

SEQ ID NO: 234654 - RNA, 60 nt, Human
cccugugacucaggaccagcucuggagucuccagcccacccuccgcaccguccccuccug

SEQ ID NO: 234655 - RNA, 64 nt, Human
cauuaccauagagaacaaaauagacaaauacaucugcccucauggaaggugacguucccaggag

SEQ ID NO: 234656 - RNA, 64 nt, Human
uauguguauguaugcguauguauguauguauguaugcccucagugcagugggguuugcugcaga

SEQ ID NO: 234657 - RNA, 64 nt, Human
caauguaguuuucccgccuucaaauaaacaugucugcccucaugguuucgguaacgagacucuu

SEQ ID NO: 234658 - RNA, 64 nt, Human
caguguagcucucuccucuucaaauaaacaugucugcccucaugguuucgauaaugugacucuu

SEQ ID NO: 234659 - RNA, 64 nt, Human
ggaacugauguaggggguggcacuccccagagacugcccucacgaggggacuggguucgcucuc

SEQ ID NO: 234660 - RNA, 64 nt, Human
ucacauacagaaggucccugauaaaguuaguagcugcccucaucagaaaccaggcccaggcagu

SEQ ID NO: 234661 - RNA, 64 nt, Human
ggcucaacuggggcuggagccacuuccaagccagugcccucacguggcugucggugacagccac

SEQ ID NO: 234662 - RNA, 64 nt, Human
cucugccuccauccacgugggaagcggacccuccugcccucagcuuggguuugggggccucagu

SEQ ID NO: 234663 - RNA, 64 nt, Human
ccaguuuuccaccgugggugggccagguguuccuugcccucauucggguaaaccagcaaccucc

SEQ ID NO: 234664 - RNA, 64 nt, Human
ccaguuuucugcccugggugggccagguguugcuugcccucauucugguaaaccagcagccucc

SEQ ID NO: 234665 - RNA, 64 nt, Human
ggauccgggaucaaaguuggcgggggcuuggcugugcccucagauuccgcaccaauaaagccuu

SEQ ID NO: 234666 - RNA, 64 nt, Human
ucagaaguuaggaaacacccucuagggcagugccugcccucagcucucacacaugacuggagag

SEQ ID NO: 234667 - RNA, 64 nt, Human
agaggguuguccuuccccccagcaaaugcaauaaugcccucaccccuccugagaggagcccccu

SEQ ID NO: 234668 - RNA, 64 nt, Human
aggcauggacccugacaccugccaacagccccucugcccucacaaccucagccuggccuucaug

SEQ ID NO: 234669 - RNA, 60 nt, Human
uugugacagugccucuuccagugaacauucccagcccagccccgccccgccccgccccac

SEQ ID NO: 234670 - RNA, 60 nt, Human
ugcaugaguucugcaccccaagcccuugccccagcccaguccagcagcagauguuacaau

SEQ ID NO: 234671 - RNA, 60 nt, Human
cacuagguaucagggaucccgagauggguaccagcccacaguccuuaccugccacgagcc

SEQ ID NO: 234672 - RNA, 64 nt, Human
uuucaccauguugcccaggcuggucucaaacuccugcccucaggugauccacccaccucagccu

SEQ ID NO: 234673 - RNA, 64 nt, Human
cugggggaccaaugaggugagggggguucuccuuugcccucagcuuuccccagccccuccggcc

SEQ ID NO: 234674 - RNA, 64 nt, Human
aaacccuagaguacacacgucccaaacuccccugugcccucaaguccuacagccccuagaagac

SEQ ID NO: 234675 - RNA, 64 nt, Human
augauaccaugguggacacagcugagaaaaucccugcccucauggugcucauucuacuugagua

SEQ ID NO: 234676 - RNA, 64 nt, Human
aguaucuaacugucccuaacacagcaugugggaaugcccucaauacgguggaugcuguuaacuu

SEQ ID NO: 234677 - RNA, 64 nt, Human
cuguccaucccacagcucagccuggaugcccaccugcccucaggcaagguagagguggcagggg

SEQ ID NO: 234678 - RNA, 64 nt, Human
ggaauccaggucccccagguggagcugccugccuugcccucacugcccacucugcccacacuuc

SEQ ID NO: 234679 - RNA, 64 nt, Human
guugaucuccccugacaaucuggaagguuccuuuugcccucagugccagccaauccgggcagga

SEQ ID NO: 234680 - RNA, 64 nt, Human
uccccgggccagggacucuguucaaacugcgcccugcccucaucucccaaggccagaggucacc

SEQ ID NO: 234681 - RNA, 64 nt, Human
gcuguuuagaagugcauagcacuucccugucgcuugcccucauucucaccaugugaaauaccga

SEQ ID NO: 234682 - RNA, 64 nt, Human
agguagagguugccgugaggcaaaaucgugccacugcccucagccugggcaguagagucagucu

SEQ ID NO: 234683 - RNA, 64 nt, Human
gugggggcagggcgggucccacgauggcccccauugcccucaucacccugacacccccacauuc

SEQ ID NO: 234684 - RNA, 64 nt, Human
ccgccccgccccuccggccuccccacaccccccuugcccucacuaccuguaucucaccggcgug

SEQ ID NO: 234685 - RNA, 64 nt, Human
cuaagggccacucugguuaucugccaagguugcuugcccucaccccaaugcuccaacagccauu

SEQ ID NO: 234686 - RNA, 60 nt, Human
ggccucgaugaagccuucucuggaaccacuccagcccagcuccaccucagccuuggccuu

SEQ ID NO: 234687 - RNA, 58 nt, Human
aaccaaaacuccccaccugaagcugagcccagcccagacccagcugcucccggggaca

SEQ ID NO: 234688 - RNA, 60 nt, Human
accaguguccuccccucaaggacaaagucuccagcccacguucucucugccugugagcca

SEQ ID NO: 234689 - RNA, 64 nt, Human
auaccuccucccguugggcugugacuuuuccuccugcccucagccucugaaacagaaaucuuug

SEQ ID NO: 234690 - RNA, 64 nt, Human
uucccucaccccuggagacuuacuguuaggugccugcccucaguauagacguauccaaugggaa

SEQ ID NO: 234691 - RNA, 64 nt, Human
gugcgccuccagcugggccugacccuccauguccugcccucaaaaaacuggguggagaaauaau

SEQ ID NO: 234692 - RNA, 64 nt, Human
ucugggucucugggccccgccugcuggccugagaugcccucauguugggaagcauuccgugccc

SEQ ID NO: 234693 - RNA, 64 nt, Human
cacuauggacgaagcgugggaccccagcacgggcugcccucaggaagaccaguguugcccgagg

SEQ ID NO: 234694 - RNA, 64 nt, Human
ccugccugcugacccguggccccagcucacucauugcccucagcagccacccgaggcugugcag

SEQ ID NO: 234695 - RNA, 64 nt, Human
agcuucucuggagacccuagaaggcggcauguccugcccucaaccugccugccuggauugcacc

SEQ ID NO: 234696 - RNA, 64 nt, Human
gaucucaucacccacucccagccccagcuccagcugcccucaccucucuagcagcucucacccc

SEQ ID NO: 234697 - RNA, 64 nt, Human
acauugcaggucagcuucuuccucugcccaguccugcccucacuccccagugaauccucaauuu

SEQ ID NO: 234698 - RNA, 64 nt, Human
ggcggguggggagcuguccggugcuaccacaccgugcccucaguggacuaaccacagcagcagc

SEQ ID NO: 234699 - RNA, 64 nt, Human
gaccauucuuuccaaccucuggguucuugcaaguugcccucaccuuguguguggagaugcauuc

SEQ ID NO: 234700 - RNA, 64 nt, Human
cggguugugugucuguucacuuuuccucccucagugcccucauuuuaugucauuaaauggggcu

SEQ ID NO: 234701 - RNA, 64 nt, Human
gguugguuugcaugucauuugcauaucguuugcaugcccucaucccacccauucucagggcagu

SEQ ID NO: 234702 - RNA, 64 nt, Human
ggaauacacugguuaacaggaccaaaaaagacccugcccucacugaguuuuaaauuuuagugga

SEQ ID NO: 234703 - RNA, 60 nt, Human
ccaucaaggugugggacuacgccacacaggccagcccaggcccccaggugugugcguggg

SEQ ID NO: 234704 - RNA, 60 nt, Human
cagcuguccucccuggugcagguggccuggccagcccacuggauuggggacgggccaggc

SEQ ID NO: 234705 - RNA, 60 nt, Human
gagaaaccaggacaggccaucugcagugacccagcccaggacgaaguuuacaaacaccuc

SEQ ID NO: 234706 - RNA, 64 nt, Human
cuggagcaaugcuccaucaacuccaucuuucuucugcccucaugaaguuugcguguguuuuuug

SEQ ID NO: 234707 - RNA, 64 nt, Human
acaugcuacugaaguuuauuuuaccauugacugcugcccucaaucuagaacgcuacacaagaaa

SEQ ID NO: 234708 - RNA, 64 nt, Human
ggcuuugcgugagaaaggggaggagagugguugcugcccucagccggcuugaggacagagccug

SEQ ID NO: 234709 - RNA, 64 nt, Human
cuuauuguggagcguccccuuccaucaagcagccugcccucaagccaaggaucauccccuggaa

SEQ ID NO: 234710 - RNA, 64 nt, Human
cucugcgccauugucaccagggcccuguccuggcugcccucacccaugucaagcuacugaggcu

SEQ ID NO: 234711 - RNA, 64 nt, Human
aaaaguguauugcaagugaaauaauauugauuucugcccucagcuucaaauaaaguaaauugaa

SEQ ID NO: 234712 - RNA, 64 nt, Human
aacaaagaugaugauaauguuuucagcagcaauuugcccucagagguaaguaggaggaauauua

SEQ ID NO: 234713 - RNA, 64 nt, Human
ggcagccgcugaguucggggcucacuacugacugugcccucaggcugggcggcuccaguccaua

SEQ ID NO: 234714 - RNA, 64 nt, Human
gacuucagguagauuaagguaucuuuuuauucauugcccucaggaaaguuaagguaucaaugag

SEQ ID NO: 234715 - RNA, 64 nt, Human
acaagguagacauggauuugaugaaagugcaaagugcccucauuuguggcccaagccuggucuc

SEQ ID NO: 234716 - RNA, 64 nt, Human
uguggggaggcuucgcacugagcucucagccuccugcccucagcugcgcgaagcgcucggccca

SEQ ID NO: 234717 - RNA, 64 nt, Human
gagaguuggugauaagcgagacgaacacauuuccugcccucauacacacauaaauaaagugaau

SEQ ID NO: 234718 - RNA, 64 nt, Human
acagggaccuggucaggaggugcacauggugcccugcccucacccacccucuguguuuccccuu

SEQ ID NO: 234719 - RNA, 62 nt, Human
cugccaacacuuuccucugaccauggcuuggaugcccucaggggugcugaccccugccaggc

SEQ ID NO: 234720 - RNA, 60 nt, Human
cccgccggacccgcauuauggcugggggcgccagcccaagaauggggaccaugggacucc

SEQ ID NO: 234721 - RNA, 60 nt, Human
aucucuccuaccaagaugguguuccacuguccagcccagcaugaguagcagguagagcac

SEQ ID NO: 234722 - RNA, 60 nt, Human
ucagggcaggaaccccacagacugucccuuccagcccacacucugccaccuccuggcccu

SEQ ID NO: 234723 - RNA, 64 nt, Human
agacaauccugcguuugccugggccggcccuggcugcccucagcuuucgcugaucugcccggcc

SEQ ID NO: 234724 - RNA, 64 nt, Human
gggggacagcagucucugagcaccagggagcaguugcccucaggccugugcccagcaugcccuc

SEQ ID NO: 234725 - RNA, 64 nt, Human
ugaggaggggaccuucgagggccucugccccaugugcccucaaagcugucccacaaucauggag

SEQ ID NO: 234726 - RNA, 64 nt, Human
uaagaaucuucccaaaauccuuuaauuuaccugaugcccucaucaggucguuaaaaauucaaau

SEQ ID NO: 234727 - RNA, 64 nt, Human
gugacagccucacagggucugguaccagggguugugcccucagcagugacagcagcuuaggugu

SEQ ID NO: 234728 - RNA, 64 nt, Human
ggcugagcagagcuugaaggccauucugucucagugcccucacucccugcuccccgcacccgga

SEQ ID NO: 234729 - RNA, 64 nt, Human
ugaggauuuuuggguuuuguaacuaaauucuugcugcccucauacuuuuuauguauuagaauca

SEQ ID NO: 234730 - RNA, 64 nt, Human
uuuguuuuuauuuaucucuuuggcccagccaagcugcccucacuacagagaccuuggacaagga

SEQ ID NO: 234731 - RNA, 64 nt, Human
ucccccucgguucaaaaccuugcacaggucccacugcccucagccccacuucucagccugguac

SEQ ID NO: 234732 - RNA, 64 nt, Human
ucaucugaacuuccguuuccccagggccuccagcugcccucagacacugaugucuguccccagg

SEQ ID NO: 234733 - RNA, 64 nt, Human
gaagggugagggggucagacacaggcccugccccugcccucagugacuggccaguccagcccag

SEQ ID NO: 234734 - RNA, 64 nt, Human
cuuugauuucuuugccaauggcaagaagaugagaugcccucagcacugaggauucuugcccccu

SEQ ID NO: 234735 - RNA, 64 nt, Human
ccucgacuccaagucaggaauaccgugggcuuccugcccucaccccacaccucaagaccauccc

SEQ ID NO: 234736 - RNA, 64 nt, Human
auuuuguuuggcagagcuuuuaccuguuauucuuugcccucaaauacaguauuguggucauuuu

SEQ ID NO: 234737 - RNA, 60 nt, Human
guguuugcuucucccuuucugcggccuucgccagcccaggcucggcugccacccaguggc

SEQ ID NO: 234738 - RNA, 60 nt, Human
cuucugugggucuguaccagguacuccaggccagcccaugggcccggggccugaccccaa

SEQ ID NO: 234739 - RNA, 60 nt, Human
uuacaucugccagggccugccucaagaagcccagcccagccuuuuccugggaugcaguga

SEQ ID NO: 234740 - RNA, 64 nt, Human
cagaaaaaaauugucaguaccuuugcucaugccaugcccucagccuggaaugcccuuugcucuu

SEQ ID NO: 234741 - RNA, 64 nt, Human
uauuuucuguguuucuggacugcacuguuguccuugcccucacauagacacucagacacccuca

SEQ ID NO: 234742 - RNA, 64 nt, Human
uaguauugguaaaaacaaacaaacaaaaauccuuugcccucagaagugcauuuccuuauucuuu

SEQ ID NO: 234743 - RNA, 64 nt, Human
uaauugacacaucucuuauuugagaagugucuguugcccucauuagguuuaauuacaaaauuug

SEQ ID NO: 234744 - RNA, 64 nt, Human
cugugucuguuggaaucuugauagcugauuaauuugcccucaauucugcucccugaacuucaca

SEQ ID NO: 234745 - RNA, 64 nt, Human
ccccagcagggguacuggguacccggcaggccagugcccucacaguugacuuggaccagggugg

SEQ ID NO: 234746 - RNA, 64 nt, Human
cuuagcguucuguuucaccaguuuccaaguuuauugcccucaaaaucuuuagaauaguuaaauu

SEQ ID NO: 234747 - RNA, 64 nt, Human
uuauauauaaauaucuauuuaucugucugagcccugcccucacuccacuccccucauccacuag

SEQ ID NO: 234748 - RNA, 64 nt, Human
ugagcuagagaaaauaaccuggucucacugugguugcccucauccacaauguccccaaagccau

SEQ ID NO: 234749 - RNA, 64 nt, Human
ugccuucaguucacagugccucugcaacagccauugcccucaggucacauucuuugggcuggcu

SEQ ID NO: 234750 - RNA, 64 nt, Human
cucugagaagugggguguggucucucagcuguucugcccucauacccuuaaagggccagccugg

SEQ ID NO: 234751 - RNA, 64 nt, Human
uuguuaacgucugccacccccacucucacccccaagcucuaagcccccgggaggccuggacugu

SEQ ID NO: 234752 - RNA, 60 nt, Human
uccauccuguggcuuccagagugugcacuuccagcccacccgggcagugcugagagggag

SEQ ID NO: 234753 - RNA, 60 nt, Human
aguucuugccucccucacggggcgucacccccagcccagcuccguuguacauaaaugccu

SEQ ID NO: 234754 - RNA, 60 nt, Human
cugggggagcugaggcucugugcugcacccccagcccacagcuggggcaucucacuggag

SEQ ID NO: 234755 - RNA, 64 nt, Human
aaaucucacagaaaaauaggcacuuugggccaaaagcucuaauggaacauuuuuaguggugauu

SEQ ID NO: 234756 - RNA, 64 nt, Human
ucucggcuucguugucuguaaauuggaugaaaagagcucuaaugccuuucaggcucuuagaagc

SEQ ID NO: 234757 - RNA, 64 nt, Human
ucaaguuuauaaaaauacagugaaauuucuacaaagcucuaaaucugcauuugcauuuccucug

SEQ ID NO: 234758 - RNA, 64 nt, Human
cugguugaacagcggaugaagauauggaauucaaagcucuaauggaccuuuuugaagagaaguu

SEQ ID NO: 234759 - RNA, 64 nt, Human
uauuuauguggcuuggcaaaaaucacuauaaggcagcucuaaauuugccuugauaagcuaaaua

SEQ ID NO: 234760 - RNA, 64 nt, Human
uucuggugaugaaugaauauuccagauuuugaggagcucuaagugguccaggaguccaaguaag

SEQ ID NO: 234761 - RNA, 64 nt, Human
cugcagcuaauuuagcugaucucuaauuuaacugagcucuaauuuagcugaucagauuuugcuu

SEQ ID NO: 234762 - RNA, 64 nt, Human
ugaaaaaccuacccagcaaagaagcauagcuuuuagcucuaauaauucuguagcaaagccaaua

SEQ ID NO: 234763 - RNA, 64 nt, Human
gacaacugcaaacucauuuaagcaagagaaaaacagcucuaauucgagauugugaagcaacacu

SEQ ID NO: 234764 - RNA, 64 nt, Human
guggucguggggcacagaaaaaauagauaggggcagcucuaaagaccagcuguuaagacagaca

SEQ ID NO: 234765 - RNA, 64 nt, Human
auuuaugucugcuuuucuaaaucugcauuauaauagcucuaaaauuuguugauugguaagaaau

SEQ ID NO: 234766 - RNA, 64 nt, Human
uccuacaaguuuaaguaguagacagauacuauccagcucuaagucucaacugcucuuuuauacu

SEQ ID NO: 234767 - RNA, 64 nt, Human
aauggccuauuucgauagauagaaaguuuucuauagcucuaaagguuucuccuuugcaacccau

SEQ ID NO: 234768 - RNA, 64 nt, Human
cugggccuaccauaaauaaauaucuccuuuucugagcucuaagaauuaucagaaacaggaaaga

SEQ ID NO: 234769 - RNA, 60 nt, Human
cucccccuuaucuaucuccuucucggcuccccagcccagucuuggcuucuuguccccucc

SEQ ID NO: 234770 - RNA, 60 nt, Human
cuuccagguucugguuagcucagccccagcccagcccagcugcucugcccagagcugggu

SEQ ID NO: 234771 - RNA, 60 nt, Human
gauggaauagaauaacugggcuaugagucaccagcccacuuugugacccagcaagaccuu

SEQ ID NO: 234772 - RNA, 64 nt, Human
gcaaacgugaaauucuauugaaaacagugucuugagcucuaaaguagcaacugcuggugauuuu

SEQ ID NO: 234773 - RNA, 64 nt, Human
cagaaacuuuagcauuggcccaguaguggcuucuagcucuaaauguuugccccgccaucccuuu

SEQ ID NO: 234774 - RNA, 64 nt, Human
gaccggugcuuauaaaaaguuauaaauaucgaguagcucuaaaacaaaccaccugaccaagagg

SEQ ID NO: 234775 - RNA, 64 nt, Human
ccaggcacugauaagccagugguaagggaaacacagcucuaaccucaccucauucuccagguua

SEQ ID NO: 234776 - RNA, 64 nt, Human
uuuuuaauaaugaaaaauauuuucgugacaagugagcucuaaauucucuuuauuguaaaagaga

SEQ ID NO: 234777 - RNA, 64 nt, Human
gucauuuccucuuaaaaaggaggagcugggcuucagcucuaagaacuucauugcccuggggauc

SEQ ID NO: 234778 - RNA, 64 nt, Human
guucagggaaggaggggaaaagggaggugcagagagcucuaagccagugugcuuacagugaggc

SEQ ID NO: 234779 - RNA, 64 nt, Human
uucuucaccauaauaaacuuuggacaaccaagcaagcucuaaccgcaaugccagauggccuugu

SEQ ID NO: 234780 - RNA, 64 nt, Human
uauaaggaaaggaaagagaagcagaguuaguuccagcucuaauagggaucuucaaaguuauuuu

SEQ ID NO: 234781 - RNA, 64 nt, Human
accaccaccuuauacaucacuuccuguuuuaagcagcucuaaaacauagacugaagauuuauuu

SEQ ID NO: 234782 - RNA, 64 nt, Human
ucaguuuaguaguaguacugagaaaaaucccuucagcucuaagaacacugaaaaauccaccgau

SEQ ID NO: 234783 - RNA, 64 nt, Human
agagcaagcaaaacccagugcaagagucucguucagcucuaaauagguuugcuuucuuuuaguu

SEQ ID NO: 234784 - RNA, 64 nt, Human
gguaaguuguuugugcuuuaggcaaacauuaaccagcucuaacaagaaaaaugucuagauuuac

SEQ ID NO: 234785 - RNA, 64 nt, Human
augccauuauuuuuguauucuuuuucuuagugugagcucuaaaaucaauguucuugaaaaagaa

SEQ ID NO: 234786 - RNA, 60 nt, Human
ggcaggcugugcgcugacaaccaccgcuccccagcccaggguucccccagcccuguggaa

SEQ ID NO: 234787 - RNA, 60 nt, Human
gaauuuauugccuggacugucaggacaucaccagcccaccuucaccuuagggaagaugcc

SEQ ID NO: 234788 - RNA, 60 nt, Human
cguguggcagaaucgcaccgccccggcuccccagcccaccgccaugcagggcucgcgugc

SEQ ID NO: 234789 - RNA, 64 nt, Human
gauuuuuguuuguuuauugaauucauuucacuguagcucuaaaaucugcuuguauuccaagcau

SEQ ID NO: 234790 - RNA, 64 nt, Human
ggagguucugaguaaggacauuucugacugaagaagcucuaaaagugaagagaccucguuuuga

SEQ ID NO: 234791 - RNA, 64 nt, Human
caagucucucucuccugagccuccucuugaugcaagcucuaaagggagaagucaggcccugccu

SEQ ID NO: 234792 - RNA, 64 nt, Human
ccagugacccuggagcuagggucccccuucguggagcucuaacugauucagggccccugaagug

SEQ ID NO: 234793 - RNA, 64 nt, Human
aauauaucaaaucgcacugaauacucaacaccagagcucuaaugugggaaaugguucuccuuuc

SEQ ID NO: 234794 - RNA, 64 nt, Human
agggcuccggcccagaaugggaaccucagagaagagcucuaaggagaagaaaccccauagcguc

SEQ ID NO: 234795 - RNA, 64 nt, Human
uuaugugucuguguuauacuguauagguacuuguagcucuaaauguuuaaaguaacuaccaccu

SEQ ID NO: 234796 - RNA, 64 nt, Human
ggagcuauugaucuacuagcaucaaacaaaggcaagcucuaauuccacagguaauacaauuuag

SEQ ID NO: 234797 - RNA, 64 nt, Human
augaacaacuuaaaggcacugauuucuauaauagagcucuaaaaacaugccaccaguguaugaa

SEQ ID NO: 234798 - RNA, 64 nt, Human
gauacuuucuauuacuagaucuaauuugauuuuaagcucuaaguuucacuuuuccauuaaacgg

SEQ ID NO: 234799 - RNA, 64 nt, Human
ggcugcaaauuuaauugcauuaaggcaagaaggaagcucuaaugugugcuuuguauccuaagau

SEQ ID NO: 234800 - RNA, 64 nt, Human
guauaaaggaauuggaccaaauaauuuaccacauagcucuaaaacuuaauuuaaaauguaauuc

SEQ ID NO: 234801 - RNA, 64 nt, Human
ggauaggaaugaaugaacuuuuaagauacugucuagcucuaaaauuggaagaacaaaaaguuuu

SEQ ID NO: 234802 - RNA, 55 nt, Human
ggcuggcuaaaauugccugagaggcagcucuaaagcacaagaccuggauguguga

SEQ ID NO: 234803 - RNA, 60 nt, Human
ugcagugagccgagaucgcuccacugcacuccagcccaggugacagugugagacuccauc

SEQ ID NO: 234804 - RNA, 60 nt, Human
uacguucucuuucuuccaagccuagagccaccagcccagcuuccuucucuggaaaagccu

SEQ ID NO: 234805 - RNA, 60 nt, Human
uuacuccccuguggugaguaccguggaaccccagcccaccucacuaucauacucagcuuc

SEQ ID NO: 234806 - RNA, 64 nt, Human
uuagaaacaggagaaguauuuuacccauucuuaaagcucuaaaaaaccaucucauggacugaaa

SEQ ID NO: 234807 - RNA, 64 nt, Human
agugacauuuguaguuggaguaauaggagcuuccagcucuaauaaaacagcugucucuaacuua

SEQ ID NO: 234808 - RNA, 64 nt, Human
uuuuuaaaaguuuguuuacaauuccacaagcaaaagcucuaauuuaaccagauuuucugacauu

SEQ ID NO: 234809 - RNA, 64 nt, Human
ggcaguggucauuuacugcugcucuuuuacaguuagcucuaaauuacuuguuugaacuauuuau

SEQ ID NO: 234810 - RNA, 64 nt, Human
agacaugugacuuauucaaugaaagugaaaaagaagcucuaaaacagugucauugauuaaaaag

SEQ ID NO: 234811 - RNA, 64 nt, Human
gccuuugucugugggaaggcaaaugaugccccagagcucuaaccaaagguuuugcagccgccga

SEQ ID NO: 234812 - RNA, 64 nt, Human
acggggucgccacugcacccagccugugucuuccagcucuaaucagaaagcugcuugucgaggg

SEQ ID NO: 234813 - RNA, 64 nt, Human
caugaaguacauuaauuucucauguaaaaaaaauagcucuaaaauuuguuucaaccuaauuggu

SEQ ID NO: 234814 - RNA, 51 nt, Human
ggcauuuccaagagcccugacagcucuaagauauuagcuacuuucuguaug

SEQ ID NO: 234815 - RNA, 64 nt, Human
uuucccagguaucagucauuauaauugauauaauagcucuaacaugcaauauaaaauucauagg

SEQ ID NO: 234816 - RNA, 64 nt, Human
ugacugaagacauuuccagguagauuucucagccagcucuaaaacagauugcuuuuucaguggc

SEQ ID NO: 234817 - RNA, 64 nt, Human
ucugaacugguaaagaauaacuauaaaauaugaaagcucuaaauuuaaaauaaauuuagagaua

SEQ ID NO: 234818 - RNA, 64 nt, Human
ggaaguucaggcucagcaugaauuuuuggcagguagcucuaauaccuggaguuuucuuuguuuu

SEQ ID NO: 234819 - RNA, 64 nt, Human
uaaaaacuuacuuuaaaucuuaccuucuauagguagcucuaaauaaauucauaugguuauaugg

SEQ ID NO: 234820 - RNA, 60 nt, Human
cggcugaacggagccaggaggccacgugucccagcccagcguccaguggugccucucaag

SEQ ID NO: 234821 - RNA, 60 nt, Human
ucagcccugggccugcaggagaggcugagaccagcccacccagccaguggucgagcacug

SEQ ID NO: 234822 - RNA, 60 nt, Human
cgcuuccuguccacugcccccuccccauccccagcccagccgagggaaucccguggguug

SEQ ID NO: 234823 - RNA, 64 nt, Human
uaaaauuaacucugugggugggggcggggggcauagcucuaaucuaauauauaaaaugugugau

SEQ ID NO: 234824 - RNA, 64 nt, Human
aagcuuuuacagaacaugcuuaauuuugauauugagcucuaaaugcaaaacucuuuuauacuga

SEQ ID NO: 234825 - RNA, 64 nt, Human
acagggaaaaaugaaagaaaugucuugguuacugagcucuaaauagacagguuugauggcacuu

SEQ ID NO: 234826 - RNA, 64 nt, Human
ccagcagacuuuucauuaugacuuacauggcaggagcucuaauuaugcuuuaaaaaucuguugu

SEQ ID NO: 234827 - RNA, 64 nt, Human
uuguauaguuuuauauuuuuuguauauguuugcuagcucuaaaaaggucgagaugcaauaacac

SEQ ID NO: 234828 - RNA, 64 nt, Human
agaggacuugaucuauuucucagguuauaaauucagcucuaaggaaauaucuuuaacucuuggu

SEQ ID NO: 234829 - RNA, 64 nt, Human
uacauaguuaccuuuaacucagugguuaucuaauagcucuaaacucauuaaaaaaacuccaagc

SEQ ID NO: 234830 - RNA, 64 nt, Human
gaaagacccauuuccaggacugaaccuaggucagagcucuaaauugguccuucuauuuuucaac

SEQ ID NO: 234831 - RNA, 64 nt, Human
cuguccaacuggaauccagauuuaaagugauaaaagcucuaaguuucuugcagucuuuuucuca

SEQ ID NO: 234832 - RNA, 64 nt, Human
uaucauuagcaacaacaugcuaaugacgacaccuagcucuaagagcaauucugggagaaugaaa

SEQ ID NO: 234833 - RNA, 64 nt, Human
ggcuggugcuuccuucuaguccuugagacuuuguagcucuaacucaagcagaacccugggguuu

SEQ ID NO: 234834 - RNA, 64 nt, Human
cugggccaagucauggugaaacaagaaagcuacaagcucuaaaugguaauuuuuuacauuuuug

SEQ ID NO: 234835 - RNA, 64 nt, Human
ucccaguuccccaaggcacgccuucuucccaggcagcucuaacagcccuuucaugaagguaaug

SEQ ID NO: 234836 - RNA, 64 nt, Human
caauuaaaauugcaguguuccucucugggaugagagcucuaaagcagaguaagauuacguucug

SEQ ID NO: 234837 - RNA, 60 nt, Human
auaggacuguuuacugcccaccuccgccugccagcccaccccagccuggggagaggucgc

SEQ ID NO: 234838 - RNA, 60 nt, Human
ggagugcagacaccuaaccccagggcacugccagcccacccccuuugacucuggggugca

SEQ ID NO: 234839 - RNA, 60 nt, Human
ggggcuuugggggugcuuucucuguaccccccagcccaugucccaaguugugccaaggga

SEQ ID NO: 234840 - RNA, 64 nt, Human
acaaguuggcacuuacaauuuuaaagaugcagccagcucuaaacaacacacagagcacaaauau

SEQ ID NO: 234841 - RNA, 64 nt, Human
aaaguauaaaggugagcacuagacugcucuuagaagcucuaauuuuuguuuucuuuggcuagua

SEQ ID NO: 234842 - RNA, 64 nt, Human
acggauucaaauguuuucauguaacuauguaaaaagcucuaagcucuagagucuagauccaguc

SEQ ID NO: 234843 - RNA, 64 nt, Human
guacuugcuguaggauucaagcugucuuugcacuagcucuaaagaagauuuucuucugguuuua

SEQ ID NO: 234844 - RNA, 64 nt, Human
cauuugauuuacagcuuaaguaauucagaggcuaagcucuaagcuuuuuucucucauugcugga

SEQ ID NO: 234845 - RNA, 64 nt, Human
ucucucucucucaaacacacacaaaugcccaaccagcucuaagagggcacugaagagguggcug

SEQ ID NO: 234846 - RNA, 64 nt, Human
cuugcaaaaucaguuuuccucucaauaaaauuauagcucuaauguuugcauauaagggaaguag

SEQ ID NO: 234847 - RNA, 64 nt, Human
uauuaacaaauauaaccaauucuaaauuuguuuuagcucuaaccucaucaaaccaaaggcacag

SEQ ID NO: 234848 - RNA, 64 nt, Human
aaaaauuggggccaaagaagcaggaaaaucucaaagcucuaauggcagcauaaaucaaagaauu

SEQ ID NO: 234849 - RNA, 64 nt, Human
uaugaucaguaguugauuuugagaaagcucuaugagcucuaaguaacugcaugguuuuuuguuu

SEQ ID NO: 234850 - RNA, 64 nt, Human
cuaucucccuugggaauaagcacauacaggcuuaagcucuaagauagauagguguuuguccuuu

SEQ ID NO: 234851 - RNA, 64 nt, Human
ccauaaucccaucaagaaaagcucugcugcucuuagcucuaaauaauucagaaucuauucucuu

SEQ ID NO: 234852 - RNA, 64 nt, Human
caugaaauuuaggaauuauuuaaaaguuaccauuagcucuaaaauuaagauucggaugcuuuau

SEQ ID NO: 234853 - RNA, 64 nt, Human
aucaaugcaggaucuaauucuuuugauaaguucuagcucuaaaagugauagugggacuguaugu

SEQ ID NO: 234854 - RNA, 60 nt, Human
ugaauauaagcaauguccacacguuuuuagccagcccacaugcuuucaacaacauguaag

SEQ ID NO: 234855 - RNA, 60 nt, Human
ugcuaggguuacaggcaugagccacugugcccagcccaggcucugggaauauugagauaa

SEQ ID NO: 234856 - RNA, 60 nt, Human
gccuggcaggcaggaaacagacauaggaccccagcccagaucugaauggcaugggaggug

SEQ ID NO: 234857 - RNA, 64 nt, Human
acaaaaaaaaaauuaaaaaaaaaaacagaaauagagcucuaaguuaugugaaauuugauuugag

SEQ ID NO: 234858 - RNA, 64 nt, Human
aaaaauggaaggaaauaugcaauguuauuuugguagcucuaagaaaauaucuugcaagcuccac

SEQ ID NO: 234859 - RNA, 64 nt, Human
uuuaugaaggggcucacagagcgguugaaauugaagcucuaacaccacacuccagcuacugugu

SEQ ID NO: 234860 - RNA, 64 nt, Human
gggagaaaaaaaccccagacuuugaauuaguaacagcucuaagauggucaugcagugagauagg

SEQ ID NO: 234861 - RNA, 64 nt, Human
aauugucuaggguguucuguacuuagaaaguaagagcucuaaguaccuuuccuacauuuucuuu

SEQ ID NO: 234862 - RNA, 64 nt, Human
ggucuuggggacgggaagggaacccucuuccaggagcucuaaggguacuugggaaucaauugug

SEQ ID NO: 234863 - RNA, 64 nt, Human
aaaacccuugccaugugcuaguaauuggaaaggcagcucuaaaugucaaucagccuaguugauc

SEQ ID NO: 234864 - RNA, 64 nt, Human
uuuaaugcauugaucauucuuaaugaacaauaucagcucuaaaggaccaaugcuuuuauaaugu

SEQ ID NO: 234865 - RNA, 64 nt, Human
uucucuacacauuuuuuuuuuccuggagucucuuagcucuaaauauaucaaucagauuuauaau

SEQ ID NO: 234866 - RNA, 64 nt, Human
aguggccucuuagacuagucauuaacuuaugauuagcucuaaagauuucaaauaguggcagaca

SEQ ID NO: 234867 - RNA, 64 nt, Human
cugaugcuccuugggugcugcugcuacucagacuagcucuaaguaaugugauucuucuaaagca

SEQ ID NO: 234868 - RNA, 64 nt, Human
uacuuuagccacaaagcuaaaacagcauuaccucagcucuaaacuagccuugaaguuuacagac

SEQ ID NO: 234869 - RNA, 64 nt, Human
aauauuggaaaugcuuaggaucuucagacccaauagcucuaauuuuaacauuucuacccaauaa

SEQ ID NO: 234870 - RNA, 64 nt, Human
cauaaagggcugcauuuuuuuaaaaagccuaggcagcucuaacaucaucugauauggacacaag

SEQ ID NO: 234871 - RNA, 60 nt, Human
cccggccagaucccuggagcuggccuccuuccagcccagugccagaaaccagcacuccau

SEQ ID NO: 234872 - RNA, 60 nt, Human
cugcaaccagacagucuacaacugcccccuccagcccauuuucugccgugaaaccccagc

SEQ ID NO: 234873 - RNA, 60 nt, Human
ccuccccuccugugucccuuguaaauagaaccagcccagcccgucuccucuucccuuccc

SEQ ID NO: 234874 - RNA, 64 nt, Human
cuccaaacacuuuuggauuaggguacaauauuagagcucuaaaaaggaauaguagaauaacuua

SEQ ID NO: 234875 - RNA, 64 nt, Human
gauccaugugauuauuaaaaugacuguagcugagagcucuaauuuuccugucuugaaacuguau

SEQ ID NO: 234876 - RNA, 64 nt, Human
gaagaccaacaaagucacagucguaucucuagaaagcucuaaagaccauguuggaaagagucuc

SEQ ID NO: 234877 - RNA, 64 nt, Human
caagcagugagaaauaagaccucucugaauuaguagcucuaaacuguuaacauagaauguuacu

SEQ ID NO: 234878 - RNA, 64 nt, Human
acuacaugacuccaaguauaugagaaaaggacagagcucuaauugauaacucuguaguucaaaa

SEQ ID NO: 234879 - RNA, 64 nt, Human
uuaacgggccuuauucugaucucaccugucgcguagcucuaauauucacauaaacugaaauaaa

SEQ ID NO: 234880 - RNA, 64 nt, Human
aucauguuguucgaucguuucacaucuguauaucagcucuaaagcagagauguauuauggugau

SEQ ID NO: 234881 - RNA, 64 nt, Human
uaccucuucacuugcuaaagcagcuaaacugugaagcucuaagugguuuggguuuguuguuuaa

SEQ ID NO: 234882 - RNA, 64 nt, Human
guuggugaucuuccugucaugaaaguugcuugacagcucuaauuacgaauugaacacauuaaac

SEQ ID NO: 234883 - RNA, 64 nt, Human
ucuacuaacaaggauccuuuaaaacugccaagggagcucuaacuugaagccacauccuacagau

SEQ ID NO: 234884 - RNA, 64 nt, Human
uucuuucaggcauugucaggugcuguuuuguuuaagcucuaacucaccccuggaauacagggga

SEQ ID NO: 234885 - RNA, 64 nt, Human
uuaaaaaaaaaaaggaagauauuucugaaagaccagcucuaaguaggccaauuaaaaaaaucua

SEQ ID NO: 234886 - RNA, 64 nt, Human
agaagauggucauuuuauucucuguauaaaacuuagcucuaaagcagaaacuaaagcagcaaau

SEQ ID NO: 234887 - RNA, 64 nt, Human
uaauuuagguuucuuuuuuucuucuucauuucggagcucuaagguguaugcaguugugacccca

SEQ ID NO: 234888 - RNA, 60 nt, Human
gucccgccucugccaauccccgccguccuuccagcccacgaccugccgcgccgaggagcg

SEQ ID NO: 234889 - RNA, 60 nt, Human
aaaagccuucagaagcuacucuguuucugaccagcccaggaaccuuugcagggccaucuc

SEQ ID NO: 234890 - RNA, 60 nt, Human
aagaugguguggguguccugccugucugccccagcccagauuccccugugucaucccauc

SEQ ID NO: 234891 - RNA, 64 nt, Human
gaucauuuaaauaauuucuaaaagggucuuuucaagcucuaacaaagucacuaacaaaugcauu

SEQ ID NO: 234892 - RNA, 61 nt, Human
acgaucucuuuguauuuuaaucuuguggaugagcucuaaguacaugcccaguggauacucc

SEQ ID NO: 234893 - RNA, 53 nt, Human
caaaaaaagaagagugcuaggacagcucuaaacagugagcucgaugugcaaaa

SEQ ID NO: 234894 - RNA, 64 nt, Human
cucuuaugcugucccuuuguagucagcuccuucuagcucuaauccuggcaacaguucuccguca

SEQ ID NO: 234895 - RNA, 64 nt, Human
auaggaucuggugcuguauauacgaaucuugcaaagcucuaacugaacggaccuucuuauuccu

SEQ ID NO: 234896 - RNA, 64 nt, Human
cuuuaagacaaacaaacaaacacacacacaaacaagcucuaagcugcuguagccugaagaagac

SEQ ID NO: 234897 - RNA, 64 nt, Human
guaaugaaugugggaaaaccuuucaucagaagucagcucuaauuguucaccacagaacucauau

SEQ ID NO: 234898 - RNA, 64 nt, Human
cgacuuuccauuuaaauacauacucuaggaaauuagcucuaaguuuuucccuucauuuuggguu

SEQ ID NO: 234899 - RNA, 64 nt, Human
ugauaccuuuguauguaugagacacauuccaaagagcucuaacuaugauagguccugauuacua

SEQ ID NO: 234900 - RNA, 64 nt, Human
uagagcuguuuucaacccaaaaauaagaaaaaauagcucuaaauaucuaaaaggaaaagguuau

SEQ ID NO: 234901 - RNA, 64 nt, Human
aauuggccuggagcgaggacagcugccaugagucagcucuaauaaguuaaacggcauuguagua

SEQ ID NO: 234902 - RNA, 64 nt, Human
uauauucacauaaaaucagcauucauugacacauagcucuaaugacauauguaugaaaaaccau

SEQ ID NO: 234903 - RNA, 64 nt, Human
aaaaauaugcauuugcuuaguuuauuugaauaaaagcucuaaaccuagguuauauauuagccau

SEQ ID NO: 234904 - RNA, 64 nt, Human
accaaagccagaaagugcaagcacccgucuacccagcucuaacuuguaugugugagacagacca

SEQ ID NO: 234905 - RNA, 60 nt, Human
ccucuguucccacccuccccugaacagaacccagcccauaagagacauucucagaugaaa

SEQ ID NO: 234906 - RNA, 60 nt, Human
ggacccugucccaacaccaacaccuccucuccagcccaaucuucuggguccagaccugcu

SEQ ID NO: 234907 - RNA, 60 nt, Human
ggucuaggccgugugguacccagaagugucccagcccaccacaccguuuaccucccucgc

SEQ ID NO: 234908 - RNA, 64 nt, Human
aacacgugacacaaacacacacaaaagggaacccagcucuaauacauuccaacucguauagcau

SEQ ID NO: 234909 - RNA, 64 nt, Human
auauucuguuuaguagaaaaauccuuuagaguucagcucuaaccagaaaucuugcugaaguaug

SEQ ID NO: 234910 - RNA, 64 nt, Human
uuacuuuguuuuuguauaaguauguauaggauugagcucuaaaaccaaaccauuauaaugauaa

SEQ ID NO: 234911 - RNA, 64 nt, Human
gcacauucuuagaguuaccacaccccaugagggaagcucuaaauagccaacacccaucuguuuu

SEQ ID NO: 234912 - RNA, 64 nt, Human
augggggcuuucggggagggcgccuaguccccccagcucuaagcagccaggagggaccugcauc

SEQ ID NO: 234913 - RNA, 64 nt, Human
cuuggaguggcagucguccaaaccccaggaagagagcucuaaagauggggcuucggggguagga

SEQ ID NO: 234914 - RNA, 64 nt, Human
gagcccucccccuuggacuagagcggcugggcagagcucuaaacaggggcaggggcuccucugc

SEQ ID NO: 234915 - RNA, 64 nt, Human
augaaggcaggagacccagaaagcagugcagugcagcucuaauaaaggccuuauuuuucuuaug

SEQ ID NO: 234916 - RNA, 64 nt, Human
auuuuauuuugcauauauuaaauugaguagguucagcucuaacauaccuuaagaaaaaugcaua

SEQ ID NO: 234917 - RNA, 64 nt, Human
gcuuaaaaagguguuuugucuggaacuuagaagcagcucuaaaucuaguagagcagacuuucua

SEQ ID NO: 234918 - RNA, 64 nt, Human
accuugggauagaugauccacugaaaucuuuuccagcucuaagauuuuaaauuguccuuuuaga

SEQ ID NO: 234919 - RNA, 64 nt, Human
guucuuggaaaaauggauccccagugaaaacuagagcucuaagcccauucagcccauuucacac

SEQ ID NO: 234920 - RNA, 64 nt, Human
agccuauccaauaaguaaguuuauuuccaacauuagcucuaauuaguucauuuccaaucccaga

SEQ ID NO: 234921 - RNA, 64 nt, Human
aaucucaaauauauaaggugucugcucuuuuaaaagcucuaagcuaagucaagagcuaggaacu

SEQ ID NO: 234922 - RNA, 60 nt, Human
ugugggcaggagggguggugaaggccucccccagcccagacccuguggucccuccugcag

SEQ ID NO: 234923 - RNA, 60 nt, Human
ucuucucacucuuacuucuagaaaaaagauccagcccaggcacggaaugggagggcccug

SEQ ID NO: 234924 - RNA, 60 nt, Human
acccaccaggccugagggggccgagcagggccagcccagugacuggugucccuugauucc

SEQ ID NO: 234925 - RNA, 64 nt, Human
aggaguaaagauaaaaggauaggaaaagauucaaagcucuaauagagucacagcuuucccaggu

SEQ ID NO: 234926 - RNA, 64 nt, Human
ugugccaguauuuuuuuucuuaaaaaucgucuuaagcucuaagguggucucaguauugcaauau

SEQ ID NO: 234927 - RNA, 64 nt, Human
uugcuugagaggcaguguggcuucugugacugccagcucuaaaucucgaucuugccauaacuuu

SEQ ID NO: 234928 - RNA, 64 nt, Human
gacauuuugcaaacaaauaaauuguaaucaaaagagcucuaaauuuguaauuucuuucuccuuu

SEQ ID NO: 234929 - RNA, 64 nt, Human
uuacuuguaugcuugugugacuuacuguuaguccagcucuaaaaauuuaaagguuguaauugaa

SEQ ID NO: 234930 - RNA, 64 nt, Human
guauuuggacuuugguacugcugucuuccaagguagcucuaaguuuugaugugugggcuucuga

SEQ ID NO: 234931 - RNA, 64 nt, Human
aaacuggacaguagacaucaugaucccuccaguuagcucuaauuacagaccccaccaguacagc

SEQ ID NO: 234932 - RNA, 64 nt, Human
uauucaggacuaagucccuuacugcaaauguguuagcucuaacaucucccacaagcuagaggaa

SEQ ID NO: 234933 - RNA, 64 nt, Human
guagggaagagguggccaagccaaccgugggguuagcucuaauuauuaagauaugcauuauaaa

SEQ ID NO: 234934 - RNA, 64 nt, Human
cagucuucucagaugaggcugcgccccugcgggcagcucuaaggaccguccugcgagaucgccu

SEQ ID NO: 234935 - RNA, 64 nt, Human
uacaaaugccgugacauuggaacaaggucaucauagcucuaacuuuaauauaccaauaaaauaa

SEQ ID NO: 234936 - RNA, 64 nt, Human
uucaaauuccaugacauuggaaaaaggucaucauagcucuaacuucaauauaccaauaaaauaa

SEQ ID NO: 234937 - RNA, 64 nt, Human
aaauuauaaauaccuauaaaauauaaaguaacauagcucuaaaaggcuuaaaaucaaacacagg

SEQ ID NO: 234938 - RNA, 64 nt, Human
aagauuucauaauugagagaauuccugaguugauagcucuaaaggcagauaugcuguauuugcc

SEQ ID NO: 234939 - RNA, 63 nt, Human
gcugcgggagagcccgcgucccacucccgugcucgccucgaccccgcgccgggcaccuguggc

SEQ ID NO: 234940 - RNA, 60 nt, Human
auggcugggacggggccuugcucuugucggccagcccacuccccagccagagagggcuug

SEQ ID NO: 234941 - RNA, 60 nt, Human
accaagugcccaggagaccccuggcucagaccagcccaaggccuugcccaguggcagggg

SEQ ID NO: 234942 - RNA, 64 nt, Human
cccccagccauuccuucuuuccuuccugccuuuuagcucuaaccacauuaagcuaagacaaggc

SEQ ID NO: 234943 - RNA, 64 nt, Human
acaaacaugaguagucugcauaucgaauaucuagagcucuaaacccccaauacuuaaaagucua

SEQ ID NO: 234944 - RNA, 64 nt, Human
auggaacucaagguggagcucagccuuuccaaugagcucuaagcauguagauagccugagcugu

SEQ ID NO: 234945 - RNA, 64 nt, Human
aaaagaaacauauuccaagggcagguucgauucuagcucuaauuacugucaugucauuuaccca

SEQ ID NO: 234946 - RNA, 64 nt, Human
uuucuuucacaacuguguaaguuuaaagagcuaaagcucuaaaacuguucugagaaacaaugaa

SEQ ID NO: 234947 - RNA, 64 nt, Human
uugaauauuucucccaacuuauccaaggaucuccagcucuaacaaaaugguuuauuuuuauuua

SEQ ID NO: 234948 - RNA, 64 nt, Human
gaguugagugccaucuuugaaaaaauuacccucuagcucuaacacugaaaauaauaauaaauug

SEQ ID NO: 234949 - RNA, 64 nt, Human
uuuccaacaucuaggaaacugaguuuuauuuccuagcucuaaggcagccuuacuauaugucagu

SEQ ID NO: 234950 - RNA, 64 nt, Human
auuaaacuaauuaauagcuuuggacacuuaaaagagcucuaaauuugcuuguacauaaaggcuu

SEQ ID NO: 234951 - RNA, 64 nt, Human
agucucucucacccuucuaggcagugcaucagucagcucuaaaucuggugcagaggguuaacag

SEQ ID NO: 234952 - RNA, 64 nt, Human
aauuaguggauauugauugaaauagcagugcuucagcucuaaggauauuagcaacaaugauaaa

SEQ ID NO: 234953 - RNA, 64 nt, Human
gucugaggaugugcgcaaauucugguucuucccaagcucuaaccguaacacgucccacccccuu

SEQ ID NO: 234954 - RNA, 64 nt, Human
aaucugauagguuuuccagaaaugaacaaaaaucagcucuaaaaccaaagcugauuuuuagaaa

SEQ ID NO: 234955 - RNA, 64 nt, Human; identical to SEQ ID NO: 234954

SEQ ID NO: 234956 - RNA, 60 nt, Human
agugagagggagggccucagucuuccgcccccagcccacucucaugguccacacugcugg

SEQ ID NO: 234957 - RNA, 60 nt, Human
gaggaggccagguccugguggagccuuugcccagcccaguccucucugccuccuccuggc

SEQ ID NO: 234958 - RNA, 60 nt, Human
ccccuguacaguccugccccccagcacccuccagcccacaaacagggcccuaagcacuuc

SEQ ID NO: 234959 - RNA, 64 nt, Human
ccauccgacaccugaaucauuccauguaaaacagagcucuaagaugauccuuuaagcaagcagu

SEQ ID NO: 234960 - RNA, 64 nt, Human
uaauuugacaguugaguaucagcauaauuuguuuagcucuaaggcaaaaguuugcuugcuugcc

SEQ ID NO: 234961 - RNA, 64 nt, Human
cauuuuuuacuuaaugcagcuguuaaauuggcaaagcucuaaaaugcacugcugccaucuagug

SEQ ID NO: 234962 - RNA, 64 nt, Human
cacuuuccucagcgggucuccaguccccugacccagcucuaaaggcacuuaggacccagggaac

SEQ ID NO: 234963 - RNA, 64 nt, Human
uuguggacugaauugcgucaaauucauauguuggagcucuaaccccuaaugugacuguaauugg

SEQ ID NO: 234964 - RNA, 64 nt, Human
cuagcaucucugccucaugucuugaaucugcuugagcucuaagaugaaccuggggacaaaguga

SEQ ID NO: 234965 - RNA, 64 nt, Human
uggcagaugggggcaucacuugcuuccuuugggaagcucuaagguugcugcagucaccuuccuc

SEQ ID NO: 234966 - RNA, 64 nt, Human
caguuaguauagcuuuauacucucuccacuuuauagcucuaauaaguuuguguuagaaaaguuu

SEQ ID NO: 234967 - RNA, 64 nt, Human
gaauccgcugacugaaggccucuuguugagugccagcucuaaacaagucccuuuaugcagagcc

SEQ ID NO: 234968 - RNA, 64 nt, Human
uuaaaaagcuguuuccaagugggacagcuaaugaagcucuaauuauugcagacauauuuuugag

SEQ ID NO: 234969 - RNA, 64 nt, Human
auaaaauucggcgcuauugcccccguagcucuggagcucuaaaccgucuaucugcuucugugcu

SEQ ID NO: 234970 - RNA, 64 nt, Human
caaggguaucuaucccaguaccaaauggugcuucagcucuaacauggaggucagagaaagggac

SEQ ID NO: 234971 - RNA, 64 nt, Human
ggcccuuuuuccaccaugggaauuucucaccucuagcucuaagggcagcugaccaccugccagc

SEQ ID NO: 234972 - RNA, 52 nt, Human
gcaaaaaacaaaaacucugaaaagcucuaaccccauguuauggacaaacacu

SEQ ID NO: 234973 - RNA, 60 nt, Human
aaggaugaccgccuuguacuccagguggaaccagcccagcuuaauuuguacuccuccaag

SEQ ID NO: 234974 - RNA, 60 nt, Human
acaugccaggggccuuugggugcuguuuugccagcccauuugggcagagaggcugugguu

SEQ ID NO: 234975 - RNA, 60 nt, Human
gugcggaaaggaggcuccgugagaugggguccagcccaucccaacacaagggugcagcuu

SEQ ID NO: 234976 - RNA, 64 nt, Human
cccuuccaugcccuaacuuuuaauaugcuuguucagcucuaauaaaguaauaaagcuugguugu

SEQ ID NO: 234977 - RNA, 64 nt, Human
ccaaggaccuuacaggcccucccuguuaauaaacagcucuaacacggccaggcugggcucuggg

SEQ ID NO: 234978 - RNA, 64 nt, Human
gguuguugggaacagcacagaauuuggagucuuaagcucuaaauuagaggcccugacccaucau

SEQ ID NO: 234979 - RNA, 64 nt, Human
aaaugucauuuuacaaauuaugugauuaucuggaagcucuaagaugagagcaaaugccugauca

SEQ ID NO: 234980 - RNA, 64 nt, Human
cuucucucuuaagacucugagauucacaaucagcagcucuaaaaaauaaaggagcaguuuggcu

SEQ ID NO: 234981 - RNA, 64 nt, Human
uucugggugggaguggggagggcgaggggccuagagcucuaauuguuuguuuuggaagaaaaaa

SEQ ID NO: 234982 - RNA, 64 nt, Human
ugcgcugcuauagcucuugcugccucucuugaauagcucuaacuccaaaccucuguccacaccu

SEQ ID NO: 234983 - RNA, 64 nt, Human
cccuugcucauauaacuuuaaaaauaauacuuuuagcucuaauagcucaagaacacaauauucg

SEQ ID NO: 234984 - RNA, 64 nt, Human
ggcagaguaucaaaagggggaaaaugacaaagugagcucuaagaaaaugugaggcuacuucuaa

SEQ ID NO: 234985 - RNA, 64 nt, Human
auuaaaauguuuuuuaaacaaaaauauuguccgaagcucuaaauaccagaguauugauuuuaaa

SEQ ID NO: 234986 - RNA, 64 nt, Human
acucaguucaaccaauccgcugccuucuguucugagcucuaaagcugcuaauucucccagucug

SEQ ID NO: 234987 - RNA, 64 nt, Human
ugggauuuacuaguagccaaaaggaaugaaagagagcucuaaccagauggaacacuggaacauu

SEQ ID NO: 234988 - RNA, 64 nt, Human
gccaacauuuaaugagcaccuacuuuauguauggagcucuaacccauggguccaugggaauaaa

SEQ ID NO: 234989 - RNA, 64 nt, Human
cagcccagacccagggacccuuggccccaagcucagcucuaagaaccgccccaaccccuccagc

SEQ ID NO: 234990 - RNA, 63 nt, Human
ggcagcugguuuuggcauccccagcaucaccacucucccaacccaucaccgugacugcaguuc

SEQ ID NO: 234991 - RNA, 63 nt, Human
gcccaggcuucccuaagaucugcuuuuucuauuucucccaaccaaauccucuuaaagacccuu

SEQ ID NO: 234992 - RNA, 63 nt, Human
gucauguggucagaucugucuuagucuuuugugucucccaaggugauguuuuugugguuuuuc

SEQ ID NO: 234993 - RNA, 63 nt, Human
aagaagaacugauuggggcuuccacagcccuccucucccaagaaauccaggcuccucucccaa

SEQ ID NO: 234994 - RNA, 64 nt, Human
gcagggcuguaguuggugacuggguguucauuuuagcucuaagaaaaaaaaucaguguuucgug

SEQ ID NO: 234995 - RNA, 64 nt, Human
uuauagggaaggacgcaggcauuccuagguccccagcucuaauuccauccaucuacccaacugu

SEQ ID NO: 234996 - RNA, 64 nt, Human
uuucucucucucucccacuuuugucccccagccaagcucuaaagcacauguagccgcugagacc

SEQ ID NO: 234997 - RNA, 64 nt, Human
uccuucuauuaagggauuggcucgcugaguucuaagcucuaaaugggucaacuccuuuguuuuc

SEQ ID NO: 234998 - RNA, 64 nt, Human
agaggaggauugaauagaaggagacuaagacugcagcucuaagaaagucucagccaaacagaug

SEQ ID NO: 234999 - RNA, 64 nt, Human
cuuauuuucuuuuuuuucccuccccaggucuaguagcucuaacuaaaaaguucuuggagccauc

SEQ ID NO: 235000 - RNA, 64 nt, Human
uggagaucuaaaggcagugauugauuucacagggagcucuaaucucugugauuacaugguccuu

SEQ ID NO: 235001 - RNA, 64 nt, Human
aagaaaaguuagggcacuccacuuaugauaauccagcucuaagaauaauuuuacuuaugauuua

SEQ ID NO: 235002 - RNA, 64 nt, Human
cugaguaaaauaacaauaugaaauaauaaacagaagcucuaacgucagguaacaaauagacagc

SEQ ID NO: 235003 - RNA, 64 nt, Human
acaugguuuuuacauuuuucucuaucguguuaaaagcucuaauaaugcuaguggagcaguugac

SEQ ID NO: 235004 - RNA, 64 nt, Human
caaaugguuuuaauagcuaaaaaacuacaaauuaagcucuaaaacaaacaaacuacagaaaugu

SEQ ID NO: 235005 - RNA, 64 nt, Human
gaaaagauauuggaugcuccuuguauucugugaaagcucuaaguauggguuuguagguguaaga

SEQ ID NO: 235006 - RNA, 64 nt, Human
cuuuuuccuucauaauuuucaaaagaaaacccaaagcucuaagguaacaaauuaccaaauuaca

SEQ ID NO: 235007 - RNA, 64 nt, Human
ucuauaauaagagcucaauaacuuugucaaggaaagcucuaauauaugcagugaugguuuauga

SEQ ID NO: 235008 - RNA, 63 nt, Human
aacauugcccaucugucuugcucacucuuaaacucucccaagaacaaggccgggguaagguaa

SEQ ID NO: 235009 - RNA, 63 nt, Human
guucuaguucuagucuguugaucugccuuuuguucucccaaaauguacaguaauuccauuugu

SEQ ID NO: 235010 - RNA, 63 nt, Human
caugguaagauaaugaaguucuaaugaacuauuucucccaagguuuuaaaauugucaagaguu

SEQ ID NO: 235011 - RNA, 63 nt, Human
aacuccugaccgcaagugauccacacgccuuggucucccaaagugcugggauuacgguguuag

SEQ ID NO: 235012 - RNA, 64 nt, Human
gaguugcgggcagccuggagacucguggacuuaccgccuggaggcaggcccgggaaggcugcug

SEQ ID NO: 235013 - RNA, 64 nt, Human
aagaauaaaacugugggccgggcgcgguggcucacgccuggaaucccagcacuuugggaagccg

SEQ ID NO: 235014 - RNA, 64 nt, Human
cugcugcuccucuaggccucacucaacaaccaagcgccuggaggacgggacagauggacagaca

SEQ ID NO: 235015 - RNA, 64 nt, Human
uguggaccugauucuggccacaccccccuucagccgccuggagaaguuguauagcacuauggug

SEQ ID NO: 235016 - RNA, 64 nt, Human
gaguuaugaggugccuuucccggaacccuccucucgccuggacccaagagaggcgacagcugug

SEQ ID NO: 235017 - RNA, 64 nt, Human
aucgccuugugcuuuggucucuuuuucucccccccgccuggauccugccucgcgcgggccgucc

SEQ ID NO: 235018 - RNA, 59 nt, Human
gcaaggccgccaggcacugagcuggagcccgccuggagagacagacacgugugaguggu

SEQ ID NO: 235019 - RNA, 64 nt, Human
ccccucuagaaagcagaaauauuuuuaccggggucgccuggauugggaugagaacacaucagcu

SEQ ID NO: 235020 - RNA, 64 nt, Human
uaaagccacaguugagaggccacccauugcccggcgccuggacagugaucaucuuguucaucuu

SEQ ID NO: 235021 - RNA, 64 nt, Human
ugcgugucagcacauacagccgcuuccuggaagccgccuggaaugucuucacggcagcguuuug

SEQ ID NO: 235022 - RNA, 64 nt, Human
ugauuuucucauuucgggaggaacucuguugcuucgccuggacaagaaggaaaaugcugauuuc

SEQ ID NO: 235023 - RNA, 64 nt, Human
gaaaggaaacuucacacgucaaaauccauagaagcgccuggacgaggcuuaaagugcuuuguga

SEQ ID NO: 235024 - RNA, 64 nt, Human
gagcaacaugacagccaucacuauggccugggcccgccuggaccacaaguuugaccugauguau

SEQ ID NO: 235025 - RNA, 63 nt, Human
cacuagaacaaggucgcuucucuuuuccucuucucucccaaccuguuaaccuagugcuagaua

SEQ ID NO: 235026 - RNA, 63 nt, Human
uuaaauauuugguuucaaaaggcagauuuaucuucucccaacauucuguuauuucugauacuu

SEQ ID NO: 235027 - RNA, 63 nt, Human
aacuccugaccucaagugauccacccaccuuggucucccaaagugcugggauuacaugcguga

SEQ ID NO: 235028 - RNA, 63 nt, Human
uuguuggggaaggagggagcugaggagggggcaucucccaacuucucccuuuuggacccugcc

SEQ ID NO: 235029 - RNA, 64 nt, Human
accugugggacuugaggacucgggaucuucaggacgccuggagaagggugguuuccugccaccc

SEQ ID NO: 235030 - RNA, 50 nt, Human
ccagccagcugcagcagugacgccuggaaggacaucuggugguccuuagg

SEQ ID NO: 235031 - RNA, 64 nt, Human
accaaagacacaggcagaccaaguccccaggccccgccuggaaggaagucguuccucaacucuc

SEQ ID NO: 235032 - RNA, 64 nt, Human
cacagagcaguggccaggccacccaaaggagcuccgccuggacuuuggcucagcggugccacug

SEQ ID NO: 235033 - RNA, 64 nt, Human
ccuucgccugaauaacuccagccccugugacauccgccuggauugggagaccuauguuccagaa

SEQ ID NO: 235034 - RNA, 64 nt, Human
ggagccccauggacacacagauggcccggcuagccgccuggacugcaggggggcggcagcagcg

SEQ ID NO: 235035 - RNA, 64 nt, Human
gcacauagccaaccaaugugagguuggcggacugcgccuggaggcggccggggccgagggggug

SEQ ID NO: 235036 - RNA, 64 nt, Human
uggagacccaccccaccugcagggcugcccugagcgccuggauuucugguucugaugccaauac

SEQ ID NO: 235037 - RNA, 64 nt, Human
guuagaagaaaauuaauguucugacaguugugaucgccuggaguacuuuuagacuuuuagcauu

SEQ ID NO: 235038 - RNA, 64 nt, Human
caucagcaaucugcugaagaaagauaugaaaaaccgccuggacugcacgcagugccuucagcau

SEQ ID NO: 235039 - RNA, 64 nt, Human
cagcaagcugucugcggcucaucggaggccccuccgccuggagccuucuauggacgugauaugc

SEQ ID NO: 235040 - RNA, 64 nt, Human
gagaacacuuggacacagggcggggaacgucacacgccuggacugucgggggguggggggcugg

SEQ ID NO: 235041 - RNA, 64 nt, Human
acgugggcugugcuacauacaggcccccacagcccgccuggauguucggggacccccacaucac

SEQ ID NO: 235042 - RNA, 64 nt, Human
gaggggcuaccuggucccuuucacagccaggacacgccuggaugagaaagccugaggugccugg

SEQ ID NO: 235043 - RNA, 64 nt, Human
cagcccucucacuacagccaggagaggccuuucccgccuggaaacuuccggacaagccucucac

SEQ ID NO: 235044 - RNA, 64 nt, Human
agccccucacaccacagccaggagaggccuuucccgccuggagagaagcuucaggccagcuccu

SEQ ID NO: 235045 - RNA, 63 nt, Human
uuagcuaugcccacagaucacugagagggaccaucucccaaguggugcaguuuagaacuucuc

SEQ ID NO: 235046 - RNA, 63 nt, Human
uggaagcagauagccaugcagguagaauugucaucucccaaguggccacauacagcaacccac

SEQ ID NO: 235047 - RNA, 63 nt, Human
aaagaaagaccuucagcuguauuuccacagauuucucccaaggaaaaggcuaauauuagucac

SEQ ID NO: 235048 - RNA, 64 nt, Human
aguccaaacccgcccaagacugcagcccaaucaacgccuggagccucauucuguuuccagcuuu

SEQ ID NO: 235049 - RNA, 64 nt, Human
cgcucugaagcaggagauucacgagcugcgagggcgccuggagcggcuggagcaggugagccaa

SEQ ID NO: 235050 - RNA, 64 nt, Human
ccucccugugcucucuggcucuggacugugacugcgccuggauucugccauugcgacacauuuu

SEQ ID NO: 235051 - RNA, 64 nt, Human
agaccgucgucgcuggagggggcaggguccagcccgccuggaucgguggugugcaccugauggg

SEQ ID NO: 235052 - RNA, 64 nt, Human
cccugacuacugggcuuccucuaucagcuuuuaacgccuggaaguagcugagucuccagucacu

SEQ ID NO: 235053 - RNA, 64 nt, Human
cucuggcuccagcauggggccuggccaggcuauucgccuggaagcucggcgaauucucaggaug

SEQ ID NO: 235054 - RNA, 64 nt, Human
cgcuuucucucccccagcuccagugauucacgcccgccuggagaagaaucagagcucagcucau

SEQ ID NO: 235055 - RNA, 64 nt, Human
cgagugcggcguggagacuggcaggcggggggggcgccuggagagcgaggaggcgcggccuccc

SEQ ID NO: 235056 - RNA, 64 nt, Human
gggauacacaagcccuuuaggaagcaguaccucucgccuggaggaucugugccaucuuggauug

SEQ ID NO: 235057 - RNA, 64 nt, Human
cuuugagcaacuaacuaaccacauuuuaggaucucgccuggaaacagagguaaaaaaaagaagu

SEQ ID NO: 235058 - RNA, 64 nt, Human
gcccuuuggacaucccauggacuugucacccagucgccuggaagucggggagcagcaccccugc

SEQ ID NO: 235059 - RNA, 64 nt, Human
agguggcucuucuaccaggcuuuuccuuugaugccgccuggauuuccgcaccugccugucuccu

SEQ ID NO: 235060 - RNA, 64 nt, Human
caggcguugguuccaagccgguucccgucccuggcgccuggagugcacacagcccagucggcac

SEQ ID NO: 235061 - RNA, 56 nt, Human
acauugcuagccugcccugaggaccccgccuggacuccccagccuucccaccccau

SEQ ID NO: 235062 - RNA, 64 nt, Human
guacagaguggcccucaccgaggaccggcugccccgccuggaggagauccgcaucuggggaccc

SEQ ID NO: 235063 - RNA, 64 nt, Human
aaggcauccagaagcuguaucagugcaaugggaucgccuggaaagccuggaguccccaaaccaa

SEQ ID NO: 235064 - RNA, 64 nt, Human
gcucuugcaaagacccgagauucucauaaauccccgcccagaagagcugcacguaucccuuuca

SEQ ID NO: 235065 - RNA, 63 nt, Human
ucucugcacccuuggcacgagggcagggcuggcucucccaaugccuccaucccauccccaugg

SEQ ID NO: 235066 - RNA, 63 nt, Human
gugagcaccugucucccacucaaaccucucccaucucccaacaacugcacuuuagaauaccag

SEQ ID NO: 235067 - RNA, 64 nt, Human
agcugugcgccaagcaggcgcucgccagccucggcgccuggacucgagccauugucgccuucua

SEQ ID NO: 235068 - RNA, 64 nt, Human
guggugccucgacacucacgaaccgccagcguggcgccuggaucuugcccagcugccagcuccc

SEQ ID NO: 235069 - RNA, 64 nt, Human
ucgucuacuccuuucuggguccuaacccuuuugucgccuggaugcacuuccuggucuuccucgu

SEQ ID NO: 235070 - RNA, 61 nt, Human
gaagguccuucuugcgcuaggucaagguccccgccuggagggggccaaacccccaguggcu

SEQ ID NO: 235071 - RNA, 64 nt, Human
augcucagcggccaggcacugaccugccaugccucgccuggaggcucagcugugggcaucccuc

SEQ ID NO: 235072 - RNA, 64 nt, Human
ccucgugcuccccgggacuguguggcuccggucucgccuggagccacuucagggcaccucagac

SEQ ID NO: 235073 - RNA, 64 nt, Human
cagguuccaagcccugcgucugacgaugcugcagcgccuggagcagcugguggaggccaaguaa

SEQ ID NO: 235074 - RNA, 64 nt, Human
ugaauccagcgcuggguaugcgaucucugccuaucgccuggauggcuuuaaauuagccacaaaa

SEQ ID NO: 235075 - RNA, 64 nt, Human
acugaugggcccacggaccccugggaagaggccccgccuggagcacuaggcccccacccugcug

SEQ ID NO: 235076 - RNA, 64 nt, Human
acacuguagccaggaaccugugcaugccacccaccgccuggacaggcagucauccugccucuga

SEQ ID NO: 235077 - RNA, 64 nt, Human
agaagacuaaggggacaggugaauaccugcuccucgccuggauggguguguauuuugaucugca

SEQ ID NO: 235078 - RNA, 64 nt, Human
aaaaugaagacaaaaauauggacugauguauccucgccuggacucagggcaggugccguggguu

SEQ ID NO: 235079 - RNA, 64 nt, Human
ggcucucccuucucugugacccggcaugacugggcgccuggagcaguuucacucugugaggagu

SEQ ID NO: 235080 - RNA, 64 nt, Human
agcccaccuugucucuuggaccuauuuucuaugucgccuggaggaguccggcacccccuccccg

SEQ ID NO: 235081 - RNA, 64 nt, Human
cccuccaugcugggccccagcccaggucugcacucgccuggaucaccuucuuugagccuuagcc

SEQ ID NO: 235082 - RNA, 64 nt, Human
ucagauuccaagacagaaggcuucacaaggccaacgccuggaaaaugggcaucucuccuuccca

SEQ ID NO: 235083 - RNA, 63 nt, Human
gauggucucgaucucuugaccucaugauccacccgccucgaccucccaaagugcugugauuac

SEQ ID NO: 235084 - RNA, 63 nt, Human
cccuccccaggguguuccucccugugacccagccgccucgacuucggcccgcuugcucacgaa

SEQ ID NO: 235085 - RNA, 63 nt, Human
cccaaggaagcugggcucagggcucgccucucccgccucgauccugcaccuuccucucccagg

SEQ ID NO: 235086 - RNA, 64 nt, Human
gaaacguguguuucccugaugcgggagguguccucgccuggacgcaggcacccagccgacugcc

SEQ ID NO: 235087 - RNA, 64 nt, Human
agcaugugaagagucaccagcagauuccugggcucgccuggagacauuccuagucgguauuccu

SEQ ID NO: 235088 - RNA, 64 nt, Human
gaaagucccgcgcgagcgccacggccuccgggcgcgccuggacucugccaauaaagcggaaagc

SEQ ID NO: 235089 - RNA, 58 nt, Human
ccccggggaacgccuccugagacuccagcgccuggaggaggcaggggcaggaagcggc

SEQ ID NO: 235090 - RNA, 64 nt, Human
ccaggaccugacagccccucccauccuggccacccgccuggaaguccccauccgucuccacucc

SEQ ID NO: 235091 - RNA, 64 nt, Human
cacccugguguagggcccgcaggaagagcagccacgccuggaccgcgccgcgccgcagccccac

SEQ ID NO: 235092 - RNA, 64 nt, Human
gacagcgcccucuggagcucgcugggagcaucaccgccuggacgcccgcgccgcggaggagccg

SEQ ID NO: 235093 - RNA, 64 nt, Human
gggcuuuccugagcuguggcccggcagggaagaucgccuggacguggagccagcaucgccccgu

SEQ ID NO: 235094 - RNA, 64 nt, Human
ccuccccaccgcccaccucggcugcuaggccccucgccuggacuggacuggggagggaaagcgc

SEQ ID NO: 235095 - RNA, 64 nt, Human
ugaugaugaccacuucuccauuggugugggcucccgccuggauggucuucgaaaccggggccca

SEQ ID NO: 235096 - RNA, 64 nt, Human
ccugcccugccuugcuuggcccauccaguccaggcgccuggagcaagugcucagcuacuucucc

SEQ ID NO: 235097 - RNA, 64 nt, Human
gccucagccuuuaucuccacucugcggagauucacgccuggaaaacgcucuucugagaggaucu

SEQ ID NO: 235098 - RNA, 64 nt, Human
guucacauuuucuccagccugagacgcagccucccgccuggaagggccugugccagcaccaggc

SEQ ID NO: 235099 - RNA, 64 nt, Human
ggcacuucgagaaggaaguggagaguaaagacagcgccuggagcgaucguagaaacacagaaug

SEQ ID NO: 235100 - RNA, 64 nt, Human
uucccuacuggugcccccuccuccccggccaaggcgccuggaccuggcgaggacgcugcccgcc

SEQ ID NO: 235101 - RNA, 64 nt, Human
gcaccccggacccugcccaccugucugccugccccgccuggagcccaggccaguguuguuucca

SEQ ID NO: 235102 - RNA, 63 nt, Human
cuuacagcacacuuaauguaccuuuucaguccuucucccaacccccugcaaauugucuuuaaa

SEQ ID NO: 235103 - RNA, 63 nt, Human
uauagauuugggguaaaaaguugucucaguuccucucccaauugcaaugagaaaaaaaagcuu

SEQ ID NO: 235104 - RNA, 63 nt, Human
auuuagcuagaccuuugcuuccuucuugccagcucucccaacauacccaauccuggugaucag

SEQ ID NO: 235105 - RNA, 64 nt, Human
cccggcccgcaucccgaggcgcccaagcuggagccgccuggagggcucggucggcgaccucuga

SEQ ID NO: 235106 - RNA, 64 nt, Human
ucacaggccuugcccucgagcauggcacccuggccgccuggacccagcacugugguuguugagc

SEQ ID NO: 235107 - RNA, 64 nt, Human
cugugagcauccuggcaggugccccaggaugccacgccuggaagggccggcuucugccuggggu

SEQ ID NO: 235108 - RNA, 64 nt, Human
cgcgcucugcgauuggagcagggccggagccgaacgccuggaacgcucuccguccgccucccug

SEQ ID NO: 235109 - RNA, 64 nt, Human
cuuccgguggagggaugccaguggcccucgcgagcgccuggacaucuaccagcccacggcgcgc

SEQ ID NO: 235110 - RNA, 64 nt, Human
gccuccuccagaccccccuccccgcugccugcaccgccuggagcagcaugggggucagaccccu

SEQ ID NO: 235111 - RNA, 64 nt, Human
ugugaagggggcugccaggacaucucagcacucccgccuggagcucucagcaucacugaaggua

SEQ ID NO: 235112 - RNA, 64 nt, Human
ccaggguuggcacauggaggguacaaggaggacucgccuggaguaucuuaaggaaccuaucgaa

SEQ ID NO: 235113 - RNA, 64 nt, Human
cuaccggcggagccaagcccuagagaagcugggccgccuggaccaggcuguccuugaccugcag

SEQ ID NO: 235114 - RNA, 64 nt, Human
ugccuucucauucucuuuccugaccccuuaggagcgccuggaagcagaaccaguagcuacaggc

SEQ ID NO: 235115 - RNA, 64 nt, Human
cugugggcacgcucucccaacuccgggagagccucgccuggaugcuggggcggggaaggcccag

SEQ ID NO: 235116 - RNA, 64 nt, Human
aguugacaucggcacucuggaccuggccagcagccgccuggacucagccauggcugugugcuuu

SEQ ID NO: 235117 - RNA, 64 nt, Human
cccaggagggagagcgcagcugcugcaggauucucgccuggaagaguggguggcuggcuggcug

SEQ ID NO: 235118 - RNA, 64 nt, Human
ugcccgaggagcugcuccaggagccugcgcggcucgccuggaaacgugccaggacacuguccug

SEQ ID NO: 235119 - RNA, 64 nt, Human
ccagaccgagcgugugccacuggaccucaguccucgccuggaggagacgcuggacuucggcgag

SEQ ID NO: 235120 - RNA, 64 nt, Human
uggacggaggguccccacagcccgugccccacgccgccuggaggccagaggggucaguggcccu

SEQ ID NO: 235121 - RNA, 63 nt, Human
uagucucaaacuccugaccucaagugaucugcccgccucgaccucucucaaagugcuggcauu

SEQ ID NO: 235122 - RNA, 63 nt, Human
gccugcaggugagcauggaggcccggcccucaccgccucgaagccaugccccagaugccacug

SEQ ID NO: 235123 - RNA, 63 nt, Human
uccaucaucuucuuccgagaugaccgcuacuggcgccucgaccaggccaaacugcaggcaacc

SEQ ID NO: 235124 - RNA, 64 nt, Human
ccaccucauggauugccacagcucaacucgggggcgccuggagggaugcccccaggcagccacc

SEQ ID NO: 235125 - RNA, 64 nt, Human
auuuuaauaguacauaauuuaauaccaaaaaaggcgccuggauccccaaaaaaccgaggcuggg

SEQ ID NO: 235126 - RNA, 64 nt, Human
uagccgaacucuuagcucugggcagaucuccaagcgccuggagugcuuuuuagcagagacaccu

SEQ ID NO: 235127 - RNA, 64 nt, Human
cuuaggugcgccguccuggggucgcugccgagagcgccuggacuucgacgucccaccagcgggc

SEQ ID NO: 235128 - RNA, 64 nt, Human
uugggggagcgugguggcagcgaugauggggagacgccuggaagcucacagaacuugggucugg

SEQ ID NO: 235129 - RNA, 64 nt, Human
cucgacgcacuugcucccggaggcugcgccccggcgccuggaacccgaggugggaggaccgguu

SEQ ID NO: 235130 - RNA, 64 nt, Human
gucgggggauuggguugugggcaguccccauggccgccuggagaagccgcuggggcccgggggu

SEQ ID NO: 235131 - RNA, 64 nt, Human
gcagcccgcuuaugcguaugugcacggggccgcccgccuggaccuggagaagggaccuacggac

SEQ ID NO: 235132 - RNA, 64 nt, Human
ccgcccgccuggaccuggagaagggaccuacggacgccuggaagcugcgacgcccugcacugcu

SEQ ID NO: 235133 - RNA, 64 nt, Human
guugggaaggaaagcaguggaacuggccggaccccgccuggagcagcguccugcgcccccuggu

SEQ ID NO: 235134 - RNA, 64 nt, Human
cugcugccuguaaauauuuguuuaauccccaguucgccuggagcccuccgccuucacauucccc

SEQ ID NO: 235135 - RNA, 64 nt, Human
ggaggcccuggagggcuggacgggcuuccugagucgccuggagaacuucacgggacugucgcug

SEQ ID NO: 235136 - RNA, 64 nt, Human
ggcuguggaacccgcugagcgcccgagccgggcccgccuggagcugcguuucgcggcggcggcg

SEQ ID NO: 235137 - RNA, 64 nt, Human
aagugcaaggaucaguagccaggaccagaguggccgccuggagguccccaucucacgugugaug

SEQ ID NO: 235138 - RNA, 64 nt, Human
ccuugggccucggagaugaucagaggugaagaaccgccuggaagaggaaggccaggguuuggcc

SEQ ID NO: 235139 - RNA, 64 nt, Human
caucugccccucacccacccgaggcucugcccaccgccuggaccugcccaccccugaaagacug

SEQ ID NO: 235140 - RNA, 63 nt, Human
uuuccauuuuuuaaguacuuauguggaagcuagucucccaaaacacaaucuuuagagagaaaa

SEQ ID NO: 235141 - RNA, 64 nt, Human
auguccaacccccgacuucaucccaaaggacagccgccuggagaugacuugaggccuuacuuaa

SEQ ID NO: 235142 - RNA, 64 nt, Human
gcugggcacccaacccuuuuccaccugugcuuaucgccuggaucuaucauuacugcaaaaaccu

SEQ ID NO: 235143 - RNA, 64 nt, Human
agcaugaaaauggugcccaugccugacgcuccagcgccuggaucugcacgugcccuuguagagg

SEQ ID NO: 235144 - RNA, 54 nt, Human
ucaugacugccuccaaguagccaccgccuggaugcggauggccggagaggaccg

SEQ ID NO: 235145 - RNA, 64 nt, Human
gggcugaggcaagguaggccaacugcaccccugucgccuggaggagggccagcucgcugcccga

SEQ ID NO: 235146 - RNA, 64 nt, Human
gcucgacccgcagcaggagcagcagcuguuccggcgccuggaagaggaguuccuggccaaugcc

SEQ ID NO: 235147 - RNA, 64 nt, Human
agugcuggagggagaagcugucagggacccagggcgccuggagaaagaggcccuguuacuauuc

SEQ ID NO: 235148 - RNA, 64 nt, Human
ggugcggaggagguacccccaccccuggcacagccgccuggaaugcaggacugucacugcuguu

SEQ ID NO: 235149 - RNA, 64 nt, Human
cagugccauccgggauuguuuccccaaguuguuacgccuggacggccgagaguuauccgcacca

SEQ ID NO: 235150 - RNA, 64 nt, Human
accccgccugcaccgcgcguccugcacucaaccccgccuggagcuccuuccgcggccaccgugc

SEQ ID NO: 235151 - RNA, 63 nt, Human
accucacucggccggcgcggcggccacuccccccgccucgacggcaccacuggccggccccgc

SEQ ID NO: 235152 - RNA, 63 nt, Human
cugcuacugggcuuuacauggugacagacauuuccgugggauagggaagauagcaggaagaaa

SEQ ID NO: 235153 - RNA, 63 nt, Human
gagacaauguugaggacucaaaugaaucaaaccccgugggaaugacagaagugaagaaucugg

SEQ ID NO: 235154 - RNA, 63 nt, Human
ccauuucucagugacagaagcauguuugagaugccgugggaaaccaaauauauaauaauaaaa

SEQ ID NO: 235155 - RNA, 64 nt, Human
acuugaggcccaaggagguggaguggagagugggcucggguacaugggagccagaagccagaug

SEQ ID NO: 235156 - RNA, 64 nt, Human
gucgaaaauuaaaccucuuuuauaauuacccagucucggguauuucuucauagcagugugagaa

SEQ ID NO: 235157 - RNA, 64 nt, Human
caagagcagagugaggaagacccccaagcauagacucggguacugugaugauggcugcagucca

SEQ ID NO: 235158 - RNA, 64 nt, Human
uguuagacuaggcgacucacauuugaggacuuuucucggguaucuugaggguuugugauccuga

SEQ ID NO: 235159 - RNA, 64 nt, Human
augcgacuccaugucaauggacuauuuuauucaacucggguauuuaugagugucuccucugugc

SEQ ID NO: 235160 - RNA, 64 nt, Human
ucuucagcugggaaaacuagcucuucagagaagccucggguaacacugaaaaacaaaacaaaac

SEQ ID NO: 235161 - RNA, 63 nt, Human
ucaccuucacccucaccuguguucucuucccucucucccaauaaaagggcucccauuauaaau

SEQ ID NO: 235162 - RNA, 63 nt, Human
ccucuuuauaaagcugggcuucuuucucaucucucucccaaauguuguaucucaguauucuuc

SEQ ID NO: 235163 - RNA, 63 nt, Human
agaaacugcagccccacuucuguuucccuggagucucccaauggaucauucaggaguguccua

SEQ ID NO: 235164 - RNA, 64 nt, Human
gguuuucauuuuaaucugcaaugucucauaaagacucggguaguuuuucuuugggggcauugau

SEQ ID NO: 235165 - RNA, 64 nt, Human
guuuacuggagagaaggaguuggauaagcacaggcucggguauuuugguagggacuguaggcau

SEQ ID NO: 235166 - RNA, 64 nt, Human
ccuacuggaaugugacugcccacugcccagcugccucggguacaaguccuggcccuauguccca

SEQ ID NO: 235167 - RNA, 64 nt, Human
gacaccugaguacacgaucacccacucuuaccugcucggguaccugcuuacucagauacuuaca

SEQ ID NO: 235168 - RNA, 64 nt, Human
acuccgaagcaguugcuauugguccaagaggaugcucggguagucuucgguggcugcaggagag

SEQ ID NO: 235169 - RNA, 64 nt, Human
uauuugagguggcucugauuuccuggcagcugaacucggguaguccaguggccuagcugguacc

SEQ ID NO: 235170 - RNA, 64 nt, Human
ccagagggaccaagcgcugagaccaaaguugacccucggguaggguuguccugccuggggcccc

SEQ ID NO: 235171 - RNA, 64 nt, Human
uggcuuauuuuaggaucuguuuuuucaucgaggucucggguauccuuucaaagauagugagaag

SEQ ID NO: 235172 - RNA, 64 nt, Human
guggaggggccaccccccaaagauacuggcauugcucggguaccacuugcuggagcugcuggag

SEQ ID NO: 235173 - RNA, 64 nt, Human
ugccuagaggacccucccccugccuugcagugggcucggguagagcaguaucaggagcuagggu

SEQ ID NO: 235174 - RNA, 64 nt, Human
uccuguaacuguccccgaggggauugagcagaagcucggguaugagcccugagguugacugccg

SEQ ID NO: 235175 - RNA, 64 nt, Human
caauuuagaaauuguugccuuuucuguaauuaaacucggguacaaauuggcauaacaugaaaac

SEQ ID NO: 235176 - RNA, 64 nt, Human
ggcugagugagggaaagcccagcacugcugcccucucggguaacucacccuaaggccucggccc

SEQ ID NO: 235177 - RNA, 63 nt, Human
cccaaaaggaacugaccagaggggucaggccgacgccucgagucagggccccagccacccaac

SEQ ID NO: 235178 - RNA, 63 nt, Human
guggcggaggcugcgguggcccagcgagacggccgccucgagagacggccggggaagaagcuc

SEQ ID NO: 235179 - RNA, 63 nt, Human
uggucucgaacuccugaccugaagugauccacccgccucgaccucccaaagugcugggaugac

SEQ ID NO: 235180 - RNA, 63 nt, Human
uggcaagaccccgaagacauuucacaucuuuaucgccucgaucaaguguggagucacaugcua

SEQ ID NO: 235181 - RNA, 64 nt, Human
uguggcagcagcaggcuccccagcggcccagggugggccagaccagcagcccaggaagcagcac

SEQ ID NO: 235182 - RNA, 64 nt, Human
cccacagcagagccaggugagggggcgccugccagggccagacccagguggggcagccugaacc

SEQ ID NO: 235183 - RNA, 64 nt, Human
ggugaguggcaucaaaugugugacuuacuaucuugggccagaacuaagaaugccaagguuuuau

SEQ ID NO: 235184 - RNA, 64 nt, Human
ggucagcacgugugcucgggacacagcggagucagggccagagcccuucccuccaggaacugau

SEQ ID NO: 235185 - RNA, 64 nt, Human
uccacuucucagcucuccccugcccugcagcccugggccagacaaggccagaagguuucagggg

SEQ ID NO: 235186 - RNA, 64 nt, Human
gcaugcuucccagagggagcaggccggaaccacagggccagagggagcuggaacccgaggggcc

SEQ ID NO: 235187 - RNA, 64 nt, Human
aggugggggauugagggagggacagaguguuggagggccagagacuaguccugagauggaaaca

SEQ ID NO: 235188 - RNA, 64 nt, Human
ggggcccuggccuggggcacccacugcacacucagggccagacccaccauccuggacuggcgag

SEQ ID NO: 235189 - RNA, 64 nt, Human
cucugcuucugcuuuccaaaguagcccagguccugggccagaugcaggggaggugccuauccau

SEQ ID NO: 235190 - RNA, 64 nt, Human
uuagcuuccacucccuuguguguauucuggcugggggccagauuggggaagcccuucuccccgg

SEQ ID NO: 235191 - RNA, 64 nt, Human
uauacugaauucccauucauguuagguaacuuaggggccagaaucuccaugcacuuuguagacc

SEQ ID NO: 235192 - RNA, 64 nt, Human
ugggccugguagcacaugucuguccucagagcaggggccagaugauuuuccucccugguuugca

SEQ ID NO: 235193 - RNA, 64 nt, Human
cggcuaagggcacgaagacgauaucugguagagagggccagagaugcccgcgugguagggcugc

SEQ ID NO: 235194 - RNA, 64 nt, Human
gaccaggguuucucaaacucguacuugacauuuggggccagauaauucuuuguuguggggcugu

SEQ ID NO: 235195 - RNA, 64 nt, Human
uugggggaggggacaggaucuaacaaugucacuugggccagaauggaccugcccuuucugcucc

SEQ ID NO: 235196 - RNA, 63 nt, Human
acuacagugauuuagaguuguuuugauuggguaccgugggagcagggaaauugguuuuuuaaa

SEQ ID NO: 235197 - RNA, 63 nt, Human
ccugcacucacaggcuacaguugaacagaacugccgugggaauuuuaucuuuuuuaggcuucu

SEQ ID NO: 235198 - RNA, 63 nt, Human
caaacauuuauugaacauccucugagcaccuggccgugggaaugccguggugaaugagagacu

SEQ ID NO: 235199 - RNA, 64 nt, Human
acuagaucaggaggucaguaaacuuucuguggaagggccagagaguaaauauuuuaggcuuugc

SEQ ID NO: 235200 - RNA, 64 nt, Human
caauugaaucagguaacacuaacggaucaaggcagggccagagggugguguggucucuauuuga

SEQ ID NO: 235201 - RNA, 64 nt, Human
gcuugcaaaggaggagaguuuaggauuagggccagggccagaaagucgguaucuugguugugcu

SEQ ID NO: 235202 - RNA, 64 nt, Human
cagcuacucugaucccucugggggcucuggccaagggccagacagaccuucacagaugccuacu

SEQ ID NO: 235203 - RNA, 60 nt, Human
gugccauggaguccucuuaaagagggacgagggccagacugaagcagcacaaggccgggg

SEQ ID NO: 235204 - RNA, 50 nt, Human
gcaugcagacucacguguaggggccagagccuggcuggggcaucucugcg

SEQ ID NO: 235205 - RNA, 64 nt, Human
caggcccucacuccccuuccccauguugucgauggggccagagaugaagggaaguggacuaaag

SEQ ID NO: 235206 - RNA, 64 nt, Human
gaccagcuuccuccagaccccuguggcagaccgggggccagacacagauacauggggaacugca

SEQ ID NO: 235207 - RNA, 64 nt, Human
caugugacacagggguguugugagagcugggauggggccagagauuauaaguuugacacaacau

SEQ ID NO: 235208 - RNA, 64 nt, Human
ugagaaccaagacagggccuggcuccaacucugugggccagaggugggggacugcuaggucgag

SEQ ID NO: 235209 - RNA, 64 nt, Human
acaccuuuugcuaacaccccuacuaggucccagagggccagaaacaccugacuuaccucugagu

SEQ ID NO: 235210 - RNA, 64 nt, Human
cccuuggaucaguaugggaaccccaaaucccacagggccagauguggagucugugucugccccc

SEQ ID NO: 235211 - RNA, 64 nt, Human
auuugagccucuccggcugccagccagggggccugggccagaccagggcucuguccuuccguga

SEQ ID NO: 235212 - RNA, 64 nt, Human
ggaugggagggucccuagccuucgggcaccuccagggccagagagcaggcucagagcagcuagu

SEQ ID NO: 235213 - RNA, 64 nt, Human
ggucucuguuuccauuacaaacuuuguucugucugggccagagaaccuagccuuugaaaucucu

SEQ ID NO: 235214 - RNA, 63 nt, Human
ugcgcuaaaaagaacucaaaaggagaacugugcucucccaaagccauaucaccagucuuacca

SEQ ID NO: 235215 - RNA, 63 nt, Human
uggccugaauuaagaccauuagaaagcaccaggccgugggagcagugaccaucugcugacugu

SEQ ID NO: 235216 - RNA, 63 nt, Human
uggguucaagugcacaugugagggaaccccaguccgugggaaggugggcugggcucccuaggu

SEQ ID NO: 235217 - RNA, 64 nt, Human
cggccaacuuggaguccuuucuguuuugaagcaugggccagacccggcacugcgcucggagagc

SEQ ID NO: 235218 - RNA, 64 nt, Human
ucauagcuucucugcuuggcaaagagaugggagggggccagauacugacuaccugggguaggca

SEQ ID NO: 235219 - RNA, 64 nt, Human
agucacuguuauggggugauaagaggacuucuuggggccagaacuguggaggagagcacauuug

SEQ ID NO: 235220 - RNA, 64 nt, Human
cucucucugcuccuccauucgcaagugucuuccugggccagacuccccuccaccucauguacuu

SEQ ID NO: 235221 - RNA, 64 nt, Human
uccccacaaagccguucgcagcuuccgggagaaggggccagagcccgguggggccaguuucuca

SEQ ID NO: 235222 - RNA, 64 nt, Human
gcagagccuuuucucugaauuccuuauguccggugggccagaagcccguccuccuaugcuggug

SEQ ID NO: 235223 - RNA, 64 nt, Human
ugccaucacauggaggacgaggcccagcucagcugggccagagcccagaagugccaccucauca

SEQ ID NO: 235224 - RNA, 64 nt, Human
gaagaagugugaaugugaaggcggcgucggcgcggggccagagcaccacucugcugccccacca

SEQ ID NO: 235225 - RNA, 64 nt, Human
uccuccugauggccaagagcaucgugacccuucagggccagaaggagggcagagccaugggccu

SEQ ID NO: 235226 - RNA, 64 nt, Human
uggucucauaauuccauuuguggagagaacaggagggccagauagauagguccuagcagaaggc

SEQ ID NO: 235227 - RNA, 64 nt, Human
gcacugaaagggcagaguaggccgaaggguccaagggccagacugccucacccucugcccuaau

SEQ ID NO: 235228 - RNA, 64 nt, Human
ccuccaccuggcuggagagauggcacaucauucagggccagaagguuguccagcaguguuucug

SEQ ID NO: 235229 - RNA, 64 nt, Human
gcagagucugaauagucuucagagauaggccugugggccagauugccauccccuauggaccaga

SEQ ID NO: 235230 - RNA, 64 nt, Human
cguggacauagcccugugauacugcaucucacuggggccagaggaagggagggagggugggggg

SEQ ID NO: 235231 - RNA, 64 nt, Human
ucaaggucuccgccuuguaaaaccacuggacagagggccagaguggguaguggggaaugaaggg

SEQ ID NO: 235232 - RNA, 64 nt, Human
agcacgccugccggcuucucaucgucagggagcccgcccagagcucgugacgagcaagugcugg

SEQ ID NO: 235233 - RNA, 64 nt, Human
uuucuuuuuuuauagagaugagauuuuacuaugucgcccagacuggucucaaacuccuggccuc

SEQ ID NO: 235234 - RNA, 64 nt, Human
ccauggaagcuacuccaaguugcauugccucccgcgcccagauccugcuuuccauuucgagaac

SEQ ID NO: 235235 - RNA, 64 nt, Human
uguuuuuuuuuuuuuaagguuugcaaauuaaaaagggccagaaaaauuuggcaccaggcaaacg

SEQ ID NO: 235236 - RNA, 64 nt, Human
gaauuaaagacaccagaaguagcagagaagcagggggccagagcuacaacaguauucuucucug

SEQ ID NO: 235237 - RNA, 64 nt, Human
ggaccaaggcuaaccuuucuaagcucccuaacuugggccagaaaccaaagcugagcuuuuaacu

SEQ ID NO: 235238 - RNA, 64 nt, Human
ggguggggggaacaacuggcuauucaguaccaaggggccagaguggaggguaggagugccacuc

SEQ ID NO: 235239 - RNA, 64 nt, Human
gugccgcaccauugaacuguaccaugugcuacaggggccagaagaugaacagacugaccuugau

SEQ ID NO: 235240 - RNA, 64 nt, Human
auuaagaaacguaaugacauaaaagguuagcucugggccagacuucucuuacucuguggguaau

SEQ ID NO: 235241 - RNA, 64 nt, Human
cuaggacuacuuuuuaccaaaagagaagcagucugggccagaugcccugccaggaaagggacau

SEQ ID NO: 235242 - RNA, 64 nt, Human
acagcuccuucccuacucauucccugcccaaguggggccagaccucuuuacacacacauucccg

SEQ ID NO: 235243 - RNA, 64 nt, Human
aggguggugaugggugagcgcucuggcccaggcugggccagacucccgcccaagcaugaacagg

SEQ ID NO: 235244 - RNA, 64 nt, Human
uacauagcagggagugaucggggugaaauaacuugggccagaauauuauuaaacaaucaucagg

SEQ ID NO: 235245 - RNA, 64 nt, Human
aggcuucuucuuucauguaguuccucauaagcaggggccagaauaucucagccaccugcaguga

SEQ ID NO: 235246 - RNA, 64 nt, Human
uaguaucuguucucucugagccuggaugggcuuggggccagaccuuugccugauuccugauucc

SEQ ID NO: 235247 - RNA, 64 nt, Human
acaggccuccuuguugggagcacagaagugcuaugggccagaagccccucccuucaaggaucuc

SEQ ID NO: 235248 - RNA, 64 nt, Human
gcugcuagucuccaauugccaagggaauuuaacugggccagacuaccuuuuuauacuaggucug

SEQ ID NO: 235249 - RNA, 64 nt, Human
caucaccaccacaccccugccggccuuggccuuggggccagacuggcugcacagcccaaccagg

SEQ ID NO: 235250 - RNA, 63 nt, Human
agggauggagagaauaggaaucuucacuagaagccgugggaagaauuggaaguuacaugcugu

SEQ ID NO: 235251 - RNA, 63 nt, Human
gggcuuggcuuugucuucguucccgguggaaaaccgugggagaggaagcuugggccucuacuc

SEQ ID NO: 235252 - RNA, 63 nt, Human
uuguucauugggagggugaggguuccgguucggccgugggagggcuuccuucccugggguuuu

SEQ ID NO: 235253 - RNA, 64 nt, Human
gacucuggucauagaaacaauaaaugaguuagaagggccagauuucauucucagucccagagca

SEQ ID NO: 235254 - RNA, 50 nt, Human
uugaguauauugaugauuaagggccagaggaucucacuugcuuaucugaa

SEQ ID NO: 235255 - RNA, 64 nt, Human
caguguccaagccccuccaggaggguccuggggugggccagaugccugcccaccucugucuccu

SEQ ID NO: 235256 - RNA, 64 nt, Human
ccugggagauccgggcuggacuguggaccccgaugggccagaguccuuguggcccacagcauag

SEQ ID NO: 235257 - RNA, 64 nt, Human
ccugcagauagcaccggucuuugauccgcagcaggggccagacccugcccacaagucccagcgc

SEQ ID NO: 235258 - RNA, 64 nt, Human
aaauuacuaaaauaaguucaaguuuacaucccuugggccagauauguggguugaggcuugacug

SEQ ID NO: 235259 - RNA, 53 nt, Human
cuguccacucagaguucugaagggggccagauguugggugcagauguagaagc

SEQ ID NO: 235260 - RNA, 64 nt, Human
guaggcaucuuagcuuggcaggugucgggggaaugggccagauggaccugcuagauuuggaagg

SEQ ID NO: 235261 - RNA, 64 nt, Human
aauccuccuccuucccuuuuuucuggagucuugagggccagaguuuuuguuuuuguuuuuguuu

SEQ ID NO: 235262 - RNA, 64 nt, Human
gcuccgacucucagggcugccucccugagcuccagggccagaaugccuggaugccuggguagcc

SEQ ID NO: 235263 - RNA, 63 nt, Human
acagcgcccaccugucauagggaccucacccuggggccagagugggcucuggucuccacagau

SEQ ID NO: 235264 - RNA, 64 nt, Human
guuuccaggaaacaucaggaaguaggaaacuguagggccagagaguaguacaacguuaaauugu

SEQ ID NO: 235265 - RNA, 64 nt, Human
ccugaguggagccuuaaaguggcuucaccuggaggggccagagggucaccuggagcuggggaga

SEQ ID NO: 235266 - RNA, 64 nt, Human
aaauauacugggguccccagauucugcucuaagggggccagacccucugccaggcuggauugua

SEQ ID NO: 235267 - RNA, 64 nt, Human
ggaaagacaaaagcgauuucuucccacuccugcagggccagaaguucaggcugccccgccucca

SEQ ID NO: 235268 - RNA, 64 nt, Human
gaauagaagaaaacgggaaacuuagaccaaguucuccccugagaaaucuuguuaaaacacauua

SEQ ID NO: 235269 - RNA, 63 nt, Human
ucugaaggggaagagggugaccucagcggcuuuucucccaaaaaucggcugaaggcugguugu

SEQ ID NO: 235270 - RNA, 63 nt, Human
ucccauugccacagcccaagcaccuucuucaacucucccaaaauggcucagccuaaccucucc

SEQ ID NO: 235271 - RNA, 64 nt, Human
caagaaaauugcauauuuccauucuggucuuucugggccagauuuuuauauugguuuucaguaa

SEQ ID NO: 235272 - RNA, 64 nt, Human
guggggcaacagcgguggcagggcaggggguggugggccagacugguccccgggggacuucuuc

SEQ ID NO: 235273 - RNA, 64 nt, Human
uaguuguaaccuacagcugauugguaagaacuaugggccagacauuuaaucucuccaucuauga

SEQ ID NO: 235274 - RNA, 64 nt, Human
caauuuuggacucugcacucccucuccucuucaggggccagacuuggcagcaugugcaccaggu

SEQ ID NO: 235275 - RNA, 64 nt, Human
ugagauuucuacagcaauaaaggagacacacacugggccagagaggccugccuucugccugcuc

SEQ ID NO: 235276 - RNA, 64 nt, Human
aagugcugggauuacaggcgugagccacugcacagggccagauucaucauuucaaaguuacuuu

SEQ ID NO: 235277 - RNA, 64 nt, Human
uuugcuugaaauucuugagcagggaucuuauaaagggccagaaauaagaugugugguucacaua

SEQ ID NO: 235278 - RNA, 64 nt, Human
cuaagccuucuccucacugcccuuuaggcucccagggccagaggagccagggacuauuuucugc

SEQ ID NO: 235279 - RNA, 64 nt, Human
ccuuuaaggaccagcugggcuguagugauuccuggggccagaguggcauuauguuuuuacaaaa

SEQ ID NO: 235280 - RNA, 64 nt, Human
gagggguuucauuauaggccuugguucucuccaggggccagaugaguuuauuguggaaucuuug

SEQ ID NO: 235281 - RNA, 64 nt, Human
gcuauacagcugggaacagcagacuuucucugaagggccagaugguaacuacauuaggguuugc

SEQ ID NO: 235282 - RNA, 64 nt, Human
ugagggggugggcuuacucccugggcagucuugggggccagagcugaggccaguccauauuaca

SEQ ID NO: 235283 - RNA, 64 nt, Human
uugaugagguauaggucauuuguuuugaguaugugggccagaaauuuaaaauuagaaauuuguu

SEQ ID NO: 235284 - RNA, 64 nt, Human
ucuaaaauaaagguuggcaaacuuuuucuguaaagggccagauuguaaauauuucagacugugu

SEQ ID NO: 235285 - RNA, 64 nt, Human
ucaggaauucaagcgugaacccauauugauaagugggccagaauuauuuaggggccuggcuugc

SEQ ID NO: 235286 - RNA, 63 nt, Human
ucuuguccccaacaccccacagaagugcuuucuucucccaauucauccucacucaguccagcu

SEQ ID NO: 235287 - RNA, 63 nt, Human
agcccucuucugugugcacugcauacgcugcagccgugggaguuauucuccccuagagaucga

SEQ ID NO: 235288 - RNA, 63 nt, Human
uucacucgaccugcacgggcucugcccgacaugccgugggagcugcugggauuccuuuagaaa

SEQ ID NO: 235289 - RNA, 64 nt, Human
gggaaccacagcuccacaagggggagaggcagcugggccagaccgaggucacagccacuccaag

SEQ ID NO: 235290 - RNA, 64 nt, Human
uugauuacccuugccugcuggggggccuagccaugggccagagauggaggagccccaguggcug

SEQ ID NO: 235291 - RNA, 64 nt, Human
ucccaaaacuggcacuagaaguggcugggcaggggggccagagucauaggaagggucuuggagu

SEQ ID NO: 235292 - RNA, 64 nt, Human
ccccgcuucccuuggaaucccugagggguagaaggggccagaaaaaacgcuuauaaaaccagag

SEQ ID NO: 235293 - RNA, 64 nt, Human
cagccuccucuuggucugaguaggcaucaugugggggccagaucugccugcuguuuccaugggu

SEQ ID NO: 235294 - RNA, 64 nt, Human
guacagaacuggacagguugggccggcagugguggggccagagggcucugugcucuaggagcua

SEQ ID NO: 235295 - RNA, 64 nt, Human
uaaauugccaaagagugggaacagguggggucaggggccagagugcaggggagggggcaauggu

SEQ ID NO: 235296 - RNA, 64 nt, Human
aguuccuaagggccacuguguacccgggcugugugggccagaacuggggggcugagucuucccu

SEQ ID NO: 235297 - RNA, 64 nt, Human
gugugcccaccagcggccuugaagaggcaggucugggccagaugcugggcaggaaaccccagcg

SEQ ID NO: 235298 - RNA, 64 nt, Human
ugguuguugccagguugcagcugcucuugcaucugggccagaaguccucccuccugcaggcugg

SEQ ID NO: 235299 - RNA, 64 nt, Human
aaaagcacacagggucugcuauuccugaggcugggggccagagaagcuuuuacgcauggaaaaa

SEQ ID NO: 235300 - RNA, 64 nt, Human
aauccccuaccccucaaaaacagguugaguuuaugggccagaauauuuuguauaccagacauug

SEQ ID NO: 235301 - RNA, 64 nt, Human
cugauuuggaaaaagagagggagguauggacugggggccagaguccuuuccaaggcuucuccaa

SEQ ID NO: 235302 - RNA, 64 nt, Human
ucugaaguauuuuauuuaccuaacuauaauuauugggccagauacuuguuaauaaaugggcuua

SEQ ID NO: 235303 - RNA, 64 nt, Human
aaucccucacauccaggaaaugaauuuugcaauugggccagaugcuaauuugcacguugauuca

SEQ ID NO: 235304 - RNA, 63 nt, Human
ggccaggccuugggcuacgucuggcuugcauggucucccaagggaaucagccccaucaacaaa

SEQ ID NO: 235305 - RNA, 63 nt, Human
guugccaaaaucccuucggacauuucucagacaucucccaaguucccaucacgucagauuugg

SEQ ID NO: 235306 - RNA, 63 nt, Human
agagauagcuucucuucuuucugaagaucaauuucucccaaggccaagauuguccuuuucucc

SEQ ID NO: 235307 - RNA, 64 nt, Human
agguaucaaaccacaucagccucugauuggccaugggccagaccugcacucuggccaaugauug

SEQ ID NO: 235308 - RNA, 64 nt, Human
agaaaaccagaacggauuucauuucuaauggagggggccagagaugggaaaauuucuuguucag

SEQ ID NO: 235309 - RNA, 64 nt, Human
agaacuacaguuaugucagcuacccagacuuaaugggccagagccaugacccucacaggucuug

SEQ ID NO: 235310 - RNA, 64 nt, Human
aauauagcugcauuaacuuggaaagaagccuguugggccagaagacagaaacuccaacuggcaa

SEQ ID NO: 235311 - RNA, 64 nt, Human
gccacugaauugaagaccacccaucuuccaggcagggccagaauuacagaaaacaauucuggua

SEQ ID NO: 235312 - RNA, 64 nt, Human
uauugaauccaaacaauguguuaaguaauauuuagggccagaaaaaucuuguacagaauaauga

SEQ ID NO: 235313 - RNA, 64 nt, Human
uaucauuuuauuaaguaugauugacacagcccaugggccagaacacacucuacaaaaugacuag

SEQ ID NO: 235314 - RNA, 64 nt, Human
aaucaacuuguguacugauaaaauacucuagccugggccagagaagauaauguucuuuaauguu

SEQ ID NO: 235315 - RNA, 64 nt, Human
acuguauuuaccacuucuaagagugacugacgacgggccagaugacccuugaaguagucauuau

SEQ ID NO: 235316 - RNA, 64 nt, Human
guguuucauucuccaaaggacagcugagacuuaugggccagaagauacuggaagaugguguggc

SEQ ID NO: 235317 - RNA, 64 nt, Human
agaggaagaagagggcaggguggggaggagcucugggccagaggaugcugagcugccugggcag

SEQ ID NO: 235318 - RNA, 64 nt, Human
aguggucucagugagaagguagaugccaacuggagggccagaccuguguccugcccauguccuc

SEQ ID NO: 235319 - RNA, 64 nt, Human
ccaguucugcagggugucagcuccaggacccacagggccagaaccagcugggagaauugguuau

SEQ ID NO: 235320 - RNA, 64 nt, Human
gcaggauggucauucucaaaaacccugggguccugggccagagacaggcagggcccaguccagg

SEQ ID NO: 235321 - RNA, 64 nt, Human
ucacugaagcauccaaauaaagaauuucccucaugggccagacuacaacuuaacagaccuaggg

SEQ ID NO: 235322 - RNA, 63 nt, Human
cacccacuaacgugucaucuagcauuagguauaucucccaaugcuaucccucccccauccccc

SEQ ID NO: 235323 - RNA, 63 nt, Human
caucuuggcacaaugagugucucugcuggugcuucucccaagacuaucuugaaggugggcugu

SEQ ID NO: 235324 - RNA, 63 nt, Human
uucuuucuaguuguggcugcgcaaaaacauuuaucucccaaauaagaugugcugcuuaccgag

SEQ ID NO: 235325 - RNA, 64 nt, Human
ugagacaggacgcagcgggccccugguggccugggggccagacccgugggcagguggggcaugg

SEQ ID NO: 235326 - RNA, 64 nt, Human
gggcaguugcgugacccugcugggaggccagaccgggccagacugagggucaggggaccaggcu

SEQ ID NO: 235327 - RNA, 64 nt, Human
gccaggcagccuccccagcugaggcaucauuccugggccagagucguguccaccaagggacagu

SEQ ID NO: 235328 - RNA, 64 nt, Human
cuggaguagggggucagcaaacauugucugcaaagggccagauacugaauccaguacuuucagu

SEQ ID NO: 235329 - RNA, 64 nt, Human
agaugucuagacuggugcguuguggucuccgguggggccagauccccagaacagggagagacug

SEQ ID NO: 235330 - RNA, 64 nt, Human
cucucuuuuugacagaggacaagggcguggaucugggccagaagccaaaccccuacuucuacag

SEQ ID NO: 235331 - RNA, 64 nt, Human
cauuucugggggugucgucacugccguccccggagggccagauacggccccgcccaaaggguuc

SEQ ID NO: 235332 - RNA, 64 nt, Human
aaccacugugugguggggggcacugggcuuguuggggccagaaauguccacguccugagcuuuc

SEQ ID NO: 235333 - RNA, 64 nt, Human
aggagcccugugcucccagcucagaggacagucugggccagaacuggaaggagacaucuguccc

SEQ ID NO: 235334 - RNA, 64 nt, Human
cacgacagcagaaggauguugcuuuuuuaagggagggccagaaagaaaguuaguggauugcaaa

SEQ ID NO: 235335 - RNA, 64 nt, Human
aaggacaggguggaagagggugguauauagggaagggccagauaggcaacuucauuuggcuugu

SEQ ID NO: 235336 - RNA, 64 nt, Human
cuggcguuggggaguugguuccugagaggucugagggccagagcugcccucuacauuaacaugc

SEQ ID NO: 235337 - RNA, 64 nt, Human
ggguggcuuucaaggcuggggcauggcaaaucaggggccagagagcaggggagcuugggacuca

SEQ ID NO: 235338 - RNA, 64 nt, Human
ugcucuucugucugucaucuugcaggaugcccgagggccagaugggcuuagcuaggccaaagua

SEQ ID NO: 235339 - RNA, 64 nt, Human
agagaagcccuccuguggcucaggggcagcugcagggccagauggaguuggccugcagggaguc

SEQ ID NO: 235340 - RNA, 64 nt, Human
gucccuguucaauaagccaaagacccuggugccccgcccagaccccugggcugacguccagacc

SEQ ID NO: 235341 - RNA, 63 nt, Human
ugguucucgaaccaucuaccugcuuuuccucucucucccaaggccugacaaugguaccuauua

SEQ ID NO: 235342 - RNA, 63 nt, Human
caaacuuacaagaagggagcuaaguauccagccucucccaaaccucuuugaacaaagcuucug

SEQ ID NO: 235343 - RNA, 64 nt, Human
gugugugacuuacagaaacugcaugaaaaaucaugggccagagccucggcccuagcauugcacu

SEQ ID NO: 235344 - RNA, 64 nt, Human
ccaggcaggcuuuggaguuguuuccauggugauggggccagauguauaguauucaguauauauu

SEQ ID NO: 235345 - RNA, 64 nt, Human
cacauccuuggaggcgagaugagcuccuugcagagggccagaguaagugcaagucauggagugc

SEQ ID NO: 235346 - RNA, 64 nt, Human
accucgcagauuugcugagucugucuugugcagagggccagagaauggcuuaugggggcccagg

SEQ ID NO: 235347 - RNA, 64 nt, Human
ucucugccuucugccccacuacuguggggcaguggggccagagcccaccuccccaacaugugaa

SEQ ID NO: 235348 - RNA, 64 nt, Human
ggaggccauuuuugccuaaauuugaaaugagggugggccagaugaguauguuuaaguggagagu

SEQ ID NO: 235349 - RNA, 64 nt, Human
cacuacuucugacacucugguuauugggcacuaagggccagacuggaaagucacuugagacaca

SEQ ID NO: 235350 - RNA, 64 nt, Human
uucuggauauuuacagcuucuuuuguuuuuaauugggccagaagauucugcaaaucccaaaucu

SEQ ID NO: 235351 - RNA, 64 nt, Human
uacucagugauugggaaauucccugucuugcccugggccagagcugguguaccgcugguggauc

SEQ ID NO: 235352 - RNA, 64 nt, Human
cuuaaaaguaagaaguagugguucauccaucagggggccagaagcagcaacuguuuuucauauu

SEQ ID NO: 235353 - RNA, 64 nt, Human
cagccccagcccugggccugggcugccgacaccugggccagagccccugcugugauuggugcuc

SEQ ID NO: 235354 - RNA, 64 nt, Human
gauucuaucuacauaaguccuuucaauuccaccagggccagagcagcuccaccacugugcacuu

SEQ ID NO: 235355 - RNA, 64 nt, Human
ugcuguaaacagguuugggcaguggugggggagggggccagagaggcggcucagguugcccagc

SEQ ID NO: 235356 - RNA, 64 nt, Human
ugcuggugggaaaugggcuugagucacucaccuggggccagaagaggcccccagggaguuguga

SEQ ID NO: 235357 - RNA, 64 nt, Human
ugccuguccauaacugugaaguauuaagcacuuagggccagaugcacuguaaacauugcagguu

SEQ ID NO: 235358 - RNA, 63 nt, Human
gaacuuugagagucaaugucuucaugguaaauuucucccaauugugcuuuagguucacagcug

SEQ ID NO: 235359 - RNA, 63 nt, Human
gcaacaaacauuucaaacgauuagauaacauuuucucccaacucaaagaucccaacaaugaau

SEQ ID NO: 235360 - RNA, 63 nt, Human
aguguuggagguuaaggcauacgagagcagaggucucccaaacgcccuuuccuccucaggcac

SEQ ID NO: 235361 - RNA, 64 nt, Human
agcagggugguggggacuccugagcccagccugggggccagagcaccccaggaccccgggggga

SEQ ID NO: 235362 - RNA, 64 nt, Human
cauggacacuccagugccagcaaugacaucucaggggccagaggaacuguccagagagcaacuc

SEQ ID NO: 235363 - RNA, 64 nt, Human
cuagccuccuauaaggcccaggaagagggcagaggggccagaaggacuccauggcccaaagacc

SEQ ID NO: 235364 - RNA, 64 nt, Human
cuguaaguggcuagguugguagaaucaaaaacaagggccagauguauuuaagggguauucagau

SEQ ID NO: 235365 - RNA, 64 nt, Human
agaggccaggagggccugaucccaggagacaccagggccagagugaccacagcagggcaggcau

SEQ ID NO: 235366 - RNA, 64 nt, Human
gaagagccucaccugggggcauuuuguggguggagggccagaguguguauacccaggcuugucu

SEQ ID NO: 235367 - RNA, 50 nt, Human
agcaggaaggaauugaguaggggccagagggggcucugcucggccuguga

SEQ ID NO: 235368 - RNA, 64 nt, Human
cuucuguagugcugcagggucccucgggugcugugggccagauccgggcggggaccuacugucc

SEQ ID NO: 235369 - RNA, 64 nt, Human
gacccuuuaaauuaaaaagugaagauagucaccagggccagaaagcucauggaguggccguaau

SEQ ID NO: 235370 - RNA, 64 nt, Human
uguaaaccaggaauuggcacacuuuuuuuagaaugggccagaugguaaauauuuaugcuucacg

SEQ ID NO: 235371 - RNA, 64 nt, Human
gauccuggcucggaccacugcaagggccgaggcagggccagaccagagcauccuggguacaggc

SEQ ID NO: 235372 - RNA, 64 nt, Human
cuuggaaagugaacuugcagccuuggauggggaagggccagaugcugggugggugccugucacc

SEQ ID NO: 235373 - RNA, 64 nt, Human
cucaccugcccuucccgugcccacagcuggagcagggccagagccuugggccgguggagccccu

SEQ ID NO: 235374 - RNA, 64 nt, Human
gggaaggccuuacagaagaggugacauuucagcugggccagagaucaguagagagcagcugaag

SEQ ID NO: 235375 - RNA, 64 nt, Human
gcacccucagggagccuccccaucuguccagcuggggccagaggcugggagucccuaccugcuu

SEQ ID NO: 235376 - RNA, 63 nt, Human
ugcauuuugcauauggcucagagcagagccggaucucccaaggaagcacaaauaguuuuuguc

SEQ ID NO: 235377 - RNA, 63 nt, Human
uucaucuuggucacauacaauuauuuuuacaguucucccaagggaguuaggcuauucacaacc

SEQ ID NO: 235378 - RNA, 63 nt, Human
gggcucccucucaaauaaaucuccauccuucccucucccaaaagacauuucugauuucugcuu

SEQ ID NO: 235379 - RNA, 57 nt, Human
cugggcagaagaagauuuaaauccauugggccagaaggaaugaccauuacuaacaug

SEQ ID NO: 235380 - RNA, 64 nt, Human
uggcaucauacucagaaaggaagaccaugccauggggccagaaauucagaaacguaauucuuac

SEQ ID NO: 235381 - RNA, 64 nt, Human
uauugaucaggguagcaaacucaaaugcugacaggggccagaggagauauggggaaggagcauc

SEQ ID NO: 235382 - RNA, 64 nt, Human
uacuuauuuuaauuuucugacuuuacuauuuuaagggccagaggguuaaucacaaagagcaauu

SEQ ID NO: 235383 - RNA, 64 nt, Human
gguggaagucaguuggccucccugguucugcagagggccagaagaaugagagagaggaagacug

SEQ ID NO: 235384 - RNA, 64 nt, Human
gggaaggcgccgggcccgggacuguccguucucggggccagagcugcugggggaccgaguuugu

SEQ ID NO: 235385 - RNA, 64 nt, Human
caggccgaacuccgcacucgcucucccggcagaggggccagaaucgcccggcccagcccuggag

SEQ ID NO: 235386 - RNA, 64 nt, Human
ucgagaugacuuugaucauugguaacuugggccugggccagacaaaguauaaaacuuacaaaag

SEQ ID NO: 235387 - RNA, 64 nt, Human
aguugcugagaggggcuggggagauggggcgggagggccagacucagugcugcuguggagcuag

SEQ ID NO: 235388 - RNA, 64 nt, Human
ggccagguggagaugaggauggguaacaguauuggggccagaucccuaagccccccagcuguaa

SEQ ID NO: 235389 - RNA, 64 nt, Human
uuuuuuucuguaccacaggcauuaucuauaccuggggccagauuuucugcacuuugaaauguug

SEQ ID NO: 235390 - RNA, 64 nt, Human
gucaugacuacgcagcagcagcaguuuccaagacgggccagaaacgcauccacagcaguggcac

SEQ ID NO: 235391 - RNA, 64 nt, Human
gaccuuugaucugcaguguaaaucuaccagucaugggccagaagggcaaaagcccagcuuucuc

SEQ ID NO: 235392 - RNA, 64 nt, Human
cugaaaggucccucugacccaggucaccaaauuugggccagaacuggcacuuccgagugcccac

SEQ ID NO: 235393 - RNA, 64 nt, Human
gcgccggacggcgcagcuggccaagaggcgggcggggccagaaauaccucaugccccugcacca

SEQ ID NO: 235394 - RNA, 64 nt, Human
ggggcccagugcaugagggcggcuccccagggaccgcccagaucccagcuuugagagaggagug

SEQ ID NO: 235395 - RNA, 63 nt, Human
cauuugcauauauauggaauuucuuacuuuuuuucucccaaacucuauuuaauaaacuuauuu

SEQ ID NO: 235396 - RNA, 63 nt, Human
gaugaaagugguggacuugaaauuucccguucaucucccaaagcuuucaacccauucgacgca

SEQ ID NO: 235397 - RNA, 64 nt, Human
ccugggcuccacucaggggaggugcuuggccaaugggccagaaaccgcuucugagcggggcacu

SEQ ID NO: 235398 - RNA, 64 nt, Human
ucucagaagaggcccagcguccaccucucucccagggccagacagcccuuccuggcucccccau

SEQ ID NO: 235399 - RNA, 64 nt, Human
cgaugcuaccccugucagacagaggcugcggccugggccagagucagggaguagcugcugcuuc

SEQ ID NO: 235400 - RNA, 64 nt, Human
auuuuagaacccuaaugcacccuggaggguagcugggccagacuucucauuucacaggugagga

SEQ ID NO: 235401 - RNA, 64 nt, Human
ccccauggaacagcccugcacgcccaggaugaaggggccagaccacgccccugccugagaccac

SEQ ID NO: 235402 - RNA, 64 nt, Human
gagcugcguaaaguuaccccggggugauauaggggggccagacgugugccccguucacccaccc

SEQ ID NO: 235403 - RNA, 64 nt, Human
uuucaaacugugguccagagaauaggggaagacugggccagacgcaguggcucaugccuguaau

SEQ ID NO: 235404 - RNA, 64 nt, Human
aaaaugcauaccaugcuuucagaacaaaagcucugggccagaaaggcaauuuggcuaaaaaaug

SEQ ID NO: 235405 - RNA, 64 nt, Human
uggggaguuuuccugaucuuggguccucuuuagggggccagacaagaaaggccuacgguuucug

SEQ ID NO: 235406 - RNA, 64 nt, Human
cuugcuccguuguucccuugcccugguggugggggggccagaccaccuccggaauccugccacc

SEQ ID NO: 235407 - RNA, 64 nt, Human
uggcugcugugggcaaggaccggcccuucauggggggccagaagccgaaucucgcugauuuggu

SEQ ID NO: 235408 - RNA, 64 nt, Human
cgagggcacagggacccggggccccgcggggcuggggccagacaaagacucggcaaaggggcga

SEQ ID NO: 235409 - RNA, 64 nt, Human
ggaauggagaagcugacccugcuggccaggcaaggggccagaccccccccaacccccagcugcc

SEQ ID NO: 235410 - RNA, 64 nt, Human
uauuacugguuaacauuguggagcuauuacugaugggccagacucugugcuaggcacagacuuu

SEQ ID NO: 235411 - RNA, 64 nt, Human
augcucuuggacuccccacugcaucugggcugcagggccagagcuagucugaccauuaggucag

SEQ ID NO: 235412 - RNA, 64 nt, Human
cagggaaagagccccaugccgcccccuaaggagccgcccagaccuagggcuggacucaggagcu

SEQ ID NO: 235413 - RNA, 64 nt, Human
cugugggucuagugggcgucacagagcuuucagacgcccagaagaagcagcugaaggagcagca

SEQ ID NO: 235414 - RNA, 64 nt, Human
gguggccagcucagggcuuccugcgggugacugucgcccagaccaggugccauucaugacuaau

SEQ ID NO: 235415 - RNA, 64 nt, Human
uggucacccagagccauagagcacccuuccuccugggccagagcuggguuaucaugguuggcuu

SEQ ID NO: 235416 - RNA, 64 nt, Human
caguacuggagagagacacacagaucuaagucgggggccagagggagcucccucaacuaggcag

SEQ ID NO: 235417 - RNA, 64 nt, Human
aaauauuuuaauggcagacugauuacaguggugugggccagaaacaagggacagugaaacaccc

SEQ ID NO: 235418 - RNA, 64 nt, Human
ucgcugccagcucuguaucaggacccagaggaaggggccagaggcucguugacuggcugugugu

SEQ ID NO: 235419 - RNA, 64 nt, Human
agcacgaacugcccgucagagaagugcacagccugggccagauacucccacaggugggugagug

SEQ ID NO: 235420 - RNA, 51 nt, Human
ggggugccggccagagcugaggggccagagcugguccuuacucccugccau

SEQ ID NO: 235421 - RNA, 64 nt, Human
aaacucacuccuuuuuagaaaaaacaaaaaaaaagggccagaaagucauuccuuccaucuuccu

SEQ ID NO: 235422 - RNA, 64 nt, Human
uaccagcagcaaccaggacgucuguucuuugugggggccagaucagaagagagaggccccugug

SEQ ID NO: 235423 - RNA, 64 nt, Human
ugucagaagggacacaggugguaauuuggagauggggccagagcuucuggcuuuuggauuuggu

SEQ ID NO: 235424 - RNA, 64 nt, Human
gugucugcuccucugaggccaggaggccggugcugggccagagaggacggcguggcgaaaguca

SEQ ID NO: 235425 - RNA, 64 nt, Human
uuccacacccuccucgguauccauggagagccuggggccagauaucuggcucaucucuggcauu

SEQ ID NO: 235426 - RNA, 64 nt, Human
ggggauucaguaguccagaucucuggagcugaaggggccagagagugggcagagugcaucucgg

SEQ ID NO: 235427 - RNA, 64 nt, Human
cuugaccuuggaccugcuugguuaaggagggagugggccagaccagagugccaggagcuaaugg

SEQ ID NO: 235428 - RNA, 64 nt, Human
gcugcucagaacccaagauuguaagcucccccuagggccagaggccucuuucuuucaguuuuuu

SEQ ID NO: 235429 - RNA, 64 nt, Human
caagcuaaaucauuuaaauguuuaaauugaaaaugggccagauucucaaugaauaagugguucc

SEQ ID NO: 235430 - RNA, 51 nt, Human
ugcugcgguuuggccccugaccgcccagacccugucccccgaucccccagc

SEQ ID NO: 235431 - RNA, 64 nt, Human
cggugagaguagagucggaggcggagagccuggacgcccagaggccggggccaggcucuggguc

SEQ ID NO: 235432 - RNA, 64 nt, Human
ugccuugcuguuuaaaaguaaugcaauaugugaacgcccagagaacaagcacuguggaacugcu

SEQ ID NO: 235433 - RNA, 64 nt, Human
gguagggagagccagaggugccagccuuccugaagggccagaaaauuuagccuggaucuccucu

SEQ ID NO: 235434 - RNA, 64 nt, Human
gacccauugcgauggccgcuccguguuccucggugggccagagcugaaccuugaggggcuaggu

SEQ ID NO: 235435 - RNA, 64 nt, Human
gaucugccuuacuucacuuuauccucugguuuuagggccagacgccagaagccaugugucaauu

SEQ ID NO: 235436 - RNA, 64 nt, Human
aagugucaagugggaggauacugcccccuugugggggccagacgggucggacacggcugugccc

SEQ ID NO: 235437 - RNA, 64 nt, Human
gagaacagccaguagccuugguaauaugaagggugggccagaagaugauuucacuugcaaaaac

SEQ ID NO: 235438 - RNA, 64 nt, Human
aggacacggaagugagagacacuaaagaaggugugggccagacaaggccuuggagcccacacau

SEQ ID NO: 235439 - RNA, 64 nt, Human
cugagcagggcccaaggcagccaggggccuggaggggccagaggaggguggggucagggccgcc

SEQ ID NO: 235440 - RNA, 64 nt, Human
ugucacugacuuugugcaggccaaggaccuggcagggccagacgcuguaccaucacccaggcca

SEQ ID NO: 235441 - RNA, 56 nt, Human
auaucaucucacagcucugaggcccugggccagauuacuuccuccaccccucccua

SEQ ID NO: 235442 - RNA, 64 nt, Human
caugaccccaugucccagcuccccacacagcgcugggccagagaggcauuggugcgagggauug

SEQ ID NO: 235443 - RNA, 64 nt, Human
ggagggagcgugagccucccagagccccaggacugggccagagcacuuagguuucuuuuuccau

SEQ ID NO: 235444 - RNA, 64 nt, Human
ccagggcucagcccugcuguccugagcgucuccugggccagagagaggagaugggggugggagg

SEQ ID NO: 235445 - RNA, 64 nt, Human
cuccacccccccgggacuguuggggggauucugagggccagagggggauauauaugauucccca

SEQ ID NO: 235446 - RNA, 64 nt, Human
guccuccagggcgagcacuuuccacuuccagagggggccagagggacuuugccugcccagucuu

SEQ ID NO: 235447 - RNA, 64 nt, Human
ucgugcugggcucugcccugggcagacaggcagagggccagagcagaggacacauggccuugcg

SEQ ID NO: 235448 - RNA, 52 nt, Human
cgcagcugcaggaguccugacccgcccagacuguccccagacucccccgaga

SEQ ID NO: 235449 - RNA, 64 nt, Human
uagaggcacugggaggacaguggcugaguggaggcgcccagaccugggcaggcagcaggcucag

SEQ ID NO: 235450 - RNA, 64 nt, Human
gugccgcugcuucauguucugcuuuaucccaucacgcccagaggaggugggugaguucuggcuc

SEQ ID NO: 235451 - RNA, 64 nt, Human
uccuuucccuuauacuuuuuauuaccuugcucaagggccagagaucucaagugucaaccuugag

SEQ ID NO: 235452 - RNA, 64 nt, Human
accccugucagucugcuccccaucccccagccuggggccagaacagccuaccccaggacaggag

SEQ ID NO: 235453 - RNA, 64 nt, Human
ggggugauuggacaagagggucuggcugggaggugggccagaccuggcagcacugaaugugggc

SEQ ID NO: 235454 - RNA, 64 nt, Human
ugaaguccaguggaguucuuagggccuaaauugggggccagaguuucaaaggcaucacuaugga

SEQ ID NO: 235455 - RNA, 64 nt, Human
ccaggaaucucaaacucccuuuggcccugaaccagggccagauaaggaacagcucgggccacuc

SEQ ID NO: 235456 - RNA, 64 nt, Human
aacaaccccccaucacaaacuuaaaggauugcaagggccagaucuguuaagugguuucauagga

SEQ ID NO: 235457 - RNA, 64 nt, Human
aaugccuauguuuucuuuuaguuacaugaauuaagggccagaaaaaaguguuuauaaugcaaug

SEQ ID NO: 235458 - RNA, 64 nt, Human
guugcccgcugggccuggggcccugcccaugccugggccagaguggcgcuggggccucggcuuc

SEQ ID NO: 235459 - RNA, 55 nt, Human
gggccucggagcuacugugagccccgggccagagaagagcccgggagggccaggg

SEQ ID NO: 235460 - RNA, 64 nt, Human
agagaagggcucuccccacugcuucgugauuccagggccagagccaugcagucccagaaacccc

SEQ ID NO: 235461 - RNA, 64 nt, Human
uccucauugugccuucaucagagcuggugccuucgggccagaaagacucucguucuuucuagau

SEQ ID NO: 235462 - RNA, 64 nt, Human
gaugugugugugacguguuuagaaaugcggugaagggccagacggugcugggaaggcaguuguu

SEQ ID NO: 235463 - RNA, 64 nt, Human
uucgguuuguugaacuuuggcagccaguuggugagggccagauguuauucccuuucuuaaagau

SEQ ID NO: 235464 - RNA, 64 nt, Human
cagaagaacauccuucucugcuugaccugaagaagggccagaccugggcagaaagacuccagca

SEQ ID NO: 235465 - RNA, 64 nt, Human
aguuucauagaugggucaggagguggacaaguuggggccagagaugauggcaguccagcagcaa

SEQ ID NO: 235466 - RNA, 64 nt, Human
auccuugaacaaauccgaaaaggcuuggaguccucgcccagaucucucuccccugcgagcccuu

SEQ ID NO: 235467 - RNA, 64 nt, Human
ugccugcucagccaggccucuccugggagccacucgcccagagacucagcuuggccaacuuggg

SEQ ID NO: 235468 - RNA, 64 nt, Human
cccaaagugcugggauuacagaugugagccgccgcgcccagacaguucuuucguuuuaaacagu

SEQ ID NO: 235469 - RNA, 64 nt, Human
cauccaagacuggagcagcaggcuggccacgcucgggccagagagagcucacagcugaagcucu

SEQ ID NO: 235470 - RNA, 63 nt, Human
ucaguggcaauggcuucugagaucaggcacccggggccagagacauaugggccauaccccuua

SEQ ID NO: 235471 - RNA, 64 nt, Human
gaggauaugugggugggugggagggcuggggcaggggccagauagaaauuauugguuuuguuuu

SEQ ID NO: 235472 - RNA, 64 nt, Human
uccccguuacucuuagagaaaggaguuggggugagggccagagcuggcaguggaaacuuguucu

SEQ ID NO: 235473 - RNA, 64 nt, Human
cguaggaaaaaggaauagcaaucauuaaaaucuugggccagagaacacuauuuuuacauaacag

SEQ ID NO: 235474 - RNA, 64 nt, Human
aaagaggugguuucugaggaagucagagcgcccagggccagagcagucaguaaugggugaauga

SEQ ID NO: 235475 - RNA, 64 nt, Human
uuccaucucacuggacugcagacccggccugguggggccagagaguccccagcuagggaccugc

SEQ ID NO: 235476 - RNA, 64 nt, Human
cuuuuucaaguucacauggggacccccuucuugggggccagagauaugacuaaaaccuuaucuc

SEQ ID NO: 235477 - RNA, 64 nt, Human
ugaagggggcaagggcugagaugugguccccaaggggccagaaauucccaaguuggucacaggu

SEQ ID NO: 235478 - RNA, 64 nt, Human
uuucacccaaccugcucccucugauccuccaucagggccagaucuuccacgucuccaucucagu

SEQ ID NO: 235479 - RNA, 64 nt, Human
uuugcccuugaacuaaaaauguuguuuggggcaagggccagaaauguggagacaugguuuuugu

SEQ ID NO: 235480 - RNA, 64 nt, Human
gagcccagcuccaaggggaaucagaacucaaauggggccagauccagccuggggucuggaguug

SEQ ID NO: 235481 - RNA, 64 nt, Human
gaaagauaacuaggaaauccauucacaguucuuugggccagacaugccacaaggacuuccuguc

SEQ ID NO: 235482 - RNA, 64 nt, Human
aagcuccucuccccagcccagagacauacuugaagggccagagccaggggggugaggagcuggg

SEQ ID NO: 235483 - RNA, 64 nt, Human
gcgucaaagcacagaggcuccccggacucggagggggccagagacugagcucuggucaccuguu

SEQ ID NO: 235484 - RNA, 63 nt, Human
cuuugagaugguguguccuggauuaauacuuugucucccaauaucacagaaaaauacaugcca

SEQ ID NO: 235485 - RNA, 63 nt, Human
uauucccugcagcccacugauaaauaucucacuucucccaaauaguauguggacucccagcua

SEQ ID NO: 235486 - RNA, 63 nt, Human
caaccaccuccacccuguuuguucccacaugugucucccaagccugcuagggacaggcagggc

SEQ ID NO: 235487 - RNA, 64 nt, Human
acacucacauggcaagaguugcucuggagagguagggccagaggaaugcugcugcacugccaac

SEQ ID NO: 235488 - RNA, 64 nt, Human
agauauugacagcuauucaccuuucacggugcuggggccagauuagggaucacucccgugagga

SEQ ID NO: 235489 - RNA, 64 nt, Human
agcuccugaugaaaucaucccuguggggagugcagggccagauggggacuccauggagacagcc

SEQ ID NO: 235490 - RNA, 64 nt, Human
ggacaguggcccugagcccaccccuuccugggaugggccagacaagcaggugcugggaggaggc

SEQ ID NO: 235491 - RNA, 64 nt, Human
ucauggcagugggaccaagcguggucccgaggaagggccagagccugguagagacuagggaagg

SEQ ID NO: 235492 - RNA, 64 nt, Human
uggcccagggccuccuuccacauuaguagccccagggccagauggagccaaaggucagcucucu

SEQ ID NO: 235493 - RNA, 64 nt, Human
agaaaacauuuguucccuguucauuuuauuuuaggggccagaucuaacauuguagugucuuuca

SEQ ID NO: 235494 - RNA, 64 nt, Human
ugcacagaauugcaaaugucuuuugccauaccaagggccagacucagaacccuuggagucaugu

SEQ ID NO: 235495 - RNA, 64 nt, Human
aagggagaaggaagggcagagaauggcugggucagggccagacuggaagacacuucagaucuga

SEQ ID NO: 235496 - RNA, 64 nt, Human
ggcuucugagcuucuccuguacugugcaucgugagggccagagacaggaauguaaggauuggca

SEQ ID NO: 235497 - RNA, 64 nt, Human
aagcucaaagguuuggaaggagcagaaaacccuugggccagaaguaccagacuagauggaccug

SEQ ID NO: 235498 - RNA, 64 nt, Human
cacgcucuucuaauugggagauaauauggaagaagggccagagcaguuacagcccuccuucuuu

SEQ ID NO: 235499 - RNA, 64 nt, Human
agagaggcuccauuuguggcuauuauguagaacugggccagagccaguccauugccuguuuuuu

SEQ ID NO: 235500 - RNA, 64 nt, Human
uguccccaaccaucccaauagggugggggccugugggccagaggacuccaugacaguagccaug

SEQ ID NO: 235501 - RNA, 58 nt, Human
acaggagaagugcacccuagggccuucugggccagaggcaccaucccuucuggccauc

SEQ ID NO: 235502 - RNA, 64 nt, Human
ucaauuccuauaagagacccucgcagcccagaggcgcccagaggaagucagcagcccuagcucg

SEQ ID NO: 235503 - RNA, 64 nt, Human
cgugauaggcacacgaggaugaguggcuuuguaucgcccagagaggugcuuguccagauuucac

SEQ ID NO: 235504 - RNA, 64 nt, Human
ccaggcguccucaacggggagccccaaauguccacgcccagaacaacaguuggcaggacaggug

SEQ ID NO: 235505 - RNA, 64 nt, Human
uggagcaagucucccagaugauucuaauacaggagggccagaggccaaacuugaagaacugcug

SEQ ID NO: 235506 - RNA, 64 nt, Human
caucagcaacaaccagcaucccuugaccaggccugggccagaguauuggucuccucucagcccc

SEQ ID NO: 235507 - RNA, 64 nt, Human
acaaaguuuuccaggaggccuugcggaacaucgggggccagauucaggagaagguaugugagug

SEQ ID NO: 235508 - RNA, 64 nt, Human
cagcaccccaccaucccuuugcaggggagucaaagggccagaacuccuugggggaccagaacau

SEQ ID NO: 235509 - RNA, 64 nt, Human
cuugcaacucagugugaguugauuccuccaauaugggccagaugcuuuugaaugauagggaaau

SEQ ID NO: 235510 - RNA, 64 nt, Human
ggaagggcccagccacuuccagcuuuugaucuuggggccagaggccgccuuacacacaccccag

SEQ ID NO: 235511 - RNA, 64 nt, Human
ggaaauagcaaaaacaaggcccaggcuggggccagggccagaggggaaggcccuggauucucac

SEQ ID NO: 235512 - RNA, 64 nt, Human
gcccuggggcugaucucagggaagcccagcuccagggccagaugagcagaagcucucgauggac

SEQ ID NO: 235513 - RNA, 64 nt, Human
ugaacccuucaagaaaacgugaaguagaacgggugggccagaaaugaaaacaggcaaguaaagu

SEQ ID NO: 235514 - RNA, 64 nt, Human
ggaacagcaaggacguugauugguuggggcaggggggccagaguagcugauguaggaguacugg

SEQ ID NO: 235515 - RNA, 55 nt, Human
cuuugguuauggacacauaacuccugggccagaggcuaaaaccccaggaccccug

SEQ ID NO: 235516 - RNA, 64 nt, Human
aaagaacaaagucuccccaccuuucucggaugcagggccagagugacacagccgaaaaauugca

SEQ ID NO: 235517 - RNA, 64 nt, Human
agcauagcuacaggaaaagucagcccuugacugagggccagaucaucccuggagugcaccucua

SEQ ID NO: 235518 - RNA, 64 nt, Human
gcaucucagcgccagcucuaccaguucucguuuugggccagaggcagccucugcacucccacgc

SEQ ID NO: 235519 - RNA, 64 nt, Human
ugacuuagccgagguaaggucagugcagcagacagggccagacugggguguggggggcugagcu

SEQ ID NO: 235520 - RNA, 64 nt, Human
uggggggcagccaggagaggaggugucccuuccucgcccagacacagcgcgcuucucucuggcc

SEQ ID NO: 235521 - RNA, 64 nt, Human
uggggacccagcuccaugcacgucaacccagucccgcccagacuaguggacagaccugguguca

SEQ ID NO: 235522 - RNA, 64 nt, Human
ccacaggccacugcaaacccugcugccugccggccgcccagacaccacagacgccaccuggcgg

SEQ ID NO: 235523 - RNA, 64 nt, Human
acagcugcauuccagagcaggaggcagggcucuggggccagaauggcuguccuugucguagagc

SEQ ID NO: 235524 - RNA, 64 nt, Human
aaaagcuccaaaugcagcuuuaaaaaauuaaucugggccagaauuucaaacggccucacuaggc

SEQ ID NO: 235525 - RNA, 64 nt, Human
caaucgggagggagagacagagacagagccgauggggccagagcaggcagaacaggcggagcgc

SEQ ID NO: 235526 - RNA, 64 nt, Human
caccugcuuggcccugccaccuuccuccaggggagggccagauggcauccuggcuuggggcggg

SEQ ID NO: 235527 - RNA, 64 nt, Human
acccagggcgaauggggcccagggcagaccuucagggccagagcccuggcggaggagaggcccu

SEQ ID NO: 235528 - RNA, 64 nt, Human
gcgggcaggaaccggggcugcgcgcagcgcuugcgggccagagugaguuccgggugggcguggg

SEQ ID NO: 235529 - RNA, 64 nt, Human
ugggugauggguagagcccucgaaacuugacauggggccagaagggccuggguugaaguaguaa

SEQ ID NO: 235530 - RNA, 64 nt, Human
gauuaugagugguucacagcagcccuuauaagcugggccagaaaauuucacuaggucaguaauu

SEQ ID NO: 235531 - RNA, 64 nt, Human
gggacugucugauugaggacagugacgacgaggcgggccagagcugagcgugaggacgugcuug

SEQ ID NO: 235532 - RNA, 64 nt, Human
uacacuuuggccuuccuuuccccagcgccccugagggccagaggcagaugugggcugcaggcug

SEQ ID NO: 235533 - RNA, 64 nt, Human
cuacgccccaugucaucacagggccuucaugacagggccagagccagccagcuuugaagacgcg

SEQ ID NO: 235534 - RNA, 64 nt, Human
accgcaacaagcgggccgccccagccaccuccgagggccagagcaagcgcuguaaacccugacg

SEQ ID NO: 235535 - RNA, 64 nt, Human
cuggggugcggcccuggcccccuccaccccugcugggccagagcgggugggcagugucaaggcc

SEQ ID NO: 235536 - RNA, 64 nt, Human
cgccccugccagccaccaagcgcaggugcagcgggggccagacuccugccggccucagaggaca

SEQ ID NO: 235537 - RNA, 58 nt, Human
aggcccuggagcgacacugacagccagggggccagaaggacugacaccacagaugaca

SEQ ID NO: 235538 - RNA, 64 nt, Human
ugggcuccggcagggagaggugcaggggagucaccgcccagaccuccccagccaccaaccgacc

SEQ ID NO: 235539 - RNA, 64 nt, Human
auuuucucuuuuaccauuccucucuuuuuguucucgcccagagugggugguuuuuuguuguugu

SEQ ID NO: 235540 - RNA, 63 nt, Human
cuguuugucaacaguauacaaaagaauugugccucucccaaguccagugugacuuuaucuucu

SEQ ID NO: 235541 - RNA, 64 nt, Human
cuggggguagaacagaaccaaauucacagcuggugggccagacugguguugguuggaggugggg

SEQ ID NO: 235542 - RNA, 64 nt, Human
gaaucagagaccuuccagaaauacuacuguguaagggccagaaauaucuucacuugucauuguu

SEQ ID NO: 235543 - RNA, 64 nt, Human
ccuucggugugaccggcagccuggcugaccgugagggccagagagagccuucacggacggcgcu

SEQ ID NO: 235544 - RNA, 64 nt, Human
agcccugcccccgggcacugcacagccugucugggggccagaccaccccauuguccauccuugu

SEQ ID NO: 235545 - RNA, 64 nt, Human
uccagccaguucaagcucagagccagagcuggacgggccagaacugcgcugcacacuuccugga

SEQ ID NO: 235546 - RNA, 64 nt, Human
cagugugcggacagaggagaccacucugcuccuggggccagaggccauucaauagccugccuuc

SEQ ID NO: 235547 - RNA, 64 nt, Human
cacugaaccucucaggaucaaugaccccuguaaggggccagagccuuggaggacacuaagagga

SEQ ID NO: 235548 - RNA, 64 nt, Human
ccucacauacgguaaagccaaagagcugucacaugggccagaaacaugagccacggcaggaaga

SEQ ID NO: 235549 - RNA, 64 nt, Human
uccuccuuuccucaugcagcacaagugcucaccggggccagagccagggcauggauaugacaag

SEQ ID NO: 235550 - RNA, 64 nt, Human
guggccuggcuccgcuguguggauggggagaucggggccagaggcagaacccuggugaggaagc

SEQ ID NO: 235551 - RNA, 63 nt, Human
cucaucaggcccucgacugaaaaguucucaguggggccagacuggcuccuggagcugacaagc

SEQ ID NO: 235552 - RNA, 64 nt, Human
ccugggcagaguaccaggcugcugacccucagcagggccagacaaggcucaguggaucuggucu

SEQ ID NO: 235553 - RNA, 64 nt, Human
gcuggggcugacccugggcagggacuuuccugcagggccagaccugccugcauucugagacaaa

SEQ ID NO: 235554 - RNA, 64 nt, Human
cuacaugcaaaucuggcuuaguaaaucgaggugugggccagagauccucugacagcuguccuga

SEQ ID NO: 235555 - RNA, 64 nt, Human
ugagccaguuccagcuggcuccagccauccugcagggccagaccaaagagaagaugguuaccau

SEQ ID NO: 235556 - RNA, 64 nt, Human
acuuggcccgcagcaggccagaccccccuacccccgcccagagcucaguagccagccugggucc

SEQ ID NO: 235557 - RNA, 64 nt, Human
uaugucacuauuuucacuagggcugaggggccugcgcccagagcuggccucccccaacaccugc

SEQ ID NO: 235558 - RNA, 64 nt, Human
ccuacacgauccgcaacccaugcccuggaccagccgcccagaucaugccgccgcagcugguugg

SEQ ID NO: 235559 - RNA, 64 nt, Human
cccuugaguguauuuguucucaguccuaacccuggggccagagauugguccgagguugagaauu

SEQ ID NO: 235560 - RNA, 64 nt, Human
gggcuuccuaggagccagucagcagggugggguggggccagaggagcucuccagcccugccuag

SEQ ID NO: 235561 - RNA, 64 nt, Human
ucauguggccaagcacaucuuugaccacgucaucgggccagaaggcgugcuggcaggcaaggug

SEQ ID NO: 235562 - RNA, 64 nt, Human
uccagugcucagagggcggggagaaucucagcgugggccagaggcagcucgugugccuggcccg

SEQ ID NO: 235563 - RNA, 64 nt, Human
auugugaccgaccccacuuccucagaauguaacggggccagagggaaacuucucacaaacuucg

SEQ ID NO: 235564 - RNA, 64 nt, Human
gcugacaccagaacagcccaaaucagaguucccagggccagacaggcucuuccugggccacaga

SEQ ID NO: 235565 - RNA, 64 nt, Human
gauucagagguugccugcggaguaccuugucccagggccagacacacccacaccacccacuguc

SEQ ID NO: 235566 - RNA, 64 nt, Human
gugaagucaggccagggccuuccagcugcucuuggggccagagccaagagccucucaguagagg

SEQ ID NO: 235567 - RNA, 64 nt, Human
ugggccaggccgggccacagcaauaggaaagccagggccagagcgagccaugccagcccuacug

SEQ ID NO: 235568 - RNA, 64 nt, Human
gccucccucucuacgucucuguaccgagccucuggggccagauauaagagugccucucugaguc

SEQ ID NO: 235569 - RNA, 64 nt, Human
ggcuuccuuaccaagaaugaguuccugaaacccagggccagagacaaggacaacuuaggggaag

SEQ ID NO: 235570 - RNA, 64 nt, Human
ccccagaccaacccugggaccuauacagaacagagggccagagcuagggcugcugcuucugcuc

SEQ ID NO: 235571 - RNA, 64 nt, Human
gguucugggaaagcaacagcuaucagagagagaagggccagaccccauagccucuuagauuccu

SEQ ID NO: 235572 - RNA, 64 nt, Human
aggcugagaaaccuccagggcagacagaaaguuggggccagagcuagguuuuagagauccuaca

SEQ ID NO: 235573 - RNA, 64 nt, Human
aaugcugaguucugucucacacugaucaggcucagggccagagaggcaacaagagagcaagacc

SEQ ID NO: 235574 - RNA, 64 nt, Human
ggccugagggguccuagccuggagcaggcgccugcgcccagacccuggagagccuugacccaga

SEQ ID NO: 235575 - RNA, 55 nt, Human
ccgcgcuuugggaguacugaggccgcgcccagaccagccugucgcgcauuaaaac

SEQ ID NO: 235576 - RNA, 52 nt, Human
ucuugcggaaacgcgaaugaggcgcccagacggucugucugaggcucugagc

SEQ ID NO: 235577 - RNA, 64 nt, Human
guucaauugccuuguguaaccacuugucgccuuagggccagauuccccucucuaguccccuuuu

SEQ ID NO: 235578 - RNA, 64 nt, Human
ggucauucuacacugaggaggcugccuuaugggugggccagauccaaaccgcaggcaaacgggu

SEQ ID NO: 235579 - RNA, 64 nt, Human
cccagcaacccugccccuccccagcaucccagcugggccagagagagccgagugugccaacaag

SEQ ID NO: 235580 - RNA, 64 nt, Human
ugggaauuaggaaccuuauuuccuaaaagaaacagggccagaggaaaaaaaacuauugauaagu

SEQ ID NO: 235581 - RNA, 64 nt, Human
acacucucccucaucuuucgugcccauucacugagggccagaaugacugcucacccacuuccac

SEQ ID NO: 235582 - RNA, 64 nt, Human
ugugugugugugcacaucuacaugccaugccuaugggccagaguugucuuuauuguccaccaug

SEQ ID NO: 235583 - RNA, 64 nt, Human
guuggacuuagaccuccuucaguguggcucugcugggccagaggcauccugcugucccgggugg

SEQ ID NO: 235584 - RNA, 64 nt, Human
gaggggauggcugaggacacuggcccuuaccccagggccagacagcauccaucccugcuguuug

SEQ ID NO: 235585 - RNA, 64 nt, Human
auucagggagaaaccucuccuucccgugugagaagggccagaggguccaggcaucccaagucca

SEQ ID NO: 235586 - RNA, 64 nt, Human
gugagagauuuuggccuuuuuuauuggauaaauugggccagaaaggcaggguagauuucgaagc

SEQ ID NO: 235587 - RNA, 64 nt, Human
agagacaccagcucucagggcagagauuggcuuggggccagaaggacccuccccaacccuggag

SEQ ID NO: 235588 - RNA, 64 nt, Human
cucuccaguaauugucuuuucauuuugaugguaggggccagacugaaugaauaaugcauucuuu

SEQ ID NO: 235589 - RNA, 64 nt, Human
uagcagaauagcaagcagaguaucauucaugcuggggccagaaugauggccgguugccagauau

SEQ ID NO: 235590 - RNA, 64 nt, Human
uuacuuuguuuuaaaacugaucaguuuugccaaggggccagaauuauuccuuguuagaauugcu

SEQ ID NO: 235591 - RNA, 64 nt, Human
uguggcagcgggaguucccggcccuccacacccggggccagacccucggggccaugccuuggug

SEQ ID NO: 235592 - RNA, 64 nt, Human
uacacacauacauaucuagaauguguauccgcggcgcccagaagccucgguuuggcccaccugu

SEQ ID NO: 235593 - RNA, 64 nt, Human
uuugggacaaaaacugcuacaucaacuuucaucucgcccagagugcucaaggcugguaugauca

SEQ ID NO: 235594 - RNA, 64 nt, Human
aagccaugccauugcgcugccccggccgccaguccgcccagaagccauagacgagacguaggua

SEQ ID NO: 235595 - RNA, 64 nt, Human
accgcagcgcgcagccacaugcccuggcugccaugggccagaccgccuccaccucccccgcccg

SEQ ID NO: 235596 - RNA, 64 nt, Human
ugcgaggcccucggggcccacccacagcggcccagggccagacccuggcuggaagccagaacgc

SEQ ID NO: 235597 - RNA, 64 nt, Human
gagagcugggccuccucuccagaaucauguggaggggccagaggccugccagacccccagcugg

SEQ ID NO: 235598 - RNA, 64 nt, Human
ccucaugcuuccugucccccgcuuacacgacaacgggccagaccacaggaaggacgguguuugu

SEQ ID NO: 235599 - RNA, 64 nt, Human
uguccuccuaaaguggccccuguucccaucucccgggccagacagcuguccccccguccuccuc

SEQ ID NO: 235600 - RNA, 64 nt, Human
uaccugagaucugggaugcugaguggcuguuugggggccagagaaacacacacucaacugccca

SEQ ID NO: 235601 - RNA, 64 nt, Human
ucccccucuucaggugucagugcggagaggcucugggccagaccucacccccagugacuuccga

SEQ ID NO: 235602 - RNA, 64 nt, Human
cgggacugcaggcggcggaugucaggcccugucugggccagaacugagcgcuguggggagcgcg

SEQ ID NO: 235603 - RNA, 64 nt, Human
ucugccccagccuccaacuuggagagacagauuugggccagacuccuguguccuugcuuggcug

SEQ ID NO: 235604 - RNA, 64 nt, Human
ggaagggugaaagagaaagccugugaaauaggcagggccagaucacccaaaacuccucaggacu

SEQ ID NO: 235605 - RNA, 64 nt, Human
gcggccagcggcgcccggaggggaggaaggggccgggccagacguucccacaguaaaucucccc

SEQ ID NO: 235606 - RNA, 64 nt, Human
gaauauauuuuacaugugaugacauggauuuugggggccagagguguaauguuuuggcugagug

SEQ ID NO: 235607 - RNA, 64 nt, Human
uucacccccauccacaguugucaguugugaagaggggccagaugacacccuaaagcaggcugau

SEQ ID NO: 235608 - RNA, 64 nt, Human
accagacuuccaguucucaggaacuucucauugugggccagaaguccugggugccuccuacuag

SEQ ID NO: 235609 - RNA, 64 nt, Human
cuagucacuggccucaaaggaccccacagcaccugggccagaccaacagcucgagggagaaccu

SEQ ID NO: 235610 - RNA, 64 nt, Human
uacaacuguggccaugacugaggaaaggagcucacgcccagagacugggcugcucucccggagg

SEQ ID NO: 235611 - RNA, 63 nt, Human
ugguguacaacugaggguaguuaacucaucacuucucccaagcacucgaucccagcuucaccc

SEQ ID NO: 235612 - RNA, 63 nt, Human
acgggguacgugauuuuguaaaaaggaaguauuucucccaaaauugggaguaggcaaacuacu

SEQ ID NO: 235613 - RNA, 64 nt, Human
gagggugggcugaggcugaaguugcccacacugggggccagagcuaggguggggggcgagggug

SEQ ID NO: 235614 - RNA, 64 nt, Human
gggauggggguguuggaugccuggaucucuguaagggccagaagugagggcccagaggucuggg

SEQ ID NO: 235615 - RNA, 64 nt, Human
gagccaagcagggggacguugccagaggggaccagggccagagacgggaccaggaaggaacuga

SEQ ID NO: 235616 - RNA, 64 nt, Human
agagauucuccuuccaggccuaagccugggauuugggccagagauaagaauccaaacuaugagg

SEQ ID NO: 235617 - RNA, 64 nt, Human
ggccagacguggcuucuccugaguucuagggcucgggccagaguggcacuacugcccggccagu

SEQ ID NO: 235618 - RNA, 64 nt, Human
agauuuugcguuugacauugugucugggaaggaagggccagaccuuggaaccuuuggaaccugc

SEQ ID NO: 235619 - RNA, 64 nt, Human
cgcucucugcagcguggauuuccuuugcccauuugggccagaaggucaccaggaguucaucacu

SEQ ID NO: 235620 - RNA, 64 nt, Human
agaauagccagcggagcauggacuguuccagcacgggccagauggccagcugucgagagcagcc

SEQ ID NO: 235621 - RNA, 64 nt, Human
gcuucuuugaaggaguaaauguguuuuguuccuagggccagaggagcuugucuuccuuguccuc

SEQ ID NO: 235622 - RNA, 64 nt, Human
cuugcuagccaaaaucucuuaaauacacguaggugggccagagaacauuggaagaaucaagaga

SEQ ID NO: 235623 - RNA, 64 nt, Human
cacccaugcuaggguccccaaagcacuggggcaggggccagagcagcagcacccagugcucccu

SEQ ID NO: 235624 - RNA, 64 nt, Human
aaguggggaggagggucagcuaagagaagugggagggccagagcuuuuugguucugauuuacaa

SEQ ID NO: 235625 - RNA, 64 nt, Human
auuuauggcuuauaaauguguauucuggcugcaagggccagaguuccacaaaucuauauuaaag

SEQ ID NO: 235626 - RNA, 64 nt, Human
aaagaacagagaagugacagcuagggguugagaggggccagaaaaacaugaaugcaggcagauu

SEQ ID NO: 235627 - RNA, 64 nt, Human
uggcacagggcugcauggaccucagggggcuguggggccagaagcugggccaagcccuccagcc

SEQ ID NO: 235628 - RNA, 64 nt, Human
aggagccagcggccaccugcggggagaccaccgccgcccagacuacugacggcaggggcugcug

SEQ ID NO: 235629 - RNA, 64 nt, Human
cacagggcucccugcagggucagggaccagaccacgcccagaggaggggaggcacuggcccccg

SEQ ID NO: 235630 - RNA, 64 nt, Human
uggccgccugcaccuuggaugaggcagggccaggcgcccagaacccccauccuggccgcacccc

SEQ ID NO: 235631 - RNA, 64 nt, Human
gucucagggggaccccagggaugccccagaucaggggccagaggggaugcuuagcaaacccaau

SEQ ID NO: 235632 - RNA, 64 nt, Human
cuccaggugcagggcgggccuccaggugcagggcgggccagaagcccccucaucggcccgcagc

SEQ ID NO: 235633 - RNA, 64 nt, Human
ccccagagccuccgccuguggcugugaugaccuugggccagaaggucaaacuccgaagacugaa

SEQ ID NO: 235634 - RNA, 64 nt, Human
cauggguggucccugcuucgauggccccaaagcugggccagaguuaagggaaagaggaggaagu

SEQ ID NO: 235635 - RNA, 64 nt, Human
cgugggugaaguccuggggucagggggugggguggggccagaaggccugauagaagggucaggg

SEQ ID NO: 235636 - RNA, 64 nt, Human
uucaggcaucugagucggcguuuacccaggggccgggccagagacgggggucggccgcucgcuc

SEQ ID NO: 235637 - RNA, 64 nt, Human
acugucuuucuguagguugguuccuguauaccuugggccagagagcaaacauagguggccugag

SEQ ID NO: 235638 - RNA, 64 nt, Human
auaccaggagucacuggagaaaggggcugugcuggggccagacuggcacaaggcacucgugccc

SEQ ID NO: 235639 - RNA, 64 nt, Human
gcagaggacuccagccuucucggggcccaggccugggccagaagcuguugaccauaccaggagu

SEQ ID NO: 235640 - RNA, 64 nt, Human
ccccagggccuuuguggacuagccaaggcugugagggccagaauaaacaacugcucaacaaagg

SEQ ID NO: 235641 - RNA, 64 nt, Human
ccggacacccauagacggugcggggggccuggcugggccagaccccaggaaggugggguagacu

SEQ ID NO: 235642 - RNA, 64 nt, Human
gugccuuugcugccccuuagguugggacuuaggugggccagaggggcuaggaucccaaaggacu

SEQ ID NO: 235643 - RNA, 64 nt, Human
acgcaggccuggggagcccccaguggcggggacagggccagauuucauguugacccuggggaug

SEQ ID NO: 235644 - RNA, 64 nt, Human
gauguugaggcgagcagggcaggcccccggggaggggccagaguuuucuaugaaucuauuuuuc

SEQ ID NO: 235645 - RNA, 64 nt, Human
gcaucccaagccccucaugcuccugccuuccugagggccagaggggagccccaggacccauuaa

SEQ ID NO: 235646 - RNA, 64 nt, Human
gguggggguguggccgagccccggcaggaagccccgcccagacgguguucagggaacccggagc

SEQ ID NO: 235647 - RNA, 64 nt, Human
caggccagccagccugccugccugccugccugcccgcccagagcuguggggaugagugucccca

SEQ ID NO: 235648 - RNA, 64 nt, Human
auuuuuauuuuuuuugaacggagucucccacugucgcccagacuggaguccaguggcacaaucu

SEQ ID NO: 235649 - RNA, 64 nt, Human
ucagcugcuucagggaaugugucccucccaccaugggccagagcuucagcccuucuuuagcuca

SEQ ID NO: 235650 - RNA, 64 nt, Human
ggcccaggacgccugcugcaagcccacccagauggggccagagucuguguggacaaccgucccc

SEQ ID NO: 235651 - RNA, 64 nt, Human
ggaaaugaguugagaccauggacuugggaguugggggccagaguugagccuggacuugaccaau

SEQ ID NO: 235652 - RNA, 64 nt, Human
gggagcagcuaugcaaaucccuaccuacccagcugggccagaggcacgaggcagccaggcaggg

SEQ ID NO: 235653 - RNA, 64 nt, Human
cauguggaauaaaguaauagaguaacaaguggcagggccagaaccaggguccccaaaguccugg

SEQ ID NO: 235654 - RNA, 64 nt, Human
gagagagcggaaggagcagcugaugcccagagcggggccagagcggcgggucuauguucacguc

SEQ ID NO: 235655 - RNA, 64 nt, Human
uggacugauucuccauuuuaucaccugaaggcuugggccagagcucaacagcuacucaacugga

SEQ ID NO: 235656 - RNA, 64 nt, Human
gcauacuccaguuuacuaauacagcaggguaacugggccagauguucuuucuacagaagaauau

SEQ ID NO: 235657 - RNA, 58 nt, Human
gccugacaggguaugugugaagaaccaggggccagagcugggggguggcugggucugu

SEQ ID NO: 235658 - RNA, 64 nt, Human
cuuaaaucaggggucagcaaacuuuuucuguaaagggccagacgggaaauauuuugggcuuugc

SEQ ID NO: 235659 - RNA, 64 nt, Human
ccuaaggacacacaaauuugguugggaguugauggggccagaugagccagcauuccagcucuuu

SEQ ID NO: 235660 - RNA, 64 nt, Human
ucaaugaaauaaaaaugaacuuauuccccacucagggccagagaaagucagaacaaagaaaaug

SEQ ID NO: 235661 - RNA, 64 nt, Human
accagcuauauccaggaucauuucucuuucuucagggccagacagcuuuuaauugaaauuguua

SEQ ID NO: 235662 - RNA, 64 nt, Human
aucaaaggaaaugagaaugacagccuuuuuuccugggccagaaguagaggggugggugcguaag

SEQ ID NO: 235663 - RNA, 64 nt, Human
cucuagccuggagaagagcaaaauggagggggaggggccagaaauaggaggagguuuugaagaa

SEQ ID NO: 235664 - RNA, 64 nt, Human
acuuaccgauucauucuuucacuguuuguaucugcgcccagaauucucagugacguggggguga

SEQ ID NO: 235665 - RNA, 64 nt, Human
cccaaagaagugaaggagaaagcagcugccucaccgcccagacauugauuuguucagauguuuc

SEQ ID NO: 235666 - RNA, 61 nt, Human
ccuuccaaggccacguuugaccggagcucaccgcccagagcguggacagggcuuccgugag

SEQ ID NO: 235667 - RNA, 64 nt, Human
agugguugguaaaaucaauagauuucaggcaagagggccagauaccuaacagguuuuucuccgu

SEQ ID NO: 235668 - RNA, 64 nt, Human
uggcaauguuuugcuuuugcucgaugcagacagggggccagaacaccacacauuucacugucug

SEQ ID NO: 235669 - RNA, 64 nt, Human
accgacaagcacagucagguugaagaccuaaccagggccagaaguagcuuugcacuuuucuaaa

SEQ ID NO: 235670 - RNA, 64 nt, Human
uggcgggaccccgcagcagccccggccccauccccgcccagagccgggcgucguguggguccgu

SEQ ID NO: 235671 - RNA, 64 nt, Human
acugagggccucgccuggcugcagccugcgccaccgcccagagacccaagcugccuccccucuc

SEQ ID NO: 235672 - RNA, 64 nt, Human
guauuuucugccuaagugcuacgugauccucugccgcccagaccucaacagcacagagcacuuc

SEQ ID NO: 235673 - RNA, 64 nt, Human
ggcagucucagccucccuccacggucaccuucaacgcccagacacucccuucucccaccuuagu

SEQ ID NO: 235674 - RNA, 64 nt, Human
auuuuggugagcuuagcuucuguauuccuacugccgcccagaaaaggggcagggcucugcagcc

SEQ ID NO: 235675 - RNA, 64 nt, Human
gguacagucauaagagccaucugucacggacccacgcccagaggaacgugcagaaaaaagcaga

SEQ ID NO: 235676 - RNA, 64 nt, Human
agaccuaaggcaucucuacucccuccagaggagccgcccagauuccugcaguggagaggagguc

SEQ ID NO: 235677 - RNA, 64 nt, Human
uuuuuuuuuuuucugagacagggucuuacucugucgcccagacuggaaugugguggcaugaaca

SEQ ID NO: 235678 - RNA, 64 nt, Human
gaagugagggccaggcccuucccggcugcgaggacgcccagagaccgcgggcgcugagcgcguu

SEQ ID NO: 235679 - RNA, 64 nt, Human
cuccuucgcuuaguucuccagacccucccucacacgcccagagccuucugcugacauggacugg

SEQ ID NO: 235680 - RNA, 64 nt, Human
aacagaugaguccugggagagacccucagagauccgcccagaccccucuccugcccucugcaca

SEQ ID NO: 235681 - RNA, 64 nt, Human
ggggauuucaccacucaaaggccagaccugcagacgcccagauuaugagacacaggaugaagca

SEQ ID NO: 235682 - RNA, 64 nt, Human
ggcgagcgccgcacccgggcccgcagcggcaccgcgcccagagcggccucuccccacgcccggg

SEQ ID NO: 235683 - RNA, 64 nt, Human
ggaguagcugaggguccuuucugugcccuuaaaccgcccagaggagcccuauuccacucugguu

SEQ ID NO: 235684 - RNA, 64 nt, Human
agcuuccaugaggcaggcugaaccugcagauaugcgcccagagauauggaucgcccaagaguug

SEQ ID NO: 235685 - RNA, 64 nt, Human
cugaaaguccucaugccuggcagucggaggagagcgcccagacucugaacucagcagaaagugg

SEQ ID NO: 235686 - RNA, 64 nt, Human
ugauuccagugcuaaaagggaaaaaccugugguccgcccagaagagauuccuccagugccugag

SEQ ID NO: 235687 - RNA, 64 nt, Human
ggagacuccacccuggggucccaaacgccgcuaacgcccagacgcauggaugcacccccuaccc

SEQ ID NO: 235688 - RNA, 64 nt, Human
acaagagcagaauaguacuuaaaauccaaacugccgcccagaugggcuuguucuucaugccuaa

SEQ ID NO: 235689 - RNA, 64 nt, Human
acgggaacuccuccuuccugcuucagggccgcaccgcccagacuggcucagcccaggccaccaa

SEQ ID NO: 235690 - RNA, 64 nt, Human
cucugggaugcagcagccgcucgcauggaagugccgcccagaggcaugcaggcugcugggcacc

SEQ ID NO: 235691 - RNA, 64 nt, Human
gacuuagagaagaagaugcaaagaggcgaacgcucgcccagagcaagaaaugauagccagucau

SEQ ID NO: 235692 - RNA, 64 nt, Human
ccucccaucugugccucuguaaggggcucugggacgcccagacccugcccgccgcccaccuggu

SEQ ID NO: 235693 - RNA, 64 nt, Human
uuaucugcacuauaagcucaaagaaugucacauccgcccagacagcucuuugaugagggugaug

SEQ ID NO: 235694 - RNA, 64 nt, Human
uuucaacauacuugccauuagaaaacaaaguauugcuaaguacuauaacauauuggccacuaaa

SEQ ID NO: 235695 - RNA, 64 nt, Human
uucacuucagaagcacuuguaggucuuuacuagugcuaaguauuauggugagcuaucauuaaag

SEQ ID NO: 235696 - RNA, 64 nt, Human
uuguggcucccaggauuccaauuuuaauuggagagcuaaguaaguaaaguuuuauaacuguuag

SEQ ID NO: 235697 - RNA, 64 nt, Human
aaaucaauggagagaaaaaacugaaaaagaugcugcuaaguaguucucuguauuaaaggagaua

SEQ ID NO: 235698 - RNA, 64 nt, Human
acaaaagaaggaaaacuguaggggggaguaaugugcuaaguaagcagaauugccucaaaaagaa

SEQ ID NO: 235699 - RNA, 64 nt, Human
acuuuuuaaaauagaaaaauuacucuucuuuaaugcuaaguauugacacaucguuguuuguuuu

SEQ ID NO: 235700 - RNA, 64 nt, Human
uuaaugguguuacagcauuugcaaaaauuauucugcuaaguauuuacaacucuauuuauuauuc

SEQ ID NO: 235701 - RNA, 64 nt, Human
ggaagccagucauugaccauuuaaaaagucuccugcuaaguauggaaaucagacaguaagagaa

SEQ ID NO: 235702 - RNA, 64 nt, Human
cauugucuuccaguaucuacagcuucagacuugagcuaaguaaaugcuucaaagaaaucagagg

SEQ ID NO: 235703 - RNA, 64 nt, Human
gaugauuuguuuggcauauaggaagcacgcuggugcuaaguauuuuuuaaaugguuauguaagc

SEQ ID NO: 235704 - RNA, 63 nt, Human
uccuggcagccucaagugauccacccaccucggucucccaaaguguugggauuacaggcguga

SEQ ID NO: 235705 - RNA, 63 nt, Human
uacagaacuacuucuuacuucuuugcccugcccucucccaaaaaacuacuucuuuuuucaaaa

SEQ ID NO: 235706 - RNA, 63 nt, Human
cuuccacucuagggcaggcagagcagucuauacucucccaagccugcuugaccuccaaguaga

SEQ ID NO: 235707 - RNA, 64 nt, Human
uggcauaugccauuucugggaaaugcaucuggaggcuaaguauugcuuucuacaaauaauugcc

SEQ ID NO: 235708 - RNA, 64 nt, Human
uuuuuuuaaauuugcaaaucucaggauaaaguuugcuaaguaaauuaguaauguacuauagaua

SEQ ID NO: 235709 - RNA, 64 nt, Human
uucccugugcuauccugugggaagguaggaaugggcuaaguaugaugaauauauagguuaggga

SEQ ID NO: 235710 - RNA, 64 nt, Human
cugacauuguucacucaucaaaccacaucuugaugcuaaguaacauuucccaugagccacaaaa

SEQ ID NO: 235711 - RNA, 64 nt, Human
cuuguggcaucauuauaaggcuuaauuguggaaagcuaaguacuugcuucuauuccuuccaaug

SEQ ID NO: 235712 - RNA, 64 nt, Human
cauuuuacagaugaggaaacugaagcuaagagaagcuaaguaauaugcccaagguccacaucua

SEQ ID NO: 235713 - RNA, 64 nt, Human
aucuggcccuucuacaagcguauaagggauggcagcuaaguacaaaagaaggcgugcgugcaag

SEQ ID NO: 235714 - RNA, 64 nt, Human
agccauuuuugguaaauucaauguuauaaguguugcuaaguauagggaguuuuaugacaucaga

SEQ ID NO: 235715 - RNA, 64 nt, Human
acauuaauccacuaaacuggucuucuucaagagagcuaaguauacacuaucuggugaaacuugg

SEQ ID NO: 235716 - RNA, 64 nt, Human
ucaauaugaaaaucucaguuggagugaauuauuugcuaaguauuaaaugauuaaggcaugugcc

SEQ ID NO: 235717 - RNA, 64 nt, Human
acgccaugggaaguguuuacacuuggggacaagugcuaaguauuguggagcccauagccccuug

SEQ ID NO: 235718 - RNA, 64 nt, Human
uauuuacugugcuaaugggcugcugucauuuuaugcuaaguaaggggcaaaaaaaaaaauuaca

SEQ ID NO: 235719 - RNA, 64 nt, Human
ucauaccuuacugccuugaaaccccuaggacucagcuaaguauuugccuaacccugaccaggga

SEQ ID NO: 235720 - RNA, 64 nt, Human
auuuacacugaauuccaauuucauuucugcuuccgcuaaguaagagcaccucauuccuguguuu

SEQ ID NO: 235721 - RNA, 64 nt, Human
caggguagcccagugcaagguucagauccauguagcuaaguauuauccugcuuccagaccuaug

SEQ ID NO: 235722 - RNA, 63 nt, Human
uucugugaugaggggaggggggcacaugcugagucucccaaggcugcgucuggaggggccccu

SEQ ID NO: 235723 - RNA, 63 nt, Human
aacuccugagcucaugccaucugccugccuuagucucccaaaaugcugggauuacaggaguga

SEQ ID NO: 235724 - RNA, 63 nt, Human
gaaucaucauaaauaauuccaauagucugcacuucucccaaggugugcacugcucauaaacuu

SEQ ID NO: 235725 - RNA, 63 nt, Human
uguuuuauauuuggacuaagguucuugagcuuaucucccaagguacuuuccauaauuuaacac

SEQ ID NO: 235726 - RNA, 64 nt, Human
accauuuugauucuuagaauguaaaaagcauaucgcuaaguaaaucauccuggaggucccaagu

SEQ ID NO: 235727 - RNA, 64 nt, Human
auauguguuuguguuuaggauauuguaaaucuuugcuaaguaguguuuuccuuggugaaugaag

SEQ ID NO: 235728 - RNA, 64 nt, Human
uugucauccucuaaauauaaauccaaauaccucagcuaaguaauucuauuuuauuauuuuuacu

SEQ ID NO: 235729 - RNA, 64 nt, Human
uuuuauauggauaucuuauaaauauauaaucauugcuaaguaagaaguuaaguuguugcuaucg

SEQ ID NO: 235730 - RNA, 64 nt, Human
cggccccauguaucucaguaccccauggagcugggcuaaguaaauaggaauugguuucacgccu

SEQ ID NO: 235731 - RNA, 64 nt, Human
uacagugcaggguaaagugcagaccuuaaaaacagcuaaguaccuagaagagcucccugcaagu

SEQ ID NO: 235732 - RNA, 64 nt, Human
aacagaaucucuggggcacaaguuuuacacucaagcuaaguauaacuuugucauuucagguaaa

SEQ ID NO: 235733 - RNA, 64 nt, Human
aucucuuuguguucagaacucguuaaagcaaagcgcuaaguaaaaauauuaacugacgaagaag

SEQ ID NO: 235734 - RNA, 64 nt, Human
auacuuaagugagcaaaaaugacaaguuuuacuagcuaaguagagaaauaaaucucaaaugcag

SEQ ID NO: 235735 - RNA, 64 nt, Human
ucaucaauaaaugugauguuucuagucugaguuugcuaaguauauuuuaaaauaaucaguaaag

SEQ ID NO: 235736 - RNA, 64 nt, Human
ugaccauuauuagggaccagaaaauuauaucuuggcuaaguaauagaggaccauuuugguuuuu

SEQ ID NO: 235737 - RNA, 64 nt, Human
uaacucuuagaagaauucagaggaaauuaacccagcuaaguaaaaaaucugucuugauuuuguu

SEQ ID NO: 235738 - RNA, 64 nt, Human
acuguauuucuguguugacauuuguuggcagugugcuaaguaauguuuuuuaaagcacaggcuu

SEQ ID NO: 235739 - RNA, 64 nt, Human
ucuucaggaauuuuuagauucuuaaaaugucuaggcuaaguaugcaccuaaauauaaguagguu

SEQ ID NO: 235740 - RNA, 64 nt, Human
cuagcccugcuaaguucaggcuuagaggcuuaucgcuaaguauaaacuucaccagauuccacga

SEQ ID NO: 235741 - RNA, 63 nt, Human
aagcuacuguuuauauuuuuccuccugcuauucucucccaaauuaauuauuaauaaguguugu

SEQ ID NO: 235742 - RNA, 63 nt, Human
gaggagucccuggcuucucuuagccugagccuuucucccaaguuccagagccucuccgggccu

SEQ ID NO: 235743 - RNA, 63 nt, Human
uggugaaggcuaauggcagaguuagcaccccacucucccaagccaccccugcaagcagcacag

SEQ ID NO: 235744 - RNA, 63 nt, Human
gugcuaaagaaaugauauuuuauugcuuugauuucucccaaagaauaacuuggagguugacua

SEQ ID NO: 235745 - RNA, 64 nt, Human
uguauacaugguuuaaaaaauaguacuguuuaaugcuaaguaaggcagcagucauuuguguauu

SEQ ID NO: 235746 - RNA, 64 nt, Human
caugcaucuuacacugaucuuauuagaggucagugcuaaguacccaucuugauugaaguuagcu

SEQ ID NO: 235747 - RNA, 64 nt, Human
auuuaaagauuuaagcucugguggaugauuaucugcuaaguaagucugaaaauguaauauuuug

SEQ ID NO: 235748 - RNA, 64 nt, Human
aaacuaaggaacaagaaugagucucuuuuugguggcuaaguagaaucuuccuaaaaccauuguc

SEQ ID NO: 235749 - RNA, 64 nt, Human
aaauuagaaaauacauaccuauccagacauaaaugcuaaguaacauuuuuuucuuccuccaacu

SEQ ID NO: 235750 - RNA, 64 nt, Human
augccaauguguguggcaaacuuacaagaagggagcuaaguauccagccucucccaaaccucuu

SEQ ID NO: 235751 - RNA, 64 nt, Human
cugugguccauuucauaccauuuggguugcuucugcuaaguaaugaauacacuaagguccuugu

SEQ ID NO: 235752 - RNA, 64 nt, Human
aaaacaaaaaaguuugacuuuuguccaguaaauugcuaaguaaugucaauaaaucgaguauggg

SEQ ID NO: 235753 - RNA, 54 nt, Human
aguacaccagcuccaaguaagccugcuaaguaaacgucauuucuaacccaaagg

SEQ ID NO: 235754 - RNA, 64 nt, Human
uaauuuugugccauauuuugaauugcaacauuaugcuaaguauaacuuugcaagucaugauauu

SEQ ID NO: 235755 - RNA, 64 nt, Human
aggaaacccugaccuacccauaacucccugcuaggcuaaguagaaaccagguuauuucucccug

SEQ ID NO: 235756 - RNA, 64 nt, Human
cauuauauauagcucaauuaugucuguuuuuuaugcuaaguaggaaaaccaaccacacacauua

SEQ ID NO: 235757 - RNA, 64 nt, Human
ucaagguuuuauuccagagacuccagagacuuaagcuaaguauuuuuucauucuuucagauuuu

SEQ ID NO: 235758 - RNA, 64 nt, Human
uucuauuauuuuauacauacacauuaaguacucagcuaaguaauggcacuaugaggauuuuuuu

SEQ ID NO: 235759 - RNA, 64 nt, Human
ugugauccuggggaaggguagucuuuugucuucagcuaaguaguuuacugaccauuuucuucug

SEQ ID NO: 235760 - RNA, 63 nt, Human
aaucuuuuuaagauuaaaaaugaauaccuuaaaucucccaaaagagauaaccaguaucugaag

SEQ ID NO: 235761 - RNA, 63 nt, Human
gacaauauccccauucgucaugcucuuauuuucccgugggauauuugcauacaaaugcauguc

SEQ ID NO: 235762 - RNA, 63 nt, Human
caccaccugagcaugugugagggguuggagcuaccgugggacuauauacuguuaaugauuuua

SEQ ID NO: 235763 - RNA, 54 nt, Human
gcaucaaagugccauccugaccagccgugggaauggcugggcugccaggccaga

SEQ ID NO: 235764 - RNA, 64 nt, Human
uguggucaaaaacuagauaaugaaaguagcaggugcuaaguaucagugcuaaaugcucuguaug

SEQ ID NO: 235765 - RNA, 64 nt, Human
guaccguaggcuuuguauucaaaaauuaucuauagcuaaguacacaauaagcaaaaacaaaaag

SEQ ID NO: 235766 - RNA, 64 nt, Human
ugugaauuuaugucuuaguuuuauuugcagucuugcuaaguaaaaugagucuuuguaucuacuu

SEQ ID NO: 235767 - RNA, 64 nt, Human
gaaggcuucaucaccaagauuuugggagaguaaagcuaaguauaguugauguaacauuguagaa

SEQ ID NO: 235768 - RNA, 64 nt, Human
uuuccuuaaauguuuugccagccacuuaccaauugcuaaguauugaauuucagaaaaaaaaaau

SEQ ID NO: 235769 - RNA, 64 nt, Human
aaagaucucaauuuauauaaaguacuggaaaaaagcuaaguaauuuuuaguucuaucuauaauc

SEQ ID NO: 235770 - RNA, 64 nt, Human
aagcagcaagucaguaaucccccguggcaucacagcuaaguagcuguggccaccggcaguuuca

SEQ ID NO: 235771 - RNA, 64 nt, Human
augagguguaauuccccaaccccugcccgcaagagcuaaguaggaucuuacuguaaguugaagg

SEQ ID NO: 235772 - RNA, 64 nt, Human
agaccugguggacuuugaggacaacuaccaguuugcuaaguacagaucauucaagguggccgac

SEQ ID NO: 235773 - RNA, 64 nt, Human
aucagauaaauuauucaguuuuuguguuuagaaagcuaaguauguguagcuggaaacaaaaaug

SEQ ID NO: 235774 - RNA, 64 nt, Human
acuuaacuuuauugcaaugugaauuaauugcacugcuaaguaggaagauguguaacuuuuauuu

SEQ ID NO: 235775 - RNA, 64 nt, Human
agagggcaguguuuccuuuuugguacuuauuacugcuaaguauuucccagcacaugaaaccuua

SEQ ID NO: 235776 - RNA, 64 nt, Human
aaacaaacuucaucaagaguaaaugcaguggcaugcuaaguacccaaauaggaguguaugcaga

SEQ ID NO: 235777 - RNA, 64 nt, Human
aucgccccuacaaagcaguaguuguuucuuaauugcuaaguaaucuguuugcacucuaggaaaa

SEQ ID NO: 235778 - RNA, 64 nt, Human
aaaaaugugggaaguaacuuuucuguacccagaggcuaaguauaagucugugaucugccuuaug

SEQ ID NO: 235779 - RNA, 63 nt, Human
ucaaauuauuguuaguaaagaacaaaaugauucucucccaaagaaagacacauuuuaaauacu

SEQ ID NO: 235780 - RNA, 63 nt, Human
acaaugaacugcuagugacauuccucaaugaccucucccaaaccucccaugaugccuuacccu

SEQ ID NO: 235781 - RNA, 63 nt, Human
ucuugaguauauauuuuaucucuuauaccuguaucucccaacuagaaacagcuccaguguuuu

SEQ ID NO: 235782 - RNA, 63 nt, Human
uaugucuucgucucuuccaaccuaucuguucugucucccaauguaccacuuaucaacuaaucc

SEQ ID NO: 235783 - RNA, 64 nt, Human
ccuagaaaugaugcauaucauucccguuugcaucgcuaaguaagcaacuuaaguugcuuuaaca

SEQ ID NO: 235784 - RNA, 64 nt, Human
uauaaaguaaaguuuauuuuccucugccauccuugcuaaguaguuuugacacaaugaaaaugga

SEQ ID NO: 235785 - RNA, 64 nt, Human
guuucagagaaaggacuguggaccucuaucaucugcuaaguaauuuagaagauauuauuugucu

SEQ ID NO: 235786 - RNA, 64 nt, Human
gucguaccuugcuuuagaguagauguuuggaaaagcuaaguagaaauuuuuuaaaauagaaguu

SEQ ID NO: 235787 - RNA, 64 nt, Human
gaguccaaucaucaagguuuugcuuuucuuuuuagcuaaguaugcauuccucaauaguagacag

SEQ ID NO: 235788 - RNA, 64 nt, Human
caauaaaaacucacugggucuuucaugucuuuaagcuaaguaaguguucagaagguucuuuuuu

SEQ ID NO: 235789 - RNA, 64 nt, Human
gccccugugugaguugagucuccucucugagacugcuaaguaggggcagugaugguugccagga

SEQ ID NO: 235790 - RNA, 64 nt, Human
ugaagacuaauccauugacauucauaaugggacagcuaaguaccaaauagcuaacuacucccua

SEQ ID NO: 235791 - RNA, 64 nt, Human
ugcccagagccacagaaaauggaggauaauugaggcuaaguaaccugauuacaaguuguacuaa

SEQ ID NO: 235792 - RNA, 64 nt, Human
agaaugcccuuaugccccaguucaagccacugcagcuaaguauuaauccccagugcuaaaagau

SEQ ID NO: 235793 - RNA, 64 nt, Human
cuuaauuguaaucauaauaaaacaauugcagauugcuaaguagcuguuggugguacaaguuuga

SEQ ID NO: 235794 - RNA, 64 nt, Human
ggaagugcuucaagaccccaggugaaaugaaaaugcuaaguacccucugaauggccaugccugu

SEQ ID NO: 235795 - RNA, 64 nt, Human
accgugccuggccuccccugugucauuuuaaauggcuaaguaaauggguauauguguuugaaug

SEQ ID NO: 235796 - RNA, 64 nt, Human
ugaagggagcucuauuuucuuuaccagaaauguugcuaaguaauucccaauagaaagcugcuua

SEQ ID NO: 235797 - RNA, 64 nt, Human
ucagcuguugugaauuauguguaucugugugugugcuaaguacagucucuuuaccaaagggcac

SEQ ID NO: 235798 - RNA, 63 nt, Human
cacagugaguuguuuuggauaagaaaaucuuuuucucccaauuaauuuaccaauucaucauuu

SEQ ID NO: 235799 - RNA, 52 nt, Human
acuucaugucucaauuuuaauuucucccaagauggcacaucucaguaccuuc

SEQ ID NO: 235800 - RNA, 63 nt, Human
ggcuuucucuaauuuugugauguucugucauugucucccaaaguauuuaggagaagcccuuua

SEQ ID NO: 235801 - RNA, 63 nt, Human
acaaacuuacuaagaaaaaaucauuaauaguuuucucccaauuuccauaucuuacucaaccgu

SEQ ID NO: 235802 - RNA, 64 nt, Human
auaaaaccauauuauuaaauaccuauauaucacagcuaaguaggagaaagggagaccuuuuuau

SEQ ID NO: 235803 - RNA, 64 nt, Human
cuguacugauuacuguaggcgguuguaacacagugcuaaguauuuguguaucuaaacauaucua

SEQ ID NO: 235804 - RNA, 64 nt, Human
uccugagcagaagagcuuggggaaaugaacuuuugcuaaguaaacccaguauuuaaauuaaguc

SEQ ID NO: 235805 - RNA, 64 nt, Human
cccaaugguggaaaggaagauuuacagucuagcggcuaaguaccuccuacacauuucccaucaa

SEQ ID NO: 235806 - RNA, 64 nt, Human
acaaccacagaaagcacucaacugguuugacauugcuaaguauauccuguauacuuuuccaggc

SEQ ID NO: 235807 - RNA, 64 nt, Human
aagugaaaaauuuuugcuucaaaggagcucacaagcuaaguaaauaaaugaaauuaagguaugg

SEQ ID NO: 235808 - RNA, 64 nt, Human
agcucuaggcauuguucucuuuggauccagggaugcuaaguagaaacugcaugagccaccagug

SEQ ID NO: 235809 - RNA, 64 nt, Human
cuaucuauauauaagcucaugguagaaaaccauagcuaaguagcaucgcagacuuaagcguaca

SEQ ID NO: 235810 - RNA, 64 nt, Human
uuuuuuuagcagacaccagagccacacucaaauggcuaaguagguuaugaccucucuggauuau

SEQ ID NO: 235811 - RNA, 64 nt, Human
aguccucuuacaauuuauuuuccgcagcaugucagcuaaguagacccaauggggagagaaaaug

SEQ ID NO: 235812 - RNA, 64 nt, Human
cauuuauucuggguuaugcuugaaguguuagauggcuaaguauuaaaauuauccaaauuaaauc

SEQ ID NO: 235813 - RNA, 64 nt, Human
aauuauuugauaaccaaggaagucaagucagauggcuaaguaguaacuuuccaauaugauuucu

SEQ ID NO: 235814 - RNA, 64 nt, Human
cagccgcagccgccaacagcagcgcuguuagugagcuaaguaagcacugacuucguagaaaacc

SEQ ID NO: 235815 - RNA, 64 nt, Human
uauugaaaccuauugauucaauggguagagauuugcuaaguaugaugugcuuccaccucuucuc

SEQ ID NO: 235816 - RNA, 64 nt, Human
cuuucugauccuggccccuaaagaauuuacuugugcuaaguaauaaaauuccuauugaucaaaa

SEQ ID NO: 235817 - RNA, 63 nt, Human
agacgcugcgccuccuagugggcucccggggcaccgugggaggcagcggcuccuggccguacc

SEQ ID NO: 235818 - RNA, 63 nt, Human
gggggacaugauccauggacaaggccaucccggccgugggagaccccagucccgaagucuugc

SEQ ID NO: 235819 - RNA, 63 nt, Human
uaauuaugagcgccuaccagccaggccacccagccgugggaggaagggggcguggcaaggggu

SEQ ID NO: 235820 - RNA, 63 nt, Human
gagagccauccauagggagcuggcuggggguuuccgugggagcuccagaacuuuccccagcug

SEQ ID NO: 235821 - RNA, 64 nt, Human
uuccugguuuuaaguaauaauacuuaacucucaagcuaaguaaaaauaugucaucaugcuuaug

SEQ ID NO: 235822 - RNA, 64 nt, Human
guucagcuagaagucauaccacccucaggaaucagcuaaguaauuauuacuugauucuuuuagc

SEQ ID NO: 235823 - RNA, 64 nt, Human
agguacugacacuucagauauacuaaaucagagugcuaaguauagaaaaucugaaacuaaaguu

SEQ ID NO: 235824 - RNA, 64 nt, Human
cccccacucugucuccugcccccgggggccuguggcuaaguaaaccauaccuaaccuaccccag

SEQ ID NO: 235825 - RNA, 64 nt, Human
uaauuuuguauuuugaauguacacgcaugcugaagcuaaguaacuuuuaaucaaagaaauaaga

SEQ ID NO: 235826 - RNA, 64 nt, Human
gauaguaagacuuacugcagucgauuugggauuugcuaaguaguuuuacagagcuagaucugug

SEQ ID NO: 235827 - RNA, 64 nt, Human
acuuugguuuuguuguuguuuugauuuguuuuuggcuaaguagaggacauggacuaguuguagc

SEQ ID NO: 235828 - RNA, 64 nt, Human
gccugcaaggccugaauuagagagacuuccauuggcuaaguaguuaagagccgucccauuucuc

SEQ ID NO: 235829 - RNA, 64 nt, Human
aagagguucuugguaagauauaaaauggaaaaaggcuaaguaauaugugaauaucauauuuuug

SEQ ID NO: 235830 - RNA, 64 nt, Human
ggugauuuggaugcguuguaacacugcuaaauaugcuaaguacagaauuuuaucuacaguacug

SEQ ID NO: 235831 - RNA, 64 nt, Human
cuuucuggagaggagggaugcugccugagucacccaugaagacaggacagugcuucagccugag

SEQ ID NO: 235832 - RNA, 64 nt, Human
ggggaccuggggggagggacagggcaggcgggcccaugaagaaagccccucguugcccagcacu

SEQ ID NO: 235833 - RNA, 64 nt, Human
gaguagagaacaacuggcagcuuugaaaaaacaccaugaagaagaaaucguucaucauaagaag

SEQ ID NO: 235834 - RNA, 64 nt, Human
cuccugaauugaguuugaugcagagcuuuuuagccaugaagaaucuuucagucauaguacuaau

SEQ ID NO: 235835 - RNA, 64 nt, Human
uguaacauauuuuugagauugucccaugucguuacaugaagaguuucuugauucuuggucuaua

SEQ ID NO: 235836 - RNA, 63 nt, Human
guuggggggcugccuuagcagccaaaggucacuucucccaaacuccuucccugcuuuccaggu

SEQ ID NO: 235837 - RNA, 63 nt, Human
auaaaugaaacaaacacugggcagcugcagguuucucccaaucaugucucuuuauguaaagac

SEQ ID NO: 235838 - RNA, 63 nt, Human
uauaaauuauauguauugaaacauuauuauguaucucccaaauauguucaauucuuaugucgc

SEQ ID NO: 235839 - RNA, 64 nt, Human
gaacugauaggaaaacaaaugaguagaaagaguucaugaagaggcccuccucugccuuucaaaa

SEQ ID NO: 235840 - RNA, 64 nt, Human
aacaaaagccaguucuguuuuaugaaauauuaaacaugaagaaaacuuguauauucuaauguuu

SEQ ID NO: 235841 - RNA, 64 nt, Human
aaugucgacccugugcggacauuccgcauacugccaugaagacggucucuguguccucagcuca

SEQ ID NO: 235842 - RNA, 64 nt, Human
uauuuauaguuuucuauauaaacuguaguaucuucaugaagacccaaggcucaaauuuacuguc

SEQ ID NO: 235843 - RNA, 61 nt, Human
caugcacugcaagcagcuaaacaugcaagaucaugaagaguguaaccaaaguaauugaaag

SEQ ID NO: 235844 - RNA, 64 nt, Human
acagcagugugugugaagugaaccucuaccugaccaugaagaggcaagagcacagacuuacaag

SEQ ID NO: 235845 - RNA, 64 nt, Human
ugaagucccuguuugggaaugaggcacuuaucagcaugaagaauuuuuucucauucugugccau

SEQ ID NO: 235846 - RNA, 64 nt, Human
caacaauccgaaggggcauguugcuccugagcagcaugaagaacugaccaaauugguuuugaug

SEQ ID NO: 235847 - RNA, 64 nt, Human
uuuuaaaagguaaaaaaauaaaauaaaauuacaacaugaagauucagauuuuuuuucuuuucca

SEQ ID NO: 235848 - RNA, 64 nt, Human
agaauacauggaaacgcaaaugaguauuucggagcaugaagacccuggaguucaaaaaacucuu

SEQ ID NO: 235849 - RNA, 64 nt, Human
cauaggcucaagauuguacagugagugaugcugucaugaagaaaauucagaugaaaaaggcaag

SEQ ID NO: 235850 - RNA, 64 nt, Human
ucuagagcaauucaguccuguuggaaauuuagaacaugaagaaacuuugaaugucuugacccuu

SEQ ID NO: 235851 - RNA, 64 nt, Human
uuaaaaacagaaaauuauagucaauauaccaugacaugaagaaugaauccauucuuuggagaug

SEQ ID NO: 235852 - RNA, 64 nt, Human
uaucagaacugccuauaguaaccaaaauuggauucaugaagaaaaaaauauauuuuaggaaaac

SEQ ID NO: 235853 - RNA, 64 nt, Human
uucuucucaggcaacauuugcuuuuaaaaauaaucaugaagagaaggcuguuaaagcaaaaauu

SEQ ID NO: 235854 - RNA, 63 nt, Human
uugugugccaggggcaguaaugucccugccucuucucccaaucaagguugaggaguggggcug

SEQ ID NO: 235855 - RNA, 63 nt, Human
aaaaaaagacauaauucacacauuaauaaacaaucucccaaguauugauuuaacuucauuuuu

SEQ ID NO: 235856 - RNA, 63 nt, Human
aagcacaaccugcaacauacuuugauuaccuguucucccaaggaaugggguugaaaucauuug

SEQ ID NO: 235857 - RNA, 64 nt, Human
aauuagaauuaugcugccuaccucacagagguaucaugaagauagcauuuagaaagggcuuugu

SEQ ID NO: 235858 - RNA, 54 nt, Human
uguugguguuuuuaaccuagcauccaugaagaagguaaaaucccuacgugaucc

SEQ ID NO: 235859 - RNA, 64 nt, Human
uuuacugcaaacuugaaaaugcuagaaaaccaagcaugaagaauaaauacauggugggaaacac

SEQ ID NO: 235860 - RNA, 64 nt, Human
ccucaggaaagggaagaaaaagaagagguggcaccaugaagaggagaagaugggggucuuggag

SEQ ID NO: 235861 - RNA, 64 nt, Human
agugagggaaggauguuuagcaguggcuggugcccaugaagaggagauuggccagugagaagcu

SEQ ID NO: 235862 - RNA, 64 nt, Human
ccagaaauuaaaauaucacccuuuucagcccucccaugaagaauuucuaggucauaaacaugaa

SEQ ID NO: 235863 - RNA, 64 nt, Human
ugugugggaaaagaaggcucuuuggggacccugacaugaagaaguccacuaagugggagaucuu

SEQ ID NO: 235864 - RNA, 64 nt, Human
uugcgacuuucucggacauaucaacugccuuucucaugaagaauuuuaauggguuacaguauga

SEQ ID NO: 235865 - RNA, 64 nt, Human
aguauuaacaaauggcaaugaguagaaaaguuaacaugaagauuuuagaaggagagaacuuaca

SEQ ID NO: 235866 - RNA, 64 nt, Human
aguuuugcauguauuaaauucaauuaaugcugaacaugaagaguaaaguauuuaucugaaagaa

SEQ ID NO: 235867 - RNA, 64 nt, Human
uauaguauauguaaguagcuaaugaaguaaagaucaugaagaaagaaauugauagguguaaaug

SEQ ID NO: 235868 - RNA, 64 nt, Human
ugcccacccugcgggggccuccccagugggcccacaugaagagagggaaccuguuaguccagaa

SEQ ID NO: 235869 - RNA, 64 nt, Human
uuaggaacguaucuuugcaaacugcccauucacccaugaagaggaagccucaagaucccuugga

SEQ ID NO: 235870 - RNA, 64 nt, Human
uuauugucacaaaucagcaggcacaagaacuguccaugaagaugggaaauagccuuaaggcuga

SEQ ID NO: 235871 - RNA, 64 nt, Human
uguauuaaugaaaaugcaucuauuucagagcugacaugaagaguuuaguuuuuuuacuuuauaa

SEQ ID NO: 235872 - RNA, 63 nt, Human
aguggaauugcccaguacugccugccagcugggucucccaagcaacuaccccaagacauacca

SEQ ID NO: 235873 - RNA, 63 nt, Human
ucuaaguuguucuugcaggaauuagccuccccgucucccaaaaccuugagaaugaagcccuug

SEQ ID NO: 235874 - RNA, 63 nt, Human
uaagugaaucacauaauugucuuuggaacuuggucucccaacacuuauugugauugcaaagug

SEQ ID NO: 235875 - RNA, 64 nt, Human
gaugacuugugauuuuuuuuucuuuuuuuuaaaccaugaagagccguuugacagagcaugcucu

SEQ ID NO: 235876 - RNA, 64 nt, Human
cccaguugagccuuauagggucaguagcucuccacaugaagaccugucacucaccacuaugcag

SEQ ID NO: 235877 - RNA, 64 nt, Human
gaacacuggaauauuacacgaugagauucugauucaugaagaaaagcagauagaagugguugaa

SEQ ID NO: 235878 - RNA, 64 nt, Human
gcaaacucuauaaagaaacuuuugaaaaaguguacaugaagaauguagcccucuccaaaucaag

SEQ ID NO: 235879 - RNA, 64 nt, Human
gacuaaagaaagaaaaucucaguauauucguucucaugaagacacagucagacacuggacaaug

SEQ ID NO: 235880 - RNA, 64 nt, Human
ucuguguaaucaucugaagaaauuggucccaagacaugaagacaucuuauccauccucacugcu

SEQ ID NO: 235881 - RNA, 64 nt, Human
aauauacuuucgaaagaauaaaauaguucuccuacaugaagaaagaauaugucaggaaauaagg

SEQ ID NO: 235882 - RNA, 64 nt, Human
cuucuccccucaagaaauuuucaacgccaggaaucaugaagagacuucugcuuuucaaccccca

SEQ ID NO: 235883 - RNA, 64 nt, Human
acuccuuuuaagcagugaguuauggugguggucucaugaagaaaagaccuuuuggcccaaucuc

SEQ ID NO: 235884 - RNA, 64 nt, Human
ccagccugagcgacagugagacucugucucaguccaugaagauguagaggagaaacuggaacuc

SEQ ID NO: 235885 - RNA, 64 nt, Human
aauuagaaaaaauaauaagucgcugucaggugugcaugaagaaaagacacugaagcuaaaaaag

SEQ ID NO: 235886 - RNA, 64 nt, Human
cccccaucagggcaaauggucuaacuggugcaaucaugaagagaguuaaugguuaacagacauu

SEQ ID NO: 235887 - RNA, 64 nt, Human
auuuuuuacugugaagaugaaauuacccuaauagcaugaagaucgugggucuguguguccguga

SEQ ID NO: 235888 - RNA, 64 nt, Human
ucuugccuccugaaguagcuucaucacagagugucaugaagacagacagucaggcugaaaugga

SEQ ID NO: 235889 - RNA, 64 nt, Human
cuuuuucuccuacuuuuuacuggggugagaggggcaugaagagaaauacgccuuuuuuuuuuuu

SEQ ID NO: 235890 - RNA, 63 nt, Human
ggucuuaauguagcuacugugcgggucacaguuucucccaaugauuaugacugggacauucuu

SEQ ID NO: 235891 - RNA, 63 nt, Human
aagaccagccugggcaacauagugagaccccugucucccaaaaauuuuuuuuaauuagcugug

SEQ ID NO: 235892 - RNA, 63 nt, Human
agauaggcccccaaauaaagaccugucuauggcucucccaaccuucugucagcuucuuuggca

SEQ ID NO: 235893 - RNA, 64 nt, Human
aucugaagccuugagaaccuugggucuggagagccaugaagagggaaggaaaagagggcaaguc

SEQ ID NO: 235894 - RNA, 64 nt, Human
aagaaagugaaggaggggaaacuguuuaauaucacaugaagacccuagcuuuaagagaagcugu

SEQ ID NO: 235895 - RNA, 64 nt, Human
auguauguagaagaucuuaaguccauacgcauuucaugaagaaccauuggaaagaggaaucugc

SEQ ID NO: 235896 - RNA, 64 nt, Human
ugacacaucauuaucacccaaaguccauaguuuacaugaagauucacucugguguuguacauug

SEQ ID NO: 235897 - RNA, 64 nt, Human
aggggaacuccgaguucuuucugagccugcuggacaugaagagcagaugaccaccaugcucugu

SEQ ID NO: 235898 - RNA, 64 nt, Human
uuguugucguuuaaagaaagacuuuaacaggugucaugaagaacaaacuggaauuucauucuga

SEQ ID NO: 235899 - RNA, 64 nt, Human
uguaugaaugaaaaugcaucuauuucagagccgacaugaagaguuuaguuuuuuuacuuuauaa

SEQ ID NO: 235900 - RNA, 64 nt, Human
uugugcaguguugacaguucauauguaccauguacaugaagaagcuaaauccuuuacuguuagu

SEQ ID NO: 235901 - RNA, 64 nt, Human
agaaaacuucaauuuucuggguaugcacaaagaccaugaagacuuauccaagugcaugaccgga

SEQ ID NO: 235902 - RNA, 64 nt, Human
uuuucucuuccagauguacagaaagguguucuuacaugaagaagggugugaaggcugaacaauc

SEQ ID NO: 235903 - RNA, 64 nt, Human
ugaagagaaggacaagucuaagaagagaaagcuucaugaagaacuuucuagcagucaccauaac

SEQ ID NO: 235904 - RNA, 64 nt, Human
aaacucaauuugaguuuuaccaauuaaugugucucaugaagagaagacaccaguuuuaaaauga

SEQ ID NO: 235905 - RNA, 64 nt, Human
uccaaaggggaccccuaugaaguaaagaacugcacaugaagaaauacugcacuuacaaucccac

SEQ ID NO: 235906 - RNA, 64 nt, Human
cagacugugacaaacccagggcugaggccugccccaugaagaggcugagcccccugaaaccccu

SEQ ID NO: 235907 - RNA, 64 nt, Human
aaagaauaaagcuuuuaaguauagacuaccuuagcaugaagaugcucaugccuaagaaugaaaa

SEQ ID NO: 235908 - RNA, 63 nt, Human
cagcuaaucauuuauccaaaggcuuuccauucuucucccaauauuuuuuuacuuuaauuuuuc

SEQ ID NO: 235909 - RNA, 63 nt, Human
gaccuccagggcucaaggauccuccugccucagucucccaacuaagugggacuacaggcacgu

SEQ ID NO: 235910 - RNA, 63 nt, Human
gaaucauuaucaucucaacaugcccccaauuucucucccaaucacccucaauacucacgugua

SEQ ID NO: 235911 - RNA, 64 nt, Human
gacaguuuuaguuugccuuuuugccucuggugggcaugaagacugagcaaagcugggaauccug

SEQ ID NO: 235912 - RNA, 64 nt, Human
ugacccaucuggcccucccuugucacgugucaggcaugaagaagccacugguucuaggcauuuc

SEQ ID NO: 235913 - RNA, 64 nt, Human
caggaccaucuuaaagccgcccucagcacaucugcaugaagauagauaggcacuccugucccug

SEQ ID NO: 235914 - RNA, 64 nt, Human
ucaaagaaaagaugauacagguaagauuggaacucaugaagacaaaagauaagacaguggcaua

SEQ ID NO: 235915 - RNA, 64 nt, Human
uuuuucucuucgcuucaggcccuuacacaaaagccaugaagagauguucaccuacccgguauuu

SEQ ID NO: 235916 - RNA, 64 nt, Human
ugggaagacauggggaggaaggacaaggcuagaucaugaagaaccuugacggcauugcuccguc

SEQ ID NO: 235917 - RNA, 64 nt, Human
ucauuuugucaucaauggcagcauuccagaggaucaugaagacugggcuuccaauggggaggag

SEQ ID NO: 235918 - RNA, 64 nt, Human
uuuagagguugaacaggugauuccauuaccuagucaugaagaaguuaccacccaccaggccuua

SEQ ID NO: 235919 - RNA, 64 nt, Human
aaaaaaggguuuucucagugaaauuuuugggcaucaugaagaacgaucaacuaucuucuaauuu

SEQ ID NO: 235920 - RNA, 64 nt, Human
uuuggugauaagcacaaaucucuacuccucaugacaugaagaaaaagacugaaugugaagggag

SEQ ID NO: 235921 - RNA, 61 nt, Human
ggcaguugcccaagaucugauacaagguacccaugaagagauuaugaacuacuugaaggug

SEQ ID NO: 235922 - RNA, 64 nt, Human
ccauacugacacugggaaaagcccauucccaugccaugaagacaccaaggcagcccuauugaga

SEQ ID NO: 235923 - RNA, 64 nt, Human
uuccuuucagcugauggagaaacuuccucuuuuucaugaagaaaacacccuuccucaacagcug

SEQ ID NO: 235924 - RNA, 64 nt, Human
guuacugucaucugaaguagcagcucuuuaaaaacaugaagagauaaaauuauaaaaaugauac

SEQ ID NO: 235925 - RNA, 64 nt, Human
ugugccuaugcuuccacuuuccuuuucccuccaccaugaagauggguuaagagucucaagguug

SEQ ID NO: 235926 - RNA, 63 nt, Human
aacuccugaccuuaggugauccacucgccuucaucucccaaagugcugggauuacaggcguga

SEQ ID NO: 235927 - RNA, 63 nt, Human
acacuaucuuccucucuccuaucuuucccucagucucccaaguuccucuaccuucuuuaucuu

SEQ ID NO: 235928 - RNA, 63 nt, Human
aauaaaacgguagaauaugaaaagcucaggaucucucccaaggcuaccuacugcaggagggcc

SEQ ID NO: 235929 - RNA, 64 nt, Human
acagaucaccauuaaaaagaauauuagaauccagcaugaagauaauggcuaauaaaaaugaggu

SEQ ID NO: 235930 - RNA, 64 nt, Human
uacaaacaucaagaaagcugcagauggauguuuccaugaagaaaucucugaagaaaccaaaaga

SEQ ID NO: 235931 - RNA, 64 nt, Human
cucuaaaucccuugcagauccuugauaaaugccucaugaagaccaaucucuugaaucccauauc

SEQ ID NO: 235932 - RNA, 64 nt, Human
aucugauaugucugguagcaugucauugaugggacaugaagacaucuuuggaaaugaugagauu

SEQ ID NO: 235933 - RNA, 64 nt, Human
gcugcauuguuugggggccaggcauuacuacuaucaugaagaaaaaugaagagcaggaugcaug

SEQ ID NO: 235934 - RNA, 64 nt, Human
aaggacagcguugcauagaggggcaguuacaggccaugaagaauguguagaugcauuacuucaa

SEQ ID NO: 235935 - RNA, 64 nt, Human
gcuccagaugaaaaugucucguuucugugaauuucaugaagagcagaacauuucucaagaaucc

SEQ ID NO: 235936 - RNA, 64 nt, Human
uguccccagcgaggggguugggggauggaguucacaugaagauguaaggaauuugggugggggc

SEQ ID NO: 235937 - RNA, 64 nt, Human
ucagacucuuaccaucccggugcaugcaggucuccaugaagaagcugggacucauucacauuuc

SEQ ID NO: 235938 - RNA, 64 nt, Human
ccagucuuuaauuucaaaaacuucaaauuagccucaugaagagaauuuuucccugugaaaagua

SEQ ID NO: 235939 - RNA, 64 nt, Human
auaaggguauuuguaaaaggcagaauguuugggccaugaagaaguaggggcugaagaggaaggu

SEQ ID NO: 235940 - RNA, 64 nt, Human
accauuuuguagaagaaggaacgaugacaggucgcaugaagaucagccucuaguacugaugauc

SEQ ID NO: 235941 - RNA, 64 nt, Human
uguuuuuguuuuuguuucguuucauuuuguacuacaugaagaacuguuuuuugccugcugguac

SEQ ID NO: 235942 - RNA, 64 nt, Human
acuaagauguguaaaauggacugaaaugcuccaucaugaagacuugcuuccccaccaaagaugu

SEQ ID NO: 235943 - RNA, 64 nt, Human
uugccagacaggaagucuuuagacugcccacauucaugaagaagaugauguguggcuggaucag

SEQ ID NO: 235944 - RNA, 63 nt, Human
gacuuggauuccuucugucccuccccaccuuucucucccaaugaagaaacguuuauauccugu

SEQ ID NO: 235945 - RNA, 63 nt, Human
acucugaauucuugcacaccuuuccuaaaaauuucucccaagagagacuuguuugggccuuuu

SEQ ID NO: 235946 - RNA, 63 nt, Human
cucccagccaucuguauaaacacaauccuuuguucucccaaaucugaaucgaauuacucuuuu

SEQ ID NO: 235947 - RNA, 64 nt, Human
uuagcacuuugguuccacaucugucuggguaaaccaugaagaaaaugaagcugcugccucaauc

SEQ ID NO: 235948 - RNA, 64 nt, Human
acauuagaauuauaagaagacaugaggagcaaaucaugaagagcggauuggucuuuguucaaca

SEQ ID NO: 235949 - RNA, 64 nt, Human
uuacacagacuuccauuuucuuaagauaaucaaucaugaagaaauccuuuaucaaucauucaaa

SEQ ID NO: 235950 - RNA, 54 nt, Human
gucaaucccaguugaauuaauuggcaugaagaguacagauguaaucacaaguaa

SEQ ID NO: 235951 - RNA, 52 nt, Human
ucuucccaggucgcuauuaaagcaugaagacuuucugaaaccugcccuagag

SEQ ID NO: 235952 - RNA, 64 nt, Human
gcuggauaaccagacugugacauuucagccugaccaugaagacggcggagguagguuggggagc

SEQ ID NO: 235953 - RNA, 64 nt, Human
uuggggugggauggggcaggccgugguccuccagcaugaagaaggagccaugaggaguucccau

SEQ ID NO: 235954 - RNA, 64 nt, Human
acuguaaaauuauaauuuagugccccguuuucuacaugaagacaccgucuuccuuuauuaauuu

SEQ ID NO: 235955 - RNA, 62 nt, Human
uccuaccauuuuuguuuuaaguuaaccucagucaugaagaaugcaaaccaggugaugguuuc

SEQ ID NO: 235956 - RNA, 64 nt, Human
uuaguaaaugaugccucugcaaaaugguaguacccaugaagauauguauauugucauuggaugu

SEQ ID NO: 235957 - RNA, 64 nt, Human
gaaaguuuugucugaaaaccuuugaauagaauggcaugaagauuuuaaucaauuacuuauaaac

SEQ ID NO: 235958 - RNA, 64 nt, Human
acauugugaaugacuacuugccacaguaaaaauacaugaagaauguguuagguuuaaacgucgu

SEQ ID NO: 235959 - RNA, 64 nt, Human
gacgagucuacccucaaaccaguagugucuuuuacaugaagagaugauuuacaccuaauagaca

SEQ ID NO: 235960 - RNA, 64 nt, Human
guauauuuaaacagugaaaaacuaacugaaagcacaugaagaguuguaacuugggggaaaauag

SEQ ID NO: 235961 - RNA, 64 nt, Human
gccccgggucaccgcccgcccagcguuccaggcacaugaagagaaagcauuccaaagccucuga

SEQ ID NO: 235962 - RNA, 60 nt, Human
augauaucagccaagaguuuuccugugguuccagcccaucuucccuaaucacaauagcaa

SEQ ID NO: 235963 - RNA, 63 nt, Human
caguaguuggagaggcaggcagagggcagugguucucccaaauaggagaccuggggccuggcc

SEQ ID NO: 235964 - RNA, 63 nt, Human
ucucugcagaguauaauauacuauaugguaacgucucccaaacuccucuccuggaucaaaaau

SEQ ID NO: 235965 - RNA, 64 nt, Human
uccccccuacccccagccugacaaauauuguuaccaugaagauaguuuuccucaauggacuuca

SEQ ID NO: 235966 - RNA, 64 nt, Human
cgcaagggcaaaccauuucaaauggcagcaguuccaugaagacacgcuuaaaaccuagaacuuc

SEQ ID NO: 235967 - RNA, 64 nt, Human
accccaaauaugguuaaaagauuuuuuuuuuaaucaugaagagaaaauuaguagcauuucuuuc

SEQ ID NO: 235968 - RNA, 64 nt, Human
ucaccgcagucugcuaaccaauuccagucugguccaugaagaggaaagguagaucugagcucau

SEQ ID NO: 235969 - RNA, 64 nt, Human
cacugccaugucagggguuugcuuacagugaugccaugaagacaguccaguagacuugguagcg

SEQ ID NO: 235970 - RNA, 64 nt, Human
gagagugacuuugucuuagaacuuaggugguagucaugaagagauaauguuuuuaggcaguuaa

SEQ ID NO: 235971 - RNA, 64 nt, Human
uuguauugugauuaucaauuaccacaccaucucccaugaagaaagggaacggugaaguacuaag

SEQ ID NO: 235972 - RNA, 64 nt, Human
ccuuuguuuucuggcaucucguaccacgaacacucaugaagacccugcagucauuggagcaccc

SEQ ID NO: 235973 - RNA, 64 nt, Human
auguuuaaaguuuuccgggccaagaauuuuuauccaugaagacuuuccuacuuuucucaguguu

SEQ ID NO: 235974 - RNA, 64 nt, Human
caucugacugugauuuucuaauguauaugauuuccaugaagaaauuuuguuucuaaacaugcac

SEQ ID NO: 235975 - RNA, 64 nt, Human
gauaaaacaucucucuucuccuucccaacuacugcaugaagaaauucuacuuccauuauauuaa

SEQ ID NO: 235976 - RNA, 64 nt, Human
gcuugucaauuaugaaggugugucccagauauuacaugaagaucaugcaaacuacuugaaauuu

SEQ ID NO: 235977 - RNA, 64 nt, Human
ggcuuccucuggggguccgagggucuucccaucacaugaagacaucagguuggguccugcccca

SEQ ID NO: 235978 - RNA, 64 nt, Human
uuauaacaaguaaaccguaguugcaagaauauaccaugaagauuaaaguaggcuggguuucauu

SEQ ID NO: 235979 - RNA, 64 nt, Human
aauaaauguauagagagugucaagugaugaguaccaugaagaagaauaaaugaggguaaggggc

SEQ ID NO: 235980 - RNA, 60 nt, Human
agacuccugggcucaccuguuagcgcuggcccagcccaggccuugggaccuggggguugg

SEQ ID NO: 235981 - RNA, 63 nt, Human
uuccaaauaaacauuuuuuaagaaaacauuucuucucccaaaugucuauuuucuugaggaaaa

SEQ ID NO: 235982 - RNA, 63 nt, Human
cagccccacuccccuuccucauccccagcugugucucccaaccucccuucguguuguuuugca

SEQ ID NO: 235983 - RNA, 64 nt, Human
aacaagauguaaacaggaaagaaaucuaguugagcaugaagauaggaucuaacagcuuuuccag

SEQ ID NO: 235984 - RNA, 64 nt, Human
aguccccaaauuucauucuuagaaaguuauguuccaugaagaaaaauauauguucuuuugaaua

SEQ ID NO: 235985 - RNA, 64 nt, Human
guccaaucaugcuguggugcauuccuuugaagaucaugaagaauagccaaacuugucuuugagg

SEQ ID NO: 235986 - RNA, 64 nt, Human
gagggacaaacucacucaguaaaacauaauguaucaugaagaaaacugauucucuaugacauga

SEQ ID NO: 235987 - RNA, 64 nt, Human
uuuugguguggaugagcagggacaaauugcugagcaugaagaagaguaaaauuaagcaagugga

SEQ ID NO: 235988 - RNA, 64 nt, Human
ucugaggacaggguggcaugucugcuugugugcucaugaagacaugcccacgccauggagccag

SEQ ID NO: 235989 - RNA, 64 nt, Human
ugaagguguuucaaaggguaaauuauaaauguuucaugaagaaaaaauuuuaaaaaucuacguc

SEQ ID NO: 235990 - RNA, 64 nt, Human
ggagggaggaauuuucauugccuucucccucaugcaugaagauucgaacagcuuauuuuuuccu

SEQ ID NO: 235991 - RNA, 64 nt, Human
ggacuugggauucugacucaccccaaacccagaacaugaagaagaccuuuacaguuugugcucu

SEQ ID NO: 235992 - RNA, 64 nt, Human
guaggcaagggauaauaaccaaagaagaaaauuucaugaagacuagacaucauaaagcauaauu

SEQ ID NO: 235993 - RNA, 64 nt, Human
aaggacuuuuuguauagaaagcacuacccuaagccaugaagaacuccaugcuuugcuaaccaag

SEQ ID NO: 235994 - RNA, 64 nt, Human
gagucugacucaucucugcacaaccucucugugccaugaagauaagucuuccauggccaaaucg

SEQ ID NO: 235995 - RNA, 64 nt, Human
cuuuuuaaaauacguccaguucuuacccaguuaacaugaagaaaccacugucucuagaagaaag

SEQ ID NO: 235996 - RNA, 64 nt, Human
auuuacuguaaaaguauucccaguaugugugcagcaugaagaaaguauuagugcuucucagugu

SEQ ID NO: 235997 - RNA, 64 nt, Human
acaccaguuccaaguaacuuugccaagggagagacaugaagacagaggagaaaugaaugcauaa

SEQ ID NO: 235998 - RNA, 60 nt, Human
cacucuggcagcaccgccucuucccgccgcccagcccaccccauggccggcuuucaggag

SEQ ID NO: 235999 - RNA, 63 nt, Human
uguucuucaguagccaucagaucagaaagaaucucucccaacauuuuagagucuugcuuccca

SEQ ID NO: 236000 - RNA, 63 nt, Human
ucccugacuuucugaagcuagaaaaauguugugucucccaaccaccuuuccauccccagcccc

SEQ ID NO: 236001 - RNA, 64 nt, Human
uuagcagacagcuguuccacgcgggccagggcggcaugaagaagucccgccgcuacgugcccgg

SEQ ID NO: 236002 - RNA, 64 nt, Human
cuugacaggauaguuaauaauaaaccuuaaaacccaugaagaaaucugagguaaaguguuagca

SEQ ID NO: 236003 - RNA, 64 nt, Human
gaggccugugguacacagagauuagguugugauacaugaagagccaagagcaggaugaggugga

SEQ ID NO: 236004 - RNA, 64 nt, Human
cugaccauguugcauuuggaaggcuaaauggggccaugaagaaggcuggaagggacagggggug

SEQ ID NO: 236005 - RNA, 64 nt, Human
uaaggugccugcuagccauuguauaaaauuaaaacaugaagaauauuuuuuuuuugagcauggc

SEQ ID NO: 236006 - RNA, 64 nt, Human
gagaauuuggauacacucucuagcuuuaggggaccaugaagagacucucuuagggaaaccaaua

SEQ ID NO: 236007 - RNA, 64 nt, Human
uaauggccugugacaugaugagcacaggaacaggcaugaagauauugccauacaauuuuaauuu

SEQ ID NO: 236008 - RNA, 64 nt, Human
aauuuggaucucuucuuaauguacauagugcuaacaugaagaccuuuuucugcacuauaugcaa

SEQ ID NO: 236009 - RNA, 64 nt, Human
auuugggaauaaaauauaaucgaauauucaacaccaugaagauaaaucuuauuuuggaaaucua

SEQ ID NO: 236010 - RNA, 64 nt, Human
auaccaauguggacauagggccuggcaaagauuucaugaagaagacacuaaaaacaauugcaac

SEQ ID NO: 236011 - RNA, 64 nt, Human
cagagacgaagaaagaguccugggauuuguacuucaugaagacuuuugugaaagaauagguguc

SEQ ID NO: 236012 - RNA, 64 nt, Human
uccuuccuaaucuugguuaaggcauguuuuaugccaugaagaauacauuagaagaauugaggga

SEQ ID NO: 236013 - RNA, 64 nt, Human
ggagaccaugccugugggagccaggccucgcuugcaugaagaaggaacgaugccuuuuucaaug

SEQ ID NO: 236014 - RNA, 64 nt, Human
acacacgcccgucacccacaccuugagcacacaccaugaagaucaccagcuuggauggccguca

SEQ ID NO: 236015 - RNA, 64 nt, Human
gcaccaugggacauuuuucuaacaaaaauaaaugcaugaagagacauagccuuuuaguuuugcu

SEQ ID NO: 236016 - RNA, 63 nt, Human
cacagcccuccucucccaagaaauccaggcuccucucccaagaaauccaggugcuuuccagac

SEQ ID NO: 236017 - RNA, 63 nt, Human
cacccgcuaacucgucaucuagcauuagguguaucucccaaugcuaucccuccccccuccccc

SEQ ID NO: 236018 - RNA, 63 nt, Human
cacaacuuguucacaaacucauucagaaaugauucucccaacaaugcguaucagcuauucauu

SEQ ID NO: 236019 - RNA, 64 nt, Human
cccgaggggaauggcagucggaggcgcaggacaccaugaagacagggucaucgaccaacaacaa

SEQ ID NO: 236020 - RNA, 64 nt, Human
aaaacagauucuucaaaagcaugaauaaaaaugacaugaagagcuguaagugagaaaugauggu

SEQ ID NO: 236021 - RNA, 64 nt, Human
caguccugccaugaugagcccuguuccugcucaucaugaagauccccgcgauacuucaacgccu

SEQ ID NO: 236022 - RNA, 64 nt, Human
cgcuggguuaggggagcaccuguuucagacugggcaugaagaagggagcacagcagcuacuaga

SEQ ID NO: 236023 - RNA, 64 nt, Human
gagcacuuaggaagaccgggcauugggcuggugucaugaagaauacuggaauauaggagguagg

SEQ ID NO: 236024 - RNA, 64 nt, Human
aguuaccuggaaucaaauaaaaauucuagauuaccaugaagaacauaaaaugccuuugaacucu

SEQ ID NO: 236025 - RNA, 64 nt, Human
cuccuuugcucgugguuagcaagauacacucaagcaugaagauaaacacagcugcuuucuucuu

SEQ ID NO: 236026 - RNA, 64 nt, Human
acaaaaauguacaauuuauccuuugagagagaaucaugaagaaaagaaggucaauaaaaagggc

SEQ ID NO: 236027 - RNA, 64 nt, Human
caucuuaguugggugagacucuuuaaagugcauccaugaagaaaccuguccaucuauugagcca

SEQ ID NO: 236028 - RNA, 64 nt, Human
ugaaguacagguuaaagacuguguccacuuugggcaugaagaguguggagacuuuucuucccca

SEQ ID NO: 236029 - RNA, 64 nt, Human
gaugaggcaugcagcuuucagcacaucuuuuauacaugaagaaauuaauuuuguguugcuaugg

SEQ ID NO: 236030 - RNA, 64 nt, Human
auuuaauauccugccuuuuaccuucaguaaacaccaugaagaugccauugacaagguguuucuc

SEQ ID NO: 236031 - RNA, 64 nt, Human
uuuucaaaccaaaucaggauugacaaaagcugugcaugaagaacugccuucuucuaagaucuaa

SEQ ID NO: 236032 - RNA, 64 nt, Human
uacuucauaccuacuugaacaucagaggguccaucaugaagagaaagccuaugaguaugaugaa

SEQ ID NO: 236033 - RNA, 64 nt, Human
gcaagagcccccuugacaccgggguggugggaaccaugaagacaggaugggggcuggccucugg

SEQ ID NO: 236034 - RNA, 63 nt, Human
uucccagcaaucuuaaucucaugacuauguucuucucccaaacaaggauugauagguaaaugc

SEQ ID NO: 236035 - RNA, 63 nt, Human
caguggcacaaucucggcucacugcaauuuccgucucccaaguucaagcgauucuccugcuuu

SEQ ID NO: 236036 - RNA, 63 nt, Human
aacugcuggauucaagugauccgcccaucuccgucucccaaagugcugggaauuacaggcgug

SEQ ID NO: 236037 - RNA, 64 nt, Human
gcaaaaccuucuuguaggaaaagagagcucucuacaugaagaugacuuguuuuauauuucagau

SEQ ID NO: 236038 - RNA, 64 nt, Human
uuggaugggauuuuuuuuuuuucacguuagaagacaugaagaaauuuuaaaagauaaacaucua

SEQ ID NO: 236039 - RNA, 64 nt, Human
gaacaagguucccucugagaauuccaaggaguuccaugaagaccacauccacacacgcaggaac

SEQ ID NO: 236040 - RNA, 64 nt, Human
auucucuaaauuauacucaauuucaugguaauuacaugaagaaguuaccugcaauuauucuuaa

SEQ ID NO: 236041 - RNA, 64 nt, Human
agcuuuagcaaaccuaagccaaaggaaggaaagccaugaagaaugcagaagucaaacccucaug

SEQ ID NO: 236042 - RNA, 64 nt, Human
auaaaugcuuauuuuuugccuuucuuuuucccaccaugaagagaaagcaaacaaacagaaaccc

SEQ ID NO: 236043 - RNA, 64 nt, Human
ggugcgcaacagcaccgugcugcucuccaugacccaugaagaccaaaagcugcaagagguacug

SEQ ID NO: 236044 - RNA, 64 nt, Human
gugcuacuugcuugcaaggauuuggagauguaaacaugaagaaaauauaguuacugccugcaaa

SEQ ID NO: 236045 - RNA, 64 nt, Human
aaauuuauugucucaguuuuuauaggcaucuuugcaugaagaaagcagaaguuuaccugaagug

SEQ ID NO: 236046 - RNA, 64 nt, Human
ggaaaaaagccuucacuucaaagaagucaaauuucaugaagaaaaccucuggcacauugacaaa

SEQ ID NO: 236047 - RNA, 64 nt, Human
uuguauaguaccaauuucguaaauucucucaauucaugaagaucguaggguuaaacuuuuuugu

SEQ ID NO: 236048 - RNA, 64 nt, Human
cuuauucaggaagauaaaaaucaguaaccuaccccaugaagauauuuggugggaguuauaucag

SEQ ID NO: 236049 - RNA, 64 nt, Human
guugaaacacagcagcuguggaguucaguccaggcaugaagacuaaaucugcuuuaccaaguaa

SEQ ID NO: 236050 - RNA, 64 nt, Human
agccaagugggauuugcauaaagugaauguuuaccaugaagauaaacuguuccugacuuuauac

SEQ ID NO: 236051 - RNA, 63 nt, Human
caacuccaguaaagaacuaagaacaguguauaacaugaagauaacauuuugucuuugaccacu

SEQ ID NO: 236052 - RNA, 60 nt, Human
gaccccaucuggggacuugagacuuuggucccagcccagacuccucagacuuuucucuca

SEQ ID NO: 236053 - RNA, 63 nt, Human
gaucuugggagaaacacagcccugacagcucguccgugggaagaugaggcaguccagguugug

SEQ ID NO: 236054 - RNA, 63 nt, Human
guucauguagucuccgcugcaccaacuccaaaaccgugggauucugcuuuucauccucugugg

SEQ ID NO: 236055 - RNA, 64 nt, Human
ugaacacuggagaaaaaccgaaaaauggacggggcaugaagagacuaaucaucuggaaaccgau

SEQ ID NO: 236056 - RNA, 64 nt, Human
guugagaccaggaguucgaguccagccugaccaacaugaagaaacccugucuguacuaaaaaua

SEQ ID NO: 236057 - RNA, 64 nt, Human
auuuuguuuauucuguggaauugacuugacaaagcaugaagauauucccagugucugucugaua

SEQ ID NO: 236058 - RNA, 64 nt, Human
uuaaaauuugaguauuuuggauaucaguguuccucaugaagauauacauggauauucaauuuug

SEQ ID NO: 236059 - RNA, 64 nt, Human
cacacgucuggccuacagaaugcggccucugagacaugaagacaccaucuccaugugaccgaac

SEQ ID NO: 236060 - RNA, 64 nt, Human
acuuuuauaauucuguauguuauuauuuuaugaacaugaagaaacuuuaguaaauguacuuguu

SEQ ID NO: 236061 - RNA, 64 nt, Human
gucacuuuuauuuuuaauuauuuuacauaugcaacaugaagaaaucguguagguggguuuuuuu

SEQ ID NO: 236062 - RNA, 64 nt, Human
guugucauuauuuugcaaucagccuggucucucccaugaagaugucgugugcauaagcacaauc

SEQ ID NO: 236063 - RNA, 64 nt, Human
uaaaacagaaaaaaagagugaaaaagagaauauacaugaagaauagaaacaagccugccauaau

SEQ ID NO: 236064 - RNA, 64 nt, Human
uguuguuuuguucuuggcuauaauacuugugacucaugaagaauuauguugacaaacaggauaa

SEQ ID NO: 236065 - RNA, 64 nt, Human
uaagaaugaaaauuauauguaagcuuuuaagcaucaugaagaacaauuuauguucacauuaaga

SEQ ID NO: 236066 - RNA, 64 nt, Human
caguauuuucagcuuuuguauuccauacuaaagccaugaagaacuacacguaacaucaucauuu

SEQ ID NO: 236067 - RNA, 64 nt, Human
ugaccccugcugagcgugaugaucuagccuccaucaugaagaagcucuugaccaaguaugacaa

SEQ ID NO: 236068 - RNA, 64 nt, Human
ucuucauucuuugaaggauuuacugcaagaaguacaugaagagcagcuggucaaccugcucacu

SEQ ID NO: 236069 - RNA, 64 nt, Human
gaaugcaucaccauuaagacaaaagcaauguguucaugaagacuuaagaaaaaugucacuacug

SEQ ID NO: 236070 - RNA, 60 nt, Human
cuugggcugcucagacccuccagaugagguccagcccagaucugagaggaacccuggaaa

SEQ ID NO: 236071 - RNA, 60 nt, Human
gaaaguuucugccuggcccugcaucugguuccagcccaccugcccuccccuuuuucggga

SEQ ID NO: 236072 - RNA, 60 nt, Human
uacuccagccggggcugccagcgcauccagccagcccagcccugugaaagauggagcuga

SEQ ID NO: 236073 - RNA, 64 nt, Human
ccugugcuguccugggaggugguguuggaggccccaugaagagcgcccuggacugcugagggug

SEQ ID NO: 236074 - RNA, 64 nt, Human
agauccuuuuucucaccuuucugccuuuggaacacaugaagaucaucucgucuauggaucaugu

SEQ ID NO: 236075 - RNA, 64 nt, Human
cccauugcuuucauuguucagagaacccaggagacaugaagaugaccagacugggcaaauuaug

SEQ ID NO: 236076 - RNA, 64 nt, Human
gacguagaaagauccuucgggugcuggaagucuccaugaagagcuuguguccuguccuuucuug

SEQ ID NO: 236077 - RNA, 64 nt, Human
aauaaaacagggugacugggaguuacuuagaauucaugaagauuuuaaaauggcuuuggagauu

SEQ ID NO: 236078 - RNA, 64 nt, Human
cugcuuccaucagcccugucaccaccugguccuucaugaagagcagacacuuagaggcuggucg

SEQ ID NO: 236079 - RNA, 64 nt, Human
cagugaauguucuggguccauguacucagauaaacaugaagaaaauaagcaaagaaaaauggag

SEQ ID NO: 236080 - RNA, 64 nt, Human
aggggaggcaguggcaccucccucucccugcugacaugaagagagcuaugauaugccacugcug

SEQ ID NO: 236081 - RNA, 64 nt, Human
caccagcuuguccuccaaaaucaugaaugauacacaugaagauaacuuuuuuuaaaaaaaagca

SEQ ID NO: 236082 - RNA, 64 nt, Human
ugauggaaaagucaaauaacggaucuuugugcuucaugaagaguuggaaaaccuguguguguag

SEQ ID NO: 236083 - RNA, 64 nt, Human
aaacuaaucaguuuauugugcaucagagacgucacaugaagaagaaaacuugucgacauccagg

SEQ ID NO: 236084 - RNA, 64 nt, Human
auuuuugauauuuugugcauuaauacauuacaaacaugaagauguuuguaaaguuuuguuuuag

SEQ ID NO: 236085 - RNA, 64 nt, Human
uggaaguuuggcugcccacaggcaggaggagaagcaugaagagaaaaccuguuugagaaguuuu

SEQ ID NO: 236086 - RNA, 64 nt, Human
uugggcauguuuguuauuucuauacucacucugucaugaagaagggucucagccuuuuguggag

SEQ ID NO: 236087 - RNA, 64 nt, Human
cuguaacuuucugaaauaacauggccuuggagggcaugaagacagauacuccuccaagguuauu

SEQ ID NO: 236088 - RNA, 60 nt, Human
gccauguugacccucucucagaaggucaguccagcccaagugcaggggcggaucuggagg

SEQ ID NO: 236089 - RNA, 60 nt, Human
uuuggaccuuuagaaccacagaugauaggaccagcccaaugagccacagucagagaguag

SEQ ID NO: 236090 - RNA, 60 nt, Human
gccaaugagguucccugcaacccccgcccuccagcccaccgcccaaccuuuuacaaaugg

SEQ ID NO: 236091 - RNA, 64 nt, Human
acacgcauuugcaacguuaaccuaacgaaauuuccaugaagaaccaagucagggcagcaucucc

SEQ ID NO: 236092 - RNA, 64 nt, Human
ggugaacaguccccacagcagacagcuacuugggcaugaagagccaaggugugaaaagcagauu

SEQ ID NO: 236093 - RNA, 64 nt, Human
uucucuucuccugugaucauucaagugcucacugcaugaagacuggcuugucucaguguuucaa

SEQ ID NO: 236094 - RNA, 64 nt, Human
agugccaucugggucuuccaucuagaacuguuuacaugaagauaagauacucacuguucaugaa

SEQ ID NO: 236095 - RNA, 64 nt, Human
ggacagaaauugcuaauagcucaugcaacucuuucaugaagagcuuagcuaugaccuuagaaga

SEQ ID NO: 236096 - RNA, 64 nt, Human
guucucaucuucugccacagucucucagauagcucaugaagacaaucaccugccucaccuucua

SEQ ID NO: 236097 - RNA, 64 nt, Human
cuugagguugggaguucaugaccagcuugaccaacaugaagaaacccugucucuauuaaaaaua

SEQ ID NO: 236098 - RNA, 64 nt, Human
ucaaaagacaaacaauaugucuuuuuuuuuuuugcaugaagaaaaaugucuaucauuuacaguu

SEQ ID NO: 236099 - RNA, 64 nt, Human
ggugaugcuggggucucacuagcuugagggggcacaugaagauaagccacaaaugaagagaaaa

SEQ ID NO: 236100 - RNA, 64 nt, Human
gccugccacccauacguaggccaaccaagcacuucaugaagaggaggccucguggcauauucag

SEQ ID NO: 236101 - RNA, 64 nt, Human
uuaaaacccaguccacaaaauaaccaauccuggacaugaagauucuuucccaauucacaucuaa

SEQ ID NO: 236102 - RNA, 64 nt, Human
ugauugugugcggguugucauuuuccuggacauccaugaagagcugaaggaaauuguuuacugc

SEQ ID NO: 236103 - RNA, 64 nt, Human
gaaaccaugaagagauuuuucaugauuuugaaaucaugaagauauuuuuccauuuuuuucuaau

SEQ ID NO: 236104 - RNA, 64 nt, Human
caaaaucauaagauauuuuucaugauuuugaaaccaugaagagauuuuucaugauuuugaaauc

SEQ ID NO: 236105 - RNA, 64 nt, Human
uaauugaaacuucuguacauuaaaagaacugauucaugaagacguuuucuaacuuuuucucuuu

SEQ ID NO: 236106 - RNA, 60 nt, Human
ucuuucuugaggacacccucacugaucaccccagcccagccagagugguugcuccugcuc

SEQ ID NO: 236107 - RNA, 60 nt, Human
ccugccucccucuggagccuucuggacuggccagcccagcgcaaagaccaggacuugucu

SEQ ID NO: 236108 - RNA, 63 nt, Human
auuggcucccaggucauuuccucucucucucuuucucccaagccuuucucccuccacaggaaa

SEQ ID NO: 236109 - RNA, 64 nt, Human
ugcaaaucagaucagagcaaagcaaugagaucaucaugaagacauauguccacuaaguacucca

SEQ ID NO: 236110 - RNA, 64 nt, Human
ucuggugaggcagccucuguuuaaaccggccccacaugaagagaacaucccuugagacgaauuu

SEQ ID NO: 236111 - RNA, 64 nt, Human
gaguuacugauuggcaaaaaagauuggcacaaagcaugaagaaaccccauuuuucccaggguaa

SEQ ID NO: 236112 - RNA, 64 nt, Human
agaaaugugaaauacacuuuguguggaaaaaccucaugaagauuguucagauacuuuauuuucu

SEQ ID NO: 236113 - RNA, 64 nt, Human
cagcugaugagacaaggaaccugcagaauguggacaugaagauugggguguaacaccuacacca

SEQ ID NO: 236114 - RNA, 64 nt, Human
accauuuccuaucugccaggcauuuuucuaagcacaugaagaaauuaguccuaacaacacuaug

SEQ ID NO: 236115 - RNA, 64 nt, Human
ucuuucuaaauuucaacuucaaugucaucuucuccaugaagaccacugaaugaacaccuuuuca

SEQ ID NO: 236116 - RNA, 64 nt, Human
auaaaguauauuccuucaagccugcuguugauaccaugaagacugggcgccucagucccagccc

SEQ ID NO: 236117 - RNA, 64 nt, Human
accuguccaggucuucucuucccacgagucuucacaugaagagccucugcagcccuucccacag

SEQ ID NO: 236118 - RNA, 64 nt, Human
ugacagcaugcuguuuuguggagaaacuugcauucaugaagagcccauuaucaacuuuuaaaag

SEQ ID NO: 236119 - RNA, 64 nt, Human
cauuaacaauaaaaauuuguaguaaacauaaccucaugaagaacuaaucauauggucucugucg

SEQ ID NO: 236120 - RNA, 64 nt, Human
ucucaggcaauauggccacaccugggucuuuaugcaugaagauaauguaaagguuuuuauuaaa

SEQ ID NO: 236121 - RNA, 64 nt, Human
ccauguugggagcagaagcuuuucauccuggucacaugaagacagaugguauuauugacuggag

SEQ ID NO: 236122 - RNA, 64 nt, Human
acccagucucaggccugcuuaccuccucacagcccaugaagaccccuucucagccccaaaaccu

SEQ ID NO: 236123 - RNA, 64 nt, Human
gggaaugccaugggguuugauaaucugccagggacaugaagaggcucagcuuccuggaccauga

SEQ ID NO: 236124 - RNA, 60 nt, Human
ccccacugggccugcuggccucccucggcuccagcccaaugccccagcuggccuucccca

SEQ ID NO: 236125 - RNA, 60 nt, Human
aaggcauugggagaagcagucugggggaggccagcccagugcgggcacagcacaacacgg

SEQ ID NO: 236126 - RNA, 60 nt, Human
ggggcccucccagaaccucagcauuuccuuccagcccauccaaacacugaggcagccuug

SEQ ID NO: 236127 - RNA, 64 nt, Human
cagcagcaaucucagaagcuuacaaauagauuuccaugaagauauuugucuucagaauuaaaac

SEQ ID NO: 236128 - RNA, 64 nt, Human
guagaggcugaacuguugauguucagguggacuacaugaagauaacaugcuuaaaaauggaaag

SEQ ID NO: 236129 - RNA, 64 nt, Human
gaagaagaugagccuugcagauaucugcaugugucaugaagaauguuucuggaauucuucacuu

SEQ ID NO: 236130 - RNA, 64 nt, Human
acagaaucaugauugccaugggccacuuuauuuacaugaagacaacuggagaacgacuaagacc

SEQ ID NO: 236131 - RNA, 64 nt, Human
agucagcuuacaucccugagcaggaaaguuuacccaugaagauuggugggauuuuuuguuuguu

SEQ ID NO: 236132 - RNA, 64 nt, Human
guuccacacuucacguggacugagguagacccugcaugaagaugaaauuauagggaggacgcuc

SEQ ID NO: 236133 - RNA, 64 nt, Human
cccuuguucaucugugucuucugcaaacuagucucaugaagaauucuggcgugcagccagggua

SEQ ID NO: 236134 - RNA, 64 nt, Human
uuuuccccucuaggaaaaaauacuugggauaucacaugaagaaguagacugaaauaucagauuu

SEQ ID NO: 236135 - RNA, 64 nt, Human
uugauuuacagcaaguagauaaauauuugacuugcaugaagagaagcaauuuuggggaaggguu

SEQ ID NO: 236136 - RNA, 64 nt, Human
cucccccauuaugugagcccuuacuugagagcuucaugaagacacuuguaacauauucaacguc

SEQ ID NO: 236137 - RNA, 64 nt, Human
uuauaccucauuauuaaaaggaggcauggccacacaugaagaaauggucauucuacuucaaaga

SEQ ID NO: 236138 - RNA, 64 nt, Human
uggguauagugauacucugccauaguucuuacugcaugaagagaacaagagucacacaaguuca

SEQ ID NO: 236139 - RNA, 64 nt, Human
caaugacauuuuuauauuacagagcuuccaucaucaugaagaaaaaaaaauuugguucucaagu

SEQ ID NO: 236140 - RNA, 64 nt, Human
aaaaugauaauuuauuuuuaagguaaaaauaauccaugaagauaaaagaaacauaugucugcgu

SEQ ID NO: 236141 - RNA, 64 nt, Human
aagacagaacaaaacuguggaucauugcccucaacaugaagacugccauauuccaagucacauu

SEQ ID NO: 236142 - RNA, 60 nt, Human
gaaaaggcaccuggaagguuuccauguggcccagcccagcauggaagcagggugggaacu

SEQ ID NO: 236143 - RNA, 60 nt, Human
cucccggggccggggccgacuccacgaacaccagcccaaacugaagugccucuucccucc

SEQ ID NO: 236144 - RNA, 60 nt, Human
cagcuggagauaguuucaaagucuaaaccaccagcccauccugaggaaagccuccuaugg

SEQ ID NO: 236145 - RNA, 64 nt, Human
ucaucuacuucuugaacaguggucuauucugcuacaugaagaugaauacaaacaaaauuuuugu

SEQ ID NO: 236146 - RNA, 64 nt, Human
uuuguuuuaauuuuuuguauuuugagccacuucacaugaagacucaguugcauuuuuaucgaau

SEQ ID NO: 236147 - RNA, 64 nt, Human
ucuuaaaagaaaaaugggaagaaagacaagguaacaugaagaaagaagagauaccuaguaugau

SEQ ID NO: 236148 - RNA, 64 nt, Human
cgaccgugcugugugacaucauaguccucuacugcaugaagaaaagacucuacuaucgggagaa

SEQ ID NO: 236149 - RNA, 64 nt, Human
uuuuuguaacaaaauauaaaugaagauauuuuaccaugaagagauugcacuuauccuugagaac

SEQ ID NO: 236150 - RNA, 64 nt, Human
gagaacagucuaaauauaaaugaagauauuuuaccaugaagagauugcacuuauccuugagaac

SEQ ID NO: 236151 - RNA, 64 nt, Human
ggagcaauaaauguaucaaauguuguaguaucaucaugaagauucagagaauuuacacuaggaa

SEQ ID NO: 236152 - RNA, 64 nt, Human
uaggaaacugggaaucucauaggaagagccaggacaugaagaaaaggaaauaugauccaucuua

SEQ ID NO: 236153 - RNA, 64 nt, Human
cuauuauuuuagccuuagagccuuacacuuguuucaugaagagaaaggacuugcauaaccaaaa

SEQ ID NO: 236154 - RNA, 64 nt, Human
uggugaauauaagaacugaauucuacaugugcugcaugaagagcuaauuuaaaaaagcaaagua

SEQ ID NO: 236155 - RNA, 64 nt, Human
ugcugguagcccagugcugaaggacuugcuuuuccaugaagaagacgaaaacagcaaacaaggg

SEQ ID NO: 236156 - RNA, 64 nt, Human
agacuuuuuaaaagucagacaugaacuugcaugucaugaagauuucagcagauuugaacugugu

SEQ ID NO: 236157 - RNA, 64 nt, Human
ucuucuggacccauguuuaaauacaguuuuauuucaugaagagaaaugaaaaccccuacacuga

SEQ ID NO: 236158 - RNA, 64 nt, Human
cacaaauuuuuaaaacuucuacauguauuuuucacaugaagaucuccuuaacagguugccaacc

SEQ ID NO: 236159 - RNA, 64 nt, Human
ugcaggccaaguccuuuuauuuuaacaugauguccaugaagagguuugccgucugggcagcccu

SEQ ID NO: 236160 - RNA, 60 nt, Human
ucagaccagccaaccuuuguggaauaagccccagcccagccaaaccaaacccagaugccu

SEQ ID NO: 236161 - RNA, 60 nt, Human
cccaaguaggcaacuguuauggcaguggguccagcccaggccagcacugccagccuccuc

SEQ ID NO: 236162 - RNA, 63 nt, Human
aaaccagcccugcaugaaacagaguccaagcugucucccaacagccuggguucgguccuuggc

SEQ ID NO: 236163 - RNA, 64 nt, Human
cauaagguuuuagagagaaauaaacgcaguaaugcaugaagagugccgggcauggugcugagcc

SEQ ID NO: 236164 - RNA, 64 nt, Human
gagcgagcaacacggcggaggagaccaucagugccaugaagacuguccggagcuucgccaauga

SEQ ID NO: 236165 - RNA, 64 nt, Human
uggagucccagaaggagaggagaaaaugaagaggcaugaagaaguauuugaauaaauaauggcu

SEQ ID NO: 236166 - RNA, 64 nt, Human
caaauaucagaaaaacccagaggugaucauuucucaugaagaugcuuauaaaugguugcuuaac

SEQ ID NO: 236167 - RNA, 64 nt, Human
gggcuuagaaacaaaaacuggaugaaagaguaugcaugaagaaaagcuucuuugauaaaugugg

SEQ ID NO: 236168 - RNA, 64 nt, Human
uuaauuaaaaaacaaaaaucaccaauauccaagacaugaagauaucaguucaacaaauacugua

SEQ ID NO: 236169 - RNA, 64 nt, Human
caaaaguugaaaaaaacugaugacagacaacaagcaugaagauggcauauuugaugucacuuug

SEQ ID NO: 236170 - RNA, 64 nt, Human
aaaguuuuuuuuuuuuuuuuaauaauaaucuaggcaugaagagcaaaaauaucccuuccggagu

SEQ ID NO: 236171 - RNA, 64 nt, Human
gcugacaguucuguuggcagccaagaacccacaccaugaagacagggagugaggggccuuugug

SEQ ID NO: 236172 - RNA, 64 nt, Human
caggaaauagauggugccccccaaauugucuccacaugaagauguacugaugacgccccagaaa

SEQ ID NO: 236173 - RNA, 64 nt, Human
gaacacuggaauauuacaagaugagauucugauucaugaagaaaagcagauagaaguggcugaa

SEQ ID NO: 236174 - RNA, 64 nt, Human
cagaggcaagcggugaacuagguaagaguucacucaugaagaaacgagugcucugaagagccag

SEQ ID NO: 236175 - RNA, 64 nt, Human
caaauugugggguuuuuguuacaguuaggacgcccaugaagauuuaggggugaaaaaaacagca

SEQ ID NO: 236176 - RNA, 64 nt, Human
auaacuuacauccuuucaaauaagucuuugcccucaugaagaaucccuagaggaagauaaggaa

SEQ ID NO: 236177 - RNA, 64 nt, Human
aggcaucaaaaaaacaaguuuagaaagcuggcaacaugaagaaugcauucaaaauauaacaggu

SEQ ID NO: 236178 - RNA, 60 nt, Human
cucuuccccgggaagggggacagacccaccccagcccagggcccucacccaccucggaga

SEQ ID NO: 236179 - RNA, 60 nt, Human
gccccuuguccaccccucuccacaccccuuccagcccaggguucccauuuggcuucuggc

SEQ ID NO: 236180 - RNA, 60 nt, Human
gcuggggccuccuuccuucucagggucuccccagcccaguccccuugcucccaucccacu

SEQ ID NO: 236181 - RNA, 64 nt, Human
gcuucuguacacuaauguuuauagguauuuauagcaugaagaaaaucagacuauauauuguaga

SEQ ID NO: 236182 - RNA, 64 nt, Human; identical to SEQ ID NO: 236173

SEQ ID NO: 236183 - RNA, 64 nt, Human
ccccuugagauaauggauauuugcuaugcagcaccaugaagaagagagacuaucgaucggccag

SEQ ID NO: 236184 - RNA, 64 nt, Human
gcuuguucuaucacagguaugagcugcuaugauacaugaagaacauuccaugaaguauguuuua

SEQ ID NO: 236185 - RNA, 64 nt, Human
uggcagaggcuauaaaagauucaccaggcacuggcaugaagaaagagucuuuguaaauggacau

SEQ ID NO: 236186 - RNA, 64 nt, Human
ugcugguugucacggugcuaagagcugugggaaacaugaagagcaaugagaccaggucccugcu

SEQ ID NO: 236187 - RNA, 64 nt, Human
aguauaugcauacaagagacuuuagauugaucugcaugaagaucacaguuaaguauacaggagu

SEQ ID NO: 236188 - RNA, 64 nt, Human
uccauuaagcuuccuugcaggguggggcccacuccaugaagacagcagucaugccuuaagaagc

SEQ ID NO: 236189 - RNA, 64 nt, Human
uguucacauuuuaaaguucugagagaaauaaaaacaugaagaaucugaaaugucuuucuuuuca

SEQ ID NO: 236190 - RNA, 64 nt, Human
guaguuccuuuaggauuuguaugugcucugggcucaugaagauauugcaucaugagcugcagca

SEQ ID NO: 236191 - RNA, 64 nt, Human
agaucagggaugcuccuagugacauguacaagaucaugaagaaagccaucgagagaggcucccu

SEQ ID NO: 236192 - RNA, 64 nt, Human
gcuuucaagauuuggaagcauugccaaagacagccaugaagaaggaagcuguagagguguuuuu

SEQ ID NO: 236193 - RNA, 64 nt, Human
ggggaaugagggcugaguuaugaaaagauaacuucaugaagacuuaacuggcccagaagcugau

SEQ ID NO: 236194 - RNA, 64 nt, Human
cuacacccgugcuucaccagaagacccugcaggccaugaagagccacucagaaaaggcccaugg

SEQ ID NO: 236195 - RNA, 64 nt, Human
guaguucccuuaggauuuguaugugcucugggcucaugaagauauugcaucaugagcugcagca

SEQ ID NO: 236196 - RNA, 60 nt, Human
ugggcucagccugguuucugggugcuagauccagcccaaaccugggaaggccagccuugu

SEQ ID NO: 236197 - RNA, 60 nt, Human
uaaaaagucaaggcuuauaacaaaaaagccccagcccauuccucccauucaagauuccca

SEQ ID NO: 236198 - RNA, 60 nt, Human
ucacacacacaugcuagcccacugaugcacccagcccagggcuggcagucuuugcagcgu

SEQ ID NO: 236199 - RNA, 64 nt, Human
ccuugcguuguuaggugaugucuuuuagcagaaucaugaagaccuuuuuucucccuuaauaaag

SEQ ID NO: 236200 - RNA, 64 nt, Human
aagagaaaguucauucacagagacugccucuuaacaugaagaucauuggacaagccacacgggu

SEQ ID NO: 236201 - RNA, 64 nt, Human
guaguuccuuuaggauuuguaugugcucugggcucaugaagauauugcaucaugagcuucagca

SEQ ID NO: 236202 - RNA, 64 nt, Human
gcaguucccuuuggauuuguaugugcucugggcucaugaagauauugcaucgugagcugcagca

SEQ ID NO: 236203 - RNA, 64 nt, Human
gggcagcaaguguuugugaagcaaggaugagcagcaugaagaugucagaucagcaaggagaaac

SEQ ID NO: 236204 - RNA, 64 nt, Human
gcagagaugaggccaagaacggagaagggaggagcaugaagaguuguauguuuuuggagugcug

SEQ ID NO: 236205 - RNA, 64 nt, Human
ccuuugguauagccaagccuuuugguuaccgccucaugaagaauaugcuucccgcauuguccua

SEQ ID NO: 236206 - RNA, 64 nt, Human
gcccggaggacaggcugcuguccagggcagaggccaugaagaagugcuuccguggccgacaguc

SEQ ID NO: 236207 - RNA, 64 nt, Human
gauuucuuuucugagaguugaugagguuuaagaacaugaagauucuaaaaggucaguuuuuaga

SEQ ID NO: 236208 - RNA, 64 nt, Human
acugcguuuuuucccagcucgccacagaauggaucaugaagacugacaacugcaaaaaaaacaa

SEQ ID NO: 236209 - RNA, 64 nt, Human
uccuccccagagacauacagauugcccuccccggcaugaagaagucacaauucugacccgccac

SEQ ID NO: 236210 - RNA, 64 nt, Human
acagucuaagaugggaaacugugguacagauagacaugaagagagcuuagcagugauugaggug

SEQ ID NO: 236211 - RNA, 64 nt, Human
ugggcuuucuagucuuucagaauccagcaggcugcaugaagaccugcccccugauugacuugga

SEQ ID NO: 236212 - RNA, 64 nt, Human
uucaaauccuggguccugagcugcuguuuccaaucaugaagaaaaacagugaauccagugaaca

SEQ ID NO: 236213 - RNA, 64 nt, Human
ugcugaggcugcuguggaccaguugcugcagucccaugaagaagaucucucaaaugaggaacug

SEQ ID NO: 236214 - RNA, 60 nt, Human
ugcagugaaccgugaucacgccacugcaccccagcccaggcaacaaagugagccccuguc

SEQ ID NO: 236215 - RNA, 60 nt, Human
cagugggcucccugccugccaccuccccugccagcccacccaccuuccccccaccugaga

SEQ ID NO: 236216 - RNA, 63 nt, Human
agcugcccacuggaacugccggcuaaugcuugcucucccaagaucuuuaacuccuccuggcug

SEQ ID NO: 236217 - RNA, 64 nt, Human
guccagccacacucauucauccuuuccccaggcccaugaagagaggcaucucauuguagaaugu

SEQ ID NO: 236218 - RNA, 64 nt, Human
uugauuaaugucagcugaacuuggauuucuaguucaugaagaaaucucucccaauacccauuua

SEQ ID NO: 236219 - RNA, 64 nt, Human
gauuuguuucuaguuuuuuuguguuuauauuuaacaugaagaccaaguuuauauaacuagguau

SEQ ID NO: 236220 - RNA, 64 nt, Human
aggccagcucuccucccacaacagcuucccacagcaugaagaucuccguggcugccauucccuu

SEQ ID NO: 236221 - RNA, 64 nt, Human
gguacuagauacccuggggccagcagaaguauagcaugaagacagaacuaccaucggugggcca

SEQ ID NO: 236222 - RNA, 64 nt, Human
uuuuuuuuacuucccuuucuucuuccuuauauaacaugaagaacauuguauuaaucugauuuuu

SEQ ID NO: 236223 - RNA, 64 nt, Human
cucuaacaucucuggauacagugucccuggucaacaugaagaaguuacagaagaacgcuuucug

SEQ ID NO: 236224 - RNA, 64 nt, Human
cuuauaaaguaaauuuacuuugaauuguaaauaacaugaagaaaccuuuauaaagauuguucaa

SEQ ID NO: 236225 - RNA, 64 nt, Human
gaggaacaaugaauuucaacauauggcuucagaacaugaagauguucuuguauggauuauagua

SEQ ID NO: 236226 - RNA, 64 nt, Human
uccaggcguuaguuggaaucauaucauaaguauccaugaagaaaacgucaugaucugccucgga

SEQ ID NO: 236227 - RNA, 64 nt, Human
uuuagccccaggggagcagcucagcuuagcccagcaugaagagaugggcucugcucugagagua

SEQ ID NO: 236228 - RNA, 64 nt, Human
gaaaaggagaaaggaauuccuuuucccgcccgaacaugaagaaaaaugaccugacccuguagag

SEQ ID NO: 236229 - RNA, 64 nt, Human
gauuuccuggaggcaaagucuaucucugaaacuccaugaagacuuuugcagccaguucccacca

SEQ ID NO: 236230 - RNA, 64 nt, Human
aagccuucaaccagaagagugcgcugcaggugcacaugaagaagcacacgggggagcggcccua

SEQ ID NO: 236231 - RNA, 64 nt, Human
acaaaauuauguguuaagaaaauaccauucauagcaugaagauuaggaaacaguuuuaaggaga

SEQ ID NO: 236232 - RNA, 60 nt, Human
ucauauuugguaaacuguaugcauuugccuccagcccaagauuauaaauaugaacugauu

SEQ ID NO: 236233 - RNA, 60 nt, Human
gagcccccccugccccgagccccccgcccuccagcccaggggggaccgugggugguggcc

SEQ ID NO: 236234 - RNA, 60 nt, Human
acgaugauagggcuggagggcuauggauucccagcccaucccugugaaggaguaggccac

SEQ ID NO: 236235 - RNA, 64 nt, Human
agacuauuuuuuauugcugaagauucuugcaaaccaugaagagauguucucacagaacagaacc

SEQ ID NO: 236236 - RNA, 64 nt, Human
uggagcccaaauuuaggacacuagcagaagcaugcaugaagagaugaguguguucuaauaaguc

SEQ ID NO: 236237 - RNA, 64 nt, Human
guauuuaaauggauuaaaagauccccggugguuccaugaagaauuuguaaagaucacuuucucu

SEQ ID NO: 236238 - RNA, 64 nt, Human
aauguucuuaaauguguaaugaucuauagaugcucaugaagaaagaucugcuacaaguacguga

SEQ ID NO: 236239 - RNA, 64 nt, Human
gagacuaagauccugaaguuaaauacccaggucucaugaagacauuguaaagcauuugaauuau

SEQ ID NO: 236240 - RNA, 64 nt, Human
ccuccuuccagcccagugccagaaaccagcacuccaugaagauaaacucugggcccgcccacca

SEQ ID NO: 236241 - RNA, 64 nt, Human
ccugucucuggugguuuuuaggauuggaggacaucaugaagauggaggccuuguaauugggauu

SEQ ID NO: 236242 - RNA, 64 nt, Human
agagucacacaccccuucccucaucaggcacacccaugaagacagugccucccuccuccagcug

SEQ ID NO: 236243 - RNA, 64 nt, Human
guuacaaagucuggcuacuuugcugaagagaccacaugaagaggcccugaaacuacguagagag

SEQ ID NO: 236244 - RNA, 64 nt, Human
aagucugccacuacuuggaguggaucagggaaaccaugaagaggaacugacuauucuagccuau

SEQ ID NO: 236245 - RNA, 64 nt, Human
ccauuuuaagagcuuuaucuugugaagugaagaacaugaagauaguuugaaucaaaguuauuga

SEQ ID NO: 236246 - RNA, 64 nt, Human
ugucuaggccucuaugucaggacucccuggccuucaugaagaauagcaaacucaucccuguagg

SEQ ID NO: 236247 - RNA, 64 nt, Human
aguauugucucuuccccaacacuaaccccacucccaugaagaauugccuggaaagauguuuuca

SEQ ID NO: 236248 - RNA, 64 nt, Human
agcagaccacauauacagcaggaugugccuguggcaugaagauuuucuuucucuuuuuuuuuuu

SEQ ID NO: 236249 - RNA, 64 nt, Human
aaauccacaccaaagggagaguuccagaggaauccaugaagaauucccaugcccaggcuccaug

SEQ ID NO: 236250 - RNA, 60 nt, Human
gacagaucacuugaggucaggaguucgagaccagcccagccaacauggcgaaaccauguc

SEQ ID NO: 236251 - RNA, 60 nt, Human
gaugaaggaaggggcuauccugggaccuccccagcccaggaaaaacuggaagccuucccc

SEQ ID NO: 236252 - RNA, 60 nt, Human
acccaggaccuggagaauaccaccccacccccagcccauaauugggacccagagcccuuu

SEQ ID NO: 236253 - RNA, 64 nt, Human
gcaccuacacuacuuuaagaauuuggaacugaaacaugaagaggaagacagaaauaagaauuug

SEQ ID NO: 236254 - RNA, 64 nt, Human
ggaugaaaaagaugaggcucuaaggaaaugguggcaugaagacccucucccuucuuuguagaau

SEQ ID NO: 236255 - RNA, 64 nt, Human
cuaccuaggacaccagcugccacuucuuuugccucaugaagaacucuugggccagccaaacugg

SEQ ID NO: 236256 - RNA, 64 nt, Human
gggugcgagcccggggcuauauuggcgagggcgacaugaagaugcacugcugcguggccgccua

SEQ ID NO: 236257 - RNA, 64 nt, Human
ggaguccuuggugguugaacuuggagaaagaccgcaugaagauacuuguaagcacacaugaucc

SEQ ID NO: 236258 - RNA, 64 nt, Human
uauugugauuaaagguagcaggaagggcaaaagucaugaagaagcucaugcuugauaucucuga

SEQ ID NO: 236259 - RNA, 64 nt, Human
uaguucuugacccgaggucgcccugaaggugucgcaugaagagcuugcuucacacacaacagga

SEQ ID NO: 236260 - RNA, 64 nt, Human
gagaaaggcaccaagcuaacaucugacguccagacaugaagagaugccagugccacgaggcaaa

SEQ ID NO: 236261 - RNA, 64 nt, Human
uagcaggaagcugugagagcaguuugguuucuagcaugaagacagagccccacccucagaugca

SEQ ID NO: 236262 - RNA, 64 nt, Human
aguuuucuaggggaaaacaaauggagaaaagaggcaugaagaaaaguaaaccgagaacauaauu

SEQ ID NO: 236263 - RNA, 64 nt, Human
uauaauauguauauauauauauauugacuuguuacaugaagauguuaaaaucgguuuuuaaagg

SEQ ID NO: 236264 - RNA, 64 nt, Human
uuuaggucagggagcaaaaaucucagaacuugaccaugaagauacacaacagacucgcaaaaau

SEQ ID NO: 236265 - RNA, 64 nt, Human
ucuauauauuuugccccugcuauaaaauuccuuccaugaagaaaacugcugcuuucagcaaaag

SEQ ID NO: 236266 - RNA, 64 nt, Human
uuacgaaauuagaacgacuucacguuggagaaagcaugaagagguauucaucuguuacggcccu

SEQ ID NO: 236267 - RNA, 64 nt, Human
aguuggggggcaucuaugguagacauggcacagccaugaagagaccagugggguggugcagggu

SEQ ID NO: 236268 - RNA, 60 nt, Human
ugcugggauuacaggcgugagccaccuugcccagcccacaucauacaguuugaaaugaaa

SEQ ID NO: 236269 - RNA, 60 nt, Human
guuugcuccacauggccgccacccccugcaccagcccacauccccacugccccuguacag

SEQ ID NO: 236270 - RNA, 60 nt, Human
caaugcaaguguuuuauuuuuuucuuuuuuccagcccauaagacuaaggguuuaaaucug

SEQ ID NO: 236271 - RNA, 64 nt, Human
cugcaauauauaaagagcuccuacaaaucaguaacaugaagaacacucaaaaauuggcaaaugu

SEQ ID NO: 236272 - RNA, 64 nt, Human
agaaaagguuaaagcaacaaguuuagccuuugugcaugaagacgccuggccugcuagacgcguu

SEQ ID NO: 236273 - RNA, 64 nt, Human
uucagugcaccaucaagagaugcagccccguggacaugaagacacaaucucccacggacagcuu

SEQ ID NO: 236274 - RNA, 64 nt, Human
agucuucucauugccuuuaguguauccacaccaacaugaagacacugaccuugucccgcuacau

SEQ ID NO: 236275 - RNA, 64 nt, Human
agcuagcugcugccuccuuacuccuggcccucuacaugaagaagcucggauacuggguaaacac

SEQ ID NO: 236276 - RNA, 64 nt, Human
gaagaagaaaaugaaaaauuugaagauuugagagcaugaagauauucaugcuuuugaacucaaa

SEQ ID NO: 236277 - RNA, 64 nt, Human
uuuaaagauuuaaagugccuuaucaaauaauauucaugaagaguuguuuauaaugucaaaugaa

SEQ ID NO: 236278 - RNA, 64 nt, Human
uauauaugaucaagauaacaugcugacuaguaaccaugaagauucagauguaccucagcaaugc

SEQ ID NO: 236279 - RNA, 64 nt, Human
cuagccauuuuuacuguuauccuauuuagauggccaugaagaggaugcugugaaauucccaaca

SEQ ID NO: 236280 - RNA, 64 nt, Human
guagcagaggaaauuucacaugcaaagccacagucaugaagagaccauggugugucuggguaac

SEQ ID NO: 236281 - RNA, 64 nt, Human
gugcuguaucuguguuugugucugugugugacagcaugaagauaaugccugugguuaugcugaa

SEQ ID NO: 236282 - RNA, 64 nt, Human
uuggucuacucuaucacaaggccaguaccacacucaugaagaaagaacacaggaguagcugaga

SEQ ID NO: 236283 - RNA, 64 nt, Human
gacacugcauacguuuguauuauuaguuagaaggcaugaagacuuuuuucccugcauggagagu

SEQ ID NO: 236284 - RNA, 64 nt, Human
acccaaagcucuaagguaacaaauuaccaaauuacaugaagauuugguuuuugucuugcauuuu

SEQ ID NO: 236285 - RNA, 64 nt, Human
caugaagacaaauaguguggagugaggcggggagcaugaagauaaauccaacucugacuguaaa

SEQ ID NO: 236286 - RNA, 60 nt, Human
cuggagucagguggugggaguaccagccccccagcccacccacuuggcccacucagccca

SEQ ID NO: 236287 - RNA, 60 nt, Human
uaucaauuaaaaaugcugugugauaaaaucccagcccagauugcucagcuguuuguaccu

SEQ ID NO: 236288 - RNA, 60 nt, Human
auuuaacaugggaggagagcgugugcggcuccagcccagcccgcugcucacuuuccaccc

SEQ ID NO: 236289 - RNA, 64 nt, Human
auaugaguuuggggaaagaguugcaguaaaguuccaugaagacaaauaguguggagugaggcgg

SEQ ID NO: 236290 - RNA, 64 nt, Human
augaaggcaagaaacagcaaaacaaauacugaagcaugaagauuccugggguggggggaaagca

SEQ ID NO: 236291 - RNA, 64 nt, Human
guagaaggaauuuccagauauuggaaacaguaugcaugaagacaugaaggcaagaaacagcaaa

SEQ ID NO: 236292 - RNA, 64 nt, Human
guguagucaugggauuuaggcacugcuaaucaagcaugaagaggaacagaggugauguuagguc

SEQ ID NO: 236293 - RNA, 64 nt, Human
cuggagcaagucagauuaggcaagcucauggccacaugaagaagauacauugucccgagaugcu

SEQ ID NO: 236294 - RNA, 64 nt, Human
ugugcacucauguguauaccccugcauguggaaacaugaagauguuuucacuuugugucuaggu

SEQ ID NO: 236295 - RNA, 64 nt, Human
auaaacuggugauuuuucuuuugucuaaaaaacacaugaagaaaauuuaccaaaaaaaaaaaaa

SEQ ID NO: 236296 - RNA, 64 nt, Human
gcauacugacagugguuacagcuaaaaaagaaagcaugaagaaacaacuacaaaaaguuaucau

SEQ ID NO: 236297 - RNA, 64 nt, Human
uuucuaccaaacauuuccagaaacguauuuauagcaugaagaaacacacauggguagugugacc

SEQ ID NO: 236298 - RNA, 64 nt, Human
caggaugagggugcccgggcuggacggcuaagggcacgaagacgauaucugguagagagggcca

SEQ ID NO: 236299 - RNA, 64 nt, Human
aguuguguuuugcuuuggcagucucucuuccccccacgaagaaggcuguuuagguuuugugaua

SEQ ID NO: 236300 - RNA, 64 nt, Human
ucugaagaacauaguguccaggaaagugguuuagcacgaagaggccccuuauuaccauguaucc

SEQ ID NO: 236301 - RNA, 64 nt, Human
gacgugugccuaugcaauggggugguaaggcaggcacgaagaguccaaaaaaucuagguggccu

SEQ ID NO: 236302 - RNA, 64 nt, Human
uguuugaggauguuuuaaauacaugcauugucuucacgaagaagauguaaaaauaaugaacaau

SEQ ID NO: 236303 - RNA, 64 nt, Human
ucauuucuuuaaugaaauauuaguuggaagacuucacgaagacugcugauaacuaucugugauu

SEQ ID NO: 236304 - RNA, 60 nt, Human
uccccaggaaguggcucagaccccucagccccagcccagacaaagaugucuuaaccucag

SEQ ID NO: 236305 - RNA, 60 nt, Human
aaagauagcaagcuaccuuccaaggccgagccagcccagagaggagcaugucuuccuuua

SEQ ID NO: 236306 - RNA, 60 nt, Human
aggagcaggaaguugcuguuucuccucugaccagcccacacuccaaaggaaacagacgcc

SEQ ID NO: 236307 - RNA, 64 nt, Human
cuuuuucaacuucuaauaagcuuaaccuaagugucacgaagacgagaugucacagagguccacu

SEQ ID NO: 236308 - RNA, 64 nt, Human
agguggagguuagaaaucucuaccugggugugcccacgaagacaaccaucacacuuaucaaugg

SEQ ID NO: 236309 - RNA, 64 nt, Human
ggaagggacucuguguauuauucagguuuauuggcacgaagauacuuguuuuaaguuccuugag

SEQ ID NO: 236310 - RNA, 64 nt, Human
cggcagacgaaggcagucgagguguggaggugaucacgaagauacauguguuugacuguuuaau

SEQ ID NO: 236311 - RNA, 64 nt, Human
caagauuccuacacccaaaugugaccguguugcucacgaagaaggcucagcuuugcgugugccc

SEQ ID NO: 236312 - RNA, 64 nt, Human
acaaaauaucaauacuuaacggaaaauaaggugacacgaagaaaguacauauguuaacuauaau

SEQ ID NO: 236313 - RNA, 64 nt, Human
uugagccaaguaauaaaagaaauucugcauuugucacgaagacaauuuaugguagacagauaaa

SEQ ID NO: 236314 - RNA, 64 nt, Human
uguguagaagaggaaaaagcaacaacagcaacaacacgaagaugauaccaaaacaaggaccaca

SEQ ID NO: 236315 - RNA, 64 nt, Human
aguaaggggggcagagauggaugaagagaaagcccacgaagaaaaaagccugguuuuguuuuuc

SEQ ID NO: 236316 - RNA, 64 nt, Human
gcuuugagacaugcuacugaauuuggagggcaggcacgaagaacagugagauugucaaaaggag

SEQ ID NO: 236317 - RNA, 64 nt, Human
cuucagauucuucuauugaguuuaggaauugcggcacgaagaaugccaagaguuuaccuggcca

SEQ ID NO: 236318 - RNA, 64 nt, Human
aaaauguuuguaucuuacuguccccuguucucaccacgaagaucauguucauuaccaccaccac

SEQ ID NO: 236319 - RNA, 64 nt, Human
acacugcaccuccuucgcugucaagugggucccccacgaagauacugcacggagagcagugcca

SEQ ID NO: 236320 - RNA, 64 nt, Human
uuuauuuguaaagcuuucagugaaacacuacauacacgaagaaaaggaacaagguuuaacuauu

SEQ ID NO: 236321 - RNA, 51 nt, Human
aucuggaagauguugcauagacacgaagaaggaaguauucuaauuaacaag

SEQ ID NO: 236322 - RNA, 60 nt, Human
aaacuuggugugggggaggagcacaaaacuccagcccacugaaccucugccaauuaagau

SEQ ID NO: 236323 - RNA, 60 nt, Human
agccagucuaugcccuuucuccaguaggccccagcccagaccucuucggcuucaggaacu

SEQ ID NO: 236324 - RNA, 63 nt, Human
uucuccuggaaauguaucucagaaaugaccuccucucccaaccacuucaacgauucuuucuuu

SEQ ID NO: 236325 - RNA, 64 nt, Human
gcauauguuugaacaggaaguaggaacaugcauacacgaagaaaugcuaacggaaggauuuguu

SEQ ID NO: 236326 - RNA, 64 nt, Human
acugccuagaucuuugcaguuaugugcuuuaugccacgaagaacugaaguaugugguaauuuuu

SEQ ID NO: 236327 - RNA, 64 nt, Human
aaaguuguuuauguuuguguucuuaaauuuaaaacacgaagaaaaagaaaugucuuucuuguua

SEQ ID NO: 236328 - RNA, 64 nt, Human
ugccccggggaccuugugauccagcucacagcuccacgaagacucaaaaggaaaagccauuuuu

SEQ ID NO: 236329 - RNA, 64 nt, Human
uuauuuuuuauuuuugggacugcacuauccuguucacgaagacaugugaacuugguucagucca

SEQ ID NO: 236330 - RNA, 64 nt, Human
cugcggguaaagugugagagcuugccauccagcucacgaagacagaguuauuaaaccauucaaa

SEQ ID NO: 236331 - RNA, 64 nt, Human
ggccuggagggcccaaugucgcugcaaacacagccacgaagaacaugcagccacugggccccau

SEQ ID NO: 236332 - RNA, 64 nt, Human
ccagggcacuuugcagcuccauccucaaguuccacacgaagaugcuuggaugagucagcuggga

SEQ ID NO: 236333 - RNA, 64 nt, Human
uugaagccaucaacaauggggacuuugaggccuacacgaagauuugugauccaggccucacuuc

SEQ ID NO: 236334 - RNA, 64 nt, Human
cugguuugggcuugccucgaagauuuuauuaaggcacgaagaagugaaaaacuaagggcuucau

SEQ ID NO: 236335 - RNA, 64 nt, Human
ggccaggcacugugcuaggcaccagcagggguaacacgaagaagacccggcccuuagggcauca

SEQ ID NO: 236336 - RNA, 64 nt, Human
gaggcucagggaagccaagugacaaguccaaggucacgaagacuuucuuggagcccgaaacacc

SEQ ID NO: 236337 - RNA, 64 nt, Human
ucugcaccccaaaccaaugucaccauaaagagggcacgaagaagagugggugugaucccaacgg

SEQ ID NO: 236338 - RNA, 64 nt, Human
uacagggcagagaggcugcacugugucauuuaaucacgaagacucuguuauuagacugcucgaa

SEQ ID NO: 236339 - RNA, 64 nt, Human
caagccagugacaagggagcccugaaguuguguccacgaagagggagcugaaacaaauucgggg

SEQ ID NO: 236340 - RNA, 60 nt, Human
ggccagacagcuguccccccguccuccuccccagcccagccugcucagagaagcuggcag

SEQ ID NO: 236341 - RNA, 60 nt, Human
gagaagaaauuuugagaauggaaaaaucccccagcccagcccagccccaccgaaaagcaa

SEQ ID NO: 236342 - RNA, 60 nt, Human
gaaauuuugagaauggaaaaaucccccagcccagcccagccccaccgaaaagcaaaaauu

SEQ ID NO: 236343 - RNA, 64 nt, Human
uguucugaaauuaggaaaguacugcaugaucuuacacgaagaaauagaauaggcaaacuuuuau

SEQ ID NO: 236344 - RNA, 64 nt, Human
uuuggagucccuuuucaacagugacaguuucuuacacgaagaauggauaugguuauugggcucc

SEQ ID NO: 236345 - RNA, 64 nt, Human
uugggacccccaaggguuaaagccacccagcauucacgaagagcaccugaaguauggaagcuga

SEQ ID NO: 236346 - RNA, 64 nt, Human
uaaucguguguugcaucgaugcguuuguggucaccacgaagaugaggaccaacuugaaaagauu

SEQ ID NO: 236347 - RNA, 64 nt, Human
acuugacuggcuccuuuuaacuggauauaaauuccacgaagaaaauccugauuccaagaugucc

SEQ ID NO: 236348 - RNA, 64 nt, Human
cagcuggaggugaaacugugcuuguauccccagccacgaagagcuggaccagcuucaaguacau

SEQ ID NO: 236349 - RNA, 64 nt, Human
cuucccuccacagaccccuaugccuuguuccgagcacgaagaaacagcagcagggaugucuacc

SEQ ID NO: 236350 - RNA, 64 nt, Human
cccaccuguacaacaacggaaagguguguggccacacgaagaagccaaacgccguggccuccug

SEQ ID NO: 236351 - RNA, 64 nt, Human
caagaaucgccuuuaagguucagcagaagcgccucacgaagacguccagguguggcccgugggc

SEQ ID NO: 236352 - RNA, 64 nt, Human
acacacaaguacacccaucuggggcccgcuuugccacgaagagcugggcaggccugcagggugu

SEQ ID NO: 236353 - RNA, 64 nt, Human
uuggugugguguuugccauugcagagcaagcugccacgaagaccccugggcaugauuuugcuug

SEQ ID NO: 236354 - RNA, 64 nt, Human
gcccagcagcuccuguggccacagcagcuuuguacacgaagaccauccauccucccuucgucca

SEQ ID NO: 236355 - RNA, 64 nt, Human
uguuaaucuguugcugacuagcauuagacuguuacacgaagauaaacugaauaagcauuuagcu

SEQ ID NO: 236356 - RNA, 64 nt, Human
guuaccagcaucaaagaccaaagguagauaaauucacgaagaugaggagaaaccagugcaaaaa

SEQ ID NO: 236357 - RNA, 64 nt, Human
ccguggugauggcgucacguggccauguagacgucacgaagagauauagcgauggcgucgugca

SEQ ID NO: 236358 - RNA, 60 nt, Human
ugcugggauuacaggcaugagccacugcacccagcccaguucuuucuuaaaacagcugag

SEQ ID NO: 236359 - RNA, 60 nt, Human
cucucacugccuuccuugguucccggucccccagcccauccgccauccccagcccguggu

SEQ ID NO: 236360 - RNA, 60 nt, Human
aaacacaggcaaggaaauuggaacugccacccagcccagcaugguggcucaauugguugg

SEQ ID NO: 236361 - RNA, 64 nt, Human
cuaguuccuccaauuccauuuucucccauggaaucacgaagagcaagacccacucuguuccaga

SEQ ID NO: 236362 - RNA, 64 nt, Human
ggggaaaggacaagucagggaccacuugcugaagcacgaagagcccuuguggcaauguuaacau

SEQ ID NO: 236363 - RNA, 64 nt, Human
gucacagugcauucccauauuaggccauccccuucacgaagaauucaggggaugugggaagugg

SEQ ID NO: 236364 - RNA, 64 nt, Human
ugggacgcugauauaauaggguagaaagaaguaacacgaagaagugguggaaauguaaaaucca

SEQ ID NO: 236365 - RNA, 64 nt, Human
cccacuuuucuuuguuucuucucacuaaaaugaucacgaagaccuuugacaagaggagagauau

SEQ ID NO: 236366 - RNA, 64 nt, Human
gaggugggaccuuugggaagugauuaagucaagucacgaagauagagcuuugcgaaugggauca

SEQ ID NO: 236367 - RNA, 64 nt, Human
gaaugagaauauguaauacuuaaauaaacaugaccacgaagaaugcuguucugauuuacuagag

SEQ ID NO: 236368 - RNA, 64 nt, Human
aaacuguugguugagauaguugguucuuuuaccccacgaagacaucaagauacacuuguaaaua

SEQ ID NO: 236369 - RNA, 64 nt, Human
aggcccucuccccacugccccaaaccggccuagacacgaagaccaaagcagccugcacagggca

SEQ ID NO: 236370 - RNA, 64 nt, Human
gcuagauggauguguaccugguggauggcccacgcacgaagacucaagacccucaggacuggcc

SEQ ID NO: 236371 - RNA, 64 nt, Human
acuccugccaggaauggggggugcugagucaucucacgaagaaucccucacucuucccggguuc

SEQ ID NO: 236372 - RNA, 64 nt, Human
agcuucgagagccaguguugucagcagccauugccacgaagauggcgcaauuucauggcaugga

SEQ ID NO: 236373 - RNA, 64 nt, Human
uccccggacaacaugaaacaggugaggucaggucacugcggacaucaagggcggacaccaccaa

SEQ ID NO: 236374 - RNA, 64 nt, Human
ccucgcacugcccagggaagcccucggccuccagacugcggagcagccuccagugcuggcugcu

SEQ ID NO: 236375 - RNA, 64 nt, Human
cacugucaccuuagcaucagagucggauuaaugaacugcggaacaagagguugugagaaucuaa

SEQ ID NO: 236376 - RNA, 60 nt, Human
gcaggugacaagggcccugccuccaccccuccagcccauccagcaaucgcccccuuucug

SEQ ID NO: 236377 - RNA, 60 nt, Human
ccuaugcuuaaugaccaggucacauaaaauccagcccacuuacagguuuucuggcaucug

SEQ ID NO: 236378 - RNA, 60 nt, Human
uuuauuguuguuuaguuuugguuuguuacgccagcccagucugucugcggaacacugacu

SEQ ID NO: 236379 - RNA, 64 nt, Human
aggauccuucccuguaaauuugacagugccacauacugcggaccaagggacuccaaucugguaa

SEQ ID NO: 236380 - RNA, 64 nt, Human
uuuuugucuuugaccauauaagcuuguaacucugacugcggagagugaguggagagaggagagg

SEQ ID NO: 236381 - RNA, 64 nt, Human
gucuucuucccugucucaaguaaguaaggaagguacugcggacagugugggccagggaggaaaa

SEQ ID NO: 236382 - RNA, 64 nt, Human
ucuagaaucuuugagugcuuggcuuuccaaggauacugcggagacucuggccaagcugaugacc

SEQ ID NO: 236383 - RNA, 64 nt, Human
caucauagcucaucacggagcuacgacuuuggguacugcggacagaccuggauaggcccagcau

SEQ ID NO: 236384 - RNA, 64 nt, Human
gagguccuccaugccagccccacggugguccaugacugcggaacugcccagacauaagcaggag

SEQ ID NO: 236385 - RNA, 64 nt, Human
aucuaaugauucagcccacaggacuguugaaacuacugcggaaguuuuucuaucugaaagaagg

SEQ ID NO: 236386 - RNA, 64 nt, Human
aaaggcgcaucuaacgcguaucuaggcuuugguaacugcggacaaguugcuuuuaccugauuug

SEQ ID NO: 236387 - RNA, 64 nt, Human
aaaaaaucauugcuuugaagcaguugugucagcuacugcggaaaaggaaggaaacuccugacag

SEQ ID NO: 236388 - RNA, 64 nt, Human
ccuagaacaugagaaucaagccucuuaauuuuaaacugcggaauguggccucugcuuccuccgu

SEQ ID NO: 236389 - RNA, 64 nt, Human
ggauggacggcaaacagguaaggaguuccaugcaacugcggauggagccccucugagaaacaca

SEQ ID NO: 236390 - RNA, 64 nt, Human
aaugccuuucaggaaaggacucggcacuucucugacugcggaggcccugacccugccagcuggc

SEQ ID NO: 236391 - RNA, 64 nt, Human
uuuuauauaaauuuaaaccaauuuuuaaaacaaaacugcggacaccaccauaaaaauggaauca

SEQ ID NO: 236392 - RNA, 64 nt, Human
gaaggagccaccagccaguccucagauuucagagacugcggaggggcuuggcagacggucuuag

SEQ ID NO: 236393 - RNA, 64 nt, Human
ucucccgggaccgccgcaggaccaguuuccauagacugcggacuggggucuuccuccagcaguu

SEQ ID NO: 236394 - RNA, 64 nt, Human
ucagauuacuauuucuauuacuaugugaaaguuaacugcggagccaagaguuggacuauaauua

SEQ ID NO: 236395 - RNA, 60 nt, Human
acagggagagagguguguggcuacccgcuuccagcccauuuuccugauucuuuggcuugu

SEQ ID NO: 236396 - RNA, 60 nt, Human
uccccacagccccccagccccucagcccucccagcccacuucugccuguuuuaaacgagu

SEQ ID NO: 236397 - RNA, 60 nt, Human
ccugaugaagcacaacuccccgcagggcccccagcccacagggguggccauauuugggca

SEQ ID NO: 236398 - RNA, 64 nt, Human
ugccuccgcagccucagugcgcuuuccugcgcgcacugcggagggcgcccuaagcgucacccaa

SEQ ID NO: 236399 - RNA, 64 nt, Human
cgccugcuucuccauaucacagacuuuaaucuacacugcggagagcaaaccagcuugggcuucu

SEQ ID NO: 236400 - RNA, 64 nt, Human
ggcaaguaagguugagccugacuguaaaccuagaacugcggaaggacugggacuuuuguacaaa

SEQ ID NO: 236401 - RNA, 64 nt, Human
gagaaauaaaaguaucuucugcuccggcuguuucacugcggacggcuggggcugcugcgcguua

SEQ ID NO: 236402 - RNA, 64 nt, Human
cugggccuccugccuccgggcaggcaagguuuacacugcggaagccaaaggcagcuaagauaga

SEQ ID NO: 236403 - RNA, 64 nt, Human
cugucuauggcggcccugucuucuuggcccuggcacugcggacgcugcuccugguccuaauggc

SEQ ID NO: 236404 - RNA, 64 nt, Human
cccuuguguauaaagacgggaguccugcaauuguacugcggacuccacgaguucuuuucuggug

SEQ ID NO: 236405 - RNA, 64 nt, Human
cccuucuacaccuaucccguggccauccgcugugacugcggagccugcuccacugccaccacgg

SEQ ID NO: 236406 - RNA, 64 nt, Human
uucccccacuucaccuucggagaggacacuucaaacugcggacacacgcaaaagcgacucccag

SEQ ID NO: 236407 - RNA, 64 nt, Human
gaccauggacacuacacccagcaauagagacgggacugcggaggaaggaggacccaggacagga

SEQ ID NO: 236408 - RNA, 64 nt, Human
gcgggugcacacgaagggugaggcugacacagccacugcggaguccaggcugcuagaggugcuc

SEQ ID NO: 236409 - RNA, 64 nt, Human
aggcugaguggcucuuuuauuaaccagucauuacacugcggaacagccaacauagaguacuugc

SEQ ID NO: 236410 - RNA, 64 nt, Human
cacucccuaaucucaaguacccagggacacaaacacugcggaaggcggcaggguccucugccua

SEQ ID NO: 236411 - RNA, 64 nt, Human
uguguucugccccucccaccuguccccgccuccaacugcggaggaccaguuccuggcccucuuu

SEQ ID NO: 236412 - RNA, 64 nt, Human
aguaaguuagaggagucuugauuuuuuagacuucacugcggaguucuguacacccuuugcccug

SEQ ID NO: 236413 - RNA, 64 nt, Human
acacacacacacgcacacacacacacacacacucacugcggagaaccuugugccuggcucagag

SEQ ID NO: 236414 - RNA, 60 nt, Human
cuaagcacaaccagaggcccaacgacuaagccagcccacccugggcugggcccaggugcg

SEQ ID NO: 236415 - RNA, 60 nt, Human
ucuuaucccucaagaagaaacccaccauaaccagcccacugucaccccuaauuuacagac

SEQ ID NO: 236416 - RNA, 60 nt, Human
ugcugggguuacagguaugagccaccacacccagcccaacucauuauucuugaaaucaau

SEQ ID NO: 236417 - RNA, 64 nt, Human
cuguucugaauuggugacucugucaccaauaacgacugcggagaacuguagcgugcagaugugu

SEQ ID NO: 236418 - RNA, 64 nt, Human
gacaacgugagcgcgcgcguggcgcccuggugcgacugcggagccagcgggaaccggcgugagg

SEQ ID NO: 236419 - RNA, 64 nt, Human
cggugauucagcccugcccaaccugauucugaugacugcggaugcugugacggacccaaggggc

SEQ ID NO: 236420 - RNA, 64 nt, Human
ugcuguccuuuuucuccuugagggaggaaauaaaacugcggaauacaauguccuuccauagcau

SEQ ID NO: 236421 - RNA, 64 nt, Human
gucucucgaggaaacgcgguucagcgauucuuugacugcggacccugugggaaaccccgucaau

SEQ ID NO: 236422 - RNA, 64 nt, Human
uacucuccagaauccaggggcuauagcgauggggacugcggaauuacgagggcuggcuguuuua

SEQ ID NO: 236423 - RNA, 64 nt, Human
gggagaaggaaagguuauuuauucuauagaagagacugcggacaauuaguauucaaaguuuauu

SEQ ID NO: 236424 - RNA, 64 nt, Human
ugccaggggguuugaggacccucccagguuucccacugcggaacaggagugacucuggcugcca

SEQ ID NO: 236425 - RNA, 64 nt, Human; identical to SEQ ID NO: 134052

SEQ ID NO: 236426 - RNA, 64 nt, Human; identical to SEQ ID NO: 134053

SEQ ID NO: 236427 - RNA, 64 nt, Human; identical to SEQ ID NO: 134054

SEQ ID NO: 236428 - RNA, 64 nt, Human; identical to SEQ ID NO: 134055

SEQ ID NO: 236429 - RNA, 64 nt, Human; identical to SEQ ID NO: 134056

SEQ ID NO: 236430 - RNA, 64 nt, Human; identical to SEQ ID NO: 134057

SEQ ID NO: 236431 - RNA, 64 nt, Human; identical to SEQ ID NO: 134058

SEQ ID NO: 236432 - RNA, 60 nt, Human
cugccgcggauaaauuauucccuccccgacccagcccagugccaccucuaucuguguaca

SEQ ID NO: 236433 - RNA, 60 nt, Human
cgggggcgggccggggcagccacuccagccccagcccagccuggggugcacugacggaga

SEQ ID NO: 236434 - RNA, 60 nt, Human
cccgguuccuccccugcggugaccccaacuccagcccauccuguuggugaccgucuauau

SEQ ID NO: 236435 - RNA, 64 nt, Human; identical to SEQ ID NO: 134059

SEQ ID NO: 236436 - RNA, 64 nt, Human; identical to SEQ ID NO: 134060

SEQ ID NO: 236437 - RNA, 64 nt, Human; identical to SEQ ID NO: 134061

SEQ ID NO: 236438 - RNA, 64 nt, Human; identical to SEQ ID NO: 134062

SEQ ID NO: 236439 - RNA, 64 nt, Human; identical to SEQ ID NO: 134063

SEQ ID NO: 236440 - RNA, 64 nt, Human; identical to SEQ ID NO: 134064

SEQ ID NO: 236441 - RNA, 64 nt, Human; identical to SEQ ID NO: 134065

SEQ ID NO: 236442 - RNA, 64 nt, Human; identical to SEQ ID NO: 134066

SEQ ID NO: 236443 - RNA, 64 nt, Human; identical to SEQ ID NO: 134067

SEQ ID NO: 236444 - RNA, 64 nt, Human; identical to SEQ ID NO: 134068

SEQ ID NO: 236445 - RNA, 64 nt, Human; identical to SEQ ID NO: 134069

SEQ ID NO: 236446 - RNA, 64 nt, Human; identical to SEQ ID NO: 134070

SEQ ID NO: 236447 - RNA, 64 nt, Human; identical to SEQ ID NO: 134071

SEQ ID NO: 236448 - RNA, 64 nt, Human; identical to SEQ ID NO: 134072

SEQ ID NO: 236449 - RNA, 64 nt, Human; identical to SEQ ID NO: 134073

SEQ ID NO: 236450 - RNA, 64 nt, Human; identical to SEQ ID NO: 134074

SEQ ID NO: 236451 - RNA, 60 nt, Human
ucuagaagccacagugcccaccugcucuucccagcccauaucuacaguacuuccagaugg

SEQ ID NO: 236452 - RNA, 60 nt, Human
aucugccacgaggggccugcuguuugccacccagcccaacuuccuguugcuggccccugc

SEQ ID NO: 236453 - RNA, 60 nt, Human
ccaggagcugagucaccuccuccacucacuccagcccaacagaaggaaggaggagggcgc

SEQ ID NO: 236454 - RNA, 64 nt, Human; identical to SEQ ID NO: 134075

SEQ ID NO: 236455 - RNA, 64 nt, Human; identical to SEQ ID NO: 134076

SEQ ID NO: 236456 - RNA, 64 nt, Human; identical to SEQ ID NO: 134077

SEQ ID NO: 236457 - RNA, 64 nt, Human; identical to SEQ ID NO: 134078

SEQ ID NO: 236458 - RNA, 64 nt, Human; identical to SEQ ID NO: 134079

SEQ ID NO: 236459 - RNA, 64 nt, Human; identical to SEQ ID NO: 134080

SEQ ID NO: 236460 - RNA, 64 nt, Human; identical to SEQ ID NO: 134081

SEQ ID NO: 236461 - RNA, 64 nt, Human; identical to SEQ ID NO: 134082

SEQ ID NO: 236462 - RNA, 50 nt, Human; identical to SEQ ID NO: 134083

SEQ ID NO: 236463 - RNA, 64 nt, Human; identical to SEQ ID NO: 134084

SEQ ID NO: 236464 - RNA, 64 nt, Human; identical to SEQ ID NO: 134085

SEQ ID NO: 236465 - RNA, 64 nt, Human; identical to SEQ ID NO: 134086

SEQ ID NO: 236466 - RNA, 64 nt, Human; identical to SEQ ID NO: 134087

SEQ ID NO: 236467 - RNA, 64 nt, Human; identical to SEQ ID NO: 134088

SEQ ID NO: 236468 - RNA, 64 nt, Human; identical to SEQ ID NO: 134089

SEQ ID NO: 236469 - RNA, 64 nt, Human; identical to SEQ ID NO: 134090

SEQ ID NO: 236470 - RNA, 60 nt, Human
ccauaccuucugggcucccuuugcugaccaccagcccaagggagcuaagaccaggagggg

SEQ ID NO: 236471 - RNA, 60 nt, Human
accgaggcccggugauccuccagccacaguccagcccaaccacugccacuuuccauggga

SEQ ID NO: 236472 - RNA, 60 nt, Human
uuagggaaggcugggauaugaugagagauuccagcccaagccuggccccccaccgccagg

SEQ ID NO: 236473 - RNA, 64 nt, Human; identical to SEQ ID NO: 134091

SEQ ID NO: 236474 - RNA, 64 nt, Human; identical to SEQ ID NO: 134092

SEQ ID NO: 236475 - RNA, 64 nt, Human; identical to SEQ ID NO: 134093

SEQ ID NO: 236476 - RNA, 64 nt, Human; identical to SEQ ID NO: 134094

SEQ ID NO: 236477 - RNA, 64 nt, Human; identical to SEQ ID NO: 134095

SEQ ID NO: 236478 - RNA, 64 nt, Human; identical to SEQ ID NO: 134096

SEQ ID NO: 236479 - RNA, 64 nt, Human; identical to SEQ ID NO: 134097

SEQ ID NO: 236480 - RNA, 64 nt, Human; identical to SEQ ID NO: 134098

SEQ ID NO: 236481 - RNA, 64 nt, Human; identical to SEQ ID NO: 134099

SEQ ID NO: 236482 - RNA, 64 nt, Human; identical to SEQ ID NO: 134100

SEQ ID NO: 236483 - RNA, 64 nt, Human; identical to SEQ ID NO: 134101

SEQ ID NO: 236484 - RNA, 64 nt, Human; identical to SEQ ID NO: 134102

SEQ ID NO: 236485 - RNA, 64 nt, Human; identical to SEQ ID NO: 134103

SEQ ID NO: 236486 - RNA, 64 nt, Human; identical to SEQ ID NO: 134104

SEQ ID NO: 236487 - RNA, 64 nt, Human; identical to SEQ ID NO: 134105

SEQ ID NO: 236488 - RNA, 64 nt, Human; identical to SEQ ID NO: 134106

SEQ ID NO: 236489 - RNA, 60 nt, Human
ugacuuauucccugagacuuuucaggagagccagcccacagaugaugaagaaaugaugga

SEQ ID NO: 236490 - RNA, 60 nt, Human
cagaggaggggacuuguaggaaucugccuuccagcccagacccccaguguauuuugucca

SEQ ID NO: 236491 - RNA, 60 nt, Human
ugcugggauuacaggcaugagccaccacggccagcccacaaugauauuacaaaccuauua

SEQ ID NO: 236492 - RNA, 64 nt, Human; identical to SEQ ID NO: 134107

SEQ ID NO: 236493 - RNA, 64 nt, Human; identical to SEQ ID NO: 134108

SEQ ID NO: 236494 - RNA, 64 nt, Human; identical to SEQ ID NO: 134109

SEQ ID NO: 236495 - RNA, 64 nt, Human; identical to SEQ ID NO: 134110

SEQ ID NO: 236496 - RNA, 64 nt, Human; identical to SEQ ID NO: 134111

SEQ ID NO: 236497 - RNA, 64 nt, Human; identical to SEQ ID NO: 134112

SEQ ID NO: 236498 - RNA, 64 nt, Human; identical to SEQ ID NO: 134113

SEQ ID NO: 236499 - RNA, 64 nt, Human; identical to SEQ ID NO: 134114

SEQ ID NO: 236500 - RNA, 64 nt, Human; identical to SEQ ID NO: 134115

SEQ ID NO: 236501 - RNA, 64 nt, Human; identical to SEQ ID NO: 134116

SEQ ID NO: 236502 - RNA, 64 nt, Human; identical to SEQ ID NO: 134117

SEQ ID NO: 236503 - RNA, 64 nt, Human; identical to SEQ ID NO: 134118

SEQ ID NO: 236504 - RNA, 64 nt, Human; identical to SEQ ID NO: 134119

SEQ ID NO: 236505 - RNA, 64 nt, Human; identical to SEQ ID NO: 134120

SEQ ID NO: 236506 - RNA, 64 nt, Human; identical to SEQ ID NO: 134121

SEQ ID NO: 236507 - RNA, 64 nt, Human; identical to SEQ ID NO: 134122

SEQ ID NO: 236508 - RNA, 60 nt, Human
cagcccauuuuaucuuugaauggucuucugccagcccauuuugaggccagaggugcuguc

SEQ ID NO: 236509 - RNA, 60 nt, Human
uucugaagaggcuucugucuuauuugaaggccagcccacacccagcuacuuuaacaccag

SEQ ID NO: 236510 - RNA, 60 nt, Human
aaggcugucuucucccagagcacaagaaggccagcccacugggcccuggggcugcccucg

SEQ ID NO: 236511 - RNA, 64 nt, Human; identical to SEQ ID NO: 134123

SEQ ID NO: 236512 - RNA, 64 nt, Human; identical to SEQ ID NO: 134124

SEQ ID NO: 236513 - RNA, 64 nt, Human; identical to SEQ ID NO: 134125

SEQ ID NO: 236514 - RNA, 64 nt, Human; identical to SEQ ID NO: 134126

SEQ ID NO: 236515 - RNA, 64 nt, Human; identical to SEQ ID NO: 134127

SEQ ID NO: 236516 - RNA, 64 nt, Human; identical to SEQ ID NO: 134128

SEQ ID NO: 236517 - RNA, 64 nt, Human; identical to SEQ ID NO: 134129

SEQ ID NO: 236518 - RNA, 64 nt, Human; identical to SEQ ID NO: 134130

SEQ ID NO: 236519 - RNA, 64 nt, Human; identical to SEQ ID NO: 134131

SEQ ID NO: 236520 - RNA, 64 nt, Human; identical to SEQ ID NO: 134132

SEQ ID NO: 236521 - RNA, 64 nt, Human; identical to SEQ ID NO: 134133

SEQ ID NO: 236522 - RNA, 64 nt, Human; identical to SEQ ID NO: 134134

SEQ ID NO: 236523 - RNA, 64 nt, Human; identical to SEQ ID NO: 134135

SEQ ID NO: 236524 - RNA, 64 nt, Human; identical to SEQ ID NO: 134136

SEQ ID NO: 236525 - RNA, 64 nt, Human; identical to SEQ ID NO: 134137

SEQ ID NO: 236526 - RNA, 64 nt, Human; identical to SEQ ID NO: 134138

SEQ ID NO: 236527 - RNA, 60 nt, Human
auccucugaaaugggacccugugucugucaccagcccacccucuguguucaugaaccugg

SEQ ID NO: 236528 - RNA, 60 nt, Human
cucgcuuugaccccuuuggacccauugggaccagcccacccggguacguagucacucagg

SEQ ID NO: 236529 - RNA, 60 nt, Human
gcagguaggcgcccugcagccucccugcucccagcccaaggccagucggccugggaaguu

SEQ ID NO: 236530 - RNA, 64 nt, Human; identical to SEQ ID NO: 134139

SEQ ID NO: 236531 - RNA, 64 nt, Human; identical to SEQ ID NO: 134140

SEQ ID NO: 236532 - RNA, 64 nt, Human; identical to SEQ ID NO: 134141

SEQ ID NO: 236533 - RNA, 64 nt, Human; identical to SEQ ID NO: 134142

SEQ ID NO: 236534 - RNA, 64 nt, Human; identical to SEQ ID NO: 134143

SEQ ID NO: 236535 - RNA, 64 nt, Human; identical to SEQ ID NO: 134144

SEQ ID NO: 236536 - RNA, 64 nt, Human; identical to SEQ ID NO: 134145

SEQ ID NO: 236537 - RNA, 64 nt, Human; identical to SEQ ID NO: 134146

SEQ ID NO: 236538 - RNA, 64 nt, Human; identical to SEQ ID NO: 134147

SEQ ID NO: 236539 - RNA, 64 nt, Human; identical to SEQ ID NO: 134148

SEQ ID NO: 236540 - RNA, 64 nt, Human; identical to SEQ ID NO: 134149

SEQ ID NO: 236541 - RNA, 64 nt, Human; identical to SEQ ID NO: 134150

SEQ ID NO: 236542 - RNA, 64 nt, Human; identical to SEQ ID NO: 134151

SEQ ID NO: 236543 - RNA, 64 nt, Human; identical to SEQ ID NO: 134152

SEQ ID NO: 236544 - RNA, 64 nt, Human; identical to SEQ ID NO: 134153

SEQ ID NO: 236545 - RNA, 64 nt, Human; identical to SEQ ID NO: 134154

SEQ ID NO: 236546 - RNA, 60 nt, Human
uccaaguggaugucccguugccuuauucccccagcccacaaaggcacccuggccuuggcc

SEQ ID NO: 236547 - RNA, 60 nt, Human
gcaugggcaauagcaagcuggcggcagaguccagcccagcauaugacuugcccugaaugg

SEQ ID NO: 236548 - RNA, 60 nt, Human
gcacuguggcucugcaugacaaacacacauccagcccaggacucuaagccucucaccugg

SEQ ID NO: 236549 - RNA, 64 nt, Human; identical to SEQ ID NO: 134155

SEQ ID NO: 236550 - RNA, 64 nt, Human; identical to SEQ ID NO: 134156

SEQ ID NO: 236551 - RNA, 64 nt, Human; identical to SEQ ID NO: 134157

SEQ ID NO: 236552 - RNA, 64 nt, Human; identical to SEQ ID NO: 134158

SEQ ID NO: 236553 - RNA, 64 nt, Human; identical to SEQ ID NO: 134159

SEQ ID NO: 236554 - RNA, 64 nt, Human; identical to SEQ ID NO: 134160

SEQ ID NO: 236555 - RNA, 64 nt, Human; identical to SEQ ID NO: 134161

SEQ ID NO: 236556 - RNA, 64 nt, Human; identical to SEQ ID NO: 134162

SEQ ID NO: 236557 - RNA, 64 nt, Human; identical to SEQ ID NO: 134163

SEQ ID NO: 236558 - RNA, 64 nt, Human; identical to SEQ ID NO: 134164

SEQ ID NO: 236559 - RNA, 64 nt, Human; identical to SEQ ID NO: 134165

SEQ ID NO: 236560 - RNA, 64 nt, Human; identical to SEQ ID NO: 134166

SEQ ID NO: 236561 - RNA, 64 nt, Human; identical to SEQ ID NO: 134167

SEQ ID NO: 236562 - RNA, 64 nt, Human; identical to SEQ ID NO: 134168

SEQ ID NO: 236563 - RNA, 64 nt, Human; identical to SEQ ID NO: 134169

SEQ ID NO: 236564 - RNA, 64 nt, Human; identical to SEQ ID NO: 134170

SEQ ID NO: 236565 - RNA, 60 nt, Human
ugccucccaggagcccuuggccaccucgcgccagcccaaaggcgcagcucugaguucaaa

SEQ ID NO: 236566 - RNA, 60 nt, Human
cagcuacuccauccuugcaccccugggggcccagcccacccgcaugcacagagcaggggc

SEQ ID NO: 236567 - RNA, 60 nt, Human
ugcgucgccccucucaccugcagucagcucccagcccaguguaggccaucuccucugugc

SEQ ID NO: 236568 - RNA, 64 nt, Human; identical to SEQ ID NO: 134171

SEQ ID NO: 236569 - RNA, 64 nt, Human; identical to SEQ ID NO: 134172

SEQ ID NO: 236570 - RNA, 64 nt, Human; identical to SEQ ID NO: 134173

SEQ ID NO: 236571 - RNA, 64 nt, Human; identical to SEQ ID NO: 134174

SEQ ID NO: 236572 - RNA, 64 nt, Human; identical to SEQ ID NO: 134175

SEQ ID NO: 236573 - RNA, 64 nt, Human; identical to SEQ ID NO: 134176

SEQ ID NO: 236574 - RNA, 64 nt, Human; identical to SEQ ID NO: 134177

SEQ ID NO: 236575 - RNA, 64 nt, Human; identical to SEQ ID NO: 134178

SEQ ID NO: 236576 - RNA, 64 nt, Human; identical to SEQ ID NO: 134179

SEQ ID NO: 236577 - RNA, 64 nt, Human; identical to SEQ ID NO: 134180

SEQ ID NO: 236578 - RNA, 64 nt, Human; identical to SEQ ID NO: 134181

SEQ ID NO: 236579 - RNA, 64 nt, Human; identical to SEQ ID NO: 134182

SEQ ID NO: 236580 - RNA, 64 nt, Human; identical to SEQ ID NO: 134183

SEQ ID NO: 236581 - RNA, 64 nt, Human; identical to SEQ ID NO: 134184

SEQ ID NO: 236582 - RNA, 64 nt, Human; identical to SEQ ID NO: 134185

SEQ ID NO: 236583 - RNA, 64 nt, Human; identical to SEQ ID NO: 134186

SEQ ID NO: 236584 - RNA, 60 nt, Human
ugccuauggugucgcuuggcuaagugacucccagcccaagcccccucaagagucuggguc

SEQ ID NO: 236585 - RNA, 60 nt, Human
guugagggccauccauaugccagcugggggccagcccacaguggccauauuggcugcagc

SEQ ID NO: 236586 - RNA, 60 nt, Human
uuuccuccagcacuuucuuuccgccugaguccagcccaaggccuuuuauuuugcgcugug

SEQ ID NO: 236587 - RNA, 64 nt, Human; identical to SEQ ID NO: 134187

SEQ ID NO: 236588 - RNA, 64 nt, Human; identical to SEQ ID NO: 134188

SEQ ID NO: 236589 - RNA, 64 nt, Human; identical to SEQ ID NO: 134189

SEQ ID NO: 236590 - RNA, 64 nt, Human; identical to SEQ ID NO: 134190

SEQ ID NO: 236591 - RNA, 64 nt, Human; identical to SEQ ID NO: 134191

SEQ ID NO: 236592 - RNA, 64 nt, Human; identical to SEQ ID NO: 134192

SEQ ID NO: 236593 - RNA, 64 nt, Human; identical to SEQ ID NO: 134193

SEQ ID NO: 236594 - RNA, 64 nt, Human; identical to SEQ ID NO: 134194

SEQ ID NO: 236595 - RNA, 64 nt, Human; identical to SEQ ID NO: 134195

SEQ ID NO: 236596 - RNA, 64 nt, Human; identical to SEQ ID NO: 134196

SEQ ID NO: 236597 - RNA, 64 nt, Human; identical to SEQ ID NO: 134197

SEQ ID NO: 236598 - RNA, 64 nt, Human; identical to SEQ ID NO: 134198

SEQ ID NO: 236599 - RNA, 64 nt, Human; identical to SEQ ID NO: 134199

SEQ ID NO: 236600 - RNA, 64 nt, Human; identical to SEQ ID NO: 134200

SEQ ID NO: 236601 - RNA, 64 nt, Human; identical to SEQ ID NO: 134201

SEQ ID NO: 236602 - RNA, 64 nt, Human; identical to SEQ ID NO: 134202

SEQ ID NO: 236603 - RNA, 60 nt, Human
gaagcacguuggccuaagugugccgugaucccagcccacacuagccugggugcaucugcu

SEQ ID NO: 236604 - RNA, 60 nt, Human
gggugggcaggggccugaggguggcucgggccagcccaccagccaauggaccccuccuca

SEQ ID NO: 236605 - RNA, 60 nt, Human
cacaggaacucugugugagagagagggcgcccagcccaggccugguggagggggagggga

SEQ ID NO: 236606 - RNA, 64 nt, Human; identical to SEQ ID NO: 134203

SEQ ID NO: 236607 - RNA, 64 nt, Human; identical to SEQ ID NO: 134204

SEQ ID NO: 236608 - RNA, 64 nt, Human; identical to SEQ ID NO: 134205

SEQ ID NO: 236609 - RNA, 64 nt, Human; identical to SEQ ID NO: 134206

SEQ ID NO: 236610 - RNA, 64 nt, Human; identical to SEQ ID NO: 134207

SEQ ID NO: 236611 - RNA, 64 nt, Human; identical to SEQ ID NO: 134208

SEQ ID NO: 236612 - RNA, 64 nt, Human; identical to SEQ ID NO: 134209

SEQ ID NO: 236613 - RNA, 64 nt, Human; identical to SEQ ID NO: 134210

SEQ ID NO: 236614 - RNA, 64 nt, Human; identical to SEQ ID NO: 134211

SEQ ID NO: 236615 - RNA, 64 nt, Human; identical to SEQ ID NO: 134212

SEQ ID NO: 236616 - RNA, 64 nt, Human; identical to SEQ ID NO: 134213

SEQ ID NO: 236617 - RNA, 64 nt, Human; identical to SEQ ID NO: 134214

SEQ ID NO: 236618 - RNA, 64 nt, Human; identical to SEQ ID NO: 134215

SEQ ID NO: 236619 - RNA, 64 nt, Human; identical to SEQ ID NO: 134216

SEQ ID NO: 236620 - RNA, 64 nt, Human; identical to SEQ ID NO: 134217

SEQ ID NO: 236621 - RNA, 64 nt, Human; identical to SEQ ID NO: 134218

SEQ ID NO: 236622 - RNA, 60 nt, Human
uccugccagcuucccccgucagccccaaccccagcccacacauuguaccaucucuucugc

SEQ ID NO: 236623 - RNA, 60 nt, Human
ugcguguccggaaaagggcuccauuugguuccagcccacuccccucugcaagugccgcag

SEQ ID NO: 236624 - RNA, 60 nt, Human
cucagguuccugaccguggcgcccuucuacccagcccagugugcggccgccgcgcugucu

SEQ ID NO: 236625 - RNA, 64 nt, Human; identical to SEQ ID NO: 134219

SEQ ID NO: 236626 - RNA, 64 nt, Human; identical to SEQ ID NO: 134220

SEQ ID NO: 236627 - RNA, 64 nt, Human; identical to SEQ ID NO: 134221

SEQ ID NO: 236628 - RNA, 64 nt, Human; identical to SEQ ID NO: 134222

SEQ ID NO: 236629 - RNA, 64 nt, Human; identical to SEQ ID NO: 134223

SEQ ID NO: 236630 - RNA, 64 nt, Human; identical to SEQ ID NO: 134224

SEQ ID NO: 236631 - RNA, 64 nt, Human; identical to SEQ ID NO: 134225

SEQ ID NO: 236632 - RNA, 64 nt, Human; identical to SEQ ID NO: 134226

SEQ ID NO: 236633 - RNA, 64 nt, Human; identical to SEQ ID NO: 134227

SEQ ID NO: 236634 - RNA, 64 nt, Human; identical to SEQ ID NO: 134228

SEQ ID NO: 236635 - RNA, 64 nt, Human; identical to SEQ ID NO: 134229

SEQ ID NO: 236636 - RNA, 64 nt, Human; identical to SEQ ID NO: 134230

SEQ ID NO: 236637 - RNA, 64 nt, Human; identical to SEQ ID NO: 134231

SEQ ID NO: 236638 - RNA, 64 nt, Human; identical to SEQ ID NO: 134211

SEQ ID NO: 236639 - RNA, 64 nt, Human; identical to SEQ ID NO: 134233

SEQ ID NO: 236640 - RNA, 64 nt, Human; identical to SEQ ID NO: 134234

SEQ ID NO: 236641 - RNA, 60 nt, Human
cuuagggagcagagagcagaacuccgcagcccagcccagaggagugucaccucccaccuu

SEQ ID NO: 236642 - RNA, 60 nt, Human
caugcccggucccaccccucccucuguccaccagcccauggcccugugcuaaucccagga

SEQ ID NO: 236643 - RNA, 60 nt, Human
aaccaaacucucuuuccccauuucuaucucccagcccagucacaaaaauacucagcucca

SEQ ID NO: 236644 - RNA, 64 nt, Human; identical to SEQ ID NO: 134235

SEQ ID NO: 236645 - RNA, 64 nt, Human; identical to SEQ ID NO: 134236

SEQ ID NO: 236646 - RNA, 64 nt, Human; identical to SEQ ID NO: 134237

SEQ ID NO: 236647 - RNA, 64 nt, Human; identical to SEQ ID NO: 134238

SEQ ID NO: 236648 - RNA, 64 nt, Human; identical to SEQ ID NO: 134239

SEQ ID NO: 236649 - RNA, 64 nt, Human; identical to SEQ ID NO: 134240

SEQ ID NO: 236650 - RNA, 64 nt, Human; identical to SEQ ID NO: 134241

SEQ ID NO: 236651 - RNA, 64 nt, Human; identical to SEQ ID NO: 134242

SEQ ID NO: 236652 - RNA, 64 nt, Human; identical to SEQ ID NO: 134243

SEQ ID NO: 236653 - RNA, 64 nt, Human; identical to SEQ ID NO: 134244

SEQ ID NO: 236654 - RNA, 64 nt, Human; identical to SEQ ID NO: 134245

SEQ ID NO: 236655 - RNA, 64 nt, Human; identical to SEQ ID NO: 134246

SEQ ID NO: 236656 - RNA, 64 nt, Human; identical to SEQ ID NO: 134247

SEQ ID NO: 236657 - RNA, 64 nt, Human; identical to SEQ ID NO: 134248

SEQ ID NO: 236658 - RNA, 64 nt, Human; identical to SEQ ID NO: 134249

SEQ ID NO: 236659 - RNA, 64 nt, Human; identical to SEQ ID NO: 134250

SEQ ID NO: 236660 - RNA, 60 nt, Human
uuaaccagggcaccaagcccacagguguccccagcccacuggaucagaaagaguucagua

SEQ ID NO: 236661 - RNA, 60 nt, Human
ggccccaaaggcugccacggugcccucaccccagcccaugugcucccauaagggcugguu

SEQ ID NO: 236662 - RNA, 60 nt, Human
ccuggcccugggagaaucgcuccugcagccccagcccagccccacuccucugcugaccug

SEQ ID NO: 236663 - RNA, 64 nt, Human; identical to SEQ ID NO: 134251

SEQ ID NO: 236664 - RNA, 64 nt, Human; identical to SEQ ID NO: 134252

SEQ ID NO: 236665 - RNA, 64 nt, Human; identical to SEQ ID NO: 134253

SEQ ID NO: 236666 - RNA, 64 nt, Human; identical to SEQ ID NO: 134254

SEQ ID NO: 236667 - RNA, 64 nt, Human; identical to SEQ ID NO: 134255

SEQ ID NO: 236668 - RNA, 64 nt, Human; identical to SEQ ID NO: 134256

SEQ ID NO: 236669 - RNA, 64 nt, Human; identical to SEQ ID NO: 134257

SEQ ID NO: 236670 - RNA, 64 nt, Human; identical to SEQ ID NO: 134258

SEQ ID NO: 236671 - RNA, 64 nt, Human; identical to SEQ ID NO: 134259

SEQ ID NO: 236672 - RNA, 64 nt, Human; identical to SEQ ID NO: 134260

SEQ ID NO: 236673 - RNA, 64 nt, Human; identical to SEQ ID NO: 134261

SEQ ID NO: 236674 - RNA, 64 nt, Human; identical to SEQ ID NO: 134262

SEQ ID NO: 236675 - RNA, 64 nt, Human; identical to SEQ ID NO: 134263

SEQ ID NO: 236676 - RNA, 64 nt, Human; identical to SEQ ID NO: 134264

SEQ ID NO: 236677 - RNA, 64 nt, Human; identical to SEQ ID NO: 134265

SEQ ID NO: 236678 - RNA, 64 nt, Human; identical to SEQ ID NO: 134266

SEQ ID NO: 236679 - RNA, 60 nt, Human
cccuacuuccagguucugguuagcucagccccagcccagcccagcugcucugcccagagc

SEQ ID NO: 236680 - RNA, 63 nt, Human
aaaucaagaggagacccccaggcagaggggcguucucccaaagauuaggucguuuuccaaaga

SEQ ID NO: 236681 - RNA, 63 nt, Human
uaauauagguuaaaacaaugauuuaaauauguuucucccaauaauuaucucuuucccuggaau

SEQ ID NO: 236682 - RNA, 64 nt, Human; identical to SEQ ID NO: 134267

SEQ ID NO: 236683 - RNA, 64 nt, Human; identical to SEQ ID NO: 134268

SEQ ID NO: 236684 - RNA, 64 nt, Human; identical to SEQ ID NO: 134269

SEQ ID NO: 236685 - RNA, 64 nt, Human; identical to SEQ ID NO: 134270

SEQ ID NO: 236686 - RNA, 64 nt, Human; identical to SEQ ID NO: 134271

SEQ ID NO: 236687 - RNA, 64 nt, Human; identical to SEQ ID NO: 134272

SEQ ID NO: 236688 - RNA, 64 nt, Human; identical to SEQ ID NO: 134273

SEQ ID NO: 236689 - RNA, 64 nt, Human; identical to SEQ ID NO: 134274

SEQ ID NO: 236690 - RNA, 64 nt, Human; identical to SEQ ID NO: 134088

SEQ ID NO: 236691 - RNA, 64 nt, Human; identical to SEQ ID NO: 134276

SEQ ID NO: 236692 - RNA, 64 nt, Human; identical to SEQ ID NO: 134277

SEQ ID NO: 236693 - RNA, 64 nt, Human; identical to SEQ ID NO: 134278

SEQ ID NO: 236694 - RNA, 64 nt, Human; identical to SEQ ID NO: 134279

SEQ ID NO: 236695 - RNA, 64 nt, Human; identical to SEQ ID NO: 134280

SEQ ID NO: 236696 - RNA, 64 nt, Human; identical to SEQ ID NO: 134281

SEQ ID NO: 236697 - RNA, 64 nt, Human; identical to SEQ ID NO: 134282

SEQ ID NO: 236698 - RNA, 60 nt, Human
aagccucuguuuacccugaagcaccacuguccagcccauugguucccacuggcagcaugg

SEQ ID NO: 236699 - RNA, 60 nt, Human
ucagauccuccucuuaugcccuugauugugccagcccaugccacccccauccugggcaca

SEQ ID NO: 236700 - RNA, 60 nt, Human
caugaaggaugugggcccagaaucauguggccagcccacccccuguuggcccucaccagc

SEQ ID NO: 236701 - RNA, 64 nt, Human; identical to SEQ ID NO: 134283

SEQ ID NO: 236702 - RNA, 64 nt, Human; identical to SEQ ID NO: 134284

SEQ ID NO: 236703 - RNA, 64 nt, Human; identical to SEQ ID NO: 134099

SEQ ID NO: 236704 - RNA, 64 nt, Human; identical to SEQ ID NO: 134286

SEQ ID NO: 236705 - RNA, 64 nt, Human; identical to SEQ ID NO: 134287

SEQ ID NO: 236706 - RNA, 64 nt, Human; identical to SEQ ID NO: 134288

SEQ ID NO: 236707 - RNA, 64 nt, Human; identical to SEQ ID NO: 134289

SEQ ID NO: 236708 - RNA, 64 nt, Human; identical to SEQ ID NO: 134290

SEQ ID NO: 236709 - RNA, 64 nt, Human; identical to SEQ ID NO: 134291

SEQ ID NO: 236710 - RNA, 64 nt, Human; identical to SEQ ID NO: 134292

SEQ ID NO: 236711 - RNA, 64 nt, Human; identical to SEQ ID NO: 134293

SEQ ID NO: 236712 - RNA, 64 nt, Human; identical to SEQ ID NO: 134294

SEQ ID NO: 236713 - RNA, 64 nt, Human; identical to SEQ ID NO: 134295

SEQ ID NO: 236714 - RNA, 64 nt, Human; identical to SEQ ID NO: 134296

SEQ ID NO: 236715 - RNA, 64 nt, Human; identical to SEQ ID NO: 134297

SEQ ID NO: 236716 - RNA, 64 nt, Human; identical to SEQ ID NO: 134298

SEQ ID NO: 236717 - RNA, 60 nt, Human
uuugaacacaaaauaucuauacuucaugcuccagcccaagccuauacccuguaauagcau

SEQ ID NO: 236718 - RNA, 60 nt, Human
gcccaguggucaccccugugugcgcccgccccagcccaggaguagucuuaccucugagga

SEQ ID NO: 236719 - RNA, 60 nt, Human
caaagugcugggauuacaggcgcaagccacccagcccagcuucuuuccauuccuugauag

SEQ ID NO: 236720 - RNA, 64 nt, Human; identical to SEQ ID NO: 134299

SEQ ID NO: 236721 - RNA, 64 nt, Human; identical to SEQ ID NO: 134300

SEQ ID NO: 236722 - RNA, 64 nt, Human; identical to SEQ ID NO: 134301

SEQ ID NO: 236723 - RNA, 64 nt, Human; identical to SEQ ID NO: 134302

SEQ ID NO: 236724 - RNA, 64 nt, Human; identical to SEQ ID NO: 134303

SEQ ID NO: 236725 - RNA, 64 nt, Human; identical to SEQ ID NO: 134304

SEQ ID NO: 236726 - RNA, 64 nt, Human; identical to SEQ ID NO: 134305

SEQ ID NO: 236727 - RNA, 64 nt, Human; identical to SEQ ID NO: 134306

SEQ ID NO: 236728 - RNA, 64 nt, Human; identical to SEQ ID NO: 134307

SEQ ID NO: 236729 - RNA, 64 nt, Human; identical to SEQ ID NO: 134308

SEQ ID NO: 236730 - RNA, 64 nt, Human; identical to SEQ ID NO: 134309

SEQ ID NO: 236731 - RNA, 64 nt, Human; identical to SEQ ID NO: 134310

SEQ ID NO: 236732 - RNA, 64 nt, Human; identical to SEQ ID NO: 134311

SEQ ID NO: 236733 - RNA, 64 nt, Human; identical to SEQ ID NO: 134312

SEQ ID NO: 236734 - RNA, 64 nt, Human; identical to SEQ ID NO: 134313

SEQ ID NO: 236735 - RNA, 64 nt, Human; identical to SEQ ID NO: 134314

SEQ ID NO: 236736 - RNA, 60 nt, Human
ccaccccaugaggcucacucauugcagaucccagcccacccugccccuuucuuccccacc

SEQ ID NO: 236737 - RNA, 60 nt, Human
gaggaugagggcugguggcuggggguagacccagcccauuucauugucuaaauugcagua

SEQ ID NO: 236738 - RNA, 60 nt, Human
cuucugucuccuacgacuccaugagcagcgccagcccagcucuccccucugcacccuugg

SEQ ID NO: 236739 - RNA, 64 nt, Human; identical to SEQ ID NO: 134315

SEQ ID NO: 236740 - RNA, 64 nt, Human; identical to SEQ ID NO: 134316

SEQ ID NO: 236741 - RNA, 64 nt, Human; identical to SEQ ID NO: 134317

SEQ ID NO: 236742 - RNA, 64 nt, Human; identical to SEQ ID NO: 134318

SEQ ID NO: 236743 - RNA, 64 nt, Human; identical to SEQ ID NO: 134319

SEQ ID NO: 236744 - RNA, 64 nt, Human; identical to SEQ ID NO: 134320

SEQ ID NO: 236745 - RNA, 64 nt, Human; identical to SEQ ID NO: 134321

SEQ ID NO: 236746 - RNA, 64 nt, Human; identical to SEQ ID NO: 134322

SEQ ID NO: 236747 - RNA, 64 nt, Human; identical to SEQ ID NO: 134323

SEQ ID NO: 236748 - RNA, 64 nt, Human; identical to SEQ ID NO: 134324

SEQ ID NO: 236749 - RNA, 64 nt, Human; identical to SEQ ID NO: 134325

SEQ ID NO: 236750 - RNA, 64 nt, Human; identical to SEQ ID NO: 134326

SEQ ID NO: 236751 - RNA, 64 nt, Human; identical to SEQ ID NO: 134327

SEQ ID NO: 236752 - RNA, 64 nt, Human; identical to SEQ ID NO: 134328

SEQ ID NO: 236753 - RNA, 64 nt, Human; identical to SEQ ID NO: 134329

SEQ ID NO: 236754 - RNA, 64 nt, Human; identical to SEQ ID NO: 134330

SEQ ID NO: 236755 - RNA, 54 nt, Human
ccucguccagccgcaucuaggccuccagcccaccugcccaugugaugaagcaga

SEQ ID NO: 236756 - RNA, 60 nt, Human
acaaggaccuggguggccucgcuuacuguuccagcccaggccaagcacagggucuggcuc

SEQ ID NO: 236757 - RNA, 60 nt, Human
gccuguuuacacagacaccuggccucacugccagcccaccuccccuacagcccuguuugu

SEQ ID NO: 236758 - RNA, 64 nt, Human; identical to SEQ ID NO: 134331

SEQ ID NO: 236759 - RNA, 64 nt, Human; identical to SEQ ID NO: 134332

SEQ ID NO: 236760 - RNA, 64 nt, Human; identical to SEQ ID NO: 134333

SEQ ID NO: 236761 - RNA, 64 nt, Human; identical to SEQ ID NO: 134334

SEQ ID NO: 236762 - RNA, 64 nt, Human; identical to SEQ ID NO: 134335

SEQ ID NO: 236763 - RNA, 64 nt, Human; identical to SEQ ID NO: 134336

SEQ ID NO: 236764 - RNA, 64 nt, Human; identical to SEQ ID NO: 134337

SEQ ID NO: 236765 - RNA, 64 nt, Human; identical to SEQ ID NO: 134338

SEQ ID NO: 236766 - RNA, 64 nt, Human; identical to SEQ ID NO: 134339

SEQ ID NO: 236767 - RNA, 64 nt, Human; identical to SEQ ID NO: 134340

SEQ ID NO: 236768 - RNA, 64 nt, Human; identical to SEQ ID NO: 134341

SEQ ID NO: 236769 - RNA, 64 nt, Human; identical to SEQ ID NO: 134342

SEQ ID NO: 236770 - RNA, 64 nt, Human; identical to SEQ ID NO: 134343

SEQ ID NO: 236771 - RNA, 64 nt, Human; identical to SEQ ID NO: 134344

SEQ ID NO: 236772 - RNA, 64 nt, Human; identical to SEQ ID NO: 134345

SEQ ID NO: 236773 - RNA, 64 nt, Human; identical to SEQ ID NO: 134346

SEQ ID NO: 236774 - RNA, 60 nt, Human
agccaaugaaugggaucauucuggaugucaccagcccaauaggcucagcucaugaugaca

SEQ ID NO: 236775 - RNA, 60 nt, Human
cagugacccuggcuccuugugccagagaacccagcccacccccggcagcagcccccagcu

SEQ ID NO: 236776 - RNA, 60 nt, Human
accacagccuccaaaaauggcagugacuccccagcccagcaccccuuccucguggguccc

SEQ ID NO: 236777 - RNA, 64 nt, Human; identical to SEQ ID NO: 134347

SEQ ID NO: 236778 - RNA, 64 nt, Human; identical to SEQ ID NO: 134348

SEQ ID NO: 236779 - RNA, 64 nt, Human; identical to SEQ ID NO: 134349

SEQ ID NO: 236780 - RNA, 64 nt, Human; identical to SEQ ID NO: 134350

SEQ ID NO: 236781 - RNA, 64 nt, Human; identical to SEQ ID NO: 134351

SEQ ID NO: 236782 - RNA, 64 nt, Human; identical to SEQ ID NO: 134352

SEQ ID NO: 236783 - RNA, 64 nt, Human; identical to SEQ ID NO: 134353

SEQ ID NO: 236784 - RNA, 64 nt, Human; identical to SEQ ID NO: 134354

SEQ ID NO: 236785 - RNA, 50 nt, Human; identical to SEQ ID NO: 134355

SEQ ID NO: 236786 - RNA, 64 nt, Human; identical to SEQ ID NO: 134356

SEQ ID NO: 236787 - RNA, 64 nt, Human; identical to SEQ ID NO: 134357

SEQ ID NO: 236788 - RNA, 64 nt, Human; identical to SEQ ID NO: 134358

SEQ ID NO: 236789 - RNA, 64 nt, Human; identical to SEQ ID NO: 134359

SEQ ID NO: 236790 - RNA, 64 nt, Human; identical to SEQ ID NO: 134360

SEQ ID NO: 236791 - RNA, 64 nt, Human; identical to SEQ ID NO: 134361

SEQ ID NO: 236792 - RNA, 64 nt, Human; identical to SEQ ID NO: 134362

SEQ ID NO: 236793 - RNA, 60 nt, Human
uguggacugaagcucagccuguuaaucagaccagcccaugaguguauaacaaacagaauu

SEQ ID NO: 236794 - RNA, 60 nt, Human
gagcugaaucggaugccaccaaggcucgguccagcccaguaccgcuggaagugaauaaac

SEQ ID NO: 236795 - RNA, 60 nt, Human
ccaggcaggaagcagcaccugccccccgcgccagcccagccccagccugagugcaggagc

SEQ ID NO: 236796 - RNA, 64 nt, Human; identical to SEQ ID NO: 134363

SEQ ID NO: 236797 - RNA, 64 nt, Human; identical to SEQ ID NO: 134364

SEQ ID NO: 236798 - RNA, 64 nt, Human; identical to SEQ ID NO: 134365

SEQ ID NO: 236799 - RNA, 64 nt, Human; identical to SEQ ID NO: 134366

SEQ ID NO: 236800 - RNA, 64 nt, Human; identical to SEQ ID NO: 134367

SEQ ID NO: 236801 - RNA, 64 nt, Human; identical to SEQ ID NO: 134368

SEQ ID NO: 236802 - RNA, 64 nt, Human; identical to SEQ ID NO: 134369

SEQ ID NO: 236803 - RNA, 64 nt, Human; identical to SEQ ID NO: 134370

SEQ ID NO: 236804 - RNA, 64 nt, Human; identical to SEQ ID NO: 134371

SEQ ID NO: 236805 - RNA, 64 nt, Human; identical to SEQ ID NO: 134372

SEQ ID NO: 236806 - RNA, 64 nt, Human; identical to SEQ ID NO: 134373

SEQ ID NO: 236807 - RNA, 64 nt, Human; identical to SEQ ID NO: 134374

SEQ ID NO: 236808 - RNA, 64 nt, Human; identical to SEQ ID NO: 134375

SEQ ID NO: 236809 - RNA, 64 nt, Human; identical to SEQ ID NO: 134376

SEQ ID NO: 236810 - RNA, 64 nt, Human; identical to SEQ ID NO: 134377

SEQ ID NO: 236811 - RNA, 64 nt, Human; identical to SEQ ID NO: 134378

SEQ ID NO: 236812 - RNA, 60 nt, Human
gacggacaugcacguggcagaucaugauuuccagcccacggagccagcauuugaaccuug

SEQ ID NO: 236813 - RNA, 60 nt, Human
agugacggcaaccugcggaaggagguucucccagcccaucugaacacaaccagagguggc

SEQ ID NO: 236814 - RNA, 60 nt, Human
gagagcagauuggcugaugccccugcaaccccagcccaagcucugccucaaagaccgagu

SEQ ID NO: 236815 - RNA, 64 nt, Human; identical to SEQ ID NO: 134379

SEQ ID NO: 236816 - RNA, 64 nt, Human; identical to SEQ ID NO: 134380

SEQ ID NO: 236817 - RNA, 64 nt, Human; identical to SEQ ID NO: 134381

SEQ ID NO: 236818 - RNA, 64 nt, Human; identical to SEQ ID NO: 134382

SEQ ID NO: 236819 - RNA, 64 nt, Human; identical to SEQ ID NO: 134383

SEQ ID NO: 236820 - RNA, 64 nt, Human; identical to SEQ ID NO: 134088

SEQ ID NO: 236821 - RNA, 64 nt, Human; identical to SEQ ID NO: 134385

SEQ ID NO: 236822 - RNA, 64 nt, Human; identical to SEQ ID NO: 134386

SEQ ID NO: 236823 - RNA, 64 nt, Human; identical to SEQ ID NO: 134387

SEQ ID NO: 236824 - RNA, 64 nt, Human; identical to SEQ ID NO: 134388

SEQ ID NO: 236825 - RNA, 64 nt, Human; identical to SEQ ID NO: 134389

SEQ ID NO: 236826 - RNA, 64 nt, Human; identical to SEQ ID NO: 134390

SEQ ID NO: 236827 - RNA, 64 nt, Human; identical to SEQ ID NO: 134391

SEQ ID NO: 236828 - RNA, 64 nt, Human; identical to SEQ ID NO: 134392

SEQ ID NO: 236829 - RNA, 64 nt, Human; identical to SEQ ID NO: 134393

SEQ ID NO: 236830 - RNA, 64 nt, Human; identical to SEQ ID NO: 134394

SEQ ID NO: 236831 - RNA, 60 nt, Human
gaaaccaaacaggccucucgcucacuccucccagcccaguaaugcugaggaguucaguug

SEQ ID NO: 236832 - RNA, 60 nt, Human
cuuuucccugcugggugcuccugcuuuggcccagcccaccuuuccuggugcuccaagcua

SEQ ID NO: 236833 - RNA, 60 nt, Human
aucccagugagucaugagccucagcccccuccagcccacuggggcucucaccuccacaug

SEQ ID NO: 236834 - RNA, 64 nt, Human; identical to SEQ ID NO: 134395

SEQ ID NO: 236835 - RNA, 64 nt, Human; identical to SEQ ID NO: 134396

SEQ ID NO: 236836 - RNA, 64 nt, Human; identical to SEQ ID NO: 134397

SEQ ID NO: 236837 - RNA, 64 nt, Human; identical to SEQ ID NO: 134398

SEQ ID NO: 236838 - RNA, 64 nt, Human; identical to SEQ ID NO: 134399

SEQ ID NO: 236839 - RNA, 64 nt, Human; identical to SEQ ID NO: 134400

SEQ ID NO: 236840 - RNA, 64 nt, Human; identical to SEQ ID NO: 134401

SEQ ID NO: 236841 - RNA, 64 nt, Human; identical to SEQ ID NO: 134402

SEQ ID NO: 236842 - RNA, 64 nt, Human; identical to SEQ ID NO: 134403

SEQ ID NO: 236843 - RNA, 64 nt, Human; identical to SEQ ID NO: 134404

SEQ ID NO: 236844 - RNA, 64 nt, Human; identical to SEQ ID NO: 134405

SEQ ID NO: 236845 - RNA, 64 nt, Human; identical to SEQ ID NO: 134406

SEQ ID NO: 236846 - RNA, 64 nt, Human; identical to SEQ ID NO: 134407

SEQ ID NO: 236847 - RNA, 64 nt, Human; identical to SEQ ID NO: 134408

SEQ ID NO: 236848 - RNA, 64 nt, Human; identical to SEQ ID NO: 134409

SEQ ID NO: 236849 - RNA, 64 nt, Human; identical to SEQ ID NO: 134410

SEQ ID NO: 236850 - RNA, 60 nt, Human
ucacuagguggcggccgggccagcuggaacccagcccauccucucaggcagagcagggug

SEQ ID NO: 236851 - RNA, 60 nt, Human
ugcagugagccgagaucccgccacugcacuccagcccaggugacagagcgagacuccauc

SEQ ID NO: 236852 - RNA, 60 nt, Human
gucuggugcugcuuagguaguuucaggcuuccagcccagcccuaugcucugugcuuggcc

SEQ ID NO: 236853 - RNA, 64 nt, Human; identical to SEQ ID NO: 134411

SEQ ID NO: 236854 - RNA, 64 nt, Human; identical to SEQ ID NO: 134412

SEQ ID NO: 236855 - RNA, 64 nt, Human; identical to SEQ ID NO: 134413

SEQ ID NO: 236856 - RNA, 64 nt, Human; identical to SEQ ID NO: 134414

SEQ ID NO: 236857 - RNA, 64 nt, Human; identical to SEQ ID NO: 134415

SEQ ID NO: 236858 - RNA, 64 nt, Human; identical to SEQ ID NO: 134416

SEQ ID NO: 236859 - RNA, 64 nt, Human; identical to SEQ ID NO: 134417

SEQ ID NO: 236860 - RNA, 64 nt, Human; identical to SEQ ID NO: 134418

SEQ ID NO: 236861 - RNA, 64 nt, Human; identical to SEQ ID NO: 134419

SEQ ID NO: 236862 - RNA, 64 nt, Human; identical to SEQ ID NO: 134420

SEQ ID NO: 236863 - RNA, 64 nt, Human; identical to SEQ ID NO: 134421

SEQ ID NO: 236864 - RNA, 64 nt, Human; identical to SEQ ID NO: 134422

SEQ ID NO: 236865 - RNA, 64 nt, Human; identical to SEQ ID NO: 134423

SEQ ID NO: 236866 - RNA, 64 nt, Human; identical to SEQ ID NO: 134424

SEQ ID NO: 236867 - RNA, 64 nt, Human; identical to SEQ ID NO: 134425

SEQ ID NO: 236868 - RNA, 64 nt, Human; identical to SEQ ID NO: 134426

SEQ ID NO: 236869 - RNA, 64 nt, Human
uggguggggaugacuuucaaugacuuucaauacuuccccugaaggaagaaugauaaggagaaau

SEQ ID NO: 236870 - RNA, 64 nt, Human
aguucuccaaggaccuagaagacagauggaguucuccccugaacuccuugcugcuaagaagugc

SEQ ID NO: 236871 - RNA, 60 nt, Human
cgcagcccuucugcacccagcacagccugcccagcccagcccugcccccgggcacugcac

SEQ ID NO: 236872 - RNA, 64 nt, Human; identical to SEQ ID NO: 134427

SEQ ID NO: 236873 - RNA, 64 nt, Human; identical to SEQ ID NO: 134428

SEQ ID NO: 236874 - RNA, 64 nt, Human; identical to SEQ ID NO: 134429

SEQ ID NO: 236875 - RNA, 64 nt, Human; identical to SEQ ID NO: 134430

SEQ ID NO: 236876 - RNA, 64 nt, Human; identical to SEQ ID NO: 134431

SEQ ID NO: 236877 - RNA, 64 nt, Human; identical to SEQ ID NO: 134432

SEQ ID NO: 236878 - RNA, 64 nt, Human; identical to SEQ ID NO: 134433

SEQ ID NO: 236879 - RNA, 64 nt, Human; identical to SEQ ID NO: 134434

SEQ ID NO: 236880 - RNA, 64 nt, Human; identical to SEQ ID NO: 134435

SEQ ID NO: 236881 - RNA, 64 nt, Human; identical to SEQ ID NO: 134436

SEQ ID NO: 236882 - RNA, 64 nt, Human; identical to SEQ ID NO: 134437

SEQ ID NO: 236883 - RNA, 64 nt, Human; identical to SEQ ID NO: 134438

SEQ ID NO: 236884 - RNA, 64 nt, Human; identical to SEQ ID NO: 134439

SEQ ID NO: 236885 - RNA, 64 nt, Human; identical to SEQ ID NO: 134440

SEQ ID NO: 236886 - RNA, 64 nt, Human; identical to SEQ ID NO: 134441

SEQ ID NO: 236887 - RNA, 64 nt, Human; identical to SEQ ID NO: 134442

SEQ ID NO: 236888 - RNA, 60 nt, Human
ucucucccuucuccccucaccccgcccccaccagcccagugcgcccugccgccgcgcuug

SEQ ID NO: 236889 - RNA, 60 nt, Human
augccuggggaggggcuccuggaauccaggccagcccaacagcccuggcuggggaggugu

SEQ ID NO: 236890 - RNA, 60 nt, Human
ggucuuugugaauauccagacuguuucagcccagcccaucucagccaacccuccuuagac

SEQ ID NO: 236891 - RNA, 64 nt, Human; identical to SEQ ID NO: 134443

SEQ ID NO: 236892 - RNA, 64 nt, Human; identical to SEQ ID NO: 134444

SEQ ID NO: 236893 - RNA, 64 nt, Human; identical to SEQ ID NO: 134445

SEQ ID NO: 236894 - RNA, 64 nt, Human; identical to SEQ ID NO: 134446

SEQ ID NO: 236895 - RNA, 64 nt, Human; identical to SEQ ID NO: 134447

SEQ ID NO: 236896 - RNA, 64 nt, Human; identical to SEQ ID NO: 134448

SEQ ID NO: 236897 - RNA, 64 nt, Human; identical to SEQ ID NO: 134449

SEQ ID NO: 236898 - RNA, 64 nt, Human; identical to SEQ ID NO: 134450

SEQ ID NO: 236899 - RNA, 64 nt, Human; identical to SEQ ID NO: 134451

SEQ ID NO: 236900 - RNA, 51 nt, Human; identical to SEQ ID NO: 134452

SEQ ID NO: 236901 - RNA, 64 nt, Human; identical to SEQ ID NO: 134453

SEQ ID NO: 236902 - RNA, 64 nt, Human; identical to SEQ ID NO: 134454

SEQ ID NO: 236903 - RNA, 64 nt, Human; identical to SEQ ID NO: 134455

SEQ ID NO: 236904 - RNA, 64 nt, Human; identical to SEQ ID NO: 134456

SEQ ID NO: 236905 - RNA, 64 nt, Human; identical to SEQ ID NO: 134457

SEQ ID NO: 236906 - RNA, 64 nt, Human; identical to SEQ ID NO: 134458

SEQ ID NO: 236907 - RNA, 64 nt, Human
ggagaugcauaaagggcaauaccgggccguguccuccccugauaggauucucccuuugaaggag

SEQ ID NO: 236908 - RNA, 64 nt, Human
acccagcuuuccuacaugcugccucuccucaggguccccugaaugcugcaucauuguguucagu

SEQ ID NO: 236909 - RNA, 64 nt, Human
uuuguuugacucuuggcugccuacgucuguaggguccccugaaaaucccacuuccugcccccag

SEQ ID NO: 236910 - RNA, 64 nt, Human; identical to SEQ ID NO: 134459

SEQ ID NO: 236911 - RNA, 64 nt, Human; identical to SEQ ID NO: 134460

SEQ ID NO: 236912 - RNA, 64 nt, Human; identical to SEQ ID NO: 134461

SEQ ID NO: 236913 - RNA, 64 nt, Human; identical to SEQ ID NO: 134462

SEQ ID NO: 236914 - RNA, 64 nt, Human; identical to SEQ ID NO: 134463

SEQ ID NO: 236915 - RNA, 64 nt, Human; identical to SEQ ID NO: 134464

SEQ ID NO: 236916 - RNA, 64 nt, Human; identical to SEQ ID NO: 134465

SEQ ID NO: 236917 - RNA, 64 nt, Human; identical to SEQ ID NO: 134466

SEQ ID NO: 236918 - RNA, 64 nt, Human; identical to SEQ ID NO: 134467

SEQ ID NO: 236919 - RNA, 64 nt, Human; identical to SEQ ID NO: 134468

SEQ ID NO: 236920 - RNA, 64 nt, Human; identical to SEQ ID NO: 134469

SEQ ID NO: 236921 - RNA, 64 nt, Human; identical to SEQ ID NO: 134236

SEQ ID NO: 236922 - RNA, 64 nt, Human; identical to SEQ ID NO: 134471

SEQ ID NO: 236923 - RNA, 64 nt, Human; identical to SEQ ID NO: 134472

SEQ ID NO: 236924 - RNA, 64 nt, Human; identical to SEQ ID NO: 134473

SEQ ID NO: 236925 - RNA, 64 nt, Human; identical to SEQ ID NO: 134474

SEQ ID NO: 236926 - RNA, 64 nt, Human
cugggaccccugaugcucuucuuuguucuuuggguccccugaugccauaggagaccuaucgucu

SEQ ID NO: 236927 - RNA, 64 nt, Human
aggguguggcugaggcagucauaaugcaguaucuuccccugacuccagccacaaagcucauacc

SEQ ID NO: 236928 - RNA, 64 nt, Human
gccccuccccaucuccaugcccucuccuucuguguccccugagucugcuguuuaccucauuggg

SEQ ID NO: 236929 - RNA, 64 nt, Human; identical to SEQ ID NO: 134475

SEQ ID NO: 236930 - RNA, 64 nt, Human; identical to SEQ ID NO: 134476

SEQ ID NO: 236931 - RNA, 64 nt, Human; identical to SEQ ID NO: 134477

SEQ ID NO: 236932 - RNA, 64 nt, Human; identical to SEQ ID NO: 134478

SEQ ID NO: 236933 - RNA, 64 nt, Human; identical to SEQ ID NO: 134479

SEQ ID NO: 236934 - RNA, 64 nt, Human; identical to SEQ ID NO: 134480

SEQ ID NO: 236935 - RNA, 64 nt, Human; identical to SEQ ID NO: 134481

SEQ ID NO: 236936 - RNA, 64 nt, Human; identical to SEQ ID NO: 134482

SEQ ID NO: 236937 - RNA, 64 nt, Human; identical to SEQ ID NO: 134483

SEQ ID NO: 236938 - RNA, 64 nt, Human; identical to SEQ ID NO: 134484

SEQ ID NO: 236939 - RNA, 64 nt, Human; identical to SEQ ID NO: 134485

SEQ ID NO: 236940 - RNA, 64 nt, Human; identical to SEQ ID NO: 134486

SEQ ID NO: 236941 - RNA, 64 nt, Human; identical to SEQ ID NO: 134487

SEQ ID NO: 236942 - RNA, 64 nt, Human; identical to SEQ ID NO: 134488

SEQ ID NO: 236943 - RNA, 64 nt, Human; identical to SEQ ID NO: 134489

SEQ ID NO: 236944 - RNA, 64 nt, Human; identical to SEQ ID NO: 134490

SEQ ID NO: 236945 - RNA, 64 nt, Human
ugucaccaagcaugacccaggucaacuuuuuuuuuccccugaauuacccaucaaauugaucugc

SEQ ID NO: 236946 - RNA, 64 nt, Human
uucuuuucaagccguuauaugccuaguggguaguuccccugaugagcagaaaaaugaacucaaa

SEQ ID NO: 236947 - RNA, 60 nt, Human
cuugaacccccucccugucccagggcccucccagcccauugcugccaagguggagggaag

SEQ ID NO: 236948 - RNA, 64 nt, Human; identical to SEQ ID NO: 134491

SEQ ID NO: 236949 - RNA, 64 nt, Human; identical to SEQ ID NO: 134492

SEQ ID NO: 236950 - RNA, 64 nt, Human; identical to SEQ ID NO: 134493

SEQ ID NO: 236951 - RNA, 64 nt, Human; identical to SEQ ID NO: 134494

SEQ ID NO: 236952 - RNA, 64 nt, Human; identical to SEQ ID NO: 134495

SEQ ID NO: 236953 - RNA, 64 nt, Human; identical to SEQ ID NO: 134496

SEQ ID NO: 236954 - RNA, 64 nt, Human; identical to SEQ ID NO: 134497

SEQ ID NO: 236955 - RNA, 64 nt, Human; identical to SEQ ID NO: 134498

SEQ ID NO: 236956 - RNA, 64 nt, Human; identical to SEQ ID NO: 134499

SEQ ID NO: 236957 - RNA, 64 nt, Human; identical to SEQ ID NO: 134500

SEQ ID NO: 236958 - RNA, 64 nt, Human; identical to SEQ ID NO: 134501

SEQ ID NO: 236959 - RNA, 64 nt, Human; identical to SEQ ID NO: 134502

SEQ ID NO: 236960 - RNA, 64 nt, Human; identical to SEQ ID NO: 134503

SEQ ID NO: 236961 - RNA, 64 nt, Human; identical to SEQ ID NO: 134504

SEQ ID NO: 236962 - RNA, 64 nt, Human; identical to SEQ ID NO: 134505

SEQ ID NO: 236963 - RNA, 64 nt, Human; identical to SEQ ID NO: 134506

SEQ ID NO: 236964 - RNA, 64 nt, Human
uggaaggcaggcccgugccugguuuugcgucuguuccccugagggccaucgucauccuggagcu

SEQ ID NO: 236965 - RNA, 64 nt, Human
acuccugcugaguuagcagguuggugagagaagcuccccugagcucaccugucucucugacugc

SEQ ID NO: 236966 - RNA, 64 nt, Human
gaggccacaccucacaccucgcuguuccccaacauccccugagcagugugagcucaucucacca

SEQ ID NO: 236967 - RNA, 64 nt, Human; identical to SEQ ID NO: 134507

SEQ ID NO: 236968 - RNA, 64 nt, Human; identical to SEQ ID NO: 134508

SEQ ID NO: 236969 - RNA, 64 nt, Human; identical to SEQ ID NO: 134509

SEQ ID NO: 236970 - RNA, 64 nt, Human; identical to SEQ ID NO: 134510

SEQ ID NO: 236971 - RNA, 64 nt, Human; identical to SEQ ID NO: 134511

SEQ ID NO: 236972 - RNA, 64 nt, Human; identical to SEQ ID NO: 134512

SEQ ID NO: 236973 - RNA, 64 nt, Human; identical to SEQ ID NO: 134513

SEQ ID NO: 236974 - RNA, 64 nt, Human; identical to SEQ ID NO: 134514

SEQ ID NO: 236975 - RNA, 64 nt, Human; identical to SEQ ID NO: 134515

SEQ ID NO: 236976 - RNA, 64 nt, Human; identical to SEQ ID NO: 134516

SEQ ID NO: 236977 - RNA, 64 nt, Human; identical to SEQ ID NO: 134517

SEQ ID NO: 236978 - RNA, 64 nt, Human; identical to SEQ ID NO: 134518

SEQ ID NO: 236979 - RNA, 64 nt, Human; identical to SEQ ID NO: 134519

SEQ ID NO: 236980 - RNA, 64 nt, Human; identical to SEQ ID NO: 134520

SEQ ID NO: 236981 - RNA, 64 nt, Human; identical to SEQ ID NO: 134521

SEQ ID NO: 236982 - RNA, 64 nt, Human; identical to SEQ ID NO: 134522

SEQ ID NO: 236983 - RNA, 64 nt, Human
auuucugcuguuguuguggccuuggguaaaggccuccccugagaacacaggacaggccugcuga

SEQ ID NO: 236984 - RNA, 60 nt, Human
ggcagcgucagccggagagcuucuccccgaccagcccagccccaggaugugucgcaccag

SEQ ID NO: 236985 - RNA, 60 nt, Human
gaccacuccucauagcaauacuuggagggcccagcccaagugaggcagccgaggucccug

SEQ ID NO: 236986 - RNA, 64 nt, Human; identical to SEQ ID NO: 134523

SEQ ID NO: 236987 - RNA, 64 nt, Human; identical to SEQ ID NO: 134524

SEQ ID NO: 236988 - RNA, 64 nt, Human; identical to SEQ ID NO: 134525

SEQ ID NO: 236989 - RNA, 64 nt, Human; identical to SEQ ID NO: 134526

SEQ ID NO: 236990 - RNA, 64 nt, Human; identical to SEQ ID NO: 134527

SEQ ID NO: 236991 - RNA, 64 nt, Human; identical to SEQ ID NO: 134528

SEQ ID NO: 236992 - RNA, 64 nt, Human; identical to SEQ ID NO: 134529

SEQ ID NO: 236993 - RNA, 64 nt, Human; identical to SEQ ID NO: 134530

SEQ ID NO: 236994 - RNA, 64 nt, Human; identical to SEQ ID NO: 134531

SEQ ID NO: 236995 - RNA, 64 nt, Human; identical to SEQ ID NO: 134532

SEQ ID NO: 236996 - RNA, 64 nt, Human; identical to SEQ ID NO: 134533

SEQ ID NO: 236997 - RNA, 64 nt, Human; identical to SEQ ID NO: 134534

SEQ ID NO: 236998 - RNA, 64 nt, Human; identical to SEQ ID NO: 134535

SEQ ID NO: 236999 - RNA, 64 nt, Human; identical to SEQ ID NO: 134536

SEQ ID NO: 237000 - RNA, 64 nt, Human; identical to SEQ ID NO: 134537

SEQ ID NO: 237001 - RNA, 64 nt, Human; identical to SEQ ID NO: 134538

SEQ ID NO: 237002 - RNA, 64 nt, Human
agcugugagagcuauccacucuccugccugcauauccccugagaguuauaggaagugcccacug

SEQ ID NO: 237003 - RNA, 64 nt, Human
aacaucggcuggcuuugggacuauuccaccuccuuccccugagcccagaucugcccccaccauc

SEQ ID NO: 237004 - RNA, 60 nt, Human
uauggauuaugagauggacuagccccugccccagcccagcucucacauuccccuuuguuu

SEQ ID NO: 237005 - RNA, 64 nt, Human; identical to SEQ ID NO: 134539

SEQ ID NO: 237006 - RNA, 64 nt, Human; identical to SEQ ID NO: 134540

SEQ ID NO: 237007 - RNA, 59 nt, Human; identical to SEQ ID NO: 134541

SEQ ID NO: 237008 - RNA, 64 nt, Human; identical to SEQ ID NO: 134542

SEQ ID NO: 237009 - RNA, 64 nt, Human; identical to SEQ ID NO: 134543

SEQ ID NO: 237010 - RNA, 64 nt, Human; identical to SEQ ID NO: 134544

SEQ ID NO: 237011 - RNA, 64 nt, Human; identical to SEQ ID NO: 134545

SEQ ID NO: 237012 - RNA, 64 nt, Human; identical to SEQ ID NO: 134546

SEQ ID NO: 237013 - RNA, 64 nt, Human; identical to SEQ ID NO: 134547

SEQ ID NO: 237014 - RNA, 64 nt, Human; identical to SEQ ID NO: 134548

SEQ ID NO: 237015 - RNA, 64 nt, Human; identical to SEQ ID NO: 134549

SEQ ID NO: 237016 - RNA, 64 nt, Human; identical to SEQ ID NO: 134550

SEQ ID NO: 237017 - RNA, 64 nt, Human; identical to SEQ ID NO: 134551

SEQ ID NO: 237018 - RNA, 64 nt, Human; identical to SEQ ID NO: 134552

SEQ ID NO: 237019 - RNA, 64 nt, Human; identical to SEQ ID NO: 134553

SEQ ID NO: 237020 - RNA, 64 nt, Human; identical to SEQ ID NO: 134554

SEQ ID NO: 237021 - RNA, 64 nt, Human
cuauuagagcuggaggcacccuuagccacuucauuccccugaugggcccugacucuuccccaua

SEQ ID NO: 237022 - RNA, 60 nt, Human
gaaguuaggaagaagggugugcugggcuaaccagcccacagagcucacauuccugucccu

SEQ ID NO: 237023 - RNA, 60 nt, Human
ggcuguuaagaggagaaagugcacugccuuccagcccaggaggaggacagcauuuuguau

SEQ ID NO: 237024 - RNA, 64 nt, Human; identical to SEQ ID NO: 134555

SEQ ID NO: 237025 - RNA, 64 nt, Human; identical to SEQ ID NO: 134556

SEQ ID NO: 237026 - RNA, 64 nt, Human; identical to SEQ ID NO: 134557

SEQ ID NO: 237027 - RNA, 64 nt, Human; identical to SEQ ID NO: 134558

SEQ ID NO: 237028 - RNA, 64 nt, Human; identical to SEQ ID NO: 134559

SEQ ID NO: 237029 - RNA, 64 nt, Human; identical to SEQ ID NO: 134560

SEQ ID NO: 237030 - RNA, 64 nt, Human; identical to SEQ ID NO: 134561

SEQ ID NO: 237031 - RNA, 64 nt, Human; identical to SEQ ID NO: 134562

SEQ ID NO: 237032 - RNA, 64 nt, Human; identical to SEQ ID NO: 134563

SEQ ID NO: 237033 - RNA, 64 nt, Human; identical to SEQ ID NO: 134564

SEQ ID NO: 237034 - RNA, 64 nt, Human; identical to SEQ ID NO: 134565

SEQ ID NO: 237035 - RNA, 64 nt, Human; identical to SEQ ID NO: 134099

SEQ ID NO: 237036 - RNA, 64 nt, Human; identical to SEQ ID NO: 134567

SEQ ID NO: 237037 - RNA, 64 nt, Human; identical to SEQ ID NO: 134568

SEQ ID NO: 237038 - RNA, 64 nt, Human; identical to SEQ ID NO: 134569

SEQ ID NO: 237039 - RNA, 64 nt, Human; identical to SEQ ID NO: 134568

SEQ ID NO: 237040 - RNA, 60 nt, Human
auaugccacauuaccugcucccaucaccauccagcccagcacccuggacuucagucgccu

SEQ ID NO: 237041 - RNA, 60 nt, Human
guccacgcuucgauaggccugacgcagcccccagcccagggccgcccuagcaacuuccug

SEQ ID NO: 237042 - RNA, 60 nt, Human
ccaauccaccaggcagcucagggcuccugcccagcccagcagcuucuguugucuaacgua

SEQ ID NO: 237043 - RNA, 64 nt, Human; identical to SEQ ID NO: 134571

SEQ ID NO: 237044 - RNA, 64 nt, Human; identical to SEQ ID NO: 134572

SEQ ID NO: 237045 - RNA, 64 nt, Human; identical to SEQ ID NO: 134573

SEQ ID NO: 237046 - RNA, 64 nt, Human; identical to SEQ ID NO: 134574

SEQ ID NO: 237047 - RNA, 64 nt, Human; identical to SEQ ID NO: 134575

SEQ ID NO: 237048 - RNA, 64 nt, Human; identical to SEQ ID NO: 134576

SEQ ID NO: 237049 - RNA, 64 nt, Human; identical to SEQ ID NO: 134577

SEQ ID NO: 237050 - RNA, 64 nt, Human; identical to SEQ ID NO: 134578

SEQ ID NO: 237051 - RNA, 64 nt, Human; identical to SEQ ID NO: 134579

SEQ ID NO: 237052 - RNA, 64 nt, Human; identical to SEQ ID NO: 134580

SEQ ID NO: 237053 - RNA, 64 nt, Human; identical to SEQ ID NO: 134581

SEQ ID NO: 237054 - RNA, 64 nt, Human; identical to SEQ ID NO: 134582

SEQ ID NO: 237055 - RNA, 64 nt, Human; identical to SEQ ID NO: 134583

SEQ ID NO: 237056 - RNA, 64 nt, Human; identical to SEQ ID NO: 134584

SEQ ID NO: 237057 - RNA, 64 nt, Human; identical to SEQ ID NO: 134585

SEQ ID NO: 237058 - RNA, 64 nt, Human; identical to SEQ ID NO: 134586

SEQ ID NO: 237059 - RNA, 60 nt, Human
cuucucugcagagcaugggauggggcccuuccagcccacuuugccuacuguuagguuccu

SEQ ID NO: 237060 - RNA, 60 nt, Human
cggcagaccccucuuccuacagcccccucuccagcccagcuaccuccucgccaaguggga

SEQ ID NO: 237061 - RNA, 60 nt, Human
accauuacgcccccucccuguuucuuaucaccagcccaucagcccacugacucccauaug

SEQ ID NO: 237062 - RNA, 64 nt, Human; identical to SEQ ID NO: 134587

SEQ ID NO: 237063 - RNA, 64 nt, Human; identical to SEQ ID NO: 134588

SEQ ID NO: 237064 - RNA, 64 nt, Human; identical to SEQ ID NO: 134589

SEQ ID NO: 237065 - RNA, 64 nt, Human; identical to SEQ ID NO: 134590

SEQ ID NO: 237066 - RNA, 64 nt, Human; identical to SEQ ID NO: 134591

SEQ ID NO: 237067 - RNA, 64 nt, Human; identical to SEQ ID NO: 134592

SEQ ID NO: 237068 - RNA, 64 nt, Human; identical to SEQ ID NO: 134593

SEQ ID NO: 237069 - RNA, 64 nt, Human; identical to SEQ ID NO: 134594

SEQ ID NO: 237070 - RNA, 64 nt, Human; identical to SEQ ID NO: 134595

SEQ ID NO: 237071 - RNA, 64 nt, Human; identical to SEQ ID NO: 134596

SEQ ID NO: 237072 - RNA, 64 nt, Human; identical to SEQ ID NO: 134597

SEQ ID NO: 237073 - RNA, 64 nt, Human; identical to SEQ ID NO: 134598

SEQ ID NO: 237074 - RNA, 64 nt, Human; identical to SEQ ID NO: 134599

SEQ ID NO: 237075 - RNA, 64 nt, Human; identical to SEQ ID NO: 134600

SEQ ID NO: 237076 - RNA, 64 nt, Human; identical to SEQ ID NO: 134601

SEQ ID NO: 237077 - RNA, 64 nt, Human; identical to SEQ ID NO: 134602

SEQ ID NO: 237078 - RNA, 60 nt, Human
aaacgcccugugucucuggcuacagcaagaccagcccaggagcccaccagcaccugccuc

SEQ ID NO: 237079 - RNA, 60 nt, Human
ucugcugaggcagcugccuccugauccuggccagcccaccucuccugcuguccccgcgug

SEQ ID NO: 237080 - RNA, 60 nt, Human
guucuacgggaaguaauugaucguuugcugccagcccagaaggaugaaggaaagaagcac

SEQ ID NO: 237081 - RNA, 64 nt, Human; identical to SEQ ID NO: 134603

SEQ ID NO: 237082 - RNA, 64 nt, Human; identical to SEQ ID NO: 134604

SEQ ID NO: 237083 - RNA, 64 nt, Human; identical to SEQ ID NO: 134605

SEQ ID NO: 237084 - RNA, 64 nt, Human; identical to SEQ ID NO: 134606

SEQ ID NO: 237085 - RNA, 64 nt, Human; identical to SEQ ID NO: 134607

SEQ ID NO: 237086 - RNA, 59 nt, Human; identical to SEQ ID NO: 134608

SEQ ID NO: 237087 - RNA, 64 nt, Human; identical to SEQ ID NO: 134609

SEQ ID NO: 237088 - RNA, 64 nt, Human; identical to SEQ ID NO: 134610

SEQ ID NO: 237089 - RNA, 64 nt, Human; identical to SEQ ID NO: 134611

SEQ ID NO: 237090 - RNA, 64 nt, Human; identical to SEQ ID NO: 134612

SEQ ID NO: 237091 - RNA, 64 nt, Human; identical to SEQ ID NO: 134379

SEQ ID NO: 237092 - RNA, 64 nt, Human; identical to SEQ ID NO: 134614

SEQ ID NO: 237093 - RNA, 64 nt, Human; identical to SEQ ID NO: 134615

SEQ ID NO: 237094 - RNA, 64 nt, Human; identical to SEQ ID NO: 134616

SEQ ID NO: 237095 - RNA, 64 nt, Human; identical to SEQ ID NO: 134617

SEQ ID NO: 237096 - RNA, 64 nt, Human; identical to SEQ ID NO: 134618

SEQ ID NO: 237097 - RNA, 60 nt, Human
cuggcagcgcugcacuugccaugcuggaaaccagcccaggccucccagggaagggcccag

SEQ ID NO: 237098 - RNA, 60 nt, Human
ccuggacaggucuccuuuccuggcccugcuccagcccagcccuucuucuagugguagcuc

SEQ ID NO: 237099 - RNA, 60 nt, Human
gucuccaaugccugucugacaaagacagucccagcccauucuccugucuggcuggguugg

SEQ ID NO: 237100 - RNA, 64 nt, Human; identical to SEQ ID NO: 134619

SEQ ID NO: 237101 - RNA, 64 nt, Human; identical to SEQ ID NO: 134620

SEQ ID NO: 237102 - RNA, 64 nt, Human; identical to SEQ ID NO: 134621

SEQ ID NO: 237103 - RNA, 64 nt, Human; identical to SEQ ID NO: 134622

SEQ ID NO: 237104 - RNA, 64 nt, Human; identical to SEQ ID NO: 134623

SEQ ID NO: 237105 - RNA, 64 nt, Human; identical to SEQ ID NO: 134624

SEQ ID NO: 237106 - RNA, 64 nt, Human; identical to SEQ ID NO: 134625

SEQ ID NO: 237107 - RNA, 64 nt, Human; identical to SEQ ID NO: 134626

SEQ ID NO: 237108 - RNA, 64 nt, Human; identical to SEQ ID NO: 134627

SEQ ID NO: 237109 - RNA, 64 nt, Human; identical to SEQ ID NO: 134628

SEQ ID NO: 237110 - RNA, 64 nt, Human; identical to SEQ ID NO: 134629

SEQ ID NO: 237111 - RNA, 64 nt, Human; identical to SEQ ID NO: 134630

SEQ ID NO: 237112 - RNA, 64 nt, Human; identical to SEQ ID NO: 134631

SEQ ID NO: 237113 - RNA, 64 nt, Human; identical to SEQ ID NO: 134632

SEQ ID NO: 237114 - RNA, 64 nt, Human; identical to SEQ ID NO: 134633

SEQ ID NO: 237115 - RNA, 64 nt, Human; identical to SEQ ID NO: 134634

SEQ ID NO: 237116 - RNA, 64 nt, Human
ucaucgcaguguggacaccauuacccacccccguuccccugaggugcucuggccuaugcccuga

SEQ ID NO: 237117 - RNA, 64 nt, Human
guuaaguuccguauggagcucuggacuccuaaauuccccugaagaagaaaccaauguacugugg

SEQ ID NO: 237118 - RNA, 60 nt, Human
cuccuccagccccugucccacccccuucccccagcccauccauuaggccagcaacgcuug

SEQ ID NO: 237119 - RNA, 64 nt, Human; identical to SEQ ID NO: 134635

SEQ ID NO: 237120 - RNA, 64 nt, Human; identical to SEQ ID NO: 134636

SEQ ID NO: 237121 - RNA, 64 nt, Human; identical to SEQ ID NO: 134637

SEQ ID NO: 237122 - RNA, 64 nt, Human; identical to SEQ ID NO: 134638

SEQ ID NO: 237123 - RNA, 64 nt, Human; identical to SEQ ID NO: 134639

SEQ ID NO: 237124 - RNA, 64 nt, Human; identical to SEQ ID NO: 134640

SEQ ID NO: 237125 - RNA, 64 nt, Human; identical to SEQ ID NO: 134641

SEQ ID NO: 237126 - RNA, 64 nt, Human; identical to SEQ ID NO: 134642

SEQ ID NO: 237127 - RNA, 64 nt, Human; identical to SEQ ID NO: 134643

SEQ ID NO: 237128 - RNA, 64 nt, Human; identical to SEQ ID NO: 134644

SEQ ID NO: 237129 - RNA, 64 nt, Human; identical to SEQ ID NO: 134645

SEQ ID NO: 237130 - RNA, 64 nt, Human; identical to SEQ ID NO: 134646

SEQ ID NO: 237131 - RNA, 64 nt, Human; identical to SEQ ID NO: 134647

SEQ ID NO: 237132 - RNA, 64 nt, Human; identical to SEQ ID NO: 134648

SEQ ID NO: 237133 - RNA, 64 nt, Human; identical to SEQ ID NO: 134649

SEQ ID NO: 237134 - RNA, 64 nt, Human; identical to SEQ ID NO: 134650

SEQ ID NO: 237135 - RNA, 64 nt, Human
aaaauuauuuucuguuaguuugagaucauuauucuccccugacucuccuguuugggcaugucuu

SEQ ID NO: 237136 - RNA, 64 nt, Human
ccuuuccaacucuaccucccucacucagcuccuuuccccugaucagagaaagggaucaaggggg

SEQ ID NO: 237137 - RNA, 60 nt, Human
ucuguagcucccuccucccaucuccuucccccagcccaauaaaggucccuuagccccgag

SEQ ID NO: 237138 - RNA, 64 nt, Human; identical to SEQ ID NO: 134651

SEQ ID NO: 237139 - RNA, 64 nt, Human; identical to SEQ ID NO: 134652

SEQ ID NO: 237140 - RNA, 64 nt, Human; identical to SEQ ID NO: 134653

SEQ ID NO: 237141 - RNA, 64 nt, Human; identical to SEQ ID NO: 134654

SEQ ID NO: 237142 - RNA, 64 nt, Human; identical to SEQ ID NO: 134655

SEQ ID NO: 237143 - RNA, 64 nt, Human; identical to SEQ ID NO: 134656

SEQ ID NO: 237144 - RNA, 64 nt, Human; identical to SEQ ID NO: 134657

SEQ ID NO: 237145 - RNA, 64 nt, Human; identical to SEQ ID NO: 134658

SEQ ID NO: 237146 - RNA, 64 nt, Human; identical to SEQ ID NO: 134659

SEQ ID NO: 237147 - RNA, 64 nt, Human; identical to SEQ ID NO: 134660

SEQ ID NO: 237148 - RNA, 64 nt, Human; identical to SEQ ID NO: 134661

SEQ ID NO: 237149 - RNA, 64 nt, Human; identical to SEQ ID NO: 134662

SEQ ID NO: 237150 - RNA, 64 nt, Human; identical to SEQ ID NO: 134663

SEQ ID NO: 237151 - RNA, 64 nt, Human; identical to SEQ ID NO: 134664

SEQ ID NO: 237152 - RNA, 64 nt, Human; identical to SEQ ID NO: 134665

SEQ ID NO: 237153 - RNA, 64 nt, Human; identical to SEQ ID NO: 134666

SEQ ID NO: 237154 - RNA, 64 nt, Human
uguaccugccucacuccuguccaguggucagguuuccccugaccuucccucacccccagaaaca

SEQ ID NO: 237155 - RNA, 64 nt, Human
cucacaggcucagacuaaaucagaggucaaggcuuccccugaguaagguccauuucuucccagg

SEQ ID NO: 237156 - RNA, 60 nt, Human
ccucaaacuugacuaaaugcagcgaugcucccagcccaagagcccaugggucggggagug

SEQ ID NO: 237157 - RNA, 64 nt, Human; identical to SEQ ID NO: 134667

SEQ ID NO: 237158 - RNA, 64 nt, Human; identical to SEQ ID NO: 134668

SEQ ID NO: 237159 - RNA, 64 nt, Human; identical to SEQ ID NO: 134669

SEQ ID NO: 237160 - RNA, 64 nt, Human; identical to SEQ ID NO: 134670

SEQ ID NO: 237161 - RNA, 64 nt, Human; identical to SEQ ID NO: 134671

SEQ ID NO: 237162 - RNA, 64 nt, Human; identical to SEQ ID NO: 134672

SEQ ID NO: 237163 - RNA, 64 nt, Human; identical to SEQ ID NO: 134673

SEQ ID NO: 237164 - RNA, 64 nt, Human; identical to SEQ ID NO: 134674

SEQ ID NO: 237165 - RNA, 64 nt, Human; identical to SEQ ID NO: 134675

SEQ ID NO: 237166 - RNA, 64 nt, Human; identical to SEQ ID NO: 134676

SEQ ID NO: 237167 - RNA, 64 nt, Human; identical to SEQ ID NO: 134677

SEQ ID NO: 237168 - RNA, 64 nt, Human; identical to SEQ ID NO: 134678

SEQ ID NO: 237169 - RNA, 64 nt, Human; identical to SEQ ID NO: 134679

SEQ ID NO: 237170 - RNA, 64 nt, Human; identical to SEQ ID NO: 134680

SEQ ID NO: 237171 - RNA, 64 nt, Human; identical to SEQ ID NO: 134681

SEQ ID NO: 237172 - RNA, 64 nt, Human; identical to SEQ ID NO: 134682

SEQ ID NO: 237173 - RNA, 64 nt, Human
agugcgucugaggaacgagcugcaguuugagcguuccccugagaugugcguagccuccguguaa

SEQ ID NO: 237174 - RNA, 64 nt, Human
ugcugccaccuuuaagccaacucuccccgaucuguccccugaugaaccuucagaagcacucggc

SEQ ID NO: 237175 - RNA, 64 nt, Human
gagauuaaguaaauaggauagaauaugcugcgucuccccugacacacacuuucuuuuuugaaug

SEQ ID NO: 237176 - RNA, 64 nt, Human; identical to SEQ ID NO: 134683

SEQ ID NO: 237177 - RNA, 64 nt, Human; identical to SEQ ID NO: 134684

SEQ ID NO: 237178 - RNA, 64 nt, Human; identical to SEQ ID NO: 134685

SEQ ID NO: 237179 - RNA, 64 nt, Human; identical to SEQ ID NO: 134686

SEQ ID NO: 237180 - RNA, 64 nt, Human; identical to SEQ ID NO: 134687

SEQ ID NO: 237181 - RNA, 64 nt, Human; identical to SEQ ID NO: 134688

SEQ ID NO: 237182 - RNA, 64 nt, Human; identical to SEQ ID NO: 134689

SEQ ID NO: 237183 - RNA, 64 nt, Human; identical to SEQ ID NO: 134690

SEQ ID NO: 237184 - RNA, 64 nt, Human; identical to SEQ ID NO: 134691

SEQ ID NO: 237185 - RNA, 64 nt, Human; identical to SEQ ID NO: 134692

SEQ ID NO: 237186 - RNA, 64 nt, Human; identical to SEQ ID NO: 134693

SEQ ID NO: 237187 - RNA, 64 nt, Human; identical to SEQ ID NO: 134694

SEQ ID NO: 237188 - RNA, 64 nt, Human; identical to SEQ ID NO: 134695

SEQ ID NO: 237189 - RNA, 64 nt, Human; identical to SEQ ID NO: 134638

SEQ ID NO: 237190 - RNA, 64 nt, Human; identical to SEQ ID NO: 134697

SEQ ID NO: 237191 - RNA, 64 nt, Human; identical to SEQ ID NO: 134698

SEQ ID NO: 237192 - RNA, 64 nt, Human
guacauaggguguuuuccuauuaaaaauucaguuuccccugagacuuaauguaaccacuuaaug

SEQ ID NO: 237193 - RNA, 64 nt, Human
ugagggaggggcccaaagcccuugugggcggaccuccccugagccugucugaggggccagcccu

SEQ ID NO: 237194 - RNA, 64 nt, Human
auacaaacugagugucuuuaugagaaucacuguguccccugaggcccagcaguaccugcuuccc

SEQ ID NO: 237195 - RNA, 64 nt, Human; identical to SEQ ID NO: 134638

SEQ ID NO: 237196 - RNA, 64 nt, Human; identical to SEQ ID NO: 134454

SEQ ID NO: 237197 - RNA, 64 nt, Human; identical to SEQ ID NO: 134701

SEQ ID NO: 237198 - RNA, 64 nt, Human; identical to SEQ ID NO: 134702

SEQ ID NO: 237199 - RNA, 64 nt, Human; identical to SEQ ID NO: 134703

SEQ ID NO: 237200 - RNA, 64 nt, Human; identical to SEQ ID NO: 134704

SEQ ID NO: 237201 - RNA, 64 nt, Human; identical to SEQ ID NO: 134705

SEQ ID NO: 237202 - RNA, 64 nt, Human; identical to SEQ ID NO: 134706

SEQ ID NO: 237203 - RNA, 64 nt, Human; identical to SEQ ID NO: 134707

SEQ ID NO: 237204 - RNA, 64 nt, Human; identical to SEQ ID NO: 134708

SEQ ID NO: 237205 - RNA, 64 nt, Human
cugguggucucugcuugcauccccaacuuagcuguccccugacccagagccuaggggauccggg

SEQ ID NO: 237206 - RNA, 64 nt, Human
acaacuugcuggcuuucggacucugggcugauuguccccugacuauccccagcccugaaaaaaa

SEQ ID NO: 237207 - RNA, 64 nt, Human
gagucagccaaccacagcuacauuucaggcuuucuccccugacacuuuuacaguuaucuuggac

SEQ ID NO: 237208 - RNA, 64 nt, Human
uaaacuggagaucacagaagucaagacugcaagcuccccugaagagaauccaacucaaccugca

SEQ ID NO: 237209 - RNA, 64 nt, Human
ucguagguauuagugcuagucucagauaggugcuuccccugaggugcaggggaagaccaaaguu

SEQ ID NO: 237210 - RNA, 64 nt, Human
aaaaaaaaauuauuaggcugcagaggcaagaggauccccugagcccagaaguucaaggguauag

SEQ ID NO: 237211 - RNA, 64 nt, Human
uccagggcagggaugugccugaaagagucaacaguccccugauccccuaccucugccugcccuc

SEQ ID NO: 237212 - RNA, 64 nt, Human
acuaggaugacagcagcacaaaagaccaccuuucuccccugagaggagcuucugcuacucugca

SEQ ID NO: 237213 - RNA, 64 nt, Human
aagcuucugugaaagucuggauuuacugaggaccuccccugaggagggaccguugggaccgcag

SEQ ID NO: 237214 - RNA, 64 nt, Human
aagcucacaucucagccaggggccaugccccacuuccccugaccccagcugucuugucuccacu

SEQ ID NO: 237215 - RNA, 64 nt, Human
cagcugcugcccaguaaagcccugugccuuuuuuuccccugaauacugcccaaagcauccccuu

SEQ ID NO: 237216 - RNA, 64 nt, Human
ccuugaauaccucuuucuacagagaggcacgggcuccccugaaggauugucgaggccaggguuc

SEQ ID NO: 237217 - RNA, 64 nt, Human
ccagccuguguguucuguaauggaacugacccccuccccugaaaacgaaggggccccggggcug

SEQ ID NO: 237218 - RNA, 64 nt, Human
aguaaauaaauugcucuuccuaccccaucccccauccccugacaaaaagugacggcagccguac

SEQ ID NO: 237219 - RNA, 64 nt, Human
agcccauuguggaggcggugggggggagaaggccuccccugaggauccccuguccccuggggcu

SEQ ID NO: 237220 - RNA, 64 nt, Human
aagggaaugaaauggaaagggaggcugauucccuuccccugacuuaccacuaauuuacuaggcu

SEQ ID NO: 237221 - RNA, 64 nt, Human
uccuuuccagacaccccuccccgcacugugaaguuccccugaccgcccuccugguucacaaaga

SEQ ID NO: 237222 - RNA, 64 nt, Human
uuguucccaguuccccagggggcaggaaguaggcuccccugagcacagugcccagugcccaucu

SEQ ID NO: 237223 - RNA, 64 nt, Human
cucuggaccuaccaggugacugcugcugggugacuccccugaggcggcuauacccuuaagccag

SEQ ID NO: 237224 - RNA, 64 nt, Human
ccaucgccccacagcucguaccuucucaccagauuccccugaauccaaacucguggugcaaacc

SEQ ID NO: 237225 - RNA, 64 nt, Human
cgcaugccucagccagcccuggaggcuggauggcuccccugaggcuggcauccuggcuggcugu

SEQ ID NO: 237226 - RNA, 64 nt, Human
auagccagugagguucuuaaaguuugcaguauucuccccugauuggaaugguugagugagggua

SEQ ID NO: 237227 - RNA, 64 nt, Human
auacacauauacauaaauuuucagcuauuucuguuccccugaacuaauuugagauuagacccaa

SEQ ID NO: 237228 - RNA, 64 nt, Human
gcagccauaaaaccugggaaggauuuucugaccuuccccugaaguagaucauaagacugucaug

SEQ ID NO: 237229 - RNA, 64 nt, Human
cagagacccuccuccuuucacgaggaaaagaccuuccccugaaccccuaaaaauguuuacaguc

SEQ ID NO: 237230 - RNA, 64 nt, Human
aaccucucuuggcuucauaaacagcugugaacccuccccugagggauuaacagcaaugaugggc

SEQ ID NO: 237231 - RNA, 64 nt, Human
cagccuuucugucaucaucuccacagcccacccauccccugagcacacuaaccaccucaugcag

SEQ ID NO: 237232 - RNA, 64 nt, Human
cucaucuuuauuuuuauucgcacaucccaccccauccccugaacuacuugggagguggggaggg

SEQ ID NO: 237233 - RNA, 64 nt, Human
uauguuucguuucccauugcuguagcauuucuuauccccugagagcugaugauuauugaggaca

SEQ ID NO: 237234 - RNA, 64 nt, Human
ccuuccaagacacacuucuaggcuggcuuguggguccccugagacgaaggcugagcagggugag

SEQ ID NO: 237235 - RNA, 64 nt, Human
cagccuuggggauggacuugcccacaccuccaccuccccugagcccugugagaggcacgacugu

SEQ ID NO: 237236 - RNA, 64 nt, Human
auuuggguagggugggggauccccaacaaucagguccccugagauagcuggucauugggcugau

SEQ ID NO: 237237 - RNA, 64 nt, Human
caagucagaguccccuuugaaccaaguaucuagauccccugaggacuugaugaagugauccuua

SEQ ID NO: 237238 - RNA, 64 nt, Human
uggaggccagggcuauagcucaggaccugggaccuccccugaggcucagggaaaggccagugug

SEQ ID NO: 237239 - RNA, 64 nt, Human
acaagugauggggaucaggccccagagcuugcuguccccugagaccccauccuggggagagggg

SEQ ID NO: 237240 - RNA, 64 nt, Human
uuguggucaucacggccaucauauucuaugugcuuccccugaagagugaggacccguguaacug

SEQ ID NO: 237241 - RNA, 64 nt, Human
uucuggacuuuuguaaacauaccuaggccccuguuccccugagagggugcuaagaggaaggaug

SEQ ID NO: 237242 - RNA, 64 nt, Human
gcacaggccugggcuccccacugagugccaaggguccccugagcaugcuuuucugaagagccgg

SEQ ID NO: 237243 - RNA, 64 nt, Human
aacaacagacaguugccaaauacugguuucucuuuccccugaaaauggcuuuuguucucaaaug

SEQ ID NO: 237244 - RNA, 64 nt, Human
cuuccucgauccagaauccacucuccagucucccuccccugacucccucugcuguccuccccuc

SEQ ID NO: 237245 - RNA, 64 nt, Human
ugucaauguuugggaccaucuuagguauuccugcuccccugaagaaugauuacaguguuaacag

SEQ ID NO: 237246 - RNA, 64 nt, Human
cgcagagcugcuguaacagcucuuccuguucugcuccccugagaacagugugguggggagaggc

SEQ ID NO: 237247 - RNA, 64 nt, Human
ugcuaagaagagcccacaaauagaggauuacucuuccccugaaucucuaaacucagaaacaauu

SEQ ID NO: 237248 - RNA, 64 nt, Human
uccagaccuggguggaauuccaggguugagagacuccccugagccagaggccacuagguauucu

SEQ ID NO: 237249 - RNA, 64 nt, Human
uuuuuuuauuccugacugagucaccacaccccucuccccugaucaaagggaauauuaguuuuua

SEQ ID NO: 237250 - RNA, 64 nt, Human
gggagggagcagccacuccucaaugcucaauggcuccccugaaaucaagacaggggccacccga

SEQ ID NO: 237251 - RNA, 64 nt, Human
uacgggcaaccagccucuucagccucacacccauuccccugagagcaagaagccuguguggucu

SEQ ID NO: 237252 - RNA, 64 nt, Human
guaugaaaugcuaucuugugguuuugauuugcauuccccugauggcaacugaugcugagugucu

SEQ ID NO: 237253 - RNA, 64 nt, Human
acuaggaucugccaaguggauacuggggugccacuccccugagaaaagacugagccaggaacua

SEQ ID NO: 237254 - RNA, 64 nt, Human
cugguacuagauuugcuccugucccaccccgcaguccccugaggagggcgaugugcgcccucuu

SEQ ID NO: 237255 - RNA, 64 nt, Human
ugucauccuuucuguuguuagauaauuggggucuuccccugauauccaaccgugauuuuggauc

SEQ ID NO: 237256 - RNA, 64 nt, Human
auugaaaagcaccuccaccccuacccuagugauguccccugaggacccgggugauaguacaguc

SEQ ID NO: 237257 - RNA, 64 nt, Human
aacaacagcaacaaugccuuugcaggcagccugcuccccugagcgcugggcuggugauggucgu

SEQ ID NO: 237258 - RNA, 64 nt, Human
auggugaccuaauguuuuguccaugacuugcagguccccugacccccuuacucccagguagcac

SEQ ID NO: 237259 - RNA, 64 nt, Human
gcugcagccccagcccagauggcacucagcgcucuccccugagggagucccugggccuagccau

SEQ ID NO: 237260 - RNA, 64 nt, Human
cucccaccccauauuguucuucaaaguggaggucuccccugauccagacaagugggagagcccg

SEQ ID NO: 237261 - RNA, 64 nt, Human
cuggcggaggauucuuggaagcuugcacuuaguuuccccugacuucaccccaugugucuuuuuu

SEQ ID NO: 237262 - RNA, 64 nt, Human
gcaaugacuuguagucaguggaagaguaucacuuuccccugaucaugaccacuaaacuguaaau

SEQ ID NO: 237263 - RNA, 64 nt, Human
acccuccuaauccucuccuagguuguggggcugguccccugacacccuucuccccuuccuggua

SEQ ID NO: 237264 - RNA, 64 nt, Human
gaccuaggaccauuucucugcaggccacuuaccuuccccugagucaggcuuacuaaugcugccc

SEQ ID NO: 237265 - RNA, 64 nt, Human
gcuguuggugucuccuugguccuuaggcagauacuccccugaguccccgaucuagggccagcug

SEQ ID NO: 237266 - RNA, 64 nt, Human
caaagaccccaguauuugcugcuauuuuuaaaacuccccugauguaccugaacaagaggauuuc

SEQ ID NO: 237267 - RNA, 64 nt, Human
cacaucacccuuaccaugugccugauccagccucuccccugauuacaccagccucgucuucauu

SEQ ID NO: 237268 - RNA, 64 nt, Human
ucuauccuuuccaaucggcaucagccagcucuuguccccugauaagugaggacagccugacccu

SEQ ID NO: 237269 - RNA, 64 nt, Human
acacugugccuggccagauauacauuguuuuagauccccugauacagaacuacuuuugagaugg

SEQ ID NO: 237270 - RNA, 64 nt, Human
aaagaauuagagaauaaaccaggccuguuucuuuuccccugaaaucccugccucuggcuuccua

SEQ ID NO: 237271 - RNA, 64 nt, Human
uccggggugcuauccccauccucugccucaucguuccccugagcacugggggacagacccucac

SEQ ID NO: 237272 - RNA, 64 nt, Human
gggggcuuuaacaaaguuuuacucccuccccuguuccccugaucuagugcucaggacccuucac

SEQ ID NO: 237273 - RNA, 64 nt, Human
ugaucuagauuacacugcaccauucccaaguuaauccccugaaaacuuacucucaacuggagca

SEQ ID NO: 237274 - RNA, 64 nt, Human
cuuccggcgggauguugaacuggucauuaauguguccccugaguuggagcucauucugucucuu

SEQ ID NO: 237275 - RNA, 64 nt, Human
cuuuugguuggaaaaagaucuucauggccccaaauccccugagacaugccuuguagaaugauuu

SEQ ID NO: 237276 - RNA, 64 nt, Human
gggcagucuuggugugcagccccucuccucucuguccccugacacuccacagugugccugcaac

SEQ ID NO: 237277 - RNA, 64 nt, Human
uuaauccccauugccaagggcauuguccagaaacuccccugagaccuuacuccuuccagcccca

SEQ ID NO: 237278 - RNA, 64 nt, Human
cuucgaggcugauccuccagggcagguggcugccuccccugacccaaccacuugacuuaaucuc

SEQ ID NO: 237279 - RNA, 64 nt, Human
cuugcucuuggaaguguugugcaguaggaccugcuccccugaaggacggggccaaccagccacu

SEQ ID NO: 237280 - RNA, 64 nt, Human
uaggacauguagcaaguaaacaguggagcccagguccccugacuccauaucuuacauucuuuua

SEQ ID NO: 237281 - RNA, 57 nt, Human
gugacaagauagcuauuuaaagauaguuccccugagaccacuuguaaauagguuaga

SEQ ID NO: 237282 - RNA, 64 nt, Human
accccgacugcucagugcaucuaaucacuuagacuccccugaagaaucccccauggaaacugcc

SEQ ID NO: 237283 - RNA, 64 nt, Human
uguaccaugggggacguugccccauugccuuucuuccccugacuacugggcuuccucuaucagc

SEQ ID NO: 237284 - RNA, 64 nt, Human
uugcuuacauacuucaacaguuucauaaaacgauuccccugagugacacaagaacauaaaaugu

SEQ ID NO: 237285 - RNA, 64 nt, Human
ugacaggagcccugaugucuuaaauucugaaggcuccccugacuuuaugaagggaagauugucu

SEQ ID NO: 237286 - RNA, 64 nt, Human
uuucuuuuuuagaaaacucagaaugaaaauucauuccccugaaauauuuaggugucuauauucu

SEQ ID NO: 237287 - RNA, 64 nt, Human
gguugguuugaggucuuagaacucugggggauauuccccugagcaaaacaaacaacgugagauu

SEQ ID NO: 237288 - RNA, 64 nt, Human
uuugaguggauugguugcugcucacuaaaguuguuccccugaucucuaaauauggaggucauua

SEQ ID NO: 237289 - RNA, 59 nt, Human
cagugacugauaggaaaugaggcuuuucuuccccugaccaaaacuccuucccuguaguc

SEQ ID NO: 237290 - RNA, 64 nt, Human
gccacaucccaaagggaucucaagccuucagcucuccccugaacuccaucuuaacagcccccau

SEQ ID NO: 237291 - RNA, 64 nt, Human
acuuccuccagcguuuugggaaggaaagagauguuccccugagcugauucccagugacagugca

SEQ ID NO: 237292 - RNA, 64 nt, Human
uuuucuuuuuuaaaaaaagagaauacucuugugguccccugaugucucuuucuaggaugugugu

SEQ ID NO: 237293 - RNA, 64 nt, Human
caccccaugaguagugcccacuugaggcuggcacuccccugaccucaccuuugcaaaguuacag

SEQ ID NO: 237294 - RNA, 64 nt, Human
agagacccugcaagacagcacaggcaacuucuccuccccugaauaccccaauggcuacucugcu

SEQ ID NO: 237295 - RNA, 64 nt, Human
uuuaccaacuuccucugccauguuuuuccccugcuccccugagaccacccccaaacacaaaaca

SEQ ID NO: 237296 - RNA, 64 nt, Human
acacauccaaaugaaaaauuuuguagauaccauauccccugaaauagcauuuaucuuacugggu

SEQ ID NO: 237297 - RNA, 64 nt, Human
caauuagcaauuuuguguuucuaaauaucuaugguccccugaaauuuugacuuaguauauaggu

SEQ ID NO: 237298 - RNA, 64 nt, Human
gcuuucugaaugagaagucugauuuuuggaacaguccccugaagaccaauguuggucggcagaa

SEQ ID NO: 237299 - RNA, 64 nt, Human
ugucuccuccuucccacggggcuucugagcuugcuccccugagccuguggcugcccucucccca

SEQ ID NO: 237300 - RNA, 64 nt, Human
cugccucugugccccugccucucccugugucccuuccccugaggacugcggcucccucccuccu

SEQ ID NO: 237301 - RNA, 64 nt, Human
cucagugcugcuguggagcuaggugcuucccccuuccccugagacugguggacugaacuccagu

SEQ ID NO: 237302 - RNA, 64 nt, Human
augguucuguguuuugccugaaacgauaccagguuccccugaauagcaacuuuacaagguccau

SEQ ID NO: 237303 - RNA, 64 nt, Human
uccugagccaccuccucuccccgcuugccucugcuccccugaaccugggagacagaugaggaga

SEQ ID NO: 237304 - RNA, 64 nt, Human
aagcguacgugucacccucuguacugacaucucuuccccugaaaugcuuuucaguuugacagcc

SEQ ID NO: 237305 - RNA, 64 nt, Human
auuuuuuucuaaauucaacuugaagauguguauuuccccugaccuucaaaaaauguuccaaggu

SEQ ID NO: 237306 - RNA, 64 nt, Human
aguccccuccccucugcccuguuuuguauaccccuccccugacccugcuccuaucccacaguau

SEQ ID NO: 237307 - RNA, 64 nt, Human
uuggauagauacagcccuacaaauguauaugcccuccccugaaaaaaauuggaugaaaaucugc

SEQ ID NO: 237308 - RNA, 64 nt, Human
uguagccgguuccccggccacgacucugggcacuuccccugaagcuccucuccggagcuugacu

SEQ ID NO: 237309 - RNA, 64 nt, Human
aaucccagcacuuugggaagcugaggcaggaggauccccugaggucaggaguucgagagcagcc

SEQ ID NO: 237310 - RNA, 64 nt, Human
cacacagugccuuuugugaaagugucaucacggguccccugaggagacaaggcagguccagcgc

SEQ ID NO: 237311 - RNA, 64 nt, Human
ugccagagcaaguggcacaagcaccacugauaccuccccugaaaaaaccccccaaauggauuag

SEQ ID NO: 237312 - RNA, 64 nt, Human
auggcagaugcaccugacagcaauaacuuaagcauccccugagaaugaccuuauggccucaaaa

SEQ ID NO: 237313 - RNA, 64 nt, Human
gcuauguucugcauugagccuaguuuugccauuguccccugaauguaguauuaucuauagauua

SEQ ID NO: 237314 - RNA, 64 nt, Human
ugagcagacugcaccccaagcucccgacuccagguccccugaucuuggggccuguuucccaugg

SEQ ID NO: 237315 - RNA, 64 nt, Human
caguucuggcugucccacagcuccaggaguuguguccccugaauuuugcagaaggugaugacuc

SEQ ID NO: 237316 - RNA, 64 nt, Human
ggcacaauaaucuguaauuuucuuuguuuauacuuccccugaugccacugguuccgaugccacu

SEQ ID NO: 237317 - RNA, 64 nt, Human
ucuccuuccuggaguguugaggucacacauugacuccccugagcccucuucucuccaggcuaaa

SEQ ID NO: 237318 - RNA, 64 nt, Human
ggcuggacucaggagcugggggggccucaccuguuccccugaggaccccgccggacccggaggc

SEQ ID NO: 237319 - RNA, 64 nt, Human
gcuaacuccuaaacugggacccccuacccuguucuccccugaggccccguuccugggaggggca

SEQ ID NO: 237320 - RNA, 64 nt, Human
cacacccagcccagauucaacaggaaaccgaucuuccccugacuccccaccgaggagagccucu

SEQ ID NO: 237321 - RNA, 64 nt, Human
agggcgaggccugagcccucacacaugcccacgcuccccugacacugaagaggauccacaacuc

SEQ ID NO: 237322 - RNA, 64 nt, Human
cacccgcagcgagggcggagccggccccaggugcuccccugacagucccuccucuccggagcau

SEQ ID NO: 237323 - RNA, 64 nt, Human
ugugcccacuccggcuuguccucaucucuacccauccccugaugcccaggucaccgggagggcu

SEQ ID NO: 237324 - RNA, 64 nt, Human
cugagccccgccccuggcccugcugccauguugcuccccugaaggaugccccgacccccgugcc

SEQ ID NO: 237325 - RNA, 64 nt, Human
ucccccagcauccagacuggaaaccuacccauuuuccccugagcauccucuagaugcugcccca

SEQ ID NO: 237326 - RNA, 64 nt, Human
ugcaauuuuuagguaaucuuuuuuuuuuuuccccuccccugaaagucugggaaccugagagucc

SEQ ID NO: 237327 - RNA, 64 nt, Human
cuccccggaggcacagcagugucauggggcugucuccccugacaggcacaacuccccgggcaga

SEQ ID NO: 237328 - RNA, 64 nt, Human
cugguuguugugcugaggccagucagaggaugcuuccccugagguuugcuauaacuaagcaacc

SEQ ID NO: 237329 - RNA, 64 nt, Human
cauggggcuuggaggaccgagccacugacagguauccccugaaacugagcugagcccaguaucc

SEQ ID NO: 237330 - RNA, 64 nt, Human
acggccuugcccucgaauucugcaggcccugggcuccccugacaccugucauauuuauggacca

SEQ ID NO: 237331 - RNA, 64 nt, Human
cuucccccacugucccgguccucuuccccugagguccccugauauccccuggcucaguccuaac

SEQ ID NO: 237332 - RNA, 64 nt, Human
cacuggccaccuucccccacugucccgguccucuuccccugagguccccugauauccccuggcu

SEQ ID NO: 237333 - RNA, 64 nt, Human
caccucccacuccugaagauccaucucuuggggcuccccugacagagaagacagccgaagucaa

SEQ ID NO: 237334 - RNA, 64 nt, Human
cuaggaggcugcuuguugcccgagaccagcccccuccccugauuuagggaugcguaggguaaga

SEQ ID NO: 237335 - RNA, 64 nt, Human
gaaaggagaggcuagggugguguggaggggcugguccccugacaccugggcagauggggucucc

SEQ ID NO: 237336 - RNA, 62 nt, Human
cgguggagaucagcgccugagccgccucgggauccccugagaggcgcccgcggucugcggcc

SEQ ID NO: 237337 - RNA, 64 nt, Human
uugcugucauagcucuauauaugucccuuuacaguccccugaggagaacuuucuuaaauugaaa

SEQ ID NO: 237338 - RNA, 64 nt, Human
ccaguaacagaugcccguugcucuugggcugguuuccccugaacaccuccaagaggcugccugc

SEQ ID NO: 237339 - RNA, 64 nt, Human
guuucuccugacugugaucucacugggguagaauuccccugagagaauucccucacucacggcu

SEQ ID NO: 237340 - RNA, 64 nt, Human
guguucggucuacauuuaguucuccccacucugauccccugacucuccagcuuccaggaagguu

SEQ ID NO: 237341 - RNA, 64 nt, Human
uuacuuugcauuugugcccacucuccaccccugcuccccugagcugaaauaaaaauacaauaaa

SEQ ID NO: 237342 - RNA, 64 nt, Human
gcuguccugaucugugauaguucacccccugagauccccugagccccagggugcccagaacuuc

SEQ ID NO: 237343 - RNA, 64 nt, Human
guucaauaagugagucaugagguuggaaauucguuccccugacagucauauugcauaacauugc

SEQ ID NO: 237344 - RNA, 64 nt, Human
agaacuggcccagcugcaggcacuaagaagcuccuccccugagacaagugagggguagucggug

SEQ ID NO: 237345 - RNA, 64 nt, Human
uuagcuucaucaguccuuccuuccuaaucucuaauccccugaagccuaacacaguuccuaaugu

SEQ ID NO: 237346 - RNA, 57 nt, Human
ugccaaaacuuguuagcugagcucacguccccugaugcugguaaccugaaagauacg

SEQ ID NO: 237347 - RNA, 63 nt, Human
acaaauggaaccaaucuuaagaaaauacacguguccccugacuucaaaacauaugugacugug

SEQ ID NO: 237348 - RNA, 60 nt, Human
ccuacccacccaaccugucccugccugcucccagcccacucauccuuaugugcuagggau

SEQ ID NO: 237349 - RNA, 60 nt, Human
augaaaucaggaagaggacaaguggccuggccagcccacaacuaguauucagccauuggg

SEQ ID NO: 237350 - RNA, 60 nt, Human
uugugggccccuuccacaaagcuguaagucccagcccaccuacucagggccuugcucagu

SEQ ID NO: 237351 - RNA, 64 nt, Human
augcuuccacuccacaguaccuaauuucucucuguccccugagaucugaaggcuaccuugggaa

SEQ ID NO: 237352 - RNA, 64 nt, Human
uuugcuucugccucuguuuccaagcccacccuuuuccccugagcucaggguuagggaugggcgc

SEQ ID NO: 237353 - RNA, 64 nt, Human
gucccgcucccgguccccucggaggagagcccacuccccugagagacggagggaagagaggagu

SEQ ID NO: 237354 - RNA, 64 nt, Human
aagggccuuggauuccaacacaguuucuuccacauccccugacuugggcuagugggcagaggaa

SEQ ID NO: 237355 - RNA, 64 nt, Human
cccuccagguacaggcugagaggcugagaaaucauccccugaauaacuuuuuccucucgauucc

SEQ ID NO: 237356 - RNA, 64 nt, Human
caugccuuguuucuauccuucucuauuuccgugguccccugaauccagaaaacaaauagaacau

SEQ ID NO: 237357 - RNA, 64 nt, Human
auaacauuugaaaauauugucuuaugugauuuuuuccccugaaaauauuugcuuguaaaugaaa

SEQ ID NO: 237358 - RNA, 64 nt, Human
ucuugggaaagagacagagugcugaggggcacucuccccugaauccucagagaguugucugucc

SEQ ID NO: 237359 - RNA, 64 nt, Human
agguggaaaguuagggucugggcuucuaccaccauccccugaauugggaauauagucaguggga

SEQ ID NO: 237360 - RNA, 64 nt, Human
gucccagccguaagucaggcucgagggagacugauccccugaccaauucaccugauaaacucua

SEQ ID NO: 237361 - RNA, 64 nt, Human
gagggguccuguucggaagcaguggcugaauuuauccccugaaagugguuuuggaggaaccggg

SEQ ID NO: 237362 - RNA, 64 nt, Human
caaggguucuucuugcaugugggguuuauaccccuccccugaugaauacagagugguagcuagg

SEQ ID NO: 237363 - RNA, 64 nt, Human
auuaaaaagcagacaguaauucaguccauucuucuccccugaaaugaagacuacaucaccucuc

SEQ ID NO: 237364 - RNA, 64 nt, Human
aaaguauuauuugaacuuuuuaagaugaggcaguuccccugaaaaaguuaaugcagcucuccau

SEQ ID NO: 237365 - RNA, 64 nt, Human
ugacucaaguacuuccuaaaaaaacccaaucuucuccccugacaccaguagagaaaugcacuuu

SEQ ID NO: 237366 - RNA, 64 nt, Human
uucuagauacagggcucaagaagucugcugggaguccccugaguccuuugacuuaguacugacu

SEQ ID NO: 237367 - RNA, 64 nt, Human
cgucaguuauguaaaauaaacauacucuucuuccuccccugauuauugccauuaagccuuuaaa

SEQ ID NO: 237368 - RNA, 64 nt, Human
guacauaaaacaucaugaaacccuagauaugaaauccccugaagucuguaaucauggugguuau

SEQ ID NO: 237369 - RNA, 64 nt, Human
auuguuuucuuugacauaacuaggauccauuauuuccccugaaggcuucuuguuagaaaauagu

SEQ ID NO: 237370 - RNA, 64 nt, Human
cuccugccccggcauugcaucuucccuagauagguccccugagggcugagugggagggcggccc

SEQ ID NO: 237371 - RNA, 64 nt, Human
auuccugcuguuguuguggccuuggguaaaggccuccccugagaacacaggacaggccugcuga

SEQ ID NO: 237372 - RNA, 64 nt, Human
uuuuuguauauuuaaaaguuggacaucaauuuuuuccccugauuucaucaaguuaucucugcca

SEQ ID NO: 237373 - RNA, 64 nt, Human
aucugggugugugagugggaggagagggcagagguccccugaggucaugcauuguaaucaucau

SEQ ID NO: 237374 - RNA, 64 nt, Human
uuuaauauuuuucucuuggcccacucucuuugcuuccccugaaucugugugguacuauagcagc

SEQ ID NO: 237375 - RNA, 64 nt, Human
cuaucccuccagcuggcaguuacuguuuuuuuaauccccugaaguuguccuguaggagacagaa

SEQ ID NO: 237376 - RNA, 64 nt, Human
auaguguaaaauaaaauguuucuuggacaagaaauccccugaaauucagcuguuauagugcuuc

SEQ ID NO: 237377 - RNA, 64 nt, Human
ggaccuccugguucaagugauccucuugucucaguccccugagacaaucccccacgcccagcua

SEQ ID NO: 237378 - RNA, 64 nt, Human
ugaaggaagggcauaggaaaauuuucccaguaaauccccugauggucacauuaagguaaagguu

SEQ ID NO: 237379 - RNA, 64 nt, Human
ugcuuuauuggaaaugaggacucaucugauagaauccccugaaagcaguagccaccauguucaa

SEQ ID NO: 237380 - RNA, 64 nt, Human
uacagugcccugcccacccuuaucugcacccaccuccccugaaaaagagagaaaaaaaaaaacc

SEQ ID NO: 237381 - RNA, 64 nt, Human
uuggugugguuuuuuucuuuucucaggugauauauccccugaaggaggucuaccccgacucagg

SEQ ID NO: 237382 - RNA, 64 nt, Human
uuuuguuuuauuuuguuuuugauuuuuuuuuuccuccccugaguguaugcuuaguuguugagua

SEQ ID NO: 237383 - RNA, 64 nt, Human
agaaaaauugagaggaagauagagauuuccuuucuccccugacaaagcccucaacagccuccca

SEQ ID NO: 237384 - RNA, 64 nt, Human
cuaugacacaguuaucaaaaaguauuaucauugcuccccugauagaagauuguuggugaauuuu

SEQ ID NO: 237385 - RNA, 64 nt, Human
uagacccucuguccugcagagucaggguggcuuuuccccugacuguguccgaugccaaggaguc

SEQ ID NO: 237386 - RNA, 64 nt, Human
ggauauacagauuuaaauauucaaaucucccugcuccccugaaaguccccaggcagcugucaau

SEQ ID NO: 237387 - RNA, 64 nt, Human
cccccacccccaccccccagaauaacgcugacuguccccugaaacagccuucucuccugcccug

SEQ ID NO: 237388 - RNA, 64 nt, Human
cccccacgaguggggccuuggcccaagcagagcuuccccugaaggugccaucagccagggcagc

SEQ ID NO: 237389 - RNA, 64 nt, Human
uggcuugcuccuacuuucaggaagggaugcaggcuccccugaggaauaugucauaguucugagc

SEQ ID NO: 237390 - RNA, 64 nt, Human
uccuugaaguuuacacuuugccacugcuggaggcuccccugaguccucugcaugaguucugcac

SEQ ID NO: 237391 - RNA, 64 nt, Human
agacccuagcaucuccauguccaucccccagaccuccccugagacgcugugccaaugugggucu

SEQ ID NO: 237392 - RNA, 64 nt, Human
uaaugugaaauaagcuauguguccaggguauugcuccccugaguguauaugagugcugaguagu

SEQ ID NO: 237393 - RNA, 64 nt, Human
cuacuccacauucggauggcccagacugacuccauccccugacuuucccuuugacuucacccug

SEQ ID NO: 237394 - RNA, 60 nt, Human
uugcuggaggagccccaugaacucccugcuuccccugaacccccagcaaguugcagaggc

SEQ ID NO: 237395 - RNA, 64 nt, Human
gagggagacccaggacugaacucuccaggccuccuccccugagcccugcagcuggcuggagucu

SEQ ID NO: 237396 - RNA, 64 nt, Human
cugcucugucccgggacccccuggccuggcgcuguccccugagcugucccauuaaacauggccc

SEQ ID NO: 237397 - RNA, 64 nt, Human
aagagccagugaggccccugguacccaagcccccuccccugaccugggugugccucgcugcugg

SEQ ID NO: 237398 - RNA, 64 nt, Human
caguccccacggggcucccaggccggggaaagguuccccugaggucacucugaggccagggacg

SEQ ID NO: 237399 - RNA, 64 nt, Human
aggccccagcaaagccauggcuucuaccccuaguuccccugacaggaaguucuuggcggguuug

SEQ ID NO: 237400 - RNA, 64 nt, Human
gacuugcuaacaggauccaggccaggcugugguuuccccugaaccagcccuggaccuuucugag

SEQ ID NO: 237401 - RNA, 64 nt, Human
gguucugacuucacuuuccucagcgggucuccaguccccugacccagcucuaaaggcacuuagg

SEQ ID NO: 237402 - RNA, 64 nt, Human
aggaguguuauuuggaaggaguauuauuugcucuuccccugagaacugaaagaggggaaaggag

SEQ ID NO: 237403 - RNA, 64 nt, Human
guggacccaucccgcgggugaccggugccuguucuccccugaccgagccugugagcacaucgcc

SEQ ID NO: 237404 - RNA, 64 nt, Human
agaaaggcuuccccuacaccccagccuccugcuguccccugaagcccaggacugcguuguaugc

SEQ ID NO: 237405 - RNA, 64 nt, Human
cagcucacauguuuacacacucagugcccuaauuuccccugagggaaucgcuuuuuaagugauc

SEQ ID NO: 237406 - RNA, 64 nt, Human
agaaacuugaaugggacccugagagagccagggguccccugaggccccccuaggggcuuucugu

SEQ ID NO: 237407 - RNA, 64 nt, Human
gacuugccaucagcacagcacacagcagcacccuuccccugaggccgguggggaggggacaagu

SEQ ID NO: 237408 - RNA, 64 nt, Human
cuaggaucuccccagcagaugcaaacaaguguccuccccugaauugugugaaccaaagcgucag

SEQ ID NO: 237409 - RNA, 64 nt, Human
cgagggcugagccuggucccacgagggugccguguccccugacagggccagugcaguuuggugu

SEQ ID NO: 237410 - RNA, 64 nt, Human
caggucccuacuaucaaccgggaguuugggguccuccccugaaguaggcaaggacugcacguuu

SEQ ID NO: 237411 - RNA, 64 nt, Human
uuggucauacugaagggaauugauggcaagaggauccccugagcaagucagaaguuacucucau

SEQ ID NO: 237412 - RNA, 64 nt, Human
aagcugacagaaguuauaccuuacuccuuuccuuuccccugaacaaaccugcuaaucccacuaa

SEQ ID NO: 237413 - RNA, 64 nt, Human
cuggcugcuccccugugggagccauuggaauguauccccugacaggcccccuuccgccuccacc

SEQ ID NO: 237414 - RNA, 64 nt, Human
agggcuuugaaucaggguaguauccugccuucccuccccugaccccacauggucucagggcccc

SEQ ID NO: 237415 - RNA, 64 nt, Human
gggugggguuaugugaggguaugaagagcugucuuccccugagaguuuccucagaacccacagu

SEQ ID NO: 237416 - RNA, 64 nt, Human
ggaccuucucuucuucucagauggucccuuccauuccccugaaaccugcaugagagcuccuaac

SEQ ID NO: 237417 - RNA, 64 nt, Human
gagccuagccaccucccaccccacuccagcccuguccccugaaaaacugaucaaaaauaaacua

SEQ ID NO: 237418 - RNA, 64 nt, Human
gaccuguugcuagaaguuggguuguucuggauuuuccccugaagacuuacuuauucuuccguca

SEQ ID NO: 237419 - RNA, 64 nt, Human
gcucugucugcgacaccaagauccagcuggggacuccccugaggccugccuaaguccaggccuu

SEQ ID NO: 237420 - RNA, 64 nt, Human
uuuuaaauaauauauuuggugcuguuuucucagauccccugagagcacuuuuuauuuuccuuuu

SEQ ID NO: 237421 - RNA, 64 nt, Human
cugucauccuuccuuagguccugcaguacagucuuccccugaaugccaccggggacccaggggg

SEQ ID NO: 237422 - RNA, 64 nt, Human
gugccccuugucauagacccaaggagcaacucuguccccugagcguugggggucccgggggaga

SEQ ID NO: 237423 - RNA, 64 nt, Human
auuccaccccaccuuuuuccuucuccccaauuacuccccugaaucaauguacaaaucagcaccc

SEQ ID NO: 237424 - RNA, 64 nt, Human
uucggggaaaaggagaccauccuuggagugaacguccccugacaccccaagguucaaacugucu

SEQ ID NO: 237425 - RNA, 64 nt, Human
cacagcccccaccagcucugaaugucuaaccugcuccccugauucguaaaccuaggggaaacca

SEQ ID NO: 237426 - RNA, 64 nt, Human
ggaaccccagcccaccucacuaucauacucagcuuccccugauggcccaucccagccccugaag

SEQ ID NO: 237427 - RNA, 64 nt, Human
ucuacauauacuuauuacccaguacaguuuuuuuuccccugaaaagcuguguauaaaauuaugg

SEQ ID NO: 237428 - RNA, 60 nt, Human
ccuuccaguguguaacuggauuggcucccaccagcccagaagauuuacgacgugggaaau

SEQ ID NO: 237429 - RNA, 60 nt, Human
ugcccaagucaaacuacaucacuuguaucuccagcccaaauguagucugccuugaaaagu

SEQ ID NO: 237430 - RNA, 60 nt, Human
acuuacuucccuguucaccucugccccaccccagcccagaggaguuugagccaccaacuu

SEQ ID NO: 237431 - RNA, 64 nt, Human
agaccagugccuugguggcaggucccuccccagguccccugagaugggguauggaggggcccuu

SEQ ID NO: 237432 - RNA, 64 nt, Human
cugauggcucuggcuguccugauccugucuucccuccccugaaggaaaguuugcacuggauuuu

SEQ ID NO: 237433 - RNA, 64 nt, Human
accugucccgggcgccguaggccucucccaccccuccccugauggucuuguucucuugugcuca

SEQ ID NO: 237434 - RNA, 64 nt, Human
ugcucuuagauugggccauggcuuucauccuguguccccugaccuguccaggugagugugaggg

SEQ ID NO: 237435 - RNA, 64 nt, Human
cuuaggccucucugccugggaugggcucccacccuccccugaggauggccuggauucacgcccu

SEQ ID NO: 237436 - RNA, 64 nt, Human
cucauagcugcaagagagaggcaccagcugaaguuccccugacugaagagagccuguggccaug

SEQ ID NO: 237437 - RNA, 56 nt, Human
cuccugugauaacagaauagaagcacuccccugauaaauacuuucugugcuccagg

SEQ ID NO: 237438 - RNA, 64 nt, Human
ucugaagagcuguacacccacaagggugacuauuuccccugaguggccguguugucccagugcc

SEQ ID NO: 237439 - RNA, 64 nt, Human
uuggugccuagcugaguccucgcuguccccgccauccccugaucugugcggcuccagccucgcc

SEQ ID NO: 237440 - RNA, 64 nt, Human
gggagucggugcaaaacaaaauaucccaguccccuccccugaaacacugacucaggagguuugg

SEQ ID NO: 237441 - RNA, 64 nt, Human
aaacccaucacuagcacggcucagccuccugcuauccccugacugcuggggacccucgccuucc

SEQ ID NO: 237442 - RNA, 64 nt, Human
ggacacccgacggccgccugcugcugccgcucccuccccugagaaaagacucgggaugggugug

SEQ ID NO: 237443 - RNA, 64 nt, Human
aaguaauccccuuuuccagaaugcauuaacccacuccccugaccucacgcuggggcaggucccc

SEQ ID NO: 237444 - RNA, 64 nt, Human
ccccccaucaguggacaaggggagaguccccuacuccccugaucccccagguucagacugagcu

SEQ ID NO: 237445 - RNA, 64 nt, Human
uguucaggcugccugucaucccgggccugccagcuccccugagugaugagcacuuccaagcacc

SEQ ID NO: 237446 - RNA, 64 nt, Human
ccgcccucagccuccuggggacucgagccggggauccccugacgguuuuucuugccuaaguuau

SEQ ID NO: 237447 - RNA, 64 nt, Human
caggcguuaucauccuguaugcauuaacguacuuuccccugaaacagagcaacccagucaacac

SEQ ID NO: 237448 - RNA, 60 nt, Human
cagaaucucaggaccccgcccagggagcugccagcccagggcucagcuucccaugggccc

SEQ ID NO: 237449 - RNA, 60 nt, Human
aguuuagacaucugcagagaggcaggcagcccagcccaggggacccguuccucuugaacc

SEQ ID NO: 237450 - RNA, 60 nt, Human
ugucucagagccuuccaugaccuccccuccccagcccaaugccaaguggacuuggagcug

SEQ ID NO: 237451 - RNA, 64 nt, Human
ccccuaggagcagcgguggggagcagggccaagguccccugaccacugcucagaggagcccuag

SEQ ID NO: 237452 - RNA, 64 nt, Human
acgacaccuggagacugucccgacacagcgacgcuccccugagagguuucuggggcccgcugcg

SEQ ID NO: 237453 - RNA, 64 nt, Human
gaaaaggucacuggaccuggaaggguccccaggguccccugacucccgucuccaucugucacgu

SEQ ID NO: 237454 - RNA, 64 nt, Human
caggcaggguucacauuuccaaaccuuuuugauuuccccugaccucuaauggcuggauccuauu

SEQ ID NO: 237455 - RNA, 64 nt, Human
gagggggggggguagcaccaccucccugacacccuccccugaccugacuagggggaggauccac

SEQ ID NO: 237456 - RNA, 64 nt, Human
cuuaagugauuucaguuuauuucaaauacaguuuuccccugacauaugcaggggauuaauucca

SEQ ID NO: 237457 - RNA, 64 nt, Human
aggaggccgggaaucaaagcgaguccaguugaucuccccugacaaucuggaagguuccuuuugc

SEQ ID NO: 237458 - RNA, 64 nt, Human
uggggauagggagaaagggaggcccaggaaggucuccccugauuuuuuuucauaguaauuuuuu

SEQ ID NO: 237459 - RNA, 64 nt, Human
ccacucaucagaaaaaaaaaaaaaagccuuuguguccccugauuuggggagaauaaacagauau

SEQ ID NO: 237460 - RNA, 64 nt, Human
acauuggcugcugaaugguccuaucugcuggcucuccccugagaucuggacagaggaagauggg

SEQ ID NO: 237461 - RNA, 64 nt, Human
agcugucuggugccagagccagccuauaguagaguccccugaccccaagcccggugcucauucc

SEQ ID NO: 237462 - RNA, 64 nt, Human
gccucaggccucggagagguggcaugauuguggauccccugagaucuggcuucccaagagcacu

SEQ ID NO: 237463 - RNA, 64 nt, Human
ugaucuuccaggguggggaggagaaaaucccaccuccccugaccuccaccaccuccaccaccac

SEQ ID NO: 237464 - RNA, 64 nt, Human
gugccuccccguguggagagaaggcaaccccagauccccugagcuaacccggaggaaaggcagu

SEQ ID NO: 237465 - RNA, 64 nt, Human
caggccuccgcuccuguuuugguggcccaggcucuccccugacccauccucgcucccccaccuc

SEQ ID NO: 237466 - RNA, 64 nt, Human
cugcagagaggauucggcccaaacucagaacuguuccccugaggagaagcgguggccucuuugc

SEQ ID NO: 237467 - RNA, 64 nt, Human
aggagcuugucuuccuuguccucuguucccacccuccccugaacagaacccagcccauaagaga

SEQ ID NO: 237468 - RNA, 60 nt, Human
gggcguggucagcugggaggagagcugugcccagcccaaccggccuggcaucuacacccg

SEQ ID NO: 237469 - RNA, 60 nt, Human
cauguggacgcccuccguccugcagucuugccagcccaccacagccacuguagaccacag

SEQ ID NO: 237470 - RNA, 60 nt, Human
acaguuucccgggcagcuccuggccagcuuccagcccagaguccucaaguccagggcacc

SEQ ID NO: 237471 - RNA, 64 nt, Human
uuuucugcauaucuucugugaugacaaaucucuguccccugaguguuaauuugauuuuuagaaa

SEQ ID NO: 237472 - RNA, 64 nt, Human
cagauuguucucgcaccccugccagaacucacucuccccugaaguuuagggucccaucucccag

SEQ ID NO: 237473 - RNA, 64 nt, Human
aggcacccagggccaugccagggaaaggaagagcuccccugaaucccgaggacacaguccccug

SEQ ID NO: 237474 - RNA, 64 nt, Human
ggaucagggugugaggaggccggggcuaaggggcuccccugaauaucuucucugcucacuucca

SEQ ID NO: 237475 - RNA, 64 nt, Human
uggaugcagggaucacaccaggacagccugggguuccccugaggggcacgggcuggaggaggag

SEQ ID NO: 237476 - RNA, 64 nt, Human
ggccucuuugagaauucucagaacuuuguaccuuuccccugauuuuuaaacccuuuuucuaaac

SEQ ID NO: 237477 - RNA, 64 nt, Human
cuauguuauuaggaaaaauuguuuaguuguuuucuccccugauuaauggugauauucaaguaug

SEQ ID NO: 237478 - RNA, 64 nt, Human
aauggcuugcccauaaaggaacugcauaggauuauccccugacauuccaagagcaaaauaaagc

SEQ ID NO: 237479 - RNA, 64 nt, Human
ugcccccugccccugcuggcacauuuaacccuuguccccugaccucaguucugugccccaccaa

SEQ ID NO: 237480 - RNA, 64 nt, Human
gaagccugaugcugacauucaccugccccaacucuccccugaccugugagcccagcugggucag

SEQ ID NO: 237481 - RNA, 64 nt, Human
acagagaugccgcgugcugggaaggcucuugggguccccugagcgucuuccaggguggcuggag

SEQ ID NO: 237482 - RNA, 64 nt, Human
aagaggggccggacgccaccuuccccaggaccauuccccugauccaacaguugcuaaacgccac

SEQ ID NO: 237483 - RNA, 64 nt, Human
cugcagacggaccauggggugucaacgauuuuuguccccugaguccgccucugcguggagccac

SEQ ID NO: 237484 - RNA, 64 nt, Human
ucuggaacuuugcuuuuagcagggaaagcagcuguccccugagugcuuugaauugggaauauac

SEQ ID NO: 237485 - RNA, 64 nt, Human
aggcaaagaucaucuacagauucuaggaauucucuccccugaaaucaaaaccuggaagacuuuu

SEQ ID NO: 237486 - RNA, 64 nt, Human
augggcaaaugccccuccuucuuacuucccagaauccccugacauucccagggucagccaggac

SEQ ID NO: 237487 - RNA, 64 nt, Human
agaauuccacccuugaaccccagcagacagucccuccccugacucccaccuugguagggugcug

SEQ ID NO: 237488 - RNA, 64 nt, Human
ccuaggaggccccuaggggugccccaucucaguguccccugaacucuuuauuugccuaauuuau

SEQ ID NO: 237489 - RNA, 64 nt, Human
uguagcaccuccuguuggagggguggagggauguuccccugagccaggcugagacuagaacccc

SEQ ID NO: 237490 - RNA, 60 nt, Human
gggguccccuccccuuacgaacacagaaacccagcccacaugacuagcacgcugagcucu

SEQ ID NO: 237491 - RNA, 64 nt, Human
uaaguucuagagcagcucucugagcaggauaagguccccugacagugaguuguguggugggggc

SEQ ID NO: 237492 - RNA, 64 nt, Human
ggaauccauggccuggaccaccccagaucccacauccccugacgaagcuuguccagauggcagg

SEQ ID NO: 237493 - RNA, 64 nt, Human
cuacugguugcuuguccauggccaacaccagaaauccccugagcacuaccugggucucauucca

SEQ ID NO: 237494 - RNA, 64 nt, Human
guuugggaauucaaauuguccugcagagguucauuccccugacccuuuccccacauugguaaga

SEQ ID NO: 237495 - RNA, 64 nt, Human
gauggagaagugccagcagcugggggucaagacguccccugaggacccaggcccacacccagcc

SEQ ID NO: 237496 - RNA, 64 nt, Human
gcccgcugcccccaaccuucaggcugccagaugcuccccugacaacaccaggcuacaggagcca

SEQ ID NO: 237497 - RNA, 64 nt, Human
gcagggcgggucugugucccauguguccugucaguccccugaguauguguguggguguggcgca

SEQ ID NO: 237498 - RNA, 61 nt, Human
cagaaccagaaaaugucugaagauguuaagauccccugauuacuuugagaaaaacaacuaa

SEQ ID NO: 237499 - RNA, 64 nt, Human
ucgacuagcaguuacucauuugcuucucccuauguccccugacaaccacuaaucuauuugucuc

SEQ ID NO: 237500 - RNA, 64 nt, Human
gaaggcucuaucuuccacuguggcccugcagagauccccugagccaagccgaggcaguuuccac

SEQ ID NO: 237501 - RNA, 64 nt, Human
aggugggcuguguccgccacaucacccauccccauccccugacucuuucaccggcaggggcacg

SEQ ID NO: 237502 - RNA, 64 nt, Human
cuccucgucagucucucaaagaccccaugguccauccccugaggguggucagccaaggcucccg

SEQ ID NO: 237503 - RNA, 64 nt, Human
uacagccaaacacagcauccaauaugaauacccauccccugaccgcauccccaguagucagauu

SEQ ID NO: 237504 - RNA, 64 nt, Human
gcaucccuuggccccucucuguuuacccucccuguccccugagguuaaggggaucuaaaaggag

SEQ ID NO: 237505 - RNA, 64 nt, Human
uuuccuuccuuccuacccccuucucccucucccuuccccugacuguuccacccaggaggaggaa

SEQ ID NO: 237506 - RNA, 64 nt, Human
gcugcugugcagggguguggaguagggagcuggcuccccugagagccaugcagggcgucugcag

SEQ ID NO: 237507 - RNA, 64 nt, Human
ugagaauuauagaugggguucaagaaucccuaaguccccugaaauuauauaaggcauucuguau

SEQ ID NO: 237508 - RNA, 60 nt, Human
ugcucugagaguucaaguccugccaggccgccagcccagagccuccucacccuauccugu

SEQ ID NO: 237509 - RNA, 60 nt, Human
cugguggggaccugggacccagacccggaaccagcccagauaucaccccugaggacccau

SEQ ID NO: 237510 - RNA, 60 nt, Human
uagcaauaauguccuacugcccgggcagccccagcccagcccgccgggagcaaggauggu

SEQ ID NO: 237511 - RNA, 64 nt, Human; identical to SEQ ID NO: 237205

SEQ ID NO: 237512 - RNA, 64 nt, Human; identical to SEQ ID NO: 237206

SEQ ID NO: 237513 - RNA, 64 nt, Human; identical to SEQ ID NO: 237207

SEQ ID NO: 237514 - RNA, 64 nt, Human; identical to SEQ ID NO: 237208

SEQ ID NO: 237515 - RNA, 64 nt, Human; identical to SEQ ID NO: 237211

SEQ ID NO: 237516 - RNA, 64 nt, Human; identical to SEQ ID NO: 237212

SEQ ID NO: 237517 - RNA, 64 nt, Human; identical to SEQ ID NO: 237213

SEQ ID NO: 237518 - RNA, 64 nt, Human; identical to SEQ ID NO: 237214

SEQ ID NO: 237519 - RNA, 64 nt, Human; identical to SEQ ID NO: 237215

SEQ ID NO: 237520 - RNA, 64 nt, Human; identical to SEQ ID NO: 237216

SEQ ID NO: 237521 - RNA, 64 nt, Human; identical to SEQ ID NO: 237217

SEQ ID NO: 237522 - RNA, 64 nt, Human; identical to SEQ ID NO: 237218

SEQ ID NO: 237523 - RNA, 64 nt, Human; identical to SEQ ID NO: 237219

SEQ ID NO: 237524 - RNA, 64 nt, Human; identical to SEQ ID NO: 237220

SEQ ID NO: 237525 - RNA, 64 nt, Human; identical to SEQ ID NO: 237221

SEQ ID NO: 237526 - RNA, 60 nt, Human
cuccuuggcuguggucccccagcuacaccaccagcccagguccuggcugccagcuuuccu

SEQ ID NO: 237527 - RNA, 60 nt, Human
caacuccguguccgcugcccacagcccaagccagcccacagcggaugcugcaaaaaucaa

SEQ ID NO: 237528 - RNA, 60 nt, Human
gugcugacggccagggagaagcuccucuccccagcccagagacauacuugaagggccaga

SEQ ID NO: 237529 - RNA, 64 nt, Human; identical to SEQ ID NO: 237222

SEQ ID NO: 237530 - RNA, 64 nt, Human; identical to SEQ ID NO: 237223

SEQ ID NO: 237531 - RNA, 64 nt, Human; identical to SEQ ID NO: 237224

SEQ ID NO: 237532 - RNA, 64 nt, Human; identical to SEQ ID NO: 237225

SEQ ID NO: 237533 - RNA, 64 nt, Human; identical to SEQ ID NO: 237226

SEQ ID NO: 237534 - RNA, 64 nt, Human; identical to SEQ ID NO: 237227

SEQ ID NO: 237535 - RNA, 64 nt, Human; identical to SEQ ID NO: 237228

SEQ ID NO: 237536 - RNA, 64 nt, Human; identical to SEQ ID NO: 237229

SEQ ID NO: 237537 - RNA, 64 nt, Human; identical to SEQ ID NO: 237230

SEQ ID NO: 237538 - RNA, 64 nt, Human; identical to SEQ ID NO: 237231

SEQ ID NO: 237539 - RNA, 64 nt, Human; identical to SEQ ID NO: 237232

SEQ ID NO: 237540 - RNA, 64 nt, Human; identical to SEQ ID NO: 237233

SEQ ID NO: 237541 - RNA, 64 nt, Human; identical to SEQ ID NO: 237234

SEQ ID NO: 237542 - RNA, 64 nt, Human; identical to SEQ ID NO: 237235

SEQ ID NO: 237543 - RNA, 64 nt, Human; identical to SEQ ID NO: 237236

SEQ ID NO: 237544 - RNA, 64 nt, Human; identical to SEQ ID NO: 237237

SEQ ID NO: 237545 - RNA, 60 nt, Human
agugcugggauuacaggcaugagccaucgcccagcccagaagcuaauuuuuuaauauugu

SEQ ID NO: 237546 - RNA, 60 nt, Human
ggagcccaggcugcccugcacuccugccucccagcccacagccaggugcuuucaucacag

SEQ ID NO: 237547 - RNA, 60 nt, Human
ugcugggauuacaggugugaaccaccacacccagcccacuucugccauauucuguuggcc

SEQ ID NO: 237548 - RNA, 64 nt, Human; identical to SEQ ID NO: 237238

SEQ ID NO: 237549 - RNA, 64 nt, Human; identical to SEQ ID NO: 237239

SEQ ID NO: 237550 - RNA, 64 nt, Human; identical to SEQ ID NO: 237240

SEQ ID NO: 237551 - RNA, 64 nt, Human; identical to SEQ ID NO: 237241

SEQ ID NO: 237552 - RNA, 64 nt, Human; identical to SEQ ID NO: 237242

SEQ ID NO: 237553 - RNA, 64 nt, Human; identical to SEQ ID NO: 237243

SEQ ID NO: 237554 - RNA, 64 nt, Human; identical to SEQ ID NO: 237244

SEQ ID NO: 237555 - RNA, 64 nt, Human; identical to SEQ ID NO: 237245

SEQ ID NO: 237556 - RNA, 64 nt, Human; identical to SEQ ID NO: 237246

SEQ ID NO: 237557 - RNA, 64 nt, Human; identical to SEQ ID NO: 237247

SEQ ID NO: 237558 - RNA, 64 nt, Human; identical to SEQ ID NO: 237248

SEQ ID NO: 237559 - RNA, 64 nt, Human; identical to SEQ ID NO: 237249

SEQ ID NO: 237560 - RNA, 64 nt, Human; identical to SEQ ID NO: 237250

SEQ ID NO: 237561 - RNA, 64 nt, Human; identical to SEQ ID NO: 235268

SEQ ID NO: 237562 - RNA, 64 nt, Human; identical to SEQ ID NO: 232794

SEQ ID NO: 237563 - RNA, 64 nt, Human; identical to SEQ ID NO: 237154

SEQ ID NO: 237564 - RNA, 60 nt, Human
guccaagaagacguaggcuucauuuucacaccagcccacaccauuccagugcucagccua

SEQ ID NO: 237565 - RNA, 60 nt, Human
cuuaaucagaccgauuuccugcccaccugaccagcccagcgugguaaaccucuguauauu

SEQ ID NO: 237566 - RNA, 60 nt, Human
gcaggcuuuccuucgcgccuccgcguccacccagcccaggaggaagacugcucugagcgu

SEQ ID NO: 237567 - RNA, 64 nt, Human; identical to SEQ ID NO: 237155

SEQ ID NO: 237568 - RNA, 64 nt, Human; identical to SEQ ID NO: 237251

SEQ ID NO: 237569 - RNA, 64 nt, Human; identical to SEQ ID NO: 237252

SEQ ID NO: 237570 - RNA, 64 nt, Human; identical to SEQ ID NO: 237253

SEQ ID NO: 237571 - RNA, 64 nt, Human; identical to SEQ ID NO: 237254

SEQ ID NO: 237572 - RNA, 64 nt, Human; identical to SEQ ID NO: 237255

SEQ ID NO: 237573 - RNA, 64 nt, Human; identical to SEQ ID NO: 237256

SEQ ID NO: 237574 - RNA, 64 nt, Human; identical to SEQ ID NO: 237257

SEQ ID NO: 237575 - RNA, 64 nt, Human; identical to SEQ ID NO: 237258

SEQ ID NO: 237576 - RNA, 64 nt, Human; identical to SEQ ID NO: 237259

SEQ ID NO: 237577 - RNA, 64 nt, Human; identical to SEQ ID NO: 237260

SEQ ID NO: 237578 - RNA, 64 nt, Human; identical to SEQ ID NO: 237261

SEQ ID NO: 237579 - RNA, 64 nt, Human; identical to SEQ ID NO: 237262

SEQ ID NO: 237580 - RNA, 64 nt, Human; identical to SEQ ID NO: 237263

SEQ ID NO: 237581 - RNA, 64 nt, Human; identical to SEQ ID NO: 237264

SEQ ID NO: 237582 - RNA, 64 nt, Human; identical to SEQ ID NO: 237265

SEQ ID NO: 237583 - RNA, 60 nt, Human
aagcaauaagagggggguuccugggggcuuccagcccaggcuagaagcccccauggcuuc

SEQ ID NO: 237584 - RNA, 60 nt, Human
ugcugcaacagacccuccccgcgccccuccccagcccaucuuacugcaagcagcguccug

SEQ ID NO: 237585 - RNA, 60 nt, Human
uccccagggguagaggcugggggcuccaccccagcccauguacguccccacgaacuggcc

SEQ ID NO: 237586 - RNA, 64 nt, Human; identical to SEQ ID NO: 237266

SEQ ID NO: 237587 - RNA, 64 nt, Human; identical to SEQ ID NO: 237267

SEQ ID NO: 237588 - RNA, 64 nt, Human; identical to SEQ ID NO: 237268

SEQ ID NO: 237589 - RNA, 64 nt, Human; identical to SEQ ID NO: 237269

SEQ ID NO: 237590 - RNA, 64 nt, Human; identical to SEQ ID NO: 237270

SEQ ID NO: 237591 - RNA, 64 nt, Human; identical to SEQ ID NO: 236945

SEQ ID NO: 237592 - RNA, 64 nt, Human; identical to SEQ ID NO: 232811

SEQ ID NO: 237593 - RNA, 64 nt, Human; identical to SEQ ID NO: 237173

SEQ ID NO: 237594 - RNA, 64 nt, Human; identical to SEQ ID NO: 237174

SEQ ID NO: 237595 - RNA, 64 nt, Human; identical to SEQ ID NO: 237175

SEQ ID NO: 237596 - RNA, 64 nt, Human; identical to SEQ ID NO: 237192

SEQ ID NO: 237597 - RNA, 54 nt, Human; identical to SEQ ID NO: 232812

SEQ ID NO: 237598 - RNA, 64 nt, Human; identical to SEQ ID NO: 237193

SEQ ID NO: 237599 - RNA, 64 nt, Human; identical to SEQ ID NO: 237194

SEQ ID NO: 237600 - RNA, 64 nt, Human; identical to SEQ ID NO: 237135

SEQ ID NO: 237601 - RNA, 64 nt, Human; identical to SEQ ID NO: 232813

SEQ ID NO: 237602 - RNA, 60 nt, Human
aaauaaguaucggaguacgugagaauauucccagcccagugaugauuugguucugaggcu

SEQ ID NO: 237603 - RNA, 60 nt, Human
augggcaugggaagaugggcucccuggcccccagcccaugccucccugggaugaagaguc

SEQ ID NO: 237604 - RNA, 60 nt, Human
ugguguuugcagucccacguggcauggccuccagcccaacccacaguggagacuggagac

SEQ ID NO: 237605 - RNA, 64 nt, Human; identical to SEQ ID NO: 237209

SEQ ID NO: 237606 - RNA, 64 nt, Human; identical to SEQ ID NO: 237210

SEQ ID NO: 237607 - RNA, 64 nt, Human; identical to SEQ ID NO: 237116

SEQ ID NO: 237608 - RNA, 64 nt, Human; identical to SEQ ID NO: 232866

SEQ ID NO: 237609 - RNA, 64 nt, Human; identical to SEQ ID NO: 236907

SEQ ID NO: 237610 - RNA, 64 nt, Human; identical to SEQ ID NO: 236908

SEQ ID NO: 237611 - RNA, 64 nt, Human; identical to SEQ ID NO: 236909

SEQ ID NO: 237612 - RNA, 64 nt, Human; identical to SEQ ID NO: 237136

SEQ ID NO: 237613 - RNA, 64 nt, Human; identical to SEQ ID NO: 237271

SEQ ID NO: 237614 - RNA, 64 nt, Human; identical to SEQ ID NO: 237272

SEQ ID NO: 237615 - RNA, 64 nt, Human; identical to SEQ ID NO: 237273

SEQ ID NO: 237616 - RNA, 64 nt, Human; identical to SEQ ID NO: 237274

SEQ ID NO: 237617 - RNA, 64 nt, Human; identical to SEQ ID NO: 237275

SEQ ID NO: 237618 - RNA, 64 nt, Human; identical to SEQ ID NO: 237276

SEQ ID NO: 237619 - RNA, 64 nt, Human; identical to SEQ ID NO: 237277

SEQ ID NO: 237620 - RNA, 64 nt, Human; identical to SEQ ID NO: 237278

SEQ ID NO: 237621 - RNA, 60 nt, Human
acccagccuguggccaggucacugucuaccccagcccagcccagcccucugccgcuugua

SEQ ID NO: 237622 - RNA, 60 nt, Human
cgggcuccacguuagcccaggcucugagagccagcccaggggcggcgcugcucagcuugg

SEQ ID NO: 237623 - RNA, 60 nt, Human
uggugaggaagcuccaguccugcucucuacccagcccaucuugccuccauggugccucug

SEQ ID NO: 237624 - RNA, 64 nt, Human; identical to SEQ ID NO: 237279

SEQ ID NO: 237625 - RNA, 64 nt, Human; identical to SEQ ID NO: 237280

SEQ ID NO: 237626 - RNA, 57 nt, Human; identical to SEQ ID NO: 237281

SEQ ID NO: 237627 - RNA, 64 nt, Human; identical to SEQ ID NO: 237282

SEQ ID NO: 237628 - RNA, 64 nt, Human; identical to SEQ ID NO: 237283

SEQ ID NO: 237629 - RNA, 64 nt, Human; identical to SEQ ID NO: 237284

SEQ ID NO: 237630 - RNA, 64 nt, Human; identical to SEQ ID NO: 237285

SEQ ID NO: 237631 - RNA, 64 nt, Human; identical to SEQ ID NO: 237286

SEQ ID NO: 237632 - RNA, 64 nt, Human; identical to SEQ ID NO: 237287

SEQ ID NO: 237633 - RNA, 64 nt, Human; identical to SEQ ID NO: 237288

SEQ ID NO: 237634 - RNA, 59 nt, Human; identical to SEQ ID NO: 237289

SEQ ID NO: 237635 - RNA, 64 nt, Human; identical to SEQ ID NO: 237290

SEQ ID NO: 237636 - RNA, 64 nt, Human; identical to SEQ ID NO: 232867

SEQ ID NO: 237637 - RNA, 64 nt, Human; identical to SEQ ID NO: 237291

SEQ ID NO: 237638 - RNA, 64 nt, Human; identical to SEQ ID NO: 237292

SEQ ID NO: 237639 - RNA, 64 nt, Human; identical to SEQ ID NO: 237293

SEQ ID NO: 237640 - RNA, 60 nt, Human
aacuucaagugcaugcucucugcagccagcccagcccagcuggugggaagcgucuguccg

SEQ ID NO: 237641 - RNA, 60 nt, Human
caccaguggccugcccucucgcucccccacccagcccacccauugaagucuccuugggcc

SEQ ID NO: 237642 - RNA, 60 nt, Human
aaucucagcucuccuaaucccaucacuuccccagcccagagaagacauuccaacccuguc

SEQ ID NO: 237643 - RNA, 64 nt, Human; identical to SEQ ID NO: 237294

SEQ ID NO: 237644 - RNA, 64 nt, Human; identical to SEQ ID NO: 237295

SEQ ID NO: 237645 - RNA, 64 nt, Human; identical to SEQ ID NO: 237296

SEQ ID NO: 237646 - RNA, 64 nt, Human; identical to SEQ ID NO: 237297

SEQ ID NO: 237647 - RNA, 64 nt, Human; identical to SEQ ID NO: 237298

SEQ ID NO: 237648 - RNA, 64 nt, Human; identical to SEQ ID NO: 237299

SEQ ID NO: 237649 - RNA, 64 nt, Human; identical to SEQ ID NO: 237300

SEQ ID NO: 237650 - RNA, 64 nt, Human; identical to SEQ ID NO: 237301

SEQ ID NO: 237651 - RNA, 64 nt, Human; identical to SEQ ID NO: 237302

SEQ ID NO: 237652 - RNA, 64 nt, Human; identical to SEQ ID NO: 237303

SEQ ID NO: 237653 - RNA, 64 nt, Human; identical to SEQ ID NO: 237304

SEQ ID NO: 237654 - RNA, 64 nt, Human; identical to SEQ ID NO: 237305

SEQ ID NO: 237655 - RNA, 64 nt, Human; identical to SEQ ID NO: 237306

SEQ ID NO: 237656 - RNA, 64 nt, Human; identical to SEQ ID NO: 237307

SEQ ID NO: 237657 - RNA, 64 nt, Human; identical to SEQ ID NO: 237308

SEQ ID NO: 237658 - RNA, 64 nt, Human; identical to SEQ ID NO: 237309

SEQ ID NO: 237659 - RNA, 60 nt, Human
uccacccugauacuuccaauuccuggaaccccagcccacucccccaucccuccucccuau

SEQ ID NO: 237660 - RNA, 60 nt, Human
ugcugggauuagaggugugagccacugugcccagcccaucaauguguuuuaaagcuagcu

SEQ ID NO: 237661 - RNA, 60 nt, Human
agccuuccgcccugguauuuggggggaugaccagcccaggcguuggguguuagucugcau

SEQ ID NO: 237662 - RNA, 64 nt, Human; identical to SEQ ID NO: 237310

SEQ ID NO: 237663 - RNA, 64 nt, Human; identical to SEQ ID NO: 236869

SEQ ID NO: 237664 - RNA, 64 nt, Human; identical to SEQ ID NO: 232868

SEQ ID NO: 237665 - RNA, 64 nt, Human; identical to SEQ ID NO: 236926

SEQ ID NO: 237666 - RNA, 64 nt, Human; identical to SEQ ID NO: 236927

SEQ ID NO: 237667 - RNA, 64 nt, Human; identical to SEQ ID NO: 236928

SEQ ID NO: 237668 - RNA, 64 nt, Human; identical to SEQ ID NO: 236946

SEQ ID NO: 237669 - RNA, 64 nt, Human; identical to SEQ ID NO: 234190

SEQ ID NO: 237670 - RNA, 64 nt, Human; identical to SEQ ID NO: 236964

SEQ ID NO: 237671 - RNA, 64 nt, Human; identical to SEQ ID NO: 236965

SEQ ID NO: 237672 - RNA, 64 nt, Human; identical to SEQ ID NO: 236966

SEQ ID NO: 237673 - RNA, 64 nt, Human; identical to SEQ ID NO: 237021

SEQ ID NO: 237674 - RNA, 64 nt, Human; identical to SEQ ID NO: 234191

SEQ ID NO: 237675 - RNA, 64 nt, Human; identical to SEQ ID NO: 237311

SEQ ID NO: 237676 - RNA, 64 nt, Human; identical to SEQ ID NO: 237312

SEQ ID NO: 237677 - RNA, 64 nt, Human; identical to SEQ ID NO: 237313

SEQ ID NO: 237678 - RNA, 60 nt, Human
ggcaaggagccaaggaccacagagccucagccagcccaggauccguccucauuuuauugg

SEQ ID NO: 237679 - RNA, 60 nt, Human
ggaugagcuggcgucuauucugcccacaccccagcccaaccugcccacguucucuauugu

SEQ ID NO: 237680 - RNA, 60 nt, Human
ggcguaggagggugggcuggcgguacccacccagcccaagggagucacagugccuuagaa

SEQ ID NO: 237681 - RNA, 64 nt, Human; identical to SEQ ID NO: 237314

SEQ ID NO: 237682 - RNA, 64 nt, Human; identical to SEQ ID NO: 237315

SEQ ID NO: 237683 - RNA, 64 nt, Human; identical to SEQ ID NO: 237316

SEQ ID NO: 237684 - RNA, 64 nt, Human; identical to SEQ ID NO: 237317

SEQ ID NO: 237685 - RNA, 64 nt, Human; identical to SEQ ID NO: 237318

SEQ ID NO: 237686 - RNA, 64 nt, Human; identical to SEQ ID NO: 237319

SEQ ID NO: 237687 - RNA, 64 nt, Human; identical to SEQ ID NO: 237320

SEQ ID NO: 237688 - RNA, 64 nt, Human; identical to SEQ ID NO: 237321

SEQ ID NO: 237689 - RNA, 64 nt, Human; identical to SEQ ID NO: 237322

SEQ ID NO: 237690 - RNA, 64 nt, Human; identical to SEQ ID NO: 237323

SEQ ID NO: 237691 - RNA, 64 nt, Human; identical to SEQ ID NO: 237324

SEQ ID NO: 237692 - RNA, 64 nt, Human; identical to SEQ ID NO: 237325

SEQ ID NO: 237693 - RNA, 64 nt, Human; identical to SEQ ID NO: 237326

SEQ ID NO: 237694 - RNA, 64 nt, Human; identical to SEQ ID NO: 237327

SEQ ID NO: 237695 - RNA, 64 nt, Human; identical to SEQ ID NO: 237328

SEQ ID NO: 237696 - RNA, 64 nt, Human; identical to SEQ ID NO: 237329

SEQ ID NO: 237697 - RNA, 60 nt, Human
ccaagugaaggacccccuccccaacaugccccagcccaccccuaagcauggucccuuguc

SEQ ID NO: 237698 - RNA, 60 nt, Human
gaauggaugggggacagugaggaggacacaccagcccauuaguuguuaaucaucaaucac

SEQ ID NO: 237699 - RNA, 60 nt, Human
caagggaaucagggacaaaggcccuuccugccagcccaugaucccgggauuggcucucuu

SEQ ID NO: 237700 - RNA, 64 nt, Human; identical to SEQ ID NO: 237330

SEQ ID NO: 237701 - RNA, 64 nt, Human; identical to SEQ ID NO: 237117

SEQ ID NO: 237702 - RNA, 64 nt, Human; identical to SEQ ID NO: 237331

SEQ ID NO: 237703 - RNA, 64 nt, Human; identical to SEQ ID NO: 237332

SEQ ID NO: 237704 - RNA, 64 nt, Human; identical to SEQ ID NO: 237333

SEQ ID NO: 237705 - RNA, 64 nt, Human; identical to SEQ ID NO: 237334

SEQ ID NO: 237706 - RNA, 64 nt, Human; identical to SEQ ID NO: 237335

SEQ ID NO: 237707 - RNA, 62 nt, Human; identical to SEQ ID NO: 237336

SEQ ID NO: 237708 - RNA, 64 nt, Human; identical to SEQ ID NO: 237337

SEQ ID NO: 237709 - RNA, 64 nt, Human; identical to SEQ ID NO: 237338

SEQ ID NO: 237710 - RNA, 64 nt, Human; identical to SEQ ID NO: 237339

SEQ ID NO: 237711 - RNA, 64 nt, Human; identical to SEQ ID NO: 237340

SEQ ID NO: 237712 - RNA, 64 nt, Human; identical to SEQ ID NO: 237341

SEQ ID NO: 237713 - RNA, 64 nt, Human; identical to SEQ ID NO: 237342

SEQ ID NO: 237714 - RNA, 64 nt, Human; identical to SEQ ID NO: 237343

SEQ ID NO: 237715 - RNA, 64 nt, Human; identical to SEQ ID NO: 237344

SEQ ID NO: 237716 - RNA, 60 nt, Human
ggcuccugggcagauggggucaaggcugggccagcccagaugaagccuaugggagucagg

SEQ ID NO: 237717 - RNA, 60 nt, Human
ucagacaaaggcaaggccucgugccccugcccagcccauucauggagcccugggccuucu

SEQ ID NO: 237718 - RNA, 60 nt, Human
gcagaaccauuaacccuacacaagaacacuccagcccaaaaccgugaggaaggugauaua

SEQ ID NO: 237719 - RNA, 64 nt, Human; identical to SEQ ID NO: 237345

SEQ ID NO: 237720 - RNA, 57 nt, Human; identical to SEQ ID NO: 237346

SEQ ID NO: 237721 - RNA, 63 nt, Human; identical to SEQ ID NO: 237347

SEQ ID NO: 237722 - RNA, 64 nt, Human; identical to SEQ ID NO: 237351

SEQ ID NO: 237723 - RNA, 64 nt, Human; identical to SEQ ID NO: 237352

SEQ ID NO: 237724 - RNA, 64 nt, Human; identical to SEQ ID NO: 237353

SEQ ID NO: 237725 - RNA, 64 nt, Human; identical to SEQ ID NO: 237354

SEQ ID NO: 237726 - RNA, 64 nt, Human; identical to SEQ ID NO: 237355

SEQ ID NO: 237727 - RNA, 64 nt, Human; identical to SEQ ID NO: 237356

SEQ ID NO: 237728 - RNA, 64 nt, Human; identical to SEQ ID NO: 237357

SEQ ID NO: 237729 - RNA, 64 nt, Human; identical to SEQ ID NO: 237358

SEQ ID NO: 237730 - RNA, 64 nt, Human; identical to SEQ ID NO: 237359

SEQ ID NO: 237731 - RNA, 64 nt, Human; identical to SEQ ID NO: 237360

SEQ ID NO: 237732 - RNA, 64 nt, Human; identical to SEQ ID NO: 237361

SEQ ID NO: 237733 - RNA, 64 nt, Human; identical to SEQ ID NO: 237362

SEQ ID NO: 237734 - RNA, 64 nt, Human; identical to SEQ ID NO: 237363

SEQ ID NO: 237735 - RNA, 60 nt, Human
ucccuguccacccugccccaucuggccggcccagcccaguccaggaccuggcuggaugcu

SEQ ID NO: 237736 - RNA, 60 nt, Human
uggacaccaacuuuagucuugggcugcaagccagcccagcugaggcgaaguggacuccag

SEQ ID NO: 237737 - RNA, 60 nt, Human
caguggcccucgcgagcgccuggacaucuaccagcccacggcgcgcuucugccugcguuc

SEQ ID NO: 237738 - RNA, 64 nt, Human; identical to SEQ ID NO: 237364

SEQ ID NO: 237739 - RNA, 64 nt, Human; identical to SEQ ID NO: 237365

SEQ ID NO: 237740 - RNA, 64 nt, Human; identical to SEQ ID NO: 237366

SEQ ID NO: 237741 - RNA, 64 nt, Human; identical to SEQ ID NO: 237367

SEQ ID NO: 237742 - RNA, 64 nt, Human; identical to SEQ ID NO: 237368

SEQ ID NO: 237743 - RNA, 64 nt, Human; identical to SEQ ID NO: 237369

SEQ ID NO: 237744 - RNA, 64 nt, Human; identical to SEQ ID NO: 237370

SEQ ID NO: 237745 - RNA, 64 nt, Human; identical to SEQ ID NO: 234192

SEQ ID NO: 237746 - RNA, 64 nt, Human; identical to SEQ ID NO: 236983

SEQ ID NO: 237747 - RNA, 64 nt, Human; identical to SEQ ID NO: 237371

SEQ ID NO: 237748 - RNA, 64 nt, Human; identical to SEQ ID NO: 237372

SEQ ID NO: 237749 - RNA, 64 nt, Human; identical to SEQ ID NO: 237373

SEQ ID NO: 237750 - RNA, 64 nt, Human; identical to SEQ ID NO: 237374

SEQ ID NO: 237751 - RNA, 64 nt, Human; identical to SEQ ID NO: 237375

SEQ ID NO: 237752 - RNA, 64 nt, Human; identical to SEQ ID NO: 237376

SEQ ID NO: 237753 - RNA, 64 nt, Human; identical to SEQ ID NO: 237377

SEQ ID NO: 237754 - RNA, 60 nt, Human
cuacgcugaggacggagaccgcggcaucaaccagcccaucaucuacagcaucuuuagggg

SEQ ID NO: 237755 - RNA, 60 nt, Human
uuuuuaggggugggucaggguugugacacaccagcccaggugagagcugcugcgggucac

SEQ ID NO: 237756 - RNA, 57 nt, Human
ccuggcuagaggagcagugagcugcucccagcccaacuuggcuaucaagaaagacau

SEQ ID NO: 237757 - RNA, 64 nt, Human; identical to SEQ ID NO: 237378

SEQ ID NO: 237758 - RNA, 64 nt, Human; identical to SEQ ID NO: 237379

SEQ ID NO: 237759 - RNA, 64 nt, Human; identical to SEQ ID NO: 237380

SEQ ID NO: 237760 - RNA, 64 nt, Human; identical to SEQ ID NO: 237381

SEQ ID NO: 237761 - RNA, 64 nt, Human; identical to SEQ ID NO: 237382

SEQ ID NO: 237762 - RNA, 64 nt, Human; identical to SEQ ID NO: 237383

SEQ ID NO: 237763 - RNA, 64 nt, Human; identical to SEQ ID NO: 237384

SEQ ID NO: 237764 - RNA, 64 nt, Human; identical to SEQ ID NO: 237385

SEQ ID NO: 237765 - RNA, 64 nt, Human; identical to SEQ ID NO: 237386

SEQ ID NO: 237766 - RNA, 64 nt, Human; identical to SEQ ID NO: 237387

SEQ ID NO: 237767 - RNA, 64 nt, Human; identical to SEQ ID NO: 237388

SEQ ID NO: 237768 - RNA, 64 nt, Human; identical to SEQ ID NO: 237389

SEQ ID NO: 237769 - RNA, 64 nt, Human; identical to SEQ ID NO: 237390

SEQ ID NO: 237770 - RNA, 64 nt, Human; identical to SEQ ID NO: 236870

SEQ ID NO: 237771 - RNA, 64 nt, Human; identical to SEQ ID NO: 237391

SEQ ID NO: 237772 - RNA, 64 nt, Human; identical to SEQ ID NO: 237392

SEQ ID NO: 237773 - RNA, 60 nt, Human
ugcugggaucacaggcgugagccacugcgcccagcccacugcuaguuugacuuuuuauaa

SEQ ID NO: 237774 - RNA, 60 nt, Human
aaauaggaauguuguucucaagugucaccuccagcccagaggugguuccuuaggcagcau

SEQ ID NO: 237775 - RNA, 60 nt, Human
ucgccaugugcguuucucuuguuuuuuuugccagcccaaugguaguuucugaaccuauug

SEQ ID NO: 237776 - RNA, 64 nt, Human; identical to SEQ ID NO: 237393

SEQ ID NO: 237777 - RNA, 60 nt, Human; identical to SEQ ID NO: 237394

SEQ ID NO: 237778 - RNA, 64 nt, Human; identical to SEQ ID NO: 237395

SEQ ID NO: 237779 - RNA, 64 nt, Human; identical to SEQ ID NO: 237396

SEQ ID NO: 237780 - RNA, 64 nt, Human; identical to SEQ ID NO: 237397

SEQ ID NO: 237781 - RNA, 64 nt, Human; identical to SEQ ID NO: 237398

SEQ ID NO: 237782 - RNA, 64 nt, Human; identical to SEQ ID NO: 237399

SEQ ID NO: 237783 - RNA, 64 nt, Human; identical to SEQ ID NO: 237400

SEQ ID NO: 237784 - RNA, 64 nt, Human; identical to SEQ ID NO: 237401

SEQ ID NO: 237785 - RNA, 64 nt, Human; identical to SEQ ID NO: 237402

SEQ ID NO: 237786 - RNA, 64 nt, Human; identical to SEQ ID NO: 237403

SEQ ID NO: 237787 - RNA, 64 nt, Human; identical to SEQ ID NO: 237404

SEQ ID NO: 237788 - RNA, 64 nt, Human; identical to SEQ ID NO: 237405

SEQ ID NO: 237789 - RNA, 64 nt, Human; identical to SEQ ID NO: 237406

SEQ ID NO: 237790 - RNA, 64 nt, Human; identical to SEQ ID NO: 237407

SEQ ID NO: 237791 - RNA, 64 nt, Human; identical to SEQ ID NO: 237408

SEQ ID NO: 237792 - RNA, 60 nt, Human
cagagcccguacuguggggauccucacugaccagcccagccccauccgcaagccaggcug

SEQ ID NO: 237793 - RNA, 60 nt, Human
ugggcccucgcuccugacuguugcugcuccccagcccauggacaggagauccuggguugg

SEQ ID NO: 237794 - RNA, 60 nt, Human
guccuauguccuauuugaguggcagcagcgccagcccagcaagaaggcuggggguuguca

SEQ ID NO: 237795 - RNA, 64 nt, Human; identical to SEQ ID NO: 237409

SEQ ID NO: 237796 - RNA, 64 nt, Human; identical to SEQ ID NO: 237410

SEQ ID NO: 237797 - RNA, 64 nt, Human; identical to SEQ ID NO: 234208

SEQ ID NO: 237798 - RNA, 64 nt, Human; identical to SEQ ID NO: 237002

SEQ ID NO: 237799 - RNA, 64 nt, Human; identical to SEQ ID NO: 237003

SEQ ID NO: 237800 - RNA, 64 nt, Human; identical to SEQ ID NO: 237411

SEQ ID NO: 237801 - RNA, 64 nt, Human; identical to SEQ ID NO: 237412

SEQ ID NO: 237802 - RNA, 64 nt, Human; identical to SEQ ID NO: 237413

SEQ ID NO: 237803 - RNA, 64 nt, Human; identical to SEQ ID NO: 237414

SEQ ID NO: 237804 - RNA, 64 nt, Human; identical to SEQ ID NO: 237415

SEQ ID NO: 237805 - RNA, 64 nt, Human; identical to SEQ ID NO: 237416

SEQ ID NO: 237806 - RNA, 64 nt, Human; identical to SEQ ID NO: 237417

SEQ ID NO: 237807 - RNA, 64 nt, Human; identical to SEQ ID NO: 237418

SEQ ID NO: 237808 - RNA, 64 nt, Human; identical to SEQ ID NO: 237419

SEQ ID NO: 237809 - RNA, 64 nt, Human; identical to SEQ ID NO: 237420

SEQ ID NO: 237810 - RNA, 64 nt, Human; identical to SEQ ID NO: 237421

SEQ ID NO: 237811 - RNA, 60 nt, Human
gcaaacccucuuuauugaacauuagccagcccagcccagaccccagggcugccuaaggac

SEQ ID NO: 237812 - RNA, 60 nt, Human
ccucugcccccacagauccuauccuccaagccagcccaccucugccuucaucauauccca

SEQ ID NO: 237813 - RNA, 60 nt, Human
gucccccaacucugagcccauguucugcccccagcccaaaggggacaggccucaccucua

SEQ ID NO: 237814 - RNA, 64 nt, Human; identical to SEQ ID NO: 237422

SEQ ID NO: 237815 - RNA, 64 nt, Human; identical to SEQ ID NO: 237423

SEQ ID NO: 237816 - RNA, 64 nt, Human; identical to SEQ ID NO: 237424

SEQ ID NO: 237817 - RNA, 64 nt, Human; identical to SEQ ID NO: 237425

SEQ ID NO: 237818 - RNA, 64 nt, Human; identical to SEQ ID NO: 237426

SEQ ID NO: 237819 - RNA, 64 nt, Human; identical to SEQ ID NO: 237427

SEQ ID NO: 237820 - RNA, 64 nt, Human; identical to SEQ ID NO: 237431

SEQ ID NO: 237821 - RNA, 64 nt, Human; identical to SEQ ID NO: 237432

SEQ ID NO: 237822 - RNA, 64 nt, Human; identical to SEQ ID NO: 237433

SEQ ID NO: 237823 - RNA, 64 nt, Human; identical to SEQ ID NO: 237434

SEQ ID NO: 237824 - RNA, 64 nt, Human; identical to SEQ ID NO: 237435

SEQ ID NO: 237825 - RNA, 64 nt, Human; identical to SEQ ID NO: 237436

SEQ ID NO: 237826 - RNA, 56 nt, Human; identical to SEQ ID NO: 237437

SEQ ID NO: 237827 - RNA, 64 nt, Human; identical to SEQ ID NO: 237438

SEQ ID NO: 237828 - RNA, 64 nt, Human; identical to SEQ ID NO: 237439

SEQ ID NO: 237829 - RNA, 64 nt, Human; identical to SEQ ID NO: 237440

SEQ ID NO: 237830 - RNA, 60 nt, Human
uccaggaagcccagggcaccauccagcuccccagcccaccugcucccaggccccaggccu

SEQ ID NO: 237831 - RNA, 60 nt, Human
cuucucgacgucuccuuccggagcugagauccagcccagggcgaauggcgagcuuggcuc

SEQ ID NO: 237832 - RNA, 60 nt, Human
uucccaagaugccauggcuggacuggacccccagcccacaugaccaugccucagacuguc

SEQ ID NO: 237833 - RNA, 64 nt, Human; identical to SEQ ID NO: 237441

SEQ ID NO: 237834 - RNA, 64 nt, Human; identical to SEQ ID NO: 237442

SEQ ID NO: 237835 - RNA, 64 nt, Human; identical to SEQ ID NO: 237443

SEQ ID NO: 237836 - RNA, 64 nt, Human; identical to SEQ ID NO: 237444

SEQ ID NO: 237837 - RNA, 64 nt, Human; identical to SEQ ID NO: 237445

SEQ ID NO: 237838 - RNA, 64 nt, Human; identical to SEQ ID NO: 237446

SEQ ID NO: 237839 - RNA, 64 nt, Human; identical to SEQ ID NO: 237447

SEQ ID NO: 237840 - RNA, 64 nt, Human; identical to SEQ ID NO: 237451

SEQ ID NO: 237841 - RNA, 64 nt, Human; identical to SEQ ID NO: 237452

SEQ ID NO: 237842 - RNA, 64 nt, Human; identical to SEQ ID NO: 237453

SEQ ID NO: 237843 - RNA, 64 nt, Human; identical to SEQ ID NO: 237454

SEQ ID NO: 237844 - RNA, 64 nt, Human; identical to SEQ ID NO: 237455

SEQ ID NO: 237845 - RNA, 64 nt, Human; identical to SEQ ID NO: 237456

SEQ ID NO: 237846 - RNA, 64 nt, Human; identical to SEQ ID NO: 237457

SEQ ID NO: 237847 - RNA, 64 nt, Human; identical to SEQ ID NO: 237458

SEQ ID NO: 237848 - RNA, 64 nt, Human; identical to SEQ ID NO: 237459

SEQ ID NO: 237849 - RNA, 60 nt, Human
auacagauagguaaagaguuccaaguucguccagcccaugugcaaagucaacaguauuug

SEQ ID NO: 237850 - RNA, 60 nt, Human
cgugcaggccuggccgugguucgcuccccgccagcccacgugccccagaagggccggccu

SEQ ID NO: 237851 - RNA, 60 nt, Human
gcugggauuaacgggugugagccacggcgcccagcccaggaagaguuuuuaaauuagagc

SEQ ID NO: 237852 - RNA, 64 nt, Human; identical to SEQ ID NO: 237460

SEQ ID NO: 237853 - RNA, 64 nt, Human; identical to SEQ ID NO: 237461

SEQ ID NO: 237854 - RNA, 64 nt, Human; identical to SEQ ID NO: 237462

SEQ ID NO: 237855 - RNA, 64 nt, Human; identical to SEQ ID NO: 237463

SEQ ID NO: 237856 - RNA, 64 nt, Human; identical to SEQ ID NO: 237464

SEQ ID NO: 237857 - RNA, 64 nt, Human; identical to SEQ ID NO: 237465

SEQ ID NO: 237858 - RNA, 64 nt, Human; identical to SEQ ID NO: 237466

SEQ ID NO: 237859 - RNA, 64 nt, Human; identical to SEQ ID NO: 237467

SEQ ID NO: 237860 - RNA, 64 nt, Human; identical to SEQ ID NO: 237471

SEQ ID NO: 237861 - RNA, 64 nt, Human; identical to SEQ ID NO: 237472

SEQ ID NO: 237862 - RNA, 64 nt, Human; identical to SEQ ID NO: 237473

SEQ ID NO: 237863 - RNA, 64 nt, Human; identical to SEQ ID NO: 237474

SEQ ID NO: 237864 - RNA, 64 nt, Human; identical to SEQ ID NO: 237475

SEQ ID NO: 237865 - RNA, 64 nt, Human; identical to SEQ ID NO: 237476

SEQ ID NO: 237866 - RNA, 64 nt, Human; identical to SEQ ID NO: 237477

SEQ ID NO: 237867 - RNA, 64 nt, Human; identical to SEQ ID NO: 237478

SEQ ID NO: 237868 - RNA, 60 nt, Human
ccuuggcggcaaaagcccauugaagaagaaccagcccagccugcccccuaucuuguccug

SEQ ID NO: 237869 - RNA, 60 nt, Human
ggcggcuccagcagggucugguuaagggguccagcccagcacuggaccauuccgucuccu

SEQ ID NO: 237870 - RNA, 60 nt, Human
ucacguguccuuacagaaucauuccaagaaccagcccauugcuacagcuagaguggagaa

SEQ ID NO: 237871 - RNA, 64 nt, Human; identical to SEQ ID NO: 237479

SEQ ID NO: 237872 - RNA, 64 nt, Human; identical to SEQ ID NO: 237480

SEQ ID NO: 237873 - RNA, 64 nt, Human; identical to SEQ ID NO: 237481

SEQ ID NO: 237874 - RNA, 64 nt, Human; identical to SEQ ID NO: 237482

SEQ ID NO: 237875 - RNA, 64 nt, Human; identical to SEQ ID NO: 237483

SEQ ID NO: 237876 - RNA, 64 nt, Human; identical to SEQ ID NO: 237484

SEQ ID NO: 237877 - RNA, 64 nt, Human; identical to SEQ ID NO: 237485

SEQ ID NO: 237878 - RNA, 64 nt, Human; identical to SEQ ID NO: 237486

SEQ ID NO: 237879 - RNA, 64 nt, Human; identical to SEQ ID NO: 237487

SEQ ID NO: 237880 - RNA, 64 nt, Human; identical to SEQ ID NO: 237488

SEQ ID NO: 237881 - RNA, 64 nt, Human; identical to SEQ ID NO: 237489

SEQ ID NO: 237882 - RNA, 64 nt, Human; identical to SEQ ID NO: 237491

SEQ ID NO: 237883 - RNA, 64 nt, Human; identical to SEQ ID NO: 237492

SEQ ID NO: 237884 - RNA, 64 nt, Human; identical to SEQ ID NO: 237493

SEQ ID NO: 237885 - RNA, 64 nt, Human; identical to SEQ ID NO: 237494

SEQ ID NO: 237886 - RNA, 64 nt, Human; identical to SEQ ID NO: 237495

SEQ ID NO: 237887 - RNA, 60 nt, Human
auugaauuuucaagugcugguuggcugucgccagcccaugguaggaggggaggaauggcu

SEQ ID NO: 237888 - RNA, 60 nt, Human
aucagagcacagguagacacacgggcauagccagcccacuccuacugucacaggcgcccc

SEQ ID NO: 237889 - RNA, 60 nt, Human
gcagaagccagaacacauggcugggccuuuccagcccaacccacugucuugcaguggacg

SEQ ID NO: 237890 - RNA, 64 nt, Human; identical to SEQ ID NO: 237496

SEQ ID NO: 237891 - RNA, 64 nt, Human; identical to SEQ ID NO: 237497

SEQ ID NO: 237892 - RNA, 61 nt, Human; identical to SEQ ID NO: 237498

SEQ ID NO: 237893 - RNA, 64 nt, Human; identical to SEQ ID NO: 237499

SEQ ID NO: 237894 - RNA, 64 nt, Human; identical to SEQ ID NO: 237500

SEQ ID NO: 237895 - RNA, 64 nt, Human; identical to SEQ ID NO: 237501

SEQ ID NO: 237896 - RNA, 64 nt, Human; identical to SEQ ID NO: 237502

SEQ ID NO: 237897 - RNA, 64 nt, Human; identical to SEQ ID NO: 237503

SEQ ID NO: 237898 - RNA, 64 nt, Human; identical to SEQ ID NO: 237504

SEQ ID NO: 237899 - RNA, 64 nt, Human; identical to SEQ ID NO: 237505

SEQ ID NO: 237900 - RNA, 64 nt, Human; identical to SEQ ID NO: 237506

SEQ ID NO: 237901 - RNA, 64 nt, Human; identical to SEQ ID NO: 237507

SEQ ID NO: 237902 - RNA, 64 nt, Human; identical to SEQ ID NO: 237205

SEQ ID NO: 237903 - RNA, 64 nt, Human; identical to SEQ ID NO: 237206

SEQ ID NO: 237904 - RNA, 64 nt, Human; identical to SEQ ID NO: 237207

SEQ ID NO: 237905 - RNA, 57 nt, Human
agucuccuguugcccacugacacugccccagcccagccccagccucugcucuuuuga

SEQ ID NO: 237906 - RNA, 60 nt, Human
uggguguuagugucagccaugggaaaugagccagcccaagggcaucauccucagcagcau

SEQ ID NO: 237907 - RNA, 60 nt, Human
ccggaguacacagugacccaggagucugggccagcccaccgcaaagaauucaccaugacc

SEQ ID NO: 237908 - RNA, 64 nt, Human; identical to SEQ ID NO: 237208

SEQ ID NO: 237909 - RNA, 64 nt, Human; identical to SEQ ID NO: 237211

SEQ ID NO: 237910 - RNA, 64 nt, Human; identical to SEQ ID NO: 237212

SEQ ID NO: 237911 - RNA, 64 nt, Human; identical to SEQ ID NO: 237213

SEQ ID NO: 237912 - RNA, 64 nt, Human; identical to SEQ ID NO: 237214

SEQ ID NO: 237913 - RNA, 64 nt, Human; identical to SEQ ID NO: 237215

SEQ ID NO: 237914 - RNA, 64 nt, Human; identical to SEQ ID NO: 237216

SEQ ID NO: 237915 - RNA, 64 nt, Human; identical to SEQ ID NO: 237217

SEQ ID NO: 237916 - RNA, 64 nt, Human; identical to SEQ ID NO: 237218

SEQ ID NO: 237917 - RNA, 64 nt, Human; identical to SEQ ID NO: 237219

SEQ ID NO: 237918 - RNA, 64 nt, Human; identical to SEQ ID NO: 237220

SEQ ID NO: 237919 - RNA, 64 nt, Human; identical to SEQ ID NO: 237221

SEQ ID NO: 237920 - RNA, 64 nt, Human; identical to SEQ ID NO: 237222

SEQ ID NO: 237921 - RNA, 64 nt, Human; identical to SEQ ID NO: 237223

SEQ ID NO: 237922 - RNA, 64 nt, Human; identical to SEQ ID NO: 237224

SEQ ID NO: 237923 - RNA, 64 nt, Human; identical to SEQ ID NO: 237225

SEQ ID NO: 237924 - RNA, 60 nt, Human
gccaaaggugcaauuacuugaccugcagccccagcccacccucggcucugcagccgguuc

SEQ ID NO: 237925 - RNA, 60 nt, Human
agcagcccgaccacaggagcauggccgcugccagcccagacgcugcugacgcuguguaaa

SEQ ID NO: 237926 - RNA, 60 nt, Human
cugagcuggcugacuaagccccgucugaccccagcccagacagcaagguguggaggcucc

SEQ ID NO: 237927 - RNA, 64 nt, Human; identical to SEQ ID NO: 237226

SEQ ID NO: 237928 - RNA, 64 nt, Human; identical to SEQ ID NO: 237227

SEQ ID NO: 237929 - RNA, 64 nt, Human; identical to SEQ ID NO: 237228

SEQ ID NO: 237930 - RNA, 64 nt, Human; identical to SEQ ID NO: 237229

SEQ ID NO: 237931 - RNA, 64 nt, Human; identical to SEQ ID NO: 237230

SEQ ID NO: 237932 - RNA, 64 nt, Human; identical to SEQ ID NO: 237231

SEQ ID NO: 237933 - RNA, 64 nt, Human; identical to SEQ ID NO: 237232

SEQ ID NO: 237934 - RNA, 64 nt, Human; identical to SEQ ID NO: 237233

SEQ ID NO: 237935 - RNA, 64 nt, Human; identical to SEQ ID NO: 237234

SEQ ID NO: 237936 - RNA, 64 nt, Human; identical to SEQ ID NO: 237235

SEQ ID NO: 237937 - RNA, 64 nt, Human; identical to SEQ ID NO: 237236

SEQ ID NO: 237938 - RNA, 64 nt, Human; identical to SEQ ID NO: 237237

SEQ ID NO: 237939 - RNA, 64 nt, Human; identical to SEQ ID NO: 237238

SEQ ID NO: 237940 - RNA, 64 nt, Human; identical to SEQ ID NO: 237239

SEQ ID NO: 237941 - RNA, 64 nt, Human; identical to SEQ ID NO: 237240

SEQ ID NO: 237942 - RNA, 64 nt, Human; identical to SEQ ID NO: 237241

SEQ ID NO: 237943 - RNA, 60 nt, Human
agugggccaggcugcccuccaugcugggccccagcccaggucugcacucgccuggaucac

SEQ ID NO: 237944 - RNA, 60 nt, Human
gaugggcagcugcgccugccugcucggcccccagcccacccagccaaaaauacagcuggg

SEQ ID NO: 237945 - RNA, 60 nt, Human
ccugccuagccccucugccccagcaaaugcccagcccaggcaaauuguauuuaaagaauc

SEQ ID NO: 237946 - RNA, 64 nt, Human; identical to SEQ ID NO: 237242

SEQ ID NO: 237947 - RNA, 64 nt, Human; identical to SEQ ID NO: 237243

SEQ ID NO: 237948 - RNA, 64 nt, Human; identical to SEQ ID NO: 237244

SEQ ID NO: 237949 - RNA, 64 nt, Human; identical to SEQ ID NO: 237245

SEQ ID NO: 237950 - RNA, 64 nt, Human; identical to SEQ ID NO: 237246

SEQ ID NO: 237951 - RNA, 64 nt, Human; identical to SEQ ID NO: 237247

SEQ ID NO: 237952 - RNA, 64 nt, Human; identical to SEQ ID NO: 237248

SEQ ID NO: 237953 - RNA, 64 nt, Human; identical to SEQ ID NO: 237249

SEQ ID NO: 237954 - RNA, 64 nt, Human; identical to SEQ ID NO: 237250

SEQ ID NO: 237955 - RNA, 64 nt, Human; identical to SEQ ID NO: 235268

SEQ ID NO: 237956 - RNA, 64 nt, Human; identical to SEQ ID NO: 232794

SEQ ID NO: 237957 - RNA, 64 nt, Human; identical to SEQ ID NO: 237154

SEQ ID NO: 237958 - RNA, 64 nt, Human; identical to SEQ ID NO: 237155

SEQ ID NO: 237959 - RNA, 64 nt, Human; identical to SEQ ID NO: 237251

SEQ ID NO: 237960 - RNA, 64 nt, Human; identical to SEQ ID NO: 237252

SEQ ID NO: 237961 - RNA, 64 nt, Human; identical to SEQ ID NO: 237253

SEQ ID NO: 237962 - RNA, 60 nt, Human
ggaccguuccagaaaucccaacucucacacccagcccaggcugcagucuccacaccaaac

SEQ ID NO: 237963 - RNA, 60 nt, Human
ugcugggauuacagguguaagucacuguacccagcccaaaagcaguuuaaaaaaaaaaaa

SEQ ID NO: 237964 - RNA, 60 nt, Human
ccgacugcuaugauguuuacuacagugaacccagcccaugguaaacacaggcuucaccug

SEQ ID NO: 237965 - RNA, 64 nt, Human; identical to SEQ ID NO: 237254

SEQ ID NO: 237966 - RNA, 64 nt, Human; identical to SEQ ID NO: 237255

SEQ ID NO: 237967 - RNA, 64 nt, Human; identical to SEQ ID NO: 237256

SEQ ID NO: 237968 - RNA, 64 nt, Human; identical to SEQ ID NO: 237257

SEQ ID NO: 237969 - RNA, 64 nt, Human; identical to SEQ ID NO: 237258

SEQ ID NO: 237970 - RNA, 64 nt, Human; identical to SEQ ID NO: 237259

SEQ ID NO: 237971 - RNA, 64 nt, Human; identical to SEQ ID NO: 237260

SEQ ID NO: 237972 - RNA, 64 nt, Human; identical to SEQ ID NO: 237261

SEQ ID NO: 237973 - RNA, 64 nt, Human; identical to SEQ ID NO: 237262

SEQ ID NO: 237974 - RNA, 64 nt, Human; identical to SEQ ID NO: 237263

SEQ ID NO: 237975 - RNA, 64 nt, Human; identical to SEQ ID NO: 237264

SEQ ID NO: 237976 - RNA, 64 nt, Human; identical to SEQ ID NO: 237265

SEQ ID NO: 237977 - RNA, 64 nt, Human; identical to SEQ ID NO: 237266

SEQ ID NO: 237978 - RNA, 64 nt, Human; identical to SEQ ID NO: 237267

SEQ ID NO: 237979 - RNA, 64 nt, Human; identical to SEQ ID NO: 237268

SEQ ID NO: 237980 - RNA, 64 nt, Human; identical to SEQ ID NO: 237269

SEQ ID NO: 237981 - RNA, 60 nt, Human
ugcugucccggugucaccugcuuccaucucccagcccaccagcccucugcccaccucaca

SEQ ID NO: 237982 - RNA, 60 nt, Human
gguguggucaagcccucgucuagagcagacccagcccagaccucugacacauuagccuug

SEQ ID NO: 237983 - RNA, 60 nt, Human
aacacacuuccccacccaccguccuccauuccagcccaggcuucuccaucacccauuccu

SEQ ID NO: 237984 - RNA, 64 nt, Human; identical to SEQ ID NO: 237270

SEQ ID NO: 237985 - RNA, 64 nt, Human; identical to SEQ ID NO: 236945

SEQ ID NO: 237986 - RNA, 64 nt, Human; identical to SEQ ID NO: 232811

SEQ ID NO: 237987 - RNA, 64 nt, Human; identical to SEQ ID NO: 237173

SEQ ID NO: 237988 - RNA, 64 nt, Human; identical to SEQ ID NO: 237174

SEQ ID NO: 237989 - RNA, 64 nt, Human; identical to SEQ ID NO: 237175

SEQ ID NO: 237990 - RNA, 64 nt, Human; identical to SEQ ID NO: 237192

SEQ ID NO: 237991 - RNA, 54 nt, Human; identical to SEQ ID NO: 232812

SEQ ID NO: 237992 - RNA, 64 nt, Human; identical to SEQ ID NO: 237193

SEQ ID NO: 237993 - RNA, 64 nt, Human; identical to SEQ ID NO: 237194

SEQ ID NO: 237994 - RNA, 64 nt, Human; identical to SEQ ID NO: 237135

SEQ ID NO: 237995 - RNA, 64 nt, Human; identical to SEQ ID NO: 232813

SEQ ID NO: 237996 - RNA, 64 nt, Human; identical to SEQ ID NO: 237209

SEQ ID NO: 237997 - RNA, 64 nt, Human; identical to SEQ ID NO: 237210

SEQ ID NO: 237998 - RNA, 64 nt, Human; identical to SEQ ID NO: 237116

SEQ ID NO: 237999 - RNA, 64 nt, Human; identical to SEQ ID NO: 232866

SEQ ID NO: 238000 - RNA, 60 nt, Human
gugacagagcccagagcaaacagggccaggccagcccaaauccagugaccuccucuucac

SEQ ID NO: 238001 - RNA, 60 nt, Human
ucggcucuggccuccaaguccacaguggaaccagcccagacccuucuccuuagaagugga

SEQ ID NO: 238002 - RNA, 60 nt, Human
cuccccuucccugcccagugccccuccuccccagcccagacccccaggugcccaaggccu

SEQ ID NO: 238003 - RNA, 64 nt, Human; identical to SEQ ID NO: 236907

SEQ ID NO: 238004 - RNA, 64 nt, Human; identical to SEQ ID NO: 236908

SEQ ID NO: 238005 - RNA, 64 nt, Human; identical to SEQ ID NO: 236909

SEQ ID NO: 238006 - RNA, 64 nt, Human; identical to SEQ ID NO: 237136

SEQ ID NO: 238007 - RNA, 64 nt, Human; identical to SEQ ID NO: 237271

SEQ ID NO: 238008 - RNA, 64 nt, Human; identical to SEQ ID NO: 237272

SEQ ID NO: 238009 - RNA, 64 nt, Human; identical to SEQ ID NO: 237273

SEQ ID NO: 238010 - RNA, 64 nt, Human; identical to SEQ ID NO: 237274

SEQ ID NO: 238011 - RNA, 64 nt, Human; identical to SEQ ID NO: 237275

SEQ ID NO: 238012 - RNA, 64 nt, Human; identical to SEQ ID NO: 237276

SEQ ID NO: 238013 - RNA, 64 nt, Human; identical to SEQ ID NO: 237277

SEQ ID NO: 238014 - RNA, 64 nt, Human; identical to SEQ ID NO: 237278

SEQ ID NO: 238015 - RNA, 64 nt, Human; identical to SEQ ID NO: 237279

SEQ ID NO: 238016 - RNA, 64 nt, Human; identical to SEQ ID NO: 237280

SEQ ID NO: 238017 - RNA, 57 nt, Human; identical to SEQ ID NO: 237281

SEQ ID NO: 238018 - RNA, 64 nt, Human; identical to SEQ ID NO: 237282

SEQ ID NO: 238019 - RNA, 60 nt, Human
cauuaauucagauggcuuagaaaagugauaccagcccaagaacagggaucuaggugagcc

SEQ ID NO: 238020 - RNA, 60 nt, Human
agauaaauaugaauguagggaagcuguaagccagcccauauacagaaacuaucacuaucu

SEQ ID NO: 238021 - RNA, 60 nt, Human
ggggcgcucuugacacugugccuucauuuuccagcccacagccugggucucagggaucuu

SEQ ID NO: 238022 - RNA, 64 nt, Human; identical to SEQ ID NO: 237283

SEQ ID NO: 238023 - RNA, 64 nt, Human; identical to SEQ ID NO: 237284

SEQ ID NO: 238024 - RNA, 64 nt, Human; identical to SEQ ID NO: 237285

SEQ ID NO: 238025 - RNA, 64 nt, Human; identical to SEQ ID NO: 237286

SEQ ID NO: 238026 - RNA, 64 nt, Human; identical to SEQ ID NO: 237287

SEQ ID NO: 238027 - RNA, 64 nt, Human; identical to SEQ ID NO: 237288

SEQ ID NO: 238028 - RNA, 59 nt, Human; identical to SEQ ID NO: 237289

SEQ ID NO: 238029 - RNA, 64 nt, Human; identical to SEQ ID NO: 237290

SEQ ID NO: 238030 - RNA, 64 nt, Human; identical to SEQ ID NO: 232867

SEQ ID NO: 238031 - RNA, 64 nt, Human; identical to SEQ ID NO: 237291

SEQ ID NO: 238032 - RNA, 64 nt, Human; identical to SEQ ID NO: 237292

SEQ ID NO: 238033 - RNA, 64 nt, Human; identical to SEQ ID NO: 237293

SEQ ID NO: 238034 - RNA, 64 nt, Human; identical to SEQ ID NO: 237294

SEQ ID NO: 238035 - RNA, 64 nt, Human; identical to SEQ ID NO: 237295

SEQ ID NO: 238036 - RNA, 64 nt, Human; identical to SEQ ID NO: 237296

SEQ ID NO: 238037 - RNA, 64 nt, Human; identical to SEQ ID NO: 237297

SEQ ID NO: 238038 - RNA, 60 nt, Human
uugaggcuuuuugguaauaauugcuuuuuuccagcccaggugugguuuuguuuguuuuuu

SEQ ID NO: 238039 - RNA, 60 nt, Human
ccagagcuccccccagacuggagagcaagcccagcccagccucggcauagacccccuucu

SEQ ID NO: 238040 - RNA, 60 nt, Human
ucacucugaauggcugcagaguuaauguucccagcccaguccccuuucgggggccuuggg

SEQ ID NO: 238041 - RNA, 64 nt, Human; identical to SEQ ID NO: 237298

SEQ ID NO: 238042 - RNA, 64 nt, Human; identical to SEQ ID NO: 237299

SEQ ID NO: 238043 - RNA, 64 nt, Human; identical to SEQ ID NO: 237300

SEQ ID NO: 238044 - RNA, 64 nt, Human; identical to SEQ ID NO: 237301

SEQ ID NO: 238045 - RNA, 64 nt, Human; identical to SEQ ID NO: 237302

SEQ ID NO: 238046 - RNA, 64 nt, Human; identical to SEQ ID NO: 237303

SEQ ID NO: 238047 - RNA, 64 nt, Human; identical to SEQ ID NO: 237304

SEQ ID NO: 238048 - RNA, 64 nt, Human; identical to SEQ ID NO: 237305

SEQ ID NO: 238049 - RNA, 64 nt, Human; identical to SEQ ID NO: 237306

SEQ ID NO: 238050 - RNA, 64 nt, Human; identical to SEQ ID NO: 237307

SEQ ID NO: 238051 - RNA, 64 nt, Human; identical to SEQ ID NO: 237308

SEQ ID NO: 238052 - RNA, 64 nt, Human; identical to SEQ ID NO: 237309

SEQ ID NO: 238053 - RNA, 64 nt, Human; identical to SEQ ID NO: 237310

SEQ ID NO: 238054 - RNA, 64 nt, Human; identical to SEQ ID NO: 236869

SEQ ID NO: 238055 - RNA, 64 nt, Human; identical to SEQ ID NO: 232868

SEQ ID NO: 238056 - RNA, 64 nt, Human; identical to SEQ ID NO: 236926

SEQ ID NO: 238057 - RNA, 60 nt, Human
guacuuacugguuagggucaggguaacuugccagcccaagauaaauacuuuaauuguuaa

SEQ ID NO: 238058 - RNA, 60 nt, Human
gguggaucacuugagguuaggaguucaagaccagcccagccaacauggugaaaacccugu

SEQ ID NO: 238059 - RNA, 60 nt, Human
uuacaaccggaccuccacccccaacuuccuccagcccagcugggcuuccuuuguuggagu

SEQ ID NO: 238060 - RNA, 64 nt, Human; identical to SEQ ID NO: 236927

SEQ ID NO: 238061 - RNA, 64 nt, Human; identical to SEQ ID NO: 236928

SEQ ID NO: 238062 - RNA, 64 nt, Human; identical to SEQ ID NO: 236946

SEQ ID NO: 238063 - RNA, 64 nt, Human; identical to SEQ ID NO: 234190

SEQ ID NO: 238064 - RNA, 64 nt, Human; identical to SEQ ID NO: 236964

SEQ ID NO: 238065 - RNA, 64 nt, Human; identical to SEQ ID NO: 236965

SEQ ID NO: 238066 - RNA, 64 nt, Human; identical to SEQ ID NO: 236966

SEQ ID NO: 238067 - RNA, 64 nt, Human; identical to SEQ ID NO: 237021

SEQ ID NO: 238068 - RNA, 64 nt, Human; identical to SEQ ID NO: 234191

SEQ ID NO: 238069 - RNA, 64 nt, Human; identical to SEQ ID NO: 237311

SEQ ID NO: 238070 - RNA, 64 nt, Human; identical to SEQ ID NO: 237312

SEQ ID NO: 238071 - RNA, 64 nt, Human; identical to SEQ ID NO: 237313

SEQ ID NO: 238072 - RNA, 64 nt, Human; identical to SEQ ID NO: 237314

SEQ ID NO: 238073 - RNA, 64 nt, Human; identical to SEQ ID NO: 237315

SEQ ID NO: 238074 - RNA, 64 nt, Human; identical to SEQ ID NO: 237316

SEQ ID NO: 238075 - RNA, 64 nt, Human; identical to SEQ ID NO: 237317

SEQ ID NO: 238076 - RNA, 60 nt, Human
aggacccugccaggcacaggcagggcaggaccagcccacgcugacuacagggccgccggc

SEQ ID NO: 238077 - RNA, 60 nt, Human
uggaauguuccuaaauaugccagguagacaccagcccaaguacccuccuccagaagucug

SEQ ID NO: 238078 - RNA, 64 nt, Human; identical to SEQ ID NO: 237318

SEQ ID NO: 238079 - RNA, 64 nt, Human; identical to SEQ ID NO: 237319

SEQ ID NO: 238080 - RNA, 64 nt, Human; identical to SEQ ID NO: 237320

SEQ ID NO: 238081 - RNA, 64 nt, Human; identical to SEQ ID NO: 237321

SEQ ID NO: 238082 - RNA, 64 nt, Human; identical to SEQ ID NO: 237322

SEQ ID NO: 238083 - RNA, 64 nt, Human; identical to SEQ ID NO: 237323

SEQ ID NO: 238084 - RNA, 64 nt, Human; identical to SEQ ID NO: 237324

SEQ ID NO: 238085 - RNA, 64 nt, Human; identical to SEQ ID NO: 237325

SEQ ID NO: 238086 - RNA, 64 nt, Human; identical to SEQ ID NO: 237326

SEQ ID NO: 238087 - RNA, 64 nt, Human; identical to SEQ ID NO: 237327

SEQ ID NO: 238088 - RNA, 64 nt, Human; identical to SEQ ID NO: 237328

SEQ ID NO: 238089 - RNA, 64 nt, Human; identical to SEQ ID NO: 237329

SEQ ID NO: 238090 - RNA, 64 nt, Human; identical to SEQ ID NO: 237330

SEQ ID NO: 238091 - RNA, 64 nt, Human; identical to SEQ ID NO: 237117

SEQ ID NO: 238092 - RNA, 64 nt, Human; identical to SEQ ID NO: 237331

SEQ ID NO: 238093 - RNA, 64 nt, Human; identical to SEQ ID NO: 237332

SEQ ID NO: 238094 - RNA, 60 nt, Human
acagcuuucucaaagcggugaccacucaggccagcccagacaaaucugagggauggccag

SEQ ID NO: 238095 - RNA, 60 nt, Human
ugcucucaccaccuaugaaacucggggaaaccagcccagcuaaguccggagugaaggagc

SEQ ID NO: 238096 - RNA, 60 nt, Human
ugcugggauuacaggcgugagccacugugcccagcccagguuuugaaguuguccgagaua

SEQ ID NO: 238097 - RNA, 64 nt, Human; identical to SEQ ID NO: 237333

SEQ ID NO: 238098 - RNA, 64 nt, Human; identical to SEQ ID NO: 237334

SEQ ID NO: 238099 - RNA, 64 nt, Human; identical to SEQ ID NO: 237335

SEQ ID NO: 238100 - RNA, 62 nt, Human; identical to SEQ ID NO: 237336

SEQ ID NO: 238101 - RNA, 64 nt, Human; identical to SEQ ID NO: 237337

SEQ ID NO: 238102 - RNA, 64 nt, Human; identical to SEQ ID NO: 237338

SEQ ID NO: 238103 - RNA, 64 nt, Human; identical to SEQ ID NO: 237339

SEQ ID NO: 238104 - RNA, 64 nt, Human; identical to SEQ ID NO: 237340

SEQ ID NO: 238105 - RNA, 64 nt, Human; identical to SEQ ID NO: 237341

SEQ ID NO: 238106 - RNA, 64 nt, Human; identical to SEQ ID NO: 237342

SEQ ID NO: 238107 - RNA, 64 nt, Human; identical to SEQ ID NO: 237343

SEQ ID NO: 238108 - RNA, 64 nt, Human; identical to SEQ ID NO: 237344

SEQ ID NO: 238109 - RNA, 64 nt, Human; identical to SEQ ID NO: 237345

SEQ ID NO: 238110 - RNA, 57 nt, Human; identical to SEQ ID NO: 237346

SEQ ID NO: 238111 - RNA, 63 nt, Human; identical to SEQ ID NO: 237347

SEQ ID NO: 238112 - RNA, 64 nt, Human; identical to SEQ ID NO: 237351

SEQ ID NO: 238113 - RNA, 60 nt, Human
gcccagccacagcccagcugagcaugaggcccagcccauagacggcacaggccaccuggc

SEQ ID NO: 238114 - RNA, 60 nt, Human
cugaguuuccuaugguuuacaaagagggccccagcccagccccaccacagaucccagaga

SEQ ID NO: 238115 - RNA, 60 nt, Human
uugccagaguggcuucugaggacucccugcccagcccagcuuucacuggggggagacgag

SEQ ID NO: 238116 - RNA, 64 nt, Human; identical to SEQ ID NO: 237352

SEQ ID NO: 238117 - RNA, 64 nt, Human; identical to SEQ ID NO: 237353

SEQ ID NO: 238118 - RNA, 64 nt, Human; identical to SEQ ID NO: 237354

SEQ ID NO: 238119 - RNA, 64 nt, Human; identical to SEQ ID NO: 237355

SEQ ID NO: 238120 - RNA, 64 nt, Human; identical to SEQ ID NO: 237356

SEQ ID NO: 238121 - RNA, 64 nt, Human; identical to SEQ ID NO: 237357

SEQ ID NO: 238122 - RNA, 64 nt, Human; identical to SEQ ID NO: 237358

SEQ ID NO: 238123 - RNA, 64 nt, Human; identical to SEQ ID NO: 237359

SEQ ID NO: 238124 - RNA, 64 nt, Human; identical to SEQ ID NO: 237360

SEQ ID NO: 238125 - RNA, 64 nt, Human; identical to SEQ ID NO: 237361

SEQ ID NO: 238126 - RNA, 64 nt, Human; identical to SEQ ID NO: 237362

SEQ ID NO: 238127 - RNA, 64 nt, Human; identical to SEQ ID NO: 237363

SEQ ID NO: 238128 - RNA, 64 nt, Human; identical to SEQ ID NO: 237364

SEQ ID NO: 238129 - RNA, 64 nt, Human; identical to SEQ ID NO: 237365

SEQ ID NO: 238130 - RNA, 64 nt, Human; identical to SEQ ID NO: 237366

SEQ ID NO: 238131 - RNA, 64 nt, Human; identical to SEQ ID NO: 237367

SEQ ID NO: 238132 - RNA, 60 nt, Human
ccgacggcagcgccgccgccgcccagaaucccagcccagaaucccgaccgccgcgccgga

SEQ ID NO: 238133 - RNA, 60 nt, Human
acggcucauguuaaugaguuacauuaucagccagcccagccuugcccaccauuuaagaaa

SEQ ID NO: 238134 - RNA, 60 nt, Human
cccaaaggaaaacaccuauuuuucuacuacccagcccaagaaaccucaaaagcaugccuu

SEQ ID NO: 238135 - RNA, 64 nt, Human; identical to SEQ ID NO: 237368

SEQ ID NO: 238136 - RNA, 64 nt, Human; identical to SEQ ID NO: 237369

SEQ ID NO: 238137 - RNA, 64 nt, Human; identical to SEQ ID NO: 237370

SEQ ID NO: 238138 - RNA, 64 nt, Human; identical to SEQ ID NO: 234192

SEQ ID NO: 238139 - RNA, 64 nt, Human; identical to SEQ ID NO: 236983

SEQ ID NO: 238140 - RNA, 64 nt, Human; identical to SEQ ID NO: 237371

SEQ ID NO: 238141 - RNA, 64 nt, Human; identical to SEQ ID NO: 237372

SEQ ID NO: 238142 - RNA, 64 nt, Human; identical to SEQ ID NO: 237373

SEQ ID NO: 238143 - RNA, 64 nt, Human; identical to SEQ ID NO: 237374

SEQ ID NO: 238144 - RNA, 64 nt, Human; identical to SEQ ID NO: 237375

SEQ ID NO: 238145 - RNA, 64 nt, Human; identical to SEQ ID NO: 237376

SEQ ID NO: 238146 - RNA, 64 nt, Human; identical to SEQ ID NO: 237377

SEQ ID NO: 238147 - RNA, 64 nt, Human; identical to SEQ ID NO: 237378

SEQ ID NO: 238148 - RNA, 64 nt, Human; identical to SEQ ID NO: 237379

SEQ ID NO: 238149 - RNA, 64 nt, Human; identical to SEQ ID NO: 237380

SEQ ID NO: 238150 - RNA, 64 nt, Human; identical to SEQ ID NO: 237381

SEQ ID NO: 238151 - RNA, 60 nt, Human
gcuuugauuucggcaagcuggaauggcccaccagcccaucccagaucuuccuuuauuaaa

SEQ ID NO: 238152 - RNA, 60 nt, Human
guucucaggagugguugaggacacagggccccagcccagcccucugcaccccccagcccg

SEQ ID NO: 238153 - RNA, 57 nt, Human
ugauacagaagaucagcuaagacacacccagcccagauucaacaggaaaccgaucuu

SEQ ID NO: 238154 - RNA, 64 nt, Human; identical to SEQ ID NO: 237382

SEQ ID NO: 238155 - RNA, 64 nt, Human; identical to SEQ ID NO: 237383

SEQ ID NO: 238156 - RNA, 64 nt, Human; identical to SEQ ID NO: 237384

SEQ ID NO: 238157 - RNA, 64 nt, Human; identical to SEQ ID NO: 237385

SEQ ID NO: 238158 - RNA, 64 nt, Human; identical to SEQ ID NO: 237386

SEQ ID NO: 238159 - RNA, 64 nt, Human; identical to SEQ ID NO: 237387

SEQ ID NO: 238160 - RNA, 64 nt, Human; identical to SEQ ID NO: 237388

SEQ ID NO: 238161 - RNA, 64 nt, Human; identical to SEQ ID NO: 237389

SEQ ID NO: 238162 - RNA, 64 nt, Human; identical to SEQ ID NO: 237390

SEQ ID NO: 238163 - RNA, 64 nt, Human; identical to SEQ ID NO: 236870

SEQ ID NO: 238164 - RNA, 64 nt, Human; identical to SEQ ID NO: 237391

SEQ ID NO: 238165 - RNA, 64 nt, Human; identical to SEQ ID NO: 237392

SEQ ID NO: 238166 - RNA, 64 nt, Human; identical to SEQ ID NO: 237393

SEQ ID NO: 238167 - RNA, 60 nt, Human; identical to SEQ ID NO: 237394

SEQ ID NO: 238168 - RNA, 64 nt, Human; identical to SEQ ID NO: 237395

SEQ ID NO: 238169 - RNA, 64 nt, Human; identical to SEQ ID NO: 237396

SEQ ID NO: 238170 - RNA, 60 nt, Human
ccuggacagcaucaaggagggcuucuccuuccagcccaagcugcgcucacccaggcgccu

SEQ ID NO: 238171 - RNA, 60 nt, Human
ccacgguggacuuagcucugaggaguacccccagcccaagagaugaacaucuggggacua

SEQ ID NO: 238172 - RNA, 60 nt, Human
uucuccucuggggccugauccaccucuacaccagcccaggaagccccaucugugccugcc

SEQ ID NO: 238173 - RNA, 64 nt, Human; identical to SEQ ID NO: 237397

SEQ ID NO: 238174 - RNA, 64 nt, Human; identical to SEQ ID NO: 237398

SEQ ID NO: 238175 - RNA, 64 nt, Human; identical to SEQ ID NO: 237399

SEQ ID NO: 238176 - RNA, 64 nt, Human; identical to SEQ ID NO: 237400

SEQ ID NO: 238177 - RNA, 64 nt, Human; identical to SEQ ID NO: 237401

SEQ ID NO: 238178 - RNA, 64 nt, Human; identical to SEQ ID NO: 237402

SEQ ID NO: 238179 - RNA, 64 nt, Human; identical to SEQ ID NO: 237403

SEQ ID NO: 238180 - RNA, 64 nt, Human; identical to SEQ ID NO: 237404

SEQ ID NO: 238181 - RNA, 64 nt, Human; identical to SEQ ID NO: 237405

SEQ ID NO: 238182 - RNA, 64 nt, Human; identical to SEQ ID NO: 237406

SEQ ID NO: 238183 - RNA, 64 nt, Human; identical to SEQ ID NO: 237407

SEQ ID NO: 238184 - RNA, 64 nt, Human; identical to SEQ ID NO: 237408

SEQ ID NO: 238185 - RNA, 64 nt, Human; identical to SEQ ID NO: 237409

SEQ ID NO: 238186 - RNA, 64 nt, Human; identical to SEQ ID NO: 237410

SEQ ID NO: 238187 - RNA, 64 nt, Human; identical to SEQ ID NO: 234208

SEQ ID NO: 238188 - RNA, 64 nt, Human; identical to SEQ ID NO: 237002

SEQ ID NO: 238189 - RNA, 60 nt, Human
gaggagcacuggcaguugguggcagugagaccagcccacccaccaccacccaccacagaa

SEQ ID NO: 238190 - RNA, 60 nt, Human
ggaguccccauuugcagguggguagggccuccagcccacaccacccagaccuaggcuucc

SEQ ID NO: 238191 - RNA, 60 nt, Human
ugauuacaaggugucugugguuuagggggcccagcccaucauuccuuuuccccuuggcac

SEQ ID NO: 238192 - RNA, 64 nt, Human; identical to SEQ ID NO: 237003

SEQ ID NO: 238193 - RNA, 64 nt, Human; identical to SEQ ID NO: 237411

SEQ ID NO: 238194 - RNA, 64 nt, Human; identical to SEQ ID NO: 237412

SEQ ID NO: 238195 - RNA, 64 nt, Human; identical to SEQ ID NO: 237413

SEQ ID NO: 238196 - RNA, 64 nt, Human; identical to SEQ ID NO: 237414

SEQ ID NO: 238197 - RNA, 64 nt, Human; identical to SEQ ID NO: 237415

SEQ ID NO: 238198 - RNA, 64 nt, Human; identical to SEQ ID NO: 237416

SEQ ID NO: 238199 - RNA, 64 nt, Human; identical to SEQ ID NO: 237417

SEQ ID NO: 238200 - RNA, 64 nt, Human; identical to SEQ ID NO: 237418

SEQ ID NO: 238201 - RNA, 64 nt, Human; identical to SEQ ID NO: 237419

SEQ ID NO: 238202 - RNA, 64 nt, Human; identical to SEQ ID NO: 237420

SEQ ID NO: 238203 - RNA, 64 nt, Human; identical to SEQ ID NO: 237421

SEQ ID NO: 238204 - RNA, 64 nt, Human; identical to SEQ ID NO: 237422

SEQ ID NO: 238205 - RNA, 64 nt, Human; identical to SEQ ID NO: 237423

SEQ ID NO: 238206 - RNA, 64 nt, Human; identical to SEQ ID NO: 237424

SEQ ID NO: 238207 - RNA, 64 nt, Human; identical to SEQ ID NO: 237425

SEQ ID NO: 238208 - RNA, 60 nt, Human
agccccuccucugccaccuccccuauccacccagcccauucucucuccuguccaaccuaa

SEQ ID NO: 238209 - RNA, 60 nt, Human
gugagucaaaugcccccugagugacugcccccagcccaggccagaagaccucccuucagg

SEQ ID NO: 238210 - RNA, 60 nt, Human
gccuguggccaggucacugucuaccccagcccagcccagcccucugccgcuuguacauac

SEQ ID NO: 238211 - RNA, 64 nt, Human; identical to SEQ ID NO: 237426

SEQ ID NO: 238212 - RNA, 64 nt, Human; identical to SEQ ID NO: 237427

SEQ ID NO: 238213 - RNA, 64 nt, Human; identical to SEQ ID NO: 237431

SEQ ID NO: 238214 - RNA, 64 nt, Human; identical to SEQ ID NO: 237432

SEQ ID NO: 238215 - RNA, 64 nt, Human; identical to SEQ ID NO: 237433

SEQ ID NO: 238216 - RNA, 64 nt, Human; identical to SEQ ID NO: 237434

SEQ ID NO: 238217 - RNA, 64 nt, Human; identical to SEQ ID NO: 237435

SEQ ID NO: 238218 - RNA, 64 nt, Human; identical to SEQ ID NO: 237436

SEQ ID NO: 238219 - RNA, 56 nt, Human; identical to SEQ ID NO: 237437

SEQ ID NO: 238220 - RNA, 64 nt, Human; identical to SEQ ID NO: 237438

SEQ ID NO: 238221 - RNA, 64 nt, Human; identical to SEQ ID NO: 237439

SEQ ID NO: 238222 - RNA, 64 nt, Human; identical to SEQ ID NO: 237440

SEQ ID NO: 238223 - RNA, 64 nt, Human; identical to SEQ ID NO: 237441

SEQ ID NO: 238224 - RNA, 64 nt, Human; identical to SEQ ID NO: 237442

SEQ ID NO: 238225 - RNA, 64 nt, Human; identical to SEQ ID NO: 237443

SEQ ID NO: 238226 - RNA, 64 nt, Human; identical to SEQ ID NO: 237444

SEQ ID NO: 238227 - RNA, 60 nt, Human
caggugccuuggagggucccaagcugggccccagcccacccuccugucuucccaggguag

SEQ ID NO: 238228 - RNA, 60 nt, Human
ccucgcauccucugccaaauccgaauucuuccagcccagcuucccgggcucuguccucca

SEQ ID NO: 238229 - RNA, 60 nt, Human
acuacaauuccuacaaaagugccuacagccccagcccaguggaaccaccaagcaaggacu

SEQ ID NO: 238230 - RNA, 64 nt, Human; identical to SEQ ID NO: 237445

SEQ ID NO: 238231 - RNA, 64 nt, Human; identical to SEQ ID NO: 237446

SEQ ID NO: 238232 - RNA, 64 nt, Human; identical to SEQ ID NO: 237447

SEQ ID NO: 238233 - RNA, 64 nt, Human; identical to SEQ ID NO: 237451

SEQ ID NO: 238234 - RNA, 64 nt, Human; identical to SEQ ID NO: 237452

SEQ ID NO: 238235 - RNA, 64 nt, Human; identical to SEQ ID NO: 237453

SEQ ID NO: 238236 - RNA, 64 nt, Human; identical to SEQ ID NO: 237454

SEQ ID NO: 238237 - RNA, 64 nt, Human; identical to SEQ ID NO: 237455

SEQ ID NO: 238238 - RNA, 64 nt, Human; identical to SEQ ID NO: 237456

SEQ ID NO: 238239 - RNA, 64 nt, Human; identical to SEQ ID NO: 237457

SEQ ID NO: 238240 - RNA, 64 nt, Human; identical to SEQ ID NO: 237458

SEQ ID NO: 238241 - RNA, 64 nt, Human; identical to SEQ ID NO: 237459

SEQ ID NO: 238242 - RNA, 64 nt, Human; identical to SEQ ID NO: 237460

SEQ ID NO: 238243 - RNA, 64 nt, Human; identical to SEQ ID NO: 237461

SEQ ID NO: 238244 - RNA, 64 nt, Human; identical to SEQ ID NO: 237462

SEQ ID NO: 238245 - RNA, 64 nt, Human; identical to SEQ ID NO: 237463

SEQ ID NO: 238246 - RNA, 60 nt, Human
ggcucacagcugccccucccucgagacuggccagcccaccucucccggccucugcagcca

SEQ ID NO: 238247 - RNA, 60 nt, Human
auggagaggauaugacaugaaauaaaagauccagcccaacugagugaaguggucaguguc

SEQ ID NO: 238248 - RNA, 64 nt, Human; identical to SEQ ID NO: 237464

SEQ ID NO: 238249 - RNA, 64 nt, Human; identical to SEQ ID NO: 237465

SEQ ID NO: 238250 - RNA, 64 nt, Human; identical to SEQ ID NO: 237466

SEQ ID NO: 238251 - RNA, 64 nt, Human; identical to SEQ ID NO: 237467

SEQ ID NO: 238252 - RNA, 64 nt, Human; identical to SEQ ID NO: 237471

SEQ ID NO: 238253 - RNA, 64 nt, Human; identical to SEQ ID NO: 237472

SEQ ID NO: 238254 - RNA, 64 nt, Human; identical to SEQ ID NO: 237473

SEQ ID NO: 238255 - RNA, 64 nt, Human; identical to SEQ ID NO: 237474

SEQ ID NO: 238256 - RNA, 64 nt, Human; identical to SEQ ID NO: 237475

SEQ ID NO: 238257 - RNA, 64 nt, Human; identical to SEQ ID NO: 237476

SEQ ID NO: 238258 - RNA, 64 nt, Human; identical to SEQ ID NO: 237477

SEQ ID NO: 238259 - RNA, 64 nt, Human; identical to SEQ ID NO: 237478

SEQ ID NO: 238260 - RNA, 64 nt, Human; identical to SEQ ID NO: 237479

SEQ ID NO: 238261 - RNA, 64 nt, Human; identical to SEQ ID NO: 237480

SEQ ID NO: 238262 - RNA, 64 nt, Human; identical to SEQ ID NO: 237481

SEQ ID NO: 238263 - RNA, 64 nt, Human; identical to SEQ ID NO: 237482

SEQ ID NO: 238264 - RNA, 60 nt, Human
cugaaggaccccagguaagauguuaaucucccagcccaccucaacccagaggcuacucuu

SEQ ID NO: 238265 - RNA, 60 nt, Human
uacaguacuccuagggcuugacccugguacccagcccagccuuagcacccagcaugugac

SEQ ID NO: 238266 - RNA, 60 nt, Human
uagcugauggagaggggcuacgcagcugccccagcccagggcacgccccuggccccuugc

SEQ ID NO: 238267 - RNA, 64 nt, Human; identical to SEQ ID NO: 237483

SEQ ID NO: 238268 - RNA, 64 nt, Human; identical to SEQ ID NO: 237484

SEQ ID NO: 238269 - RNA, 64 nt, Human; identical to SEQ ID NO: 237485

SEQ ID NO: 238270 - RNA, 64 nt, Human; identical to SEQ ID NO: 237486

SEQ ID NO: 238271 - RNA, 64 nt, Human; identical to SEQ ID NO: 237487

SEQ ID NO: 238272 - RNA, 64 nt, Human; identical to SEQ ID NO: 237488

SEQ ID NO: 238273 - RNA, 64 nt, Human; identical to SEQ ID NO: 237489

SEQ ID NO: 238274 - RNA, 64 nt, Human; identical to SEQ ID NO: 237491

SEQ ID NO: 238275 - RNA, 64 nt, Human; identical to SEQ ID NO: 237492

SEQ ID NO: 238276 - RNA, 64 nt, Human; identical to SEQ ID NO: 237493

SEQ ID NO: 238277 - RNA, 64 nt, Human; identical to SEQ ID NO: 237494

SEQ ID NO: 238278 - RNA, 64 nt, Human; identical to SEQ ID NO: 237495

SEQ ID NO: 238279 - RNA, 64 nt, Human; identical to SEQ ID NO: 237496

SEQ ID NO: 238280 - RNA, 64 nt, Human; identical to SEQ ID NO: 237497

SEQ ID NO: 238281 - RNA, 61 nt, Human; identical to SEQ ID NO: 237498

SEQ ID NO: 238282 - RNA, 64 nt, Human; identical to SEQ ID NO: 237499

SEQ ID NO: 238283 - RNA, 60 nt, Human
caauagacuguccugcaaauaaccgcagccccagcccagccugccuguccuccagcuguc

SEQ ID NO: 238284 - RNA, 60 nt, Human
uuaucugugggaaugugguaguacccagggccagcccacgucauuaagguuaugcacugc

SEQ ID NO: 238285 - RNA, 60 nt, Human
ucuuucauaaaggaccucauuccuugcgucccagcccaggaacagugcugucuuugcugu

SEQ ID NO: 238286 - RNA, 64 nt, Human; identical to SEQ ID NO: 237500

SEQ ID NO: 238287 - RNA, 64 nt, Human; identical to SEQ ID NO: 237501

SEQ ID NO: 238288 - RNA, 64 nt, Human; identical to SEQ ID NO: 237502

SEQ ID NO: 238289 - RNA, 64 nt, Human; identical to SEQ ID NO: 237503

SEQ ID NO: 238290 - RNA, 64 nt, Human; identical to SEQ ID NO: 237504

SEQ ID NO: 238291 - RNA, 64 nt, Human; identical to SEQ ID NO: 237505

SEQ ID NO: 238292 - RNA, 64 nt, Human; identical to SEQ ID NO: 237506

SEQ ID NO: 238293 - RNA, 64 nt, Human; identical to SEQ ID NO: 237507

SEQ ID NO: 238294 - RNA, 64 nt, Human
guguggccugagagacugcccagcuggagaggccuuccuuuacaaggccacgcgugcagcuguc

SEQ ID NO: 238295 - RNA, 64 nt, Human
guugaccugucugaauuauaaaccagccugaccuuuccuuuagcauuagauguaauaaaauaac

SEQ ID NO: 238296 - RNA, 64 nt, Human
uggaaccucuguaucaugcggcugaauucccuuuuuccuuuacucaauaaaagcuacaucagac

SEQ ID NO: 238297 - RNA, 64 nt, Human
guucccacagcucuuccgugucaucuucauccccuuccuuuaaucaaaggcugaaaucucugcc

SEQ ID NO: 238298 - RNA, 64 nt, Human
aaaggggguuuaaauacuguuggcauuuuuaugguuccuuuaaaugcccuagcuauucccagag

SEQ ID NO: 238299 - RNA, 64 nt, Human
cacuguugcagaaugaagucaccucgccccccucuuccuuuaaucuucaggccucacuggccug

SEQ ID NO: 238300 - RNA, 64 nt, Human
uguaaaagugagcucagacgucucuaaaaaauguuuccuuuauaaaagcacauggcgguugaau

SEQ ID NO: 238301 - RNA, 60 nt, Human
gggcacugcuguccccccuccagcuaggacccagcccauccccagaugccugagccuuug

SEQ ID NO: 238302 - RNA, 60 nt, Human
aggguggcaggaagacauccccccuccaucccagcccacuggaccagaacugggagagga

SEQ ID NO: 238303 - RNA, 60 nt, Human
acacagaaucagaagggaugaauggaugucccagcccaaccucuaauucacuguaugguc

SEQ ID NO: 238304 - RNA, 64 nt, Human
uagaguccaaaggaauauucuuuuacaccaauucuuccuuuaaaaaucucugaggaauuuguuu

SEQ ID NO: 238305 - RNA, 64 nt, Human
aaucaagagauuauuaagaucuuugcuagaagaguuccuuuaccuguacuuaacucccuuaaaa

SEQ ID NO: 238306 - RNA, 64 nt, Human
uggugcuucaaagggagagacccacugacucuccuuccuuuacucuuaugccauuggucccauc

SEQ ID NO: 238307 - RNA, 64 nt, Human
aaaagaaaaugcaguuauauuccuuuuuuauuuguuccuuuaguuuguuuugguucagcaguca

SEQ ID NO: 238308 - RNA, 64 nt, Human
uuguauuuuuauguccaaacuuuuccauuuuagauuccuuuauagacacgucagccuaaaaauc

SEQ ID NO: 238309 - RNA, 64 nt, Human
auuccauuauuauauuuugcgcuuggcauauuuauuccuuuaugcuuuuaaucacuaacauauu

SEQ ID NO: 238310 - RNA, 64 nt, Human
aaaauaccugguaguaaaauaaaugcugaaaauuuuccuuuaaaauagaaucauuaggccaggc

SEQ ID NO: 238311 - RNA, 64 nt, Human
gccugccauagaacaacccccuuugauuguaauuuuccuuuaccuacccaaauccuauaaaacg

SEQ ID NO: 238312 - RNA, 64 nt, Human
acacuugaacauguguuuguauaucuuuaaaauuuuccuuuauguuccauuccauaggaaaaca

SEQ ID NO: 238313 - RNA, 64 nt, Human
cugcaacauaagcaacucaacaauauuaguugcauuccuuuauagacauaccaugucaaagacg

SEQ ID NO: 238314 - RNA, 64 nt, Human
uaacauuuacuuuccaagaaacauucaggacauauuccuuuaauucuaauuuuaaaggaagagc

SEQ ID NO: 238315 - RNA, 64 nt, Human
cuccgaagcagucaucucugccugagauccauucuuccuuuacuucccccacccuccucucuug

SEQ ID NO: 238316 - RNA, 64 nt, Human
acugaaaugugguaucuuuuuuuuuuucaacuuuuuccuuuaaaggacuccuaaacuaagcaca

SEQ ID NO: 238317 - RNA, 64 nt, Human
acuuuauguguuaccaauuaauuuuguuuacccauuccuuuauccaucccuccccuccuuuuca

SEQ ID NO: 238318 - RNA, 55 nt, Human
gccccuaugacggugugugaccaggccagcccagugaccuuucuccugcugcacu

SEQ ID NO: 238319 - RNA, 60 nt, Human
gguuggauuugaagacuuuuaaguuuccuuccagcccagaaagucucucauucuaggccu

SEQ ID NO: 238320 - RNA, 60 nt, Human
agcaccuccccgcugggaagagaagagggcccagcccagagccaccuggaucuaucccug

SEQ ID NO: 238321 - RNA, 64 nt, Human
uuaagcuguaauaucuauuuuuguuuuugucuuuuuccuuuauucuuuuuguaaauauauauau

SEQ ID NO: 238322 - RNA, 64 nt, Human
gaacacuaaacuucaugaauugcgccucagauuuuuccuuuaacaucuuuuuuuuuuuugacag

SEQ ID NO: 238323 - RNA, 64 nt, Human
auuuuuucuuaaagcaguacuguaguacugaauauuccuuuaaaggaacugcagugagccuauc

SEQ ID NO: 238324 - RNA, 64 nt, Human
gcauucccacauaaguuugaguguuacgaaaacauuccuuuaaagggaucugugcuacacaaaa

SEQ ID NO: 238325 - RNA, 64 nt, Human
uauaaacacauguaauuuuacuauuuuauugucuuuccuuuaaucgaugaauugauuaaauuua

SEQ ID NO: 238326 - RNA, 64 nt, Human
ccuuaggugggauaggaaugaaagccuaaaccucuuccuuuagcuuuguuccuauuucuugcac

SEQ ID NO: 238327 - RNA, 64 nt, Human
uggaagggacugcaauuauucaguauuuuuuucuuuccuuuaaaaaaauauaucugaaguuucu

SEQ ID NO: 238328 - RNA, 64 nt, Human
ucuugguuuugaggauauuggauacaaaacucucuuccuuuagggcuacugagucuugauuccu

SEQ ID NO: 238329 - RNA, 64 nt, Human
auguugcuuuuuuuuuuaaaggaauuuuaauauauuccuuuaaaagaaagcaauuuaaucaauu

SEQ ID NO: 238330 - RNA, 64 nt, Human
ggcagcaugcucuuaacuagugcucuuccuaaaguuccuuuaauguccuuuugagauuuugagc

SEQ ID NO: 238331 - RNA, 64 nt, Human
uuuucuuagauugauuuugugagguuuuuuuuuuuuccuuuagucuuuucuuuagugggggagg

SEQ ID NO: 238332 - RNA, 64 nt, Human
aucuaauuauaccugagguugagcaagaaaugucuuccuuuagaaaaucucauucaagucaggu

SEQ ID NO: 238333 - RNA, 64 nt, Human
guugcuuccuucuggauuaauacauuuagagccauuccuuuauauggucacauuuccuaugacu

SEQ ID NO: 238334 - RNA, 64 nt, Human
uuuugaugaucugcuuccuagaguauugaguaucuuccuuuaaacuacagcuccuccucggacg

SEQ ID NO: 238335 - RNA, 60 nt, Human
agcaccccuaucucuagaggaucuggccccccagcccaguuacugcagggcagcuuuccc

SEQ ID NO: 238336 - RNA, 60 nt, Human
agggcgcugcgggaacccaguugugcugccccagcccaugccuccgggucugcugugcau

SEQ ID NO: 238337 - RNA, 60 nt, Human
ggccaucugaggguacgugccaucaucucuccagcccaggccccugggcaucucaugcug

SEQ ID NO: 238338 - RNA, 64 nt, Human
cucagagcugaacauaauuuauaucuaauuugaguuccuuuaaagaucuugguuuuccaugaau

SEQ ID NO: 238339 - RNA, 64 nt, Human
cucuuauuucucuuuuccccuuacucucuaccauuuccuuuauguggggaaacauuuuaaggua

SEQ ID NO: 238340 - RNA, 64 nt, Human
auguuuuacagaaagcacugaguugagcaagcaauuccuuuauuuaaaaaaaaaaguacguauu

SEQ ID NO: 238341 - RNA, 64 nt, Human
guaacuguguaaaguuucuaauucacaacauuaauuccuuuaaaauacacagccuucugccucu

SEQ ID NO: 238342 - RNA, 64 nt, Human
acaaagaacaaugcggcacugaaggaagagaugauuccuuuacucaaaccugcaggaaucagcc

SEQ ID NO: 238343 - RNA, 64 nt, Human
caaaaacaauuagguauuuuaaucugaaaucagauuccuuuacaaacaacaaguuuuuguaugc

SEQ ID NO: 238344 - RNA, 64 nt, Human
aauugucuauaaagaaaauacuugcaauauauuuuuccuuuauuuuuaugacuaauauaaauca

SEQ ID NO: 238345 - RNA, 64 nt, Human
aaucuuuauuucgggugguuuacguuuaugccaguuccuuuauauuuaaauuucuuguuuuaua

SEQ ID NO: 238346 - RNA, 64 nt, Human
ugaagugccuuuuuccuagaagugguuuguagacuuccuuuauaauauuucaguggaauagaug

SEQ ID NO: 238347 - RNA, 64 nt, Human
guagaauccuugcuagguugaugugggccauacauuccuuuaauaaaccauuguguacauaaga

SEQ ID NO: 238348 - RNA, 64 nt, Human
ucccacaaagccuagcaccaaacuucuuuuuuucuuccuuuaauuagaucauaaauaaaugauc

SEQ ID NO: 238349 - RNA, 64 nt, Human
ccacaagaacccuuauuccucucauuucacauucuuccuuuaauagccuccuucagaucccaua

SEQ ID NO: 238350 - RNA, 64 nt, Human
guuuuuaggugugcauucuuuuucuucuuagcaauuccuuuaugaucaccuucccuucuuguuu

SEQ ID NO: 238351 - RNA, 64 nt, Human
ucaaaauugauuuuguucauuaccuacuuaauauuuccuuuaaauauauacuaacuguuaaggc

SEQ ID NO: 238352 - RNA, 60 nt, Human
agcaccaucaggcagcacccaugggcuccaccagcccagcucugucccuccccuagguaa

SEQ ID NO: 238353 - RNA, 60 nt, Human
cuggcacacggggccgaccccagcgagugcccagcccacgagucccucacccacaucugc

SEQ ID NO: 238354 - RNA, 60 nt, Human
cgaacacgcacagaaggaaggagccagcucccagcccacucaucgcagggcucaugauuu

SEQ ID NO: 238355 - RNA, 64 nt, Human
aucacuuguaaaaauugucagugcuugaagcuguuuccuuuacucacauugaagggacuucguu

SEQ ID NO: 238356 - RNA, 64 nt, Human
gucacucguaaaaacugucagugcuugaaacuguuuccuuuacucauguugaagggacuuuguu

SEQ ID NO: 238357 - RNA, 64 nt, Human
ugguugccuggacacccucucccucuguccacucuuccuuuaauuuauuugaccucccacuacc

SEQ ID NO: 238358 - RNA, 64 nt, Human
gaagaaaaaaaacaaaaaacaaaaaaaaaccuuguuccuuuauagguuccugguagaaucagua

SEQ ID NO: 238359 - RNA, 64 nt, Human
gagggugugauaguaaggaaggccacuguuagguuuccuuuagaaauaaagagaucucagcagc

SEQ ID NO: 238360 - RNA, 64 nt, Human
gaaaaaaacuuuagaguucaguugauccaacacuuuccuuuaaaaguugagggagcagaggccc

SEQ ID NO: 238361 - RNA, 64 nt, Human
uuuucacuuugggaguuuuuguuuguuucuucuuuuccuuuauccacuuuucuucuuccuggua

SEQ ID NO: 238362 - RNA, 64 nt, Human
aagucccuuccauuguuuucuaguugcuuccucauuccuuuacccccaaacuuucuaagggcuc

SEQ ID NO: 238363 - RNA, 64 nt, Human
ccgcaaucuggcuccugcaggccuuucuguggucuuccuuuauccaggcuuucugcucucagcc

SEQ ID NO: 238364 - RNA, 64 nt, Human
ggaguuuaagauauagcuguagaggugguuuuaauuccuuuagaugucucauaaaaugagacuu

SEQ ID NO: 238365 - RNA, 64 nt, Human
caacugcacgggacauuguuuuugagaaguucuuuuccuuuauauaggcuuccaacaccaaaua

SEQ ID NO: 238366 - RNA, 64 nt, Human
ugaacaaaaacaaaaccaaauaggaguguuuguauuccuuuagagaucuggauauuuuucaaag

SEQ ID NO: 238367 - RNA, 64 nt, Human
cccuuuaauaaacacuuuuuguuaaauuguauucuuccuuuaauaaaauauuuuaagcaauugu

SEQ ID NO: 238368 - RNA, 64 nt, Human
acauuuuuccuguccuuuuuuuguccccccucccuuccuuuaucgugucucaagguaguugcau

SEQ ID NO: 238369 - RNA, 60 nt, Human
aaggaccuggcguggccacuuccuccugccccagcccaaccucugggaacaggcagcucc

SEQ ID NO: 238370 - RNA, 60 nt, Human
gacagguagcacugcuguccagccacagccccagcccaggcagcccacagugcugcacgu

SEQ ID NO: 238371 - RNA, 60 nt, Human
acaugaaaugucaccuugcugaggcccagcccagcccagcauagcccgagggcuggaaaa

SEQ ID NO: 238372 - RNA, 64 nt, Human
ucucauguucgugcagauuauuacagacaccucuuuccuuuagccagagaaugguucaaauguc

SEQ ID NO: 238373 - RNA, 64 nt, Human
ggacauuuuaggaagcuuaaguaaauuucugauuuuccuuuauugauuauguaacccacgugau

SEQ ID NO: 238374 - RNA, 64 nt, Human
uacaguucgguuuuggacucugagucaaaggauuuuccuuuaaaugcuugucucaauuuuaguc

SEQ ID NO: 238375 - RNA, 64 nt, Human
aaauccucguaaauguuaaaggcuuuaaauaggcuuccuuuagaaaauguguuucuuuaaauuu

SEQ ID NO: 238376 - RNA, 64 nt, Human
gcagucagcauugcaccugcuauggagaaggguauuccuuuauuaaaaucuuccucauuuggau

SEQ ID NO: 238377 - RNA, 64 nt, Human
gugcucaagcuaauaaguuauugugaaacugaguuuccuuuaacuuacaaagcuaguugccaua

SEQ ID NO: 238378 - RNA, 64 nt, Human
gucuauugguucaaguuaccgagagauagguguguuccuuuaugggggauggggggguguguug

SEQ ID NO: 238379 - RNA, 64 nt, Human
gcuuguucccgucauacccguaaugcuuucuuuuuuccuuuauugccaaucuuugaacucauuc

SEQ ID NO: 238380 - RNA, 64 nt, Human
agaaaugccuuuuucaguugguguauugaaagcuuuccuuuaacauuuucaccugcucauugug

SEQ ID NO: 238381 - RNA, 64 nt, Human
uaaaagauuuuuuuuuuuucucucaacaccaugauuccuuuaacaacauguuuccagcauuccc

SEQ ID NO: 238382 - RNA, 64 nt, Human
aagagggaggcaggccucuauucaaaggcagaaauuccuuuaagauuguggucugcuggguuuc

SEQ ID NO: 238383 - RNA, 64 nt, Human
cacagaauguuuaugaagaaauugcauuuucuuuuuccuuuacauuugaacuucuuuauaguuu

SEQ ID NO: 238384 - RNA, 51 nt, Human
agaccuuaggaaggaaauaaguuccuuuauuuuuucuuuucuaugcaagau

SEQ ID NO: 238385 - RNA, 64 nt, Human
cgauuaauuuuuacauuuuaaacaaguugacuauuuccuuuagggguuuuguuucaaacuuuuc

SEQ ID NO: 238386 - RNA, 60 nt, Human
ggcggaucacuugaugccagaaguuugagaccagcccagccaacauggugaaaccccguc

SEQ ID NO: 238387 - RNA, 60 nt, Human
acaagggguccagcuugcgggggacccuccccagcccauuccugcugucaaacaaacaaa

SEQ ID NO: 238388 - RNA, 60 nt, Human
uggggagggucacagcccacgggcuggcagccagcccagcaccuacuuguaaaaauuuug

SEQ ID NO: 238389 - RNA, 64 nt, Human
aaaaauauauauguauauauugcauauucacuuuuuccuuuagguagagaugauuucaauccaa

SEQ ID NO: 238390 - RNA, 64 nt, Human
aucaacugagccaaaugucugugugcaauuguguuuccuuuaccuuguaaaauuuuguacagca

SEQ ID NO: 238391 - RNA, 64 nt, Human
cacaagguacguccauuuggacuacaagaagagcuuccuuuaaaguuccuauuucagcauaaag

SEQ ID NO: 238392 - RNA, 64 nt, Human
gaaugaacauguaauaauuuguuuaggucaauuuuuccuuuacuuuuuuaauuuaaaaauuguu

SEQ ID NO: 238393 - RNA, 64 nt, Human
caauaacuuaccuaguagagauuuagugaguuguuuccuuuaaagaauuuuacacuacauauuu

SEQ ID NO: 238394 - RNA, 64 nt, Human
cacuacauauuuuaauaguaaacagggaucacuuuuccuuuagcauucagaaugacaccauauu

SEQ ID NO: 238395 - RNA, 64 nt, Human
ugucaaauggaaccugcccucuaaagcacuuucuuuccuuuacuugcgugguuucauguaagcu

SEQ ID NO: 238396 - RNA, 64 nt, Human
cuaagaaauguuuuaaaggaaaaaugaaauuaucuuccuuuagcuuauuuuuaagguaaaacag

SEQ ID NO: 238397 - RNA, 64 nt, Human
uaaugaauacuuuuuaguuuguauuugacuuuauuuccuuuauucaaaucauuuuuaaaaacuu

SEQ ID NO: 238398 - RNA, 64 nt, Human
guuacgauagcagcuugauggugauuguauuguauuccuuuaaucaaaaaggaaacacaauauu

SEQ ID NO: 238399 - RNA, 64 nt, Human
gccucucuucucagacauuuagcuaucugccucuuuccuuuagcugggaaagugagagcuggca

SEQ ID NO: 238400 - RNA, 64 nt, Human
acuaacagugucuauuuucaugucugauguguucuuccuuuagucaucauguuaggucugugua

SEQ ID NO: 238401 - RNA, 64 nt, Human
gaaaugagccacguaguuccuauuuaaugcuguuuuccuuuaguuuagaaauacauagacauug

SEQ ID NO: 238402 - RNA, 64 nt, Human
aggugaaaggggaagggugaaugggacuggcugguuccuuuaaauguuaacuuauggaaaugcu

SEQ ID NO: 238403 - RNA, 60 nt, Human
ggaaaggauuuuaccaaagcaucaauacaaccagcccaaccaucgguccacaccugggca

SEQ ID NO: 238404 - RNA, 60 nt, Human
cacccacagcacuuucugaggaagaggacaccagcccaagcuggaccugccauuucucca

SEQ ID NO: 238405 - RNA, 60 nt, Human
agcauccaggauugccucccagcugccuggccagcccacccuccugcaaccucucacccg

SEQ ID NO: 238406 - RNA, 64 nt, Human
uucauacuugaagacggauauaaaggaagaauauuuccuuuauguguuucuccagaauggugcc

SEQ ID NO: 238407 - RNA, 64 nt, Human
uugauaguuuaaguguguucuuaccgccuccuuuuuccuuuaaucuuauuuuugaugaacacau

SEQ ID NO: 238408 - RNA, 64 nt, Human
ccucugaugccuaccggguucuccugauuugaguuuccuuuaaauacucccuuuuugaguaauu

SEQ ID NO: 238409 - RNA, 64 nt, Human
aguuuugauuucaacuaucauaagugaaaauaucuuccuuuaauguucuaaguagugauaauau

SEQ ID NO: 238410 - RNA, 64 nt, Human
uguaaaaugaggugauacaguucugaauugagcauuccuuuaugauauucacucuguuccucuu

SEQ ID NO: 238411 - RNA, 64 nt, Human
ugaacacuccugaacagucauguuuuuuaaaaucuuccuuuauaucaagucagagaguauacuu

SEQ ID NO: 238412 - RNA, 64 nt, Human
gagcccuccggaccugagacugaguuuugucuuuuuccuuuagccuuagcaguggguaugaggu

SEQ ID NO: 238413 - RNA, 64 nt, Human
auagauuugucuuucuucaagaaauuaguuuucuuuccuuuauuugauugauggucauugacua

SEQ ID NO: 238414 - RNA, 64 nt, Human
aauaucaauagauauuuaccuuuuauuuuaauguuuccuuuaauuuuuuacuauuuuuacuaau

SEQ ID NO: 238415 - RNA, 64 nt, Human
ccugcucuguuucauuuauuucauuaaaauguuauuccuuuauuuaagauucacuuauuagucu

SEQ ID NO: 238416 - RNA, 64 nt, Human
ucuuuucucucaucucucauaaaucucuucugucuuccuuuaaaaaaaacaaaaguaguaguuc

SEQ ID NO: 238417 - RNA, 64 nt, Human
aauaccaaaucaaauaauauaaaagcuguaacauuuccuuuaaaacuaaugcuaauaagggauu

SEQ ID NO: 238418 - RNA, 64 nt, Human
uuugauguaucauauuuuuaaauaaaaauaaauauuccuuuagaagaucacucuaucuuuggag

SEQ ID NO: 238419 - RNA, 64 nt, Human
agaugacccauuauguccuaguuaaucaucauuuuuccuuuaguuuaauuuuauaaacaaaacu

SEQ ID NO: 238420 - RNA, 60 nt, Human
ggaaaagcccaggagaagucccaccagggaccagcccagccugcauacuugccacuuggc

SEQ ID NO: 238421 - RNA, 60 nt, Human
acacccgcagcuagcauccccacuccuccuccagcccacccaaccgccuugggucaaggg

SEQ ID NO: 238422 - RNA, 60 nt, Human
aucaaagaaauaacucagaguaauuugacaccagcccagaucauauauugauuauacaau

SEQ ID NO: 238423 - RNA, 64 nt, Human
ucuuuuucuuuuuucuuuuuccuuuuuuuuuuuuuuccuuuauguucucaccguuugaaugcau

SEQ ID NO: 238424 - RNA, 64 nt, Human
uagacaguaucuucuuuuaauauuuugauuuguuuuccuuuaguuugaaaaguuguauaauacu

SEQ ID NO: 238425 - RNA, 64 nt, Human
acgcagacaccucguacugcuacaggugugucauuuccuuuaauaggaccagggaccauguaac

SEQ ID NO: 238426 - RNA, 64 nt, Human
ccccaacacaaaaccagugucugggagguucauuuuccuuuaaacugauccagcuggcccugaa

SEQ ID NO: 238427 - RNA, 64 nt, Human
acuuuuggauuuuuaacuaaauauguuggacguguuccuuuauauauuuaaguucagcacagaa

SEQ ID NO: 238428 - RNA, 64 nt, Human
gagcugcacugggauucuucacucugccccucacuuccuuuagggcaaauaacacagcagaacc

SEQ ID NO: 238429 - RNA, 64 nt, Human
gugguaaguauggaaaaaucuucaguuguaucucuuccuuuacuaagcaucaagaacacauacu

SEQ ID NO: 238430 - RNA, 64 nt, Human
cagaauugagguugaaaaauauuugauugccacauuccuuuaagcaucuuugaugaauacucug

SEQ ID NO: 238431 - RNA, 64 nt, Human
uuaauaucucauguucuguuuuuuauucaguauuuuccuuuauguuaauucaauuauauacuuc

SEQ ID NO: 238432 - RNA, 64 nt, Human
agcagugaccucagcaaccccuccuuuuuauuuuuuccuuuaaaaacauuucaguuaaauuaag

SEQ ID NO: 238433 - RNA, 64 nt, Human
cucucugaaucucagaucuccagcuuugaucuguuuccuuuacuuuagagcuauauauuugccu

SEQ ID NO: 238434 - RNA, 64 nt, Human
aguuccauaccuucuaauuuuaggcugucagaaauuccuuuauucuuugggauuucacaaucau

SEQ ID NO: 238435 - RNA, 64 nt, Human
ggagauaggcagggcuaaaaagguauuauuauuuuuccuuuaaugauggugcuaaaauucuucc

SEQ ID NO: 238436 - RNA, 64 nt, Human
gaaugauugaacauuggaaguuucaagaggaugcuuccuuuaggauaaagcuaugugcuguugu

SEQ ID NO: 238437 - RNA, 60 nt, Human
agugaguaucuuggugaugacuccuccugaccagcccaggaccagcuuucuugucaccuu

SEQ ID NO: 238438 - RNA, 60 nt, Human
gcugaggauuucaagccugccuaggaauucccagcccaaagcuguuggucugucccacca

SEQ ID NO: 238439 - RNA, 60 nt, Human
ucaccccagcuucuuugucccccaguacccccagcccagccagccaauaagaggacacaa

SEQ ID NO: 238440 - RNA, 54 nt, Human
aggaagaagaggaggcuugaagcuuuccuuuauucuugaaucucccauggaagg

SEQ ID NO: 238441 - RNA, 64 nt, Human
gguuaugugguuaccuauuuuaacuuaauuuuuuuuccuuuaccucauaugcagcugugguaga

SEQ ID NO: 238442 - RNA, 64 nt, Human
gagccauuacuuaucucuucagaagacuuaagucuuccuuuauacucagugaaauuucccagaa

SEQ ID NO: 238443 - RNA, 64 nt, Human
uuugguuuuuuucauuuuguuuugcucugaccgauuccuuuauauuugcuccccuauuuuuggc

SEQ ID NO: 238444 - RNA, 64 nt, Human
ucuguccauucuuguggcccuaucagccuucuccuuccuuuacuccuuuaaucuacuucuuuga

SEQ ID NO: 238445 - RNA, 64 nt, Human
guuuauagagaccuagagauacagcaucuaugacuuccuuuauuauucuaaaauaguaugauaa

SEQ ID NO: 238446 - RNA, 64 nt, Human
cguugauaaauacuaaucuuuaaaguuuguggaguuccuuuauuuguaauauaugugcucuuaa

SEQ ID NO: 238447 - RNA, 64 nt, Human
cuuaggaaaaaagacuuugcucugcccuuuuauauuccuuuaugcugcaaguggugacauguuc

SEQ ID NO: 238448 - RNA, 64 nt, Human
cgggagucuguaacacagcagcacaggaccgcgcuuccuuuagcagugcugaguaagcaggcag

SEQ ID NO: 238449 - RNA, 64 nt, Human
gcaacacaaucaugcaauuauaauuugaaaauauuuccuuuaaagacagaguuugaaacucauc

SEQ ID NO: 238450 - RNA, 64 nt, Human
gucucauggucccacuuccccaucugugugugaauuccuuuagacuaagggcaggaagacuucc

SEQ ID NO: 238451 - RNA, 64 nt, Human
uauucagaaaccguuuugugccugcugggaguaauuccuuuagcaauuaaguauuugguagcug

SEQ ID NO: 238452 - RNA, 64 nt, Human
acacagccacgcugauaauaugcaaaugaacauuuuccuuuaugucucuccagauaauguuuau

SEQ ID NO: 238453 - RNA, 64 nt, Human
agcacuuaagacuuauacuugccuucugauaguauuccuuuauacacaguggauugauuauaaa

SEQ ID NO: 238454 - RNA, 60 nt, Human
cccuuugaguccccuugagugucuuaagaaccagcccacaacagccucucuuucuccucc

SEQ ID NO: 238455 - RNA, 60 nt, Human
ugacccuccccacugcaagcccagggagccccagcccaagauggccagccugaaacuguu

SEQ ID NO: 238456 - RNA, 59 nt, Human
agccugugccagcccagugaaugcgugccccagcccagccagcuacccagccccucucu

SEQ ID NO: 238457 - RNA, 64 nt, Human
uucggccaggucacacgaccggggccagcaccacuuccuuuaaagaugaacucugaacuuugga

SEQ ID NO: 238458 - RNA, 64 nt, Human
agggagaguuccugugagcauguggggggugccuuuccuuuaaccagggaggugaacacuaccu

SEQ ID NO: 238459 - RNA, 64 nt, Human
gccccagcugcauggacucugagcugccccuggcuuccuuuaaggaggcugcuccagaaggaac

SEQ ID NO: 238460 - RNA, 64 nt, Human
uuuuacauuuccauuucuauggguuuuccuuucuuuccuuuaugcaguagaugcuuucuuccuc

SEQ ID NO: 238461 - RNA, 64 nt, Human
ugcaguggaaacugguuaagccaguuguucauacuuccuuuacaaauauaaagauagcuguuua

SEQ ID NO: 238462 - RNA, 64 nt, Human
uaauaacuuaccugaagggguuuucuugauaauuuuccuuuaauaugaaauuuuuuuucaugcu

SEQ ID NO: 238463 - RNA, 64 nt, Human
uuguagauaaagcagauggggaguuacggaguuguuccuuuacuggcugaaagauauauucgaa

SEQ ID NO: 238464 - RNA, 64 nt, Human
uuccuuuguucuaguguugugaagggccucccucuuccuuuaucugaaguggugaauauaguaa

SEQ ID NO: 238465 - RNA, 64 nt, Human
uugauuugagaagaaaucuggcugguuugaggguuuccuuuaguucacccucauacucucagga

SEQ ID NO: 238466 - RNA, 64 nt, Human
uuuucuuauuagcacauuugagaaaaauauuccuuuccuuuauuguaguaaaucuauuaaaggc

SEQ ID NO: 238467 - RNA, 64 nt, Human
ugugucuuacauugccaagucagaugguacggacuuccuuuaggaucucaggcuucugcaguuc

SEQ ID NO: 238468 - RNA, 64 nt, Human
gaucauucucuguggguaugcaaaguuaugggaauuccuuuauagguaacugccauuuaggacu

SEQ ID NO: 238469 - RNA, 64 nt, Human
aagagaacucuggggagccugagccacaaaaauguuccuuuauuuuauguaaacccucaagggu

SEQ ID NO: 238470 - RNA, 64 nt, Human
auucacacacaucccagccccuggccuugcccucuuccuuuaggcaugugagaaaaucagccua

SEQ ID NO: 238471 - RNA, 60 nt, Human
ucugccaggcuccucaggcccagacagaggccagcccacaaccuaugacccccuccccca

SEQ ID NO: 238472 - RNA, 60 nt, Human
uuccagauuguaugcuugagugauggguccccagcccaagcccacucuucccucagcuca

SEQ ID NO: 238473 - RNA, 60 nt, Human
ucucaagaccuuuccuccaaucagcccaacccagcccagacugggcuuuucuggggagcu

SEQ ID NO: 238474 - RNA, 64 nt, Human
auuuuuuuuuucuugguguauguaagcacauuuguuccuuuauaucuguuuacaaaacugugaa

SEQ ID NO: 238475 - RNA, 64 nt, Human
ugccugcacagcagagauaacccucuucccuugcuuccuuuaauaguuaaauagacuuuguaua

SEQ ID NO: 238476 - RNA, 64 nt, Human
uauaccagauaccaaaagcuagcuuucuuauguuuuccuuuaaauuuucagauuuaccuucauu

SEQ ID NO: 238477 - RNA, 64 nt, Human
caguuaaagacauccaauaucuuaaaaaggaguuuuccuuuagaaacacacacacccuuccucu

SEQ ID NO: 238478 - RNA, 64 nt, Human
aaugaaaggaugcuguacucauuagaauacaagauuccuuuacugucccucaaccuugaccaaa

SEQ ID NO: 238479 - RNA, 64 nt, Human
uaugcaguuuuuugagcccacgaauaguugucauuuccuuuaugugccuguuaguaaaaaguag

SEQ ID NO: 238480 - RNA, 64 nt, Human
augauuuuaucauuugauucauucucacauuuuuuuccuuuaaauauuuuuaguugaccuuuuu

SEQ ID NO: 238481 - RNA, 64 nt, Human
uuaauacuaccaacuuagucaucaagccucaauuuuccuuuaccugaaggauuaagugaaagcu

SEQ ID NO: 238482 - RNA, 64 nt, Human
uauuuagaugguuuuuaauacucagcagauugucuuccuuuauauugugucuuuuuuauguugc

SEQ ID NO: 238483 - RNA, 64 nt, Human
uggugcucauguuuccuggauuguauuaucugcuuuccuuuaccaaggcagacagaacugcugc

SEQ ID NO: 238484 - RNA, 64 nt, Human
aguuuaauaguuacacauucaugcuaauauacauuuccuuuaaacauccacaaauucuuaaaaa

SEQ ID NO: 238485 - RNA, 64 nt, Human
guccaaaauaauaacauauauagagggagcuguauuccuuuauacaaaucugauggcuccugca

SEQ ID NO: 238486 - RNA, 64 nt, Human
gcuaacaagcccacguggaccagucugaaugucuuuccuuuacaccuauguuuuuaaguaguca

SEQ ID NO: 238487 - RNA, 64 nt, Human
cagcucgauucuaaucuuuucaugcugcacacgauuccuuuaauguagcauccuuaucugaaag

SEQ ID NO: 238488 - RNA, 60 nt, Human
gugcagcugcauccagaaaccggccacuacccagcccaucucugccugugcuuauccaga

SEQ ID NO: 238489 - RNA, 60 nt, Human
cccuccuaaagcuggcuggaaaaagaagccccagcccagccugccucaucccaccccaau

SEQ ID NO: 238490 - RNA, 60 nt, Human
ucuuucauuggugacccauaaccccaagucccagcccagaaccccuaacccccaauacuu

SEQ ID NO: 238491 - RNA, 64 nt, Human
auauugucuguaaaaaauguaugcuauccucuuauuccuuuaaagugaguacuguuaagaauaa

SEQ ID NO: 238492 - RNA, 64 nt, Human
uaccguuuuuaguucuccuugauucuuuguuuucuuccuuuaucguuuuuagguuugguaugug

SEQ ID NO: 238493 - RNA, 64 nt, Human
uuauuugcuuuccaagauuuggaauuuuauuuaauuccuuuaaguguuagcagugucuuaugaa

SEQ ID NO: 238494 - RNA, 64 nt, Human
ugacauugacaaaagcacagugacugucagcagauuccuuuacuuuuguuugugggagguagga

SEQ ID NO: 238495 - RNA, 64 nt, Human
cuaauuaauagauuuacccuuuauagaacauauuuuccuuuagaucaaggcaaaaauaucagga

SEQ ID NO: 238496 - RNA, 64 nt, Human
aucuuucagcacucagaaaagaaaaccauuuuaguuccuuuauuuaauggccaaaugguuuuug

SEQ ID NO: 238497 - RNA, 64 nt, Human
acacaaauguuuugaguaucuuuuaagcugcauuuuccuuuagugaugcauuugucaauugcac

SEQ ID NO: 238498 - RNA, 64 nt, Human
uaugaaagauauagugagcuguuuauuuucuaguuuccuuuagaauauuuuagccacucaaagu

SEQ ID NO: 238499 - RNA, 64 nt, Human
gaaguacguuaaagaaaaagaaaaaaccucacuuuuccuuuauagugucccuuccuguuuuaau

SEQ ID NO: 238500 - RNA, 64 nt, Human
uagagaauaaacagccacacacacauuuuuuuuuuuccuuuaaaacaguaacuuggaaauauga

SEQ ID NO: 238501 - RNA, 64 nt, Human
auuuuuuuucuugaauuucgcuguuuucuucugcuuccuuuagauaaaaagcagcucaagagac

SEQ ID NO: 238502 - RNA, 64 nt, Human
caaggcagaaugaaaaguccuuaaccguggacucuuccuuuauccccuccuuuaccccacauau

SEQ ID NO: 238503 - RNA, 64 nt, Human
caaagccuauuuugaguagcuuuuaaaacugaauuuccuuuaauugguuugaagccuagagaug

SEQ ID NO: 238504 - RNA, 64 nt, Human
uuuagugccccguuuucuacaugaagacaccgucuuccuuuauuaauuuaguauaauuauucua

SEQ ID NO: 238505 - RNA, 60 nt, Human
aaauuuuccagccccuugccucccagaaccccagcccagaacucuucagagauuuaagaa

SEQ ID NO: 238506 - RNA, 60 nt, Human
gauaugggagacacccaggggccuggcccgccagcccaaaagauggucaucgggaagaga

SEQ ID NO: 238507 - RNA, 60 nt, Human
uccagaaccccuuuggaaauggugaaggaaccagcccaauagaaguacagagccagcuga

SEQ ID NO: 238508 - RNA, 64 nt, Human
acucucugaauaugugaaauguacucugugucuuuuccuuuagaguggggagggggcauaaucg

SEQ ID NO: 238509 - RNA, 64 nt, Human
ccuuuagcauuucucaaugacuggaugggaaauuuuccuuuauugccuagcugcuuguguuuga

SEQ ID NO: 238510 - RNA, 64 nt, Human
uucuucauuuucuuuuuuucuuuuuugccuuuuauuccuuuaaaauuucgccuggcaaaaaaua

SEQ ID NO: 238511 - RNA, 64 nt, Human
ugggggauauauuuuuugcuauaacguaaaaauuuuccuuuaaccacugcccucuccuucuuuc

SEQ ID NO: 238512 - RNA, 64 nt, Human
ccuuauuuaaagcuucuacugggauaaaccucaauuccuuuauucaggaaaggauacuuuauug

SEQ ID NO: 238513 - RNA, 64 nt, Human
cuaaaaaggucuuauacucaagagugggguagucuuccuuuaauuuuguuaccaauacgcuuua

SEQ ID NO: 238514 - RNA, 64 nt, Human
gguaaggaauuuaagaacuggaugagguuauuucuuccuuuacucuucaaaauguauuuuugau

SEQ ID NO: 238515 - RNA, 64 nt, Human
agacagaagcuucguccagccacucuucagcacauuccuuuacuaagcaguuuaaagccguccu

SEQ ID NO: 238516 - RNA, 64 nt, Human
aaauuaugugcauauaaaugugugucuauaugcuuuccuuuaaauauguuugaaaagauguuug

SEQ ID NO: 238517 - RNA, 64 nt, Human
cuaauuuugaucaaucccauuaaaaaaaggcucuuuccuuuagagaaacucuauuuugauguca

SEQ ID NO: 238518 - RNA, 64 nt, Human
aaaaugugugucuucagugcuuucucuaaaaacguuccuuuauagcuuuguacuuuuuuuuuua

SEQ ID NO: 238519 - RNA, 64 nt, Human
ucagugagcuaggaaagcaccaaucgauauuuguuuccuuuagggauacuuuguucucaccacu

SEQ ID NO: 238520 - RNA, 64 nt, Human
acauuuuuggaaacuaaucucuuuuccguaauauuuccuuuauuucaaugauucucagaaggcc

SEQ ID NO: 238521 - RNA, 64 nt, Human
caguuuaugaaauagguggcacuauuagggaaucuuccuuuaaagcaagaaaucauguuauuua

SEQ ID NO: 238522 - RNA, 60 nt, Human
aucugguacaggcaugcucaccagcccagcccagcccagcuguccuguccuccuuauucu

SEQ ID NO: 238523 - RNA, 60 nt, Human
ugccacugccaacccuguucacaggcgcuuccagcccacuccagccaggggagcagggaa

SEQ ID NO: 238524 - RNA, 60 nt, Human
acuuggucugccaggcccccaccacacaucccagcccaauccagguacgcacagacaggu

SEQ ID NO: 238525 - RNA, 64 nt, Human
aucuuaagaaauaauuauuugguuauucauuggcuuccuuuaaaaaaaaguguucuucuacaaa

SEQ ID NO: 238526 - RNA, 64 nt, Human
cuguugagcugguuuuugagucauagaucuuggcuuccuuuagaagccacuuaacuuccauaca

SEQ ID NO: 238527 - RNA, 64 nt, Human
acuucuauggcuuccagggucuucuuacaaugcauuccuuuaacuugucccuggaagcauugcu

SEQ ID NO: 238528 - RNA, 64 nt, Human
ucuccacaaauagucgggggaaaaaauuaaaauuuuccuuuaugauucuuacuguucuucgcag

SEQ ID NO: 238529 - RNA, 64 nt, Human
auaucagauauuggagauucuaucuugguuucucuuccuuuacuuagccuauaaaacuaguuaa

SEQ ID NO: 238530 - RNA, 64 nt, Human
uuuaccaugugcuaauaaguuugaaauauauuauuuccuuuauuccuuucagcaauccaugaga

SEQ ID NO: 238531 - RNA, 64 nt, Human
augaaagccacugugcuuguguuuugauuggaaauuccuuuagugucaguuuuuuggaagccaa

SEQ ID NO: 238532 - RNA, 64 nt, Human
uugucaccacugucucuuaauuuugaauaauaguuuccuuuaauaggaguauuagagauaagaa

SEQ ID NO: 238533 - RNA, 64 nt, Human
auaguuacagugaguuguuugcuuaaauuauagauuccuuuaaggacaugccuuguucauaaaa

SEQ ID NO: 238534 - RNA, 64 nt, Human
uccuuugcuucuuuggaauauuucuuucaacacauuccuuuauuuuauuauacauuguguccuu

SEQ ID NO: 238535 - RNA, 64 nt, Human
cagccaugcaaaacuguagaucaauaaaaccucuuuccuuuauaaauuacacagucuugggcag

SEQ ID NO: 238536 - RNA, 64 nt, Human
auuaaucuuugcaugaagguugguuucgcuuuuuuuccuuuaaguuuguuuuuaaauguauuag

SEQ ID NO: 238537 - RNA, 64 nt, Human
gaaauacauaauaaacccuuucaucuuuuuuuuuuuccuuuaagaauuaaaacugggaaauaga

SEQ ID NO: 238538 - RNA, 64 nt, Human
uuuuugcaguuucuucucaguuuuaauuuugcuuuuccuuuauaauggggucauuguuauuaau

SEQ ID NO: 238539 - RNA, 60 nt, Human
cuuacuacaguuaauauguagguuacugccccagcccaacugcagguucccagaugugag

SEQ ID NO: 238540 - RNA, 60 nt, Human
uccucauccuccuuguuggucuacucaggcccagcccagagcuguguucccugucucagg

SEQ ID NO: 238541 - RNA, 60 nt, Human
gacuauuucagacaaccagguuccgacaguccagcccagaacuuuuccuucucauuuugg

SEQ ID NO: 238542 - RNA, 64 nt, Human
aaaguaccauaaaccuuauguuaugccacagaaauuccuuuaaaauaaaauucuuaaacuaaac

SEQ ID NO: 238543 - RNA, 64 nt, Human
cugacuucagacagaaaccaauaccagcuuccuuuuccuuuaaacuuugaagaguguugauuug

SEQ ID NO: 238544 - RNA, 64 nt, Human
uaguuucaucugcuucaucuguuguaaacucuucuuccuuuauuucaguggugaagggauagag

SEQ ID NO: 238545 - RNA, 64 nt, Human
gggaauggagcacaggugcaguuagaugcuguucuuccuuuagauuuugucacguggggaccca

SEQ ID NO: 238546 - RNA, 64 nt, Human
ccaaugguuuuucacucuuuuuauuuacuucauuuuccuuuaauaacuuaaucucuucauguuc

SEQ ID NO: 238547 - RNA, 64 nt, Human
aaaguggcauuucauuuuuggggaauccaugagcuuccuuuauuucuggcucacagaggcagcc

SEQ ID NO: 238548 - RNA, 64 nt, Human
cagcgauuugaauuuugggggggucugcuguucauuccuuuaggugcuauacauuauucaaaaa

SEQ ID NO: 238549 - RNA, 64 nt, Human
uuuacauguauuuaaaguagcaucccaucccaacuuccuuuaauuauugcuugucuuaaaauaa

SEQ ID NO: 238550 - RNA, 64 nt, Human
auaauacucaucacuuaauucaccacacucucacuuccuuuauuagccuuauacaucucaaacu

SEQ ID NO: 238551 - RNA, 64 nt, Human
agagccuucucagaagcacagaauauuuuuauauuuccuuuaugugaauuuuuaagcugcaaau

SEQ ID NO: 238552 - RNA, 64 nt, Human
gggucuauaucuagagggaccuucaaaguauuuguuccuuuaaauuucagaccauguccaaccc

SEQ ID NO: 238553 - RNA, 64 nt, Human
uuuucucacuucugcuuauacuuuugcugguggauuccuuuaauucauaaagacauaccuacuc

SEQ ID NO: 238554 - RNA, 64 nt, Human
acuuuaaaagauucuucuguagaaguaugaguucuuccuuuaauuaucauuccaacuuucagcu

SEQ ID NO: 238555 - RNA, 64 nt, Human
aaugaggcugacauagguauauauauauauuuuuuuccuuuauuugauaaagagccaauucuuu

SEQ ID NO: 238556 - RNA, 60 nt, Human
ucugaucccuuuggggugcgggggugggguccagcccagagcaggcacugagugaaugcc

SEQ ID NO: 238557 - RNA, 60 nt, Human
ggccagcaguugagguccaucgggcuggccccagcccaucugcuggcaucaguaccuggu

SEQ ID NO: 238558 - RNA, 60 nt, Human
aaaaaauuccauuaauuaccaagcccucacccagcccaugugugauaggauuuauguagg

SEQ ID NO: 238559 - RNA, 64 nt, Human
agcguggucacugugcaguugugcacagaugucuuuccuuuaccguuggccuuucugucugccu

SEQ ID NO: 238560 - RNA, 64 nt, Human
aguauauuuuucuaaguuuuggaaagcagguuuuuuccuuuaaaaaaauuauagacacgguuca

SEQ ID NO: 238561 - RNA, 64 nt, Human
uacagaacaacgguuuuucuucugccaaggcuacuuccuuuaacgaagugccuuuaauucagcc

SEQ ID NO: 238562 - RNA, 64 nt, Human
ucaaaugcaaauggguuaaauaaaaugagacuacuuccuuuauaaauauauuuucauccuuuug

SEQ ID NO: 238563 - RNA, 64 nt, Human
guuauggcauuuauuagaaguuuuauuauuuggcuuccuuuagaauuauugugaaguuuaaaaa

SEQ ID NO: 238564 - RNA, 64 nt, Human
uuagccacaaaaggcuacuuacuuucuuuuccuuuuccuuuaaaauuguaaauaaauaauguua

SEQ ID NO: 238565 - RNA, 64 nt, Human
ccuuuuauagcuauuacugucugguuuuaacaauuuccuuuauauuuagugaacuacgcuugcu

SEQ ID NO: 238566 - RNA, 64 nt, Human
cguguccaccaagggacaguagccagagcuccucuuccuuuaccaggcaaggugcauccccuca

SEQ ID NO: 238567 - RNA, 64 nt, Human
uaggaagaaauuuuuuucaggacugcucuaugguuuccuuuaaaagaaaaaaacuucuguuugu

SEQ ID NO: 238568 - RNA, 64 nt, Human
gaaccccuccccaugaacacaaggguuuuauccuuuccuuuaaaaacaguguuugaaaugaaga

SEQ ID NO: 238569 - RNA, 64 nt, Human
agaaaugcucuuuugagcuggggcauuuaaagcuuuccuuuaauauuuuuaccugcucauuaug

SEQ ID NO: 238570 - RNA, 64 nt, Human
gauagugaaacagcuuucuggguaauucaccaauuuccuuuaaaacauaagcuaccugaaugga

SEQ ID NO: 238571 - RNA, 64 nt, Human
agggaggaccuguuguguuccagccauucugguauuccuuuauguaucuaauuucauucaaacc

SEQ ID NO: 238572 - RNA, 64 nt, Human
aaaaagcagcucacucaauguggguggcucccuauuccuuuacgcucccccuaucccuacccca

SEQ ID NO: 238573 - RNA, 60 nt, Human
ccgguacugaccagcucccguugggccaggccagcccagcccagagcacaggcuccagca

SEQ ID NO: 238574 - RNA, 60 nt, Human
cucacuuugaucaaaugacagugaacaaagccagcccaagcugguaaggugcuguucacu

SEQ ID NO: 238575 - RNA, 60 nt, Human
ucaacaaguccugcuaucuccacaaggcggccagcccagcccuguccucaccuuccagcc

SEQ ID NO: 238576 - RNA, 64 nt, Human
cuuuugucccuuuuuuucuuuccuuucuuuuuacuuccuuuauuucuuuauuccuuccuuuucc

SEQ ID NO: 238577 - RNA, 64 nt, Human
acugauugcaccuguguauuugccccugagcacuuuccuuuacacauguggcuugucuugccaa

SEQ ID NO: 238578 - RNA, 64 nt, Human
uucucuuacccacccuacugcauguugcaaaguauuccuuuaaaaugaagugaguaaaauacug

SEQ ID NO: 238579 - RNA, 64 nt, Human
cacaaauaaucaaaacccaacaugacuguuuguuuuccuuuaaaaauaugcaccaaaucaucuc

SEQ ID NO: 238580 - RNA, 64 nt, Human
aggaccuccggggagagcagaggguuccgacggauuccuuuaugagucagucucucucucccuu

SEQ ID NO: 238581 - RNA, 64 nt, Human
uuuuuuuuugguuuuuuuguucuuuuuuguuuuuuuccuuuaaaauaaaaacaaagaaaagcuc

SEQ ID NO: 238582 - RNA, 64 nt, Human
uuuuuuuuaguuuuaaaccaccaaaccaauauuuuuccuuuaaauuuuaaucuuauaauauaga

SEQ ID NO: 238583 - RNA, 64 nt, Human
aaccaaacaaacccaggccugaugggaaaaaugauuccuuuauucuagcaacuuacuuucuguu

SEQ ID NO: 238584 - RNA, 64 nt, Human
uuaguauuugguacaugaaggcuuaauguuaaguuuccuuuaaugauccacaauaaucccuuug

SEQ ID NO: 238585 - RNA, 64 nt, Human
cacaaaaugaaguugagauucggcaguugcccaauuccuuuaauaaaaagaaacuaaauaauuu

SEQ ID NO: 238586 - RNA, 64 nt, Human
aaaucaagucagcuuggaucauucaccuuaacuuuuccuuuagcagccauuuccacuaguuucc

SEQ ID NO: 238587 - RNA, 64 nt, Human
auaucugcauuuaaaaaagcaauucuuagaauacuuccuuuacauuauucuccuauuuuagaca

SEQ ID NO: 238588 - RNA, 64 nt, Human
uuuuuuuuucuguaaaacugugaacugauauauuuuccuuuaucacuuuaguauucugcaguuc

SEQ ID NO: 238589 - RNA, 64 nt, Human
guuuagucaguuccacaccaagaaugaacugcauuuccuuuaaaaauuauuuuaaaacaccuuu

SEQ ID NO: 238590 - RNA, 60 nt, Human
gcagagauccuuuucagagcacacacuguuccagcccaucugucucacccucuccuguug

SEQ ID NO: 238591 - RNA, 60 nt, Human
cuaccccucccggucccggcccuggcccagccagcccagcccucgaggcucgaugccugu

SEQ ID NO: 238592 - RNA, 60 nt, Human
ggaaggcaaacccucuuuauugaacauuagccagcccagcccagaccccagggcugccua

SEQ ID NO: 238593 - RNA, 64 nt, Human
aacuauuaugguuuccauugcuuacaaaaugauuuuccuuuacauucuuaucaugaacacuauu

SEQ ID NO: 238594 - RNA, 64 nt, Human
uauuuaauaagaaaaaauuuauauuaaugauuguuuccuuuaguaauuuauuguucuguacuga

SEQ ID NO: 238595 - RNA, 64 nt, Human
ugaauccugcacacaucccuuccuguguugguguuuccuuuagacuggccuagccugggcauca

SEQ ID NO: 238596 - RNA, 64 nt, Human
aaauguaacuuucugaacacauugcauugaauucuuccuuuaacaaaaagcaaaggcguaggua

SEQ ID NO: 238597 - RNA, 64 nt, Human
aagcaauaaugccagugcauaaucauuccauuuguuccuuuagcaaucaaccccagaaaauauu

SEQ ID NO: 238598 - RNA, 64 nt, Human
aggcaaaauaguggcauuuaacucauauaugaccuuccuuuaggaaggcuugacugguaaggga

SEQ ID NO: 238599 - RNA, 64 nt, Human
gacauuagaaaacucuacuguuuuaagcuuuaguuuccuuuauggaaugaaggauuuggaguag

SEQ ID NO: 238600 - RNA, 64 nt, Human
cuuauucccuagccuuugguccauuucuuaugauuuccuuuaaaggcaccaaaucuuaucugga

SEQ ID NO: 238601 - RNA, 64 nt, Human
ggcaaaaucaccuucccuuuaccagggaaaucacuuccuuuaggacugaaagcuaggcguccuc

SEQ ID NO: 238602 - RNA, 64 nt, Human
ggucugcuggagacgccugaaagacaguuccaucuuccuuuagacuccagccuuggcaaaauca

SEQ ID NO: 238603 - RNA, 64 nt, Human
ggcccccgggugaucucccaccacacuuacugucuuccuuuaucucuguggacuuguauauauu

SEQ ID NO: 238604 - RNA, 64 nt, Human
uucagaggaguucggcucgcaggaaaaugugggcuuccuuuaaagggagggggagaagccaggg

SEQ ID NO: 238605 - RNA, 64 nt, Human
cccauggaacaaaugggaucaauuugugaguuuuuuccuuuaaugauaacuaaaaucccucuaa

SEQ ID NO: 238606 - RNA, 64 nt, Human
uugugacacgcucucugccaagcccaccaaguauuuccuuuauagcuaaaaguuccauaguacu

SEQ ID NO: 238607 - RNA, 60 nt, Human
aaugugaauguaugagcugggggagucaacccagcccaccaugccuuggcugaugauacc

SEQ ID NO: 238608 - RNA, 60 nt, Human
gacuucugagaucagcguccuaccaagaccccagcccaacucaagcuacagcagcagcac

SEQ ID NO: 238609 - RNA, 60 nt, Human
gcuugacucaggcccugugagauagagggcccagcccagccccacccacagauccccugc

SEQ ID NO: 238610 - RNA, 64 nt, Human
uaccacaagaggguugaccagauggccccagguuuuccuuuaggucugacauccugagggucau

SEQ ID NO: 238611 - RNA, 64 nt, Human
gggaugcaauguaggcugagggaaagacgucagguuccuuuaaucacagucacuguuuguuuac

SEQ ID NO: 238612 - RNA, 64 nt, Human
agacacaauuucuguuuucaucugagagccaguuuuccuuuauuucuacaucuaaaauaagaac

SEQ ID NO: 238613 - RNA, 64 nt, Human
gguguaacugugaugucauagugccgagacuacuuuccuuuaaccauugggguuaaguugggca

SEQ ID NO: 238614 - RNA, 64 nt, Human
agacaaaauaauucagaaauccauugugccaugauuccuuuaguuucugcuauuuuucugugga

SEQ ID NO: 238615 - RNA, 64 nt, Human
cuuuacccuuaguaauaauuuuggaucauuuucuuuccuuuaaaggggaacaaagccuuuuuuu

SEQ ID NO: 238616 - RNA, 64 nt, Human
aguuauuuuagcuuuugaaaguguuuuaaaagauuuccuuuaucggacaggaccaucuuuauga

SEQ ID NO: 238617 - RNA, 64 nt, Human
caaaaagccauaauaauaaguauaaaaaagcuuuuuccuuuacaauuucauguuaaucugguuu

SEQ ID NO: 238618 - RNA, 64 nt, Human
auuauguauuaaguauacaggaacaauauuauuuuuccuuuaacaaaaugaagagacaggcuau

SEQ ID NO: 238619 - RNA, 64 nt, Human
auuuauaaacauuacuugguauaacguuuuucauuuccuuuaaugucucuguuuuuuggcucua

SEQ ID NO: 238620 - RNA, 64 nt, Human
augguccaaaccuguugccauaguugguaaggcuuuccuuuaagugugaaauauuuagaugaaa

SEQ ID NO: 238621 - RNA, 64 nt, Human
auauccaagauguucuguaucuauguaaacaugauuccuuuaauaaauuguauuuuauuauuaa

SEQ ID NO: 238622 - RNA, 64 nt, Human
gugcuccaagucuaggaacucccucagaucccaguuccuuuagaaagcaguuacccaacagaaa

SEQ ID NO: 238623 - RNA, 64 nt, Human
cuuauggauacgaaggguacauuuuucauaaugauuccuuuauauuuucacuuugugucauugc

SEQ ID NO: 238624 - RNA, 60 nt, Human
acauggcuggcggaacccagagcccccaccccagcccaccuggcucuuuguugacagucg

SEQ ID NO: 238625 - RNA, 60 nt, Human
gcucuucuucuuccaucuccuuggugacacccagcccaggggcacccccuuccccagccc

SEQ ID NO: 238626 - RNA, 60 nt, Human
auacaucacguuaaaguaggacuaucacacccagcccauguggcuaaaaaagcugaauca

SEQ ID NO: 238627 - RNA, 64 nt, Human
uuugaacaaauaaauaaaagcuuucuguaguugcuuccuuuaucagaaaagaacauuugauacc

SEQ ID NO: 238628 - RNA, 64 nt, Human
uacuggugaacagugguuaauaaauaguuuuauauuccuuuaugcaauuauuagacuuuuuucu

SEQ ID NO: 238629 - RNA, 64 nt, Human
aucuuggguggguugauuacaaguuuguguggcauuccuuuagcuggggauuagcuuaaucucu

SEQ ID NO: 238630 - RNA, 64 nt, Human
caucuuucauaugguaggaaccaacaaggaaacuuuccuuuaacucccuuuuuacacuuuaugg

SEQ ID NO: 238631 - RNA, 64 nt, Human
auaugagaugggaaggaauguugacuugcuaacauuccuuuaacaaguuaagaaaacuuguuaa

SEQ ID NO: 238632 - RNA, 64 nt, Human
ucauauaucucuccuuuagauuuuaaauuuauauuuccuuuaucuugguacauaccuauuugaa

SEQ ID NO: 238633 - RNA, 64 nt, Human
gacuugguaaaugcagugacauuuucucauggaguuccuuuauuuaauauguauucuaaguagg

SEQ ID NO: 238634 - RNA, 64 nt, Human
auuugggggcuguuuauuauagcagugcaaagaguuccuuuauccuccccaaggauggaaaaau

SEQ ID NO: 238635 - RNA, 64 nt, Human
uucguuguauuuuucucauuuuugcuuuuuaaaauuccuuuaaaaaaugugcuguuaagccagu

SEQ ID NO: 238636 - RNA, 64 nt, Human
guacuauuuuuccauucaaauauucauuuagaauuuccuuuagaagauggcagugauuauaaua

SEQ ID NO: 238637 - RNA, 64 nt, Human
caaauaaauaugaaaguagauucaugaaaauguauuccuuuaaaauauuguuuuccuacaggcc

SEQ ID NO: 238638 - RNA, 64 nt, Human
gaccugagaguuucccuuaccugaucgacauauuuuccuuuaucugaucaacccaucaaucaug

SEQ ID NO: 238639 - RNA, 64 nt, Human
uuuucaacccuacuuccuaaacaucugucugggguuccuuuagucuugaaugucuuaugcucaa

SEQ ID NO: 238640 - RNA, 64 nt, Human
ugucuuuaggugggucucaaagaugauguagaauuuccuuuaauuucucgcagucuuccuggaa

SEQ ID NO: 238641 - RNA, 60 nt, Human
accuggaggcccugcccagcccugcucugcccagcccagcaggggcuccaggccuuggcu

SEQ ID NO: 238642 - RNA, 60 nt, Human
ggcccugccccaaauccagccaguccugccccagcccacccccacauuggagcccuccug

SEQ ID NO: 238643 - RNA, 60 nt, Human
gacgugggcggugggccccagccccacagaccagcccagcauucagguuaguucuacuuc

SEQ ID NO: 238644 - RNA, 64 nt, Human
guguagucaagucaccaugcugaauguacacugauuccuuuaugaugacugcuuaacuccccac

SEQ ID NO: 238645 - RNA, 64 nt, Human
ccuaaguggcuuugcaacugggccuaaguucuguuuccuuuauggaucucaaauuuucaucugc

SEQ ID NO: 238646 - RNA, 64 nt, Human
uucugggagaugucauuuuccaucucccgauuacuuccuuuacgucuagcaguaugugccgaga

SEQ ID NO: 238647 - RNA, 64 nt, Human
uguguagcacacacucaucauggauugcucagaguuccuuuagggcagagcugagggccuggga

SEQ ID NO: 238648 - RNA, 64 nt, Human
uccuuuuucuuuucuucccuauuuuuuucuuuuuuuccuuuauuuuuuucuuuucuuggagugg

SEQ ID NO: 238649 - RNA, 64 nt, Human
cugaguaguccggccuugucaaugagugcuuguuuuccuuuaaacagucugacauauuuacucg

SEQ ID NO: 238650 - RNA, 64 nt, Human
augacuugaaauagauugaggcucauuugguaacuuccuuuacugagccagucuugaucagaag

SEQ ID NO: 238651 - RNA, 64 nt, Human
uuuaaaaacucaggacauuaacuaauuuuagguuuuccuuuaucauggcuuucuacaguauuuc

SEQ ID NO: 238652 - RNA, 64 nt, Human
ccuuuugucauccuuuuccugcacuucucuugaauuccuuuauagauguacaguuuugcuuuaa

SEQ ID NO: 238653 - RNA, 64 nt, Human
aaaacuauauugucuuaaaaguauguggacucuguuccuuuauguaaacauguaaagaaaauaa

SEQ ID NO: 238654 - RNA, 64 nt, Human
agccaggaucaugguguaauaagacauaacguuuuuccuuuaaaaaaauuuaagugcgugugua

SEQ ID NO: 238655 - RNA, 64 nt, Human
cuuagaauuuuuuuuauuugaaagagaaauauaauuccuuuaaacgguaacgauacaauaaaac

SEQ ID NO: 238656 - RNA, 64 nt, Human
ggaauaaacuagagaagggagacauuguuuggauuuccuuuauacugugaaguuacaugcauaa

SEQ ID NO: 238657 - RNA, 64 nt, Human
gcagguauaugccuguuagaccuuagcugugggguuccuuuacuauugggugaaucauuaggua

SEQ ID NO: 238658 - RNA, 60 nt, Human
gacuccaacccaacaacaaccagaugugcuccagcccagccgggcuucaguuccauauuu

SEQ ID NO: 238659 - RNA, 60 nt, Human
auuuuuguauuucuacugggccugcacacuccagcccaaagggucuguggccggaggccc

SEQ ID NO: 238660 - RNA, 60 nt, Human
uugggguugguccuugucccagccucugccccagcccacuggcaugccacccagcauccc

SEQ ID NO: 238661 - RNA, 64 nt, Human
uggaaaugauuuacuggaauuacaaaaccuauuuuuccuuuaaauuucagcuuuggcucuggcu

SEQ ID NO: 238662 - RNA, 64 nt, Human
acaauuuguuuaaucaagauaggcaacgcugcaguuccuuuaugaagaggcuuuucugucgucc

SEQ ID NO: 238663 - RNA, 60 nt, Human
gcaugcuuuucuuuauuuaguuuuacuuuauuccuuuauuguucuguuucuugauuguuu

SEQ ID NO: 238664 - RNA, 64 nt, Human
gaacagugaucacacagauuccuacuugggcucuuuccuuuaaucuucggaggcugaguuugcc

SEQ ID NO: 238665 - RNA, 64 nt, Human
uccauucucuuguucccauuuacaggugaaucucuuccuuuaagccauuuuugucuccugugaa

SEQ ID NO: 238666 - RNA, 64 nt, Human
ggauggaagcacagucgggacagaauucgauggauuccuuuaguuggaguccgcguagucagca

SEQ ID NO: 238667 - RNA, 64 nt, Human
aauacagcgucagaaggaugccauaaccauucuguuccuuuacagaacuaaauugccgcagaca

SEQ ID NO: 238668 - RNA, 64 nt, Human
gggucaaggagcccaagcaaaucauuucuacuuuuuccuuuaagcauaauaauaaaaguauacu

SEQ ID NO: 238669 - RNA, 64 nt, Human
auuugguaccuaaaguaauugaaaaaaaugcaguuuccuuuaauccuugacuauaaguuauacu

SEQ ID NO: 238670 - RNA, 64 nt, Human
aaauccgcucucuuccugccccucuuucucuuucuuccuuuacuuucccuugcuuuucccucuu

SEQ ID NO: 238671 - RNA, 64 nt, Human
ggucaaaauauucagaugagacauuuggcaugucuuccuuuauucacugauauuuucuacccau

SEQ ID NO: 238672 - RNA, 64 nt, Human
aauaucagugaaauauuuugagaucuuugaauaauuccuuuagaggaauuauacaaaauuaaua

SEQ ID NO: 238673 - RNA, 64 nt, Human
ugacuuuuuguuauuauauuaugguagcuuucauuuccuuuacucuuuaacagugcaggugguc

SEQ ID NO: 238674 - RNA, 64 nt, Human
auauuaauaauauuuacauccaauacacugaaucuuccuuuagagguaagacuuuaauaucuau

SEQ ID NO: 238675 - RNA, 60 nt, Human
gugccauguguacuucugaaaauauuuuaaccagcccacccagcagucaguacacaugcc

SEQ ID NO: 238676 - RNA, 60 nt, Human
caggaagggagaacuugaaacagauucaggccagcccagccaggccaacagcaccucccc

SEQ ID NO: 238677 - RNA, 60 nt, Human
ucuagacaugaaaugucaccuugcugaggcccagcccagcccagcauagcccgagggcug

SEQ ID NO: 238678 - RNA, 64 nt, Human
aagggaagagaaaagcagaacacuguauuauuuuuuccuuuauugucuucagugcauauauuug

SEQ ID NO: 238679 - RNA, 64 nt, Human
ccuuuuuuguuuucugcuuuuaugacuguauuuauuccuuuacuguaaaagaauaugaagaacu

SEQ ID NO: 238680 - RNA, 64 nt, Human
ccaaaaaucaggcauggcauuaaaacguugcaaauuccuuuacuguuaucccccccaccaccag

SEQ ID NO: 238681 - RNA, 64 nt, Human
aacugaaacagccccugacuuaucccaagcaugcuuccuuuagcugcugugagaauuugucuuc

SEQ ID NO: 238682 - RNA, 64 nt, Human
cgauuuaaauuuuuuuuuauuuuucaaaguauuguuccuuuaaagaauauuucuguucuagggc

SEQ ID NO: 238683 - RNA, 64 nt, Human
auuuuauuuuuccuacauuucuuuuuuuuuuuuuuuccuuuagaaugcccuggaaauauauuua

SEQ ID NO: 238684 - RNA, 64 nt, Human
ucuagacuaccagccuuaucaguguuuaagcuuauuccuuuaacauaagcuuccugacaacaug

SEQ ID NO: 238685 - RNA, 64 nt, Human
acaugcauuuuuaaaacuagcaacucuuauuucuuuccuuuaaaaauacauagcauuaaauccc

SEQ ID NO: 238686 - RNA, 64 nt, Human
auuggcucauuuugugcagaccuuagagcaaaguuuccuuuaugguaucuguguacguauccaa

SEQ ID NO: 238687 - RNA, 64 nt, Human
gcgccuugucggccggggguggggcugcuuuugcuuccuuuagaggggcgggcagggagaggaa

SEQ ID NO: 238688 - RNA, 64 nt, Human
ugaaaguaggcuuuucgcucugcuucauuacugcuuccuuuaguuucuaugaaacagauugcuu

SEQ ID NO: 238689 - RNA, 64 nt, Human
uucuugcugugaaaaagaacucccuaccugugaguuccuuuauuuauaauucuugaaaccaaaa

SEQ ID NO: 238690 - RNA, 64 nt, Human
auucuugggaaacacccuuuaguguacauuuauguuccuuuauuuaggaaacaccauuauaaaa

SEQ ID NO: 238691 - RNA, 64 nt, Human
ucaucuucgaccacaucagaaagaaggaaucauauuccuuuaugaauguguaaugggaaugagg

SEQ ID NO: 238692 - RNA, 60 nt, Human
gccaagagccacagggcggccucuccccaaccagcccagcuucuccuuaccugcacccag

SEQ ID NO: 238693 - RNA, 60 nt, Human
ucucugggggcgauggggaaggucaggaguccagcccauucccagggugugugggauagc

SEQ ID NO: 238694 - RNA, 60 nt, Human
ccuuccuccucuuaugcaagcagcucgcagccagcccagaaucucuuaugcagcccaaag

SEQ ID NO: 238695 - RNA, 64 nt, Human
gaagccaaccacagucuauaccauagcaauguuuuuccuuuaauccaguguuacuguguuuauc

SEQ ID NO: 238696 - RNA, 64 nt, Human
aaauuucaccugcaaaccuuaaaccugcaaaauuuuccuuuaauaaaauuugcuuguuuuaaaa

SEQ ID NO: 238697 - RNA, 64 nt, Human
aauguguacaccuuugacuacagcugcagaaguguuccuuuagacaaaguugugacccauuuua

SEQ ID NO: 238698 - RNA, 64 nt, Human
uaauuucuaguugguuuuggaaugcuugauaaaguuccuuuacagcuuuauuuuccugauuugu

SEQ ID NO: 238699 - RNA, 64 nt, Human
cccaacccuaaaauuccauggguaaaaauuuugauuccuuuauuuucaauacugcguuccuuau

SEQ ID NO: 238700 - RNA, 64 nt, Human
cagcuauguggaacugugaguuaauuaaaccucuuuccuuuauaaauuacccagucaugggcag

SEQ ID NO: 238701 - RNA, 64 nt, Human
uaauuuacuagcuguggccucccacuaacuagcauuccuuuaaagagacugggaaauguuuuaa

SEQ ID NO: 238702 - RNA, 64 nt, Human
ccccaggcuuauucagaacugguguuuuuaaaguuuccuuuacccugcccuuguugaacauuua

SEQ ID NO: 238703 - RNA, 64 nt, Human
caaacaaggcagaaacuuccuuuuaauuuccuucuuccuuuauuuuaacaaauggugaaagaug

SEQ ID NO: 238704 - RNA, 64 nt, Human
ccuauuuauuucuuuguuaaauuuuucugauuguuuccuuuauagagugucucagggugcagag

SEQ ID NO: 238705 - RNA, 64 nt, Human
uuauacguuauauguaguugucauucucuuuuguuuccuuuaauugauuagaguugcccuuuug

SEQ ID NO: 238706 - RNA, 64 nt, Human
caguuuaucuucugccaaaauaaaaauuuacuauuuccuuuauauacuuguuuaucuggacugc

SEQ ID NO: 238707 - RNA, 64 nt, Human
uuucaaucagugauuugaauguugauacuuuuuuuuccuuuacauuuccaguaaguuucuuaca

SEQ ID NO: 238708 - RNA, 64 nt, Human
guuugccuaacucccaaacuguuggggugguacauuccuuuaggaccaauuaaaacauaauuga

SEQ ID NO: 238709 - RNA, 60 nt, Human
gagugaggagcccaggaacgacguggucuuccagcccaucuccggggaagacgugcgcga

SEQ ID NO: 238710 - RNA, 60 nt, Human
aagugccaagauuggcuuggcaucugcacuccagcccaggacuguggucugccauugcaa

SEQ ID NO: 238711 - RNA, 60 nt, Human
aaagggccccaguggcuuugggaagcacccccagcccagggugaaacaugcuucuucucu

SEQ ID NO: 238712 - RNA, 64 nt, Human
ugaaagcugauucucaugaauucaaguagcugaguuccuuuauguuucguuuauucacuaaagu

SEQ ID NO: 238713 - RNA, 64 nt, Human
ucagagccuucuucaaaagcuucaaaaggaaggcuuccuuuaaggucaaguuucauaaacuugg

SEQ ID NO: 238714 - RNA, 64 nt, Human
aguuuucuuccccugcccugaugguuggguguuuuuccuuuaaauucucucagccuuacacuca

SEQ ID NO: 238715 - RNA, 64 nt, Human
ggcugguuuuucauuuccauugguuauuuaaaguuuccuuuaaaauaaacgauuuuaaguuaua

SEQ ID NO: 238716 - RNA, 64 nt, Human
aggagcccgaagucugcugcugugcagcauggaauuccuuuaaaaaggugcacuacaguuuuag

SEQ ID NO: 238717 - RNA, 64 nt, Human
cccccacgcccccugcuccaggcugccaaguguuuuccuuuagccgggcggggacagacagagc

SEQ ID NO: 238718 - RNA, 64 nt, Human
agagaaauguuugccuuauguauauucccuuuauuuccuuuaccuuuuguuuuuccuuggaccu

SEQ ID NO: 238719 - RNA, 64 nt, Human
uaacaaagaggaaugagccaggagaacaaacuaauuccuuuaaauaaauaaaaaaaaaaaaugc

SEQ ID NO: 238720 - RNA, 64 nt, Human
acuuuauugccuagaugcugcaauguuuuuauguuuccuuuaugccaaacauaacaaaacaguu

SEQ ID NO: 238721 - RNA, 64 nt, Human
gcggaaaaaggccaaaacuccauauauguuagucuuccuuuaucuuacagcgcagcauuuauuu

SEQ ID NO: 238722 - RNA, 64 nt, Human
uuaaguugguccuuuacacucaggcuuucacuauuuccuuuauaaugaggaugauuauuuucaa

SEQ ID NO: 238723 - RNA, 64 nt, Human
aaacugugcaauugugugcauguuuguuuuuauguuccuuuagaaaacauugacuguuaccauu

SEQ ID NO: 238724 - RNA, 64 nt, Human
cccaccuucaggucugcaucauccuuuucaaauguuccuuuaaaugcagcacacugaguuugua

SEQ ID NO: 238725 - RNA, 64 nt, Human
uuucacuuguugccccaaaugugaaagcauuucauuccuuuaagaggccuaacucauucacccu

SEQ ID NO: 238726 - RNA, 60 nt, Human
uagugcacaaaauaugcugcuuacgugcccccagcccacugccuccaagucaggcagacc

SEQ ID NO: 238727 - RNA, 60 nt, Human
gagcugggguugcaaagucacuggccacauccagcccaaagauaaauuuuguuuguccag

SEQ ID NO: 238728 - RNA, 60 nt, Human
ugcauguuguggguuaaagggagucucucaccagcccaggcccucaggaggaggagauac

SEQ ID NO: 238729 - RNA, 64 nt, Human
ucuagccagagaccugaacuggggaauuugaacauuccuuuacauuguuggagaaaugaagcca

SEQ ID NO: 238730 - RNA, 64 nt, Human
ccucugcccccuccuuuucccacugguucuuggcuuccuuuagagaccccgguaauuguggaac

SEQ ID NO: 238731 - RNA, 64 nt, Human
gucggugccccuauggggcugaccaguagagaauuuccuuuacuguauuuuugugucuggucuu

SEQ ID NO: 238732 - RNA, 64 nt, Human
augcagccagucuguagaaacauucagaucccucuuccuuuacucaaauacaguuucaaaagga

SEQ ID NO: 238733 - RNA, 64 nt, Human
cuagcagaucggugaguaggcugcuuguucagcuuuccuuuaacaccuguugguaaauacuaau

SEQ ID NO: 238734 - RNA, 64 nt, Human
ccaaagagaguguuguagguuuucccuguaguucuuccuuuauagcuuuucuucugauaaccau

SEQ ID NO: 238735 - RNA, 64 nt, Human
uguguccugauagguggauuaggaacaggauucauuccuuuaacuuuaacuuuuggcuaaacga

SEQ ID NO: 238736 - RNA, 64 nt, Human
aaacucauuuuuccuucuucauuuuguauguacuuuccuuuaguugacuauuaucaaagcuugu

SEQ ID NO: 238737 - RNA, 64 nt, Human
aaccguauguggcguauuguuauuagguucuagcuuccuuuaaacuaauaaagaauaagaaaac

SEQ ID NO: 238738 - RNA, 64 nt, Human
augacaauccccuuugauuccucagaaucuggccuuccuuuauagcacuggucauauuguauug

SEQ ID NO: 238739 - RNA, 64 nt, Human
auucacuugaaacuuguccauaugaguaucuuuauuccuuuauuaacuuagggcagauauaaaa

SEQ ID NO: 238740 - RNA, 64 nt, Human
aguuuuuuuuccagaguuccauuaaaucauuuauuuccuuuacuuucucaccucuguugaaaca

SEQ ID NO: 238741 - RNA, 64 nt, Human
acuucauuuucccaguauugaaauagccauacuuuuccuuuacauaccucuauacuuuccagau

SEQ ID NO: 238742 - RNA, 64 nt, Human
uuuucccacuuuccuucugucucuccuuccucccuuccuuuacaguuuaaaaaaaaaaucuaaa

SEQ ID NO: 238743 - RNA, 60 nt, Human
ccgcauucccugccucacaggccggaagucccagcccaguccccgcgcgcgucccucuuc

SEQ ID NO: 238744 - RNA, 60 nt, Human
gggagucuccucacugccacuaaaauccacccagcccacuaacugaggagcuaguguuaa

SEQ ID NO: 238745 - RNA, 60 nt, Human
cugugucccagggggacccacacgaagucaccagcccauagguccagggaggcaggcagu

SEQ ID NO: 238746 - RNA, 64 nt, Human
ucuaagcauucuuuuuuuuuuccuaguugaugccuuccuuuauuacaaaucaguauuaaaacuu

SEQ ID NO: 238747 - RNA, 64 nt, Human
gggugcaaauaucucuuugagacucugccuuuaauuccuuuaccacccagaguuuuaucuuuag

SEQ ID NO: 238748 - RNA, 64 nt, Human
cagccauguggaacagugagucaauuaaaccucuuuccuuuauaaauuauccagucuugggcaa

SEQ ID NO: 238749 - RNA, 64 nt, Human
uuuugagaaagcacaggguuauagguguuuaaauuuccuuuagugaaacucuuauuuauuuuua

SEQ ID NO: 238750 - RNA, 64 nt, Human
cuggggauuccagggaccccacuuagugcucuauuuccuuuauagguuuuauuucuggucauag

SEQ ID NO: 238751 - RNA, 64 nt, Human
auugaaaugguauucuuccuuaacucuuccuucuuuccuuuauuuguuuagacgugcuucaucc

SEQ ID NO: 238752 - RNA, 64 nt, Human
accuugaaucuuuuuaucccauuuagugugaauauuccuuuauuuugcugcuugaugaugagag

SEQ ID NO: 238753 - RNA, 64 nt, Human
agcacacuuuaaccaguuauuuacaguuaccuuuuuccuuuaaccggauugugaaagcuucaug

SEQ ID NO: 238754 - RNA, 64 nt, Human
uuuguugguauauuaucugguuagugguuaaugcuuccuuuaaaaauaauugagucauccauuc

SEQ ID NO: 238755 - RNA, 64 nt, Human
caagcuggaauggcccaccagcccaucccagaucuuccuuuauuaaaauaauaacucugaaagc

SEQ ID NO: 238756 - RNA, 64 nt, Human
acaacaggagcugcguuguuuucuucuuuuucuuuuccuuuaucuguuguccaacaacagugcu

SEQ ID NO: 238757 - RNA, 64 nt, Human
uucuuccgcgcuccugucccguaaacgccugcgcuuccuuuaaggaguucucucucuguggugu

SEQ ID NO: 238758 - RNA, 64 nt, Human
ugcaucaaaucacaaaaagaauaaauagagcuuuuuccuuuaucagucccuugggcacagcagg

SEQ ID NO: 238759 - RNA, 64 nt, Human
gacugugugcccaccgagcuccugaguguucucauuccuuuacccacuucugcauaguagcccu

SEQ ID NO: 238760 - RNA, 60 nt, Human
acaaaugacugucugggcccacacaguuaaccagcccauuucuccacacugguacaguag

SEQ ID NO: 238761 - RNA, 60 nt, Human
cccacagggcagguggggaagcaguuuggcccagcccaaggagaccccaccuugagccuu

SEQ ID NO: 238762 - RNA, 60 nt, Human
augggaauuugcuguugcacaauuugagaaccagcccauuucauaauaaaagauuaaugu

SEQ ID NO: 238763 - RNA, 64 nt, Human
ugguggugguguuucugauuugaagaaacugacauuccuuuaaaaauauaaauauaaauacaua

SEQ ID NO: 238764 - RNA, 64 nt, Human
ucuccucuuuucaguggguaacaguaucaucauauuccuuuauaguuacuaaguuucuggucua

SEQ ID NO: 238765 - RNA, 64 nt, Human
agcuguuaaaacagcacacaucucucauccccucuuccuuuauuccccccuggguuucagaaag

SEQ ID NO: 238766 - RNA, 64 nt, Human
aguucgguuccgaugaauucuuauccccugccccuuccuuuaaaaaacuuagugacaaaauaga

SEQ ID NO: 238767 - RNA, 64 nt, Human
gcuuuccacugucgucgucuccccacuuucccucuuccuuuaagaaaacuuacuaaaaaauguu

SEQ ID NO: 238768 - RNA, 64 nt, Human
aguacacccacaaaacaauaugaauauggagaucuuccuuuaccccucaacuuuaauuugccca

SEQ ID NO: 238769 - RNA, 64 nt, Human
ugcaguggcccuagggguuccacuagugucugcuuuccuuuauuauugcacugugugagguuuu

SEQ ID NO: 238770 - RNA, 64 nt, Human
ucuuauccaucaaaaaucacuuuaacuuuucuuguuccuuuacucuuccauauaaauuguuuau

SEQ ID NO: 238771 - RNA, 64 nt, Human
gacaguuuaccauccucaagaucauucaguguuuuuccuuuaaaaaaauggucaauaaagcucc

SEQ ID NO: 238772 - RNA, 64 nt, Human
acuguuuuacucugauacuaccuggauaucuagcuuccuuuaccccuguucugcuuaacagaac

SEQ ID NO: 238773 - RNA, 64 nt, Human
aggaaacacuaaggcugcuucaaagauuaucugauuccuuuaaaauauaugucuauauacacag

SEQ ID NO: 238774 - RNA, 64 nt, Human
ccuggucaccaaggcagugcaugcauguugggguuuccuuuaccuuuucuauaaguuguaccaa

SEQ ID NO: 238775 - RNA, 64 nt, Human
uauuuguuguuaugaugaguaugcaccuaccauuuuccuuuauugugaucacuaaaaugaggcc

SEQ ID NO: 238776 - RNA, 64 nt, Human; identical to SEQ ID NO: 238774

SEQ ID NO: 238777 - RNA, 60 nt, Human
gggucucuugggccauggacauccccacuuccagcccauguacacuaguggcccacgacc

SEQ ID NO: 238778 - RNA, 60 nt, Human
cacggucugcgcccuggggccucaucucccccagcccacuuguuuuccccccuuuuauuc

SEQ ID NO: 238779 - RNA, 60 nt, Human
ccccagcuuugcccaacaccagccccugccccagcccaaguccaaauguuuacagggagc

SEQ ID NO: 238780 - RNA, 64 nt, Human
ucugcuugagcuacuugguugauucauauccucuuuccuuuauggagacccauuuccugaucuc

SEQ ID NO: 238781 - RNA, 64 nt, Human
ucaaaagauuguguucccauuaagugguaguaauuuccuuuauuauucuguauccuuaauggug

SEQ ID NO: 238782 - RNA, 64 nt, Human
uugaauugugacuugcaccuuuuguucaaaguauuuccuuuaggcauuguaauugugaacagcu

SEQ ID NO: 238783 - RNA, 64 nt, Human
gcuugaaacuucagcccugaaccuuuguccaccauuccuuuaaauucuccaacccaaaguauuc

SEQ ID NO: 238784 - RNA, 64 nt, Human
gccugugucucuugcugugccucuugcuggcgucuuccuuuauugaagcuugcugaugcacugu

SEQ ID NO: 238785 - RNA, 64 nt, Human
augguuuugucagguguguaaauuugcaaauuguuuccuuuauauauguauguauauauauaua

SEQ ID NO: 238786 - RNA, 64 nt, Human
gcagggagaagaacaugagguagacuuaaagaacuuccuuuauguaaagaucugugacucugaa

SEQ ID NO: 238787 - RNA, 64 nt, Human
guggcgggagcagagucccccccuccggccccucuuccuuuaccccuucuccuccagcaguggc

SEQ ID NO: 238788 - RNA, 64 nt, Human
cugcuccuuccuguggccucauccaaacuguaucuuccuuuacuguuuauaucuucacccugua

SEQ ID NO: 238789 - RNA, 64 nt, Human
uugguuuaaguucaaaugaaugaaacaacuauuuuuccuuuaguugauuuuacccugauuucac

SEQ ID NO: 238790 - RNA, 64 nt, Human
gggaauuccucuggcucauagaacccuuuuuuuuuuccuuuaaguauucuugagauacaaaaaa

SEQ ID NO: 238791 - RNA, 64 nt, Human
uccuuaccauaaguauucugguccgaggguucaguuccuuuagucaagaugucacaaguuuaaa

SEQ ID NO: 238792 - RNA, 64 nt, Human
uaaaaugaaugugggugaagccgcccuaaggauuuuccuuuaauuucucuggaguaauacugua

SEQ ID NO: 238793 - RNA, 64 nt, Human
gcaagacugggauggguacaacugaacuggggucuuccuuuacuacccccuucuacacucagcu

SEQ ID NO: 238794 - RNA, 60 nt, Human
ggcagucagagcuggaaguguauggagagcccagcccaccagguccugccuuuugcggug

SEQ ID NO: 238795 - RNA, 60 nt, Human
cccagcucaggccugggccagccccugcccccagcccacugagggggugggcuuacuccc

SEQ ID NO: 238796 - RNA, 60 nt, Human
cucugcugcuacagaggggcagggccucccccagcccacgcuuaggaaugcuuggccucu

SEQ ID NO: 238797 - RNA, 64 nt, Human
uggggacgugaacguuuuaauaauuuuugcugaauuccuuuacaacuaaauaacacagauauug

SEQ ID NO: 238798 - RNA, 64 nt, Human
cuuuuaaguuugcugcuguuuugauuaauuauguuuccuuuaauuuuuuggaugugaguugaug

SEQ ID NO: 238799 - RNA, 64 nt, Human
caugcaguguucucuuuugacuaaaucaccuagguuccuuuaaacaugcuacaaagcccaggca

SEQ ID NO: 238800 - RNA, 64 nt, Human
uucaaacuggugcaaauggaaaagacuuucucuuuuccuuuaaagcuaaagacaagaauaucau

SEQ ID NO: 238801 - RNA, 64 nt, Human
aaaauauugugucugugugcauagucugcagcauuuccuuuaauugacucaauaagugagucuu

SEQ ID NO: 238802 - RNA, 64 nt, Human
cuuuuucucucucauauuaaucugauguauaacuuuccuuuauuucacuuguacccaguuucac

SEQ ID NO: 238803 - RNA, 64 nt, Human
cuacaguugagaagaaaaugacagacaauuauuuuuccuuuaggucaaaauaaugucacugcua

SEQ ID NO: 238804 - RNA, 64 nt, Human
uacuucugcccacguuguuuucucucaaaauccauuccuuuaaaaaauaaaucugaugcagaug

SEQ ID NO: 238805 - RNA, 64 nt, Human
gcauggcuaguugaaaaugguauuagauacuuauuuccuuuaaacuuuauuuaaaacaaacaac

SEQ ID NO: 238806 - RNA, 64 nt, Human
uacauucaguuguuuugcauaacgucugccuucuuuccuuuacgguccaugccuuuaauguugc

SEQ ID NO: 238807 - RNA, 64 nt, Human
guucuggggacagugguuugcucugagaccucgcuuccuuuauggauccaaggagacuugcuuu

SEQ ID NO: 238808 - RNA, 64 nt, Human
auauauauauuauauauauucuuaguucuaagauuuccuuuaauucuaugauucucuggauuua

SEQ ID NO: 238809 - RNA, 64 nt, Human
cacaaagggagaaaugggacauggauucuugaucuuccuuuacacauuucucgggaaaucugaa

SEQ ID NO: 238810 - RNA, 64 nt, Human
auuucuaauggauuugcuuuucuuuuuauauggauuccuuuaaaacuuauuccagauguaguuc

SEQ ID NO: 238811 - RNA, 60 nt, Human
uugauggcuacaaauaaaugucccguggccccagcccacucuacuggugucucucucucu

SEQ ID NO: 238812 - RNA, 60 nt, Human
agcaauaagagaaagauauuuguaaucucuccagcccaugaucucgguuuucuuacacug

SEQ ID NO: 238813 - RNA, 60 nt, Human
aucagcugcaacacacugucuuuaauacccccagcccaggagcucgugccuuacaugcug

SEQ ID NO: 238814 - RNA, 64 nt, Human
acguuucauguaugaaugacaauaguuugaugauuuccuuuacugaucuuaaauauuuaugcca

SEQ ID NO: 238815 - RNA, 64 nt, Human
auacuuucaauggaauaccagcuaaccagauauguuccuuuaaaacaugaauuuuuuugucuua

SEQ ID NO: 238816 - RNA, 64 nt, Human
acuuuaggcucucaugccccuaagaaaagugaauuuccuuuaacaccgccugaaacaugcacac

SEQ ID NO: 238817 - RNA, 64 nt, Human
cccagaagcagagaaaagcaggcacuguucacuuuuccuuuauucuuaauggccuuccucuguu

SEQ ID NO: 238818 - RNA, 64 nt, Human
caaagcuuguuccaucaaguuagggauuaaucgauuccuuuauguuuuauaagaguuuaccggc

SEQ ID NO: 238819 - RNA, 64 nt, Human
auuguagccuugcugcccaggggagggauaugucuuccuuuaugcaucugggaaaccaggaaca

SEQ ID NO: 238820 - RNA, 64 nt, Human
auuccuucaugucuaggauaacuugcuuucuucuuuccuuuacuccuggcucaagcccugaauu

SEQ ID NO: 238821 - RNA, 64 nt, Human
uaggggcaguguagguccuggggcagccccuuuauuccuuuaugccccuucucccucauagccu

SEQ ID NO: 238822 - RNA, 64 nt, Human
auagucauguugggcuaacagucaauuggauauauuccuuuaccucacaugaccccagcaacug

SEQ ID NO: 238823 - RNA, 64 nt, Human
ugcccaugugucaggaguggcugucucuggucucuuccuuuagcugacaaggacacuccugagg

SEQ ID NO: 238824 - RNA, 64 nt, Human
aauugucuuuuuccauaaaaaagauuacuuuccauuccuuuaggggaaaaaaccccuaaauagc

SEQ ID NO: 238825 - RNA, 64 nt, Human
gaugaucaaacacuggaauauauuuuccuaggacuuccuuuauucugguuucuuguuuguuugu

SEQ ID NO: 238826 - RNA, 64 nt, Human
gucaccucaaaugcaauacuuuggguugguuucuuuccuuuaaaaaaauuuguauaaaacugga

SEQ ID NO: 238827 - RNA, 64 nt, Human
ggugcaaggcagggaggcagagagaauguugugcuuccuuuagcuuuuguauuucgauggccag

SEQ ID NO: 238828 - RNA, 60 nt, Human
auggauggcuugcagggcagccccugguaaccagcccagucaggccccagccccguuucu

SEQ ID NO: 238829 - RNA, 60 nt, Human
uaaaugaguuucuucacaugaaaaacacagccagcccaagaugacuuaucuggguuuagg

SEQ ID NO: 238830 - RNA, 60 nt, Human
uauuggauuccaguacaaacgccaccaaagccagcccacugcucuccuacaaggaaggaa

SEQ ID NO: 238831 - RNA, 64 nt, Human
gauaccauucaccgccuucagcccagaugauacuuuccuuuaaaucugugucucuguguguaua

SEQ ID NO: 238832 - RNA, 64 nt, Human
aggcagcagaaauuaaaugaauuuuucuuccugauuccuuuaaaugaauaugaaacacuacaaa

SEQ ID NO: 238833 - RNA, 64 nt, Human
aguuuagaauucuggcauugacauuucccucucuuuccuuuauuucgaugaagcuauaauugug

SEQ ID NO: 238834 - RNA, 64 nt, Human
uagaauugcaacugucagguuuuguguucuuguuuuccuuuaguuggguuuauuuccaggucac

SEQ ID NO: 238835 - RNA, 64 nt, Human
gcuugacuucaugccagcuauaaucuccccugccuuccuuuaaucccaauuuccccugcucacu

SEQ ID NO: 238836 - RNA, 64 nt, Human
caguacuaaaaugccccaaaguucuauacagcauuuccuuuauagcauucaaaccucacauccu

SEQ ID NO: 238837 - RNA, 64 nt, Human
aagaauuuucagcaaaguacaaaaauuuaaagcauuccuuuaauuuuuuaauucuuuacugugg

SEQ ID NO: 238838 - RNA, 64 nt, Human
uacuugacaaauuugugugacagacuccgaacaauuccuuuacuacgaaguauaauuuauaaaa

SEQ ID NO: 238839 - RNA, 64 nt, Human
uuuacaguagaagcauccuuugcugaguuauacauuccuuuaucaaucucuuuugauacaacau

SEQ ID NO: 238840 - RNA, 64 nt, Human
uuuaagauacuucugauuuguacaaaaggaauguuuccuuuauaaaucacagaagaaaaugaca

SEQ ID NO: 238841 - RNA, 64 nt, Human
agcuucgguggaagauacgaaaagggugugcaauuuccuuuaaaauuuacacgugggaaacauu

SEQ ID NO: 238842 - RNA, 64 nt, Human
accagaaaacuaacuccaaauaaacgcuuacccuuuccuuuagguuucuuuguuuuguuuuuga

SEQ ID NO: 238843 - RNA, 64 nt, Human
cauagcacuaacauucaguagucauguccagcucuuccuuuaugucagguaccuagacauagcg

SEQ ID NO: 238844 - RNA, 64 nt, Human
cacaacacucaaacacaguugcugcacuuggauuuuccuuuaauaccaaguaucauuugguuau

SEQ ID NO: 238845 - RNA, 60 nt, Human
cuagcaauuauggaccauaagcacuucccuccagcccacaagucacagccuggugccgag

SEQ ID NO: 238846 - RNA, 60 nt, Human
gaccacuguaagugagaacaaauuacuggcccagcccaacccacaccaaauaagaaauuu

SEQ ID NO: 238847 - RNA, 60 nt, Human
cugccaaaggaccccucgacuggccacagcccagcccagccugacguggauguggcugcc

SEQ ID NO: 238848 - RNA, 64 nt, Human
ugagauuggacaagaagauguuacuaaagagaaguuccuuuaaaaggucuuguucuugugucaa

SEQ ID NO: 238849 - RNA, 64 nt, Human
agcggugacuguauaaccgagagucacugguggguuccuuuacugaagggagacgaaggcaggg

SEQ ID NO: 238850 - RNA, 64 nt, Human
gcacucaguagagggcugaugaaacuaauuuuuuuuccuuuaagacaugcacucuugaguccua

SEQ ID NO: 238851 - RNA, 64 nt, Human
uccuaauauuccacuccgcagugcaaacaaucucuuccuuuaaaaaggaauaauaauacaauau

SEQ ID NO: 238852 - RNA, 64 nt, Human
caugaugaaugaccagaugcuuauggucuacauuuuccuuuauccuguuaguauuaccuuccuu

SEQ ID NO: 238853 - RNA, 64 nt, Human
aauauuguuuuaugaguuuuaugaauucaugcccuuccuuuacucuauuagcauaagcaguaaa

SEQ ID NO: 238854 - RNA, 64 nt, Human
agccuguauucuuucaaugaaugucaguaggaccuuccuuuagcuguaagacuuggugggcggg

SEQ ID NO: 238855 - RNA, 64 nt, Human
uaaaauuugguuuguucguuuuugaggggaaccauuccuuuauguugccccuuacugaugccca

SEQ ID NO: 238856 - RNA, 64 nt, Human
cuuggucucuggaaguuuuaccacauguaacagauuccuuuauauguaguggaaaucacuauuu

SEQ ID NO: 238857 - RNA, 64 nt, Human
auagcauucaguaggacuggacuggaccccagguuuccuuuacaugagaucccauuucucaccc

SEQ ID NO: 238858 - RNA, 64 nt, Human
guaacuccucgccuguugcugcuuugcaaugaauuuccuuuaccuuucuggaacacaagcugcu

SEQ ID NO: 238859 - RNA, 64 nt, Human
ucaggcccuugccacgaccuacuuaggcuacaauuuccuuuaaggcagccccuagcucugggaa

SEQ ID NO: 238860 - RNA, 64 nt, Human
aaugaaauagggugguuuuuguuucuguuccuaauuccuuuaaaaaauagggggaauaguauuu

SEQ ID NO: 238861 - RNA, 64 nt, Human
aauuccugaaguaugcugaauggacuuuuuaagguuccuuuagcauuuuuguauagaguuauau

SEQ ID NO: 238862 - RNA, 60 nt, Human
aggaaugcgguugggaggcaggucgggcugccagcccagcuggccggaaggagacugugg

SEQ ID NO: 238863 - RNA, 60 nt, Human
gaagugccauuuguugaagccuacugcaugccagcccacugcucauccacguggucugcc

SEQ ID NO: 238864 - RNA, 60 nt, Human
gcauuucucuggcugguuccacuaaaugugccagcccaaaugcagggcaugggcucuggu

SEQ ID NO: 238865 - RNA, 64 nt, Human
acguuugguuuuuuuuuguuuuuguuuuuguuuuuuccuuuauaagguugucuguuuuuuuuuu

SEQ ID NO: 238866 - RNA, 64 nt, Human
aguuaacucugcugccaucuuguuuuuuuuuuuuuuccuuuauuuugauaagugauuauuaugc

SEQ ID NO: 238867 - RNA, 64 nt, Human
auaguauugucugacuuuuuauuuucuacuaugguuccuuuagcagaaaaguaacuuuugugca

SEQ ID NO: 238868 - RNA, 64 nt, Human
uaauuuucuuuugacuuuaaugugccaauguaacuuccuuuaaaggaucuaugcauuuauuaaa

SEQ ID NO: 238869 - RNA, 64 nt, Human
uuauuguacaaguauucuaccuaaaucuuccaauuuccuuuaaaugguaagaguuucuaaaaca

SEQ ID NO: 238870 - RNA, 64 nt, Human
agggcugcuuugccuauggaguagccauucuauauuccuuuacuuucuuaauaaacuugcuuuc

SEQ ID NO: 238871 - RNA, 64 nt, Human
auuccuuuauuuuuauaaauuauucccccuaucauuccuuuacagugccuagugcuacucauua

SEQ ID NO: 238872 - RNA, 64 nt, Human
aguuguaagcuccuugagagcaggauccaugucauuccuuuauuuuuauaaauuauucccccua

SEQ ID NO: 238873 - RNA, 64 nt, Human
uuuguguaucauuuuuuuguuucuuaauccaauauuccuuuacaaauuaaaugccuugaaaaau

SEQ ID NO: 238874 - RNA, 64 nt, Human
augacugaaagcuguucuguggaugaccuacccuuuccuuuaaacacgauucucucacuuccaa

SEQ ID NO: 238875 - RNA, 64 nt, Human
cugaaugagagaaaauuguauaaccauccugcuguuccuuuagugcaauacaauaaaacucuga

SEQ ID NO: 238876 - RNA, 64 nt, Human
cugagauugaauuuacaaaggaauucagugucaguuccuuuacagaggaaugucuuauacuuca

SEQ ID NO: 238877 - RNA, 64 nt, Human
uggccaugcugaacucuucagucaauuaaacacuuuccuuuauaaauuacccagucuugggcag

SEQ ID NO: 238878 - RNA, 64 nt, Human
caugcuuccagugauuugucuccguaaugccuucuuccuuuauuuggccuuucuuucuuucugu

SEQ ID NO: 238879 - RNA, 60 nt, Human
cauuuuccuugcuucucuuauugcacacccccagcccauuuugcuucucucuuggauuuu

SEQ ID NO: 238880 - RNA, 60 nt, Human
ugugcaguccagcccugccuugcugcagccccagcccagauggcacucagcgcucucccc

SEQ ID NO: 238881 - RNA, 60 nt, Human
ccagggucuggaggguugcuaucacuuuguccagcccaaauaccuuccugggcaacuccu

SEQ ID NO: 238882 - RNA, 64 nt, Human
uuauuccauuuucuucuggucaccagaugauuucuuccuuuaccaucaaauacuucuucauaau

SEQ ID NO: 238883 - RNA, 64 nt, Human
auguguauuaaugucuaacuacauacgcaaaaacuuccuuuacagagguucggacuaacauuuc

SEQ ID NO: 238884 - RNA, 64 nt, Human
uuucacuuuuuucuucugccauccacccucauuuuuccuuuagcaagauuuuuauaucuaacuu

SEQ ID NO: 238885 - RNA, 64 nt, Human
ucaaaauaaguguaauccacgguagcagccacacuuccuuuagaaggaacuguuauaauuuauu

SEQ ID NO: 238886 - RNA, 64 nt, Human
cagguacuuuuuauuauuauuuuuucuguuugaauuccuuuaagagauuuuguuggguauccau

SEQ ID NO: 238887 - RNA, 64 nt, Human
ucuguugccaagaauuagugcuguacuauuguaguuccuuuaggauuuguaugugcucugggcu

SEQ ID NO: 238888 - RNA, 64 nt, Human
uggcuguuuccaaagagagcacuuaauuuaauuuuuccuuuaaaugacccagggcuguuccguc

SEQ ID NO: 238889 - RNA, 64 nt, Human
ucaaaaaccucagaggcugaaauuccuaauaccuuuccuuuaucgugguuauagucagcucauu

SEQ ID NO: 238890 - RNA, 64 nt, Human
ugcugcuaagauuuugccgucccauucccauuuuuuccuuuacaauuuuaaacaaguuucuuca

SEQ ID NO: 238891 - RNA, 64 nt, Human
acaacuuuaccaggguuuuggcauuuccuuuccuuuccuuuauaaaacaugcucagcaaacugc

SEQ ID NO: 238892 - RNA, 64 nt, Human
uacacagcaauaauuacaguaaauuaaauaaagauuccuuuaaggcagacaagggcuaagauuu

SEQ ID NO: 238893 - RNA, 64 nt, Human
ccaucuuacuggggaaaagagcaaguagccugucuuccuuuaaguaaguagccuguaauggaug

SEQ ID NO: 238894 - RNA, 64 nt, Human
gggcuacccaagccccuccaggugagcugggccuuuccuuuaugaaccuccauccucccagcca

SEQ ID NO: 238895 - RNA, 64 nt, Human
cccauaagccaggaaaagugaaaagagaacacaguuccuuuaagaacuggcagcaaggcuugag

SEQ ID NO: 238896 - RNA, 60 nt, Human
ccacauggcugggauuuaaagccuuuagagccagcccauggcuuuagcuaccucacuaug

SEQ ID NO: 238897 - RNA, 60 nt, Human
aggguccuuucuuguuaggaguuuauccugccagcccauaaauggacuauuuauuguaag

SEQ ID NO: 238898 - RNA, 60 nt, Human
ugccuccuccagagggacauggcaauguuaccagcccaccuucugaagccugggaggugu

SEQ ID NO: 238899 - RNA, 64 nt, Human
cuugggcucaagcaucacgccuagcaguuucugguuccuuuaacagcaaaaggaaagagagguu

SEQ ID NO: 238900 - RNA, 64 nt, Human
uuaacaguuauuagguugucauuuaaaaauaaaguuccuuuauauuucugucccaucaggaaaa

SEQ ID NO: 238901 - RNA, 64 nt, Human
cugacauuacagaccaccggauaaggccccauucuuccuuuacacccuccccuggucagccuag

SEQ ID NO: 238902 - RNA, 64 nt, Human
uacuuuuuuaaagaguacucccggcauggucaauuuccuuuauaguuaauccguaaagguuucc

SEQ ID NO: 238903 - RNA, 64 nt, Human
ugaggaguguugccccauccagagaaugaaugaguuccuuuaagugccaccgccagcaagccca

SEQ ID NO: 238904 - RNA, 64 nt, Human
cgcuugcuaucauggcagcaugcgaugucauauuuuccuuuaugugauguaacuacuuucuguu

SEQ ID NO: 238905 - RNA, 64 nt, Human; identical to SEQ ID NO: 238887

SEQ ID NO: 238906 - RNA, 64 nt, Human
ggauaguuuuaacaacaggaaacacuuguaggacuuccuuuaccaacauacuuuuuaaauguuu

SEQ ID NO: 238907 - RNA, 64 nt, Human
ccagagagaaguuaaacaaaagguuauguaacuguuccuuuaauguuguaauugaaaacuuggu

SEQ ID NO: 238908 - RNA, 64 nt, Human
uuuauaugaaaagaucaccuuaagugaaauuauuuuccuuuaaucuuuuauguauuuauucacu

SEQ ID NO: 238909 - RNA, 64 nt, Human
agaauucuguaggcaaaaugcuacaguucauaucuuccuuuaaccaaacugaaguacauaaaga

SEQ ID NO: 238910 - RNA, 64 nt, Human
ugcuuggcuucuuuuagggcuacccccaucucauuuccuuuagcccgugugccuguaacucuga

SEQ ID NO: 238911 - RNA, 64 nt, Human
ugacagcuuccuuuccuguguguacucuguccaguuccuuuagaaaaaauggaugcccagagga

SEQ ID NO: 238912 - RNA, 64 nt, Human
agggaaguagauguuuugccaaaauacuucuucauuccuuuaaaaacuacaucuuuccuaugca

SEQ ID NO: 238913 - RNA, 60 nt, Human
ccccacuccuacgacugggagcugacaugaccagcccacugauccugucagcagguccug

SEQ ID NO: 238914 - RNA, 60 nt, Human
ccacuccccuugccccacacccuuuacuccccagcccagagagacgcugcuuuuaccagg

SEQ ID NO: 238915 - RNA, 60 nt, Human
uguagaagcuuguauuuguguacaggugugccagcccaugcagguguacacagacacacc

SEQ ID NO: 238916 - RNA, 64 nt, Human
cugaugauaacauauuaccuuauuugaacaaguuuuccuuuauugaguaccaagccauguaaug

SEQ ID NO: 238917 - RNA, 64 nt, Human
gaugagcuggggcccuuuuucuuuugcuggaugguuccuuuaugcagcuuggcccugucuaccg

SEQ ID NO: 238918 - RNA, 64 nt, Human
gacacagagacuauuuuaucaauugucagucccguuccuuuaccauaggauucuccacaguggc

SEQ ID NO: 238919 - RNA, 64 nt, Human
ggcucugcccgacaugccgugggagcugcugggauuccuuuagaaaccgcugcccgcaugcuuu

SEQ ID NO: 238920 - RNA, 64 nt, Human
augaagaacacuucucaacaguuuccuuuuuguuuuccuuuauaauucacuaaaauaaagcauc

SEQ ID NO: 238921 - RNA, 64 nt, Human
agggucauaugcaugacaggaaaaugaaagaaacuuccuuuacuuuucuaucucuggauuuaaa

SEQ ID NO: 238922 - RNA, 64 nt, Human
acgggggggggucggggcaaagcuccaucuccccuuccuuuaaccagguccuagggcugagguu

SEQ ID NO: 238923 - RNA, 64 nt, Human
gacaacuuggacaaccugugagugcaucucuucuuuccuuuagucuucacagcuaacucuggag

SEQ ID NO: 238924 - RNA, 64 nt, Human
aauugaggggauuaauaugaaaacuuaugaccucuuccuuuaggagggaguuaucuaaaagaaa

SEQ ID NO: 238925 - RNA, 64 nt, Human
cugagacuuuacuggccuaugccugaggccucuuuuccuuuaacucccuaaauuaugaugacuc

SEQ ID NO: 238926 - RNA, 64 nt, Human
uucccuuuggaacaugaguuauaaguuauuacuuuuccuuuacauguuuacacuuuuauaaaaa

SEQ ID NO: 238927 - RNA, 64 nt, Human
auugauuagauccaguccuucuaagaaaccuccuuuccuuuaacaaaaagaccuugaccaugaa

SEQ ID NO: 238928 - RNA, 64 nt, Human
agaugccuggccucucucugccaaaaagcauuuuuuccuuuaaauauguuuuuuaagaacaggg

SEQ ID NO: 238929 - RNA, 64 nt, Human
uuauuuuuugagguuuuucuagcaaacguauuguuuccuuuaaaagccaaaaaaaaaaaaaaaa

SEQ ID NO: 238930 - RNA, 60 nt, Human
ugcauccaccacagcaucaauucccuugauccagcccaagagaccaggcagccauggcca

SEQ ID NO: 238931 - RNA, 60 nt, Human
agcuguauccucuaaccacgagacccucaaccagcccaacaucuuccauggacacaugac

SEQ ID NO: 238932 - RNA, 60 nt, Human
guccggugaccucccccagggccuccuugcccagcccaguccaggcugcugugccaaauc

SEQ ID NO: 238933 - RNA, 64 nt, Human
gugccugcgugggugugugcguguuuggguuuuuuuccuuuaacugacaagccaucuugagugg

SEQ ID NO: 238934 - RNA, 64 nt, Human
gguaagcucauccauuagcugcguccuucagcuauuccuuuagauuggaggaaguggauaugaa

SEQ ID NO: 238935 - RNA, 64 nt, Human
aggagagcugagcaagcuggugaaaccacucuccuuccuuuaaacaccguuucaaccaaccucu

SEQ ID NO: 238936 - RNA, 64 nt, Human
aauuccaagugcuguaaacauaacugagaaccaguuccuuuacuaaacauccauuuuauaaaac

SEQ ID NO: 238937 - RNA, 64 nt, Human
uugggggccccaugggaaagagcuucugaacucuuuccuuuaugaacucccacuguguuccuau

SEQ ID NO: 238938 - RNA, 64 nt, Human
aucaagaagcaaucugugacaaagucugagggucuuccuuuaugcuugcccuccacacuaagag

SEQ ID NO: 238939 - RNA, 64 nt, Human
aaauggagucaaauccgcgugguuuguaucuucuuuccuuuaaucuugggcauuuuguuucucu

SEQ ID NO: 238940 - RNA, 64 nt, Human
uccucaggaccaugagguagcuuuggccaauggauuccuuuaugagcaugaagcauguggcaau

SEQ ID NO: 238941 - RNA, 64 nt, Human
accugggguucucucuauugaguugagccccuucuuccuuuaguggguuuuggacaucuucugg

SEQ ID NO: 238942 - RNA, 64 nt, Human
cuccugacccacaaaugacugagugcuccauuucuuccuuuaccccccauuuuuccuauuauuc

SEQ ID NO: 238943 - RNA, 53 nt, Human
acauaggcuuagaugacugaguuuuccuuuaggaaaacucccgagggccaaac

SEQ ID NO: 238944 - RNA, 64 nt, Human
aaggauggcgcagguccugggcaggaaagaauuuuuccuuuaucacauaacuguaauauuuggu

SEQ ID NO: 238945 - RNA, 64 nt, Human
aauaaggaucugaauaaauccagaucacagacuguuccuuuaccaauauguaaaagaaugugca

SEQ ID NO: 238946 - RNA, 64 nt, Human
cuuuugaauuuuaauuuagguguuuuggguuuuuuuccuuuaaagagaauaguguucacaaaau

SEQ ID NO: 238947 - RNA, 60 nt, Human
cugcccgaggagcccugccugccccgacacccagcccagcuugccaauggcggacucaaa

SEQ ID NO: 238948 - RNA, 60 nt, Human
aggagucccuaccacccaucucaucacuuuccagcccagcacucuucaugcucauucauu

SEQ ID NO: 238949 - RNA, 60 nt, Human
gagcgcagccuucccaguaacuucuaccugccagcccagagggaaauauggauuuucaca

SEQ ID NO: 238950 - RNA, 64 nt, Human
uugccaggcucccuuucucuucuuccccagguccuuccuuuaggucugguuguugcaccaucug

SEQ ID NO: 238951 - RNA, 64 nt, Human
uaaaauuaaauuauaauaaauauugccaaaugcuuuccuuuagcauuguuccaagucuaaaugu

SEQ ID NO: 238952 - RNA, 64 nt, Human
gauuacaggcaugagccacugugucuggcccuauuuccuuuaaaaagugaaauuaagaguuguu

SEQ ID NO: 238953 - RNA, 64 nt, Human
uccuuuauuguccauuccaauacauugaacacauuuccuuuacccuccacacacuucuuccaaa

SEQ ID NO: 238954 - RNA, 64 nt, Human
cagcugcacaacguggggugcaaaacugccccgcuuccuuuacagcucuucucaacccucaccu

SEQ ID NO: 238955 - RNA, 64 nt, Human
agaaccugagauuuuuaaucauuagguuuuagauuuccuuuagcagcagagacugacuugcugu

SEQ ID NO: 238956 - RNA, 64 nt, Human
ccucucucccuucccccuccucaaggaaauagucuuccuuuauggauuuucauuggacucuuuc

SEQ ID NO: 238957 - RNA, 64 nt, Human
uguucggauaugccaaagagaaaccguaaggugcuuccuuuaagugaaaagaugggaagaaaac

SEQ ID NO: 238958 - RNA, 64 nt, Human
uuccuauucauuguuucuuaucaguuuaaaaggauuccuuuaagcaugucagaugaaaagcaau

SEQ ID NO: 238959 - RNA, 64 nt, Human
uaauuuuaauguacugauaaaaacaaacaugguuuuccuuuacuuugacaaaguaauguaauuu

SEQ ID NO: 238960 - RNA, 64 nt, Human
uuuaaaaguuggauauuuaggauauuugaggauauuccuuuaugagcucuccauauccuucuug

SEQ ID NO: 238961 - RNA, 64 nt, Human
cuggaauuugggcugggaaaaaucuugugguuauuuccuuuaaaaaggaacaaaacuuuaguau

SEQ ID NO: 238962 - RNA, 64 nt, Human
cauucuugcucaucuccaaauaaaacguguuuuauuccuuuagcgugguaaauauagcucuaug

SEQ ID NO: 238963 - RNA, 64 nt, Human
gcacugcuuuauaauaaaaugaaauauauucuacuuccuuuauuuugugguuuacacgguuguc

SEQ ID NO: 238964 - RNA, 60 nt, Human
ccauuucgccccucauuuaucccucaacccccagcccacagguguuuauacagcucagcu

SEQ ID NO: 238965 - RNA, 60 nt, Human
agaauuacagggagaaaaaacuuguacuuaccagcccaauucuacucuccucaaacugac

SEQ ID NO: 238966 - RNA, 60 nt, Human
cccgacucccugggacaguaguguggagucccagcccaggcugaccucacaccggagcuu

SEQ ID NO: 238967 - RNA, 64 nt, Human
ccaggcuuugugcugagugcuguacauguauuaguuccuuuacugcugaccacauuguacccau

SEQ ID NO: 238968 - RNA, 64 nt, Human
gacaucaacuauucuaaaaauuguguacaggauauuccuuuagugguggaauuaaaauguacga

SEQ ID NO: 238969 - RNA, 64 nt, Human
gacacuuuuuguagaacccauguuguauacaguuuuccuuuauucaguacaaucuuuucauuuu

SEQ ID NO: 238970 - RNA, 64 nt, Human
uccaaggccgagccagcccagagaggagcaugucuuccuuuaccucccccuaaggagauacuac

SEQ ID NO: 238971 - RNA, 64 nt, Human
aguuuucucuauucuuucauuucccccuuccccauuccuuuauuguacauaaaguaacugguau

SEQ ID NO: 238972 - RNA, 64 nt, Human
agauacaagucuuaaccacaguguaacuuacaguuuccuuuaaaaaaaaaaaaaguaaaccugg

SEQ ID NO: 238973 - RNA, 64 nt, Human
acaaacaugucacuuccuaauuaacaaaauguucuuccuuuaguuugcuuuugcacuuaaaaua

SEQ ID NO: 238974 - RNA, 64 nt, Human
ugcccaauauuuuacauuguacugcucagagguauuccuuuauuaugugguuagcauagguuau

SEQ ID NO: 238975 - RNA, 64 nt, Human
uucuuuuuuuuuuuuuuuuguaaagacaaguuuauuccuuuacgcuucuuguugcauuaguucu

SEQ ID NO: 238976 - RNA, 64 nt, Human
ugggagccgagagacccauggucacuccaacuccuuccuuuaggcugugcucuugccugucaca

SEQ ID NO: 238977 - RNA, 64 nt, Human
guccaguuuagaagugagagacuuccauuuuuaguuccuuuacacucaccacccuagcaagugc

SEQ ID NO: 238978 - RNA, 64 nt, Human
uucucaguacuaagcaaggagacagaaugcuuuguuccuuuaaaagacugaaaagcugaccuuc

SEQ ID NO: 238979 - RNA, 64 nt, Human
caaauuuccccaaacugaacgggcucaggaaauguuccuuuacacucagaacauucuauuuuaa

SEQ ID NO: 238980 - RNA, 64 nt, Human
uaaugagagaccuuggucccccuaaaggaugaauuuccuuuaggccuuugaucuuccucucuag

SEQ ID NO: 238981 - RNA, 60 nt, Human
ccagggcugggcugacaucaagaugggagcccagcccacgggcuuuauaaacacccaaga

SEQ ID NO: 238982 - RNA, 60 nt, Human
caccugcacaggcugaguuccugggcucgaccagcccagcugcgugggguacaggcauug

SEQ ID NO: 238983 - RNA, 60 nt, Human
ccucuggcugaguggccacuaggcccagacccagcccagccugagccccaacaacuuuuc

SEQ ID NO: 238984 - RNA, 64 nt, Human
agaaauuuucaugaauuauuccaugaaguauuguuuccuuuauuuaaaaaaaaaaaaaaaaaaa

SEQ ID NO: 238985 - RNA, 64 nt, Human
aaagcaaaugggagaugaugucagaggcaucuguuuccuuuaccaucugcaucuuauuauaaau

SEQ ID NO: 238986 - RNA, 64 nt, Human
ugauagaaauuaaucauacucaaucuaggacauguuccuuuacuccuuaaaaaagaaaggaaag

SEQ ID NO: 238987 - RNA, 64 nt, Human
uuaaaaagaaagcaguuucugucccuuucuguaguuccuuuaaguucaggauguaagcgaagcc

SEQ ID NO: 238988 - RNA, 64 nt, Human
guuaucagcaauuuagcacuuuacuuccauuagguuccuuuagcuuaccuacuaauguaacuau

SEQ ID NO: 238989 - RNA, 64 nt, Human
cugagcaauauuucauuguuugcauuuaccacauuuccuuuauuucugacaucuauucauggac

SEQ ID NO: 238990 - RNA, 64 nt, Human
aauguaccaggugaacugacggagcucagaaguuuuccuuuacaccaacugucaaugccggaau

SEQ ID NO: 238991 - RNA, 64 nt, Human
ccucucucucuuuccucugcuguucuucccauuguuccuuuaacuuucgcucuuguucuugccg

SEQ ID NO: 238992 - RNA, 64 nt, Human
caauguuagaccaaucuuaaguuucguaaguuauuuccuuuaagauauauauuaaacagaaauc

SEQ ID NO: 238993 - RNA, 64 nt, Human
gaccgagauaggucaucagcccagggcuucagucuuccuuuauuuauaaugggugggggcuacc

SEQ ID NO: 238994 - RNA, 64 nt, Human
uuuguguuccaccucuagauuacuucagguuuuuuuccuuuaaaauuaguuacuaccacucaaa

SEQ ID NO: 238995 - RNA, 64 nt, Human
gaggcgcugcagccaccagggccccaggcucguuuuccuuuauagcgaagcaaaaaacacaaga

SEQ ID NO: 238996 - RNA, 64 nt, Human
gggcuccgagggggcgcagccucaaacccugccuuuccuuuacuuuuacuuuuuuuuuuuuuuc

SEQ ID NO: 238997 - RNA, 62 nt, Human
cccacaccaaccccaaaauaaaaaaauguauauauuccuuuagcucuaauauucugagaaaa

SEQ ID NO: 238998 - RNA, 60 nt, Human
auaacacauggaaagacgguguggugcagcccagcccacgguggcuguuccaugaaugcu

SEQ ID NO: 238999 - RNA, 60 nt, Human
acauuuccauauuuaaaacuagaaacagcuccagcccaaaccuuguuuauggggagucug

SEQ ID NO: 239000 - RNA, 60 nt, Human
auuagaaaaaggcuuggugaggcugagaaaccagcccacaauuacacaaagacaaaaaaa

SEQ ID NO: 239001 - RNA, 64 nt, Human
aguguguauguguguuauauuggaauauaaccaguuccuuuaagcagucuuuuuaccugcaggc

SEQ ID NO: 239002 - RNA, 64 nt, Human
aaaucucugagauaaccaguauguguauuucuucuuccuuuaugcucaaacaaccuguacacag

SEQ ID NO: 239003 - RNA, 64 nt, Human
gaagagucccaucugagcaggaagacauuucucuuuccuuuaugccauuuuuuguuuuuguuau

SEQ ID NO: 239004 - RNA, 64 nt, Human
aaagucuugucggagucugcacaggagagaggccuuccuuuaacaaaaguaugauugacagaaa

SEQ ID NO: 239005 - RNA, 64 nt, Human
ccguugggaaguccaugcugaugauugugaaaaguuccuuuaaaacuagaagcuucaaagaauc

SEQ ID NO: 239006 - RNA, 64 nt, Human
cucuugugguuuugaggcacccacaccccccgcuuuccuuuaucuccagggacucucaggcuaa

SEQ ID NO: 239007 - RNA, 64 nt, Human
cgcugcucuugucuauggaguagccauucuuuuguuccuuuacuuucuuaauaaacuugcuuuc

SEQ ID NO: 239008 - RNA, 64 nt, Human
ucacgaccccugcagcaaagaagcccgagacugauuccuuuagaauuaacagcccuccaugcug

SEQ ID NO: 239009 - RNA, 64 nt, Human
acacugcucugccuauggaguagccguucuuuuauuccuuuacuuucuuaacaaauuugcuuuc

SEQ ID NO: 239010 - RNA, 64 nt, Human
cacaaacuccauggaugaaagcuguuuauuuuguuuccuuuauguguaaacaagaugauaucug

SEQ ID NO: 239011 - RNA, 64 nt, Human
ucaugaaugucucgauuagacuccauguaguuacuuccuuuaaaccaucagccggccuuuuaua

SEQ ID NO: 239012 - RNA, 64 nt, Human
aaugaaauuugccuugucuuauuccacuaguuuauuccuuuaacaacaauauuuuauguguguc

SEQ ID NO: 239013 - RNA, 64 nt, Human
auuuuugcagccugggaucucccuacuccauuuuuuccuuuaauuuaaguggccacauguauau

SEQ ID NO: 239014 - RNA, 64 nt, Human
ucaguauuuaccaaaguguaucugauuuuaaaaauuccuuuagucuguaaaacuccuagaggga

SEQ ID NO: 239015 - RNA, 60 nt, Human
ggaugggaggaagggcagacgguacaugucccagcccacauagaugccccuugcugaggg

SEQ ID NO: 239016 - RNA, 60 nt, Human
cagcucugccauugugacauuuccuguuacccagcccaaguuuucaucgucugcucaaua

SEQ ID NO: 239017 - RNA, 60 nt, Human
gaacacaggcuggcuggugggcuuccuaggccagcccagcuuguauggguucuggcuaca

SEQ ID NO: 239018 - RNA, 64 nt, Human
ugcuuuucggcuccuagaauccuuagagucugaauuccuuuagcugggaacagcugucaugguc

SEQ ID NO: 239019 - RNA, 64 nt, Human
agaugauugccuuauugaauaggucacuauuaaauuccuuuaaauguugauaucugccauuugu

SEQ ID NO: 239020 - RNA, 64 nt, Human
uuugugccaauaugaaaaggagaggguugguucuuuccuuuauuguugaaugcucccauuuaau

SEQ ID NO: 239021 - RNA, 64 nt, Human
aagaucagaaugauauaaaggagauacauguuucuuccuuuaaaaaauaaacggaaguuacauu

SEQ ID NO: 239022 - RNA, 64 nt, Human
acucuucaaaugggagacucuuugaaaugacauguuccuuuaagguacugaagcuuuauuugca

SEQ ID NO: 239023 - RNA, 64 nt, Human
cuuuccuuguuaacaauuuagcuuaucuuucuguuuccuuuauuuuuccccugccucuguuagu

SEQ ID NO: 239024 - RNA, 64 nt, Human
uuagccgcgggucccugugaaccggcacauuccuuuccuuuaggccguccagagcucuagucca

SEQ ID NO: 239025 - RNA, 64 nt, Human
uugucccuuguaaaucaagauguucugcagauuauuccuuuaacggccggacuuuuggcuguuu

SEQ ID NO: 239026 - RNA, 64 nt, Human
caaaaauucaacugcauuaaccgaucugagaguuuuccuuuaaccuggacuguguuucucaagc

SEQ ID NO: 239027 - RNA, 64 nt, Human
agagaaaagcccaguuaguggugugcaaacuuacuuccuuuaaaugucccauggauguaggaca

SEQ ID NO: 239028 - RNA, 64 nt, Human
uucaaagaaacccauacucuagucguuucugcauuuccuuuaaaaauagcaugggaucauauuu

SEQ ID NO: 239029 - RNA, 64 nt, Human
ucucaucaguucuuccucccacaauguaggaccuuuccuuuaccuuccaauggauaaaauaguu

SEQ ID NO: 239030 - RNA, 64 nt, Human
agauggggcaccagugcccaggaauuugaacauuuuccuuuacccaggaaaucuccggagccaa

SEQ ID NO: 239031 - RNA, 64 nt, Human
ccccagccaugcugaacugugaguuauuaaacuuuuccuuuauaaauuacccggucucggguau

SEQ ID NO: 239032 - RNA, 60 nt, Human
caccacauauuuggaaucucuuccacgggaccagcccagagcuaugccauggaaaugaua

SEQ ID NO: 239033 - RNA, 60 nt, Human
uuauccugcgcauguggccuagggucauccccagcccaucccugugucagcccugagugc

SEQ ID NO: 239034 - RNA, 60 nt, Human
gcuguccccuccaucuggggauggagaaugccagcccaaagcuggagccaauggugaggg

SEQ ID NO: 239035 - RNA, 64 nt, Human
ugaaaaaaagagaaaccuuaucuuugcuuugugguuccuuuaaacacacucacacacacuuggu

SEQ ID NO: 239036 - RNA, 64 nt, Human
gguuuuguuuuguuuuguuuuguuguuuuguuuuuuccuuuaaagaggauuucugucucuggga

SEQ ID NO: 239037 - RNA, 64 nt, Human
gaggaccuuaaaauuguuuauuuuuuaaaugugauuccuuuauggcauuaggguaaagaugaag

SEQ ID NO: 239038 - RNA, 64 nt, Human
auauguacagacuuguauuuuuucucugguggcauuccuuuaggaaugcugugugucuguccgg

SEQ ID NO: 239039 - RNA, 64 nt, Human
aggacgcacuuguaaagaugauuaaaacguaucuuuccuuuaugugacgcgucucuagugccuu

SEQ ID NO: 239040 - RNA, 64 nt, Human
uuuucucacucgaagaaacuauauaggguuguuuuuccuuuagcuugugcucaaguccucuugc

SEQ ID NO: 239041 - RNA, 64 nt, Human
auaugaccaucuguugcucaacaauacuguuuuuuuccuuuaguaguuuaccauaagggaauuu

SEQ ID NO: 239042 - RNA, 64 nt, Human
guuuuuuuccuuuaguaguuuaccauaagggaauuuccuuuaagucaaccaugauuucuccuug

SEQ ID NO: 239043 - RNA, 64 nt, Human
uagucaguuucgauuuguuacagacguuaacaaauuccuuuacccaagguuaugcuaugaccuu

SEQ ID NO: 239044 - RNA, 64 nt, Human
aguggugcacuuugaaggaagcacaugugcaccuuuccuuuacacuaaugcacuuaggauguuu

SEQ ID NO: 239045 - RNA, 64 nt, Human
uaccugcacauguacccaccugauguaggucuuauuccuuuaguauggacuuaaaguacuuauu

SEQ ID NO: 239046 - RNA, 64 nt, Human
uuagagaaagggugcuuauggacauagccugaguuuccuuuaaccucucugcaaugggugcuuu

SEQ ID NO: 239047 - RNA, 64 nt, Human
gcacuguggucacacacagugccuccucugccaguuccuuuauugaaagaggugugcuggcugg

SEQ ID NO: 239048 - RNA, 64 nt, Human
uccgagcacuaaauagguagcuuacuugacaagcuuccuuuaauuacacacagacauggagguu

SEQ ID NO: 239049 - RNA, 60 nt, Human
acuucuuccaccucaacaccaagcuguaggccagcccaugguguuguguacacuguggag

SEQ ID NO: 239050 - RNA, 60 nt, Human
gguggaucaccagaggucaggaguucgagaccagcccagccaacauggcaaaaccccauc

SEQ ID NO: 239051 - RNA, 60 nt, Human
gaauggugaaaugacuggauugcucuuuauccagcccacagcaggggaaagaaaggcaac

SEQ ID NO: 239052 - RNA, 64 nt, Human
auuuggagcagaguuguuuguuuuuguuguuuguuuccuuuaagaaaaaccacagggaccaaga

SEQ ID NO: 239053 - RNA, 64 nt, Human
caccauauaauagaaauacccaauuauauucuaguuccuuuauguccuguacaucauucucugc

SEQ ID NO: 239054 - RNA, 64 nt, Human
aggauuguguuacuccccgugaaaguuauuacuuuuccuuuaaaaaugguuuuauaauaagacu

SEQ ID NO: 239055 - RNA, 64 nt, Human
uaaacauuguuuuguaguguauauuacuuguccauuccuuuaaggggagcagccugcacucuuu

SEQ ID NO: 239056 - RNA, 64 nt, Human
ugggagcucaugugucccuggcgcugugcuagcuuuccuuuacagcuguuuacagacaaggcag

SEQ ID NO: 239057 - RNA, 64 nt, Human
cuguagauuuaccauggcuggacucuuacucaccuuccuuuagucucguccugugguguugaag

SEQ ID NO: 239058 - RNA, 64 nt, Human
aagaggugcaauucaggguguguguguguuuuuuuuccuuuaaagaagaaacgcugcuaagauc

SEQ ID NO: 239059 - RNA, 64 nt, Human
uuuccccugcuuguuguacaaguaaguuacucuuuuccuuuaaucuguaagauucaugaaauuc

SEQ ID NO: 239060 - RNA, 62 nt, Human
cauggaauuuuauaagcugaauaaaguuuuugacuuccuuuaccauggccuuuuugcuuggg

SEQ ID NO: 239061 - RNA, 64 nt, Human
ugcauccacucagcaggagugacagaggcagaaguuccuuuaaagcacaucuuccacuuaggaa

SEQ ID NO: 239062 - RNA, 64 nt, Human
uuuauaccucacuauguucuuugaauauguauuuuuccuuuaaauuucugccuuuaauucuuuu

SEQ ID NO: 239063 - RNA, 64 nt, Human
ggacuggagaguguggggaauaggaagaagaaauuuccuuuagacuaacgaauauauugggggg

SEQ ID NO: 239064 - RNA, 64 nt, Human
ggucagaugcuuuccaacaugacaccugaacaucuuccuuuaugcaacacccaaacaucuuggc

SEQ ID NO: 239065 - RNA, 64 nt, Human
cucucugguggcuccaccccaaccccuacuucuuuuccuuuauuucucucccaaccuggcugca

SEQ ID NO: 239066 - RNA, 60 nt, Human
caagucuauucaauucaaguuaacucuagcccagcccagaucaacuccuccuacaaauau

SEQ ID NO: 239067 - RNA, 60 nt, Human
ugcaaccaugaucugguacaggcaugcucaccagcccagcccagcccagcuguccugucc

SEQ ID NO: 239068 - RNA, 60 nt, Human
uacaaacuuugaaaacaagugugacacugaccagcccaaaucauaaucauguuuucuugc

SEQ ID NO: 239069 - RNA, 64 nt, Human
accaaaaauugucaagucuuuuucaguuuaacaguuccuuuacauguguaguauuugaggaaaa

SEQ ID NO: 239070 - RNA, 64 nt, Human; identical to SEQ ID NO: 238391

SEQ ID NO: 239071 - RNA, 64 nt, Human
caagcaauccaugaucuauacacauaagcauaauuuccuuuaguucuaguuagucaucagagaa

SEQ ID NO: 239072 - RNA, 64 nt, Human
cagauauaagacuuuccccaacaaugugauuggauuccuuuauggcaaaaucgagagaagcugc

SEQ ID NO: 239073 - RNA, 64 nt, Human
uuuuuaguuuccccuuugauugcugagagccauuuuccuuuacacauaacuacaccugacacca

SEQ ID NO: 239074 - RNA, 64 nt, Human
auccucugacacccuuuaauguucuauauaauuuuuccuuuaaucggagacccuauuuguuuca

SEQ ID NO: 239075 - RNA, 64 nt, Human
cacucccucccucuuuguuuccuuccuuccuuauuuccuuuaguuuccuuccuuagccguuuug

SEQ ID NO: 239076 - RNA, 64 nt, Human
uaaaguaaacaagugaccagcagcccacagaugauuccuuuauauagauguauaaugauucaaa

SEQ ID NO: 239077 - RNA, 64 nt, Human
cucuguaccugcagcucugcucucgggauggugcuuccuuuaucuugaaggguggcacauguuu

SEQ ID NO: 239078 - RNA, 64 nt, Human
uggauccauacucaaaggaaagcauaagcaaauuuuccuuuacaaugcaaacaugccacuggug

SEQ ID NO: 239079 - RNA, 64 nt, Human
ggcggcacaaaagagagcuguuuucucuauuuuauuccuuuaacugccaugguuauuuuuauaa

SEQ ID NO: 239080 - RNA, 64 nt, Human
uauccuguacacggcagauugugaacaaacuauauuccuuuaaguuuuccugguugcacucugu

SEQ ID NO: 239081 - RNA, 64 nt, Human
auaggaugaagucaugauuuugcuuuugcaaguuuuccuuuaaauuauuucucucucgcucucc

SEQ ID NO: 239082 - RNA, 64 nt, Human
ggacccaaaccccagugugcccugccccaugccuuuccuuuaguggugggaaacccuuaucuug

SEQ ID NO: 239083 - RNA, 60 nt, Human
gagaugguccugcagaagcagaagugcaauccagcccaugccgacggggacugcuucgug

SEQ ID NO: 239084 - RNA, 60 nt, Human
gcacaagagcaagugaugcccccagcgcccccagcccagcccacuccccgcauggggagg

SEQ ID NO: 239085 - RNA, 60 nt, Human
agagcaagugaugcccccagcgcccccagcccagcccacuccccgcauggggaggccgcc

SEQ ID NO: 239086 - RNA, 64 nt, Human
cccuacuuggccagucuguaggccaacaagaagguuccuuuacccccaugcaagacacuuauga

SEQ ID NO: 239087 - RNA, 64 nt, Human
aguauagaaucuacuuuauccuuccuuuuaauaguuccuuuagaccugugaaauuucuucacua

SEQ ID NO: 239088 - RNA, 64 nt, Human
uuacaugaagauuugguuuuugucuugcauuuuuuuccuuuaugugacgcuggaccuuuucuuu

SEQ ID NO: 239089 - RNA, 64 nt, Human
agcuucaccacuuguccauugcguuauuuucuuuuuccuuuauaauucuuucuuuuuccuucau

SEQ ID NO: 239090 - RNA, 64 nt, Human
cacuguucaggagcaguugacuaaacuuuuauccuuccuuuaacuuaaucuuuuuauccuucug

SEQ ID NO: 239091 - RNA, 64 nt, Human
cccugccucuacuuuccuuccuuggaaucagggguuccuuuagcccauuugcuuucucuaccuu

SEQ ID NO: 239092 - RNA, 64 nt, Human
aguaucuuaaguacuguagaaaagaugucacuucuuccuuuaaggcuguuuuguaauauauaua

SEQ ID NO: 239093 - RNA, 64 nt, Human
ucuauguuuugcuguuauuuuagucuuuauucucuuccuuuagguggagaaacaaaguaccaau

SEQ ID NO: 239094 - RNA, 64 nt, Human
auccguuguuuuuuuuguuuguuuguuuuuucuuuuccuuuaaguaagcucuuuauucaucuua

SEQ ID NO: 239095 - RNA, 64 nt, Human
gccggccuaugugcuuuaaccuuaagcugauacuuuccuuuaggugucacucuuguuaccagca

SEQ ID NO: 239096 - RNA, 64 nt, Human
ucuuauaacauuucaguuacuuuucaguuaauuauuccuuuaaaaagaaaauacagcagaaccu

SEQ ID NO: 239097 - RNA, 64 nt, Human
uuauaaauaaaaaaaugaaaguguagugaugagauuccuuuagcuaucuaucuauauguauaua

SEQ ID NO: 239098 - RNA, 64 nt, Human
cauaagaugccauuguacuuguaggcauuuuauuuuccuuuagaaauggacaucagcucuucuc

SEQ ID NO: 239099 - RNA, 64 nt, Human
cucccacuuuauaaugaaggcgucaugucaccccuuccuuuacagguccugggguccaggagac

SEQ ID NO: 239100 - RNA, 60 nt, Human
uuuugaugggagaaagcuggagaucugaacccagcccauuugcacacuauaagaaaaaaa

SEQ ID NO: 239101 - RNA, 60 nt, Human
ccccuggcuccugccuggaagaauuccgagccagcccauuucuagaaugucauggaagag

SEQ ID NO: 239102 - RNA, 60 nt, Human
cucccacccggcugcagaggccagaggcccccagcccagggcuccugcacuuacuugcuu

SEQ ID NO: 239103 - RNA, 64 nt, Human
gaugaaggaucagugaaaagcaauaauuaacugcuuccuuuaugacuaugcacuaaggucuuau

SEQ ID NO: 239104 - RNA, 64 nt, Human
uagaauugguggugagauaucgcuugauuuucuuuuccuuuauaaaugucuaguucuuacccag

SEQ ID NO: 239105 - RNA, 64 nt, Human; identical to SEQ ID NO: 118169

SEQ ID NO: 239106 - RNA, 64 nt, Human; identical to SEQ ID NO: 118170

SEQ ID NO: 239107 - RNA, 64 nt, Human; identical to SEQ ID NO: 118171

SEQ ID NO: 239108 - RNA, 64 nt, Human; identical to SEQ ID NO: 118172

SEQ ID NO: 239109 - RNA, 64 nt, Human; identical to SEQ ID NO: 118173

SEQ ID NO: 239110 - RNA, 64 nt, Human; identical to SEQ ID NO: 118174

SEQ ID NO: 239111 - RNA, 64 nt, Human; identical to SEQ ID NO: 118175

SEQ ID NO: 239112 - RNA, 58 nt, Human; identical to SEQ ID NO: 118176

SEQ ID NO: 239113 - RNA, 64 nt, Human; identical to SEQ ID NO: 118177

SEQ ID NO: 239114 - RNA, 60 nt, Human
cacugggaucacaggugucagccauugcacccagcccagauugucuuaauuucuaucuug

SEQ ID NO: 239115 - RNA, 60 nt, Human
ucuuccuccuucccccuuucccaggaaaggccagcccaguccauggccuucuugggccuc

SEQ ID NO: 239116 - RNA, 60 nt, Human
ccuucauguaaaccagcuuugcaaaauuuuccagcccagauacucuucaucuauucaaau

SEQ ID NO: 239117 - RNA, 64 nt, Human; identical to SEQ ID NO: 57581

SEQ ID NO: 239118 - RNA, 64 nt, Human; identical to SEQ ID NO: 57582

SEQ ID NO: 239119 - RNA, 64 nt, Human; identical to SEQ ID NO: 57583

SEQ ID NO: 239120 - RNA, 64 nt, Human; identical to SEQ ID NO: 57584

SEQ ID NO: 239121 - RNA, 64 nt, Human; identical to SEQ ID NO: 57585

SEQ ID NO: 239122 - RNA, 56 nt, Human
acaugcuuuugcucaggugaccuguuccagcccaggcagagaucaggugggcagag

SEQ ID NO: 239123 - RNA, 60 nt, Human
ucacgccccccuuaaguccuuaaugaagagccagcccaaguagaggggccccugauccuc

SEQ ID NO: 239124 - RNA, 60 nt, Human
gaauauuugcaagacucagccagcuccuucccagcccagccucuuggggcugggacuuuc

SEQ ID NO: 239125 - RNA, 64 nt, Human; identical to SEQ ID NO: 57586

SEQ ID NO: 239126 - RNA, 64 nt, Human; identical to SEQ ID NO: 57587

SEQ ID NO: 239127 - RNA, 64 nt, Human; identical to SEQ ID NO: 57588

SEQ ID NO: 239128 - RNA, 64 nt, Human; identical to SEQ ID NO: 57589

SEQ ID NO: 239129 - RNA, 64 nt, Human; identical to SEQ ID NO: 57590

SEQ ID NO: 239130 - RNA, 64 nt, Human; identical to SEQ ID NO: 57591

SEQ ID NO: 239131 - RNA, 64 nt, Human; identical to SEQ ID NO: 57592

SEQ ID NO: 239132 - RNA, 64 nt, Human; identical to SEQ ID NO: 57593

SEQ ID NO: 239133 - RNA, 64 nt, Human; identical to SEQ ID NO: 57594

SEQ ID NO: 239134 - RNA, 64 nt, Human; identical to SEQ ID NO: 57595

SEQ ID NO: 239135 - RNA, 64 nt, Human; identical to SEQ ID NO: 57596

SEQ ID NO: 239136 - RNA, 64 nt, Human; identical to SEQ ID NO: 57597

SEQ ID NO: 239137 - RNA, 64 nt, Human; identical to SEQ ID NO: 57598

SEQ ID NO: 239138 - RNA, 64 nt, Human; identical to SEQ ID NO: 57599

SEQ ID NO: 239139 - RNA, 64 nt, Human; identical to SEQ ID NO: 57600

SEQ ID NO: 239140 - RNA, 64 nt, Human; identical to SEQ ID NO: 57601

SEQ ID NO: 239141 - RNA, 60 nt, Human
guccugcccugccuuccuccugccuguagcccagcccaucuaaauggaagcugggaauug

SEQ ID NO: 239142 - RNA, 60 nt, Human
ccugcccugcugccuuccauguucauaggcccagcccaagagagugacacacagugcugg

SEQ ID NO: 239143 - RNA, 60 nt, Human
agcaaagagaccagcugacugucucucggcccagcccaccacgccgaguagcuugugugg

SEQ ID NO: 239144 - RNA, 64 nt, Human; identical to SEQ ID NO: 57602

SEQ ID NO: 239145 - RNA, 64 nt, Human; identical to SEQ ID NO: 57603

SEQ ID NO: 239146 - RNA, 64 nt, Human; identical to SEQ ID NO: 57604

SEQ ID NO: 239147 - RNA, 64 nt, Human; identical to SEQ ID NO: 57605

SEQ ID NO: 239148 - RNA, 64 nt, Human; identical to SEQ ID NO: 57606

SEQ ID NO: 239149 - RNA, 64 nt, Human; identical to SEQ ID NO: 57607

SEQ ID NO: 239150 - RNA, 64 nt, Human; identical to SEQ ID NO: 57608

SEQ ID NO: 239151 - RNA, 64 nt, Human; identical to SEQ ID NO: 57609

SEQ ID NO: 239152 - RNA, 64 nt, Human; identical to SEQ ID NO: 57610

SEQ ID NO: 239153 - RNA, 58 nt, Human; identical to SEQ ID NO: 57611

SEQ ID NO: 239154 - RNA, 64 nt, Human; identical to SEQ ID NO: 57612

SEQ ID NO: 239155 - RNA, 64 nt, Human; identical to SEQ ID NO: 57613

SEQ ID NO: 239156 - RNA, 64 nt, Human; identical to SEQ ID NO: 57614

SEQ ID NO: 239157 - RNA, 64 nt, Human; identical to SEQ ID NO: 57615

SEQ ID NO: 239158 - RNA, 64 nt, Human; identical to SEQ ID NO: 57616

SEQ ID NO: 239159 - RNA, 64 nt, Human; identical to SEQ ID NO: 57617

SEQ ID NO: 239160 - RNA, 60 nt, Human
ccccaucccuuccuccccagucuacguucuccagcccacaccccuccaaagccccaccuu

SEQ ID NO: 239161 - RNA, 60 nt, Human
gauucugugggcagcuggcucugaauguagccagcccacauccauuccagagcugcagaa

SEQ ID NO: 239162 - RNA, 60 nt, Human
caggcugguaaauuuaggauauuacaauggccagcccagauggcucccugggcuggcaug

SEQ ID NO: 239163 - RNA, 64 nt, Human; identical to SEQ ID NO: 57618

SEQ ID NO: 239164 - RNA, 64 nt, Human; identical to SEQ ID NO: 57619

SEQ ID NO: 239165 - RNA, 64 nt, Human; identical to SEQ ID NO: 57620

SEQ ID NO: 239166 - RNA, 64 nt, Human; identical to SEQ ID NO: 57621

SEQ ID NO: 239167 - RNA, 64 nt, Human; identical to SEQ ID NO: 57622

SEQ ID NO: 239168 - RNA, 64 nt, Human; identical to SEQ ID NO: 57623

SEQ ID NO: 239169 - RNA, 64 nt, Human; identical to SEQ ID NO: 57624

SEQ ID NO: 239170 - RNA, 64 nt, Human; identical to SEQ ID NO: 57625

SEQ ID NO: 239171 - RNA, 64 nt, Human; identical to SEQ ID NO: 57626

SEQ ID NO: 239172 - RNA, 64 nt, Human; identical to SEQ ID NO: 57627

SEQ ID NO: 239173 - RNA, 64 nt, Human; identical to SEQ ID NO: 57628

SEQ ID NO: 239174 - RNA, 64 nt, Human; identical to SEQ ID NO: 57629

SEQ ID NO: 239175 - RNA, 64 nt, Human; identical to SEQ ID NO: 57630

SEQ ID NO: 239176 - RNA, 64 nt, Human; identical to SEQ ID NO: 57631

SEQ ID NO: 239177 - RNA, 64 nt, Human; identical to SEQ ID NO: 57632

SEQ ID NO: 239178 - RNA, 64 nt, Human; identical to SEQ ID NO: 57633

SEQ ID NO: 239179 - RNA, 60 nt, Human
gccccaucuuggaaugggggcuccuuggggccagcccaguguggcucaccacacucuucu

SEQ ID NO: 239180 - RNA, 60 nt, Human
cugaugacuagaccccgccuuccgcucccaccagcccacauccaguggggucucagucca

SEQ ID NO: 239181 - RNA, 60 nt, Human
ugcuagggugccugcucuccuugcccugggccagcccaggauuguacgugggagaggcag

SEQ ID NO: 239182 - RNA, 64 nt, Human; identical to SEQ ID NO: 57634

SEQ ID NO: 239183 - RNA, 64 nt, Human; identical to SEQ ID NO: 57635

SEQ ID NO: 239184 - RNA, 50 nt, Human; identical to SEQ ID NO: 57636

SEQ ID NO: 239185 - RNA, 64 nt, Human
auagguuggggacugugaucuugagaagccaugggccagcaauaccugcuuuucugaagccccc

SEQ ID NO: 239186 - RNA, 64 nt, Human
uuaaaugccccgucucuuuguaaacugauauucagccagcaaugccuaagacuuuguuaagauc

SEQ ID NO: 239187 - RNA, 64 nt, Human
acagugccacuuggccacuugggguaaagccagugccagcaauaacaguuuaucaugcucauua

SEQ ID NO: 239188 - RNA, 64 nt, Human
ugugggcugcuucacauccaccccggcucccccugccagcaacgcucacucuacccccaacacc

SEQ ID NO: 239189 - RNA, 64 nt, Human
cuuuugcccccguggggcucccggcauccugaaagccagcaaagccuccagcaucuuuuccauc

SEQ ID NO: 239190 - RNA, 60 nt, Human
aaccgcagggccgccccucccgcuugcuccccagcccacccaccccccuguacagaaugu

SEQ ID NO: 239191 - RNA, 60 nt, Human
gcacugagcacucaguggauaaacacuccuccagcccagacacacuccuccucuugggca

SEQ ID NO: 239192 - RNA, 60 nt, Human
uacagggauuagaguugugagccaccgcugccagcccagaguuacccucuaaagauaaga

SEQ ID NO: 239193 - RNA, 64 nt, Human
cucuauuucaggugccccacaccggcaaguaccagccagcaacaccaaccaaaugcuacucucu

SEQ ID NO: 239194 - RNA, 64 nt, Human
cuucuauagaggugguguaagaguggggaacagggccagcaagacagaccaccagccagaaauc

SEQ ID NO: 239195 - RNA, 64 nt, Human
gcaucauuucucccuguuggguuuuagccaguuugccagcaagcgcauccuagcaggguccccg

SEQ ID NO: 239196 - RNA, 64 nt, Human
agagauaggaaugaguucuuaucuaguguugcaggccagcaaauacagaggugguuuaaucaaa

SEQ ID NO: 239197 - RNA, 64 nt, Human
cuuucccuuggcuggcuggguccagccaucuccggccagcaacccugucaguguuccacccugu

SEQ ID NO: 239198 - RNA, 64 nt, Human
accaccccugggugcucaguuucuaccaacaugagccagcaaguccuugugguagcccuggggu

SEQ ID NO: 239199 - RNA, 64 nt, Human
guaguagacucggguccuguccacagcccuagcugccagcaaugcuguccucacagaggcauag

SEQ ID NO: 239200 - RNA, 64 nt, Human
aggccaaugcaagaggccaaggcuggagaggcgugccagcaaggccagggauggccggagggcu

SEQ ID NO: 239201 - RNA, 64 nt, Human
auacuuccuuuguugucacauggacgauacaaaagccagcaauaauucuucaagauccaaaaga

SEQ ID NO: 239202 - RNA, 64 nt, Human
gagagauccuccuuuacccucuugaaauuucuuagccagcaacuuguucugcaggggcccacug

SEQ ID NO: 239203 - RNA, 64 nt, Human
ucugucuguuuaacagacaguccauaucugugaggccagcaaauauuuucuuaaacucaugggg

SEQ ID NO: 239204 - RNA, 64 nt, Human
gacucagacgaugcccugcugaagaugaccaucagccagcaagaguuuggccgcacugggcuuc

SEQ ID NO: 239205 - RNA, 64 nt, Human
guucaacuuaaugaagaaauacagcuaaggccuugccagcaacaccugccguaaguuacuggcu

SEQ ID NO: 239206 - RNA, 64 nt, Human
gucccaagaauaguaauaucaccucuaguuauaagccagcaacaggaacuuuugugaagacaca

SEQ ID NO: 239207 - RNA, 64 nt, Human
aggaauauaagacauaccccauagcucugugugagccagcaauaccgcugcccccuggcgacag

SEQ ID NO: 239208 - RNA, 64 nt, Human
uucuguccucagucaaggagauggccaugcuuaagccagcaauuggcugggguccaggaaacaa

SEQ ID NO: 239209 - RNA, 60 nt, Human
uuccuugggccauaccuucccugcagaucuccagcccagaaccaucuuccccuguugucc

SEQ ID NO: 239210 - RNA, 60 nt, Human
aggaggagcacaggcucuuggguggcgaagccagcccaggauccauuaccuggaagguuu

SEQ ID NO: 239211 - RNA, 60 nt, Human
ggcgcggggggccccaagcugcgccggccuccagcccacccacagcuguugcugaaguca

SEQ ID NO: 239212 - RNA, 64 nt, Human
gggaaaaaaaaaagccuuucguaguucaguaauugccagcaauauaacacggcuaaaaugaagu

SEQ ID NO: 239213 - RNA, 64 nt, Human
cccuucccuuucccuguccccccgccccacgccugccagcaaagccucgcuaaccccauuacaa

SEQ ID NO: 239214 - RNA, 64 nt, Human
cucacacacacagcugggcaaagccacaaggcuggccagcaaggcagguuggaugggagugggc

SEQ ID NO: 239215 - RNA, 64 nt, Human
cuggcuccuuggcucccagcagccgcugaccauagccagcaaaagaccuggcagguccugaauc

SEQ ID NO: 239216 - RNA, 64 nt, Human
augaguguucggugaaacaagugggauuuucugggccagcaagucuuccaaacuguauaugaug

SEQ ID NO: 239217 - RNA, 64 nt, Human
gucagccgagccgggccuggggcuccuuucuccagccagcaaugauguccagaagaauauucag

SEQ ID NO: 239218 - RNA, 64 nt, Human
aagccuuuuggguaugauuagagugaaaauggcagccagcaaacuugauagugcuuuugguccu

SEQ ID NO: 239219 - RNA, 64 nt, Human
cugugugucuguccagccuugcagucaugucaaggccagcaagcugaugugacucuugccccau

SEQ ID NO: 239220 - RNA, 64 nt, Human
uggucagaaacaaagggcuggucaccugauuuaggccagcaaccagggaagcucuuagaauccc

SEQ ID NO: 239221 - RNA, 64 nt, Human
ugagucacugcuaagagacagagcacauuuucaggccagcaacuauccuugccagaguuuuuuc

SEQ ID NO: 239222 - RNA, 64 nt, Human
aaaaucccauuuaagguuagggguugguccuuaugccagcaagauuuaaccaacuguaaagaua

SEQ ID NO: 239223 - RNA, 64 nt, Human
gaagauggagugcucuuuucuaggcccauguucugccagcaaccgggaugcgugggcaacugga

SEQ ID NO: 239224 - RNA, 64 nt, Human
gccuccuccccagcccccaccccugggaugcgaagccagcaagcuuuugcugcagauggacagg

SEQ ID NO: 239225 - RNA, 64 nt, Human
gaauguauaugucuugguagaccaggaggccuuugccagcaauuuaagcaacagaugugaauac

SEQ ID NO: 239226 - RNA, 64 nt, Human
uuaauuccuccaaggaagagcagaacaccugaaagccagcaauuuccugacacugagaaugaag

SEQ ID NO: 239227 - RNA, 64 nt, Human
agcacccccgggaccccugccgguggcuccaucagccagcaaccuuagagagaggaaagacagu

SEQ ID NO: 239228 - RNA, 60 nt, Human
ucuaggauucucauggcugcacacccugccccagcccagcugccuccagaccccuaagca

SEQ ID NO: 239229 - RNA, 60 nt, Human
aacauucccacauaauacauuccaucacagccagcccagcuccacucagggcuggcccgg

SEQ ID NO: 239230 - RNA, 60 nt, Human
caaaucagggcucagggagaggccaugcggccagcccaggucugcaugcugagccccauc

SEQ ID NO: 239231 - RNA, 64 nt, Human
cgauucugggaaaaugaaagaaaagagauaugaugccagcaaagggauggaaagucuagaggac

SEQ ID NO: 239232 - RNA, 64 nt, Human
cagguuuaaguacuaaacugcagccuuuucugucgccagcaauuaaagaccaccaaucuuguuu

SEQ ID NO: 239233 - RNA, 64 nt, Human
aaccaguggcacaguguccuugugcccacacugagccagcaaguccugcuguccacacccacaa

SEQ ID NO: 239234 - RNA, 64 nt, Human
uuuucuaccugaaauuggaagacuuggugccaccgccagcaauaauugacaaacuuuuccugga

SEQ ID NO: 239235 - RNA, 64 nt, Human
guugaaaagacuccaaagaaauguaagggaaacugccagcaacgcaggcccccaggugccaguu

SEQ ID NO: 239236 - RNA, 64 nt, Human
ucacauccuguguuucuagggaaaugaaagaaaggccagcaaauucgcugcaaccuguugauag

SEQ ID NO: 239237 - RNA, 64 nt, Human
aguggaggagggacgagggacagggguuucaccagccagcaaccugggccuuguacugucugug

SEQ ID NO: 239238 - RNA, 64 nt, Human
ugauguacugguuaauuuugcauggcuucuuaaggccagcaaaaugcuggcaguuuucuuuauc

SEQ ID NO: 239239 - RNA, 64 nt, Human
gucauauacuuuuaccacuugaauugaucuucuugccagcaauagaucucauuuucaaaagcaa

SEQ ID NO: 239240 - RNA, 64 nt, Human
gauuccuuggugacagguugagggcagcuccagugccagcaauaggguggcacagaagcucauc

SEQ ID NO: 239241 - RNA, 64 nt, Human
acuacuggaaaaggucuggcggcuggggaggagugccagcaauaguucauaauaaaaaucuguu

SEQ ID NO: 239242 - RNA, 64 nt, Human
ucuucacuccaggcacauagccccaaccaccucugccagcaaccuugagaggaaggacaagaag

SEQ ID NO: 239243 - RNA, 64 nt, Human
ccuuguaaugaucgaauacccacucugauguuuugccagcaaagggauaucuaauauuucagaa

SEQ ID NO: 239244 - RNA, 64 nt, Human
ugccugcauaccucuggcagcuggcccaggaagagccagcaagagcaaggcaugggagagggga

SEQ ID NO: 239245 - RNA, 64 nt, Human
agcaaagugcuuugacuucuugcuucagucaucagccagcaagagggaacaaaacuguucuuuu

SEQ ID NO: 239246 - RNA, 64 nt, Human
ucauuaaucaaugaaagugccuucgcagacuuuugccagcaaauguuaucauuauuuuuuuaua

SEQ ID NO: 239247 - RNA, 60 nt, Human
cacugcccagcagccuucuccguccuguccccagcccacgugcuccuugggugucagcuu

SEQ ID NO: 239248 - RNA, 60 nt, Human
augaaaaucccuaccuucagagacucuagcccagcccaacaccaucucuuccuaccucuc

SEQ ID NO: 239249 - RNA, 60 nt, Human
cuccauccacuacaagaaggaaggauguccccagcccaggaggucuuucugcuccaucgu

SEQ ID NO: 239250 - RNA, 64 nt, Human
cugcagagguccgugcagccacacccucuucccugccagcaagcugucugcggcucaucggagg

SEQ ID NO: 239251 - RNA, 64 nt, Human
cgggaagugugcuucucagggaggaaaccggcuugccagcaaguagauucuuacgaacuccaac

SEQ ID NO: 239252 - RNA, 64 nt, Human
uacuugaucuauguuaugaaauaaguagcaaauugccagcaaaaugucuuguaccuuuucuaaa

SEQ ID NO: 239253 - RNA, 51 nt, Human
cauguacccacucacagugaugccagcaagaagagacugauugaggauacu

SEQ ID NO: 239254 - RNA, 64 nt, Human
gcucccuccagcacacagcccucaccccagcacagccagcaaggacacgcucuccccaacaggg

SEQ ID NO: 239255 - RNA, 64 nt, Human
ucuucaagucuccaagggcucuucagcgucacaagccagcaacucucuuugcauuaaaauuuca

SEQ ID NO: 239256 - RNA, 64 nt, Human
auacuuccuagccucuuccuggcuuuuggugguugccagcaaucccugcuguuccuuagccuau

SEQ ID NO: 239257 - RNA, 64 nt, Human
acuuggcugcauuugccugucaugcgcaacuggagccagcaaccagcacauccaucagcacccc

SEQ ID NO: 239258 - RNA, 64 nt, Human
gggcaguggaggugcugcauugccugcggucaaggccagcaagguggaguggaugccucagaac

SEQ ID NO: 239259 - RNA, 64 nt, Human
ucccagcccacccccaguggaugggaugcauaaugccagcaaguuuuguuuaacagcaaaaaag

SEQ ID NO: 239260 - RNA, 64 nt, Human
aacaaaauccaagauucugcuggugaauaacuaugccagcaaccuuguaagcuaucugugcagg

SEQ ID NO: 239261 - RNA, 64 nt, Human
gggugaaauuuggauaggcgguaugcucaaagcagccagcaaugagugcucuguuuugauccuu

SEQ ID NO: 239262 - RNA, 64 nt, Human
ugcaggaggguuuacaucuccaggaagaugggcugccagcaacugcagaggaugcagccaccug

SEQ ID NO: 239263 - RNA, 64 nt, Human
aggaaucaugaugagagagaagguaaguggcuuugccagcaaugaaacagcugacauaauggua

SEQ ID NO: 239264 - RNA, 64 nt, Human
caugcucuuaaaaagggaguaacaccuauaacaugccagcaaaagaggugacuguaucaaguag

SEQ ID NO: 239265 - RNA, 64 nt, Human
uuuccacaaccgcccacugagcagcaaggcugcagccagcaaagaggugcggaggcaagcaagc

SEQ ID NO: 239266 - RNA, 50 nt, Human
aaggggggaacauuagcuagccagcccagcaucuuccccccuucuuccac

SEQ ID NO: 239267 - RNA, 60 nt, Human
aguggggcuuucaacccucucccccaccacccagcccacugcacugaaaugagacuuuau

SEQ ID NO: 239268 - RNA, 60 nt, Human
gggcaggggacuaccuuccagugucucccuccagcccagcccugaccucaggaaguguca

SEQ ID NO: 239269 - RNA, 64 nt, Human
uccuagccccgaggugcugauggagaugcucaaggccagcaagccccucaggccagcacuucgc

SEQ ID NO: 239270 - RNA, 64 nt, Human
caucucaucaaugaaggaguaacugaucaaugaagccagcaaugcuuuuuucuuggcaucauca

SEQ ID NO: 239271 - RNA, 64 nt, Human
uuucuaaacauuccuucauaugccuuuaaugaaagccagcaauuaucccaugggcccuacuuga

SEQ ID NO: 239272 - RNA, 62 nt, Human
aguacaccagcuccaagugagcucucgcagcugccagcaauccaaaggcucuuuucagagcc

SEQ ID NO: 239273 - RNA, 64 nt, Human
gguaugagguguuugcugcucugccacguagagagccagcaaagggaucaugaccaacucaaca

SEQ ID NO: 239274 - RNA, 64 nt, Human
ggccuaggguggggacccccaaaccuacggcaaagccagcaacaguagcagccugcucccauuu

SEQ ID NO: 239275 - RNA, 64 nt, Human
auaauccaggcuucagcaacacuccucuuucccagccagcaaaggcugugaauuugaauucuuu

SEQ ID NO: 239276 - RNA, 64 nt, Human
uugaauuuccaggaaauauccauccaugaauuaugccagcaagaaugaagcacagaugaaggca

SEQ ID NO: 239277 - RNA, 64 nt, Human
cccuauagacucaggaguugcuucucaagaaagagccagcaaguauucucagccugaggguggg

SEQ ID NO: 239278 - RNA, 64 nt, Human
acaggagagcaaggcacuugcaguagugaucuaugccagcaaaacaucauuuugagacaaacau

SEQ ID NO: 239279 - RNA, 64 nt, Human
ccuugaccuuaacucugaugguucuucaccuccugccagcaaccccaaacccaagugccuucag

SEQ ID NO: 239280 - RNA, 64 nt, Human
gccuaagcuuagaguucuuuuauauaccucuacggccagcaaaaugcucaggucugcucuuggu

SEQ ID NO: 239281 - RNA, 64 nt, Human
gcucagcgccagccugucccauggacacuccagugccagcaaugacaucucaggggccagagga

SEQ ID NO: 239282 - RNA, 64 nt, Human
ggcauugugaaaagcuuugcugugauuuaaaaaugccagcaauuuuaaucuagcaguguugaag

SEQ ID NO: 239283 - RNA, 64 nt, Human
auuggggagagaagcacugggggucuucagaccagccagcaaggggccgugccagugcccagag

SEQ ID NO: 239284 - RNA, 64 nt, Human
aucuaccuacaauugaccaaaaaaaauuuuuuaggccagcaauuauuauuuagcuucgcucuuu

SEQ ID NO: 239285 - RNA, 60 nt, Human
ugcagugagccaauaucucaccacuguacuccagcccagugcgagacuccaucucaaaaa

SEQ ID NO: 239286 - RNA, 60 nt, Human
cugccaggcauuugugugacuguccuguuuccagcccagguggucucaaucaucaggcag

SEQ ID NO: 239287 - RNA, 60 nt, Human
ggggaagggccugagaggaauguaaggaaaccagcccagaucagucccaaggccagaguc

SEQ ID NO: 239288 - RNA, 64 nt, Human
cacucaguggugccccugcaguugggugggguacgccagcaaaggaucaguuuggcugccuuau

SEQ ID NO: 239289 - RNA, 64 nt, Human
auuugagagccaugagcuggaggcugugguucgugccagcaaggagccuacugucuggugugcu

SEQ ID NO: 239290 - RNA, 64 nt, Human
cacagcagggcagugcacccuggcaccaugcacggccagcaagaaucaaggcccgcagaugcua

SEQ ID NO: 239291 - RNA, 64 nt, Human
uccuauuuuaaaucucagagugauccugcugacugccagcaaagguuuguaauuaagaagggac

SEQ ID NO: 239292 - RNA, 64 nt, Human
cauccugucucaggccucggauaggaagcugccugccagcaagaggagacugaugugccccggg

SEQ ID NO: 239293 - RNA, 64 nt, Human
ggccugggcuugaaugugacucuguugagacauggccagcaauucuggcacuuggcugucauuc

SEQ ID NO: 239294 - RNA, 64 nt, Human
uuugagaagucuacauugcuuacauuuuaauugagccagcaaagaaggcuuaaugauuuauuga

SEQ ID NO: 239295 - RNA, 64 nt, Human
caagcaaaugcuaaggggaacauacauguaaaaagccagcaaacuaucuucaaacucuuccguc

SEQ ID NO: 239296 - RNA, 64 nt, Human
ccaccuuucacauccaaggggugggucaagugcagccagcaauuuauuuucauuguuggcccac

SEQ ID NO: 239297 - RNA, 64 nt, Human
cuccccucucuuugacauuccugaaagauuaccagccagcaauagcccagggcucccccaaaag

SEQ ID NO: 239298 - RNA, 64 nt, Human
uacauauaucauuauuauauaaaucaugaugcuagccagcaaagaugugaaaauaucugcucaa

SEQ ID NO: 239299 - RNA, 64 nt, Human
uacaacaaugcuaaaauugagcagauugauaacugccagcaaaccauagauuuaagauaaauga

SEQ ID NO: 239300 - RNA, 64 nt, Human
caaacaauguuaaggauugucuuaaaguuccuuagccagcaaaacaaaacaaaacaaaacaaac

SEQ ID NO: 239301 - RNA, 64 nt, Human
gaccaaagaacuccuuggaugaaaguccacuggggccagcaauacuccagagcccaguuucugc

SEQ ID NO: 239302 - RNA, 64 nt, Human
guguugggauuacaggcaugagccacugcgccuggccagcaaaugcuuuuugugcagaauacac

SEQ ID NO: 239303 - RNA, 64 nt, Human
acccaucccccgccugaagccaccggcuccaauugccagcaaccucugcuuguccggaaaacga

SEQ ID NO: 239304 - RNA, 60 nt, Human
aaauaucuacucacucauacagccagcccaccagcccaccauuaacucacugaacaauga

SEQ ID NO: 239305 - RNA, 60 nt, Human
ggcagaguaaauaucuacucacucauacagccagcccaccagcccaccauuaacucacug

SEQ ID NO: 239306 - RNA, 60 nt, Human
cuauuuuggcuacauuguuuaucauuaaaaccagcccagggauguguaaaccugcaucug

SEQ ID NO: 239307 - RNA, 64 nt, Human
uuaaauaacucgaucuguacccagcuggguagcagccagcaaaggccaucagacaaccagaagc

SEQ ID NO: 239308 - RNA, 64 nt, Human
ccaacacacucagcaucccugggaacugagaggugccagcaauugcugaagguggcgaugaaca

SEQ ID NO: 239309 - RNA, 64 nt, Human
ggacagcugaggaugggccuagcagaugaagcuugccagcaaggccaaagcaaacgguuucucc

SEQ ID NO: 239310 - RNA, 64 nt, Human
ccuugcugaagacagcuuuuucugagacacagcugccagcaaaccugagggaaagagagaagau

SEQ ID NO: 239311 - RNA, 64 nt, Human
cuacuugagauaaugggagugcuagaagcaaggagccagcaagucuggacacauuacaaaggcc

SEQ ID NO: 239312 - RNA, 64 nt, Human
ucccugggacggggguccugagguccccaccuaugccagcaaucagagaagcccucuuggcauc

SEQ ID NO: 239313 - RNA, 64 nt, Human
ucaggaaaucuacugaauuacugucagaacaagagccagcaagcuuuacugcaaagugaaaaga

SEQ ID NO: 239314 - RNA, 64 nt, Human
ucacuguuaguugaagaaaaagcaguucccaggugccagcaaagaccaucuuucauaacuguca

SEQ ID NO: 239315 - RNA, 64 nt, Human
gagugugugggguauggggcagcagaggcagccagccagcaaagaggggccacugagcaccagg

SEQ ID NO: 239316 - RNA, 64 nt, Human
aggaggcagcgcccugcagccucccguccacacugccagcaaugccccuggcccagugagccca

SEQ ID NO: 239317 - RNA, 64 nt, Human
cuuauuccuaauggcuauuuuugaagcaaagaaggccagcaacauuggcacaugccaccuggca

SEQ ID NO: 239318 - RNA, 64 nt, Human
uguggcuuuuacuuuuuaaauggcauauuaacaagccagcaaagugugucagaccauggcgugg

SEQ ID NO: 239319 - RNA, 64 nt, Human
gccuugaguccauugccaaauuuucagcacaccugccagcaacuugggggaauaagcgaagguu

SEQ ID NO: 239320 - RNA, 64 nt, Human
ugcccggaggcgcauccugcagcccaugcuugaugccagcaacccagauccugcccccaaagcc

SEQ ID NO: 239321 - RNA, 64 nt, Human
ugcuccugccaugaggagcucagaaggccaggaagccagcaauaggggagagaaucugugugcu

SEQ ID NO: 239322 - RNA, 64 nt, Human
uuuuuaugagaaaccuggaccuuccaugaauguugccagcaauaaagugacuuguccuaaucua

SEQ ID NO: 239323 - RNA, 60 nt, Human
ccaacccagcccaacccggcccaacccagcccagcccagcucagcucagcuacugccaag

SEQ ID NO: 239324 - RNA, 60 nt, Human
cuagcccaacccagcccaacccggcccaacccagcccagcccagcucagcucagcuacug

SEQ ID NO: 239325 - RNA, 56 nt, Human
ccagcagcagcacggccuagcccaacccagcccaacccggcccaacccagcccagc

SEQ ID NO: 239326 - RNA, 64 nt, Human
cauacaaaauuuuuccaccacacauacccucuaagccagcaagauuuccucuuugcaaaaucau

SEQ ID NO: 239327 - RNA, 64 nt, Human
ggagacccugagccugcugagaaauccuuuuagcgccagcaagccccacccagggcccuguccu

SEQ ID NO: 239328 - RNA, 64 nt, Human
ucacagggaaagccaggaguggccuucucugcaggccagcaagccugcagcagcaggugccccc

SEQ ID NO: 239329 - RNA, 64 nt, Human
cucugcuugaaacagguacacgggccagggaaaugccagcaagccagagcgggcguggagauuu

SEQ ID NO: 239330 - RNA, 64 nt, Human
ugaauucugaaguuuuggagagggaaguggagcagccagcaaguaagcuagccagaguuuucuc

SEQ ID NO: 239331 - RNA, 64 nt, Human
caccaaauuaccuaggcugagguuagagagauuggccagcaaaaacugugggaagaugaacuuu

SEQ ID NO: 239332 - RNA, 64 nt, Human
guauaguauagcagugcaggaacaaacagcacuugccagcaaagucuguguguacuguuaagug

SEQ ID NO: 239333 - RNA, 64 nt, Human
uggagcuuuagcuucucugccaagcccucaauaagccagcaaaccaggacucugccccuucugu

SEQ ID NO: 239334 - RNA, 64 nt, Human
caagucaccaacugcuucagggauaccuggaggggccagcaaguagaguguugguggcccaagc

SEQ ID NO: 239335 - RNA, 64 nt, Human
cuaucucucucaguugguuuuugauagaacagaggccagcaaacuuucuuuguaaaaggcuggu

SEQ ID NO: 239336 - RNA, 64 nt, Human
gaauauaugcaaaaagaaggccccauuuaguggagccagcaauccuguucagucaacaaguauu

SEQ ID NO: 239337 - RNA, 64 nt, Human
uuugaacagggccuugaagggugugcaggaguucgccagcaaagccaggcaggccaagacuuga

SEQ ID NO: 239338 - RNA, 64 nt, Human
ugcuguauuuggaaaccccuucuuuacuucccaggccagcaagcucuucacugaaacugguuga

SEQ ID NO: 239339 - RNA, 64 nt, Human
uuuuuuuuuuuaagauguuacaugguguuucgaagccagcaaguuaccauccuccggugucucu

SEQ ID NO: 239340 - RNA, 64 nt, Human
cggaaccuuccaucuaagauuucuuccagggaaugccagcaaucaggcagcacccagcuguggg

SEQ ID NO: 239341 - RNA, 64 nt, Human
uagguguguguagggugguagaggccaaggugcugccagcaauccuuuccauacuagguacugg

SEQ ID NO: 239342 - RNA, 60 nt, Human
gcccugcccaggagauagaagaccuggacuccagcccaccguggccacuggagaccucag

SEQ ID NO: 239343 - RNA, 60 nt, Human
agcuagccauggaagcuucuugccucugacccagcccacuuucccagccuaccucugggc

SEQ ID NO: 239344 - RNA, 60 nt, Human
uucugccaucuugaaacccccauucuguuuccagcccagaagaaaugcugccccuaccag

SEQ ID NO: 239345 - RNA, 64 nt, Human
uuauuauuaauaaugaaguagaaguuacuuaauugccagcaaauaaauacgugucaaaaaagaa

SEQ ID NO: 239346 - RNA, 64 nt, Human
aucaguagucauuguguuaacuauaaagucaagugccagcaaagaacuuuaaaacuguaaagcu

SEQ ID NO: 239347 - RNA, 64 nt, Human
uaccugugucacgaacaaaggcaacaagcaugcagccagcaagcuucggaaaaccacagcauca

SEQ ID NO: 239348 - RNA, 64 nt, Human
cuugucguagagucuaauguuuuuuaaaauuggugccagcaauucacgauuuauauuuuuugaa

SEQ ID NO: 239349 - RNA, 64 nt, Human
uuccauuuaaagucugcgggacgcgcccaguggcgccagcaagcugcccaugcaaagccgcagc

SEQ ID NO: 239350 - RNA, 64 nt, Human
cugucagggaggcauuaaaaauuuggaaauguaugccagcaaaaugugagcucuguauuuuuug

SEQ ID NO: 239351 - RNA, 64 nt, Human
uggcaggacugccauuaucugggguguggccucugccagcaagagaaguguccuggguguuuuu

SEQ ID NO: 239352 - RNA, 64 nt, Human
gaauuguuuuauagugcauacaaaucagcgaucagccagcaaauauuuuucuuugagcuuguga

SEQ ID NO: 239353 - RNA, 64 nt, Human
uggagggguucgagccccugguucuguaucuucagccagcaaacgaaaccauaucgcaaaccag

SEQ ID NO: 239354 - RNA, 64 nt, Human
uuaauuccaccaaggaaaagcagaacaccugaaagccagcaauuuccugacacugagaaugaac

SEQ ID NO: 239355 - RNA, 64 nt, Human
uuugccacaucuugaucugcucagcccuggaggugccagcaaagccccaugcuggagccugugu

SEQ ID NO: 239356 - RNA, 64 nt, Human
cuggagccaaguccagauuuacacugggagaggugccagcaacugaauaaauaccucuuagcug

SEQ ID NO: 239357 - RNA, 64 nt, Human
cugcuaaugacaaaacaaauccuguaacuacccagccagcaaguauauagcacagaacacugug

SEQ ID NO: 239358 - RNA, 64 nt, Human
cucuaaagaccaaacuucacucugggcacacucugccagcaaagaggacucgcuuguaaauacc

SEQ ID NO: 239359 - RNA, 64 nt, Human
guucucaacuuaaaauuaagccuaaccuaaaacugccagcaacacaacuggaguuuccauuuau

SEQ ID NO: 239360 - RNA, 64 nt, Human
ccauaggaaggagcuggaaggccuccggaugcgugccagcaaugaguuggcacuggcagagcug

SEQ ID NO: 239361 - RNA, 60 nt, Human
ggagaaucgcuuaaccccagaaguuugaguccagcccaggcaacacagcaagaccccauc

SEQ ID NO: 239362 - RNA, 60 nt, Human
uugggaacacggaagucuauuccaggccaaccagcccaaaauuauuucaucuuguauucu

SEQ ID NO: 239363 - RNA, 60 nt, Human
aagucuggacuuuggugguacccuccucccccagcccaucuguugcacauuauacuccgu

SEQ ID NO: 239364 - RNA, 64 nt, Human
uccggauggaggccagcuaagccacucggggcaggccagcaauaaaaacugucugucuccaucg

SEQ ID NO: 239365 - RNA, 64 nt, Human
cguggcauuuggcaccucugucccagauacguuugccagcaaagcugcugcccuccaggaugua

SEQ ID NO: 239366 - RNA, 64 nt, Human
uguggcagggggauggcagguuggggguccuggggccagcaaugugguuccugugcacugagcc

SEQ ID NO: 239367 - RNA, 64 nt, Human
gagaaagugagagaggcaaucaugccaagaacaagccagcaaagcucuuucaccagauguagac

SEQ ID NO: 239368 - RNA, 64 nt, Human
aucaggugccccucuuccaaaggcagcgugccgagccagcaagaggaaggggugcugugaggcu

SEQ ID NO: 239369 - RNA, 64 nt, Human
cugacugacacuaagucuagcacacagcacuugggccagcaaauccuggaaggcagacaaaaau

SEQ ID NO: 239370 - RNA, 64 nt, Human
auccuguuugaagaaaaaggacaaauaaaacauggccagcaaauacagcuccuguuucacucuu

SEQ ID NO: 239371 - RNA, 64 nt, Human
uccagagaaugaaugaguuccuuuaagugccaccgccagcaagcccagaggcacacaguccgag

SEQ ID NO: 239372 - RNA, 64 nt, Human
aggacucccaacccuggcuuggggucaagaaacagccagcaagaguuaggggccuuagggcacu

SEQ ID NO: 239373 - RNA, 64 nt, Human
cugucccacccccuucccccagcccauccauuaggccagcaacgcuuguagaacucacucuggg

SEQ ID NO: 239374 - RNA, 64 nt, Human
ggcccuggccuuugccaucccgggaggcccccuagccagcaagagugggauugccuuuccugug

SEQ ID NO: 239375 - RNA, 64 nt, Human
ggucuaucucauuuggucucagagcugugaaucagccagcaauauuuuaguugcaaaucacuga

SEQ ID NO: 239376 - RNA, 64 nt, Human
aggcucuaaaguuccuauaguccugagacccccugccagcaaagagugacagucaccuccaugc

SEQ ID NO: 239377 - RNA, 64 nt, Human
caaguuauagcuacauaugggagagacucagugagccagcaaaggccauagaaacaacaauuua

SEQ ID NO: 239378 - RNA, 64 nt, Human
uggcuguucgggacugagagcgccaagggucuuugccagcaaaggagguucugccuguaauuga

SEQ ID NO: 239379 - RNA, 64 nt, Human
agggcaagacccuaucucaaaaaaaaaaaaagucgccagcaacaagcacguaguguaguguucc

SEQ ID NO: 239380 - RNA, 60 nt, Human
cuccccucuccuuuucuucucuuuagagacccagcccagggcccucccacccuuguccag

SEQ ID NO: 239381 - RNA, 60 nt, Human
ggcucagaguguggugcuagaaacuggcccccagcccagccccaguacugccaccuuuac

SEQ ID NO: 239382 - RNA, 60 nt, Human
uauuuguggcagaaggugaucagauaagcuccagcccaaauggaaccuguggggugguau

SEQ ID NO: 239383 - RNA, 64 nt, Human
ggcucugcuuugcgucuaaccuuugugggggagggccagcaaggcaguccccccacgcccgaga

SEQ ID NO: 239384 - RNA, 64 nt, Human
caucagcagccaggggcgagcacuaguggacaaagccagcaaaugcggcguuccugugagcaga

SEQ ID NO: 239385 - RNA, 64 nt, Human
uguucaauuuuuuaucuuguugagcuuguaaaaugccagcaauuuaaaacuaggacuuuucccc

SEQ ID NO: 239386 - RNA, 64 nt, Human
gaugcacaccaccaacauucuuggcauuacgcaggccagcaacucccagcucaaugcaauggua

SEQ ID NO: 239387 - RNA, 64 nt, Human
gaagugagagguagaaguacuucaaauucaacaggccagcaagcaaucggcuuaaaauucccuu

SEQ ID NO: 239388 - RNA, 64 nt, Human
aggagguucucaugcccaggguccacagugaccagccagcaagucucugguagaaaaacaccca

SEQ ID NO: 239389 - RNA, 64 nt, Human
gccgguggccaucuuuuccuacuaccuagagaaagccagcaaagaaugaaggcaacaaaggaaa

SEQ ID NO: 239390 - RNA, 64 nt, Human
gacuuuuuuaaaaaaccagaucgggaggacuguggccagcaauuaacaccauguagacuuccuu

SEQ ID NO: 239391 - RNA, 64 nt, Human
aaauaagccgucaaguaguaagaagaacuuggaugccagcaaagagaauggggcugggcagauc

SEQ ID NO: 239392 - RNA, 64 nt, Human
cugcacagcagcucggugcccaagaacuggccaagccagcaaagcgggagcccugaaaaauuag

SEQ ID NO: 239393 - RNA, 64 nt, Human
gggaaugcugcccgcucugcagacugcugcuagagccagcaacuccacuaagguggauuuucau

SEQ ID NO: 239394 - RNA, 64 nt, Human
aauaucacuacccacauaaccuauaauuuguguggccagcaauuuauugaacacuaaaauguuu

SEQ ID NO: 239395 - RNA, 64 nt, Human
ccaccccaguuaaaccauuuucauaauuaguagugccagcaauaguggcaaacacugcaacuuu

SEQ ID NO: 239396 - RNA, 64 nt, Human
uucagggauggaaacaaaccagcucgucucagaggccagcaagcuggggccuguccgccacggu

SEQ ID NO: 239397 - RNA, 64 nt, Human
gccucuccugcccugaaaaggaggaaugauuggggccagcaacuuugcucucccugccgugccu

SEQ ID NO: 239398 - RNA, 64 nt, Human
aggagaucugucucccugugccuggagaguuacagccagcaaggugcccccaucuuagagugug

SEQ ID NO: 239399 - RNA, 60 nt, Human
guucacugggccagggauggucucuguuccccagcccaccuggcucacacacagccucau

SEQ ID NO: 239400 - RNA, 60 nt, Human
cuugaugagcaugccagcuaugugguagggccagcccaccaugggggccaagaccugcac

SEQ ID NO: 239401 - RNA, 60 nt, Human
ggagauuauauucacuccugccaaggacucccagcccaggacucucuuuagagcaaggaa

SEQ ID NO: 239402 - RNA, 64 nt, Human
ugaguuucacacagaagaauuucaugugaauggggccagcaagagcugcccuguguccauggug

SEQ ID NO: 239403 - RNA, 64 nt, Human
cacuggugcuauagaaauugagaugcccccccaggccagcaaauguuccuuuuuguucaaaguc

SEQ ID NO: 239404 - RNA, 64 nt, Human
gaacuuacuaucuucauagaguuauggaguggcugccagcaagagacaguguucagauguggau

SEQ ID NO: 239405 - RNA, 64 nt, Human
ggcauaagccuaagccauaccaugcagccuuugugccagcaaccaaaucccauguuuccuacug

SEQ ID NO: 239406 - RNA, 64 nt, Human
caccuccugaguuuauuuuuccagagauuccagggccagcaaagccggcguucagaaggaggga

SEQ ID NO: 239407 - RNA, 64 nt, Human
ugagaacaagccuaaaggauucccacagcugggagccagcaagagagcuuggagucgccucucu

SEQ ID NO: 239408 - RNA, 61 nt, Human
gggaaucaacagcugaauaagguuugaugaagccagcaauggcaacaagugaacgaggaca

SEQ ID NO: 239409 - RNA, 64 nt, Human
guggagcuucccugagggugcccgggcaagucuugccagcaaggcagcaagacuuccugcuauc

SEQ ID NO: 239410 - RNA, 64 nt, Human
ugcucccauccuguguguuaagcucugcuauuaggccagcaagcggggaugucccugggaggga

SEQ ID NO: 239411 - RNA, 64 nt, Human
cacacaggcagcauuaauggagugccuacugcaugccagcaacagggcuuggcccuggggaauu

SEQ ID NO: 239412 - RNA, 64 nt, Human
auuuauuaauaaaagcuuauuagaguguagaaaugccagcaagaguuaagaaagggcuuuucag

SEQ ID NO: 239413 - RNA, 64 nt, Human
cagcaucugcagccacuuucugccagcaucugcagccagcaagcugggacuggcaggaaauaac

SEQ ID NO: 239414 - RNA, 64 nt, Human
cgcagggcauggaagguucuggacacccucaugugccagcaagcccacggucuuccacuaccag

SEQ ID NO: 239415 - RNA, 64 nt, Human
ucuagaccaacugaugcagaaacaggaggugugagccagcaaucagauggagauucuagugcuc

SEQ ID NO: 239416 - RNA, 64 nt, Human
cccuuacagcccccagacccuucuugaaacgagagccagcaagcugagcacagaccagcagcga

SEQ ID NO: 239417 - RNA, 64 nt, Human
guuuaauugaugaugacagaggacacagguuuuugccagcaaaaaggaaaaccaaggcuuggug

SEQ ID NO: 239418 - RNA, 60 nt, Human
ccuccccaagucagcaguccuagccccaaaccagcccagagcagggucucucuaaagggg

SEQ ID NO: 239419 - RNA, 60 nt, Human
ccucuucuacucacuuuucccacuccaagcccagcccauggagauugaccuggauggggc

SEQ ID NO: 239420 - RNA, 60 nt, Human
aucuuuacguucaggacucaguuuuaacacccagcccagugguucuuucauagaugggaa

SEQ ID NO: 239421 - RNA, 64 nt, Human
ggagaccgagggucccagaggaccaaugcuacaagccagcaaaugcugccacaucucugccuga

SEQ ID NO: 239422 - RNA, 64 nt, Human
gucauugcacuuucugcugaaaugguaguuucuugccagcaaggugagauuauggaauccagaa

SEQ ID NO: 239423 - RNA, 64 nt, Human
gcagagagcuuagccuggagcaccuuuccuucaagccagcaacacagagcacuagguucaauuc

SEQ ID NO: 239424 - RNA, 64 nt, Human
gcgccugccggugaagagcugcagaugccgagaagccagcaaacacagggcccacuggaaaaaa

SEQ ID NO: 239425 - RNA, 64 nt, Human
cccagcggggaggaggagcaaggacauguaccaugccagcaagagugccaagcgggcccugagc

SEQ ID NO: 239426 - RNA, 64 nt, Human
gugcugggauuacaggcaugagccaccaugccuagccagcaagcaucauuucuauuauaccuug

SEQ ID NO: 239427 - RNA, 64 nt, Human
ccauucugucccacagccaccaccucucuccucagccagcaaugacaucagcgucgacuugccu

SEQ ID NO: 239428 - RNA, 64 nt, Human
uucucuugcacaccacucccaccacggggggagagccagcaacccaaccagacagcucagguug

SEQ ID NO: 239429 - RNA, 64 nt, Human
gugauguccccuuucccugccaccuccagccucugccagcaaugagcugucccccucccacccu

SEQ ID NO: 239430 - RNA, 64 nt, Human
caaaauggcuuguugccaauauggccacaacauugccagcaaauacugccuuggcaucacucag

SEQ ID NO: 239431 - RNA, 64 nt, Human
cccaaacacgcuccauguauauauucuucugauggccagcaaaugaaauucugccuagaaauua

SEQ ID NO: 239432 - RNA, 64 nt, Human
ccugccagggagaugggacccuugugccaccugggccagcaaagaggagggguccagagaacag

SEQ ID NO: 239433 - RNA, 64 nt, Human
ggcagucgccgagagccuccuuccccuccguccagccagcaaggcuuucccaagcguccugggc

SEQ ID NO: 239434 - RNA, 64 nt, Human
gggcgccgaugucgagggcaccugagcgaggggugccagcaagggggcggccggcuggugggug

SEQ ID NO: 239435 - RNA, 64 nt, Human
uuucgcuaguggucacccaccaccaugguuacuugccagcaacaucucuauugcuggauggucc

SEQ ID NO: 239436 - RNA, 64 nt, Human
caucaagguggucccucuccagucuggacacgaugccagcaaggaugacguccugccaccuccu

SEQ ID NO: 239437 - RNA, 60 nt, Human
cucugccaugagaacaggacaccauccugcccagcccagacgggguugcuccugguccaa

SEQ ID NO: 239438 - RNA, 60 nt, Human
uagccaucucccuguccccagcaccccuccccagcccacagugguggccucugccucuuu

SEQ ID NO: 239439 - RNA, 60 nt, Human
aacccccagcgcugcgcuagagaaacccgcccagcccagagcgggcccgccccgcugcgg

SEQ ID NO: 239440 - RNA, 64 nt, Human
accugugugcaugucagggcucggccgggaagaagccagcaaagucccccgugucccuugcuga

SEQ ID NO: 239441 - RNA, 64 nt, Human
cugaugucauggcuggacaaagucacggaguaaagccagcaaagccacccucuuccuguguagu

SEQ ID NO: 239442 - RNA, 64 nt, Human
gucuccgccuccaggguucugcucuuccaggcaggccagcaaguggcgcugggccacacuggcu

SEQ ID NO: 239443 - RNA, 64 nt, Human
gaccguucaccaccaucuccagcugcucacagacgccagcaaagcaguaugcucccgaucaagu

SEQ ID NO: 239444 - RNA, 64 nt, Human
aaaaaaaaaaaagaugcaaucaaaggggcuguuggccagcaauggcagcagcagcggcgggcag

SEQ ID NO: 239445 - RNA, 64 nt, Human
agcuagggcuggagcucugcccaggugcccuggggccagcaaggcagucccaggccugccgucu

SEQ ID NO: 239446 - RNA, 64 nt, Human
gagucaggguaacacacaccaagaguggagugcggccagcaaguuugagaccugcccgcccucc

SEQ ID NO: 239447 - RNA, 64 nt, Human
ucagggugcagugagcuccccugggaaaaccgaagccagcaagaccaggagagggccaccucac

SEQ ID NO: 239448 - RNA, 64 nt, Human
gccucuggacuggaaagcacaagacuggcccagugccagcaaguccuuaggcuacuguaaugcu

SEQ ID NO: 239449 - RNA, 64 nt, Human
cuccccaucccuguuauagaagcuuagagagccagccagcaauggaaccuucugguuccugcgc

SEQ ID NO: 239450 - RNA, 64 nt, Human
caugaacuugucaugaacaaauucaaauguuuaugccagcaaauuuuuguacuguugcauaguu

SEQ ID NO: 239451 - RNA, 64 nt, Human
uaugcaauuguagguucaaccugucccuuucccugccagcaaaccccaccacccuaagagaaau

SEQ ID NO: 239452 - RNA, 64 nt, Human
ggccuugcuauggaugcgcuuaaucaccauggaggccagcaauacccaucucagcauggcuuug

SEQ ID NO: 239453 - RNA, 64 nt, Human
aguaaucaaaaccacaaaugcauuugguuuuugggccagcaauuccacuucuaggaauguacau

SEQ ID NO: 239454 - RNA, 64 nt, Human
agccuuggcaguggggcgugcuuggaagccaccagccagcaagcauuaauggggcuggugccca

SEQ ID NO: 239455 - RNA, 64 nt, Human
aguggcagcuauaggaaauuaucaacauaccuuggccagcaaguuagagaaucuggcaauggau

SEQ ID NO: 239456 - RNA, 60 nt, Human
accagcaccauggcuggcaucgcucagcccccagcccaauugccaucaagacuccugaag

SEQ ID NO: 239457 - RNA, 60 nt, Human
uucaaucuccacugauugcccccuugcuggccagcccaggggccuuuaccauguucucuc

SEQ ID NO: 239458 - RNA, 60 nt, Human
ucuggaacugauugcucccaggaucuccugccagcccagcuggccuggcccccagcuuca

SEQ ID NO: 239459 - RNA, 64 nt, Human
ugcagucaauguauuaagcaaagcaaaccugccagccagcaaauucaaauaaaaaauaaagcau

SEQ ID NO: 239460 - RNA, 64 nt, Human
ccccaccccaaacuucugucgaggagcaaggcuugccagcaagucagaaggauuugaaccgagc

SEQ ID NO: 239461 - RNA, 64 nt, Human
uggguaugagguuugaacacugaggacugacagggccagcaacguggagguuuaggggcucccc

SEQ ID NO: 239462 - RNA, 64 nt, Human
guaaaguccacaccccgaugcucagaagugucuugccagcaacauuccugcuagcauacaggag

SEQ ID NO: 239463 - RNA, 60 nt, Human
gcccacagcuguggggcuucagcagccacaccagcccagcccagcccagcucucgauacg

SEQ ID NO: 239464 - RNA, 60 nt, Human
cagcuguggggcuucagcagccacaccagcccagcccagcccagcucucgauacguuugg

SEQ ID NO: 239465 - RNA, 60 nt, Human
guggggcuucagcagccacaccagcccagcccagcccagcucucgauacguuuggucuuu

SEQ ID NO: 239466 - RNA, 60 nt, Human
cccacccccaucccauccccacccccagccccagcccaguccuccuaggagcaggacccg

SEQ ID NO: 239467 - RNA, 60 nt, Human
gccccuguagacuuucucuaaagccgcccgccagcccaggccgcugcucugcaccgagcu

SEQ ID NO: 239468 - RNA, 60 nt, Human
ugggacccucgaccccacccuucuuuccuaccagcccagagccuuguggcuuguacaguu

SEQ ID NO: 239469 - RNA, 60 nt, Human
agcgcucaggccaggacugugcagggccagccagcccaugcgcuagucaggagcacaggc

SEQ ID NO: 239470 - RNA, 54 nt, Human
agcacuaccagaccaucugacagcccagcccacccucuccuggugcugccuggg

SEQ ID NO: 239471 - RNA, 60 nt, Human
cucuucccccaucaccaccugccccucccuccagcccagcuccauucuuuggcauaacag

SEQ ID NO: 239472 - RNA, 60 nt, Human
gcgucugcucuucugugcccaggguggcugccagcccacugccuccugccugggguggcc

SEQ ID NO: 239473 - RNA, 60 nt, Human
agggaccagaggauccuaucuucucagcacccagcccaccccuuccuguagcauaugggg

SEQ ID NO: 239474 - RNA, 60 nt, Human
gagcuggaacccgaggggccggggaagcugccagcccagaacaccccuaaugagggugug

SEQ ID NO: 239475 - RNA, 60 nt, Human
uagugucuugguagcaccagccaguguuucccagcccagaguuuacugacuuguaauucu

SEQ ID NO: 239476 - RNA, 60 nt, Human
gucugcucuguucaaaaggcagcugggaucccagcccacaagugaucagcagaguugcau

SEQ ID NO: 239477 - RNA, 60 nt, Human
cggggcuccugagccucugcgugugcccucccagcccacaccagugcucucggccacuga

SEQ ID NO: 239478 - RNA, 60 nt, Human
ggcugggcucucggggccaggcaggccagcccagcccacgccgagcugggcagcgucugc

SEQ ID NO: 239479 - RNA, 60 nt, Human
ccuagggcugggcucucggggccaggcaggccagcccagcccacgccgagcugggcagcg

SEQ ID NO: 239480 - RNA, 60 nt, Human
caucagauggagcacacagguggcugcagcccagcccaccuucccagcguucucgaggug

SEQ ID NO: 239481 - RNA, 60 nt, Human
auuucaaguaaucgaauaccaacuucccugccagcccaccugccuuccgccccgcuugug

SEQ ID NO: 239482 - RNA, 60 nt, Human
caugggacaacucccacaacaaagaauuauccagcccaaaaugucauuagugcugagguu

SEQ ID NO: 239483 - RNA, 60 nt, Human
caaagcucaggcaaguggcucaguaguuggccagcccagcaggguccucuguaugagugu

SEQ ID NO: 239484 - RNA, 60 nt, Human
aguacuggagcuucucuuuaacucaggacuccagcccauugguagacguguguuucuaga

SEQ ID NO: 239485 - RNA, 60 nt, Human
uugugaagaaccaucgaaaccuguuuguucccagcccacccccaguggaugggaugcaua

SEQ ID NO: 239486 - RNA, 60 nt, Human
caaggugaggcaaaggcaucuggacuuguuccagcccagcccaccgggugacaucaccgg

SEQ ID NO: 239487 - RNA, 60 nt, Human
ugaggcaaaggcaucuggacuuguuccagcccagcccaccgggugacaucaccgggcagg

SEQ ID NO: 239488 - RNA, 60 nt, Human
ggacuucccuagaagucuucauggucucuuccagcccagacauccugugaugucaugaaa

SEQ ID NO: 239489 - RNA, 60 nt, Human
agcagcugaggugcugcagccccuucccuuccagcccacaagugugugcauauugagcuc

SEQ ID NO: 239490 - RNA, 60 nt, Human
ugcaagcaagguggacaagagcucaggacuccagcccacugccacugggugacacagacu

SEQ ID NO: 239491 - RNA, 60 nt, Human
ccucccuugcugcucugccccugccagugcccagcccagcggcucugggaagggguuccc

SEQ ID NO: 239492 - RNA, 60 nt, Human
cagugcccagacagggucauggggcucagaccagcccacuguagagaaucacucugaggc

SEQ ID NO: 239493 - RNA, 60 nt, Human
cuccauccuaggcucugagccucagaggacccagcccaugagagaacggggaucuggggg

SEQ ID NO: 239494 - RNA, 55 nt, Human
ucugggacaugcucaccugaccagaccagcccagccguccuguccugccagcucu

SEQ ID NO: 239495 - RNA, 60 nt, Human
cacccagcagagccacuggagcuggcuaguccagcccagccauggugcaugacucuucca

SEQ ID NO: 239496 - RNA, 60 nt, Human
agggcccggaucuaagaugcccuuagaagaccagcccaagugccgucuuagccauucagu

SEQ ID NO: 239497 - RNA, 60 nt, Human
aucagcccccacaauuugucagagcugaagccagcccacuacccacccccacuacagcau

SEQ ID NO: 239498 - RNA, 60 nt, Human
agcacaggcuuuugaauggucucccucuccccagcccagguacaugaggccaaggugaac

SEQ ID NO: 239499 - RNA, 60 nt, Human
auguaaugguugguuuauuguucuauaaccccagcccaucauuuucuguguaaaucauaa

SEQ ID NO: 239500 - RNA, 60 nt, Human
gcgggcguuggguuuggggggacggugcccccagcccaggaucgggcacucaguggagcc

SEQ ID NO: 239501 - RNA, 60 nt, Human
ccauccaagacugugggaggaguaaacaacccagcccaguuaagaggagaugccgaauuu

SEQ ID NO: 239502 - RNA, 60 nt, Human
ggggcaacggugugauccagcuggcucaucccagcccaggugggccaauuauucaauuuu

SEQ ID NO: 239503 - RNA, 60 nt, Human
guuguggugaggggccuugcccucccgcucccagcccaggguccaaccugacccagugau

SEQ ID NO: 239504 - RNA, 60 nt, Human
gugccccccagaguagagagcaauaagagcccagcccagugcagucccggcuguguuuuc

SEQ ID NO: 239505 - RNA, 60 nt, Human
cccaggacaggucauggccccucucugggcccagcccauuuaucuauaccaugagguaac

SEQ ID NO: 239506 - RNA, 60 nt, Human
uguucccuugaccauuggcugcgcuaacccccagcccacagagccugaauuuguaagcaa

SEQ ID NO: 239507 - RNA, 60 nt, Human
cccagaccuagcagugacaucucauuguccccagcccagugggcauuggaggugccaggg

SEQ ID NO: 239508 - RNA, 60 nt, Human
agagaaagagaaauauauauauauccacccccagcccaaccgagggcggcccuuggcggc

SEQ ID NO: 239509 - RNA, 60 nt, Human
ccagcucaaaggggguuuaaaaaaaaaaaaccagcccauccuuugaggcugauuuuucuu

SEQ ID NO: 239510 - RNA, 60 nt, Human
gcaaaaaaauaaaaaggaucuccuuuuuucccagcccaaauucuccucucuaaaaguguc

SEQ ID NO: 239511 - RNA, 60 nt, Human
aucucuuugaauuuucuguguuuugcuguaccagcccagauguuuuacgucugggagaaa

SEQ ID NO: 239512 - RNA, 60 nt, Human
ugcugggauuacaggcgugagccacuccacccagcccagauuaaauguuuuuauuucuac

SEQ ID NO: 239513 - RNA, 60 nt, Human
caagaacccugacuccucuuugugcagagaccagcccaccccugugcccaccaugacccu

SEQ ID NO: 239514 - RNA, 60 nt, Human
uccaauggcuuuauccuaccuagaucccuuccagcccauuuuaauuagacuaugucauug

SEQ ID NO: 239515 - RNA, 60 nt, Human
gaggugagcuucugaggccuuugccauuauccagcccaagauuuggugccugcagccucu

SEQ ID NO: 239516 - RNA, 60 nt, Human
cuggggcacugagacaguuguuuggcagccccagcccagccaggggcucauccuucucag

SEQ ID NO: 239517 - RNA, 60 nt, Human
aggaugacacaucaaauaauaacucggauuccagcccacauuggauucaucagcauuugg

SEQ ID NO: 239518 - RNA, 60 nt, Human
uccuccggaccugagcuccgugcucaacccccagcccaccccacccucccugggcagggu

SEQ ID NO: 239519 - RNA, 60 nt, Human
aaugccaguguguucacaucuucgcucuggccagcccauucuguauuuaaagcuuuugag

SEQ ID NO: 239520 - RNA, 60 nt, Human
cucacuucaucugugucaucucugcacacuccagcccacuuucugccuucagccauugag

SEQ ID NO: 239521 - RNA, 56 nt, Human
aggagugugggugcucauagaguugcccagcccagggggaaagggagcaagaguug

SEQ ID NO: 239522 - RNA, 60 nt, Human
ucaccucgggccuggaucccaggccucaaaccagcccaacccgagcuuuuggacagcucu

SEQ ID NO: 239523 - RNA, 60 nt, Human
aggccaaagcaucagcaccagaacgcacacccagcccagccccaaagagaaagaagagag

SEQ ID NO: 239524 - RNA, 60 nt, Human
aggccaaagcaucagcaccagaacgcacacccagcccagccccaaagagaaagaagagac

SEQ ID NO: 239525 - RNA, 60 nt, Human
ugauggaucuggccagagggguguuggagcccagcccacccacauaccagucaagcucuu

SEQ ID NO: 239526 - RNA, 60 nt, Human
ccuucaugggcucgugagcacacucagugcccagcccagccucaaggugagccccgggcc

SEQ ID NO: 239527 - RNA, 60 nt, Human
gccauccagcgugcagccuugccucggaggccagcccacccccagaagccaggaagcccc

SEQ ID NO: 239528 - RNA, 60 nt, Human
cucaaaaaaaaaaagauucugugucagagcccagcccaggaguuugaggcugcaaugagc

SEQ ID NO: 239529 - RNA, 60 nt, Human
gguguggcugcagccucagucccugccccuccagcccacagcccccaucccguagcccuu

SEQ ID NO: 239530 - RNA, 60 nt, Human
ucccagagcucacccgcgggugaccgggggccagcccaggagggcgggugguuugugcga

SEQ ID NO: 239531 - RNA, 60 nt, Human
ucccauagggcugcccaccaagcccugcccccagcccaagaggagcccccacugccugcg

SEQ ID NO: 239532 - RNA, 60 nt, Human
cugucuuguuugcugugccacgccugaugcccagcccagcagcaugcuuuguacacugau

SEQ ID NO: 239533 - RNA, 60 nt, Human
uuacuccuucagcucuggggcagaggaagcccagcccaagcacggggcuggcagggcgug

SEQ ID NO: 239534 - RNA, 60 nt, Human
uggguuuuggugauguuggaggaguaccccccagcccaccgccccgauuccuuuuugcuu

SEQ ID NO: 239535 - RNA, 60 nt, Human
acugcauuuccugaucugggaugauguuuaccagcccaaaaccagucauguucuuccaaa

SEQ ID NO: 239536 - RNA, 60 nt, Human
acucuugcagcccugaaggaccuagggagcccagcccaccuucccacggacugggguucc

SEQ ID NO: 239537 - RNA, 60 nt, Human
aaaaucaucccaaaccaggcugccccagccccagcccagcaacagugaacucccuugggu

SEQ ID NO: 239538 - RNA, 60 nt, Human
guguccccagaagacacccacugcagacccccagcccagccugcucugcggcccccugcg

SEQ ID NO: 239539 - RNA, 60 nt, Human
ucaacaccugacauucacagcaagcauggcccagcccaacugcaugucuaucucaaaccg

SEQ ID NO: 239540 - RNA, 60 nt, Human
ugcuuuuagacuuuucaguguuuucuuuuuccagcccacuguauaaacuuggauugucca

SEQ ID NO: 239541 - RNA, 60 nt, Human
cugacccaguccgcaaauauuuauugggggccagcccagggcugggacugggcaugaggu

SEQ ID NO: 239542 - RNA, 60 nt, Human
ugucucuugucuuuggccagcccccucagcccagcccaccccacccgcuguccggccaca

SEQ ID NO: 239543 - RNA, 60 nt, Human
caccccuggaauacaggggaaugaugacaaccagcccagccaggccugacucaucauggu

SEQ ID NO: 239544 - RNA, 60 nt, Human
gggaaagguuuuucuuguagggaacuggaaccagcccacaacugcacacuugugagcugu

SEQ ID NO: 239545 - RNA, 60 nt, Human
gcagggucccuccuuccugucaugcucccuccagcccaugacccggggcuaggaggcuca

SEQ ID NO: 239546 - RNA, 60 nt, Human
cccagcaugccggugggcccacagcccgagccagcccagagcugccggaagggccgcccu

SEQ ID NO: 239547 - RNA, 60 nt, Human
uugucugcauugacggcccugugacggccuccagcccacaggccugcuuucuccuguccu

SEQ ID NO: 239548 - RNA, 60 nt, Human
agggggcccugcccggcccucccuggcgccccagcccagugccccccgaagggccaaaug

SEQ ID NO: 239549 - RNA, 60 nt, Human
aggguauacccuggcucugccacccaugaaccagcccagcauccagccagugagugggca

SEQ ID NO: 239550 - RNA, 60 nt, Human
aaccaguaaugggggcaaggcuggggcaucccagcccacacacccuggaugcccagcaag

SEQ ID NO: 239551 - RNA, 60 nt, Human
ucuuccucagaguggcucgggucagcgcagccagcccagcucccugcagcccaagucuca

SEQ ID NO: 239552 - RNA, 60 nt, Human
uaugcacccccaccauuccuacacaucuugccagcccaccagcagccccacucacagcug

SEQ ID NO: 239553 - RNA, 60 nt, Human
gcuggacuccaauggcccauuccccucaccccagcccaagacgugggaggcugcuuccca

SEQ ID NO: 239554 - RNA, 60 nt, Human
ccccucaccaaugcaucuaucugucugccaccagcccaccccacccugcccccacccuca

SEQ ID NO: 239555 - RNA, 60 nt, Human
gcuguaccucgaucugaaucugccggggccccagcccacuccacccugccagcagcuucc

SEQ ID NO: 239556 - RNA, 60 nt, Human
ccucagcccagcccacccucaccugcuuuuccagcccacaaagggggacgaucacggccc

SEQ ID NO: 239557 - RNA, 60 nt, Human
uacacagauaguggcggcaauggccucagcccagcccacccucaccugcuuuuccagccc

SEQ ID NO: 239558 - RNA, 60 nt, Human
uggaaacgugccaggacacuguccuggugcccagcccaacgugguccaacguuuuuuuau

SEQ ID NO: 239559 - RNA, 60 nt, Human
ggggucgggggccugggaguucauucuggaccagcccaccuaucuccauuuccuuuuaua

SEQ ID NO: 239560 - RNA, 60 nt, Human
gugugaaaucgugcaaaucuacaacaugucccagcccauucuccguugaaacagaucaca

SEQ ID NO: 239561 - RNA, 60 nt, Human
uacuagggaggcugagccaggaagaacgcuccagcccaggacuucgaggcugcaaugagc

SEQ ID NO: 239562 - RNA, 60 nt, Human
gcggugguagaucccuuucuaaggucccuuccagcccagccguucugggagcccaggaau

SEQ ID NO: 239563 - RNA, 60 nt, Human
cagagccucuggccccucacccaccauggaccagcccauuggccgagcuccuggggagcu

SEQ ID NO: 239564 - RNA, 60 nt, Human
gcuucucccugcccuaaggagggugugaugccagcccaaccuucccauaucuuucaagcu

SEQ ID NO: 239565 - RNA, 60 nt, Human
gacgaagggaaggguagccagggagggaguccagcccagcugccugcaggaagaucuggc

SEQ ID NO: 239566 - RNA, 60 nt, Human
cgagugggguuugaaggcagccggcccggcccagcccaggagcgcuauuuauugcauauu

SEQ ID NO: 239567 - RNA, 60 nt, Human
ugcaggguccgagggcugcaucucuaccagccagcccagggcucuucccagggucucgca

SEQ ID NO: 239568 - RNA, 60 nt, Human
ucaagaccagaagaaccacucaagcagaucccagcccaaauugcccauucacacaaucag

SEQ ID NO: 239569 - RNA, 60 nt, Human
uugccagauagaaaagacuuaaauggagaaccagcccaugccucacagacaguaggaucc

SEQ ID NO: 239570 - RNA, 60 nt, Human
gugcuugcucuauuuggcuccuaacaguugccagcccaccuaaguucucuucgcuuaaag

SEQ ID NO: 239571 - RNA, 60 nt, Human
agaggaccgccggccucagcuacuagcccaccagcccaccagggagaaaagaagccauga

SEQ ID NO: 239572 - RNA, 60 nt, Human
agagcacgguguccagagcuggcccuucccccagcccacagccagcuccgugcccgagug

SEQ ID NO: 239573 - RNA, 60 nt, Human
ucacuagggaaugucaccugaaugcacagcccagcccaugcaccugccccagccccucca

SEQ ID NO: 239574 - RNA, 60 nt, Human
cuccugcaguaugagugaccacagggccucccagcccaacaucuccagcuggaucccagg

SEQ ID NO: 239575 - RNA, 60 nt, Human
aucucuucugacgggaccugccacugcacaccagcccagcucccguguaaauaauuuauu

SEQ ID NO: 239576 - RNA, 60 nt, Human
caguccaggucaaaggcaaacacacacgcuccagcccaaauccuccugguggcacauccu

SEQ ID NO: 239577 - RNA, 60 nt, Human
aggcugagggacucacuggagggcaccaagccagcccacagccagggaaguggggagggg

SEQ ID NO: 239578 - RNA, 60 nt, Human
cauacguggucugcggacagggcagcgcccccagcccaugacaagggagucuuguuuucu

SEQ ID NO: 239579 - RNA, 60 nt, Human
cuggccacauggggccacugggacuucaacccagcccaucggugggaagguccuuuuugg

SEQ ID NO: 239580 - RNA, 60 nt, Human
gcgccugcccucugcuggcuaggaccgggcccagcccagcccuuccugaagccagaagcg

SEQ ID NO: 239581 - RNA, 60 nt, Human
gggacacguggggugugcugcugcugcuccccagcccaccagugccuggccagccugccc

SEQ ID NO: 239582 - RNA, 60 nt, Human
cuggaaaucucuguggucugcaagugcuucccagcccagaacagggguggauuccccaac

SEQ ID NO: 239583 - RNA, 60 nt, Human
augaugccuccuccgggaagccuucccugcccagcccacgccgccaccgggaggaagccu

SEQ ID NO: 239584 - RNA, 60 nt, Human
ucuguccacuagcgagaaucccuagcugccccagcccagucuuucuccccggcauucaca

SEQ ID NO: 239585 - RNA, 60 nt, Human
caaaaaucaauaaacacugugauugcacucccagcccagaucagcauuuuuagccaucuc

SEQ ID NO: 239586 - RNA, 60 nt, Human
aaggacuugcugggcucuguggccagcuguccagcccagcccugugugugaaucguuugu

SEQ ID NO: 239587 - RNA, 60 nt, Human
gaaggccaagaaggcugccaccauucccugccagcccaagaacuccagcuuccccacugc

SEQ ID NO: 239588 - RNA, 60 nt, Human
agcaaccagggcccgcggguguggcccccaccagcccaggccuggacucuccucaguucu

SEQ ID NO: 239589 - RNA, 60 nt, Human
uucggaucggccacccucgccccucgcaccccagcccagggcggcggggacuccgagagc

SEQ ID NO: 239590 - RNA, 60 nt, Human
ugccgagaccccugcggucugugcccgcgcccagcccagcugccccggcugcacgccugc

SEQ ID NO: 239591 - RNA, 60 nt, Human
aaauccccguuccccugcacuccucuucucccagcccaucccuccggccccugugccucu

SEQ ID NO: 239592 - RNA, 60 nt, Human
caucccuccggccccugugccucugcggccccagcccagcucccagggccgucaccugcu

SEQ ID NO: 239593 - RNA, 60 nt, Human
cagcccccugccccggcccugcuccagaacccagcccagaucggaggacaaguuccucuc

SEQ ID NO: 239594 - RNA, 60 nt, Human
ccucucuagaacccaauccaauuuggagccccagcccaacuccagaacccaacccuucuc

SEQ ID NO: 239595 - RNA, 60 nt, Human
caacuccagaacccaacccuucucuagaauccagcccagaucugaggccaagcuaugugc

SEQ ID NO: 239596 - RNA, 60 nt, Human
gaaugcucacugcuguguugccagcaccacccagcccagggcugugaacggagugggugg

SEQ ID NO: 239597 - RNA, 60 nt, Human
ucaggccugagcaagugcagggcggagcuaccagcccaggcucagauguuggggugugaa

SEQ ID NO: 239598 - RNA, 60 nt, Human
gggauggggucaucccagggcugccucccuccagcccacugccuccccucugaggggcuu

SEQ ID NO: 239599 - RNA, 60 nt, Human
gauuccagccuguuggccccugucuucgacccagcccagcccccucuguugcucugcaua

SEQ ID NO: 239600 - RNA, 60 nt, Human
augcccauggcugcacagauagaagaaccuccagcccauucagguaaaaacucgcacaaa

SEQ ID NO: 239601 - RNA, 60 nt, Human
ucccucuguguuuccagccaucucgcccugccagcccagcaccacugggaaucaugguga

SEQ ID NO: 239602 - RNA, 60 nt, Human
cugcccaccuccgugcagcugaccugcccuccagcccaggacuaggggcaggacucuugc

SEQ ID NO: 239603 - RNA, 60 nt, Human
auaagcaauaccuauuucugacugagucucccagcccagacccagggacccuuggcccca

SEQ ID NO: 239604 - RNA, 60 nt, Human
cugccuccaguagacaucacugaaccccagccagcccagaccccugacacagaccacuag

SEQ ID NO: 239605 - RNA, 60 nt, Human
gugaauaucauucuguccucagcugcauuuccagcccaggcuguuuggcgcugcccagga

SEQ ID NO: 239606 - RNA, 60 nt, Human
ugcagugagcugagauugcaccacugcacuccagcccaggcaacagagugagacuccguc

SEQ ID NO: 239607 - RNA, 60 nt, Human
ugauggccccugaggcuggagcccccauggccagcccagccuggcucuguucucuguccu

SEQ ID NO: 239608 - RNA, 60 nt, Human
gcuuucccggcuucucugugaggggucccaccagcccagggcugaucccagcuguguguc

SEQ ID NO: 239609 - RNA, 60 nt, Human
gccuguuuaucaaaagcaagccccccaggcccagcccacgugcagagggaggagaaugag

SEQ ID NO: 239610 - RNA, 60 nt, Human
ggaugagcuggcggccagagaacgcccagcccagcccacccccgcucacguccugccgca

SEQ ID NO: 239611 - RNA, 60 nt, Human
cagcgggaugagcuggcggccagagaacgcccagcccagcccacccccgcucacguccug

SEQ ID NO: 239612 - RNA, 60 nt, Human
uaguauuuaugguggccgccggcgggggccccagcccagcuugcaggccaccucuagcuu

SEQ ID NO: 239613 - RNA, 60 nt, Human
cucugcuggucaguggcggcuguccccuccccagcccagccgcccagccacaugugucug

SEQ ID NO: 239614 - RNA, 60 nt, Human
ucagaaacacuuggcccaacauagcccuguccagcccagugccugggcucugggaccucc

SEQ ID NO: 239615 - RNA, 60 nt, Human
gaccgguaggcguggggccaggacagccagccagcccagcgcccgcucacccaggagccc

SEQ ID NO: 239616 - RNA, 60 nt, Human
cugcacuaaacauuugucaugcuguaguugccagcccagaauauuagaaguuacaagacu

SEQ ID NO: 239617 - RNA, 60 nt, Human
cuuuuccagcaggccuggguagcugccuucccagcccagcccucccuggggccugcggga

SEQ ID NO: 239618 - RNA, 60 nt, Human
gcgugaagcugaagcucugucccuauucccccagcccagcuagcugaucacaccaacaga

SEQ ID NO: 239619 - RNA, 60 nt, Human
cccagcauuagcccaguauuggaaaagacaccagcccaggggcccugacucgucacacuu

SEQ ID NO: 239620 - RNA, 60 nt, Human
aggacaucuccugggcugggcccagguaccccagcccaccccucaugacacagaauacuu

SEQ ID NO: 239621 - RNA, 59 nt, Human
gugcgcuggccuuggccuagguccccaggccagcccaugucaggggaacagccuggaac

SEQ ID NO: 239622 - RNA, 60 nt, Human
gauggguggcucagccucgaaucccaggccccagcccaggcaggugcugcugccuguugu

SEQ ID NO: 239623 - RNA, 60 nt, Human
gaccagugagaacucucucccuggucucugccagcccaagcaucacugcccgaggcgcca

SEQ ID NO: 239624 - RNA, 60 nt, Human
ggguccuggggcaggcaucucagggagcagccagcccaggccuccugccgucuccaacag

SEQ ID NO: 239625 - RNA, 60 nt, Human
gccugcugagucacuugucuguccacccacccagcccaguucuaggucguuccccagcac

SEQ ID NO: 239626 - RNA, 60 nt, Human
ggaggauugugggaagccaggaguucaagaccagcccagccaacauugugagacauaauc

SEQ ID NO: 239627 - RNA, 60 nt, Human
ugaauagguauugauaaauggaagcgcuuaccagcccagcuuugccagcccuaauaagaa

SEQ ID NO: 239628 - RNA, 60 nt, Human
uguaacucccaucuguggacccaucguccaccagcccagcugcggggagcacagggcagg

SEQ ID NO: 239629 - RNA, 60 nt, Human
gccccaccucccugccaguccuuggaccucccagcccacccagccucagcacagcucaac

SEQ ID NO: 239630 - RNA, 60 nt, Human
cgcuccaccugcauuuccucuaccgacucgccagcccaaaugccgcucuucacucuggcc

SEQ ID NO: 239631 - RNA, 60 nt, Human
gcggaggcuuuucccaucagcgugcauucaccagcccaucgccacaaacucuaucggaga

SEQ ID NO: 239632 - RNA, 60 nt, Human
ugaggcacuggggaggcaggcacacguccuccagcccaagacugccuaauuuaacaggga

SEQ ID NO: 239633 - RNA, 60 nt, Human
agccaccaacagccacucagaaaagacgcaccagcccagaagugcagaacugcagucacu

SEQ ID NO: 239634 - RNA, 60 nt, Human
gcucccugaguccaguccccgcccccaaacccagcccaggugccuucagcuacuucggcu

SEQ ID NO: 239635 - RNA, 60 nt, Human
cccauugccugcuugaggggcaccacuacuccagcccagaaggaaaggggggcagcucag

SEQ ID NO: 239636 - RNA, 60 nt, Human
gccccaccucccugccaguccuuggaccucccagcccacccagccucagcacagcucagc

SEQ ID NO: 239637 - RNA, 60 nt, Human
acgcuuccugugaggugcacgcuccgcagcccagcccagccgggagaccacguggccauu

SEQ ID NO: 239638 - RNA, 60 nt, Human
gcuggagcuaugggcugagccauaggagagccagcccagcucccuggggguugggggcug

SEQ ID NO: 239639 - RNA, 60 nt, Human
uggagaaaccccuggagaaggguguccccaccagcccauacagcguguguguggaggggg

SEQ ID NO: 239640 - RNA, 60 nt, Human
ggcacugcuaugugcagggacagccagcacccagcccaucaccacucccugggcuggcug

SEQ ID NO: 239641 - RNA, 60 nt, Human
ggaccuucuauaucccuccucgguaaccccccagcccaaccccuuggaaucuuuccucca

SEQ ID NO: 239642 - RNA, 60 nt, Human
ggccccugcugacccccuccuccagagcagccagcccagcccgggaacaagacggacuuc

SEQ ID NO: 239643 - RNA, 60 nt, Human
aacugcgccauggcuggcuccuucucuucuccagcccaucccucugcagccugucauccc

SEQ ID NO: 239644 - RNA, 50 nt, Human
acacggccccggccugguaaccagcccaucagcacacggcucccacggag

SEQ ID NO: 239645 - RNA, 60 nt, Human
ugccacuccccacacagcccccaggccugcccagcccaccuccucauggcauccucccug

SEQ ID NO: 239646 - RNA, 60 nt, Human
ucaaguaggacccagggugcaugcccaucuccagcccagggcagcuccccuguaagcugg

SEQ ID NO: 239647 - RNA, 60 nt, Human
agacccccuuuucuccauguaccugcugggccagcccauuucacaggugaggaacccgag

SEQ ID NO: 239648 - RNA, 60 nt, Human
cagggauggaggcagcuccugaacugguggccagcccacgggguacuggaagacaguggu

SEQ ID NO: 239649 - RNA, 60 nt, Human
agugcacuacagcccaggcuuaugccacccccagcccaccugccucaccacccuggcugu

SEQ ID NO: 239650 - RNA, 60 nt, Human
cacucaauuuaguacugaauggucuuucucccagcccauucccagcccuuccuauuuccu

SEQ ID NO: 239651 - RNA, 60 nt, Human
ccacagagcccaaaacagaagggggcugccccagcccagcagagcacagaguuucuggag

SEQ ID NO: 239652 - RNA, 60 nt, Human
ggcuucuguuuaccugcucacuggcucuagccagcccagggaccacaucaaugugagagg

SEQ ID NO: 239653 - RNA, 60 nt, Human
ucggagaugaugcagcacacacacaauuccccagcccagugaugcuuguguugaccagau

SEQ ID NO: 239654 - RNA, 60 nt, Human
auuccacugcaaaaguggcugcuuuggaugccagcccaggaugaguaguuccuguucuca

SEQ ID NO: 239655 - RNA, 56 nt, Human
aauguguggccuuugacugaaaucagccagcccauggcccccaauaaaggcagcug

SEQ ID NO: 239656 - RNA, 60 nt, Human
uacccugggaggcauaggagaagggucgggccagcccagcccagggccugaguuagacua

SEQ ID NO: 239657 - RNA, 60 nt, Human
ugggaggcauaggagaagggucgggccagcccagcccagggccugaguuagacuauuucc

SEQ ID NO: 239658 - RNA, 60 nt, Human
gggaaacugagcccuggagaggggaagcagccagcccaggaugcuucagggcccuggcag

SEQ ID NO: 239659 - RNA, 60 nt, Human
cugggauguggacgggugacccccuccuccccagcccaaccucgggccugcgucugaggu

SEQ ID NO: 239660 - RNA, 60 nt, Human
ccugccuccagccuggcuucuagcuggaagccagcccagcguuucucuaccaccaccacc

SEQ ID NO: 239661 - RNA, 60 nt, Human
cuguagguccucagagccuucagagaugauccagcccaaaccccauuuugcagagaggaa

SEQ ID NO: 239662 - RNA, 60 nt, Human
agcuccuucuuacagugcacacacacgcucccagcccagcuguagcucugggccuggaac

SEQ ID NO: 239663 - RNA, 60 nt, Human
cccgggcuguggcgagacagcccaacucccccagcccagcucccccagcccagagccagg

SEQ ID NO: 239664 - RNA, 60 nt, Human
agacagcccaacucccccagcccagcucccccagcccagagccagggaagaggaaggugg

SEQ ID NO: 239665 - RNA, 60 nt, Human
accuagaggauuguccaccuucugccaaggccagcccacacagcccgagccccuugggga

SEQ ID NO: 239666 - RNA, 60 nt, Human
uggcaggagaugugcuguccugcaccagcgccagcccagcucccugggcagaugugcccu

SEQ ID NO: 239667 - RNA, 60 nt, Human
ugaggccccugugcaguagagagccuuucuccagcccaugcuggcuggggccggggcugc

SEQ ID NO: 239668 - RNA, 60 nt, Human
gacacuggucuguaaauuguaauccuuucuccagcccagcucuccacuuguuccuugugu

SEQ ID NO: 239669 - RNA, 60 nt, Human
uucucccaggauguguggcgagagccugggccagcccacagcguuccuagucaggcagcc

SEQ ID NO: 239670 - RNA, 60 nt, Human
cccugccccugcccucagugacuggccaguccagcccaggcggggagagauguguacaua

SEQ ID NO: 239671 - RNA, 60 nt, Human
cauugcuccagacguguuccgaccccuuucccagcccacagggcuugaagugaaggaaca

SEQ ID NO: 239672 - RNA, 60 nt, Human
accuacggcuguggccgugcaggccuccuuccagcccagaguggcccaguagagcaaggc

SEQ ID NO: 239673 - RNA, 60 nt, Human
caguccccuccgggaugaccugauucaccuccagcccagggaauggaaucuagaggaaua

SEQ ID NO: 239674 - RNA, 60 nt, Human
ggcugugcugugugaugggcaggcuuugccccagcccaccccuggcaaggugcacuuguu

SEQ ID NO: 239675 - RNA, 60 nt, Human
caccaucuguuccccuagacuucucaggggccagcccagucugggccacccuuuguuucc

SEQ ID NO: 239676 - RNA, 63 nt, Human
aacuccugaccucaggugaucugcccgccucggucucccaaagugcugggauuacaggcauga

SEQ ID NO: 239677 - RNA, 63 nt, Human
aaaacaccacacugugaugucaucgggaaaugaucucccaagucgcugccagacaccacccac

SEQ ID NO: 239678 - RNA, 63 nt, Human
aaguuggaucgcuuccuagaaauaagcaacaccucucccaaaaagcagcccacaaggcagggg

SEQ ID NO: 239679 - RNA, 63 nt, Human
gcaggaagucgauagucucaaaggcacuuuguuucucccaaguaggccaccaggcagccucua

SEQ ID NO: 239680 - RNA, 63 nt, Human
aucagaaacauccucuccccgcucuagguuucuucucccaaaggggacccaaggcugugacac

SEQ ID NO: 239681 - RNA, 63 nt, Human
cugugaacauguaauguaacuggcuuuugagggucucccaaggggugaguggacguguuggaa

SEQ ID NO: 239682 - RNA, 63 nt, Human
ucuuuaagggaucccagccugccccuccacuucucucccaagccaggucccggcauggguggg

SEQ ID NO: 239683 - RNA, 63 nt, Human
ugaggcucaccgggucccaaguccagcccuggaucucccaauggccuuccaauccuuaaacug

SEQ ID NO: 239684 - RNA, 63 nt, Human
acucuccugccuccaguggcccugccgcagaugucucccaaaaaguugagccuuucuagaugg

SEQ ID NO: 239685 - RNA, 63 nt, Human
gggcagugagcaagagaaaugucuaaagcugcuucucccaacaccguccaaagucuccacugc

SEQ ID NO: 239686 - RNA, 63 nt, Human
cagcucuguuuugucaaugaccuuuguuguaagucucccaacguccuauuaggagccacagca

SEQ ID NO: 239687 - RNA, 63 nt, Human
uuuucaguucaagugcucuucagcacugucuugucucccaauauaccaacccacuggcacauu

SEQ ID NO: 239688 - RNA, 63 nt, Human
aggaguaguaggaauaugguugauuagauuggaucucccaaguuuuaauugaaaggagacuga

SEQ ID NO: 239689 - RNA, 63 nt, Human
gacugaacaguucccucaggacucacguacugaucucccaaaagaagagagggucucccuggg

SEQ ID NO: 239690 - RNA, 63 nt, Human
cccccuggccccuuccgcaaucuccucccccagucucccaaagagccauuucaacagagaagg

SEQ ID NO: 239691 - RNA, 63 nt, Human
cccaguuggggcaggggcaggagggaggguuucucucccaacgcugaagcggucagacuggag

SEQ ID NO: 239692 - RNA, 63 nt, Human
accauucaacauucaccucauuaaccuaaaaugucucccaaagauguauguaagacacacacu

SEQ ID NO: 239693 - RNA, 63 nt, Human
cgaucucuugaccucaugauccacccaccucggucucccaaagugcugggauuacaggcuuga

SEQ ID NO: 239694 - RNA, 63 nt, Human
aggguuccaguaaccagugauggauucaccccaucucccaaauaaaguuuacuuguuuuacau

SEQ ID NO: 239695 - RNA, 63 nt, Human
guuuccccucaguccuccuuugcuccugcugcuucucccaacagcccacuguuaggagguagu

SEQ ID NO: 239696 - RNA, 63 nt, Human
augggagguugugggugaggccucuaaagguccucucccaaacugaccaggcugaugucaacc

SEQ ID NO: 239697 - RNA, 63 nt, Human
guggcuuucccucucugggccucagucuguucaucucccaaauggauaaugaagccucuuggg

SEQ ID NO: 239698 - RNA, 63 nt, Human
ucgcaguccccgcccuccaucucaccucacccgucucccaaccacccuuuuccauguuacccu

SEQ ID NO: 239699 - RNA, 63 nt, Human
ggcugugucuuuugcacccaauaugaaacaucuucucccaacacugcuuuaauggaaguucua

SEQ ID NO: 239700 - RNA, 63 nt, Human
acuuuacuaaguaaucucacagcauuugccaagucucccaauauccaauuuuaaaaugaaaug

SEQ ID NO: 239701 - RNA, 63 nt, Human
uguacuacccucagucuacacucacaaucaucuucucccaagacugcucccuuuuguuuugug

SEQ ID NO: 239702 - RNA, 63 nt, Human
cugccuuugugcucuguuccuguccagcaggggucucccaacaagugcucuuuccaccccaaa

SEQ ID NO: 239703 - RNA, 63 nt, Human
cucgcucuuccuuacauucccacgucccccuucucucccaaccccucauaucagcaagggaaa

SEQ ID NO: 239704 - RNA, 63 nt, Human
guuuccucucuuguccccuagucccuggauguuucucccaaauaaauuuguguguaaacuguu

SEQ ID NO: 239705 - RNA, 63 nt, Human
gccauguuuugucuucucucuugguauuucuucucucccaacuuuagccauuuugccuuggaa

SEQ ID NO: 239706 - RNA, 63 nt, Human
gcagcuaagagccucugggcugcagggucagccucucccaagacugaagugcagaggcuggac

SEQ ID NO: 239707 - RNA, 63 nt, Human
gaucucccccucauccaacuccgaaagucugaaucucccaaggagggcaccaucuuacagaga

SEQ ID NO: 239708 - RNA, 60 nt, Human
ccuucccuggugggcucugagcaccgcgccucucccaagggguaagggagcugugagggu

SEQ ID NO: 239709 - RNA, 63 nt, Human
gcauggcuuggacccuaucugugaccaugcucuucucccaauuuaagugguucuguaccacaa

SEQ ID NO: 239710 - RNA, 63 nt, Human
acucagugaaacaacaucauuuaagccaaaauaucucccaacugacugauagacucugagcac

SEQ ID NO: 239711 - RNA, 63 nt, Human
cugggacccgguccuacauucgugauuuuguuuucucccaagucagaaaaauguugaggguau

SEQ ID NO: 239712 - RNA, 63 nt, Human
cuggcagccccccaugugggagaaauaccugauucucccaaucugcagugggagagcuuugcu

SEQ ID NO: 239713 - RNA, 63 nt, Human
cucacugcgccagccuccccgcccgcucucuuuucucccaagcgaaaccaaaugcgccccuuc

SEQ ID NO: 239714 - RNA, 63 nt, Human
gcaucuggcuugagucuccccgaggccugugcgucucccaaacacgcagcucaagguccacau

SEQ ID NO: 239715 - RNA, 63 nt, Human
cuuccccuucuguccucauucuuagagacugcuucucccaaacauaacgcguuagccaugaag

SEQ ID NO: 239716 - RNA, 63 nt, Human
ugaucuggcccuugcuuaccucucagccuuagcucucccaacucuugcacagucacugcucuu

SEQ ID NO: 239717 - RNA, 63 nt, Human
cucgggaaauucagccaugagcagggaaagaacucucccaacccuggggccuagcuguauagg

SEQ ID NO: 239718 - RNA, 63 nt, Human
ggugagacaguccacccagagcucucccaagucucucccaaauaccuuagaguagggacacug

SEQ ID NO: 239719 - RNA, 63 nt, Human
cauuugaacagggugagacaguccacccagagcucucccaagucucucccaaauaccuuagag

SEQ ID NO: 239720 - RNA, 63 nt, Human
ccccacuucucucuaaggagaauggcccaguccucucccaaguccacacaggggaggugauag

SEQ ID NO: 239721 - RNA, 63 nt, Human
gcagcccgagacccagaguuuguagaguuuagaucucccaaugucagucugccucuuuuucuu

SEQ ID NO: 239722 - RNA, 63 nt, Human
accgacaguaccaucaugccuugaguguucuuuucucccaagugcuauuccuuaaacacgaga

SEQ ID NO: 239723 - RNA, 63 nt, Human
uucagaugugggacaagauucuaacuccagccuucucccaaaugguuaauuugccaguugccc

SEQ ID NO: 239724 - RNA, 63 nt, Human
uuuuuuuuuuuaaguuucacucacauagccaacucucccaaagggcacaccccuggggcugag

SEQ ID NO: 239725 - RNA, 63 nt, Human
caugucccaccauuuucucaguuucucccucucucucccaacacacacacacacacaccccuc

SEQ ID NO: 239726 - RNA, 63 nt, Human
uaguugauucagaaaggacuuguaugcuguuuuucucccaaaugaagacucuuuuugacacua

SEQ ID NO: 239727 - RNA, 63 nt, Human
aggaagaugcggguguaagcccugauuuuuuuuucucccaagaaaaaucuuaaaggaccacuu

SEQ ID NO: 239728 - RNA, 63 nt, Human
ucucagaaaacucaguuucuuuauuccuucuuuucucccaacuacuguuacugguuauagagg

SEQ ID NO: 239729 - RNA, 63 nt, Human
acuccuacaacucaagcauuccucccaccuuggucucccaaaauguugggaccacggguguga

SEQ ID NO: 239730 - RNA, 63 nt, Human
auuuuaaaugcuacauuacuugguguccuuuuuucucccaaacuuuauuuagaaauggaagga

SEQ ID NO: 239731 - RNA, 63 nt, Human
guuuuguuuuuguuuuugaacugucucaaauguucucccaaagaugcuaaaaacacagccucu

SEQ ID NO: 239732 - RNA, 63 nt, Human
cuuaauagaagucaguuacuccagccaggcagcucucccaauguuucuccucuccuucccaug

SEQ ID NO: 239733 - RNA, 63 nt, Human
auacauugaucaggccauccaggacaccacgauucucccaaaguaccuugaacucuuagugau

SEQ ID NO: 239734 - RNA, 63 nt, Human
gccgaacguggaacaguaucacaaaagauuccaucucccaacgauuucagaacucugagcuca

SEQ ID NO: 239735 - RNA, 63 nt, Human
aagagaagaaagauaaggaggcucccacccaccucucccaagagcagacauuaaacaucuuug

SEQ ID NO: 239736 - RNA, 63 nt, Human
guccuacuguucuuugccucguccaggucucuaucucccaaagaccugcccaccuccugggcu

SEQ ID NO: 239737 - RNA, 63 nt, Human
guuguuuuccaugauuuagcaagcaacuaauuuucucccaagcugauuuuauucaauaugguu

SEQ ID NO: 239738 - RNA, 63 nt, Human
aacuccugacgucaagugaucugccugccuuggucucccaauacaggcaugaaccacugcacc

SEQ ID NO: 239739 - RNA, 63 nt, Human
uacacaaagacuucaacaauugcacaucuucauucucccaacugaguguaguauguggagcau

SEQ ID NO: 239740 - RNA, 63 nt, Human
ucauauguuuauuuguguaauaaaauguauuauucucccaaauuucaaggaauaauugagauu

SEQ ID NO: 239741 - RNA, 63 nt, Human
acuuuaaauccuuugucagacacacauauucuuucucccaauccaugccuucccuauucauuc

SEQ ID NO: 239742 - RNA, 63 nt, Human
gcuauaggaucugucugcuaauggugcuuaaauucucccaagagguucucacuuuuauuugaa

SEQ ID NO: 239743 - RNA, 63 nt, Human
gcucuaagaugugucugcuaauggugcuuaaauucucccaagagguucucgcuuuuauuugaa

SEQ ID NO: 239744 - RNA, 63 nt, Human
ccuguggggaaccuacuacucccugggccuuagucucccaaauccaccaugcaucugccccuc

SEQ ID NO: 239745 - RNA, 63 nt, Human
cuggugcugccgagggcuggccgggacugcugcucucccaaggguuuuauuuuauuucugaau

SEQ ID NO: 239746 - RNA, 63 nt, Human
uggaaccggaauuugggucaauacauccuuuugucucccaagggaagagaaugggcagcaggu

SEQ ID NO: 239747 - RNA, 63 nt, Human
ucgcuauugauggcuugaucaucccucagcauuucucccaaccagaucggugacuccuaaaau

SEQ ID NO: 239748 - RNA, 63 nt, Human
ucaguucccuuguccugaucucauccucucuggucucccaauaacucacccuugggauguguu

SEQ ID NO: 239749 - RNA, 63 nt, Human
gacauuccagaaggacaaggagaugucucucccucucccaaagcaccagcgucccugccuccc

SEQ ID NO: 239750 - RNA, 63 nt, Human
aaaggggaaagaaacuacuuuagagccucuuuuucucccaacucauauuuuugauaggaaaaa

SEQ ID NO: 239751 - RNA, 63 nt, Human
uguguaugcuuccagguggaggagaaaggggaaucucccaaaauuuaaaaacaaauuggaaga

SEQ ID NO: 239752 - RNA, 63 nt, Human
aacucuuguaacucgcagcugcauccuaugagcucucccaagcuuccccgccccuccccuggg

SEQ ID NO: 239753 - RNA, 63 nt, Human
ugggguuuggggauuagaacuuaccccacugggucucccaaaagccuuggugcucccggcugu

SEQ ID NO: 239754 - RNA, 63 nt, Human
ucucuggucacagggguccuggguccuuugaugucucccaaccacauguagccaauuccucac

SEQ ID NO: 239755 - RNA, 63 nt, Human
cuguuuugggaagggucuccacacaggcacugaucucccaagcuuuugucaugaugucuuuua

SEQ ID NO: 239756 - RNA, 63 nt, Human
ccaccccuguauccccaccccuccacccaccccucucccaaccucucuccccgccccuguauc

SEQ ID NO: 239757 - RNA, 63 nt, Human
cuucccugggcucaagcaguccucccaccucagucucccaaauagcuaggacuacaggcgugc

SEQ ID NO: 239758 - RNA, 63 nt, Human
guguuucaugcauucagaaaugauuguuaaaauucucccaacugguucgaccuuugcagauac

SEQ ID NO: 239759 - RNA, 63 nt, Human
ugcuaauagaguuucugaaauacuuuggaaaagucucccaaaccuucagagaguggaugggag

SEQ ID NO: 239760 - RNA, 63 nt, Human
auagaggaacuugaaaccuugaaagacauuuguucucccaaaacagauuacuagaaauauuua

SEQ ID NO: 239761 - RNA, 63 nt, Human
acccuggcaauauuaugugucccuuuggaccagucucccaagaggagaggggcaggcaggaaa

SEQ ID NO: 239762 - RNA, 63 nt, Human
ccccggacauguuccaagcccugccucaacuuuucucccaacacuaagcuuuccucccaacac

SEQ ID NO: 239763 - RNA, 63 nt, Human
gccuuuuuuucuggagaauaaaugcaguaauccucucccaaauaagcacacacauuuucaauu

SEQ ID NO: 239764 - RNA, 63 nt, Human
caggacauuugcaggccuugucuacuggacuuuucucccaaacaggacaagcccaggcagggc

SEQ ID NO: 239765 - RNA, 63 nt, Human
ugaacucugucacuuguuagagauugggaacacucucccaaggugauuuucuuuuucuaagug

SEQ ID NO: 239766 - RNA, 63 nt, Human
cacccucccuucauuacccccacuccauacccuucucccaacuuuuugaugucccuguagggc

SEQ ID NO: 239767 - RNA, 63 nt, Human
aacuccugaccucaagugaucugccugccuuggucucccaaagugcugggaauacaggcauga

SEQ ID NO: 239768 - RNA, 63 nt, Human
agcuucuauaccucuuucuucuucgcuuccuccucucccaagcaauggaaacuuuuacccaug

SEQ ID NO: 239769 - RNA, 63 nt, Human
gagggugggacaggccugucaggccucugggaaucucccaaaucccagaacucaccacucacc

SEQ ID NO: 239770 - RNA, 63 nt, Human
uucagaaacauuauacauugggccauuuuucuuucucccaaagaagauucauggauagucaga

SEQ ID NO: 239771 - RNA, 63 nt, Human
aaggacgaauagcuucuuacauauucuagauauucucccaagagaccucuugauacaaacaau

SEQ ID NO: 239772 - RNA, 63 nt, Human
ccuuuuguugugaaaggaaggaggggacugaaaucucccaaagugcaaauuggagaguguuua

SEQ ID NO: 239773 - RNA, 63 nt, Human
gucgaaggacaagcccacagcccagauuccgguucucccaacucaggaagagcaugcccugcc

SEQ ID NO: 239774 - RNA, 63 nt, Human
uccuaucccaguuuagggcuccagaaaagccauucucccaaacuaaugauucuugggugcugu

SEQ ID NO: 239775 - RNA, 61 nt, Human
aaaaaaacuggguggaccuacaaaaacccauccucucccaacuccuucuucucugccucuu

SEQ ID NO: 239776 - RNA, 63 nt, Human
aauuccuggacugaagcuaucuacccgccuuagucucccaaagugcuaggauuacagcgugau

SEQ ID NO: 239777 - RNA, 63 nt, Human
ggaaacauccucauugauccucuucaguuggagucucccaaauuuaauguggaagacaaagug

SEQ ID NO: 239778 - RNA, 63 nt, Human
aacuccugaccgcaagugauccacccgccucggucucccaaagugcugggauuacagauguga

SEQ ID NO: 239779 - RNA, 63 nt, Human
cgggcucagagcuuugucacuugccacauggugucucccaacaugggagggaucagccccgcc

SEQ ID NO: 239780 - RNA, 63 nt, Human
cucgugggaaacagcaaaacacuaagccugaccucucccaaauugggaagaccagaggagaaa

SEQ ID NO: 239781 - RNA, 63 nt, Human
ccaacauguuuuaaauccuuaaaugaauugcuuucucccaaaaaaagcacaauauaaagaaac

SEQ ID NO: 239782 - RNA, 63 nt, Human
caacgccucccccucccccauucccuccauuuuucucccaagaaaccugacucaauuauuugc

SEQ ID NO: 239783 - RNA, 63 nt, Human
ugggagaaaauguauucuccuuuccuauaccgcucucccaacaaaaaaacaacuaguuaguuc

SEQ ID NO: 239784 - RNA, 63 nt, Human
uaugccuugcacuugggaaagcucuugugagacucucccaaggugcuguauuuuucuaccuca

SEQ ID NO: 239785 - RNA, 63 nt, Human
aaugcccaaacuugguuggagcauagccccugcucucccaaaguugcacuuucacugggaaga

SEQ ID NO: 239786 - RNA, 63 nt, Human
aacuccugaccucaagugauccacccgccucagucucccaaagugcugagauuacaggcauga

SEQ ID NO: 239787 - RNA, 63 nt, Human
agacccgugccgaucacacuggugcuguugagaucucccaaaccucacguccuuaacugugcu

SEQ ID NO: 239788 - RNA, 63 nt, Human
aagcucaacaaguugccuaaguuccaaguuuccucucccaacucuccuacccucuccucuucc

SEQ ID NO: 239789 - RNA, 63 nt, Human
ucuuuguauuuuuaucucuaucuccucacuuuuucucccaaaguagaaaaaaaugauaucuga

SEQ ID NO: 239790 - RNA, 63 nt, Human
guuauuuaugaccuuguuuaaagaaaauaaauaucucccaaccuuuauuggucuggucuuucu

SEQ ID NO: 239791 - RNA, 63 nt, Human
caccucagcugccuccccagcucuaucccaaccucucccaacuauaaaacuaggugcugcagc

SEQ ID NO: 239792 - RNA, 63 nt, Human
ggggccucugcuuuggggaugggaauguguuuuucucccaaacuuguuuuuauagcucugcuu

SEQ ID NO: 239793 - RNA, 63 nt, Human
aacuccugggcucaagcgauccuccugccccugucucccaaagugcuaggauuacagguguga

SEQ ID NO: 239794 - RNA, 63 nt, Human
cagggacuucagagauugcacguuugaauacauucucccaagacugagguuguucgguuuuaa

SEQ ID NO: 239795 - RNA, 63 nt, Human
accggacuugccugccucggccucacccgcacuucucccaaaaggcagaugacggggaguuag

SEQ ID NO: 239796 - RNA, 63 nt, Human
agccuucaucccuaagucaacaccaggagagcuucucccaaacuccccguuccugcguagucc

SEQ ID NO: 239797 - RNA, 63 nt, Human
gaauugaagacacguucuugccagcuucccuuuucucccaagaugcagaaauguggaugcucu

SEQ ID NO: 239798 - RNA, 63 nt, Human
gccaggcugggccugggcauaacuucgcugggcucucccaagaccaucagcagugcauccagc

SEQ ID NO: 239799 - RNA, 63 nt, Human
uuuuaauauaaaaauguuugcugccuaccuuuuucucccaaaaaaucuuuaaguaaagaugau

SEQ ID NO: 239800 - RNA, 63 nt, Human
cggcaggcagcccuacaaauccuggugaccugcucucccaagaacagagccuguccccagaug

SEQ ID NO: 239801 - RNA, 63 nt, Human
gacucaaucugccaaaugugcugcagcucguuuucucccaauuacagcaagacugucagccuc

SEQ ID NO: 239802 - RNA, 63 nt, Human
ccacuaggagauuuuuauaaacccucuccagccucucccaaaggaagcguuggcagcaaaggg

SEQ ID NO: 239803 - RNA, 63 nt, Human
gggaccauggcaagcuuggaaccaggacuucuaucucccaaccccagcagccugaauacugug

SEQ ID NO: 239804 - RNA, 63 nt, Human
aaaaaaaaaaaaaagcuccuguaauuugcacuuucucccaauccuuaaaucucuuguauggca

SEQ ID NO: 239805 - RNA, 63 nt, Human
gggaggcagcaggggucagccugggcaggaaccucucccaacucuguccagguguucagaccu

SEQ ID NO: 239806 - RNA, 63 nt, Human
cacgguaagaaaaugaaguucuaaugaacuguuucucccaagguuuuaaaauugucaagaguu

SEQ ID NO: 239807 - RNA, 63 nt, Human
gccugacaggccuauuaaguagaugugauauuuucucccaagaugaccuccauucucggcaga

SEQ ID NO: 239808 - RNA, 63 nt, Human
acaauggugcgaucuuggcucacugcaccucugucucccaaguucaagugauucuccugccug

SEQ ID NO: 239809 - RNA, 63 nt, Human
ugugugugugugugcauaugugugcauugccacucucccaaguuuuucagaaaccagcagagc

SEQ ID NO: 239810 - RNA, 63 nt, Human
cccugucccaucugcagccacacuacucgcuccucucccaacaacucccuucguggggacaaa

SEQ ID NO: 239811 - RNA, 63 nt, Human
ccugggccccuccucuagagaagagcucaacucucucccaaccucaccauggaaagaaaauaa

SEQ ID NO: 239812 - RNA, 63 nt, Human
gagcaggccucacgauggcuugggagcacucguucucccaaggucugagucuucauccagccc

SEQ ID NO: 239813 - RNA, 63 nt, Human
caguuuucauguuggaaucuaagaugugucccuucucccaaagggauuuuaaucauucuuggc

SEQ ID NO: 239814 - RNA, 63 nt, Human
aagaaguuuauucucauuugggagaucuggugaucucccaagcuaucuaaaguuuguuagaua

SEQ ID NO: 239815 - RNA, 63 nt, Human
accaccugugcucaagcaauccucccaucuccaucucccaaagugcugggaugacaggcguga

SEQ ID NO: 239816 - RNA, 63 nt, Human
caaucuccugaccucgugaaucgccccccucggucucccaaagugcugggauuacaggcguga

SEQ ID NO: 239817 - RNA, 63 nt, Human
gcugcccugggccauaugugcuauggagaggacucucccaaacccccaauagcuagugacagc

SEQ ID NO: 239818 - RNA, 63 nt, Human
uccaaagcuuccccuuaucguccccugugauuaucucccaaccccgugacaaagguagagcaa

SEQ ID NO: 239819 - RNA, 63 nt, Human
ugggauuacaggcgugagccaccgugcccggccucucccaauaggucuuuauuccucaauccu

SEQ ID NO: 239820 - RNA, 63 nt, Human
gccucugguuuuccucugcuccucugccuguccucucccaacucaagguucuagugggaaggg

SEQ ID NO: 239821 - RNA, 63 nt, Human
uuuugcuucugagaaagcauuugccuuucuuccucucccaacauaacaaucgugguaacagaa

SEQ ID NO: 239822 - RNA, 63 nt, Human
gagggagggaaggcagagaaaaauuacuuagccucucccaagaugagaaaguccucaagugag

SEQ ID NO: 239823 - RNA, 63 nt, Human
cugcuuguaguauuagaauguuauuguugacucucucccaagugccuugaucuuuguaauauc

SEQ ID NO: 239824 - RNA, 63 nt, Human
gccucccggguucaagcgauccuccugccucagucucccaaguagcugggauuacaggugugc

SEQ ID NO: 239825 - RNA, 63 nt, Human
uaccccauuuugugguaauuuggcaacuugagcucucccaauuauuguaauauaaggacagac

SEQ ID NO: 239826 - RNA, 63 nt, Human
aagcacaaaaaaagaucucgaacaagaucacguucucccaaguaccauucgucauccaagucc

SEQ ID NO: 239827 - RNA, 63 nt, Human
auuuccccuucaugaagguagagagaaggggucucucccaacauauuucucuuccuugugccu

SEQ ID NO: 239828 - RNA, 63 nt, Human
aagguuugcuacauuuuguaugugugugaugcuucucccaaagguauauuaacuauauaagag

SEQ ID NO: 239829 - RNA, 63 nt, Human
ccuacacucuucggugcuuagagagaucugcugucucccaaauaagcuuuuguaucugccagu

SEQ ID NO: 239830 - RNA, 63 nt, Human
acgagaauuugaagagcauggcaaagcccuuucucucccaagccccaggcagaguacaagcuc

SEQ ID NO: 239831 - RNA, 63 nt, Human
uuuagauaaagaugagcccccaccaccaccgacucucccaacccagacucucccacuccagaa

SEQ ID NO: 239832 - RNA, 63 nt, Human
cuaucguguacggguuccucccuccuuuucucuucucccaaaucuuuucccuucaaaggaaaa

SEQ ID NO: 239833 - RNA, 63 nt, Human
guuacuaguacagguuuugcccugauuaaaaaaucucccaaagccccaaauuccuguuagcca

SEQ ID NO: 239834 - RNA, 63 nt, Human
gcugguguucuguuuugaggauaucccuuuaaaucucccaaaugacugucucuaucuucauga

SEQ ID NO: 239835 - RNA, 63 nt, Human
gcuccuacaaaacguaacuccaguccuccacccucucccaacaaaaauaacaaugcuguugac

SEQ ID NO: 239836 - RNA, 63 nt, Human
cgauaggccacauuccaguaagaacucaauuugucucccaaauuugcagaaacaaaacgugau

SEQ ID NO: 239837 - RNA, 63 nt, Human
gggagaggagugggaaauugauuaaaggggcugucucccaaugaaagaggcauucccagaauu

SEQ ID NO: 239838 - RNA, 63 nt, Human
uacauugguuuugaaauguuuccuuagcucgguucucccaaacacauaauuucuguuucagca

SEQ ID NO: 239839 - RNA, 63 nt, Human
ugcaggcugauuggauagaaccugccugcccuuucucccaaaaggacaaagagguggcugaga

SEQ ID NO: 239840 - RNA, 63 nt, Human
aucauuuugugcugcuccaacaccagcaggguaucucccaauaaaguguuccuaagcagccug

SEQ ID NO: 239841 - RNA, 63 nt, Human
gcuuucuacgccaauguuaugccagcuccauguucucccaaauaccguugaugugaauuauuu

SEQ ID NO: 239842 - RNA, 63 nt, Human
auucaaaguguaccaaggaccaaauccuggaguucucccaacuuuagaggauggaaaggggca

SEQ ID NO: 239843 - RNA, 63 nt, Human
uauaucuuccuccugagucuggguaauuauaccucucccaagcccccauuguguguugaaauc

SEQ ID NO: 239844 - RNA, 63 nt, Human
aaaauuaagaaugucaauuuaaguuaauaaaaaucucccaauaugauuuggguucauggcuuu

SEQ ID NO: 239845 - RNA, 63 nt, Human
uuggguagcaagaacuuuaauuugcacuaccagucucccaaauagaaaaucauguauaguauu

SEQ ID NO: 239846 - RNA, 63 nt, Human
caacagaugucucucauuuucagcuagcauuucucucccaaguugagcugguuuaauguguuu

SEQ ID NO: 239847 - RNA, 63 nt, Human
uauacauacaagaugcuaguucauuugaauauuucucccaacuuauccaaggaucuccagcuc

SEQ ID NO: 239848 - RNA, 63 nt, Human
ucacguuugucacugccguuuauuacauugacuucucccaagaugaaucuuccuuccaaaugu

SEQ ID NO: 239849 - RNA, 63 nt, Human
acccugaagauaaucaaggccaguuacucaucaucucccaaccacuguuuccucaacugcccu

SEQ ID NO: 239850 - RNA, 63 nt, Human
auucuaacauccacuauuguucaguauagguaaucucccaaaaauaucacauccucuugaaaa

SEQ ID NO: 239851 - RNA, 63 nt, Human
uguuugcuuucaaauccccaaauaucaucuccaucucccaauuaauuuuauugucucuuuccu

SEQ ID NO: 239852 - RNA, 63 nt, Human
acccugcagaguauuaagguuucuggauuuuuuucucccaacuguggcccaaaagaauuaaaa

SEQ ID NO: 239853 - RNA, 63 nt, Human
cguccucagcaccccacuccucaguaaaagucuucucccaacucagccuguuccuuccugcag

SEQ ID NO: 239854 - RNA, 54 nt, Human
guuggccaagagcagcuuagaggaucucccaaggaugaaagaaugucaagccau

SEQ ID NO: 239855 - RNA, 63 nt, Human
gauaggaaagcacccugcccuucaucuucauguucucccaaauggaacuuaggaucuuuuaac

SEQ ID NO: 239856 - RNA, 63 nt, Human
auacugucggaaaaaagcguaccccaggccucaucucccaaaucccaaaugccacuccaagua

SEQ ID NO: 239857 - RNA, 63 nt, Human
ccuugccuuuccccucugccuguuuccuuuuccucucccaacccucugguuggugauucaacu

SEQ ID NO: 239858 - RNA, 63 nt, Human
ccuguggaauaaaccuguuuuccaggugucucuucucccaagcacaagaaguccuggagucuu

SEQ ID NO: 239859 - RNA, 63 nt, Human
ugaaaaaugcugugacuugaaaucuuucccacaucucccaagaaaguagguaggaguuuaucc

SEQ ID NO: 239860 - RNA, 63 nt, Human
uaagcgaugacugcugaaaggcucauuguguaaucucccaaggguuuggucuuauuccauuuu

SEQ ID NO: 239861 - RNA, 63 nt, Human
uagguuuucuauugggugucaacaacgcugauuucucccaaaacuauaguuucucuuacgguc

SEQ ID NO: 239862 - RNA, 63 nt, Human
cuaccaacuccaccuccacccccucauuccccuucucccaaaguacuacugcuguugcaugac

SEQ ID NO: 239863 - RNA, 63 nt, Human
gcacaggccggaggcaccacgcacaggccagagucucccaaauccugucccgcacucucuccc

SEQ ID NO: 239864 - RNA, 63 nt, Human
uaucuucacgcagauaaguuucuuugcuucacuucucccaagacucccucgucgagcuggaug

SEQ ID NO: 239865 - RNA, 63 nt, Human
gaguauuuaaaaaauauauaccaacagaacuacucucccaaggaaaauauugccaccauuugu

SEQ ID NO: 239866 - RNA, 63 nt, Human
uucaugguuccaagcaaugaguguaauguauuuucucccaauaguaauuguuuauauucauaa

SEQ ID NO: 239867 - RNA, 63 nt, Human
uaagcugugugcgugcccugguguggggcuacuucucccaagaagaaggggugccuuuccuaa

SEQ ID NO: 239868 - RNA, 63 nt, Human
uccugcccuuagcaagugcgcaaccagucaggaucucccaaagaagauaaagaccacuccuca

SEQ ID NO: 239869 - RNA, 63 nt, Human
gaaaauacauuuuuaaagagaaaguacugauuaucucccaaaugagaagucauuaacuggaaa

SEQ ID NO: 239870 - RNA, 63 nt, Human
ugucuccuggguucaggugauucuccucccuagucucccaaguagcugggacuauaggcacgu

SEQ ID NO: 239871 - RNA, 63 nt, Human
ugcuuugacucaugccuuacuccauggccacccucucccaaagagggggcucgcuucccccau

SEQ ID NO: 239872 - RNA, 63 nt, Human
ugcuccuggaggcaggugaugcugugggcacgcucucccaacuccgggagagccucgccugga

SEQ ID NO: 239873 - RNA, 63 nt, Human
aacucaugaccucaagugauccgcccacuucggucucccaaagugcugggauuacaggcauga

SEQ ID NO: 239874 - RNA, 63 nt, Human
aacuccuggacuuaagugagccucccgccucagucucccaaagcgcugggauuacaggcagga

SEQ ID NO: 239875 - RNA, 63 nt, Human
cuuggugggagguuaccuuaccugaagaccaucucucccaagcacuguaguucugagcauguu

SEQ ID NO: 239876 - RNA, 63 nt, Human
ccaugacuccccacugcccuaagcugaggucagucucccaagccuggcauguggcccucugga

SEQ ID NO: 239877 - RNA, 63 nt, Human
aagguguuaggguuugggagacagcucauccaaucucccaagucucaugguggauuugugacu

SEQ ID NO: 239878 - RNA, 63 nt, Human
uuuauuuagacuuuuucaguggguauuuuucugucucccaaccucuacuguaaacuuucuggu

SEQ ID NO: 239879 - RNA, 63 nt, Human
uccccucucaaauacccuuauuuuauuuauguuucucccaauaaaaacccagccugugugcca

SEQ ID NO: 239880 - RNA, 63 nt, Human
caguacugaaaucaaaggagcugguucuucuuuucucccaauuauuuucauaugaaagcaccu

SEQ ID NO: 239881 - RNA, 63 nt, Human
uguuccuacacuuacggguguaucuccaaauccucucccaauuuuauucccuuauucauuuca

SEQ ID NO: 239882 - RNA, 63 nt, Human
ugcagauggaccucucuccgcuagagaugcccuucucccaaauggcuucccuccuggaaggcc

SEQ ID NO: 239883 - RNA, 63 nt, Human
ugcaguagacacgaguuccucggaccuguauaaucucccaaagccaagguuugguaauaaugu

SEQ ID NO: 239884 - RNA, 63 nt, Human
cuacagcucuuagcuucucaguaaagaggauacucucccaaccagccaaggaauaaaagcuga

SEQ ID NO: 239885 - RNA, 63 nt, Human
agauccuuagaaaaggagaggauggggguagagucucccaagccaaaauuuugacauuugagu

SEQ ID NO: 239886 - RNA, 63 nt, Human
uugcgguuccgucacucgccuuucccaccaacuucucccaaccucagaucagucagacaggga

SEQ ID NO: 239887 - RNA, 63 nt, Human
caaacacuggccuccauaauuccugccugcagaucucccaacuugaacuauaauccaccagcc

SEQ ID NO: 239888 - RNA, 63 nt, Human
gcugaacuuggauuucuaguucaugaagaaaucucucccaauacccauuuauccuauuuuuag

SEQ ID NO: 239889 - RNA, 63 nt, Human
agauagacacaguauagggggaaugggcuugcuucucccaaacccaccaguucuccacugucu

SEQ ID NO: 239890 - RNA, 63 nt, Human
aacuccugaccucaaaugagccuccugcuucagucucccaaauugccgggauuacaggcauga

SEQ ID NO: 239891 - RNA, 63 nt, Human
agcacaauguauaggcagaccagugguccuuccucucccaauguggccauguggaggacagga

SEQ ID NO: 239892 - RNA, 63 nt, Human
auuuggugaugagacuuauggagugugccucucucucccaacugcugcuuaaaaugcaaggac

SEQ ID NO: 239893 - RNA, 63 nt, Human
agauaauuuaacccugccucucagaggguuuucucucccaauuuucuuuuuacucccccucuu

SEQ ID NO: 239894 - RNA, 63 nt, Human
ucucccgcucuccaggagcuuaucuucgccccaucucccaaauaagugggcccuugugcugug

SEQ ID NO: 239895 - RNA, 63 nt, Human
uccugcuuguuccaacccuuuucacucugggcuucucccaaaacccauccuggcaugaccugc

SEQ ID NO: 239896 - RNA, 63 nt, Human
aggacggcacggccagcgccugcugugagugggucucccaagacuaggccucaggacgcgggg

SEQ ID NO: 239897 - RNA, 63 nt, Human
gccucccggguucaagcgauucuucugcuucagucucccaaguagcuuggauuacaggugagc

SEQ ID NO: 239898 - RNA, 63 nt, Human
aaagccuugcccugguguucuaccagaaaaacgucucccaaucacccaggaaagcuguccaca

SEQ ID NO: 239899 - RNA, 63 nt, Human
uccuccccauauuccuggacuucggagauggccucucccaagccaggucaaggagguuugggg

SEQ ID NO: 239900 - RNA, 63 nt, Human
cuaagugacgguccuaagugggauggcucuccuucucccaagcugcaguacuggggaagggcu

SEQ ID NO: 239901 - RNA, 63 nt, Human
ccuucucucuccccaagggguucccuccuccucucucccaaggagugcuucuccagggaccuc

SEQ ID NO: 239902 - RNA, 63 nt, Human
gaccuguccccucuggcugccucugagucugaaucucccaaagagagaaaccaauuucuaaga

SEQ ID NO: 239903 - RNA, 63 nt, Human
accuccuaggcucaagcgauccuaucaccucagucucccaaguagcugggacuguaagugcac

SEQ ID NO: 239904 - RNA, 63 nt, Human
ggggacugaagcccuggcugccucagcgcucugucucccaacaccagcugguguugcagaggg

SEQ ID NO: 239905 - RNA, 63 nt, Human
uuguaaugaccaagguaccgauuucugcuaaguucucccaacaacaugaaacugccuauucac

SEQ ID NO: 239906 - RNA, 63 nt, Human
uauuuuucuuguaucgauguagagacucuauuuucucccaaagacacuauuuuugcagcuguu

SEQ ID NO: 239907 - RNA, 63 nt, Human
gcuggaggcacugggaugugauaugccccucucucucccaaucagagccuguugauauuacaa

SEQ ID NO: 239908 - RNA, 63 nt, Human
agcgccuguggcccuauuacuauccaguuggccucucccaaaucaacuucaagucuuuuauag

SEQ ID NO: 239909 - RNA, 63 nt, Human
aacacuuauuuugcuucaagaguuccacuuggcucucccaaauagguaccucaaaaacuguua

SEQ ID NO: 239910 - RNA, 63 nt, Human
gcuccuuuuccccuuccccagcgccguuugaccucucccaagauacaccagcagccugcuuac

SEQ ID NO: 239911 - RNA, 63 nt, Human
aacuccuggccucaagugauccaccuaccuuagucucccaaagugcugggauuacagguguga

SEQ ID NO: 239912 - RNA, 63 nt, Human
aaggcauucauucaguggacagugggaauuaacucucccaaggcaagugaaaaugaaugauug

SEQ ID NO: 239913 - RNA, 63 nt, Human
cugggacggcaccuauagaaacuaggguacaaaucucccaaagaugguuugcaccgucauuuc

SEQ ID NO: 239914 - RNA, 63 nt, Human
cccaugcaacaaagcaacuuacuucuggaguucucucccaaggagaggacacagacacaguug

SEQ ID NO: 239915 - RNA, 63 nt, Human
gagcccugggggagucucuccugccucccagccucucccaagaccuccccccucgucaccagc

SEQ ID NO: 239916 - RNA, 63 nt, Human
aucaaucugaggagacuuaauaaugauauugauucucccaauucaugaauauaguauaccccu

SEQ ID NO: 239917 - RNA, 63 nt, Human
ugauuauuagagaaauguaucaacuccaugccaucucccaaaauaauugucuaagaaaacuug

SEQ ID NO: 239918 - RNA, 63 nt, Human
cagugacugaggggagaauccccuccuguucacucucccaacccugcuccagccccucagcuu

SEQ ID NO: 239919 - RNA, 63 nt, Human
gacaccugggacuuuccccuucugguuccugugucucccaauaaacucucugaccaacccuag

SEQ ID NO: 239920 - RNA, 53 nt, Human
ugguuuuugucaaggucuaagacucucccaagaggcucccguucccucuccaa

SEQ ID NO: 239921 - RNA, 63 nt, Human
aacuucugucuucguccucucccccgagcccccucucccaaauuuuuaaagcacuuuuuagau

SEQ ID NO: 239922 - RNA, 63 nt, Human
uugguaacuuucuguuuuguucuuccuaauuauucucccaagaucccacacugcagcuuuauc

SEQ ID NO: 239923 - RNA, 63 nt, Human
ugccaccacucccuuagucuuucccaggcuuacucucccaauaaaugugcuagagcucugcca

SEQ ID NO: 239924 - RNA, 63 nt, Human
ugaaaagacuugacauuguaaaaauauaauuucucucccaaaucacuaaguuuaauauacuuc

SEQ ID NO: 239925 - RNA, 63 nt, Human
cauagacacacuaguggucauggcauguccucaucucccaauaaacaugacuuuagccucugc

SEQ ID NO: 239926 - RNA, 63 nt, Human
aaaucugcagggggagggagaggggaacuguuaucucccaagauuaaccuucacuuuuaaaaa

SEQ ID NO: 239927 - RNA, 63 nt, Human
aaauucaagguccuccucuagaaguuucaaaucucucccaacucuguucugcaucuuccagau

SEQ ID NO: 239928 - RNA, 63 nt, Human
cagggacucuguucaaacugcgcccugcccucaucucccaaggccagaggucaccagguggcc

SEQ ID NO: 239929 - RNA, 63 nt, Human
uccucccagguucaagcaauucuccugccucagucucccaaguagcugacacuacaguugugu

SEQ ID NO: 239930 - RNA, 63 nt, Human
ggccucuugccucccuccccaccuacaaggcccucucccaagggaucgcagggccuaggugcc

SEQ ID NO: 239931 - RNA, 63 nt, Human
uugcauacuaaggcgaggcagauacaccuguguucucccaacccuuggaggaaauuccuugag

SEQ ID NO: 239932 - RNA, 63 nt, Human
gagcacucggaaggguugguuugggccugaaacucucccaaguggcauagccccuuuuccggu

SEQ ID NO: 239933 - RNA, 63 nt, Human
agagcugggcuugaguggaguuuauuguagauuucucccaaggggaucacuuagcuucucacu

SEQ ID NO: 239934 - RNA, 63 nt, Human
gcccaugcuguccggccugggaaacccucuccaucucccaaggcugccagacauggaccucca

SEQ ID NO: 239935 - RNA, 63 nt, Human
gggcuccccuagacuaggacuccagugcccuccucucccaagagacaaaggccauugcauuga

SEQ ID NO: 239936 - RNA, 63 nt, Human
gggaagaaacaaagccaugccugcuccugccucucucccaacauguuuccagcaaguagaugc

SEQ ID NO: 239937 - RNA, 63 nt, Human
cacuagggccccaguaguugacagccuugcuccucucccaaguucuccuucagaaccuaguug

SEQ ID NO: 239938 - RNA, 63 nt, Human
aaccaccaaagggcaugucugaugggcacagggucucccaaacccaguggcuucugucugucc

SEQ ID NO: 239939 - RNA, 63 nt, Human
cccuccccaaggccacagggagcuccgucagcuucucccaagcccacgucaggccuggccuca

SEQ ID NO: 239940 - RNA, 63 nt, Human
gcccugaucaugcuuuuugugccugucaccaggucucccaagugcacucauccaggucagugc

SEQ ID NO: 239941 - RNA, 63 nt, Human
uagcugggaaaguuuuacauugucuguuuuucuucucccaauagcuuucaauuguucuuucug

SEQ ID NO: 239942 - RNA, 63 nt, Human
agaaccucucacuucacccuggagcccauccagucucccaacuuguauuaaagacagaggcag

SEQ ID NO: 239943 - RNA, 63 nt, Human
ccaggcuccuuaccuuggucuuuucccuguucaucucccaacaugcugugcuccauagcuggu

SEQ ID NO: 239944 - RNA, 63 nt, Human
gauauuuauuuaaccuugaauauucaagaacauucucccaaaucuaaauggcuacugugcauu

SEQ ID NO: 239945 - RNA, 63 nt, Human
cccuucuuugccuccuacccccgagaccuccccucucccaacgggauuggcuacacuuuugac

SEQ ID NO: 239946 - RNA, 63 nt, Human
ucgcaugugcuguucccucugccuagaacacucucucccaaguauaugucugguuccccgacu

SEQ ID NO: 239947 - RNA, 63 nt, Human
agagagcgagcgagagagauuuccuuggaaauuucucccaagggcgaaagucauuggaauuuu

SEQ ID NO: 239948 - RNA, 63 nt, Human
cuugugaaaugagcccuccugccacacggggccucucccaaaggcucaucccuuggccgcccc

SEQ ID NO: 239949 - RNA, 63 nt, Human
cacagaaaugaguggugugacuaauuccuuaccucucccaaggaggguacacaacuagcacca

SEQ ID NO: 239950 - RNA, 63 nt, Human
cugggccaucugacuucuaccucccauguuugcucucccaacucauuagcuccugggcagcau

SEQ ID NO: 239951 - RNA, 63 nt, Human
ccgccucucacuggugcgauggaagguggccuuucucccaagcugguggauaaugaaaaauaa

SEQ ID NO: 239952 - RNA, 63 nt, Human
uuagggacaagucccaagaugccagaaaggcagucucccaaggacccaccaugcagaaguguc

SEQ ID NO: 239953 - RNA, 63 nt, Human
ggcagggccuuugccugaggagaguguguagggucucccaacgucgugggccgggucuuaggc

SEQ ID NO: 239954 - RNA, 63 nt, Human
uccccgggccagcagggaugggguuggggagguucucccaaccccacuuucuuccuuccccag

SEQ ID NO: 239955 - RNA, 63 nt, Human
caaccccacuccaacuccuucuccaccacccauucucccaauggucuuuagaaauagauuuuc

SEQ ID NO: 239956 - RNA, 63 nt, Human
caagcuggaaaggccagcagccuuccaguggcuucucccaacacucuuggggaccaaauauau

SEQ ID NO: 239957 - RNA, 63 nt, Human
gaacauucuggaauccuccccacauucuagaauucucccaacauuuuuuuuucuugagacaga

SEQ ID NO: 239958 - RNA, 63 nt, Human
gggucugcagcaccugcuguuguugccaaccagucucccaaagcuccuugcuccccaccccuu

SEQ ID NO: 239959 - RNA, 63 nt, Human
ccaccccaaccccuacuucuuuuccuuuauuucucucccaaccuggcugcaaaggagguucau

SEQ ID NO: 239960 - RNA, 63 nt, Human
aaacaggaacugaaugaauggccugaagcucccucucccaaggguucccacucccauuggccu

SEQ ID NO: 239961 - RNA, 63 nt, Human
auuaccuggcagaggcaaagaaaggugagacccucucccaagaggagcagagaaaacuggaag

SEQ ID NO: 239962 - RNA, 63 nt, Human
aggugccaauuccaaaucaagacccuaaugauuucucccaagcaaaucaggcauacggagagg

SEQ ID NO: 239963 - RNA, 63 nt, Human
gccaggccuugcacuacugccauagccaaucaaucucccaaagccaaguuuaccugcuguucu

SEQ ID NO: 239964 - RNA, 63 nt, Human
cagagucuuucauaugcuaacauucauugugaaucucccaagaggccacacaauccuuuuuuc

SEQ ID NO: 239965 - RNA, 63 nt, Human
cugcuccuauguuggaaauuuguucauuaaaauucucccaauaaagcuuuacagccuucugca

SEQ ID NO: 239966 - RNA, 63 nt, Human; identical to SEQ ID NO: 239965

SEQ ID NO: 239967 - RNA, 63 nt, Human
cugcuccuauguuggaaaauucuucauugaaguucucccaauaaagcuuuacagccuucugca

SEQ ID NO: 239968 - RNA, 63 nt, Human
gcagugcccauggaggcgcugcugccaccuuccucucccaaguucuuucuccaucccucuccu

SEQ ID NO: 239969 - RNA, 63 nt, Human
auuuaauaaaucagaguucuagcaauagaguccucucccaaguggcugaggcaggcuuagggg

SEQ ID NO: 239970 - RNA, 63 nt, Human
auguccucaacugucaucauucuauguuuacuuucucccaaucacaucaccugagguagaaga

SEQ ID NO: 239971 - RNA, 63 nt, Human
ucaguuucuaaaugcauuaauuacuaacugcccucucccaagauucauuuaguucaaacagua

SEQ ID NO: 239972 - RNA, 63 nt, Human
cacauguccaccuucuugccauguuccagcugcucucccaaccuggaaggccgucuccccuua

SEQ ID NO: 239973 - RNA, 63 nt, Human
ccaaagucugaaucuccucuacaauguuuccuuucucccaaaacagggaacugacugucuggu

SEQ ID NO: 239974 - RNA, 63 nt, Human
gaucuagauguuuguuuaccaagcuaugugacuucucccaaaggaucuguacuuucuuuccuu

SEQ ID NO: 239975 - RNA, 63 nt, Human
gauuuacaugcauuacccucauguucccugaauucucccaaaagccucucugacccuggguuu

SEQ ID NO: 239976 - RNA, 63 nt, Human
aagaggcccucucaagggugccagaugccugggucucccaagaggggucccccaacucaccgu

SEQ ID NO: 239977 - RNA, 63 nt, Human
uuucaccaauuagugcugccaguuacugaggcuucucccaaaagguaucaguccagucuuaaa

SEQ ID NO: 239978 - RNA, 63 nt, Human
cacacacacacacaccaaguaccaguauaggcaucucccaacugcuuuuccccauguguccug

SEQ ID NO: 239979 - RNA, 63 nt, Human
auccccaggccuugccugaggggucaggcugccucucccaacacacacucagauagcacaaau

SEQ ID NO: 239980 - RNA, 63 nt, Human
ccccuccccaaggaagaacaaauaugauucuccucucccaaauaaacuccuuaaccaccuagu

SEQ ID NO: 239981 - RNA, 63 nt, Human
cugcuccuguguuggaaauuugaccauuaaaauucucccaauaaagcuuuacagccuucugca

SEQ ID NO: 239982 - RNA, 63 nt, Human
ccucccgcccugucuggaucccuaagcugucccucucccaaucucuggauauuugacucccaa

SEQ ID NO: 239983 - RNA, 63 nt, Human
acgcuguuuucaccccuuccuccuccuagccucucucccaaaaaguaaaacacaaugcugaag

SEQ ID NO: 239984 - RNA, 63 nt, Human
aacuccugggcucaagugauccgcccgccucagucucccaaagugcgaggaugacauguguga

SEQ ID NO: 239985 - RNA, 63 nt, Human
gccuccuggguucacgccauucuccugccucagucucccaaguaccugggaugacaggcgccu

SEQ ID NO: 239986 - RNA, 63 nt, Human
gcguuaaauggcucaaaaaggccuguacauacuucucccaaagcgccacugaaaagauggcau

SEQ ID NO: 239987 - RNA, 63 nt, Human
aguuaccacagccugcccagagagaaacuaucuucucccaacauuuacuaacauccacugguc

SEQ ID NO: 239988 - RNA, 64 nt, Human
agccccagccccagccccaggcccagcugccuuuggcuuugaucucaagucaggcugaaggcag

SEQ ID NO: 239989 - RNA, 64 nt, Human
ugcucucuguagacugaauucagcaccagugaaaggcuuugagaaggacgugggcagcaaaacg

SEQ ID NO: 239990 - RNA, 64 nt, Human
uauaacuucaauaaagauuguaagcaaagguugaggcuuugaugguuuuuuucuuaauuauugg

SEQ ID NO: 239991 - RNA, 64 nt, Human
aucuuugacacgauuagacacuccuccccacaaaggcuuugaaaucauaaggauuuuccucauc

SEQ ID NO: 239992 - RNA, 64 nt, Human
ucuucagugguuucaggcagauaguugagacuggggcuuugauauucaaggucuuuggcaagaa

SEQ ID NO: 239993 - RNA, 64 nt, Human
gaaugcagaagcaaaggaaggacuaaaaagccuccacggacaucgauaaucaagagauuauuaa

SEQ ID NO: 239994 - RNA, 64 nt, Human
agaagcugcuggaaggcaggccugagccauucaccacggacaggaagagcagcucuggcuauca

SEQ ID NO: 239995 - RNA, 64 nt, Human
uucccugugagccuuaguuauauuuuaauucaguggcuuugagucaaggccgguucuaauugag

SEQ ID NO: 239996 - RNA, 64 nt, Human
gauuuuguccuuugcaugacccuacuuucagcagggcuuugaggcugggaaacugaucugcugg

SEQ ID NO: 239997 - RNA, 64 nt, Human
ucggccuagaagcaguuauucucucuccauauugggcuuugauuugugcugagggucagcuuuu

SEQ ID NO: 239998 - RNA, 64 nt, Human
gggaggagggagaaaaacagaauccagccgcuuaggcuuugaugaacucccaggccaaaaugag

SEQ ID NO: 239999 - RNA, 64 nt, Human
gaagaaagguuuuagagcuguguguucuuucucuggcuuugauucuucuuugaguucucuuacu

SEQ ID NO: 240000 - RNA, 64 nt, Human
uccuucaccuagucccuccugacccagggauggaggcuuugagucccacaguguggugauacag

SEQ ID NO: 240001 - RNA, 64 nt, Human
uccccaacccccaacuccgugugguaagcaacauggcuuugaugauaaacgacuuuacucuaaa

SEQ ID NO: 240002 - RNA, 64 nt, Human
cauuucuaggcuuauacauaauagcaauaauaaaggcuuugaaccuacuaaugauuuucugauc

SEQ ID NO: 240003 - RNA, 64 nt, Human
guauguuuguuuugcaaguuugggagaguaaguuggcuuugagucacacaucgaagcuuuaaga

SEQ ID NO: 240004 - RNA, 64 nt, Human
agaaggaccuccugcccagaccugaggagugagaggcuuugagggcugaagucucccuuuguua

SEQ ID NO: 240005 - RNA, 64 nt, Human
ggagacagagggucgucccaacagggggagguagggcuuugaaaacaccuucauccaggcuggg

SEQ ID NO: 240006 - RNA, 64 nt, Human
uuaccggcaugagccacugcgccuggccgacaaaggcuuugauaucagaaugaacugucaaggg

SEQ ID NO: 240007 - RNA, 64 nt, Human
cuggggccuggccaggccaggguuugggccuaauggcuuugacuaaauuacccccauccuccuu

SEQ ID NO: 240008 - RNA, 64 nt, Human
caacaaauauuuccugaagauccacccugggugaggcuuugagcugacuuuagagaucacugug

SEQ ID NO: 240009 - RNA, 64 nt, Human
uggaaagcaaaccccuuuuaaaaucuaaugucugggcuuugaguauuagcucauuuagggugga

SEQ ID NO: 240010 - RNA, 63 nt, Human
gauuucuuuaguuguagcuaaauguuagauccaccgugggaaaucauucccuuuaaaaugaca

SEQ ID NO: 240011 - RNA, 64 nt, Human
uauugaagugucuuuggauagcugucugagugaccacggacaaagucuuaacaaaacucaggag

SEQ ID NO: 240012 - RNA, 64 nt, Human
gccuccugaacguccguccucaggagcacagccucacggacagugccaaacccugugggucucc

SEQ ID NO: 240013 - RNA, 64 nt, Human
gggacucuggugcccccaacccugggcauccucaggcuuugaggagaauacacaggauuugaag

SEQ ID NO: 240014 - RNA, 64 nt, Human
ccagcucuucaccagaagcuuugaugauggccugggcuuugaauacgugauguucuacaaugac

SEQ ID NO: 240015 - RNA, 64 nt, Human
auuuggggcuugaugacuuucuuuuuguagcuggggcuuugauguuccuuccagugucauuucu

SEQ ID NO: 240016 - RNA, 64 nt, Human
ggcuuuacccuuaggauauaucuuuaugagucuuggcuuugaaguggagaagggcuuuaucuua

SEQ ID NO: 240017 - RNA, 64 nt, Human
cauuucucuuuuaggaaaacuguuuguaugugguggcuuugaugguucucaugccaucaguugu

SEQ ID NO: 240018 - RNA, 64 nt, Human
gucagccccacccuacugccucagcuggacccagggcuuugacacaaacccagugcuuugcuua

SEQ ID NO: 240019 - RNA, 64 nt, Human
ugauuuaucaaauuaaugugcugaugauaauacuggcuuugacuuuguuacuccauguucagcu

SEQ ID NO: 240020 - RNA, 64 nt, Human
cuaaagagaaauaagaauacugcaauuuugugcuggcuuugaacaauuacgaacaauaaugaag

SEQ ID NO: 240021 - RNA, 64 nt, Human
uccauaaguuaacaagucuauaucaggugcagcuggcuuugauuaaaggccauuuuuaaaacuu

SEQ ID NO: 240022 - RNA, 64 nt, Human
gucuguauauuuuuacuuggggugcugcuuuauuggcuuugaaaacacugucagauaagcucag

SEQ ID NO: 240023 - RNA, 64 nt, Human
uacguaaaaaacagagcuguaaauggaacugcuuggcuuugaccauacacauuucugcccagcc

SEQ ID NO: 240024 - RNA, 64 nt, Human
aagccgagcuuaaaaaugccuuuuguuuuaaaugggcuuugagaaaaaaaacagaaacaagcga

SEQ ID NO: 240025 - RNA, 64 nt, Human
uaguguaugccuuuccaagcuugccagucuuuuuggcuuugaacacugcccaucagcuacaguc

SEQ ID NO: 240026 - RNA, 64 nt, Human
agaaaauggauuuaaacauauuucccuguggaggggcuuugaccacgaccuuugaagagcuuca

SEQ ID NO: 240027 - RNA, 64 nt, Human
ccucgccucaccuuucacagaccagaccggcacaggcuuugagcucauuauaaccacacuccuu

SEQ ID NO: 240028 - RNA, 64 nt, Human
aaagcaagcaaggagauaggauuauagauaauuucacggacauuuggaaauaacauuggugauu

SEQ ID NO: 240029 - RNA, 64 nt, Human
ugccaucagauaaagucacguggcucuuuaguaacacggacaaggcuccucgccaaggaacucg

SEQ ID NO: 240030 - RNA, 64 nt, Human
aggccccaaugccuacagacaaagcagaagcugccacggacaccaaugggaccaaguccaaaug

SEQ ID NO: 240031 - RNA, 64 nt, Human
ccaaggaggcugcugugguggggauccccaggggggcuuugacacaguccucugcugucccucc

SEQ ID NO: 240032 - RNA, 64 nt, Human
ccaaggaggcuacuggaucggggauucccaggggggcuuugacacaguccucugcugucucccc

SEQ ID NO: 240033 - RNA, 64 nt, Human
uaaauuuaucaggcauaaauuauguagaauuagaggcuuugaaaauaauacugguagguugcuc

SEQ ID NO: 240034 - RNA, 64 nt, Human
uuuuacuuauauauuugauacauauaauucuuuuggcuuugaaacuugcaacuuugagaacaaa

SEQ ID NO: 240035 - RNA, 64 nt, Human
ugcucaggagaccccugcccucuaguugguucugggcuuugaucucuuccaaccugcccaguca

SEQ ID NO: 240036 - RNA, 64 nt, Human
gauuuuugcaaaguauuuuaccaaccuccucgauggcuuugauaaagguuagauuugauguuuu

SEQ ID NO: 240037 - RNA, 64 nt, Human
acccaugggauauauccagaggcaaacuuuaugaggcuuugaaaucuugccuuccugaagauag

SEQ ID NO: 240038 - RNA, 64 nt, Human
ccuuaaguccuccuccacagggaacaucuauuugggcuuugauguuuaauaaaguagaaagcac

SEQ ID NO: 240039 - RNA, 64 nt, Human
gugagucacucuucaguuugggagcugggucuguggcuuugaucagaagguacuuucaaaagag

SEQ ID NO: 240040 - RNA, 64 nt, Human
uacucaagugaucuauuaucuagcugcaaagccuggcuuugauuugaaauuuuguaaaaauuuc

SEQ ID NO: 240041 - RNA, 64 nt, Human
auuguuuuuaauuauuaccauguauuaaauugugggcuuugaaaccuaaugaaaccuguuagcc

SEQ ID NO: 240042 - RNA, 64 nt, Human
agucagcagucugcuauuaaguggccuacuucaaggcuuugaaucaacuuaagggaaaaccuuu

SEQ ID NO: 240043 - RNA, 64 nt, Human
caaaaaauaaacaauucccaauguuccaggugagggcuuugaaaggccuuccaaacagcuccgu

SEQ ID NO: 240044 - RNA, 64 nt, Human
agaugccagaaguuuuuccacagccuuggagaggggcuuugacugagggcugggggcccugggc

SEQ ID NO: 240045 - RNA, 64 nt, Human
caugaguaaaaaaaaaaacaauuacuggcucacuggcuuugaaaagucacuuacuauuguugcu

SEQ ID NO: 240046 - RNA, 64 nt, Human
cuucuucgacgcgcuggaccacgucauagacauacacggacacaucaucggcaugggccugucg

SEQ ID NO: 240047 - RNA, 64 nt, Human
uuccuggugcucacacaccugucaccuuguaaaacacggacauuagugugaacacaggacagcu

SEQ ID NO: 240048 - RNA, 64 nt, Human
acccacccacccccuggggcugcucagccucaggcacggacagggcacaugauaccaacugcug

SEQ ID NO: 240049 - RNA, 64 nt, Human
uugcuugccgcuggcaugccugaggaauguauuuggcuuugauuacacacuaaguuuuuguaau

SEQ ID NO: 240050 - RNA, 64 nt, Human
accagugagcggagugaggugcccuggagaagcaggcuuugaaggcacagcgaagcuguaacug

SEQ ID NO: 240051 - RNA, 64 nt, Human
uacugugucagauuuggaacuaaacaggcaaggaggcuuugagucacaucguuuucauuuuaaa

SEQ ID NO: 240052 - RNA, 64 nt, Human
guuuugguccugcgacccuuuacuggucuccgcuggcuuugaaucuuccucugggcucuacucu

SEQ ID NO: 240053 - RNA, 64 nt, Human
aggccccaacacagccccauggccucugccagauggcuuugaaaaaggugauccaagcaggccc

SEQ ID NO: 240054 - RNA, 64 nt, Human
accuguaaagaaaauagugaaucacuguagcaauggcuuugauucagaccuuaaaaucacauaa

SEQ ID NO: 240055 - RNA, 64 nt, Human
uaacugacaaaucacaagugguuuaguugggcagggcuuugaucauucaaaaguaacuaaagua

SEQ ID NO: 240056 - RNA, 64 nt, Human
uuuaugccagaucauuuuccggcacacacggaguggcuuugacagauugauaacuuuguaagau

SEQ ID NO: 240057 - RNA, 64 nt, Human
uugaaaggggaaacgucucccagaucgcucccuuggcuuugaggccgaagcugcugugacugug

SEQ ID NO: 240058 - RNA, 64 nt, Human
cacuguguuuuccuuguuaacuaaaacagacaugggcuuugauuuuuuucauacuauuagacca

SEQ ID NO: 240059 - RNA, 64 nt, Human
caagcuccccacugcccacacugaguggucuacuggcuuugagaaacagcuguggggaccuucc

SEQ ID NO: 240060 - RNA, 64 nt, Human
guucacugcuacaaagggaucccaacccacuggaggcuuugaaguagggagguuggcaggggug

SEQ ID NO: 240061 - RNA, 64 nt, Human
gauacaggcuggaaaguaagggaagcagaaggaaggcuuugaaaaguuguuuuaucugguggga

SEQ ID NO: 240062 - RNA, 64 nt, Human
gaaaaaaugguaaagaauggcauuuaacgauucaggcuuugaauuacucugucccucuggaccg

SEQ ID NO: 240063 - RNA, 64 nt, Human
gagaggacaauuuggucauuggacacggauugcaggcuuugagaagcgcucagaggcccagggc

SEQ ID NO: 240064 - RNA, 64 nt, Human
gagagaaggagagagacaguagccaagagaaccccacggacaagauuuuucauuucacccaaug

SEQ ID NO: 240065 - RNA, 64 nt, Human
aaggucgggggcaggcgcugcccagcuggccgcacacggacauuccaaagaccuccagagacca

SEQ ID NO: 240066 - RNA, 64 nt, Human
guucccagguuccagcgugccccucccucagacacacggacacaaucagccgagaaguuccugg

SEQ ID NO: 240067 - RNA, 64 nt, Human
ugggccuccaauccugcggagcuuuccuggguguggcuuugaccucagaaguggcucugguuug

SEQ ID NO: 240068 - RNA, 64 nt, Human
auaaacuaaaauuuauggcacaaaagauaaauauggcuuugaaauuaaagauauuccacucaac

SEQ ID NO: 240069 - RNA, 64 nt, Human
cuagaauugauauuugaguauaguagagcuuuggggcuuugaaggcagguucaagaaagcauau

SEQ ID NO: 240070 - RNA, 64 nt, Human
ugcugagaugugaaugaugcagcaaccuggauuuggcuuugacuauagcacaaaugugggcaau

SEQ ID NO: 240071 - RNA, 64 nt, Human
aaaugcacugaacucugggugccgagagauguaaggcuuugagacaugcuacugaauuuggagg

SEQ ID NO: 240072 - RNA, 64 nt, Human
auguggucuugaccucccagcaugaagugugcauggcuuugagaagugccucagcacccugaaa

SEQ ID NO: 240073 - RNA, 64 nt, Human
auggacaagaaaccuugaaaagcaccugucaaauggcuuugaagaagugaugccaccaucucua

SEQ ID NO: 240074 - RNA, 64 nt, Human
ugucaacuuuugaaaacagauaguuaugacucaaggcuuugagaauguaaagagaccaccuuca

SEQ ID NO: 240075 - RNA, 64 nt, Human
aaaaaugcaacgcuguaauauggcuguaucagagggcuuugaaaacauacacugagcugcuucu

SEQ ID NO: 240076 - RNA, 64 nt, Human
ugucaacuuuugaaaacagauaguuaugacucaaggcuuugagaauguaaagagacgcccuuca

SEQ ID NO: 240077 - RNA, 64 nt, Human
gacugaugcaagccccucuucuuaaccguuucuuggcuuugagcccagaaacacagcucucccu

SEQ ID NO: 240078 - RNA, 64 nt, Human
uugauauucuuuaaguuaguugcucacacacuuaggcuuugauugcugaagaaguauguuuaag

SEQ ID NO: 240079 - RNA, 64 nt, Human
aauuguuauguuacccaagggauaaacuugaacuggcuuugaacauccuuuaggucauuuucuc

SEQ ID NO: 240080 - RNA, 64 nt, Human
guggagacaaaguuguggguuccuccucccaccuggcuuugaggcugucgucgauaucauagua

SEQ ID NO: 240081 - RNA, 64 nt, Human
gacacuuucugcuggaagcugucaggcugggacaggcuuugauuuugaggguuagcaagacaaa

SEQ ID NO: 240082 - RNA, 64 nt, Human
ucccacaaggcccgguguugaccgagccacaggccacggacaggggccgggguuggggagacua

SEQ ID NO: 240083 - RNA, 64 nt, Human
aaacgaaaauguguagacgcacucucaaaaacugcacggacauacaaaaucaaucuuuuccuuu

SEQ ID NO: 240084 - RNA, 64 nt, Human
uaggcagcgggugggcacagccccucaccacggacacggacagaggaccaccuccccauacaga

SEQ ID NO: 240085 - RNA, 64 nt, Human
uuuuuuuuuuuaauauagaaucugaggcuguuugggcuuugacuuaaauuuccaucaggccucu

SEQ ID NO: 240086 - RNA, 64 nt, Human
ugauuuuuggcuauuuuauauuuaguguacacagggcuuugaaauauuaauuuacauaaaggcc

SEQ ID NO: 240087 - RNA, 64 nt, Human
uaccaauacuauuuauuaugcucaaauauaucuuggcuuugaccuuauuucaacacauucuaag

SEQ ID NO: 240088 - RNA, 64 nt, Human
cugggucaccuccucccugcucgcugacaucuggggcuuugacccuuucuuuuuuaaucuacuu

SEQ ID NO: 240089 - RNA, 64 nt, Human
cuucccugcugcugaguggagagaggccucauccggcuuugacccaccauccguugcagaagcc

SEQ ID NO: 240090 - RNA, 64 nt, Human
gagaccaacaaaaauaauaaaacacaaagagccaggcuuugagacucauguaauuacaauuucu

SEQ ID NO: 240091 - RNA, 64 nt, Human
uuaagcucaggacuugauacccucugagaugaguggcuuugagugacaugcuaacagcaauuuc

SEQ ID NO: 240092 - RNA, 64 nt, Human
auguugcugucuccauccgucuuuaaugggucagggcuuugauuuccaagggucuucaggugau

SEQ ID NO: 240093 - RNA, 64 nt, Human
cucccacucugccagacacccugacacccacccaggcuuugaagagcauggagggggagccuca

SEQ ID NO: 240094 - RNA, 64 nt, Human
gggaggcugacuuggacccaaacugggcgacuagggcuuugagcugggcaguuuucccugccac

SEQ ID NO: 240095 - RNA, 64 nt, Human
ccagagagucccucuggaaccauauaaaguuccuggcuuugaaugaaccagaaguguuugccca

SEQ ID NO: 240096 - RNA, 64 nt, Human
uggcucaccacauagugugcuuugauuguauuuuggcuuugacucugccauuucugaaaugugg

SEQ ID NO: 240097 - RNA, 64 nt, Human
aaaucagacacggcaccuucaguuuuguacuauuggcuuugaaucaagcaggcucaaaucuagu

SEQ ID NO: 240098 - RNA, 64 nt, Human
aaauacggaaccuuuagggauaguuccguguaagggcuuugaugccagcauccuuggaucagua

SEQ ID NO: 240099 - RNA, 64 nt, Human
gcagagcucuuccccggagaccuccacacacccuggcuuugaaguggagucugugacugcucug

SEQ ID NO: 240100 - RNA, 64 nt, Human
uguaauaauaaagaaagauucggcuuuuggcaaucacggacacuuuuuuccccuccaccgaaug

SEQ ID NO: 240101 - RNA, 64 nt, Human
cuauuuaaagugacucaagaagcaugugcuaucuggcuuugaaggaaaaaaaaagaauucugca

SEQ ID NO: 240102 - RNA, 64 nt, Human
gcugcagcauguuggugccauuuucagcaauuacggcuuugacagugccaccucuuugaugcca

SEQ ID NO: 240103 - RNA, 64 nt, Human
caguggaccagcuccugggaccuuccaaaacauuggcuuugacaucugccaagguauuggccuu

SEQ ID NO: 240104 - RNA, 64 nt, Human
uaagagguggaagacgcuuccuuccaggacagcaggcuuugaguccagcacccccagccugccu

SEQ ID NO: 240105 - RNA, 64 nt, Human
ugccaacaauuuucuagauauuauauacaacacaggcuuugaucuuggggacuuuucccauaua

SEQ ID NO: 240106 - RNA, 64 nt, Human
cauguuguuuaauuucuuuuuaaaaucacuguugggcuuugaaagcauugagaauauaauauga

SEQ ID NO: 240107 - RNA, 64 nt, Human
augguacaaccugugggaagggaagcggguucauggcuuugagggccugagaggcaaaugcauc

SEQ ID NO: 240108 - RNA, 64 nt, Human
gauacccauucuuucugccuuugcccaggauggaggcuuugaagacagguggucaccuggaccu

SEQ ID NO: 240109 - RNA, 64 nt, Human
gaaagacaacuacuuuugaaggaaguuaaaagguggcuuugaaggaggaagacaccuugagcca

SEQ ID NO: 240110 - RNA, 64 nt, Human
uucuuuaaaugccucucacucuuacaagauaguaggcuuugagauaauaaacuuacccguguca

SEQ ID NO: 240111 - RNA, 64 nt, Human
aucacgaaacugggacccccagaagggaggagugggcuuugaacuuagacaucuaccucagagc

SEQ ID NO: 240112 - RNA, 64 nt, Human
uccuguaugaauaaaauauugauuugauuacaguggcuuugacuauaaugugggagccaauuuu

SEQ ID NO: 240113 - RNA, 64 nt, Human
gcaucggggcgucacaccuguugaggagugggguggcuuugaaugcuggaaauggcuucauagu

SEQ ID NO: 240114 - RNA, 64 nt, Human
cgagaucuagcaucucugaaauccuggcugucgaggcuuugaagcauguguuaccugguuaagc

SEQ ID NO: 240115 - RNA, 64 nt, Human
aacgucaguguauaaguaaguuggguuuauggugggcuuugacuaugucauuagguggguacaa

SEQ ID NO: 240116 - RNA, 62 nt, Human
auuaagguacaugaucagcucuuucuauuuuuacucguaaaaauuauggaaaugaauaauuu

SEQ ID NO: 240117 - RNA, 62 nt, Human
cucugcuuuuagucacguguauuuucauuaccacucguaaaaagguaucuuuuuuaaaugaa

SEQ ID NO: 240118 - RNA, 62 nt, Human
uaccaaaccuggaagcagcagcaggugccugaacucguaacuagagaagaguuauccuucuu

SEQ ID NO: 240119 - RNA, 64 nt, Human
ucaguuguacuuccagugcgucucuuuuguuccuggcuuugacaugaaaagauagguuugaguu

SEQ ID NO: 240120 - RNA, 62 nt, Human
ccggugcagcuggcguccaaagggugacccagacucguaaaugaugcccuuguggcuggcau

SEQ ID NO: 240121 - RNA, 62 nt, Human
auaguaucgucugcauuccagcaaaaauaucaacucguaaggcacuaguacaguuaaacuga

SEQ ID NO: 240122 - RNA, 62 nt, Human
acugucacaauuuuccagauauuauauaaugaacucguaauguaacauuuccuucuagcuuc

SEQ ID NO: 240123 - RNA, 64 nt, Human
cccugaaggagcugagagggagcucaacuccccaccccgccacguggggagacagcccuuccca

SEQ ID NO: 240124 - RNA, 64 nt, Human
auagccuucaagcaugugaauaaucuuccaucuuccccgccacacauacacacacacacuuuuu

SEQ ID NO: 240125 - RNA, 64 nt, Human
guggcagaucuccgguauccucagcacuacccacccccgccagcuccccagcacaaaggacccu

SEQ ID NO: 240126 - RNA, 64 nt, Human
caaggagaguccuuccucuccccuuuugaggcauccccgccauccccccacuuagagcuaugug

SEQ ID NO: 240127 - RNA, 64 nt, Human
gcguggggaugcggggagauuugagaggggaaaaccccgccaggagggagagagaggcaccccu

SEQ ID NO: 240128 - RNA, 64 nt, Human
uccccgucucccgucuucugccucccacuccauaccccgccaaggaaaggcauguacaaaaauu

SEQ ID NO: 240129 - RNA, 64 nt, Human
gcugacagcuguaggcuguagccugcacggggcgccccgccaaggaggcaccuggaggugaaac

SEQ ID NO: 240130 - RNA, 64 nt, Human
uucauguuacaaacagaaaagcucgaggcucccaccccgccacaucccaacuucauuucccccu

SEQ ID NO: 240131 - RNA, 64 nt, Human
ucaaggaugcgcucuuuauuucuacccugucucuccccgccacccccgacuucccguggaaauu

SEQ ID NO: 240132 - RNA, 64 nt, Human
aggccagcggugaccagccugucacccagcuccuccccgccaacccugccugccgcugcaccug

SEQ ID NO: 240133 - RNA, 64 nt, Human
augaaaggcaauucaaacaucugcuugauucccgccccgccaccccuaauuucugagagaauaa

SEQ ID NO: 240134 - RNA, 64 nt, Human
gauaugcugcccccugacccccaccuucaccccuccccgccaaggccuggcucuuccggagguc

SEQ ID NO: 240135 - RNA, 64 nt, Human
aaguggcuccuucccaugugcagucccuguccccccccgccaguccuccacacccaaacuguuu

SEQ ID NO: 240136 - RNA, 64 nt, Human
cagugcacgcuguggccugucaccgccaccguggccccgccagcuggccuccccuuuggcccac

SEQ ID NO: 240137 - RNA, 64 nt, Human
aucaagggauuuuuuuuuuuuguauucccccugcccccgccagucaaagguuucuuuucccuuu

SEQ ID NO: 240138 - RNA, 64 nt, Human
ugagguccccuaaucuguggccaccaccccccccccccgccacgccuuagagcagagcagcccc

SEQ ID NO: 240139 - RNA, 64 nt, Human
uuggccaggagacccugaaacaugaaaccaaacaggcuuugauauuuuuuuuuuuuuaauuacu

SEQ ID NO: 240140 - RNA, 64 nt, Human
aaauacauagaaguacacagcuauuauaugcuguggcuuugagaaguuaacuuuuguggaauau

SEQ ID NO: 240141 - RNA, 64 nt, Human
uaaaaaaaaaaaaaaaaucccaauaguccaugaaggcuuugaucucuugggaaguucuucauag

SEQ ID NO: 240142 - RNA, 64 nt, Human
aagccuuuucaggcacaugguuucaacaaagccuggcuuugacauuccuuguccugaggagcac

SEQ ID NO: 240143 - RNA, 64 nt, Human
cuauguucgauuuuguuuuguuuuguuuuguucuggcuuugaggcuuguuuuguugucuguguc

SEQ ID NO: 240144 - RNA, 64 nt, Human
ccagcccccacccuccuggcagcagcgccaggaaggcuuugacaauuaccuccgucugaucuac

SEQ ID NO: 240145 - RNA, 64 nt, Human
gagguguagggguggaaugagccgcggggaagcuggcuuugaaaccucagggcugucccagccc

SEQ ID NO: 240146 - RNA, 64 nt, Human
ugggggcaaaggggaggguucuuggauguggaagggcuuugaacaauguuuagauuuggagaug

SEQ ID NO: 240147 - RNA, 64 nt, Human
gucaggauucaagggcucagugucaaagauaauuggcuuugacuuuuuguaaucuaggagcagc

SEQ ID NO: 240148 - RNA, 64 nt, Human
uacuguggcuuuggauuuccuuaugugucuuacaggcuuugauagaaggggaggggaggagaga

SEQ ID NO: 240149 - RNA, 64 nt, Human
uuuuaauauucauaaugucgugugcuuaaaagugggcuuugaagugugugcugcuuacuccuuu

SEQ ID NO: 240150 - RNA, 64 nt, Human
auccacugauuuucuguggcuccagugagaacaaggcuuugaaacugaacaagauaacuucuag

SEQ ID NO: 240151 - RNA, 64 nt, Human
gucaauuuagaaugugaaauucugaccaccuuuuggcuuugaguauuuuccaaaagauauuuga

SEQ ID NO: 240152 - RNA, 64 nt, Human
uugcauuacuguuucacaaugaagcuuucuuuaaggcuuugauuuuuaugauuaugaaagaaau

SEQ ID NO: 240153 - RNA, 64 nt, Human
uaaauauuggagagcaaggaauguggacuuguauggcuuugaaccaagagaggguuaugagccu

SEQ ID NO: 240154 - RNA, 64 nt, Human
auagcaguuacgccuuaggaaggggacaaccaggccccgccacacgcucacacacaaaccugcu

SEQ ID NO: 240155 - RNA, 64 nt, Human
ugaugcugcgucccccgcugcuugccgccccccaccccgccauuuuguauaauaaagcucccug

SEQ ID NO: 240156 - RNA, 64 nt, Human
uaugcugagcuuguagccuuuuagcuccacagagccccgccauguguuugcaccagcuuaaaau

SEQ ID NO: 240157 - RNA, 64 nt, Human
uauccuaaucuuccuagcccuucaggcuagaguaggcuuugauccugagaaccuugcuguugcu

SEQ ID NO: 240158 - RNA, 64 nt, Human
uguuaaggaagggaaagauugucauagaugguagggcuuugaaaaugcaggguaucagcugcca

SEQ ID NO: 240159 - RNA, 64 nt, Human
gcccuuguauuaaauccuugauuuuuucccauuuggcuuugaugcccuugauccauuguuuccu

SEQ ID NO: 240160 - RNA, 64 nt, Human
accaggagcugauggcagcuggggcuaggggaagggcuuugaggguggaaggaugggauggguu

SEQ ID NO: 240161 - RNA, 64 nt, Human
cuuuaguugaauuccaaguguauuuuaaaauagaggcuuugagcaacuaacuaaccacauuuua

SEQ ID NO: 240162 - RNA, 64 nt, Human
cucugcucgcugcauugugguguucucuucucaaggcuuugaaaucuccccuugcacugagauu

SEQ ID NO: 240163 - RNA, 64 nt, Human
auauaucauagaguugaaucacaaugagaccguuggcuuugaauuugagucguugguucccaug

SEQ ID NO: 240164 - RNA, 64 nt, Human
gcagcuagcagucaucaggggagacacccugcggggcuuugauucuacagaucuuucucaaagg

SEQ ID NO: 240165 - RNA, 64 nt, Human
caagucugcuaagauucacauccauagcccccauggcuuugaggagaauccucucugccauucu

SEQ ID NO: 240166 - RNA, 64 nt, Human
gccuuccauaggggguucagucccaaagacauggggcuuugaaaacccuagccugaagucugag

SEQ ID NO: 240167 - RNA, 64 nt, Human
cacugcagucaggaauaaacuguuuucuccaccaggcuuugacaaaagggcccacaggaaucuu

SEQ ID NO: 240168 - RNA, 64 nt, Human
cuuugcaaauauuaaaaaauuuuuuuugcuauaaggcuuugaucauauaguccucauagcaaca

SEQ ID NO: 240169 - RNA, 64 nt, Human
gacauugccaugggacggaagucugcuuggcaguggcuuugauaagcgaugcuugggggucaga

SEQ ID NO: 240170 - RNA, 64 nt, Human
acaguuaaucucccugguuuaaaaucacaccaguggcuuugauguuguuucugccccgcauugu

SEQ ID NO: 240171 - RNA, 64 nt, Human
cuucuugauucuauagagacuuaaucaugccuauggcuuugaauaaucuuaugugauuuaaaua

SEQ ID NO: 240172 - RNA, 64 nt, Human
agggcuaguccucuuccccaguccccucagaggcccccgccagccccaccuugaaagcagcaua

SEQ ID NO: 240173 - RNA, 64 nt, Human
cgaggaggacaccucccugucggagagugaggggccccgccagcccgauggggaugaggaggag

SEQ ID NO: 240174 - RNA, 64 nt, Human
ugucacaaaacauuacucauuugauuucccccacccccgccaaccauuuaaaaaaguuugccgg

SEQ ID NO: 240175 - RNA, 64 nt, Human
guauuccuaauuuuuaccuaagcucauugcuccaggcuuugauuaccuaaaauaagcuuggaua

SEQ ID NO: 240176 - RNA, 64 nt, Human
caaaggauuaauugcugcaaggacauucuuguaaggcuuugauuaguuuucuuguugcuuuguu

SEQ ID NO: 240177 - RNA, 64 nt, Human
gaaugauaaggagaaaugucuguuuugaggaaagggcuuugaauuccccagauacugaacaauu

SEQ ID NO: 240178 - RNA, 64 nt, Human
cuagauuguuuccugguacugucacugccacuggggcuuugauuuggaggaauggggcagggga

SEQ ID NO: 240179 - RNA, 64 nt, Human
gcuccugugcuccggagggaagcauuuccugguaggcuuugauuuuucuguguguuaaagaaau

SEQ ID NO: 240180 - RNA, 64 nt, Human
aauccucgcagccacaccuaggucugagaacucaggcuuugaguuacugaucuuccuuggauua

SEQ ID NO: 240181 - RNA, 64 nt, Human
acugcccaguuucccuggacuagccgaggagcagggcuuugagacuccuguugggacacaguug

SEQ ID NO: 240182 - RNA, 64 nt, Human
ucagauucaucucucauuuuauauguccagaaauggcuuugaauuuuaagcaauuacuaguuuu

SEQ ID NO: 240183 - RNA, 64 nt, Human
ccccagugcugugcuugaagccucgugccacacuggcuuugagguagcacgcugcaaguuagug

SEQ ID NO: 240184 - RNA, 64 nt, Human
uagcaaccauggaaugaaugugugaccagaaaguggcuuugacaccaagugcuacugucccuuu

SEQ ID NO: 240185 - RNA, 64 nt, Human
uuguccaacccgaggcccgcaugcggcccaggauggcuuugaaugcggcccaacgcaaauucgc

SEQ ID NO: 240186 - RNA, 64 nt, Human
ugagggccuccugcucugccugggcugggccaggggcuuugaggagaggguaaacauaggcccg

SEQ ID NO: 240187 - RNA, 64 nt, Human
gaagcugacaauuacccauagugagguaauugagggcuuugauacugagcuguucucauaucau

SEQ ID NO: 240188 - RNA, 64 nt, Human
uguuggggucuguacagaugaugcuacccaauuuggcuuugaaggaucaaguaacagguugaaa

SEQ ID NO: 240189 - RNA, 64 nt, Human
accuuggauuuacugagaacucagccguggccuuggcuuugauacuuauaggugucagcccuug

SEQ ID NO: 240190 - RNA, 64 nt, Human
gagcgccugcgugcaggccuggccgugguucgcuccccgccagcccacgugccccagaagggcc

SEQ ID NO: 240191 - RNA, 64 nt, Human
cacgggcgcccaggacccuggccugcagagacgcccccgccacaggauccagagcaagcaccgc

SEQ ID NO: 240192 - RNA, 64 nt, Human
guccaaggaggaacuguagcugcccccgugucacccccgccaucacugcuggacaggagccacc

SEQ ID NO: 240193 - RNA, 64 nt, Human
cuaaagcaagcuuguccaacccuuggcccaggacggcuuugaauauggcccgacacaaauucgu

SEQ ID NO: 240194 - RNA, 64 nt, Human
acaacuucauuucuuucuggggucaccugugaugggcuuugauguggugucaauuuggggccuu

SEQ ID NO: 240195 - RNA, 64 nt, Human
guguguucacuuguguuggauagagcaguggcauggcuuugaccuaguaugaacuggugucugc

SEQ ID NO: 240196 - RNA, 64 nt, Human
cuuaaguuuucuuucacagaacuccaccauugugggcuuugagagagcccuaaagcauuguacc

SEQ ID NO: 240197 - RNA, 64 nt, Human
gaggaaguuuguucaccagagacaggcuucagauggcuuugauuucggcaagcuggaauggccc

SEQ ID NO: 240198 - RNA, 64 nt, Human
auacuguauaagacaaagccaagaugcaaaauuaggcuuugauuggcacuuuuugaaaaauaug

SEQ ID NO: 240199 - RNA, 64 nt, Human
gaguacaaauagaccuaaauuaagcucauuuuuaggcuuugauuuuggggagacaaagggaaau

SEQ ID NO: 240200 - RNA, 64 nt, Human
acccggcccaagggccgcauguggcccaggauauggcuuugaauggggccuaacacaaauucau

SEQ ID NO: 240201 - RNA, 64 nt, Human
uggcccuugccuucugagcagcucccagugccagggcuuugagacuuucccacaugauaaaaga

SEQ ID NO: 240202 - RNA, 64 nt, Human
uugugccaauuaauuaccaaacauugagccugcaggcuuugagugggaguguugcccccaggag

SEQ ID NO: 240203 - RNA, 64 nt, Human
ccucgacucccgccugcaggagccccagccccaaggcuuugacaaccaggcguuccucccugac

SEQ ID NO: 240204 - RNA, 64 nt, Human
uccugcggggcuggugugaaaggcgcugggaaccggcuuugaaugaauaaaugaaucgugucau

SEQ ID NO: 240205 - RNA, 64 nt, Human
uucuuucccagcaucguggauguagacugagaauggcuuugaguggcaucagcuucucacugcu

SEQ ID NO: 240206 - RNA, 64 nt, Human
aaugcuuucccacagcuggguaacuguucuaaauggcuuugauaaugcucacacaucuuggagu

SEQ ID NO: 240207 - RNA, 64 nt, Human
ucuaccaguuggcagacagccguuuguucuacauggcuuugauaauuguuugaggggaggagau

SEQ ID NO: 240208 - RNA, 64 nt, Human
gauuccugggagucgaaguugaaaggaagcuuucccccgccaaggacgccuaccccgaaaccgg

SEQ ID NO: 240209 - RNA, 64 nt, Human
cuuugagcucuccagacugugcccuuaccgccuuccccgccacacccgcucugucuucccacug

SEQ ID NO: 240210 - RNA, 64 nt, Human
cuuuugccauucaagcaacauugugaucuuucuuccccgccacgugugugggaaugauugaguc

SEQ ID NO: 240211 - RNA, 64 nt, Human
agauggacagccucuacuuccaucagauauauguggcuuugagaggcaacuuugccccugucug

SEQ ID NO: 240212 - RNA, 64 nt, Human
acccacggccugugggccgcauacggcccaggauggcuuugaaugcagcccaacacaaauucgu

SEQ ID NO: 240213 - RNA, 64 nt, Human
aaaauucaguggaggcuuuuguuuguguguguguggcuuugaaaacaaauuauuugagaaagac

SEQ ID NO: 240214 - RNA, 64 nt, Human
aagaaauggggaguaaguguucacaucauuaaaaggcuuugaauucauggaaauacaucaacug

SEQ ID NO: 240215 - RNA, 64 nt, Human
aauccagaucaucuggcugaagcuuuugcaaguaggcuuugaggggugaaggagauugguggag

SEQ ID NO: 240216 - RNA, 64 nt, Human
gagucacagcuuuacugugacagguuuugcccaaggcuuugauaccugucacccaggguaucuu

SEQ ID NO: 240217 - RNA, 64 nt, Human
gaaaaugucuguacagccaacgguuucucuugggggcuuugaaauaacaccaccaguggacuua

SEQ ID NO: 240218 - RNA, 64 nt, Human
gggagaaagcaugucaggacagagcuguuggauuggcuuugauagaggaauggggaugauguaa

SEQ ID NO: 240219 - RNA, 64 nt, Human
gcuuauucuuuuguacacagcugaagaaagauaaggcuuugaugggccacuuccaggaugggcu

SEQ ID NO: 240220 - RNA, 64 nt, Human
gcguauuaagguccauucugccugugugugcuguggcuuugaacuguaacaccucuaaucaauu

SEQ ID NO: 240221 - RNA, 64 nt, Human
augacuauaaugcauguacuauauaagcugaucuggcuuugaaagaugugaguuggcaaguucc

SEQ ID NO: 240222 - RNA, 64 nt, Human
guaguaaaaacuggcccuuaccugacagagcccuggcuuugaccugcucagcccuguguguuaa

SEQ ID NO: 240223 - RNA, 64 nt, Human
uaucaauauucuuauaaaaggaauauaugaagauggcuuugauacuagaggugaggcacaagug

SEQ ID NO: 240224 - RNA, 64 nt, Human
cgagaagcugcgcuacgccaucagcaugaacacgggcuuugaacucuccuagcuccugucccag

SEQ ID NO: 240225 - RNA, 64 nt, Human
ccucggucugugacaguccuccuagcacccccauggcuuugagccucggggacucaucaagucc

SEQ ID NO: 240226 - RNA, 64 nt, Human
gaagugcccacugacccacccacccaccuacaccccccgccacacacacacacaaacgugcaca

SEQ ID NO: 240227 - RNA, 64 nt, Human
ggcuaggggccuccccuucucauccuccccacccccccgccaagguucucacacuggccugggc

SEQ ID NO: 240228 - RNA, 64 nt, Human
caguucuuccaaacuugaccgcacccugccccacccccgccacgucccacuaggcguccucccg

SEQ ID NO: 240229 - RNA, 64 nt, Human
uaagagcuacugggaucacguuagcgggcauuuaggcuuugaugagagggcacaguuugaguua

SEQ ID NO: 240230 - RNA, 64 nt, Human
aguugggcaaaacaggcuagcaauugcaaagucaggcuuugaccaacauauuucuuugcacuga

SEQ ID NO: 240231 - RNA, 64 nt, Human
gaagaaccuacuacaaggcaaggagccguuuuuuggcuuugaaaagucuugcugucuugggucu

SEQ ID NO: 240232 - RNA, 64 nt, Human
ucugaacaaacuacaaaaaugugacugggaagggggcuuugagagacugggacugcucuggguu

SEQ ID NO: 240233 - RNA, 64 nt, Human
agagcaaacccaguaccucagacaggaaagucggggcuuugaccacuaccauaucugguagccc

SEQ ID NO: 240234 - RNA, 64 nt, Human
uuuccuugaggcauuuagcaacacauagaaaaugggcuuugauucuuuuccaaaacuuuuagcc

SEQ ID NO: 240235 - RNA, 64 nt, Human
aguaucuggaaacuuuccccuuuguuuagggguaggcuuugaugaccaggaaaaaaaaaaaggu

SEQ ID NO: 240236 - RNA, 64 nt, Human
ccuccauuuuaaucaugcauaaaaugaauuagauggcuuugaguggauuuucacaauggcucaa

SEQ ID NO: 240237 - RNA, 64 nt, Human
cugcuacucccaguccuucccagaaacugccuagggcuuugagucauuuuaugaagcuaggucu

SEQ ID NO: 240238 - RNA, 64 nt, Human
ugaaaggcuguuugaaagaggaauguuuaauaaaggcuuugauuuaaucuugauauaaacagau

SEQ ID NO: 240239 - RNA, 64 nt, Human
gugacuuagaauuaacucgugcuaaggggucgggggcuuugaaaaugccaccccccuuucuuau

SEQ ID NO: 240240 - RNA, 64 nt, Human
gaaagauaacuguguugaacaaacaggugcuccaggcuuugauuauagauacgacuucaaaaau

SEQ ID NO: 240241 - RNA, 64 nt, Human
cccuuaggugaacaauguaggaaauccucaaaguggcuuugaauuuaaugcuccacuucaguua

SEQ ID NO: 240242 - RNA, 64 nt, Human
uucccuucuguauaauuaacauagguugucucauggcuuugaucuucaaaaggaagagccuuuu

SEQ ID NO: 240243 - RNA, 64 nt, Human
acaaccucucuauccccagggagaccucccaaauggcuuugacccucagacauuucuuuacuca

SEQ ID NO: 240244 - RNA, 64 nt, Human
ggauagggagcagaugcaaugacucaggacauccccccgccaaaagcugcucagggaaaagcag

SEQ ID NO: 240245 - RNA, 64 nt, Human
acuugcaagggcuuuccuguagggucuggggcuuccccgccacaucgcggcccuccagccuggc

SEQ ID NO: 240246 - RNA, 64 nt, Human
agcguggcgcucuguaacuuccugccgucugccaccccgccacguguauuuaacccucgcacuu

SEQ ID NO: 240247 - RNA, 64 nt, Human
aaaugaggugcaaauaaaaugcagaugauugcgcggcuuugaauccaauugaccuguucauuuc

SEQ ID NO: 240248 - RNA, 64 nt, Human
aaaguacauaaaguggagguuuauuuaucauacaggcuuugaaacauuaagaagcaguauuuuu

SEQ ID NO: 240249 - RNA, 64 nt, Human
ggaaucuaggcuaacgagacaaaggaagucugaaggcuuugaauaagaaauuuucuguugcucu

SEQ ID NO: 240250 - RNA, 64 nt, Human
caacucuagagaaaaccaauauaugguggugcugggcuuugaagauagcauaucagacgccuug

SEQ ID NO: 240251 - RNA, 64 nt, Human
accucagcuagccugacaccgcaauaacccguuaggcuuugaggcuuuucagugaauucuugac

SEQ ID NO: 240252 - RNA, 64 nt, Human
aaaucaauuaucaagaacguccuaaaacaccuauggcuuugacuuuguuauugauccagauuau

SEQ ID NO: 240253 - RNA, 64 nt, Human
ugaaaaaacuggaaucuaaauagucagugaggaaggcuuugauaaaaugaaauugccagaaaga

SEQ ID NO: 240254 - RNA, 64 nt, Human
cacuaggcuuucugggaguccauccagcuggaguggcuuugagugaguuacacagcuagaaggu

SEQ ID NO: 240255 - RNA, 64 nt, Human
aacugcggcacgcgcuucgggcagccuagccacaggcuuugagcgccugcauuccugggggcug

SEQ ID NO: 240256 - RNA, 64 nt, Human
ggguuuggagccaggggauggcauggagugauguggcuuugaaggguccucuggcugcugagcu

SEQ ID NO: 240257 - RNA, 64 nt, Human
ugaugacuuggcaggacuugccccaccagggucuggcuuugaaggguaguggacaccaggaucc

SEQ ID NO: 240258 - RNA, 55 nt, Human
ucaccuuuuacugccaguaacuccaggcuuugacaucccuguccacagcucugag

SEQ ID NO: 240259 - RNA, 64 nt, Human
gcaaacugaugguguuugugcuguagcuguuggaggcuuugacaggaauggacuggaucaccug

SEQ ID NO: 240260 - RNA, 64 nt, Human
uuaagaucaugagcccuuuuucuccaguaguacaggcuuugaaaacuacuucuauuaaguuauu

SEQ ID NO: 240261 - RNA, 64 nt, Human
ucccgcuuggggggcggggcucgguccuugggggggcuuugagcucuccagacugugcccuuac

SEQ ID NO: 240262 - RNA, 64 nt, Human
gucuuccuuccacccugcagcccguguccaggagccccgccaggugcccgcgccaggcccucag

SEQ ID NO: 240263 - RNA, 64 nt, Human
agugugauccuggaggccccccggccuggccccgccccgccagccgcccccguuagcgucauaa

SEQ ID NO: 240264 - RNA, 64 nt, Human
auagccgggcggggcuggcuguaagggguugcccccccgccagugccuuggauauuucuggggu

SEQ ID NO: 240265 - RNA, 64 nt, Human
cagagauuugacaccagggagauccuccauagcuggcuuugaggacacggggaccacagccaug

SEQ ID NO: 240266 - RNA, 64 nt, Human
gacaaagaucuugccuuacagacuuuacaggcuuggcuuugagauucuguaacugcagacuuca

SEQ ID NO: 240267 - RNA, 64 nt, Human
ggaaccugagccuggcugagauggcuaggcggagggcuuugaaguccaagcagcugaacuggcu

SEQ ID NO: 240268 - RNA, 64 nt, Human
uggcuguguaaauagucucccuaucccacgagggggcuuugauggcccuggagauccuacagua

SEQ ID NO: 240269 - RNA, 64 nt, Human
gucagguuccucgugagaaacagcacacguuagaggcuuugagagaaggccuaguucugucaug

SEQ ID NO: 240270 - RNA, 64 nt, Human
gcuuugagaguaucuuucuucccagccagucaguggcuuugagcccuaucuuccacuacaaaug

SEQ ID NO: 240271 - RNA, 64 nt, Human
agcaaggaucaaugugcugacugcauuggccaauggcuuugauacuucugcuauuuuuuuagac

SEQ ID NO: 240272 - RNA, 64 nt, Human
guacuccaauauuggagagucgcugggggcacagggcuuugaaucaggguaguauccugccuuc

SEQ ID NO: 240273 - RNA, 64 nt, Human
acuagugguggcucugagaaggggaggaccucugggcuuugauuccaucuccuugucuuuuuuc

SEQ ID NO: 240274 - RNA, 64 nt, Human
auccagcuccccuucugaaucagcugggaugacuggcuuugagaaggaagggaagauggaacag

SEQ ID NO: 240275 - RNA, 64 nt, Human
ugugcaccagugcuuuccacacuugacagugguuggcuuugaugaacccucaugcugcaccuuc

SEQ ID NO: 240276 - RNA, 64 nt, Human
uccuccagcaaaagcugaagcagucccagcugcuggcuuugaagaaagagcugauggugcagaa

SEQ ID NO: 240277 - RNA, 64 nt, Human
uuucaaucgaauggagccacugggccccaacacuggcuuugagauuuagagucaaaggguagag

SEQ ID NO: 240278 - RNA, 64 nt, Human
guuugcaaugggcuuaccauccaaauaucccaaaggcuuugaccagcaaccaaguaaaaucagu

SEQ ID NO: 240279 - RNA, 64 nt, Human
uuuuuaaggucucuaucacuuuaaucuggaucaaggcuuugaagcaaugccucucugcauuuuu

SEQ ID NO: 240280 - RNA, 64 nt, Human
cuugggggucgggggggacauuggaaaggagggaccccgccaccccagcagcugaggaggggau

SEQ ID NO: 240281 - RNA, 64 nt, Human
cuccagggggcccugggccucuaugauggacacaccccgccauaugcugccugccucggcuuug

SEQ ID NO: 240282 - RNA, 64 nt, Human
cugugggucugucucaugcucucccuguuccucuccccgccaccccagggccuccaagccaccu

SEQ ID NO: 240283 - RNA, 64 nt, Human
gagaaauguugaauuuaugaagaauagauuuuaaggcuuugaaaaugguuaauuucucaaaaac

SEQ ID NO: 240284 - RNA, 64 nt, Human
cgcugcaggcggagucaccgacucugugcagagaggcuuugagggaugguggaguccggcucug

SEQ ID NO: 240285 - RNA, 64 nt, Human
uugggagagggaaaagugaggugggacuuggaaaggcuuugaacgccaggcugaugguugaggg

SEQ ID NO: 240286 - RNA, 64 nt, Human
aaaacagagaagaggcaauuucaaacauggugguggcuuugaaggagcugucuauucgggguga

SEQ ID NO: 240287 - RNA, 64 nt, Human
caggucugauuugguuaagaauccuaaauggcauggcuuugacaucaagcugggugaauuagaa

SEQ ID NO: 240288 - RNA, 64 nt, Human
gccucuggcuuuccauuggcuuccaacccugcuuggcuuugaugccuucaggguuggggagaca

SEQ ID NO: 240289 - RNA, 64 nt, Human
gauaguaguuaaacugcuaagcuugggcccaggaggcuuugagaaagccuucucuguguacucu

SEQ ID NO: 240290 - RNA, 64 nt, Human
uuuaaucuucauuauagcagaaaugugccaccauggcuuugacauguugguagguauugucuuc

SEQ ID NO: 240291 - RNA, 64 nt, Human
ccccaaccaaguccaccgaaaguccgugaagaaaggcuuugacuuuacccucaugguggcaggu

SEQ ID NO: 240292 - RNA, 64 nt, Human
ccccguggugccugcacacagagugagggaggagggcuuugaaucugggacugugccuggcucc

SEQ ID NO: 240293 - RNA, 64 nt, Human
ugagugacucaucgccaagauuugcuguaaugcaggcuuugaucuguuucaccauggcuucuau

SEQ ID NO: 240294 - RNA, 64 nt, Human
ccgguaccaguguccacagaccgcccaacacagaggcuuugaggcuucucuagaucggaaccuc

SEQ ID NO: 240295 - RNA, 64 nt, Human
aaauguaacugugccaguucuuuccauaauaaaaggcuuugaguuaacucacugaggguaucug

SEQ ID NO: 240296 - RNA, 64 nt, Human
ucacggccucgcucucgccucaccccggcuccugggcuuugauggucuggugccagugccugug

SEQ ID NO: 240297 - RNA, 64 nt, Human
caccaacagagucaacaaggaaacauaauuagagggcuuugaaaugaucuacugaaauaccuaa

SEQ ID NO: 240298 - RNA, 64 nt, Human
auaucccuaccucccaccaccuaguggccaaacaccccgccaggaguucaaugcugggagaggu

SEQ ID NO: 240299 - RNA, 64 nt, Human
cucccaguucgaagcaaacagcuuacugccuaguccccgccaaucccaagggcgggcuggcuga

SEQ ID NO: 240300 - RNA, 64 nt, Human
acagagcaggcuuugugagagaggaccuccaugcccccgccaccuccccacuccagcagauaag

SEQ ID NO: 240301 - RNA, 64 nt, Human
aacugggagguugagccaggagcaggggaacuugggcuuugaggcgagaccuaauucuuagggu

SEQ ID NO: 240302 - RNA, 62 nt, Human
ggcgcacacuguauguaccuauaauaaacccuuuggcuuugacggucuaugguccuuuguuu

SEQ ID NO: 240303 - RNA, 64 nt, Human
ucagagacccugagcuuuagaaagacaaguggguggcuuugauggacgguuuggaggaggcaag

SEQ ID NO: 240304 - RNA, 64 nt, Human
aaggacuaugcaaaugaggaaguaagucagggcgggcuuugagaaggggacccauauccuacag

SEQ ID NO: 240305 - RNA, 64 nt, Human
ugauggacacaccccgccauaugcugccugccucggcuuugaguuccggaagcaccuggggaau

SEQ ID NO: 240306 - RNA, 64 nt, Human
uauucaagggugagcccuuuacuugggauguacaggcuuugagcagugcagggcugcugaguca

SEQ ID NO: 240307 - RNA, 64 nt, Human
guuuuaagcaugaggcauccgcguggcugggagaggcuuugaccauccuuggcucuuccagguu

SEQ ID NO: 240308 - RNA, 64 nt, Human
uuuaucaaaaaucugguuugggaaauaccaaagaggcuuugauugaauucccuuuugacccgug

SEQ ID NO: 240309 - RNA, 64 nt, Human
agggagccccagaauggggugcauuuggugcugaggcuuugaagccaccguauuuuucguuacc

SEQ ID NO: 240310 - RNA, 64 nt, Human
agauggaccucauaaauguaagauaugugggaaaggcuuugauuguuccaguacacugcaaagu

SEQ ID NO: 240311 - RNA, 64 nt, Human
cucuuuuuccccaacagaccugucuucacccuugggcuuugaaagccagacaaagcagcugccc

SEQ ID NO: 240312 - RNA, 64 nt, Human
uggauuaacaucucuaguaaucucuuuugcuaguggcuuugacugcaaauaaguuaaagaauau

SEQ ID NO: 240313 - RNA, 64 nt, Human
ccacugaacaauuugaaugaagacaauguggaauggcuuugagauacaguucaguuuuuauuag

SEQ ID NO: 240314 - RNA, 64 nt, Human
gggauauaguuuaaaacauugguuauauuaccaaggcuuugauugggauguuauauuugagaaa

SEQ ID NO: 240315 - RNA, 64 nt, Human
ugggacucggccucccuucuccgcccccuccccuggcuuugauugcccuguucuguguccccag

SEQ ID NO: 240316 - RNA, 64 nt, Human
cgacuaggccaccccagcccccugacaccccagcccccgccagucaccccuccccgcacacacc

SEQ ID NO: 240317 - RNA, 64 nt, Human
guuucagucccagcuguaggcuuguaaauacccgccccgccaaaccgcauagagaacguggcag

SEQ ID NO: 240318 - RNA, 64 nt, Human
agcuauggacguuaauuugaccgucuacuccaauccccgccaagagacuggcauagcuggacau

SEQ ID NO: 240319 - RNA, 64 nt, Human
gggucucagacagcuuucgugcucaugguggcuuggcuuugacucuccaaagagcaauaaaugc

SEQ ID NO: 240320 - RNA, 64 nt, Human
uuuuuuuuuuuacagcuuuacacacacagaugugggcuuugauuuccaaguaauauaauggaag

SEQ ID NO: 240321 - RNA, 64 nt, Human
agcugagaacguggaaugcagaaugagcccaccuggcuuugaaucugggcccuacuuaacuuau

SEQ ID NO: 240322 - RNA, 64 nt, Human
gccuacucagcagaagugaugacucuuaaaaauuggcuuugaccaaaguucucuuguuuucagg

SEQ ID NO: 240323 - RNA, 64 nt, Human
ccugcauggugggcauggccuggcuuacaccaaaggcuuugacgguuucuccaaguaaggaucu

SEQ ID NO: 240324 - RNA, 64 nt, Human
gcucucugggaagugggcccucagagauuacucuggcuuugacccuuguuuagcugauggucau

SEQ ID NO: 240325 - RNA, 64 nt, Human
ggcucauguuguaugccuuugauaaggccaucuuggcuuugaguagcaguguuccucgucaccc

SEQ ID NO: 240326 - RNA, 64 nt, Human
acuucccauucacaucauuggccugcguugcuggggcuuugaaccaccaccccguacuuuguuu

SEQ ID NO: 240327 - RNA, 64 nt, Human
gcgggggcugcuacacuacaggacacccagcaucggcuuugacugcagacuguucacccacacg

SEQ ID NO: 240328 - RNA, 64 nt, Human
ucucaaguaccccucgugagcugugauuucacugggcuuugaacucuuaggccauuugaggcug

SEQ ID NO: 240329 - RNA, 64 nt, Human
auuguguaaaaagcaaucuguaaaaacaucuccaggcuuugauuuuuguaccauggaaauugua

SEQ ID NO: 240330 - RNA, 64 nt, Human
aguagagacucgguuucaccauguuggucaggcuggcuuugaacuccugaccucaggugaucca

SEQ ID NO: 240331 - RNA, 64 nt, Human
ccucccagcugccccagcaagcucugcccucucuggcuuugacacccucagaagguggggcagg

SEQ ID NO: 240332 - RNA, 64 nt, Human
aaguccuaugguuuuauucauuuaugguuuuacaggcuuugaaguacucagauuugauuuuugc

SEQ ID NO: 240333 - RNA, 64 nt, Human
ucuagucucuaaaugaugacuaaguagugggguuggcuuugaaaacaauguuuuaugcaacaag

SEQ ID NO: 240334 - RNA, 52 nt, Human
uugagcagaugcagaacuagacccccgccacagcagccucugaaguuggaca

SEQ ID NO: 240335 - RNA, 64 nt, Human
uggagggagggcuggcccauaggugcugcuggcuccccgccaccagcugggccucagcccucac

SEQ ID NO: 240336 - RNA, 64 nt, Human
caccgguguguggcccgcucucacccaggcacagccccgccaccauggaucuccguguacacua

SEQ ID NO: 240337 - RNA, 64 nt, Human
ccucccagcugccccagcaagcucugcccucucuggcuuugacacccucagaagauggggcagg

SEQ ID NO: 240338 - RNA, 64 nt, Human
gauguggauucuaguucugauucugucacucauuggcuuugagugacauauuuuuauuuccugg

SEQ ID NO: 240339 - RNA, 64 nt, Human
auuuucuauuggcagugacugauucaugggaaagggcuuugaaggaacuacuucagugcacaca

SEQ ID NO: 240340 - RNA, 64 nt, Human
aggcgucugcuaaguugugugauguaucagcacaggcuuugagacgucuggacccuguccuucc

SEQ ID NO: 240341 - RNA, 64 nt, Human
cuaguggcagagcaaccuagcuagguccuccuugggcuuugaaugcaggagcacccagugcccc

SEQ ID NO: 240342 - RNA, 64 nt, Human
gguggacuucgaguacagcaguuauaacuauaggggcuuugacauugggaaccauuuuugugag

SEQ ID NO: 240343 - RNA, 64 nt, Human
uuggcuuucacuucaucuaaucacugaauugucaggcuuugauugauaauuguagaaauaagua

SEQ ID NO: 240344 - RNA, 64 nt, Human
ggcuguuugccuuuugguccuuuugguuugguuuggcuuugacuaauucugguacugaaaaguu

SEQ ID NO: 240345 - RNA, 64 nt, Human
gacugggcacccucuucuugguuuuuaccagagaggcuuugaauggaagcaggcugagaguagc

SEQ ID NO: 240346 - RNA, 64 nt, Human
aucgugaggagcuguugggugucuugccucuagaggcuuugagaagcucagcugccuuccuggg

SEQ ID NO: 240347 - RNA, 64 nt, Human
auucaagacagaaacauacaguuuccuaaagccuggcuuugaaugcagaagggagcagcuccuc

SEQ ID NO: 240348 - RNA, 64 nt, Human
ucaccauggaggccagcaauacccaucucagcauggcuuugauauucucuacuuccuggccuuu

SEQ ID NO: 240349 - RNA, 64 nt, Human
uacaggaguaggacuggggccuugagagccagugggcuuugaguuuaagcuccaccaacuucaa

SEQ ID NO: 240350 - RNA, 64 nt, Human
uguccuacuguggaugagggaugaacaaggggauggcuuugauccaauggagccugggaggugu

SEQ ID NO: 240351 - RNA, 64 nt, Human
ccaagaaaacaaguaaacaugcagcugccgacgaggcuuugaaaauucuucaaaaaacacagcc

SEQ ID NO: 240352 - RNA, 64 nt, Human
gcagugugagucuggccugcgugcggugaggaggccccgccaagagacugguggacaucugacu

SEQ ID NO: 240353 - RNA, 64 nt, Human
ucuguucagaugacagcgaccgccuuuucauuccccccgccaccuguacucacccucacgcucu

SEQ ID NO: 240354 - RNA, 64 nt, Human
cuaacacaguggagaaccgaaaccccccccccccccccgccacccucucggacaguuauucauu

SEQ ID NO: 240355 - RNA, 64 nt, Human
gcucacugaugcaucucucaucaaugcuacggaaggcuuugauucaucagucucgggcucuugg

SEQ ID NO: 240356 - RNA, 64 nt, Human
ggcuggaaagauggacagaggcccaaugggugaaggcuuugaagagcacacagaagccccuggc

SEQ ID NO: 240357 - RNA, 64 nt, Human; identical to SEQ ID NO: 240345

SEQ ID NO: 240358 - RNA, 64 nt, Human
cucucaaaaagaaaaaagaagacacaagagagguggcuuugaguggguuuccuuuccuccccua

SEQ ID NO: 240359 - RNA, 64 nt, Human
ccugagagcggcugagggcugccucacugcaaauccuccccacagcgucagugaaagucguccu

SEQ ID NO: 240360 - RNA, 64 nt, Human
acccgcaacggaguggggguggcggccgccccacccuccccacccggggaagccaucacagcuc

SEQ ID NO: 240361 - RNA, 64 nt, Human
aacccugucccugcguguggccacuccucagcauccuccccacccaccaugguucauuccgacu

SEQ ID NO: 240362 - RNA, 64 nt, Human
uuggcuggcugggccccucagcugcugggccccaccuccccacugcacccagggggcaacucca

SEQ ID NO: 240363 - RNA, 64 nt, Human
ggcuuuuagccgcugcguucugggagcuccucccccuccccagaaggccaagggaugugggggc

SEQ ID NO: 240364 - RNA, 64 nt, Human
cccuucugccagggccuugguugcuggggcagggccuccccacugggggucuuccuccaccucc

SEQ ID NO: 240365 - RNA, 64 nt, Human
aggcugaaggcagcgaagccucggggcccaagccccuccccagcccccucucccggacagacgc

SEQ ID NO: 240366 - RNA, 64 nt, Human
cccagagaaccugcuuuacuuugcccagggacuuccuccccaugugaacauggggaacuucggg

SEQ ID NO: 240367 - RNA, 64 nt, Human
gggcacugcccucccucacccauauugcaugcccccccgccauucccuuacaccuaccccaccu

SEQ ID NO: 240368 - RNA, 64 nt, Human
cugcaugcccaguauugccaaggaccgggcccugccccgccacccuaccucccaccccagcagc

SEQ ID NO: 240369 - RNA, 64 nt, Human
gccuagggcuugggcuguuugugugauaccggccccccgccagacaauagccuuugcugacacc

SEQ ID NO: 240370 - RNA, 64 nt, Human
aauggccugccuugaagccacugaagcugggauuccuccccauuagagucagccuucccccucc

SEQ ID NO: 240371 - RNA, 64 nt, Human
augaagcauaccccggccucucaguucuugagggccuccccaccgcagcagcaaggaaagcuca

SEQ ID NO: 240372 - RNA, 64 nt, Human
gacccaaggggcuaauuggaggcacgaggggaccccuccccagggccuuuuccuccucugcguc

SEQ ID NO: 240373 - RNA, 51 nt, Human
ccaacauccucugcuccuaggccuccccagcgagcuccucccagaccaaga

SEQ ID NO: 240374 - RNA, 64 nt, Human
ccaacagcaccauccucuguagcagacaggccucccuccccacaggcccgcugcugcggccucu

SEQ ID NO: 240375 - RNA, 64 nt, Human
ggaguggcgagcccagcugcccagcccugcccccccuccccauagccagcacagcuaucccgcg

SEQ ID NO: 240376 - RNA, 64 nt, Human
gucagaacacgaucugggggggggauccugucuuccuccccaccccaccccacucuuacccaau

SEQ ID NO: 240377 - RNA, 64 nt, Human
agggagcccacccugacccacccccacugcacccccuccccauggguucucuccuuccucugaa

SEQ ID NO: 240378 - RNA, 64 nt, Human
guuucuguguguccguuugagugucugcgccccgccuccccauacuuccugggaugauguguga

SEQ ID NO: 240379 - RNA, 64 nt, Human
ucucuuucauuaaggucuugaagucaggcugcccccuccccagcccccaguucucuccccaccc

SEQ ID NO: 240380 - RNA, 64 nt, Human
gcaucaggagaaaggcugggucuugggaccuuguccuccccaguuggccuacuguuacacauua

SEQ ID NO: 240381 - RNA, 64 nt, Human
cacucagaugggaaagucccuuacucggccccucccuccccagcagccccaagcuuuacacugg

SEQ ID NO: 240382 - RNA, 64 nt, Human
gacagccccagacccuuuugugucccaugcccacccuccccacgcugcagugggcuugugugug

SEQ ID NO: 240383 - RNA, 64 nt, Human
caauucugaauagccaguggggcacacugacuguccuccccaggggaacugcagcgcccuccuc

SEQ ID NO: 240384 - RNA, 64 nt, Human
cugacuguccuccccaggggaacugcagcgcccuccuccccacugcccccugcagccccugaga

SEQ ID NO: 240385 - RNA, 64 nt, Human
ccugcacgccgccacccccuccccgcagcccucaccccgccaggagccacugcucucccccuug

SEQ ID NO: 240386 - RNA, 64 nt, Human
uccccuguugccucucccgccccugccccccccgccccgccaaaagccgagggggugcuggcag

SEQ ID NO: 240387 - RNA, 64 nt, Human
ccacaagcucugagcccugggcacccaccuccacccccgccacggccacccuccuucccgccgc

SEQ ID NO: 240388 - RNA, 64 nt, Human
ccccugcagccccugagauauuuugcucacuaucccuccccacuugcuucccugauaugugcuc

SEQ ID NO: 240389 - RNA, 64 nt, Human
ggugccucucggcucagugacagccaaccugcccccuccccacaccaaucagccaggcugagcc

SEQ ID NO: 240390 - RNA, 64 nt, Human
uguggagcugaaggcacagucugccccacccccaccuccccacugugguuagucagaggcaucc

SEQ ID NO: 240391 - RNA, 64 nt, Human
guaaugagugucuugcagaauuuggcauagacagccuccccauugacuuggaagcugaacaaca

SEQ ID NO: 240392 - RNA, 64 nt, Human
cucccucagccucaggcaguggugcucccaucuuccuccccacaacugugcucaggcuggugcc

SEQ ID NO: 240393 - RNA, 64 nt, Human
ggcaucuucccugaagcccccaaucuggccccccccuccccagacuuccuccccaaaacacccc

SEQ ID NO: 240394 - RNA, 64 nt, Human
aagcccccaaucuggccccccccuccccagacuuccuccccaaaacaccccagcuuucuggcuu

SEQ ID NO: 240395 - RNA, 64 nt, Human
uugccauacagccccaggcaaugggcacagccuuccuccccagaggacccggccgaccucagcg

SEQ ID NO: 240396 - RNA, 64 nt, Human
ccuucguuuccuaggacucaguuccucgaccaccccuccccauccucagccuggauggaacccc

SEQ ID NO: 240397 - RNA, 64 nt, Human
ucuguuugguuugacacccagccucuucccuggcccuccccagagaacuuuggguaccuggugg

SEQ ID NO: 240398 - RNA, 64 nt, Human
agauggcucaggcugugaccucccugggcaccacccuccccaggcuggguguggaggaguuggg

SEQ ID NO: 240399 - RNA, 64 nt, Human
cuccuugccuggaacucacucacucugggugccuccuccccagguggaggugccaggaagcucc

SEQ ID NO: 240400 - RNA, 64 nt, Human
cuugucaguaucugcucugaggaaccaggucccaccuccccacaaggcaaaucuagacccauua

SEQ ID NO: 240401 - RNA, 64 nt, Human
gucaaauagaugaucuuugacacgauuagacacuccuccccacaaaggcuuugaaaucauaagg

SEQ ID NO: 240402 - RNA, 64 nt, Human
auuagggcuuagccaucucccuguccccagcaccccuccccagcccacagugguggccucugcc

SEQ ID NO: 240403 - RNA, 64 nt, Human
cagcaugccgcguuaggcucgccauggaaauacgcgcggggagcggccgcuucaaaggcggcac

SEQ ID NO: 240404 - RNA, 64 nt, Human
ccaugagguuuuccuccccaggcaggcaggaggccgcggggagcacguggaaaguuggcugcug

SEQ ID NO: 240405 - RNA, 64 nt, Human
ccaccgcgccccucugcgccccagcgacgcggcccgcggggacgucgcuguccguccugcucgc

SEQ ID NO: 240406 - RNA, 64 nt, Human
aguccugacaguguuugaaaagggccgccugcccccuccccacugugcuuuugaugccuuugga

SEQ ID NO: 240407 - RNA, 64 nt, Human
aggugguaaauggcagaaaggacauucccccuccccuccccaggugaccugcucucuuuccugg

SEQ ID NO: 240408 - RNA, 64 nt, Human
cuggaaaucuccagguuaauuucuaucucugaucccuccccaacccacuccauauuugggucau

SEQ ID NO: 240409 - RNA, 64 nt, Human
gcugcccugggaacuccaaagcacacaccuacuuccuccccagcucacgcugcuguauucugug

SEQ ID NO: 240410 - RNA, 64 nt, Human
ggccgggcugggcuguggauuccugauccccuccccuccccaugcucuccucccucagccuugc

SEQ ID NO: 240411 - RNA, 64 nt, Human
cucggcgccucccaccuucacccucucggggaugccuccccaagaggguaguuaggggugggga

SEQ ID NO: 240412 - RNA, 64 nt, Human
guuuauuggcagacucccuuuugaccucccuuugccuccccaucuggugcuuucuugcaucuac

SEQ ID NO: 240413 - RNA, 64 nt, Human
cccugugggccuuuucccuggggcagcaccuugcccuccccaggggaucacucacuugucuucu

SEQ ID NO: 240414 - RNA, 64 nt, Human
ggcagugguuuuggcaaacgcuaaagagcccuugccuccccauuucccaucugcaccccuucuc

SEQ ID NO: 240415 - RNA, 64 nt, Human
uugccuccccauuucccaucugcaccccuucucuccuccccaaaucaauacacuaguuguuucu

SEQ ID NO: 240416 - RNA, 64 nt, Human
uuugcucucugucaggugugauaaaauguugaacccuccccaccaccacuuuuuuuuuuuuaaa

SEQ ID NO: 240417 - RNA, 64 nt, Human
auggauugcaguccccagucaccucuucugccagccuccccacauauggcacaacugucuaaug

SEQ ID NO: 240418 - RNA, 64 nt, Human
agugaccccagccuccugccuaccccaagaugccccuccccacccugaccgugcuaacugugug

SEQ ID NO: 240419 - RNA, 64 nt, Human
agccuguacauccaucccaggacacagcccagccccuccccacaccauacaagguaucagaaaa

SEQ ID NO: 240420 - RNA, 64 nt, Human
uaccaucuucaucuucacacauucacugugcuuuccuccccauagugggagcugucaucaccaa

SEQ ID NO: 240421 - RNA, 64 nt, Human; identical to SEQ ID NO: 142951

SEQ ID NO: 240422 - RNA, 64 nt, Human; identical to SEQ ID NO: 142956

SEQ ID NO: 240423 - RNA, 64 nt, Human; identical to SEQ ID NO: 142961

SEQ ID NO: 240424 - RNA, 58 nt, Human
uggaucauccuccuuuuuaaacuucucuccuccccacccuaccugccccccuggcuug

SEQ ID NO: 240425 - RNA, 64 nt, Human
uuagccaagagcacagacuuggauuccuucugucccuccccaccuuucucucccaaugaagaaa

SEQ ID NO: 240426 - RNA, 64 nt, Human
ugaacaugccccugggccaagauggggcuucaccccuccccagaguaagagcuggggcugacag

SEQ ID NO: 240427 - RNA, 64 nt, Human
cuucuaagacaagcaucuccugcccucucuccuuccuccccaucucucgcacgcagucuagaga

SEQ ID NO: 240428 - RNA, 64 nt, Human
ccaaaguaauugaaaguauuuugugcaagucauaccuccccauuuaugucugguguuaagauua

SEQ ID NO: 240429 - RNA, 64 nt, Human
cccaaagcauuacagagaacagcagcaucauugcccuccccagcugaaaaacaaguuggcuaga

SEQ ID NO: 240430 - RNA, 64 nt, Human
uccaggggugcaggaguaacuggggcugggccagccuccccacuuacaaggcugcuuuccagga

SEQ ID NO: 240431 - RNA, 64 nt, Human
caggcugcaggcacugcagggcagcggguauucuccuccccaccuaagucucugggaagaagug

SEQ ID NO: 240432 - RNA, 64 nt, Human
gccaucguccugggacucggagacuauggccucgccuccccacccuccucuuggaauuacaagc

SEQ ID NO: 240433 - RNA, 64 nt, Human
uguacauagagaucuauuuuuucuaaaacauuccccuccccacuccucucccacagagugcugg

SEQ ID NO: 240434 - RNA, 64 nt, Human
uuccucuugucaagguuugggaaugucaaagcccccuccccacacagggccuuuccugucccuu

SEQ ID NO: 240435 - RNA, 55 nt, Human
ccuuugcuucacacguguaaauaucccuccccauucuucucuuccccucucuucc

SEQ ID NO: 240436 - RNA, 64 nt, Human
aaaaaaauccuucaagggagcugcuuggaaguggccuccccaggugccuuuggagagaacuguu

SEQ ID NO: 240437 - RNA, 64 nt, Human
aaucuucaccccacuuccucuacccccagguucuccuccccacagccaguccccuuuccuggau

SEQ ID NO: 240438 - RNA, 64 nt, Human
gaacuccuggccucaagugauccucccaccuuggccuccccagagugcugggauuacacacgug

SEQ ID NO: 240439 - RNA, 64 nt, Human
ccauguggauuuuggggggucccuuuugugucucccccgccauucaaggacuccucucuuucuu

SEQ ID NO: 240440 - RNA, 64 nt, Human
ccaccggugccaaacccagccccugcggccgucaccccgccagccuacacugccagccgccacc

SEQ ID NO: 240441 - RNA, 64 nt, Human
auccaguucaccuacagagguagagcacucacgcccccgccauugagaauaagguuccauugcg

SEQ ID NO: 240442 - RNA, 64 nt, Human
ccugcaguucucagaccgaaggugcugccuucauccuccccaccuaaugcauuuuugaaaccaa

SEQ ID NO: 240443 - RNA, 64 nt, Human
gccacggcuguuucuucuuugugcuucccgugugccuccccaguagcccucaccugcauaccaa

SEQ ID NO: 240444 - RNA, 64 nt, Human
ccaggcugaccucagcucccgaaggcucgcacagccuccccauccuuccuucccagcccuugug

SEQ ID NO: 240445 - RNA, 64 nt, Human
cugcccugcccaccucaggcccccacccuccacuccuccccacgguacugugaacgucguguga

SEQ ID NO: 240446 - RNA, 64 nt, Human
ggccguccuccggggccaccgaccgcagccagccccuccccaggagcuccccaggccgcagggg

SEQ ID NO: 240447 - RNA, 64 nt, Human
uaccugugucuucgugugccugccuucccucccuccuccccaccgggccggacuguacagagcc

SEQ ID NO: 240448 - RNA, 64 nt, Human
cugugaggagccacuaaaccuuuccgugccuagaccuccccaucuguggaauggggucaauacc

SEQ ID NO: 240449 - RNA, 64 nt, Human
ccccgcuuuggagaggcugagcuggagccauuggccuccccaggggcuuuccacccacacugca

SEQ ID NO: 240450 - RNA, 61 nt, Human
cgcugggcuccgcguccuaggaccgccggcgccuccccacggacgccaggcaggccaggcc

SEQ ID NO: 240451 - RNA, 64 nt, Human
agcccacccacagcuguugcugaagucaggccucccuccccagcacugguaucugaguaacggc

SEQ ID NO: 240452 - RNA, 64 nt, Human
caacucugauguggaaugcaguccucaucuccagccuccccaccccagugggaacugugcaaag

SEQ ID NO: 240453 - RNA, 64 nt, Human
ggaauuuuccaaaacagccuguucucuccucucuccuccccagagcacccccugccaucagggg

SEQ ID NO: 240454 - RNA, 64 nt, Human
agcucugagcacgggcucuucccgccggguccucccuccccagaccccagagggagaggcccac

SEQ ID NO: 240455 - RNA, 64 nt, Human
uuccccucauucuaccucucuaaggcuaugcaacccuccccacgucuuccagcugggggauggg

SEQ ID NO: 240456 - RNA, 64 nt, Human
acaccagcccgugggcugcccccugccuccccacccuccccauggcccacccaucugggcuguc

SEQ ID NO: 240457 - RNA, 64 nt, Human
gcagcgagauugcucugcagccagugagggagguccccgccaugccggcuggaagaagaaccuc

SEQ ID NO: 240458 - RNA, 64 nt, Human
cgccgggggucccgcagcauccugugagcauuuccgcggggaagcugagcacgugaagcucgcu

SEQ ID NO: 240459 - RNA, 64 nt, Human
ucagaggacccaccugggccaaggacuccaaagccgcggggacaccgggaagugcagcgggcca

SEQ ID NO: 240460 - RNA, 64 nt, Human
ugaagaccaacaccagcccgugggcugcccccugccuccccacccuccccauggcccacccauc

SEQ ID NO: 240461 - RNA, 64 nt, Human
accaggcaggcaaccccaagggcaccaaccagggccuccccaaagccugggccuuuguggcugc

SEQ ID NO: 240462 - RNA, 64 nt, Human
uacucaugcggauacccauuggaaugacaucaucccuccccaaccccagcucucucugcucacc

SEQ ID NO: 240463 - RNA, 64 nt, Human
aaacuggcuuuaggaugguucugacuuuguucucccuccccaaguguucucaaccuccauucug

SEQ ID NO: 240464 - RNA, 64 nt, Human
ccaacaccaucucuuccuaccucucagccuucucccuccccagggccacuuguugaagucugag

SEQ ID NO: 240465 - RNA, 64 nt, Human
cgccucccgggaagcauccuccccaccagagcugccuccccaauccauuuggcagaacugcugg

SEQ ID NO: 240466 - RNA, 64 nt, Human
cacagcuccuccccugccgccucccgggaagcauccuccccaccagagcugccuccccaaucca

SEQ ID NO: 240467 - RNA, 64 nt, Human
uauucggugcagaacucggcaaggggcagcuuacccuccccagaacccaggaucauccugucug

SEQ ID NO: 240468 - RNA, 64 nt, Human
aaacuccugaacucagguaaucugccugccucggccuccccaagugcuaggauuacagauguga

SEQ ID NO: 240469 - RNA, 64 nt, Human
cugggcucuuacagagccuccaugagucaagcccccuccccacaccuggacuccagaauucacc

SEQ ID NO: 240470 - RNA, 64 nt, Human
ccccgggcuguucggggccggaucccggcagcggccuccccaaagcgacagguaacgcagugcg

SEQ ID NO: 240471 - RNA, 64 nt, Human
agauucucccaccuccucccuuugauggaaccacccuccccagaggcugcauugaggagacucc

SEQ ID NO: 240472 - RNA, 64 nt, Human
cgucuuacagucgccauccuccaggcguguggucccuccccauugggugcacagugcagagggg

SEQ ID NO: 240473 - RNA, 64 nt, Human
ccauccacaggcacagcccggcagagugguuccaccuccccaugggcccaaggaugcgccucuc

SEQ ID NO: 240474 - RNA, 64 nt, Human
uuaaaaugccaauaauaaaugcccucuucucgugccuccccaccaccacuuaccacucgugcau

SEQ ID NO: 240475 - RNA, 64 nt, Human
uugauccuguccccuuuggcaugcgggaagcagccgcggggagguaaugaauugucugugguau

SEQ ID NO: 240476 - RNA, 64 nt, Human
gacgcugcccacccgcgagggcugaaaaccccgccgcggggaggaccguccauccccuuccccc

SEQ ID NO: 240477 - RNA, 64 nt, Human
ggccuuagggcccgugggggacgcggccccgcgccgcggggagggucugccuccccuuccucgc

SEQ ID NO: 240478 - RNA, 64 nt, Human
uccacuauuccaccucucuaaaagaagguaauuuccuccccaaauugaccuuggggaauuauuc

SEQ ID NO: 240479 - RNA, 64 nt, Human
uuagcauuuguucuucaucuccugucucuucaagccuccccacuccaccgugccgaaggagcuc

SEQ ID NO: 240480 - RNA, 64 nt, Human
ggcauccuggcuggcuguguccucuccagcuuucccuccccagaguucuugcacccucauuccc

SEQ ID NO: 240481 - RNA, 64 nt, Human
auguggucaggacugagcaggggacuggcccuccccuccccacagcugcucuacagggaccacg

SEQ ID NO: 240482 - RNA, 64 nt, Human
ccacauccacucaaugugaacucuacuaccacgaccuccccauauuccucacuucuccaucacc

SEQ ID NO: 240483 - RNA, 64 nt, Human
uaaaaacauaaaacacuggagguuaguggaggccccuccccaagcagggagccugggaugggca

SEQ ID NO: 240484 - RNA, 64 nt, Human
gagugcaggaguggacucuccacugaugggucucccuccccauccugguuuccaccccgggcug

SEQ ID NO: 240485 - RNA, 64 nt, Human
uuagucagaaugugagcagauggcuaaguucucuccuccccagaauggauuaacagcugcgugg

SEQ ID NO: 240486 - RNA, 64 nt, Human
gaagcaaacagugucccuucuggcuguguuggagccuccccaguaaccaccuauuuauuuuacc

SEQ ID NO: 240487 - RNA, 64 nt, Human
ucucccaugaugggguggagucagcccugcuuccccuccccaccagcagggggcgcacuggugu

SEQ ID NO: 240488 - RNA, 64 nt, Human
agaguagaagcuggacccuggaguuaccaacacuccuccccaacaguucuuagcaccccgcagg

SEQ ID NO: 240489 - RNA, 64 nt, Human
aaaguuuuauccuugauagucuaguuacuaugacccuccccacuuuuuuaaaaccagaaaaagg

SEQ ID NO: 240490 - RNA, 64 nt, Human
uaagagaggugacaacccacccagacugcaguucccuccccacccucuacccaguauacgaagc

SEQ ID NO: 240491 - RNA, 64 nt, Human
cuacaacaguauucuucucuguuccucuuugccuccuccccagaugggccucucagcucccaca

SEQ ID NO: 240492 - RNA, 64 nt, Human
ugugaaaccccugcuggaaaccugagugacccucccuccccaccaagaguccacagaccuuuca

SEQ ID NO: 240493 - RNA, 64 nt, Human
uuccgcgagagccuuguuccuggaggcaggagcgccccgccauccuggguacccgcggguccgc

SEQ ID NO: 240494 - RNA, 64 nt, Human
gugcuacuuacaucucccucccuuggcugaggucccccgccacagccuggacccuucccucaga

SEQ ID NO: 240495 - RNA, 64 nt, Human; identical to SEQ ID NO: 142966

SEQ ID NO: 240496 - RNA, 64 nt, Human
aaggggagagagaagcaguagauacacuccuuauccuccccaaauuuuaagcucuauuucugug

SEQ ID NO: 240497 - RNA, 64 nt, Human
ggacaacaccuuuggggaaaagggugggggucagccuccccaaaaucacauggauuccccaagu

SEQ ID NO: 240498 - RNA, 63 nt, Human
acaagugcucccugggcugaggacccuuucuugccuccccaccccggaagcugaaccugaggg

SEQ ID NO: 240499 - RNA, 64 nt, Human
gaagacggcuaacccuggaguaucacccuuccucccuccccaggcaccacuggaccaauuaccu

SEQ ID NO: 240500 - RNA, 64 nt, Human
cucuggcccagccuacccuuguaccccaucccuuccuccccagucuacguucuccagcccacac

SEQ ID NO: 240501 - RNA, 64 nt, Human
aaaguaaccacuggagucaucuaauggcccucccccuccccagguuucccacagcuuucaggga

SEQ ID NO: 240502 - RNA, 64 nt, Human
gagcccagaucacccauuccggguucacuccccgccuccccaagucagcaguccuagccccaaa

SEQ ID NO: 240503 - RNA, 64 nt, Human
ggucuauugguauugagccuggggcagagcagcuccuccccaacuucugucccagccuugaagg

SEQ ID NO: 240504 - RNA, 64 nt, Human
augagccggacagccuggcugucauugcuuucuuccuccccauuuggacccuucucugcccuua

SEQ ID NO: 240505 - RNA, 64 nt, Human
uagaucaauccauacguguaugugcuggucucauccuccccaguuuauauuuuugugcaaauga

SEQ ID NO: 240506 - RNA, 64 nt, Human
ccgugcacugugccagaugccucaggaggagaacccuccccaguguacugugaaggaugacaca

SEQ ID NO: 240507 - RNA, 64 nt, Human
ugugaauuggaccauccuauuuaacuggcuucagccuccccaccuucuucagccaccucucuuu

SEQ ID NO: 240508 - RNA, 64 nt, Human
ccuugggaccccuaguuccacugcacauggcccuccuccccacccucaugacugggaaggaagc

SEQ ID NO: 240509 - RNA, 64 nt, Human
uccuugccgacuugauguugcuguaccagggcuuccuccccagaggugcagcuugcguuuugag

SEQ ID NO: 240510 - RNA, 64 nt, Human
aaagugcugggauuacagcgugagcuaccuggccccuccccaaauuuuaacaucagaucucaac

SEQ ID NO: 240511 - RNA, 64 nt, Human; identical to SEQ ID NO: 142971

SEQ ID NO: 240512 - RNA, 62 nt, Human
acgcaggcucagcugcuccgaagcaccugccagcaccgcacaguacaguuucagaggacagc

SEQ ID NO: 240513 - RNA, 62 nt, Human
ccauguaagggacucugcaagcuuguuguucagcaccgcaguguuaccucuuggcaagcugu

SEQ ID NO: 240514 - RNA, 64 nt, Human
cccuagggcucagaggggccucaucuuccccagcccuccccaccugcucaccaauuccacuucc

SEQ ID NO: 240515 - RNA, 64 nt, Human
cccuccugccuguuccuggcucccagcucccgccccuccccagggcccccaccuccacggccca

SEQ ID NO: 240516 - RNA, 64 nt, Human
ccccugcacugacucacuccccgacauauccggaccuccccaaguccagaaggaaggaauggag

SEQ ID NO: 240517 - RNA, 64 nt, Human
gcauccccuuagcaucuuucuagccaaugagcccccuccccaggaggagggauggccugacuga

SEQ ID NO: 240518 - RNA, 64 nt, Human
aaggaacaggagggacuuuggcuagagccuccugccuccccaucuucucucugcccagaggcuc

SEQ ID NO: 240519 - RNA, 64 nt, Human
uugcauucauuuucuacccuuuaugacuuggaugccuccccaccuccauuuccccucuucugag

SEQ ID NO: 240520 - RNA, 64 nt, Human
ccaugacauuaauagaaaacccuucuuucccaccccuccccaucuugacauuuucuuuuuuagg

SEQ ID NO: 240521 - RNA, 64 nt, Human
agugcugccaagcacagccuuauuucugccggggccuccccaccggagagcccagggggccggc

SEQ ID NO: 240522 - RNA, 64 nt, Human
uuugccuucugccaugauucuaaguuuccugaggccuccccagaagcagaagcauguaaagccc

SEQ ID NO: 240523 - RNA, 64 nt, Human
acccgccccccagccucccgcucugggcgagccuccuccccagcccccaccccugggaugcgaa

SEQ ID NO: 240524 - RNA, 64 nt, Human
ucccugccuccgggaaguguggcucucccccaacccuccccaccguccccccuucacuaaacau

SEQ ID NO: 240525 - RNA, 64 nt, Human
accaaaggcugucaugugucucgaaaucagcagcccuccccaucccaaucccaggcagcuugug

SEQ ID NO: 240526 - RNA, 64 nt, Human
ugcgucucccugcaugcugcuuuauuugcuucucccuccccaaccaccucaugguauauuuaag

SEQ ID NO: 240527 - RNA, 64 nt, Human
ccuggaccccauugucugucugcuucccaccugcccuccccacccccugccccucgggcaccag

SEQ ID NO: 240528 - RNA, 63 nt, Human
ccacucugcuggcucuguaacccagugcaccucccuccccagcuccggaggggguccuccucg

SEQ ID NO: 240529 - RNA, 64 nt, Human
aauugugggaaaacuauaaacucucuuguuacagccccgccaccccuugcuguguguauauaua

SEQ ID NO: 240530 - RNA, 62 nt, Human
acaccacaccccacaccgcacugcaccgcaccgcaccgcaccguaccucgccacaucucacc

SEQ ID NO: 240531 - RNA, 62 nt, Human
cccgaagcucggagccagggcucgcgagggcagcaccgcagccucugccccagccccggcca

SEQ ID NO: 240532 - RNA, 64 nt, Human
ggccuggaccuuccccagaugcugccaggcagccccuccccaagccucaaagaagcauuugcug

SEQ ID NO: 240533 - RNA, 64 nt, Human
ccucugcuguccuuacucaacagugguccucaucccuccccaccucccacugcuuccugcaagg

SEQ ID NO: 240534 - RNA, 64 nt, Human
cucaggcaguaguuuauucaucauuugguaagccccuccccacacuccucuaauuuaaacaagu

SEQ ID NO: 240535 - RNA, 64 nt, Human
ucugaaauguucuuaaauuuuguaggauuuuuuuccuccccaccuucaaugacuucuaauuuau

SEQ ID NO: 240536 - RNA, 64 nt, Human
aguuggaguuguugaaaccaagguguccaugaucccuccccacugaccuuuucuaagaaaauuc

SEQ ID NO: 240537 - RNA, 64 nt, Human
gagggcccggggcccccugcccacccugcgggggccuccccagugggcccacaugaagagaggg

SEQ ID NO: 240538 - RNA, 64 nt, Human
caggagaguagcugccuguugcaccugcuccacaccuccccacagccucccugcaggugcugug

SEQ ID NO: 240539 - RNA, 64 nt, Human
guccuggaaaucacagcaacccauugaaaacugcccuccccaccagaacgugcuacguucuuuc

SEQ ID NO: 240540 - RNA, 64 nt, Human
ugcuacccgcugcugccugccggcugacacacugccuccccagccuuccugcuaggccacccuc

SEQ ID NO: 240541 - RNA, 64 nt, Human
gagcucuuaggcacaugacggucauuccugacauccuccccagcucaagucuauucuuaccaua

SEQ ID NO: 240542 - RNA, 64 nt, Human
acccagcaagaggcaucugcccuuuccccagccaccuccccagcaagcaaccugaaaucucagc

SEQ ID NO: 240543 - RNA, 64 nt, Human
ugaguuugcuucuuuauuucugucuauacuucccccuccccagccccaaacaugcccaucacau

SEQ ID NO: 240544 - RNA, 64 nt, Human
ccagccagccccucacagcucuuccccagcuccgccuccccacacuccuccuugcgcacccacu

SEQ ID NO: 240545 - RNA, 64 nt, Human
augagaaaaaacaccaccaaaugacaagucacacccuccccauuaguauccuguuaggggaaaa

SEQ ID NO: 240546 - RNA, 64 nt, Human
cugguuccuuucuccccaugccugccuucugcucccuccccagcugguuugggcucaaauuguc

SEQ ID NO: 240547 - RNA, 62 nt, Human
cacagaggacuuacaccauacaaaaauauugggcaccgcagugccagagaagaugcuugagg

SEQ ID NO: 240548 - RNA, 64 nt, Human
augguagcgugagcauuaggugacguggcuagcggaggacuacccuugcucacugacuuccugu

SEQ ID NO: 240549 - RNA, 59 nt, Human
agggggagacugcgguaugagccccggccccuccccaccuuucccaccccagcccucuu

SEQ ID NO: 240550 - RNA, 64 nt, Human
caaaggacccuuucgacaagacguuccgccuuccccuccccagcaccaaagaaugccagccuau

SEQ ID NO: 240551 - RNA, 64 nt, Human
aggguguuuugucaaagcagguuauucagugauuccuccccaccauucuuaagaacguuaaaua

SEQ ID NO: 240552 - RNA, 64 nt, Human
aucccgcuuccuuauccuuagcuuuuuuguugcuccuccccacugccccuuuuaauuuauuugg

SEQ ID NO: 240553 - RNA, 64 nt, Human
gggauacugcagggccaggacugagccccgcagaccuccccagccccuagcccaggagagagaa

SEQ ID NO: 240554 - RNA, 64 nt, Human
gagagcggucucaggcuggugggaggggcgcccaccuccccacgcccuccccuccccugcugca

SEQ ID NO: 240555 - RNA, 64 nt, Human
ccaggccugccggcccggacccgucccagccuccccuccccaccccaugcagcccccaggggga

SEQ ID NO: 240556 - RNA, 64 nt, Human
cagggggauagcccaugggccccuguggacccucccuccccaaguggacacauggcugugcagg

SEQ ID NO: 240557 - RNA, 64 nt, Human
ccucccuccuuucacuucucugccuaugggcuacccuccccaccccacuucuaucucaauaaag

SEQ ID NO: 240558 - RNA, 64 nt, Human
gugaguuccagaccugcccguccccucaccagcgccuccccacccuguugguacuguuccagaa

SEQ ID NO: 240559 - RNA, 64 nt, Human
cugggugcaggacacuggucgagagccaaaggucccuccccagacaucuggacacugggcauag

SEQ ID NO: 240560 - RNA, 64 nt, Human
gggcauagauuucucaagaaggaagacuccccugccuccccagggccucugcucuccugggaga

SEQ ID NO: 240561 - RNA, 64 nt, Human
caguggugaagcggaaacacuuagcuuuauccacccuccccacugggaacugggcacgccuguu

SEQ ID NO: 240562 - RNA, 64 nt, Human
gaguacuuucugcaggggccuguuaaggacgaggccuccccagcccugcccggugcaggaggug

SEQ ID NO: 240563 - RNA, 64 nt, Human
ccuccuugugucuggcagagaccuguggaccuggccuccccacucccagcucucuugcacugca

SEQ ID NO: 240564 - RNA, 64 nt, Human
caccucaggguuauauuucccucuccccuucccuccccgccaagagcucugccaggggcgggca

SEQ ID NO: 240565 - RNA, 64 nt, Human
gacugggccuccccggcagcaagaccccggcacuccccgccaggcccagggugggguggauggg

SEQ ID NO: 240566 - RNA, 64 nt, Human
ccagcuaagcccuuggccuccccgccccacccgcccccgccaccccuccacgccagggucccuc

SEQ ID NO: 240567 - RNA, 64 nt, Human
ggaaccuucuguagcuaagagggaauccuggcccccuccccagaagccauuugucaauaaacca

SEQ ID NO: 240568 - RNA, 64 nt, Human
gccccugcacccaagggacccugucccucgguggccuccccaggccccuggacacgacaguucu

SEQ ID NO: 240569 - RNA, 64 nt, Human
gcaggaggcccucagcacccgaacacaucuuccuccuccccacccgagccuggagcacucuaac

SEQ ID NO: 240570 - RNA, 64 nt, Human
ggcaucuuuccuggagccccgagccagcccugucccuccccagugcagcauggcacucaggaga

SEQ ID NO: 240571 - RNA, 64 nt, Human
aaucaauauuuugaagugauacacagaugucuuuccuccccacaaacuuuuuuaaacaaaaaac

SEQ ID NO: 240572 - RNA, 64 nt, Human
acugcaggcccuggccuccccugccaccaggccaccuccccagcauuccagccccucuggucgc

SEQ ID NO: 240573 - RNA, 64 nt, Human
ugaagggaagggacugggcccugcagggucagaaccuccccacccccaggggaggccaggcaga

SEQ ID NO: 240574 - RNA, 64 nt, Human
ucaggcccaggcuccagaggaagacuccugaaacccuccccaggucuuccaaguacaggauuga

SEQ ID NO: 240575 - RNA, 64 nt, Human
ugugccuaugccugggggaggucaguaggggcccccuccccacauggcccucgcucugucuaug

SEQ ID NO: 240576 - RNA, 64 nt, Human
cagugaucaugccaggccuggaccuuuaggccugccuccccaggacuccuuagaucccacucuu

SEQ ID NO: 240577 - RNA, 64 nt, Human
cagggcuagaauggggauuucagguuucuaugagccuccccauuaccccuaaaguagaacauuu

SEQ ID NO: 240578 - RNA, 64 nt, Human
gauuccaggcuauauauuucuuuuuaaugggccaccuccccacaacagaauucugcccaacaca

SEQ ID NO: 240579 - RNA, 64 nt, Human
ggggccaagcccccaccccaucccacuccccuucccuccccagauauuuaugugaaaugaacug

SEQ ID NO: 240580 - RNA, 64 nt, Human
cggggucgggaaccaagggugugucugcucuuucccuccccauccucuggcagaaaucagcuag

SEQ ID NO: 240581 - RNA, 64 nt, Human
agacacccuguguccuccuucagcugaagaugccccuccccaggccuuggacucuuccgaaggg

SEQ ID NO: 240582 - RNA, 64 nt, Human
cucgaaaccacagcccuuaccccaaucccacgagccccgccaacgaaccacaggugcugggcuu

SEQ ID NO: 240583 - RNA, 64 nt, Human
gaagguguuuguagaugaugcaacugagccuuaagaggacuaauucccuuuuucuaaggcacag

SEQ ID NO: 240584 - RNA, 64 nt, Human
ugucccucgauaacagucagcuagacacacucaggaggacuacugaggcucugcgaccuucagg

SEQ ID NO: 240585 - RNA, 64 nt, Human
gcaaauugcaccacagcuccccgccuggccuggcccuccccaggcggcucaguggcucaugcug

SEQ ID NO: 240586 - RNA, 64 nt, Human
ucccugaagguugaacccacacacaccccugcagccuccccagaugaaguagguguauuccccu

SEQ ID NO: 240587 - RNA, 64 nt, Human
cugacugguugucagaauggaauccaucugucucccuccccaaauggcugcuuugacaaggcag

SEQ ID NO: 240588 - RNA, 64 nt, Human
uuccuugcugcuuggaacccucccuguuuggaacccuccccaaagaggcagucaggcugaugcu

SEQ ID NO: 240589 - RNA, 64 nt, Human
uagcccugccucaagcuaugugagcucaccagucccuccccaaaugcuuuccaugaguugcagu

SEQ ID NO: 240590 - RNA, 64 nt, Human
aaaguguuccaauaaaauggauggaugucuuuuuccuccccauuuugcuuuauacugaguaaug

SEQ ID NO: 240591 - RNA, 64 nt, Human
auuccuuuccuucuuuuuucuuuucuuacccuuuccuccccaaagaaaagauuugcugcugacc

SEQ ID NO: 240592 - RNA, 64 nt, Human
gcaggcacgcgcuucauacaaagcaucucacuccccuccccaggagagccugcacagcuucuug

SEQ ID NO: 240593 - RNA, 64 nt, Human
aucgugagaucugguaguuuaaaaguguguagcaccuccccacucucucuuucuccugcuuugg

SEQ ID NO: 240594 - RNA, 64 nt, Human
cccaagccccacuuccucccugaccuccccaugcccuccccagccucucccagcacaagugggg

SEQ ID NO: 240595 - RNA, 64 nt, Human
ucuuuaucaaccccaagccccacuuccucccugaccuccccaugcccuccccagccucucccag

SEQ ID NO: 240596 - RNA, 64 nt, Human
ggggggggggggcucugggaagcacaggccagcaccuccccagguggcaggaucuggcuugggg

SEQ ID NO: 240597 - RNA, 64 nt, Human
ucccggaggccguggcccgcugggacuggccgccccuccccagcgucccagggcucugguucug

SEQ ID NO: 240598 - RNA, 64 nt, Human
agucauguccagaggccuagggagguuuuagggcccuccccacccacacccacaggucgauuug

SEQ ID NO: 240599 - RNA, 64 nt, Human
uccuccacaggucccuccacucauauggccucucccuccccagcuaguggaggggaagcagucu

SEQ ID NO: 240600 - RNA, 58 nt, Human
auccggucucugcgccgugagccccauuccccgccaucgugggccagccuugcccucu

SEQ ID NO: 240601 - RNA, 64 nt, Human
ugcaucuuccagauugguuuaaccaauuacucguccccgccauuccagggauugauucucacca

SEQ ID NO: 240602 - RNA, 64 nt, Human
ccuuccgccaugauuguaaguuuccugaggccucccccgccauguggaacugugagucaauuac

SEQ ID NO: 240603 - RNA, 64 nt, Human
aaaaauaucuauuuaagccucucucucuuucucuccuccccaacuuuuuucugaaagccuugau

SEQ ID NO: 240604 - RNA, 64 nt, Human
ccaucucuccucucccccuccuucaucucuccucccuccccaaacucacuuggcauaauucaca

SEQ ID NO: 240605 - RNA, 64 nt, Human
gcugauucaugccuuccugccucuuggcuauggcccuccccaucuacucuuuaaacuuuaaucu

SEQ ID NO: 240606 - RNA, 64 nt, Human
cccaccacuccccagcucugucaugcaggccuguccuccccaaccccagcuggaugugccuccc

SEQ ID NO: 240607 - RNA, 64 nt, Human
ggaccugguacaaaugcacgucacaggcucagcuccuccccacuagcauuuucucuaccuucaa

SEQ ID NO: 240608 - RNA, 64 nt, Human
cacugucuauccauccgguggacugggcagcauuccuccccagggcucuucccuugggggccuc

SEQ ID NO: 240609 - RNA, 64 nt, Human
gaaacuggauagauacacucauaaaacccccaccccuccccaccccaccccugcucccauugug

SEQ ID NO: 240610 - RNA, 64 nt, Human
uugcuccugaggccaaagccagagacucgaacagccuccccaccaccaccagcauaugucaagg

SEQ ID NO: 240611 - RNA, 64 nt, Human
ccucucucuccacauuacccuuacaaaaacaggcccuccccaugagagagcuacacggcagggg

SEQ ID NO: 240612 - RNA, 60 nt, Human
uagaggucacugggaaauagcuagggagccccuccccaccucacuuggggcccccagcag

SEQ ID NO: 240613 - RNA, 64 nt, Human
uguaaucucuguauaaacuuugucaacauuuuuaccuccccaguuuuaucuucuguuuuguuuu

SEQ ID NO: 240614 - RNA, 64 nt, Human
cugacaccggugucaguguggcccgagccuguguccuccccaccucgcccacccuggcaaggac

SEQ ID NO: 240615 - RNA, 64 nt, Human
acugaagcguugugugcaaauccagcuuccauccccuccccaaccuggcaggauucuccaugug

SEQ ID NO: 240616 - RNA, 64 nt, Human
cacagugacgguggccuggccagcccucgggaccccuccccaccuaacugcacugaaaccauuu

SEQ ID NO: 240617 - RNA, 64 nt, Human
uuguuuuucagacaguauggguuaaguucucugcccuccccaggggucugaggaggcucugggu

SEQ ID NO: 240618 - RNA, 64 nt, Human
acugguuugcaucccagguuccucgcccaccuacccccgccacaccccgucuuuuuagagaucu

SEQ ID NO: 240619 - RNA, 64 nt, Human
ccaccccgccugccgcccccuguccagguucccuccccgccacagugaaauaaagcaucccacc

SEQ ID NO: 240620 - RNA, 64 nt, Human
agcgcugccugaaauaggguuggcgcauacccacccccgccacggccacaagcccuggcauccc

SEQ ID NO: 240621 - RNA, 64 nt, Human
cccaucaagucacccagacccaugaaaugcccugccuccccauucgcauggccgcccaagaggc

SEQ ID NO: 240622 - RNA, 64 nt, Human
cugcagggaagaaggcccaccuuugugucacucaccuccccaggcucagaguccccaaggcccu

SEQ ID NO: 240623 - RNA, 64 nt, Human
ugggauaucagagccccagacagcacugccucuuccuccccaccccacugcccccaccuuaaug

SEQ ID NO: 240624 - RNA, 64 nt, Human
cccucaagugauccaccagagaggagauccucggccuccccaagugcugggauuauaggcauga

SEQ ID NO: 240625 - RNA, 64 nt, Human
agcauuuguuggaaggugauggcucucccuccucccuccccauuucauuggcguaacguaaagu

SEQ ID NO: 240626 - RNA, 64 nt, Human
gugccuccaaauguauaucauuucacuccccuccccuccccacccccaauagauucaaauaaau

SEQ ID NO: 240627 - RNA, 64 nt, Human
aaauccuuguacugauuacuaaaauuaacccacuccuccccaacaaggucuuauaaaccacagc

SEQ ID NO: 240628 - RNA, 64 nt, Human
cccugggugugcuuaagggggcuccuugggcccgccuccccaggagguagaaaaugaguggcag

SEQ ID NO: 240629 - RNA, 64 nt, Human
acucgcugcuagcugccacuaggcagcuagcccaccuccccagccacccuccuccacaggucca

SEQ ID NO: 240630 - RNA, 64 nt, Human
aggcccaagcugggacuucuccaggccuguguucccuccccaggaagugcgccccaaaccucuu

SEQ ID NO: 240631 - RNA, 64 nt, Human
uauugaagauggauuaggagagggggugaugaccccuccccaagccccucagggcccagaccuu

SEQ ID NO: 240632 - RNA, 64 nt, Human
aauuaaaguucaggcauuuauggggagaaaaggcccuccccaccgacccgccaccugccaccuc

SEQ ID NO: 240633 - RNA, 64 nt, Human
gugcccacaagccuggcagcuguagagccgcgaaccuccccacaccucccucaccgcgcaggac

SEQ ID NO: 240634 - RNA, 64 nt, Human
uagucuguuuucuaaagccaggacuauucccuuuccuccccaggaauauguguuuuccuuuguc

SEQ ID NO: 240635 - RNA, 64 nt, Human
aggaagccauuugcagugcugguguguccugcucccuccccacauuccccaugcucaaggccca

SEQ ID NO: 240636 - RNA, 50 nt, Human
acgagggcgccgacuccuaaccccgccaggcagccucguucugcacaggc

SEQ ID NO: 240637 - RNA, 64 nt, Human
auauaauaacuauaaucccuugcucaccccuuucccccgccaaauaagaaacgcaagccagacc

SEQ ID NO: 240638 - RNA, 64 nt, Human
aggacagagagauggacaugcguccccucccuccccccgccaagugcucacacacaaccucacg

SEQ ID NO: 240639 - RNA, 64 nt, Human
ugggagugcaguggcacacugacuacagccuugaccuccccaggcucaggugaucuucccaccu

SEQ ID NO: 240640 - RNA, 64 nt, Human
guuaucauuucaaaauuauugugauucucaccucccuccccaccucaguguuuugucuguccgc

SEQ ID NO: 240641 - RNA, 64 nt, Human
ucgaagguaauacugacagauuucuucccucuucccuccccaucacccaccucagugauaacac

SEQ ID NO: 240642 - RNA, 64 nt, Human
ugccuccuggguuuaagcaauucuccugccucagccuccccaguagcugggauuacaggcaccu

SEQ ID NO: 240643 - RNA, 64 nt, Human
guuagccuugcugccaguucccauaaaucagacuccuccccacuccguuucugaauuuucuaua

SEQ ID NO: 240644 - RNA, 64 nt, Human
uuuucuucucacagcuccaagcacgugucccgugccuccccacuccucuuaccaccccucucuc

SEQ ID NO: 240645 - RNA, 64 nt, Human
gaaacgugagggcaggggggcaguuguggucgccccuccccaguugugcauguacccggcuacu

SEQ ID NO: 240646 - RNA, 64 nt, Human
caugaagcaagaacaacuccuggccaggcccuguccuccccacguaccccugcauccccagccu

SEQ ID NO: 240647 - RNA, 64 nt, Human
uguggucuuaaccccuggguauuuuucuguucucccuccccaucuacuaucccaggcuugggcc

SEQ ID NO: 240648 - RNA, 64 nt, Human
guugcugggaugccugccccuccugagaggacccccuccccauugucaggcucuccauguccac

SEQ ID NO: 240649 - RNA, 64 nt, Human
cuggccauguccucaaccccaaaucccccgacucccuccccagaucuguccugggggaugcaaa

SEQ ID NO: 240650 - RNA, 64 nt, Human
ugcucugagggagagacagugagcugcaagacugccuccccauaacaacaggcaacucagagaa

SEQ ID NO: 240651 - RNA, 64 nt, Human
ugcaguggcaugaucucaguuuaugcaacuucugccuccccagguucaagcgauucuuuugccu

SEQ ID NO: 240652 - RNA, 64 nt, Human
cauacuguuuuccagagguuguaaaauguacauuccuccccacaguguauaagcugugccuuua

SEQ ID NO: 240653 - RNA, 64 nt, Human
ggccacacugcugcugugccaagaagguguacagccuccccaggauggggccucauacaacccu

SEQ ID NO: 240654 - RNA, 64 nt, Human
uuucaguacugggggcgaaacagccaggugauccccccgccauuaucucccccuaguuagagac

SEQ ID NO: 240655 - RNA, 64 nt, Human
auauaaacauaaguaacucccaaacacuuauguagaggacuaaaaauguaucugguauuuaagu

SEQ ID NO: 240656 - RNA, 64 nt, Human
agagaacugucgugucugauuugcacuauuggaggaggacuaaaguugccugacaacuuuaugu

SEQ ID NO: 240657 - RNA, 64 nt, Human
uucuugguccccacccucccugcacuccgcaucuccuccccagcagccauucuccccuuucccu

SEQ ID NO: 240658 - RNA, 64 nt, Human
cucauuugccuucccuaccucuuccucccagaguccuccccacaguuccuaagggccacugugu

SEQ ID NO: 240659 - RNA, 64 nt, Human
cccggucuuacccucccaaagggccaaggccagaccuccccagggagggcucgaaggaagugca

SEQ ID NO: 240660 - RNA, 64 nt, Human
gcaauagugggcccuccgacagcccccucugccgccuccccacggccgcuccagggguggcugg

SEQ ID NO: 240661 - RNA, 64 nt, Human
cagccuggagaauaaaauauccucagcccugaugccuccccauuauguaacacccaaccgcucu

SEQ ID NO: 240662 - RNA, 64 nt, Human
cugggcuuccuucgagagggcucuuccuccaaauccuccccaccuguccuccaagaacagccuu

SEQ ID NO: 240663 - RNA, 64 nt, Human
gaauccagacccgcugcugucuugcucucccuccccuccccacuccuccucucuucuuccucuu

SEQ ID NO: 240664 - RNA, 64 nt, Human
ccagcaccuugugccugggguguuaguggcaccgccuccccaccuccaggcuuucccacuuccc

SEQ ID NO: 240665 - RNA, 64 nt, Human
caucucccggguucaagcgauuuuccugccucagccuccccaguagcugggacuacagacgugu

SEQ ID NO: 240666 - RNA, 64 nt, Human
ucgaacuccugaccucaucguccaccugccucggccuccccaaagugcugagauuaggcguuag

SEQ ID NO: 240667 - RNA, 64 nt, Human
aaacuccugggcucaagugauccuuccaccucagccuccccaguagcugggacuacggggucgc

SEQ ID NO: 240668 - RNA, 64 nt, Human
acaaucucgucagaugcucauacuggaccaucagccuccccauuuuagcugacuuucccagggu

SEQ ID NO: 240669 - RNA, 64 nt, Human
ccacccuaccugcccaccuggggcuccugugcccccuccccacuccagaggccacccuacaagu

SEQ ID NO: 240670 - RNA, 64 nt, Human
ugcggagcugagccccgcccugccaugagguuuuccuccccaggcaggcaggaggccgcgggga

SEQ ID NO: 240671 - RNA, 64 nt, Human
cguggaaaguuggcugcugccuggggaagcuucuccuccccaaggcggccauggggcagccugc

SEQ ID NO: 240672 - RNA, 64 nt, Human
ccuccaccagcgccugccucggccccuccucugcccccgccagaucccguggugcuggggaugg

SEQ ID NO: 240673 - RNA, 64 nt, Human
guggaucucccgggugugaggggcuuggccugcgccccgccagcugcccgcagaggugcagccu

SEQ ID NO: 240674 - RNA, 64 nt, Human
gggugggggggcggggcugacccugaacccucccccccgccaggucggggaggggucccaccac

SEQ ID NO: 240675 - RNA, 64 nt, Human
gccgcucugggggguugccucgaguccccccaccccuccccacccaccaccgcucccgcgggaa

SEQ ID NO: 240676 - RNA, 64 nt, Human
gcuggucucaaacuccugaccucaagugauccgcccuccccagccucccaaagugcugggauua

SEQ ID NO: 240677 - RNA, 64 nt, Human
ugauaguccugaccucaugaucugcccaccucggccuccccaaagugcugggauuacagguaca

SEQ ID NO: 240678 - RNA, 64 nt, Human
aauugagugguuaaaaaagauaccuuauccuauuccuccccacccacccauguuuuuaaacuaa

SEQ ID NO: 240679 - RNA, 64 nt, Human
gagcuccugggcucaagcaauccucccaccucagccuccccaguacugggacuguagguacuca

SEQ ID NO: 240680 - RNA, 64 nt, Human
gcccugccucccucugucagggaaccugggacccccuccccacugccugcacagaggacccuga

SEQ ID NO: 240681 - RNA, 64 nt, Human
cacggaggggcugugaccugguccccaguguugcccuccccaguggcuggcaggggccugcuug

SEQ ID NO: 240682 - RNA, 64 nt, Human
cacaaggacauaaacacuccuucuuucagccccaccuccccagggcccuggaggagacccccac

SEQ ID NO: 240683 - RNA, 64 nt, Human
uccucgcucugcuugguggcuucaggaguguggcccuccccaggacuccacuucauccugggcu

SEQ ID NO: 240684 - RNA, 64 nt, Human
auuauauauaagguggccacgcuggggcaaguucccuccccacucacagcuuuggccccuuuca

SEQ ID NO: 240685 - RNA, 64 nt, Human
agcuacaucagccugccagauaauccacaugcucccuccccagcuccacuaagauuuucacuuu

SEQ ID NO: 240686 - RNA, 64 nt, Human
auucugaucccugaucaagcuucagaccucccucccuccccaguguuuuugcaggugaggaaac

SEQ ID NO: 240687 - RNA, 64 nt, Human
aaaacaaacucguuuuuuacaaagcccuuuuauaccuccccagacuccuucaacaauucuaaaa

SEQ ID NO: 240688 - RNA, 64 nt, Human
cuguccuguagcugguuuauuuuuuacuuugcccccuccccacuuuuuuugagauccauccuuu

SEQ ID NO: 240689 - RNA, 64 nt, Human
gcaguaacgugaucuuggcucacugcgaccuccaccuccccaguucaagcgauucuccugccuc

SEQ ID NO: 240690 - RNA, 62 nt, Human
ugccggagcaccagcgccgccuuuccauggagacucguaagcagcuucaucugacacgggca

SEQ ID NO: 240691 - RNA, 62 nt, Human
uaagggcaccuauugagauucaagacaagcagacucguaaaaucuuguagaggcagaggcaa

SEQ ID NO: 240692 - RNA, 62 nt, Human
uauauauacauaaauacuauaucucuauauggacucguaaaggcauggguauaaugguaccc

SEQ ID NO: 240693 - RNA, 64 nt, Human
ucagcaguacagccgagacucgacucugugccucccuccccagugcaaaugcaugcuucuucuc

SEQ ID NO: 240694 - RNA, 64 nt, Human
caaauaguuuuguggcaugggguaguggagcuucccuccccacccccauauguaucagugaagc

SEQ ID NO: 240695 - RNA, 64 nt, Human
cucuacccaucucccccaucccccacugccacacccuccccauucagacacuucauggaccaag

SEQ ID NO: 240696 - RNA, 64 nt, Human
ucaaagaagucauggcccaaauccagugugcaccccuccccauucacagagccuuuuucacaau

SEQ ID NO: 240697 - RNA, 64 nt, Human
cagcauggaaaacgucuuuaccaugugguucccuccuccccaaauacauaaagcaaauaagcag

SEQ ID NO: 240698 - RNA, 64 nt, Human
acuucagcuaaugaucuuuucuucagccccacccccuccccacuagcucgaucuaguauauugg

SEQ ID NO: 240699 - RNA, 64 nt, Human
aaaucaaucaggcccauccaucccaugccucccuccuccccaccccacuccaacaguuccucuu

SEQ ID NO: 240700 - RNA, 64 nt, Human
augagcugcugccaaugggaucuuucagguacccccuccccagcuucccuguggcugugcggug

SEQ ID NO: 240701 - RNA, 64 nt, Human
guggccuggggcugagcagaccuuaggaaggggcccuccccagugccguggcugcucuggggcu

SEQ ID NO: 240702 - RNA, 64 nt, Human
uaugcagcccaaagggcuucuugagguagagagcccuccccagugucuucccaggauaaguaga

SEQ ID NO: 240703 - RNA, 64 nt, Human
uggacaacgugugggauggaccuggaaacaagcaccuccccaaacacaucaccacucccuaggg

SEQ ID NO: 240704 - RNA, 64 nt, Human
agagacaggcagggcccaguccaggggccccaggccuccccagucccagugugcgagccccacu

SEQ ID NO: 240705 - RNA, 64 nt, Human
ugcagaggaauuuuuccacuuaagucagagccuuccuccccaucuggaauucacagcuguuccc

SEQ ID NO: 240706 - RNA, 64 nt, Human
cggcucuucgguggcaacacuaccugggacacugccuccccagucaccaagggccccagcuggc

SEQ ID NO: 240707 - RNA, 64 nt, Human
gcccaacauggagggauggcguuggcagugccagccuccccagccugugccaagcuucaacagg

SEQ ID NO: 240708 - RNA, 62 nt, Human
gcugagacccgcuuaccuuaguucaucuguucacucguaauaaaaagaauucucucagguca

SEQ ID NO: 240709 - RNA, 62 nt, Human
ucugcauuguucgguguuuuuuguacaugucaacucguaaaucugauuaaauuggguucuug

SEQ ID NO: 240710 - RNA, 64 nt, Human
ccccugcaggugugaccccgccugcucuuuccucccccgccagguguggccccgccugcucuuu

SEQ ID NO: 240711 - RNA, 64 nt, Human
ucccagcugcccuggcuuagccuucccugcagccccuccccaacaggcuugguccgggcagccu

SEQ ID NO: 240712 - RNA, 64 nt, Human
aguucccccgacagcccacgacagccaggacugcccuccccaccccaccccaccccaggagcac

SEQ ID NO: 240713 - RNA, 64 nt, Human
agguucuugaugaaugugcuuuguguccaaaaugccuccccauuguacacagguguacaccaug

SEQ ID NO: 240714 - RNA, 64 nt, Human
guuccugugcauauguauuuucacuaugugcuccccuccccagaucuuaauuaaaccagauuuu

SEQ ID NO: 240715 - RNA, 58 nt, Human
ccuuucaccuccugccaugauucugaggccuccccagccauguggaacuguaagucca

SEQ ID NO: 240716 - RNA, 64 nt, Human
ugcuucccugcauuucgaagcugcucuuucugguccuccccaccaccccacccccaagacuugu

SEQ ID NO: 240717 - RNA, 64 nt, Human
aauccuuauaggauuccugaguuacuguuuuguuccuccccacugcuucccauuccugaguuuu

SEQ ID NO: 240718 - RNA, 64 nt, Human
caucugcagggccccgcaccaguuggagcagaugccuccccaccaccaauugccaaagguccaa

SEQ ID NO: 240719 - RNA, 64 nt, Human
guugcaugcaaaagcuguaguguaucugguccuuccuccccagcuuuugugugggguucuugcu

SEQ ID NO: 240720 - RNA, 64 nt, Human
ucugaaggcccuuggggcugacagggccaggcagccuccccagcugaggcaucauuccugggcc

SEQ ID NO: 240721 - RNA, 64 nt, Human
cgccacugauuuccuacuggcccucaggcaaguuccuccccaucucucagucuaugaagugaac

SEQ ID NO: 240722 - RNA, 64 nt, Human
auugccauagucccuucccccugaagcaauagccccuccccaccuccugcaauacgccuuucca

SEQ ID NO: 240723 - RNA, 64 nt, Human
aaauaaauacuauaauauagauaucaaauuauuaccuccccauguuauguugaaaauuuuuuua

SEQ ID NO: 240724 - RNA, 64 nt, Human
gucaauggacaaacacuuaggacugaacugaaccccuccccaugaacacaaggguuuuauccuu

SEQ ID NO: 240725 - RNA, 64 nt, Human
cucgcagcagcugcuacccacagccuauuccacuccuccccaucuccaggcgcugggagggggg

SEQ ID NO: 240726 - RNA, 64 nt, Human
cucuucacguucaucccugucucucccgggcugcccccgccagcucuggcuguuuagcuugagg

SEQ ID NO: 240727 - RNA, 64 nt, Human
ccaccuucaggcuuccccagccaugacacuucagccccgccacccaugccugucugcugcagcc

SEQ ID NO: 240728 - RNA, 64 nt, Human
uucacugucauuguguuucccagccucuccacucccccgccagaaaggagccugagugauucuc

SEQ ID NO: 240729 - RNA, 64 nt, Human
cuacucgugccaggcccacuugccaggcaggagcccuccccaagccuucagggcugcucggagu

SEQ ID NO: 240730 - RNA, 64 nt, Human
gggcuauggauggggcccaggggcuuugguggccccuccccaacuccuuccucuuugcuugggu

SEQ ID NO: 240731 - RNA, 64 nt, Human
ccugucucugggcugccggugggaggggaugucgccuccccagagaugccugguccgucuuggg

SEQ ID NO: 240732 - RNA, 64 nt, Human
ccgguaaacggaccaaguucucacuucccauccuccuccccagucucacccacccgugcuccca

SEQ ID NO: 240733 - RNA, 64 nt, Human
uuauacauuuuggugacuucugacucuccuuccaccuccccacuguacacugugguacagauag

SEQ ID NO: 240734 - RNA, 64 nt, Human
caccaugacccucuucccacgcugaccugugcucccuccccaaucaucuuuccuguuccagaga

SEQ ID NO: 240735 - RNA, 64 nt, Human
gcgucgugcaacccuaggaccgacccccaccaccccuccccagccuccugacccuucccagccc

SEQ ID NO: 240736 - RNA, 64 nt, Human
aauugugaacuuuccaucagacugccucccuggcccuccccauucuucuccuguugguuauucu

SEQ ID NO: 240737 - RNA, 64 nt, Human
gcguaauuaaccucucacaaagaugcuuaucuaaccuccccagcagucauggguuucagcaaga

SEQ ID NO: 240738 - RNA, 64 nt, Human
uguuuccagacuuccuugagacacggagcccagcccuccccauggagccagcucccucuauuua

SEQ ID NO: 240739 - RNA, 64 nt, Human
ugccaccagcauccucugagaguccuuccaguguccuccccagccuccugagacuccggugggc

SEQ ID NO: 240740 - RNA, 64 nt, Human
acuccuucuccuucuaccacucuuaaauuuacucccuccccacccagaacccagauggggugga

SEQ ID NO: 240741 - RNA, 64 nt, Human
ugcccuuuccccaccucaggcccuaccccuggacccuccccaaccuuccuucucucuucuuugg

SEQ ID NO: 240742 - RNA, 64 nt, Human
uuccuggcccccuccccccccgccccucugcuucccuccccacccaccaccucaaggguaggga

SEQ ID NO: 240743 - RNA, 64 nt, Human
cuuccuaccuguuuuauuuuguuuucucguucucccuccccaccccacucccagccuuaucuau

SEQ ID NO: 240744 - RNA, 64 nt, Human
agugcucauucaguuucguuugcuugauaaaucugaggacuaugagauaucagaguuacuagua

SEQ ID NO: 240745 - RNA, 64 nt, Human
cacaacuuuugagaguauagcaugaauguuuuuagaggacuauuacauauuuuuuguauauuug

SEQ ID NO: 240746 - RNA, 64 nt, Human
uuuggacaucuuuuaaguacauuuucaacaguuugaggacuaagccuuucuaaaauaacauugu

SEQ ID NO: 240747 - RNA, 64 nt, Human
ucuagaggcccccucccuccauacucccgucacuccuccccacugccgccccuccccucccacu

SEQ ID NO: 240748 - RNA, 64 nt, Human
agugggcaggaggccccaggcugagagccagaugccuccccaagacugucauugccccuccgau

SEQ ID NO: 240749 - RNA, 64 nt, Human
acccucugccuccuuccuucuuucucuucaacccccuccccaccuucaccuucucaaaaaugga

SEQ ID NO: 240750 - RNA, 64 nt, Human
guugggugggccggcuucaugccagcuacuuccuccuccccacuuguccgcugggugguacccu

SEQ ID NO: 240751 - RNA, 64 nt, Human
aaaucguccagcgaccuuccucauccaccccaucccuccccaguucauugcacuuugauuagca

SEQ ID NO: 240752 - RNA, 64 nt, Human
cuuuccuggagcaucugcccuuugcuccuagcagccuccccaggaagggacugcagaggcgggc

SEQ ID NO: 240753 - RNA, 64 nt, Human
uggucccgaagaggcugugcgagcccuucccggcccuccccagggccccccgcccccuccucug

SEQ ID NO: 240754 - RNA, 64 nt, Human
cacacacacacacacacacauacauccugcuuucccuccccaaacccaucagacagguaaaugg

SEQ ID NO: 240755 - RNA, 64 nt, Human
gucagucucucucucccuuuuaaauggugggaacccuccccaaaaccuuuccccagacacauuc

SEQ ID NO: 240756 - RNA, 64 nt, Human
aauagguuguuucuuggucuugcuuucuucaugcccuccccacugcuccugccaccuuuagaua

SEQ ID NO: 240757 - RNA, 64 nt, Human
agaggacacggaggguucagaccccuccucagacccuccccacaucugaaacugccucccccca

SEQ ID NO: 240758 - RNA, 64 nt, Human
aaccaaaacuuuuuguuggcuuuuuccuuugucgccuccccagcaccugcccucccagucuccc

SEQ ID NO: 240759 - RNA, 64 nt, Human
ccaccccuccugagaggcagggggcccuccgcccccuccccauguauuccccaccuguguuccg

SEQ ID NO: 240760 - RNA, 64 nt, Human
agagccgucauggguagcccacgccguccuuuccccuccccaaguguuucucuccugacccagg

SEQ ID NO: 240761 - RNA, 64 nt, Human
cccccuccggagaccaaacucaccaucccucaguccuccccaacaggguacuaggacugcagcc

SEQ ID NO: 240762 - RNA, 64 nt, Human
auuucugcucggccacgcggugggaaccccgcguccccgccauguggcagaggggucucagucg

SEQ ID NO: 240763 - RNA, 64 nt, Human
cccccgccccgcgcgccgguccggcgccccgcacccccgccaggcgcaugucugcaccuccgcu

SEQ ID NO: 240764 - RNA, 64 nt, Human
gguggguguggggcagugugagguaguccuggauccccgccaggguggcccagacgccagcccu

SEQ ID NO: 240765 - RNA, 64 nt, Human
uagaccaggauuauagaggacacagcaagugaguccuccccacucugggcuugugcacacugac

SEQ ID NO: 240766 - RNA, 64 nt, Human
ugaguauuagcuuacccaaugggaccgugccccaccuccccacacacaggccuucuguggggcu

SEQ ID NO: 240767 - RNA, 64 nt, Human
gaugcagggucugcucaccccaacacaugccuucccuccccagccacaccgugcacgaaggggg

SEQ ID NO: 240768 - RNA, 64 nt, Human
aagaauguuuacaugccaaacagaauguaacaccccuccccaagcccuucccagucacugcaug

SEQ ID NO: 240769 - RNA, 64 nt, Human
aaacgcuaauaauuuauuagaucuaaagccccuuccuccccagccccugcuuucauuaagguau

SEQ ID NO: 240770 - RNA, 64 nt, Human
cagagggaguucccccagaucaguaccccccaccccuccccagcuaguagcaugaccaggagag

SEQ ID NO: 240771 - RNA, 64 nt, Human
ugcugaccacccauccuggcacagccucuguuuuccuccccaucuguggauacuauucuaauaa

SEQ ID NO: 240772 - RNA, 64 nt, Human
gucauuauuaaagaucauauggggaaaaugaaacccuccccaaaauacaagaaguucugggagg

SEQ ID NO: 240773 - RNA, 64 nt, Human
gcagugaugcaaucacggcucacugcagccucgaccuccccagcucaagcaauccucccaccuc

SEQ ID NO: 240774 - RNA, 64 nt, Human
ccuccaaaagagcagaauccucccaccgcccugcccuccccaccgaguccuguggccauucaga

SEQ ID NO: 240775 - RNA, 64 nt, Human
aagcaccaaauuuuguuguuuuuuuuuuuucuccccuccccacagaucccaucucaaaucauuc

SEQ ID NO: 240776 - RNA, 64 nt, Human
gaguaaauuggccucuuugauacacuuuugcuugccuccccaggaaagaaggaauugcauccaa

SEQ ID NO: 240777 - RNA, 64 nt, Human
uuccgauucuucauccggucuacgcuaugcaauuccuccccaaauauagaucuuauuucugcuc

SEQ ID NO: 240778 - RNA, 64 nt, Human
accugggaauuugcuggaaaugcaggcucaagccccuccccacaccuggugaaugagagagccc

SEQ ID NO: 240779 - RNA, 64 nt, Human
uggggcagccucuccgacucugcacccgccucgaccuccccacccgcucccacaccccugugcc

SEQ ID NO: 240780 - RNA, 64 nt, Human
ucccugccccaaccggagaggccggugcacagggccccgccaggggcugggggcaucccggcuu

SEQ ID NO: 240781 - RNA, 64 nt, Human
acaaagcauauaaaauacaaggugaaagccccccccccgccacauuagcugcgccccugaagug

SEQ ID NO: 240782 - RNA, 64 nt, Human
cccgcccagagcucgugacgagcaagugcuggguccccgccaggcaccccgaggcggcgcucug

SEQ ID NO: 240783 - RNA, 64 nt, Human
uaaacauaugcucuggcaccaaguucaaaucuuuccuccccauuugugagcugugggacuuuag

SEQ ID NO: 240784 - RNA, 64 nt, Human
ucaaaccauucuaggccugcaauggggaacaggcccuccccaucaguauugguaaagugaccau

SEQ ID NO: 240785 - RNA, 64 nt, Human
cuggagcaggggaccccauauccacugguagccaccuccccauugcuguggcccccugaaaucu

SEQ ID NO: 240786 - RNA, 64 nt, Human
acugugaccccuguucccaugcugaccuguguuuccuccccagucaucuuucuuguuccagaga

SEQ ID NO: 240787 - RNA, 64 nt, Human
ggcucugagcucuccucccaucuguccccaucuuccuccccacaccuacccacccagugggccc

SEQ ID NO: 240788 - RNA, 64 nt, Human
ggcugugaauggaccuucagcccugcccacccucccuccccacugcugcugagucugucugaug

SEQ ID NO: 240789 - RNA, 64 nt, Human
uggccauggugggaaaugggcaugagaauaaauaccuccccaaauucaaucugagcccagcagg

SEQ ID NO: 240790 - RNA, 64 nt, Human
gugggagaaaagcuugugugaaauucccucuucaccuccccaccccccaaaaaauaaaaggggg

SEQ ID NO: 240791 - RNA, 64 nt, Human
uaccugccaggccucaggcccaggacccaggaggccuccccaccuaccccagcacacacacucc

SEQ ID NO: 240792 - RNA, 64 nt, Human
uuuuuccuuugcagaugccuuccugggggauacuccuccccacccuaaagggucgccugcaacu

SEQ ID NO: 240793 - RNA, 64 nt, Human
ccccacuacuguggggcaguggggccagagcccaccuccccaacaugugaagacagugaugggc

SEQ ID NO: 240794 - RNA, 64 nt, Human
ucgugucccccccuaccccgcaacacccacaucaccuccccaccacccggccggggugugcuca

SEQ ID NO: 240795 - RNA, 64 nt, Human
cgucugccucagaaacccuauugggcugagcugcccuccccaccagggccacuguguccucugc

SEQ ID NO: 240796 - RNA, 64 nt, Human
gccucugccucacacuccuguccucugaacccacccuccccaggguucaggguugcuuugcaga

SEQ ID NO: 240797 - RNA, 64 nt, Human
ucucagcuguggcuuuuguucuggggcugaguccccuccccaacccccugacucucacacauag

SEQ ID NO: 240798 - RNA, 64 nt, Human
acacacgcagauggaggcgccucacugggaggugccccgccagcccugggcagugucaggcagg

SEQ ID NO: 240799 - RNA, 64 nt, Human
gugugccagugauggugggugggggcugggccuuccccgccaccuccaccccuguugugaccug

SEQ ID NO: 240800 - RNA, 57 nt, Human
gcccggccuccugcuccuagugcccgcccccgccaugccucagccacgccccuccgg

SEQ ID NO: 240801 - RNA, 64 nt, Human
caaugcagaaaaugggucagcuccuuugagaaccccuccccaccuaccccuuccuuccucuuua

SEQ ID NO: 240802 - RNA, 64 nt, Human
aucuugcccuuccaugaaugaccccucagucuggccuccccagccucaagguccacucaggcac

SEQ ID NO: 240803 - RNA, 64 nt, Human
gaugcagcccggagccaguaacccggcgccuccuccuccccagggcgcagcgcuggcugcuccc

SEQ ID NO: 240804 - RNA, 64 nt, Human
caauaaucugcuugaauauuuuuauauuucaccuccuccccaccuuucccuaagcaaaguuuaa

SEQ ID NO: 240805 - RNA, 64 nt, Human
uauagaaaaacucaaauggauugcuucccaaaccccuccccacccuuuuuuuuugguuuuaaau

SEQ ID NO: 240806 - RNA, 64 nt, Human
aaauguucacagccauagguuauggucuugccaaccuccccaguuauguuuuuuuguuuucuag

SEQ ID NO: 240807 - RNA, 64 nt, Human
cggagagaggccuugucccagaggcugccccaccccuccccauuagcuuucaauuccguagcca

SEQ ID NO: 240808 - RNA, 64 nt, Human
cucugaaaugauaaagacagccuuuaaucccccuccuccccagaaggaaccucaaaagguagau

SEQ ID NO: 240809 - RNA, 64 nt, Human
aauaaaaguauuuuguggugaccauaagaaugucccuccccaaacaaguaaacuugugaaaguu

SEQ ID NO: 240810 - RNA, 64 nt, Human
aaaugcuccguaugauuugcacaaaugacauagaccuccccaaaaguuaacuggcucuccuucc

SEQ ID NO: 240811 - RNA, 64 nt, Human
ggcuggggaaguguuucccaauccuuugaccauuccuccccaaaagcauuuuaaagaggcgguu

SEQ ID NO: 240812 - RNA, 64 nt, Human
ccuguccucaccuuccagccccagcugagcagccccuccccacaucaucuucagcugcugccca

SEQ ID NO: 240813 - RNA, 64 nt, Human
cgcgcucuccucagccaccaaaugucccugacacccuccccagcccccacagauaacaucagcu

SEQ ID NO: 240814 - RNA, 64 nt, Human
agucuuccaggccuccucagaggucuucccuuugccuccccaggacagggugagucagagcuca

SEQ ID NO: 240815 - RNA, 64 nt, Human
acagaccgacaggcagcccaagggccuggacaccccuccccaggcaggugcugccccaggagga

SEQ ID NO: 240816 - RNA, 62 nt, Human
ugcacagaauacacuuagauugauaggaaagaacucguaauggaguuugaguaaagaaaaug

SEQ ID NO: 240817 - RNA, 64 nt, Human
gugcucaguggucccgaggcccuagacccccaccccccgccaguugcuuugucugguagcucaa

SEQ ID NO: 240818 - RNA, 64 nt, Human
uaacugagcugccaguggggucgugaggcaagauccccgccacccggggacaucuucaaucuag

SEQ ID NO: 240819 - RNA, 64 nt, Human
gggcuuuggacugaggucccuguggccucggucuccuccccaugaagugggagcgaggcucccc

SEQ ID NO: 240820 - RNA, 64 nt, Human
accacagcagugaugccagcugggcacgucaggaccuccccacacacccacacgaugccacagg

SEQ ID NO: 240821 - RNA, 64 nt, Human
guagcgagugaucuggcggggggcgucucagcacccuccccagggggugcaucucagcccccuc

SEQ ID NO: 240822 - RNA, 64 nt, Human
ucuuaagcuuuuccuuucucuuacaccugccaugccuccccaaauugggcauuuaauucaucuu

SEQ ID NO: 240823 - RNA, 64 nt, Human
aagaauucucucagggugguaucaccuccucccuccuccccacucacuccaguuuuuagcccgg

SEQ ID NO: 240824 - RNA, 64 nt, Human
uaaguuuggaccaacuuuuauguaacaaacagccccuccccaccuccaguuuuacaacaaucag

SEQ ID NO: 240825 - RNA, 64 nt, Human
auguccuuggggaggggucagcucuggccacaauccuccccaccagucucacccacuaggauag

SEQ ID NO: 240826 - RNA, 64 nt, Human
guccuguuaacccuccaccuccucucuuggacucccuccccaccccaaccacucuuucuuucuc

SEQ ID NO: 240827 - RNA, 64 nt, Human
aacaugucacuuuucuguuaagaaaacugagcccccuccccacagguuaaaaaacuuuaguaac

SEQ ID NO: 240828 - RNA, 64 nt, Human
cgccuccuggguucacgccauucuccugccucagccuccccagcagcugggacuacaggcacac

SEQ ID NO: 240829 - RNA, 64 nt, Human
auguccaaucucauccaaauaacauuguucccauccuccccacccaccacaucaaaacauaaca

SEQ ID NO: 240830 - RNA, 64 nt, Human
acauaacacaucacagcacucaguagagguccugccuccccauuucucaagggaagccaguagg

SEQ ID NO: 240831 - RNA, 64 nt, Human
cguguggccgcccggguguggcucagccauguccccuccccagguccuucauucaccccucccc

SEQ ID NO: 240832 - RNA, 64 nt, Human
auguccccuccccagguccuucauucaccccuccccuccccacaguggaauuguugaagugugg

SEQ ID NO: 240833 - RNA, 64 nt, Human
uucgccuucugccgugauugucaguuuccugaggccuccccagccaugcuuccuguacagccug

SEQ ID NO: 240834 - RNA, 64 nt, Human
gaaacucggggccaccuccacuccaugugcccagccccgccacaaccucuccuccagcacauuc

SEQ ID NO: 240835 - RNA, 64 nt, Human
aaauugugaucaaaagggcuaugggaagggcagaccccgccaaugauuucucuucaccugucuu

SEQ ID NO: 240836 - RNA, 64 nt, Human
ggggacccccugugucucugaccaccccccugacccccgccauuacuuucuuuucuggagugcc

SEQ ID NO: 240837 - RNA, 64 nt, Human
cccauuauauaagggcuauuuuagaugcuuuuaaccuccccaacaaauaauuugccaagugucc

SEQ ID NO: 240838 - RNA, 64 nt, Human
ccacuccugcccuccugccccgugcuggaucuucccuccccagcugggaucugcucccaggcaa

SEQ ID NO: 240839 - RNA, 64 nt, Human
agacugagaacaaaccucaagacuaucagugugaccuccccauaacaagagaaccccauauaua

SEQ ID NO: 240840 - RNA, 64 nt, Human
ucucauuauaggauuucugacaggacucugggccccuccccagcuccacucccuaccucaagaa

SEQ ID NO: 240841 - RNA, 64 nt, Human
cuguuuauuauagcagugcaaagaguuccuuuauccuccccaaggauggaaaaauacaauuuau

SEQ ID NO: 240842 - RNA, 64 nt, Human
uuucaucucagaguccacuguggcacuggccaccccuccccaguacaggggugcugcagguggc

SEQ ID NO: 240843 - RNA, 64 nt, Human
ucauguggcccaacucuccuggccuggccaucucccuccccagaaacagugugcauggguuauu

SEQ ID NO: 240844 - RNA, 62 nt, Human
ucaaagucaaggucccuugaaucccaaaagugccuccccagccucagcccccaccuccagcc

SEQ ID NO: 240845 - RNA, 64 nt, Human
aaacaccugccuugggggugaagugaaggcccagccuccccaccccaccgcgccccagggguug

SEQ ID NO: 240846 - RNA, 64 nt, Human
accuguucccaggacacccucccacaugaugucaccuccccaucauccacgccaaguggaagcc

SEQ ID NO: 240847 - RNA, 64 nt, Human
gagcagcuggcaggggaggccaaucccucccuccccuccccaguccugccggcugccucccucc

SEQ ID NO: 240848 - RNA, 64 nt, Human
cuacagagaaccagugcuuccuucgucagcagcgccuccccagacccacgaggauacucacacu

SEQ ID NO: 240849 - RNA, 64 nt, Human
ccugggcaggccgcgucacaaucacaguccuccuccuccccacccugacgucugagcgcagggc

SEQ ID NO: 240850 - RNA, 64 nt, Human
cagucuccaguguagcaggagagccagucacuucccuccccaggccccaaagcaccccaaggcu

SEQ ID NO: 240851 - RNA, 64 nt, Human
cucuucucuucuccugcuccguuccucauccaccccuccccaucuggaccauaauagacaccaa

SEQ ID NO: 240852 - RNA, 64 nt, Human
caucugacuugcccaauccccuggauauggugagccccgccaugcuuuuauucuguaucgcuuu

SEQ ID NO: 240853 - RNA, 64 nt, Human
gggucucccacagcugugccgggcagggggccugccccgccauccugacgccgcccucuucuuc

SEQ ID NO: 240854 - RNA, 64 nt, Human
ggcucacuuguaccccacccuuguuccuguguccccuccccagccauccucccgccuugggggc

SEQ ID NO: 240855 - RNA, 64 nt, Human
ccucaucacugugugacccugggucugcucuuagccuccccauggcucacguuccugcccugga

SEQ ID NO: 240856 - RNA, 64 nt, Human
cuucuugcucccagugaccuggaagcaagcccacccuccccaggggaaaaucuaggagaaugca

SEQ ID NO: 240857 - RNA, 64 nt, Human; identical to SEQ ID NO: 240833

SEQ ID NO: 240858 - RNA, 64 nt, Human
cugugaaccaacccccaucucccuagcccaccccccuccccaacucccucucugugcauuuucu

SEQ ID NO: 240859 - RNA, 64 nt, Human
gcaguguagcuuuaguuuaagaaaaaaaaauauuccuccccacugcaugaaggacuuggauguc

SEQ ID NO: 240860 - RNA, 64 nt, Human
ucagcaggaagcaguuagagcggucgucggccaaccuccccaacagcacuuagguuuuccuguu

SEQ ID NO: 240861 - RNA, 57 nt, Human
uggagcgaaagugccccugauggcacuccuccccacacaccugcucccaagcucaga

SEQ ID NO: 240862 - RNA, 64 nt, Human
accagaggaaaaggaagugcccaacaucucccagccuccccaggugccccccucaccuugaugg

SEQ ID NO: 240863 - RNA, 64 nt, Human
ugaccugcaggaacuccccaccccagggacaccgccuccccauuuuccggggcagaguggggac

SEQ ID NO: 240864 - RNA, 64 nt, Human
cagcuucacagaacuggagaaccaggccaaguccccuccccaaccuaauuaggucauucaggac

SEQ ID NO: 240865 - RNA, 64 nt, Human
uggguuguguacuuucuggugacacuccugggcuccuccccaucccccgugucucucacugagg

SEQ ID NO: 240866 - RNA, 64 nt, Human
uuuguuuuuuuaauuuuaaaaugcaacccugcccccuccccagcaaagucacagcuccauuuca

SEQ ID NO: 240867 - RNA, 64 nt, Human
cccacacauccauaguucugccuccccagcuucuccuccccaguuguaaauaguauuuauuagc

SEQ ID NO: 240868 - RNA, 64 nt, Human
ccacaaccugguuccccacacauccauaguucugccuccccagcuucuccuccccaguuguaaa

SEQ ID NO: 240869 - RNA, 64 nt, Human
ucaggagcccuaccucccugccauuauagcugcuccccgccagaagccugugccaacucucugc

SEQ ID NO: 240870 - RNA, 64 nt, Human
ccagccugguucccgcggcccauuuggucagcuuccccgccacgggcaccucguucuuccacac

SEQ ID NO: 240871 - RNA, 64 nt, Human
cagcuuauacugcuccaucuuccccggccacaugccccgccaaguacugcacagggacccccca

SEQ ID NO: 240872 - RNA, 64 nt, Human
gaaggcucuucuccggggcacagugcuaguggggccuccccacaggccaccgucgcccagccug

SEQ ID NO: 240873 - RNA, 64 nt, Human
uauuuuaacaacauauaaaacuguuucaagcccuccuccccagagcuggcgcucagcagcccua

SEQ ID NO: 240874 - RNA, 64 nt, Human
gcccugccccacccaacuccacagggcuguuuugccuccccacggaaggcgggcugaggagaca

SEQ ID NO: 240875 - RNA, 64 nt, Human
cagcagagcuguagcugacuguggcauuacuacgccuccccacacgcccagaccccucacucca

SEQ ID NO: 240876 - RNA, 64 nt, Human
gucugggaggcagggggcagcagccccugggccgccuccccaccccuuucccuucuuaauccaa

SEQ ID NO: 240877 - RNA, 64 nt, Human
acucacaggcauuccucccacagcccuuucauuuccuccccaccccacuccccaaauacagagg

SEQ ID NO: 240878 - RNA, 64 nt, Human
gucaccucuggucacaacuggaggucaccacagcccuccccagcgcucuguaggcucucagcuu

SEQ ID NO: 240879 - RNA, 64 nt, Human
ucuggaguuagaaaguucucuucuucaacacgucccuccccaggguguuccucccugugaccca

SEQ ID NO: 240880 - RNA, 64 nt, Human
uccagaggcaaaguggaccuggcaaccacaagacccuccccauaagcaggggaccagcauaccc

SEQ ID NO: 240881 - RNA, 64 nt, Human
ucguuugccuccagaaccuucccgucugauuguuccuccccagcccccuggcauguuucaccac

SEQ ID NO: 240882 - RNA, 64 nt, Human
ugucacuggcuuauccuuaaagaucaucucccauccuccccagcgccaucugugugcagcaacc

SEQ ID NO: 240883 - RNA, 64 nt, Human
cugugugaaagggcacagcacaucccaggugcacccuccccaaguacucccaccccgccuacug

SEQ ID NO: 240884 - RNA, 64 nt, Human
gugugaacuuuuuauucuuccaaagaauuguaauccuccccacacugaagucuagggguugcga

SEQ ID NO: 240885 - RNA, 64 nt, Human
aaacuccugggcucagucaguccccccaucucacccuccccaagugcuggaauuacaggcguga

SEQ ID NO: 240886 - RNA, 64 nt, Human
uuaauaaugccugugaacuaaaaaaaugggaagcccuccccaaaaaaagugcauaaaauguuau

SEQ ID NO: 240887 - RNA, 64 nt, Human
uuucaccucugccucaucuuuccucccgucccugccccgccaccuccccaaagaauugaaacgu

SEQ ID NO: 240888 - RNA, 64 nt, Human
cauggugggggaggaaccucaggggcuaugcagcccccgccagcugcccucgaaucccguccag

SEQ ID NO: 240889 - RNA, 64 nt, Human
gucaccagacccuauugcuucaacagugcuuggcccccgccagcuugucccagccacucuagcu

SEQ ID NO: 240890 - RNA, 64 nt, Human
aagcccaggaucugucccgugccgccgcugcuccccuccccagacaccucuccacgucuccuac

SEQ ID NO: 240891 - RNA, 64 nt, Human
aggggagaaggaaaugcagggcacaugaucuggcccuccccagaacaaucuggauuucacggag

SEQ ID NO: 240892 - RNA, 59 nt, Human
ugggggccaggagacccugacccacggccccuccccacccccacccggcucacccccgg

SEQ ID NO: 240893 - RNA, 64 nt, Human
cauucaugagggcucuccccuugugauucuguccccuccccaagaccccaccucauaucaucuu

SEQ ID NO: 240894 - RNA, 64 nt, Human
cgacagacgcuggaugcccuccuaccgccagacaccuccccagaggccuuggaccuccuuaggc

SEQ ID NO: 240895 - RNA, 64 nt, Human
ugccuggaccuguccaccugagaggccccuggggccuccccagcugcuggccagacccuggcgc

SEQ ID NO: 240896 - RNA, 64 nt, Human
gcaggggcccugucgcgggcacagcccaaggcugccuccccacggugcgugcccuggugcugcg

SEQ ID NO: 240897 - RNA, 64 nt, Human
cacucaaacaucuccucuuggugccuuccugggcccuccccagcuccagcucucccagaccuac

SEQ ID NO: 240898 - RNA, 64 nt, Human
gagagcaugagcacuucccugaguccucaccagcccuccccauuuguccuccaagacuccacuc

SEQ ID NO: 240899 - RNA, 64 nt, Human
cagguccugaauuuuacuuugccuuaagaagugcccuccccacaaugcaggagaggcacagagu

SEQ ID NO: 240900 - RNA, 64 nt, Human
ccuucccuagccccagcauuucacccagaugacaccuccccaaaguccacagacucucugaaag

SEQ ID NO: 240901 - RNA, 64 nt, Human
ugccccacggagacagaggaaagggcuggcucccccuccccaggcuggagacccccccccaacu

SEQ ID NO: 240902 - RNA, 64 nt, Human
cacguuggccggcggcuacucuggaauguuuuucccuccccagaaucaagcuuuugcuugaucc

SEQ ID NO: 240903 - RNA, 64 nt, Human
cagaggguguggcuuuccaggcacccucagggagccuccccaucuguccagcuggggccagagg

SEQ ID NO: 240904 - RNA, 64 nt, Human
cuggacuguggacccucugcugcuccgccucuccccuccccacuggcucugucugcucuccugc

SEQ ID NO: 240905 - RNA, 64 nt, Human
gacuauggagccaaugggaugugacuucgcucaucacggacagucauuccuucuccuuuccagg

SEQ ID NO: 240906 - RNA, 64 nt, Human
aaacaaccacgcagacagucacaccacggggacacacggacagacgcagacggacacagcgaca

SEQ ID NO: 240907 - RNA, 64 nt, Human
aggaggggggcccucguagggacgcguacacucacacggacacacauggccacacgcaugugcg

SEQ ID NO: 240908 - RNA, 64 nt, Human
gagaugggggugggggaugcuucugggggcccugccuccccauugugugcccagaacaucccug

SEQ ID NO: 240909 - RNA, 64 nt, Human
cuuaaccuaaaccauaauuguaaccagugccuuuccuccccacuggagggcaagcccccccacc

SEQ ID NO: 240910 - RNA, 64 nt, Human
cggacucaaacgccgcugacugccacccacacgcccuccccagacuccaccgucagcuguaacc

SEQ ID NO: 240911 - RNA, 64 nt, Human
accuuaaucuuaagccauguccucaucugcccacccuccccaacccacauaccuccauuccacu

SEQ ID NO: 240912 - RNA, 64 nt, Human
gcgucugucaacccucuccacuucugggcugaagccuccccaagccccgcugcgccaaccugug

SEQ ID NO: 240913 - RNA, 64 nt, Human
accauggcugcugcuuucugcccagcucgccaguccuccccaaagaguugcgcaucagcaccug

SEQ ID NO: 240914 - RNA, 64 nt, Human
auuuggaaauuguugcuguguucugugaaaauaaccuccccaaaauaauuaguaacugguuguu

SEQ ID NO: 240915 - RNA, 64 nt, Human
aggcccccuaccagugcaugagacacacaccuacccuccccagcuuuccaggaacccuacuggc

SEQ ID NO: 240916 - RNA, 64 nt, Human
acuacuguuuccaugucccaugauccccucucuuccuccccacccugaaaaaaaugaguuccua

SEQ ID NO: 240917 - RNA, 64 nt, Human
uguaguucuggauaaacuauuucauccgcuguuuccuccccaaaacacacacacagagcaaacu

SEQ ID NO: 240918 - RNA, 64 nt, Human
gccccacccaggcaggggcuucccacagccucuuccuccccaugucaccacaacaaagugcuuc

SEQ ID NO: 240919 - RNA, 64 nt, Human
ggcccaucgugccugccgccccuucaggucccgaccuccccacaauaaaaugugauuggaucgu

SEQ ID NO: 240920 - RNA, 64 nt, Human
ugccauuggcaacaguggcccugcagcccccagcccuccccacccagguuuucggcccagugaa

SEQ ID NO: 240921 - RNA, 64 nt, Human
ggcgggggagccccgaccaguggggacacuccucccuccccagugagcagaaggcaccguggug

SEQ ID NO: 240922 - RNA, 64 nt, Human
cugucuuuggugucagaacuuugggggccgggccccuccccacaauaaagaugcucuccgaccu

SEQ ID NO: 240923 - RNA, 64 nt, Human
agguguacaaaggcuacauggaugacccgaggaacacggacaaugccuggaucgagacgguggc

SEQ ID NO: 240924 - RNA, 64 nt, Human
aaaaagaggugugcugcuugucagcauguauugucacggacacucaauaagugccauuuuggac

SEQ ID NO: 240925 - RNA, 64 nt, Human
caucggagcaguugacggcagggacaaaugaguacacggacagucugaccuccagcaccccuuc

SEQ ID NO: 240926 - RNA, 64 nt, Human
ugaccuuuacauuuaaagcuguucauccauggugccuccccaaaucauaagaccaaagaccacc

SEQ ID NO: 240927 - RNA, 64 nt, Human
gcauuauagcauuccauuagcaagaguuguacccccuccccagucuucgccuuccucuuuuuaa

SEQ ID NO: 240928 - RNA, 64 nt, Human
ggcuacugggcuguggucucugacccccuggaggccuccccacgccucacagaacacagugcag

SEQ ID NO: 240929 - RNA, 64 nt, Human
gggaggcccagcccugcaggugggacuggcucucccuccccagccacgaguaugccacaggggg

SEQ ID NO: 240930 - RNA, 64 nt, Human
cccucucucucccucucucucccucucucuuuacccuccccagggcuccaucuccgccucaggg

SEQ ID NO: 240931 - RNA, 64 nt, Human
agcacauaauuacuaccuuccccuuggcggcucuccuccccaacccccaccccacaauuuuaug

SEQ ID NO: 240932 - RNA, 64 nt, Human
uaccucagaucauagaguuuguaaaguuugugucccuccccaguuuuucagucuguugaauguc

SEQ ID NO: 240933 - RNA, 64 nt, Human
accaccgcccgccucaguuccuuugcgucuguugccuccccagcccugcacgcccuggcuggca

SEQ ID NO: 240934 - RNA, 64 nt, Human
ggccagcguccuccuccacagccugucacugcccccuccccagccuguguccacagugcuguga

SEQ ID NO: 240935 - RNA, 64 nt, Human
cccuucuugcuggggaggggacgaguucuacccaccuccccacacuggcacucagccagcugcc

SEQ ID NO: 240936 - RNA, 64 nt, Human
accagcccgaacaccauugagggagcugggagacccuccccacagugccacccaugcagcugcu

SEQ ID NO: 240937 - RNA, 64 nt, Human
acugaacugggucacucgggaucuguguucgaauccuccccaccccuuucuuuguggaguuucc

SEQ ID NO: 240938 - RNA, 64 nt, Human
uccugugccugccuuccccaccccagcaguggccccuccccauccccucccucuguucgucccg

SEQ ID NO: 240939 - RNA, 64 nt, Human
cguguccguggauuagugagucuguggccugugcccuccccacucccaggcggggcaggaaggg

SEQ ID NO: 240940 - RNA, 64 nt, Human
cagcuggaugccaccucugcaggggagaaggcucccuccccauggggcagcaucaggacggggg

SEQ ID NO: 240941 - RNA, 64 nt, Human
ccucucuaggcagcgggugggcacagccccucaccacggacacggacagaggaccaccucccca

SEQ ID NO: 240942 - RNA, 64 nt, Human
agaacugaccagcccucaucauuccccauaaaaccacggacagcgucugugugcgcaucuugag

SEQ ID NO: 240943 - RNA, 64 nt, Human
ggccugcguggaaggccuccgcucccugcacacacacggacaggaauuuccgugacuguggugu

SEQ ID NO: 240944 - RNA, 64 nt, Human
ucguggcaagaacuagcgugagcccagccaggcgccuccccaccgggcucucaggacacccugc

SEQ ID NO: 240945 - RNA, 64 nt, Human
cccgacuccccguucagaccagagugccccggccccuccccagccugagucuucuccuugcucu

SEQ ID NO: 240946 - RNA, 64 nt, Human
uguagauuuaacacccagacggcugacuuguaacccuccccacuagccuucugagcauuuaaac

SEQ ID NO: 240947 - RNA, 64 nt, Human
uaacagcagucagguuguuuaccagcccuuugcaccuccccaggcagagggagccucuguucug

SEQ ID NO: 240948 - RNA, 64 nt, Human
gcaccuacugugcagaacucuccacuuccccaacccuccccaggugggcagggcggagggagcc

SEQ ID NO: 240949 - RNA, 64 nt, Human
uugggggauggcggcagauguuagccaggucugcccuccccauucaagccccuucuccacugua

SEQ ID NO: 240950 - RNA, 64 nt, Human
ugaggccuuuccauagcuccacagcuucccaccuccuccccaccaaaccgggguucuagaguua

SEQ ID NO: 240951 - RNA, 64 nt, Human
guucucacuuccuucuucuggaguuuaaccagauccuccccacccccgcucccucauagucuac

SEQ ID NO: 240952 - RNA, 64 nt, Human
gccuucaugcccuagggccccccaagugccugccccuccccagaguauuaacgcuccaagagua

SEQ ID NO: 240953 - RNA, 64 nt, Human
ggccccgcccagucccgcaguacauccccuguccccuccccaaccccaagugccuucaugcccu

SEQ ID NO: 240954 - RNA, 64 nt, Human
gaggacaagccuguucuccauuucuucacucuccccuccccauauagcaacucucccagguuua

SEQ ID NO: 240955 - RNA, 64 nt, Human
uccucugccaccugccuggcuucacccuccaaggccuccccauggccacagugggcccacacca

SEQ ID NO: 240956 - RNA, 64 nt, Human
cucggugugaggcugcagugggugggggauggauccuccccacacaucugaggacacacaacca

SEQ ID NO: 240957 - RNA, 64 nt, Human
cugccuggaccugcaggcccuccuaggcccacuuccuccccagcacaguguguguucccgggcg

SEQ ID NO: 240958 - RNA, 64 nt, Human
uucugucucuugaggucccuugaaucuuccgcuuccuccccaccgauuucagcguguccacauc

SEQ ID NO: 240959 - RNA, 64 nt, Human
cccgcauuccacucagccaggguccagcugcagcccccgccacccuuccuucccuucccugucc

SEQ ID NO: 240960 - RNA, 64 nt, Human
ggaggaauagagggggacagucugucaccucccuccccgccacuuuguguagauccuaccugga

SEQ ID NO: 240961 - RNA, 64 nt, Human
ugggccaggggcggccggacccgucccuccacgaccccgccaccccuccuaggccuggcuuugu

SEQ ID NO: 240962 - RNA, 63 nt, Human
agguggagggggaagccugacuuggccaccuccccuccccacagccuuccucacccuuggcug

SEQ ID NO: 240963 - RNA, 64 nt, Human
ggguuggaaggaccuuaaaggucaucuaguuuagccuccccacccccucugaaugcuugaaucc

SEQ ID NO: 240964 - RNA, 64 nt, Human
cuccuuaucccccaugguguuuauuauuuauuucccuccccaugccccuggggaccccaaggcc

SEQ ID NO: 240965 - RNA, 64 nt, Human
caagaccuuuagugccacaaauaagcaucgagcaccuccccauucacacccccauuccuccugg

SEQ ID NO: 240966 - RNA, 64 nt, Human
cgccuccuggguucaagagauucuccugccucagccuccccaguagcugggauuacaggcucau

SEQ ID NO: 240967 - RNA, 64 nt, Human
cucggggaagcaggaggagggcuagaagccagucccuccccaccugcccagagcuccaggccag

SEQ ID NO: 240968 - RNA, 64 nt, Human
gccggcuucuccccucuugugaagcacaaaguccccuccccaccuacccuuccugcagauggcu

SEQ ID NO: 240969 - RNA, 64 nt, Human
uggaaggcucagcucuuuggggggucuggggugaccuccccaccuccuggaaaacuuuagggua

SEQ ID NO: 240970 - RNA, 64 nt, Human
ccagcaucaugaccuugugccaguccugguccucccuccccagccgcuccuaccaccuuuuggu

SEQ ID NO: 240971 - RNA, 64 nt, Human
ugggggcuucucucucugggaggggugcaggugcccuccccaggcugggaggguuccuucccua

SEQ ID NO: 240972 - RNA, 64 nt, Human
ugguaccugcggguggagagggccaucaccgaggccuccccagcgcacugaauguccccgcgca

SEQ ID NO: 240973 - RNA, 64 nt, Human
cuguguccaccggccaugaggagcccacgccuguccuccccaucacuuuccugucccugagaac

SEQ ID NO: 240974 - RNA, 64 nt, Human
acccccauggcucgggucaguccucaucgcucccccuccccaccccgcgcaggccacugagacg

SEQ ID NO: 240975 - RNA, 64 nt, Human
cgcucgcugugugccuuaaacuccaucucaugucccuccccauccccuggcuuucccucccucc

SEQ ID NO: 240976 - RNA, 64 nt, Human
uaggccccguccccaccucaaaucacacacacccccuccccaccacagagacaccauuacauac

SEQ ID NO: 240977 - RNA, 64 nt, Human
gguucaggcccggaggaggguuugcggguaguugcacggacaauucggcggggugcugccuguu

SEQ ID NO: 240978 - RNA, 64 nt, Human
cccaccggcgcgcucuucgcgcccgccccugcagcacggacaauaaaccuccgccaaugcacgg

SEQ ID NO: 240979 - RNA, 64 nt, Human
gaugcagccccguggacaugaagacacaaucucccacggacagcuuucccccuuccgcccucuc

SEQ ID NO: 240980 - RNA, 64 nt, Human
auggggcgaggaggccugcaccccaguauaagggccuccccagcugaguaagaagcugcuuccc

SEQ ID NO: 240981 - RNA, 64 nt, Human
ccgaacggaacaagggguccagcuugcgggggacccuccccagcccauuccugcugucaaacaa

SEQ ID NO: 240982 - RNA, 64 nt, Human
ugcggcagacgggaggggaaaggcugccgaggacccuccccacccugaacaaaucuuggguggg

SEQ ID NO: 240983 - RNA, 64 nt, Human
acggaacgcucccacugcaggcaaaccgugacgcccuccccacucgggagaagcagagcugacc

SEQ ID NO: 240984 - RNA, 64 nt, Human
ucucaacgaaaaacaauuuacugaagccgacuccccuccccaucucccucucaaccucaaccca

SEQ ID NO: 240985 - RNA, 64 nt, Human
ugauggauugcaucauuuaaguguugauguaucaccuccccaaaacuguugguaaaugucagau

SEQ ID NO: 240986 - RNA, 64 nt, Human
auugugaguauaugaauacggggaaauagaacccccuccccaccaccuacacacaugcuguuuu

SEQ ID NO: 240987 - RNA, 64 nt, Human
cagcugaaaagagcuuuguauuauuuuuuaauucccuccccagauaucauuuaggaguauuaua

SEQ ID NO: 240988 - RNA, 64 nt, Human
auuuugaaaacaaauucccuacuaucaucacaugccuccccaaccccaagucaaaaacaagagg

SEQ ID NO: 240989 - RNA, 64 nt, Human
ugugugugccuguguguaggucccacggccucugccuccccagggagcagagccugggccuccc

SEQ ID NO: 240990 - RNA, 64 nt, Human
ggcaggcccagaagugcuggccguucuuccccagccuccccacugcucccuccucuguucccca

SEQ ID NO: 240991 - RNA, 64 nt, Human
uacugaaauugucacccagaauuugaauccugacccuccccacugcaagcccagggagccccag

SEQ ID NO: 240992 - RNA, 64 nt, Human
cuucccuccccuuccuccaaaacccucccucccaccuccccacacccauugagucauucacagg

SEQ ID NO: 240993 - RNA, 64 nt, Human
uccucucccuuccuguguggcccuugugaaucagccuccccacucuccuuggucauucucaaga

SEQ ID NO: 240994 - RNA, 64 nt, Human
acucaggggucacugaggccugagacccaggacuccuccccacccuccuggccucagacugcac

SEQ ID NO: 240995 - RNA, 64 nt, Human
ugggucccaagaucuucgccuccuucccuggggccacggacaucagcaguggguuggguggcga

SEQ ID NO: 240996 - RNA, 64 nt, Human
guccuggugcagugagggcagcccugcauccuggcacggacacugacucuuacagcaauaacuu

SEQ ID NO: 240997 - RNA, 64 nt, Human
acgccacgcaggcggcggggcgcuggggaaucuuccuccccagcccccgggcucgggaguuaug

SEQ ID NO: 240998 - RNA, 64 nt, Human
uuuaaagaaaaaugcuaagggcagcccugccugcccuccccaucccccgcuguaaauauacacu

SEQ ID NO: 240999 - RNA, 64 nt, Human
uugacgugcagaaucucaguggcaucuggguucaccuccccacucugaugaucuccagccucca

SEQ ID NO: 241000 - RNA, 64 nt, Human
ggcucacccucccuuuccuuuuccccucuucuacccuccccaagaaaaagggccuucaaggcag

SEQ ID NO: 241001 - RNA, 64 nt, Human
acgucgcaagccucucuggaaagagugugcugccccuccccaucuccaugcccucuccuucugu

SEQ ID NO: 241002 - RNA, 64 nt, Human
guuucucgaaggugcuuggcggucuugccuucccccuccccacaggcucuccuugugggguccc

SEQ ID NO: 241003 - RNA, 64 nt, Human
gggccgagucccgccuggugggcauuugccgccgccuccccaccaccagucacugccucgcaga

SEQ ID NO: 241004 - RNA, 64 nt, Human
gacuccaccccagggacacggcagggucugcagaccuccccaugcuagaucagccguauuucau

SEQ ID NO: 241005 - RNA, 64 nt, Human
agaaccgcucuccccuucccugcccagugccccuccuccccagcccagacccccaggugcccaa

SEQ ID NO: 241006 - RNA, 64 nt, Human
gguguggccgcccugggggccaggcccucgccauccuccccauccuuguuccucagcaaauggc

SEQ ID NO: 241007 - RNA, 52 nt, Human
cggugauccaugaacucugaccccuccccaguaaaggcuucuguagagagca

SEQ ID NO: 241008 - RNA, 64 nt, Human
cucccacauugugucaagucugcccauggcccacccuccccacaguccaaaaccacacagcccu

SEQ ID NO: 241009 - RNA, 64 nt, Human
ugccagccuggaggaggaaagggagccugcucucccuccccacaccccacccaaagcauacacc

SEQ ID NO: 241010 - RNA, 64 nt, Human
gcguagccucuaucucguauuuuuuucuauuucuccuccccacaccaucaaugggacuauucug

SEQ ID NO: 241011 - RNA, 64 nt, Human
aaccauuuaaaagccugagcaaggaccaccacccccuccccaccaaauuauucggucucuuucu

SEQ ID NO: 241012 - RNA, 64 nt, Human
uauuuauugccacagcagagucuaauuuauaugccacggacacuccuuagagcccggauucgga

SEQ ID NO: 241013 - RNA, 64 nt, Human
guugaugaguucaucugaagaaauucaggccccaccuccccacccugccccucccugcucccuu

SEQ ID NO: 241014 - RNA, 64 nt, Human
uauucuccaaaguagucugugugugaccugucccccuccccaaagauuaaggaucacuguauag

SEQ ID NO: 241015 - RNA, 64 nt, Human
ggaaggugaguggagaggggcaccugccccccgcccuccccauccccuacucccacugcucagc

SEQ ID NO: 241016 - RNA, 64 nt, Human
uccccucuuucuccuguccucucucuguccuucaccuccccacuccagccccggcucaguucag

SEQ ID NO: 241017 - RNA, 64 nt, Human
gccgccugaaugccgagcuaacuguugccacucuccuccccagacuaugaaaucccuggagaau

SEQ ID NO: 241018 - RNA, 64 nt, Human
accaaggucgguuuccgcccucuagcgaugcuguccuccccacuccuccgcucugcucccuggc

SEQ ID NO: 241019 - RNA, 64 nt, Human
acccggugggacacuccccuucuccccacuuucaccuccccacccaaacuuuauaaaaguugaa

SEQ ID NO: 241020 - RNA, 64 nt, Human
cucuucaagcagcaauccaacccagagcaggggcccuccccacucaggcaucugauaaccucug

SEQ ID NO: 241021 - RNA, 64 nt, Human
uucacugucugccaugauuguaaguuuccugaggccuccccagccauguggaacagugagucaa

SEQ ID NO: 241022 - RNA, 64 nt, Human
agacaguagggauguaaaggccugggagcuagacccuccccaagcccauccaugcacauuacuu

SEQ ID NO: 241023 - RNA, 64 nt, Human
cucaccaguuuggagggaagcugguuacuuuuggccuccccagcaccccugcccaucuggugcc

SEQ ID NO: 241024 - RNA, 62 nt, Human
gggcccccgagccccgauaggugcugccuggcccuccccacaaugccagaccgcagagaggc

SEQ ID NO: 241025 - RNA, 64 nt, Human
ccaggauuuggggcugagcugguuuccccuccuuccuccccaagggcuuacucuuucucuugcu

SEQ ID NO: 241026 - RNA, 64 nt, Human
ucugguuccugcacaaccucagaggggcaaaaacccuccccaggaaggaggaggguguucagga

SEQ ID NO: 241027 - RNA, 64 nt, Human
uucugcugcuuggauggguggauuuggugcucagccuccccaaggacaagcuccucccccugua

SEQ ID NO: 241028 - RNA, 64 nt, Human
ccugagagagcucagcacacacacagcucagacccacggacaggaccccgggacagaaccccgg

SEQ ID NO: 241029 - RNA, 64 nt, Human
guaggcagccugccgcaaacacacggauggcuccccccgccacgaagguugagaacaaagccag

SEQ ID NO: 241030 - RNA, 64 nt, Human
gggccuccuaccugugccuuucucugaggggacaccccgccagagagggccccgggagccgggg

SEQ ID NO: 241031 - RNA, 64 nt, Human
gggacaagcuguggagcuggcugagucacagccaccuccccaccuccccgcaagcuggucccau

SEQ ID NO: 241032 - RNA, 64 nt, Human
gugugggugaccugcccucaaaccuugccugccaccuccccauucaggccugguggcaggaagg

SEQ ID NO: 241033 - RNA, 64 nt, Human
uagcccgccaucccccaggucaccugucuggauuccuccccauucacccaccuugccaggugca

SEQ ID NO: 241034 - RNA, 64 nt, Human
cugguucugccacugagccccugaggaaucugacccuccccaaaagaagcagugaaauggacca

SEQ ID NO: 241035 - RNA, 64 nt, Human
aggugaagggguaggaggagggcccucagcuggcccuccccacacacaggacggcaggggcacu

SEQ ID NO: 241036 - RNA, 64 nt, Human
cucugcccuuccacucucugaccaccgcccccgcccuccccacccagcuccgcuucuuguuacu

SEQ ID NO: 241037 - RNA, 64 nt, Human
uugcugagaugaccucuuuuaaaagcaaagccccccuccccauacaccccaagccugagcccug

SEQ ID NO: 241038 - RNA, 64 nt, Human
acggcguggcugugcuuccuggggaaaugaacccccuccccacagacaccacccuggguggauc

SEQ ID NO: 241039 - RNA, 64 nt, Human
uccagaggugucgggacaugguugggggaaugcaccuccccaaagcagcaggccucugguugcc

SEQ ID NO: 241040 - RNA, 64 nt, Human
gauggaaauaccuacaagagugaaggucaagggcccuccccaggcaucucauucauuacucagc

SEQ ID NO: 241041 - RNA, 64 nt, Human
uaucucuggccuccugggggcccauucugcaugcccuccccacuucccccgauucagagacuua

SEQ ID NO: 241042 - RNA, 64 nt, Human
gcccuccuccccucucagccuccucuuuagcuagccuccccaucucaucacaacgcaugucugu

SEQ ID NO: 241043 - RNA, 64 nt, Human
uguuucguauauuuuuguuucacaguuaaucuucccuccccaaguuugcuauucaaaucaacug

SEQ ID NO: 241044 - RNA, 64 nt, Human
cauuccaugacuucccaccgcgcccucgcuccuaccuccccacaccucucucugaguccccagg

SEQ ID NO: 241045 - RNA, 64 nt, Human
gccaaggagcugcuucucucuucucccaguucuaccuccccagaagccuuccuccccagguggg

SEQ ID NO: 241046 - RNA, 62 nt, Human
uuguaagaagcugcccucuguuuuuuuuauccacucguaaaucuggauuuauuucuucuguu

SEQ ID NO: 241047 - RNA, 62 nt, Human
uuccaugagcucuuggaggcaccaagaaauaaacucguaacccuguccuucagauggccuug

SEQ ID NO: 241048 - RNA, 62 nt, Human
cucucuggcuccugugcauucuuugaauagucacucguaaaaacugucagugcuugaaacug

SEQ ID NO: 241049 - RNA, 64 nt, Human
ucucuucucccaguucuaccuccccagaagccuuccuccccagguggggcugauggagcaaggg

SEQ ID NO: 241050 - RNA, 64 nt, Human
cuuuccagggccccacacucacaaaggcuccaggccuccccacagaggacccugccugagcaag

SEQ ID NO: 241051 - RNA, 64 nt, Human
cuaugagauuucggugugagccuucggcaccuccccuccccaacgccucugcgccuacaccaaa

SEQ ID NO: 241052 - RNA, 64 nt, Human
guggaucacagcacacacauacauacacccuccaccuccccauccccuguucucccucuguugc

SEQ ID NO: 241053 - RNA, 64 nt, Human
guacagauaaccccucauaaagaugcuuaucuaaccuccccaguguucagguguuucacaagaa

SEQ ID NO: 241054 - RNA, 64 nt, Human
uacucccuuuccccuuucccacccucccagcucaccuccccauggagcugagaggccucccuug

SEQ ID NO: 241055 - RNA, 64 nt, Human
cagcgucaccccacucccucugucuuaugacuccccuccccaacccccucaucuaaagacaccu

SEQ ID NO: 241056 - RNA, 64 nt, Human
cugacccugggcuuucacgggccccauuccaccgccuccccaacuugagccugugaccuuggga

SEQ ID NO: 241057 - RNA, 64 nt, Human
ggagggcacuggagcugggaggucucgucccagcccuccccaucucggggcugcuguguggacg

SEQ ID NO: 241058 - RNA, 64 nt, Human
guccucaggucuaggcagggcugccgguucuccaccuccccauccgccccaggcccccugccug

SEQ ID NO: 241059 - RNA, 64 nt, Human
uuacccagaagcccuguaagccuggccccuggccccuccccaugucccuccaggccucagccac

SEQ ID NO: 241060 - RNA, 64 nt, Human
caccucccagguucaagcaguucuccugucucagccuccccaguagcugagauugcaggcacau

SEQ ID NO: 241061 - RNA, 64 nt, Human
ggcuggagucuccaccauagacucaguggccuggccuccccagaccccagagccaagaacacua

SEQ ID NO: 241062 - RNA, 64 nt, Human
agcauggucccacugaaguccuacuacgcccuccccuccccagccuuuuccagaaaccauacug

SEQ ID NO: 241063 - RNA, 64 nt, Human
uggauacgcuaugaacucucaccggcuccccagcccuccccaccaagggguacugcaggggaag

SEQ ID NO: 241064 - RNA, 64 nt, Human
uuguaguaacaacuauuggguccugucagaccuccacggacagcaaagugguuuuaaugcaagc

SEQ ID NO: 241065 - RNA, 62 nt, Human
gaaagccacgauggacuuacaagcuuuaauggacucguaagccagcaugggcuugcaaaaau

SEQ ID NO: 241066 - RNA, 62 nt, Human
cagaggaaugaggcccaauuaauugugguguuacucguaauuagugcccuguguacuuuuuc

SEQ ID NO: 241067 - RNA, 64 nt, Human
ugcaaccuucaucugcacugggcccugugccccuccuccccauccaugguccccagcagugccu

SEQ ID NO: 241068 - RNA, 64 nt, Human
gggccugaaccacagcggaggagcuccgcuaagaccuccccacccccgcugggggugggggcgg

SEQ ID NO: 241069 - RNA, 64 nt, Human
ugaccaucugugcggucaggguacacucagcucuccuccccaacuccagcagccuuuaagaagu

SEQ ID NO: 241070 - RNA, 64 nt, Human
ccagcccucuucugacacuaaaacaccucagcugccuccccagcucuaucccaaccucucccaa

SEQ ID NO: 241071 - RNA, 64 nt, Human
guggaggaguuuccuugcugagauuucaaauaguccuccccaccucaacugucaccacugcuaa

SEQ ID NO: 241072 - RNA, 64 nt, Human
gacacagccccagaagggggcauuaugggcccugccuccccauaggccauuuggacucugccuu

SEQ ID NO: 241073 - RNA, 64 nt, Human
aaaaauguuagaguacuugucaucuugaauauagccuccccaagagagaacagggugguauucu

SEQ ID NO: 241074 - RNA, 64 nt, Human
aggcccguccggcaguucugggugcucccuaccaccuccccagccuuugaucagguggggaguc

SEQ ID NO: 241075 - RNA, 64 nt, Human
ucccagccugggcucugggagugggggcuccagcccuccccacuaugcccaggagucuucccaa

SEQ ID NO: 241076 - RNA, 64 nt, Human
uggagaggccuggggcugugggaugccccaucccccuccccaucaccuuuggugggggcagggc

SEQ ID NO: 241077 - RNA, 64 nt, Human
auuugagauagaggccuuuaaauacauuccaugcccuccccagaaaauagucugugggagucag

SEQ ID NO: 241078 - RNA, 64 nt, Human
aucuauagguccuuuuccugccuccuucacauuuccuccccagcuuuugcggccacaacacauc

SEQ ID NO: 241079 - RNA, 64 nt, Human
gaguccccgcaccaggcagagccguaccugucacccuccccaagcgccugcaccgcggugcaag

SEQ ID NO: 241080 - RNA, 64 nt, Human
ccgaugcccgcagagcccgcaccccccggcccugccuccccaggcggugccccugagccccccg

SEQ ID NO: 241081 - RNA, 64 nt, Human
ggugggcacucaccucagcagagccucaaugccaccuccccacaccacccaagccuagcugggu

SEQ ID NO: 241082 - RNA, 62 nt, Human
uagucgagugcucuaguuucugucucucaggcacucguaacuaaggaccaccauuggccauu

SEQ ID NO: 241083 - RNA, 60 nt, Human
cauuuuuaaggcaauuaaauauagauauuuccacucguaaaggacaucuacuagcuguga

SEQ ID NO: 241084 - RNA, 62 nt, Human
uuaaaauuaugugaaauguuuuaaauuugugaacucguaauuacuguuuuaaugauucaguu

SEQ ID NO: 241085 - RNA, 64 nt, Human
aggcagcuagcccaggacggagcaagggaagaccccuccccagcccucccgucggcaggggcag

SEQ ID NO: 241086 - RNA, 64 nt, Human
cccauaagggcuggcggcuuccuccgacgccgccccuccccacagcuucucgacugcagugggg

SEQ ID NO: 241087 - RNA, 64 nt, Human
auucucaugagcucauccaagccaagguuggaccccuccccaagaggccaacccagugcccccu

SEQ ID NO: 241088 - RNA, 64 nt, Human
gcuauuccuaggccucaggccucccaaauaugccccuccccaguagcuacgguucccugccuag

SEQ ID NO: 241089 - RNA, 64 nt, Human
ugugugcagagcuucacccuacccuucuuacacaccuccccaccccugucagucugcuccccau

SEQ ID NO: 241090 - RNA, 64 nt, Human
uuuguucuuaaguaaaaaaucauuuuuccuccucccuccccaaaccccaaggaacucucacucu

SEQ ID NO: 241091 - RNA, 64 nt, Human
uuugcugaauuaaaguacucugacauuucaccccccuccccaacaaagaguuauuaaagagccc

SEQ ID NO: 241092 - RNA, 64 nt, Human
gggcaaaggggagauguagcuaacugguggcccuccuccccaucucaguuugcaacucaagggc

SEQ ID NO: 241093 - RNA, 62 nt, Human
gguaagucuuugaaacuauuaaaucaugucccccccuccccaaauucccuguucuacccguu

SEQ ID NO: 241094 - RNA, 64 nt, Human
ccuugcucucaguagcgucagccccaguucugagccuccccacauuacacuuaacaagcaguaa

SEQ ID NO: 241095 - RNA, 64 nt, Human
ucagaggugacagaagcguucaggggugccugggccuccccaggagcuguggacucaguuccug

SEQ ID NO: 241096 - RNA, 64 nt, Human
guggggaggggaggagaacugcucacuccuuuucccuccccauacaaacucaaaguccccuggg

SEQ ID NO: 241097 - RNA, 64 nt, Human
caggcagggugugcccuuccuccgcaugccccucccuccccacggcccugccaagcagucuaua

SEQ ID NO: 241098 - RNA, 64 nt, Human
cccagguccucuuacauuugacauaagcaauuuaccuccccacauuuccaggaccucuaugaca

SEQ ID NO: 241099 - RNA, 64 nt, Human
auuggggcuuguuuaggauuggagggccaggucaccuccccagccacccucccuucucuccucu

SEQ ID NO: 241100 - RNA, 64 nt, Human
uuagaguguucagccugaccccgccucaccaauacacggacacaaccaaaucauaacauauagc

SEQ ID NO: 241101 - RNA, 64 nt, Human
ccagcaucaucugagaggcuggagcagggucacccacggacagagaccaagagagguccugcga

SEQ ID NO: 241102 - RNA, 64 nt, Human
ggaacacgggacagacgccggcgacgcgcagacacacggacacgcggaagccaagcacacucug

SEQ ID NO: 241103 - RNA, 64 nt, Human
ccauuagccaagggcagggggccccuuugcugacccuccccaaaggcuuugcccugcugcccuc

SEQ ID NO: 241104 - RNA, 64 nt, Human
ccuugggaggggacaccugaggcagccagcgcccccuccccaguccccagaacugccugcaggu

SEQ ID NO: 241105 - RNA, 64 nt, Human
gagagauauucuuucuucugccuuggaguucggcccuccccagacuucacuuaugcuagucuaa

SEQ ID NO: 241106 - RNA, 64 nt, Human
ucagcuuuccaggcuguucccaaauagcucccugccuccccacugccccuaaagccacagcaga

SEQ ID NO: 241107 - RNA, 64 nt, Human
ucaccagaacccaggcgcugccccagcaccuucuccuccccagguuacuugcuucuaggacucu

SEQ ID NO: 241108 - RNA, 64 nt, Human
gagucagaucagcuccuaagggggugacgccugcccuccccagagcacuggguugcaggggauu

SEQ ID NO: 241109 - RNA, 64 nt, Human
cuuagagccccuaagccagcaugggcccuuucccccuccccaccaagaacuuugcauggcucug

SEQ ID NO: 241110 - RNA, 64 nt, Human
ggcucccuauacuuuucugucuuccagguucuacccuccccacagaccuaagcugcucccaguc

SEQ ID NO: 241111 - RNA, 64 nt, Human
gugccagaugacagucagaggcgcaggagcccucccuccccacccccacccuguaacuccagcu

SEQ ID NO: 241112 - RNA, 64 nt, Human
accggcugggcgugugaugcgaucagcccugucuccuccccaccucccaaaggucuaccgagcu

SEQ ID NO: 241113 - RNA, 64 nt, Human
accaucuccccgaccacugcccagcccucugcucccuccccagaggaggcgggagggugggcuc

SEQ ID NO: 241114 - RNA, 64 nt, Human
ugaagcccaucgccucuagcggggacccuccuuuccuccccaucccaccugugugcagugcccu

SEQ ID NO: 241115 - RNA, 64 nt, Human
cugccaccuaccaugcaccauguuccuugccaggccuccccaaccccuggccucaauuucccuu

SEQ ID NO: 241116 - RNA, 61 nt, Human
ccccgagcccagcuuccuaacccaagacacaccuccccaaccucagucuucccaucugaac

SEQ ID NO: 241117 - RNA, 64 nt, Human
cgcagaacaugccagguguccucacucaccccacccuccccaauuccagcccuuugcccucucg

SEQ ID NO: 241118 - RNA, 64 nt, Human
ccacacggcucggugucagauggugucaggcugucacggacauagggauaaacuugguuaggac

SEQ ID NO: 241119 - RNA, 64 nt, Human
gcggagcuguuagggacgggcccagcuccugcaccacggacacagaaugucuggagagggccag

SEQ ID NO: 241120 - RNA, 64 nt, Human
aagucacaaccucccaggcuccucauuugcuagucacggacagugauuccugccucacagguga

SEQ ID NO: 241121 - RNA, 64 nt, Human
ucccagcccaccagcccucugcccaccucacaugccuccccauggauuggggccucccaggccc

SEQ ID NO: 241122 - RNA, 64 nt, Human
ucuccacucccuacugucucaccccucgguguguccuccccaacuuuggagaccaagucagggc

SEQ ID NO: 241123 - RNA, 64 nt, Human
gaaacagaaggagggauuucaggagaggcuggcuccuccccaagguuaguccccagacugagaa

SEQ ID NO: 241124 - RNA, 64 nt, Human
uucugacccaccaaagaccuucugccuucacccuccuccccaccugaugucccucugugucuga

SEQ ID NO: 241125 - RNA, 64 nt, Human
ggaggaagccagcugcaauguggagacacguccuccuccccaacccaccucaugccaccgccaa

SEQ ID NO: 241126 - RNA, 64 nt, Human
agcagagccuggaguuugagacuauggaauccaaccuccccauugcacagauggggaaacugag

SEQ ID NO: 241127 - RNA, 64 nt, Human
gcucccuagcauuccaggagccaucuuggacucuccuccccagguuugaaaggccaucagauua

SEQ ID NO: 241128 - RNA, 64 nt, Human
uucacaauugccucauguaaucugcagauuccugccuccccacuuugguucagucugucuugug

SEQ ID NO: 241129 - RNA, 64 nt, Human
acagauggcaccuguggccagagcaccucaggacccuccccacccaccaaaugccucugccuug

SEQ ID NO: 241130 - RNA, 64 nt, Human
ccauuccuccaccugaugaugcaacuaacacuugccuccccacugcagccugcgguccugccca

SEQ ID NO: 241131 - RNA, 64 nt, Human
agaguagggagaagaagggcaccauccucucuuuccuccccagggucuacugcugauuucuaga

SEQ ID NO: 241132 - RNA, 64 nt, Human
ugguguggugcuggugaggguucgccagcccuccccuccccagggucauagagggggccaugag

SEQ ID NO: 241133 - RNA, 64 nt, Human
caguaccucugugguuaaaaauggaaacuguucuccuccccagccccacucccuguucccuacc

SEQ ID NO: 241134 - RNA, 64 nt, Human
acuaagagggcccgcgccgcggccggccgccaggccuccccaugccaccacaaaggcccuuuua

SEQ ID NO: 241135 - RNA, 64 nt, Human
ggugcucucuuccugguccucugcuucucuggauccuccccacccccuccugcuccuggggccg

SEQ ID NO: 241136 - RNA, 64 nt, Human
agugugagagaccauugucucguuggcuggcgcucacggacaugcagucacgguagcgggagca

SEQ ID NO: 241137 - RNA, 64 nt, Human
ccuuacaccacuuuccaccuuccuguccgaaguacacggacacuagcugccccaggaaguugug

SEQ ID NO: 241138 - RNA, 62 nt, Human
guuggauauccauguucagcaugacagucagcacucguaaaugccaagaaaagaauuaccug

SEQ ID NO: 241139 - RNA, 64 nt, Human
ccuggagaaagaacagugugccucaaacuccugcccuccccaggccucuggggcccacuggaaa

SEQ ID NO: 241140 - RNA, 64 nt, Human
cuaagaaccccacggccccacuguccacacacugccuccccaccgcccaccucggcugcuaggc

SEQ ID NO: 241141 - RNA, 64 nt, Human
uguccagcaccagccaagcuggugcuccagcgcaccuccccagagcuccccgcacugacggggc

SEQ ID NO: 241142 - RNA, 64 nt, Human
ccagcccuuguguucccgugccccacacuuuccuccuccccacugcagugagucaauaguccag

SEQ ID NO: 241143 - RNA, 64 nt, Human
uugaggcacgaggccaggcagaucccacuugcagccuccccaggugucugccccgcguuuccug

SEQ ID NO: 241144 - RNA, 64 nt, Human
gcaaagaacugccccaucuccucccauggccuucccuccccacaguccucacagccucucccuu

SEQ ID NO: 241145 - RNA, 64 nt, Human
cagccucucccuuaaugagcaaggacaaccugccccuccccagcccuuugcaggcccagcagac

SEQ ID NO: 241146 - RNA, 64 nt, Human
gcaccaaucugugagggaaguuaggaacccauuuccuccccagaaccagaaugacuggacaauc

SEQ ID NO: 241147 - RNA, 64 nt, Human
uuuuaaaaaagcaacagaaaccuauccucacugcccuccccagucucucuuaaaguuggaauuu

SEQ ID NO: 241148 - RNA, 64 nt, Human
ggagcccuacagugaauccuuaccaguguucaguccuccccaaaacuugcauaaaaauauucuu

SEQ ID NO: 241149 - RNA, 64 nt, Human
agcugcaggagaagauggccuacuuggaucaaacccuccccagagcccccggccaggcaccccc

SEQ ID NO: 241150 - RNA, 64 nt, Human
cagaaggucaguccuaccuuuuucuuucugagagccuccccaccccgagaucacauuucucacu

SEQ ID NO: 241151 - RNA, 64 nt, Human
cccugaacccacaccugggcaucagggccuuucuccuccccaccuguagcugaagcaggagguu

SEQ ID NO: 241152 - RNA, 64 nt, Human
ucggcccaaccucagagugaaggcaggguggcagccuccccacggacuccaugcggcccgcugg

SEQ ID NO: 241153 - RNA, 64 nt, Human
ggcuggggacuucucacuuccccuugcaccccuuccuccccaaccugcaauaaauccgcuucuc

SEQ ID NO: 241154 - RNA, 64 nt, Human
gacuuuggcucccgcuuuggggagcgccucgcuucacggacaggaagcacagcagguuuaucca

SEQ ID NO: 241155 - RNA, 64 nt, Human
gaggccacauccugccccaccccacccccacucccacggacacuaaaacgcuaauaauuuauua

SEQ ID NO: 241156 - RNA, 64 nt, Human
aucuauugccuuuguaaaaaacagagaaaacgaucacggacagguaugcacugguaacaugcag

SEQ ID NO: 241157 - RNA, 64 nt, Human
cucuugguuccuaagaguuuccucagagaucauaccuccccagagggaagcaggaaugaggcca

SEQ ID NO: 241158 - RNA, 64 nt, Human
cagggacuucccgguuccuaguucuuugccagcuccuccccacucugugcgaccuuuccaagcc

SEQ ID NO: 241159 - RNA, 64 nt, Human
gagcccaggucuggguacugaguguccagagcugccuccccaggagguuaaggugggggcaaag

SEQ ID NO: 241160 - RNA, 64 nt, Human
ccacuuugugacucccuucauguaauccucuuuuccuccccacuccuccacagagggcagagcu

SEQ ID NO: 241161 - RNA, 64 nt, Human
cccagggcuucuuuccccucuggagugccuccggccuccccauccaccucugccuaaguaaauc

SEQ ID NO: 241162 - RNA, 64 nt, Human
aauagccgccgcccgcugccugcacucuaagcgcccuccccaccgcuccgcuccgggagccauc

SEQ ID NO: 241163 - RNA, 64 nt, Human
aaagcaaggaauauccccucccccucccccucccccuccccagggcucccugcuuagaaaaacc

SEQ ID NO: 241164 - RNA, 64 nt, Human
aucuccacaaccucuuccccccaaaacccgggaaccuccccagccugcgccugcugcaugcccu

SEQ ID NO: 241165 - RNA, 64 nt, Human
cuugggucuaaucuuuccccuugacccagaacuuccuccccacaaaaaugccuuuaaaaaccuu

SEQ ID NO: 241166 - RNA, 64 nt, Human
caaaugccagagauuugggguuggggaaagggccccuccccaccugacacccacuggggugcac

SEQ ID NO: 241167 - RNA, 64 nt, Human
gacuuacguaucuuuucuccuccucccuaguguuccuccccauuuuuucagaaaacacuucuga

SEQ ID NO: 241168 - RNA, 64 nt, Human
ugaauuuagucccuccauccuuaauccccccaucccuccccaucaugcaaccagugguuuaauc

SEQ ID NO: 241169 - RNA, 62 nt, Human
cuuuccaguucaacaaguaacagugggauuccccuccccaucuuuacugaauagaaaugaau

SEQ ID NO: 241170 - RNA, 64 nt, Human
cacaacccuggauccuuccucugcccuucuccugccuccccaccugcuccaugggcauaagacu

SEQ ID NO: 241171 - RNA, 64 nt, Human
ccugcccccugccagugaaguccuucagugagccccuccccagccagcccuucccuggccccgc

SEQ ID NO: 241172 - RNA, 64 nt, Human
cucccaauuggugcuaucuguuacugcccgugcucacggacauggauacagacccugcugugcu

SEQ ID NO: 241173 - RNA, 64 nt, Human
caagcauaaaccuuagcgagugcggcuggaggaccacggacauuggacucacuguggcuggacg

SEQ ID NO: 241174 - RNA, 64 nt, Human
gagaggaggagaccuucugagugugcccuuuggccacggacacuguugggaaccaaacucuguc

SEQ ID NO: 241175 - RNA, 54 nt, Human
agcaccccuacuucggauagcgccccuccccagccaguccugagccucccgcca

SEQ ID NO: 241176 - RNA, 64 nt, Human
caugcugcaaaccuguggucucugauacuaacucccuccccaaccccuguuguuggacuguacu

SEQ ID NO: 241177 - RNA, 64 nt, Human
uuuuuccucuuugcccauuuuucuucccucucuuccuccccaugagaagucugcuuguaguauu

SEQ ID NO: 241178 - RNA, 64 nt, Human
acggaauccagacucuuccuggacuggcuugccuccuccccaccuccccacccuggaaccccug

SEQ ID NO: 241179 - RNA, 64 nt, Human
cagacucuuccuggacuggcuugccuccuccccaccuccccacccuggaaccccugagggccaa

SEQ ID NO: 241180 - RNA, 64 nt, Human
gacauucacuauguuuuuaugguucauguuauauccuccccagggugacagccccuuaaggccc

SEQ ID NO: 241181 - RNA, 64 nt, Human
uuuaagcugugaauacugaaauuaugccuugucuccuccccaccccagggggaugccguuuugc

SEQ ID NO: 241182 - RNA, 64 nt, Human
gagugagggccccgggcagcaguggacgacccagccuccccauaccgggccucuggcccagacc

SEQ ID NO: 241183 - RNA, 64 nt, Human
agggccuccguccccagguccccaguggggcagcccuccccacagacgagccccccacauggug

SEQ ID NO: 241184 - RNA, 64 nt, Human
gauuuucuguuuuuaaauuguauuucaucugcuuccuccccauucucucacuuuaagugacauu

SEQ ID NO: 241185 - RNA, 64 nt, Human
ugugccccacccuggcauacagccccugacaccuccuccccagcuggucccuacagggcugcuc

SEQ ID NO: 241186 - RNA, 64 nt, Human
cccucaaagugucacaaugcuccuccugaugacuccuccccagaaaaccaccaaucggcuuuca

SEQ ID NO: 241187 - RNA, 53 nt, Human
cuuccagaccuccccagugacagccuccccagucaucuaggauucaaugacag

SEQ ID NO: 241188 - RNA, 64 nt, Human
caccgagaguagccgagagccugcucccccacccccuccccaggggagagggucuggagaagca

SEQ ID NO: 241189 - RNA, 64 nt, Human
gcugagaaccucaggcuucccuagauccagagccccuccccaucuuccucucucuaaaaacaac

SEQ ID NO: 241190 - RNA, 64 nt, Human
ggauaaggggaugugcagcaucuguguggauuuucacggacaaguuccaguaggugggacagug

SEQ ID NO: 241191 - RNA, 64 nt, Human
aucuuugaucuucugaauggauugcugucauggacacggacacggaucuucaucugguucauug

SEQ ID NO: 241192 - RNA, 64 nt, Human
aggcccuggugggaccacccagccugguauuguccacggacagcguuguucacccagagccuua

SEQ ID NO: 241193 - RNA, 64 nt, Human
uugggggcaggaucuggcccgagcucuccucagaccuccccagaccugucuucucaucagccac

SEQ ID NO: 241194 - RNA, 64 nt, Human
gagacgaggugugcuguuccuucccagccccaucccuccccacccuuccuacucccagcuuuca

SEQ ID NO: 241195 - RNA, 64 nt, Human
agaauacaccaucggcucauucccaccagcggcuccuccccaccuuucaucccacuggaaaggg

SEQ ID NO: 241196 - RNA, 64 nt, Human
ggccacccacaacccgagaaucagggagaaagucccuccccagcagcccccuccuccuggcugg

SEQ ID NO: 241197 - RNA, 64 nt, Human
gagaaauugggagugguccccaaagacccuucaaccuccccagucccccaccagacccacccuc

SEQ ID NO: 241198 - RNA, 64 nt, Human
cgucugguuggccccguguguuccuuuuccuauaccuccccaggcagccuggggaacgugguug

SEQ ID NO: 241199 - RNA, 64 nt, Human
guuccaggaacagcccuucccccaccacugggacccuccccagccuggagaguucaucacuacg

SEQ ID NO: 241200 - RNA, 64 nt, Human
uggaggugggagugugguuggagauagaaaggcuccuccccaccauguaauggcuuccucucag

SEQ ID NO: 241201 - RNA, 64 nt, Human
uuacuuccacagaauacaagccacuaccuucugaccuccccaccccccaccaacccccaucuuu

SEQ ID NO: 241202 - RNA, 64 nt, Human
cgccuuccggguucaagugacucuccugccucagccuccccaguagcugggauuacagaucugc

SEQ ID NO: 241203 - RNA, 64 nt, Human
accccugcuucucuucuuguucccuguuaucauuccuccccaacauaauaauacauaaaguggc

SEQ ID NO: 241204 - RNA, 64 nt, Human
aaguucuaggaccugguucuagccuagauucuuaccuccccaaaagcagcauauuaggcccagg

SEQ ID NO: 241205 - RNA, 64 nt, Human
guugagauggguuuucccugaugcucccgacuccccuccccaccaccucccaagguauuucuga

SEQ ID NO: 241206 - RNA, 64 nt, Human
uggcucuccccgcuucuccuggucacuggagucuccuccccauguacccaaggaagauggagcu

SEQ ID NO: 241207 - RNA, 64 nt, Human
ggaggccccaggacccugugguccccuggcucugccuccccacccuggggugggggcucccggc

SEQ ID NO: 241208 - RNA, 64 nt, Human
ccugcaguguuuaaggaacucuuuuuuuguaaaucacggacaccucaauuagcaagaacugagg

SEQ ID NO: 241209 - RNA, 64 nt, Human
ucucccuguaauccucuuccuccauuaugcaguacacggacaccuggcuacagaccaggacgug

SEQ ID NO: 241210 - RNA, 62 nt, Human
acuuaauauucucuauuuauuacuuacugcuuacucguaaugaucuaguggggaaacaugau

SEQ ID NO: 241211 - RNA, 64 nt, Human
guucuuuuucacccuguauucucaaugaucccuuccuccccauaugccacccuucccccaaagc

SEQ ID NO: 241212 - RNA, 64 nt, Human
gcuuucuuuccaauccuuuauagcuuuggagacgccuccccaauuccccagggaaggaaacugu

SEQ ID NO: 241213 - RNA, 64 nt, Human
ugacaugaacccauccaauggauugugcaaauccccuccccaaacccacccauaccagcuagaa

SEQ ID NO: 241214 - RNA, 64 nt, Human
cucugaucaaauuuuuuuacuuccuccuccuguuccuccccaccucccuccuuuuccaguucag

SEQ ID NO: 241215 - RNA, 64 nt, Human
augccagccugcugcaacagacccuccccgcgccccuccccagcccaucuuacugcaagcagcg

SEQ ID NO: 241216 - RNA, 64 nt, Human
uccuguagcucucccuaggcugcccacucuccauccuccccagggguagaggcugggggcucca

SEQ ID NO: 241217 - RNA, 64 nt, Human
ccucccuccgugccgcgccccccuaggaccgcccccuccccaaaaggcuuuuggauuugugcau

SEQ ID NO: 241218 - RNA, 64 nt, Human
agucagguugccaaaggaaggagccuucugagacccuccccaacccacccagguucccaaggcc

SEQ ID NO: 241219 - RNA, 64 nt, Human
gcaauugcuguuagaaaacacuagcuagaaauccccuccccaccacccuuuuuaaggccaguua

SEQ ID NO: 241220 - RNA, 64 nt, Human
gccccucguccacccaccccuggcuggcagccucccuccccacacccgccccugugcucugcug

SEQ ID NO: 241221 - RNA, 64 nt, Human
uggugccaggugugggcccaggcgcagccugccaccuccccauccacuggccacccucacuccc

SEQ ID NO: 241222 - RNA, 64 nt, Human
gugaggaaaggaaucccccaguggacacagccuuccuccccaagcacguggucucugcgccagg

SEQ ID NO: 241223 - RNA, 64 nt, Human
acucuucuguggagcuuuacccucugagugagacccuccccagagccccgggggccgcagcccg

SEQ ID NO: 241224 - RNA, 64 nt, Human
ucuuuauacucaggaaaaugucaccaagcacccuccuccccaguucacaaaaggaagaagauga

SEQ ID NO: 241225 - RNA, 64 nt, Human
aggaagaagaugaagauucugucucccuguucccccuccccaguuuuccaaagugucugagcau

SEQ ID NO: 241226 - RNA, 64 nt, Human
gacugugguaagaaggauauuuaaucaugacaugcacggacacguacauauuuaacugaaacaa

SEQ ID NO: 241227 - RNA, 64 nt, Human
guguuuuagauugauuucccuguuucagggaaaucacggacaguaguuucaguucugaugguau

SEQ ID NO: 241228 - RNA, 64 nt, Human
uuucaguuccauguaacaaucuggaaggaaacuucacggacaggaagacugcuggagaagagaa

SEQ ID NO: 241229 - RNA, 64 nt, Human
aagugcugaacuggcugaaguucaaguacggagaccuccccauguacauaauauccaauggaau

SEQ ID NO: 241230 - RNA, 64 nt, Human
cugagcaccacuacgacuuaguccgggauaagggccuccccaguccucuccgggagaugauuug

SEQ ID NO: 241231 - RNA, 53 nt, Human
agaaugacgaggacgacugacguccuccccacuucagauucggcuucaggaaa

SEQ ID NO: 241232 - RNA, 64 nt, Human
ccuggacugaccacaccaaccaggccuucauccuccuccccagcucuucucuuccuagaucugc

SEQ ID NO: 241233 - RNA, 64 nt, Human
cccacgccucugcaagugggagagacccgagcauccuccccacccccauagcuccagugcacgc

SEQ ID NO: 241234 - RNA, 64 nt, Human
agggacgcccccagaggaccgggaggcaccccacccuccccaccagugcaacagaaaccaccug

SEQ ID NO: 241235 - RNA, 64 nt, Human
uagaagagaaaaaagagcaccaccauuauuaccaccuccccaacccuacacgcacgaacugagu

SEQ ID NO: 241236 - RNA, 64 nt, Human
uguggugccagaaguguggcuucccgaggcccggccuccccacuggguccuggaccuggcgcag

SEQ ID NO: 241237 - RNA, 59 nt, Human
auagaaauaugcauagguagaauguacccccuccccaagcaugaaaaucaucucacuga

SEQ ID NO: 241238 - RNA, 64 nt, Human
aauagccucaaucucccaccccauguaggcacuaccuccccaauuacccuuagaaaaugaucac

SEQ ID NO: 241239 - RNA, 64 nt, Human
ucuuucuuccuucuccucuaccccuccuuccaccccuccccauuagaguaguguggagauaagg

SEQ ID NO: 241240 - RNA, 64 nt, Human
ucccuggagcccagggcagcuuucagauuguguuccuccccaggagcagggaaccuguguggca

SEQ ID NO: 241241 - RNA, 64 nt, Human
ugugauaagaauggcacuuuaccucugugguccuccuccccagaacucagaacccaagucugau

SEQ ID NO: 241242 - RNA, 64 nt, Human
aauuuggggucaaucuauuucccccacccucucuccuccccaacccuucaggaacccuuuaguu

SEQ ID NO: 241243 - RNA, 64 nt, Human
ggcaauggagugacaggugaccugcucaggugccccuccccagaccaaaugucccaggcacaca

SEQ ID NO: 241244 - RNA, 63 nt, Human
caagaccugauuucugagcauuuaauauggaugccgugggaguacaaaaguggaguguggccu

SEQ ID NO: 241245 - RNA, 64 nt, Human
agcccccucccugcaaccagccugaguucagccccacggacaaagggacacacagcccccaaug

SEQ ID NO: 241246 - RNA, 64 nt, Human
ggaugaggagugguugggcugugccugggccuagcacggacauggucuguccugacagcacucc

SEQ ID NO: 241247 - RNA, 64 nt, Human
uuccccuuccaccaugauuguaaguuucaugaggccuccccagccugugggacugugagucaau

SEQ ID NO: 241248 - RNA, 64 nt, Human
cguugaguugcauggagucgguuguucaucccagccuccccauggcccucgccucccaugucuu

SEQ ID NO: 241249 - RNA, 64 nt, Human
caggacuuugccucuacagcauuuucuuacacccccuccccagcgugcccucagccaagugcuu

SEQ ID NO: 241250 - RNA, 64 nt, Human
gcugugcaauguuuuaaguucacaaguuccugcuccuccccacacugagcuccuuuguuccucc

SEQ ID NO: 241251 - RNA, 64 nt, Human
gccucccgggcuucugcugggggcagaagaaaugccuccccaggucugucucuggaggcucuga

SEQ ID NO: 241252 - RNA, 64 nt, Human
caaggggaugcuucccucugcccucuuuccugccccuccccaucauaccugcacccaccccagc

SEQ ID NO: 241253 - RNA, 64 nt, Human
caaugaggcuguauuuucauucugaagcuuguaaccuccccauuuuagcacuacagaauuuuca

SEQ ID NO: 241254 - RNA, 64 nt, Human
aguuccuggguucaagccaucccuccugccucagccuccccaguagcuggaacuacaggugugu

SEQ ID NO: 241255 - RNA, 64 nt, Human
gguguucuucaugagaguacuagccuccuccacuccuccccacagcgcagaggaaacaggccag

SEQ ID NO: 241256 - RNA, 64 nt, Human
aggcgagaugagcuggcgcagccccgcccuccauccuccccacaucccugcagccaccucccag

SEQ ID NO: 241257 - RNA, 64 nt, Human
ccacccccacugucccucaugugccaugggccugccuccccagugaccugcgaaaguggagcau

SEQ ID NO: 241258 - RNA, 64 nt, Human
gaaagaggguuucccuuuuugcucuuuugaacacccuccccacugauccuugggacccaacgcc

SEQ ID NO: 241259 - RNA, 64 nt, Human
aggaaguagggauauuuuuauaaaacaauuguguccuccccacauuuugcuauguuaauauuug

SEQ ID NO: 241260 - RNA, 64 nt, Human
ugagaagugauaaacaccuccagcuuucuaacauccuccccacaccaucucaccauauccaucu

SEQ ID NO: 241261 - RNA, 64 nt, Human
agcacaagcucacccacuuuggagcagcauuucuccuccccagaggaccucgaaggcugcaacg

SEQ ID NO: 241262 - RNA, 64 nt, Human
uuggggagggcuccuagugcugagcuuggagcagcacggacagcagcauuguuuaugggaaugg

SEQ ID NO: 241263 - RNA, 64 nt, Human
cgcccuuccccuugaccuuguccugccccagccucacggacagccugcgcagggggcugggcuu

SEQ ID NO: 241264 - RNA, 64 nt, Human
gcugaucgcuggugcugagcccugcccugggccccacggacagucagccugccggccucccugc

SEQ ID NO: 241265 - RNA, 64 nt, Human
ucaccguguguccuccccuccccucccuuccucuccuccccacaggcggaauugcuuucuucug

SEQ ID NO: 241266 - RNA, 64 nt, Human
ucaaacaagaagcucagagcugccccuuccacuuccuccccaaaagggaugaagaaaacccugu

SEQ ID NO: 241267 - RNA, 64 nt, Human
ucgcucucccggcacaccucaugccucuucccugccuccccauuccccuggcugcacuuccuug

SEQ ID NO: 241268 - RNA, 64 nt, Human
ggaaaaccagugggucugguggugcuggucuuuuccuccccauuccuacaauuucuauguggcc

SEQ ID NO: 241269 - RNA, 64 nt, Human
guuuuccauuguaugaauauaccacaauuuguuuccuccccaccaguuucugauacuacaauua

SEQ ID NO: 241270 - RNA, 64 nt, Human
gcccccacccugccuggugugcagcuaaccccucccuccccacagccagaggaggccacagacc

SEQ ID NO: 241271 - RNA, 64 nt, Human
cccuggaccuugaguguggcccucccuuucugggccuccccaggugaggccuggcccugcccca

SEQ ID NO: 241272 - RNA, 64 nt, Human
caacgaggagucuguuccuccccgcaccuccucuccuccccagcccuguaggccugaggggagg

SEQ ID NO: 241273 - RNA, 64 nt, Human
cugaaauauccacccagcaggcagaguggcguggccuccccaugggcacaguggugacccccuu

SEQ ID NO: 241274 - RNA, 64 nt, Human
agagccgugccucacugacccccaggggccucauccuccccauggaaugggcuguauguccugc

SEQ ID NO: 241275 - RNA, 64 nt, Human
caucgaggagggagggcagacggaggcccgagagccuccccaggccucuucgugggaaggcccc

SEQ ID NO: 241276 - RNA, 64 nt, Human
gggacuugggcugggcuaaaugggagggguugucccuccccaucauccauuccugugagguguc

SEQ ID NO: 241277 - RNA, 64 nt, Human
uagcuccacccuccccgugcugcuguguucugcuccuccccacgcuucccugcuauaguuccca

SEQ ID NO: 241278 - RNA, 64 nt, Human
aauuguguuauuucacuugccaagugaaggacccccuccccaacaugccccagcccaccccuaa

SEQ ID NO: 241279 - RNA, 64 nt, Human
aauaguaaaaaauaaaagcuguuuucaccaccucccuccccaccccccaaaaaaggcguacagc

SEQ ID NO: 241280 - RNA, 64 nt, Human
aguguguuuccuuuggcuguucccuaauacaaaacacggacauauuuuuacucguagcacucaa

SEQ ID NO: 241281 - RNA, 64 nt, Human
cagccugggccccucagccacccuuggucucaugccccgccauggucacccucaggaacccacc

SEQ ID NO: 241282 - RNA, 64 nt, Human
caaggagccaacuuuuauucccuuuccucucuccccuccccaccucgcuucuucccaauuuagu

SEQ ID NO: 241283 - RNA, 64 nt, Human
ccuucagguccccacccucagcugucaccaccacccuccccaggggacuccaucugagaugagg

SEQ ID NO: 241284 - RNA, 64 nt, Human
cagcccacucauccuuuccccagcccucuucagcccuccccaguccuccccagccuucuucagc

SEQ ID NO: 241285 - RNA, 64 nt, Human
auccuuuccccagcccucuucagcccuccccaguccuccccagccuucuucagccuucuucagc

SEQ ID NO: 241286 - RNA, 64 nt, Human
ccccacccccagcugaccagggaggcagaggacaccuccccaucacucagcauucccagcucag

SEQ ID NO: 241287 - RNA, 59 nt, Human
gugccugcugucugcuguaaaggcugcagccuccccagcucuccucugccagccacccu

SEQ ID NO: 241288 - RNA, 64 nt, Human
ccccuugagccccucugccuaugucccucugccuccuccccaugcccccaguugcuguggcuug

SEQ ID NO: 241289 - RNA, 64 nt, Human
uuauaccaaagaaaucauaggugaaacccccuacccuccccaacguuaaaugcucgagaggaau

SEQ ID NO: 241290 - RNA, 64 nt, Human
ccuccugucucuggccuguuuuagaagguucucuccuccccaaggagacacaacaacuccuagg

SEQ ID NO: 241291 - RNA, 64 nt, Human
cuucuguugugggcugcacaccaaagccuccuccccuccccacuuccuaggcacuaggaucucu

SEQ ID NO: 241292 - RNA, 64 nt, Human
accacauauaacacuuaacuuccccuacccugccccuccccaaaagaaaccaugacaaaccuag

SEQ ID NO: 241293 - RNA, 64 nt, Human
uaugggaaugaguauggcacagccaaguuacacuccuccccagaugaccccacacccuacucaa

SEQ ID NO: 241294 - RNA, 64 nt, Human
ccuugggcucccaggacaggugaacagggagggaccuccccacaccuacuccaaagaacagcug

SEQ ID NO: 241295 - RNA, 64 nt, Human
gcaacuuugaggagggcaccaggaaacaaagaugccuccccagcccugauauucuugaugucac

SEQ ID NO: 241296 - RNA, 64 nt, Human
agccuggccaaaaauuacaccagagagacagaguccuccccauugggaacagggugauugagga

SEQ ID NO: 241297 - RNA, 64 nt, Human
cccucuggcucagcggggcccagacccaccucggcacggacaccccugucuccaggaggggcag

SEQ ID NO: 241298 - RNA, 64 nt, Human
cucgagaggggccgaugcccagagacacagcccccacggacaaaaccccccagauaucaucuac

SEQ ID NO: 241299 - RNA, 64 nt, Human
cuagacuuuggagaugcagugucucccaggugugcacggacaccugguccguggaaacaggugu

SEQ ID NO: 241300 - RNA, 64 nt, Human
gauacuucuggcuggcugaguauaguacuagcugccuccccaccagguuccgaguagugucuga

SEQ ID NO: 241301 - RNA, 55 nt, Human
agggcuucaagaucuucugaggcccccuccccaggaagccuaggcucgguggcug

SEQ ID NO: 241302 - RNA, 64 nt, Human
acaaacagccuucuccuauagcuguacuugccccccuccccaaaaaaccauggaugagaaagaa

SEQ ID NO: 241303 - RNA, 64 nt, Human
ucaaguggcccacacuggucauugccuuaagccaccuccccaggacuuacggagagaaauaagg

SEQ ID NO: 241304 - RNA, 64 nt, Human
ggaauggggcacuccaacaccccucagggaccacccuccccacaguaugcacucagccccacag

SEQ ID NO: 241305 - RNA, 64 nt, Human
uggauuggaacuaucauggucacugcuccucuccccuccccacaaaaggaaaaaaaagcuggau

SEQ ID NO: 241306 - RNA, 64 nt, Human
cucugccucugggucaugaguaccacccugccugccuccccaacaccguggaauccucacuggu

SEQ ID NO: 241307 - RNA, 64 nt, Human
cuguauucgcuguucaauaaacauugagugagcaccuccccagauggagcaugcugguccuggg

SEQ ID NO: 241308 - RNA, 64 nt, Human
gcuagugcgcaccgugcugggggaagggggaaccccuccccacccucuuuccccagcgcucgcc

SEQ ID NO: 241309 - RNA, 64 nt, Human
ucucccucuggaggaccaagcccuccccuaaugcccuccccauggauuccuuagugaucugugc

SEQ ID NO: 241310 - RNA, 64 nt, Human
ccaaaugcugugaccuguuuggcucccaucuauaccuccccaugacaccuaggcugucagucuc

SEQ ID NO: 241311 - RNA, 64 nt, Human
acgggcuucuauaccgcuucgacuggaagauccaccuccccacugccuuuucucacucagaugg

SEQ ID NO: 241312 - RNA, 64 nt, Human
cuggcugcgacuaggagcagggcugccucuucucccuccccaaggucugcuugugggcacgcuc

SEQ ID NO: 241313 - RNA, 64 nt, Human
ugcuucccggguucaagcauuucuccugucucagccuccccaguagcugggauuacaggcaccc

SEQ ID NO: 241314 - RNA, 64 nt, Human
ccuccucugaacacucagcuauuacugcgcuuucccuccccacggccccaacuccagggcagga

SEQ ID NO: 241315 - RNA, 63 nt, Human
ugccaggcgcccuucgcaaagagugacgaggccccgugggagaacggacuccucagacucucc

SEQ ID NO: 241316 - RNA, 61 nt, Human
accccgccgggcacaugugaaagguaugccuccgugggacgagccacccgcuuucagcccu

SEQ ID NO: 241317 - RNA, 63 nt, Human
ccuguacauacuguugcccuagcccaccuggugccgugggagccacccccaggugcugggggc

SEQ ID NO: 241318 - RNA, 63 nt, Human
ucucuccucugucuucacagugggguguggggcccgugggaugggccucaggccaccaggcaa

SEQ ID NO: 241319 - RNA, 64 nt, Human
ggugcggccuggcccggccuccuaaaggccacacccuccccacgcacuucccaggccagaaucc

SEQ ID NO: 241320 - RNA, 64 nt, Human
caucgugggcacgggcagggcucagccgcucccaccuccccacagaagcccaggagugugugga

SEQ ID NO: 241321 - RNA, 64 nt, Human
ugcuuccgggaaucuuggucggaaacaagccgggccuccccagcugccugggcuugaccggcgg

SEQ ID NO: 241322 - RNA, 64 nt, Human
ccuggcagcccacauuuuuguugcuccccaaaucccuccccacguggggaugagaaccuuccug

SEQ ID NO: 241323 - RNA, 64 nt, Human
cgccucccagguucacaccauucuccugccucagccuccccaguagcugggacuacaggcgccu

SEQ ID NO: 241324 - RNA, 64 nt, Human
gugcuuuccuaacccccuuggaccuacucucccuccuccccaccauuccucuucccccacaugu

SEQ ID NO: 241325 - RNA, 64 nt, Human
caagguggggggugacugggacccagccuuugggccuccccagccagagcagcccagcaacagu

SEQ ID NO: 241326 - RNA, 64 nt, Human
uucaccugcuguuuaauagacuuggggccaugugccuccccacacaugggcaaggacaggugga

SEQ ID NO: 241327 - RNA, 64 nt, Human
gccuagagguguugggaacccuggccugcccccaccuccccaguaauuguuuccuuccguugcc

SEQ ID NO: 241328 - RNA, 64 nt, Human
accuuuuccguugcucccccgccacccaccuccuccuccccaggccacccaacuugggcaccuc

SEQ ID NO: 241329 - RNA, 56 nt, Human
uggaggugaugcugaagugagcagccccuccccacaccaguugaacugcaggaaga

SEQ ID NO: 241330 - RNA, 64 nt, Human
ccaggcccuccuuccuuucccuuuggugcucccuccuccccacguaccauugcgcgugcagcug

SEQ ID NO: 241331 - RNA, 64 nt, Human
ugugggugacaucagaagggugccacaucaguccccuccccaaccucagugacugacagaggau

SEQ ID NO: 241332 - RNA, 64 nt, Human
auugucucagggccgacguuccaccuggggcuucccuccccacccaccccgacuccaggcuuuc

SEQ ID NO: 241333 - RNA, 64 nt, Human
guaggcaauggcaaagaauguggucaggcuguagccuccccaaccagcagacagcuuuauggaa

SEQ ID NO: 241334 - RNA, 63 nt, Human
gagccccggcuccgccugcuguggaggccccagccgugggaauccaggucccccagguggagc

SEQ ID NO: 241335 - RNA, 63 nt, Human
ucggugaaaccagguggcuucuugcccccuucuccgugggaaccccaggccucuugccucccu

SEQ ID NO: 241336 - RNA, 63 nt, Human
ugugguuuccugggccuuguggcaggguuucucccgugggagaauuugguguggaaagcauag

SEQ ID NO: 241337 - RNA, 64 nt, Human
gccuuuggauucuuuuuuuuuuuuuccuucuauuccuccccaacccccccccccgccccuuuuu

SEQ ID NO: 241338 - RNA, 64 nt, Human
uuaaaggucucaucccacaaccccugacuuccucccuccccacaucaugaaggcagaggcaugc

SEQ ID NO: 241339 - RNA, 64 nt, Human
acugagaccaccucucagggugccugcccugguuccuccccagccugagucagcugucuggacu

SEQ ID NO: 241340 - RNA, 64 nt, Human
cuccguccucgcucaguugugauccagcagccccccuccccacugccuccccagcucucaguga

SEQ ID NO: 241341 - RNA, 64 nt, Human
cucaguugugauccagcagccccccuccccacugccuccccagcucucagugaccccgacuguc

SEQ ID NO: 241342 - RNA, 64 nt, Human
cucgggagaggcucccgucacacacuacagguccccuccccagggcaggggauuugggcuccau

SEQ ID NO: 241343 - RNA, 64 nt, Human
augaaagaaggaagugagcauccuuuugcucuguccuccccaccccgauagugacacaucuuca

SEQ ID NO: 241344 - RNA, 64 nt, Human
uugccccuguaagggccucuaggcccugggccugccuccccaagggcucacuaagccagaggcc

SEQ ID NO: 241345 - RNA, 64 nt, Human
aacaccauggacccugggggcugugcccccaucuccuccccaccccaggucuaguggccccacc

SEQ ID NO: 241346 - RNA, 64 nt, Human
aauacccccuugggggucaccucucugcuuccccccuccccaggcuucaguuccuucccccuga

SEQ ID NO: 241347 - RNA, 64 nt, Human
cuggcgacagcggggaaaugagggcugaaaauauccuccccacaagggcaauccccgggaccug

SEQ ID NO: 241348 - RNA, 54 nt, Human
accacuucuaccagacauagagccccuccccagggccccacccugccauaugaa

SEQ ID NO: 241349 - RNA, 64 nt, Human
uauguggcucugcauucuagucagacaccuaacaccuccccaagcuucugcuauaauguaggga

SEQ ID NO: 241350 - RNA, 64 nt, Human
ggucccggcugacaccucccuucgugugugcgccccuccccaccccugccuuuguuucggugcc

SEQ ID NO: 241351 - RNA, 64 nt, Human
gaaacaccuucuuguauucauuaaccauaguacuccuccccaccucaaguagacaccucucuca

SEQ ID NO: 241352 - RNA, 63 nt, Human
aggcaccaggaagccguccuggcgccuggcaguccgugggacgggaugguucuggcuguuuga

SEQ ID NO: 241353 - RNA, 63 nt, Human
cacagcgcagggucccagcaucuccacgcgcgcccgugggagguggguccggccggagaggcc

SEQ ID NO: 241354 - RNA, 63 nt, Human
guaaccacugaucauuacaggaagcuucagaaaccgugggaccaguguagaagaauggacuau

SEQ ID NO: 241355 - RNA, 63 nt, Human
cuucccaguaccccagacccacugugggucuucccgugggaugcgggauccugagaccgaagg

SEQ ID NO: 241356 - RNA, 64 nt, Human
aaccuuuuggaauagcauuagacccuggcuguccccuccccaccaaauaaacaugauauuucau

SEQ ID NO: 241357 - RNA, 64 nt, Human
agcuguggaugggcaaaccccgguggaaucccacccuccccaacaccccacugagcccugggcc

SEQ ID NO: 241358 - RNA, 64 nt, Human
cccccaccccccgugggcuccugugcggccggagccuccccaaggagcgccgcccccugcucca

SEQ ID NO: 241359 - RNA, 64 nt, Human
cuucaguggaugccagccuucccugccccaacucccuccccagcacugggucagugguguccug

SEQ ID NO: 241360 - RNA, 64 nt, Human
ggugacaccagcaauuaugacuuugucuacccuuccuccccaguuauuguugcagauucugguu

SEQ ID NO: 241361 - RNA, 64 nt, Human
caugggaagugaugccaccagggcagccucaccuccuccccaucaucuuguccuagagugggcg

SEQ ID NO: 241362 - RNA, 64 nt, Human
aagagagaugugucgccuccgccaguccgacugcccuccccaccccacccccgccaccccccac

SEQ ID NO: 241363 - RNA, 64 nt, Human
uugcuuuugccgcagcgauggggccagucucauuccuccccaggagugaaacuugcuucagcug

SEQ ID NO: 241364 - RNA, 64 nt, Human
aagugacaagagcucagaucucccucccgaucucccuccccaccuccgaagucuccuccgugga

SEQ ID NO: 241365 - RNA, 64 nt, Human
ccuugccgcccuccugcaguauuuauggccucguccuccccaccuaggccacgugugagcugcu

SEQ ID NO: 241366 - RNA, 64 nt, Human
ucaacaaagaggggaugaaucacccuuggcccagccuccccacaaagccugacccugggcaggu

SEQ ID NO: 241367 - RNA, 64 nt, Human
gacagccuucuauuugugaagugcccuguggcccccuccccagcaccucugucugccaugcgcu

SEQ ID NO: 241368 - RNA, 64 nt, Human
gcugaguggucaggagccaguuucuccagccccuccuccccacaaccccuaguggggaggggca

SEQ ID NO: 241369 - RNA, 64 nt, Human
ccuuucuagccugcccccccacccccacuucaccccuccccagcuucccaaacuucugucugcc

SEQ ID NO: 241370 - RNA, 64 nt, Human
uggggggcugggugcggcccccugccguguauuuccuccccagggaguggggccuccccgggag

SEQ ID NO: 241371 - RNA, 63 nt, Human
guccgcagccccggccuggcugcggugcucgcgccgugggaaagcacacuggggaggggucag

SEQ ID NO: 241372 - RNA, 63 nt, Human
ggggcugggaguggguagccgucauguugucccccgugggaucccauuuuuaacuugacccag

SEQ ID NO: 241373 - RNA, 63 nt, Human
cccaacgucgugggccgggucuuaggccuucgcccgugggaaggucuuaagcuguaugugcuc

SEQ ID NO: 241374 - RNA, 64 nt, Human
aagaggcuguguggccaaccaggacccaggguccccuccccagcucccuugggaaggacacagc

SEQ ID NO: 241375 - RNA, 64 nt, Human
ccaagggcucuaggcagacccugcgcccgcggguccuccccaccugcugcuccccgugcaauac

SEQ ID NO: 241376 - RNA, 64 nt, Human
uuuucacaccgcaucaguccccaucaucacuacuccuccccagagacauacagauugcccuccc

SEQ ID NO: 241377 - RNA, 64 nt, Human
cuuuuguguuuuggccaccuggggccgcccccaaccuccccaccccaagaggggucugaguggg

SEQ ID NO: 241378 - RNA, 64 nt, Human
ugaagggaaaaaaaccaccccaucguucccuacuccuccccaccacuuacccguucccccuuua

SEQ ID NO: 241379 - RNA, 64 nt, Human
agccucccgcguccugcaggguaguccgcccccuccuccccaccauccucccuaccuccuuaac

SEQ ID NO: 241380 - RNA, 64 nt, Human
cccuuuuaaagagguggccauugcagggucucugccuccccagcagguggcagaugcucccggc

SEQ ID NO: 241381 - RNA, 64 nt, Human
ucaggcaggccaaggccuucuccuccccacccgcccuccccacggggccucgggaccucaggug

SEQ ID NO: 241382 - RNA, 64 nt, Human
gaggccuccagcuucaggcaggccaaggccuucuccuccccacccgcccuccccacggggccuc

SEQ ID NO: 241383 - RNA, 64 nt, Human
gauuucuacccuguucccucugcuugagggcuauccuccccaugcccaucucacuucuccacca

SEQ ID NO: 241384 - RNA, 64 nt, Human
ugucucuggcucaccuccgucuguucaucaccuuccuccccaguguuuccacuuaucuuggaug

SEQ ID NO: 241385 - RNA, 64 nt, Human
guaagaaaaagaaauaaaaccaguccuccucagcccuccccaagucgcuucuguggcaccccgc

SEQ ID NO: 241386 - RNA, 64 nt, Human
aaagcacucugaaaccaagaccuucccauuuccuccuccccacauggugcugaggcucccugcu

SEQ ID NO: 241387 - RNA, 64 nt, Human
ugucugccuggcucgcacuugguacccauggccaccuccccauuuucugugccuuaucucacug

SEQ ID NO: 241388 - RNA, 63 nt, Human
aggucauagccuacaacugagcucaccacaggcccuccccagcucaacccauuaaagacccag

SEQ ID NO: 241389 - RNA, 64 nt, Human
cagccggcugucccagccagccccgcagagcgcccacggacaguguccacucuggcaagguggg

SEQ ID NO: 241390 - RNA, 64 nt, Human
gcugcccgaaccucugugugaagcuuuacgcgcacacggacaaaaugcccaaacuggagcccuu

SEQ ID NO: 241391 - RNA, 64 nt, Human
aucccuuuugagacaccgccuucugcccaccacucacggacacauuucugccuagaaaacagcu

SEQ ID NO: 241392 - RNA, 64 nt, Human
uauugaccaaggaguuugugguacgaccccucccccuccccaaguaggcaaggacugcacguuu

SEQ ID NO: 241393 - RNA, 59 nt, Human
caugcacaaggaagaucugaucuugguguccuccccagcaccuuagggccaggggcuua

SEQ ID NO: 241394 - RNA, 64 nt, Human
caaaaaaacuacaaacaaaagcagcccucugccuccuccccagggaagacccugaccguguaca

SEQ ID NO: 241395 - RNA, 64 nt, Human
aguguugguagguccuagacgugguucccuccagccuccccaaaaucaacccugguguugagag

SEQ ID NO: 241396 - RNA, 64 nt, Human
ggacccuccugccuccucuccaggcccuuguucgccuccccacccuccucagaggcccggggaa

SEQ ID NO: 241397 - RNA, 64 nt, Human
ggcagggagaggugcaggggagucaccgcccagaccuccccagccaccaaccgaccccaccucu

SEQ ID NO: 241398 - RNA, 64 nt, Human
acaauggggguucaaggaagacgucguuaucuccccuccccacuuacucgaggagagaggugag

SEQ ID NO: 241399 - RNA, 64 nt, Human
cucuccccucccucuuccuucccccauccccuuuccuccccaccuuccccagacucagcuccag

SEQ ID NO: 241400 - RNA, 64 nt, Human
gaaagcgguggauucuggcaaaugguccuugugcccuccccacucaucccuggucugguccccu

SEQ ID NO: 241401 - RNA, 64 nt, Human
cgucucuaggucuguucuucuucccuagcauccuccuccccacaucuccuuucacccucuuggc

SEQ ID NO: 241402 - RNA, 64 nt, Human
ccaguaaaugguuguggggaggaaagagguggagccuccccagccguuucccugcagaaucagc

SEQ ID NO: 241403 - RNA, 64 nt, Human
ggcccaggacuugggacaguggccuugucuuuguccuccccaccccccagcccuagggacaccc

SEQ ID NO: 241404 - RNA, 64 nt, Human
aucccaggguuucuggcugcaagugagacuccacccuccccaccuggcucauuuccccgaugac

SEQ ID NO: 241405 - RNA, 64 nt, Human
uccccacugagguguugugaugcuugccuuuugaccuccccauccccuuuagucccugcuuacu

SEQ ID NO: 241406 - RNA, 64 nt, Human
ccagacgauugagucuaccuucuuuucuuggccaccuccccauucacaacuacuuucucgcucc

SEQ ID NO: 241407 - RNA, 63 nt, Human
gguggggauggcuuuguccuuugcuccugcuccccgugggaccugggaccuuaaagcguugca

SEQ ID NO: 241408 - RNA, 63 nt, Human
aaacacuuuggccacagccccaaacaagcgccaccgugggagaggagaggcugcugucacugg

SEQ ID NO: 241409 - RNA, 63 nt, Human
agcagagaguaaauuagagacgggauaggaaggccgugggagaacucgauccuagccuguguc

SEQ ID NO: 241410 - RNA, 64 nt, Human
uggggugugguccaggcaucgagauguguaaagaccuccccaggugaugauaugcaguccgagg

SEQ ID NO: 241411 - RNA, 64 nt, Human
ugucccucaacccccgaaacaaggcuucucucagccuccccaccagugauggauaacagcuccu

SEQ ID NO: 241412 - RNA, 64 nt, Human
caggugaccuagugacugugggagcuccuccuucccuccccacccuucauggcuugccuccugc

SEQ ID NO: 241413 - RNA, 64 nt, Human
gccagagaggggaccucccagcucuuauuugcacccuccccaccucaccaacuuuggucccucu

SEQ ID NO: 241414 - RNA, 64 nt, Human
augggaagaugucucagagccuuccaugaccuccccuccccagcccaaugccaaguggacuugg

SEQ ID NO: 241415 - RNA, 64 nt, Human
cugggagccagccacccugaccucccccagggcuccuccccagccggugacuuacuguacagca

SEQ ID NO: 241416 - RNA, 57 nt, Human
gccaccuugcccagcccugagccaagcccuccccaucccauguauuuaucucuauuu

SEQ ID NO: 241417 - RNA, 64 nt, Human
uggacccauaagucuguucauccugcugaaguccccuccccauugcuccuucaagccaaaacua

SEQ ID NO: 241418 - RNA, 64 nt, Human
gucucugucccucucucuuugacucucccuuuguccuccccauagagcuggggugggguggauc

SEQ ID NO: 241419 - RNA, 64 nt, Human
gccucccucuccauaucuccuuccccuacaccucccuccccacaccucccuacuccccugggca

SEQ ID NO: 241420 - RNA, 64 nt, Human
ucuaugugacagcucccuaggaccccucugccuuccuccccaauccugacuggcuccuagggaa

SEQ ID NO: 241421 - RNA, 64 nt, Human
aacacugaggaugugguucaugggggagcaguccccuccccacucuugcccaugggugacucuu

SEQ ID NO: 241422 - RNA, 54 nt, Human
ggggcacccaggagcagugauuucccuccccacuacuccuucuccuucuagaug

SEQ ID NO: 241423 - RNA, 64 nt, Human
ccucugagucaggcuaggggccuccccuucucauccuccccacccccccgccaagguucucaca

SEQ ID NO: 241424 - RNA, 64 nt, Human
uuuuauuuuugugucugugaaagugccaagaaccccuccccacauuuguagauccaugacccuu

SEQ ID NO: 241425 - RNA, 63 nt, Human
aaguagcugccaggcacagaggaaagagcaucaccgugggagaggccagccgccgccugcuca

SEQ ID NO: 241426 - RNA, 63 nt, Human
auccccugaggguggucagccaaggcucccguuccgugggaugccauaaaagccgcccagugg

SEQ ID NO: 241427 - RNA, 63 nt, Human
gcccugacaugcugcagucggaaguuuccuuuuccgugggagggaggcauucaucuacagacu

SEQ ID NO: 241428 - RNA, 64 nt, Human
aguccagcugcccggacuccagggcucuccccacccuccccaggcucuccucuugcauguucca

SEQ ID NO: 241429 - RNA, 64 nt, Human
cccggagaaacugagguauggccaugcccuagacccuccccaaggaugaccacacccgaagucc

SEQ ID NO: 241430 - RNA, 64 nt, Human
uucagcucagagagcaccaucccgggggucagggccuccccacaggagcccugcagugugguag

SEQ ID NO: 241431 - RNA, 64 nt, Human
gaagguguuagaggacuccaggagcuccugcaccccuccccaaauguccaucuuucucagacgg

SEQ ID NO: 241432 - RNA, 64 nt, Human
aagauugagaagugcauaugacaggcugagagcaccuccccaaacacacaagcucucagccaca

SEQ ID NO: 241433 - RNA, 64 nt, Human
cacuuccuguccagagagagaagugccccugcugccuccccaacccugccccugccccgucacc

SEQ ID NO: 241434 - RNA, 64 nt, Human
ggggagugggacagagucuggguguauuuauuuuccuccccagcagguggggaggggguuuggg

SEQ ID NO: 241435 - RNA, 64 nt, Human
gaacaguguuuggaaaucuuucuacaggcaauuaccuccccaagagaagccuuccuuauuuugg

SEQ ID NO: 241436 - RNA, 64 nt, Human
agugcaguaugaaacucaccagcgagaacaaacaccuccccagcccccagcccuccccgcagug

SEQ ID NO: 241437 - RNA, 64 nt, Human
ccacugccaugaccaggccgaaggcagggaacgcccuccccagucccgcuguccagcaaggccc

SEQ ID NO: 241438 - RNA, 64 nt, Human
ugaagaaguguucuggucaaaacuaaaggaacucccuccccaccugcaggacuccgaagacagu

SEQ ID NO: 241439 - RNA, 64 nt, Human
ugccccacggucccugaaggguccaaggaggggcccuccccauggcccuggagagugggccugg

SEQ ID NO: 241440 - RNA, 64 nt, Human
gugcauggaaguuggggcacugggcgucugacucccuccccacccaagagaggaaggaccccuc

SEQ ID NO: 241441 - RNA, 64 nt, Human
gcugcgaugcucugcuggucgcggacggacccugccuccccagcuuaucccaggccagaggcug

SEQ ID NO: 241442 - RNA, 64 nt, Human
augucugucccugucugccugggcaggccagauuccuccccagcagccgggucucuccagaccc

SEQ ID NO: 241443 - RNA, 63 nt, Human
aagugccucagcuuccccccggcccgggucaggccgugggagccgcuauuaucugcguucucu

SEQ ID NO: 241444 - RNA, 63 nt, Human
uggguccacgcaucucucuacacuuccuucucuccgugggauacuggacucgugccucugcgc

SEQ ID NO: 241445 - RNA, 64 nt, Human
ccaggcgccccccccucuaaggguccucuggccccacggacagcaggacccggacacccugugg

SEQ ID NO: 241446 - RNA, 64 nt, Human
cucacccuguccacuugggugaucauuccagaccccuccccaaacaugcauauguaccuguccg

SEQ ID NO: 241447 - RNA, 64 nt, Human
ggggugaaccuuggccuccaggacaucugcacccccuccccaccuccacggaccucggaccucc

SEQ ID NO: 241448 - RNA, 64 nt, Human
caugacucaacaaaccaguguugggagccgucugccuccccagcucagugccuuucugcacccc

SEQ ID NO: 241449 - RNA, 64 nt, Human
agccaacaagagaaaccaucucugaccacccccuccuccccaucccacccuuuggaaacucccc

SEQ ID NO: 241450 - RNA, 64 nt, Human
ccgcguucacucccacucucccgaggggugcuggccuccccaggguuugccuucuuacggauuu

SEQ ID NO: 241451 - RNA, 64 nt, Human
ggagcccuggugggucccagccagggcagaggggccuccccaggaagucuccuacccucucagc

SEQ ID NO: 241452 - RNA, 64 nt, Human
gggcuuccuggacucuuggccucacuccuugcccccuccccacgacacccaugagccgaaagga

SEQ ID NO: 241453 - RNA, 64 nt, Human
gccccccggaggguccaggccacguccuuggucaccuccccagcagcugcucugcucaccagcc

SEQ ID NO: 241454 - RNA, 64 nt, Human
gagccauuccugcaggggucccagggugcagagaccuccccacccccgguucugggcugggacc

SEQ ID NO: 241455 - RNA, 64 nt, Human
cccuucaccgcuccccacagcuuugcaccccuuuccuccccauacacacacaaaccauuuuauu

SEQ ID NO: 241456 - RNA, 64 nt, Human
accuuuguuggagcccucuguaggccuccucccuccuccccacgccuugcucccacaccccucu

SEQ ID NO: 241457 - RNA, 64 nt, Human
agccucagaccauggcacuuugagggggucucuaccuccccaucaacagcugcagggggacccc

SEQ ID NO: 241458 - RNA, 64 nt, Human
uccucagcuuccaugccuuuggaucuuccauguuccuccccauauuccuggacuucggagaugg

SEQ ID NO: 241459 - RNA, 64 nt, Human
gcccagcuuggguuucugagcuuuucucccucauccuccccaauccccaaacuccuucuccuac

SEQ ID NO: 241460 - RNA, 64 nt, Human
auuuauugcggggagacagcucucucucccaccuccuccccagaugggaggagagccugaggcc

SEQ ID NO: 241461 - RNA, 63 nt, Human
auucaguuuguucugugcaccugaggcgcucagccgugggaggaccauuuugcgaguguagcc

SEQ ID NO: 241462 - RNA, 64 nt, Human
ccucaccccugcuggggguuggacugaaaacccuccuccccaauuugggggguguugccccauc

SEQ ID NO: 241463 - RNA, 64 nt, Human
gccguggaccccuaagccgagcugguggaaggccccuccccaucgccagccgggcccucaugcu

SEQ ID NO: 241464 - RNA, 64 nt, Human
gcccucuucgcccugugagcagcucugugguuugccuccccagauggcggguccccgcucgcac

SEQ ID NO: 241465 - RNA, 64 nt, Human
ccaagggagucugggcccuaggccuagccccaucccuccccaugaggggccaagacacugccua

SEQ ID NO: 241466 - RNA, 64 nt, Human
ccaggaggcuccaguucugggcugggagcugugaccuccccaacgcucaccccucaaccccaag

SEQ ID NO: 241467 - RNA, 64 nt, Human
aagagguauugguguucuggagugggggucaaccccuccccagucucugugcuaaguucacuug

SEQ ID NO: 241468 - RNA, 64 nt, Human
gccaguuuugguccugccagcugccucccugaucccuccccacucucgccccuucucuaugaac

SEQ ID NO: 241469 - RNA, 64 nt, Human
ugcuugcccauguguuucaucaaucagaaguccuccuccccagcacauucggauuuaaauuucu

SEQ ID NO: 241470 - RNA, 64 nt, Human
cagagaacaaaggcugagauggcagugcacacacccuccccaccaguggggaccugagaaugcg

SEQ ID NO: 241471 - RNA, 64 nt, Human
agagccagcagcugcgcugggggagggaagcgugccuccccaccccuccccucacggggaaggu

SEQ ID NO: 241472 - RNA, 64 nt, Human
agaucccuuggcccuuuccuccgaggacuucuauccuccccaggccuuuguuucuucggcuaaa

SEQ ID NO: 241473 - RNA, 64 nt, Human
gagagaacacagaagaaaagcaauugccccagguccuccccacagucaagggagcucuuccuuc

SEQ ID NO: 241474 - RNA, 64 nt, Human
gcuauuuauaaucauauuucaucagccuacccacccuccccaucuuugcugagcucucaguucc

SEQ ID NO: 241475 - RNA, 64 nt, Human
ugccuuggcaucccuguagcccagcaacccugccccuccccagcaucccagcugggccagagag

SEQ ID NO: 241476 - RNA, 64 nt, Human
ggaggacagcugccuguuuccuccccaucagccuccuccccacauccccagcugccuggcuggg

SEQ ID NO: 241477 - RNA, 63 nt, Human
uggaagccagagcccugcagguguccggcgcagccgugggagcugaggaucuggcacuugaga

SEQ ID NO: 241478 - RNA, 63 nt, Human
caggccacagccagggguccggccacuacccgcccgugggauaaaagccaaaagcaugcguca

SEQ ID NO: 241479 - RNA, 63 nt, Human
ggggcucugcaccuucugaggggucuccuguugccgugggagaugcugcuccaaaaggcccag

SEQ ID NO: 241480 - RNA, 64 nt, Human
cucuuagcucuaccgggaggacagcugccuguuuccuccccaucagccuccuccccacaucccc

SEQ ID NO: 241481 - RNA, 64 nt, Human
gccgggagccugagccugggcuggagccuucuccccuccccaguuggacuaggggcaguguuaa

SEQ ID NO: 241482 - RNA, 64 nt, Human
uaaggcagccaagaaacucacccaaagccuguagccuccccaacuacuccagacuguccugcuc

SEQ ID NO: 241483 - RNA, 64 nt, Human
uccucaggcccugcccgcuuccuguccacugcccccuccccauccccagcccagccgagggaau

SEQ ID NO: 241484 - RNA, 64 nt, Human
acgaccagguucucaagacacgaguccccuuguuccuccccauuaaaggggguuugucagaagc

SEQ ID NO: 241485 - RNA, 64 nt, Human
uggcugagauuuuucuaaauugaaaacacgccccccuccccacaccuccaggaacuccacuccc

SEQ ID NO: 241486 - RNA, 64 nt, Human
ugcugucccccacuuuuaaagaugggucucaaccccuccccaccacgucaugauggauggggca

SEQ ID NO: 241487 - RNA, 64 nt, Human
gccuuccuuguucugguggagcugggguuucucuccuccccagucccacaacacugccaaaaau

SEQ ID NO: 241488 - RNA, 64 nt, Human
cugccucaucuuuccucccgucccugccccgccaccuccccaaagaauugaaacgucagcucag

SEQ ID NO: 241489 - RNA, 64 nt, Human
aaauauuugggaaaaccuaucggaagaaggcaagccuccccaacuuaagccauguaacugaaaa

SEQ ID NO: 241490 - RNA, 64 nt, Human
cagauguaaucauucacauguaaaaauaaccccaccuccccaccccaaaaagggcaagagcugu

SEQ ID NO: 241491 - RNA, 64 nt, Human
agcuggagaacgccuacuagagcccgcccgcgccccuccccaccggcgggcgccccggcccuga

SEQ ID NO: 241492 - RNA, 64 nt, Human
agugauggaacaggaacucagggugcccuuacccccuccccagaccuguucccuuucuuugacu

SEQ ID NO: 241493 - RNA, 64 nt, Human
cacauggucaguaggcacacugcccccugccaccccuccccagucaccaguucuccucuggacu

SEQ ID NO: 241494 - RNA, 64 nt, Human
guggcuccuagggggcugacucuuccuuccuccuccuccccaguaccacauauacuuucucucc

SEQ ID NO: 241495 - RNA, 63 nt, Human
cuucacgaguucagcccauuguacgugcaggucccgugggaaggaggcaaaagccccugcuuc

SEQ ID NO: 241496 - RNA, 64 nt, Human
ucagcugcagggaggcagaaggcaaggcaggccccacggacacacuugggcugcucugaaauaa

SEQ ID NO: 241497 - RNA, 64 nt, Human
accccagggcagccagggagagcccaggagcuccccuccccaacugaccaccuuuguuucuccc

SEQ ID NO: 241498 - RNA, 64 nt, Human
aaaaagaaauucgcauguuuaaugugaacucuccccuccccaucuguguucuaacuuauuuaua

SEQ ID NO: 241499 - RNA, 64 nt, Human
cucccugaucccagaccugucgucucucccacccccuccccaaagccacuggaaggagcacaua

SEQ ID NO: 241500 - RNA, 64 nt, Human
uuuaccauagagaccagugccuugguggcaggucccuccccagguccccugagaugggguaugg

SEQ ID NO: 241501 - RNA, 64 nt, Human
acuaggaugacaaggaguaugugggcuuugcaacccuccccaaccaaguccaccgaaaguccgu

SEQ ID NO: 241502 - RNA, 64 nt, Human
ucagucuacaccuggacgugugggccacuuaagcccuccccacccccauccuauuccugaauaa

SEQ ID NO: 241503 - RNA, 64 nt, Human
uucuaggugcccgcguggcauccugugaccgaccccuccccagugccucuccuggcccuggaag

SEQ ID NO: 241504 - RNA, 64 nt, Human
ggcuucuagcugcccggguggcaucccugugaccccuccccagugccucuccuggucguggaag

SEQ ID NO: 241505 - RNA, 64 nt, Human
uggcuucuaggugcccgaguagcauccugugaccccuccccagugccucuccuggcccugaagg

SEQ ID NO: 241506 - RNA, 64 nt, Human
uggcuucuaggggcccgcguggcauccugugaccccuccccagugccucuccuggcccugaagg

SEQ ID NO: 241507 - RNA, 64 nt, Human
ggcuucuagcugcccggguggcaucccugugaccccuccccagugccucuccuggcccuggaag

SEQ ID NO: 241508 - RNA, 64 nt, Human
guugauccugugacugaggcucccccucauguagccuccccaggcccagggcccugaggccugc

SEQ ID NO: 241509 - RNA, 64 nt, Human
uggaaucagggcucagggccuucacuucaagggcccuccccagcuacucgggaggcugaggcag

SEQ ID NO: 241510 - RNA, 64 nt, Human
ggcugagaagggacguuuccaucauucacagugcccuccccacagcacuaccucaccccgaccc

SEQ ID NO: 241511 - RNA, 64 nt, Human
aggaggucaagagagagcucaguuucccucucccccuccccaaacacaccaagaagcauuuuua

SEQ ID NO: 241512 - RNA, 63 nt, Human
cggggcugagcgugacaagaggaaggaaugggcccgugggaugcaggcaaugugggacuuaaa

SEQ ID NO: 241513 - RNA, 63 nt, Human
cccaguggccucccccagacagagccaccccugccgugggaaccuguccguguuccugcgugg

SEQ ID NO: 241514 - RNA, 63 nt, Human
uucuacagaucuuucucaaaggaagcuuaggacccgugggaauggcaaaacaguaaggauggg

SEQ ID NO: 241515 - RNA, 64 nt, Human
gggagagcugggucaccggugccgaugcucuggcccuccccaauacgcugcuucgucccacugc

SEQ ID NO: 241516 - RNA, 64 nt, Human
acggacaggcggaugugucccccccagccccuccccuccccauaccaaagugcugacaggcccu

SEQ ID NO: 241517 - RNA, 64 nt, Human
cucagggcagagauuggcuuggggccagaaggacccuccccaacccuggagacacccugaaggu

SEQ ID NO: 241518 - RNA, 64 nt, Human
uacuaauacagaagcuugacaagcauguccucacccuccccaccacauaaacacauggacacac

SEQ ID NO: 241519 - RNA, 64 nt, Human
caccuucaaaagcacugauuacccaaugcaccucccuccccagcucgagaucauucuucacuca

SEQ ID NO: 241520 - RNA, 64 nt, Human
ccagcuuuucucacuuucacccuaaacgacacuuccuccccagccagccucacucugucuccgg

SEQ ID NO: 241521 - RNA, 64 nt, Human
acuaguccuaauugcagaaagagcgucaguuucaccuccccacgagcacuucagaucaguauug

SEQ ID NO: 241522 - RNA, 64 nt, Human
gcggcaccucagugggugggcagggcuuggucccccuccccacagcaagggaaggcagcuggcu

SEQ ID NO: 241523 - RNA, 64 nt, Human
gcucacucccucacucaccgaucaaaaccugcuaccuccccaagacuuuacuagugccgauaaa

SEQ ID NO: 241524 - RNA, 64 nt, Human
guaaaauucuagacugcuuucacuuauuucauuuccuccccauacaaauuugaugagcagguac

SEQ ID NO: 241525 - RNA, 64 nt, Human
ccguacccgcauccucucucccagggacaaccccccuccccagcucggccccucuuucccuguc

SEQ ID NO: 241526 - RNA, 64 nt, Human
uucuuccauuauagugugaguggagacugcccccccuccccaacauauuccuucccauaucucu

SEQ ID NO: 241527 - RNA, 64 nt, Human
gaguccaacguggggcagcacagagagggggccaccuccccaggccguggcugcccacacaccc

SEQ ID NO: 241528 - RNA, 64 nt, Human
gucuccucugguuguuucguuuuggcuuuuucucccuccccaugucuguucuggguuuucacgu

SEQ ID NO: 241529 - RNA, 64 nt, Human
uggcgccaucgccgggacuccagaaccgcagaagccuccccagcucaccccuggaggacggccg

SEQ ID NO: 241530 - RNA, 63 nt, Human
ccuagucccucuccugccaccucuccaagacuuccgugggacacccacuucccucuguccuag

SEQ ID NO: 241531 - RNA, 63 nt, Human
uuaauaaguaacuugacuauaaaauaaagccguccgugggacgacugaccucguugcaagucu

SEQ ID NO: 241532 - RNA, 63 nt, Human
uguuauuggaugggcccuguaguauuucagggaccgugggaccccuuugcugggacaguuauu

SEQ ID NO: 241533 - RNA, 64 nt, Human
acuccuggccucaggugugauccgcccgccuccgccuccccaagcgcugagauuacagguguga

SEQ ID NO: 241534 - RNA, 64 nt, Human
ugcuuugaggggcugugacccucuucccccaggcccuccccagccgacgacagccaccggagag

SEQ ID NO: 241535 - RNA, 64 nt, Human
ccauccccugaucugugcggcuccagccucgcccccuccccacgugcaccauaccuggggaguu

SEQ ID NO: 241536 - RNA, 64 nt, Human
cugaccacaacuuuggacaccccaggcugccaccccuccccacccguucacccccaggaugcug

SEQ ID NO: 241537 - RNA, 64 nt, Human
ugcuguugcuguaggacgccugcugcccuggagcccuccccaggaugugagccaguccccucgc

SEQ ID NO: 241538 - RNA, 64 nt, Human
ucgcccggcugccacaagcucucugcggguccauccuccccaccgggguccguccucgcaggcc

SEQ ID NO: 241539 - RNA, 64 nt, Human
ugcucaccagcugcuucggccuucaggugaccucccuccccacggcauccugcucuccgggugg

SEQ ID NO: 241540 - RNA, 64 nt, Human
cucagccagaggugccuggccaugccugcacacuccuccccauuuuaauaaauggucgcaacuu

SEQ ID NO: 241541 - RNA, 64 nt, Human
gcugccccucgagggggcccugccugccgcggggccuccccacaagccccucccaaagcgccgg

SEQ ID NO: 241542 - RNA, 64 nt, Human
agcaggggugacguauguagaaugcuuaggguguccuccccacagagcagauacuugaaccgac

SEQ ID NO: 241543 - RNA, 64 nt, Human
ccuguguaaagagcacuuuguccugcuucacggaccuccccaaagugugcagaguucuauauag

SEQ ID NO: 241544 - RNA, 64 nt, Human
aacgacacaucccagugggauuuccaacacucccccuccccaugcaacaaagcaacuuacuucu

SEQ ID NO: 241545 - RNA, 64 nt, Human
cccacagggggccaggggcauggccacaggccccccuccccacuuggccacccagcugccugcc

SEQ ID NO: 241546 - RNA, 64 nt, Human
cccuuccccccaaaacugacaccuuuguuagccaccuccccacccacauacauuucugccagug

SEQ ID NO: 241547 - RNA, 64 nt, Human
ggcucaccugaaguccuaucacugccgcucugccccuccccaugagccagaucccaccaguuuc

SEQ ID NO: 241548 - RNA, 63 nt, Human
ucaugaaggaggggaccucuccacacagguguuccgugggacccucagcagcucuggcucugc

SEQ ID NO: 241549 - RNA, 64 nt, Human
gaagagaaccauaucaagacucuuuggacacucacacggacacucaaaagcugggcagguuggu

SEQ ID NO: 241550 - RNA, 64 nt, Human
ccagccuccacuuucagagugaaauucaaggcagcacggacaugugcccaucaggcacagaaga

SEQ ID NO: 241551 - RNA, 64 nt, Human
gggagggguggccccgccgaggcuucaggggcccccuccccaccaaaggguucaccucacacuu

SEQ ID NO: 241552 - RNA, 64 nt, Human
ccccaaccgcugccauuucacacucacccuccacccuccccacccccucggggcagaguuugca

SEQ ID NO: 241553 - RNA, 64 nt, Human
caucucccgggccagacagcuguccccccguccuccuccccagcccagccugcucagagaagcu

SEQ ID NO: 241554 - RNA, 64 nt, Human
ccaucuagggcaaguccugaaaggcccaaggcccccuccccagucuggccuuggccuccagccu

SEQ ID NO: 241555 - RNA, 64 nt, Human
caccugccaucuuggucaugagcuacugucugucccuccccaggacccgcggugggugcugcau

SEQ ID NO: 241556 - RNA, 64 nt, Human
gggagggggcuggccugggggucuugggaaggccccuccccaggcccuaggccaccucgcggaa

SEQ ID NO: 241557 - RNA, 64 nt, Human
guuucuggcccucguccucccugccucucaucugccuccccaacccccaccuacccacugcucc

SEQ ID NO: 241558 - RNA, 64 nt, Human
ggcugcccacccuguccacgugaagugccaacgcccuccccacccugggccgagcccccacccc

SEQ ID NO: 241559 - RNA, 64 nt, Human
cccgagggccccugcaagcacuuuacuuccuguuccuccccagccuuaaccccaaagcccuccu

SEQ ID NO: 241560 - RNA, 64 nt, Human
cacgugucacccacgucugcgcuuggucacccguccuccccacccuguguguguuuaugucaua

SEQ ID NO: 241561 - RNA, 64 nt, Human
aucaucuccccugggcccuggacucggacuggggccuccccaccucccucucggcugugccuua

SEQ ID NO: 241562 - RNA, 64 nt, Human
gccggcacccugccgcucagccgucccgacggcgccuccccagcccggggacggccgugcuccg

SEQ ID NO: 241563 - RNA, 64 nt, Human
ggcccugugcccuccggccaccuggaucccugccccuccccacugggacggaauaaaugcucug

SEQ ID NO: 241564 - RNA, 64 nt, Human
uccaucccuaagaauucccagauagucccagcagccuccccacguggcaccuccucaccuuaau

SEQ ID NO: 241565 - RNA, 64 nt, Human
aggucucuuccuuugcucugaggucccuucaaggccuccccaauccaggccaaagccccaugug

SEQ ID NO: 241566 - RNA, 63 nt, Human
gcacuuugaaccuggaaaacaaucccaacaggcccgugggaccaugacuuagggaggugggac

SEQ ID NO: 241567 - RNA, 63 nt, Human
uugccaagccucggggacugguuucuaagacaaccgugggaaccacugugacgggagaaaccg

SEQ ID NO: 241568 - RNA, 63 nt, Human
gcuucagagaauuuaggcaaacacuggccauggccgugggaguacugggaguaaaauaaaaau

SEQ ID NO: 241569 - RNA, 64 nt, Human
gagucugggggaggguccccaccuuccuguaccuccuccccacagcuugcuuuuguuguaccgu

SEQ ID NO: 241570 - RNA, 64 nt, Human
cccaccuucccucuuuucuggaagccaaagucacccuccccaauaaaguccucacugccaacau

SEQ ID NO: 241571 - RNA, 64 nt, Human
ugcugagaauuaaauaaacaucucuaaagccugaccuccccacgucaagaggugaucugugcca

SEQ ID NO: 241572 - RNA, 64 nt, Human
gugccccucuccuucuuagcuaucauugcuuccuccuccccaacugugggggugugcccccuuc

SEQ ID NO: 241573 - RNA, 64 nt, Human
gcaacaaugaccuuuuauuuucuguuuguccccaccuccccagccuuccaccuccuguucuucc

SEQ ID NO: 241574 - RNA, 64 nt, Human
acauaugggaggagggggcagauuccuggcccucccuccccagacuugaaggugggggguaggu

SEQ ID NO: 241575 - RNA, 64 nt, Human
agccuguugcccaauaaauuuaagagagucccccccuccccaaugcugacccuaggauuuuccu

SEQ ID NO: 241576 - RNA, 64 nt, Human
accugggccaccagaaggugacacccccagaaucccuccccagagacugcaccagcgcagccag

SEQ ID NO: 241577 - RNA, 64 nt, Human
aaccuuccccaucucccugccagccccuaacuacccuccccagccuccaggaacuauccaucca

SEQ ID NO: 241578 - RNA, 64 nt, Human
gugggaugacagccagaggaauaagaacuugcucccuccccagagguaaacacuugguccaaag

SEQ ID NO: 241579 - RNA, 64 nt, Human
agccccaugguggggcuaggcuggggcucaccccccuccccagcuauuuuaugucuguaauuaa

SEQ ID NO: 241580 - RNA, 64 nt, Human
ucuuccaaggccugaugcauucauaaguugaagcccuccccagauccccuuggggagccucugc

SEQ ID NO: 241581 - RNA, 64 nt, Human
cuuuucuguucauuucaucuggcuccccccaccaccuccccaccccaccccccacccccugcuu

SEQ ID NO: 241582 - RNA, 64 nt, Human
ccacucccagagccugccccagcccuucgagcccccuccccaauaaagaauucacauccuccaa

SEQ ID NO: 241583 - RNA, 64 nt, Human
ugcccauccagaaagcagcagcugccuuguuaguccuccccagggucuagcuuuccuucuuccu

SEQ ID NO: 241584 - RNA, 63 nt, Human
acguccccucaccccaucccucagccagugacaccgugggaacagcaggcuugggagugcagc

SEQ ID NO: 241585 - RNA, 63 nt, Human
auguagaccauggguucaucuggaguuccuuguccgugggaacacaguguucuauucuacucu

SEQ ID NO: 241586 - RNA, 63 nt, Human
agucggaacggagaaagguggacuggaaggggcccgugggagucaucucaaccauccccuccg

SEQ ID NO: 241587 - RNA, 64 nt, Human
ggaacugcccagccugcuccuggcccccuggaagccuccccacagcugguaaucuggacuuaag

SEQ ID NO: 241588 - RNA, 57 nt, Human
ggcucgcucgauaccguuaggccccgcccuccccaaagucccgccccgcccccguca

SEQ ID NO: 241589 - RNA, 64 nt, Human
agaggccggucccuuccuugggccccucucauucccuccccagaauggaggcaacgccagaauc

SEQ ID NO: 241590 - RNA, 64 nt, Human
ccucuuugaaacucuggacguauuuauggcuccaccuccccaccucccucccccgucaguggga

SEQ ID NO: 241591 - RNA, 64 nt, Human
cucccaccccacccuguuguagccccuccuacccccuccccauccaggggcuguguauuauugu

SEQ ID NO: 241592 - RNA, 64 nt, Human
aggucccgaccacugacccuucccggcugcccucccuccccagcuuacaccucaagcccagcac

SEQ ID NO: 241593 - RNA, 64 nt, Human
cagcaagcccacggucuuccacuaccagccugggccuccccagauguccugcggacucuugccc

SEQ ID NO: 241594 - RNA, 64 nt, Human
gaaccccucccccauuuacuucuccaccucccguccuccccaucauugguuuuuuuuugugugu

SEQ ID NO: 241595 - RNA, 64 nt, Human
caccucccagguuccagcaauucuccugccucagccuccccaguagcugggauuacagacaugc

SEQ ID NO: 241596 - RNA, 64 nt, Human
cuggaagccacggguacgguuaaccuggcccuucccuccccaucuccccuacuucccuggaagg

SEQ ID NO: 241597 - RNA, 64 nt, Human
ugggggcccgggggcgagggcugcccccuccuccccuccccagugagggacauuuuuugguaaa

SEQ ID NO: 241598 - RNA, 64 nt, Human
cccacucccacagggagccccggccauuugcugcccuccccaccccugccccagccucaggacu

SEQ ID NO: 241599 - RNA, 64 nt, Human
gacugcaggagccauccgccccccucagccccuuccuccccagggagcaaagccauaaggggca

SEQ ID NO: 241600 - RNA, 64 nt, Human
uugccuaaggcuaugugugacacccuccugaggaccuccccaccccaguguaauggcccuucau

SEQ ID NO: 241601 - RNA, 64 nt, Human
gccugggucccugacaggcacugcugccaugcugccuccccaggcuggccccagaggagcgagc

SEQ ID NO: 241602 - RNA, 63 nt, Human
aucuuuagugaaaucuuauguguaauuauuccaccgugggaacagagaauaccuguuuagugu

SEQ ID NO: 241603 - RNA, 63 nt, Human
gcgcugacucccgcuagugucaggagaaaagucccgugggaaggguccugcaggggugcaggg

SEQ ID NO: 241604 - RNA, 63 nt, Human
ccgcggcagcuccucgccucagcuccgcacggcccgugggaggaaggccaggcucgggggagc

SEQ ID NO: 241605 - RNA, 64 nt, Human
uggcucccuacgaccuuugggcucgaggccagcuccuccccaugcccgcugucccagcuccuug

SEQ ID NO: 241606 - RNA, 64 nt, Human
guuacccccaggagauccuggacugccugacuccccuccccagacuggcuugggagccugggcc

SEQ ID NO: 241607 - RNA, 64 nt, Human
cagcuguggcccccagggcuacccuacacaacgcccuccccaggccccccuaagcugcucuccc

SEQ ID NO: 241608 - RNA, 64 nt, Human
gacaauccgcucuucauccagaaaaccaaccugcccuccccaaauaugugcucaccagcagcaa

SEQ ID NO: 241609 - RNA, 64 nt, Human
cguguuucugcccugugacuccuggaaccugcguccuccccaaagccaugggagggguguccuc

SEQ ID NO: 241610 - RNA, 64 nt, Human
gugggagccacccccaggugcugggggcacagccccuccccacuccggccacgcccccacccac

SEQ ID NO: 241611 - RNA, 64 nt, Human
uuuuuucugaaggugggacagucacuuccuccucccuccccaccccugucgcauccacgugcga

SEQ ID NO: 241612 - RNA, 64 nt, Human
cgccucccagauucacgccauucuccugccucagccuccccagcagcugggacuacaggcaccc

SEQ ID NO: 241613 - RNA, 64 nt, Human
aggcacaaccuggacccaggcagccucuuuccucccuccccaaucucuuccauuuuucuacaga

SEQ ID NO: 241614 - RNA, 64 nt, Human
caggaaggagccagaacccucaccccucucccacccuccccagggguaaccccaggccaagcac

SEQ ID NO: 241615 - RNA, 64 nt, Human
gggcgccccggacagaggucugccccacccacuuccuccccaccaccugugccccagagagcag

SEQ ID NO: 241616 - RNA, 64 nt, Human
ggcuggggcagcccucagagccuggccacguggaccuccccagcaugaucaguuccuucaucag

SEQ ID NO: 241617 - RNA, 64 nt, Human
agcggggagcuugaacacccaggccagggacaccccuccccagcucccagagaggcccccugag

SEQ ID NO: 241618 - RNA, 64 nt, Human
cucugcccucucuggaguuugccucccccagcccccuccccaucaauaaaacucuguuuacaac

SEQ ID NO: 241619 - RNA, 64 nt, Human
cagaccuaagcccucccccaccccuggaaaggucccuccccaacccaggccccuggcgugugug

SEQ ID NO: 241620 - RNA, 63 nt, Human
cuuacuguuuugccguucaaaaaggucgcgaauccgugggacugagcacggggaccucacccg

SEQ ID NO: 241621 - RNA, 63 nt, Human
uuuuguccccggcagcagggaagaagcuggaggccgugggagaauggcugggcagagcagagg

SEQ ID NO: 241622 - RNA, 63 nt, Human
uuauauucauucucugcugcuuucucccuucacccgugggacucucacccuucuugcucauuc

SEQ ID NO: 241623 - RNA, 64 nt, Human
acuuccacgcucugcuggucaguggcggcuguccccuccccagcccagccgcccagccacaugu

SEQ ID NO: 241624 - RNA, 64 nt, Human
cccaagcaugcaauugccugucccccccggccagccuccccaacuugauguuuguguuuuguuu

SEQ ID NO: 241625 - RNA, 64 nt, Human
gccuccaacugugccccauuuccacccccaaauaccuccccaggaggcaccugugcccaccccc

SEQ ID NO: 241626 - RNA, 64 nt, Human
augaagggauguccccaccccagcacuaucagggccuccccaggcuuccagaguugaaagccag

SEQ ID NO: 241627 - RNA, 64 nt, Human
ugacccgucccucccccauccccccuccccacccccuccccaauacagcuacguuuguacauca

SEQ ID NO: 241628 - RNA, 64 nt, Human
ugaaggaagacugacccgucccucccccauccccccuccccacccccuccccaauacagcuacg

SEQ ID NO: 241629 - RNA, 64 nt, Human
aaucccgggcgggaggaggacccccgcaccgcccccuccccagcguguaaguggcucugcuauu

SEQ ID NO: 241630 - RNA, 64 nt, Human
cccagcucugcaaauccccucccccugccccccaccuccccaggcucaccuugccaugccaggu

SEQ ID NO: 241631 - RNA, 64 nt, Human
uccgucgcugcccuucacaccuuuuggugcuaccccuccccagaguuaagcacuggaugucucc

SEQ ID NO: 241632 - RNA, 64 nt, Human
gcucuuucuccccucccuccccacccaagccucaccuccccaccccuugaacccccaugcaaug

SEQ ID NO: 241633 - RNA, 64 nt, Human
gguggcauacugcagucuggcucuuucuccccucccuccccacccaagccucaccuccccaccc

SEQ ID NO: 241634 - RNA, 64 nt, Human
gcagcagggugugugcauaugagacuugggggucccuccccaauuuuaguuuccugccaaaacg

SEQ ID NO: 241635 - RNA, 64 nt, Human
acccuggggggggccaggcuccagagagggggcaccuccccacacaccccccccccaccgaggc

SEQ ID NO: 241636 - RNA, 64 nt, Human
ccagggggugcccucccagacccccuugcccaggccuccccagcaccuagguggggccuggggu

SEQ ID NO: 241637 - RNA, 64 nt, Human
gcucucuucccucaucucuagcaguauggcauccccuccccaggaucucgggcugccagcgaug

SEQ ID NO: 241638 - RNA, 63 nt, Human
cauuaguuauacaguuuuggguguucuugccacccgugggaugccugcuucucacuaccaccu

SEQ ID NO: 241639 - RNA, 64 nt, Human
agcacaaccccaaucacacacagaaacccguaggcacggacacacccagucucaaugcacgaag

SEQ ID NO: 241640 - RNA, 64 nt, Human
aaguagacagcagcggcugggaccccacaccuuucacggacacugacaagauccagagcuauca

SEQ ID NO: 241641 - RNA, 64 nt, Human
agccagggaagcaacugggacccugaaaacugucccuccccagcccgcucccccucucugugcc

SEQ ID NO: 241642 - RNA, 64 nt, Human
ucucuuauccucaacuuucuguccauucgggccuccuccccaccucccacgccccagccccucc

SEQ ID NO: 241643 - RNA, 64 nt, Human
ucccggcccccuccucuccagccugucaggccagccuccccagcccccuucccucaacucuagg

SEQ ID NO: 241644 - RNA, 64 nt, Human
ccugccccaggaccagaggccugucucccccuucccuccccaccggcccgggggagaccucuuc

SEQ ID NO: 241645 - RNA, 64 nt, Human
auuugacacgagucugcugugaaccccgcaaccuccuccccaccucccaucucuccuuccaggc

SEQ ID NO: 241646 - RNA, 64 nt, Human
cuggggccaggggucgggggaguguugggagccuccuccccaccccaccucccucacuucacug

SEQ ID NO: 241647 - RNA, 64 nt, Human
aaaaagagacugaucauccaggccucagccucauccuccccaggaccccuguccaggauggagg

SEQ ID NO: 241648 - RNA, 64 nt, Human
gugcccgcguacugaguccgcgcgcggcggccacccuccccaaggggcgggcucgcgggggggu

SEQ ID NO: 241649 - RNA, 64 nt, Human
agccaggacagaggccaggagccagcccugcagcccuccccacccggcauccaccugcaucccc

SEQ ID NO: 241650 - RNA, 64 nt, Human
acaaggucuggcauggcacagcaccacugccaggccuccccaggcacaccacucugcccaggga

SEQ ID NO: 241651 - RNA, 64 nt, Human
accuccccagacucugcacggauguccuaggcccccuccccaacucuaaccagaccccaucccc

SEQ ID NO: 241652 - RNA, 64 nt, Human
ccaacaccaaacuguacagacucucccaccccaaccuccccagacucugcacggauguccuagg

SEQ ID NO: 241653 - RNA, 64 nt, Human
aacauucuugaaucacccaacccuggaucagaaaccuccccauuaacaaacacugccccuuaag

SEQ ID NO: 241654 - RNA, 64 nt, Human
ggagcucagaacaucccccaaucucuuacagcucccuccccaaaacuggggucccagcaacccu

SEQ ID NO: 241655 - RNA, 64 nt, Human
ggcaggggggucaaggagaggguuuuggccgcucccuccccacuaaggacuggacccuugggcc

SEQ ID NO: 241656 - RNA, 63 nt, Human
gauuugacaagaugccuucccacccagguaaccccgugggaacgugccaguaccucaccgcac

SEQ ID NO: 241657 - RNA, 63 nt, Human
cagcuccgcuggucugucugugcauccacugugccgugggacauauguaauuugugcagugug

SEQ ID NO: 241658 - RNA, 63 nt, Human
cacaacacagccuuggaccaugagcagaagcguccgugggaacuccacugggguggaugggcu

SEQ ID NO: 241659 - RNA, 64 nt, Human
ggggaacucccaacuucgugcccuagauccugcaccuccccacucgaaaguggguauccgaaaa

SEQ ID NO: 241660 - RNA, 64 nt, Human
gcucucuugucucuucccugccuccucccuuuucccuccccacauuuuguauaaaacuuuaauu

SEQ ID NO: 241661 - RNA, 64 nt, Human
cuuuugcguucugccaugacuaaguuuucggaggccuccccagccauguggaacugugugugag

SEQ ID NO: 241662 - RNA, 64 nt, Human
ggacaggcagccccgcgccccugagacuggagacccuccccaguguggcauuuccugccagggg

SEQ ID NO: 241663 - RNA, 64 nt, Human
ucccccuuuggaugggaggccucucuguuacagcccuccccaugcugugcccugccauauacgu

SEQ ID NO: 241664 - RNA, 64 nt, Human
acuugaagagaauugacccgugggggacuccccaccuccccaacccagacuuuggagcgggugg

SEQ ID NO: 241665 - RNA, 64 nt, Human
uugagugacgguugggaagggggcucagaagcccccuccccagcccggaacugaccccuccuuc

SEQ ID NO: 241666 - RNA, 64 nt, Human
ccugguggugcuaacggcccuuuccccaggaaucccuccccaacggcugccuuccccaagcauc

SEQ ID NO: 241667 - RNA, 64 nt, Human
gucuauaucccuggggaaauuuccaccccaguccccuccccagggaaccacccccaguaaccau

SEQ ID NO: 241668 - RNA, 64 nt, Human
cuccccuucgaggauugcacccgcccguccuaagccuccccacaaggcgaggggaguuaccccu

SEQ ID NO: 241669 - RNA, 64 nt, Human
cauugaacucccccauggugguuucaugaugcccccuccccaauuccucgcacuuuauucuccu

SEQ ID NO: 241670 - RNA, 64 nt, Human
ccagaugcccagaggcuccaucguccauccucuuccuccccagucggcugaacucuccccuugu

SEQ ID NO: 241671 - RNA, 64 nt, Human
uauagccccgauucaccaucucuccuccauuuuuccuccccaagaauagcuggcaucucuucuc

SEQ ID NO: 241672 - RNA, 64 nt, Human
uucuuauaaagacacuagucauauuggauuagggccuccccaugaccuaauuuaaauaaauuaa

SEQ ID NO: 241673 - RNA, 64 nt, Human
ggucccgggaauucugugaaccaggcugcugucuccuccccagaaagaguccuuaccuuggaga

SEQ ID NO: 241674 - RNA, 63 nt, Human
gccacaaggagugucccuucuuccccagcagagccgugggaggguccuugucugcucuccuuu

SEQ ID NO: 241675 - RNA, 63 nt, Human
accuugucuccaggauguguccugcugucugccccgugggaagagcagagaaaucaucaccac

SEQ ID NO: 241676 - RNA, 63 nt, Human; identical to SEQ ID NO: 241478

SEQ ID NO: 241677 - RNA, 64 nt, Human
cccuucuccgugggaaccccaggccucuugccucccuccccaccuacaaggcccucucccaagg

SEQ ID NO: 241678 - RNA, 64 nt, Human
cugcagcugagggacgccaagcagacacaccugcccuccccagccagcuccugucuguaugggc

SEQ ID NO: 241679 - RNA, 64 nt, Human
uaugaauugccaggauguuugaguaaauauguguccuccccacugagcuuuguuuucuguuuca

SEQ ID NO: 241680 - RNA, 64 nt, Human
gcccaacccccaccccuuccccgacacccaagccccuccccacgucgcccccuccugcacagcc

SEQ ID NO: 241681 - RNA, 64 nt, Human
gccgccaucucucugccccgccccgccccuccggccuccccacaccccccuugcccucacuacc

SEQ ID NO: 241682 - RNA, 64 nt, Human
uucugcucauguguuugcagaccggcugggauagccuccccaccccuuaucagagccaagacac

SEQ ID NO: 241683 - RNA, 64 nt, Human
gaggccagaaccacugggccggccggcauuccagccuccccagacugcugcccaccuugggacu

SEQ ID NO: 241684 - RNA, 64 nt, Human
ucauccguaaaguggggauagugaagaugacaccccuccccaccaccucucauaagcacuuuag

SEQ ID NO: 241685 - RNA, 64 nt, Human
acuuaugacaccucacuucccuagagaaggccugccuccccauagggaaucuggggguuucuuc

SEQ ID NO: 241686 - RNA, 64 nt, Human
ccagccuaaugagccccuuauuuucuuuuuuuucccuccccaggucuaguagcucuaacuaaaa

SEQ ID NO: 241687 - RNA, 55 nt, Human
gccuccauccuugggccugagagccccuccccacaacucaguguccuucaaauau

SEQ ID NO: 241688 - RNA, 64 nt, Human
agccaccacgcccugccuacucuuuguuuucuuuccuccccacccauuuucccccguccugucc

SEQ ID NO: 241689 - RNA, 64 nt, Human
cuagcgcugcacauccgccuuucccaccgcccucccuccccagcuccgccucuguccucgcucc

SEQ ID NO: 241690 - RNA, 64 nt, Human
uuauuugauugcagauuuuuuuggcgcgcugcccccuccccacccugccacucuugacauucca

SEQ ID NO: 241691 - RNA, 64 nt, Human
aaugcaacugaagaaauagauuguugcauucauuccuccccaccccccauuuguaggcaguaaa

SEQ ID NO: 241692 - RNA, 64 nt, Human
cugggaugggggcuuuggugaagugcacggagcucacggacaagccgcaggcucugggaagcgu

SEQ ID NO: 241693 - RNA, 62 nt, Human
ccaugcacauuacuuagcuaacaauuagggagacucguaaggccaggcccugugcugggcac

SEQ ID NO: 241694 - RNA, 62 nt, Human
ugaccacuggcccuggggccaugggugcauggacucguaaagcugcuagggccccuagaaac

SEQ ID NO: 241695 - RNA, 64 nt, Human
gcgaugggagucuugucucccagccugucaguuuccuccccagggcagagcuccccuuccugca

SEQ ID NO: 241696 - RNA, 64 nt, Human
ugggaggugggggugagccccucacagccuugccccuccccaaggcuggcaaccugccucccau

SEQ ID NO: 241697 - RNA, 64 nt, Human
ccucggaguguggccuggauccauccugcuagcaccuccccagacagggcuccagccugucggc

SEQ ID NO: 241698 - RNA, 64 nt, Human
gacuccaggcccccguugaagccgcucccgguucccuccccagcuccucgucuuugaacugccg

SEQ ID NO: 241699 - RNA, 64 nt, Human
ggcuuugugagagaggaccuccaugcccccgccaccuccccacuccagcagauaaggccgagcc

SEQ ID NO: 241700 - RNA, 64 nt, Human
agccggccccuuuucaguguagaccaccagcuccccuccccaucuccuugagucagcagacugu

SEQ ID NO: 241701 - RNA, 64 nt, Human
uggucggggccccugggagaggagacagggcauuccuccccacucugucuccaggcugccucug

SEQ ID NO: 241702 - RNA, 64 nt, Human
ggguagagcacagggguuuccccauacuaccuccccuccccaggacacucccaggcuuggguuu

SEQ ID NO: 241703 - RNA, 64 nt, Human
gggaccugcaaagcuagaaucuagggcacuguuuccuccccauccuucucuuuguagagaauag

SEQ ID NO: 241704 - RNA, 64 nt, Human
cucuggaaguguauugggcugaggugggauuuucccuccccacagugcacugagcaauggaggg

SEQ ID NO: 241705 - RNA, 64 nt, Human
ugucccguggcauuucaauuccuggcccuguucuccuccccaagucggcacccuuuaacucaug

SEQ ID NO: 241706 - RNA, 64 nt, Human
gugaccuccugcagggagccuucugccaccagccccuccccagacucucagguggaggcaacag

SEQ ID NO: 241707 - RNA, 64 nt, Human
acaacaaaguuccacuuccaggucugccugguucccuccccaaggccacagggagcuccgucag

SEQ ID NO: 241708 - RNA, 64 nt, Human
gaaugggagggucuggcuucagcuaucagggcacccuccccagggauuggaaacggaugacggg

SEQ ID NO: 241709 - RNA, 64 nt, Human
gagaggacuugaggccaugaggucuggccucuucccuccccaucuggagacucuuucucccuug

SEQ ID NO: 241710 - RNA, 63 nt, Human
agccgagauccagucagggugggggcgcuggagccgugggagcccggccagggcagggggcuc

SEQ ID NO: 241711 - RNA, 63 nt, Human
auuccccacgcacccgaugaccuauuuuuucagccgugggaggaauggagucuuugguacauu

SEQ ID NO: 241712 - RNA, 63 nt, Human
cagccgugaucacaggugacgaccgcaccgcggccgugggacugaugcgggaucccgagggcc

SEQ ID NO: 241713 - RNA, 64 nt, Human
gccaucucacccucagacccccucgccuuccccaccuccccaccgagaacuccagagacccaga

SEQ ID NO: 241714 - RNA, 64 nt, Human
gagagccucuagucgccuccugccaucugaucucccuccccaccauucccguacucaguuguuc

SEQ ID NO: 241715 - RNA, 64 nt, Human
ucacugcgacguugacacuccucucccuucccuuccuccccaacuccccaaacacuguggaagg

SEQ ID NO: 241716 - RNA, 64 nt, Human
uucucauuagugucucccgggccuguccccaacuccuccccaccccucccccaucuccucuuug

SEQ ID NO: 241717 - RNA, 64 nt, Human
cggcucguucaagaacauaagcuaccaccuucucccuccccacccccuccaggcccggggcuga

SEQ ID NO: 241718 - RNA, 64 nt, Human
agagguucucuaagcagcugugaccagguuccucccuccccaccugcccuccuagcuccagcac

SEQ ID NO: 241719 - RNA, 64 nt, Human
gcgggcuccugagccugcuucugccugcuuuccaccuccccagucccuuucucuggcccugucc

SEQ ID NO: 241720 - RNA, 64 nt, Human
gccugcuuauugccucuuucucagaauccucuuuccuccccauuuggcccugggcucaggggac

SEQ ID NO: 241721 - RNA, 64 nt, Human
gcacuuucuuuccauggaaacauuuagacacaaaccuccccagcuccggccaagccaucauuug

SEQ ID NO: 241722 - RNA, 64 nt, Human
ucggcucacaccaacaaggcaagccaaaggcgccccuccccagagggaucccuaacgugcccag

SEQ ID NO: 241723 - RNA, 64 nt, Human
cuguguugagggcagaugccacaagauucccgaaccuccccaaaccccgcccuacugucucuuc

SEQ ID NO: 241724 - RNA, 64 nt, Human
gccacauggccuucagaaccuucucucuggucuuccuccccacuucuucccugccuucuagaga

SEQ ID NO: 241725 - RNA, 64 nt, Human
accccuggacugguggcccccacccugcgggaggccuccccaugugccugugccaagagacaga

SEQ ID NO: 241726 - RNA, 64 nt, Human
accccuggacugguggcccccacccugcgggaggccuccccaugugccugcgccaagagacaga

SEQ ID NO: 241727 - RNA, 64 nt, Human
ggggaagaaaugaaaggcaugcccacguccgucaccuccccauccccuaguccccaccuugaac

SEQ ID NO: 241728 - RNA, 63 nt, Human
aauccugagugcucuguggcugacgcugucuacccgugggagagacacacucaggaguggccg

SEQ ID NO: 241729 - RNA, 63 nt, Human
aaaggggucggcugaccaugcucaucugcugguccgugggacggugcccaagccagaggcugg

SEQ ID NO: 241730 - RNA, 63 nt, Human
uugcuaaagaaagagcagagagggugggucugaccgugggauaccagauucgguuagaaagug

SEQ ID NO: 241731 - RNA, 64 nt, Human
cugagaggauggccucagagcugacuugggcaauccuccccaacaggaaggggagacauugccu

SEQ ID NO: 241732 - RNA, 64 nt, Human
ccuguggucccuccugcagugucugaagcgccugccuccccacugcucugccccacccuccaau

SEQ ID NO: 241733 - RNA, 64 nt, Human
uguggaccuuggaggcuuuggcuuuguggcagggccuccccaggcagcucugggaccuaggagu

SEQ ID NO: 241734 - RNA, 64 nt, Human
gggagcagcugugggcgccucauuucaggcaaguccuccccaaaccuucagaugcagugagacc

SEQ ID NO: 241735 - RNA, 64 nt, Human
aucaucagcacaagaacaucaacaggaaugccacccuccccagugucugaacucccugucccug

SEQ ID NO: 241736 - RNA, 64 nt, Human
cuucauuuucucgcuccuguuagaacaccaguccccuccccaguggggccccacugcaccugcu

SEQ ID NO: 241737 - RNA, 64 nt, Human
ccugccaccaagauguguucuccuuacuccaucuccuccccaaacacgcuccauguauauauuc

SEQ ID NO: 241738 - RNA, 64 nt, Human
ccaccggggccaguggcuggagcuugacgucuuuccuccccaugggggugggagggcccccagc

SEQ ID NO: 241739 - RNA, 64 nt, Human
caggacugggagggaaaguccagggcccccccacccuccccaccacccuccgccaucagccugc

SEQ ID NO: 241740 - RNA, 64 nt, Human
gugcaagaguuccaaagagccucuggcccaggccccuccccaccagggcuuugcagauguccuu

SEQ ID NO: 241741 - RNA, 64 nt, Human
auuuucuucccuaaaaccaacagugucccacugaccuccccaaguguuugcugcguggcagauu

SEQ ID NO: 241742 - RNA, 64 nt, Human
agccaugcuggacccaugagccucgcuggggccuccuccccaggcagccaaugggccccagaca

SEQ ID NO: 241743 - RNA, 64 nt, Human
ugucuccugcaauuggaauuccaccuuguccagcccuccccaguuaaaguggggaagacagacu

SEQ ID NO: 241744 - RNA, 64 nt, Human
uuaacgcuagauugugaggaaugacacaccacucccuccccaccuugaaucccuaauuagauua

SEQ ID NO: 241745 - RNA, 64 nt, Human
ggauggcuguguccggagccuggcggggaggcggccuccccaguaugugagugcagggaucugc

SEQ ID NO: 241746 - RNA, 63 nt, Human
aacgagccugaauacagcagauguaggggacagccgugggaccgcgugagaauugaagcggug

SEQ ID NO: 241747 - RNA, 63 nt, Human
gacaucguaugcuugggaugggggccgugccacccgugggaaugcugcccgcucugcagacug

SEQ ID NO: 241748 - RNA, 63 nt, Human
gugcaucuuuccucuucgguuuuacaguggcuuccgugggaucgucaauuucuuguucuuaga

SEQ ID NO: 241749 - RNA, 64 nt, Human
aauugucagccucuacgggcagaguccggcauccccuccccagacugccugcugucaaaccacg

SEQ ID NO: 241750 - RNA, 64 nt, Human
gacaagggcuucugaggccagccaugcccacgccccuccccagcccccacccaugccagcgcag

SEQ ID NO: 241751 - RNA, 64 nt, Human
ccugcacgccggcaccaaacccuguccucccaccccuccccacucaucacuaaacagaguaaaa

SEQ ID NO: 241752 - RNA, 64 nt, Human
uuaucagcagacauaagcaaggcagaugugucuuccuccccaacaccuucuucagacuugccuu

SEQ ID NO: 241753 - RNA, 64 nt, Human
gcucagggcggugccugcccugggccgggaccccccuccccaccccccaccuaggcuuuuuggg

SEQ ID NO: 241754 - RNA, 64 nt, Human
aaucacaagccugggcauggccugggucgcacccccuccccacggccccacccacagggaccuc

SEQ ID NO: 241755 - RNA, 64 nt, Human
acagccccucaccacggacacggacagaggaccaccuccccauacagagagaggcuucccuccc

SEQ ID NO: 241756 - RNA, 64 nt, Human
gcucccucagcagccacucauagcacagauuccuccuccccaggccuucccuacucaacgguca

SEQ ID NO: 241757 - RNA, 64 nt, Human
ccagagcugccccccacgggcauccuacccacugccuccccauccccgcuggccccagacccgc

SEQ ID NO: 241758 - RNA, 64 nt, Human
ugccacggggaccaggaccccacagcgcacccccccuccccaccaacuucucugccccagggac

SEQ ID NO: 241759 - RNA, 64 nt, Human
ugcugccacagggggcuggugacacccagagcccccuccccagcccucaggcccucccugccaa

SEQ ID NO: 241760 - RNA, 64 nt, Human
augccagggugccuccucuaguuaaagucagucaccuccccagaagggccacacuccaggagga

SEQ ID NO: 241761 - RNA, 64 nt, Human
cuguagugugucugcuguuaccuagagggucucaccuccccacucuucacagcaaaccugagca

SEQ ID NO: 241762 - RNA, 64 nt, Human
gagaggagggaagccaggggucccagcccgucuaccuccccaucccacccaggcccccagcucc

SEQ ID NO: 241763 - RNA, 64 nt, Human
aguuuucauguggauggauuguaguucauuugacccuccccauccgcgggccauccggcuugug

SEQ ID NO: 241764 - RNA, 63 nt, Human
cugugggguagguugucaaaccaaacagagccaccgugggacaucaaguggaagaacuuguuu

SEQ ID NO: 241765 - RNA, 63 nt, Human
agaaagcagucuguaauaaagauuaaaauaaugccgugggagcaaagaggaagggauaaugaa

SEQ ID NO: 241766 - RNA, 63 nt, Human
ggaggugaugggaguucccuucccacuugcucuccgugggaccgggugaagcacagaccuugc

SEQ ID NO: 241767 - RNA, 64 nt, Human
ccccaguccugccccccaccccacccucccuaccccuccccagucucuggggucaggaagaaac

SEQ ID NO: 241768 - RNA, 64 nt, Human
cagagcagcccuugggcaacuccugccaccacccccuccccagggagcccaaggcaggggaggc

SEQ ID NO: 241769 - RNA, 53 nt, Human
ccuuccaccccuccaacuagugcccuccccaccaugccuccuucccaggaccc

SEQ ID NO: 241770 - RNA, 64 nt, Human
aagagagggcacucccaggccccugcccccaggcccuccccaggcgauggacaauuaugauagc

SEQ ID NO: 241771 - RNA, 64 nt, Human
ugcguguacuucagggccuggguauccagcgagcccuccccacccacccacgguccucaccugg

SEQ ID NO: 241772 - RNA, 64 nt, Human
gaauguuuagaagcagaacaagccauuccuauuaccuccccaggaggcaagugggcgcagcacc

SEQ ID NO: 241773 - RNA, 64 nt, Human
cucccugguuccugccacuuuuccuguccguccuccuccccauuuuuuuuuuaaaagaaagcug

SEQ ID NO: 241774 - RNA, 64 nt, Human
cugccugccauugacaauguugcugggaccucugccuccccacugcagcccucgaacuucccag

SEQ ID NO: 241775 - RNA, 64 nt, Human
guuugugucucaccuaucugugaccuggaagcucccuccccacugaaccaauguucuucuuaca

SEQ ID NO: 241776 - RNA, 64 nt, Human
ccggagaggggagaagucauguugccccuaaaccccuccccaccucugcaggacagacauggga

SEQ ID NO: 241777 - RNA, 64 nt, Human
ugguuucucccuaagcagcccucagcacccccucccuccccaccuggcccucccaggacagcuc

SEQ ID NO: 241778 - RNA, 64 nt, Human
cugagcccacugcaccugcagccacaggcccaccccuccccacucccugaucccguagguggag

SEQ ID NO: 241779 - RNA, 64 nt, Human
ccaugccucagccacgccccuccggccucagcucccuccccaaagugccugagcgccgccucug

SEQ ID NO: 241780 - RNA, 64 nt, Human
ucucagucccucccccaacacuguccacacugccccuccccacuguuuauuuauugcacggauc

SEQ ID NO: 241781 - RNA, 64 nt, Human
ccagacuuccggaggacugaccaucucucacuguccuccccaccuucuuccucacucacacauu

SEQ ID NO: 241782 - RNA, 63 nt, Human
agccaagcaacagagccccucucccgccguggcccgugggagcaguuacaucgggucuggugc

SEQ ID NO: 241783 - RNA, 63 nt, Human
acacaguccucacacacggaggccagacacaggccgugggacccaggcucccagccuaaggga

SEQ ID NO: 241784 - RNA, 63 nt, Human
agcaggucagcaccccagagcagacugauagguccgugggacccauguuagagcagaaaauuu

SEQ ID NO: 241785 - RNA, 64 nt, Human
ggcuacugagccacagugaccgccugcccccgccccuccccaucuguccccucucuccacaccc

SEQ ID NO: 241786 - RNA, 64 nt, Human
ccuccugcagcuggacccugcaggguggcucccuccuccccaucaagcacaagagagggcccag

SEQ ID NO: 241787 - RNA, 64 nt, Human
auagaaaccgcagugggccugcaagccgcccgagccuccccagcagccuccuacagagcaggaa

SEQ ID NO: 241788 - RNA, 64 nt, Human
ugucaguauccaggaccccccggauucuccacgcccuccccaucucccagucucccugcccccc

SEQ ID NO: 241789 - RNA, 64 nt, Human
acaugggugaggguugggcaaagggcccuuccuuccuccccaacccuguggucuggggccaugg

SEQ ID NO: 241790 - RNA, 56 nt, Human
gcugggauguggacgggugacccccuccuccccagcccaaccucgggccugcgucu

SEQ ID NO: 241791 - RNA, 64 nt, Human
agaggugauucgggcagccagggacaggagccacccuccccaggcccaacucugcuagcuuccc

SEQ ID NO: 241792 - RNA, 64 nt, Human
ggggccuccuggguggcaggggggcagcagcucuccuccccacucacaggcccugcagugcuca

SEQ ID NO: 241793 - RNA, 64 nt, Human
ccacuuguggcugucccagagugcgguuguacauccuccccaccucauaacgcagccacugagg

SEQ ID NO: 241794 - RNA, 64 nt, Human
aggacccauucugugucaaggugaaugccuguguccuccccagcuucaugccucugucaugggg

SEQ ID NO: 241795 - RNA, 64 nt, Human
gcagcaaggugggggucaggcuacaggugccccaccuccccagagcccugcagucacgugaggc

SEQ ID NO: 241796 - RNA, 64 nt, Human
ggucgaggccugacaggcgcuuagcgggcgacucccuccccauuggccgaguuauggagcgcuc

SEQ ID NO: 241797 - RNA, 64 nt, Human
gaacuccugaccuuaggggagccuccugccucagccuccccaagugcuggguugugugagucac

SEQ ID NO: 241798 - RNA, 64 nt, Human
ggggaccugugcuggccugugcucaacacgggccccuccccacagaaagcugcuccuggaugcc

SEQ ID NO: 241799 - RNA, 64 nt, Human
ccuuuuaguuuugaacucuggaauuccucugcccccuccccaacauuuuuuuggaaucucaccc

SEQ ID NO: 241800 - RNA, 63 nt, Human
ggcugaucccaacugcagcucugcugugggggcccgugggagggaggcagaccccugggcuuu

SEQ ID NO: 241801 - RNA, 63 nt, Human
ucacccucacccugaggccccaggggagaggacccgugggauggugcccagggguugccuugg

SEQ ID NO: 241802 - RNA, 63 nt, Human
ccucaaccuccuggggcaggggacgccgagacuccgugggagaagcucauucccacaucuugc

SEQ ID NO: 241803 - RNA, 64 nt, Human
uuuuuuaaaaagcacugcuaguuuacuugucucuccuccccaucguccccaucguccuccuugu

SEQ ID NO: 241804 - RNA, 64 nt, Human
cccauugcacauggcaggccuggaauccugcagcccuccccaaaaacagauugacccaggaaug

SEQ ID NO: 241805 - RNA, 64 nt, Human
gcacagaaggcugggguggggggaggaguggauuccuccccacccugucccaggcagcgccacu

SEQ ID NO: 241806 - RNA, 64 nt, Human
ucaauauucuaguacuuucugaacauucuggaauccuccccacauucuagaauucucccaacau

SEQ ID NO: 241807 - RNA, 64 nt, Human
agagugcccacuccccucuacuugcugcucugggccuccccaccuuuccuggggucuccacauu

SEQ ID NO: 241808 - RNA, 64 nt, Human
caagaagcgggucccugagacgggggguggcugcccuccccagaccaccccggcagccugagca

SEQ ID NO: 241809 - RNA, 64 nt, Human
auuacuaauugguuuuauuucccuucacacucugccuccccacuucuccccccguuacugaaaa

SEQ ID NO: 241810 - RNA, 64 nt, Human
gacacugugacauuagugcacccuacugacaaccccuccccagccuugccccuuucuccucucc

SEQ ID NO: 241811 - RNA, 64 nt, Human
cuccuaagccccuuccuccuuccauucugcauccccuccccauccaaccuaaaugccacagcug

SEQ ID NO: 241812 - RNA, 64 nt, Human
ugaccuggguauccccugccuccugccaccccuuccuccccacacuccacucugauucaccucu

SEQ ID NO: 241813 - RNA, 64 nt, Human
cgcaccccacgcccuguucacgcucacccagucaccuccccacaucgcacacuggggccccggg

SEQ ID NO: 241814 - RNA, 64 nt, Human
augaaaauguacuugugaggggcccgccaggucaccuccccaaccugcuccugauggggcacug

SEQ ID NO: 241815 - RNA, 64 nt, Human
augaacuucagcacccgagucagucccagcucauccuccccaguuuaccacuuuguucuaauag

SEQ ID NO: 241816 - RNA, 64 nt, Human
gcggugcugguuuuucuccacaaacacccccgccccuccccaugcccaggguggccguggaagg

SEQ ID NO: 241817 - RNA, 64 nt, Human
ccaucagagcagacgcccggguuccauggacccuccuccccacggccaugccucugcucuuggg

SEQ ID NO: 241818 - RNA, 63 nt, Human
auaugcaggaggaaugcugucuccgauaucucaccgugggaaugagugcacugauucaaacgu

SEQ ID NO: 241819 - RNA, 63 nt, Human
ccccaagcugacucauccuaacuaacagucacgccgugggaugucucuguccacauuaaacua

SEQ ID NO: 241820 - RNA, 63 nt, Human
caugcagcuucucuggugcgcaguugguuuugaccgugggacuaggugcuucugcagguuuua

SEQ ID NO: 241821 - RNA, 64 nt, Human
cuggagaugcaguuccagaggauccuggacgaccccuccccaccucagccuggggaggagaagc

SEQ ID NO: 241822 - RNA, 64 nt, Human
aagauguacugcuuuaaaacacaacuccagagccccuccccaagcuccccuccccaagcuccug

SEQ ID NO: 241823 - RNA, 64 nt, Human
uaaaacacaacuccagagccccuccccaagcuccccuccccaagcuccugaagacccgguuucu

SEQ ID NO: 241824 - RNA, 64 nt, Human
uuguauaaguagaauucuuaccaucuuacuccugccuccccauuccuugccugucaggaccauu

SEQ ID NO: 241825 - RNA, 64 nt, Human
gccagcccuagacuuguuggagcauagagcccuuccuccccaggccuaaguauguggagcucug

SEQ ID NO: 241826 - RNA, 64 nt, Human
ggauccggcgcguguggccgcugggcacuuggcaccuccccaagagcuuccacuugguuugguc

SEQ ID NO: 241827 - RNA, 64 nt, Human
gcaaucugcaaauaacuccuccauugaaauaacuccuccccaccccaacaacaacauucccagc

SEQ ID NO: 241828 - RNA, 64 nt, Human
uuugaagaaaaauggaaaaauguaaaaggcagccccuccccaggcuuugugagccuggcccaag

SEQ ID NO: 241829 - RNA, 64 nt, Human
caggcguguucauaucuacucuuuacccuugagcccuccccaggaauuugggacccugcuuuag

SEQ ID NO: 241830 - RNA, 64 nt, Human
agacuugggagcuuuaaagagcaggauagcucuuccuccccaggacuuggucuuuuuucugggu

SEQ ID NO: 241831 - RNA, 64 nt, Human
uaccuucuuuucuuccucauuuccuucuuuuauuccuccccaccccaaccccuuaaaaaaaagg

SEQ ID NO: 241832 - RNA, 64 nt, Human
auuuuccugaaaguuuugaguagaggugagacccccuccccaaguaucuguuuauauaguuagu

SEQ ID NO: 241833 - RNA, 64 nt, Human
gucagaacgaauacuagcaucaguggggaagaaaccuccccaggaaauuggaauuaaagugaaa

SEQ ID NO: 241834 - RNA, 64 nt, Human
ccagauaaaaaugaaagcugcucacacccacuugccuccccaaucuguuaaacagcuucguguc

SEQ ID NO: 241835 - RNA, 64 nt, Human
uuuaugcauuucaauuucaaugguguuggcuuccccuccccaccccacgcgugcauaaaaacug

SEQ ID NO: 241836 - RNA, 63 nt, Human
aaagccuuuuuaacacacguaagggcccucaaaccgugggaccucuaaggagaccuuugaagc

SEQ ID NO: 241837 - RNA, 63 nt, Human
gcugugcuggaaaugccgcuuuaaaaagggauaccgugggacucugcccgucucuuucauaac

SEQ ID NO: 241838 - RNA, 63 nt, Human
augugucugugugugggaauugguaucuugcacccgugggagucgggacauauaauggaaagg

SEQ ID NO: 241839 - RNA, 64 nt, Human
uaugucaguugucuacucuggagcuugacuuggaccuccccagguccuaggcaguagguugaaa

SEQ ID NO: 241840 - RNA, 64 nt, Human
acacacacacacauuagucauaucaccucuguuuccuccccaacaaaagaggcuuuucuucuua

SEQ ID NO: 241841 - RNA, 64 nt, Human
aggaagaaucacacccuuggaauagaaauuuccaccuccccaaccuuucucucagacagcuuau

SEQ ID NO: 241842 - RNA, 64 nt, Human
cuaaccuuuuagggugguuaggacaucucccccaccuccccacuuuuuuccccaagacaagaca

SEQ ID NO: 241843 - RNA, 64 nt, Human
ggacagcagaggcugcagacuggcccacuucccuccuccccagggaugccaagcuuggaucaug

SEQ ID NO: 241844 - RNA, 64 nt, Human
gggcaagaggaugaaggaaggggcuauccugggaccuccccagcccaggaaaaacuggaagccu

SEQ ID NO: 241845 - RNA, 64 nt, Human
uucccaaacccuucgguauuguucaaagaaccccccuccccaaggaagaacaaauaugauucuc

SEQ ID NO: 241846 - RNA, 64 nt, Human
uggggcuuccauggugguuucagaaagggcagccccuccccauggugcagugaagaaaauguuu

SEQ ID NO: 241847 - RNA, 64 nt, Human
ccuccccaacugcucaauaaaccuccugcccuccccuccccagcaggaggcaggcauggaccac

SEQ ID NO: 241848 - RNA, 59 nt, Human
ccugcguccacgcccucugaauucccaccccuccccaacugcucaauaaaccuccugcc

SEQ ID NO: 241849 - RNA, 64 nt, Human
uuuucaaaaauauauauacacauagcaauguccuccuccccauguccucccugccuugggaccc

SEQ ID NO: 241850 - RNA, 64 nt, Human
cuaccucccaccccagcagcccucucuucccccaccuccccagcagcccccacccuugccccag

SEQ ID NO: 241851 - RNA, 64 nt, Human
aaugaucuaugacuccaaccguaugauuuucuugccuccccaguuuucaucccagugguaacgc

SEQ ID NO: 241852 - RNA, 64 nt, Human
ucccuuuacuucuaauacugauuuauguucuaagccuccccaaguuccaauggauuugccuucu

SEQ ID NO: 241853 - RNA, 64 nt, Human
gggugaaagagaauugguugcaaaugaggacuucccuccccaaauggacagucuucucuguuga

SEQ ID NO: 241854 - RNA, 63 nt, Human
gggagggagagggcaggaaggaggcagagcuguccgugggagguggaggccgaggacauuuuc

SEQ ID NO: 241855 - RNA, 57 nt, Human
cacucucccugaauaaguaacugcgacccgugggaggagaugccggggaccugggcc

SEQ ID NO: 241856 - RNA, 63 nt, Human
uucucuccacccaguagguuuucuguuguggucccgugggagaggccagacuggauuauuccu

SEQ ID NO: 241857 - RNA, 64 nt, Human
aaguuggccuaaggcucagugccacucaccccucccuccccaaaagacaagagaaauuuggcca

SEQ ID NO: 241858 - RNA, 64 nt, Human
aggcauggaggggaggaaaggcgucccucuuggcccuccccagaguggcuuuccuggcacccug

SEQ ID NO: 241859 - RNA, 64 nt, Human
ccgccccugcccugugccgugcugcgcucaccugccuccccagccagccgcugaccucucggcu

SEQ ID NO: 241860 - RNA, 62 nt, Human
gcaguaccuggaacagguaaugacgggcacggccuccccacggccuguccgggaaagaccag

SEQ ID NO: 241861 - RNA, 63 nt, Human
accccggugugagcaggauggggcccugcccucccgugggaguuguggacucgagcccagggg

SEQ ID NO: 241862 - RNA, 63 nt, Human
ucuaccucacaggcccacccccugccgggcaugccgugggaucaugggcagggaaggcucugg

SEQ ID NO: 241863 - RNA, 63 nt, Human
gauguacuguuuuugauuggccagucaugacagccgugggacaccucccccccccgugugugu

SEQ ID NO: 241864 - RNA, 63 nt, Human
gaaagccaaagaccuuuauuucuuccugccuccccgugggaagccuccgcccugagguccgcu

SEQ ID NO: 241865 - RNA, 63 nt, Human
cugccagccacauggccggggaccgaaaaacucccgugggagauuuuggccccaacccacaca

SEQ ID NO: 241866 - RNA, 63 nt, Human
aagauugucuuaagaaauguaucugcaugaacuccgugggaacuaaaggaagugggaacuuag

SEQ ID NO: 241867 - RNA, 63 nt, Human
cucucccacagcuggacgcacagaacagucucuccgugggaggagacauuauggggcguccac

SEQ ID NO: 241868 - RNA, 63 nt, Human
ccucugggcccggccccucccagggccgccgcuccgugggaaaaaacagcuccuccauuuccu

SEQ ID NO: 241869 - RNA, 63 nt, Human
ucugggccccuugggggaggacuggggagggggccgugggagagcccugacgcuggaaccugu

SEQ ID NO: 241870 - RNA, 63 nt, Human
aggauuggugguuuuguuuugcuuuguuuaaagccgugggaaaauggcacaacuuuaccucug

SEQ ID NO: 241871 - RNA, 63 nt, Human
ccagugccugaacuggacccugugaaaucugucccgugggaauccugaagucugacucaggaa

SEQ ID NO: 241872 - RNA, 60 nt, Human
uggccaaaauuugcaagugccuugugaacacccaccgagacagcgccuucauauuccuca

SEQ ID NO: 241873 - RNA, 60 nt, Human
aagccaauccuuuuucuuuuuuuuggaggucccaccgagauagauaggaacuuggauugc

SEQ ID NO: 241874 - RNA, 60 nt, Human
gggcccagaacugcccccacugucccccuacccaccgauggagcccccagauagagcugg

SEQ ID NO: 241875 - RNA, 60 nt, Human
uacauggccaggugagcugucccccgacaucccaccgaaucugaugcugcugcugccuuu

SEQ ID NO: 241876 - RNA, 60 nt, Human
cucucuccacaaggcccaggcgcccagggucccaccgaccugcccaggaaugcaucacau

SEQ ID NO: 241877 - RNA, 60 nt, Human
uuaacucuaucccuauuaggaaccuuguuucccaccgaauaagaguuaagguaagaggua

SEQ ID NO: 241878 - RNA, 60 nt, Human
aaaauagacguggagcaagagaaaugcauucccaccgaggccgcuuuuuuaggccuaguu

SEQ ID NO: 241879 - RNA, 60 nt, Human
ccccgccggccgcgggucucccggcccaaccccaccgacccagaccaagaccgcgccgag

SEQ ID NO: 241880 - RNA, 60 nt, Human
cccaucuucaagggcugcuucuacacccaccccaccgaggugcugaagccugucagccag

SEQ ID NO: 241881 - RNA, 60 nt, Human
gagcuggugagagaggagucagguggccuucccaccgaugguccuggccuccaccugccc

SEQ ID NO: 241882 - RNA, 60 nt, Human
uaaaaacuaggaaaguguuaacuaucguugcccaccgaauuugagguagcaaaaaaaaaa

SEQ ID NO: 241883 - RNA, 60 nt, Human
acagugauuccccacguguguucaucugcacccaccgagccaggcagaggccagcccucc

SEQ ID NO: 241884 - RNA, 60 nt, Human
cugcccacccacagccagaauccacaggaucccaccgagaaggagagccaggugugccga

SEQ ID NO: 241885 - RNA, 60 nt, Human
ucuacccacggcuaaggucuucauuucccucccaccgaaccuugauuucaagguggcacc

SEQ ID NO: 241886 - RNA, 60 nt, Human
uuccucaaucacacugaagccacagcugggcccaccgaggugcuauccugcccaggccag

SEQ ID NO: 241887 - RNA, 60 nt, Human
guuuggagagcacaccuaucuuagugguuccccaccgaaguggacuggccccugggucag

SEQ ID NO: 241888 - RNA, 60 nt, Human
cuggccugugcccagccugugcgugucaaccccaccgacugcugcaaacaguguccaggu

SEQ ID NO: 241889 - RNA, 64 nt, Human
cugacacagccugugggcucccggaccgagugucccccgccaggcuacuccuaacuaacgcguu

SEQ ID NO: 241890 - RNA, 64 nt, Human
gaagugcccccgccaucccgccaccaggacugcuccccgccagcacguccagagcaacuuaccc

SEQ ID NO: 241891 - RNA, 64 nt, Human
cccggaucccgugcacccugggacccagaagugcccccgccaucccgccaccaggacugcuccc

SEQ ID NO: 241892 - RNA, 60 nt, Human
caaaagagggugcugccccuagccugggcccccaccgacagacugcagcugcguuacugu

SEQ ID NO: 241893 - RNA, 60 nt, Human
uucaggcauuuauggggagaaaaggcccuccccaccgacccgccaccugccaccucugac

SEQ ID NO: 241894 - RNA, 60 nt, Human
uuuaccucagauccaugccaccaaacaucucccaccgaguuauuuggugggauuugcagg

SEQ ID NO: 241895 - RNA, 60 nt, Human
uauauccauuccuugaugucauuggccucucccaccgauuucauuacggugccacgcagu

SEQ ID NO: 241896 - RNA, 60 nt, Human
aggaaugcagauucucaggccccccuaagacccaccgacucugugcuagaacaagcgccc

SEQ ID NO: 241897 - RNA, 60 nt, Human
ccaagaugggaggaggccagugcccacuugcccaccgaccugagccugaguaaguggcug

SEQ ID NO: 241898 - RNA, 60 nt, Human
agagcagaauccucccaccgcccugcccuccccaccgaguccuguggccauucagagcgg

SEQ ID NO: 241899 - RNA, 60 nt, Human
ugaaagaauucuacaaauaccacacagccucccaccgagucuugcucugucgccaggcug

SEQ ID NO: 241900 - RNA, 60 nt, Human
gucucggcagcagcuccgcucccggcgccacccaccgacacccccagaacccucuggggg

SEQ ID NO: 241901 - RNA, 60 nt, Human
aaggucugagaacuccccucccucccuggacccaccgaugccucucgaagcccuggagac

SEQ ID NO: 241902 - RNA, 60 nt, Human
gcaggcuagcucccgcccugccugcccggccccaccgaggccugagcacguucccgggug

SEQ ID NO: 241903 - RNA, 60 nt, Human
auggauccgcucuacugaucuucuccgaggcccaccgaaggguacugaagagccucaccu

SEQ ID NO: 241904 - RNA, 60 nt, Human
accccgcucugcaugcggcccagcccggcucccaccgaggcgcgggggccguuuucaacg

SEQ ID NO: 241905 - RNA, 60 nt, Human
ugaccaugagccauuucacagaaaaaccaucccaccgaagauauugucuaucaccccagg

SEQ ID NO: 241906 - RNA, 60 nt, Human
uugggagcccgccuuguggauccaccacaccccaccgagcacuagaagcugcauaagcua

SEQ ID NO: 241907 - RNA, 60 nt, Human
cuugaggucccuugaaucuuccgcuuccuccccaccgauuucagcguguccacaucacag

SEQ ID NO: 241908 - RNA, 64 nt, Human
ggccauuugcgguuuugugggcuucuggaggguuccccgccauccaggcuggucucccucccuu

SEQ ID NO: 241909 - RNA, 64 nt, Human
aaggggcugcagcccuguugcaauuccaugcuucccccgccaaccagcuccugcugccaucccc

SEQ ID NO: 241910 - RNA, 64 nt, Human
auaaaccacccugccugauccugccccugccugaccccgccacgcccugccguccagcaugauu

SEQ ID NO: 241911 - RNA, 64 nt, Human
ggugagcaucugggcgccgggacgcugcagugauccccgccagagccugugcccuuccugcucc

SEQ ID NO: 241912 - RNA, 60 nt, Human
gaacuuucagccaauaaagcuugugcuucccccaccgagcucacgcugucucuuuguucc

SEQ ID NO: 241913 - RNA, 60 nt, Human
cgcuggcuccgcaugguucauuuucugaugcccaccgaggagccccagccccgucccaga

SEQ ID NO: 241914 - RNA, 60 nt, Human
cucugcucagcccugagagucccuuccugccccaccgauacuggcacuuuaaaaaggaag

SEQ ID NO: 241915 - RNA, 60 nt, Human
caccugaucucccccaauguguaccgcacgcccaccgaggcucuggcguccuuugacuac

SEQ ID NO: 241916 - RNA, 60 nt, Human
gugguggguggcuuggcauugccccuuuuucccaccgauucgguggcuggugaagguggg

SEQ ID NO: 241917 - RNA, 60 nt, Human
uuggaacugccuaguccccaugacugugugcccaccgagcuccugaguguucucauuccu

SEQ ID NO: 241918 - RNA, 60 nt, Human
gcaagugcccgcccugccccugccccaacccccaccgaagagcccugagcucaggcugag

SEQ ID NO: 241919 - RNA, 60 nt, Human
ucaauuccagagaaccaaaaaucccaccuucccaccgaacacuacuaaggggcuuguguu

SEQ ID NO: 241920 - RNA, 60 nt, Human
caggcacggccgaccccgccccgggcaccgcccaccgagccauccugccucgccuccccc

SEQ ID NO: 241921 - RNA, 60 nt, Human
uucaacaggaaaccgaucuuccccugacuccccaccgaggagagccucuccucgacccug

SEQ ID NO: 241922 - RNA, 60 nt, Human
uuccuccaggcuuuacuccccuuuuuaugccccaccgauacacugggaccaccccuuacc

SEQ ID NO: 241923 - RNA, 60 nt, Human
acuggcagcugcgggacccuuggcuugucccccaccgacaagucccaccugcugggugag

SEQ ID NO: 241924 - RNA, 60 nt, Human
cccagacaggcccucccugucuccagggcccccaccgagguucccagggcuggagacuuc

SEQ ID NO: 241925 - RNA, 60 nt, Human
cuugagaccuucuccacgcagcaggaagaucccaccgacccuuccuggccuaauccuuua

SEQ ID NO: 241926 - RNA, 60 nt, Human
guauuuauccguuuccacuggcuuuuuguacccaccgagccccugagccuugcgugugug

SEQ ID NO: 241927 - RNA, 52 nt, Human; identical to SEQ ID NO: 75225

SEQ ID NO: 241928 - RNA, 60 nt, Human
guucauuguuugucucagggaaaaucuucccccaccgagcuuguaaaaaacuuuaauaau

SEQ ID NO: 241929 - RNA, 60 nt, Human
ccuccuggaagcuuuuccaagugugagcgccccaccgacugugugcugaucagagacugg

SEQ ID NO: 241930 - RNA, 60 nt, Human
gugccuuugucagcucuucuuucaaaagaccccaccgacagaccgcauuccacccccaac

SEQ ID NO: 241931 - RNA, 64 nt, Human
gaccagcuggcggguguggagaccaggcuccugaccccgccaugcaugcagcgccaccuggaag

SEQ ID NO: 241932 - RNA, 60 nt, Human
ccagguaguguugagacccaggccuguggccccaccgagcuggagcggagaggaagccag

SEQ ID NO: 241933 - RNA, 60 nt, Human
agaggaaacagaaacucccaacuguccuuacccaccgacaucacagccccuaugaagaaa

SEQ ID NO: 241934 - RNA, 60 nt, Human
ggccaagugggaggcugggaggcugccccacccaccgacucuaccaagucucucuuccuc

SEQ ID NO: 241935 - RNA, 60 nt, Human
aggaaauccagccccauagaaaacaaucugcccaccgacccccuuucuaaggauagccuu

SEQ ID NO: 241936 - RNA, 60 nt, Human
gccuucaggugccaaagccauacucaggcccccaccgacauuguccacccuggccagaag

SEQ ID NO: 241937 - RNA, 60 nt, Human
cucccuaagcaauggggcaaggucugagggcccaccgaugagagagaugguggcagccgc

SEQ ID NO: 241938 - RNA, 60 nt, Human
cugugcugccugucuucgcgccacuguugucccaccgaauggacagcuuugcaggugcug

SEQ ID NO: 241939 - RNA, 60 nt, Human
gcccagccggcuggaaccucaagggccccacccaccgagauugcagcggcucuggcuaau

SEQ ID NO: 241940 - RNA, 60 nt, Human
agggagauggacaaccacuucaaagaaagacccaccgaaugcaguuucugcuugacugac

SEQ ID NO: 241941 - RNA, 60 nt, Human
ggccaggugaugcucugggggcagcaucuccccaccgagagaagcgggcuccuaaugagg

SEQ ID NO: 241942 - RNA, 60 nt, Human
guccucugacaggccuggcacggaggagggcccaccgaguggucccaugaaacacuaagg

SEQ ID NO: 241943 - RNA, 60 nt, Human
cauuccagcucuauuuaaaaaguaaagacacccaccgacuccugaucccccucuuuuucu

SEQ ID NO: 241944 - RNA, 60 nt, Human
cccugcccgcacccggacacuugaucgauccccaccgacgcccccugcaccgccuccaac

SEQ ID NO: 241945 - RNA, 60 nt, Human
gcuuuguccuuccaaagcaggugagucagccccaccgagagccaggcagcuuugaguggc

SEQ ID NO: 241946 - RNA, 60 nt, Human
uccuuagggacagacccuggcaggucgcugcccaccgagauuuccucaagugugcauaga

SEQ ID NO: 241947 - RNA, 60 nt, Human
gaagaccuuucccuccaccacugaugcagucccaccgaaagccuccaucugcuccagggg

SEQ ID NO: 241948 - RNA, 60 nt, Human
cgggagagcuucccugacgggagucgcggccccaccgaggcgucggccgcccgaagagcc

SEQ ID NO: 241949 - RNA, 64 nt, Human
uagagggcuuggugccuagcugaguccucgcuguccccgccauccccugaucugugcggcucca

SEQ ID NO: 241950 - RNA, 64 nt, Human
cgggacgccaaggccgcaggacuggagggccaggccccgccacccccacgggagacccgggaca

SEQ ID NO: 241951 - RNA, 51 nt, Human
cggcgggagacgagcugugagccccgccaggacuaugcucccaggccccuc

SEQ ID NO: 241952 - RNA, 60 nt, Human
acuacuucccuuucuuuucucaggccuccccccaccgacuuuugaggccaggguuggcca

SEQ ID NO: 241953 - RNA, 60 nt, Human
gcuucggugccgcgugggcaguacgcaggucccaccgacacucaccugggagcacggcgc

SEQ ID NO: 241954 - RNA, 60 nt, Human
cucugccggacacggaccggccccucagcccccaccgaggacgcagccacuggggggaaa

SEQ ID NO: 241955 - RNA, 60 nt, Human
gaauggaaaaaucccccagcccagcccagccccaccgaaaagcaaaaauuacacgucguc

SEQ ID NO: 241956 - RNA, 60 nt, Human
cccucugccccuccuguccuacccccuuuccccaccgagagcugggccgggagaggaccg

SEQ ID NO: 241957 - RNA, 60 nt, Human
gcguggccuguggcaccgugaggguugggacccaccgaggcgcagaggcggcccgaaugc

SEQ ID NO: 241958 - RNA, 60 nt, Human
gagagggggcaccuccccacacaccccccccccaccgaggccuaggccccugccaccccc

SEQ ID NO: 241959 - RNA, 60 nt, Human
cuacccuaacccucagccgacagucucagccccaccgacccacuuucuuggcauauagcc

SEQ ID NO: 241960 - RNA, 60 nt, Human
cucaagaggaagaaaccgagaggcccgcgccccaccgaggaagccccgccccggugccuu

SEQ ID NO: 241961 - RNA, 60 nt, Human
acccucagacccccucgccuuccccaccuccccaccgagaacuccagagacccagauguu

SEQ ID NO: 241962 - RNA, 60 nt, Human
caguucaaaaucucuuucagcugcgcucuucccaccgagccgagcuuacugugagugugg

SEQ ID NO: 241963 - RNA, 60 nt, Human
cagagaggcaggacggcagagccaugauuucccaccgagcgauuacgagaaccucuuccc

SEQ ID NO: 241964 - RNA, 60 nt, Human
ugaaauggcuugucuccucccccaucagggcccaccgaaagcucaggggagcacagaagc

SEQ ID NO: 241965 - RNA, 60 nt, Human
uuguaguuauuauuuuaaaauagaaacuaccccaccgacucaucuuuccuucucuaagca

SEQ ID NO: 241966 - RNA, 60 nt, Human
agggcuggcugugcuggguuccagcucgcucccaccgagggacuagcuuggccuuugcgc

SEQ ID NO: 241967 - RNA, 60 nt, Human
guggccccagaugcccacugugcgcaucuccccaccgaggccccggcagcagucuuguuc

SEQ ID NO: 241968 - RNA, 60 nt, Human
cucuguugucuguucuuucccugacucccucccaccgaaggccugauggcuacucacccc

SEQ ID NO: 241969 - RNA, 64 nt, Human
cgaggguggaggucccacugagccucucgccugcccccgccacucgucuggugcuuguugaucc

SEQ ID NO: 241970 - RNA, 64 nt, Human
ggggcuugggaaaugcacgucccuuccccuuacuccccgccaaaacccacaucccagccucugg

SEQ ID NO: 241971 - RNA, 64 nt, Human
gcgaagcagagagguggagaacugggauuugaacccccgccauccuucaccagagcccaugcuc

SEQ ID NO: 241972 - RNA, 60 nt, Human
ucccucccucuccccacccucagaaggauccccaccgauggggaccugugcuggccugug

SEQ ID NO: 241973 - RNA, 60 nt, Human
agaagcucccagagccccugucucgggcuccccaccgacuggcagcugcacuauccccaa

SEQ ID NO: 241974 - RNA, 60 nt, Human
agggagugguguagucaguugaaggcaguucccaccgaguuuuccgagccucagaaucca

SEQ ID NO: 241975 - RNA, 60 nt, Human
accuggcagcuguggggcccuuaggagccccccaccgaggguggacacagucccuuuccu

SEQ ID NO: 241976 - RNA, 60 nt, Human
cagcgcugcgccgcguccgaacgucgagaccccaccgagggcgggagggggacucucggg

SEQ ID NO: 241977 - RNA, 60 nt, Human
uaugucaguggugaaaugucacuccauugacccaccgaaaaaagaaaagaaaucuguuuc

SEQ ID NO: 241978 - RNA, 60 nt, Human
uuauuaagucccuguaacucaaaugucaaccccaccgaggcacccccccgucccccagaa

SEQ ID NO: 241979 - RNA, 64 nt, Human
cacccgccccacugagcccgcagcccccgccgggccccgccaggccuccccgcuggccauagca

SEQ ID NO: 241980 - RNA, 64 nt, Human
acuguaucccugccucaccccaggucuccgucugccccgccagguaccccacagagaccaauga

SEQ ID NO: 241981 - RNA, 64 nt, Human
uucccccauaaaggugugcauuucaguuaggcugccccgccacagagcaggcuucaucugcucu

SEQ ID NO: 241982 - RNA, 64 nt, Human
ugaguagcugggacuacagguuccuaccaccacacccggccaauuuuuguauuuuuaguagaga

SEQ ID NO: 241983 - RNA, 64 nt, Human
ggauccacuuagaucagggcggaaccaucuuucacccggccaagcuccugcccagauguugacc

SEQ ID NO: 241984 - RNA, 64 nt, Human
cucaaagugcugggauuacaggugugccaccgcgcccggccaagaugggaguauuuuuauggcc

SEQ ID NO: 241985 - RNA, 64 nt, Human
cugcccucugguggccauuuggggaaaacugcagcccggccaggcagcugggaccagaaugcaa

SEQ ID NO: 241986 - RNA, 64 nt, Human
uucugucccuguaacugcuuuccuuauggcccagcccggccacucagacuuguuugaagcugca

SEQ ID NO: 241987 - RNA, 64 nt, Human
ucccauggcauugcucagcaacuacuucucccuucccggccacccugugcccccuuccuggucc

SEQ ID NO: 241988 - RNA, 64 nt, Human
caaagugcugagauuacaggugugagccaccgcacccggccaacuuucugaaauuucaaaacug

SEQ ID NO: 241989 - RNA, 64 nt, Human
ggugcagcuagcggcgacccaguguacgucccgccccggccaaccaugccaagccugccugcca

SEQ ID NO: 241990 - RNA, 64 nt, Human
caaagugcugggauuacagacaugaacugccaggcccggccaaaauaaugcaccacuuuuaaca

SEQ ID NO: 241991 - RNA, 58 nt, Human
acuccacccucagcuacugacccgugcccccggccaccucgguuucugcuuucgaaga

SEQ ID NO: 241992 - RNA, 64 nt, Human
accagaccacgcccagaggaggggaggcacuggcccccgccacaggacuggagacgcaagaaca

SEQ ID NO: 241993 - RNA, 64 nt, Human
cgguucuggacucaccccucauccgggcccccagccccgccagagccuccguggcugcgggugu

SEQ ID NO: 241994 - RNA, 64 nt, Human
uugugauucugagcuugcaaugccgccaagcgccccccgccagcccgcccccgguuguccaccu

SEQ ID NO: 241995 - RNA, 64 nt, Human
aggcuccuaccugucugcugccagcacaguaggucccggccagcucuggaguucucucaucgga

SEQ ID NO: 241996 - RNA, 64 nt, Human
gaagacucagcccagcgaagcucauucccuuacccccggccagugcugcugcuucaguggaaga

SEQ ID NO: 241997 - RNA, 64 nt, Human
gcuguaauuccccuuaaaggacgggagaaagggccccggccaucuugcagcaggagggauucuu

SEQ ID NO: 241998 - RNA, 64 nt, Human
augcaacccuuagagauugccccagagccccacucccggccaggcgggagauggaccccucccu

SEQ ID NO: 241999 - RNA, 64 nt, Human
gccacucucuucaccgcccucugccccagccacucccggccaccaggacaugcuucaaugccug

SEQ ID NO: 242000 - RNA, 64 nt, Human
uuuuuccgagacggagucuugcucugccacugugcccggccaauacauuauuauuaacuuaagg

SEQ ID NO: 242001 - RNA, 64 nt, Human
aauggggugagcagccaccauucccaccagcuggcccggccacucugaauugcgccuuccgagc

SEQ ID NO: 242002 - RNA, 64 nt, Human
ugccccucugcccucuaguucuccaaguccccagcccggccaguggugccaggcagcuugccac

SEQ ID NO: 242003 - RNA, 64 nt, Human
cguccgggagggaggugggggggucagccccccgcccggccagccgccccguccgggagggagg

SEQ ID NO: 242004 - RNA, 64 nt, Human
ggcugccccuacugggaagugaggagccccucugcccggccagccgccccguccaggagggagg

SEQ ID NO: 242005 - RNA, 64 nt, Human
cguccaggagggaggugggggggucagccccccgcccggccagccgcccgguccgggagggagg

SEQ ID NO: 242006 - RNA, 64 nt, Human
gguccgggagggaggugggggggucagccccccgcccggccagccgccccguccgggagguuag

SEQ ID NO: 242007 - RNA, 64 nt, Human
ggccgccccuacugggaagugaggagccccucugcccggccaccaccccgucugggagguguac

SEQ ID NO: 242008 - RNA, 64 nt, Human
acauagcccaucccugccuggucacagggcaugccccggccaccucugcggaccccagcuguga

SEQ ID NO: 242009 - RNA, 64 nt, Human
agguauuuaaaggucacugggagcguuucugauucccggccacacuuugcauuucaacacucag

SEQ ID NO: 242010 - RNA, 64 nt, Human
gaggccuggccuagcagccacccaccugagcccucccggccaggcuucgugcuggggugggcca

SEQ ID NO: 242011 - RNA, 64 nt, Human
caggggacccacaggggugaggacccacgguccuccccgccagccuugcucagcuguggguugc

SEQ ID NO: 242012 - RNA, 64 nt, Human
uccgagcccguguggaggucaaagcuaccuuuggccccgccauugcugcugugcagaaggucag

SEQ ID NO: 242013 - RNA, 64 nt, Human
cucugugcgaccuuuccaagccuucccucacccuccccgccagcacccucuuuggggagcagga

SEQ ID NO: 242014 - RNA, 64 nt, Human
caaagugcugggaugacaggcaugagccaccgcacccggccaacacagauguuuauugaucgug

SEQ ID NO: 242015 - RNA, 64 nt, Human
cccucugccaugauuguaaguuucccgaggccuccccggccauguggaacugagucaauuaaac

SEQ ID NO: 242016 - RNA, 64 nt, Human
agauuaccaauaaagaacugaaugaauucauccccccggccaccucucuacccguccagccugc

SEQ ID NO: 242017 - RNA, 64 nt, Human
uggugcgccccuaggggagccucccacuggagugcccggccaggucuccaagccccaaaugagu

SEQ ID NO: 242018 - RNA, 64 nt, Human
ugcucugucugggacagauacugcccagcacccacccggccaugaggaccugcucugcucagca

SEQ ID NO: 242019 - RNA, 64 nt, Human
caaaguccucggauuacaggcaugagccaccacacccggccaaucaguccaccuuucuaggccu

SEQ ID NO: 242020 - RNA, 64 nt, Human
uccguggcaagggcagggaggguugcuuaggaugcccggccacccugggaggcuugccagaugc

SEQ ID NO: 242021 - RNA, 64 nt, Human
caggccucagcuucagugccucaucuugccaucucccggccaggcugggaacgggcaccaagca

SEQ ID NO: 242022 - RNA, 64 nt, Human
uugaugucaacagaguuuuagggauaaaaugguacccggccaacaucaagugacuuuauagcug

SEQ ID NO: 242023 - RNA, 64 nt, Human
caaaaugcugggauuacaggugugagccacugugcccggccaaaagaacagaaauuauuuuauc

SEQ ID NO: 242024 - RNA, 64 nt, Human
ggaagggaaggagaggggccagggaggccacaggcccggccauaugagcaucaugggucauuac

SEQ ID NO: 242025 - RNA, 64 nt, Human
cagggcagacugcagauggccuuguugcuggcaucccggccaggugggcggggacuaacaaaga

SEQ ID NO: 242026 - RNA, 64 nt, Human
caaaaucauaaaccauggcuacucuugggaaccacccggccauguggucgccaaguagagcaag

SEQ ID NO: 242027 - RNA, 64 nt, Human
ggugggaaugccagaggcaugggcauuagguccccccggccagccuccguugccacaugggcua

SEQ ID NO: 242028 - RNA, 64 nt, Human
uccuguccggagcgacccuggcucugccagcguccccggccacgucugugcucuguccuugugu

SEQ ID NO: 242029 - RNA, 64 nt, Human
gcaugcgacagcguccggggugguggacagggcccccggccacgcucccucuccuguagccacu

SEQ ID NO: 242030 - RNA, 64 nt, Human
ugagggaguggggggcccagccccuucucuucucccccgccaaaccacagugggagcuggggca

SEQ ID NO: 242031 - RNA, 64 nt, Human
auucaguuucuuuaucuguaaaauggagaccaccccccgccacgcugaacggugauucugugac

SEQ ID NO: 242032 - RNA, 64 nt, Human
cggggucuccauggugcuaggccaggguggccagccccgccaggaggccuggccugggcacacg

SEQ ID NO: 242033 - RNA, 64 nt, Human
cccaaagugcugagauuaggcguuagccaccgcgcccggccagaaaucacuuuuauauugucac

SEQ ID NO: 242034 - RNA, 64 nt, Human
ucuucagaggccagaaaguucuaaguucugaguccccggccagggucccuuaacaccucggcac

SEQ ID NO: 242035 - RNA, 64 nt, Human
agagauugccauacuuagacucacugugagucuccccggccauuucacgaggagaccacagugc

SEQ ID NO: 242036 - RNA, 64 nt, Human
ugaggggggcgugcgcuagagggggaaaggggcccccggccaccuguccaccgugugggccgug

SEQ ID NO: 242037 - RNA, 64 nt, Human
caaagugcugggauuacaggugugagccaccgugcccggccaaguaaaauguuuuuuaaaaugg

SEQ ID NO: 242038 - RNA, 64 nt, Human
caaagugcugggauuacaggcgugagucacagcccccggccauaauuuagcacuuuaaaaaaua

SEQ ID NO: 242039 - RNA, 64 nt, Human
accuucuucucccacccccuucugccccuggguccccggccauccagcggggcugccagagaac

SEQ ID NO: 242040 - RNA, 64 nt, Human
caaagugcugggaugauaggcgugagccaccacacccggccaagcacaggcuuuugaauggucu

SEQ ID NO: 242041 - RNA, 64 nt, Human
caaagugcugggauuacaggcgugagccacugcgcccggccaaaaagaacauuuugucaaucug

SEQ ID NO: 242042 - RNA, 64 nt, Human
cuaccaagcucccucguggccacgaggccacgaacccggccagcccugacgccccacugucccc

SEQ ID NO: 242043 - RNA, 64 nt, Human
aguuuugaaguuuauacuuagaacugaccaccuccccggccacgcggagagcuguacagugugu

SEQ ID NO: 242044 - RNA, 64 nt, Human
gcauccagcugcuuaagaugggugcuuccuuguacccggccaccagaaaaccccuggaacuccu

SEQ ID NO: 242045 - RNA, 64 nt, Human
ugaagggacagcugcugggacccaccucccccuccccggccacaugccgcgucccugccccgac

SEQ ID NO: 242046 - RNA, 64 nt, Human
ucugaucacuguggccacugugcgagccguggaccccggccaggaaccacuccuguuguacaaa

SEQ ID NO: 242047 - RNA, 64 nt, Human
acuugccuuggacuaucaugcuaccuuacgccuccccggccaaauucccuccucuccuccgggg

SEQ ID NO: 242048 - RNA, 64 nt, Human
gaaagcugagucucgucuccaacuagaaguuuggcccggccacuggcccugcagcugcuuuuug

SEQ ID NO: 242049 - RNA, 64 nt, Human
ugcugcuccacggcgcggagcccaacugcgccgaccccgccacucucacccgacccgugcacga

SEQ ID NO: 242050 - RNA, 64 nt, Human
ccagggacguggaaacaggaggugaacuaaggcaccccgccacccacuguggcagcuugaauuu

SEQ ID NO: 242051 - RNA, 64 nt, Human
uuccacccucuuugagaucagcguucggagagguccccgccagcccgguggcugcccucagguc

SEQ ID NO: 242052 - RNA, 64 nt, Human
ucgagggcgccgagacggugacuccagugcuggacccggccaggagacaaggguacgggccucu

SEQ ID NO: 242053 - RNA, 64 nt, Human
aacccacacccccagggacgccgcuuuccgggaucccggccaaacgccggacccucagucgcuc

SEQ ID NO: 242054 - RNA, 64 nt, Human
gguccuacccauccccgcagugugcacuaaggggcccggccagccaugucugcauuucgguggc

SEQ ID NO: 242055 - RNA, 64 nt, Human
guauuaccacugcaagacaaaacugauaucuuaacccggccaucaacccaaauuggacauucca

SEQ ID NO: 242056 - RNA, 64 nt, Human
agauguuuacuaggcguuuguuauauaaaaauaccccggccaggcacgguggcucacgccugua

SEQ ID NO: 242057 - RNA, 64 nt, Human
caaagugcugggauuacaggcaugagccacagugcccggccaaguauuuuuauauuucagauca

SEQ ID NO: 242058 - RNA, 64 nt, Human
aggcccgcuagguccagagagcgagcccccaaugcccggccaggcuaagccgcagagacccucu

SEQ ID NO: 242059 - RNA, 64 nt, Human
gaccuugcuuugguucuuguugaagugaaccaagcccggccaccacgcauggcaugcugugcuu

SEQ ID NO: 242060 - RNA, 64 nt, Human
gagagcagcugcugcugccccaccaccugccaggcccggccacugagcagccccccggagcccc

SEQ ID NO: 242061 - RNA, 64 nt, Human
ucagcuucucaaauugcugggauuacuccccgugcccggccacucucuguacuuuaaacauuuc

SEQ ID NO: 242062 - RNA, 64 nt, Human
cugggaccagagccagaugcaggacaggaggcggcccggccagcgggcacagggcaccagaggc

SEQ ID NO: 242063 - RNA, 64 nt, Human
cccugcuucccacacaaauccgccccggugcacccccggccaggcaggccccggggcggccuag

SEQ ID NO: 242064 - RNA, 64 nt, Human
caaagugcugggauuacaggugggagccacaacacccggccaugaauuaacuccguuaaaaaau

SEQ ID NO: 242065 - RNA, 64 nt, Human
ggaaagcacugagcuguuggggcacacugcccagcccggccacagcagcucagccagucacagc

SEQ ID NO: 242066 - RNA, 64 nt, Human
uguguggccggccuccuccucacccuucccggcccccggccaaggacccaggcgcugcauacag

SEQ ID NO: 242067 - RNA, 64 nt, Human
gccugacucaucauggucacauccagcccccacccccggccaacuaaccacugcaggcuccucu

SEQ ID NO: 242068 - RNA, 64 nt, Human
cccgaggcccacggggcccgcgccugccucccuuccccgccaccgggcccucugccauuaaagc

SEQ ID NO: 242069 - RNA, 64 nt, Human
uguccgccccgcuucucuuauucguguuaggugcccccgccaggcauugcaggcuuagucgugg

SEQ ID NO: 242070 - RNA, 64 nt, Human
augugcuuuuccaguucuucuggaauugggggacccccgccaaagacugagcccccugucuccu

SEQ ID NO: 242071 - RNA, 64 nt, Human
cuggagagccuggauuccucuuggcagucuuaggcccggccacuucugcuaccuuugcgcugcu

SEQ ID NO: 242072 - RNA, 64 nt, Human
acgugugacagggcccaaggcugggccucccugacccggccagacuggugucuggccuaaugag

SEQ ID NO: 242073 - RNA, 64 nt, Human
ggcagaguguugagccucauaccuguaccagguccccggccagcugggccccucccaggcacug

SEQ ID NO: 242074 - RNA, 64 nt, Human
accccucaggacuccccagggcugaagcugggaucccggccagccaggugacccccacgcucug

SEQ ID NO: 242075 - RNA, 64 nt, Human
ugaggcccccggaggcgcccaccugcccaguuagcccggccaaggacacugauggguccugcug

SEQ ID NO: 242076 - RNA, 64 nt, Human
aacuuuuuccaagucaacuugguguagccgguuccccggccacgacucugggcacuuccccuga

SEQ ID NO: 242077 - RNA, 64 nt, Human
gacucaagugagccuucgguacuccuggugcccgcccggccagaccgucagcuugauaauuacu

SEQ ID NO: 242078 - RNA, 64 nt, Human
ccuggccucuaaacuggcucgagagcaucuuggccccggccaccuuccccagggaaaccccugg

SEQ ID NO: 242079 - RNA, 64 nt, Human
gagagauuguguggggguagaagcugucuggaggcccggccagagaauuugugggguuguggag

SEQ ID NO: 242080 - RNA, 64 nt, Human
augcggcgcucccuuccuucccacgcucagcggccccggccagacccuggcagacuucacaccu

SEQ ID NO: 242081 - RNA, 64 nt, Human
gacuggcaagagcucuuugucucaccagcucagccccggccacucccugccaacuccaugacca

SEQ ID NO: 242082 - RNA, 64 nt, Human
augguggagucugccccaggcacccucugcccugcccggccaaauacccggcauuauggggaca

SEQ ID NO: 242083 - RNA, 64 nt, Human
cacaggcuggaggaggguuugggcagagcgaagacccggccaggaccuuggugagauggggugc

SEQ ID NO: 242084 - RNA, 64 nt, Human
ucgacagcccugaccugcugcuggaagccggugacccggccacgucccccugccgcaucuuuga

SEQ ID NO: 242085 - RNA, 64 nt, Human
cagauuggccuggcagccccuggcacagagcagacccggccacugguagcuccccacuuccuua

SEQ ID NO: 242086 - RNA, 64 nt, Human
gaaaacacaucuguuggggugaucagacccaacacccggccaugggggcuacaaaguccagccg

SEQ ID NO: 242087 - RNA, 64 nt, Human
ucuccaagcagucauuucagggggcuccugcugaccccgccacucagcagugcacuccccggau

SEQ ID NO: 242088 - RNA, 64 nt, Human
ggacaagcugucuuucccagucagccagggagcuccccgccaggccacgccccagccacuuugc

SEQ ID NO: 242089 - RNA, 64 nt, Human
uuugcauggcuccucccccacucaagcaauagggccccgccauaggaagacccccagagagagg

SEQ ID NO: 242090 - RNA, 64 nt, Human
cggagggagggaggaccgacgcgacgcgaugccucccggccaccgccccagccucaccccaucc

SEQ ID NO: 242091 - RNA, 64 nt, Human
acagaccauaagaaacaacaaaugagccacugcgcccggccauaaaugaauuauuuuuaagagg

SEQ ID NO: 242092 - RNA, 64 nt, Human
cgcucuucacuugaaaucaugucccuauuucuaccccggccagaacauggacagaggccagaag

SEQ ID NO: 242093 - RNA, 64 nt, Human
acagggccccagcccagcccucugcaccccccagcccggccaucugcgccccacagccccuuug

SEQ ID NO: 242094 - RNA, 64 nt, Human
uucuaugucgccuggaggaguccggcacccccuccccggccauuugugacaaaauaugaauaaa

SEQ ID NO: 242095 - RNA, 64 nt, Human
uccagucagggugggggcgcuggagccgugggagcccggccagggcagggggcucguugcugug

SEQ ID NO: 242096 - RNA, 64 nt, Human
uaaauuagcugggcacaguguucacaccuguagucccggccacucggggcugaggcaggaggau

SEQ ID NO: 242097 - RNA, 64 nt, Human
acgcguguguacacacggaccaugugguauguagcccggccagggccuggugugaggcugggcc

SEQ ID NO: 242098 - RNA, 64 nt, Human
caaagugcugggauuacaggcgugagccaccgugcccggccagaaaauacauucuuuacagcaa

SEQ ID NO: 242099 - RNA, 64 nt, Human
gccccucccuggcacugaggcccugaccccugcucccggccacaggcaguggagaaagccaggu

SEQ ID NO: 242100 - RNA, 64 nt, Human
caaagugcugggauuccaggcgugagccacugcacccggccagcccuguugucuuucaaagaac

SEQ ID NO: 242101 - RNA, 64 nt, Human
gggagaccccauagggccgggacucuugggucagcccggccacuggcuucucucuuuuucucug

SEQ ID NO: 242102 - RNA, 64 nt, Human
gggaucccccgaccggcacgggccacgccgagcucccggccagccgccggcccgcaggcagcgc

SEQ ID NO: 242103 - RNA, 64 nt, Human
gauggccuacuuggaucaaacccuccccagagcccccggccaggcacccccagggaaggcucug

SEQ ID NO: 242104 - RNA, 64 nt, Human
aggcaucccuuuccuggcuuauggccaagcccuacccggccagcagucgcugggccucucccug

SEQ ID NO: 242105 - RNA, 64 nt, Human
ucgcuuccaccgacagccgucagacaucaggcuccccggccaccaugauugggaucucuguggc

SEQ ID NO: 242106 - RNA, 64 nt, Human
uuauaucauaauuugauucucccuccccccauccccccgccaacucuguaaaccccaaguauaa

SEQ ID NO: 242107 - RNA, 64 nt, Human
aacacgaccgcguguguugccccugcccugggcuccccgccaugacaucuucaccuugcagcuu

SEQ ID NO: 242108 - RNA, 64 nt, Human
ggcaccugcuucacacggaccauucucugaccgcccccgccaaaccucaugcuccccacuugcc

SEQ ID NO: 242109 - RNA, 64 nt, Human
caaagugcugggauuacaggcgugagccacugcgcccggccacauucaguucuuaucaaagaaa

SEQ ID NO: 242110 - RNA, 64 nt, Human
cuucacugugcucaucaagaacaauaucgacuuccccggccacaacuacaccacguaagugccc

SEQ ID NO: 242111 - RNA, 64 nt, Human
cagcaagaagcugggaucgcugcagccauguuuucccggccaugccggcguuguaaccucagga

SEQ ID NO: 242112 - RNA, 64 nt, Human
aaggcuuguggccucuugcuccuccuuccagauccccggccaagcccagucacgagaauuucag

SEQ ID NO: 242113 - RNA, 64 nt, Human
agaaggggaacuugugccccagaaagggcaguuacccggccagggucacaucaaccgccagaag

SEQ ID NO: 242114 - RNA, 64 nt, Human
gcagaggccuuaggaccccguuccaagugcacugcccggccaagccccagccucagccugcgcc

SEQ ID NO: 242115 - RNA, 64 nt, Human
ccuggcucugccuccccacccuggggugggggcucccggccaccugucuugcuccuauggaguc

SEQ ID NO: 242116 - RNA, 64 nt, Human
ccagcccgcccuucccuacuggugcccccuccuccccggccaaggcgccuggaccuggcgagga

SEQ ID NO: 242117 - RNA, 64 nt, Human
cauguggaugccacaugcugcuguuuccugcuugcccggccaccacccaugcccuccauagggu

SEQ ID NO: 242118 - RNA, 64 nt, Human
gcgcaaggaggacugaggcgccgcccguccugggcccggccaggccccgcuuggaggaggcauc

SEQ ID NO: 242119 - RNA, 64 nt, Human
caaagugcugggauuacaggcaugagccacugugcccggccaagaucuaacucacgcuuacuuu

SEQ ID NO: 242120 - RNA, 64 nt, Human
ccucaccucuccccagcccccgcuguuccccugccccggccaacaacgaggagucuguuccucc

SEQ ID NO: 242121 - RNA, 64 nt, Human
agagagggggcaggcucggcaccggcccucccagcccggccagccugagcuugcugcccuccag

SEQ ID NO: 242122 - RNA, 64 nt, Human
caaagugcuggcauuacaggugugagccaccgugcccggccaccagaauccuuugguauagcca

SEQ ID NO: 242123 - RNA, 57 nt, Human
ugagugaggugaaagccugauguuuuucccggccaguguugacaucuucccugaaca

SEQ ID NO: 242124 - RNA, 64 nt, Human
gccccggcauugccaucagcagccucagcgucuccccggccaugugugcugugggcucugagga

SEQ ID NO: 242125 - RNA, 64 nt, Human
uccuuccuaaacccaaugacuucccugcuccaacccccgccaccucagggcacgcaggaccagu

SEQ ID NO: 242126 - RNA, 64 nt, Human
uagggcaggaggggggcugugaccccugcccuuuccccgccagagaccucaggcucucagcaca

SEQ ID NO: 242127 - RNA, 64 nt, Human
cucuuucucccucccgccuccguccccugcugccccccgccagcccucaccaccugcccuccuu

SEQ ID NO: 242128 - RNA, 64 nt, Human
guuuuagaaagcuguugcuguuaacaauaauucucccggccaucuccacuccacuacucaaaaa

SEQ ID NO: 242129 - RNA, 64 nt, Human
accaaccccacucacuuuguaacuucaucacugacccggccaauaaggacccugugcgucuucu

SEQ ID NO: 242130 - RNA, 64 nt, Human
ugugucucuugguccugcugcaguugccagucaccccggccaccugcggugcuaucucccccag

SEQ ID NO: 242131 - RNA, 64 nt, Human
cgaagugcugggauuacaggcaugagccacugcgcccggccauggaccuggcugucuuuaucau

SEQ ID NO: 242132 - RNA, 64 nt, Human
ugugaguaccacagaaacgccugagagucacuuacccggccacugcuuggaagguuucccuccg

SEQ ID NO: 242133 - RNA, 64 nt, Human
gcccaggaccagucugcccacugccuaaaugaugcccggccagcaggaccuggccugcagaucc

SEQ ID NO: 242134 - RNA, 64 nt, Human
gaguagcgcgaggcccccgccccggucgcgggaacccggccaugaccugggcgggggcgcgggg

SEQ ID NO: 242135 - RNA, 64 nt, Human
gaggugccaggcagcaucaggcccacuggguugccccggccaggccugcgaggaagggcugagg

SEQ ID NO: 242136 - RNA, 64 nt, Human
gcccgggcccagcacagaacugcccaucgggacgcccggccagccgcucgggcgcagcacaagg

SEQ ID NO: 242137 - RNA, 64 nt, Human
ggguauggggggcagguguggggugugggguguucccggccaucagcacagccuaugaccauug

SEQ ID NO: 242138 - RNA, 64 nt, Human
agggucucugccuccccagcagguggcagaugcucccggccacucguuuaaauaacuguccccu

SEQ ID NO: 242139 - RNA, 64 nt, Human
cccuguguuucggaaaccagagcacagugucugccccggccaaggaguuugucaaggugucucu

SEQ ID NO: 242140 - RNA, 64 nt, Human
uagccugccuucguccgggccccuccugggccuccccggccaggcacguggcaccgucgccuug

SEQ ID NO: 242141 - RNA, 55 nt, Human
gcaacccacuuggcuucugaauacucccggccagggccugucccaguuaugugcc

SEQ ID NO: 242142 - RNA, 64 nt, Human
ggguggggaggcccuccuccccggcccucccuggcccggccacuccgaaggcagggaggaggac

SEQ ID NO: 242143 - RNA, 64 nt, Human
cacaggaucgggauuacaggcaagagccuccacgcccggccaugaaauauaauucuuaauauca

SEQ ID NO: 242144 - RNA, 64 nt, Human
cgcuccagguggagaacagccccucuccccgcgcccccgccagggagagaaggggagugcggag

SEQ ID NO: 242145 - RNA, 64 nt, Human
uagcucacugcagccuugacccccucccugaccuccccgccagcuggacuccagccauccuccu

SEQ ID NO: 242146 - RNA, 64 nt, Human
uugcucuccaggcuguuaaccuuuuccguugcucccccgccacccaccuccuccuccccaggcc

SEQ ID NO: 242147 - RNA, 64 nt, Human; identical to SEQ ID NO: 242003

SEQ ID NO: 242148 - RNA, 64 nt, Human
guccgggagggaggugggggggaucagccccccgcccggccagccgccccguccgggagggagg

SEQ ID NO: 242149 - RNA, 64 nt, Human
gacucucugugaacccuaugagagcgcgucugggcccggccauguccuuagcacaggggggccg

SEQ ID NO: 242150 - RNA, 64 nt, Human
ccugaguagaaggagagacgggguagggaacgggcccggccagaaaagaaccauuucuucugcc

SEQ ID NO: 242151 - RNA, 64 nt, Human
caaagugcugggauuccaggcgugagccacugcgcccggccagaauggcauuauauuuaaauag

SEQ ID NO: 242152 - RNA, 64 nt, Human
gagacucuguuugggagcacgggauggccgggggcccggccagagcggggcugcauggcuuucg

SEQ ID NO: 242153 - RNA, 64 nt, Human
cacugucucgcccgcgccuggcccccacccccuccccggccagccugaggcugccugaggaagg

SEQ ID NO: 242154 - RNA, 64 nt, Human
caggagagucacugagcugccuuuggugggaccacccggccacagaaauggcggugggaggagg

SEQ ID NO: 242155 - RNA, 64 nt, Human
gggaacugacgccccgcggaggccuggcccggagcccggccacacuccgaguccugggucccag

SEQ ID NO: 242156 - RNA, 64 nt, Human
cccugagcugugaguccacgucucaugugcacgccccggccagcuaagccucgggccgucagca

SEQ ID NO: 242157 - RNA, 64 nt, Human
cccuuagggaauaaaccagccccguuucuaucagcccggccagcaugcaggucuccacaucacc

SEQ ID NO: 242158 - RNA, 64 nt, Human
caaagugcugggauuacacgcgugagccaccaugcccggccaauacuacacucuuauucugccu

SEQ ID NO: 242159 - RNA, 64 nt, Human
ccgaggagcugggccccugcacaggcacacagggcccggccacacccagcggccccccgcacag

SEQ ID NO: 242160 - RNA, 64 nt, Human
gucugcaguaucgguuugagaucauccuugggaacccggccaccgaacucaguguugcaacuca

SEQ ID NO: 242161 - RNA, 64 nt, Human
cucgcgagggcagcaccgcagccucugccccagccccggccacccagggaucgaucgguacagu

SEQ ID NO: 242162 - RNA, 64 nt, Human
cacacccagggcuccuuggucccccacaaccugccccggccaggccugcagacccagacuccag

SEQ ID NO: 242163 - RNA, 64 nt, Human
gucacuccaccauccccaccccaccccaccccacccccgccaugcaacgggauugaaggguccu

SEQ ID NO: 242164 - RNA, 64 nt, Human
caaaaccuuuaauuccaaaagaaauccccccucuccccgccaaaaaaggcguucccaccgcccg

SEQ ID NO: 242165 - RNA, 64 nt, Human
gacccgagggcagccucucggugccaagagccauccccgccaacagccagccaggacacggggc

SEQ ID NO: 242166 - RNA, 64 nt, Human
ucugggcccgaccagcuuauacugcuccaucuuccccggccacaugccccgccaaguacugcac

SEQ ID NO: 242167 - RNA, 64 nt, Human
cuggaguaggcggugcguacccggugucccgaggcccggccaggggcugggcagggaugccagg

SEQ ID NO: 242168 - RNA, 64 nt, Human
gggaugccaggugggcccagccagcuccuggggucccggccaccuggggaagccgcgccugcca

SEQ ID NO: 242169 - RNA, 64 nt, Human
ucacggccaugcuucagggucuucagguccugcccccggccagucugccaagaggcacccccuu

SEQ ID NO: 242170 - RNA, 64 nt, Human
uagagugaacaagaacaccccugccgacucccagcccggccaaaaagacaaaacacauagacgc

SEQ ID NO: 242171 - RNA, 64 nt, Human
cccagcuggcaggccugagguguacauaguccuucccggccauauuaaccacacagccugagcc

SEQ ID NO: 242172 - RNA, 64 nt, Human
cugucccacuucgaaguggaggucugccagcugccccggccaggcuugcggggaguucucuucc

SEQ ID NO: 242173 - RNA, 64 nt, Human
ucaugggccacuguggcccgauguccccuuccuucccggccauucucccucuuguuuucacuuc

SEQ ID NO: 242174 - RNA, 64 nt, Human
agggcucaguccugacgcuugccaccugcuccuacccggccaggauggcugagggcggagucua

SEQ ID NO: 242175 - RNA, 64 nt, Human
uccuccuccccuccucuucccuuagccucucccacccggccacagcugcuggagaauaaauuug

SEQ ID NO: 242176 - RNA, 64 nt, Human
ugaccccugagccacccccacucccacagggagccccggccauuugcugcccuccccaccccug

SEQ ID NO: 242177 - RNA, 58 nt, Human
ggaaaggggagccggccugacccacacccccggccaucgcucccugggccagguuuag

SEQ ID NO: 242178 - RNA, 56 nt, Human
cgcccuggcccuuggguuagccgccucccggccagcgccaucucccgcccuuggug

SEQ ID NO: 242179 - RNA, 64 nt, Human
caaagugcugggguuacaggugugagccacugcacccggccacaagauguaauuuuuacuuuau

SEQ ID NO: 242180 - RNA, 64 nt, Human
caaagugcugggauuacaggcgugagccaccgcgcccggccaucucagggauauuuaaacaaag

SEQ ID NO: 242181 - RNA, 63 nt, Human
cccuggugaccaaaggcugagcccccaccccggcccggccacacccaugcccuccuccgugcc

SEQ ID NO: 242182 - RNA, 64 nt, Human
ugguugggggaagggaggaaaccccaccuccagcccccgccaccgggcucccugggcacccagc

SEQ ID NO: 242183 - RNA, 64 nt, Human
agagucuaccuauacaucccuuccccauugcccaccccgccaucucaaucagucacugacuuuu

SEQ ID NO: 242184 - RNA, 64 nt, Human
gcacccgcgaggacgcgcgcgagcacacgcggcgccccgccaggccuuagggcccgugggggac

SEQ ID NO: 242185 - RNA, 64 nt, Human
cccggcgcuguccuggcugagccccugcaggagccccggccacacacagcaagaaagauacauc

SEQ ID NO: 242186 - RNA, 64 nt, Human
cugucucccccagggcucgggaugucuccagcagcccggccacgcagcuucccaggugggcucg

SEQ ID NO: 242187 - RNA, 64 nt, Human
caaagugcugggauuacaggcgugagccacugugcccggccaagaauuuuuuuaucgauaacau

SEQ ID NO: 242188 - RNA, 64 nt, Human
caaguagcggggaucacaggcaugagccgccacacccggccaucacaccuggauuuucaguggg

SEQ ID NO: 242189 - RNA, 64 nt, Human
ggaccuggggugcucaggaggggguacccggggccccggccagagauacaucaauuacaccccc

SEQ ID NO: 242190 - RNA, 64 nt, Human
cccgucugugagaagccucuuuccgagucgaccucccggccaccccggcccugugccugcucgg

SEQ ID NO: 242191 - RNA, 64 nt, Human
uccccagcacccaagcaugcaauugccugucccccccggccagccuccccaacuugauguuugu

SEQ ID NO: 242192 - RNA, 64 nt, Human
gccuggggcucccugugaccucucaguccccuggcccggccagccaccguccccagcacccaag

SEQ ID NO: 242193 - RNA, 64 nt, Human
cgcaccaaguagcgagucagcaggggccgccugccccggccagaacgggcagggcugccacuga

SEQ ID NO: 242194 - RNA, 64 nt, Human
gugacugauucccucccgggugcugaguccccuccccggccaccauccugcgugaauauccuga

SEQ ID NO: 242195 - RNA, 64 nt, Human
uugaagaugaauucuugaauucugccugcccacccccggccagaucccuggagcuggccuccuu

SEQ ID NO: 242196 - RNA, 64 nt, Human
uccugcaggggccccacacaggcaugagggauggcccggccaaagucuaggcagaagccuccua

SEQ ID NO: 242197 - RNA, 64 nt, Human
ggccgccgccagcucccccagacccccuccaccccccggccacacguguccuauuccccuguga

SEQ ID NO: 242198 - RNA, 64 nt, Human
uggcccuggcccagcuccucguggagcagaacuucccggccaucgccauccaccggggcauggc

SEQ ID NO: 242199 - RNA, 64 nt, Human
ucuuuuuguuuguaaacguuuaaaaacaaaguuccccggccaggcacaguggcucacaccugua

SEQ ID NO: 242200 - RNA, 64 nt, Human
ccugggaccccgcccccucauccugccuccaguucccggccacgccccccaggaccccugcccc

SEQ ID NO: 242201 - RNA, 64 nt, Human
gugucuguguguugauggguggcccaugagugacccccgccaggggagaccaggcuggcuggau

SEQ ID NO: 242202 - RNA, 64 nt, Human
acaccaaaguguccacauuguaccaaagacugacccccgccagcuggggugcccaggggcaggg

SEQ ID NO: 242203 - RNA, 64 nt, Human
uaacuuaguuaucagaaaucagcucaguggucuuccccgccaugauucacauuugaugaguuuu

SEQ ID NO: 242204 - RNA, 64 nt, Human
cccgcccccguggacccggccccaccccgaauaccccggccacgcuccccguccuuggccgccc

SEQ ID NO: 242205 - RNA, 64 nt, Human
guagcugggacuacaggcaugcgcagccacuaugcccggccaauaagcuauauuuauucuuauu

SEQ ID NO: 242206 - RNA, 64 nt, Human
ugcaaguggaaugucugcccugugggugggugggcccggccagggccucucccucccucccucc

SEQ ID NO: 242207 - RNA, 64 nt, Human
cucuccaagcccugguggugcuggggguuguauccccggccaccuccuguccaggucuccaucc

SEQ ID NO: 242208 - RNA, 64 nt, Human
gcugcugccugcgcccugacucccaccccaagcccccggccaagccuggacucuagccccugac

SEQ ID NO: 242209 - RNA, 64 nt, Human
caaggagcugagauuacgaguacaccacaccaugcccggccaaauacuugguuuucaguaccac

SEQ ID NO: 242210 - RNA, 64 nt, Human
gaguucuagggcucgggccagaguggcacuacugcccggccaguccaggcucaggcaggaaucg

SEQ ID NO: 242211 - RNA, 64 nt, Human
uaaggugauuucauaaaaggaauccaacccugugcccggccauugauguguugucauugaaucc

SEQ ID NO: 242212 - RNA, 64 nt, Human
cuccagagcagcgucugaccaccgcccgcgcccacccggccacggcgggcacucagcauuuccu

SEQ ID NO: 242213 - RNA, 64 nt, Human
gccucuggccugcuccccgggaggggcgcucucucccggccaugucuaugcaacucucccggac

SEQ ID NO: 242214 - RNA, 64 nt, Human
ucaagaugcccuuccgcccccucugaaaguggggcccggccagcacugcucguuacugucugcc

SEQ ID NO: 242215 - RNA, 64 nt, Human
cugggcucacaccagcccugguggccaagccugccccggccacucuguuugcucacccaggacc

SEQ ID NO: 242216 - RNA, 64 nt, Human
gguaugagugcgucccacccaacgcagcaccagccccggccaccgcuccccguguccccaguuc

SEQ ID NO: 242217 - RNA, 64 nt, Human
caaagugcugggauuacaggcgugagccacugagcccggccaaaaaaaaauguauuuauuaaaa

SEQ ID NO: 242218 - RNA, 64 nt, Human
caaagugcugggauuacaggcgugagccacugcgcccggccacuuucacacuuuuuacagugag

SEQ ID NO: 242219 - RNA, 64 nt, Human
aggcccgcccccauccuggccggugucacuguggcccggccaccccugagcgcccagcucccua

SEQ ID NO: 242220 - RNA, 64 nt, Human
ccgccuggcugacauucugagccccccucggaggccccgccacagccaaccugcccagucuuuc

SEQ ID NO: 242221 - RNA, 64 nt, Human
ugcccaccccugcugccgccacuggcugugccucccccgccaccuguguguucuuuugauacau

SEQ ID NO: 242222 - RNA, 64 nt, Human
acagucaucuucucuaguucucauaagacuaucuccccgccaccuauaguuaguacccucaagu

SEQ ID NO: 242223 - RNA, 64 nt, Human
ucgcgacaagcccgccgggaucccgggcccugggcccggccaccguccuggggccgagggcgcc

SEQ ID NO: 242224 - RNA, 64 nt, Human
gccuguaaucccagcacuuuggaaggccaucgcgcccggccaacuuuucuuuagaaaaaugagu

SEQ ID NO: 242225 - RNA, 64 nt, Human
cugaucagucagaauggaugcuuucaccagcagacccggccauguggcugcucgguccugggug

SEQ ID NO: 242226 - RNA, 64 nt, Human
gccccgguccugcacagccccgaaguucgccgggcccggccacccugccccaagggcaagcaag

SEQ ID NO: 242227 - RNA, 64 nt, Human
acagcagugcuacccaccacacacaccuugcuggcccggccaccacugcuggcuucagccccuu

SEQ ID NO: 242228 - RNA, 64 nt, Human
ggaaccaugaggaggguggcaggucuuugcagcucccggccagggugaggcggaagugagcccu

SEQ ID NO: 242229 - RNA, 64 nt, Human
aacagggauggcacuucccugagcaguccuggcccccggccacugucucggggcccaccucucg

SEQ ID NO: 242230 - RNA, 64 nt, Human
cgaagugcugggauuacaagggugagccaccaugcccggccauaaaugauuuuauucauuuuua

SEQ ID NO: 242231 - RNA, 64 nt, Human
acuggccccuccacccucccuccccucccggcuccccggccagagggagagcuuggucucugga

SEQ ID NO: 242232 - RNA, 64 nt, Human
aagaagcguugcagaggcccacggucuccugggucccggccaccuguccauauuccacauuugc

SEQ ID NO: 242233 - RNA, 61 nt, Human
ccuuaaauggcccagugugaugcugcugccgcccggccacggcccacccuggucaggcugc

SEQ ID NO: 242234 - RNA, 53 nt, Human
agaccauccucaagaacugagaccccggccagcgcccaccccagccuucugcc

SEQ ID NO: 242235 - RNA, 64 nt, Human
cuccccauuggcagcacgggacccaugcugugcccccggccaggcccugaggaaaugcucagcc

SEQ ID NO: 242236 - RNA, 64 nt, Human
gugggguacgacaggcuggggcacacagucuccccccggccaccucggggcugccugggccucu

SEQ ID NO: 242237 - RNA, 64 nt, Human
caaaggcagaugccagacaagacacagccaggaacccggccagguccccccacaugccccucag

SEQ ID NO: 242238 - RNA, 64 nt, Human
gucguuaccgaccacuaggggugggcagggccgccccggccauguuuacagccccggcccucga

SEQ ID NO: 242239 - RNA, 55 nt, Human
guaugaugauaucaauguaagccaucccggccagccccugacaucugccaucgau

SEQ ID NO: 242240 - RNA, 64 nt, Human
ccucccucaccaacauugcuugugccacacccucccccgccacuccugaaccccgucgaggggc

SEQ ID NO: 242241 - RNA, 64 nt, Human
gccacucugcuuggccugaccugcagguccccugccccgccagccacaggcugggugcacgucc

SEQ ID NO: 242242 - RNA, 64 nt, Human
ccacauccauggccuaggagcuacugggcagguucccggccacacaucuggugggcuguuuugu

SEQ ID NO: 242243 - RNA, 64 nt, Human
caaagugcuaggauuacaggcaugaaccaccgugcccggccaggaauaagcuuuugacuuaccc

SEQ ID NO: 242244 - RNA, 64 nt, Human
aagugcugggauuacaggcgugugagccaccacgcccggccaugaaauauuuuuacuuaaaaau

SEQ ID NO: 242245 - RNA, 64 nt, Human
acugcuccccgccagcacguccagagcaacuuaccccggccagccagcccucucacccgaggau

SEQ ID NO: 242246 - RNA, 64 nt, Human
augccagcagcaggcgcggcugggggcccuggaucccggccaccagggggcuccuacucccacc

SEQ ID NO: 242247 - RNA, 64 nt, Human
ugccgguuucaacacacacagacaaacacagccacacgcgcacacaaguauaagacuuuuugua

SEQ ID NO: 242248 - RNA, 64 nt, Human
ggcaacccccaggucugcagcuccagguacauaucacgcgcacagccuggcagccuggcccucc

SEQ ID NO: 242249 - RNA, 64 nt, Human
cuggccugcaucucucuaagacuuagucugacgccacgcgcaucucuuguucuguguucaauca

SEQ ID NO: 242250 - RNA, 64 nt, Human
gguggcucccuguggagccagggcugagccuugucacgcgcacucgccaauuaagagauggacc

SEQ ID NO: 242251 - RNA, 64 nt, Human
uguguguguguguguaugugugugugugugugugcacgcgcaguguccaucaguaucagugccu

SEQ ID NO: 242252 - RNA, 64 nt, Human
accauggucugcccucaccccacauauguguguacacgcgcacgccuguaugugcgcugcccuc

SEQ ID NO: 242253 - RNA, 64 nt, Human
ccagcacgcgguucccacccggggccaaccucuccacgcgcacucaggaaagugaccagugacc

SEQ ID NO: 242254 - RNA, 64 nt, Human
ugaacugagcgcgcaggggcccguggcuugguuucacgcgcagcggcgccagacccugcaggag

SEQ ID NO: 242255 - RNA, 64 nt, Human
uugggaaaaaugugggggagaggacuucuuccuacacgcgcauugagacagauuccaacugguu

SEQ ID NO: 242256 - RNA, 64 nt, Human
ggcagcgucugcucugguaggacugucagacgcacacgcgcacgcaccuagacacacccacuca

SEQ ID NO: 242257 - RNA, 64 nt, Human
gcacccgccgcaccccgaggccgccaauuguccgccccgccagcgcugcaaauaaaccuucuga

SEQ ID NO: 242258 - RNA, 64 nt, Human
agcugacccccaccccccaccccccaccccccccccccgccaacuccuauacccaucuucccua

SEQ ID NO: 242259 - RNA, 64 nt, Human
uguggccacagcauggccccuuuaguccucccgcccccgccaaggggcaccaaggccacguuuc

SEQ ID NO: 242260 - RNA, 64 nt, Human
guuaucacggcacacagcagggaaucccaggcccccccgccaagugguuacccaagucaccacu

SEQ ID NO: 242261 - RNA, 64 nt, Human
cucugcaggcguggcacgcacgcacgcacccacccacgcgcacuuacacgagaagacauucaug

SEQ ID NO: 242262 - RNA, 64 nt, Human
augugagcagauuuuuuagaagggauaggagacacacgcgcacacacacacacacacgaaacuu

SEQ ID NO: 242263 - RNA, 64 nt, Human
cauugggguuaaguugggcagcccauuuaguuuacacgcgcauaagacuaauuuacaaaaucac

SEQ ID NO: 242264 - RNA, 64 nt, Human
gcguugcuuuuucucgcgugccuggaaccugacgcacgcgcacuccaguuuuuuuaugaccuac

SEQ ID NO: 242265 - RNA, 64 nt, Human
uuccauuacaauuaacagucaaggauaaaacaagcacgcgcacaaucaaggagcuggaacacac

SEQ ID NO: 242266 - RNA, 64 nt, Human
gggccaugcuggggaaaacgggccgguauuuacacacgcgcaaaacacccagagacggcacaag

SEQ ID NO: 242267 - RNA, 64 nt, Human
ucaaaagauaagcugaguguucccaccaggaagucacgcgcagagaggagagucuuacggaggg

SEQ ID NO: 242268 - RNA, 64 nt, Human
uagcgccucuccccggggcccgcgccccgagccccacgcgcaagacagcccaacagcuguuccu

SEQ ID NO: 242269 - RNA, 64 nt, Human
cacauucauuacacaccuacauacgcccccaacacacgcgcacggugaagaggacgcccgagcc

SEQ ID NO: 242270 - RNA, 64 nt, Human
gcgccuggacucugccaauaaagcggaaagcgggcacgcgcagcgcccggcagcccaggccccu

SEQ ID NO: 242271 - RNA, 64 nt, Human
gagcccuccaggccuuugcucuccccucuaggcacacgcgcacuuccaucucugccccauccca

SEQ ID NO: 242272 - RNA, 64 nt, Human
uacacacaucccucugagaagcacaaggagacgacacgcgcauuguaaccuuugcacugucuca

SEQ ID NO: 242273 - RNA, 64 nt, Human
acucaucaucgcgcaccggcugagcaccguggagcacgcgcaccucauuguggugcuggacaag

SEQ ID NO: 242274 - RNA, 64 nt, Human
accaaaaaagcaagagcgagagagaguacgugcacacgcgcacaaaagagagaaacggacacca

SEQ ID NO: 242275 - RNA, 64 nt, Human
ggauccugaaucugugcaaacaguaacgugugcgcacgcgcagcgggguggggggggagagaga

SEQ ID NO: 242276 - RNA, 64 nt, Human
gucauacgccccuccuccuucucucuuggcgaggccccgccacaccgcgcucuuccucccggga

SEQ ID NO: 242277 - RNA, 64 nt, Human
ggagugcaguggcgcgaucuuggcucacugcaacccccgccaccuagguucaagugauucucau

SEQ ID NO: 242278 - RNA, 64 nt, Human
ccuccuugucaugcccggccuguggacagccagcccccgccaucccucccacccccuaccaagc

SEQ ID NO: 242279 - RNA, 63 nt, Human
aagcuaagagcagagagugaccaacaguaaacaacacgcgcagacuccgcggcuggcggcugu

SEQ ID NO: 242280 - RNA, 64 nt, Human
uuuccuggcacacucugccccucuguccgggggacacgcgcauguguuugccagggauggggcc

SEQ ID NO: 242281 - RNA, 64 nt, Human
uuccugcagccaagggcacugggccagggcggcgcacgcgcaagaggcgcgcuucgagggaaua

SEQ ID NO: 242282 - RNA, 64 nt, Human
auagccccuuuuccgguauggggucuccuacacccacgcgcaccaccucuccggucgcguggcu

SEQ ID NO: 242283 - RNA, 64 nt, Human
cucccuccccccgccaagugcucacacacaaccucacgcgcacacacacacacgcagauggagg

SEQ ID NO: 242284 - RNA, 64 nt, Human
ugcaugcccgggcgaggaccgaagcacacaccuccacgcgcacgggcccuggcccccuccgcuu

SEQ ID NO: 242285 - RNA, 64 nt, Human
uaagaagccucugguuucugucuacuccaacguccacgcgcauagauacaggcaucccgggcac

SEQ ID NO: 242286 - RNA, 64 nt, Human
ugcuucugaaacucccaccuguugcucugagccccacgcgcaugcuaaugcguggaguguaugc

SEQ ID NO: 242287 - RNA, 64 nt, Human
ugugugugugugugugugugugcgcgcgcgcgcgcacgcgcacacacucacgcacacacaagca

SEQ ID NO: 242288 - RNA, 64 nt, Human
gucccccacccauccacacacaccuacacucacacacgcgcacaugggcgcgcacgaacuacca

SEQ ID NO: 242289 - RNA, 64 nt, Human
agccuggaguauuugggagagacuggcugcagauccccgccagccaagaugcaagccacucggg

SEQ ID NO: 242290 - RNA, 64 nt, Human
ccaacugggggcaaagguuugaagacacagccucccccgccagccccaagcugggccgaggcgc

SEQ ID NO: 242291 - RNA, 64 nt, Human
aacaggaacaaagacagaaaccaugacagggcugccccgccaggccccgguggguuugucugca

SEQ ID NO: 242292 - RNA, 64 nt, Human; identical to SEQ ID NO: 242247

SEQ ID NO: 242293 - RNA, 64 nt, Human; identical to SEQ ID NO: 242248

SEQ ID NO: 242294 - RNA, 64 nt, Human; identical to SEQ ID NO: 242249

SEQ ID NO: 242295 - RNA, 64 nt, Human; identical to SEQ ID NO: 242250

SEQ ID NO: 242296 - RNA, 64 nt, Human; identical to SEQ ID NO: 242251

SEQ ID NO: 242297 - RNA, 64 nt, Human; identical to SEQ ID NO: 242252

SEQ ID NO: 242298 - RNA, 64 nt, Human; identical to SEQ ID NO: 242253

SEQ ID NO: 242299 - RNA, 64 nt, Human; identical to SEQ ID NO: 242254

SEQ ID NO: 242300 - RNA, 64 nt, Human; identical to SEQ ID NO: 242255

SEQ ID NO: 242301 - RNA, 64 nt, Human; identical to SEQ ID NO: 242256

SEQ ID NO: 242302 - RNA, 64 nt, Human; identical to SEQ ID NO: 242261

SEQ ID NO: 242303 - RNA, 64 nt, Human; identical to SEQ ID NO: 242262

SEQ ID NO: 242304 - RNA, 64 nt, Human; identical to SEQ ID NO: 242263

SEQ ID NO: 242305 - RNA, 64 nt, Human
gagaaggagggucucuugcccaucucuccggccaccccgccaggaaacgacgagaaggccgagg

SEQ ID NO: 242306 - RNA, 64 nt, Human
gacacacacagacacaaaaucacacacacacccuccccgccacagagacaccauuacauacaca

SEQ ID NO: 242307 - RNA, 64 nt, Human
acuagcuuugcccuaacuccuucaucaaaagaccccccgccagcuucccacaccucauacgcag

SEQ ID NO: 242308 - RNA, 64 nt, Human; identical to SEQ ID NO: 242264

SEQ ID NO: 242309 - RNA, 64 nt, Human; identical to SEQ ID NO: 242265

SEQ ID NO: 242310 - RNA, 64 nt, Human; identical to SEQ ID NO: 242266

SEQ ID NO: 242311 - RNA, 64 nt, Human; identical to SEQ ID NO: 242267

SEQ ID NO: 242312 - RNA, 64 nt, Human; identical to SEQ ID NO: 242268

SEQ ID NO: 242313 - RNA, 64 nt, Human; identical to SEQ ID NO: 242269

SEQ ID NO: 242314 - RNA, 64 nt, Human; identical to SEQ ID NO: 242270

SEQ ID NO: 242315 - RNA, 64 nt, Human; identical to SEQ ID NO: 242271

SEQ ID NO: 242316 - RNA, 64 nt, Human; identical to SEQ ID NO: 242272

SEQ ID NO: 242317 - RNA, 64 nt, Human; identical to SEQ ID NO: 242273

SEQ ID NO: 242318 - RNA, 64 nt, Human; identical to SEQ ID NO: 242274

SEQ ID NO: 242319 - RNA, 64 nt, Human; identical to SEQ ID NO: 242275

SEQ ID NO: 242320 - RNA, 63 nt, Human; identical to SEQ ID NO: 242279

SEQ ID NO: 242321 - RNA, 64 nt, Human; identical to SEQ ID NO: 242280

SEQ ID NO: 242322 - RNA, 64 nt, Human; identical to SEQ ID NO: 242281

SEQ ID NO: 242323 - RNA, 64 nt, Human
gccuccgccaguccgacugcccuccccaccccacccccgccaccccccacaugugaccacugca

SEQ ID NO: 242324 - RNA, 64 nt, Human
ccaaucaugcugcagcccaggggcgucugcugugccccgccaaucacgagacugggggaccggc

SEQ ID NO: 242325 - RNA, 57 nt, Human
acgacgcccagacggaguaaccccagcccccgccacaccaccccuugccaaagucau

SEQ ID NO: 242326 - RNA, 64 nt, Human; identical to SEQ ID NO: 242282

SEQ ID NO: 242327 - RNA, 64 nt, Human; identical to SEQ ID NO: 242283

SEQ ID NO: 242328 - RNA, 64 nt, Human; identical to SEQ ID NO: 242284

SEQ ID NO: 242329 - RNA, 64 nt, Human; identical to SEQ ID NO: 242285

SEQ ID NO: 242330 - RNA, 64 nt, Human; identical to SEQ ID NO: 242286

SEQ ID NO: 242331 - RNA, 64 nt, Human; identical to SEQ ID NO: 242287

SEQ ID NO: 242332 - RNA, 64 nt, Human; identical to SEQ ID NO: 242288

SEQ ID NO: 242333 - RNA, 64 nt, Human
acugaggcugcgggcaccacgcgggguccggccugggauccaggcuaagggccggcggaagagg

SEQ ID NO: 242334 - RNA, 64 nt, Human
gacccaggcagcgccccaggaagccaugcugggcccccgccagggccuaucccaaaagcagggg

SEQ ID NO: 242335 - RNA, 64 nt, Human
ggggaaauuaccuuccugcgaagaaaggugacauccccgccacagacacggaggccccgccugc

SEQ ID NO: 242336 - RNA, 64 nt, Human
cgaggguccguccacugcugcgguuccgaggcucccccgccacucucucucugcccagguucug

SEQ ID NO: 242337 - RNA, 64 nt, Human
auuacagugggcuuuuuuguuuuaaaagugguuggggauccacaggaacgacauucauacaggg

SEQ ID NO: 242338 - RNA, 64 nt, Human
ccuucaugaggaugugcaguaucccaguaucacugggauccauguggaacagagccagcugggg

SEQ ID NO: 242339 - RNA, 64 nt, Human
ucucugugacuuccuuaaacagcagugaugggaagggauccaauaguaucuucaaggccuuggg

SEQ ID NO: 242340 - RNA, 64 nt, Human
cuuccagcucagucccacagccccuugcuucuaagggauccagagaccugcuccagauccucuu

SEQ ID NO: 242341 - RNA, 64 nt, Human
acccacuguggacagcugucugucagcaugcagagggauccaggaauccccccggcagcacggc

SEQ ID NO: 242342 - RNA, 64 nt, Human
uaaugggcggcccacuucagcacugggcaaggaggggauccaugaaucugggguacaaagauaa

SEQ ID NO: 242343 - RNA, 64 nt, Human
gacugauuuaggagcauugugucccuucgagauggggauccacacacugugaaugugaugacug

SEQ ID NO: 242344 - RNA, 64 nt, Human
aggccucaugcuaugacuuuuuauuucucuuccugggauccaccacccucuacucucagcugac

SEQ ID NO: 242345 - RNA, 64 nt, Human
caaugggucccucuagccuguggacaccagcugggggauccagggucaggcccccuccucuccc

SEQ ID NO: 242346 - RNA, 64 nt, Human
acacuguggcuuuccacgugagguuuuguuuagagggauccacuacucaagaaaaaguuagcaa

SEQ ID NO: 242347 - RNA, 64 nt, Human
ccacgaauucuucuggggucaggugccacugaccgggauccaguuccaguucccaugguguaug

SEQ ID NO: 242348 - RNA, 64 nt, Human
agagacauguccaguggccuuuggaaaggugguggggauccaguucaggagggagggguauguu

SEQ ID NO: 242349 - RNA, 64 nt, Human
acugggcuccaccugcucacccgccugcagaucugggauccagccugcucucaccgcuguagcu

SEQ ID NO: 242350 - RNA, 64 nt, Human
auucuacuuugaaauauccgugaauauuuacugugggauccaauuuaaacuucuuucuucucua

SEQ ID NO: 242351 - RNA, 64 nt, Human
agcugccccuacugggaagugaggagccccucugccccgccagccaccccguccgggagggagg

SEQ ID NO: 242352 - RNA, 64 nt, Human
aggucaggccccugcccacugccugacccccaccccccgccaguccagggagacccugugggug

SEQ ID NO: 242353 - RNA, 64 nt, Human
agggcagaggggugcucauagcgggcgcugccagccccgccacgcuugugucuuuagugcucca

SEQ ID NO: 242354 - RNA, 64 nt, Human
agugacccucaaagaaugagaaccucaagcaucugggauccaguggagcuaaucaguccugccu

SEQ ID NO: 242355 - RNA, 64 nt, Human
gggagcugcugccagaaugaaguaggaaagaggagggauccaucuggguuggucuguggauuuu

SEQ ID NO: 242356 - RNA, 64 nt, Human
cagaccuguucuccagagcucaauucugcacucugggauccacacccuuggacagggugggaga

SEQ ID NO: 242357 - RNA, 64 nt, Human
uaaaaaucacauucucuguucagcuguuaaugcugggauccauauuuaguuuuauaagcuuuuc

SEQ ID NO: 242358 - RNA, 64 nt, Human
agucucaacccauaaaaaggaagaacugacaaaggggauccaucggccaccccucugcaggggc

SEQ ID NO: 242359 - RNA, 64 nt, Human
cggaccaaaagaaauuuccugccccaagaagcaugggauccaggaaggggcgcguagaugcuua

SEQ ID NO: 242360 - RNA, 64 nt, Human
ucagaaauucgucuuugucuugccucugguuccugggauccagugaucucuacuggcccagggc

SEQ ID NO: 242361 - RNA, 64 nt, Human
ucccaguuccuguucagguucuggcaggggcccagggauccaggggaccugguuccaaucucag

SEQ ID NO: 242362 - RNA, 64 nt, Human
cugaccccauuugucgacauggccccagacaggagggauccacuucucuguucugaacagcucu

SEQ ID NO: 242363 - RNA, 64 nt, Human
gcguuggccaggaugaucucgaucucuugaccuugggauccacccgccuuggccucccaaagug

SEQ ID NO: 242364 - RNA, 64 nt, Human
cccaguggugagaagacuuccccaagccuggcaggggauccagcucaagggaguaaguagaggu

SEQ ID NO: 242365 - RNA, 64 nt, Human
uuaucaccaaggggauggcccaggccauucaugagggauccaccuuugugcuccaaacaccucc

SEQ ID NO: 242366 - RNA, 64 nt, Human
ucaguugccaaaggacuuugcugaccacugcauggggauccaaccaauucaauuaaugucuuca

SEQ ID NO: 242367 - RNA, 64 nt, Human
caucuggggcccugguuuugcuuucagucaaauggggauccaacuccugccccaccugccaucu

SEQ ID NO: 242368 - RNA, 64 nt, Human
ugcucuguuccuuccccgagccccugccccggcuccccgccaaagcaacccugcccacucaggc

SEQ ID NO: 242369 - RNA, 64 nt, Human
ugcccugauaaauaacaaguuauaguaccaucucccccgccaauaaaaaagagaagaaaaaaga

SEQ ID NO: 242370 - RNA, 64 nt, Human
ucagucaccgaagguccuacagggccacaacugcccccgccacaacccaccccgcuuucguagu

SEQ ID NO: 242371 - RNA, 53 nt, Human
augagaagcggcuuuucugaaaagggauccagcacaccuccucgguuuuuuuu

SEQ ID NO: 242372 - RNA, 64 nt, Human
uggguggggaggaucaauuagagaggaggcaccugggauccaccuucuuccuuagguccccucc

SEQ ID NO: 242373 - RNA, 64 nt, Human
auugugagcaagauauuuaucucuuuagcccuuggggauccagcugagagcaaucucuugcauu

SEQ ID NO: 242374 - RNA, 64 nt, Human
auuccugaucuucccaccucacagugauguuguggggauccagugagauagaauacauguaagu

SEQ ID NO: 242375 - RNA, 64 nt, Human
cccuacaaguuguccucaaggucauccuggagaugggauccaggacguggggccaugacucucu

SEQ ID NO: 242376 - RNA, 64 nt, Human
aucugggguuccagaagguggaacaagcaggaaugggauccaaagagacucccacucagauucu

SEQ ID NO: 242377 - RNA, 64 nt, Human
uuaucuuucuuauucuuuacuugaaauaacuauagggauccacaggagaucaaaaggaaugaug

SEQ ID NO: 242378 - RNA, 64 nt, Human
ggagaagcaguuagugacuggcuagaggucucuugggauccaucuugaccucaaagaauauuug

SEQ ID NO: 242379 - RNA, 64 nt, Human
gggauauuuuuaaaaacuccuuuugguuuaccuggggauccaauugauguauauguuuauauac

SEQ ID NO: 242380 - RNA, 64 nt, Human
aucuuuugaggucauuagcaaacaugaacucacagggauccagagaugguaaaauucaaaacag

SEQ ID NO: 242381 - RNA, 64 nt, Human
gggcuaaccacuucacaccuaccaucgucccauggggauccaagaccugagauaaagcaacagc

SEQ ID NO: 242382 - RNA, 64 nt, Human
aaaucuguuagcauuauugccaaauaagacaguugggauccaaacccaagucuugagcaauguu

SEQ ID NO: 242383 - RNA, 64 nt, Human
gccagcccggggcuggggaggcgcaaggagaggagggauccaguggggccgugggcuggguagg

SEQ ID NO: 242384 - RNA, 64 nt, Human
guguuuguuauuagaaaugauuuuuuagauauuggggauccaguguccacacuuaaaaguugua

SEQ ID NO: 242385 - RNA, 64 nt, Human
gacccuucuccucugagaaggcucccggcugccuccccgccaccgagcuuguagccugaaugcc

SEQ ID NO: 242386 - RNA, 64 nt, Human
gacacacacagacacacaaucacacgcagccccuccccgccacagagacacaccauuacauaca

SEQ ID NO: 242387 - RNA, 64 nt, Human
gaaagacacagacacaaaaucacacacacacccuccccgccacagagacacaccauuacauaca

SEQ ID NO: 242388 - RNA, 64 nt, Human
uguuuguuaauagaaauaauuuuuuuagguauuggggauccauugucuauauuucaaaucaguu

SEQ ID NO: 242389 - RNA, 64 nt, Human
uugaacacaacauacacugucaaacuuuacaucagggauccaacauaacucagacauagcccag

SEQ ID NO: 242390 - RNA, 64 nt, Human
agguggggguucugucuuaacucgaggggcaccugggauccaggacgcuucuagggggcucugg

SEQ ID NO: 242391 - RNA, 64 nt, Human
ucucacaccguccacugugcguuuguaugugucugggauccagggcaaugugaauuuucuuuuu

SEQ ID NO: 242392 - RNA, 64 nt, Human
gcuuuaguaguuccuuugcuuguaauuaugggaugggauccaggcauagggaacuaguuguuuc

SEQ ID NO: 242393 - RNA, 64 nt, Human
uuuuuaguaguuccuuugcuuguaacuaugggaugggauccaggcauagggaacuaguuguuac

SEQ ID NO: 242394 - RNA, 64 nt, Human
gcgaagggcggcgaagcggagacggcggcucuccgggauccagcuccgccccuggccagugugc

SEQ ID NO: 242395 - RNA, 64 nt, Human
ugagcggugcagggagugcucaguugcuggggaugggauccaaguccauuucuuaguuccacac

SEQ ID NO: 242396 - RNA, 64 nt, Human
uguuugagaaagucagauucuugcaucccuggcugggauccacgacgcuuaaauacagcuuuug

SEQ ID NO: 242397 - RNA, 64 nt, Human
cuuuuuuuuuuuuaaagaaagaaaaagaaacccugggauccaucuguuuuuuuuguuguuguug

SEQ ID NO: 242398 - RNA, 64 nt, Human
aacuuugcuuugggcaagaaucuggucaccugaugggauccaugguacaggcuacugcuaaacu

SEQ ID NO: 242399 - RNA, 64 nt, Human
auacaacuuuauggcaggguuuuagugugugagugggauccaaaacacucaauccuguaaaagg

SEQ ID NO: 242400 - RNA, 64 nt, Human
ccagucugcccaccugugcucaggaugcagcccugggauccagcacccauggaagcuucugcug

SEQ ID NO: 242401 - RNA, 64 nt, Human
gcucagaguuccuuuagggcagagcugagggccugggauccaggaaccagugggauuggauggg

SEQ ID NO: 242402 - RNA, 64 nt, Human
uccccauugugugcccagaacaucccuggccccaccccgccacuucccucgggcccuuaugaag

SEQ ID NO: 242403 - RNA, 64 nt, Human
aguguggcaguccccacagcuccacaaugggcucccccgccaacggggacgacagggaucuuca

SEQ ID NO: 242404 - RNA, 64 nt, Human
cccuucccccaaacuccagggaauggaggggggaccccgccagccaaaacauuccccccauucc

SEQ ID NO: 242405 - RNA, 64 nt, Human
ggaugagaauauagauagucguacaacaacccaggggauccagauacaugagaccagggcagcg

SEQ ID NO: 242406 - RNA, 64 nt, Human
aaaaagcaaauggauuuccaccugacaaaucuucgggauccaagaagcagaaacaauaucagcg

SEQ ID NO: 242407 - RNA, 64 nt, Human
ccgucuccaaaaaaaaaaaaaacaaaacuugauugggauccaaaaucauacaacuauacacuaa

SEQ ID NO: 242408 - RNA, 64 nt, Human
auuauccaggcuggugucgaauuccugggcuccagggauccacagucccccuuggccucccaaa

SEQ ID NO: 242409 - RNA, 64 nt, Human
cuuacugguuauagugggaauauaaauaaagugagggauccaacauuacuuuaaaagucacccc

SEQ ID NO: 242410 - RNA, 64 nt, Human
ugcuugucugcuuuggcggagcugagcuguguaugggauccaggaggcuggggugauuuauuuu

SEQ ID NO: 242411 - RNA, 64 nt, Human
ggaaagagccauagcuuaagucucuauguagacagggauccauuuuaaagagcuacuuagagaa

SEQ ID NO: 242412 - RNA, 64 nt, Human
gccagaucucuuuuuaacaucaugugcgucucuugggauccagcaaaaguguuaagccacaaug

SEQ ID NO: 242413 - RNA, 64 nt, Human
aauauauaagaaagauguuaagaaaaauuaaggggggauccauugaaagacuugaagaauacau

SEQ ID NO: 242414 - RNA, 64 nt, Human
guggccucaccaucccagagggcuucaccagugugggauccaccugucaguccccagcgacucu

SEQ ID NO: 242415 - RNA, 64 nt, Human
cauccuaauuuggaauuuggucccuggauggcuagggauccaugaaccaggcagguaccuuuuu

SEQ ID NO: 242416 - RNA, 64 nt, Human
gggcagaguuguuuuguucuggcuuggggagagugggauccauccucauccuggcacuccucca

SEQ ID NO: 242417 - RNA, 64 nt, Human
gacagaagucuaggcccagggauggcuccaguuggggauccagcaggagacccucugcacauga

SEQ ID NO: 242418 - RNA, 64 nt, Human
cuuuaguaauuuaacuguuuauguuacccacguugggauccaguuggucuugguuugcuucucu

SEQ ID NO: 242419 - RNA, 64 nt, Human
caaugcccaggccaggggggcugcagcccucagcccccgccaggauucccgcaggcuccuggac

SEQ ID NO: 242420 - RNA, 64 nt, Human
aggcaccggcaaguguugucagcacuggaggagaccccgccaguggggugaggccagccaaguc

SEQ ID NO: 242421 - RNA, 64 nt, Human
aacaguucuccuggaagggagguuuuugcuuuacccccgccagcacuuccgcacacaaucauag

SEQ ID NO: 242422 - RNA, 64 nt, Human
agccaaccccuagcccaggggugcugugggaacugggauccaauuuguagcuuccugccuggcu

SEQ ID NO: 242423 - RNA, 61 nt, Human
accgggaagagaagaccuaggagcagacgccgggauccaggagaaugcucgaggggcgcag

SEQ ID NO: 242424 - RNA, 64 nt, Human
gaaaaggccagacccugcugaguuagaggcugcugggauccacuguuuccacacagcgggaagg

SEQ ID NO: 242425 - RNA, 64 nt, Human
auaucauuuauguggagauccacaaccuuuaacagggauccaagaucuuugcaguucaaucgac

SEQ ID NO: 242426 - RNA, 64 nt, Human
cugccagccucccugcaguaggaaaacaaugccagggauccagggagacuaagguggccggaac

SEQ ID NO: 242427 - RNA, 64 nt, Human
auggaaacagaaaaggcugccagcuguuuuaccagggauccagagacauagaggaaguaggggg

SEQ ID NO: 242428 - RNA, 64 nt, Human
auguguacucccauaauucccacauuuuauaggagggauccagugagagauaauuugaaucaag

SEQ ID NO: 242429 - RNA, 64 nt, Human
gacugauugcaccugggacccaggcccuuucuuugggauccagucccagccuucauccauguga

SEQ ID NO: 242430 - RNA, 64 nt, Human
ucuauccucauccuacgccucccugggggcuggagggauccaagagcuuggggauucaguaguc

SEQ ID NO: 242431 - RNA, 64 nt, Human
uacaucccuggggaaucuuuuacaucaaacuuuugggauccaaauccaucuccuuuuaaauuuc

SEQ ID NO: 242432 - RNA, 64 nt, Human
aaggagccucauccuaaucucacucaggccuccagggauccaugggggagugaaaccaauucuc

SEQ ID NO: 242433 - RNA, 64 nt, Human
uaguccaacauuuuuucccagugagucacauccugggauccaguguauaaauccaauaucaugu

SEQ ID NO: 242434 - RNA, 64 nt, Human
ccuagccuggaguucuagaaggauggagagugaggggauccaggccauucaccugcauggcuuu

SEQ ID NO: 242435 - RNA, 56 nt, Human
auggggcucagaggcuguaaagaacugggauccaugagcaaaaagccgagagccag

SEQ ID NO: 242436 - RNA, 64 nt, Human
cuccuuuucuaaaccaccucugggacucagcuccccccgccaaaaaaaaugggucuccuucugg

SEQ ID NO: 242437 - RNA, 64 nt, Human
uugcuggaauaaggagggcugaggcugaguuguuccccgccacuguugaggaucccaucugaca

SEQ ID NO: 242438 - RNA, 64 nt, Human
uggcccaguaguggcuucuagcucuaaauguuugccccgccaucccuuuccacaguauccuucu

SEQ ID NO: 242439 - RNA, 64 nt, Human
ugcagucagugcccagggcgaggaauguggccaggggauccaggaccugggauccagggcccug

SEQ ID NO: 242440 - RNA, 64 nt, Human
agggcgaggaauguggccaggggauccaggaccugggauccagggcccugggcuggaccucagg

SEQ ID NO: 242441 - RNA, 64 nt, Human
gucacugcugggccaagaagccuucacuaggagugggauccaggcuccucucccacagaaagcg

SEQ ID NO: 242442 - RNA, 64 nt, Human
agccagcccccaccuuccaggcgccuucgcccuggggauccaaccaacuuguaucgagugggcg

SEQ ID NO: 242443 - RNA, 64 nt, Human
cugcugccccagccaggguuggagucuuagccucgggauccagugaagccagaagccaaauaaa

SEQ ID NO: 242444 - RNA, 64 nt, Human
aaacccaaaauaauagcuuugcuuagcccuguuagggauccauuggagcauuaaggagcacaua

SEQ ID NO: 242445 - RNA, 64 nt, Human
cccaagccuggaacgcagagaggucuuuacugcugggauccacggaaaacaugucuguccuagc

SEQ ID NO: 242446 - RNA, 64 nt, Human
cuauucauguggcaggccccuguccuaggcccuagggauccaacuggcugucugccucuagaac

SEQ ID NO: 242447 - RNA, 64 nt, Human
ucacaugaaacggaggcagauggagaccaagggugggauccagaauggagucuuuucuguuauu

SEQ ID NO: 242448 - RNA, 64 nt, Human
aacaauucggugguaaaaguaccacacaaacuaugggauccaaggggcagucuugcaacagugc

SEQ ID NO: 242449 - RNA, 64 nt, Human
gauugggaucucuguggcacugggccaccucauugggauccacuucacuggcugcuccaugaau

SEQ ID NO: 242450 - RNA, 64 nt, Human
uuuaaaacaagaaugauaggccaggaaggcaguggggauccaccaucacauggaacuguaaggc

SEQ ID NO: 242451 - RNA, 64 nt, Human
ccuguuuccuuuugcaaaacagugccuggcaugugggauccaggcguucuuuaggauccuugga

SEQ ID NO: 242452 - RNA, 64 nt, Human
cuucuccauucccuuccugcuuuuuucauggugggggauccaccaggucaucuaggcucuggcc

SEQ ID NO: 242453 - RNA, 54 nt, Human
ucuuugccccacaggugugacaagccccgccaagacagaccugcaagucuucgu

SEQ ID NO: 242454 - RNA, 64 nt, Human
gagaaugucacagaugaggcugccccugccccccccccgccagggagguuucaugagcucaugu

SEQ ID NO: 242455 - RNA, 64 nt, Human
aaucaggaccuaucuaggcagaccccagccagacccccgccagacagacucccaaccagacuga

SEQ ID NO: 242456 - RNA, 64 nt, Human
ccauaacuuugaggcauuuucuaaaugaacuguggggauccaggauuuguaauuucuugaucua

SEQ ID NO: 242457 - RNA, 64 nt, Human
agccaagcaagacugagcagcagcagggccccaugggauccauccugucucccucagagaagga

SEQ ID NO: 242458 - RNA, 64 nt, Human
aacucaaauguauucccaagguuugcugggcucugggauccacgagacaaccagagagggauau

SEQ ID NO: 242459 - RNA, 64 nt, Human
uacuccuugaggcugaacuggucacagacaaacugggauccagcacaguccagcaguucucaaa

SEQ ID NO: 242460 - RNA, 64 nt, Human
guaacauuuugacaacugaaagaaaaaguacaaggggauccaguguguaaauuguauucucaua

SEQ ID NO: 242461 - RNA, 64 nt, Human
cuuaggagcagagcucugccgcaauggccauguggggauccacaccuggucugaggggcaacug

SEQ ID NO: 242462 - RNA, 64 nt, Human
uaggaacuguggcugggaaggugccuccaacaaugggauccagggaagccaaggagaagacagc

SEQ ID NO: 242463 - RNA, 64 nt, Human
gccuggcuggugggaaggccggcagcgggcggaggggauccagccacuucccccucuucuucug

SEQ ID NO: 242464 - RNA, 64 nt, Human
gauauaagaacucaaggucccauacucuguauucgggauccaucugagaugcaugcuaagcuau

SEQ ID NO: 242465 - RNA, 64 nt, Human
gaguuaaggaguagcucgaggugaagcuggaugggggauccaguggagcaggaguugacggaca

SEQ ID NO: 242466 - RNA, 64 nt, Human
uuguaggagauccaugagcaugcuggauauugaggggauccaaucugugaucuauuuuuuauua

SEQ ID NO: 242467 - RNA, 64 nt, Human
gagucccuuuguccucaucugagacugaaauguggggauccaggauggccuuccuuccucuuac

SEQ ID NO: 242468 - RNA, 64 nt, Human
caggagauagugagcagcucccaggaggcauggagggauccagaaccuggacugaagaaccacc

SEQ ID NO: 242469 - RNA, 64 nt, Human
ugcauuugccuggcccugaucucgccuguccucagggauccagacuuccucugcuggucuggcc

SEQ ID NO: 242470 - RNA, 64 nt, Human
gccucuucuccuaaagcauuccuaggaauauuuuccccgccaaugcugggcguacacccuagcc

SEQ ID NO: 242471 - RNA, 64 nt, Human
acagcaaacuugugucugucucuucuuucauuuuccccgccaccaacuuacuuuaccaccuaug

SEQ ID NO: 242472 - RNA, 64 nt, Human
uaagacucagggaggcuaaaucaguguuugauugccccgccaacccuuccugaaacuucagacc

SEQ ID NO: 242473 - RNA, 64 nt, Human
acuggcagguugugaauuuuucuuuuccucuuuggggauccaaaugaugaugugcaauuucaug

SEQ ID NO: 242474 - RNA, 64 nt, Human
guauuauuuuauuuguauucgaucuguguuaccugggauccaguaucaaauauauccacauucu

SEQ ID NO: 242475 - RNA, 63 nt, Human
uaaacccagcugacacuugagcccagcauccuggggauccagcggauggacagcuuggcucuc

SEQ ID NO: 242476 - RNA, 64 nt, Human
ucuucuggcuucccugcaucuugccuuugggauugggauccaaggguucuccauggauggaucc

SEQ ID NO: 242477 - RNA, 64 nt, Human
guuggucaggcuggucucaaacuccugaccucaggggauccacccgccucggccucccgaagug

SEQ ID NO: 242478 - RNA, 64 nt, Human
uggggccacaaaaggaaaaccggaggagcaauuggggauccaggugucagagguaggggaacca

SEQ ID NO: 242479 - RNA, 64 nt, Human
gagaccugggaugggagaaguccuggggcgccaggggauccagccuagagcagaccuuagcccc

SEQ ID NO: 242480 - RNA, 64 nt, Human
agccacauguuucacacaaguguagaaaaugccagggauccaccacaagauggagauggucagc

SEQ ID NO: 242481 - RNA, 64 nt, Human
gaagggugccgcgagccaggcugaccaggcgcccgggauccagcucauccccuuggcugggaac

SEQ ID NO: 242482 - RNA, 64 nt, Human
ggugagccgagcugugguggcggcugguuuaaaagggauccaguuuccagcugcagguuuguua

SEQ ID NO: 242483 - RNA, 64 nt, Human
ggcugaagcaucugagucuucuaauaagugggaagggauccaacaaagaagccaugaccaguua

SEQ ID NO: 242484 - RNA, 64 nt, Human
gaggaugccgagcagggacucucgucugugggacgggauccaagaguuuggggauuagggguau

SEQ ID NO: 242485 - RNA, 64 nt, Human
gcuacugcaucuuaugauacucgaguauauaucugggauccacauaauggagacauucugaugg

SEQ ID NO: 242486 - RNA, 64 nt, Human
ccccaggucaggggcucccuacauuccccagagugggauccacuucuugguuccugggauggcg

SEQ ID NO: 242487 - RNA, 64 nt, Human
gcuuggcagggacuaggcugaagaugugucuucuccccgccaccuacuguaugacaccacauuc

SEQ ID NO: 242488 - RNA, 64 nt, Human
aggacugaaugguguccagccuggugcccgcccaccccgccaggcugcacucggucgggccucc

SEQ ID NO: 242489 - RNA, 64 nt, Human
ccagcagauuccauuaccucagcagcucuuguucccccgccacuggcaguucugcaaugccaua

SEQ ID NO: 242490 - RNA, 64 nt, Human
ggggcccgcgauguggaacugcugccacugaggggggauccaguuuugucaaugcaguugucuc

SEQ ID NO: 242491 - RNA, 64 nt, Human
ccuucuacagcagcuaacuagaguccuaacuaaugggauccagcagggccauuucuccagaggg

SEQ ID NO: 242492 - RNA, 64 nt, Human
uccaagcagacaaccuuugucuuuacaugcaagagggauccaauuaugacaggcugacccagcu

SEQ ID NO: 242493 - RNA, 64 nt, Human
uguuccccuaucaaggcugugacuagaucaggcagggauccauucccuguccccugcccacuac

SEQ ID NO: 242494 - RNA, 64 nt, Human
ggagaggcugcugcccagaaacugcuggguuggugggauccacacagaugggcaucuuggcucu

SEQ ID NO: 242495 - RNA, 64 nt, Human
aaagguacaguuccuuucaagagguaacagcacugggauccaagcagggggaugaaaaacucag

SEQ ID NO: 242496 - RNA, 64 nt, Human
ccccuuccuccacuccugacauucuuucccuucagggauccaaaaugguuggccgagcucccag

SEQ ID NO: 242497 - RNA, 64 nt, Human
cggggaagggugagaaggagagccugccugcucagggauccaggcucguagagucacucccugc

SEQ ID NO: 242498 - RNA, 64 nt, Human
auggagguucuagaagggguaaggccagaacccagggauccaggagucggcucucagcuggagc

SEQ ID NO: 242499 - RNA, 64 nt, Human
cuggcgggggccgcggaggagccgaaagggcguugggauccaggggaagggucuguccugcgcu

SEQ ID NO: 242500 - RNA, 64 nt, Human
ugcugucagcauaaugauuguguuccuucccuaugggauccaucuguuuuguaaacaauaaagc

SEQ ID NO: 242501 - RNA, 64 nt, Human
ccgucucuuccuucugcuuuucgguuuuuggaaagggauccaucuccaggcagcccacccuggu

SEQ ID NO: 242502 - RNA, 51 nt, Human
acuucugugugggcaagugacgggauccagggaagucgcacccaagcugcg

SEQ ID NO: 242503 - RNA, 64 nt, Human
cgcagccuccagggcccgaggugaucccgguggugggauccacgcugggccuaggaugggacgu

SEQ ID NO: 242504 - RNA, 64 nt, Human
ugcagacuaaaggucuggccaaugucuugccccaccccgccagccgcgauacggcgcaguuccu

SEQ ID NO: 242505 - RNA, 64 nt, Human
augaggaauuucuguucuuccaucaccuccccccccccgccacccucccacugccaaagaacuu

SEQ ID NO: 242506 - RNA, 64 nt, Human
gaaugagugcagagcuccuacccacacaugacugccccgccauuucauccuaggcauucuguga

SEQ ID NO: 242507 - RNA, 64 nt, Human
gggcugcauggggagcccggggagcugaguaguggggauccagagaggacccccgcccccagag

SEQ ID NO: 242508 - RNA, 64 nt, Human
uucacuguaggacaccagagagcugauuuuucaagggauccaacagacagaaauucacccucau

SEQ ID NO: 242509 - RNA, 64 nt, Human
gcuugcucuuaggacaccaggcugcagaugaucagggauccaauaugacucagagaaccagugc

SEQ ID NO: 242510 - RNA, 64 nt, Human
uauccgggugggaagagggagucacaucgcuuuggggauccauugguguuugguuugggguguu

SEQ ID NO: 242511 - RNA, 64 nt, Human
caaaaugguacagcuucuggagcagaacuuuccagggauccagggacacuuuuuuuuaaagcuc

SEQ ID NO: 242512 - RNA, 64 nt, Human
ugaugccaccccgucaccccuccccuccugagcagggauccaagaaugugccaagagucccgcc

SEQ ID NO: 242513 - RNA, 64 nt, Human
gcuuacgauacuacuaccucauaggguuguccuggggauccaguaugaugaagugcgccagggg

SEQ ID NO: 242514 - RNA, 64 nt, Human
uacuggugcacuucuuacgacuuuuuugagacaugggauccaauuuuaauauuaacuuuuaaug

SEQ ID NO: 242515 - RNA, 64 nt, Human
gacauggauuagcgcuacgugggcugcagcauuugggauccaggcuaccuagaggggcaucggg

SEQ ID NO: 242516 - RNA, 64 nt, Human
ccuacuggggcugcagccuuuagacccugggucugggauccacgucuagggaccacucuggcuu

SEQ ID NO: 242517 - RNA, 64 nt, Human
cccacagccccaacgcagucuguguaugauuccugggauccaacgagcccuccuauuuucacag

SEQ ID NO: 242518 - RNA, 64 nt, Human
agcauaaaaaggaaaaaaaggaaacucaggcaaagggauccauaugugcaauggcaaagaaaug

SEQ ID NO: 242519 - RNA, 64 nt, Human
aucuucucuucacuugcugagaaagucagaggaggggauccaguagcccuuuccacauacugug

SEQ ID NO: 242520 - RNA, 64 nt, Human
ggagcuggugacacuugugugcuguggggcagcugggauccagguaagaccggauugaagcuuu

SEQ ID NO: 242521 - RNA, 64 nt, Human
cgcucaggguugacaucuuauuugaacaagggucccccgccaucaugcagccuccaaggugcca

SEQ ID NO: 242522 - RNA, 64 nt, Human
uaccaggauaacccccgcaaaccacauagcagacccccgccauccucgcagagugggagaggcu

SEQ ID NO: 242523 - RNA, 64 nt, Human
guauugcggcugcacgucacacuaggguggccacccccgccauugcgagccacaugucugcacu

SEQ ID NO: 242524 - RNA, 64 nt, Human
aucauauccaacucagggaagcggacugagugcugggauccaaggcauucuacaggguucacug

SEQ ID NO: 242525 - RNA, 64 nt, Human
cuguuccaugggugcccagccagccaggccgugugggauccagcgagaggccagggcuuggagu

SEQ ID NO: 242526 - RNA, 64 nt, Human
gaagggcuggugcagggaaagcaagaaggcuggagggauccagcguaucuugccaguaaccagu

SEQ ID NO: 242527 - RNA, 64 nt, Human
aaaaaagucccuaccugagccuuuaggugaaugugggauccacucccgcuuuuaacaugaaagc

SEQ ID NO: 242528 - RNA, 64 nt, Human
cauucccaggcuggucuugaacuccuggacucgagggauccacccauuggccuccaaaagugcu

SEQ ID NO: 242529 - RNA, 64 nt, Human
uacugcuccucucuucucagcucagggagaggaggggauccauucucuaaggaccaaacugcac

SEQ ID NO: 242530 - RNA, 64 nt, Human
uguggugggguggaugggaaggcccacagcccaagggauccauaauaauaauugcuuggccagc

SEQ ID NO: 242531 - RNA, 61 nt, Human
cggucaugacuuuuuuaugauugggcacggagggauccagggcaucugugaacuggcugcu

SEQ ID NO: 242532 - RNA, 64 nt, Human
cccugucucccuacuuagacccagucauucuagagggauccaccgccacacuggccggcccacg

SEQ ID NO: 242533 - RNA, 64 nt, Human
ggacucuauggacucgauuuuaccauauggaauagggauccacuucucuguuaaccuacaaaac

SEQ ID NO: 242534 - RNA, 64 nt, Human
cacauuccccauugaucaacccccaaagccaugagggauccaaguagagccacagaaaaagaag

SEQ ID NO: 242535 - RNA, 64 nt, Human
agagucgagugauauggcuuguagggugaggcgugggauccagagagaagcaccccaccacaca

SEQ ID NO: 242536 - RNA, 64 nt, Human
aaggagagacucuaguuaagaggugcuggcugcggggauccagacagggcacauugggggcaug

SEQ ID NO: 242537 - RNA, 64 nt, Human
aguccaggacaggagaugcugugccccuggccuugggauccaggccccucccucuccagcaggc

SEQ ID NO: 242538 - RNA, 64 nt, Human
acuccuuccucucccaguacuuuaccaaaggaacccccgccaggacccacauggggccacgugu

SEQ ID NO: 242539 - RNA, 64 nt, Human
cuuucuccuccgccgcaaaggagaggcuucccagccccgccagugagagguuggacucucugcc

SEQ ID NO: 242540 - RNA, 64 nt, Human
agggggcagagucuucccuaccagguuucuacacccccgccaggcugcccaucagggcccaggg

SEQ ID NO: 242541 - RNA, 64 nt, Human
auuccugguugcugugaugaaaugggauacacuggggauccagcugcacaacuuuucggaagca

SEQ ID NO: 242542 - RNA, 64 nt, Human
aggagcaaggccugcgagggaggaacgggccgcuccccgccagccgccuuccccagcagccgca

SEQ ID NO: 242543 - RNA, 64 nt, Human
cugcgcgcggccuagcccgggccucauuucuuauccccgccaaggguuuccucucagucauuug

SEQ ID NO: 242544 - RNA, 64 nt, Human
cuuuccuucgcccgugucuucccucccuucucggccccgccaccugcccagcgugcccuggcuc

SEQ ID NO: 242545 - RNA, 64 nt, Human
aucaagucacucaucucagaauguccccaccaauccccgccacagcaggcgccucgggucccag

SEQ ID NO: 242546 - RNA, 64 nt, Human
gggugagcggagagacagaacuguccccgccccaccccgccacccauuccuaggguuccuaguc

SEQ ID NO: 242547 - RNA, 64 nt, Human
ccgaggagcaucaggcuccugcagagccccauccccccgccacacccacacgguggagcugccu

SEQ ID NO: 242548 - RNA, 64 nt, Human
gggcagggaucggcuuggaaaucaacgugguuguccccgccaggccggggaagguuggagcagc

SEQ ID NO: 242549 - RNA, 64 nt, Human
cucagcucuccgcgucuuuacccugugaucccagccccgccacugaccaucugugacccuuccc

SEQ ID NO: 242550 - RNA, 64 nt, Human
uugugggggcgggggaaggaagaggcagccccgcccccgccaucuguucuccaucagugugcgc

SEQ ID NO: 242551 - RNA, 64 nt, Human
accauguuuggacccggggggcugcucuucccucccccgccauagcuaagaugccugaaucaau

SEQ ID NO: 242552 - RNA, 64 nt, Human
cugcugggcgagcagggcaggugcaggccgccugccccgccacgcuccugggccaacucugcac

SEQ ID NO: 242553 - RNA, 64 nt, Human
gaucugaccugggcccaccaagguggacgcugggccccgccaggcuggagcccggagggucugc

SEQ ID NO: 242554 - RNA, 64 nt, Human
aaagucauuucggccaguaggugugcagaccccuccccgccacgaucgucgcugugcuuggugu

SEQ ID NO: 242555 - RNA, 64 nt, Human
cuuuguggagagaauguguguguguggcagggggccccgccagggcuggggacagaggguguca

SEQ ID NO: 242556 - RNA, 64 nt, Human
gcaccgccacgucccagcaucccuggagcaggagccccgccacagccuucggacagacauaugg

SEQ ID NO: 242557 - RNA, 64 nt, Human
agagcuaaacacaggggguucuuaaaauggcugcccccgccacccgggccucccuugggcaaaa

SEQ ID NO: 242558 - RNA, 64 nt, Human
ugcguguccuccccuccacugccugcauggggggcgcggggagugaccaggcgggggccucacc

SEQ ID NO: 242559 - RNA, 64 nt, Human
ggaacuugcugcugugccugcgucgcggcggauccgcggggacccugccgagggggcugucaug

SEQ ID NO: 242560 - RNA, 64 nt, Human
cugcccccccuccccauagccagcacagcuaucccgcggggacaccagcacugagcccccucuc

SEQ ID NO: 242561 - RNA, 64 nt, Human
gaaaggggcuuuuguccuccugggucagggagaacgcggggaccccagaaaggucagccuuccu

SEQ ID NO: 242562 - RNA, 64 nt, Human
ugucgugagcuggaggaacauugggaaggaagcccgcggggagagaggaggagagaaguggcca

SEQ ID NO: 242563 - RNA, 64 nt, Human
ccguggauaauaaacuuugacgacgcugagagcgcgcggggagaccggagccggccuguucccc

SEQ ID NO: 242564 - RNA, 64 nt, Human
gcugcccgcccggccuuguggcagaggcuccucccgcggggacggccccgacggcuucucugcg

SEQ ID NO: 242565 - RNA, 64 nt, Human
uccgcgggacccggagcaucgcaguuauagcgaccgcggggagccaggcgcugaggagcgggcc

SEQ ID NO: 242566 - RNA, 64 nt, Human
ccgggcggggucgcugguuggccgggcccaggcgcgcggggacgcggaggccgcgcauccuuuc

SEQ ID NO: 242567 - RNA, 64 nt, Human
cagcuucccacugacuuaacaucccuugcccuugcgcggggagcacagcaucuggggaaggggg

SEQ ID NO: 242568 - RNA, 64 nt, Human
uguggccacuuguagggcagugagaggaagccgucgcggggaccaugcugccuucucugggcuc

SEQ ID NO: 242569 - RNA, 64 nt, Human
uuuccuaguucuucuuguaacccugaggugccagcgcggggagugaggaggggucagggggcua

SEQ ID NO: 242570 - RNA, 64 nt, Human
aggggacaaugggaauccuagaggggauggaagacgcggggagugagcugggugggcccugcua

SEQ ID NO: 242571 - RNA, 64 nt, Human
agagacagaggccaggaggcagugaggggagccccgcggggaggcggcggcgacugccacagcc

SEQ ID NO: 242572 - RNA, 64 nt, Human
ccucuggccgcagagguguagggguggaaugagccgcggggaagcuggcuuugaaaccucaggg

SEQ ID NO: 242573 - RNA, 64 nt, Human
agggcucugcggaccugcagccaucugugaggcccgcggggaugggaggggaggaggguggccu

SEQ ID NO: 242574 - RNA, 64 nt, Human
ugcgcugggagacgcuggcgccagggccugccggcgcggggaggaaagcaaaauccaacuaaug

SEQ ID NO: 242575 - RNA, 64 nt, Human
gcugcugccgcugccuaugaccgccacuaguuaccgcggggaccacaucaagcuucaggccgac

SEQ ID NO: 242576 - RNA, 64 nt, Human
gagcuucaccacucgucugccuccuguguccuuccgcggggaguaaaugucacuucagcuugcc

SEQ ID NO: 242577 - RNA, 64 nt, Human
gacuguguguguguugaaaguaaagauggggggccgcggggaaggcaagaguuuuuccaaaaga

SEQ ID NO: 242578 - RNA, 64 nt, Human
guugucucgggagcggggugagcugcagggugaacgcggggagcuacggggccggcuggcgcgg

SEQ ID NO: 242579 - RNA, 64 nt, Human
ccagugacuccggcagcggcgaugagggcgagggcgcggggaggggugggggucccuacgaugc

SEQ ID NO: 242580 - RNA, 64 nt, Human
cccagcucgcaggccccgggcccggccgcgccuccgcggggagagcaccccggcuucccgcgcg

SEQ ID NO: 242581 - RNA, 64 nt, Human
ccucugacgccgcgcacucagccgugggcccgggcgcggggaggccggcgcagcgcagagcggg

SEQ ID NO: 242582 - RNA, 64 nt, Human
uccuuggacccuguagacccagcaggagccuggccgcggggacugcagggagggugccuggacc

SEQ ID NO: 242583 - RNA, 59 nt, Human
ccacccugaccaggcccugagggcccagccgcggggagggacucgcaggcgucaggggg

SEQ ID NO: 242584 - RNA, 64 nt, Human
caggguggggucaggaaucugcauuuuaacuagucgcggggauuguggggggcaguagcuggcu

SEQ ID NO: 242585 - RNA, 64 nt, Human
guucugcugaagugcgucugaaggccgcugccuccgcggggaacagcauccuaucaacugaaag

SEQ ID NO: 242586 - RNA, 64 nt, Human
ggaagagggaaaggggaaacucuaaggguccuggcgcggggaagggguggaaggguggagguag

SEQ ID NO: 242587 - RNA, 64 nt, Human
ccuuucccuccgaagggcugcucuuccccacaggcgcggggacagcagcccgaccuguggucuc

SEQ ID NO: 242588 - RNA, 64 nt, Human
gaggaaugcacaugccacgcugggugucccgggucgcggggaggcagcucagcucuuaggagca

SEQ ID NO: 242589 - RNA, 64 nt, Human
auacagaguauagugaagaaucuauuuaaggcgccgcggggagggcugcacggccgggcuugug

SEQ ID NO: 242590 - RNA, 64 nt, Human
cgcagggacacccccauccuaccccggcgccgggcgcggggagcgggccaccgguccugccgcu
